United States Patent 7,250,496 (BIOINFORMATICALLY DETECTABLE GROUP OF NOVEL REGULATORY GENES AND USES THEREOF) - sequence listing, part 26

SEQ ID NO: 1105716 - RNA, 18 nt, Human
caucauaggggccagagc

SEQ ID NO: 1105717 - RNA, 19 nt, Human
ccacagcuacugcugcuac

SEQ ID NO: 1105718 - RNA, 20 nt, Human
cccuggcacuucucuggcuc

SEQ ID NO: 1105719 - RNA, 24 nt, Human
cucuccugcuaagcuuuguuuccu

SEQ ID NO: 1105720 - RNA, 18 nt, Human
cugcuaagcuuuguuucc

SEQ ID NO: 1105721 - RNA, 23 nt, Human
cuggcacuucucuggcucuccuc

SEQ ID NO: 1105722 - RNA, 20 nt, Human
gccaccuugguuucaugguu

SEQ ID NO: 1105723 - RNA, 21 nt, Human
gcuucuucggcggcguccaug

SEQ ID NO: 1105724 - RNA, 22 nt, Human
uaaaucuucugccacugccaca

SEQ ID NO: 1105725 - RNA, 20 nt, Human
ucucuggcucuccucuccug

SEQ ID NO: 1105726 - RNA, 19 nt, Human
ugccacagcuacugcugcu

SEQ ID NO: 1105727 - RNA, 23 nt, Human
ugccacagcuacugcugcuacug

SEQ ID NO: 1105728 - RNA, 19 nt, Human
uguuguaaccuguagcuuc

SEQ ID NO: 1105729 - RNA, 19 nt, Human
uucccuggcacuucucugg

SEQ ID NO: 1105730 - RNA, 21 nt, Human
aucaucugagccuggaguuug

SEQ ID NO: 1105731 - RNA, 23 nt, Human
caucaucugagccuggaguuugg

SEQ ID NO: 1105732 - RNA, 22 nt, Human
ucuuccauuguuauuguucugu

SEQ ID NO: 1105733 - RNA, 21 nt, Human
uuggcaggaugauagcuuugu

SEQ ID NO: 1105734 - RNA, 27 nt, Human
uuugugauaauguucccaauuucuucc

SEQ ID NO: 1105735 - RNA, 27 nt, Human
uuuuuaaccugugacaucaucugagcc

SEQ ID NO: 1105736 - RNA, 19 nt, Human
agcgcgcaucugccuaaaa

SEQ ID NO: 1105737 - RNA, 19 nt, Human
aucugccuaaaacgcugcc

SEQ ID NO: 1105738 - RNA, 26 nt, Human
caauccaacugcaacaaccaauagag

SEQ ID NO: 1105739 - RNA, 21 nt, Human
caauccugaagauucauuaac

SEQ ID NO: 1105740 - RNA, 25 nt, Human
ccugcagcgcgcaucugccuaaaac

SEQ ID NO: 1105741 - RNA, 21 nt, Human
cuaaaacgcugccgccgccgu

SEQ ID NO: 1105742 - RNA, 22 nt, Human
gccuaaaacgcugccgccgccg

SEQ ID NO: 1105743 - RNA, 24 nt, Human
ggaccacggguucagaugcugcca

SEQ ID NO: 1105744 - RNA, 24 nt, Human
gugaaggaaaugguucaauuucug

SEQ ID NO: 1105745 - RNA, 21 nt, Human
uccaugcagcuuucaucuaag

SEQ ID NO: 1105746 - RNA, 22 nt, Human
uccugaagauucauuaacaaag

SEQ ID NO: 1105747 - RNA, 19 nt, Human
ugaaaagggaggauguugg

SEQ ID NO: 1105748 - RNA, 25 nt, Human
uggaccacggguucagaugcugcca

SEQ ID NO: 1105749 - RNA, 18 nt, Human
uuaagcagaucucagcaa

SEQ ID NO: 1105750 - RNA, 25 nt, Human
aaaauucuuauacacagaaguguua

SEQ ID NO: 1105751 - RNA, 26 nt, Human
aaacacaauguggugacacugaaaau

SEQ ID NO: 1105752 - RNA, 21 nt, Human
aaaccugaaacacugcacaga

SEQ ID NO: 1105753 - RNA, 21 nt, Human
aaacuacggccgggcgcggug

SEQ ID NO: 1105754 - RNA, 19 nt, Human
aacauggugaaaccccauc

SEQ ID NO: 1105755 - RNA, 20 nt, Human
aacauggugaaaccccaucu

SEQ ID NO: 1105756 - RNA, 21 nt, Human
aacauggugaaaccccaucuc

SEQ ID NO: 1105757 - RNA, 21 nt, Human
aacauggugaaaccccaucuc

SEQ ID NO: 1105758 - RNA, 21 nt, Human
aagcaauuuccacaugugccc

SEQ ID NO: 1105759 - RNA, 24 nt, Human
aaucgcuugaacccgggagaugga

SEQ ID NO: 1105760 - RNA, 24 nt, Human
accccaucucuacuaaaaauacaa

SEQ ID NO: 1105761 - RNA, 24 nt, Human
acuaacauggugaaaccccaucuc

SEQ ID NO: 1105762 - RNA, 24 nt, Human
acuguauuccagccugggcaacag

SEQ ID NO: 1105763 - RNA, 25 nt, Human
acuguauuccagccugggcaacagg

SEQ ID NO: 1105764 - RNA, 22 nt, Human
agaaucgcuugaacccgggaga

SEQ ID NO: 1105765 - RNA, 21 nt, Human
agaguaccaguaaggauccag

SEQ ID NO: 1105766 - RNA, 24 nt, Human
agauggagauugcagugagccagg

SEQ ID NO: 1105767 - RNA, 22 nt, Human
agccugggcaacagggugagac

SEQ ID NO: 1105768 - RNA, 24 nt, Human
aggcaggagaaucgcuugaacccg

SEQ ID NO: 1105769 - RNA, 21 nt, Human
aggcgggggcgggcggaucac

SEQ ID NO: 1105770 - RNA, 20 nt, Human
aggcugaggcaggagaaucg

SEQ ID NO: 1105771 - RNA, 24 nt, Human
aggcugaggcaggagaaucgcuug

SEQ ID NO: 1105772 - RNA, 20 nt, Human
agggucuguuggaaaugcag

SEQ ID NO: 1105773 - RNA, 27 nt, Human
auacugaagacuuccauccucaggcca

SEQ ID NO: 1105774 - RNA, 22 nt, Human
augaaauuaauucuuugccuga

SEQ ID NO: 1105775 - RNA, 18 nt, Human
augugcccuguguacaga

SEQ ID NO: 1105776 - RNA, 23 nt, Human
auuuccacaugugcccuguguac

SEQ ID NO: 1105777 - RNA, 20 nt, Human
caagagaaauacugaagaua

SEQ ID NO: 1105778 - RNA, 25 nt, Human
caaugaauauugacagauaaucacc

SEQ ID NO: 1105779 - RNA, 20 nt, Human
caauuuaacuuccccucaag

SEQ ID NO: 1105780 - RNA, 19 nt, Human
cacccuucuucauacaagg

SEQ ID NO: 1105781 - RNA, 24 nt, Human
cacgccuguaaucccagcacuuug

SEQ ID NO: 1105782 - RNA, 19 nt, Human
cacuguauuccagccuggg

SEQ ID NO: 1105783 - RNA, 22 nt, Human
cacuguauuccagccugggcaa

SEQ ID NO: 1105784 - RNA, 23 nt, Human
cacuguauuccagccugggcaac

SEQ ID NO: 1105785 - RNA, 24 nt, Human
cacuguauuccagccugggcaaca

SEQ ID NO: 1105786 - RNA, 23 nt, Human
cagaauucucucauuuucuaaag

SEQ ID NO: 1105787 - RNA, 24 nt, Human
cagcacuuugggaggcgggggcgg

SEQ ID NO: 1105788 - RNA, 22 nt, Human
cagcaggaaacacaauguggug

SEQ ID NO: 1105789 - RNA, 20 nt, Human
cagccugggcaacaggguga

SEQ ID NO: 1105790 - RNA, 24 nt, Human
cagcuacuugagaggcugaggcag

SEQ ID NO: 1105791 - RNA, 24 nt, Human
cagcuucugaagcccuggaauccc

SEQ ID NO: 1105792 - RNA, 22 nt, Human
caggaucagugcaaccuauacu

SEQ ID NO: 1105793 - RNA, 21 nt, Human
caggccaaaaggucaggauca

SEQ ID NO: 1105794 - RNA, 19 nt, Human
caguaaggauccagugaaa

SEQ ID NO: 1105795 - RNA, 21 nt, Human
caucaaacaaggauggaauaa

SEQ ID NO: 1105796 - RNA, 20 nt, Human
caugugcccuguguacagaa

SEQ ID NO: 1105797 - RNA, 23 nt, Human
ccaaccaucagugaaaacuacag

SEQ ID NO: 1105798 - RNA, 20 nt, Human
ccacuguauuccagccuggg

SEQ ID NO: 1105799 - RNA, 21 nt, Human
ccacuguauuccagccugggc

SEQ ID NO: 1105800 - RNA, 22 nt, Human
ccacuguauuccagccugggca

SEQ ID NO: 1105801 - RNA, 23 nt, Human
ccacuguauuccagccugggcaa

SEQ ID NO: 1105802 - RNA, 24 nt, Human
ccacuguauuccagccugggcaac

SEQ ID NO: 1105803 - RNA, 19 nt, Human
ccaggaucuucggguuucc

SEQ ID NO: 1105804 - RNA, 21 nt, Human
cccaauuguccucagggucug

SEQ ID NO: 1105805 - RNA, 20 nt, Human
cccagcacuuugggaggcgg

SEQ ID NO: 1105806 - RNA, 22 nt, Human
cccucaaguauuccauacuuga

SEQ ID NO: 1105807 - RNA, 25 nt, Human
ccgggaaggagaagaaaugcggaca

SEQ ID NO: 1105808 - RNA, 22 nt, Human
ccucagggucuguuggaaaugc

SEQ ID NO: 1105809 - RNA, 19 nt, Human
ccucauaaacucuaaagca

SEQ ID NO: 1105810 - RNA, 22 nt, Human
ccugacuaacauggugaaaccc

SEQ ID NO: 1105811 - RNA, 24 nt, Human
ccugacuaacauggugaaacccca

SEQ ID NO: 1105812 - RNA, 22 nt, Human
ccuguaaucccagcacuuuggg

SEQ ID NO: 1105813 - RNA, 24 nt, Human
cgagaccauccugacuaacauggu

SEQ ID NO: 1105814 - RNA, 20 nt, Human
cuaaagcaagugaaauuauc

SEQ ID NO: 1105815 - RNA, 22 nt, Human
cucacgccuguaaucccagcac

SEQ ID NO: 1105816 - RNA, 24 nt, Human
cucacgccuguaaucccagcacuu

SEQ ID NO: 1105817 - RNA, 24 nt, Human
cugaagacuuccauccucaggcca

SEQ ID NO: 1105818 - RNA, 20 nt, Human
cugaagcccuggaaucccag

SEQ ID NO: 1105819 - RNA, 23 nt, Human
cuguuacuaagaugacacuuaau

SEQ ID NO: 1105820 - RNA, 19 nt, Human
cuucaccccucucauaacu

SEQ ID NO: 1105821 - RNA, 21 nt, Human
cuucggguuuccuccugcuuc

SEQ ID NO: 1105822 - RNA, 21 nt, Human
gaaaaaauucuuauacacaga

SEQ ID NO: 1105823 - RNA, 23 nt, Human
gacuuccauccucaggccaaaag

SEQ ID NO: 1105824 - RNA, 23 nt, Human
gagauugcagugagccaggaucg

SEQ ID NO: 1105825 - RNA, 19 nt, Human
gaggcgggggcgggcggau

SEQ ID NO: 1105826 - RNA, 22 nt, Human
gaggguguguuauuccuugcuu

SEQ ID NO: 1105827 - RNA, 24 nt, Human
gaucacaaggucaggaaaucgaga

SEQ ID NO: 1105828 - RNA, 24 nt, Human
gcaggaugugaaagaaagugccag

SEQ ID NO: 1105829 - RNA, 19 nt, Human
gccacuguauuccagccug

SEQ ID NO: 1105830 - RNA, 22 nt, Human
gccacuguauuccagccugggc

SEQ ID NO: 1105831 - RNA, 24 nt, Human
gccacuguauuccagccugggcaa

SEQ ID NO: 1105832 - RNA, 18 nt, Human
ggagauugcagugagcca

SEQ ID NO: 1105833 - RNA, 19 nt, Human
ggagauugcagugagccag

SEQ ID NO: 1105834 - RNA, 24 nt, Human
ggagauugcagugagccaggaucg

SEQ ID NO: 1105835 - RNA, 31 nt, Human
ggaggcgggggcgggcggaucacaaggucaa

SEQ ID NO: 1105836 - RNA, 18 nt, Human
ggaguaaaguuguacaga

SEQ ID NO: 1105837 - RNA, 22 nt, Human
ggaucacaaggucaggaaaucg

SEQ ID NO: 1105838 - RNA, 23 nt, Human
ggcgcgguggcucacgccuguaa

SEQ ID NO: 1105839 - RNA, 21 nt, Human
ggcggaucacaaggucaggaa

SEQ ID NO: 1105840 - RNA, 23 nt, Human
ggcgggcggaucacaaggucagg

SEQ ID NO: 1105841 - RNA, 18 nt, Human
ggcgugguugcgggcgcc

SEQ ID NO: 1105842 - RNA, 22 nt, Human
ggcgugguugcgggcgccugua

SEQ ID NO: 1105843 - RNA, 23 nt, Human
gguggcucacgccuguaauccca

SEQ ID NO: 1105844 - RNA, 24 nt, Human
gguggcucacgccuguaaucccag

SEQ ID NO: 1105845 - RNA, 24 nt, Human
gguugcgggcgccuguagucccag

SEQ ID NO: 1105846 - RNA, 24 nt, Human
guauuccagccugggcaacagggu

SEQ ID NO: 1105847 - RNA, 23 nt, Human
guggcucacgccuguaaucccag

SEQ ID NO: 1105848 - RNA, 20 nt, Human
uaaaaaccugaaacacugca

SEQ ID NO: 1105849 - RNA, 24 nt, Human
uaaaaaccugaaacacugcacaga

SEQ ID NO: 1105850 - RNA, 23 nt, Human
uaaauugaaaccaauuuuauuua

SEQ ID NO: 1105851 - RNA, 22 nt, Human
uaacauggugaaaccccaucuc

SEQ ID NO: 1105852 - RNA, 24 nt, Human
uaacauggugaaaccccaucucua

SEQ ID NO: 1105853 - RNA, 19 nt, Human
uaaucaaucaauaagcaau

SEQ ID NO: 1105854 - RNA, 24 nt, Human
uacggccgggcgcgguggcucacg

SEQ ID NO: 1105855 - RNA, 18 nt, Human
uacuuuguaaacaaauga

SEQ ID NO: 1105856 - RNA, 26 nt, Human
uagcagaggguguguuauuccuugcu

SEQ ID NO: 1105857 - RNA, 21 nt, Human
uagccaaucagaauucucuca

SEQ ID NO: 1105858 - RNA, 19 nt, Human
uauaugccuugcucaaaau

SEQ ID NO: 1105859 - RNA, 23 nt, Human
uauuccagccugggcaacagggu

SEQ ID NO: 1105860 - RNA, 24 nt, Human
uauuccagccugggcaacagggug

SEQ ID NO: 1105861 - RNA, 27 nt, Human
ucaaaaauauucagcgcauucuuccca

SEQ ID NO: 1105862 - RNA, 25 nt, Human
ucaaacaaggauggaauaaacaaga

SEQ ID NO: 1105863 - RNA, 20 nt, Human
ucaacagaugggagccacuu

SEQ ID NO: 1105864 - RNA, 24 nt, Human
ucacaaggucaggaaaucgagacc

SEQ ID NO: 1105865 - RNA, 24 nt, Human
ucagaauucucucauuuucuaaag

SEQ ID NO: 1105866 - RNA, 19 nt, Human
ucagugaugauuaaugcau

SEQ ID NO: 1105867 - RNA, 21 nt, Human
ucauacaagagaaauacugaa

SEQ ID NO: 1105868 - RNA, 23 nt, Human
uccagccugggcaacagggugag

SEQ ID NO: 1105869 - RNA, 24 nt, Human
uccagccugggcaacagggugaga

SEQ ID NO: 1105870 - RNA, 18 nt, Human
uccugcuuccacucuuaa

SEQ ID NO: 1105871 - RNA, 21 nt, Human
uccuuuuugcucccucuccac

SEQ ID NO: 1105872 - RNA, 23 nt, Human
uccuuuuugcucccucuccacug

SEQ ID NO: 1105873 - RNA, 21 nt, Human
ucgcuugaacccgggagaugg

SEQ ID NO: 1105874 - RNA, 22 nt, Human
ucucuacuaaaaauacaaaaaa

SEQ ID NO: 1105875 - RNA, 19 nt, Human
ugaaacagccaaccaucag

SEQ ID NO: 1105876 - RNA, 19 nt, Human
ugaaaccccaucucuacua

SEQ ID NO: 1105877 - RNA, 24 nt, Human
ugacuaacauggugaaaccccauc

SEQ ID NO: 1105878 - RNA, 19 nt, Human
ugagaggcugaggcaggag

SEQ ID NO: 1105879 - RNA, 20 nt, Human
ugagaggcugaggcaggaga

SEQ ID NO: 1105880 - RNA, 22 nt, Human
ugagccaggaucgugccacugu

SEQ ID NO: 1105881 - RNA, 20 nt, Human
ugaggcaggagaaucgcuug

SEQ ID NO: 1105882 - RNA, 24 nt, Human
ugaggcaggagaaucgcuugaacc

SEQ ID NO: 1105883 - RNA, 25 nt, Human
ugaggcaggagaaucgcuugaaccc

SEQ ID NO: 1105884 - RNA, 20 nt, Human
ugauguagacuugauucagc

SEQ ID NO: 1105885 - RNA, 21 nt, Human
ugauguagacuugauucagca

SEQ ID NO: 1105886 - RNA, 22 nt, Human
uggcucacgccuguaaucccag

SEQ ID NO: 1105887 - RNA, 24 nt, Human
uggcucacgccuguaaucccagca

SEQ ID NO: 1105888 - RNA, 18 nt, Human
uggcuggcagaguacgcu

SEQ ID NO: 1105889 - RNA, 22 nt, Human
ugggagccacuuauggccucau

SEQ ID NO: 1105890 - RNA, 24 nt, Human
ugggaggcgggggcgggcggauca

SEQ ID NO: 1105891 - RNA, 19 nt, Human
ugggcaacagggugagaca

SEQ ID NO: 1105892 - RNA, 23 nt, Human
ugguucuguuacuaagaugacac

SEQ ID NO: 1105893 - RNA, 24 nt, Human
ugguugcgggcgccuguaguccca

SEQ ID NO: 1105894 - RNA, 24 nt, Human
uguagacuugauucagcaggaaac

SEQ ID NO: 1105895 - RNA, 24 nt, Human
uguuugccacuuggcuggcagagu

SEQ ID NO: 1105896 - RNA, 18 nt, Human
uuagccgggcgugguugc

SEQ ID NO: 1105897 - RNA, 24 nt, Human
uuagccgggcgugguugcgggcgc

SEQ ID NO: 1105898 - RNA, 23 nt, Human
uuaggccaguguucuguggaugu

SEQ ID NO: 1105899 - RNA, 21 nt, Human
uuauggccucauaaacucuaa

SEQ ID NO: 1105900 - RNA, 18 nt, Human
uucuucauacaagagaaa

SEQ ID NO: 1105901 - RNA, 25 nt, Human
uugagaggcugaggcaggagaaucg

SEQ ID NO: 1105902 - RNA, 22 nt, Human
uugcagugagccaggaucgugc

SEQ ID NO: 1105903 - RNA, 24 nt, Human
uuuaagcuuuauuugacaaaguag

SEQ ID NO: 1105904 - RNA, 19 nt, Human
aaaagaccaaagagacaag

SEQ ID NO: 1105905 - RNA, 21 nt, Human
aaaagaccaaagagacaagcc

SEQ ID NO: 1105906 - RNA, 19 nt, Human
aaaauaaaagaccaaagag

SEQ ID NO: 1105907 - RNA, 23 nt, Human
aacaauagagccaaaauaaaaga

SEQ ID NO: 1105908 - RNA, 22 nt, Human
aacucaaaaacaugcauagaug

SEQ ID NO: 1105909 - RNA, 27 nt, Human
aaucugugaacaugccaggccccccuc

SEQ ID NO: 1105910 - RNA, 23 nt, Human
agaggagaauguuuuauacugga

SEQ ID NO: 1105911 - RNA, 25 nt, Human
aggcauuuagacaccauuaauuaua

SEQ ID NO: 1105912 - RNA, 28 nt, Human
aguuuugaucccuuucaaaggaauaauu

SEQ ID NO: 1105913 - RNA, 22 nt, Human
caaaagcaaaagugccucaauc

SEQ ID NO: 1105914 - RNA, 22 nt, Human
caaaagugccucaauccauuga

SEQ ID NO: 1105915 - RNA, 20 nt, Human
caagagggucccugagcugu

SEQ ID NO: 1105916 - RNA, 20 nt, Human
ccaaaauaaaagaccaaaga

SEQ ID NO: 1105917 - RNA, 23 nt, Human
cccaacaauagagccaaaauaaa

SEQ ID NO: 1105918 - RNA, 18 nt, Human
cccggcccuucacucucc

SEQ ID NO: 1105919 - RNA, 25 nt, Human
cccggcccuucacucucccggggcc

SEQ ID NO: 1105920 - RNA, 20 nt, Human
cccggggcgccuuguccucc

SEQ ID NO: 1105921 - RNA, 18 nt, Human
ccgcgcgcucccgccgcc

SEQ ID NO: 1105922 - RNA, 24 nt, Human
ccgcgcgcucccgccgcccggccc

SEQ ID NO: 1105923 - RNA, 21 nt, Human
ccggggcgccuuguccucccc

SEQ ID NO: 1105924 - RNA, 24 nt, Human
ccuuguccuccccggcccuucacu

SEQ ID NO: 1105925 - RNA, 18 nt, Human
cgcccggcccggcagcag

SEQ ID NO: 1105926 - RNA, 24 nt, Human
cgccuuguccuccccggcccuuca

SEQ ID NO: 1105927 - RNA, 24 nt, Human
cggccuccgacgccgcgcgcuccc

SEQ ID NO: 1105928 - RNA, 21 nt, Human
cucccggggcucucggcguuc

SEQ ID NO: 1105929 - RNA, 21 nt, Human
cugacugaggcauuuagacac

SEQ ID NO: 1105930 - RNA, 18 nt, Human
cugguauuuuaaccuacc

SEQ ID NO: 1105931 - RNA, 25 nt, Human
cuucgugcacagagcguagcucuuc

SEQ ID NO: 1105932 - RNA, 22 nt, Human
gaaauagauucccaacaauaga

SEQ ID NO: 1105933 - RNA, 20 nt, Human
gaacaaaugcacagucuguc

SEQ ID NO: 1105934 - RNA, 22 nt, Human
gaacaaaugcacagucugucuu

SEQ ID NO: 1105935 - RNA, 18 nt, Human
gaauuuccaacacugcuu

SEQ ID NO: 1105936 - RNA, 23 nt, Human
gccuuguccuccccggcccuuca

SEQ ID NO: 1105937 - RNA, 21 nt, Human
gcuuaguacugagaacccugu

SEQ ID NO: 1105938 - RNA, 21 nt, Human
ggagaauguuuuauacuggaa

SEQ ID NO: 1105939 - RNA, 23 nt, Human
gggcaagagggucccugagcugu

SEQ ID NO: 1105940 - RNA, 21 nt, Human
uaacacaaaagcaaaagugcc

SEQ ID NO: 1105941 - RNA, 23 nt, Human
uaacacaaaagcaaaagugccuc

SEQ ID NO: 1105942 - RNA, 22 nt, Human
uaacugacagguccaaguuagc

SEQ ID NO: 1105943 - RNA, 24 nt, Human
uacuaagugcuaauaacagucuuu

SEQ ID NO: 1105944 - RNA, 23 nt, Human
uagcauuguugaaaaugaguuuc

SEQ ID NO: 1105945 - RNA, 21 nt, Human
ucaagauuccacagcauguua

SEQ ID NO: 1105946 - RNA, 22 nt, Human
uccaacacugcuugaaaugcaa

SEQ ID NO: 1105947 - RNA, 19 nt, Human
uccaaggaccucaaaguca

SEQ ID NO: 1105948 - RNA, 21 nt, Human
uccaaggaccucaaagucauu

SEQ ID NO: 1105949 - RNA, 18 nt, Human
ucccugagcuguuugguu

SEQ ID NO: 1105950 - RNA, 20 nt, Human
uccgcagaggggcggccucc

SEQ ID NO: 1105951 - RNA, 20 nt, Human
ugaaggggcaagaggguccc

SEQ ID NO: 1105952 - RNA, 18 nt, Human
ugaauagcacauaaugga

SEQ ID NO: 1105953 - RNA, 20 nt, Human
ugacauacauauguagguaa

SEQ ID NO: 1105954 - RNA, 21 nt, Human
ugacauacauauguagguaaa

SEQ ID NO: 1105955 - RNA, 19 nt, Human
ugagaaguccauggugaag

SEQ ID NO: 1105956 - RNA, 23 nt, Human
ugcaguuaggcacugacugaggc

SEQ ID NO: 1105957 - RNA, 26 nt, Human
ugggcauucugggcaucuuuuuuuuu

SEQ ID NO: 1105958 - RNA, 20 nt, Human
ugucagggacccacaggaug

SEQ ID NO: 1105959 - RNA, 18 nt, Human
uuagcauuguugaaaaug

SEQ ID NO: 1105960 - RNA, 20 nt, Human
uuuauaaguuucugaauuuc

SEQ ID NO: 1105961 - RNA, 23 nt, Human
uuucucgugguuuauaaguuucu

SEQ ID NO: 1105962 - RNA, 26 nt, Human
uccgucgccucuugagaaucagcaaa

SEQ ID NO: 1105963 - RNA, 21 nt, Human
aaaggaagacaggcugcaacc

SEQ ID NO: 1105964 - RNA, 21 nt, Human
aagaggcccuagcuuucaucc

SEQ ID NO: 1105965 - RNA, 18 nt, Human
accugcuggccgagcuuc

SEQ ID NO: 1105966 - RNA, 19 nt, Human
acucacagccguucuccuc

SEQ ID NO: 1105967 - RNA, 23 nt, Human
agaggcccuagcuuucaucccug

SEQ ID NO: 1105968 - RNA, 24 nt, Human
aggaagacaggcugcaaccacagg

SEQ ID NO: 1105969 - RNA, 19 nt, Human
aggagaaaaagaaggacag

SEQ ID NO: 1105970 - RNA, 19 nt, Human
aggggcugggagggaggga

SEQ ID NO: 1105971 - RNA, 18 nt, Human
auaguuguuucuucuaag

SEQ ID NO: 1105972 - RNA, 33 nt, Human
auauaauaauaauuaagagaaaaaaauaagaag

SEQ ID NO: 1105973 - RNA, 21 nt, Human
cacaggaaaauggcaggaaaa

SEQ ID NO: 1105974 - RNA, 18 nt, Human
caggaggccuggcggagg

SEQ ID NO: 1105975 - RNA, 19 nt, Human
cgcaacauuucugaaauga

SEQ ID NO: 1105976 - RNA, 18 nt, Human
gagggagaggagaaaaag

SEQ ID NO: 1105977 - RNA, 24 nt, Human
gcucguccagaacucuaggcuguc

SEQ ID NO: 1105978 - RNA, 21 nt, Human
ggaagacaggcugcaaccaca

SEQ ID NO: 1105979 - RNA, 20 nt, Human
ggccuuggugcacucacagg

SEQ ID NO: 1105980 - RNA, 20 nt, Human
gggagaggagaaaaagaagg

SEQ ID NO: 1105981 - RNA, 19 nt, Human
ggggcugggagggagggag

SEQ ID NO: 1105982 - RNA, 19 nt, Human
guauauacauaucuacacc

SEQ ID NO: 1105983 - RNA, 26 nt, Human
uaccaaacacgcucguccagaacucu

SEQ ID NO: 1105984 - RNA, 22 nt, Human
uagcuugauaguuguuucuucu

SEQ ID NO: 1105985 - RNA, 18 nt, Human
uagucggcuuccgugccc

SEQ ID NO: 1105986 - RNA, 21 nt, Human
uauaaaacucagagaguaaaa

SEQ ID NO: 1105987 - RNA, 23 nt, Human
uauacauaucuacaccugugucu

SEQ ID NO: 1105988 - RNA, 20 nt, Human
ucaaacacuccuugcuguuc

SEQ ID NO: 1105989 - RNA, 20 nt, Human
uccagaacucuaggcugucu

SEQ ID NO: 1105990 - RNA, 20 nt, Human
uccaggaggccuggcggagg

SEQ ID NO: 1105991 - RNA, 18 nt, Human
ucuguguggcagaucacc

SEQ ID NO: 1105992 - RNA, 24 nt, Human
ucuucuaaguuuaacucagaaaua

SEQ ID NO: 1105993 - RNA, 18 nt, Human
ugaugagaguauaagugg

SEQ ID NO: 1105994 - RNA, 23 nt, Human
ugcacccagggacccccgucugc

SEQ ID NO: 1105995 - RNA, 23 nt, Human
uggacggaguucaaagcagaaac

SEQ ID NO: 1105996 - RNA, 18 nt, Human
uggcauucaagugcauca

SEQ ID NO: 1105997 - RNA, 22 nt, Human
ugucuuuucuuuugguaaagca

SEQ ID NO: 1105998 - RNA, 21 nt, Human
uguggcagaucaccuggacgu

SEQ ID NO: 1105999 - RNA, 20 nt, Human
uucaccugcuggccgagcuc

SEQ ID NO: 1106000 - RNA, 22 nt, Human
uuguauauacauaucuacaccu

SEQ ID NO: 1106001 - RNA, 19 nt, Human
aauucugcugugaaucugu

SEQ ID NO: 1106002 - RNA, 24 nt, Human
accauuauauacugccugucuuug

SEQ ID NO: 1106003 - RNA, 25 nt, Human
augaaagaagacauucuuugaaugu

SEQ ID NO: 1106004 - RNA, 22 nt, Human
auuuucucucuucuuuucuugg

SEQ ID NO: 1106005 - RNA, 18 nt, Human
gacuuuuugacaucagug

SEQ ID NO: 1106006 - RNA, 24 nt, Human
gugaaaggauugguaucauuucuu

SEQ ID NO: 1106007 - RNA, 26 nt, Human
gugaacuuagauugucuguuugugcu

SEQ ID NO: 1106008 - RNA, 24 nt, Human
guguucauaguacccuugaauaac

SEQ ID NO: 1106009 - RNA, 19 nt, Human
uagaauucugcugugaauc

SEQ ID NO: 1106010 - RNA, 19 nt, Human
uauccaacucuucuagguu

SEQ ID NO: 1106011 - RNA, 21 nt, Human
uauguuuuguauuuguuguug

SEQ ID NO: 1106012 - RNA, 27 nt, Human
ucaguggugucaguuguaauauccccu

SEQ ID NO: 1106013 - RNA, 24 nt, Human
ucccagaggucuugauagguugug

SEQ ID NO: 1106014 - RNA, 25 nt, Human
ucuuuuagcuacuguugcuuuaaag

SEQ ID NO: 1106015 - RNA, 21 nt, Human
ugaaagaagacauucuuugaa

SEQ ID NO: 1106016 - RNA, 22 nt, Human
ugaaaggauugguaucauuucu

SEQ ID NO: 1106017 - RNA, 20 nt, Human
ugucucauaugagaauagcu

SEQ ID NO: 1106018 - RNA, 25 nt, Human
uguuguuguucuugugucaauuuca

SEQ ID NO: 1106019 - RNA, 23 nt, Human
uuaccauuucaaucuugcugcuu

SEQ ID NO: 1106020 - RNA, 21 nt, Human
uuccugcuucucugguucccu

SEQ ID NO: 1106021 - RNA, 21 nt, Human
uuggcuuguuccugcuucucu

SEQ ID NO: 1106022 - RNA, 23 nt, Human
uuguuuugucucauaugagaaua

SEQ ID NO: 1106023 - RNA, 18 nt, Human
uuuggauuuucucucuuc

SEQ ID NO: 1106024 - RNA, 23 nt, Human
uuugugcucuuucagacuuuuug

SEQ ID NO: 1106025 - RNA, 27 nt, Human
aaaaagauacacaaaucauaagccccu

SEQ ID NO: 1106026 - RNA, 18 nt, Human
aaaacccaggaaagaagc

SEQ ID NO: 1106027 - RNA, 18 nt, Human
aaacaaugcugccacuca

SEQ ID NO: 1106028 - RNA, 24 nt, Human
aaacccgccccccacccggaccac

SEQ ID NO: 1106029 - RNA, 20 nt, Human
aaagaagccuuuugucccuu

SEQ ID NO: 1106030 - RNA, 20 nt, Human
aaaggaaccagcgcugcugu

SEQ ID NO: 1106031 - RNA, 19 nt, Human
aaaggagaaugcuggaagg

SEQ ID NO: 1106032 - RNA, 18 nt, Human
aacaccaaaacccaggaa

SEQ ID NO: 1106033 - RNA, 24 nt, Human
aaccaaaaacaaaaagauacacaa

SEQ ID NO: 1106034 - RNA, 23 nt, Human
aaccacccgugguggacacucga

SEQ ID NO: 1106035 - RNA, 21 nt, Human
aacccgccccccacccggacc

SEQ ID NO: 1106036 - RNA, 20 nt, Human
aaccugcccccccucaccac

SEQ ID NO: 1106037 - RNA, 18 nt, Human
aagaagugggaaggucaa

SEQ ID NO: 1106038 - RNA, 24 nt, Human
aagaggagaagggccccuuccuca

SEQ ID NO: 1106039 - RNA, 23 nt, Human
aagcagcacagccccagauagcg

SEQ ID NO: 1106040 - RNA, 23 nt, Human
acaacacggaggcagcagaacac

SEQ ID NO: 1106041 - RNA, 24 nt, Human
acacacagcuugccaagaaagcac

SEQ ID NO: 1106042 - RNA, 21 nt, Human
acaccauccauguuuccuuuu

SEQ ID NO: 1106043 - RNA, 22 nt, Human
acagccccagauagcgccccca

SEQ ID NO: 1106044 - RNA, 18 nt, Human
acaggggacaccuccuuc

SEQ ID NO: 1106045 - RNA, 18 nt, Human
accaaaacccaggaaaga

SEQ ID NO: 1106046 - RNA, 22 nt, Human
accaccccuaaccugccccccc

SEQ ID NO: 1106047 - RNA, 20 nt, Human
acccgccccccacccggacc

SEQ ID NO: 1106048 - RNA, 18 nt, Human
acccggaccacaagcagc

SEQ ID NO: 1106049 - RNA, 19 nt, Human
acccggaccacaagcagca

SEQ ID NO: 1106050 - RNA, 21 nt, Human
accuggcucagaugccagcag

SEQ ID NO: 1106051 - RNA, 19 nt, Human
accuugaguccaggaagag

SEQ ID NO: 1106052 - RNA, 22 nt, Human
accuugaguccaggaagaggag

SEQ ID NO: 1106053 - RNA, 26 nt, Human
acggaggcagcagaacaccaacagaa

SEQ ID NO: 1106054 - RNA, 20 nt, Human
acugcacccaaccaaccccc

SEQ ID NO: 1106055 - RNA, 19 nt, Human
agaauuauuucauauuucu

SEQ ID NO: 1106056 - RNA, 25 nt, Human
agaggagaagggccccuuccucaga

SEQ ID NO: 1106057 - RNA, 26 nt, Human
agcaaaagugaucccaaccacaccac

SEQ ID NO: 1106058 - RNA, 26 nt, Human
agcagaacaccaacagaagaguccca

SEQ ID NO: 1106059 - RNA, 26 nt, Human
agcagcacagccccagauagcgcccc

SEQ ID NO: 1106060 - RNA, 21 nt, Human
agccaacauagacacauucuc

SEQ ID NO: 1106061 - RNA, 19 nt, Human
agccuggcuuggagcagcu

SEQ ID NO: 1106062 - RNA, 22 nt, Human
agcgcugcugucacccuccaug

SEQ ID NO: 1106063 - RNA, 25 nt, Human
agugcagccuccccccauaccaccc

SEQ ID NO: 1106064 - RNA, 22 nt, Human
aucccaggcugggccaggcccc

SEQ ID NO: 1106065 - RNA, 22 nt, Human
caaaccacccgugguggacacu

SEQ ID NO: 1106066 - RNA, 18 nt, Human
caaagggugcccagaggc

SEQ ID NO: 1106067 - RNA, 19 nt, Human
caacauagacacauucucc

SEQ ID NO: 1106068 - RNA, 19 nt, Human
caaccaaaaacaaaaagau

SEQ ID NO: 1106069 - RNA, 25 nt, Human
caagaaagcacccuuuaucuuacau

SEQ ID NO: 1106070 - RNA, 24 nt, Human
caagcuagcaagaaaacacagccc

SEQ ID NO: 1106071 - RNA, 21 nt, Human
cacaaaucauaagccccuaaa

SEQ ID NO: 1106072 - RNA, 21 nt, Human
cacaacacacccagagacugc

SEQ ID NO: 1106073 - RNA, 19 nt, Human
cacaacaccaaaacccagg

SEQ ID NO: 1106074 - RNA, 19 nt, Human
cacaacaccaaaacccagg

SEQ ID NO: 1106075 - RNA, 22 nt, Human
cacaacaccaaaacccaggaaa

SEQ ID NO: 1106076 - RNA, 22 nt, Human
cacaaccaaaaacaaaaagaua

SEQ ID NO: 1106077 - RNA, 23 nt, Human
cacaaccaaaaacaaaaagauac

SEQ ID NO: 1106078 - RNA, 23 nt, Human
cacaagcagcacagccccagaua

SEQ ID NO: 1106079 - RNA, 22 nt, Human
cacacagcuugccaagaaagca

SEQ ID NO: 1106080 - RNA, 24 nt, Human
cacaccacgcaaacuagccaggaa

SEQ ID NO: 1106081 - RNA, 22 nt, Human
cacagcagccacccuccugaga

SEQ ID NO: 1106082 - RNA, 22 nt, Human
cacagcccagguaagcucaucu

SEQ ID NO: 1106083 - RNA, 23 nt, Human
cacagguacccuccuaccgcucc

SEQ ID NO: 1106084 - RNA, 21 nt, Human
caccacugucauggccaccuc

SEQ ID NO: 1106085 - RNA, 20 nt, Human
cacccaaccaaccccccgag

SEQ ID NO: 1106086 - RNA, 19 nt, Human
caccccuaaccugcccccc

SEQ ID NO: 1106087 - RNA, 25 nt, Human
caccccuaaccugcccccccucacc

SEQ ID NO: 1106088 - RNA, 19 nt, Human
cacccggaccacaagcagc

SEQ ID NO: 1106089 - RNA, 18 nt, Human
cacccuccaugcaccugc

SEQ ID NO: 1106090 - RNA, 27 nt, Human
cacccucuagaaccuugaguccaggaa

SEQ ID NO: 1106091 - RNA, 19 nt, Human
cagaacaccaacagaagag

SEQ ID NO: 1106092 - RNA, 18 nt, Human
cagaacagaaucugcuac

SEQ ID NO: 1106093 - RNA, 22 nt, Human
cagacaaugccagaaaaaccua

SEQ ID NO: 1106094 - RNA, 21 nt, Human
cagcagaacaccaacagaaga

SEQ ID NO: 1106095 - RNA, 24 nt, Human
cagcagaaggagggcacccuccaa

SEQ ID NO: 1106096 - RNA, 20 nt, Human
cagcagugcagccucccccc

SEQ ID NO: 1106097 - RNA, 21 nt, Human
cagccacccuccugagagguu

SEQ ID NO: 1106098 - RNA, 23 nt, Human
cagcccagguaagcucaucucuu

SEQ ID NO: 1106099 - RNA, 19 nt, Human
cagccccagauagcgcccc

SEQ ID NO: 1106100 - RNA, 23 nt, Human
cagccuccccccauaccaccccu

SEQ ID NO: 1106101 - RNA, 23 nt, Human
cagcuugccaagaaagcacccuu

SEQ ID NO: 1106102 - RNA, 23 nt, Human
caggaggaugccucuuugaugau

SEQ ID NO: 1106103 - RNA, 19 nt, Human
caggccccaaagcccuccu

SEQ ID NO: 1106104 - RNA, 23 nt, Human
caggggaccugccacagcagcca

SEQ ID NO: 1106105 - RNA, 19 nt, Human
cagguacccuccuaccgcu

SEQ ID NO: 1106106 - RNA, 21 nt, Human
cagguacccuccuaccgcucc

SEQ ID NO: 1106107 - RNA, 24 nt, Human
cagugcagccuccccccauaccac

SEQ ID NO: 1106108 - RNA, 24 nt, Human
cauauucaggcuccaaccuccagc

SEQ ID NO: 1106109 - RNA, 20 nt, Human
cauuuagaauagaauuguuc

SEQ ID NO: 1106110 - RNA, 24 nt, Human
ccaacacacagcuugccaagaaag

SEQ ID NO: 1106111 - RNA, 18 nt, Human
ccaaccaaccccccgacc

SEQ ID NO: 1106112 - RNA, 20 nt, Human
ccaaccaaccccccgacccc

SEQ ID NO: 1106113 - RNA, 18 nt, Human
ccaaccacaccacgcaaa

SEQ ID NO: 1106114 - RNA, 22 nt, Human
ccacaacacacccagagacugc

SEQ ID NO: 1106115 - RNA, 20 nt, Human
ccacaacccaucccugccac

SEQ ID NO: 1106116 - RNA, 19 nt, Human
ccacagcagccacccuccu

SEQ ID NO: 1106117 - RNA, 20 nt, Human
ccagagacaacacggaggca

SEQ ID NO: 1106118 - RNA, 22 nt, Human
ccaucaaacccgccccccaccc

SEQ ID NO: 1106119 - RNA, 19 nt, Human
cccaaagcccuccuacucc

SEQ ID NO: 1106120 - RNA, 21 nt, Human
cccaaagcccuccuacucccc

SEQ ID NO: 1106121 - RNA, 23 nt, Human
cccaaccaaccccccgaccccac

SEQ ID NO: 1106122 - RNA, 18 nt, Human
cccacaacacacccagag

SEQ ID NO: 1106123 - RNA, 18 nt, Human
cccacaacaccaaaaccc

SEQ ID NO: 1106124 - RNA, 24 nt, Human
cccagauugugcccacaacacacc

SEQ ID NO: 1106125 - RNA, 18 nt, Human
cccauaccaccccuaacc

SEQ ID NO: 1106126 - RNA, 21 nt, Human
ccccaaagcccuccuacuccc

SEQ ID NO: 1106127 - RNA, 19 nt, Human
ccccagauagcgcccccaa

SEQ ID NO: 1106128 - RNA, 22 nt, Human
ccccagauagcgcccccaaucu

SEQ ID NO: 1106129 - RNA, 24 nt, Human
ccccagauagcgcccccaaucugc

SEQ ID NO: 1106130 - RNA, 28 nt, Human
ccccauaccaccccuaaccugccccccc

SEQ ID NO: 1106131 - RNA, 20 nt, Human
ccccaucaaacccgcccccc

SEQ ID NO: 1106132 - RNA, 25 nt, Human
cccccccucaccacaagcuuagccc

SEQ ID NO: 1106133 - RNA, 27 nt, Human
ccccccucaccacaagcuuagccccca

SEQ ID NO: 1106134 - RNA, 21 nt, Human
cccccuuccuggccccuagac

SEQ ID NO: 1106135 - RNA, 23 nt, Human
ccccuaaauucuguuaagaacaa

SEQ ID NO: 1106136 - RNA, 22 nt, Human
ccccuaaccugcccccccucac

SEQ ID NO: 1106137 - RNA, 23 nt, Human
ccccuaaccugcccccccucacc

SEQ ID NO: 1106138 - RNA, 23 nt, Human
ccccuagacuugcugcugcugcc

SEQ ID NO: 1106139 - RNA, 22 nt, Human
ccccuguggccuaagguuccac

SEQ ID NO: 1106140 - RNA, 22 nt, Human
cccggaccacaagcagcacagc

SEQ ID NO: 1106141 - RNA, 23 nt, Human
cccuccaacacacagcuugccaa

SEQ ID NO: 1106142 - RNA, 21 nt, Human
cccuccaugcaccugcccacc

SEQ ID NO: 1106143 - RNA, 20 nt, Human
cccuccuacucccccuuccu

SEQ ID NO: 1106144 - RNA, 22 nt, Human
cccuuccucagaggccaccagu

SEQ ID NO: 1106145 - RNA, 19 nt, Human
cccuuuaucuuacaugggg

SEQ ID NO: 1106146 - RNA, 18 nt, Human
cccuuuucccccacuagg

SEQ ID NO: 1106147 - RNA, 22 nt, Human
ccuaaccugcccccccucacca

SEQ ID NO: 1106148 - RNA, 18 nt, Human
ccucaagcuagcaagaaa

SEQ ID NO: 1106149 - RNA, 19 nt, Human
ccucaagcuagcaagaaaa

SEQ ID NO: 1106150 - RNA, 23 nt, Human
ccucaccacaagcuuagccccca

SEQ ID NO: 1106151 - RNA, 22 nt, Human
ccucagaggccaccacugucau

SEQ ID NO: 1106152 - RNA, 21 nt, Human
ccuccaaggcuccuaccacuu

SEQ ID NO: 1106153 - RNA, 25 nt, Human
ccuccaaggcuccuaccacuuggcc

SEQ ID NO: 1106154 - RNA, 26 nt, Human
ccuccaaggcuccuaccacuuggccu

SEQ ID NO: 1106155 - RNA, 24 nt, Human
ccuccaugcaccugcccacccucc

SEQ ID NO: 1106156 - RNA, 25 nt, Human
ccuccuacucccccuuccuggcccc

SEQ ID NO: 1106157 - RNA, 21 nt, Human
ccuccugagagguucccuuuc

SEQ ID NO: 1106158 - RNA, 23 nt, Human
ccugccacggguguugcagcacc

SEQ ID NO: 1106159 - RNA, 19 nt, Human
ccugucacaggcagugaac

SEQ ID NO: 1106160 - RNA, 19 nt, Human
ccugugguacagaaccagc

SEQ ID NO: 1106161 - RNA, 19 nt, Human
ccuucacacaucugagagu

SEQ ID NO: 1106162 - RNA, 25 nt, Human
cggaggcagcagaacaccaacagaa

SEQ ID NO: 1106163 - RNA, 18 nt, Human
cucagaugccagcagaag

SEQ ID NO: 1106164 - RNA, 19 nt, Human
cuccaaagacugcaggaga

SEQ ID NO: 1106165 - RNA, 18 nt, Human
cuccagaacugaagaaau

SEQ ID NO: 1106166 - RNA, 19 nt, Human
cuccccccauaccaccccu

SEQ ID NO: 1106167 - RNA, 28 nt, Human
cuccccccauaccaccccuaaccugccc

SEQ ID NO: 1106168 - RNA, 18 nt, Human
cucccccuuccuggcccc

SEQ ID NO: 1106169 - RNA, 23 nt, Human
cucgauaguguccacaacccauc

SEQ ID NO: 1106170 - RNA, 21 nt, Human
cugaaaggagaaugcuggaag

SEQ ID NO: 1106171 - RNA, 21 nt, Human
cugacgccaaaggaaccagcg

SEQ ID NO: 1106172 - RNA, 20 nt, Human
cugcccccccucaccacaag

SEQ ID NO: 1106173 - RNA, 27 nt, Human
cuggcagcagcagugcagccucccccu

SEQ ID NO: 1106174 - RNA, 24 nt, Human
cuggccccuagacuugcugcugcu

SEQ ID NO: 1106175 - RNA, 20 nt, Human
cugggcagacaaugccagaa

SEQ ID NO: 1106176 - RNA, 24 nt, Human
cugucauggccaccuccacaaccu

SEQ ID NO: 1106177 - RNA, 18 nt, Human
gaacucccuccaacacac

SEQ ID NO: 1106178 - RNA, 19 nt, Human
gaagggggaggacuccucc

SEQ ID NO: 1106179 - RNA, 24 nt, Human
gaggccaccacugucauggccacc

SEQ ID NO: 1106180 - RNA, 20 nt, Human
gcagcagaacaccaacagaa

SEQ ID NO: 1106181 - RNA, 22 nt, Human
gcagugcagccuccccccauac

SEQ ID NO: 1106182 - RNA, 18 nt, Human
gcccacaacacacccaga

SEQ ID NO: 1106183 - RNA, 22 nt, Human
gccccaaagcccuccuacuccc

SEQ ID NO: 1106184 - RNA, 21 nt, Human
gccccaucaaacccgcccccc

SEQ ID NO: 1106185 - RNA, 21 nt, Human
gcccuccuacucccccuuccu

SEQ ID NO: 1106186 - RNA, 22 nt, Human
gcuccaaccuccagcucaccac

SEQ ID NO: 1106187 - RNA, 18 nt, Human
ggagggcacccuccaaag

SEQ ID NO: 1106188 - RNA, 18 nt, Human
ggcaggugggcugaagaa

SEQ ID NO: 1106189 - RNA, 23 nt, Human
ggccccaaagcccuccuacuccc

SEQ ID NO: 1106190 - RNA, 19 nt, Human
ggccuaagguuccacuuuc

SEQ ID NO: 1106191 - RNA, 20 nt, Human
gggugcgaaggcccugcagu

SEQ ID NO: 1106192 - RNA, 22 nt, Human
guacuggucuaagccuccccuc

SEQ ID NO: 1106193 - RNA, 24 nt, Human
gugcccacaacacacccagagacu

SEQ ID NO: 1106194 - RNA, 18 nt, Human
guggcccaaagggugccc

SEQ ID NO: 1106195 - RNA, 20 nt, Human
uaaaagaagaaugacuaaau

SEQ ID NO: 1106196 - RNA, 24 nt, Human
uaaccugcccccccucaccacaag

SEQ ID NO: 1106197 - RNA, 26 nt, Human
uaacucaacuggaaaaggagacaaaa

SEQ ID NO: 1106198 - RNA, 20 nt, Human
uaagaacaaaacaaugcugc

SEQ ID NO: 1106199 - RNA, 27 nt, Human
uaagaacaccauccauguugucguaga

SEQ ID NO: 1106200 - RNA, 18 nt, Human
uaagaugacugucuaagg

SEQ ID NO: 1106201 - RNA, 18 nt, Human
uaagcagccaacauagac

SEQ ID NO: 1106202 - RNA, 24 nt, Human
uaagcagccaacauagacacauuc

SEQ ID NO: 1106203 - RNA, 21 nt, Human
uacagaaccagcagcuucuua

SEQ ID NO: 1106204 - RNA, 20 nt, Human
uacccugauagcacccccaa

SEQ ID NO: 1106205 - RNA, 20 nt, Human
uagggugccugagaggcaug

SEQ ID NO: 1106206 - RNA, 20 nt, Human
uaucucacugaaaggagaau

SEQ ID NO: 1106207 - RNA, 24 nt, Human
ucaacuggaaaaggagacaaaauc

SEQ ID NO: 1106208 - RNA, 23 nt, Human
ucaccacaagcuuagcccccaga

SEQ ID NO: 1106209 - RNA, 22 nt, Human
ucauggccaccuccacaaccug

SEQ ID NO: 1106210 - RNA, 24 nt, Human
ucauggccaccuccacaaccugcu

SEQ ID NO: 1106211 - RNA, 19 nt, Human
uccaacacgagcagaaguu

SEQ ID NO: 1106212 - RNA, 18 nt, Human
uccaaggcuccuaccacu

SEQ ID NO: 1106213 - RNA, 22 nt, Human
uccaggaagaggagaagggccc

SEQ ID NO: 1106214 - RNA, 23 nt, Human
uccaggaagaggagaagggcccc

SEQ ID NO: 1106215 - RNA, 25 nt, Human
uccaucaccauggcugccacaacca

SEQ ID NO: 1106216 - RNA, 27 nt, Human
uccaucaccauggcugccacaaccaua

SEQ ID NO: 1106217 - RNA, 20 nt, Human
uccaugcaccugcccacccu

SEQ ID NO: 1106218 - RNA, 21 nt, Human
ucccacaacaccaaaacccag

SEQ ID NO: 1106219 - RNA, 22 nt, Human
ucccacaacaccaaaacccagg

SEQ ID NO: 1106220 - RNA, 23 nt, Human
ucccacaacaccaaaacccagga

SEQ ID NO: 1106221 - RNA, 21 nt, Human
uccccaggugacaccauggga

SEQ ID NO: 1106222 - RNA, 19 nt, Human
uccccccauaccaccccua

SEQ ID NO: 1106223 - RNA, 21 nt, Human
ucccuccaacacacagcuugc

SEQ ID NO: 1106224 - RNA, 19 nt, Human
ucccuuuucccccacuagg

SEQ ID NO: 1106225 - RNA, 21 nt, Human
uccuccuugcccuggcugcac

SEQ ID NO: 1106226 - RNA, 19 nt, Human
uccuggccccuagacuugc

SEQ ID NO: 1106227 - RNA, 26 nt, Human
ucuaaauuuaaaagaagaaugacuaa

SEQ ID NO: 1106228 - RNA, 24 nt, Human
ucugcgcuccaacacgagcagaag

SEQ ID NO: 1106229 - RNA, 21 nt, Human
ugaaaggagaaugcuggaagg

SEQ ID NO: 1106230 - RNA, 18 nt, Human
ugaacucccuccaacaca

SEQ ID NO: 1106231 - RNA, 18 nt, Human
ugacaccaugggcaggug

SEQ ID NO: 1106232 - RNA, 19 nt, Human
ugagagguucccuuucuuc

SEQ ID NO: 1106233 - RNA, 25 nt, Human
ugcaccuccaccaucacugaggccu

SEQ ID NO: 1106234 - RNA, 20 nt, Human
ugcaccugcccacccuccaa

SEQ ID NO: 1106235 - RNA, 22 nt, Human
ugccaccauuagcacugacgcc

SEQ ID NO: 1106236 - RNA, 22 nt, Human
ugcccacccuccaaggcuccua

SEQ ID NO: 1106237 - RNA, 22 nt, Human
ugcuaacaauaagcagccaaca

SEQ ID NO: 1106238 - RNA, 18 nt, Human
ugcugcugcugccaccau

SEQ ID NO: 1106239 - RNA, 19 nt, Human
uggaaggugcuaguaagau

SEQ ID NO: 1106240 - RNA, 20 nt, Human
uggaaggugcuaguaagaug

SEQ ID NO: 1106241 - RNA, 24 nt, Human
uggccaccuccacaaccugcugcu

SEQ ID NO: 1106242 - RNA, 22 nt, Human
uggccuccacagguacccuccu

SEQ ID NO: 1106243 - RNA, 18 nt, Human
uggcucagaugccagcag

SEQ ID NO: 1106244 - RNA, 19 nt, Human
ugggcagacaaugccagaa

SEQ ID NO: 1106245 - RNA, 22 nt, Human
ugguacagaaccagcagcuucu

SEQ ID NO: 1106246 - RNA, 24 nt, Human
uguccacaacccaucccugccacg

SEQ ID NO: 1106247 - RNA, 21 nt, Human
ugucuaaggacuccagaacug

SEQ ID NO: 1106248 - RNA, 24 nt, Human
ugucuaaggacuccagaacugaag

SEQ ID NO: 1106249 - RNA, 24 nt, Human
ugugcccacaacacacccagagag

SEQ ID NO: 1106250 - RNA, 18 nt, Human
uguucacccucuagaacc

SEQ ID NO: 1106251 - RNA, 19 nt, Human
uguucagaaauuugcuaac

SEQ ID NO: 1106252 - RNA, 24 nt, Human
uuaucacaaccaaaaacaaaaaga

SEQ ID NO: 1106253 - RNA, 18 nt, Human
uuccuggccauagaagcc

SEQ ID NO: 1106254 - RNA, 22 nt, Human
uuccuggccauagaagcccucc

SEQ ID NO: 1106255 - RNA, 19 nt, Human
uuguucacccucuagaacc

SEQ ID NO: 1106256 - RNA, 22 nt, Human
uuuuguggcaaugcaugucacu

SEQ ID NO: 1106257 - RNA, 25 nt, Human
uuuuucagaauuauuucauauuucu

SEQ ID NO: 1106258 - RNA, 24 nt, Human
aaacuaaauuugcugugacuauga

SEQ ID NO: 1106259 - RNA, 23 nt, Human
aauguggaaaaaaaguggaugau

SEQ ID NO: 1106260 - RNA, 19 nt, Human
agagccauuaaaggcugag

SEQ ID NO: 1106261 - RNA, 20 nt, Human
agccauuaaaggcugagcuc

SEQ ID NO: 1106262 - RNA, 21 nt, Human
agccauuaaaggcugagcucu

SEQ ID NO: 1106263 - RNA, 21 nt, Human
augaugccagagaacaaguac

SEQ ID NO: 1106264 - RNA, 25 nt, Human
caaacuaaauuugcugugacuauga

SEQ ID NO: 1106265 - RNA, 18 nt, Human
uaaaaagagccauuaaag

SEQ ID NO: 1106266 - RNA, 19 nt, Human
uacaaucaacagagcuauc

SEQ ID NO: 1106267 - RNA, 22 nt, Human
uaccuguuuauucucaaaucca

SEQ ID NO: 1106268 - RNA, 21 nt, Human
uauaucaagcagcaugaugcc

SEQ ID NO: 1106269 - RNA, 24 nt, Human
ucagugaaaaaaaaauucuaagaa

SEQ ID NO: 1106270 - RNA, 23 nt, Human
ucuaagaaauacauauaaaggag

SEQ ID NO: 1106271 - RNA, 19 nt, Human
ugaaaaaaaaauucuaaga

SEQ ID NO: 1106272 - RNA, 24 nt, Human
ugaaaaaaaaauucuaagaaauac

SEQ ID NO: 1106273 - RNA, 18 nt, Human
ugacuaugaaauuccaga

SEQ ID NO: 1106274 - RNA, 21 nt, Human
ugccagagaacaaguacuuaa

SEQ ID NO: 1106275 - RNA, 24 nt, Human
ugcccgauaagcagcuagaaacaa

SEQ ID NO: 1106276 - RNA, 21 nt, Human
uuagcuccaacuccuuucuca

SEQ ID NO: 1106277 - RNA, 26 nt, Human
uucagugaaaaaaaaauucuaagaaa

SEQ ID NO: 1106278 - RNA, 22 nt, Human
aaaacagauaagaacuggggca

SEQ ID NO: 1106279 - RNA, 18 nt, Human
aaaaggcagaaugaaacg

SEQ ID NO: 1106280 - RNA, 21 nt, Human
aacacaacuuauaacauugga

SEQ ID NO: 1106281 - RNA, 25 nt, Human
acgcaggcacacacacaccagugcu

SEQ ID NO: 1106282 - RNA, 21 nt, Human
acguaccauauacauguagac

SEQ ID NO: 1106283 - RNA, 18 nt, Human
agacccagaagccugaaa

SEQ ID NO: 1106284 - RNA, 21 nt, Human
agacgacaaaugaaaacuguc

SEQ ID NO: 1106285 - RNA, 21 nt, Human
agacuuggagacccagaagcc

SEQ ID NO: 1106286 - RNA, 21 nt, Human
agcggagccgcccgccugagg

SEQ ID NO: 1106287 - RNA, 18 nt, Human
augaaacguaccauauac

SEQ ID NO: 1106288 - RNA, 21 nt, Human
caauaucaccuccugaagcuu

SEQ ID NO: 1106289 - RNA, 22 nt, Human
cacacaccagugcucacagcca

SEQ ID NO: 1106290 - RNA, 24 nt, Human
cacaucaauaucaccuccugaagc

SEQ ID NO: 1106291 - RNA, 21 nt, Human
cacgcaggcacacacacacca

SEQ ID NO: 1106292 - RNA, 25 nt, Human
caucaauaucaccuccugaagcuuu

SEQ ID NO: 1106293 - RNA, 23 nt, Human
cccgccuaccgagccugcccacc

SEQ ID NO: 1106294 - RNA, 21 nt, Human
ccgccgaccgcggcccucucu

SEQ ID NO: 1106295 - RNA, 29 nt, Human
ccgccugagggagcccuccgggagugagg

SEQ ID NO: 1106296 - RNA, 23 nt, Human
ccuaccgagccugcccaccaccc

SEQ ID NO: 1106297 - RNA, 21 nt, Human
cggcggcuagcagggacgaag

SEQ ID NO: 1106298 - RNA, 23 nt, Human
cucaaauuaaggcaucaugcagc

SEQ ID NO: 1106299 - RNA, 20 nt, Human
cuccgggagugagcgcacgc

SEQ ID NO: 1106300 - RNA, 24 nt, Human
cuccugaagcuuuuuacccaguuu

SEQ ID NO: 1106301 - RNA, 18 nt, Human
cuggaccaaaugguauac

SEQ ID NO: 1106302 - RNA, 22 nt, Human
gaaagugguucuugaccgacuu

SEQ ID NO: 1106303 - RNA, 19 nt, Human
gaacuggggcaauggaggc

SEQ ID NO: 1106304 - RNA, 25 nt, Human
gcaaaacagauaagaacuggggcaa

SEQ ID NO: 1106305 - RNA, 26 nt, Human
gcacgcaggcacacacacaccagugc

SEQ ID NO: 1106306 - RNA, 25 nt, Human
uacccaguuucacgguugguauuuc

SEQ ID NO: 1106307 - RNA, 20 nt, Human
uaccgagccugcccaccacc

SEQ ID NO: 1106308 - RNA, 26 nt, Human
uagcagggacgaagcucaacuucaug

SEQ ID NO: 1106309 - RNA, 22 nt, Human
ucaaaguauccuucucucuaaa

SEQ ID NO: 1106310 - RNA, 26 nt, Human
ucucuaaaaagccacaaauuacguuc

SEQ ID NO: 1106311 - RNA, 18 nt, Human
ucuuguuuauuuggcuuu

SEQ ID NO: 1106312 - RNA, 18 nt, Human
ugaaacguaccauauaca

SEQ ID NO: 1106313 - RNA, 20 nt, Human
ugagcgcacgcaaccgugca

SEQ ID NO: 1106314 - RNA, 19 nt, Human
ugcacgcaggcacacacac

SEQ ID NO: 1106315 - RNA, 20 nt, Human
ugcacgcaggcacacacaca

SEQ ID NO: 1106316 - RNA, 26 nt, Human
ugcacgcaggcacacacacaccagug

SEQ ID NO: 1106317 - RNA, 21 nt, Human
ugcagucagauuccuccgccc

SEQ ID NO: 1106318 - RNA, 21 nt, Human
ugcaucuuguuuauuuggcuu

SEQ ID NO: 1106319 - RNA, 20 nt, Human
uggaaugccucguuuggaua

SEQ ID NO: 1106320 - RNA, 24 nt, Human
uggaccaaaugguauacgugucuu

SEQ ID NO: 1106321 - RNA, 21 nt, Human
uggagacccagaagccugaaa

SEQ ID NO: 1106322 - RNA, 23 nt, Human
ugucuuucaucaauauaaacaug

SEQ ID NO: 1106323 - RNA, 21 nt, Human
uucuuugaaguaaguauuggg

SEQ ID NO: 1106324 - RNA, 20 nt, Human
aaggaccacaggagcuaagg

SEQ ID NO: 1106325 - RNA, 24 nt, Human
aagugauccaccugccucggccuc

SEQ ID NO: 1106326 - RNA, 20 nt, Human
aaguugcugggacuauaggc

SEQ ID NO: 1106327 - RNA, 23 nt, Human
aaguugcugggacuauaggcacg

SEQ ID NO: 1106328 - RNA, 33 nt, Human
acacacacacacacacacagacguaugcacagu

SEQ ID NO: 1106329 - RNA, 21 nt, Human
acagaguuuuaccauguuagc

SEQ ID NO: 1106330 - RNA, 25 nt, Human
acaguaaaugaauugagacccagaa

SEQ ID NO: 1106331 - RNA, 21 nt, Human
acaguggggugaucucagcuc

SEQ ID NO: 1106332 - RNA, 23 nt, Human
accauguuagcuaggcuggucuc

SEQ ID NO: 1106333 - RNA, 24 nt, Human
accauguuagcuaggcuggucucg

SEQ ID NO: 1106334 - RNA, 19 nt, Human
acccagagaagugaagaga

SEQ ID NO: 1106335 - RNA, 20 nt, Human
acccugagguguaaauaggg

SEQ ID NO: 1106336 - RNA, 22 nt, Human
acccugagguguaaauagggaa

SEQ ID NO: 1106337 - RNA, 19 nt, Human
acuaauuuacauucccacc

SEQ ID NO: 1106338 - RNA, 22 nt, Human
aggcacgugccagcacgcccag

SEQ ID NO: 1106339 - RNA, 18 nt, Human
aggucucccggcuucagc

SEQ ID NO: 1106340 - RNA, 24 nt, Human
agucucucuguugcccaggcugga

SEQ ID NO: 1106341 - RNA, 24 nt, Human
aguggggugaucucagcucacugc

SEQ ID NO: 1106342 - RNA, 23 nt, Human
auagugcugcaguaaacauggga

SEQ ID NO: 1106343 - RNA, 24 nt, Human
auuuuuguauuuuuaguagagaca

SEQ ID NO: 1106344 - RNA, 21 nt, Human
caagacugggccuccaggccc

SEQ ID NO: 1106345 - RNA, 22 nt, Human
caagcaauacuucugccucagc

SEQ ID NO: 1106346 - RNA, 23 nt, Human
caaggaccacaggagcuaaggug

SEQ ID NO: 1106347 - RNA, 22 nt, Human
caagugauccaccugccucggc

SEQ ID NO: 1106348 - RNA, 24 nt, Human
cacacacacacacacagacguaug

SEQ ID NO: 1106349 - RNA, 20 nt, Human
caccugccucggccucccag

SEQ ID NO: 1106350 - RNA, 23 nt, Human
cacgcccagccuauuuuuaguuu

SEQ ID NO: 1106351 - RNA, 21 nt, Human
cacgcccugagaggcugcagg

SEQ ID NO: 1106352 - RNA, 21 nt, Human
cacugcaaccucugccuccug

SEQ ID NO: 1106353 - RNA, 23 nt, Human
cacugcaaccucugccuccuggg

SEQ ID NO: 1106354 - RNA, 24 nt, Human
cagaguuuuaccauguuagcuagg

SEQ ID NO: 1106355 - RNA, 24 nt, Human
cagcacgcccagcuaauuuuugua

SEQ ID NO: 1106356 - RNA, 20 nt, Human
cagcagugggauuacuggau

SEQ ID NO: 1106357 - RNA, 20 nt, Human
cauuuucuucauucauucgu

SEQ ID NO: 1106358 - RNA, 20 nt, Human
ccaccacgcccagccuauuu

SEQ ID NO: 1106359 - RNA, 20 nt, Human
ccagcacgcccagcuaauuu

SEQ ID NO: 1106360 - RNA, 23 nt, Human
ccagggugcugggauuacaggca

SEQ ID NO: 1106361 - RNA, 24 nt, Human
ccagggugcugggauuacaggcau

SEQ ID NO: 1106362 - RNA, 24 nt, Human
cccaaguugcugggacuauaggca

SEQ ID NO: 1106363 - RNA, 24 nt, Human
cccagggugcugggauuacaggca

SEQ ID NO: 1106364 - RNA, 23 nt, Human
ccuaagccccaaggaccacagga

SEQ ID NO: 1106365 - RNA, 19 nt, Human
ccucugccuccuggguuca

SEQ ID NO: 1106366 - RNA, 21 nt, Human
ccucuugccagcuuaccuggg

SEQ ID NO: 1106367 - RNA, 20 nt, Human
ccucuuucuccacuuucuca

SEQ ID NO: 1106368 - RNA, 21 nt, Human
ccugaccucaagugauccacc

SEQ ID NO: 1106369 - RNA, 23 nt, Human
ccugaccucaagugauccaccug

SEQ ID NO: 1106370 - RNA, 23 nt, Human
ccugaccucaagugauccaccug

SEQ ID NO: 1106371 - RNA, 21 nt, Human
ccuggguucaagcaauacuuc

SEQ ID NO: 1106372 - RNA, 21 nt, Human
ccuugagagaggggagccugg

SEQ ID NO: 1106373 - RNA, 23 nt, Human
cuauuucuuuuuuuuucuuugga

SEQ ID NO: 1106374 - RNA, 21 nt, Human
cucaagugauccaccugccuc

SEQ ID NO: 1106375 - RNA, 21 nt, Human
cucacacacacacacacacac

SEQ ID NO: 1106376 - RNA, 31 nt, Human
cucacacacacacacacacacagacguaugg

SEQ ID NO: 1106377 - RNA, 24 nt, Human
cucacugcaaccucugccuccugg

SEQ ID NO: 1106378 - RNA, 20 nt, Human
cuccggccagaccuccccuc

SEQ ID NO: 1106379 - RNA, 22 nt, Human
cucucucucucucucucacaca

SEQ ID NO: 1106380 - RNA, 19 nt, Human
cucucuguugcccaggcug

SEQ ID NO: 1106381 - RNA, 22 nt, Human
cucucuguugcccaggcuggag

SEQ ID NO: 1106382 - RNA, 23 nt, Human
cugcaaccucugccuccuggguu

SEQ ID NO: 1106383 - RNA, 24 nt, Human
cugcaaccucugccuccuggguuc

SEQ ID NO: 1106384 - RNA, 19 nt, Human
cugccucagccucccaagu

SEQ ID NO: 1106385 - RNA, 24 nt, Human
cuggaaguuucacgcucaagcuaa

SEQ ID NO: 1106386 - RNA, 19 nt, Human
cuguacuguucuccauagu

SEQ ID NO: 1106387 - RNA, 21 nt, Human
cuguggcccuuuccucuugcc

SEQ ID NO: 1106388 - RNA, 19 nt, Human
cuuuacgcacggacucucc

SEQ ID NO: 1106389 - RNA, 24 nt, Human
gaccucaagugauccaccugccuc

SEQ ID NO: 1106390 - RNA, 21 nt, Human
gagacagaguuuuaccauguu

SEQ ID NO: 1106391 - RNA, 22 nt, Human
gagaggggagccugguuuccaa

SEQ ID NO: 1106392 - RNA, 22 nt, Human
gaggacaagacugggccuccag

SEQ ID NO: 1106393 - RNA, 18 nt, Human
gauuacaggcaugagcca

SEQ ID NO: 1106394 - RNA, 21 nt, Human
gauuacaggcaugagccacca

SEQ ID NO: 1106395 - RNA, 22 nt, Human
gauuacaggcaugagccaccac

SEQ ID NO: 1106396 - RNA, 22 nt, Human
gcaaccucugccuccuggguuc

SEQ ID NO: 1106397 - RNA, 22 nt, Human
gcccagcuaauuuuuguauuuu

SEQ ID NO: 1106398 - RNA, 20 nt, Human
gccuguggcccuuuccucuu

SEQ ID NO: 1106399 - RNA, 23 nt, Human
gcugcuuuacgcacggacucucc

SEQ ID NO: 1106400 - RNA, 23 nt, Human
gcuggucucgaacuccugaccuc

SEQ ID NO: 1106401 - RNA, 19 nt, Human
ggacuauaggcacgugcca

SEQ ID NO: 1106402 - RNA, 19 nt, Human
ggauuacaggcaugagcca

SEQ ID NO: 1106403 - RNA, 20 nt, Human
ggauuccucuuucuccacuu

SEQ ID NO: 1106404 - RNA, 21 nt, Human
ggcccuuuccucuugccagcu

SEQ ID NO: 1106405 - RNA, 24 nt, Human
ggcuggucucgaacuccugaccuc

SEQ ID NO: 1106406 - RNA, 19 nt, Human
ggucucgaacuccugaccu

SEQ ID NO: 1106407 - RNA, 20 nt, Human
ggugacagaggaggacaaga

SEQ ID NO: 1106408 - RNA, 23 nt, Human
guacucucucucucucucucuca

SEQ ID NO: 1106409 - RNA, 23 nt, Human
gucucucuguugcccaggcugga

SEQ ID NO: 1106410 - RNA, 24 nt, Human
gucucucuguugcccaggcuggag

SEQ ID NO: 1106411 - RNA, 24 nt, Human
gugauccaccugccucggccuccc

SEQ ID NO: 1106412 - RNA, 21 nt, Human
gugcugggauuacaggcauga

SEQ ID NO: 1106413 - RNA, 22 nt, Human
uaagccccaaggaccacaggag

SEQ ID NO: 1106414 - RNA, 26 nt, Human
uaagccccaaggaccacaggagcuaa

SEQ ID NO: 1106415 - RNA, 25 nt, Human
uaaggugaucaacaaauucaccccc

SEQ ID NO: 1106416 - RNA, 24 nt, Human
uaauuuuuguauuuuuaguagaga

SEQ ID NO: 1106417 - RNA, 24 nt, Human
uacaggcaugagccaccacgccca

SEQ ID NO: 1106418 - RNA, 21 nt, Human
uaccauguuagcuaggcuggu

SEQ ID NO: 1106419 - RNA, 24 nt, Human
uaccauguuagcuaggcuggucuc

SEQ ID NO: 1106420 - RNA, 22 nt, Human
uaccuugagagaggggagccug

SEQ ID NO: 1106421 - RNA, 22 nt, Human
uagagacagaguuuuaccaugu

SEQ ID NO: 1106422 - RNA, 24 nt, Human
uagcuaggcuggucucgaacuccu

SEQ ID NO: 1106423 - RNA, 24 nt, Human
uaguagagacagaguuuuaccaug

SEQ ID NO: 1106424 - RNA, 24 nt, Human
uauugcaaauagugcugcaguaaa

SEQ ID NO: 1106425 - RNA, 21 nt, Human
ucaagugauccaccugccucg

SEQ ID NO: 1106426 - RNA, 21 nt, Human
ucacacacacacacacacaca

SEQ ID NO: 1106427 - RNA, 31 nt, Human
ucacacacacacacacacacagacguaugca

SEQ ID NO: 1106428 - RNA, 24 nt, Human
ucacugcaaccucugccuccuggg

SEQ ID NO: 1106429 - RNA, 25 nt, Human
ucacugcaaccucugccuccugggu

SEQ ID NO: 1106430 - RNA, 27 nt, Human
ucacugcaaccucugccuccuggguuc

SEQ ID NO: 1106431 - RNA, 19 nt, Human
ucauuguguguucauuuuc

SEQ ID NO: 1106432 - RNA, 18 nt, Human
uccacacagcaagucggu

SEQ ID NO: 1106433 - RNA, 22 nt, Human
uccaccugccucggccucccag

SEQ ID NO: 1106434 - RNA, 24 nt, Human
uccaggcccuguaaacaguuuccu

SEQ ID NO: 1106435 - RNA, 24 nt, Human
uccauaguggcuauacuaauuuac

SEQ ID NO: 1106436 - RNA, 24 nt, Human
ucccaaguugcugggacuauaggc

SEQ ID NO: 1106437 - RNA, 24 nt, Human
ucccagggugcugggauuacaggc

SEQ ID NO: 1106438 - RNA, 21 nt, Human
ucccuaagccccaaggaccac

SEQ ID NO: 1106439 - RNA, 21 nt, Human
uccuggguucaagcaauacuu

SEQ ID NO: 1106440 - RNA, 24 nt, Human
uccuggguucaagcaauacuucug

SEQ ID NO: 1106441 - RNA, 21 nt, Human
ucggccucccagggugcuggg

SEQ ID NO: 1106442 - RNA, 21 nt, Human
ucucacacacacacacacaca

SEQ ID NO: 1106443 - RNA, 24 nt, Human
ucuccauaguggcuauacuaauuu

SEQ ID NO: 1106444 - RNA, 21 nt, Human
ucucgaacuccugaccucaag

SEQ ID NO: 1106445 - RNA, 27 nt, Human
ucucucacacacacacacacacacaga

SEQ ID NO: 1106446 - RNA, 21 nt, Human
ucucucuguugcccaggcugg

SEQ ID NO: 1106447 - RNA, 22 nt, Human
ucucucuguugcccaggcugga

SEQ ID NO: 1106448 - RNA, 23 nt, Human
ucucucuguugcccaggcuggag

SEQ ID NO: 1106449 - RNA, 18 nt, Human
ucucuguugcccaggcug

SEQ ID NO: 1106450 - RNA, 18 nt, Human
ucucuguugcccaggcug

SEQ ID NO: 1106451 - RNA, 25 nt, Human
ucucuguugcccaggcuggaggaca

SEQ ID NO: 1106452 - RNA, 18 nt, Human
ucugccucagccucccaa

SEQ ID NO: 1106453 - RNA, 18 nt, Human
ucuguugcccaggcugga

SEQ ID NO: 1106454 - RNA, 24 nt, Human
ucuuggcuauugcaaauagugcug

SEQ ID NO: 1106455 - RNA, 24 nt, Human
ugaccucaagugauccaccugccu

SEQ ID NO: 1106456 - RNA, 18 nt, Human
ugagagaggggagccugg

SEQ ID NO: 1106457 - RNA, 23 nt, Human
ugagagaggggagccugguuucc

SEQ ID NO: 1106458 - RNA, 19 nt, Human
ugccucagccucccaaguu

SEQ ID NO: 1106459 - RNA, 24 nt, Human
ugccucagccucccaaguugcugg

SEQ ID NO: 1106460 - RNA, 21 nt, Human
ugccucggccucccagggugc

SEQ ID NO: 1106461 - RNA, 24 nt, Human
ugccucggccucccagggugcugg

SEQ ID NO: 1106462 - RNA, 20 nt, Human
ugcugcaguaaacauggggg

SEQ ID NO: 1106463 - RNA, 23 nt, Human
uggcccuuuccucuugccagcuu

SEQ ID NO: 1106464 - RNA, 21 nt, Human
ugggacuauaggcacgugcca

SEQ ID NO: 1106465 - RNA, 18 nt, Human
ugggauuacaggcaugag

SEQ ID NO: 1106466 - RNA, 19 nt, Human
ugggauuacaggcaugagc

SEQ ID NO: 1106467 - RNA, 22 nt, Human
ugggauuacaggcaugagccac

SEQ ID NO: 1106468 - RNA, 23 nt, Human
ugggauuacaggcaugagccacc

SEQ ID NO: 1106469 - RNA, 24 nt, Human
ugggauuacaggcaugagccacca

SEQ ID NO: 1106470 - RNA, 24 nt, Human
ugggauuacaggcaugagccacca

SEQ ID NO: 1106471 - RNA, 24 nt, Human
ugggccuccaggcccuguaaacag

SEQ ID NO: 1106472 - RNA, 27 nt, Human
ugggccuccaggcccuguaaacaguuu

SEQ ID NO: 1106473 - RNA, 24 nt, Human
uggggugaucucagcucacugcaa

SEQ ID NO: 1106474 - RNA, 23 nt, Human
uggguucaagcaauacuucugcc

SEQ ID NO: 1106475 - RNA, 24 nt, Human
uuaguagagacagaguuuuaccau

SEQ ID NO: 1106476 - RNA, 19 nt, Human
uuccccuagccuguggccc

SEQ ID NO: 1106477 - RNA, 21 nt, Human
uuuuuaguagagacagaguuu

SEQ ID NO: 1106478 - RNA, 20 nt, Human
uuuuuguauuuuuaguagag

SEQ ID NO: 1106479 - RNA, 24 nt, Human
aagcacagcagagaagcaaccagc

SEQ ID NO: 1106480 - RNA, 23 nt, Human
agacuuuaacauuguuguaguca

SEQ ID NO: 1106481 - RNA, 20 nt, Human
cacagcagagaagcaaccag

SEQ ID NO: 1106482 - RNA, 22 nt, Human
cuguaggucuccuguugccugg

SEQ ID NO: 1106483 - RNA, 19 nt, Human
gcuggaagggaguaggucc

SEQ ID NO: 1106484 - RNA, 24 nt, Human
ggguagguguugaugaagcuguag

SEQ ID NO: 1106485 - RNA, 25 nt, Human
uaggucuccuguugccuggggaaag

SEQ ID NO: 1106486 - RNA, 23 nt, Human
ucuccuguugccuggggaaaguc

SEQ ID NO: 1106487 - RNA, 21 nt, Human
ugauucggcuggaagggagua

SEQ ID NO: 1106488 - RNA, 25 nt, Human
uggaagggaguaggucccgccaaau

SEQ ID NO: 1106489 - RNA, 28 nt, Human
uguacaauagggaauucuagauaagcac

SEQ ID NO: 1106490 - RNA, 24 nt, Human
aauacuuagugauagccacaagug

SEQ ID NO: 1106491 - RNA, 21 nt, Human
gacagucugaaaaggcugccc

SEQ ID NO: 1106492 - RNA, 23 nt, Human
uaagaaaaugaaccgugccacag

SEQ ID NO: 1106493 - RNA, 18 nt, Human
ucuuaacccaaaguuaca

SEQ ID NO: 1106494 - RNA, 19 nt, Human
uucuaggcagagccuaagg

SEQ ID NO: 1106495 - RNA, 21 nt, Human
aaaaacaaaaaaggaaaucug

SEQ ID NO: 1106496 - RNA, 24 nt, Human
aaaaacaaaaacaaaaacaaaaac

SEQ ID NO: 1106497 - RNA, 18 nt, Human
aaaaaggaaaucugaaga

SEQ ID NO: 1106498 - RNA, 22 nt, Human
aaaacaaaaacaaaaacaaaaa

SEQ ID NO: 1106499 - RNA, 25 nt, Human
aaaacaaaaacaaaaacaaaccaga

SEQ ID NO: 1106500 - RNA, 18 nt, Human
aaaauuugaaguccuccc

SEQ ID NO: 1106501 - RNA, 25 nt, Human
aaacaaaaacaaaaacaaaaacaaa

SEQ ID NO: 1106502 - RNA, 26 nt, Human
aaacaaaaacaaaaacaaaaacaaac

SEQ ID NO: 1106503 - RNA, 25 nt, Human
aaacaaaaacaaaaacaaaccagaa

SEQ ID NO: 1106504 - RNA, 20 nt, Human
aaacaagcacgaaagcucac

SEQ ID NO: 1106505 - RNA, 23 nt, Human
aaagaaccccaaccaagugcgcc

SEQ ID NO: 1106506 - RNA, 23 nt, Human
aacaaaaacaaaaacaaaccaga

SEQ ID NO: 1106507 - RNA, 18 nt, Human
aacaaaaacaaaccagaa

SEQ ID NO: 1106508 - RNA, 24 nt, Human
aacaaaaacaaaccagaauuggcu

SEQ ID NO: 1106509 - RNA, 18 nt, Human
aaccugaaaggcuggugc

SEQ ID NO: 1106510 - RNA, 23 nt, Human
aaggaaaucugaagaauaugaua

SEQ ID NO: 1106511 - RNA, 26 nt, Human
acaaaacauuccccauuucuuuaaaa

SEQ ID NO: 1106512 - RNA, 23 nt, Human
acacuuuaagucugguaagaaac

SEQ ID NO: 1106513 - RNA, 22 nt, Human
acugcaaaaacaaaaaaggaaa

SEQ ID NO: 1106514 - RNA, 18 nt, Human
acugcacugcagccuagg

SEQ ID NO: 1106515 - RNA, 24 nt, Human
acugcacugcagccuaggggacag

SEQ ID NO: 1106516 - RNA, 21 nt, Human
acugcagccuaggggacagag

SEQ ID NO: 1106517 - RNA, 24 nt, Human
agagagcaagacuccaucucaaaa

SEQ ID NO: 1106518 - RNA, 21 nt, Human
aggaaaucugaagaauaugau

SEQ ID NO: 1106519 - RNA, 27 nt, Human
agggcacucuaaaauuuaaccugaaaa

SEQ ID NO: 1106520 - RNA, 21 nt, Human
agguggucaaaggaaaaggga

SEQ ID NO: 1106521 - RNA, 18 nt, Human
agugacaugaucuugguu

SEQ ID NO: 1106522 - RNA, 20 nt, Human
aucgcgccacugcacugcag

SEQ ID NO: 1106523 - RNA, 19 nt, Human
aucugaauggaccuccccu

SEQ ID NO: 1106524 - RNA, 21 nt, Human
caaacaagcacgaaagcucac

SEQ ID NO: 1106525 - RNA, 21 nt, Human
caaacaagcacgaaagcucac

SEQ ID NO: 1106526 - RNA, 18 nt, Human
caaagaaccccaaccaag

SEQ ID NO: 1106527 - RNA, 22 nt, Human
caacuuaaagaccacacuaaua

SEQ ID NO: 1106528 - RNA, 20 nt, Human
caaucaggaaggacuaacac

SEQ ID NO: 1106529 - RNA, 18 nt, Human
cacaguggaguaagcugg

SEQ ID NO: 1106530 - RNA, 19 nt, Human
caccagagccucucaccac

SEQ ID NO: 1106531 - RNA, 26 nt, Human
caccagagccucucaccacacagcag

SEQ ID NO: 1106532 - RNA, 24 nt, Human
cacugcacugcagccuaggggaca

SEQ ID NO: 1106533 - RNA, 24 nt, Human
cagcagggaguuccugaaagggga

SEQ ID NO: 1106534 - RNA, 21 nt, Human
caggcuggaaugcaaucagug

SEQ ID NO: 1106535 - RNA, 27 nt, Human
caucucaaaaaacaaaaacaaaaacaa

SEQ ID NO: 1106536 - RNA, 18 nt, Human
ccaaagaaccccaaccaa

SEQ ID NO: 1106537 - RNA, 20 nt, Human
ccacaucaggcaaggcaaag

SEQ ID NO: 1106538 - RNA, 19 nt, Human
ccaccaaauuaguucacau

SEQ ID NO: 1106539 - RNA, 20 nt, Human
ccacugcacugcagccuagg

SEQ ID NO: 1106540 - RNA, 24 nt, Human
ccacugcacugcagccuaggggac

SEQ ID NO: 1106541 - RNA, 20 nt, Human
ccaucucaaaaaacaaaaac

SEQ ID NO: 1106542 - RNA, 26 nt, Human
ccaucucaaaaaacaaaaacaaaaac

SEQ ID NO: 1106543 - RNA, 18 nt, Human
ccaugaugagcagugggg

SEQ ID NO: 1106544 - RNA, 20 nt, Human
cccaaagaaccccaaccaag

SEQ ID NO: 1106545 - RNA, 19 nt, Human
cccaaccaagugcgccaca

SEQ ID NO: 1106546 - RNA, 22 nt, Human
cccacaaccaucugaauggacc

SEQ ID NO: 1106547 - RNA, 22 nt, Human
cccuguuucuccuuuuuaaacc

SEQ ID NO: 1106548 - RNA, 22 nt, Human
cccuucggccagggcacucuaa

SEQ ID NO: 1106549 - RNA, 19 nt, Human
ccuagaaacugagaaccac

SEQ ID NO: 1106550 - RNA, 22 nt, Human
ccugugggacugggucccuaga

SEQ ID NO: 1106551 - RNA, 26 nt, Human
cuaacacuugcaaagcgauuucuuua

SEQ ID NO: 1106552 - RNA, 21 nt, Human
cuagcucugucacccaggcug

SEQ ID NO: 1106553 - RNA, 23 nt, Human
cucaaaaaacaaaaacaaaaaca

SEQ ID NO: 1106554 - RNA, 19 nt, Human
cuccagcaugaacaugagg

SEQ ID NO: 1106555 - RNA, 23 nt, Human
cucugucacccaggcuggaaugc

SEQ ID NO: 1106556 - RNA, 20 nt, Human
cucuuccaugcaaggccacc

SEQ ID NO: 1106557 - RNA, 23 nt, Human
cugaaccacaaauuuaaauaaca

SEQ ID NO: 1106558 - RNA, 26 nt, Human
cugaagccagcuacuuagaggcucau

SEQ ID NO: 1106559 - RNA, 19 nt, Human
cugcacugcagccuagggg

SEQ ID NO: 1106560 - RNA, 21 nt, Human
cuggccaugaugagcaguggg

SEQ ID NO: 1106561 - RNA, 18 nt, Human
cuguuacaauuucugguu

SEQ ID NO: 1106562 - RNA, 21 nt, Human
cuuccaaaccaauaaagaguu

SEQ ID NO: 1106563 - RNA, 19 nt, Human
gaaguccucccacaaccau

SEQ ID NO: 1106564 - RNA, 20 nt, Human
gaaguccucccacaaccauc

SEQ ID NO: 1106565 - RNA, 24 nt, Human
gauucaaucaaauguuuuuaaugu

SEQ ID NO: 1106566 - RNA, 24 nt, Human
gcaaggcaaagaaacuucaucuuu

SEQ ID NO: 1106567 - RNA, 22 nt, Human
gcacucuaaaauuuaaccugaa

SEQ ID NO: 1106568 - RNA, 21 nt, Human
gccaccagagccucucaccac

SEQ ID NO: 1106569 - RNA, 19 nt, Human
gccaugaugagcagugggg

SEQ ID NO: 1106570 - RNA, 19 nt, Human
gcccugacuggaaggugag

SEQ ID NO: 1106571 - RNA, 21 nt, Human
ggaaggacuaacacuugcaaa

SEQ ID NO: 1106572 - RNA, 21 nt, Human
ggcagagguggguauguuucu

SEQ ID NO: 1106573 - RNA, 20 nt, Human
gggcagagguggguauguuu

SEQ ID NO: 1106574 - RNA, 19 nt, Human
ggguauacuuuacuacuuc

SEQ ID NO: 1106575 - RNA, 23 nt, Human
uaacacaauaucgcugaaccaca

SEQ ID NO: 1106576 - RNA, 22 nt, Human
uacagaugccagcugagcccug

SEQ ID NO: 1106577 - RNA, 25 nt, Human
uacccuccagcaugaacaugaacac

SEQ ID NO: 1106578 - RNA, 23 nt, Human
uagcuuuacccaaagaaccccaa

SEQ ID NO: 1106579 - RNA, 24 nt, Human
uagguggucaaaggaaaagggagg

SEQ ID NO: 1106580 - RNA, 19 nt, Human
uagguuugcaaauauggua

SEQ ID NO: 1106581 - RNA, 22 nt, Human
ucaaaaaacaaaaacaaaaaca

SEQ ID NO: 1106582 - RNA, 20 nt, Human
ucacccaggcuggaaugcaa

SEQ ID NO: 1106583 - RNA, 20 nt, Human
ucagaggaugguuuaccauc

SEQ ID NO: 1106584 - RNA, 21 nt, Human
ucaugcaaucgcgccacugca

SEQ ID NO: 1106585 - RNA, 20 nt, Human
uccacaugaagaauguaagc

SEQ ID NO: 1106586 - RNA, 24 nt, Human
ucccuagaaacaccccuuggccau

SEQ ID NO: 1106587 - RNA, 19 nt, Human
ucuagcucugucacccagg

SEQ ID NO: 1106588 - RNA, 23 nt, Human
ucuagcucugucacccaggcugg

SEQ ID NO: 1106589 - RNA, 24 nt, Human
ucuagcucugucacccaggcugga

SEQ ID NO: 1106590 - RNA, 22 nt, Human
ucucaaaaaacaaaaacaaaaa

SEQ ID NO: 1106591 - RNA, 24 nt, Human
ucuccaggcugacacuggccacau

SEQ ID NO: 1106592 - RNA, 24 nt, Human
ucugucacccaggcuggaaugcaa

SEQ ID NO: 1106593 - RNA, 22 nt, Human
ugaaaucagugguuaacacaau

SEQ ID NO: 1106594 - RNA, 23 nt, Human
ugaagccagcuacuuagaggcuc

SEQ ID NO: 1106595 - RNA, 25 nt, Human
ugaagccagcuacuuagaggcuccu

SEQ ID NO: 1106596 - RNA, 21 nt, Human
ugacuggaaggugaggagggc

SEQ ID NO: 1106597 - RNA, 23 nt, Human
ugauugagaccugucucagauac

SEQ ID NO: 1106598 - RNA, 22 nt, Human
ugcaaaaacaaaaaaggaaauc

SEQ ID NO: 1106599 - RNA, 20 nt, Human
ugcaaagcgauuucuuuaaa

SEQ ID NO: 1106600 - RNA, 21 nt, Human
ugcaaagcgauuucuuuaaag

SEQ ID NO: 1106601 - RNA, 18 nt, Human
ugcagccuaggggacaga

SEQ ID NO: 1106602 - RNA, 21 nt, Human
ugcccugacuggaaggugagg

SEQ ID NO: 1106603 - RNA, 19 nt, Human
ugccucagaggauaugagg

SEQ ID NO: 1106604 - RNA, 20 nt, Human
uggaaggugaggagggcaga

SEQ ID NO: 1106605 - RNA, 28 nt, Human
uggaaugcaaucagugacaugaucuugg

SEQ ID NO: 1106606 - RNA, 27 nt, Human
uggcugagaaggaacagaguuagauac

SEQ ID NO: 1106607 - RNA, 22 nt, Human
ugucacccaggcuggaaugcaa

SEQ ID NO: 1106608 - RNA, 23 nt, Human
uguuacaaaacauuccccauuuc

SEQ ID NO: 1106609 - RNA, 20 nt, Human
uuacccaaagaaccccaacc

SEQ ID NO: 1106610 - RNA, 20 nt, Human
uucauuauuacccaacugcu

SEQ ID NO: 1106611 - RNA, 21 nt, Human
uugaugccacaucaggcaagg

SEQ ID NO: 1106612 - RNA, 24 nt, Human
uuucuacucugaaaucagugguua

SEQ ID NO: 1106613 - RNA, 24 nt, Human
uuugaaguccucccacaaccaucu

SEQ ID NO: 1106614 - RNA, 22 nt, Human
aaaaaggaccauuuccugagga

SEQ ID NO: 1106615 - RNA, 21 nt, Human
aaagcaaagaagucgggaacc

SEQ ID NO: 1106616 - RNA, 19 nt, Human
aagaagucgggaaccacuu

SEQ ID NO: 1106617 - RNA, 21 nt, Human
aagaauugaauguaagcguuu

SEQ ID NO: 1106618 - RNA, 26 nt, Human
aauaacaaaaucaaauuugggaggga

SEQ ID NO: 1106619 - RNA, 23 nt, Human
acauuuuuuuuuuucccccaagg

SEQ ID NO: 1106620 - RNA, 19 nt, Human
acugagcagguuagauaca

SEQ ID NO: 1106621 - RNA, 23 nt, Human
acuuugaaaaauaaucugguggg

SEQ ID NO: 1106622 - RNA, 25 nt, Human
agaaaaaaaaaggaccauuuccuga

SEQ ID NO: 1106623 - RNA, 22 nt, Human
agaccaaauucucccaaagcaa

SEQ ID NO: 1106624 - RNA, 23 nt, Human
agcgcuucccuccuggggcccgu

SEQ ID NO: 1106625 - RNA, 20 nt, Human
aggaaagagaacauuuccau

SEQ ID NO: 1106626 - RNA, 26 nt, Human
aggaaagagaacauuuccauuucaca

SEQ ID NO: 1106627 - RNA, 19 nt, Human
aggaggagaaggagagacc

SEQ ID NO: 1106628 - RNA, 19 nt, Human
agggaagaggaggaggagg

SEQ ID NO: 1106629 - RNA, 19 nt, Human
aucaaauuugggagggaau

SEQ ID NO: 1106630 - RNA, 19 nt, Human
augggacauaccguaccuc

SEQ ID NO: 1106631 - RNA, 23 nt, Human
caaauucucccaaagcaaagaag

SEQ ID NO: 1106632 - RNA, 23 nt, Human
cacuuucaaaacugauuuuaaaa

SEQ ID NO: 1106633 - RNA, 19 nt, Human
cagcgcaacggugacagcg

SEQ ID NO: 1106634 - RNA, 19 nt, Human
cagguuagauacaccgaaa

SEQ ID NO: 1106635 - RNA, 21 nt, Human
cauaagaccaaauucucccaa

SEQ ID NO: 1106636 - RNA, 22 nt, Human
caucaggaaugaauuuaguucc

SEQ ID NO: 1106637 - RNA, 24 nt, Human
cccaaagcaaagaagucgggaacc

SEQ ID NO: 1106638 - RNA, 18 nt, Human
ccucuaaggagaagcaaa

SEQ ID NO: 1106639 - RNA, 23 nt, Human
cggugacagcggcagcagucuuc

SEQ ID NO: 1106640 - RNA, 18 nt, Human
cguuuucccucuuagcca

SEQ ID NO: 1106641 - RNA, 24 nt, Human
cugugguuucccuuuccaaaaccu

SEQ ID NO: 1106642 - RNA, 23 nt, Human
cuucaaaacacaucuguguucac

SEQ ID NO: 1106643 - RNA, 25 nt, Human
cuuucugucuauguaaguuuucaac

SEQ ID NO: 1106644 - RNA, 20 nt, Human
gaucaagcugaagacauacu

SEQ ID NO: 1106645 - RNA, 21 nt, Human
gcacacuuuucucuuuccugu

SEQ ID NO: 1106646 - RNA, 21 nt, Human
ggaauucccccaaauguccau

SEQ ID NO: 1106647 - RNA, 21 nt, Human
ggcacuaaagguuaagaggga

SEQ ID NO: 1106648 - RNA, 25 nt, Human
ggcacuaaagguuaagagggaagcc

SEQ ID NO: 1106649 - RNA, 18 nt, Human
gggaagaggaggaggagg

SEQ ID NO: 1106650 - RNA, 18 nt, Human
gggaauucccccaaaugu

SEQ ID NO: 1106651 - RNA, 19 nt, Human
ggggcccguguuuuguggu

SEQ ID NO: 1106652 - RNA, 23 nt, Human
ggugauuuauagaaaaaaaaagg

SEQ ID NO: 1106653 - RNA, 25 nt, Human
gguuggugauuuauagaaaaaaaaa

SEQ ID NO: 1106654 - RNA, 19 nt, Human
gugcuacuucuucaaaaca

SEQ ID NO: 1106655 - RNA, 19 nt, Human
uaaguuuucaacauuaauu

SEQ ID NO: 1106656 - RNA, 27 nt, Human
uaaguuuucaacauuaauuugcugcuu

SEQ ID NO: 1106657 - RNA, 20 nt, Human
uaaucucugugguuucccuu

SEQ ID NO: 1106658 - RNA, 22 nt, Human
uagcacauuuuuuuuuuucccc

SEQ ID NO: 1106659 - RNA, 21 nt, Human
uagcuucuaguucgaacgccu

SEQ ID NO: 1106660 - RNA, 24 nt, Human
uaguugguuggugauuuauagaaa

SEQ ID NO: 1106661 - RNA, 20 nt, Human
uauagaaaaaaaaaggacca

SEQ ID NO: 1106662 - RNA, 23 nt, Human
ucaaaacacaucuguguucacgg

SEQ ID NO: 1106663 - RNA, 19 nt, Human
ucagaggaaagagaacauu

SEQ ID NO: 1106664 - RNA, 22 nt, Human
ucauuccaccagaacacgugga

SEQ ID NO: 1106665 - RNA, 19 nt, Human
uccaccagaacacguggag

SEQ ID NO: 1106666 - RNA, 23 nt, Human
uccaccagaacacguggagagaa

SEQ ID NO: 1106667 - RNA, 18 nt, Human
ucccaaagcaaagaaguc

SEQ ID NO: 1106668 - RNA, 26 nt, Human
ucucccaaagcaaagaagucgggaac

SEQ ID NO: 1106669 - RNA, 18 nt, Human
ucucugugguuucccuuu

SEQ ID NO: 1106670 - RNA, 23 nt, Human
ucuggaacgagaccauccaugac

SEQ ID NO: 1106671 - RNA, 24 nt, Human
ucuucaaaacacaucuguguucac

SEQ ID NO: 1106672 - RNA, 21 nt, Human
ugaguggcugcuauucuguuu

SEQ ID NO: 1106673 - RNA, 19 nt, Human
uggaacaauaacaucugga

SEQ ID NO: 1106674 - RNA, 21 nt, Human
ugggagggaauucccccaaau

SEQ ID NO: 1106675 - RNA, 24 nt, Human
uggugauuuauagaaaaaaaaagg

SEQ ID NO: 1106676 - RNA, 19 nt, Human
uguccauuuagauaguugg

SEQ ID NO: 1106677 - RNA, 23 nt, Human
uucccuggaacaauaacaucugg

SEQ ID NO: 1106678 - RNA, 24 nt, Human
uugccgugugccuagacagcgcuu

SEQ ID NO: 1106679 - RNA, 19 nt, Human
aaaaagcuuuucuggagaa

SEQ ID NO: 1106680 - RNA, 26 nt, Human
aaacaaaaauaagguagauuuucugg

SEQ ID NO: 1106681 - RNA, 24 nt, Human
aaacaaccuugcagcuuugcagau

SEQ ID NO: 1106682 - RNA, 23 nt, Human
aaagcagaggagccgcauaaaug

SEQ ID NO: 1106683 - RNA, 23 nt, Human
aaaguccccaccaucagccauau

SEQ ID NO: 1106684 - RNA, 20 nt, Human
aagaaugcauuaagccggag

SEQ ID NO: 1106685 - RNA, 20 nt, Human
aagcagaggagccgcauaaa

SEQ ID NO: 1106686 - RNA, 20 nt, Human
aagcaugcauggagugccag

SEQ ID NO: 1106687 - RNA, 18 nt, Human
aaguaauuaugaaaggaa

SEQ ID NO: 1106688 - RNA, 25 nt, Human
aagugcuggaaacaaccuugcagcu

SEQ ID NO: 1106689 - RNA, 21 nt, Human
acaacaaaaagcuuuucugga

SEQ ID NO: 1106690 - RNA, 18 nt, Human
acagccaggucucucaga

SEQ ID NO: 1106691 - RNA, 21 nt, Human
acagcugggcuggguucuggu

SEQ ID NO: 1106692 - RNA, 19 nt, Human
accacaggagccacaugcc

SEQ ID NO: 1106693 - RNA, 20 nt, Human
agaaaaacacagauuaugaa

SEQ ID NO: 1106694 - RNA, 23 nt, Human
agaaaacaaaugaaguuagggac

SEQ ID NO: 1106695 - RNA, 23 nt, Human
agaaaagcuaaaguaauuaugaa

SEQ ID NO: 1106696 - RNA, 21 nt, Human
agaaaucacaguugaagguaa

SEQ ID NO: 1106697 - RNA, 20 nt, Human
agaaggcaauauauaauuau

SEQ ID NO: 1106698 - RNA, 21 nt, Human
agagacgugucuccacagccc

SEQ ID NO: 1106699 - RNA, 18 nt, Human
agagggagaaaucacagu

SEQ ID NO: 1106700 - RNA, 22 nt, Human
agcaaaaggcagccaggucucg

SEQ ID NO: 1106701 - RNA, 18 nt, Human
agcaaagaaauagccgcc

SEQ ID NO: 1106702 - RNA, 19 nt, Human
agcagcggugcuccagcag

SEQ ID NO: 1106703 - RNA, 19 nt, Human
aggaaacaguaaagucccc

SEQ ID NO: 1106704 - RNA, 23 nt, Human
aggaggccacagaggaagggggu

SEQ ID NO: 1106705 - RNA, 19 nt, Human
aggauggaaccagaagacu

SEQ ID NO: 1106706 - RNA, 21 nt, Human
aggcaggauuuagagaaagcc

SEQ ID NO: 1106707 - RNA, 21 nt, Human
aggggccaagggugagaacag

SEQ ID NO: 1106708 - RNA, 20 nt, Human
agugcuggaaacaaccuugc

SEQ ID NO: 1106709 - RNA, 20 nt, Human
augaaacacuggccaggccg

SEQ ID NO: 1106710 - RNA, 21 nt, Human
auggaaacaaaaauaagguag

SEQ ID NO: 1106711 - RNA, 19 nt, Human
caaaagggacaaaugaaac

SEQ ID NO: 1106712 - RNA, 24 nt, Human
caaagugcuggaaacaaccuugca

SEQ ID NO: 1106713 - RNA, 18 nt, Human
caacccaagcgucaacaa

SEQ ID NO: 1106714 - RNA, 22 nt, Human
caaggagcuuccgguuucagcg

SEQ ID NO: 1106715 - RNA, 22 nt, Human
cacagaggaaggggguuguguu

SEQ ID NO: 1106716 - RNA, 19 nt, Human
caccacaggagccacaugc

SEQ ID NO: 1106717 - RNA, 23 nt, Human
caccacaggagccacaugccacc

SEQ ID NO: 1106718 - RNA, 21 nt, Human
cagaggagccgcauaaaugca

SEQ ID NO: 1106719 - RNA, 20 nt, Human
cagaucaggccuagcagcgg

SEQ ID NO: 1106720 - RNA, 19 nt, Human
cagcaaaaggcagccaggu

SEQ ID NO: 1106721 - RNA, 19 nt, Human
cagcacuuuuaaaaauaau

SEQ ID NO: 1106722 - RNA, 20 nt, Human
caggccuagaaaacaaauga

SEQ ID NO: 1106723 - RNA, 19 nt, Human
cauuuuauauagcuguucu

SEQ ID NO: 1106724 - RNA, 19 nt, Human
ccaggucuuggggauggaa

SEQ ID NO: 1106725 - RNA, 20 nt, Human
cccaaagugcuggaaacaac

SEQ ID NO: 1106726 - RNA, 20 nt, Human
cccaagcgucaacaaguucu

SEQ ID NO: 1106727 - RNA, 20 nt, Human
ccccucuucugaugugacca

SEQ ID NO: 1106728 - RNA, 24 nt, Human
ccccuugccaagcaccacaggagc

SEQ ID NO: 1106729 - RNA, 22 nt, Human
ccuucgagaugaagaaaaugga

SEQ ID NO: 1106730 - RNA, 18 nt, Human
cgcugcaggaaucagggg

SEQ ID NO: 1106731 - RNA, 22 nt, Human
cggugcuccagcaggagggaaa

SEQ ID NO: 1106732 - RNA, 20 nt, Human
cucaccccgacccuaucccc

SEQ ID NO: 1106733 - RNA, 24 nt, Human
cucaccccgacccuauccccuggc

SEQ ID NO: 1106734 - RNA, 23 nt, Human
cugggugcacacuugggccccuc

SEQ ID NO: 1106735 - RNA, 22 nt, Human
cuggugugaaagcuguagacau

SEQ ID NO: 1106736 - RNA, 23 nt, Human
cuuccgguuucagcggcaaaagg

SEQ ID NO: 1106737 - RNA, 24 nt, Human
cuuggagcaaagaaauagccgccu

SEQ ID NO: 1106738 - RNA, 22 nt, Human
gacaaaugaaacacuggccagg

SEQ ID NO: 1106739 - RNA, 24 nt, Human
gagccgcauaaaugcaaucacuua

SEQ ID NO: 1106740 - RNA, 23 nt, Human
gauucauucacuguuaggaaugg

SEQ ID NO: 1106741 - RNA, 21 nt, Human
gcugcuggggcgucuuucggc

SEQ ID NO: 1106742 - RNA, 22 nt, Human
ggagguaucccaacucggagag

SEQ ID NO: 1106743 - RNA, 18 nt, Human
ggcagcacuucuuucuuu

SEQ ID NO: 1106744 - RNA, 27 nt, Human
gggaacagagaggagagaccgguaccc

SEQ ID NO: 1106745 - RNA, 19 nt, Human
gggaagggaacagagagga

SEQ ID NO: 1106746 - RNA, 22 nt, Human
gggaggugaauggggaagggaa

SEQ ID NO: 1106747 - RNA, 19 nt, Human
ggggauggaaauccaaggg

SEQ ID NO: 1106748 - RNA, 25 nt, Human
gggguuguguuucccacacaacagg

SEQ ID NO: 1106749 - RNA, 22 nt, Human
ggugugaaagcuguagacauau

SEQ ID NO: 1106750 - RNA, 26 nt, Human
guaaaacaacaacaaaaagcuuuucu

SEQ ID NO: 1106751 - RNA, 22 nt, Human
guaggacaggcaggauuuagag

SEQ ID NO: 1106752 - RNA, 20 nt, Human
gucauuuuauauagcuguuc

SEQ ID NO: 1106753 - RNA, 19 nt, Human
guucuggaggcugggaguu

SEQ ID NO: 1106754 - RNA, 22 nt, Human
guuguguuucccacacaacagg

SEQ ID NO: 1106755 - RNA, 23 nt, Human
guuguguuucccacacaacagga

SEQ ID NO: 1106756 - RNA, 23 nt, Human
guuuggccagcaaaaggcagcca

SEQ ID NO: 1106757 - RNA, 20 nt, Human
guuuugaugacuuggagaaa

SEQ ID NO: 1106758 - RNA, 25 nt, Human
uaaacacagggaguaccaggucuug

SEQ ID NO: 1106759 - RNA, 21 nt, Human
uaaaguaauuaugaaaggaac

SEQ ID NO: 1106760 - RNA, 24 nt, Human
uaaaguaauuaugaaaggaacuag

SEQ ID NO: 1106761 - RNA, 21 nt, Human
uaaaguccccaccaucagcca

SEQ ID NO: 1106762 - RNA, 21 nt, Human
uaagccggagaaaaacacaga

SEQ ID NO: 1106763 - RNA, 18 nt, Human
uacccacggagcaugggg

SEQ ID NO: 1106764 - RNA, 26 nt, Human
uagaaaacaaaugaaguuagggacau

SEQ ID NO: 1106765 - RNA, 22 nt, Human
uagcuguucuuuuauaguggaa

SEQ ID NO: 1106766 - RNA, 24 nt, Human
uagggguuucuucucaccccgacc

SEQ ID NO: 1106767 - RNA, 20 nt, Human
uaguacaugcugggugcaca

SEQ ID NO: 1106768 - RNA, 20 nt, Human
ucacuguggcagcacuucuu

SEQ ID NO: 1106769 - RNA, 23 nt, Human
uccacgaaguaaaacaacaacaa

SEQ ID NO: 1106770 - RNA, 25 nt, Human
ucccaaagugcuggaaacaaccucg

SEQ ID NO: 1106771 - RNA, 19 nt, Human
uccccuggcagcaagacuc

SEQ ID NO: 1106772 - RNA, 25 nt, Human
ucgagaugaagaaaauggaaacaac

SEQ ID NO: 1106773 - RNA, 19 nt, Human
ucucucagaguucuggagg

SEQ ID NO: 1106774 - RNA, 23 nt, Human
ucucucagaguucuggaggcugg

SEQ ID NO: 1106775 - RNA, 19 nt, Human
ucugacaucacuggaaaug

SEQ ID NO: 1106776 - RNA, 21 nt, Human
ucuugggaggaaggcuauugu

SEQ ID NO: 1106777 - RNA, 20 nt, Human
ucuuguagcuuuugucucuu

SEQ ID NO: 1106778 - RNA, 21 nt, Human
ucuuucggcugcggcccugcc

SEQ ID NO: 1106779 - RNA, 20 nt, Human
ugaaaggaacuagaaggauu

SEQ ID NO: 1106780 - RNA, 26 nt, Human
ugaauggggaagggaacagagaggag

SEQ ID NO: 1106781 - RNA, 25 nt, Human
ugacuuggagaaagauaguggaacu

SEQ ID NO: 1106782 - RNA, 22 nt, Human
ugagaacagccaggucucucag

SEQ ID NO: 1106783 - RNA, 21 nt, Human
ugagaagaggggcagccuggu

SEQ ID NO: 1106784 - RNA, 22 nt, Human
ugagaagaggggcagccuggug

SEQ ID NO: 1106785 - RNA, 20 nt, Human
ugaggaaucuugaugccagu

SEQ ID NO: 1106786 - RNA, 18 nt, Human
ugcaguuggugagauggg

SEQ ID NO: 1106787 - RNA, 18 nt, Human
ugcaguuggugagauggg

SEQ ID NO: 1106788 - RNA, 22 nt, Human
ugcuuguuguaucuucuucuca

SEQ ID NO: 1106789 - RNA, 23 nt, Human
uggaaaugugugugugcugcugg

SEQ ID NO: 1106790 - RNA, 23 nt, Human
uggaacuaauucucacuugaaug

SEQ ID NO: 1106791 - RNA, 22 nt, Human
uggaagagagcaauuaguaaug

SEQ ID NO: 1106792 - RNA, 18 nt, Human
uggccagcaaaaggcagc

SEQ ID NO: 1106793 - RNA, 20 nt, Human
ugucucuugaaauaaugauc

SEQ ID NO: 1106794 - RNA, 21 nt, Human
ugugaugcuagugaugacaca

SEQ ID NO: 1106795 - RNA, 23 nt, Human
ugugucacuacuggauaucuggc

SEQ ID NO: 1106796 - RNA, 22 nt, Human
uuaaugcugguuugugucccug

SEQ ID NO: 1106797 - RNA, 20 nt, Human
uuagcggucuauucaaaacc

SEQ ID NO: 1106798 - RNA, 18 nt, Human
uucauucacuguuaggaa

SEQ ID NO: 1106799 - RNA, 25 nt, Human
uucauucacuguuaggaauggaauc

SEQ ID NO: 1106800 - RNA, 25 nt, Human
uucgagaugaagaaaauggaaacaa

SEQ ID NO: 1106801 - RNA, 19 nt, Human
uugaaggaugcuaaccaua

SEQ ID NO: 1106802 - RNA, 18 nt, Human
uugccaagcaccacagga

SEQ ID NO: 1106803 - RNA, 23 nt, Human
uugcugcuggggcgucuuucggc

SEQ ID NO: 1106804 - RNA, 19 nt, Human
uuggagcaaagaaauagcc

SEQ ID NO: 1106805 - RNA, 18 nt, Human
uuucuuggagcaaagaaa

SEQ ID NO: 1106806 - RNA, 21 nt, Human
uuugcagaucaggccuagcag

SEQ ID NO: 1106807 - RNA, 26 nt, Human
uuugcagggaggugaauggggaaggg

SEQ ID NO: 1106808 - RNA, 23 nt, Human
uuugcaguuggugagaugggccc

SEQ ID NO: 1106809 - RNA, 24 nt, Human
aaagagaagagugacaugaucuga

SEQ ID NO: 1106810 - RNA, 23 nt, Human
aaguguuauaagcacagcaaacu

SEQ ID NO: 1106811 - RNA, 20 nt, Human
accacuggcucugaucacac

SEQ ID NO: 1106812 - RNA, 21 nt, Human
acccagcgccccacugcacag

SEQ ID NO: 1106813 - RNA, 20 nt, Human
accccgcgggcaccgcggcc

SEQ ID NO: 1106814 - RNA, 19 nt, Human
acggcugcaucucuggcuc

SEQ ID NO: 1106815 - RNA, 20 nt, Human
acuugcacaaauacaggaag

SEQ ID NO: 1106816 - RNA, 21 nt, Human
agagaagagugacaugaucug

SEQ ID NO: 1106817 - RNA, 18 nt, Human
agaguuucccagccaaga

SEQ ID NO: 1106818 - RNA, 21 nt, Human
agcacagaggacacuggcccg

SEQ ID NO: 1106819 - RNA, 28 nt, Human
agcagcaccucucggggggccuccggcu

SEQ ID NO: 1106820 - RNA, 26 nt, Human
agcggcggcggcggccgguacgcggg

SEQ ID NO: 1106821 - RNA, 20 nt, Human
aggaaguucuggcccaaaac

SEQ ID NO: 1106822 - RNA, 25 nt, Human
aggccagaccacaagguuuugaagg

SEQ ID NO: 1106823 - RNA, 20 nt, Human
aggccaugaaaucuccacug

SEQ ID NO: 1106824 - RNA, 22 nt, Human
aggcuuggagguugugcaaacc

SEQ ID NO: 1106825 - RNA, 19 nt, Human
agggaggccaacagaggcc

SEQ ID NO: 1106826 - RNA, 18 nt, Human
cacagcaagcccugccug

SEQ ID NO: 1106827 - RNA, 20 nt, Human
caccagguggcgagcaaggc

SEQ ID NO: 1106828 - RNA, 23 nt, Human
caccgccagcacccagcgcccca

SEQ ID NO: 1106829 - RNA, 24 nt, Human
cacugcacagcacggaguaauuuc

SEQ ID NO: 1106830 - RNA, 18 nt, Human
cagcagcacagaggacac

SEQ ID NO: 1106831 - RNA, 23 nt, Human
cagcagcacagaggacacuggcc

SEQ ID NO: 1106832 - RNA, 22 nt, Human
cagccaagaagucacaucuccu

SEQ ID NO: 1106833 - RNA, 22 nt, Human
caggcccuggcugcugcuggag

SEQ ID NO: 1106834 - RNA, 18 nt, Human
caggcgacucccgccucc

SEQ ID NO: 1106835 - RNA, 23 nt, Human
caggggccucccuucccgggccc

SEQ ID NO: 1106836 - RNA, 21 nt, Human
cauaugggaaaaagaaguguu

SEQ ID NO: 1106837 - RNA, 18 nt, Human
cauggccaagcucccucu

SEQ ID NO: 1106838 - RNA, 22 nt, Human
ccaacagaggccagaccacaag

SEQ ID NO: 1106839 - RNA, 25 nt, Human
ccacuuucaggguccaacccucagu

SEQ ID NO: 1106840 - RNA, 18 nt, Human
ccccggggggcagguccg

SEQ ID NO: 1106841 - RNA, 20 nt, Human
ccccggggggcagguccgcc

SEQ ID NO: 1106842 - RNA, 19 nt, Human
ccgcugagccggggguggg

SEQ ID NO: 1106843 - RNA, 22 nt, Human
ccuccagugccaccucugccuc

SEQ ID NO: 1106844 - RNA, 18 nt, Human
ccuccuggagccaggggc

SEQ ID NO: 1106845 - RNA, 22 nt, Human
ccucugccucccccaaccgugu

SEQ ID NO: 1106846 - RNA, 23 nt, Human
ccuggagccaggggccucccuuc

SEQ ID NO: 1106847 - RNA, 21 nt, Human
ccuuaguuuagagagagaguc

SEQ ID NO: 1106848 - RNA, 23 nt, Human
ccuucaacugagcacuguggggc

SEQ ID NO: 1106849 - RNA, 18 nt, Human
cgccagcacccagcgccc

SEQ ID NO: 1106850 - RNA, 19 nt, Human
cgccgggccacgagcagcg

SEQ ID NO: 1106851 - RNA, 20 nt, Human
cgccgggccacgagcagcgg

SEQ ID NO: 1106852 - RNA, 22 nt, Human
cgccgggccacgagcagcggaa

SEQ ID NO: 1106853 - RNA, 23 nt, Human
cgcgaccccgcgggcaccgcggc

SEQ ID NO: 1106854 - RNA, 21 nt, Human
cgguccgaccgcgggcagcag

SEQ ID NO: 1106855 - RNA, 22 nt, Human
cuagcucagagcaacacagcaa

SEQ ID NO: 1106856 - RNA, 23 nt, Human
cuccagugccaccucugccuccc

SEQ ID NO: 1106857 - RNA, 23 nt, Human
cuccuggagccaggggccucccu

SEQ ID NO: 1106858 - RNA, 18 nt, Human
cugccucccccaaccgug

SEQ ID NO: 1106859 - RNA, 18 nt, Human
cugccucccccaaccgug

SEQ ID NO: 1106860 - RNA, 21 nt, Human
cugccucccccaaccgugucu

SEQ ID NO: 1106861 - RNA, 22 nt, Human
cuggcccaaaacgcccugugca

SEQ ID NO: 1106862 - RNA, 25 nt, Human
gacucccgccuccuggagccagggg

SEQ ID NO: 1106863 - RNA, 24 nt, Human
gagcagcgagcggcggcggcggcc

SEQ ID NO: 1106864 - RNA, 21 nt, Human
gagcggcggcggcggccggua

SEQ ID NO: 1106865 - RNA, 20 nt, Human
gaggggaggucagggaggcc

SEQ ID NO: 1106866 - RNA, 18 nt, Human
gcaacacagcaagcccug

SEQ ID NO: 1106867 - RNA, 18 nt, Human
gcagagaaagaauuggga

SEQ ID NO: 1106868 - RNA, 18 nt, Human
gcaggcccuggcugcugc

SEQ ID NO: 1106869 - RNA, 18 nt, Human
gcaggcgacucccgccuc

SEQ ID NO: 1106870 - RNA, 20 nt, Human
gcaggcgacucccgccuccu

SEQ ID NO: 1106871 - RNA, 21 nt, Human
gccacacaagaaauuacauau

SEQ ID NO: 1106872 - RNA, 25 nt, Human
gccucccccaaccgugucucugcca

SEQ ID NO: 1106873 - RNA, 19 nt, Human
gcggcggcggcggccggua

SEQ ID NO: 1106874 - RNA, 25 nt, Human
gcguggcccgguccgaccgcgggca

SEQ ID NO: 1106875 - RNA, 18 nt, Human
gcugcagaggcuuggagg

SEQ ID NO: 1106876 - RNA, 18 nt, Human
ggaccuuuucagagaaca

SEQ ID NO: 1106877 - RNA, 25 nt, Human
ggaugccuucggggagacccuggaa

SEQ ID NO: 1106878 - RNA, 21 nt, Human
ggaugggguguggccuacagg

SEQ ID NO: 1106879 - RNA, 23 nt, Human
ggccaugaaaucuccacuggggu

SEQ ID NO: 1106880 - RNA, 18 nt, Human
ggggaccuuuucagagaa

SEQ ID NO: 1106881 - RNA, 21 nt, Human
gggggcagagaaagaauuggg

SEQ ID NO: 1106882 - RNA, 19 nt, Human
ggggucugugcuugguagg

SEQ ID NO: 1106883 - RNA, 18 nt, Human
ggguucgccgccaggcag

SEQ ID NO: 1106884 - RNA, 20 nt, Human
ggugauggggacgccgcuga

SEQ ID NO: 1106885 - RNA, 22 nt, Human
guggcgagcaaggcaggugaug

SEQ ID NO: 1106886 - RNA, 19 nt, Human
uaaagagaagagugacaug

SEQ ID NO: 1106887 - RNA, 20 nt, Human
uaaagagaagagugacauga

SEQ ID NO: 1106888 - RNA, 19 nt, Human
uacuggaguccgggggcag

SEQ ID NO: 1106889 - RNA, 23 nt, Human
uagacuugagaaaugaaugacau

SEQ ID NO: 1106890 - RNA, 20 nt, Human
uaggaaguucuggcccaaaa

SEQ ID NO: 1106891 - RNA, 23 nt, Human
uaugcaucuucuuuucugagggg

SEQ ID NO: 1106892 - RNA, 20 nt, Human
ucaggaacggcaaauucaag

SEQ ID NO: 1106893 - RNA, 21 nt, Human
uccacuggggucacacuaugc

SEQ ID NO: 1106894 - RNA, 19 nt, Human
ucccaagucagcacggcug

SEQ ID NO: 1106895 - RNA, 20 nt, Human
ucccccaaccgugucucugc

SEQ ID NO: 1106896 - RNA, 24 nt, Human
ucccccaaccgugucucugccacc

SEQ ID NO: 1106897 - RNA, 18 nt, Human
ucccgggcccaggaugcc

SEQ ID NO: 1106898 - RNA, 19 nt, Human
ucccgggcccaggaugccc

SEQ ID NO: 1106899 - RNA, 21 nt, Human
ucccucucuagcucagagcaa

SEQ ID NO: 1106900 - RNA, 18 nt, Human
ucucuggcucucugaagc

SEQ ID NO: 1106901 - RNA, 21 nt, Human
ucugcagcaagagagggagac

SEQ ID NO: 1106902 - RNA, 22 nt, Human
ucugcugcagaggcuuggaggu

SEQ ID NO: 1106903 - RNA, 21 nt, Human
ugaaauaggaaguucuggccc

SEQ ID NO: 1106904 - RNA, 19 nt, Human
ugaaggucacgacgaugag

SEQ ID NO: 1106905 - RNA, 23 nt, Human
ugagaaaugaaugacauauggga

SEQ ID NO: 1106906 - RNA, 18 nt, Human
ugagggggugaccacggg

SEQ ID NO: 1106907 - RNA, 19 nt, Human
ugagggggugaccacgggg

SEQ ID NO: 1106908 - RNA, 21 nt, Human
ugagggugaucuggucaccgc

SEQ ID NO: 1106909 - RNA, 25 nt, Human
ugaucuggucaccgccagcacccag

SEQ ID NO: 1106910 - RNA, 22 nt, Human
ugcugcagaggcuuggagguug

SEQ ID NO: 1106911 - RNA, 20 nt, Human
uggagguugugcaaaccaca

SEQ ID NO: 1106912 - RNA, 22 nt, Human
uggccaagcucccucucuagcu

SEQ ID NO: 1106913 - RNA, 22 nt, Human
uggcccaaaacgcccugugcag

SEQ ID NO: 1106914 - RNA, 19 nt, Human
uggcccgguccgaccgcgg

SEQ ID NO: 1106915 - RNA, 21 nt, Human
uggcccgguccgaccgcgggc

SEQ ID NO: 1106916 - RNA, 24 nt, Human
uggcugagagacagacugugauac

SEQ ID NO: 1106917 - RNA, 19 nt, Human
ugggacuuaacccaagacu

SEQ ID NO: 1106918 - RNA, 21 nt, Human
ugggagcuggauggggugugg

SEQ ID NO: 1106919 - RNA, 22 nt, Human
ugggaggggaggucagggaggc

SEQ ID NO: 1106920 - RNA, 22 nt, Human
uggggccccggggggcaggucc

SEQ ID NO: 1106921 - RNA, 20 nt, Human
ugggggacaaccagaggccu

SEQ ID NO: 1106922 - RNA, 21 nt, Human
ugguaacugcuacucuuagac

SEQ ID NO: 1106923 - RNA, 19 nt, Human
ugucucugccaccagcgga

SEQ ID NO: 1106924 - RNA, 18 nt, Human
ugugauacuggaguccgg

SEQ ID NO: 1106925 - RNA, 20 nt, Human
uguggaguuuccgcccaucu

SEQ ID NO: 1106926 - RNA, 25 nt, Human
uucuucugcagcaagagagggagac

SEQ ID NO: 1106927 - RNA, 18 nt, Human
uugagcagcgagcggcgg

SEQ ID NO: 1106928 - RNA, 24 nt, Human
uugccugcugugugugaggcucug

SEQ ID NO: 1106929 - RNA, 23 nt, Human
agggcugagaucacucugggccg

SEQ ID NO: 1106930 - RNA, 25 nt, Human
aggggaggauggaagauguuucuug

SEQ ID NO: 1106931 - RNA, 20 nt, Human
caggaaaacccuccugggug

SEQ ID NO: 1106932 - RNA, 20 nt, Human
caggugccugacccuccaag

SEQ ID NO: 1106933 - RNA, 18 nt, Human
ccuccgagauccuucggg

SEQ ID NO: 1106934 - RNA, 21 nt, Human
cucugggccccaggaaaaccc

SEQ ID NO: 1106935 - RNA, 20 nt, Human
gauggaagauguuucuuggg

SEQ ID NO: 1106936 - RNA, 23 nt, Human
uagcaacuucgccuccgagaucc

SEQ ID NO: 1106937 - RNA, 24 nt, Human
uccugggugacugcaaucucaggu

SEQ ID NO: 1106938 - RNA, 23 nt, Human
ucuucuagcaacuucgccuccga

SEQ ID NO: 1106939 - RNA, 22 nt, Human
ugggccccaggaaaacccuccu

SEQ ID NO: 1106940 - RNA, 19 nt, Human
uggggagaggggaggaugg

SEQ ID NO: 1106941 - RNA, 22 nt, Human
ugugguuuuggggagaggggag

SEQ ID NO: 1106942 - RNA, 24 nt, Human
aaacauggaauuucauuaaaucug

SEQ ID NO: 1106943 - RNA, 19 nt, Human
aagugugaaguccugaucc

SEQ ID NO: 1106944 - RNA, 21 nt, Human
acaggcgcccaccaccaugcc

SEQ ID NO: 1106945 - RNA, 24 nt, Human
accguguuggccaggauggucucg

SEQ ID NO: 1106946 - RNA, 20 nt, Human
accuggaugcuacacauccc

SEQ ID NO: 1106947 - RNA, 18 nt, Human
acgggguuucaccguguu

SEQ ID NO: 1106948 - RNA, 23 nt, Human
acgggguuucaccguguuggcca

SEQ ID NO: 1106949 - RNA, 24 nt, Human
acgggguuucaccguguuggccag

SEQ ID NO: 1106950 - RNA, 20 nt, Human
acugcaagcuccgccucccg

SEQ ID NO: 1106951 - RNA, 18 nt, Human
acuugauccauccuuuga

SEQ ID NO: 1106952 - RNA, 20 nt, Human
aguagagacgggguuucacc

SEQ ID NO: 1106953 - RNA, 18 nt, Human
aguagcugggacuacagg

SEQ ID NO: 1106954 - RNA, 21 nt, Human
agugcaguggcacgaucucag

SEQ ID NO: 1106955 - RNA, 23 nt, Human
agugcaguggcacgaucucagcu

SEQ ID NO: 1106956 - RNA, 24 nt, Human
agugcaguggcacgaucucagcuc

SEQ ID NO: 1106957 - RNA, 20 nt, Human
augggcucuggagccaaccu

SEQ ID NO: 1106958 - RNA, 21 nt, Human
auucuccugccucagccuccc

SEQ ID NO: 1106959 - RNA, 19 nt, Human
caaaugcucguucuuaaug

SEQ ID NO: 1106960 - RNA, 22 nt, Human
caacaaacauggaauuucauua

SEQ ID NO: 1106961 - RNA, 21 nt, Human
cacaucccagcucugccccuc

SEQ ID NO: 1106962 - RNA, 18 nt, Human
caccguguuggccaggau

SEQ ID NO: 1106963 - RNA, 21 nt, Human
caccguguuggccaggauggu

SEQ ID NO: 1106964 - RNA, 24 nt, Human
caccguguuggccaggauggucuc

SEQ ID NO: 1106965 - RNA, 22 nt, Human
cacgccauucuccugccucagc

SEQ ID NO: 1106966 - RNA, 21 nt, Human
cagaguccccugcccccaccc

SEQ ID NO: 1106967 - RNA, 18 nt, Human
cagcucacugcaagcucc

SEQ ID NO: 1106968 - RNA, 26 nt, Human
ccacccccaaaaccaguacuugaucc

SEQ ID NO: 1106969 - RNA, 23 nt, Human
ccagaguccccugcccccacccc

SEQ ID NO: 1106970 - RNA, 24 nt, Human
ccagaguccccugcccccaccccc

SEQ ID NO: 1106971 - RNA, 18 nt, Human
ccagcucugccccucgcu

SEQ ID NO: 1106972 - RNA, 21 nt, Human
cccacccccaaaaccaguacu

SEQ ID NO: 1106973 - RNA, 19 nt, Human
cccagaguccccugccccc

SEQ ID NO: 1106974 - RNA, 18 nt, Human
cccagcucugccccucgc

SEQ ID NO: 1106975 - RNA, 23 nt, Human
ccccaaaaccaguacuugaucca

SEQ ID NO: 1106976 - RNA, 23 nt, Human
cccccaaaaccaguacuugaucc

SEQ ID NO: 1106977 - RNA, 22 nt, Human
cccccacccccaaaaccaguac

SEQ ID NO: 1106978 - RNA, 24 nt, Human
ccccugcccccacccccaaaacca

SEQ ID NO: 1106979 - RNA, 25 nt, Human
ccccugcccccacccccaaaacccc

SEQ ID NO: 1106980 - RNA, 23 nt, Human
cccgaguagcugggacuacaggc

SEQ ID NO: 1106981 - RNA, 24 nt, Human
cccgaguagcugggacuacaggcg

SEQ ID NO: 1106982 - RNA, 19 nt, Human
ccucgugaucccccccccu

SEQ ID NO: 1106983 - RNA, 18 nt, Human
ccugauccagacucaccu

SEQ ID NO: 1106984 - RNA, 23 nt, Human
ccugccucagccucccgaguagc

SEQ ID NO: 1106985 - RNA, 19 nt, Human
cgccucccggguucacgcc

SEQ ID NO: 1106986 - RNA, 26 nt, Human
cgcucugucgcccaggcucuggagug

SEQ ID NO: 1106987 - RNA, 24 nt, Human
cgggguuucaccguguuggccagg

SEQ ID NO: 1106988 - RNA, 18 nt, Human
cgugcacacuauuuacca

SEQ ID NO: 1106989 - RNA, 26 nt, Human
cuacacaucccagcucugccccucgc

SEQ ID NO: 1106990 - RNA, 24 nt, Human
cucagccucccgaguagcugggac

SEQ ID NO: 1106991 - RNA, 21 nt, Human
cucccggguucacgccauucu

SEQ ID NO: 1106992 - RNA, 18 nt, Human
cuccugaccucgugaucc

SEQ ID NO: 1106993 - RNA, 27 nt, Human
cucgugaucccccccccucggccuccc

SEQ ID NO: 1106994 - RNA, 20 nt, Human
cugcccccacccccaaaacc

SEQ ID NO: 1106995 - RNA, 23 nt, Human
cugcccccacccccaaaaccagu

SEQ ID NO: 1106996 - RNA, 23 nt, Human
cugccucagccucccgaguagcu

SEQ ID NO: 1106997 - RNA, 18 nt, Human
cuuaaagagaccuuuccc

SEQ ID NO: 1106998 - RNA, 24 nt, Human
gacuacaggcgcccaccaccaugc

SEQ ID NO: 1106999 - RNA, 24 nt, Human
gagacgggguuucaccguguuggc

SEQ ID NO: 1107000 - RNA, 20 nt, Human
gaguagcugggacuacaggc

SEQ ID NO: 1107001 - RNA, 25 nt, Human
gaguagcugggacuacaggcgccca

SEQ ID NO: 1107002 - RNA, 21 nt, Human
gcacacuauuuaccacaaagg

SEQ ID NO: 1107003 - RNA, 18 nt, Human
gcccccacccccaaaacc

SEQ ID NO: 1107004 - RNA, 25 nt, Human
gccucccggguucacgccauucucc

SEQ ID NO: 1107005 - RNA, 23 nt, Human
gccuggcuaauuuuuuguauuuu

SEQ ID NO: 1107006 - RNA, 21 nt, Human
gcucugucgcccaggcucugg

SEQ ID NO: 1107007 - RNA, 18 nt, Human
ggcgauuggcacaaaggu

SEQ ID NO: 1107008 - RNA, 23 nt, Human
gggguuucaccguguuggccagg

SEQ ID NO: 1107009 - RNA, 20 nt, Human
ggucucgaucuccugaccuc

SEQ ID NO: 1107010 - RNA, 23 nt, Human
guagagacgggguuucaccgugu

SEQ ID NO: 1107011 - RNA, 26 nt, Human
gugaucccccccccucggccucccaa

SEQ ID NO: 1107012 - RNA, 22 nt, Human
uaaagagaccuuucccuguacu

SEQ ID NO: 1107013 - RNA, 23 nt, Human
uaauagaucucgccuuguggcuc

SEQ ID NO: 1107014 - RNA, 24 nt, Human
uaauuuuuuguauuuuuaguagag

SEQ ID NO: 1107015 - RNA, 25 nt, Human
uaauuuuuuguauuuuuaguagaga

SEQ ID NO: 1107016 - RNA, 22 nt, Human
uaccuggaugcuacacauccca

SEQ ID NO: 1107017 - RNA, 21 nt, Human
uaguagagacgggguuucacc

SEQ ID NO: 1107018 - RNA, 24 nt, Human
uaguagagacgggguuucaccgug

SEQ ID NO: 1107019 - RNA, 26 nt, Human
uaguagagacgggguuucaccguguu

SEQ ID NO: 1107020 - RNA, 26 nt, Human
uaguagagacgggguuucaccguugg

SEQ ID NO: 1107021 - RNA, 21 nt, Human
ucaagcauuagaaugguggcu

SEQ ID NO: 1107022 - RNA, 24 nt, Human
ucaccguguuggccaggauggucu

SEQ ID NO: 1107023 - RNA, 18 nt, Human
ucacugcaagcuccgccu

SEQ ID NO: 1107024 - RNA, 19 nt, Human
ucacugcaagcuccgccuc

SEQ ID NO: 1107025 - RNA, 24 nt, Human
ucacugcaagcuccgccucccggg

SEQ ID NO: 1107026 - RNA, 19 nt, Human
ucagaaaacauacugccca

SEQ ID NO: 1107027 - RNA, 23 nt, Human
ucagccucccgaguagcugggac

SEQ ID NO: 1107028 - RNA, 20 nt, Human
uccccugcccccacccccaa

SEQ ID NO: 1107029 - RNA, 24 nt, Human
ucccgaguagcugggacuacaggc

SEQ ID NO: 1107030 - RNA, 21 nt, Human
ucccggguucacgccauucuc

SEQ ID NO: 1107031 - RNA, 24 nt, Human
ucccggguucacgccauucuccug

SEQ ID NO: 1107032 - RNA, 19 nt, Human
uccguuaucaagugugaag

SEQ ID NO: 1107033 - RNA, 22 nt, Human
ucuccagcagcacaaugggaau

SEQ ID NO: 1107034 - RNA, 24 nt, Human
ucuccugccucagccucccgagua

SEQ ID NO: 1107035 - RNA, 18 nt, Human
ucucgcucugucgcccag

SEQ ID NO: 1107036 - RNA, 18 nt, Human
ucucgcucugucgcccag

SEQ ID NO: 1107037 - RNA, 19 nt, Human
ucucgcucugucgcccagg

SEQ ID NO: 1107038 - RNA, 25 nt, Human
ucucgcucugucgcccaggcucugg

SEQ ID NO: 1107039 - RNA, 26 nt, Human
ucucgcucugucgcccaggcucugga

SEQ ID NO: 1107040 - RNA, 26 nt, Human
ucugucgcccaggcucuggagugcag

SEQ ID NO: 1107041 - RNA, 28 nt, Human
ugacagcagugcacagcagcuggcagag

SEQ ID NO: 1107042 - RNA, 19 nt, Human
ugaccucgugauccccccc

SEQ ID NO: 1107043 - RNA, 22 nt, Human
ugagauggagucucgcucuguc

SEQ ID NO: 1107044 - RNA, 18 nt, Human
ugaucagaaaacauacug

SEQ ID NO: 1107045 - RNA, 21 nt, Human
ugaucccccccccucggccuc

SEQ ID NO: 1107046 - RNA, 21 nt, Human
ugcccccacccccaaaaccag

SEQ ID NO: 1107047 - RNA, 25 nt, Human
ugcccccacccccaaaaccaguacu

SEQ ID NO: 1107048 - RNA, 24 nt, Human
ugccucagccucccgaguagcugg

SEQ ID NO: 1107049 - RNA, 21 nt, Human
ugccuuaauuucuccagcagc

SEQ ID NO: 1107050 - RNA, 24 nt, Human
uggagucucgcucugucgcccagg

SEQ ID NO: 1107051 - RNA, 23 nt, Human
uggagugcaguggcacgaucuca

SEQ ID NO: 1107052 - RNA, 24 nt, Human
uggagugcaguggcacgaucucag

SEQ ID NO: 1107053 - RNA, 21 nt, Human
uggaugcuacacaucccagcu

SEQ ID NO: 1107054 - RNA, 24 nt, Human
uggcacgaucucagcucacugcaa

SEQ ID NO: 1107055 - RNA, 20 nt, Human
uggcagagaauucuggcacg

SEQ ID NO: 1107056 - RNA, 24 nt, Human
uggccaggauggucucgaucuccu

SEQ ID NO: 1107057 - RNA, 21 nt, Human
ugggacuacaggcgcccacca

SEQ ID NO: 1107058 - RNA, 24 nt, Human
ugggacuacaggcgcccaccacca

SEQ ID NO: 1107059 - RNA, 25 nt, Human
ugggacuacaggcgcccaccaccau

SEQ ID NO: 1107060 - RNA, 21 nt, Human
uguauuuuuaguagagacggg

SEQ ID NO: 1107061 - RNA, 19 nt, Human
uguuguggcgauuggcaca

SEQ ID NO: 1107062 - RNA, 18 nt, Human
uuaguagagacgggguuu

SEQ ID NO: 1107063 - RNA, 22 nt, Human
uuaguagagacgggguuucacc

SEQ ID NO: 1107064 - RNA, 24 nt, Human
uuaguagagacgggguuucaccgu

SEQ ID NO: 1107065 - RNA, 25 nt, Human
uucaacaaacauggaauuucauuaa

SEQ ID NO: 1107066 - RNA, 19 nt, Human
uuucaccguguuggccagg

SEQ ID NO: 1107067 - RNA, 24 nt, Human
uuuuuaguagagacgggguuucac

SEQ ID NO: 1107068 - RNA, 21 nt, Human
uuuuuguauuuuuaguagaga

SEQ ID NO: 1107069 - RNA, 24 nt, Human
uuuuuuguauuuuuaguagagacg

SEQ ID NO: 1107070 - RNA, 22 nt, Human
acugcaagcaggaacagauugc

SEQ ID NO: 1107071 - RNA, 25 nt, Human
acugcaguaccaucgaaagaacauc

SEQ ID NO: 1107072 - RNA, 24 nt, Human
agcucgcccaggcugggccuccag

SEQ ID NO: 1107073 - RNA, 18 nt, Human
agggagcaggggcugggg

SEQ ID NO: 1107074 - RNA, 19 nt, Human
agggagggagcaggggcug

SEQ ID NO: 1107075 - RNA, 24 nt, Human
aguguccauccuccccucucugac

SEQ ID NO: 1107076 - RNA, 19 nt, Human
auccugcuuccccuagucu

SEQ ID NO: 1107077 - RNA, 22 nt, Human
auccugcuuccccuagucucug

SEQ ID NO: 1107078 - RNA, 24 nt, Human
caacucugucuccgcccgcggggg

SEQ ID NO: 1107079 - RNA, 24 nt, Human
cacccucugagucuccauccuccc

SEQ ID NO: 1107080 - RNA, 23 nt, Human
cagcagcucgcccaggcugggcc

SEQ ID NO: 1107081 - RNA, 19 nt, Human
cagggcucgaucagcucgg

SEQ ID NO: 1107082 - RNA, 21 nt, Human
ccauccuccccucucugacuc

SEQ ID NO: 1107083 - RNA, 18 nt, Human
ccaucuuccacccucuga

SEQ ID NO: 1107084 - RNA, 21 nt, Human
ccaucuuccccucucugacuc

SEQ ID NO: 1107085 - RNA, 20 nt, Human
ccccacagucgcuaugcuuc

SEQ ID NO: 1107086 - RNA, 21 nt, Human
ccccuagucucugccucaucu

SEQ ID NO: 1107087 - RNA, 22 nt, Human
cccgaguguccauccuccccuc

SEQ ID NO: 1107088 - RNA, 22 nt, Human
cccugcugucuuccccugucug

SEQ ID NO: 1107089 - RNA, 18 nt, Human
ccgcaacaccaugucccu

SEQ ID NO: 1107090 - RNA, 20 nt, Human
ccuccccucucugacucucc

SEQ ID NO: 1107091 - RNA, 19 nt, Human
ccucgggccuggccagcag

SEQ ID NO: 1107092 - RNA, 24 nt, Human
ccucugagucuccauccuccccuc

SEQ ID NO: 1107093 - RNA, 21 nt, Human
ccugcaacucugucuccgccc

SEQ ID NO: 1107094 - RNA, 20 nt, Human
cgaggacugcaagcaggaac

SEQ ID NO: 1107095 - RNA, 23 nt, Human
cgcccaggcugggccuccagggc

SEQ ID NO: 1107096 - RNA, 24 nt, Human
cgcccaggcugggccuccagggcu

SEQ ID NO: 1107097 - RNA, 22 nt, Human
cucauggucuuugagccuuucu

SEQ ID NO: 1107098 - RNA, 19 nt, Human
cuccgcccgcgggggcggg

SEQ ID NO: 1107099 - RNA, 20 nt, Human
cucggcaucccgcggcgccc

SEQ ID NO: 1107100 - RNA, 23 nt, Human
cucuccauccucccgagugucca

SEQ ID NO: 1107101 - RNA, 25 nt, Human
cucucucuggguuuccauccucuuu

SEQ ID NO: 1107102 - RNA, 24 nt, Human
cugagucuccauccucccccucuc

SEQ ID NO: 1107103 - RNA, 19 nt, Human
cugcugucuuccccugucu

SEQ ID NO: 1107104 - RNA, 22 nt, Human
cuuccccugucugugucucucu

SEQ ID NO: 1107105 - RNA, 19 nt, Human
cuuccucucucucugaguc

SEQ ID NO: 1107106 - RNA, 18 nt, Human
cuuugagucuccaucuuc

SEQ ID NO: 1107107 - RNA, 18 nt, Human
gaccagucgcuauccugc

SEQ ID NO: 1107108 - RNA, 20 nt, Human
gccucaucucuguccuccuc

SEQ ID NO: 1107109 - RNA, 21 nt, Human
gccucgggccuggccagcagc

SEQ ID NO: 1107110 - RNA, 22 nt, Human
gcugucuuccccugucuguguc

SEQ ID NO: 1107111 - RNA, 19 nt, Human
ggaaauaggauagggaagg

SEQ ID NO: 1107112 - RNA, 19 nt, Human
gggcugggggaggcagcuc

SEQ ID NO: 1107113 - RNA, 20 nt, Human
ggucuuugagccuuucuccu

SEQ ID NO: 1107114 - RNA, 19 nt, Human
uaccaucgaaagaacaucc

SEQ ID NO: 1107115 - RNA, 28 nt, Human
uauccugcuuccccuagucucugccuca

SEQ ID NO: 1107116 - RNA, 18 nt, Human
uccaucuuuccgagucuc

SEQ ID NO: 1107117 - RNA, 22 nt, Human
ucccaagucucuauccucccug

SEQ ID NO: 1107118 - RNA, 23 nt, Human
ucccaagucuguauccuccccuc

SEQ ID NO: 1107119 - RNA, 21 nt, Human
uccccgcaacaccaugucccu

SEQ ID NO: 1107120 - RNA, 21 nt, Human
uccccucucugacucuccaua

SEQ ID NO: 1107121 - RNA, 23 nt, Human
ucccuaagucucuguuguucucc

SEQ ID NO: 1107122 - RNA, 25 nt, Human
uccucccugagucucugcccccgac

SEQ ID NO: 1107123 - RNA, 19 nt, Human
uccugagucuccaucuuuc

SEQ ID NO: 1107124 - RNA, 20 nt, Human
ucgcccaggcugggccucca

SEQ ID NO: 1107125 - RNA, 20 nt, Human
ucuccaaccucuccugacuc

SEQ ID NO: 1107126 - RNA, 28 nt, Human
ucuccaucuuccucucucuccucugaag

SEQ ID NO: 1107127 - RNA, 25 nt, Human
ucuccaucuuccucucucucugagu

SEQ ID NO: 1107128 - RNA, 21 nt, Human
ucuccaucuuuccgagucucc

SEQ ID NO: 1107129 - RNA, 23 nt, Human
ucucuauucccucuccagucucc

SEQ ID NO: 1107130 - RNA, 24 nt, Human
ucucucuggguuuccauccucuuu

SEQ ID NO: 1107131 - RNA, 18 nt, Human
ucucugacucuccauacu

SEQ ID NO: 1107132 - RNA, 24 nt, Human
ucucugacucuccauccuccccuc

SEQ ID NO: 1107133 - RNA, 21 nt, Human
ucucugacucuuugccccaca

SEQ ID NO: 1107134 - RNA, 21 nt, Human
ucucugagucuccauccuccc

SEQ ID NO: 1107135 - RNA, 21 nt, Human
ucucugagucuccaucuuccc

SEQ ID NO: 1107136 - RNA, 20 nt, Human
ucucugccucaucucugucc

SEQ ID NO: 1107137 - RNA, 23 nt, Human
ucucugccucaucucuguccucc

SEQ ID NO: 1107138 - RNA, 18 nt, Human
ucuggguuuccauccucc

SEQ ID NO: 1107139 - RNA, 21 nt, Human
ucuuccucucucucugagucu

SEQ ID NO: 1107140 - RNA, 18 nt, Human
ugacucuccauccucccc

SEQ ID NO: 1107141 - RNA, 18 nt, Human
ugacucuccauccucccc

SEQ ID NO: 1107142 - RNA, 19 nt, Human
ugagggagggagcaggggc

SEQ ID NO: 1107143 - RNA, 20 nt, Human
uggaaauaggauagggaagg

SEQ ID NO: 1107144 - RNA, 20 nt, Human
uggaaauaggauagggaagg

SEQ ID NO: 1107145 - RNA, 22 nt, Human
uguccuccucucucuggguuuc

SEQ ID NO: 1107146 - RNA, 21 nt, Human
uuccacccucugagucuccau

SEQ ID NO: 1107147 - RNA, 21 nt, Human
uuccugagucccucccaaguc

SEQ ID NO: 1107148 - RNA, 23 nt, Human
uucuaugagucuccauccuccug

SEQ ID NO: 1107149 - RNA, 20 nt, Human
uucuguuucugagucucugc

SEQ ID NO: 1107150 - RNA, 20 nt, Human
uugcugggcgucagagccuc

SEQ ID NO: 1107151 - RNA, 24 nt, Human
uugcugggcgucagagccucgggc

SEQ ID NO: 1107152 - RNA, 20 nt, Human
uuucaggauggaaauaggau

SEQ ID NO: 1107153 - RNA, 22 nt, Human
uuuccauccucuuugagucucc

SEQ ID NO: 1107154 - RNA, 20 nt, Human
ccagaacauuuauugcauga

SEQ ID NO: 1107155 - RNA, 20 nt, Human
uggcuucugcggccaagacc

SEQ ID NO: 1107156 - RNA, 19 nt, Human
uuaaaaccagaacauuuau

SEQ ID NO: 1107157 - RNA, 23 nt, Human
aaaacaccaaaacacuuuaagca

SEQ ID NO: 1107158 - RNA, 22 nt, Human
aaaacacuuuaagcaaaaacuc

SEQ ID NO: 1107159 - RNA, 23 nt, Human
aaacaccaaaacacuuuaagcaa

SEQ ID NO: 1107160 - RNA, 22 nt, Human
aacugcagaaaaacaaaguuuc

SEQ ID NO: 1107161 - RNA, 24 nt, Human
acaccaacauuuccucuauaaucu

SEQ ID NO: 1107162 - RNA, 25 nt, Human
accacaaaguagauuuacaaauaac

SEQ ID NO: 1107163 - RNA, 24 nt, Human
caacugcagaaaaacaaaguuucu

SEQ ID NO: 1107164 - RNA, 21 nt, Human
cagaaaaacaaaguuucuuug

SEQ ID NO: 1107165 - RNA, 21 nt, Human
cccgcgugcccggagagccag

SEQ ID NO: 1107166 - RNA, 19 nt, Human
cuccauaacauccagaagg

SEQ ID NO: 1107167 - RNA, 19 nt, Human
cuccugauccccuuuuggu

SEQ ID NO: 1107168 - RNA, 18 nt, Human
cugacuuccuuucuuucc

SEQ ID NO: 1107169 - RNA, 19 nt, Human
cugcaugccgcccuccucc

SEQ ID NO: 1107170 - RNA, 23 nt, Human
cuggauuaaaaaauccguucaca

SEQ ID NO: 1107171 - RNA, 21 nt, Human
cuuccgaguugcuuccuugca

SEQ ID NO: 1107172 - RNA, 22 nt, Human
ggcugggcccgcuggcugggug

SEQ ID NO: 1107173 - RNA, 22 nt, Human
ggugccgggucuacaggaaaaa

SEQ ID NO: 1107174 - RNA, 25 nt, Human
guugcugaagggguaucauuucuug

SEQ ID NO: 1107175 - RNA, 23 nt, Human
guuuucacaagagccuucuccau

SEQ ID NO: 1107176 - RNA, 25 nt, Human
uaaaacaccaaaacacuuuaagcaa

SEQ ID NO: 1107177 - RNA, 23 nt, Human
uaagaagacacuguuuacaucag

SEQ ID NO: 1107178 - RNA, 19 nt, Human
uccgcgcagucgggugccg

SEQ ID NO: 1107179 - RNA, 18 nt, Human
ucgggugccgggucuaca

SEQ ID NO: 1107180 - RNA, 19 nt, Human
ucuuugugauccaaacaca

SEQ ID NO: 1107181 - RNA, 18 nt, Human
ugaaagugaaucgagugg

SEQ ID NO: 1107182 - RNA, 19 nt, Human
ugaaagugaaucgaguggc

SEQ ID NO: 1107183 - RNA, 22 nt, Human
ugacuuccuuucuuuccucuuc

SEQ ID NO: 1107184 - RNA, 21 nt, Human
ugcaaaaauuaaagaguacaa

SEQ ID NO: 1107185 - RNA, 19 nt, Human
ugcccggagagccaggcaa

SEQ ID NO: 1107186 - RNA, 20 nt, Human
ugcccggagagccaggcaac

SEQ ID NO: 1107187 - RNA, 19 nt, Human
uggcugggugaaacggcgg

SEQ ID NO: 1107188 - RNA, 25 nt, Human
uguaaaacaccaaaacacuuuaagc

SEQ ID NO: 1107189 - RNA, 22 nt, Human
uguacagaucguagcccgcgug

SEQ ID NO: 1107190 - RNA, 21 nt, Human
uucaucugugauaccagcucc

SEQ ID NO: 1107191 - RNA, 23 nt, Human
uuuaaaugaucucuucuuugauc

SEQ ID NO: 1107192 - RNA, 25 nt, Human
uuuucuguucuuggcauaaauuuua

SEQ ID NO: 1107193 - RNA, 24 nt, Human
aaacaggcugggaaaacuggcuca

SEQ ID NO: 1107194 - RNA, 24 nt, Human
aaacuggcucacaucucuuggcca

SEQ ID NO: 1107195 - RNA, 24 nt, Human
aaguuuuuguauuuuuaguagaga

SEQ ID NO: 1107196 - RNA, 22 nt, Human
aauaauaauaaacaggcuggga

SEQ ID NO: 1107197 - RNA, 24 nt, Human
aaucgcuugaacccaggaggcgga

SEQ ID NO: 1107198 - RNA, 24 nt, Human
aaugugcugggauuacaggcguga

SEQ ID NO: 1107199 - RNA, 25 nt, Human
acacucaucacacuugugacauuuc

SEQ ID NO: 1107200 - RNA, 23 nt, Human
acaggugcccaccaccaugcccg

SEQ ID NO: 1107201 - RNA, 24 nt, Human
accauugcacucuagccugggcag

SEQ ID NO: 1107202 - RNA, 18 nt, Human
acgagguuucaccguguu

SEQ ID NO: 1107203 - RNA, 20 nt, Human
acgagguuucaccguguuag

SEQ ID NO: 1107204 - RNA, 24 nt, Human
acucugucgcccagccuggagugc

SEQ ID NO: 1107205 - RNA, 18 nt, Human
acugaagacuuugugaca

SEQ ID NO: 1107206 - RNA, 18 nt, Human
aggaguauguguuucagg

SEQ ID NO: 1107207 - RNA, 23 nt, Human
aggcagaggaaucgcuugaaccc

SEQ ID NO: 1107208 - RNA, 24 nt, Human
aggcggagguugcugugagucaag

SEQ ID NO: 1107209 - RNA, 18 nt, Human
agugaccucggacugaag

SEQ ID NO: 1107210 - RNA, 20 nt, Human
agugcaguggcacgaucucg

SEQ ID NO: 1107211 - RNA, 23 nt, Human
agugcaguggcacgaucucggcu

SEQ ID NO: 1107212 - RNA, 24 nt, Human
agugcaguggcacgaucucggcuc

SEQ ID NO: 1107213 - RNA, 18 nt, Human
auaggaugaagcuugacu

SEQ ID NO: 1107214 - RNA, 19 nt, Human
aucugccugccuuggccuc

SEQ ID NO: 1107215 - RNA, 24 nt, Human
auugcacucuagccugggcagcaa

SEQ ID NO: 1107216 - RNA, 25 nt, Human
auugcacucuagccugggcagcaag

SEQ ID NO: 1107217 - RNA, 30 nt, Human
auuguccagccucagcccccugaguagcuu

SEQ ID NO: 1107218 - RNA, 24 nt, Human
caaugugcugggauuacaggcgug

SEQ ID NO: 1107219 - RNA, 24 nt, Human
caccauugcacucuagccugggca

SEQ ID NO: 1107220 - RNA, 24 nt, Human
caccguguuagccaggacggucuc

SEQ ID NO: 1107221 - RNA, 21 nt, Human
cacuaaaggcuuugccacacu

SEQ ID NO: 1107222 - RNA, 18 nt, Human
cacucugucgcccagccu

SEQ ID NO: 1107223 - RNA, 24 nt, Human
cacucugucgcccagccuggagug

SEQ ID NO: 1107224 - RNA, 18 nt, Human
cagccucagcccccugag

SEQ ID NO: 1107225 - RNA, 25 nt, Human
cagccucagcccccugaguagcuga

SEQ ID NO: 1107226 - RNA, 19 nt, Human
caggugcccaccaccaugc

SEQ ID NO: 1107227 - RNA, 21 nt, Human
caggugcccaccaccaugccc

SEQ ID NO: 1107228 - RNA, 23 nt, Human
caucucaaaaaauaauaauaaac

SEQ ID NO: 1107229 - RNA, 20 nt, Human
cauuauggauucuccaauga

SEQ ID NO: 1107230 - RNA, 18 nt, Human
cauugcacucuagccugg

SEQ ID NO: 1107231 - RNA, 19 nt, Human
cauugcacucuagccuggg

SEQ ID NO: 1107232 - RNA, 23 nt, Human
cauugcacucuagccugggcagc

SEQ ID NO: 1107233 - RNA, 24 nt, Human
cauugcacucuagccugggcagca

SEQ ID NO: 1107234 - RNA, 22 nt, Human
ccaaugugcugggauuacaggc

SEQ ID NO: 1107235 - RNA, 24 nt, Human
ccaaugugcugggauuacaggcgu

SEQ ID NO: 1107236 - RNA, 21 nt, Human
ccauugcacucuagccugggc

SEQ ID NO: 1107237 - RNA, 23 nt, Human
ccauugcacucuagccugggcag

SEQ ID NO: 1107238 - RNA, 24 nt, Human
ccauugcacucuagccugggcagc

SEQ ID NO: 1107239 - RNA, 25 nt, Human
ccauugcacucuagccugggcagca

SEQ ID NO: 1107240 - RNA, 23 nt, Human
cccagccuggagugcaguggcac

SEQ ID NO: 1107241 - RNA, 22 nt, Human
ccugaguagcugagacuacagg

SEQ ID NO: 1107242 - RNA, 21 nt, Human
ccugcaagcaccgccuccugg

SEQ ID NO: 1107243 - RNA, 22 nt, Human
ccugccuuggccucccaaagug

SEQ ID NO: 1107244 - RNA, 24 nt, Human
cgagguuucaccguguuagccagg

SEQ ID NO: 1107245 - RNA, 19 nt, Human
cgccuccuggguucacacc

SEQ ID NO: 1107246 - RNA, 18 nt, Human
cggcucccugcaagcacc

SEQ ID NO: 1107247 - RNA, 23 nt, Human
cucaagugaccuaugugccuugg

SEQ ID NO: 1107248 - RNA, 24 nt, Human
cuccugacuuuguuaucugccugc

SEQ ID NO: 1107249 - RNA, 21 nt, Human
cugaagaccuugccacacuga

SEQ ID NO: 1107250 - RNA, 20 nt, Human
cugaagacuuugugacaauc

SEQ ID NO: 1107251 - RNA, 18 nt, Human
cugaguagcugagacuac

SEQ ID NO: 1107252 - RNA, 20 nt, Human
cugccugccuuggccuccca

SEQ ID NO: 1107253 - RNA, 23 nt, Human
cugccuuggccucccaaagugcu

SEQ ID NO: 1107254 - RNA, 22 nt, Human
cuggucacuaaaggcuuugcca

SEQ ID NO: 1107255 - RNA, 21 nt, Human
cuugaccucaagugaccuaug

SEQ ID NO: 1107256 - RNA, 20 nt, Human
cuugacugaagaccuugcca

SEQ ID NO: 1107257 - RNA, 19 nt, Human
cuuguaagguuucucucca

SEQ ID NO: 1107258 - RNA, 20 nt, Human
gacggucucaaucuccugac

SEQ ID NO: 1107259 - RNA, 21 nt, Human
gacuacaggugcccaccacca

SEQ ID NO: 1107260 - RNA, 19 nt, Human
gagguugcugugagucaag

SEQ ID NO: 1107261 - RNA, 19 nt, Human
gauuacaggcgugauccac

SEQ ID NO: 1107262 - RNA, 23 nt, Human
gauuacaggcgugauccacugca

SEQ ID NO: 1107263 - RNA, 19 nt, Human
gcaagagcaacacuccauc

SEQ ID NO: 1107264 - RNA, 20 nt, Human
gccucagcccccugaguagc

SEQ ID NO: 1107265 - RNA, 22 nt, Human
gccuuggccucccaaagugcug

SEQ ID NO: 1107266 - RNA, 24 nt, Human
ggagguugcugugagucaagaucg

SEQ ID NO: 1107267 - RNA, 19 nt, Human
gggcagcaagagcaacacu

SEQ ID NO: 1107268 - RNA, 19 nt, Human
guagcugagacuacaggug

SEQ ID NO: 1107269 - RNA, 24 nt, Human
gugcugaggcagaggaaucgcuug

SEQ ID NO: 1107270 - RNA, 21 nt, Human
gugcugggauuacaggcguga

SEQ ID NO: 1107271 - RNA, 24 nt, Human
guuuuuguauuuuuaguagagacg

SEQ ID NO: 1107272 - RNA, 24 nt, Human
uaagucaacacaaacucaagucaa

SEQ ID NO: 1107273 - RNA, 24 nt, Human
uaaguuuuuguauuuuuaguagag

SEQ ID NO: 1107274 - RNA, 26 nt, Human
uagcguuacugaagacuuugugacaa

SEQ ID NO: 1107275 - RNA, 21 nt, Human
uaguagagacgagguuucacc

SEQ ID NO: 1107276 - RNA, 24 nt, Human
uaguagagacgagguuucaccgug

SEQ ID NO: 1107277 - RNA, 26 nt, Human
uaguagagacgagguuucaccguguu

SEQ ID NO: 1107278 - RNA, 24 nt, Human
ucaccguguuagccaggacggucu

SEQ ID NO: 1107279 - RNA, 18 nt, Human
ucagcccccugaguagcu

SEQ ID NO: 1107280 - RNA, 24 nt, Human
ucccaaugugcugggauuacaggc

SEQ ID NO: 1107281 - RNA, 24 nt, Human
ucccugcaagcaccgccuccuggg

SEQ ID NO: 1107282 - RNA, 24 nt, Human
ucgcccagccuggagugcaguggc

SEQ ID NO: 1107283 - RNA, 24 nt, Human
ucgcuugaacccaggaggcggagg

SEQ ID NO: 1107284 - RNA, 19 nt, Human
ucggaagaucucucuucau

SEQ ID NO: 1107285 - RNA, 24 nt, Human
ucucacucugucgcccagccugga

SEQ ID NO: 1107286 - RNA, 19 nt, Human
ucugauguucugcaaggag

SEQ ID NO: 1107287 - RNA, 20 nt, Human
ucugauguucugcaaggagu

SEQ ID NO: 1107288 - RNA, 24 nt, Human
ucugucgcccagccuggagugcag

SEQ ID NO: 1107289 - RNA, 20 nt, Human
ugacuggucacuaaaggcuu

SEQ ID NO: 1107290 - RNA, 21 nt, Human
ugagacuacaggugcccacca

SEQ ID NO: 1107291 - RNA, 24 nt, Human
ugagacuacaggugcccaccacca

SEQ ID NO: 1107292 - RNA, 24 nt, Human
ugaggcagaggaaucgcuugaacc

SEQ ID NO: 1107293 - RNA, 25 nt, Human
ugaggcagaggaaucgcuugaaccc

SEQ ID NO: 1107294 - RNA, 23 nt, Human
ugagucaagaucgcaccauugca

SEQ ID NO: 1107295 - RNA, 25 nt, Human
ugcacucuagccugggcagcaagag

SEQ ID NO: 1107296 - RNA, 25 nt, Human
ugcccggcuaaguuuuuguauuuuu

SEQ ID NO: 1107297 - RNA, 22 nt, Human
ugccuuggccucccaaugugcu

SEQ ID NO: 1107298 - RNA, 24 nt, Human
ugcugggauuacaggcgugaucca

SEQ ID NO: 1107299 - RNA, 23 nt, Human
uggagugcaguggcacgaucucg

SEQ ID NO: 1107300 - RNA, 24 nt, Human
uggagugcaguggcacgaucucgg

SEQ ID NO: 1107301 - RNA, 18 nt, Human
ugggauuacaggcgugau

SEQ ID NO: 1107302 - RNA, 21 nt, Human
ugggauuacaggcgugaucca

SEQ ID NO: 1107303 - RNA, 22 nt, Human
ugggauuacaggcgugauccac

SEQ ID NO: 1107304 - RNA, 22 nt, Human
ugggauuacaggcgugauccac

SEQ ID NO: 1107305 - RNA, 24 nt, Human
ugggauuacaggcgugauccacug

SEQ ID NO: 1107306 - RNA, 26 nt, Human
uguccagccucagcccccugaguagc

SEQ ID NO: 1107307 - RNA, 19 nt, Human
uguuucaaacucuugaccu

SEQ ID NO: 1107308 - RNA, 21 nt, Human
uguuucaaacucuugaccuca

SEQ ID NO: 1107309 - RNA, 23 nt, Human
uuacacuuguaagguuucucucc

SEQ ID NO: 1107310 - RNA, 21 nt, Human
uuacugaagacuuugugacaa

SEQ ID NO: 1107311 - RNA, 22 nt, Human
uuaguagagacgagguuucacc

SEQ ID NO: 1107312 - RNA, 24 nt, Human
uuaguagagacgagguuucaccgu

SEQ ID NO: 1107313 - RNA, 24 nt, Human
uugaacccaggaggcggagguugc

SEQ ID NO: 1107314 - RNA, 18 nt, Human
uuggccucccaaagugcu

SEQ ID NO: 1107315 - RNA, 22 nt, Human
uuucaccguguuagccaggacg

SEQ ID NO: 1107316 - RNA, 19 nt, Human
uuuguaagauuucucucca

SEQ ID NO: 1107317 - RNA, 19 nt, Human
uuuguaagguuucucucca

SEQ ID NO: 1107318 - RNA, 19 nt, Human
uuuguaagguuucucucca

SEQ ID NO: 1107319 - RNA, 24 nt, Human
uuuuuaguagagacgagguuucac

SEQ ID NO: 1107320 - RNA, 21 nt, Human
uuuuuguauuuuuaguagaga

SEQ ID NO: 1107321 - RNA, 23 nt, Human
aaagguggagugagauccaggca

SEQ ID NO: 1107322 - RNA, 24 nt, Human
aaaguguugggauuacaggcguga

SEQ ID NO: 1107323 - RNA, 24 nt, Human
aagaguuggagacccugaaaagcu

SEQ ID NO: 1107324 - RNA, 20 nt, Human
aaggccagguguagccagug

SEQ ID NO: 1107325 - RNA, 22 nt, Human
aaguagcugggauuacaggcau

SEQ ID NO: 1107326 - RNA, 24 nt, Human
aaguagcugggauuacaggcaugc

SEQ ID NO: 1107327 - RNA, 21 nt, Human
aaguguugggauuacaggcgu

SEQ ID NO: 1107328 - RNA, 26 nt, Human
aaguguugggauuacaggcgugagcc

SEQ ID NO: 1107329 - RNA, 24 nt, Human
aauuuuguauuuuuaguagagacg

SEQ ID NO: 1107330 - RNA, 19 nt, Human
acaaccucugccucccggg

SEQ ID NO: 1107331 - RNA, 19 nt, Human
acagaggaaugcagccaca

SEQ ID NO: 1107332 - RNA, 18 nt, Human
accuugguaaccucuggc

SEQ ID NO: 1107333 - RNA, 18 nt, Human
acgggguuucuccauguu

SEQ ID NO: 1107334 - RNA, 20 nt, Human
acgggguuucuccauguugg

SEQ ID NO: 1107335 - RNA, 24 nt, Human
acgggguuucuccauguuggucag

SEQ ID NO: 1107336 - RNA, 21 nt, Human
agagaaguauacaugcuucuu

SEQ ID NO: 1107337 - RNA, 22 nt, Human
agccacaaggccagguguagcc

SEQ ID NO: 1107338 - RNA, 24 nt, Human
agcgauucuccugccucagccucc

SEQ ID NO: 1107339 - RNA, 23 nt, Human
aggaaugcagccacaaggccagg

SEQ ID NO: 1107340 - RNA, 24 nt, Human
aggugaucugccugccucagccuc

SEQ ID NO: 1107341 - RNA, 21 nt, Human
aguaagcauguguugggaacu

SEQ ID NO: 1107342 - RNA, 24 nt, Human
aguguccuucagggcauggacaac

SEQ ID NO: 1107343 - RNA, 30 nt, Human
aucccuccucagagguguucuuccugucag

SEQ ID NO: 1107344 - RNA, 20 nt, Human
augcagccacaaggccaggu

SEQ ID NO: 1107345 - RNA, 18 nt, Human
augcgccaccacgcccag

SEQ ID NO: 1107346 - RNA, 23 nt, Human
auucaugaaggggucaugcaggg

SEQ ID NO: 1107347 - RNA, 24 nt, Human
caaaguguugggauuacaggcgug

SEQ ID NO: 1107348 - RNA, 20 nt, Human
caacacaaccucugccuccc

SEQ ID NO: 1107349 - RNA, 22 nt, Human
caagcgauucuccugccucagc

SEQ ID NO: 1107350 - RNA, 27 nt, Human
caagcgauucuccugccucagccuccc

SEQ ID NO: 1107351 - RNA, 20 nt, Human
cacaaccucugccucccggg

SEQ ID NO: 1107352 - RNA, 23 nt, Human
cacaaccucugccucccggguuc

SEQ ID NO: 1107353 - RNA, 22 nt, Human
caggugaucugccugccucagc

SEQ ID NO: 1107354 - RNA, 21 nt, Human
caugcgccaccacgcccagcu

SEQ ID NO: 1107355 - RNA, 22 nt, Human
ccaaaguguugggauuacaggc

SEQ ID NO: 1107356 - RNA, 22 nt, Human
ccaaaguguugggauuacaggc

SEQ ID NO: 1107357 - RNA, 24 nt, Human
ccaaaguguugggauuacaggcgu

SEQ ID NO: 1107358 - RNA, 23 nt, Human
ccaaguagcugggauuacaggca

SEQ ID NO: 1107359 - RNA, 24 nt, Human
ccaaguagcugggauuacaggcau

SEQ ID NO: 1107360 - RNA, 20 nt, Human
ccaccacgcccagcuaauuu

SEQ ID NO: 1107361 - RNA, 19 nt, Human
ccauguuggucaggcuggu

SEQ ID NO: 1107362 - RNA, 22 nt, Human
ccauguuggucaggcuggucuc

SEQ ID NO: 1107363 - RNA, 23 nt, Human
ccauguuggucaggcuggucucg

SEQ ID NO: 1107364 - RNA, 23 nt, Human
cccaaguagcugggauuacaggc

SEQ ID NO: 1107365 - RNA, 24 nt, Human
cccaaguagcugggauuacaggca

SEQ ID NO: 1107366 - RNA, 21 nt, Human
cccgaccucaggugaucugcc

SEQ ID NO: 1107367 - RNA, 23 nt, Human
cccgaccucaggugaucugccug

SEQ ID NO: 1107368 - RNA, 20 nt, Human
cccggguucaagcgauucuc

SEQ ID NO: 1107369 - RNA, 23 nt, Human
cccggguucaagcgauucuccug

SEQ ID NO: 1107370 - RNA, 24 nt, Human
ccucccggguucaagcgauucucc

SEQ ID NO: 1107371 - RNA, 20 nt, Human
ccucucguugcccaggcugg

SEQ ID NO: 1107372 - RNA, 21 nt, Human
ccucucguugcccaggcugga

SEQ ID NO: 1107373 - RNA, 23 nt, Human
ccucucguugcccaggcuggagu

SEQ ID NO: 1107374 - RNA, 24 nt, Human
ccucucguugcccaggcuggagug

SEQ ID NO: 1107375 - RNA, 18 nt, Human
ccugaaaagcuuugggca

SEQ ID NO: 1107376 - RNA, 24 nt, Human
ccugccucagccucccaaaguguu

SEQ ID NO: 1107377 - RNA, 18 nt, Human
cgaccucaggugaucugc

SEQ ID NO: 1107378 - RNA, 20 nt, Human
cgaccucaggugaucugccu

SEQ ID NO: 1107379 - RNA, 24 nt, Human
cgaccucaggugaucugccugccu

SEQ ID NO: 1107380 - RNA, 22 nt, Human
cgcucccgaccucaggugaucu

SEQ ID NO: 1107381 - RNA, 22 nt, Human
cguugcccaggcuggaguggaa

SEQ ID NO: 1107382 - RNA, 24 nt, Human
cucaacacaaccucugccucccgg

SEQ ID NO: 1107383 - RNA, 24 nt, Human
cucagccucccaaguagcugggau

SEQ ID NO: 1107384 - RNA, 23 nt, Human
cucaggugaucugccugccucag

SEQ ID NO: 1107385 - RNA, 26 nt, Human
cucccgaccucaggugaucugccugc

SEQ ID NO: 1107386 - RNA, 18 nt, Human
cucucguugcccaggcug

SEQ ID NO: 1107387 - RNA, 19 nt, Human
cucucguugcccaggcugg

SEQ ID NO: 1107388 - RNA, 20 nt, Human
cucucguugcccaggcugga

SEQ ID NO: 1107389 - RNA, 22 nt, Human
cucucuugcucucugucaggga

SEQ ID NO: 1107390 - RNA, 24 nt, Human
cugccucagccucccaaaguguug

SEQ ID NO: 1107391 - RNA, 23 nt, Human
cugccucagccucccaaguagcu

SEQ ID NO: 1107392 - RNA, 23 nt, Human
gaccucaggugaucugccugccu

SEQ ID NO: 1107393 - RNA, 24 nt, Human
gaccucaggugaucugccugccuc

SEQ ID NO: 1107394 - RNA, 23 nt, Human
gagacgggguuucuccauguugg

SEQ ID NO: 1107395 - RNA, 24 nt, Human
gagacgggguuucuccauguuggu

SEQ ID NO: 1107396 - RNA, 18 nt, Human
gauuacaggcaugcgcca

SEQ ID NO: 1107397 - RNA, 18 nt, Human
gauuacaggcgugagcca

SEQ ID NO: 1107398 - RNA, 21 nt, Human
gauuacaggcgugagccacca

SEQ ID NO: 1107399 - RNA, 22 nt, Human
gauuacaggcgugagccaccac

SEQ ID NO: 1107400 - RNA, 19 nt, Human
gcccaggcuggaguggaau

SEQ ID NO: 1107401 - RNA, 20 nt, Human
gccucagccucccaaguagc

SEQ ID NO: 1107402 - RNA, 24 nt, Human
gcgauucuccugccucagccuccc

SEQ ID NO: 1107403 - RNA, 23 nt, Human
gcuggucucgcgcucccgaccuc

SEQ ID NO: 1107404 - RNA, 22 nt, Human
ggaacagaggaaugcagccaca

SEQ ID NO: 1107405 - RNA, 22 nt, Human
ggacuggggaaucccuccucag

SEQ ID NO: 1107406 - RNA, 19 nt, Human
ggauuacaggcaugcgcca

SEQ ID NO: 1107407 - RNA, 19 nt, Human
ggauuacaggcgugagcca

SEQ ID NO: 1107408 - RNA, 22 nt, Human
gggaaucccuccucagaggugu

SEQ ID NO: 1107409 - RNA, 19 nt, Human
gggcauggacaacagguuu

SEQ ID NO: 1107410 - RNA, 23 nt, Human
gggguuucuccauguuggucagg

SEQ ID NO: 1107411 - RNA, 22 nt, Human
ggguuucuccauguuggucagg

SEQ ID NO: 1107412 - RNA, 24 nt, Human
ggugaucugccugccucagccucc

SEQ ID NO: 1107413 - RNA, 23 nt, Human
guagagacgggguuucuccaugu

SEQ ID NO: 1107414 - RNA, 18 nt, Human
guagcugggauuacaggc

SEQ ID NO: 1107415 - RNA, 18 nt, Human
gugaucugccugccucag

SEQ ID NO: 1107416 - RNA, 24 nt, Human
gugaucugccugccucagccuccc

SEQ ID NO: 1107417 - RNA, 26 nt, Human
guggagugagauccaggcaggggacu

SEQ ID NO: 1107418 - RNA, 23 nt, Human
guugcagaaucuuuggacgaggu

SEQ ID NO: 1107419 - RNA, 19 nt, Human
uaaaaaauaaaaucuccac

SEQ ID NO: 1107420 - RNA, 25 nt, Human
uaaaaaauaaaaucuccacacaggu

SEQ ID NO: 1107421 - RNA, 24 nt, Human
uaaagauuccuuucccaggggcuu

SEQ ID NO: 1107422 - RNA, 21 nt, Human
uaacaguauucccccucaaga

SEQ ID NO: 1107423 - RNA, 24 nt, Human
uacaggcaugcgccaccacgccca

SEQ ID NO: 1107424 - RNA, 22 nt, Human
uacaggcgugagccaccacacc

SEQ ID NO: 1107425 - RNA, 23 nt, Human
uacaggcgugagccaccacaccu

SEQ ID NO: 1107426 - RNA, 22 nt, Human
uaggugcugggaccuccaagga

SEQ ID NO: 1107427 - RNA, 24 nt, Human
uaguagagacgggguuucuccaug

SEQ ID NO: 1107428 - RNA, 23 nt, Human
uauucccccucaagaguuggaga

SEQ ID NO: 1107429 - RNA, 24 nt, Human
ucaacacaaccucugccucccggg

SEQ ID NO: 1107430 - RNA, 19 nt, Human
ucaagaguuggagacccug

SEQ ID NO: 1107431 - RNA, 24 nt, Human
ucaagaguuggagacccugaaaag

SEQ ID NO: 1107432 - RNA, 22 nt, Human
ucacaguguccuucagggcaug

SEQ ID NO: 1107433 - RNA, 20 nt, Human
ucagccucccaaguagcugg

SEQ ID NO: 1107434 - RNA, 25 nt, Human
ucagggucucccucucuugcucucu

SEQ ID NO: 1107435 - RNA, 22 nt, Human
ucaggugaucugccugccucag

SEQ ID NO: 1107436 - RNA, 18 nt, Human
uccaggcaggggacuugg

SEQ ID NO: 1107437 - RNA, 24 nt, Human
ucccaaaguguugggauuacaggc

SEQ ID NO: 1107438 - RNA, 24 nt, Human
ucccaaguagcugggauuacaggc

SEQ ID NO: 1107439 - RNA, 23 nt, Human
ucccaggggcuuccuugccugcu

SEQ ID NO: 1107440 - RNA, 24 nt, Human
uccccucucguugcccaggcugga

SEQ ID NO: 1107441 - RNA, 21 nt, Human
ucccggguucaagcgauucuc

SEQ ID NO: 1107442 - RNA, 24 nt, Human
ucccggguucaagcgauucuccug

SEQ ID NO: 1107443 - RNA, 24 nt, Human
ucccuucuggaacagaggaaugca

SEQ ID NO: 1107444 - RNA, 23 nt, Human
ucucccucucuugcucucuguca

SEQ ID NO: 1107445 - RNA, 26 nt, Human
ucuccugccucagccucccaaguagc

SEQ ID NO: 1107446 - RNA, 19 nt, Human
ucugucagggaaggagccc

SEQ ID NO: 1107447 - RNA, 24 nt, Human
ucuuugcccacuggcauccaaggg

SEQ ID NO: 1107448 - RNA, 23 nt, Human
ugaaagguggagugagauccagg

SEQ ID NO: 1107449 - RNA, 25 nt, Human
ugcagccacaaggccagguguagcc

SEQ ID NO: 1107450 - RNA, 19 nt, Human
ugcccaggcuggaguggaa

SEQ ID NO: 1107451 - RNA, 21 nt, Human
ugcccaggcuggaguggaaug

SEQ ID NO: 1107452 - RNA, 24 nt, Human
ugcccaggcuggaguggaauggca

SEQ ID NO: 1107453 - RNA, 24 nt, Human
ugccucagccucccaaaguguugg

SEQ ID NO: 1107454 - RNA, 24 nt, Human
ugccucagccucccaaguagcugg

SEQ ID NO: 1107455 - RNA, 24 nt, Human
uggaagagacauauuuaauuagug

SEQ ID NO: 1107456 - RNA, 19 nt, Human
uggaguggaauggcacgau

SEQ ID NO: 1107457 - RNA, 24 nt, Human
uggaguggaauggcacgaucuugg

SEQ ID NO: 1107458 - RNA, 19 nt, Human
uggcugggccuugauaagu

SEQ ID NO: 1107459 - RNA, 20 nt, Human
ugggacgaagaagucaucag

SEQ ID NO: 1107460 - RNA, 18 nt, Human
ugggauuacaggcaugcg

SEQ ID NO: 1107461 - RNA, 21 nt, Human
ugggauuacaggcaugcgcca

SEQ ID NO: 1107462 - RNA, 22 nt, Human
ugggauuacaggcaugcgccac

SEQ ID NO: 1107463 - RNA, 24 nt, Human
ugggauuacaggcaugcgccacca

SEQ ID NO: 1107464 - RNA, 18 nt, Human
ugggauuacaggcgugag

SEQ ID NO: 1107465 - RNA, 19 nt, Human
ugggauuacaggcgugagc

SEQ ID NO: 1107466 - RNA, 22 nt, Human
ugggauuacaggcgugagccac

SEQ ID NO: 1107467 - RNA, 23 nt, Human
ugggauuacaggcgugagccacc

SEQ ID NO: 1107468 - RNA, 24 nt, Human
ugggauuacaggcgugagccacca

SEQ ID NO: 1107469 - RNA, 21 nt, Human
uggucaggcuggucucgcgcu

SEQ ID NO: 1107470 - RNA, 19 nt, Human
uggucucgcgcucccgacc

SEQ ID NO: 1107471 - RNA, 27 nt, Human
ugguuaaaaaauaaaaucuccacacag

SEQ ID NO: 1107472 - RNA, 21 nt, Human
uguauuuuuaguagagacggg

SEQ ID NO: 1107473 - RNA, 18 nt, Human
ugucacaguguccuucag

SEQ ID NO: 1107474 - RNA, 20 nt, Human
ugucacaguguccuucaggg

SEQ ID NO: 1107475 - RNA, 18 nt, Human
uuaguagagacgggguuu

SEQ ID NO: 1107476 - RNA, 24 nt, Human
uuaguagagacgggguuucuccau

SEQ ID NO: 1107477 - RNA, 21 nt, Human
uucaagcgauucuccugccuc

SEQ ID NO: 1107478 - RNA, 23 nt, Human
uucaagcgauucuccugccucag

SEQ ID NO: 1107479 - RNA, 24 nt, Human
uucaagcgauucuccugccucagc

SEQ ID NO: 1107480 - RNA, 25 nt, Human
uucuaaagauuccuuucccaggggc

SEQ ID NO: 1107481 - RNA, 23 nt, Human
uuguauuuuuaguagagacgggg

SEQ ID NO: 1107482 - RNA, 21 nt, Human
uuucuccauguuggucaggcu

SEQ ID NO: 1107483 - RNA, 19 nt, Human
uuuuguauuuuuaguagag

SEQ ID NO: 1107484 - RNA, 20 nt, Human
uuuuguauuuuuaguagaga

SEQ ID NO: 1107485 - RNA, 22 nt, Human
uuuuuaguagagacgggguuuc

SEQ ID NO: 1107486 - RNA, 20 nt, Human
aaaccaaggccaggagucaa

SEQ ID NO: 1107487 - RNA, 27 nt, Human
aaacugguuuugcucuuaaggccuuca

SEQ ID NO: 1107488 - RNA, 22 nt, Human
aaagaaacaggagggaccugag

SEQ ID NO: 1107489 - RNA, 23 nt, Human
aaagugcugggauuacaggugug

SEQ ID NO: 1107490 - RNA, 24 nt, Human
aaagugcugggauuacaggugugg

SEQ ID NO: 1107491 - RNA, 25 nt, Human
aaagugcugggauuacagguguggg

SEQ ID NO: 1107492 - RNA, 19 nt, Human
aaggagcacggaccucgga

SEQ ID NO: 1107493 - RNA, 19 nt, Human
aaggccaggagucaagucc

SEQ ID NO: 1107494 - RNA, 25 nt, Human
aaguaauccucccaccuuggccucc

SEQ ID NO: 1107495 - RNA, 18 nt, Human
aagugcugggauuacagg

SEQ ID NO: 1107496 - RNA, 19 nt, Human
aagugcugggauuacaggu

SEQ ID NO: 1107497 - RNA, 18 nt, Human
accacagcauccccccag

SEQ ID NO: 1107498 - RNA, 21 nt, Human
acccuguccccuccacuucca

SEQ ID NO: 1107499 - RNA, 21 nt, Human
accuccgucucuugaguagcu

SEQ ID NO: 1107500 - RNA, 21 nt, Human
acucaggccggaguuggcacu

SEQ ID NO: 1107501 - RNA, 21 nt, Human
acugaggaacuggugggugga

SEQ ID NO: 1107502 - RNA, 19 nt, Human
acugcaguccagcuucugg

SEQ ID NO: 1107503 - RNA, 24 nt, Human
acugguuuugcucuuaaggccuuc

SEQ ID NO: 1107504 - RNA, 19 nt, Human
agagaaaagaaacaggagg

SEQ ID NO: 1107505 - RNA, 25 nt, Human
agcacauaaccccaaauagugccuu

SEQ ID NO: 1107506 - RNA, 24 nt, Human
aggaagcuuaccuugccucacuga

SEQ ID NO: 1107507 - RNA, 21 nt, Human
aggagcacggaccucggagcc

SEQ ID NO: 1107508 - RNA, 23 nt, Human
aggagcacggaccucggagccca

SEQ ID NO: 1107509 - RNA, 21 nt, Human
aggcuggucucaaacuccugg

SEQ ID NO: 1107510 - RNA, 19 nt, Human
aggcuugggucaggccugg

SEQ ID NO: 1107511 - RNA, 22 nt, Human
aggucuugcuauguugccuagg

SEQ ID NO: 1107512 - RNA, 26 nt, Human
aguggugccguggacugcaguccagc

SEQ ID NO: 1107513 - RNA, 18 nt, Human
auaccucacugcaaccuc

SEQ ID NO: 1107514 - RNA, 24 nt, Human
caaagugcugggauuacaggugug

SEQ ID NO: 1107515 - RNA, 27 nt, Human
caaguaauccucccaccuuggccuccc

SEQ ID NO: 1107516 - RNA, 27 nt, Human
caaguaauccucccaccuuggccuccc

SEQ ID NO: 1107517 - RNA, 19 nt, Human
caauguggccauuauucca

SEQ ID NO: 1107518 - RNA, 19 nt, Human
cacacccuguccccuccac

SEQ ID NO: 1107519 - RNA, 22 nt, Human
cacacgccaccacaccuggcua

SEQ ID NO: 1107520 - RNA, 22 nt, Human
cacaggcacacgccaccacacc

SEQ ID NO: 1107521 - RNA, 23 nt, Human
caccuccgucucuugaguagcug

SEQ ID NO: 1107522 - RNA, 24 nt, Human
cagagaaaagaaacaggagggacc

SEQ ID NO: 1107523 - RNA, 23 nt, Human
caggaaaccaaggccaggaguca

SEQ ID NO: 1107524 - RNA, 19 nt, Human
cagggacacagggcccagu

SEQ ID NO: 1107525 - RNA, 19 nt, Human
cauguugugugcccucagg

SEQ ID NO: 1107526 - RNA, 21 nt, Human
ccaaagugcugggauuacagg

SEQ ID NO: 1107527 - RNA, 21 nt, Human
ccaaagugcugggauuacagg

SEQ ID NO: 1107528 - RNA, 24 nt, Human
ccaaagugcugggauuacaggugu

SEQ ID NO: 1107529 - RNA, 22 nt, Human
ccacaccuggcuaauuuuucua

SEQ ID NO: 1107530 - RNA, 23 nt, Human
ccagaggagccucaaugcccucc

SEQ ID NO: 1107531 - RNA, 20 nt, Human
ccagcacccaugaccucuac

SEQ ID NO: 1107532 - RNA, 23 nt, Human
ccagguggaccccagcucacacc

SEQ ID NO: 1107533 - RNA, 25 nt, Human
ccaucucugcuucacacacugggga

SEQ ID NO: 1107534 - RNA, 22 nt, Human
cccagcacccaugaccucuacc

SEQ ID NO: 1107535 - RNA, 24 nt, Human
cccagcacccaugaccucuaccuc

SEQ ID NO: 1107536 - RNA, 22 nt, Human
cccagcucacacccuguccccu

SEQ ID NO: 1107537 - RNA, 23 nt, Human
cccaggcuggagugcaauggcau

SEQ ID NO: 1107538 - RNA, 18 nt, Human
cccuugucacccaggcug

SEQ ID NO: 1107539 - RNA, 23 nt, Human
cccuugucacccaggcuggagug

SEQ ID NO: 1107540 - RNA, 24 nt, Human
ccucacugcaaccucuaauuccug

SEQ ID NO: 1107541 - RNA, 26 nt, Human
ccucccaccuuggccucccaaagugc

SEQ ID NO: 1107542 - RNA, 20 nt, Human
ccuggucucaaguaauccuc

SEQ ID NO: 1107543 - RNA, 21 nt, Human
cgaaggccagcacauaacccc

SEQ ID NO: 1107544 - RNA, 19 nt, Human
cuauacgacaugcacauga

SEQ ID NO: 1107545 - RNA, 24 nt, Human
cucaaguaauccucccaccuuggc

SEQ ID NO: 1107546 - RNA, 21 nt, Human
cucacacccuguccccuccac

SEQ ID NO: 1107547 - RNA, 24 nt, Human
cucacugcaaccucuaauuccugg

SEQ ID NO: 1107548 - RNA, 24 nt, Human
cucuugaguagcugggaccacagg

SEQ ID NO: 1107549 - RNA, 23 nt, Human
cugcaaccucuaauuccuggacu

SEQ ID NO: 1107550 - RNA, 23 nt, Human
cugcgagccuguuuccccaucug

SEQ ID NO: 1107551 - RNA, 18 nt, Human
cuggaugggagaggggga

SEQ ID NO: 1107552 - RNA, 19 nt, Human
cugggauuacagguguggg

SEQ ID NO: 1107553 - RNA, 23 nt, Human
cuggggacacagggacacaggga

SEQ ID NO: 1107554 - RNA, 24 nt, Human
cuucccuugucacccaggcuggag

SEQ ID NO: 1107555 - RNA, 24 nt, Human
cuugucacccaggcuggagugcaa

SEQ ID NO: 1107556 - RNA, 19 nt, Human
gacacagggacacagggac

SEQ ID NO: 1107557 - RNA, 21 nt, Human
gacaugcacaugaaucccuac

SEQ ID NO: 1107558 - RNA, 21 nt, Human
gaccucuaccucaaggccagg

SEQ ID NO: 1107559 - RNA, 20 nt, Human
gagcacggaccucggagccc

SEQ ID NO: 1107560 - RNA, 24 nt, Human
gaguagcugggaccacaggcacac

SEQ ID NO: 1107561 - RNA, 22 nt, Human
gaguccaggaaaccaaggccag

SEQ ID NO: 1107562 - RNA, 18 nt, Human
gaucauaccucacugcaa

SEQ ID NO: 1107563 - RNA, 21 nt, Human
gauuacaggugugggucacca

SEQ ID NO: 1107564 - RNA, 24 nt, Human
gauuacaggugugggucaccaugc

SEQ ID NO: 1107565 - RNA, 25 nt, Human
gcaagucccaaauccauaagguagg

SEQ ID NO: 1107566 - RNA, 18 nt, Human
gcccucaggaagcuuacc

SEQ ID NO: 1107567 - RNA, 23 nt, Human
gccuaggcuggucucaaacuccu

SEQ ID NO: 1107568 - RNA, 24 nt, Human
gccucaaugcccuccacaucagcu

SEQ ID NO: 1107569 - RNA, 23 nt, Human
gccuuagaaggucuuccccucca

SEQ ID NO: 1107570 - RNA, 18 nt, Human
gcgggagaccagggaugu

SEQ ID NO: 1107571 - RNA, 22 nt, Human
gcucacacccuguccccuccac

SEQ ID NO: 1107572 - RNA, 19 nt, Human
gcuggagugcaauggcaug

SEQ ID NO: 1107573 - RNA, 22 nt, Human
gcuggucucaaacuccuggucu

SEQ ID NO: 1107574 - RNA, 21 nt, Human
ggaccugagagguggcccggc

SEQ ID NO: 1107575 - RNA, 20 nt, Human
ggagcuugcccaggaggcgg

SEQ ID NO: 1107576 - RNA, 19 nt, Human
ggagggaccugagaggugg

SEQ ID NO: 1107577 - RNA, 24 nt, Human
ggcuggucucaaacuccuggucuc

SEQ ID NO: 1107578 - RNA, 18 nt, Human
ggguuugaauccagcagc

SEQ ID NO: 1107579 - RNA, 23 nt, Human
ggugaugagagcgcccccucaga

SEQ ID NO: 1107580 - RNA, 20 nt, Human
gugacauccacaucuauaaa

SEQ ID NO: 1107581 - RNA, 22 nt, Human
uaaaaagcagguuccugaccug

SEQ ID NO: 1107582 - RNA, 22 nt, Human
uaaagaugaggucuugcuaugu

SEQ ID NO: 1107583 - RNA, 23 nt, Human
uaaguaccugacugaggaacugg

SEQ ID NO: 1107584 - RNA, 19 nt, Human
uaccucaaggccaggcuug

SEQ ID NO: 1107585 - RNA, 24 nt, Human
uaccucacugcaaccucuaauucc

SEQ ID NO: 1107586 - RNA, 22 nt, Human
uauacauauggcauauguauac

SEQ ID NO: 1107587 - RNA, 24 nt, Human
uauguugccuaggcuggucucaaa

SEQ ID NO: 1107588 - RNA, 18 nt, Human
uauuccagccaccucagg

SEQ ID NO: 1107589 - RNA, 24 nt, Human
ucaaguaauccucccaccuuggcc

SEQ ID NO: 1107590 - RNA, 18 nt, Human
ucacccaggcuggagugc

SEQ ID NO: 1107591 - RNA, 23 nt, Human
ucacugcaaccucuaauuccugg

SEQ ID NO: 1107592 - RNA, 31 nt, Human
ucacugcaaccucuaauuccuggacucgggg

SEQ ID NO: 1107593 - RNA, 18 nt, Human
ucagaguuggacaaguga

SEQ ID NO: 1107594 - RNA, 22 nt, Human
ucagauuccuuaucuauacgac

SEQ ID NO: 1107595 - RNA, 23 nt, Human
ucccaaagugcugggauuacagg

SEQ ID NO: 1107596 - RNA, 22 nt, Human
uccccaucuguagagugggggu

SEQ ID NO: 1107597 - RNA, 23 nt, Human
ucccuugucacccaggcuggagu

SEQ ID NO: 1107598 - RNA, 21 nt, Human
ucguuuacuuaaagucagcug

SEQ ID NO: 1107599 - RNA, 24 nt, Human
ucuucccuugucacccaggcugga

SEQ ID NO: 1107600 - RNA, 24 nt, Human
ucuugaguagcugggaccacaggc

SEQ ID NO: 1107601 - RNA, 19 nt, Human
ucuugcuauguugccuagg

SEQ ID NO: 1107602 - RNA, 23 nt, Human
ucuugcuauguugccuaggcugg

SEQ ID NO: 1107603 - RNA, 24 nt, Human
ucuugcuauguugccuaggcuggu

SEQ ID NO: 1107604 - RNA, 24 nt, Human
ugagagguggcccggcugguuccc

SEQ ID NO: 1107605 - RNA, 24 nt, Human
ugaggucuugcuauguugccuagg

SEQ ID NO: 1107606 - RNA, 18 nt, Human
ugcaaccucuaauuccug

SEQ ID NO: 1107607 - RNA, 24 nt, Human
ugcagagaaaagaaacaggaggga

SEQ ID NO: 1107608 - RNA, 24 nt, Human
ugcauacauauucucauuuauucc

SEQ ID NO: 1107609 - RNA, 20 nt, Human
ugccguggacugcaguccag

SEQ ID NO: 1107610 - RNA, 24 nt, Human
ugcuauguugccuaggcuggucuc

SEQ ID NO: 1107611 - RNA, 24 nt, Human
ugcugggauuacagguguggguca

SEQ ID NO: 1107612 - RNA, 18 nt, Human
uggaaacucaggccggag

SEQ ID NO: 1107613 - RNA, 21 nt, Human
uggagcccugaguggggagcu

SEQ ID NO: 1107614 - RNA, 21 nt, Human
uggagcccugaguggggagcu

SEQ ID NO: 1107615 - RNA, 19 nt, Human
uggagugcaauggcaugau

SEQ ID NO: 1107616 - RNA, 19 nt, Human
uggagugcaauggcaugau

SEQ ID NO: 1107617 - RNA, 21 nt, Human
uggagugcaauggcaugauca

SEQ ID NO: 1107618 - RNA, 19 nt, Human
uggcacuguaauccugagg

SEQ ID NO: 1107619 - RNA, 21 nt, Human
ugggaccacaggcacacgcca

SEQ ID NO: 1107620 - RNA, 24 nt, Human
ugggaccacaggcacacgccacca

SEQ ID NO: 1107621 - RNA, 18 nt, Human
ugggagagggggauggug

SEQ ID NO: 1107622 - RNA, 21 nt, Human
ugggagagggggaugguggug

SEQ ID NO: 1107623 - RNA, 18 nt, Human
ugggauuacagguguggg

SEQ ID NO: 1107624 - RNA, 22 nt, Human
ugggauuacaggugugggucac

SEQ ID NO: 1107625 - RNA, 23 nt, Human
ugggauuacaggugugggucacc

SEQ ID NO: 1107626 - RNA, 24 nt, Human
ugggauuacaggugugggucacca

SEQ ID NO: 1107627 - RNA, 25 nt, Human
ugggauuacaggugugggucaccau

SEQ ID NO: 1107628 - RNA, 23 nt, Human
uggggagcuugcccaggaggcgg

SEQ ID NO: 1107629 - RNA, 20 nt, Human
uggguuugaauccagcagcu

SEQ ID NO: 1107630 - RNA, 18 nt, Human
ugguaccacagcaucccc

SEQ ID NO: 1107631 - RNA, 18 nt, Human
ugguggguggaguggugc

SEQ ID NO: 1107632 - RNA, 24 nt, Human
uguaaagaugaggucuugcuaugu

SEQ ID NO: 1107633 - RNA, 24 nt, Human
uguaauccugaggcagaguuuuuu

SEQ ID NO: 1107634 - RNA, 20 nt, Human
ugucacccaggcuggagugc

SEQ ID NO: 1107635 - RNA, 19 nt, Human
ugugggucaccaugcccua

SEQ ID NO: 1107636 - RNA, 25 nt, Human
ugugggucaccaugcccuacccuau

SEQ ID NO: 1107637 - RNA, 24 nt, Human
uguguacauauuagcuaacauuug

SEQ ID NO: 1107638 - RNA, 24 nt, Human
uguuauacauauggcauauguaua

SEQ ID NO: 1107639 - RNA, 25 nt, Human
uuggcacuguaauccugaggcagag

SEQ ID NO: 1107640 - RNA, 18 nt, Human
uuggccucccaaagugcu

SEQ ID NO: 1107641 - RNA, 18 nt, Human
uugggcaggugccugaac

SEQ ID NO: 1107642 - RNA, 24 nt, Human
uuguaaagaugaggucuugcuaug

SEQ ID NO: 1107643 - RNA, 22 nt, Human
aaucaucucaaaggauguuuga

SEQ ID NO: 1107644 - RNA, 19 nt, Human
acccugucugggcucugca

SEQ ID NO: 1107645 - RNA, 19 nt, Human
aggguccucucugguucuc

SEQ ID NO: 1107646 - RNA, 26 nt, Human
cacaccaaaaauuuuuuaaaaaucau

SEQ ID NO: 1107647 - RNA, 20 nt, Human
caucuucucaaagucaggag

SEQ ID NO: 1107648 - RNA, 22 nt, Human
ccaggguccucucugguucucc

SEQ ID NO: 1107649 - RNA, 20 nt, Human
ccccaggaggagguggagcu

SEQ ID NO: 1107650 - RNA, 22 nt, Human
cgccgcacugacugcggcugcg

SEQ ID NO: 1107651 - RNA, 22 nt, Human
cuagcacaauuccuuaacauga

SEQ ID NO: 1107652 - RNA, 20 nt, Human
cucaaaggauguuugaaagg

SEQ ID NO: 1107653 - RNA, 21 nt, Human
cucucugguucuccaggcaca

SEQ ID NO: 1107654 - RNA, 24 nt, Human
gaaauaaaguaugugaaaacucac

SEQ ID NO: 1107655 - RNA, 21 nt, Human
gacccugucugggcucugcag

SEQ ID NO: 1107656 - RNA, 21 nt, Human
gauuuuuaacuagcacaauuc

SEQ ID NO: 1107657 - RNA, 21 nt, Human
gcagagcuggcgccgcacuga

SEQ ID NO: 1107658 - RNA, 24 nt, Human
gguggagcuucugagacaagcuuc

SEQ ID NO: 1107659 - RNA, 18 nt, Human
uaaaacaacagccaccau

SEQ ID NO: 1107660 - RNA, 23 nt, Human
uaacaugacauagggcaucuauu

SEQ ID NO: 1107661 - RNA, 23 nt, Human
ucaacaccuauuccugauuuuua

SEQ ID NO: 1107662 - RNA, 21 nt, Human
ucagaaccugaggaccucccc

SEQ ID NO: 1107663 - RNA, 20 nt, Human
ucauuucauggaaauaaagu

SEQ ID NO: 1107664 - RNA, 18 nt, Human
ucuuaaugauuaauuagc

SEQ ID NO: 1107665 - RNA, 20 nt, Human
ugguauacaaaauaauguuu

SEQ ID NO: 1107666 - RNA, 20 nt, Human
ugucugggcucugcagagcu

SEQ ID NO: 1107667 - RNA, 25 nt, Human
uuaaugauuaauuagcacuuuucuu

SEQ ID NO: 1107668 - RNA, 20 nt, Human
uuuaaaacaacagccaccau

SEQ ID NO: 1107669 - RNA, 23 nt, Human
aaacagggauagauagaggggac

SEQ ID NO: 1107670 - RNA, 18 nt, Human
aaacuaaaaucucuaaac

SEQ ID NO: 1107671 - RNA, 18 nt, Human
aacauucugaauacaaaa

SEQ ID NO: 1107672 - RNA, 20 nt, Human
aacauucugaauacaaaacc

SEQ ID NO: 1107673 - RNA, 21 nt, Human
aacugggcccaagagcccagc

SEQ ID NO: 1107674 - RNA, 20 nt, Human
aacuucaugacccugcuccc

SEQ ID NO: 1107675 - RNA, 20 nt, Human
aagaaaaaacuucaugaccc

SEQ ID NO: 1107676 - RNA, 21 nt, Human
aagaaaaaaucuugaaaagaa

SEQ ID NO: 1107677 - RNA, 25 nt, Human
acaagcagaccuggugugggugggu

SEQ ID NO: 1107678 - RNA, 23 nt, Human
acaucauucuggacuaacaguuu

SEQ ID NO: 1107679 - RNA, 27 nt, Human
accuggugugggugggugccugugugu

SEQ ID NO: 1107680 - RNA, 25 nt, Human
acuuuaaaaaaucuggaacaauaga

SEQ ID NO: 1107681 - RNA, 19 nt, Human
agaaacaagcagaccuggu

SEQ ID NO: 1107682 - RNA, 26 nt, Human
agacaagacagacugaacugggccca

SEQ ID NO: 1107683 - RNA, 19 nt, Human
agggauagauagaggaugg

SEQ ID NO: 1107684 - RNA, 23 nt, Human
auucugaauacaaaacccuugau

SEQ ID NO: 1107685 - RNA, 20 nt, Human
caaagggguuggucuccccc

SEQ ID NO: 1107686 - RNA, 23 nt, Human
caagcagaccugguguggguggg

SEQ ID NO: 1107687 - RNA, 20 nt, Human
cagaccuggugugggugggu

SEQ ID NO: 1107688 - RNA, 21 nt, Human
cagcauccaaccuuucccaga

SEQ ID NO: 1107689 - RNA, 20 nt, Human
cccugcuccccgggcuccuc

SEQ ID NO: 1107690 - RNA, 22 nt, Human
ccuagggagaaaacuagagaau

SEQ ID NO: 1107691 - RNA, 22 nt, Human
cgucaaugcccccuucccaucc

SEQ ID NO: 1107692 - RNA, 19 nt, Human
cuccccgggcuccucucca

SEQ ID NO: 1107693 - RNA, 24 nt, Human
cugggcccaagagcccagcacugg

SEQ ID NO: 1107694 - RNA, 19 nt, Human
cuucaugacccugcucccc

SEQ ID NO: 1107695 - RNA, 19 nt, Human
gaacugggcccaagagccc

SEQ ID NO: 1107696 - RNA, 23 nt, Human
gaagaaaaaacuucaugacccug

SEQ ID NO: 1107697 - RNA, 18 nt, Human
gacagacugaacugggcc

SEQ ID NO: 1107698 - RNA, 24 nt, Human
gacugaacugggcccaagagccca

SEQ ID NO: 1107699 - RNA, 20 nt, Human
gaggagggauagaaggggau

SEQ ID NO: 1107700 - RNA, 22 nt, Human
gaggauggggaaaggggagaaa

SEQ ID NO: 1107701 - RNA, 24 nt, Human
gauagauagaggauggggaaaggg

SEQ ID NO: 1107702 - RNA, 18 nt, Human
gcuugccuggccuccugg

SEQ ID NO: 1107703 - RNA, 20 nt, Human
gggaaaggggagaaaagguu

SEQ ID NO: 1107704 - RNA, 18 nt, Human
guuuuauuucuccucuuu

SEQ ID NO: 1107705 - RNA, 20 nt, Human
uaaaauugaagcaaaagugc

SEQ ID NO: 1107706 - RNA, 21 nt, Human
uaaaauugaagcaaaagugcc

SEQ ID NO: 1107707 - RNA, 23 nt, Human
uaaacacaccaauguccuauucc

SEQ ID NO: 1107708 - RNA, 22 nt, Human
uaagaaaaaaucuugaaaagaa

SEQ ID NO: 1107709 - RNA, 18 nt, Human
uagaaggggauguaaggc

SEQ ID NO: 1107710 - RNA, 22 nt, Human
uagaaggggauguaaggcagca

SEQ ID NO: 1107711 - RNA, 21 nt, Human
ucacugaagaaaaaacuucau

SEQ ID NO: 1107712 - RNA, 18 nt, Human
ucccuacaugugagaaac

SEQ ID NO: 1107713 - RNA, 21 nt, Human
ucucuaaacacaccaaugucc

SEQ ID NO: 1107714 - RNA, 19 nt, Human
ugagaaacaagcagaccug

SEQ ID NO: 1107715 - RNA, 23 nt, Human
ugagacaagacagacugaacugg

SEQ ID NO: 1107716 - RNA, 23 nt, Human
uggaacaauagaaacuguacaga

SEQ ID NO: 1107717 - RNA, 18 nt, Human
ugggugccugugugugug

SEQ ID NO: 1107718 - RNA, 19 nt, Human
uucaaaagacacaaagggg

SEQ ID NO: 1107719 - RNA, 23 nt, Human
uugauuuguuccugggaaacagg

SEQ ID NO: 1107720 - RNA, 23 nt, Human
uugcacaacauucugaauacaaa

SEQ ID NO: 1107721 - RNA, 22 nt, Human
uuggucucccccccucucccua

SEQ ID NO: 1107722 - RNA, 19 nt, Human
uuguauuccuccuucacug

SEQ ID NO: 1107723 - RNA, 20 nt, Human
uuuguuuuguuuuuaaacua

SEQ ID NO: 1107724 - RNA, 23 nt, Human
caagccacgcccacaggcucagg

SEQ ID NO: 1107725 - RNA, 25 nt, Human
cccacaggcucagucucccagcacc

SEQ ID NO: 1107726 - RNA, 19 nt, Human
cccagcacccccauaguuu

SEQ ID NO: 1107727 - RNA, 18 nt, Human
ggauacaggucuggcauu

SEQ ID NO: 1107728 - RNA, 20 nt, Human
uacaguccagcaucuguccc

SEQ ID NO: 1107729 - RNA, 22 nt, Human
uacaguccagcaucuguccucu

SEQ ID NO: 1107730 - RNA, 23 nt, Human
uagaugaaaggaaauacuuagcu

SEQ ID NO: 1107731 - RNA, 21 nt, Human
uaucugaggaaucaagaaguu

SEQ ID NO: 1107732 - RNA, 25 nt, Human
ucucccagcacccccauaguuucuc

SEQ ID NO: 1107733 - RNA, 20 nt, Human
ugccucagccggcaccucug

SEQ ID NO: 1107734 - RNA, 18 nt, Human
uuaucaguauuuuauccc

SEQ ID NO: 1107735 - RNA, 20 nt, Human
uuccauaagguucucuggga

SEQ ID NO: 1107736 - RNA, 22 nt, Human
acggggcugcagagccgccucu

SEQ ID NO: 1107737 - RNA, 21 nt, Human
caccuucuagguucagucacc

SEQ ID NO: 1107738 - RNA, 23 nt, Human
ccucugggcaccgaggacgauuc

SEQ ID NO: 1107739 - RNA, 24 nt, Human
gcagagccgccucugggcaccgag

SEQ ID NO: 1107740 - RNA, 22 nt, Human
uacuuggggaagcacggcccgg

SEQ ID NO: 1107741 - RNA, 21 nt, Human
ucagucaccgcgguccccccc

SEQ ID NO: 1107742 - RNA, 19 nt, Human
cacugucugucuucucuac

SEQ ID NO: 1107743 - RNA, 21 nt, Human
cagcagcuucuucuuggcaca

SEQ ID NO: 1107744 - RNA, 21 nt, Human
cuacagcagcuucuucuuggc

SEQ ID NO: 1107745 - RNA, 19 nt, Human
cuucuuggcacaauccuga

SEQ ID NO: 1107746 - RNA, 18 nt, Human
ucuacagcagcuucuucu

SEQ ID NO: 1107747 - RNA, 20 nt, Human
uguggggaaugugggaaaug

SEQ ID NO: 1107748 - RNA, 33 nt, Human
aaaacaaaaggcacuacaaaaaaccccaaaagg

SEQ ID NO: 1107749 - RNA, 21 nt, Human
aaaacgaccaccaccaggagg

SEQ ID NO: 1107750 - RNA, 22 nt, Human
aaacaaaaaaaaaaaauagaaa

SEQ ID NO: 1107751 - RNA, 20 nt, Human
aaacagaaauagaaaaugaa

SEQ ID NO: 1107752 - RNA, 21 nt, Human
aaacagaaauagaaaaugaac

SEQ ID NO: 1107753 - RNA, 23 nt, Human
aaacagaaauagaaaaugaacaa

SEQ ID NO: 1107754 - RNA, 21 nt, Human
aaagaacuacaacucaacaac

SEQ ID NO: 1107755 - RNA, 20 nt, Human
aacaaaaagcaaauaguccc

SEQ ID NO: 1107756 - RNA, 19 nt, Human
aacacggugaaaccccguc

SEQ ID NO: 1107757 - RNA, 20 nt, Human
aacacggugaaaccccgucu

SEQ ID NO: 1107758 - RNA, 21 nt, Human
aacacggugaaaccccgucuc

SEQ ID NO: 1107759 - RNA, 25 nt, Human
aacccacagacagaaagaggaaagc

SEQ ID NO: 1107760 - RNA, 24 nt, Human
aaccccaaaaacagaaauagaaaa

SEQ ID NO: 1107761 - RNA, 18 nt, Human
aagcacaugaaaagaucc

SEQ ID NO: 1107762 - RNA, 22 nt, Human
aaggcacuacaaaaaaccccaa

SEQ ID NO: 1107763 - RNA, 20 nt, Human
aaggcaggcagaucacaagg

SEQ ID NO: 1107764 - RNA, 18 nt, Human
aaugacaagaaaaaauga

SEQ ID NO: 1107765 - RNA, 24 nt, Human
aauggcaugaaccugggaggcgga

SEQ ID NO: 1107766 - RNA, 24 nt, Human
acagaacccacagacagaaagagu

SEQ ID NO: 1107767 - RNA, 24 nt, Human
acagagcaagacucugucucaaaa

SEQ ID NO: 1107768 - RNA, 18 nt, Human
acagcacugcacuccagc

SEQ ID NO: 1107769 - RNA, 20 nt, Human
accaaaacgaccaccaccag

SEQ ID NO: 1107770 - RNA, 21 nt, Human
accacacagaaccaaaacgac

SEQ ID NO: 1107771 - RNA, 24 nt, Human
accccaaaaacagaaauagaaaau

SEQ ID NO: 1107772 - RNA, 24 nt, Human
accccgucucuacuaaaaauacaa

SEQ ID NO: 1107773 - RNA, 23 nt, Human
accuguagucccagcuacucggg

SEQ ID NO: 1107774 - RNA, 18 nt, Human
acugcaauccauggaugc

SEQ ID NO: 1107775 - RNA, 21 nt, Human
acugcacuccagccuggguga

SEQ ID NO: 1107776 - RNA, 24 nt, Human
acugcacuccagccugggugacag

SEQ ID NO: 1107777 - RNA, 26 nt, Human
acugcacuccagccugggugacagag

SEQ ID NO: 1107778 - RNA, 18 nt, Human
agagcaagacucugucuc

SEQ ID NO: 1107779 - RNA, 19 nt, Human
agaggccaaggcaggcagu

SEQ ID NO: 1107780 - RNA, 19 nt, Human
agauagcugcuauccaaaa

SEQ ID NO: 1107781 - RNA, 18 nt, Human
agccauaggccgaaguug

SEQ ID NO: 1107782 - RNA, 24 nt, Human
agccugggugacagagcaagacuc

SEQ ID NO: 1107783 - RNA, 21 nt, Human
agcgaaaaagcaaccuaugga

SEQ ID NO: 1107784 - RNA, 22 nt, Human
agcgacaaaggcaagacaagga

SEQ ID NO: 1107785 - RNA, 26 nt, Human
aggcaaaagguggaaguaggggaccc

SEQ ID NO: 1107786 - RNA, 24 nt, Human
aggcagaucacaaggucaggagau

SEQ ID NO: 1107787 - RNA, 21 nt, Human
aggcaggagaauggcaugaac

SEQ ID NO: 1107788 - RNA, 22 nt, Human
aggcaggagaauggcaugaacc

SEQ ID NO: 1107789 - RNA, 24 nt, Human
aggcaggagaauggcaugaaccug

SEQ ID NO: 1107790 - RNA, 24 nt, Human
aggcaggcagaucacaaggucagg

SEQ ID NO: 1107791 - RNA, 26 nt, Human
aggcaggcagaucacaaggucaggag

SEQ ID NO: 1107792 - RNA, 23 nt, Human
aggccaaggcaggcagaucacaa

SEQ ID NO: 1107793 - RNA, 18 nt, Human
aggccuccgccagcccag

SEQ ID NO: 1107794 - RNA, 24 nt, Human
aggcgcgguggcucacgcccguaa

SEQ ID NO: 1107795 - RNA, 24 nt, Human
aggcggagcuugcagugagccaag

SEQ ID NO: 1107796 - RNA, 24 nt, Human
aggcgugguggcaggcaccuguag

SEQ ID NO: 1107797 - RNA, 18 nt, Human
aguacagaugcaacuacc

SEQ ID NO: 1107798 - RNA, 25 nt, Human
agucccauuaaaaauggaaaaaaaa

SEQ ID NO: 1107799 - RNA, 20 nt, Human
auaaugacaagaaaaaaugu

SEQ ID NO: 1107800 - RNA, 23 nt, Human
auagaauauuauuucaccuaaaa

SEQ ID NO: 1107801 - RNA, 20 nt, Human
aucacaaggucaggagaucc

SEQ ID NO: 1107802 - RNA, 24 nt, Human
aucacagcacugcacuccagccug

SEQ ID NO: 1107803 - RNA, 25 nt, Human
caaaaagcaaauagucccauuaaaa

SEQ ID NO: 1107804 - RNA, 19 nt, Human
caaaacaaaaggcacuaca

SEQ ID NO: 1107805 - RNA, 23 nt, Human
caaaacaaaaggcacuacaaaaa

SEQ ID NO: 1107806 - RNA, 26 nt, Human
caacaacaaaaagcaaauagucccau

SEQ ID NO: 1107807 - RNA, 23 nt, Human
caacaagauagcugcuauccaaa

SEQ ID NO: 1107808 - RNA, 21 nt, Human
caacaguacaucaaaacuuaa

SEQ ID NO: 1107809 - RNA, 20 nt, Human
caacucaacaacaaaaagca

SEQ ID NO: 1107810 - RNA, 21 nt, Human
caacucaacaacaaaaagcaa

SEQ ID NO: 1107811 - RNA, 19 nt, Human
caagauagcugcuauccaa

SEQ ID NO: 1107812 - RNA, 22 nt, Human
caagauagcugcuauccaaaac

SEQ ID NO: 1107813 - RNA, 26 nt, Human
caaggcaggcagaucacaaggucagg

SEQ ID NO: 1107814 - RNA, 25 nt, Human
cacacagaaccaaaacgaccaccac

SEQ ID NO: 1107815 - RNA, 22 nt, Human
cacagacagaaagagucaacag

SEQ ID NO: 1107816 - RNA, 24 nt, Human
caccaggaggacggcggaaguccc

SEQ ID NO: 1107817 - RNA, 23 nt, Human
caccucacauccaacaagauagc

SEQ ID NO: 1107818 - RNA, 23 nt, Human
caccuguagucccagcuacucgg

SEQ ID NO: 1107819 - RNA, 24 nt, Human
caccuguagucccagcuacucggg

SEQ ID NO: 1107820 - RNA, 24 nt, Human
cacgcccguaaucccagcacuuug

SEQ ID NO: 1107821 - RNA, 22 nt, Human
cacuccagccugggugacagag

SEQ ID NO: 1107822 - RNA, 19 nt, Human
cacugcacuccagccuggg

SEQ ID NO: 1107823 - RNA, 19 nt, Human
cacugcacuccagccuggg

SEQ ID NO: 1107824 - RNA, 19 nt, Human
cacugcacuccagccuggg

SEQ ID NO: 1107825 - RNA, 19 nt, Human
cacugcacuccagccuggg

SEQ ID NO: 1107826 - RNA, 20 nt, Human
cacugcacuccagccugggu

SEQ ID NO: 1107827 - RNA, 22 nt, Human
cacugcacuccagccuggguga

SEQ ID NO: 1107828 - RNA, 23 nt, Human
cacugcacuccagccugggugac

SEQ ID NO: 1107829 - RNA, 24 nt, Human
cacugcacuccagccugggugaca

SEQ ID NO: 1107830 - RNA, 24 nt, Human
cacugcacuccagccugggugaca

SEQ ID NO: 1107831 - RNA, 24 nt, Human
cagaaccaaaacgaccaccaccag

SEQ ID NO: 1107832 - RNA, 25 nt, Human
cagagcaagacucugucucaaaaac

SEQ ID NO: 1107833 - RNA, 24 nt, Human
cagcacuuugagaggccaaggcag

SEQ ID NO: 1107834 - RNA, 25 nt, Human
cagcacuuugagaggccaaggcagg

SEQ ID NO: 1107835 - RNA, 22 nt, Human
caggcagaucacaaggucagga

SEQ ID NO: 1107836 - RNA, 20 nt, Human
caggcagaucacaaggucau

SEQ ID NO: 1107837 - RNA, 22 nt, Human
cauaggccgaaguuggugaaac

SEQ ID NO: 1107838 - RNA, 21 nt, Human
caugaaccugggaggcggagc

SEQ ID NO: 1107839 - RNA, 23 nt, Human
cauuauacaacaugggugaaccg

SEQ ID NO: 1107840 - RNA, 19 nt, Human
ccaaaacaaaaggcacuac

SEQ ID NO: 1107841 - RNA, 24 nt, Human
ccacacagaaccaaaacgaccacc

SEQ ID NO: 1107842 - RNA, 21 nt, Human
cccaaaaacagaaauagaaaa

SEQ ID NO: 1107843 - RNA, 26 nt, Human
cccaaaaacagaaauagaaaaugaac

SEQ ID NO: 1107844 - RNA, 24 nt, Human
cccacagacagaaagagucaacag

SEQ ID NO: 1107845 - RNA, 19 nt, Human
ccgcuucucgcgcuuuucc

SEQ ID NO: 1107846 - RNA, 24 nt, Human
ccuggccaggcgcgguggcucacg

SEQ ID NO: 1107847 - RNA, 23 nt, Human
ccuggcuaacacggugaaacccc

SEQ ID NO: 1107848 - RNA, 24 nt, Human
ccuggcuaacacggugaaaccccg

SEQ ID NO: 1107849 - RNA, 22 nt, Human
ccugggugacagagcaagacuc

SEQ ID NO: 1107850 - RNA, 21 nt, Human
ccuguagucccagcuacucgg

SEQ ID NO: 1107851 - RNA, 22 nt, Human
cgaaaaagcaaccuauggacug

SEQ ID NO: 1107852 - RNA, 24 nt, Human
cguuccgucacuucggugacguca

SEQ ID NO: 1107853 - RNA, 22 nt, Human
cucacgcccguaaucccagcac

SEQ ID NO: 1107854 - RNA, 24 nt, Human
cucacgcccguaaucccagcacuu

SEQ ID NO: 1107855 - RNA, 18 nt, Human
cucgcgcuuuuccguucc

SEQ ID NO: 1107856 - RNA, 18 nt, Human
cuggcuaacacggugaaa

SEQ ID NO: 1107857 - RNA, 21 nt, Human
cugucucaaaaacaaacaaaa

SEQ ID NO: 1107858 - RNA, 23 nt, Human
gaaaaagcaaccuauggacuggg

SEQ ID NO: 1107859 - RNA, 20 nt, Human
gaaacaccacacagaaccaa

SEQ ID NO: 1107860 - RNA, 22 nt, Human
gaaacaccacacagaaccaaaa

SEQ ID NO: 1107861 - RNA, 19 nt, Human
gaacuacaacucaacaaca

SEQ ID NO: 1107862 - RNA, 18 nt, Human
gacaagaaaaaaugucug

SEQ ID NO: 1107863 - RNA, 24 nt, Human
gacagagcaagacucugucucaaa

SEQ ID NO: 1107864 - RNA, 21 nt, Human
gaccauccuggcuaacacggu

SEQ ID NO: 1107865 - RNA, 18 nt, Human
gagcuugcagugagccaa

SEQ ID NO: 1107866 - RNA, 22 nt, Human
gagcuugcagugagccaagauc

SEQ ID NO: 1107867 - RNA, 19 nt, Human
gaucacugcaauccaugga

SEQ ID NO: 1107868 - RNA, 24 nt, Human
gcacuccagccugggugacagagc

SEQ ID NO: 1107869 - RNA, 18 nt, Human
gcacugcacuccagccug

SEQ ID NO: 1107870 - RNA, 21 nt, Human
gcacugcacuccagccugggu

SEQ ID NO: 1107871 - RNA, 24 nt, Human
gcacugcacuccagccugggugac

SEQ ID NO: 1107872 - RNA, 24 nt, Human
gcuaacacggugaaaccccgucuc

SEQ ID NO: 1107873 - RNA, 20 nt, Human
ggagcuugcagugagccaag

SEQ ID NO: 1107874 - RNA, 24 nt, Human
ggagcuugcagugagccaagauca

SEQ ID NO: 1107875 - RNA, 19 nt, Human
ggcaccuguagucccagcu

SEQ ID NO: 1107876 - RNA, 24 nt, Human
gguggcucacgcccguaaucccag

SEQ ID NO: 1107877 - RNA, 19 nt, Human
guacagaugcaacuacccu

SEQ ID NO: 1107878 - RNA, 21 nt, Human
gugaaacaccacacagaacca

SEQ ID NO: 1107879 - RNA, 21 nt, Human
uaaaauggcacagguacuaug

SEQ ID NO: 1107880 - RNA, 21 nt, Human
uaaaauuucaucaaaggacac

SEQ ID NO: 1107881 - RNA, 22 nt, Human
uaacacggugaaaccccgucuc

SEQ ID NO: 1107882 - RNA, 24 nt, Human
uaacacggugaaaccccgucucua

SEQ ID NO: 1107883 - RNA, 20 nt, Human
uaacagaugaauggauaaau

SEQ ID NO: 1107884 - RNA, 19 nt, Human
uaaguaccauagaguauag

SEQ ID NO: 1107885 - RNA, 21 nt, Human
uacaaaaaaccccaaaaacag

SEQ ID NO: 1107886 - RNA, 25 nt, Human
uacaaaaaaccccaaaaacagaaau

SEQ ID NO: 1107887 - RNA, 24 nt, Human
uacaacucaacaacaaaaagcaaa

SEQ ID NO: 1107888 - RNA, 25 nt, Human
uacacaaaugccuaacaagcacaug

SEQ ID NO: 1107889 - RNA, 23 nt, Human
uacagaugcaacuacccuuuuug

SEQ ID NO: 1107890 - RNA, 20 nt, Human
uacuauauaguuuagggaau

SEQ ID NO: 1107891 - RNA, 19 nt, Human
uacuuuugauccaugguug

SEQ ID NO: 1107892 - RNA, 22 nt, Human
uagcccaaguauccacuaacag

SEQ ID NO: 1107893 - RNA, 23 nt, Human
uaguugagacauuucuggggaag

SEQ ID NO: 1107894 - RNA, 18 nt, Human
ucaacagagcgaaaaagc

SEQ ID NO: 1107895 - RNA, 18 nt, Human
ucacaaggucaggagauc

SEQ ID NO: 1107896 - RNA, 24 nt, Human
ucacaaggucaggagaucaggacc

SEQ ID NO: 1107897 - RNA, 19 nt, Human
ucacauccaacaagauagc

SEQ ID NO: 1107898 - RNA, 18 nt, Human
ucaccuaaaaaggaagga

SEQ ID NO: 1107899 - RNA, 23 nt, Human
ucacucccgccucuccguggugg

SEQ ID NO: 1107900 - RNA, 19 nt, Human
ucacugcaauccauggaug

SEQ ID NO: 1107901 - RNA, 20 nt, Human
ucacugcaauccauggaugc

SEQ ID NO: 1107902 - RNA, 24 nt, Human
ucaucuucauagcagcauuauuuc

SEQ ID NO: 1107903 - RNA, 25 nt, Human
uccaacaagauagcugcuauccaaa

SEQ ID NO: 1107904 - RNA, 23 nt, Human
uccacuaacagaugaauggauaa

SEQ ID NO: 1107905 - RNA, 24 nt, Human
uccagccugggugacagagcaaga

SEQ ID NO: 1107906 - RNA, 21 nt, Human
ucgauccaugaauacagaacc

SEQ ID NO: 1107907 - RNA, 21 nt, Human
ucucaaaagauaaauacugua

SEQ ID NO: 1107908 - RNA, 22 nt, Human
ucucuacuaaaaauacaaaaaa

SEQ ID NO: 1107909 - RNA, 22 nt, Human
ugaaagacacuauagauuccac

SEQ ID NO: 1107910 - RNA, 22 nt, Human
ugaaaguagaaucuugaauaga

SEQ ID NO: 1107911 - RNA, 23 nt, Human
ugaauggauaaauaaauguggua

SEQ ID NO: 1107912 - RNA, 24 nt, Human
ugagaggccaaggcaggcagauca

SEQ ID NO: 1107913 - RNA, 24 nt, Human
ugaggcaggagaauggcaugaacc

SEQ ID NO: 1107914 - RNA, 25 nt, Human
ugaggcaggagaauggcaugaaccu

SEQ ID NO: 1107915 - RNA, 20 nt, Human
ugccuaacaagcacaugaaa

SEQ ID NO: 1107916 - RNA, 21 nt, Human
uggaaaaaaaagacuugaaua

SEQ ID NO: 1107917 - RNA, 19 nt, Human
uggauaaauaaauguggua

SEQ ID NO: 1107918 - RNA, 22 nt, Human
uggcaggcaccuguagucccag

SEQ ID NO: 1107919 - RNA, 24 nt, Human
uggccaggcgcgguggcucacgcc

SEQ ID NO: 1107920 - RNA, 22 nt, Human
uggcucacgcccguaaucccag

SEQ ID NO: 1107921 - RNA, 24 nt, Human
uggcucacgcccguaaucccagca

SEQ ID NO: 1107922 - RNA, 29 nt, Human
ugggaggcggagcuugcagugacaacggu

SEQ ID NO: 1107923 - RNA, 24 nt, Human
ugggaggcggagcuugcagugagc

SEQ ID NO: 1107924 - RNA, 22 nt, Human
ugguaagaggaaaaauguucug

SEQ ID NO: 1107925 - RNA, 24 nt, Human
ugguggcaggcaccuguaguccca

SEQ ID NO: 1107926 - RNA, 22 nt, Human
ugugcacugcuggugggaauga

SEQ ID NO: 1107927 - RNA, 20 nt, Human
uugcagugagccaagaucac

SEQ ID NO: 1107928 - RNA, 23 nt, Human
uuuagggaauaaugacaagaaaa

SEQ ID NO: 1107929 - RNA, 24 nt, Human
uuugguaaggaguuaauauccaga

SEQ ID NO: 1107930 - RNA, 25 nt, Human
uuuuccguuccgucacuucggugac

SEQ ID NO: 1107931 - RNA, 18 nt, Human
aagacuuuucugugagag

SEQ ID NO: 1107932 - RNA, 20 nt, Human
acuuuucugugagagggaag

SEQ ID NO: 1107933 - RNA, 21 nt, Human
gagaagaagaaauaagcauuu

SEQ ID NO: 1107934 - RNA, 19 nt, Human
uuugggcuuuuuucuuuuu

SEQ ID NO: 1107935 - RNA, 24 nt, Human
aaaguguugggauuacaggcguga

SEQ ID NO: 1107936 - RNA, 21 nt, Human
aaguguugggauuacaggcgu

SEQ ID NO: 1107937 - RNA, 26 nt, Human
aaguguugggauuacaggcgugagcc

SEQ ID NO: 1107938 - RNA, 23 nt, Human
acggaguuucgcuuguugcacag

SEQ ID NO: 1107939 - RNA, 20 nt, Human
acgggguuucuccauguugg

SEQ ID NO: 1107940 - RNA, 21 nt, Human
acgggguuucuccauguuggu

SEQ ID NO: 1107941 - RNA, 20 nt, Human
agccaccgcacccagccuau

SEQ ID NO: 1107942 - RNA, 24 nt, Human
aggagggucugggggacuguggga

SEQ ID NO: 1107943 - RNA, 24 nt, Human
aggugaucugcucgccucggccuc

SEQ ID NO: 1107944 - RNA, 22 nt, Human
aguagagacgggguuucuccau

SEQ ID NO: 1107945 - RNA, 20 nt, Human
aguagcugggauuacaggca

SEQ ID NO: 1107946 - RNA, 23 nt, Human
aguagcugggauuacaggcaugu

SEQ ID NO: 1107947 - RNA, 23 nt, Human
aguagcugggauuacaggcaugu

SEQ ID NO: 1107948 - RNA, 23 nt, Human
agugcaauggugcgaucuuggcu

SEQ ID NO: 1107949 - RNA, 24 nt, Human
agugcaauggugcgaucuuggcuc

SEQ ID NO: 1107950 - RNA, 24 nt, Human
caaaguguugggauuacaggcgug

SEQ ID NO: 1107951 - RNA, 23 nt, Human
caaccuccaccuccuggguucaa

SEQ ID NO: 1107952 - RNA, 22 nt, Human
caagccauucuccugccucagc

SEQ ID NO: 1107953 - RNA, 21 nt, Human
caccgcacccagccuaucuca

SEQ ID NO: 1107954 - RNA, 18 nt, Human
cagcaaccuccaccuccu

SEQ ID NO: 1107955 - RNA, 22 nt, Human
ccaaaguguugggauuacaggc

SEQ ID NO: 1107956 - RNA, 22 nt, Human
ccaaaguguugggauuacaggc

SEQ ID NO: 1107957 - RNA, 24 nt, Human
ccaaaguguugggauuacaggcgu

SEQ ID NO: 1107958 - RNA, 20 nt, Human
ccaccacacccggcuaauuu

SEQ ID NO: 1107959 - RNA, 21 nt, Human
ccauguuggucaugcuggucu

SEQ ID NO: 1107960 - RNA, 22 nt, Human
ccccgccgcucccgcugcgccg

SEQ ID NO: 1107961 - RNA, 24 nt, Human
ccggaccucaggugaucugcucgc

SEQ ID NO: 1107962 - RNA, 19 nt, Human
ccggaguagcugggauuac

SEQ ID NO: 1107963 - RNA, 23 nt, Human
ccggaguagcugggauuacaggc

SEQ ID NO: 1107964 - RNA, 24 nt, Human
ccggaguagcugggauuacaggca

SEQ ID NO: 1107965 - RNA, 19 nt, Human
ccuccaccuccuggguuca

SEQ ID NO: 1107966 - RNA, 24 nt, Human
ccugccucagcuuccggaguagcu

SEQ ID NO: 1107967 - RNA, 23 nt, Human
ccuggguucaagccauucuccug

SEQ ID NO: 1107968 - RNA, 24 nt, Human
cgccucggccucccaaaguguugg

SEQ ID NO: 1107969 - RNA, 22 nt, Human
cgcuucgccccacugcgaucag

SEQ ID NO: 1107970 - RNA, 24 nt, Human
cggaguagcugggauuacaggcau

SEQ ID NO: 1107971 - RNA, 29 nt, Human
cggcuaauuuuguauuuuuaguagagacg

SEQ ID NO: 1107972 - RNA, 19 nt, Human
cgggguuucuccauguugg

SEQ ID NO: 1107973 - RNA, 26 nt, Human
cucacagcaaccuccaccuccugggu

SEQ ID NO: 1107974 - RNA, 23 nt, Human
cucagcuuccggaguagcuggga

SEQ ID NO: 1107975 - RNA, 23 nt, Human
gaccucaggugaucugcucgccu

SEQ ID NO: 1107976 - RNA, 24 nt, Human
gaccucaggugaucugcucgccuc

SEQ ID NO: 1107977 - RNA, 23 nt, Human
gagacgggguuucuccauguugg

SEQ ID NO: 1107978 - RNA, 24 nt, Human
gagacgggguuucuccauguuggu

SEQ ID NO: 1107979 - RNA, 22 nt, Human
gaguagcugggauuacaggcau

SEQ ID NO: 1107980 - RNA, 21 nt, Human
gaucuuggcucacagcaaccu

SEQ ID NO: 1107981 - RNA, 18 nt, Human
gauuacaggcaugugcca

SEQ ID NO: 1107982 - RNA, 18 nt, Human
gauuacaggcgugagcca

SEQ ID NO: 1107983 - RNA, 22 nt, Human
gauuacaggcgugagccaccgc

SEQ ID NO: 1107984 - RNA, 23 nt, Human
gauuacaggcgugagccaccgca

SEQ ID NO: 1107985 - RNA, 22 nt, Human
gcaaccuccaccuccuggguuc

SEQ ID NO: 1107986 - RNA, 23 nt, Human
gcggcuccggccccgcuucgccc

SEQ ID NO: 1107987 - RNA, 30 nt, Human
gcuggagugcaauggugcgaucuuggcucc

SEQ ID NO: 1107988 - RNA, 24 nt, Human
ggaccucaggugaucugcucgccu

SEQ ID NO: 1107989 - RNA, 19 nt, Human
ggauuacaggcaugugcca

SEQ ID NO: 1107990 - RNA, 26 nt, Human
ggcuaauuuuguauuuuuaguagaga

SEQ ID NO: 1107991 - RNA, 21 nt, Human
ggggucuggcgaggcucgggg

SEQ ID NO: 1107992 - RNA, 19 nt, Human
ggguugggggacuguggca

SEQ ID NO: 1107993 - RNA, 23 nt, Human
guagagacgggguuucuccaugu

SEQ ID NO: 1107994 - RNA, 18 nt, Human
guagcugggauuacaggc

SEQ ID NO: 1107995 - RNA, 20 nt, Human
guagcugggauuacaggcau

SEQ ID NO: 1107996 - RNA, 23 nt, Human
uacaggcaugugccaccacaccc

SEQ ID NO: 1107997 - RNA, 24 nt, Human
uacaggcgugagccaccgcaccca

SEQ ID NO: 1107998 - RNA, 24 nt, Human
uaguagagacgggguuucuccaug

SEQ ID NO: 1107999 - RNA, 22 nt, Human
ucaagguuugagggagguggug

SEQ ID NO: 1108000 - RNA, 24 nt, Human
ucacagcaaccuccaccuccuggg

SEQ ID NO: 1108001 - RNA, 27 nt, Human
ucacagcaaccuccaccuccuggguuc

SEQ ID NO: 1108002 - RNA, 24 nt, Human
uccauguuggucaugcuggucuug

SEQ ID NO: 1108003 - RNA, 24 nt, Human
ucccaaaguguugggauuacaggc

SEQ ID NO: 1108004 - RNA, 24 nt, Human
uccggaguagcugggauuacaggc

SEQ ID NO: 1108005 - RNA, 21 nt, Human
uccuggguucaagccauucuc

SEQ ID NO: 1108006 - RNA, 24 nt, Human
uccuggguucaagccauucuccug

SEQ ID NO: 1108007 - RNA, 24 nt, Human
ucgccucggccucccaaaguguug

SEQ ID NO: 1108008 - RNA, 20 nt, Human
ucgcuuguugcacaggcugg

SEQ ID NO: 1108009 - RNA, 21 nt, Human
ucgcuuguugcacaggcugga

SEQ ID NO: 1108010 - RNA, 21 nt, Human
ucgggggcuucguggaguagc

SEQ ID NO: 1108011 - RNA, 18 nt, Human
ucugggggacugugggau

SEQ ID NO: 1108012 - RNA, 20 nt, Human
ucuguggaaguucugguggg

SEQ ID NO: 1108013 - RNA, 24 nt, Human
ugcacaggcuggagugcaauggug

SEQ ID NO: 1108014 - RNA, 24 nt, Human
ugccucagcuuccggaguagcugg

SEQ ID NO: 1108015 - RNA, 19 nt, Human
ugcgccgggcgucugggac

SEQ ID NO: 1108016 - RNA, 20 nt, Human
uggaggguugggggacugug

SEQ ID NO: 1108017 - RNA, 23 nt, Human
uggagugcaauggugcgaucuug

SEQ ID NO: 1108018 - RNA, 24 nt, Human
uggagugcaauggugcgaucuugg

SEQ ID NO: 1108019 - RNA, 18 nt, Human
ugggauuacaggcaugug

SEQ ID NO: 1108020 - RNA, 21 nt, Human
ugggauuacaggcaugugcca

SEQ ID NO: 1108021 - RNA, 22 nt, Human
ugggauuacaggcaugugccac

SEQ ID NO: 1108022 - RNA, 24 nt, Human
ugggauuacaggcaugugccacca

SEQ ID NO: 1108023 - RNA, 18 nt, Human
ugggauuacaggcgugag

SEQ ID NO: 1108024 - RNA, 19 nt, Human
ugggauuacaggcgugagc

SEQ ID NO: 1108025 - RNA, 21 nt, Human
ugggauuacaggcgugagcca

SEQ ID NO: 1108026 - RNA, 22 nt, Human
ugggauuacaggcgugagccac

SEQ ID NO: 1108027 - RNA, 23 nt, Human
ugggauuacaggcgugagccacc

SEQ ID NO: 1108028 - RNA, 24 nt, Human
ugggauuacaggcgugagccaccg

SEQ ID NO: 1108029 - RNA, 21 nt, Human
uggucaugcuggucuugaaau

SEQ ID NO: 1108030 - RNA, 21 nt, Human
uguggaggguugggggacugu

SEQ ID NO: 1108031 - RNA, 18 nt, Human
uuaguagagacgggguuu

SEQ ID NO: 1108032 - RNA, 22 nt, Human
uuaguagagacgggguuucucc

SEQ ID NO: 1108033 - RNA, 24 nt, Human
uuaguagagacgggguuucuccau

SEQ ID NO: 1108034 - RNA, 21 nt, Human
uucaagccauucuccugccuc

SEQ ID NO: 1108035 - RNA, 18 nt, Human
uugcacaggcuggagugc

SEQ ID NO: 1108036 - RNA, 23 nt, Human
uuguauuuuuaguagagacgggg

SEQ ID NO: 1108037 - RNA, 23 nt, Human
uuguugcacaggcuggagugcaa

SEQ ID NO: 1108038 - RNA, 23 nt, Human
uuucgcuuguugcacaggcugga

SEQ ID NO: 1108039 - RNA, 19 nt, Human
uuuuguauuuuuaguagag

SEQ ID NO: 1108040 - RNA, 20 nt, Human
uuuuguauuuuuaguagaga

SEQ ID NO: 1108041 - RNA, 22 nt, Human
uuuuuaguagagacgggguuuc

SEQ ID NO: 1108042 - RNA, 25 nt, Human
uuuuuuuuuuuugagacggaguuuc

SEQ ID NO: 1108043 - RNA, 22 nt, Human
uuuuuuuuuuuuuugagacgga

SEQ ID NO: 1108044 - RNA, 27 nt, Human
uuuuuuuuuuuuuuuuuuuuuuugggg

SEQ ID NO: 1108045 - RNA, 20 nt, Human
aaggagguaugaauuacgac

SEQ ID NO: 1108046 - RNA, 18 nt, Human
cacgcucacagugugugu

SEQ ID NO: 1108047 - RNA, 18 nt, Human
cccagcccucccaaaggc

SEQ ID NO: 1108048 - RNA, 21 nt, Human
ccuccacgauucugggguaag

SEQ ID NO: 1108049 - RNA, 24 nt, Human
cgacugaagcccuuaccacaugcc

SEQ ID NO: 1108050 - RNA, 24 nt, Human
cucucugcuuauguaguuuuugau

SEQ ID NO: 1108051 - RNA, 23 nt, Human
cugggguaagaaccugugucagg

SEQ ID NO: 1108052 - RNA, 21 nt, Human
gaagcccuuaccacaugccuu

SEQ ID NO: 1108053 - RNA, 19 nt, Human
gacugaagcccuuaccaca

SEQ ID NO: 1108054 - RNA, 21 nt, Human
gccucucuccuguguggacuc

SEQ ID NO: 1108055 - RNA, 18 nt, Human
gcuuuccuccacgauucu

SEQ ID NO: 1108056 - RNA, 23 nt, Human
uaacuaaagcacuuuccacacac

SEQ ID NO: 1108057 - RNA, 20 nt, Human
uauagggccucucuccugug

SEQ ID NO: 1108058 - RNA, 22 nt, Human
ucccaaaggcugaguuagccuc

SEQ ID NO: 1108059 - RNA, 24 nt, Human
ucgauggcagcgucccugucuuuu

SEQ ID NO: 1108060 - RNA, 23 nt, Human
ucucugaugggcaaggagguaug

SEQ ID NO: 1108061 - RNA, 22 nt, Human
ucucuuugauguaagugaaaau

SEQ ID NO: 1108062 - RNA, 22 nt, Human
ucugaagagacuugccugcuca

SEQ ID NO: 1108063 - RNA, 22 nt, Human
ucugggguaagaaccuguguca

SEQ ID NO: 1108064 - RNA, 24 nt, Human
ucuuuugcucccccagcccuccca

SEQ ID NO: 1108065 - RNA, 20 nt, Human
ugacugaagucuuuaccaca

SEQ ID NO: 1108066 - RNA, 23 nt, Human
ugacugaagucuuuaccacacuc

SEQ ID NO: 1108067 - RNA, 23 nt, Human
ugaguuagccucuaucaucugga

SEQ ID NO: 1108068 - RNA, 20 nt, Human
ugcacucucugaugggcaag

SEQ ID NO: 1108069 - RNA, 25 nt, Human
ugcuacauaguuuucauuuucagaa

SEQ ID NO: 1108070 - RNA, 19 nt, Human
uggcauuugcuacauaguu

SEQ ID NO: 1108071 - RNA, 21 nt, Human
ugucuuuugcucccccagccc

SEQ ID NO: 1108072 - RNA, 19 nt, Human
uguggcuucuguuuuccuc

SEQ ID NO: 1108073 - RNA, 24 nt, Human
uguguacugugucucaucuauaug

SEQ ID NO: 1108074 - RNA, 23 nt, Human
uguguggacucugagaugaacac

SEQ ID NO: 1108075 - RNA, 22 nt, Human
uugcucccccagcccucccaaa

SEQ ID NO: 1108076 - RNA, 23 nt, Human
uuugcauuuauaugguuuuucuc

SEQ ID NO: 1108077 - RNA, 19 nt, Human
gcccugugucuggguccug

SEQ ID NO: 1108078 - RNA, 21 nt, Human
ugugaaagagucugggugcuu

SEQ ID NO: 1108079 - RNA, 20 nt, Human
aaauaaaaacaaaguuucag

SEQ ID NO: 1108080 - RNA, 24 nt, Human
aucugcucuuuaauguuuuccuau

SEQ ID NO: 1108081 - RNA, 22 nt, Human
caucugcucuuuaauguuuucc

SEQ ID NO: 1108082 - RNA, 21 nt, Human
ucugcucuuuaauguuuuccu

SEQ ID NO: 1108083 - RNA, 24 nt, Human
ugcaucugcucuuuaauguuuucc

SEQ ID NO: 1108084 - RNA, 21 nt, Human
uucagucucuucacaagaagu

SEQ ID NO: 1108085 - RNA, 23 nt, Human
aaaagaaaaacagagucuacaaa

SEQ ID NO: 1108086 - RNA, 20 nt, Human
aaacagagucuacaaaucuu

SEQ ID NO: 1108087 - RNA, 18 nt, Human
aaagugcugggauuacaa

SEQ ID NO: 1108088 - RNA, 18 nt, Human
aaagugcugggauuacaa

SEQ ID NO: 1108089 - RNA, 24 nt, Human
aaagugcugggauuacaaacguga

SEQ ID NO: 1108090 - RNA, 24 nt, Human
aaagugcugggauuacaagcguga

SEQ ID NO: 1108091 - RNA, 21 nt, Human
aacaggcggacaucugucaaa

SEQ ID NO: 1108092 - RNA, 24 nt, Human
aaccugacccuggaagacaguggg

SEQ ID NO: 1108093 - RNA, 19 nt, Human
aacugcugacuuagcauaa

SEQ ID NO: 1108094 - RNA, 21 nt, Human
aagaaaaacagagucuacaaa

SEQ ID NO: 1108095 - RNA, 24 nt, Human
aaguaggugggacuacaggcaugu

SEQ ID NO: 1108096 - RNA, 19 nt, Human
aagugcugggauuacaaac

SEQ ID NO: 1108097 - RNA, 26 nt, Human
aagugcugggauuacaaacgugagcc

SEQ ID NO: 1108098 - RNA, 19 nt, Human
aagugcugggauuacaagc

SEQ ID NO: 1108099 - RNA, 19 nt, Human
aagugcugggauuacaagc

SEQ ID NO: 1108100 - RNA, 26 nt, Human
aagugcugggauuacaagcgugagcc

SEQ ID NO: 1108101 - RNA, 20 nt, Human
aauuuuuccaggaaauggcg

SEQ ID NO: 1108102 - RNA, 18 nt, Human
acaaacgugagccaccgc

SEQ ID NO: 1108103 - RNA, 23 nt, Human
acagcuguuggccuugcagcugu

SEQ ID NO: 1108104 - RNA, 18 nt, Human
acaggcgcccuccaccac

SEQ ID NO: 1108105 - RNA, 24 nt, Human
accaugcuggccaggcuggucucg

SEQ ID NO: 1108106 - RNA, 18 nt, Human
accauguuggccaggcug

SEQ ID NO: 1108107 - RNA, 20 nt, Human
acccaguuaauuuuucuauu

SEQ ID NO: 1108108 - RNA, 24 nt, Human
acccaguuaauuuuucuauuuuua

SEQ ID NO: 1108109 - RNA, 19 nt, Human
acgggguuucaccaugcug

SEQ ID NO: 1108110 - RNA, 20 nt, Human
acgggguuucaccaugcugg

SEQ ID NO: 1108111 - RNA, 24 nt, Human
acgggguuucaccaugcuggccag

SEQ ID NO: 1108112 - RNA, 18 nt, Human
acgguguuucaccauguu

SEQ ID NO: 1108113 - RNA, 24 nt, Human
acgguguuucaccauguuggccag

SEQ ID NO: 1108114 - RNA, 21 nt, Human
acgugagccaccgcgccuggc

SEQ ID NO: 1108115 - RNA, 27 nt, Human
acucuaucgcccaggcuggagugcaau

SEQ ID NO: 1108116 - RNA, 19 nt, Human
acuggagugcaguggcgca

SEQ ID NO: 1108117 - RNA, 21 nt, Human
acuuguggcuuugcacagcug

SEQ ID NO: 1108118 - RNA, 22 nt, Human
agccaccacgcccagccaggaa

SEQ ID NO: 1108119 - RNA, 21 nt, Human
agguucaagugauucaagcca

SEQ ID NO: 1108120 - RNA, 22 nt, Human
aguagagacgggguuucaccau

SEQ ID NO: 1108121 - RNA, 18 nt, Human
aguagcugggauuauagg

SEQ ID NO: 1108122 - RNA, 24 nt, Human
agugcaauggagcaaucucggcuc

SEQ ID NO: 1108123 - RNA, 20 nt, Human
agugcaguggcgcaaucucg

SEQ ID NO: 1108124 - RNA, 24 nt, Human
agugcaguggcgcaaucucggcuc

SEQ ID NO: 1108125 - RNA, 24 nt, Human
agugcugggauuacaaacgugagc

SEQ ID NO: 1108126 - RNA, 24 nt, Human
agugcugggauuacaagcgugagc

SEQ ID NO: 1108127 - RNA, 21 nt, Human
auucuccugccucagccuccc

SEQ ID NO: 1108128 - RNA, 24 nt, Human
auuuuucuauuuuuaguggagacg

SEQ ID NO: 1108129 - RNA, 21 nt, Human
caaaagaaaaacagagucuac

SEQ ID NO: 1108130 - RNA, 23 nt, Human
caaaagaaaaacagagucuacaa

SEQ ID NO: 1108131 - RNA, 22 nt, Human
caaacaauucuccugccucagc

SEQ ID NO: 1108132 - RNA, 27 nt, Human
caaacaauucuccugccucagccuccc

SEQ ID NO: 1108133 - RNA, 24 nt, Human
caaagugcugggauuacaaacgug

SEQ ID NO: 1108134 - RNA, 24 nt, Human
caaagugcugggauuacaagcgug

SEQ ID NO: 1108135 - RNA, 19 nt, Human
caagccauucuugugccuc

SEQ ID NO: 1108136 - RNA, 22 nt, Human
caagcgauccuccugucucagc

SEQ ID NO: 1108137 - RNA, 27 nt, Human
caagcgauccuccugucucagcuuccu

SEQ ID NO: 1108138 - RNA, 24 nt, Human
cacaccaccacaccuggcgaauuu

SEQ ID NO: 1108139 - RNA, 18 nt, Human
cacagcuguuggccuugc

SEQ ID NO: 1108140 - RNA, 21 nt, Human
caccaugcuggccaggcuggu

SEQ ID NO: 1108141 - RNA, 24 nt, Human
caccaugcuggccaggcuggucuc

SEQ ID NO: 1108142 - RNA, 27 nt, Human
caccaugcuggccaggcuggucucgaa

SEQ ID NO: 1108143 - RNA, 21 nt, Human
caccauguuggccaggcuggu

SEQ ID NO: 1108144 - RNA, 24 nt, Human
caccauguuggccaggcuggucuc

SEQ ID NO: 1108145 - RNA, 27 nt, Human
caccauguuggccaggcuggucucaaa

SEQ ID NO: 1108146 - RNA, 24 nt, Human
caccucagcuucccaaagugcugg

SEQ ID NO: 1108147 - RNA, 24 nt, Human
cacucuaucgcccaggcuggagug

SEQ ID NO: 1108148 - RNA, 21 nt, Human
cacugcaaccuccgccuccug

SEQ ID NO: 1108149 - RNA, 23 nt, Human
cacugcaaccuccgccuccuggg

SEQ ID NO: 1108150 - RNA, 18 nt, Human
cagaagcaaaacaaaagc

SEQ ID NO: 1108151 - RNA, 19 nt, Human
cagaagcaaaacaaaagca

SEQ ID NO: 1108152 - RNA, 21 nt, Human
cagaagcaaaacaaaagcagu

SEQ ID NO: 1108153 - RNA, 21 nt, Human
caggcgcccuccaccacaccc

SEQ ID NO: 1108154 - RNA, 24 nt, Human
caugcuggccaggcuggucucgaa

SEQ ID NO: 1108155 - RNA, 24 nt, Human
cauguuggccaggcuggucucaaa

SEQ ID NO: 1108156 - RNA, 21 nt, Human
cauuguaaccucugccuccca

SEQ ID NO: 1108157 - RNA, 22 nt, Human
ccaaagugcugggauuacaaac

SEQ ID NO: 1108158 - RNA, 24 nt, Human
ccaaagugcugggauuacaaacgu

SEQ ID NO: 1108159 - RNA, 22 nt, Human
ccaaagugcugggauuacaagc

SEQ ID NO: 1108160 - RNA, 24 nt, Human
ccaaagugcugggauuacaagcgu

SEQ ID NO: 1108161 - RNA, 21 nt, Human
ccaaccugacccuggaagaca

SEQ ID NO: 1108162 - RNA, 20 nt, Human
ccaccacacccggcuaauuu

SEQ ID NO: 1108163 - RNA, 19 nt, Human
ccaccgcgccuggccuucc

SEQ ID NO: 1108164 - RNA, 24 nt, Human
cccaaguaggugggacuacaggca

SEQ ID NO: 1108165 - RNA, 23 nt, Human
cccaggcuggagugcaauggagc

SEQ ID NO: 1108166 - RNA, 24 nt, Human
ccgccuccuggguucaagcgaucc

SEQ ID NO: 1108167 - RNA, 21 nt, Human
ccucccagguucaagugauuc

SEQ ID NO: 1108168 - RNA, 19 nt, Human
ccuccgccuccuggguuca

SEQ ID NO: 1108169 - RNA, 24 nt, Human
ccuccuggguucaagcgauccucc

SEQ ID NO: 1108170 - RNA, 24 nt, Human
ccuccugucucagcuuccugauua

SEQ ID NO: 1108171 - RNA, 19 nt, Human
ccugaccucaagugauccg

SEQ ID NO: 1108172 - RNA, 24 nt, Human
ccugaccucaagugauccgcccac

SEQ ID NO: 1108173 - RNA, 23 nt, Human
ccugaguagcugggauuauaggc

SEQ ID NO: 1108174 - RNA, 24 nt, Human
ccugaguagcugggauuauaggcg

SEQ ID NO: 1108175 - RNA, 23 nt, Human
ccugauuagcugggauuacaggc

SEQ ID NO: 1108176 - RNA, 23 nt, Human
ccugauuagcugggauuacaggc

SEQ ID NO: 1108177 - RNA, 23 nt, Human
ccugcggauggccaaccugaccc

SEQ ID NO: 1108178 - RNA, 23 nt, Human
ccuggccuuccuugcucuucuug

SEQ ID NO: 1108179 - RNA, 26 nt, Human
ccuggcgaauuuuuuuuuuuuuuuuu

SEQ ID NO: 1108180 - RNA, 20 nt, Human
ccuggguucaagcgauccuc

SEQ ID NO: 1108181 - RNA, 23 nt, Human
ccuggguucaagcgauccuccug

SEQ ID NO: 1108182 - RNA, 27 nt, Human
ccuugcucuucuugcuccaaauccugg

SEQ ID NO: 1108183 - RNA, 24 nt, Human
cgcacaccaccacaccuggcgaau

SEQ ID NO: 1108184 - RNA, 24 nt, Human
cgcccagacuggagugcaguggcg

SEQ ID NO: 1108185 - RNA, 25 nt, Human
cgcccaggcuggagugcaauggagc

SEQ ID NO: 1108186 - RNA, 18 nt, Human
cgcccuccaccacaccca

SEQ ID NO: 1108187 - RNA, 24 nt, Human
cgccuccuggguucaagcgauccu

SEQ ID NO: 1108188 - RNA, 22 nt, Human
cgccugccaggucaaacaauuc

SEQ ID NO: 1108189 - RNA, 19 nt, Human
cgccuuuacuucggagcuc

SEQ ID NO: 1108190 - RNA, 21 nt, Human
cgggcgccuuuacuucggagc

SEQ ID NO: 1108191 - RNA, 24 nt, Human
cgggcgccuuuacuucggagcucc

SEQ ID NO: 1108192 - RNA, 24 nt, Human
cgggguuucaccaugcuggccagg

SEQ ID NO: 1108193 - RNA, 24 nt, Human
cgguguuucaccauguuggccagg

SEQ ID NO: 1108194 - RNA, 22 nt, Human
cuacgccugcggauggccaacc

SEQ ID NO: 1108195 - RNA, 24 nt, Human
cucaagugauccgcccaccucagc

SEQ ID NO: 1108196 - RNA, 20 nt, Human
cucacucuaucgcccaggcc

SEQ ID NO: 1108197 - RNA, 24 nt, Human
cucacugcaaccuccgccuccugg

SEQ ID NO: 1108198 - RNA, 19 nt, Human
cucauuguaaccucugccu

SEQ ID NO: 1108199 - RNA, 25 nt, Human
cucauuguaaccucugccucccagg

SEQ ID NO: 1108200 - RNA, 18 nt, Human
cucccagguucaagugau

SEQ ID NO: 1108201 - RNA, 24 nt, Human
cuccugaccucgugauccgcccgc

SEQ ID NO: 1108202 - RNA, 20 nt, Human
cucugucgcccagacuggag

SEQ ID NO: 1108203 - RNA, 21 nt, Human
cugauuagcugggauuacagg

SEQ ID NO: 1108204 - RNA, 23 nt, Human
cugcaaccuccgccuccuggguu

SEQ ID NO: 1108205 - RNA, 24 nt, Human
cugcaaccuccgccuccuggguuc

SEQ ID NO: 1108206 - RNA, 23 nt, Human
cugcaaccuccgccugccagguc

SEQ ID NO: 1108207 - RNA, 18 nt, Human
cuguuggccuugcagcug

SEQ ID NO: 1108208 - RNA, 23 nt, Human
cuucuugcuccaaauccugggaa

SEQ ID NO: 1108209 - RNA, 20 nt, Human
cuuugcacagcuguuggccu

SEQ ID NO: 1108210 - RNA, 21 nt, Human
cuuuuguauuuuuaguagaga

SEQ ID NO: 1108211 - RNA, 19 nt, Human
gaagcaaaacaaaagcagu

SEQ ID NO: 1108212 - RNA, 18 nt, Human
gaauuuuuuuuuuuuuuu

SEQ ID NO: 1108213 - RNA, 22 nt, Human
gacccuggaagacagugggguu

SEQ ID NO: 1108214 - RNA, 24 nt, Human
gaccucaagugauccgcccaccuc

SEQ ID NO: 1108215 - RNA, 22 nt, Human
gaccucgugauccgcccgccuc

SEQ ID NO: 1108216 - RNA, 22 nt, Human
gaccucgugauccgcccgccuc

SEQ ID NO: 1108217 - RNA, 24 nt, Human
gaccucgugauccgcccgccucgg

SEQ ID NO: 1108218 - RNA, 24 nt, Human
gagacgggguuucaccaugcuggc

SEQ ID NO: 1108219 - RNA, 25 nt, Human
gaguagcugggauuauaggcgcaca

SEQ ID NO: 1108220 - RNA, 18 nt, Human
gauuacaaacgugagcca

SEQ ID NO: 1108221 - RNA, 18 nt, Human
gauuacaagcgugagcca

SEQ ID NO: 1108222 - RNA, 21 nt, Human
gcaaccuccgccugccagguc

SEQ ID NO: 1108223 - RNA, 23 nt, Human
gcacaccaccacaccuggcgaau

SEQ ID NO: 1108224 - RNA, 19 nt, Human
gcccaggcuggagugcaau

SEQ ID NO: 1108225 - RNA, 23 nt, Human
gccucggccucccaaagugcugg

SEQ ID NO: 1108226 - RNA, 21 nt, Human
gcggauggccaaccugacccu

SEQ ID NO: 1108227 - RNA, 25 nt, Human
gcucugucgcccagacuggagugca

SEQ ID NO: 1108228 - RNA, 20 nt, Human
gcucuucuugcuccaaaucc

SEQ ID NO: 1108229 - RNA, 23 nt, Human
gcuggucucaaacuccugaccuc

SEQ ID NO: 1108230 - RNA, 23 nt, Human
gcuggucucgaacuccugaccuc

SEQ ID NO: 1108231 - RNA, 19 nt, Human
ggacuacaggcaugugcca

SEQ ID NO: 1108232 - RNA, 19 nt, Human
ggauuacaagcgugagcca

SEQ ID NO: 1108233 - RNA, 19 nt, Human
ggcuggagugcaauggagc

SEQ ID NO: 1108234 - RNA, 24 nt, Human
ggcuggucucaaacuccugaccuc

SEQ ID NO: 1108235 - RNA, 24 nt, Human
ggcuggucucgaacuccugaccuc

SEQ ID NO: 1108236 - RNA, 18 nt, Human
ggcuuugcacagcuguug

SEQ ID NO: 1108237 - RNA, 23 nt, Human
gggguuucaccaugcuggccagg

SEQ ID NO: 1108238 - RNA, 19 nt, Human
ggucucgaacuccugaccu

SEQ ID NO: 1108239 - RNA, 23 nt, Human
gguguuucaccauguuggccagg

SEQ ID NO: 1108240 - RNA, 18 nt, Human
guagcugggauuauaggc

SEQ ID NO: 1108241 - RNA, 24 nt, Human
gugauccgcccaccucagcuuccc

SEQ ID NO: 1108242 - RNA, 24 nt, Human
gugauccgcccgccucggccuccc

SEQ ID NO: 1108243 - RNA, 22 nt, Human
gugccucugccuccugaguagc

SEQ ID NO: 1108244 - RNA, 23 nt, Human
gugccucugccuccugaguagcu

SEQ ID NO: 1108245 - RNA, 28 nt, Human
uaauuuucuuuuguauuuuuaguagaga

SEQ ID NO: 1108246 - RNA, 23 nt, Human
uaauuuuucuauuuuuaguggag

SEQ ID NO: 1108247 - RNA, 24 nt, Human
uaauuuuucuauuuuuaguggaga

SEQ ID NO: 1108248 - RNA, 22 nt, Human
uacaaacgugagccaccgcgcc

SEQ ID NO: 1108249 - RNA, 24 nt, Human
uacaagcgugagccaccacgccca

SEQ ID NO: 1108250 - RNA, 21 nt, Human
uacagaagcaaaacaaaagca

SEQ ID NO: 1108251 - RNA, 22 nt, Human
uacagaagcaaaacaaaagcag

SEQ ID NO: 1108252 - RNA, 23 nt, Human
uacaggcaugugccaccacaccc

SEQ ID NO: 1108253 - RNA, 22 nt, Human
uaggcaaacuuacagaagcaaa

SEQ ID NO: 1108254 - RNA, 21 nt, Human
uaggcgcacaccaccacaccu

SEQ ID NO: 1108255 - RNA, 24 nt, Human
uaguagagacgggguuucaccaug

SEQ ID NO: 1108256 - RNA, 26 nt, Human
uaguagagacgggguuucaccaugcu

SEQ ID NO: 1108257 - RNA, 24 nt, Human
uaguggagacgguguuucaccaug

SEQ ID NO: 1108258 - RNA, 19 nt, Human
uaucgcccaggcuggagug

SEQ ID NO: 1108259 - RNA, 20 nt, Human
uaucgcccaggcuggagugc

SEQ ID NO: 1108260 - RNA, 24 nt, Human
ucacucuaucgcccaggcuggagu

SEQ ID NO: 1108261 - RNA, 18 nt, Human
ucacugcaaccuccgccu

SEQ ID NO: 1108262 - RNA, 18 nt, Human
ucacugcaaccuccgccu

SEQ ID NO: 1108263 - RNA, 23 nt, Human
ucacugcaaccuccgccuccugg

SEQ ID NO: 1108264 - RNA, 24 nt, Human
ucacugcaaccuccgccuccuggg

SEQ ID NO: 1108265 - RNA, 25 nt, Human
ucacugcaaccuccgccuccugggu

SEQ ID NO: 1108266 - RNA, 27 nt, Human
ucacugcaaccuccgccuccuggguuc

SEQ ID NO: 1108267 - RNA, 19 nt, Human
ucacugcaaccuccgccug

SEQ ID NO: 1108268 - RNA, 24 nt, Human
ucacugcaaccuccgccugccagg

SEQ ID NO: 1108269 - RNA, 27 nt, Human
ucacugcaaccuccgccugccagguca

SEQ ID NO: 1108270 - RNA, 19 nt, Human
ucauuguaaccucugccuc

SEQ ID NO: 1108271 - RNA, 24 nt, Human
ucauuguaaccucugccucccagg

SEQ ID NO: 1108272 - RNA, 25 nt, Human
ucauuguaaccucugccucccaggu

SEQ ID NO: 1108273 - RNA, 18 nt, Human
ucccaaagugcugggauu

SEQ ID NO: 1108274 - RNA, 18 nt, Human
ucccaaagugcugggauu

SEQ ID NO: 1108275 - RNA, 24 nt, Human
ucccaaagugcugggauuacaaac

SEQ ID NO: 1108276 - RNA, 24 nt, Human
ucccaaagugcugggauuacaagc

SEQ ID NO: 1108277 - RNA, 24 nt, Human
ucccaaguaggugggacuacaggc

SEQ ID NO: 1108278 - RNA, 19 nt, Human
ucccagguucaagugauuc

SEQ ID NO: 1108279 - RNA, 22 nt, Human
ucccagguucaagugauucaag

SEQ ID NO: 1108280 - RNA, 21 nt, Human
uccgcccaccucagcuuccca

SEQ ID NO: 1108281 - RNA, 24 nt, Human
uccugaguagcugggauuauaggc

SEQ ID NO: 1108282 - RNA, 24 nt, Human
uccugauuagcugggauuacaggc

SEQ ID NO: 1108283 - RNA, 21 nt, Human
uccuggguucaagcgauccuc

SEQ ID NO: 1108284 - RNA, 24 nt, Human
uccuggguucaagcgauccuccug

SEQ ID NO: 1108285 - RNA, 24 nt, Human
ucgcccagacuggagugcaguggc

SEQ ID NO: 1108286 - RNA, 18 nt, Human
ucgcccaggcuggagugc

SEQ ID NO: 1108287 - RNA, 18 nt, Human
ucggccucccaaagugcu

SEQ ID NO: 1108288 - RNA, 24 nt, Human
ucuaucgcccaggcuggagugcaa

SEQ ID NO: 1108289 - RNA, 22 nt, Human
ucucacucuaucgcccaggcug

SEQ ID NO: 1108290 - RNA, 23 nt, Human
ucucacucuaucgcccaggcugg

SEQ ID NO: 1108291 - RNA, 24 nt, Human
ucucacucuaucgcccaggcugga

SEQ ID NO: 1108292 - RNA, 26 nt, Human
ucucacucuaucgcccaggcuggagu

SEQ ID NO: 1108293 - RNA, 27 nt, Human
ucucacucuaucgcccaggcuggagug

SEQ ID NO: 1108294 - RNA, 19 nt, Human
ucuccugccucagccuccc

SEQ ID NO: 1108295 - RNA, 19 nt, Human
ucucgaacuccugaccucg

SEQ ID NO: 1108296 - RNA, 22 nt, Human
ucucgcucugucgcccagacug

SEQ ID NO: 1108297 - RNA, 24 nt, Human
ucucgcucugucgcccagacugga

SEQ ID NO: 1108298 - RNA, 26 nt, Human
ucucgcucugucgcccagacuggagu

SEQ ID NO: 1108299 - RNA, 27 nt, Human
ucucgcucugucgcccagacuggagug

SEQ ID NO: 1108300 - RNA, 21 nt, Human
ucuucuugcuccaaauccugg

SEQ ID NO: 1108301 - RNA, 21 nt, Human
ucuuuuguauuuuuaguagag

SEQ ID NO: 1108302 - RNA, 23 nt, Human
ucuuuuguauuuuuaguagagac

SEQ ID NO: 1108303 - RNA, 24 nt, Human
ucuuuuguauuuuuaguagagacg

SEQ ID NO: 1108304 - RNA, 18 nt, Human
ugaacaaagacugagugu

SEQ ID NO: 1108305 - RNA, 21 nt, Human
ugaccauugaacaaagacuga

SEQ ID NO: 1108306 - RNA, 18 nt, Human
ugaccucaagugauccgc

SEQ ID NO: 1108307 - RNA, 18 nt, Human
ugagacagagucucgcuc

SEQ ID NO: 1108308 - RNA, 22 nt, Human
ugagacagagucucgcucuguc

SEQ ID NO: 1108309 - RNA, 21 nt, Human
ugagucucacucuaucgccca

SEQ ID NO: 1108310 - RNA, 23 nt, Human
ugauccgcccaccucagcuuccc

SEQ ID NO: 1108311 - RNA, 23 nt, Human
ugcaauggagcaaucucggcuca

SEQ ID NO: 1108312 - RNA, 22 nt, Human
ugcaguggcgcaaucucggcuc

SEQ ID NO: 1108313 - RNA, 23 nt, Human
ugcaguggcgcaaucucggcuca

SEQ ID NO: 1108314 - RNA, 23 nt, Human
ugccaggucaaacaauucuccug

SEQ ID NO: 1108315 - RNA, 24 nt, Human
ugccucagccucccaaguaggugg

SEQ ID NO: 1108316 - RNA, 24 nt, Human
ugccucugccuccugaguagcugg

SEQ ID NO: 1108317 - RNA, 18 nt, Human
ugcuccaaauccugggaa

SEQ ID NO: 1108318 - RNA, 20 nt, Human
ugcugcuggacgagcguccg

SEQ ID NO: 1108319 - RNA, 18 nt, Human
ugcuggccaggcuggucu

SEQ ID NO: 1108320 - RNA, 24 nt, Human
ugcugggauuacaaacgugagcca

SEQ ID NO: 1108321 - RNA, 26 nt, Human
ugcugggauuacaagcgugagccacc

SEQ ID NO: 1108322 - RNA, 23 nt, Human
uggagugcaauggagcaaucucg

SEQ ID NO: 1108323 - RNA, 24 nt, Human
uggagugcaauggagcaaucucgg

SEQ ID NO: 1108324 - RNA, 23 nt, Human
uggagugcaguggcgcaaucucg

SEQ ID NO: 1108325 - RNA, 24 nt, Human
uggagugcaguggcgcaaucucgg

SEQ ID NO: 1108326 - RNA, 23 nt, Human
uggcaaacagucauauuuaaugg

SEQ ID NO: 1108327 - RNA, 24 nt, Human
uggccaggcuggucucaaacuccu

SEQ ID NO: 1108328 - RNA, 24 nt, Human
uggccaggcuggucucgaacuccu

SEQ ID NO: 1108329 - RNA, 24 nt, Human
uggcgaauuuuuuuuuuuuuuuuu

SEQ ID NO: 1108330 - RNA, 18 nt, Human
ugggacuacaggcaugug

SEQ ID NO: 1108331 - RNA, 21 nt, Human
ugggacuacaggcaugugcca

SEQ ID NO: 1108332 - RNA, 22 nt, Human
ugggacuacaggcaugugccac

SEQ ID NO: 1108333 - RNA, 24 nt, Human
ugggacuacaggcaugugccacca

SEQ ID NO: 1108334 - RNA, 21 nt, Human
ugggauuacaaacgugagcca

SEQ ID NO: 1108335 - RNA, 22 nt, Human
ugggauuacaaacgugagccac

SEQ ID NO: 1108336 - RNA, 23 nt, Human
ugggauuacaaacgugagccacc

SEQ ID NO: 1108337 - RNA, 24 nt, Human
ugggauuacaaacgugagccaccg

SEQ ID NO: 1108338 - RNA, 18 nt, Human
ugggauuacaagcgugag

SEQ ID NO: 1108339 - RNA, 19 nt, Human
ugggauuacaagcgugagc

SEQ ID NO: 1108340 - RNA, 22 nt, Human
ugggauuacaagcgugagccac

SEQ ID NO: 1108341 - RNA, 23 nt, Human
ugggauuacaagcgugagccacc

SEQ ID NO: 1108342 - RNA, 24 nt, Human
ugggauuacaagcgugagccacca

SEQ ID NO: 1108343 - RNA, 22 nt, Human
ugggauuacaggcgcccuccac

SEQ ID NO: 1108344 - RNA, 24 nt, Human
ugggauuacaggcgcccuccacca

SEQ ID NO: 1108345 - RNA, 21 nt, Human
ugggauuauaggcgcacacca

SEQ ID NO: 1108346 - RNA, 24 nt, Human
ugggauuauaggcgcacaccacca

SEQ ID NO: 1108347 - RNA, 23 nt, Human
uggguucaagcgauccuccuguc

SEQ ID NO: 1108348 - RNA, 24 nt, Human
uggguucaagcgauccuccugucu

SEQ ID NO: 1108349 - RNA, 23 nt, Human
uguaaccucugccucccagguuc

SEQ ID NO: 1108350 - RNA, 21 nt, Human
uguauuuuuaguagagacggg

SEQ ID NO: 1108351 - RNA, 21 nt, Human
ugucgcccagacuggagugca

SEQ ID NO: 1108352 - RNA, 24 nt, Human
ugucucagcuuccugauuagcugg

SEQ ID NO: 1108353 - RNA, 22 nt, Human
uguggcuuugcacagcuguugg

SEQ ID NO: 1108354 - RNA, 22 nt, Human
uuagauguacaccggcucagug

SEQ ID NO: 1108355 - RNA, 18 nt, Human
uuaguagagacgggguuu

SEQ ID NO: 1108356 - RNA, 22 nt, Human
uuaguagagacgggguuucacc

SEQ ID NO: 1108357 - RNA, 24 nt, Human
uuaguagagacgggguuucaccau

SEQ ID NO: 1108358 - RNA, 24 nt, Human
uuaguggagacgguguuucaccau

SEQ ID NO: 1108359 - RNA, 24 nt, Human
uucaagccauucuugugccucugc

SEQ ID NO: 1108360 - RNA, 24 nt, Human
uuguaaccucugccucccagguuc

SEQ ID NO: 1108361 - RNA, 23 nt, Human
uuguauuuuuaguagagacgggg

SEQ ID NO: 1108362 - RNA, 21 nt, Human
uuucaccaugcuggccaggcu

SEQ ID NO: 1108363 - RNA, 24 nt, Human
uuucaccauguuggccaggcuggu

SEQ ID NO: 1108364 - RNA, 25 nt, Human
uuucuauuuuuaguggagacggugu

SEQ ID NO: 1108365 - RNA, 19 nt, Human
uuugcacagcuguuggccu

SEQ ID NO: 1108366 - RNA, 24 nt, Human
uuuuuaguagagacgggguuucac

SEQ ID NO: 1108367 - RNA, 24 nt, Human
uuuuuaguggagacgguguuucac

SEQ ID NO: 1108368 - RNA, 25 nt, Human
uuuuuuuuuucugagacagagucuc

SEQ ID NO: 1108369 - RNA, 27 nt, Human
uuuuuuuuuuuuugaggcugagucuca

SEQ ID NO: 1108370 - RNA, 18 nt, Human
uuuuuuuuuuuuuuuuug

SEQ ID NO: 1108371 - RNA, 23 nt, Human
uuuuuuuuuuuuuuuuuuugagg

SEQ ID NO: 1108372 - RNA, 18 nt, Human
aggaaagagaaagugacu

SEQ ID NO: 1108373 - RNA, 19 nt, Human
acccgaaagcccagcaccg

SEQ ID NO: 1108374 - RNA, 20 nt, Human
cccgaaagcccagcaccgug

SEQ ID NO: 1108375 - RNA, 22 nt, Human
cuucucaugggagagcuggaga

SEQ ID NO: 1108376 - RNA, 18 nt, Human
gaacccgaaagcccagca

SEQ ID NO: 1108377 - RNA, 19 nt, Human
gugaacccgaaagcccagc

SEQ ID NO: 1108378 - RNA, 21 nt, Human
uauccugugcucuuuauuugg

SEQ ID NO: 1108379 - RNA, 18 nt, Human
ucauauccugugcucuuu

SEQ ID NO: 1108380 - RNA, 18 nt, Human
ucccugaaagcagaagag

SEQ ID NO: 1108381 - RNA, 19 nt, Human
aaaaaagagagagagaaga

SEQ ID NO: 1108382 - RNA, 18 nt, Human
aaguggcucugaggaaac

SEQ ID NO: 1108383 - RNA, 19 nt, Human
acacgguggagucgccagg

SEQ ID NO: 1108384 - RNA, 20 nt, Human
agaaagacccgaacacggug

SEQ ID NO: 1108385 - RNA, 21 nt, Human
aggaaacaggcgccagcgacc

SEQ ID NO: 1108386 - RNA, 22 nt, Human
agguuuuuccacauucuucaca

SEQ ID NO: 1108387 - RNA, 19 nt, Human
aucaaaaaaaaaaaaagag

SEQ ID NO: 1108388 - RNA, 21 nt, Human
auugauaguguuacuuucucc

SEQ ID NO: 1108389 - RNA, 20 nt, Human
caaucgaacgcgaacggcaa

SEQ ID NO: 1108390 - RNA, 23 nt, Human
cacaaaggaaaaaguggcucuga

SEQ ID NO: 1108391 - RNA, 22 nt, Human
cagacaacacaaaggaaaaagu

SEQ ID NO: 1108392 - RNA, 21 nt, Human
cagagugagacucaucaaaaa

SEQ ID NO: 1108393 - RNA, 20 nt, Human
cagucgccaggcuggagugc

SEQ ID NO: 1108394 - RNA, 20 nt, Human
caugaaggcagauuggguuc

SEQ ID NO: 1108395 - RNA, 18 nt, Human
ccacauucuucacaucca

SEQ ID NO: 1108396 - RNA, 22 nt, Human
cgaccagacaacacaaaggaaa

SEQ ID NO: 1108397 - RNA, 24 nt, Human
cgcgaacggcaaaauucuuuuccc

SEQ ID NO: 1108398 - RNA, 18 nt, Human
cggcaaaauucuuuuccc

SEQ ID NO: 1108399 - RNA, 19 nt, Human
cucaucaaaaaaaaaaaaa

SEQ ID NO: 1108400 - RNA, 24 nt, Human
cucgcucagucgccaggcuggagu

SEQ ID NO: 1108401 - RNA, 19 nt, Human
cucugaggaaacaggcgcc

SEQ ID NO: 1108402 - RNA, 21 nt, Human
gaacggcaaaauucuuuuccc

SEQ ID NO: 1108403 - RNA, 20 nt, Human
gagucucgcucagucgccag

SEQ ID NO: 1108404 - RNA, 22 nt, Human
gcaaaauucuuuucccucaaag

SEQ ID NO: 1108405 - RNA, 18 nt, Human
gcaaagguuuuuccacau

SEQ ID NO: 1108406 - RNA, 19 nt, Human
gcuacaggaucuuggggac

SEQ ID NO: 1108407 - RNA, 21 nt, Human
gggcuacaggaucuuggggac

SEQ ID NO: 1108408 - RNA, 20 nt, Human
gucuuuucuucaugaaggca

SEQ ID NO: 1108409 - RNA, 21 nt, Human
guuacuuucuccugugaauuu

SEQ ID NO: 1108410 - RNA, 19 nt, Human
uacaggguuucucuacagu

SEQ ID NO: 1108411 - RNA, 21 nt, Human
uagaaagacccgaacacggug

SEQ ID NO: 1108412 - RNA, 21 nt, Human
uaucuagaaagauucaacugu

SEQ ID NO: 1108413 - RNA, 21 nt, Human
ucaacuguucaggcuuucuca

SEQ ID NO: 1108414 - RNA, 19 nt, Human
ucacauccacagggcuucu

SEQ ID NO: 1108415 - RNA, 23 nt, Human
ucagucgccaggcuggagugcag

SEQ ID NO: 1108416 - RNA, 20 nt, Human
ucaucaaaaaaaaaaaaaga

SEQ ID NO: 1108417 - RNA, 23 nt, Human
ucaucaaaaaaaaaaaaagagag

SEQ ID NO: 1108418 - RNA, 23 nt, Human
ucucgcucagucgccaggcugga

SEQ ID NO: 1108419 - RNA, 19 nt, Human
ucugccucugucuuuucuu

SEQ ID NO: 1108420 - RNA, 19 nt, Human
ugaaggcagauuggguucc

SEQ ID NO: 1108421 - RNA, 19 nt, Human
ugaaggcagauuggguucc

SEQ ID NO: 1108422 - RNA, 23 nt, Human
ugaggaaacagcaaagguuuuuc

SEQ ID NO: 1108423 - RNA, 21 nt, Human
ugcagagugagacucaucaaa

SEQ ID NO: 1108424 - RNA, 21 nt, Human
uggagucgccagguccguggg

SEQ ID NO: 1108425 - RNA, 21 nt, Human
uguacauaucuagaaagauuc

SEQ ID NO: 1108426 - RNA, 24 nt, Human
uuaggcuugaggaaacagcaaagg

SEQ ID NO: 1108427 - RNA, 18 nt, Human
uuccuagaaagacccgaa

SEQ ID NO: 1108428 - RNA, 18 nt, Human
cagagaacgaggcugaag

SEQ ID NO: 1108429 - RNA, 19 nt, Human
cccgacacgccgcgaucca

SEQ ID NO: 1108430 - RNA, 20 nt, Human
cccgacacgccgcgauccac

SEQ ID NO: 1108431 - RNA, 23 nt, Human
cgaauggcagagaugcucuuccu

SEQ ID NO: 1108432 - RNA, 20 nt, Human
cgcgauccacagaucagcuc

SEQ ID NO: 1108433 - RNA, 19 nt, Human
aaccccagcuucaggaauc

SEQ ID NO: 1108434 - RNA, 21 nt, Human
acccagagccccacccccacc

SEQ ID NO: 1108435 - RNA, 23 nt, Human
acccagagccccacccccacccc

SEQ ID NO: 1108436 - RNA, 24 nt, Human
acccagagccccacccccaccccc

SEQ ID NO: 1108437 - RNA, 28 nt, Human
acccccacccccagccugcuuuugccac

SEQ ID NO: 1108438 - RNA, 21 nt, Human
aggaaucuucugacccagagc

SEQ ID NO: 1108439 - RNA, 22 nt, Human
aggcugcacccuggggagggag

SEQ ID NO: 1108440 - RNA, 21 nt, Human
cacccccagccugcuuuugcc

SEQ ID NO: 1108441 - RNA, 21 nt, Human
cacccuggggagggaguccca

SEQ ID NO: 1108442 - RNA, 18 nt, Human
cacugccccccuccaccc

SEQ ID NO: 1108443 - RNA, 21 nt, Human
cagagccccacccccaccccc

SEQ ID NO: 1108444 - RNA, 21 nt, Human
ccaccaccaaccccagcuuca

SEQ ID NO: 1108445 - RNA, 21 nt, Human
ccagggccugaaccuugaggc

SEQ ID NO: 1108446 - RNA, 21 nt, Human
cccagagccccacccccaccc

SEQ ID NO: 1108447 - RNA, 20 nt, Human
ccccacccccacccccagcc

SEQ ID NO: 1108448 - RNA, 24 nt, Human
ccccagccugcuuuugccaccaaa

SEQ ID NO: 1108449 - RNA, 18 nt, Human
ccccccuccacccaccac

SEQ ID NO: 1108450 - RNA, 23 nt, Human
ccccccuccacccaccaccaacc

SEQ ID NO: 1108451 - RNA, 24 nt, Human
ccccccuccacccaccaccaaccc

SEQ ID NO: 1108452 - RNA, 24 nt, Human
cccuccacccaccaccaaccccag

SEQ ID NO: 1108453 - RNA, 19 nt, Human
ccuccacccaccaccaacc

SEQ ID NO: 1108454 - RNA, 20 nt, Human
ccuccugucccauuucugcc

SEQ ID NO: 1108455 - RNA, 23 nt, Human
cuccacccaccaccaaccccagc

SEQ ID NO: 1108456 - RNA, 23 nt, Human
cugcacccuggggagggaguccc

SEQ ID NO: 1108457 - RNA, 18 nt, Human
cugccuaggcugugucgu

SEQ ID NO: 1108458 - RNA, 18 nt, Human
gacccagagccccacccc

SEQ ID NO: 1108459 - RNA, 19 nt, Human
gagccccacccccaccccc

SEQ ID NO: 1108460 - RNA, 26 nt, Human
ggccugaaccuugaggccucgagggc

SEQ ID NO: 1108461 - RNA, 21 nt, Human
gggccugaaccuugaggccuc

SEQ ID NO: 1108462 - RNA, 19 nt, Human
uccacccaccaccaacccc

SEQ ID NO: 1108463 - RNA, 24 nt, Human
uccacccaccaccaaccccagcuu

SEQ ID NO: 1108464 - RNA, 19 nt, Human
ucgagggcucuuuggggcc

SEQ ID NO: 1108465 - RNA, 19 nt, Human
ugacccagagccccacccc

SEQ ID NO: 1108466 - RNA, 20 nt, Human
ugacccagagccccaccccc

SEQ ID NO: 1108467 - RNA, 25 nt, Human
ugacccagagccccacccccacccc

SEQ ID NO: 1108468 - RNA, 21 nt, Human
ugacccagcacugccccccuc

SEQ ID NO: 1108469 - RNA, 23 nt, Human
ugccaccaaaaacugccccaggg

SEQ ID NO: 1108470 - RNA, 24 nt, Human
ugccuaggcugugucguccagcuc

SEQ ID NO: 1108471 - RNA, 20 nt, Human
ugucucaggcugcacccugg

SEQ ID NO: 1108472 - RNA, 23 nt, Human
ugucucaggcugcacccugggga

SEQ ID NO: 1108473 - RNA, 21 nt, Human
uugucucaggcugcacccugg

SEQ ID NO: 1108474 - RNA, 23 nt, Human
aggauccuuucucccaaaccaag

SEQ ID NO: 1108475 - RNA, 22 nt, Human
cccauuuuaggauccuuucucc

SEQ ID NO: 1108476 - RNA, 22 nt, Human
cucuggauguaacacggaccuc

SEQ ID NO: 1108477 - RNA, 21 nt, Human
uaaaaugaaucaacaugggca

SEQ ID NO: 1108478 - RNA, 21 nt, Human
uagagaguagggcuugguguc

SEQ ID NO: 1108479 - RNA, 22 nt, Human
aaagggaccgaaagcccaagac

SEQ ID NO: 1108480 - RNA, 23 nt, Human
aagggaccgaaagcccaagacug

SEQ ID NO: 1108481 - RNA, 22 nt, Human
agaguuccuccugcugacccca

SEQ ID NO: 1108482 - RNA, 25 nt, Human
agaguuccuccugcugaccccacuc

SEQ ID NO: 1108483 - RNA, 26 nt, Human
agggaccgaaagcccaagacugagcu

SEQ ID NO: 1108484 - RNA, 22 nt, Human
gaugggcauuaaaagaaaggga

SEQ ID NO: 1108485 - RNA, 20 nt, Human
gggaagggaaaagugugaca

SEQ ID NO: 1108486 - RNA, 18 nt, Human
gggcauuaaaagaaaggg

SEQ ID NO: 1108487 - RNA, 20 nt, Human
guagaguuccuccugcugac

SEQ ID NO: 1108488 - RNA, 24 nt, Human
ugggcauuaaaagaaagggaccga

SEQ ID NO: 1108489 - RNA, 19 nt, Human
uguagaguuccuccugcug

SEQ ID NO: 1108490 - RNA, 22 nt, Human
aaacugacgccccucuucccug

SEQ ID NO: 1108491 - RNA, 23 nt, Human
aaagacacagacuggcaaagaca

SEQ ID NO: 1108492 - RNA, 19 nt, Human
aacggguggagcaggccca

SEQ ID NO: 1108493 - RNA, 18 nt, Human
aagcaaaggucuaguagc

SEQ ID NO: 1108494 - RNA, 22 nt, Human
aagcauggcgcggggaggaggg

SEQ ID NO: 1108495 - RNA, 25 nt, Human
aaugaaguacaauugcaaauuuagc

SEQ ID NO: 1108496 - RNA, 23 nt, Human
acagcagaaggcaaagacacaga

SEQ ID NO: 1108497 - RNA, 21 nt, Human
acagugccaggacagccccac

SEQ ID NO: 1108498 - RNA, 25 nt, Human
acagugccaggacagccccaccucc

SEQ ID NO: 1108499 - RNA, 20 nt, Human
acccgccucaucuccuggcc

SEQ ID NO: 1108500 - RNA, 21 nt, Human
acugcagagacccccgccccc

SEQ ID NO: 1108501 - RNA, 19 nt, Human
agagggcagugacccggga

SEQ ID NO: 1108502 - RNA, 24 nt, Human
agaggugggcccagauugacgacu

SEQ ID NO: 1108503 - RNA, 21 nt, Human
agaugggagcccaggggcagu

SEQ ID NO: 1108504 - RNA, 22 nt, Human
agccuuggcugggacccugcca

SEQ ID NO: 1108505 - RNA, 19 nt, Human
aggcaggggagaggugggc

SEQ ID NO: 1108506 - RNA, 21 nt, Human
agggaauggggaaaggggagc

SEQ ID NO: 1108507 - RNA, 18 nt, Human
agggcagggcuugagcug

SEQ ID NO: 1108508 - RNA, 21 nt, Human
agggggugcggccuggggggu

SEQ ID NO: 1108509 - RNA, 22 nt, Human
auugcaaauuuagccucugacu

SEQ ID NO: 1108510 - RNA, 23 nt, Human
caaaaaccagcagcgccuugcaa

SEQ ID NO: 1108511 - RNA, 23 nt, Human
caaagacacagacuggcaaagac

SEQ ID NO: 1108512 - RNA, 21 nt, Human
caaaggucuaguagccugaaa

SEQ ID NO: 1108513 - RNA, 24 nt, Human
caagcccacgccaccccaagcauc

SEQ ID NO: 1108514 - RNA, 18 nt, Human
caccccagagggcagggc

SEQ ID NO: 1108515 - RNA, 24 nt, Human
cagaaggcaaagacacagacuggc

SEQ ID NO: 1108516 - RNA, 23 nt, Human
cagacgccuuccgcggaugcccc

SEQ ID NO: 1108517 - RNA, 23 nt, Human
cagcgucucugguuacgccuccc

SEQ ID NO: 1108518 - RNA, 18 nt, Human
cagcuccugggucuuccc

SEQ ID NO: 1108519 - RNA, 18 nt, Human
cagcuggaaucaaccgau

SEQ ID NO: 1108520 - RNA, 19 nt, Human
caggugggcagucucaggc

SEQ ID NO: 1108521 - RNA, 24 nt, Human
cauccacucaggugggcagucuca

SEQ ID NO: 1108522 - RNA, 20 nt, Human
caucgcacagugccaggaca

SEQ ID NO: 1108523 - RNA, 23 nt, Human
caucgcacagugccaggacagcc

SEQ ID NO: 1108524 - RNA, 28 nt, Human
ccacuaaucccagcgucucugguuacgc

SEQ ID NO: 1108525 - RNA, 24 nt, Human
ccagcgucucugguuacgccuccc

SEQ ID NO: 1108526 - RNA, 20 nt, Human
ccaggacucuucugaaacgu

SEQ ID NO: 1108527 - RNA, 18 nt, Human
cccaagcaucccaggacu

SEQ ID NO: 1108528 - RNA, 24 nt, Human
cccacagacacauugacucaggcc

SEQ ID NO: 1108529 - RNA, 25 nt, Human
cccacagacacauugacucaggccc

SEQ ID NO: 1108530 - RNA, 19 nt, Human
cccacgccaccccaagcau

SEQ ID NO: 1108531 - RNA, 22 nt, Human
cccaggacuccgggcuaccaga

SEQ ID NO: 1108532 - RNA, 23 nt, Human
cccaggacucuucugaaacgugg

SEQ ID NO: 1108533 - RNA, 18 nt, Human
ccccagcaucccggcggc

SEQ ID NO: 1108534 - RNA, 19 nt, Human
cccccgcccccgaccccgc

SEQ ID NO: 1108535 - RNA, 22 nt, Human
ccccgccaccccagagggcagg

SEQ ID NO: 1108536 - RNA, 19 nt, Human
ccccucuucccugcuuccu

SEQ ID NO: 1108537 - RNA, 24 nt, Human
ccccugggugagucuggguuuccg

SEQ ID NO: 1108538 - RNA, 20 nt, Human
cccgcccccgaccccgcuua

SEQ ID NO: 1108539 - RNA, 22 nt, Human
cccggcggcgcaggcgcagagg

SEQ ID NO: 1108540 - RNA, 24 nt, Human
cccucuucccugcuuccuuccucc

SEQ ID NO: 1108541 - RNA, 25 nt, Human
ccggcagauggguacacccccuucu

SEQ ID NO: 1108542 - RNA, 21 nt, Human
ccggggugggguuggacaggc

SEQ ID NO: 1108543 - RNA, 23 nt, Human
ccucccagcuccugggucuuccc

SEQ ID NO: 1108544 - RNA, 18 nt, Human
ccucccggcuucucuccc

SEQ ID NO: 1108545 - RNA, 19 nt, Human
ccucgccccuggcagcugg

SEQ ID NO: 1108546 - RNA, 24 nt, Human
ccucuagacugaagagaugggagc

SEQ ID NO: 1108547 - RNA, 22 nt, Human
cgagccagagaaaacugacgcc

SEQ ID NO: 1108548 - RNA, 22 nt, Human
cgccccuggcagcuggagacgc

SEQ ID NO: 1108549 - RNA, 18 nt, Human
cgcggaguggaccccggc

SEQ ID NO: 1108550 - RNA, 25 nt, Human
cggcaguacucccgugccucccagc

SEQ ID NO: 1108551 - RNA, 24 nt, Human
cggccuggggggugggguggucag

SEQ ID NO: 1108552 - RNA, 21 nt, Human
cggggacccgccucaucuccu

SEQ ID NO: 1108553 - RNA, 19 nt, Human
cuaggucuguaggugcugg

SEQ ID NO: 1108554 - RNA, 23 nt, Human
cucaggcccugcucccacugcug

SEQ ID NO: 1108555 - RNA, 18 nt, Human
cuccccagcaucccggcc

SEQ ID NO: 1108556 - RNA, 25 nt, Human
cucggccugcagccuucucugcugc

SEQ ID NO: 1108557 - RNA, 18 nt, Human
cucugugccauagagccc

SEQ ID NO: 1108558 - RNA, 21 nt, Human
cugcaggcugcugacaguggg

SEQ ID NO: 1108559 - RNA, 19 nt, Human
cuggaaucaaccgauggag

SEQ ID NO: 1108560 - RNA, 23 nt, Human
cuggaccuacagcagaaggcaaa

SEQ ID NO: 1108561 - RNA, 22 nt, Human
cuucccccgccaccccagaggg

SEQ ID NO: 1108562 - RNA, 23 nt, Human
cuucccugcuuccuuccuccagg

SEQ ID NO: 1108563 - RNA, 25 nt, Human
cuucccugcuuccuuccuccaggga

SEQ ID NO: 1108564 - RNA, 19 nt, Human
gacacauugacucaggccc

SEQ ID NO: 1108565 - RNA, 19 nt, Human
gacgccccucuucccugcu

SEQ ID NO: 1108566 - RNA, 18 nt, Human
gacuugcacggguuccuu

SEQ ID NO: 1108567 - RNA, 19 nt, Human
gagggcagggcuugagcug

SEQ ID NO: 1108568 - RNA, 20 nt, Human
gcaggcugcugacagugggu

SEQ ID NO: 1108569 - RNA, 19 nt, Human
gcagggcuugaggcagggg

SEQ ID NO: 1108570 - RNA, 18 nt, Human
gccaccccaagcauccca

SEQ ID NO: 1108571 - RNA, 21 nt, Human
gccccucuagccucgccccug

SEQ ID NO: 1108572 - RNA, 24 nt, Human
gccccuggcagcuggagacgcuuc

SEQ ID NO: 1108573 - RNA, 18 nt, Human
gcccugcucccacugcug

SEQ ID NO: 1108574 - RNA, 23 nt, Human
gcccuggacugcagagacccccg

SEQ ID NO: 1108575 - RNA, 18 nt, Human
gccuuccgcggaugcccc

SEQ ID NO: 1108576 - RNA, 22 nt, Human
gcgccuugcaagcccacgccac

SEQ ID NO: 1108577 - RNA, 20 nt, Human
gcggccucagucggccuucc

SEQ ID NO: 1108578 - RNA, 18 nt, Human
gcucccacugcugugcuc

SEQ ID NO: 1108579 - RNA, 21 nt, Human
gcugggacccugccacaucca

SEQ ID NO: 1108580 - RNA, 21 nt, Human
gcuugagcugggggcagggcu

SEQ ID NO: 1108581 - RNA, 21 nt, Human
ggaggggugggagggucggga

SEQ ID NO: 1108582 - RNA, 23 nt, Human
ggagguugggagccacuuucagg

SEQ ID NO: 1108583 - RNA, 25 nt, Human
ggaguagggggugcggccugggggg

SEQ ID NO: 1108584 - RNA, 18 nt, Human
ggcaggcuugcgucggga

SEQ ID NO: 1108585 - RNA, 19 nt, Human
ggccuacaucgcacagugc

SEQ ID NO: 1108586 - RNA, 19 nt, Human
ggccugggggguggggugg

SEQ ID NO: 1108587 - RNA, 20 nt, Human
ggcgcggggaggaggggugg

SEQ ID NO: 1108588 - RNA, 21 nt, Human
ggcggccucagucggccuucc

SEQ ID NO: 1108589 - RNA, 21 nt, Human
ggcggggagacugggugggga

SEQ ID NO: 1108590 - RNA, 23 nt, Human
ggcuugaggcaggggagaggugg

SEQ ID NO: 1108591 - RNA, 22 nt, Human
gggagggucgggagggacugcg

SEQ ID NO: 1108592 - RNA, 24 nt, Human
gggaggguguugaauaaaagggaa

SEQ ID NO: 1108593 - RNA, 21 nt, Human
gggcagggcuugagcuggggg

SEQ ID NO: 1108594 - RNA, 21 nt, Human
gggcagggcuugaggcagggg

SEQ ID NO: 1108595 - RNA, 22 nt, Human
gggcagggcuugaggcagggga

SEQ ID NO: 1108596 - RNA, 21 nt, Human
ggggaggaggggugggagggu

SEQ ID NO: 1108597 - RNA, 20 nt, Human
ggggcggggagacugggugg

SEQ ID NO: 1108598 - RNA, 20 nt, Human
ggggggugggguggucaggc

SEQ ID NO: 1108599 - RNA, 22 nt, Human
ggggugggagggucgggaggga

SEQ ID NO: 1108600 - RNA, 18 nt, Human
gggguuggacaggcgggc

SEQ ID NO: 1108601 - RNA, 20 nt, Human
ggugggagggucgggaggga

SEQ ID NO: 1108602 - RNA, 20 nt, Human
guagacaucacacacaugca

SEQ ID NO: 1108603 - RNA, 24 nt, Human
gucccgcagcgccccucuagccuc

SEQ ID NO: 1108604 - RNA, 21 nt, Human
gugcccacucccggaccccac

SEQ ID NO: 1108605 - RNA, 22 nt, Human
guggaccccggcugcggccccu

SEQ ID NO: 1108606 - RNA, 21 nt, Human
uaaauccccggcaaaaaccag

SEQ ID NO: 1108607 - RNA, 19 nt, Human
uacgcguaggcgaagggag

SEQ ID NO: 1108608 - RNA, 24 nt, Human
uacucccgugccucccagcuccug

SEQ ID NO: 1108609 - RNA, 19 nt, Human
uacuuccugucuugccuua

SEQ ID NO: 1108610 - RNA, 18 nt, Human
uagagcccccauaacuuc

SEQ ID NO: 1108611 - RNA, 23 nt, Human
uagccucugacuugcaccauccu

SEQ ID NO: 1108612 - RNA, 25 nt, Human
uaggcccuggacugcagagaccccc

SEQ ID NO: 1108613 - RNA, 19 nt, Human
uaggugcccacucccggac

SEQ ID NO: 1108614 - RNA, 19 nt, Human
uauccagguucagggguca

SEQ ID NO: 1108615 - RNA, 20 nt, Human
ucacacacaugcauccacuc

SEQ ID NO: 1108616 - RNA, 19 nt, Human
ucagcccuggcucuagguc

SEQ ID NO: 1108617 - RNA, 22 nt, Human
ucaggugggcagucucaggccc

SEQ ID NO: 1108618 - RNA, 22 nt, Human
ucccaggacuccgggcuaccag

SEQ ID NO: 1108619 - RNA, 21 nt, Human
uccccagcaucccggcggcgc

SEQ ID NO: 1108620 - RNA, 27 nt, Human
ucccggaccccacgguuugcgggcccc

SEQ ID NO: 1108621 - RNA, 22 nt, Human
ucccggagucccagugaugcuc

SEQ ID NO: 1108622 - RNA, 22 nt, Human
ucuagacugaagagaugggagc

SEQ ID NO: 1108623 - RNA, 19 nt, Human
ucuaguagccugaaaaaac

SEQ ID NO: 1108624 - RNA, 20 nt, Human
ucugcugcugcggaagguuc

SEQ ID NO: 1108625 - RNA, 19 nt, Human
ugaaaaaacuuggagaaaa

SEQ ID NO: 1108626 - RNA, 19 nt, Human
ugaagagaugggagcccag

SEQ ID NO: 1108627 - RNA, 20 nt, Human
ugacaguggguaccaggucg

SEQ ID NO: 1108628 - RNA, 22 nt, Human
ugacccgggaggaagucaccag

SEQ ID NO: 1108629 - RNA, 19 nt, Human
ugacucaggcccuuggaac

SEQ ID NO: 1108630 - RNA, 24 nt, Human
ugacuugcaccauccuguauccag

SEQ ID NO: 1108631 - RNA, 19 nt, Human
ugagcugggggcagggcuu

SEQ ID NO: 1108632 - RNA, 22 nt, Human
ugaggcaggggagaggugggcc

SEQ ID NO: 1108633 - RNA, 24 nt, Human
ugaggcaggggagaggugggcccc

SEQ ID NO: 1108634 - RNA, 21 nt, Human
ugcaagcaaacuguggaacaa

SEQ ID NO: 1108635 - RNA, 21 nt, Human
ugccauagagcccccauaacu

SEQ ID NO: 1108636 - RNA, 25 nt, Human
ugccauagagcccccauaacuucac

SEQ ID NO: 1108637 - RNA, 22 nt, Human
ugcccacucccggaccccacgg

SEQ ID NO: 1108638 - RNA, 21 nt, Human
ugcccuguggggaccugccug

SEQ ID NO: 1108639 - RNA, 19 nt, Human
ugccugcaggcugcugaca

SEQ ID NO: 1108640 - RNA, 19 nt, Human
ugcuccaucccuuaguccc

SEQ ID NO: 1108641 - RNA, 26 nt, Human
uggacagcauagauauugguuaaaga

SEQ ID NO: 1108642 - RNA, 22 nt, Human
uggcaaagacacagcuuguauc

SEQ ID NO: 1108643 - RNA, 21 nt, Human
uggcagcuggagacgcuuccc

SEQ ID NO: 1108644 - RNA, 21 nt, Human
uggcuggaggggagggcggac

SEQ ID NO: 1108645 - RNA, 21 nt, Human
ugggaagcgaugcagauaugg

SEQ ID NO: 1108646 - RNA, 25 nt, Human
ugggagcccaggggcagugcaccga

SEQ ID NO: 1108647 - RNA, 21 nt, Human
ugggcagucucaggcccugcu

SEQ ID NO: 1108648 - RNA, 18 nt, Human
ugggggcggggagacugg

SEQ ID NO: 1108649 - RNA, 19 nt, Human
ugggguggucaggcuugau

SEQ ID NO: 1108650 - RNA, 22 nt, Human
uggguacacccccuuuucccca

SEQ ID NO: 1108651 - RNA, 23 nt, Human
ugugcaagcaaacuguggaacaa

SEQ ID NO: 1108652 - RNA, 20 nt, Human
ugugucguuuucauuuuuaa

SEQ ID NO: 1108653 - RNA, 22 nt, Human
uuaaggcgcggccacacucagc

SEQ ID NO: 1108654 - RNA, 21 nt, Human
uuagccucgcagggguguccc

SEQ ID NO: 1108655 - RNA, 21 nt, Human
uucccugcuuccuuccuccag

SEQ ID NO: 1108656 - RNA, 22 nt, Human
aauaaccuuuguaucucucuca

SEQ ID NO: 1108657 - RNA, 25 nt, Human
accuuuuucccucagcuucucacug

SEQ ID NO: 1108658 - RNA, 22 nt, Human
agaggaaggagcagcagcaggg

SEQ ID NO: 1108659 - RNA, 23 nt, Human
agaggaaggagcagcagcagggu

SEQ ID NO: 1108660 - RNA, 18 nt, Human
agcagggugggacugggg

SEQ ID NO: 1108661 - RNA, 22 nt, Human
aggcgcuccugagcacagucca

SEQ ID NO: 1108662 - RNA, 21 nt, Human
agggagaaaagcgccgcggug

SEQ ID NO: 1108663 - RNA, 21 nt, Human
aguagcagaauuaaaaccaga

SEQ ID NO: 1108664 - RNA, 19 nt, Human
auaaauaucagccagugcu

SEQ ID NO: 1108665 - RNA, 21 nt, Human
augcaccaguaguagcagaau

SEQ ID NO: 1108666 - RNA, 18 nt, Human
caccaguaguagcagaau

SEQ ID NO: 1108667 - RNA, 25 nt, Human
caccaguaguagcagaauuaaaacc

SEQ ID NO: 1108668 - RNA, 22 nt, Human
cacuccgguuccuccuuccucc

SEQ ID NO: 1108669 - RNA, 26 nt, Human
cacuccgguuccuccuuccuccacuc

SEQ ID NO: 1108670 - RNA, 22 nt, Human
cagaauuaaaaccagaagcaac

SEQ ID NO: 1108671 - RNA, 19 nt, Human
cagacuaccacucagcuaa

SEQ ID NO: 1108672 - RNA, 18 nt, Human
cagcagcagggugggacu

SEQ ID NO: 1108673 - RNA, 20 nt, Human
cagcagcagggugggacugg

SEQ ID NO: 1108674 - RNA, 23 nt, Human
cagcagcagggugggacuggggc

SEQ ID NO: 1108675 - RNA, 19 nt, Human
cagcucagcucguuccucu

SEQ ID NO: 1108676 - RNA, 24 nt, Human
cagcucguuccucugugcauccca

SEQ ID NO: 1108677 - RNA, 18 nt, Human
cagggugggacuggggca

SEQ ID NO: 1108678 - RNA, 22 nt, Human
caucaguacccaguuccccaaa

SEQ ID NO: 1108679 - RNA, 22 nt, Human
caugcaccaguaguagcagaau

SEQ ID NO: 1108680 - RNA, 18 nt, Human
ccucugccuguucccagg

SEQ ID NO: 1108681 - RNA, 18 nt, Human
ccucugccuguucccagg

SEQ ID NO: 1108682 - RNA, 20 nt, Human
cgauauaaauaucagccagu

SEQ ID NO: 1108683 - RNA, 22 nt, Human
cugcagaaccuggaucuugcgc

SEQ ID NO: 1108684 - RNA, 18 nt, Human
cugcaucaucugccuggu

SEQ ID NO: 1108685 - RNA, 22 nt, Human
gaaaagcgccgcgguggcaccg

SEQ ID NO: 1108686 - RNA, 18 nt, Human
gacuccucucugguuuag

SEQ ID NO: 1108687 - RNA, 19 nt, Human
gagcagcagcaggguggga

SEQ ID NO: 1108688 - RNA, 25 nt, Human
gaguuccaucuucuuccuccucugg

SEQ ID NO: 1108689 - RNA, 24 nt, Human
gcaguggccaggcgcuccugagca

SEQ ID NO: 1108690 - RNA, 19 nt, Human
gccaugcugcccacccagc

SEQ ID NO: 1108691 - RNA, 28 nt, Human
ggagcagcagcagggugggacuggggca

SEQ ID NO: 1108692 - RNA, 24 nt, Human
ggaggugcucagcucacuccucug

SEQ ID NO: 1108693 - RNA, 21 nt, Human
gggcaggcuggccucaggcag

SEQ ID NO: 1108694 - RNA, 18 nt, Human
ggucagcuucgggcaggc

SEQ ID NO: 1108695 - RNA, 18 nt, Human
gguuccuccuuccuccac

SEQ ID NO: 1108696 - RNA, 23 nt, Human
uacccaguuccccaaaagucugu

SEQ ID NO: 1108697 - RNA, 23 nt, Human
uaguaaaaucuuguucauaaaag

SEQ ID NO: 1108698 - RNA, 24 nt, Human
uagugaugucuucuaguaaaaucu

SEQ ID NO: 1108699 - RNA, 20 nt, Human
ucaaccagcuggauccuacc

SEQ ID NO: 1108700 - RNA, 24 nt, Human
ucaauaaccuuuguaucucucuca

SEQ ID NO: 1108701 - RNA, 18 nt, Human
ucacacuccgguuccucc

SEQ ID NO: 1108702 - RNA, 19 nt, Human
ucacuggaggugcucagcu

SEQ ID NO: 1108703 - RNA, 23 nt, Human
ucagcagcuuuucccgcuucuuc

SEQ ID NO: 1108704 - RNA, 24 nt, Human
ucagcagcuuuucccgcuucuucc

SEQ ID NO: 1108705 - RNA, 19 nt, Human
ucccaggcccaccuuuuuc

SEQ ID NO: 1108706 - RNA, 20 nt, Human
ucccucagcuucucacugga

SEQ ID NO: 1108707 - RNA, 18 nt, Human
uccgguuccuccuuccuc

SEQ ID NO: 1108708 - RNA, 24 nt, Human
ucuucauacuucccaucugccuca

SEQ ID NO: 1108709 - RNA, 19 nt, Human
ugaguuggauuuccuggag

SEQ ID NO: 1108710 - RNA, 22 nt, Human
ugaugucuucuaguaaaaucuu

SEQ ID NO: 1108711 - RNA, 18 nt, Human
ugccucaucugcaaugug

SEQ ID NO: 1108712 - RNA, 23 nt, Human
ugccucgaugguggugaucccag

SEQ ID NO: 1108713 - RNA, 21 nt, Human
ugguggugaucccagccaugc

SEQ ID NO: 1108714 - RNA, 23 nt, Human
uuaaaaccagaagcaacuccugu

SEQ ID NO: 1108715 - RNA, 24 nt, Human
uucagccucugccuguucccaggc

SEQ ID NO: 1108716 - RNA, 22 nt, Human
uuucccgcuucuuccagcuuuu

SEQ ID NO: 1108717 - RNA, 19 nt, Human
aaccuggcccagggagcga

SEQ ID NO: 1108718 - RNA, 21 nt, Human
acaacgggaagaccaccggaa

SEQ ID NO: 1108719 - RNA, 21 nt, Human
accccaaaguuuaggucucca

SEQ ID NO: 1108720 - RNA, 23 nt, Human
agccaaacucccugcucuaaacc

SEQ ID NO: 1108721 - RNA, 25 nt, Human
agccaaacucccugcucuaaaccug

SEQ ID NO: 1108722 - RNA, 21 nt, Human
agucugggggaggggggcuga

SEQ ID NO: 1108723 - RNA, 24 nt, Human
caaacucccugcucuaaaccuggc

SEQ ID NO: 1108724 - RNA, 19 nt, Human
caaaguuuaggucuccacc

SEQ ID NO: 1108725 - RNA, 20 nt, Human
cacaacgggaagaccaccgg

SEQ ID NO: 1108726 - RNA, 20 nt, Human
cacagccccugccuccaagg

SEQ ID NO: 1108727 - RNA, 19 nt, Human
cagcaccagccaaacuccc

SEQ ID NO: 1108728 - RNA, 19 nt, Human
caggcccagcaccagccaa

SEQ ID NO: 1108729 - RNA, 24 nt, Human
caggcccagcaccagccaaacucc

SEQ ID NO: 1108730 - RNA, 19 nt, Human
ccaaacucccugcucuaaa

SEQ ID NO: 1108731 - RNA, 20 nt, Human
ccacagccccugccuccaag

SEQ ID NO: 1108732 - RNA, 25 nt, Human
cccagcaccagccaaacucccugcu

SEQ ID NO: 1108733 - RNA, 22 nt, Human
ccccaaaguuuaggucuccacc

SEQ ID NO: 1108734 - RNA, 20 nt, Human
cccugcucuaaaccuggccc

SEQ ID NO: 1108735 - RNA, 21 nt, Human
ccuccaagggucuguuagucu

SEQ ID NO: 1108736 - RNA, 20 nt, Human
cggcccccuggcucaggccc

SEQ ID NO: 1108737 - RNA, 27 nt, Human
cucccugcucuaaaccuggcccaggga

SEQ ID NO: 1108738 - RNA, 22 nt, Human
gagcgauggccggggguguggg

SEQ ID NO: 1108739 - RNA, 22 nt, Human
gccccugccuccaagggucugu

SEQ ID NO: 1108740 - RNA, 19 nt, Human
gcucaggcccagcaccagc

SEQ ID NO: 1108741 - RNA, 20 nt, Human
gcucuaaaccuggcccaggg

SEQ ID NO: 1108742 - RNA, 21 nt, Human
ggcccccuggcucaggcccag

SEQ ID NO: 1108743 - RNA, 20 nt, Human
ggcuugggucugggcacugg

SEQ ID NO: 1108744 - RNA, 19 nt, Human
ggggcugaaggcagcugga

SEQ ID NO: 1108745 - RNA, 22 nt, Human
gggggaggggggcugaaggcag

SEQ ID NO: 1108746 - RNA, 19 nt, Human
guggggggcuugggucugg

SEQ ID NO: 1108747 - RNA, 20 nt, Human
uccacagccccugccuccaa

SEQ ID NO: 1108748 - RNA, 21 nt, Human
ucugggggaggggggcugaag

SEQ ID NO: 1108749 - RNA, 18 nt, Human
ugcucccacaacgggaag

SEQ ID NO: 1108750 - RNA, 25 nt, Human
ugucccggcccccuggcucaggccc

SEQ ID NO: 1108751 - RNA, 21 nt, Human
aaagaaccuggcuccgggggc

SEQ ID NO: 1108752 - RNA, 23 nt, Human
aggcacaguggaaagaaccuggc

SEQ ID NO: 1108753 - RNA, 23 nt, Human
ccgacucugggccucugggcgcg

SEQ ID NO: 1108754 - RNA, 20 nt, Human
ccgcugcgcccgccgccgcc

SEQ ID NO: 1108755 - RNA, 24 nt, Human
ccgcugcgcccgccgccgccgccg

SEQ ID NO: 1108756 - RNA, 20 nt, Human
ccuggcuccgggggcucagg

SEQ ID NO: 1108757 - RNA, 22 nt, Human
cgacucugggccucugggcgcg

SEQ ID NO: 1108758 - RNA, 19 nt, Human
cggaaggcagcagggcaca

SEQ ID NO: 1108759 - RNA, 22 nt, Human
cuccgggggcucagggaccagc

SEQ ID NO: 1108760 - RNA, 22 nt, Human
cugcaggcaaaaggcuucccca

SEQ ID NO: 1108761 - RNA, 20 nt, Human
cugcgcccgccgccgccgcc

SEQ ID NO: 1108762 - RNA, 20 nt, Human
gcgcagaaccugcaggcaaa

SEQ ID NO: 1108763 - RNA, 23 nt, Human
ugaggagcggcggaagggcuugg

SEQ ID NO: 1108764 - RNA, 24 nt, Human
uggcuccgggggcucagggaccag

SEQ ID NO: 1108765 - RNA, 19 nt, Human
ugggccucugggcgcgcag

SEQ ID NO: 1108766 - RNA, 22 nt, Human
ugggugaagcccuugccgcaga

SEQ ID NO: 1108767 - RNA, 26 nt, Human
aaaaagaacaggaaagcagacaugac

SEQ ID NO: 1108768 - RNA, 21 nt, Human
aaaaaugaaacgggaguggga

SEQ ID NO: 1108769 - RNA, 18 nt, Human
aaaagaacaggaaagcag

SEQ ID NO: 1108770 - RNA, 29 nt, Human
aaaagaacaggaaagcagacagugggcac

SEQ ID NO: 1108771 - RNA, 24 nt, Human
aaagcaagaggaucacuugaagcc

SEQ ID NO: 1108772 - RNA, 25 nt, Human
aaagcaagaggaucacuugaagcca

SEQ ID NO: 1108773 - RNA, 21 nt, Human
aacauggugaagcccugucuc

SEQ ID NO: 1108774 - RNA, 18 nt, Human
aaccaagaaaaagaacag

SEQ ID NO: 1108775 - RNA, 19 nt, Human
aacccccuucuucugcucu

SEQ ID NO: 1108776 - RNA, 23 nt, Human
aagaauugcuugaacccgggaag

SEQ ID NO: 1108777 - RNA, 24 nt, Human
aagcaagaggaucacuugaagcca

SEQ ID NO: 1108778 - RNA, 20 nt, Human
aagcagacaugacaauagau

SEQ ID NO: 1108779 - RNA, 21 nt, Human
aagccaggaguuugagaccag

SEQ ID NO: 1108780 - RNA, 23 nt, Human
aagccagucaugauggcuugugc

SEQ ID NO: 1108781 - RNA, 20 nt, Human
aaggucaggaguuugagacc

SEQ ID NO: 1108782 - RNA, 24 nt, Human
aaucacuugaaccugggaggugga

SEQ ID NO: 1108783 - RNA, 18 nt, Human
aauugcuugaacccggga

SEQ ID NO: 1108784 - RNA, 20 nt, Human
acaaccaagaaaaagaacag

SEQ ID NO: 1108785 - RNA, 24 nt, Human
acagagcgagacuccaucucaaaa

SEQ ID NO: 1108786 - RNA, 20 nt, Human
acagaggaagacuccgucuc

SEQ ID NO: 1108787 - RNA, 23 nt, Human
acagaggaagacuccgucucaaa

SEQ ID NO: 1108788 - RNA, 24 nt, Human
acagaggaagacuccgucucaaaa

SEQ ID NO: 1108789 - RNA, 22 nt, Human
accugcuuugucccaaaccccc

SEQ ID NO: 1108790 - RNA, 20 nt, Human
accuguaaucgcagcuccuc

SEQ ID NO: 1108791 - RNA, 18 nt, Human
acgccuguaaucccagca

SEQ ID NO: 1108792 - RNA, 24 nt, Human
acuccacuacagccugggugacag

SEQ ID NO: 1108793 - RNA, 24 nt, Human
acuccgucucuacuaaaaauacaa

SEQ ID NO: 1108794 - RNA, 24 nt, Human
agaccagccaauauggugaaacuc

SEQ ID NO: 1108795 - RNA, 24 nt, Human
agagauugccguaagcugagaucg

SEQ ID NO: 1108796 - RNA, 23 nt, Human
agaucacuugaggucaugaguuc

SEQ ID NO: 1108797 - RNA, 20 nt, Human
agcagagauugccguaagcu

SEQ ID NO: 1108798 - RNA, 23 nt, Human
agcauuuuggaggccgagguggg

SEQ ID NO: 1108799 - RNA, 21 nt, Human
agccaggugugguggugcaug

SEQ ID NO: 1108800 - RNA, 24 nt, Human
agccugggcgacagaggaagacuc

SEQ ID NO: 1108801 - RNA, 24 nt, Human
agccugggugacagagcgagacuc

SEQ ID NO: 1108802 - RNA, 21 nt, Human
agcuggguaauguagugagac

SEQ ID NO: 1108803 - RNA, 23 nt, Human
agcuggguaauguagugagaccc

SEQ ID NO: 1108804 - RNA, 20 nt, Human
aggaguuugagaccagccug

SEQ ID NO: 1108805 - RNA, 24 nt, Human
aggaucacuugaagccaggaguuu

SEQ ID NO: 1108806 - RNA, 24 nt, Human
aggaucgcuugaggccaggagcuc

SEQ ID NO: 1108807 - RNA, 24 nt, Human
aggcagaagaauugcuugaacccg

SEQ ID NO: 1108808 - RNA, 22 nt, Human
aggcaggagaaucacuugaacc

SEQ ID NO: 1108809 - RNA, 24 nt, Human
aggcaggagaaucacuugaaccug

SEQ ID NO: 1108810 - RNA, 21 nt, Human
aggccgaggugggcggauuau

SEQ ID NO: 1108811 - RNA, 24 nt, Human
aggcugagaugagaggaucgcuug

SEQ ID NO: 1108812 - RNA, 24 nt, Human
aggcugaggcagaagaauugcuug

SEQ ID NO: 1108813 - RNA, 24 nt, Human
aggcugaggcaggagaaucacuug

SEQ ID NO: 1108814 - RNA, 24 nt, Human
agggauaguggcuuacgccuguaa

SEQ ID NO: 1108815 - RNA, 22 nt, Human
aggugagcagaucacuugaggg

SEQ ID NO: 1108816 - RNA, 24 nt, Human
agguggagguugcagugagccaag

SEQ ID NO: 1108817 - RNA, 24 nt, Human
aggugggcggauuauaaggucagg

SEQ ID NO: 1108818 - RNA, 23 nt, Human
agucagguguggugguaggcgcc

SEQ ID NO: 1108819 - RNA, 24 nt, Human
agucaugauggcuugugccuguaa

SEQ ID NO: 1108820 - RNA, 23 nt, Human
aguggcucaugccuauaauccca

SEQ ID NO: 1108821 - RNA, 24 nt, Human
aguggcuguaaucccagcacuuug

SEQ ID NO: 1108822 - RNA, 24 nt, Human
aguggcuuacgccuguaaucccag

SEQ ID NO: 1108823 - RNA, 23 nt, Human
auaaggucaggaguuugagacca

SEQ ID NO: 1108824 - RNA, 22 nt, Human
aucccagcacuuugggaggcca

SEQ ID NO: 1108825 - RNA, 24 nt, Human
aucgcgccauugcacuccagccug

SEQ ID NO: 1108826 - RNA, 23 nt, Human
auggcuugugccuguaauccaag

SEQ ID NO: 1108827 - RNA, 20 nt, Human
auggugaaacuccgucucua

SEQ ID NO: 1108828 - RNA, 24 nt, Human
auugcacuccagccugggcgacag

SEQ ID NO: 1108829 - RNA, 21 nt, Human
caacacuuugggaggccaaag

SEQ ID NO: 1108830 - RNA, 24 nt, Human
caacauggugaagcccugucucua

SEQ ID NO: 1108831 - RNA, 24 nt, Human
caagaggaucacuugaagccagga

SEQ ID NO: 1108832 - RNA, 24 nt, Human
caaggugagcagaucacuugaggu

SEQ ID NO: 1108833 - RNA, 26 nt, Human
caaggugagcagaucacuugagguca

SEQ ID NO: 1108834 - RNA, 24 nt, Human
caauauggugaaacuccgucucua

SEQ ID NO: 1108835 - RNA, 23 nt, Human
cacuacagccugggugacagagc

SEQ ID NO: 1108836 - RNA, 24 nt, Human
cacuacagccugggugacagagcg

SEQ ID NO: 1108837 - RNA, 24 nt, Human
cacugcaaacaacucaaauaucua

SEQ ID NO: 1108838 - RNA, 21 nt, Human
cacuugaaccugggaggugga

SEQ ID NO: 1108839 - RNA, 21 nt, Human
cacuugaagccaggaguuuga

SEQ ID NO: 1108840 - RNA, 20 nt, Human
cagcacuuugggaggccaag

SEQ ID NO: 1108841 - RNA, 23 nt, Human
cagcacuuugggaggccaaggug

SEQ ID NO: 1108842 - RNA, 22 nt, Human
cagccugggcgacagaggaaga

SEQ ID NO: 1108843 - RNA, 19 nt, Human
cagccuucccaggucccac

SEQ ID NO: 1108844 - RNA, 24 nt, Human
cagcuacucgggaggcugaggcag

SEQ ID NO: 1108845 - RNA, 24 nt, Human
cagcuccucaggaggcugaggcag

SEQ ID NO: 1108846 - RNA, 24 nt, Human
caggaggcugaggcaggagaauca

SEQ ID NO: 1108847 - RNA, 18 nt, Human
cagugcuugugggguuug

SEQ ID NO: 1108848 - RNA, 21 nt, Human
cauaauaauaaugaaaagaaa

SEQ ID NO: 1108849 - RNA, 21 nt, Human
caucguaugcagugcuugugg

SEQ ID NO: 1108850 - RNA, 24 nt, Human
caugccuauaaucccaacacuuug

SEQ ID NO: 1108851 - RNA, 19 nt, Human
cauugcacuccagccuggg

SEQ ID NO: 1108852 - RNA, 21 nt, Human
cauugcacuccagccugggcg

SEQ ID NO: 1108853 - RNA, 22 nt, Human
cauugcacuccagccugggcga

SEQ ID NO: 1108854 - RNA, 24 nt, Human
cauugcacuccagccugggcgaca

SEQ ID NO: 1108855 - RNA, 27 nt, Human
cauugcacuccagccugggcgacagag

SEQ ID NO: 1108856 - RNA, 19 nt, Human
ccaacacuuugggaggcca

SEQ ID NO: 1108857 - RNA, 26 nt, Human
ccaagaaaaagaacaggaaagcagac

SEQ ID NO: 1108858 - RNA, 24 nt, Human
ccacuccacuacagccugggugac

SEQ ID NO: 1108859 - RNA, 24 nt, Human
ccagcauuuuggaggccgaggugg

SEQ ID NO: 1108860 - RNA, 22 nt, Human
ccagccaauauggugaaacucc

SEQ ID NO: 1108861 - RNA, 27 nt, Human
ccagugguugaucuugaaguuucuuuc

SEQ ID NO: 1108862 - RNA, 20 nt, Human
ccauugcacuccagccuggg

SEQ ID NO: 1108863 - RNA, 21 nt, Human
ccauugcacuccagccugggc

SEQ ID NO: 1108864 - RNA, 22 nt, Human
ccauugcacuccagccugggcg

SEQ ID NO: 1108865 - RNA, 23 nt, Human
ccauugcacuccagccugggcga

SEQ ID NO: 1108866 - RNA, 23 nt, Human
ccauugcacuccagccugggcga

SEQ ID NO: 1108867 - RNA, 24 nt, Human
ccauugcacuccagccugggcgac

SEQ ID NO: 1108868 - RNA, 23 nt, Human
ccccgggaaccugcugguccgcc

SEQ ID NO: 1108869 - RNA, 24 nt, Human
cccuggguuuuagcagccuuccca

SEQ ID NO: 1108870 - RNA, 22 nt, Human
ccuauaaucccaacacuuuggg

SEQ ID NO: 1108871 - RNA, 22 nt, Human
ccuauaaucccaacacuuuggg

SEQ ID NO: 1108872 - RNA, 21 nt, Human
ccucaucccuuuccugcccaa

SEQ ID NO: 1108873 - RNA, 22 nt, Human
ccugcuuugucccaaacccccg

SEQ ID NO: 1108874 - RNA, 21 nt, Human
ccugggagguggagguugcag

SEQ ID NO: 1108875 - RNA, 22 nt, Human
ccugggugacagagcgagacuc

SEQ ID NO: 1108876 - RNA, 21 nt, Human
ccuguaauccaagcuacucag

SEQ ID NO: 1108877 - RNA, 22 nt, Human
ccuguaauccaagcuacucagg

SEQ ID NO: 1108878 - RNA, 21 nt, Human
ccuguagucccagcuacucgg

SEQ ID NO: 1108879 - RNA, 24 nt, Human
ccuuaaaaaugaaacgggaguggg

SEQ ID NO: 1108880 - RNA, 23 nt, Human
ccuugccaacauggugaagcccu

SEQ ID NO: 1108881 - RNA, 24 nt, Human
ccuugccaacauggugaagcccug

SEQ ID NO: 1108882 - RNA, 23 nt, Human
cgagaccagcuggguaauguagu

SEQ ID NO: 1108883 - RNA, 24 nt, Human
cgagacuugccuugccaacauggu

SEQ ID NO: 1108884 - RNA, 22 nt, Human
cgaggugggcggauuauaaggu

SEQ ID NO: 1108885 - RNA, 24 nt, Human
cgaggugggcggauuauaagguca

SEQ ID NO: 1108886 - RNA, 21 nt, Human
cggauuauaaggucaggaguu

SEQ ID NO: 1108887 - RNA, 27 nt, Human
cgggaggcugaggcagaagaauugcuu

SEQ ID NO: 1108888 - RNA, 24 nt, Human
cucaaauaucuaucagcaguaaga

SEQ ID NO: 1108889 - RNA, 21 nt, Human
cucacagauacaauguugcgu

SEQ ID NO: 1108890 - RNA, 18 nt, Human
cucaggaggcugagauga

SEQ ID NO: 1108891 - RNA, 21 nt, Human
cucaucguaugcagugcuugu

SEQ ID NO: 1108892 - RNA, 24 nt, Human
cucaugccuauaaucccaacacuu

SEQ ID NO: 1108893 - RNA, 19 nt, Human
cucccuggguuuuagcagc

SEQ ID NO: 1108894 - RNA, 19 nt, Human
cuguagucccagcuacucg

SEQ ID NO: 1108895 - RNA, 18 nt, Human
cuguucaucccacuggag

SEQ ID NO: 1108896 - RNA, 21 nt, Human
cuuacgccuguaaucccagca

SEQ ID NO: 1108897 - RNA, 21 nt, Human
cuucccaggucccaccgaaca

SEQ ID NO: 1108898 - RNA, 31 nt, Human
cuucccaggucccaccgaacacgaggaacaa

SEQ ID NO: 1108899 - RNA, 21 nt, Human
cuugaaccugggagguggagg

SEQ ID NO: 1108900 - RNA, 21 nt, Human
cuugaaguuucuuuccuacuc

SEQ ID NO: 1108901 - RNA, 20 nt, Human
cuuuaccauauucauuaaaa

SEQ ID NO: 1108902 - RNA, 19 nt, Human
gaagacuccgucucaaaaa

SEQ ID NO: 1108903 - RNA, 23 nt, Human
gagaaucacuugaaccugggagg

SEQ ID NO: 1108904 - RNA, 23 nt, Human
gagaucgcgccauugcacuccag

SEQ ID NO: 1108905 - RNA, 24 nt, Human
gagaugagaggaucgcuugaggcc

SEQ ID NO: 1108906 - RNA, 18 nt, Human
gagguugcagugagccaa

SEQ ID NO: 1108907 - RNA, 19 nt, Human
gagguugcagugagccaag

SEQ ID NO: 1108908 - RNA, 24 nt, Human
gaucacuugaagccaggaguuuga

SEQ ID NO: 1108909 - RNA, 18 nt, Human
gaucacuugaggucauga

SEQ ID NO: 1108910 - RNA, 24 nt, Human
gaucacuugaggucaugaguucga

SEQ ID NO: 1108911 - RNA, 18 nt, Human
gaucgcuugaggccagga

SEQ ID NO: 1108912 - RNA, 24 nt, Human
gaucgcuugaggccaggagcucga

SEQ ID NO: 1108913 - RNA, 24 nt, Human
gcaggacccuaucucuacaaaaac

SEQ ID NO: 1108914 - RNA, 23 nt, Human
gcaggagaaucacuugaaccugg

SEQ ID NO: 1108915 - RNA, 24 nt, Human
gccaacauggugaagcccugucuc

SEQ ID NO: 1108916 - RNA, 24 nt, Human
gccaauauggugaaacuccgucuc

SEQ ID NO: 1108917 - RNA, 22 nt, Human
gccauugcacuccagccugggc

SEQ ID NO: 1108918 - RNA, 24 nt, Human
gccauugcacuccagccugggcga

SEQ ID NO: 1108919 - RNA, 23 nt, Human
gccuugccaacauggugaagccc

SEQ ID NO: 1108920 - RNA, 18 nt, Human
gcgcagcucggcgugagg

SEQ ID NO: 1108921 - RNA, 23 nt, Human
gcggauuauaaggucaggaguuu

SEQ ID NO: 1108922 - RNA, 20 nt, Human
gcuggaugcaguggcucaug

SEQ ID NO: 1108923 - RNA, 18 nt, Human
ggaaagcagacaugacaa

SEQ ID NO: 1108924 - RNA, 19 nt, Human
ggaacccccuucuucugcu

SEQ ID NO: 1108925 - RNA, 20 nt, Human
ggagguugcagugagccaag

SEQ ID NO: 1108926 - RNA, 20 nt, Human
ggagguugcagugagccaag

SEQ ID NO: 1108927 - RNA, 24 nt, Human
ggagguugcagugagccaagguca

SEQ ID NO: 1108928 - RNA, 22 nt, Human
ggaucacuugaagccaggaguu

SEQ ID NO: 1108929 - RNA, 23 nt, Human
ggaucacuugaagccaggaguuu

SEQ ID NO: 1108930 - RNA, 24 nt, Human
ggaugcaguggcucaugccuauaa

SEQ ID NO: 1108931 - RNA, 20 nt, Human
ggauuauaaggucaggaguu

SEQ ID NO: 1108932 - RNA, 23 nt, Human
ggauuauaaggucaggaguuuga

SEQ ID NO: 1108933 - RNA, 24 nt, Human
ggauuauuauacaaccaagaaaaa

SEQ ID NO: 1108934 - RNA, 21 nt, Human
ggcaaaacuaaucuaugauga

SEQ ID NO: 1108935 - RNA, 23 nt, Human
ggcggauuauaaggucaggaguu

SEQ ID NO: 1108936 - RNA, 22 nt, Human
ggugcaguggcuguaaucccag

SEQ ID NO: 1108937 - RNA, 21 nt, Human
gugaaacuccgucucuacuaa

SEQ ID NO: 1108938 - RNA, 21 nt, Human
gugaagcccugucucuacuaa

SEQ ID NO: 1108939 - RNA, 20 nt, Human
guucgagacuugccuugcca

SEQ ID NO: 1108940 - RNA, 22 nt, Human
uaagcugagaucgcgccauugc

SEQ ID NO: 1108941 - RNA, 23 nt, Human
uacacaaaguucagggguaggca

SEQ ID NO: 1108942 - RNA, 24 nt, Human
uacagccugggugacagagcgaga

SEQ ID NO: 1108943 - RNA, 24 nt, Human
uaccuguaaucgcagcuccucagg

SEQ ID NO: 1108944 - RNA, 24 nt, Human
uacgccuguaaucccagcauuuug

SEQ ID NO: 1108945 - RNA, 18 nt, Human
uagcagccuucccagguc

SEQ ID NO: 1108946 - RNA, 22 nt, Human
uaggcaaaacuaaucuaugaug

SEQ ID NO: 1108947 - RNA, 21 nt, Human
uaggcgccugccuguaguccc

SEQ ID NO: 1108948 - RNA, 21 nt, Human
uagucagguguggugguaggc

SEQ ID NO: 1108949 - RNA, 24 nt, Human
uaguggcuuacgccuguaauccca

SEQ ID NO: 1108950 - RNA, 25 nt, Human
uauuauacaaccaagaaaaagaaca

SEQ ID NO: 1108951 - RNA, 19 nt, Human
ucacuugaaccugggaggu

SEQ ID NO: 1108952 - RNA, 24 nt, Human
ucacuugaaccugggagguggagg

SEQ ID NO: 1108953 - RNA, 19 nt, Human
ucacuugaagccaggaguu

SEQ ID NO: 1108954 - RNA, 24 nt, Human
ucauuuaaaaaaaaaaaaaaaaaa

SEQ ID NO: 1108955 - RNA, 19 nt, Human
uccagccugggcgacagag

SEQ ID NO: 1108956 - RNA, 23 nt, Human
ucccccuuaaaaaugaaacggga

SEQ ID NO: 1108957 - RNA, 25 nt, Human
ucccccuuaaaaaugaaacgggagu

SEQ ID NO: 1108958 - RNA, 18 nt, Human
uccccgggaaccugcugg

SEQ ID NO: 1108959 - RNA, 21 nt, Human
ucccucaucccuuuccugccc

SEQ ID NO: 1108960 - RNA, 19 nt, Human
ucccuggguuuuagcagcc

SEQ ID NO: 1108961 - RNA, 23 nt, Human
ucccuggguuuuagcagccuucc

SEQ ID NO: 1108962 - RNA, 22 nt, Human
uccgucucaaaaagaaaaaaaa

SEQ ID NO: 1108963 - RNA, 22 nt, Human
uccgucucaaaaagaaaaaaaa

SEQ ID NO: 1108964 - RNA, 23 nt, Human
ucgcgccauugcacuccagccug

SEQ ID NO: 1108965 - RNA, 23 nt, Human
ucgggaggcugaggcagaagaau

SEQ ID NO: 1108966 - RNA, 19 nt, Human
ucucaaaaagaaaaaaaag

SEQ ID NO: 1108967 - RNA, 24 nt, Human
ucuccagcuccaacuuuucucauc

SEQ ID NO: 1108968 - RNA, 23 nt, Human
ucucuacuaaaaauacaaaaauu

SEQ ID NO: 1108969 - RNA, 21 nt, Human
ucucuacuaaaaauauaaaaa

SEQ ID NO: 1108970 - RNA, 28 nt, Human
ugaaaagaaaugaugcuggaugcagugg

SEQ ID NO: 1108971 - RNA, 24 nt, Human
ugaaccugggagguggagguugca

SEQ ID NO: 1108972 - RNA, 18 nt, Human
ugacuccccuaucagcga

SEQ ID NO: 1108973 - RNA, 18 nt, Human
ugagaaagagcauuuggg

SEQ ID NO: 1108974 - RNA, 24 nt, Human
ugagaggaucgcuugaggccagga

SEQ ID NO: 1108975 - RNA, 26 nt, Human
ugagaugagaggaucgcuugaggcca

SEQ ID NO: 1108976 - RNA, 18 nt, Human
ugagcagaucacuugagg

SEQ ID NO: 1108977 - RNA, 24 nt, Human
ugagcagaucacuugaggucauga

SEQ ID NO: 1108978 - RNA, 24 nt, Human
ugaggcagaagaauugcuugaacc

SEQ ID NO: 1108979 - RNA, 25 nt, Human
ugaggcagaagaauugcuugaaccc

SEQ ID NO: 1108980 - RNA, 20 nt, Human
ugaggcaggagaaucacuug

SEQ ID NO: 1108981 - RNA, 24 nt, Human
ugaggcaggagaaucacuugaacc

SEQ ID NO: 1108982 - RNA, 25 nt, Human
ugaggcaggagaaucacuugaaccu

SEQ ID NO: 1108983 - RNA, 23 nt, Human
ugaggccaggagcucgagaccag

SEQ ID NO: 1108984 - RNA, 22 nt, Human
ugauggcuugugccuguaaucc

SEQ ID NO: 1108985 - RNA, 22 nt, Human
ugcacuccagccugggcgacag

SEQ ID NO: 1108986 - RNA, 24 nt, Human
ugcacuccagccugggcgacagag

SEQ ID NO: 1108987 - RNA, 20 nt, Human
ugcagugcuugugggguuug

SEQ ID NO: 1108988 - RNA, 22 nt, Human
ugcaguggcuguaaucccagca

SEQ ID NO: 1108989 - RNA, 23 nt, Human
ugccaacauggugaagcccuguc

SEQ ID NO: 1108990 - RNA, 25 nt, Human
ugcccaagcuguggucccagcugac

SEQ ID NO: 1108991 - RNA, 23 nt, Human
ugccuauaaucccaacacuuugg

SEQ ID NO: 1108992 - RNA, 24 nt, Human
ugccuguaauccaagcuacucagg

SEQ ID NO: 1108993 - RNA, 23 nt, Human
ugccuguagucccagcuacucgg

SEQ ID NO: 1108994 - RNA, 24 nt, Human
ugccuguagucccagcuacucggg

SEQ ID NO: 1108995 - RNA, 19 nt, Human
ugcgcagcucggcgugagg

SEQ ID NO: 1108996 - RNA, 27 nt, Human
uggaaugaaaugccucccucaccugcu

SEQ ID NO: 1108997 - RNA, 26 nt, Human
uggagaggagggucuggaugggaccc

SEQ ID NO: 1108998 - RNA, 21 nt, Human
uggcucaugccuauaauccca

SEQ ID NO: 1108999 - RNA, 23 nt, Human
uggcuguaaucccagcacuuugg

SEQ ID NO: 1109000 - RNA, 24 nt, Human
uggcuguaaucccagcacuuuggg

SEQ ID NO: 1109001 - RNA, 22 nt, Human
uggcuuacgccuguaaucccag

SEQ ID NO: 1109002 - RNA, 24 nt, Human
uggcuuacgccuguaaucccagca

SEQ ID NO: 1109003 - RNA, 19 nt, Human
uggcuugugccuguaaucc

SEQ ID NO: 1109004 - RNA, 20 nt, Human
uggcuugugccuguaaucca

SEQ ID NO: 1109005 - RNA, 24 nt, Human
ugggaggccaaagcaagaggauca

SEQ ID NO: 1109006 - RNA, 24 nt, Human
ugggaggccaaggugagcagauca

SEQ ID NO: 1109007 - RNA, 18 nt, Human
ugggagguggagguugca

SEQ ID NO: 1109008 - RNA, 29 nt, Human
ugggagguggagguugcagugacaacggu

SEQ ID NO: 1109009 - RNA, 24 nt, Human
ugggagguggagguugcagugagc

SEQ ID NO: 1109010 - RNA, 22 nt, Human
ugggcggauuauaaggucagga

SEQ ID NO: 1109011 - RNA, 20 nt, Human
uggggugugcgcagcucggc

SEQ ID NO: 1109012 - RNA, 25 nt, Human
ugguaggcgccugccuguaguccca

SEQ ID NO: 1109013 - RNA, 18 nt, Human
uggugcaugucuguaguc

SEQ ID NO: 1109014 - RNA, 24 nt, Human
ugguggugcaugucuguaguccca

SEQ ID NO: 1109015 - RNA, 22 nt, Human
ugucuguagucccagcuacucg

SEQ ID NO: 1109016 - RNA, 19 nt, Human
uguggugguaggcgccugc

SEQ ID NO: 1109017 - RNA, 20 nt, Human
uuaaaaaaaaaaaaaaaaaa

SEQ ID NO: 1109018 - RNA, 21 nt, Human
uuacgccuguaaucccagcau

SEQ ID NO: 1109019 - RNA, 21 nt, Human
uuagcagccuucccagguccc

SEQ ID NO: 1109020 - RNA, 21 nt, Human
uuagccaggugugguggugca

SEQ ID NO: 1109021 - RNA, 24 nt, Human
uuauaaggucaggaguuugagacc

SEQ ID NO: 1109022 - RNA, 18 nt, Human
uucacugcccagcacggc

SEQ ID NO: 1109023 - RNA, 22 nt, Human
uucuccagcuccaacuuuucuc

SEQ ID NO: 1109024 - RNA, 19 nt, Human
uucuggucugcauggugga

SEQ ID NO: 1109025 - RNA, 24 nt, Human
uugaaccugggagguggagguugc

SEQ ID NO: 1109026 - RNA, 22 nt, Human
uugaagccaggaguuugagacc

SEQ ID NO: 1109027 - RNA, 20 nt, Human
uugcagugagccaaggucac

SEQ ID NO: 1109028 - RNA, 21 nt, Human
uugcuugaacccgggaagcag

SEQ ID NO: 1109029 - RNA, 22 nt, Human
uuggaggauacugacugagaaa

SEQ ID NO: 1109030 - RNA, 24 nt, Human
uuggaggauacugacugagaaaga

SEQ ID NO: 1109031 - RNA, 19 nt, Human
aaguagcugggacuacagg

SEQ ID NO: 1109032 - RNA, 22 nt, Human
aaguagcugggacuacaggggc

SEQ ID NO: 1109033 - RNA, 26 nt, Human
aaguagcugggacuacaggggcauac

SEQ ID NO: 1109034 - RNA, 18 nt, Human
aagugcugggauuacagg

SEQ ID NO: 1109035 - RNA, 19 nt, Human
aagugcugggauuacaggc

SEQ ID NO: 1109036 - RNA, 19 nt, Human
aagugcugggauuacaggc

SEQ ID NO: 1109037 - RNA, 23 nt, Human
aagugcugggauuacaggcguga

SEQ ID NO: 1109038 - RNA, 26 nt, Human
aagugcugggauuacaggcgugagcc

SEQ ID NO: 1109039 - RNA, 18 nt, Human
agagaacucaaugcuuuu

SEQ ID NO: 1109040 - RNA, 23 nt, Human
agaguaucucuccagugaguccu

SEQ ID NO: 1109041 - RNA, 25 nt, Human
aggcuggagugcaguggcgcgaucu

SEQ ID NO: 1109042 - RNA, 21 nt, Human
aggcuggggugcagugcaucu

SEQ ID NO: 1109043 - RNA, 24 nt, Human
aggguuucuguccaguguaaguuu

SEQ ID NO: 1109044 - RNA, 21 nt, Human
aguagcugggauuacaggcau

SEQ ID NO: 1109045 - RNA, 23 nt, Human
aguagcugggauuacaggcaugu

SEQ ID NO: 1109046 - RNA, 24 nt, Human
agugauuauccugccucagccucc

SEQ ID NO: 1109047 - RNA, 23 nt, Human
agugcaguggcgcgaucuuggcu

SEQ ID NO: 1109048 - RNA, 24 nt, Human
agugcaguggcgcgaucuuggcuc

SEQ ID NO: 1109049 - RNA, 18 nt, Human
agugcugggauuacaggc

SEQ ID NO: 1109050 - RNA, 21 nt, Human
auagaguaucucuccagugag

SEQ ID NO: 1109051 - RNA, 24 nt, Human
caaauuccugaggucaagcaauuu

SEQ ID NO: 1109052 - RNA, 23 nt, Human
caacccccaccccuugggcucaa

SEQ ID NO: 1109053 - RNA, 24 nt, Human
caacccccaccccuugggcucaag

SEQ ID NO: 1109054 - RNA, 22 nt, Human
caaggaccugagagaacucaau

SEQ ID NO: 1109055 - RNA, 22 nt, Human
caagugauuauccugccucagc

SEQ ID NO: 1109056 - RNA, 24 nt, Human
caccauuuugcccaggcaggccuc

SEQ ID NO: 1109057 - RNA, 21 nt, Human
caccgcaaccuccgccucccg

SEQ ID NO: 1109058 - RNA, 24 nt, Human
caccucagccucccaaguagcugg

SEQ ID NO: 1109059 - RNA, 20 nt, Human
cagccuccugaguagcuggg

SEQ ID NO: 1109060 - RNA, 21 nt, Human
cagggggugguagaaccacgc

SEQ ID NO: 1109061 - RNA, 19 nt, Human
caggguccucccucugccu

SEQ ID NO: 1109062 - RNA, 22 nt, Human
caggguccucccucugccuccc

SEQ ID NO: 1109063 - RNA, 24 nt, Human
cagggucuggcucugucgcccagg

SEQ ID NO: 1109064 - RNA, 19 nt, Human
cagugaguccuuuuauguc

SEQ ID NO: 1109065 - RNA, 19 nt, Human
caguggcgcgaucuuggcu

SEQ ID NO: 1109066 - RNA, 22 nt, Human
cauaccaccacaccugcuacuu

SEQ ID NO: 1109067 - RNA, 24 nt, Human
ccaaguagcugggacuacaggggc

SEQ ID NO: 1109068 - RNA, 21 nt, Human
ccacaccugcuacuuuuucua

SEQ ID NO: 1109069 - RNA, 23 nt, Human
ccaggguccucccucugccuccc

SEQ ID NO: 1109070 - RNA, 21 nt, Human
ccagugaguccuuuuaugucu

SEQ ID NO: 1109071 - RNA, 23 nt, Human
cccaaguagcugggacuacaggg

SEQ ID NO: 1109072 - RNA, 23 nt, Human
cccaccucagccucccaaguagc

SEQ ID NO: 1109073 - RNA, 22 nt, Human
cccaggcuggagugcaguggcg

SEQ ID NO: 1109074 - RNA, 23 nt, Human
cccggauucaagugauuauccuc

SEQ ID NO: 1109075 - RNA, 23 nt, Human
cccggauucaagugauuauccug

SEQ ID NO: 1109076 - RNA, 23 nt, Human
cccuaagugcugggauuacaggc

SEQ ID NO: 1109077 - RNA, 25 nt, Human
cccuugggcucaagagaucuuccca

SEQ ID NO: 1109078 - RNA, 23 nt, Human
ccgcaaccuccgccucccggauu

SEQ ID NO: 1109079 - RNA, 24 nt, Human
ccgcaaccuccgccucccggauuc

SEQ ID NO: 1109080 - RNA, 22 nt, Human
ccuaagugcugggauuacaggc

SEQ ID NO: 1109081 - RNA, 24 nt, Human
ccuaagugcugggauuacaggcgu

SEQ ID NO: 1109082 - RNA, 22 nt, Human
ccucccgcugccagugcggguc

SEQ ID NO: 1109083 - RNA, 23 nt, Human
ccugaguagcugggauuacaggc

SEQ ID NO: 1109084 - RNA, 24 nt, Human
ccugaguagcugggauuacaggca

SEQ ID NO: 1109085 - RNA, 23 nt, Human
ccugccucagccuccugaguagc

SEQ ID NO: 1109086 - RNA, 24 nt, Human
ccugccucagccuccugaguagcu

SEQ ID NO: 1109087 - RNA, 21 nt, Human
cuaagugcugggauuacaggc

SEQ ID NO: 1109088 - RNA, 24 nt, Human
cuaagugcugggauuacaggcgug

SEQ ID NO: 1109089 - RNA, 18 nt, Human
cuacaggggcauaccacc

SEQ ID NO: 1109090 - RNA, 19 nt, Human
cucaagagaucuucccacc

SEQ ID NO: 1109091 - RNA, 24 nt, Human
cucaagagaucuucccaccucagc

SEQ ID NO: 1109092 - RNA, 24 nt, Human
cucaccgcaaccuccgccucccgg

SEQ ID NO: 1109093 - RNA, 22 nt, Human
cucacugcaacccccaccccuu

SEQ ID NO: 1109094 - RNA, 24 nt, Human
cucacugcaacccccaccccuugg

SEQ ID NO: 1109095 - RNA, 24 nt, Human
cucagccucccaaguagcugggac

SEQ ID NO: 1109096 - RNA, 24 nt, Human
cucagccuccugaguagcugggau

SEQ ID NO: 1109097 - RNA, 23 nt, Human
cuccagugugagauauuucauga

SEQ ID NO: 1109098 - RNA, 23 nt, Human
cugaguagcugggauuacaggca

SEQ ID NO: 1109099 - RNA, 24 nt, Human
cugaguagcugggauuacaggcau

SEQ ID NO: 1109100 - RNA, 24 nt, Human
cugcccaggcuggagugcaguggc

SEQ ID NO: 1109101 - RNA, 19 nt, Human
cugugaguuguuuuauguu

SEQ ID NO: 1109102 - RNA, 23 nt, Human
cuucccaccucagccucccaagu

SEQ ID NO: 1109103 - RNA, 26 nt, Human
cuucccaccucagccucccaaguagc

SEQ ID NO: 1109104 - RNA, 24 nt, Human
cuugcugcccaggcuggagugcag

SEQ ID NO: 1109105 - RNA, 31 nt, Human
cuuuuuuuuuuuuuuugagacagggucuggg

SEQ ID NO: 1109106 - RNA, 21 nt, Human
gaaaggaauaaaaauuaugaa

SEQ ID NO: 1109107 - RNA, 18 nt, Human
gacugaggcuacacagac

SEQ ID NO: 1109108 - RNA, 20 nt, Human
gagacagggucuggcucugu

SEQ ID NO: 1109109 - RNA, 22 nt, Human
gaguagcugggauuacaggcau

SEQ ID NO: 1109110 - RNA, 25 nt, Human
gaguagcugggauuacaggcaugug

SEQ ID NO: 1109111 - RNA, 18 nt, Human
gauuacaggcaugugcca

SEQ ID NO: 1109112 - RNA, 18 nt, Human
gauuacaggcgugagcca

SEQ ID NO: 1109113 - RNA, 21 nt, Human
gauuacaggcgugagccacug

SEQ ID NO: 1109114 - RNA, 24 nt, Human
gauuacaggcgugagccacugugc

SEQ ID NO: 1109115 - RNA, 19 nt, Human
gcccaggcuggagugcagu

SEQ ID NO: 1109116 - RNA, 23 nt, Human
gcccaggcuggggugcagugcau

SEQ ID NO: 1109117 - RNA, 25 nt, Human
gcucugucgcccaggcuggggugca

SEQ ID NO: 1109118 - RNA, 20 nt, Human
gcucuugcugcccaggcugg

SEQ ID NO: 1109119 - RNA, 21 nt, Human
gcucuugcugcccaggcugga

SEQ ID NO: 1109120 - RNA, 24 nt, Human
gcucuugcugcccaggcuggagug

SEQ ID NO: 1109121 - RNA, 18 nt, Human
gcugagcgcaggggcgug

SEQ ID NO: 1109122 - RNA, 19 nt, Human
gcuggagugcaguggcgcg

SEQ ID NO: 1109123 - RNA, 19 nt, Human
ggauuacaggcaugugcca

SEQ ID NO: 1109124 - RNA, 24 nt, Human
ggcucugucgcccaggcuggggug

SEQ ID NO: 1109125 - RNA, 19 nt, Human
ggugcagugcaucuuggcu

SEQ ID NO: 1109126 - RNA, 18 nt, Human
guagcugggauuacaggc

SEQ ID NO: 1109127 - RNA, 20 nt, Human
guagcugggauuacaggcau

SEQ ID NO: 1109128 - RNA, 22 nt, Human
guccucccucugccucccgcug

SEQ ID NO: 1109129 - RNA, 24 nt, Human
gugauuauccugccucagccuccu

SEQ ID NO: 1109130 - RNA, 24 nt, Human
uaagugcugggauuacaggcguga

SEQ ID NO: 1109131 - RNA, 23 nt, Human
uacaggcaugugccaucacaucc

SEQ ID NO: 1109132 - RNA, 23 nt, Human
uacaggcgugagccacugugccc

SEQ ID NO: 1109133 - RNA, 24 nt, Human
uacaggcgugagccacugugccca

SEQ ID NO: 1109134 - RNA, 22 nt, Human
uacaggggcauaccaccacacc

SEQ ID NO: 1109135 - RNA, 20 nt, Human
uacuuuuuuuuuuuuuuuga

SEQ ID NO: 1109136 - RNA, 20 nt, Human
uagagacaugguuucaccau

SEQ ID NO: 1109137 - RNA, 18 nt, Human
uaugcaaggaccugagag

SEQ ID NO: 1109138 - RNA, 22 nt, Human
ucaccauuuugcccaggcaggc

SEQ ID NO: 1109139 - RNA, 18 nt, Human
ucaccgcaaccuccgccu

SEQ ID NO: 1109140 - RNA, 23 nt, Human
ucaccgcaaccuccgccucccgg

SEQ ID NO: 1109141 - RNA, 27 nt, Human
ucaccgcaaccuccgccucccggauuc

SEQ ID NO: 1109142 - RNA, 21 nt, Human
ucacugcaacccccaccccuu

SEQ ID NO: 1109143 - RNA, 23 nt, Human
ucacugcaacccccaccccuugg

SEQ ID NO: 1109144 - RNA, 24 nt, Human
ucacugcaacccccaccccuuggg

SEQ ID NO: 1109145 - RNA, 18 nt, Human
ucagccucccaaguagcu

SEQ ID NO: 1109146 - RNA, 20 nt, Human
ucagccuccugaguagcugg

SEQ ID NO: 1109147 - RNA, 18 nt, Human
ucauguacuuuuuuuuuu

SEQ ID NO: 1109148 - RNA, 25 nt, Human
ucccaaguagcugggacuacagggg

SEQ ID NO: 1109149 - RNA, 21 nt, Human
ucccggauucaagugauuauc

SEQ ID NO: 1109150 - RNA, 24 nt, Human
ucccggauucaagugauuauccug

SEQ ID NO: 1109151 - RNA, 19 nt, Human
uccgggauguuccaggguc

SEQ ID NO: 1109152 - RNA, 21 nt, Human
uccugaggucaagcaauuugc

SEQ ID NO: 1109153 - RNA, 24 nt, Human
uccugaguagcugggauuacaggc

SEQ ID NO: 1109154 - RNA, 23 nt, Human
ucgcccaggcuggggugcagugc

SEQ ID NO: 1109155 - RNA, 27 nt, Human
ucgcccaggcuggggugcagugcaucu

SEQ ID NO: 1109156 - RNA, 19 nt, Human
ucuggcucugucgcccagg

SEQ ID NO: 1109157 - RNA, 23 nt, Human
ucuggcucugucgcccaggcugg

SEQ ID NO: 1109158 - RNA, 24 nt, Human
ucuggcucugucgcccaggcuggg

SEQ ID NO: 1109159 - RNA, 27 nt, Human
ucuggcucugucgcccaggcuggggug

SEQ ID NO: 1109160 - RNA, 22 nt, Human
ugaaaggaauaaaaauuaugaa

SEQ ID NO: 1109161 - RNA, 22 nt, Human
ugaaaggcuuucccacauuuac

SEQ ID NO: 1109162 - RNA, 19 nt, Human
ugaauccuuucauguacuu

SEQ ID NO: 1109163 - RNA, 22 nt, Human
ugagacagggucuggcucuguc

SEQ ID NO: 1109164 - RNA, 23 nt, Human
ugagacagggucuggcucugucg

SEQ ID NO: 1109165 - RNA, 25 nt, Human
ugcaacccccaccccuugggcucaa

SEQ ID NO: 1109166 - RNA, 22 nt, Human
ugcaguggcgcgaucuuggcuc

SEQ ID NO: 1109167 - RNA, 18 nt, Human
ugcccaggcuggagugca

SEQ ID NO: 1109168 - RNA, 21 nt, Human
ugcccaggcuggagugcagug

SEQ ID NO: 1109169 - RNA, 22 nt, Human
ugcccaggcuggagugcagugg

SEQ ID NO: 1109170 - RNA, 24 nt, Human
ugccucagccuccugaguagcugg

SEQ ID NO: 1109171 - RNA, 24 nt, Human
ugcucuugcugcccaggcuggagu

SEQ ID NO: 1109172 - RNA, 24 nt, Human
ugcugggauuacaggcgugagcca

SEQ ID NO: 1109173 - RNA, 23 nt, Human
uggagugcaguggcgcgaucuug

SEQ ID NO: 1109174 - RNA, 24 nt, Human
uggagugcaguggcgcgaucuugg

SEQ ID NO: 1109175 - RNA, 24 nt, Human
uggcucugucgcccaggcuggggu

SEQ ID NO: 1109176 - RNA, 21 nt, Human
ugggacuacaggggcauacca

SEQ ID NO: 1109177 - RNA, 24 nt, Human
ugggacuacaggggcauaccacca

SEQ ID NO: 1109178 - RNA, 18 nt, Human
ugggauuacaggcaugug

SEQ ID NO: 1109179 - RNA, 19 nt, Human
ugggauuacaggcaugugc

SEQ ID NO: 1109180 - RNA, 21 nt, Human
ugggauuacaggcaugugcca

SEQ ID NO: 1109181 - RNA, 21 nt, Human
ugggauuacaggcaugugcca

SEQ ID NO: 1109182 - RNA, 22 nt, Human
ugggauuacaggcaugugccau

SEQ ID NO: 1109183 - RNA, 24 nt, Human
ugggauuacaggcaugugccauca

SEQ ID NO: 1109184 - RNA, 31 nt, Human
ugggauuacaggcaugugccaucacauccgg

SEQ ID NO: 1109185 - RNA, 18 nt, Human
ugggauuacaggcgugag

SEQ ID NO: 1109186 - RNA, 21 nt, Human
ugggauuacaggcgugagcca

SEQ ID NO: 1109187 - RNA, 22 nt, Human
ugggauuacaggcgugagccac

SEQ ID NO: 1109188 - RNA, 22 nt, Human
ugggauuacaggcgugagccac

SEQ ID NO: 1109189 - RNA, 22 nt, Human
ugggauuacaggcgugagccac

SEQ ID NO: 1109190 - RNA, 24 nt, Human
ugggauuacaggcgugagccacug

SEQ ID NO: 1109191 - RNA, 26 nt, Human
ugggauuacaggcgugagccacugug

SEQ ID NO: 1109192 - RNA, 22 nt, Human
ugggcucaagagaucuucccac

SEQ ID NO: 1109193 - RNA, 24 nt, Human
ugggcucaagagaucuucccaccu

SEQ ID NO: 1109194 - RNA, 19 nt, Human
uggggugcagugcaucuug

SEQ ID NO: 1109195 - RNA, 18 nt, Human
uguaugcccagggggugg

SEQ ID NO: 1109196 - RNA, 23 nt, Human
uguccaguguaaguuuauucaug

SEQ ID NO: 1109197 - RNA, 21 nt, Human
ugucgcccaggcuggggugca

SEQ ID NO: 1109198 - RNA, 21 nt, Human
uucaagugauuauccugccuc

SEQ ID NO: 1109199 - RNA, 23 nt, Human
uucaagugauuauccugccucag

SEQ ID NO: 1109200 - RNA, 24 nt, Human
uucaugauaucaaagggaacugga

SEQ ID NO: 1109201 - RNA, 19 nt, Human
uuccaggguccucccucug

SEQ ID NO: 1109202 - RNA, 23 nt, Human
uucccaccucagccucccaagua

SEQ ID NO: 1109203 - RNA, 25 nt, Human
uugagacagggucuggcucugucgc

SEQ ID NO: 1109204 - RNA, 18 nt, Human
uugcccaggcaggccuca

SEQ ID NO: 1109205 - RNA, 23 nt, Human
uugcucuugcugcccaggcugga

SEQ ID NO: 1109206 - RNA, 19 nt, Human
uuuauagaguaucucucca

SEQ ID NO: 1109207 - RNA, 21 nt, Human
uuugcccacccuaagugcugg

SEQ ID NO: 1109208 - RNA, 24 nt, Human
uuugcucuugcugcccaggcugga

SEQ ID NO: 1109209 - RNA, 24 nt, Human
uuuguagagacaugguuucaccau

SEQ ID NO: 1109210 - RNA, 23 nt, Human
uuuugcucuugcugcccaggcug

SEQ ID NO: 1109211 - RNA, 24 nt, Human
uuuugcucuugcugcccaggcugg

SEQ ID NO: 1109212 - RNA, 24 nt, Human
uuuuuuguagagacaugguuucac

SEQ ID NO: 1109213 - RNA, 23 nt, Human
uuuuuuuuugagacagggucugg

SEQ ID NO: 1109214 - RNA, 19 nt, Human
uuuuuuuuuuugugugugu

SEQ ID NO: 1109215 - RNA, 23 nt, Human
uuuuuuuuuuugugugugugaca

SEQ ID NO: 1109216 - RNA, 23 nt, Human
uuuuuuuuuuuugagacaggguc

SEQ ID NO: 1109217 - RNA, 24 nt, Human
uuuuuuuuuuuuuuugagacaggg

SEQ ID NO: 1109218 - RNA, 19 nt, Human
uuuuuuuuuuuuuuugugu

SEQ ID NO: 1109219 - RNA, 23 nt, Human
aaaaagaucuauguccccacauu

SEQ ID NO: 1109220 - RNA, 23 nt, Human
aagagugaaacucugucucaaaa

SEQ ID NO: 1109221 - RNA, 24 nt, Human
aaucgcuugaacccaggaggcaga

SEQ ID NO: 1109222 - RNA, 20 nt, Human
acaagagugaaacucugucu

SEQ ID NO: 1109223 - RNA, 21 nt, Human
acaagagugaaacucugucuc

SEQ ID NO: 1109224 - RNA, 19 nt, Human
accauggugaaacuccauc

SEQ ID NO: 1109225 - RNA, 20 nt, Human
accauggugaaacuccaucu

SEQ ID NO: 1109226 - RNA, 21 nt, Human
accauggugaaacuccaucuc

SEQ ID NO: 1109227 - RNA, 24 nt, Human
accugaggucaggaguucaagacc

SEQ ID NO: 1109228 - RNA, 21 nt, Human
accugcucguggcgccccagc

SEQ ID NO: 1109229 - RNA, 18 nt, Human
acuuuggaggcugaggca

SEQ ID NO: 1109230 - RNA, 22 nt, Human
agagguugcugugagcugagau

SEQ ID NO: 1109231 - RNA, 24 nt, Human
agagguugcugugagcugagauug

SEQ ID NO: 1109232 - RNA, 28 nt, Human
agagguugcugugagcugagauugugcc

SEQ ID NO: 1109233 - RNA, 23 nt, Human
agcaggcugagcagccccuggcu

SEQ ID NO: 1109234 - RNA, 20 nt, Human
agccgucgcugcugcgccuc

SEQ ID NO: 1109235 - RNA, 22 nt, Human
agccugaccaccauggugaaac

SEQ ID NO: 1109236 - RNA, 23 nt, Human
agcugggugugguggcgcaugcc

SEQ ID NO: 1109237 - RNA, 20 nt, Human
aggcagagguugcugugagc

SEQ ID NO: 1109238 - RNA, 23 nt, Human
aggcaggagaaucgcuugaaccc

SEQ ID NO: 1109239 - RNA, 24 nt, Human
aggcaggagaaucgcuugaaccca

SEQ ID NO: 1109240 - RNA, 21 nt, Human
aggccaaggcgggcgggugga

SEQ ID NO: 1109241 - RNA, 25 nt, Human
aggccaaggcgggcggguggaucac

SEQ ID NO: 1109242 - RNA, 26 nt, Human
aggcgggcggguggaucaccugaggu

SEQ ID NO: 1109243 - RNA, 20 nt, Human
aggcugaggcaggagaaucg

SEQ ID NO: 1109244 - RNA, 24 nt, Human
aggcugaggcaggagaaucgcuug

SEQ ID NO: 1109245 - RNA, 20 nt, Human
auggcucacgccuggaaucc

SEQ ID NO: 1109246 - RNA, 25 nt, Human
auugcacuccagacuggacaacaag

SEQ ID NO: 1109247 - RNA, 24 nt, Human
auugugccauugcacuccagacug

SEQ ID NO: 1109248 - RNA, 18 nt, Human
caccauggugaaacucca

SEQ ID NO: 1109249 - RNA, 23 nt, Human
caccugaggucaggaguucaaga

SEQ ID NO: 1109250 - RNA, 24 nt, Human
cacgccuggaauccuagcacuuug

SEQ ID NO: 1109251 - RNA, 24 nt, Human
cacuccagacuggacaacaagagu

SEQ ID NO: 1109252 - RNA, 20 nt, Human
cagccccuggcucaccuccu

SEQ ID NO: 1109253 - RNA, 25 nt, Human
caugccuguaaucccagcuacuuug

SEQ ID NO: 1109254 - RNA, 18 nt, Human
cauggugaaacuccaucu

SEQ ID NO: 1109255 - RNA, 19 nt, Human
cauugcacuccagacugga

SEQ ID NO: 1109256 - RNA, 20 nt, Human
cauugcacuccagacuggac

SEQ ID NO: 1109257 - RNA, 22 nt, Human
cauugcacuccagacuggacaa

SEQ ID NO: 1109258 - RNA, 24 nt, Human
cauugcacuccagacuggacaaca

SEQ ID NO: 1109259 - RNA, 18 nt, Human
ccauugcacuccagacug

SEQ ID NO: 1109260 - RNA, 19 nt, Human
ccauugcacuccagacugg

SEQ ID NO: 1109261 - RNA, 21 nt, Human
ccauugcacuccagacuggac

SEQ ID NO: 1109262 - RNA, 24 nt, Human
ccugaccaccauggugaaacucca

SEQ ID NO: 1109263 - RNA, 18 nt, Human
ccuguaaucccagcuacu

SEQ ID NO: 1109264 - RNA, 22 nt, Human
ccuguaaucccagcuacuuugg

SEQ ID NO: 1109265 - RNA, 20 nt, Human
cgcagcugcuucucggcacc

SEQ ID NO: 1109266 - RNA, 21 nt, Human
cggcagaugcccgcugggugc

SEQ ID NO: 1109267 - RNA, 25 nt, Human
cgggcggguggaucaccugagguca

SEQ ID NO: 1109268 - RNA, 24 nt, Human
cggguggaucaccugaggucagga

SEQ ID NO: 1109269 - RNA, 20 nt, Human
cgucuugcguuuccagcagc

SEQ ID NO: 1109270 - RNA, 18 nt, Human
cucaaaaaaaaaaaaaaa

SEQ ID NO: 1109271 - RNA, 24 nt, Human
cucaaaaaaaaaaaaaaaaagauc

SEQ ID NO: 1109272 - RNA, 24 nt, Human
cucacgccuggaauccuagcacuu

SEQ ID NO: 1109273 - RNA, 23 nt, Human
cucguggcgccccagcagccguc

SEQ ID NO: 1109274 - RNA, 19 nt, Human
cucugucucaaaaaaaaaa

SEQ ID NO: 1109275 - RNA, 21 nt, Human
cugcugcgccuccgcgcgguu

SEQ ID NO: 1109276 - RNA, 23 nt, Human
cugcugcgccuccgcgcgguugg

SEQ ID NO: 1109277 - RNA, 28 nt, Human
cugucucaaaaaaaaaaaaaaaaagauc

SEQ ID NO: 1109278 - RNA, 18 nt, Human
cugugagcugagauugug

SEQ ID NO: 1109279 - RNA, 20 nt, Human
gaccaccauggugaaacucc

SEQ ID NO: 1109280 - RNA, 23 nt, Human
gagaaucgcuugaacccaggagg

SEQ ID NO: 1109281 - RNA, 23 nt, Human
gagauugugccauugcacuccag

SEQ ID NO: 1109282 - RNA, 21 nt, Human
gaucaccugaggucaggaguu

SEQ ID NO: 1109283 - RNA, 23 nt, Human
gaucaccugaggucaggaguuca

SEQ ID NO: 1109284 - RNA, 24 nt, Human
gaucaccugaggucaggaguucaa

SEQ ID NO: 1109285 - RNA, 22 nt, Human
gcagccccuggcucaccuccuc

SEQ ID NO: 1109286 - RNA, 22 nt, Human
gcaggagaaucgcuugaaccca

SEQ ID NO: 1109287 - RNA, 30 nt, Human
gccuggaauccuagcacuuugggaggccaa

SEQ ID NO: 1109288 - RNA, 20 nt, Human
gccuguaaucccagcuacuu

SEQ ID NO: 1109289 - RNA, 22 nt, Human
ggaggccaaggcgggcgggugg

SEQ ID NO: 1109290 - RNA, 21 nt, Human
ggcggguggaucaccugaggu

SEQ ID NO: 1109291 - RNA, 22 nt, Human
gggcacgauggcucacgccugg

SEQ ID NO: 1109292 - RNA, 24 nt, Human
gguggcgcaugccuguaaucccag

SEQ ID NO: 1109293 - RNA, 19 nt, Human
ggugugguggcgcaugccu

SEQ ID NO: 1109294 - RNA, 23 nt, Human
ggugugguggcgcaugccuguaa

SEQ ID NO: 1109295 - RNA, 24 nt, Human
uagcacuuugggaggccaaggcgg

SEQ ID NO: 1109296 - RNA, 23 nt, Human
ucaccugaggucaggaguucaag

SEQ ID NO: 1109297 - RNA, 19 nt, Human
uccgcgcgguuggcgccca

SEQ ID NO: 1109298 - RNA, 24 nt, Human
ucuagcugggcacgauggcucacg

SEQ ID NO: 1109299 - RNA, 21 nt, Human
ucucuaccaaauacaaaaaau

SEQ ID NO: 1109300 - RNA, 23 nt, Human
ucugucucaaaaaaaaaaaaaaa

SEQ ID NO: 1109301 - RNA, 25 nt, Human
ucugucucaaaaaaaaaaaaaaaaa

SEQ ID NO: 1109302 - RNA, 19 nt, Human
ucuugcguuuccagcagcc

SEQ ID NO: 1109303 - RNA, 20 nt, Human
ugaggcaggagaaucgcuug

SEQ ID NO: 1109304 - RNA, 24 nt, Human
ugaggcaggagaaucgcuugaacc

SEQ ID NO: 1109305 - RNA, 25 nt, Human
ugaggcaggagaaucgcuugaaccc

SEQ ID NO: 1109306 - RNA, 25 nt, Human
ugcacuccagacuggacaacaagag

SEQ ID NO: 1109307 - RNA, 19 nt, Human
ugccuguaaucccagcuac

SEQ ID NO: 1109308 - RNA, 24 nt, Human
ugccuguaaucccagcuacuuugg

SEQ ID NO: 1109309 - RNA, 21 nt, Human
ugcucguggcgccccagcagc

SEQ ID NO: 1109310 - RNA, 24 nt, Human
uggaucaccugaggucaggaguuc

SEQ ID NO: 1109311 - RNA, 26 nt, Human
uggaucaccugaggucaggaguucaa

SEQ ID NO: 1109312 - RNA, 21 nt, Human
uggcgcaugccuguaauccca

SEQ ID NO: 1109313 - RNA, 22 nt, Human
uggcgcaugccuguaaucccag

SEQ ID NO: 1109314 - RNA, 21 nt, Human
uggcgcccagcaggcugagca

SEQ ID NO: 1109315 - RNA, 24 nt, Human
uggcucacgccuggaauccuagca

SEQ ID NO: 1109316 - RNA, 28 nt, Human
ugggaggccaaggcgggcggguggauca

SEQ ID NO: 1109317 - RNA, 18 nt, Human
ugggugugguggcgcaug

SEQ ID NO: 1109318 - RNA, 24 nt, Human
ugguggcgcaugccuguaauccca

SEQ ID NO: 1109319 - RNA, 18 nt, Human
uuagcugggugugguggc

SEQ ID NO: 1109320 - RNA, 19 nt, Human
uuagcugggugugguggcg

SEQ ID NO: 1109321 - RNA, 24 nt, Human
uuagcugggugugguggcgcaugc

SEQ ID NO: 1109322 - RNA, 19 nt, Human
uucauuugaaauggaucug

SEQ ID NO: 1109323 - RNA, 19 nt, Human
uugcugugagcugagauug

SEQ ID NO: 1109324 - RNA, 23 nt, Human
uuggaggcugaggcaggagaauc

SEQ ID NO: 1109325 - RNA, 23 nt, Human
uugugccauugcacuccagacug

SEQ ID NO: 1109326 - RNA, 21 nt, Human
aacccuuuguuggaaugcuuu

SEQ ID NO: 1109327 - RNA, 22 nt, Human
aacccuuuguuggaaugcuuuc

SEQ ID NO: 1109328 - RNA, 20 nt, Human
agcauggggugcaaaaagaa

SEQ ID NO: 1109329 - RNA, 19 nt, Human
caacagcauggggugcaaa

SEQ ID NO: 1109330 - RNA, 22 nt, Human
cagcauggggugcaaaaagaaa

SEQ ID NO: 1109331 - RNA, 21 nt, Human
cagggugaagagagacuuuaa

SEQ ID NO: 1109332 - RNA, 21 nt, Human
cuuuccacagaacagaaacua

SEQ ID NO: 1109333 - RNA, 20 nt, Human
gaagagagacuuuaacgaug

SEQ ID NO: 1109334 - RNA, 24 nt, Human
guuuuuugcccauacacaugaguc

SEQ ID NO: 1109335 - RNA, 20 nt, Human
ucucuggcucuccucuccug

SEQ ID NO: 1109336 - RNA, 22 nt, Human
aaaaaaagaaagggaaacagag

SEQ ID NO: 1109337 - RNA, 18 nt, Human
aaaaaagaaagggaaaca

SEQ ID NO: 1109338 - RNA, 23 nt, Human
aaaaaagaaagggaaacagagag

SEQ ID NO: 1109339 - RNA, 21 nt, Human
aaagaaagggaaacagagagu

SEQ ID NO: 1109340 - RNA, 21 nt, Human
aaagggaaacagagagugggg

SEQ ID NO: 1109341 - RNA, 25 nt, Human
acaaaaaaagaaagggaaacagaga

SEQ ID NO: 1109342 - RNA, 21 nt, Human
acggcuccggagugcagcauc

SEQ ID NO: 1109343 - RNA, 22 nt, Human
aggagcccuggagagaggggac

SEQ ID NO: 1109344 - RNA, 22 nt, Human
aggggacaaaaaaagaaaggga

SEQ ID NO: 1109345 - RNA, 22 nt, Human
caaacuagccacacugccgagc

SEQ ID NO: 1109346 - RNA, 20 nt, Human
cacaaacuagccacacugcc

SEQ ID NO: 1109347 - RNA, 21 nt, Human
cacagguaggaggucaccagg

SEQ ID NO: 1109348 - RNA, 21 nt, Human
caccagguaggacaccaccgg

SEQ ID NO: 1109349 - RNA, 23 nt, Human
cacccuggcugggcaccaggggc

SEQ ID NO: 1109350 - RNA, 18 nt, Human
cagcgucugaguuccgcu

SEQ ID NO: 1109351 - RNA, 23 nt, Human
caggagcccuggagagaggggac

SEQ ID NO: 1109352 - RNA, 26 nt, Human
ccacacaaacuagccacacugccgag

SEQ ID NO: 1109353 - RNA, 21 nt, Human
ccaccuggggacaagggugga

SEQ ID NO: 1109354 - RNA, 24 nt, Human
ccgccgcgcauucaagggcugccc

SEQ ID NO: 1109355 - RNA, 25 nt, Human
ccgccgcgcauucaagggcugcccu

SEQ ID NO: 1109356 - RNA, 19 nt, Human
ccucgcugcgcccugcugc

SEQ ID NO: 1109357 - RNA, 21 nt, Human
cugaagagaaaucaggagccc

SEQ ID NO: 1109358 - RNA, 22 nt, Human
cugcccucugcuucacaugccc

SEQ ID NO: 1109359 - RNA, 18 nt, Human
gagagagagacaucccac

SEQ ID NO: 1109360 - RNA, 25 nt, Human
gagcugaggccggaacuccgggaaa

SEQ ID NO: 1109361 - RNA, 22 nt, Human
gaggggcccguucugcagaagg

SEQ ID NO: 1109362 - RNA, 18 nt, Human
gcugggcaccaggggcag

SEQ ID NO: 1109363 - RNA, 18 nt, Human
ggaaacagagaguggggg

SEQ ID NO: 1109364 - RNA, 19 nt, Human
ggaaagaaguuccaugcag

SEQ ID NO: 1109365 - RNA, 18 nt, Human
ggacaaaaaaagaaaggg

SEQ ID NO: 1109366 - RNA, 22 nt, Human
ggcccggggugcgcucggaguc

SEQ ID NO: 1109367 - RNA, 20 nt, Human
guggcggggaagccagaaaa

SEQ ID NO: 1109368 - RNA, 23 nt, Human
guuuggauguccgccucgcugcg

SEQ ID NO: 1109369 - RNA, 24 nt, Human
uaacugaaaagagcgucaggcuga

SEQ ID NO: 1109370 - RNA, 23 nt, Human
uaggacaccaccggacuugggug

SEQ ID NO: 1109371 - RNA, 20 nt, Human
uccaccuggggacaaggguu

SEQ ID NO: 1109372 - RNA, 23 nt, Human
ugaaaagagcgucaggcugaaga

SEQ ID NO: 1109373 - RNA, 26 nt, Human
ugcagcaucaagucgcuggcgucccc

SEQ ID NO: 1109374 - RNA, 19 nt, Human
ugcugcacggcccacccgc

SEQ ID NO: 1109375 - RNA, 24 nt, Human
ugcuucacaugcccacugggcuua

SEQ ID NO: 1109376 - RNA, 20 nt, Human
uggcugggcaccaggggcag

SEQ ID NO: 1109377 - RNA, 18 nt, Human
ugggcggugcugugucca

SEQ ID NO: 1109378 - RNA, 20 nt, Human
uggggacaaggguggacauc

SEQ ID NO: 1109379 - RNA, 21 nt, Human
ugggggagagagagacauccc

SEQ ID NO: 1109380 - RNA, 22 nt, Human
ugggggagagagagacauccca

SEQ ID NO: 1109381 - RNA, 22 nt, Human
uguccgccucgcugcgcccugc

SEQ ID NO: 1109382 - RNA, 23 nt, Human
aggaccaagaccaaggccuggga

SEQ ID NO: 1109383 - RNA, 23 nt, Human
agggcacgauggaggugaaggug

SEQ ID NO: 1109384 - RNA, 21 nt, Human
auggaggugaaggugucuaca

SEQ ID NO: 1109385 - RNA, 25 nt, Human
caagaccaaggccugggacaacugg

SEQ ID NO: 1109386 - RNA, 22 nt, Human
caggcccugggucccaaaggcc

SEQ ID NO: 1109387 - RNA, 27 nt, Human
cccaggaccaagaccaaggccugggac

SEQ ID NO: 1109388 - RNA, 22 nt, Human
ccugggucccaaaggccgagag

SEQ ID NO: 1109389 - RNA, 19 nt, Human
gaggugaaggugucuacag

SEQ ID NO: 1109390 - RNA, 19 nt, Human
gcccugggucccaaaggcc

SEQ ID NO: 1109391 - RNA, 18 nt, Human
ggcccaggaccaagacca

SEQ ID NO: 1109392 - RNA, 19 nt, Human
uggcaggcccuggguccca

SEQ ID NO: 1109393 - RNA, 23 nt, Human
uggcaggcccugggucccaaagg

SEQ ID NO: 1109394 - RNA, 21 nt, Human
uuguacgcguguacuccggcc

SEQ ID NO: 1109395 - RNA, 19 nt, Human
uuuguacgcguguacuccg

SEQ ID NO: 1109396 - RNA, 21 nt, Human
uuuguacgcguguacuccggc

SEQ ID NO: 1109397 - RNA, 24 nt, Human
acaccacugcacuccagcguaggc

SEQ ID NO: 1109398 - RNA, 25 nt, Human
acugcacuccagcguaggacaacgg

SEQ ID NO: 1109399 - RNA, 26 nt, Human
acugcacuccagcguaggacaucggg

SEQ ID NO: 1109400 - RNA, 21 nt, Human
agaaauggaaaggagaagaga

SEQ ID NO: 1109401 - RNA, 22 nt, Human
agccccuuccuguguccccucc

SEQ ID NO: 1109402 - RNA, 23 nt, Human
aggcaggaaaaucgcuugagucc

SEQ ID NO: 1109403 - RNA, 24 nt, Human
aggcaggaaaaucgcuugagucca

SEQ ID NO: 1109404 - RNA, 22 nt, Human
aggccuccugguccucuuccag

SEQ ID NO: 1109405 - RNA, 21 nt, Human
agguugaggcaggaaaaucgc

SEQ ID NO: 1109406 - RNA, 24 nt, Human
agguugaggcaggaaaaucgcuug

SEQ ID NO: 1109407 - RNA, 20 nt, Human
aguuccuggcacauaagggc

SEQ ID NO: 1109408 - RNA, 20 nt, Human
aucacaccacugcacuccag

SEQ ID NO: 1109409 - RNA, 20 nt, Human
caaaacaagacccuccucac

SEQ ID NO: 1109410 - RNA, 26 nt, Human
caccacugcacuccagcguaggcgac

SEQ ID NO: 1109411 - RNA, 19 nt, Human
cacugcacuccagcguagg

SEQ ID NO: 1109412 - RNA, 20 nt, Human
cacugcacuccagcguaggc

SEQ ID NO: 1109413 - RNA, 22 nt, Human
cacugcacuccagcguaggcga

SEQ ID NO: 1109414 - RNA, 23 nt, Human
cacugcacuccagcguaggcgac

SEQ ID NO: 1109415 - RNA, 20 nt, Human
ccacugcacuccagcguagg

SEQ ID NO: 1109416 - RNA, 20 nt, Human
ccacugcacuccagcguagg

SEQ ID NO: 1109417 - RNA, 21 nt, Human
ccacugcacuccagcguaggc

SEQ ID NO: 1109418 - RNA, 24 nt, Human
ccacugcacuccagcguaggcgac

SEQ ID NO: 1109419 - RNA, 25 nt, Human
ccacugcacuccagcguaggcgaca

SEQ ID NO: 1109420 - RNA, 22 nt, Human
ccaggaaguugaggcugcagug

SEQ ID NO: 1109421 - RNA, 21 nt, Human
ccguggccaccaccucccauc

SEQ ID NO: 1109422 - RNA, 22 nt, Human
ccucacaauucaugcaagugcc

SEQ ID NO: 1109423 - RNA, 25 nt, Human
ccucacaggcguggcugaggggugg

SEQ ID NO: 1109424 - RNA, 20 nt, Human
ccuguguccccuccagggcc

SEQ ID NO: 1109425 - RNA, 20 nt, Human
cgaccuggccgccaucuugg

SEQ ID NO: 1109426 - RNA, 18 nt, Human
cuuccuguguccccucca

SEQ ID NO: 1109427 - RNA, 18 nt, Human
cuugggagguugaggcag

SEQ ID NO: 1109428 - RNA, 19 nt, Human
gaccuggccgccaucuugg

SEQ ID NO: 1109429 - RNA, 23 nt, Human
gagaggccguggccaccaccucc

SEQ ID NO: 1109430 - RNA, 19 nt, Human
gagcaggcgaccuggccgc

SEQ ID NO: 1109431 - RNA, 19 nt, Human
gcaccacaucuccauugcu

SEQ ID NO: 1109432 - RNA, 21 nt, Human
gcaggcagccccuuccugugu

SEQ ID NO: 1109433 - RNA, 22 nt, Human
gcccgcgcaacggccgggcacc

SEQ ID NO: 1109434 - RNA, 20 nt, Human
gcugugaucacaccacugca

SEQ ID NO: 1109435 - RNA, 18 nt, Human
ggagaagagagcgcgggc

SEQ ID NO: 1109436 - RNA, 22 nt, Human
ggccgggcacccggcgguucag

SEQ ID NO: 1109437 - RNA, 19 nt, Human
uacgucaucagcccgcgca

SEQ ID NO: 1109438 - RNA, 21 nt, Human
ucagcccgcgcaacggccggg

SEQ ID NO: 1109439 - RNA, 21 nt, Human
uccguacgucaucagcccgcg

SEQ ID NO: 1109440 - RNA, 23 nt, Human
uccguacgucaucagcccgcggu

SEQ ID NO: 1109441 - RNA, 24 nt, Human
ucgcuugaguccaggaaguugagg

SEQ ID NO: 1109442 - RNA, 20 nt, Human
ugaggcaggaaaaucgcuug

SEQ ID NO: 1109443 - RNA, 24 nt, Human
ugaggcaggaaaaucgcuugaguc

SEQ ID NO: 1109444 - RNA, 25 nt, Human
ugaggcaggaaaaucgcuugagucc

SEQ ID NO: 1109445 - RNA, 23 nt, Human
ugaggcugcagugagcugugauc

SEQ ID NO: 1109446 - RNA, 21 nt, Human
ugggagagggcaacgccggca

SEQ ID NO: 1109447 - RNA, 19 nt, Human
ugggaggcccgagcaggcg

SEQ ID NO: 1109448 - RNA, 22 nt, Human
ugggagguugaggcaggaaaau

SEQ ID NO: 1109449 - RNA, 23 nt, Human
ugggagguugaggcaggaaaauc

SEQ ID NO: 1109450 - RNA, 20 nt, Human
uguccauggggaucuggggu

SEQ ID NO: 1109451 - RNA, 18 nt, Human
uugaagggucauagguca

SEQ ID NO: 1109452 - RNA, 25 nt, Human
caccuguccccccuuuucgccccca

SEQ ID NO: 1109453 - RNA, 22 nt, Human
cagccuccucccccaccugucc

SEQ ID NO: 1109454 - RNA, 26 nt, Human
cagccuccucccccaccugucccccc

SEQ ID NO: 1109455 - RNA, 23 nt, Human
ccacuccccgcucuucucgaucu

SEQ ID NO: 1109456 - RNA, 18 nt, Human
ccccaccuguccccccuu

SEQ ID NO: 1109457 - RNA, 19 nt, Human
ccccaccuguccccccuuu

SEQ ID NO: 1109458 - RNA, 21 nt, Human
ccccaccuguccccccuuuuc

SEQ ID NO: 1109459 - RNA, 21 nt, Human
ccccacuccccgcucuucucg

SEQ ID NO: 1109460 - RNA, 18 nt, Human
ccccccuuuucgccccca

SEQ ID NO: 1109461 - RNA, 25 nt, Human
ccccgcucuucucgaucuucuuucu

SEQ ID NO: 1109462 - RNA, 20 nt, Human
cccucgggcuuuccccagcc

SEQ ID NO: 1109463 - RNA, 22 nt, Human
ccucccucccucucuuccuccc

SEQ ID NO: 1109464 - RNA, 25 nt, Human
cugcgucuucagcaccaaugucgac

SEQ ID NO: 1109465 - RNA, 24 nt, Human
cugcgucuucagcaccaaugucgg

SEQ ID NO: 1109466 - RNA, 19 nt, Human
cuguccccccuuuucgccc

SEQ ID NO: 1109467 - RNA, 20 nt, Human
cuguccccccuuuucgcccc

SEQ ID NO: 1109468 - RNA, 18 nt, Human
cuucuuucuggccgaccc

SEQ ID NO: 1109469 - RNA, 19 nt, Human
cuuuucgcccccacucccc

SEQ ID NO: 1109470 - RNA, 24 nt, Human
gaaggcgagauccagcucuccacu

SEQ ID NO: 1109471 - RNA, 22 nt, Human
gcaccaaugucgggagaggcca

SEQ ID NO: 1109472 - RNA, 21 nt, Human
gcgucuucagcaccaaugucg

SEQ ID NO: 1109473 - RNA, 20 nt, Human
gcuuuccccagccuccuccc

SEQ ID NO: 1109474 - RNA, 21 nt, Human
gcuuuccccagccuccucccc

SEQ ID NO: 1109475 - RNA, 23 nt, Human
ggagaggccacggggccacacug

SEQ ID NO: 1109476 - RNA, 22 nt, Human
uccccagccuccucccccaccu

SEQ ID NO: 1109477 - RNA, 24 nt, Human
uccccagccuccucccccaccugu

SEQ ID NO: 1109478 - RNA, 21 nt, Human
ucccccaccuguccccccuuu

SEQ ID NO: 1109479 - RNA, 23 nt, Human
ucccucgggcuuuccccagccuc

SEQ ID NO: 1109480 - RNA, 21 nt, Human
ugucgggagaggccacggggc

SEQ ID NO: 1109481 - RNA, 21 nt, Human
uuuccccagccuccuccccca

SEQ ID NO: 1109482 - RNA, 19 nt, Human
aaaggaggggguugagcuc

SEQ ID NO: 1109483 - RNA, 21 nt, Human
aaaggaggggguugagcucug

SEQ ID NO: 1109484 - RNA, 19 nt, Human
agaaaggaggggguugagc

SEQ ID NO: 1109485 - RNA, 21 nt, Human
agaacccaaccuguaccucuc

SEQ ID NO: 1109486 - RNA, 24 nt, Human
cagagacagcaaugguaggcagag

SEQ ID NO: 1109487 - RNA, 18 nt, Human
ccacugggagaaaggagg

SEQ ID NO: 1109488 - RNA, 19 nt, Human
gagaacccaaccuguaccu

SEQ ID NO: 1109489 - RNA, 18 nt, Human
ggaaaccuuuucuccgcu

SEQ ID NO: 1109490 - RNA, 21 nt, Human
ggaggggguugagcucuggaa

SEQ ID NO: 1109491 - RNA, 22 nt, Human
gguaggcagagaacccaaccug

SEQ ID NO: 1109492 - RNA, 23 nt, Human
uagggaaaccuuuucuccgcuug

SEQ ID NO: 1109493 - RNA, 21 nt, Human
ugggagaaaggaggggguuga

SEQ ID NO: 1109494 - RNA, 20 nt, Human
acauuggaaaaaccacuuua

SEQ ID NO: 1109495 - RNA, 19 nt, Human
agaucuagucuccacuccu

SEQ ID NO: 1109496 - RNA, 22 nt, Human
agguguguacauuggaaaaacc

SEQ ID NO: 1109497 - RNA, 23 nt, Human
cacauauuaccuuagccuauguu

SEQ ID NO: 1109498 - RNA, 20 nt, Human
caggcaauagugccugggcc

SEQ ID NO: 1109499 - RNA, 22 nt, Human
ccuggcgcugagagcccaggaa

SEQ ID NO: 1109500 - RNA, 24 nt, Human
ccuggcgcugagagcccaggaacu

SEQ ID NO: 1109501 - RNA, 22 nt, Human
cgcugagagcccaggaacucca

SEQ ID NO: 1109502 - RNA, 22 nt, Human
cucuacugguacacauauuacc

SEQ ID NO: 1109503 - RNA, 24 nt, Human
cuggcgcugagagcccaggaacuc

SEQ ID NO: 1109504 - RNA, 21 nt, Human
gagcccaggaacuccaggcaa

SEQ ID NO: 1109505 - RNA, 20 nt, Human
gcccaggaacuccaggcaag

SEQ ID NO: 1109506 - RNA, 18 nt, Human
gggcugggucugguucga

SEQ ID NO: 1109507 - RNA, 22 nt, Human
gggcugggucugguucgagggc

SEQ ID NO: 1109508 - RNA, 18 nt, Human
uagucuccacuccugagu

SEQ ID NO: 1109509 - RNA, 18 nt, Human
uccuggcgcugagagccc

SEQ ID NO: 1109510 - RNA, 21 nt, Human
ugccugggcuacagggcuggg

SEQ ID NO: 1109511 - RNA, 22 nt, Human
uuagugaaaguugauuuucuuu

SEQ ID NO: 1109512 - RNA, 21 nt, Human
uuccucaggcuucucuacugg

SEQ ID NO: 1109513 - RNA, 18 nt, Human
uuguaaauuccucaggcu

SEQ ID NO: 1109514 - RNA, 24 nt, Human
acugccaauccauaaugaccacga

SEQ ID NO: 1109515 - RNA, 18 nt, Human
gaccacgacuccuguuug

SEQ ID NO: 1109516 - RNA, 18 nt, Human
gguguuggcuguuguggc

SEQ ID NO: 1109517 - RNA, 24 nt, Human
guuggcuguuguggcugcccuucu

SEQ ID NO: 1109518 - RNA, 24 nt, Human
uaaugaccacgacuccuguuuggu

SEQ ID NO: 1109519 - RNA, 22 nt, Human
uggcuguuguggcugcccuucu

SEQ ID NO: 1109520 - RNA, 21 nt, Human
uguuggcuguuguggcugccc

SEQ ID NO: 1109521 - RNA, 24 nt, Human
uguuggcuguuguggcugcccuuc

SEQ ID NO: 1109522 - RNA, 24 nt, Human
acacuacauuaaaaauuaccuagu

SEQ ID NO: 1109523 - RNA, 22 nt, Human
acuacauuaaaaauuaccuagu

SEQ ID NO: 1109524 - RNA, 20 nt, Human
cacacgugugccugugugug

SEQ ID NO: 1109525 - RNA, 21 nt, Human
cacgugucuguuugccugugg

SEQ ID NO: 1109526 - RNA, 20 nt, Human
cagcuucgaggcuaccaccu

SEQ ID NO: 1109527 - RNA, 20 nt, Human
ccggagcuggcgcgggggag

SEQ ID NO: 1109528 - RNA, 25 nt, Human
cugugugugcgucucugcacguguc

SEQ ID NO: 1109529 - RNA, 21 nt, Human
cuucgaggcuaccaccugccc

SEQ ID NO: 1109530 - RNA, 20 nt, Human
cuugagucccgguuccuucg

SEQ ID NO: 1109531 - RNA, 23 nt, Human
cuuggagggcucggugccggagg

SEQ ID NO: 1109532 - RNA, 22 nt, Human
gacgugugugugcgcgcgugug

SEQ ID NO: 1109533 - RNA, 23 nt, Human
gacgugugugugcgcgcgugugu

SEQ ID NO: 1109534 - RNA, 22 nt, Human
gagccggagcuggcgcggggga

SEQ ID NO: 1109535 - RNA, 22 nt, Human
gaugcagccucccagcuucgag

SEQ ID NO: 1109536 - RNA, 19 nt, Human
gccugugugugcgucucug

SEQ ID NO: 1109537 - RNA, 21 nt, Human
gggccucgggcuacuggaucc

SEQ ID NO: 1109538 - RNA, 19 nt, Human
gggugugcgcgcacgucuc

SEQ ID NO: 1109539 - RNA, 18 nt, Human
ggugccggaggcuacucu

SEQ ID NO: 1109540 - RNA, 19 nt, Human
gucaggagcccgggucugg

SEQ ID NO: 1109541 - RNA, 20 nt, Human
gugugugugcgcgcguguga

SEQ ID NO: 1109542 - RNA, 19 nt, Human
uaggaggaggcuugagaug

SEQ ID NO: 1109543 - RNA, 23 nt, Human
ucagggucucuuaaggacccucc

SEQ ID NO: 1109544 - RNA, 22 nt, Human
ucuguguuugcaucucugugug

SEQ ID NO: 1109545 - RNA, 20 nt, Human
ugacauuaauuacacuacau

SEQ ID NO: 1109546 - RNA, 22 nt, Human
ugccuguggugcacacgcgugg

SEQ ID NO: 1109547 - RNA, 20 nt, Human
ugccugugugcacacgugug

SEQ ID NO: 1109548 - RNA, 19 nt, Human
ugcgcgcacgucuccgugu

SEQ ID NO: 1109549 - RNA, 20 nt, Human
ugcgcgcgugugucucucuu

SEQ ID NO: 1109550 - RNA, 18 nt, Human
uggagggcucggugccgg

SEQ ID NO: 1109551 - RNA, 20 nt, Human
uggagggcucggugccggag

SEQ ID NO: 1109552 - RNA, 19 nt, Human
uggcucaggcggaacccga

SEQ ID NO: 1109553 - RNA, 18 nt, Human
ugggcggggaccccaagg

SEQ ID NO: 1109554 - RNA, 22 nt, Human
uggugcacacgcgugucugugu

SEQ ID NO: 1109555 - RNA, 23 nt, Human
uggugcacacgcgugucugugug

SEQ ID NO: 1109556 - RNA, 24 nt, Human
ugucuguguuugcaucucugugug

SEQ ID NO: 1109557 - RNA, 20 nt, Human
ugugcacacgugugccugug

SEQ ID NO: 1109558 - RNA, 18 nt, Human
ugugcacacgugugucug

SEQ ID NO: 1109559 - RNA, 22 nt, Human
ugugcacacgugugucugugug

SEQ ID NO: 1109560 - RNA, 19 nt, Human
ugugcgcacgugucugcgu

SEQ ID NO: 1109561 - RNA, 26 nt, Human
ugugcgcacgugucugcgugcgcgug

SEQ ID NO: 1109562 - RNA, 22 nt, Human
ugugcgcgcgucagugugugca

SEQ ID NO: 1109563 - RNA, 24 nt, Human
ugugugcacacgugugccugugug

SEQ ID NO: 1109564 - RNA, 27 nt, Human
ugugugcacacgugugccugugugugc

SEQ ID NO: 1109565 - RNA, 25 nt, Human
ugugugcacacgugugucugugugc

SEQ ID NO: 1109566 - RNA, 22 nt, Human
ugugugcacgcgugugucugug

SEQ ID NO: 1109567 - RNA, 25 nt, Human
ugugugcacgcgugugucuguguuu

SEQ ID NO: 1109568 - RNA, 24 nt, Human
ugugugcgcgcgugugucucucug

SEQ ID NO: 1109569 - RNA, 22 nt, Human
uguuugcaucucugugugugca

SEQ ID NO: 1109570 - RNA, 27 nt, Human
uuuaauuuucuuugggugugaguuuuc

SEQ ID NO: 1109571 - RNA, 23 nt, Human
aaaaaaaaaaaaaaaaaaaagag

SEQ ID NO: 1109572 - RNA, 26 nt, Human
aaaaaaaagagaaacuaggaagagaa

SEQ ID NO: 1109573 - RNA, 23 nt, Human
aaaaaaagagaaacuaggaagag

SEQ ID NO: 1109574 - RNA, 24 nt, Human
aaaaaagagaaacuaggaagagaa

SEQ ID NO: 1109575 - RNA, 24 nt, Human
aauggcaugcaccuguagucccag

SEQ ID NO: 1109576 - RNA, 24 nt, Human
aggaucacuugagcccaggaguuu

SEQ ID NO: 1109577 - RNA, 18 nt, Human
aggcaggaggaucacuug

SEQ ID NO: 1109578 - RNA, 23 nt, Human
aggcaggaggaucacuugagccc

SEQ ID NO: 1109579 - RNA, 24 nt, Human
aggcaggaggaucacuugagccca

SEQ ID NO: 1109580 - RNA, 24 nt, Human
aggcugaggcaggaggaucacuug

SEQ ID NO: 1109581 - RNA, 20 nt, Human
aucacuugagcccaggaguu

SEQ ID NO: 1109582 - RNA, 24 nt, Human
aucacuugagcccaggaguuugag

SEQ ID NO: 1109583 - RNA, 24 nt, Human
cacaccacuggucauuugcaccug

SEQ ID NO: 1109584 - RNA, 22 nt, Human
caccugggugagagaauuagac

SEQ ID NO: 1109585 - RNA, 24 nt, Human
caccuguagucccagguacucagg

SEQ ID NO: 1109586 - RNA, 24 nt, Human
caggaggcugaggcaggaggauca

SEQ ID NO: 1109587 - RNA, 24 nt, Human
cagguacucaggaggcugaggcag

SEQ ID NO: 1109588 - RNA, 21 nt, Human
ccuguagucccagguacucag

SEQ ID NO: 1109589 - RNA, 22 nt, Human
ccugucugaaaaaaaaaaaaaa

SEQ ID NO: 1109590 - RNA, 18 nt, Human
gagcccaggaguuugagg

SEQ ID NO: 1109591 - RNA, 24 nt, Human
gaucacuugagcccaggaguuuga

SEQ ID NO: 1109592 - RNA, 24 nt, Human
gcccaggaguuugaggcugcagug

SEQ ID NO: 1109593 - RNA, 21 nt, Human
gcugcagugagcuaugagcua

SEQ ID NO: 1109594 - RNA, 20 nt, Human
ggacauaacuccuucuuuuu

SEQ ID NO: 1109595 - RNA, 22 nt, Human
ggaucacuugagcccaggaguu

SEQ ID NO: 1109596 - RNA, 23 nt, Human
gucugaaaaaaaaaaaaaaaaaa

SEQ ID NO: 1109597 - RNA, 23 nt, Human
uaaaaaauaaaaaaauuagccug

SEQ ID NO: 1109598 - RNA, 23 nt, Human
uaugagcuaugaucacaccacug

SEQ ID NO: 1109599 - RNA, 20 nt, Human
ugaggcaggaggaucacuug

SEQ ID NO: 1109600 - RNA, 24 nt, Human
ugaggcaggaggaucacuugagcc

SEQ ID NO: 1109601 - RNA, 25 nt, Human
ugaggcaggaggaucacuugagccc

SEQ ID NO: 1109602 - RNA, 18 nt, Human
aaggccucuccagggccc

SEQ ID NO: 1109603 - RNA, 19 nt, Human
agagacagggaugcuggcu

SEQ ID NO: 1109604 - RNA, 19 nt, Human
agggcagugaggccaggug

SEQ ID NO: 1109605 - RNA, 18 nt, Human
ccccagagacagggaugc

SEQ ID NO: 1109606 - RNA, 24 nt, Human
ccucuccagggccccagagacagg

SEQ ID NO: 1109607 - RNA, 22 nt, Human
cuccagggccccagagacagga

SEQ ID NO: 1109608 - RNA, 22 nt, Human
gccucuccagggccccagagac

SEQ ID NO: 1109609 - RNA, 20 nt, Human
uaauuaccagugucuguaau

SEQ ID NO: 1109610 - RNA, 24 nt, Human
uugaaggccucuccagggccccag

SEQ ID NO: 1109611 - RNA, 26 nt, Human
uuuauaggagaugcucggccucuuug

SEQ ID NO: 1109612 - RNA, 18 nt, Human
agagucuggcuuguggau

SEQ ID NO: 1109613 - RNA, 21 nt, Human
aguggaggccaagagucuggc

SEQ ID NO: 1109614 - RNA, 24 nt, Human
ggcuuuugcccagcauaacaacuc

SEQ ID NO: 1109615 - RNA, 20 nt, Human
uggcuuguggaugggcaugg

SEQ ID NO: 1109616 - RNA, 22 nt, Human
aaagucccagccagaccagguu

SEQ ID NO: 1109617 - RNA, 18 nt, Human
aaccacucauaagcauuu

SEQ ID NO: 1109618 - RNA, 24 nt, Human
aaccucuaauuuaaaaaauaaucu

SEQ ID NO: 1109619 - RNA, 27 nt, Human
acagagcauauuuaaaaagacucaaag

SEQ ID NO: 1109620 - RNA, 23 nt, Human
acagauuuagaaauggaaagucc

SEQ ID NO: 1109621 - RNA, 20 nt, Human
acaucuggcaaugggccucu

SEQ ID NO: 1109622 - RNA, 24 nt, Human
accuagugauaaaccucuaauuua

SEQ ID NO: 1109623 - RNA, 18 nt, Human
acugagucugaaccacuc

SEQ ID NO: 1109624 - RNA, 19 nt, Human
agcaucacaguuguguaca

SEQ ID NO: 1109625 - RNA, 23 nt, Human
aggagauauaccuagugauaaac

SEQ ID NO: 1109626 - RNA, 19 nt, Human
auggcccagccuccgcgug

SEQ ID NO: 1109627 - RNA, 19 nt, Human
caagaaaggagaaacggcg

SEQ ID NO: 1109628 - RNA, 23 nt, Human
caaugaaauaucauuccauacaa

SEQ ID NO: 1109629 - RNA, 22 nt, Human
cacaaaaaauacauaucaacag

SEQ ID NO: 1109630 - RNA, 18 nt, Human
cacacuucacaaaaaaua

SEQ ID NO: 1109631 - RNA, 18 nt, Human
cagguucugauaauucuc

SEQ ID NO: 1109632 - RNA, 18 nt, Human
caguauagauuuccacau

SEQ ID NO: 1109633 - RNA, 19 nt, Human
cauaagcauuuucuaugcu

SEQ ID NO: 1109634 - RNA, 22 nt, Human
caucacaguuguguacaaaucu

SEQ ID NO: 1109635 - RNA, 23 nt, Human
caucacaguuguguacaaaucuc

SEQ ID NO: 1109636 - RNA, 21 nt, Human
ccaagaaaggagaaacggcga

SEQ ID NO: 1109637 - RNA, 19 nt, Human
ccagccagaccagguucug

SEQ ID NO: 1109638 - RNA, 19 nt, Human
ccagugugaauucucucau

SEQ ID NO: 1109639 - RNA, 19 nt, Human
cccuggagcccgccgaccu

SEQ ID NO: 1109640 - RNA, 25 nt, Human
cgccgaccugaagcagcggccgcac

SEQ ID NO: 1109641 - RNA, 23 nt, Human
cucucucccguguggauucuuug

SEQ ID NO: 1109642 - RNA, 26 nt, Human
cugcccaagaaaggagaaacggcgag

SEQ ID NO: 1109643 - RNA, 22 nt, Human
cuggagcugagacauggcuaac

SEQ ID NO: 1109644 - RNA, 18 nt, Human
gcacugcgcuggaaccgu

SEQ ID NO: 1109645 - RNA, 18 nt, Human
gccauguuggugugcugc

SEQ ID NO: 1109646 - RNA, 19 nt, Human
ggggagggauagcauuagg

SEQ ID NO: 1109647 - RNA, 21 nt, Human
gucucucucccguguggauuc

SEQ ID NO: 1109648 - RNA, 18 nt, Human
guggcgcugggaaaaaua

SEQ ID NO: 1109649 - RNA, 24 nt, Human
uaaaaagacucaaaguacaaagua

SEQ ID NO: 1109650 - RNA, 22 nt, Human
uaacagagcauauuuaaaaaga

SEQ ID NO: 1109651 - RNA, 19 nt, Human
uaagguuucucaccagugu

SEQ ID NO: 1109652 - RNA, 21 nt, Human
uaaguuuuaggguaccaugug

SEQ ID NO: 1109653 - RNA, 22 nt, Human
uaaucucugcaccuggcacauc

SEQ ID NO: 1109654 - RNA, 20 nt, Human
uaccuagugauaaaccucua

SEQ ID NO: 1109655 - RNA, 24 nt, Human
uaccuagugauaaaccucuaauuu

SEQ ID NO: 1109656 - RNA, 21 nt, Human
uaggagauauaccuagugaua

SEQ ID NO: 1109657 - RNA, 21 nt, Human
ucaaaguacaaaguacuggug

SEQ ID NO: 1109658 - RNA, 22 nt, Human
ucaacacacacuucacaaaaaa

SEQ ID NO: 1109659 - RNA, 20 nt, Human
uccaaggcaguuuccuuuuc

SEQ ID NO: 1109660 - RNA, 18 nt, Human
ucccuggagcccgccgac

SEQ ID NO: 1109661 - RNA, 18 nt, Human
uccuuggagaagucaaug

SEQ ID NO: 1109662 - RNA, 22 nt, Human
ucuaugcugcguccucucaguc

SEQ ID NO: 1109663 - RNA, 26 nt, Human
ucuaugcugcguccucucagucugga

SEQ ID NO: 1109664 - RNA, 24 nt, Human
ucucucugagcaggguucaggaau

SEQ ID NO: 1109665 - RNA, 18 nt, Human
ucucuuauggagaguaag

SEQ ID NO: 1109666 - RNA, 23 nt, Human
ucugaaccacucauaagcauuuu

SEQ ID NO: 1109667 - RNA, 27 nt, Human
ucuggagcugagacauggccggggucc

SEQ ID NO: 1109668 - RNA, 18 nt, Human
ugaaauaucauuccauac

SEQ ID NO: 1109669 - RNA, 19 nt, Human
ugaaaucacagauuuagaa

SEQ ID NO: 1109670 - RNA, 20 nt, Human
ugaaccacucauaagcauuu

SEQ ID NO: 1109671 - RNA, 23 nt, Human
ugagucugaaccacucauaagca

SEQ ID NO: 1109672 - RNA, 21 nt, Human
ugcagguuuguuacauaugua

SEQ ID NO: 1109673 - RNA, 19 nt, Human
ugccauguuggugugcugc

SEQ ID NO: 1109674 - RNA, 18 nt, Human
uggaaugucacucauccc

SEQ ID NO: 1109675 - RNA, 18 nt, Human
uguuacauauguauacau

SEQ ID NO: 1109676 - RNA, 19 nt, Human
uguuacauauguauacaug

SEQ ID NO: 1109677 - RNA, 22 nt, Human
uguuggugugcugcaccauuaa

SEQ ID NO: 1109678 - RNA, 24 nt, Human
uucacaaaaaauacauaucaacag

SEQ ID NO: 1109679 - RNA, 18 nt, Human
uuuaauacauucguuaca

SEQ ID NO: 1109680 - RNA, 21 nt, Human
uuuauagggucucucucccgu

SEQ ID NO: 1109681 - RNA, 25 nt, Human
aaauggaagugcaaagauuggaacc

SEQ ID NO: 1109682 - RNA, 23 nt, Human
aaccaugggaugccacugaggga

SEQ ID NO: 1109683 - RNA, 21 nt, Human
aacuuuggaagguaaccugga

SEQ ID NO: 1109684 - RNA, 21 nt, Human
aagcacaaacugcugccccca

SEQ ID NO: 1109685 - RNA, 20 nt, Human
aaucauggcugagaugauug

SEQ ID NO: 1109686 - RNA, 22 nt, Human
acaaagcacaaacugcugcccc

SEQ ID NO: 1109687 - RNA, 22 nt, Human
accuccuucggcgcgguccuug

SEQ ID NO: 1109688 - RNA, 18 nt, Human
acuccuucagcuccucug

SEQ ID NO: 1109689 - RNA, 19 nt, Human
caagguguuagaggcuagg

SEQ ID NO: 1109690 - RNA, 19 nt, Human
caccuccuucggcgcgguc

SEQ ID NO: 1109691 - RNA, 24 nt, Human
caccuccuucggcgcgguccuugg

SEQ ID NO: 1109692 - RNA, 27 nt, Human
cagugggcaccuccuucggcgcggucc

SEQ ID NO: 1109693 - RNA, 23 nt, Human
ccugagaaagucgagcgccuccu

SEQ ID NO: 1109694 - RNA, 18 nt, Human
cgcgguccuuggaggccg

SEQ ID NO: 1109695 - RNA, 20 nt, Human
cuuuaugcuaggcacgcugc

SEQ ID NO: 1109696 - RNA, 18 nt, Human
gaaauggaagugcaaaga

SEQ ID NO: 1109697 - RNA, 21 nt, Human
gacaauggugaguacaaggag

SEQ ID NO: 1109698 - RNA, 21 nt, Human
gcccccaaauuagagggcagg

SEQ ID NO: 1109699 - RNA, 23 nt, Human
gggcaggaaauggaagugcaaag

SEQ ID NO: 1109700 - RNA, 24 nt, Human
guuuuuaggcuauuuugaagaaug

SEQ ID NO: 1109701 - RNA, 24 nt, Human
uagaaacuuuggaagguaaccugg

SEQ ID NO: 1109702 - RNA, 23 nt, Human
uaugcuaggcacgcugcugagca

SEQ ID NO: 1109703 - RNA, 27 nt, Human
uauuucauucuucuauuaacuucugag

SEQ ID NO: 1109704 - RNA, 23 nt, Human
ucaaauauauuaaugugcauugg

SEQ ID NO: 1109705 - RNA, 24 nt, Human
ucccacacuauaaauaagacugaa

SEQ ID NO: 1109706 - RNA, 24 nt, Human
uccuucggcgcgguccuuggaggc

SEQ ID NO: 1109707 - RNA, 18 nt, Human
ucuauuaacuucugaggu

SEQ ID NO: 1109708 - RNA, 19 nt, Human
ugagaugauuggcuuucua

SEQ ID NO: 1109709 - RNA, 23 nt, Human
uggcuuucuauguauaguauggu

SEQ ID NO: 1109710 - RNA, 21 nt, Human
ugggagagggacaguauccug

SEQ ID NO: 1109711 - RNA, 21 nt, Human
uugauccuggaauauguaucu

SEQ ID NO: 1109712 - RNA, 24 nt, Human
uuuuaaaaauacaaauuugguugc

SEQ ID NO: 1109713 - RNA, 23 nt, Human
aagcccaccagaccuagaggaga

SEQ ID NO: 1109714 - RNA, 23 nt, Human
aaugguggacgcugcgggagaaa

SEQ ID NO: 1109715 - RNA, 18 nt, Human
acccacccaccugggcgg

SEQ ID NO: 1109716 - RNA, 19 nt, Human
agaauaucucgcgaauugg

SEQ ID NO: 1109717 - RNA, 18 nt, Human
aggaaccggagaucggga

SEQ ID NO: 1109718 - RNA, 24 nt, Human
aggagacccccgccgcacggcucc

SEQ ID NO: 1109719 - RNA, 18 nt, Human
aggcaucacccacugaaa

SEQ ID NO: 1109720 - RNA, 19 nt, Human
agugcggggaucugcggua

SEQ ID NO: 1109721 - RNA, 20 nt, Human
aucucugccccgguggccuc

SEQ ID NO: 1109722 - RNA, 21 nt, Human
augcggcgggaccaggggggu

SEQ ID NO: 1109723 - RNA, 19 nt, Human
augguggacgcugcgggag

SEQ ID NO: 1109724 - RNA, 19 nt, Human
caccagaccuagaggagac

SEQ ID NO: 1109725 - RNA, 21 nt, Human
caccugggcgggcugcuuggg

SEQ ID NO: 1109726 - RNA, 19 nt, Human
cacgccaacuccccccccg

SEQ ID NO: 1109727 - RNA, 23 nt, Human
cagcugggcccucccugccggcu

SEQ ID NO: 1109728 - RNA, 19 nt, Human
ccacugagugccuccuggg

SEQ ID NO: 1109729 - RNA, 20 nt, Human
cccaccagaccuagaggaga

SEQ ID NO: 1109730 - RNA, 22 nt, Human
cccccgccgcacggcuccccag

SEQ ID NO: 1109731 - RNA, 18 nt, Human
ccccgccgcacggcuccc

SEQ ID NO: 1109732 - RNA, 20 nt, Human
cccgggcagccugacggccc

SEQ ID NO: 1109733 - RNA, 21 nt, Human
cccugcuaggugggggcugcu

SEQ ID NO: 1109734 - RNA, 22 nt, Human
ccgcccugccgucuccugcugc

SEQ ID NO: 1109735 - RNA, 22 nt, Human
ccgcuggcgaguugggaguggg

SEQ ID NO: 1109736 - RNA, 26 nt, Human
ccggaaacaacgguggggcgaccgag

SEQ ID NO: 1109737 - RNA, 20 nt, Human
ccucccuggcgggguggaga

SEQ ID NO: 1109738 - RNA, 18 nt, Human
ccucucggcauguuuugg

SEQ ID NO: 1109739 - RNA, 20 nt, Human
ccuuggaggaucugaggcug

SEQ ID NO: 1109740 - RNA, 19 nt, Human
cgaccagggcagaauucgg

SEQ ID NO: 1109741 - RNA, 22 nt, Human
cgccgcacggcuccccagggca

SEQ ID NO: 1109742 - RNA, 22 nt, Human
cgggaaggugugggaugcggcg

SEQ ID NO: 1109743 - RNA, 23 nt, Human
cggggaucugcgguaccgggggg

SEQ ID NO: 1109744 - RNA, 18 nt, Human
cuaggugggggcugcugg

SEQ ID NO: 1109745 - RNA, 21 nt, Human
cuccugcugcugcugacuugc

SEQ ID NO: 1109746 - RNA, 20 nt, Human
cucugagccuguuacuccuc

SEQ ID NO: 1109747 - RNA, 23 nt, Human
cugagccuucucugagccuguua

SEQ ID NO: 1109748 - RNA, 18 nt, Human
cugaggcuuucugcugcc

SEQ ID NO: 1109749 - RNA, 19 nt, Human
cugcugccugcccugcagc

SEQ ID NO: 1109750 - RNA, 23 nt, Human
cuggggagguagagguggggucc

SEQ ID NO: 1109751 - RNA, 18 nt, Human
cuggggggcacagggcag

SEQ ID NO: 1109752 - RNA, 19 nt, Human
gaagagggccaucucugcc

SEQ ID NO: 1109753 - RNA, 23 nt, Human
gaggaucugaggcuggcucaggg

SEQ ID NO: 1109754 - RNA, 20 nt, Human
gaggugcagauggguggggg

SEQ ID NO: 1109755 - RNA, 21 nt, Human
gcccuguggccgcccugccgu

SEQ ID NO: 1109756 - RNA, 19 nt, Human
gccuuggaggaucugaggc

SEQ ID NO: 1109757 - RNA, 23 nt, Human
gcugcuggguuccacagcugggc

SEQ ID NO: 1109758 - RNA, 20 nt, Human
ggaaacaacgguggggcgac

SEQ ID NO: 1109759 - RNA, 20 nt, Human
ggaacugcgggucugggaua

SEQ ID NO: 1109760 - RNA, 19 nt, Human
ggcgacgggggaauaggga

SEQ ID NO: 1109761 - RNA, 24 nt, Human
ggcuccccagggcacgccaacucc

SEQ ID NO: 1109762 - RNA, 20 nt, Human
gggaaugggauacuugggaa

SEQ ID NO: 1109763 - RNA, 22 nt, Human
gggaaugguggacgcugcggga

SEQ ID NO: 1109764 - RNA, 18 nt, Human
gggagcucuggggggccg

SEQ ID NO: 1109765 - RNA, 19 nt, Human
gggcacccggcacacggga

SEQ ID NO: 1109766 - RNA, 21 nt, Human
ggggaauagggaacuagugcg

SEQ ID NO: 1109767 - RNA, 27 nt, Human
ggggaauagggaacuagugcggggaaa

SEQ ID NO: 1109768 - RNA, 19 nt, Human
ggggccgagugcguggggc

SEQ ID NO: 1109769 - RNA, 27 nt, Human
ggggcggggaugccgggcgacggggga

SEQ ID NO: 1109770 - RNA, 21 nt, Human
gggucccuggcagcaacugcc

SEQ ID NO: 1109771 - RNA, 22 nt, Human
gguaucguggcgacugugccgg

SEQ ID NO: 1109772 - RNA, 21 nt, Human
ggugcagauggguggggggca

SEQ ID NO: 1109773 - RNA, 20 nt, Human
gugcguggggccucugcggg

SEQ ID NO: 1109774 - RNA, 19 nt, Human
uaaagcccaccagaccuag

SEQ ID NO: 1109775 - RNA, 22 nt, Human
ucacuuggagagaucuggggag

SEQ ID NO: 1109776 - RNA, 24 nt, Human
ucaggggugguccuggcugcucug

SEQ ID NO: 1109777 - RNA, 23 nt, Human
ucagugaccacugagugccuccu

SEQ ID NO: 1109778 - RNA, 18 nt, Human
ucccuggcagcaacugcc

SEQ ID NO: 1109779 - RNA, 23 nt, Human
ucggcugagaccgcagaguccca

SEQ ID NO: 1109780 - RNA, 22 nt, Human
ucuccugcugcugcugacuugc

SEQ ID NO: 1109781 - RNA, 22 nt, Human
ucucugagccuguuacuccucu

SEQ ID NO: 1109782 - RNA, 20 nt, Human
ucuggggagguagagguggg

SEQ ID NO: 1109783 - RNA, 19 nt, Human
ucuggggggcacagggcag

SEQ ID NO: 1109784 - RNA, 21 nt, Human
ugacaaaggcugaggcuuucu

SEQ ID NO: 1109785 - RNA, 23 nt, Human
ugacuugcaggucuguguuucug

SEQ ID NO: 1109786 - RNA, 19 nt, Human
ugaggcuggcucagggucc

SEQ ID NO: 1109787 - RNA, 19 nt, Human
ugcacagccuuggaggauc

SEQ ID NO: 1109788 - RNA, 24 nt, Human
ugcccugggagcucuggggggcac

SEQ ID NO: 1109789 - RNA, 18 nt, Human
ugccuccuggguguagga

SEQ ID NO: 1109790 - RNA, 18 nt, Human
ugcuaggugggggcugcu

SEQ ID NO: 1109791 - RNA, 20 nt, Human
ugcucagugaccacugagug

SEQ ID NO: 1109792 - RNA, 18 nt, Human
ugcugcacagccuuggag

SEQ ID NO: 1109793 - RNA, 20 nt, Human
ugcugccugcccugcagcug

SEQ ID NO: 1109794 - RNA, 21 nt, Human
ugcuugggcaagguucagggg

SEQ ID NO: 1109795 - RNA, 24 nt, Human
ugcuugggcaagguucaggggugg

SEQ ID NO: 1109796 - RNA, 23 nt, Human
uggcgaguugggagugggcaggc

SEQ ID NO: 1109797 - RNA, 23 nt, Human
uggcucagggucccuggcagcaa

SEQ ID NO: 1109798 - RNA, 21 nt, Human
ugggagugggcaggcgagucg

SEQ ID NO: 1109799 - RNA, 23 nt, Human
ugggcaggcgagucguaaauugg

SEQ ID NO: 1109800 - RNA, 21 nt, Human
uggggcaggcccuggagcccc

SEQ ID NO: 1109801 - RNA, 22 nt, Human
ugggucucccugugaccccaau

SEQ ID NO: 1109802 - RNA, 19 nt, Human
uguaggaagagggccaucu

SEQ ID NO: 1109803 - RNA, 18 nt, Human
uucugcugccugcccugc

SEQ ID NO: 1109804 - RNA, 20 nt, Human
uucugcugccugcccugcag

SEQ ID NO: 1109805 - RNA, 18 nt, Human
uuggaggaucugaggcug

SEQ ID NO: 1109806 - RNA, 21 nt, Human
uuucugcugccugcccugcag

SEQ ID NO: 1109807 - RNA, 23 nt, Human
accuccgcgcccgccucucgcug

SEQ ID NO: 1109808 - RNA, 23 nt, Human
agaaagcgcagcaggcgcagucc

SEQ ID NO: 1109809 - RNA, 21 nt, Human
agcaggcgcaguccggcaccg

SEQ ID NO: 1109810 - RNA, 20 nt, Human
aggcacaggaggcggguggc

SEQ ID NO: 1109811 - RNA, 21 nt, Human
aggcgccccgcgacgccgccc

SEQ ID NO: 1109812 - RNA, 20 nt, Human
auaggagauggggggcuugg

SEQ ID NO: 1109813 - RNA, 21 nt, Human
auggaggaccccccgcccccg

SEQ ID NO: 1109814 - RNA, 30 nt, Human
caccuccauaccccagagccagcagguccu

SEQ ID NO: 1109815 - RNA, 20 nt, Human
cagcagagagcggaggcaca

SEQ ID NO: 1109816 - RNA, 22 nt, Human
ccaaggaaagccuuaaacggac

SEQ ID NO: 1109817 - RNA, 19 nt, Human
ccagcagagagcggaggca

SEQ ID NO: 1109818 - RNA, 21 nt, Human
ccccccgcccccgaccaccag

SEQ ID NO: 1109819 - RNA, 19 nt, Human
cccccgaccaccagucccc

SEQ ID NO: 1109820 - RNA, 22 nt, Human
cccgcgacgccgcccccgggac

SEQ ID NO: 1109821 - RNA, 21 nt, Human
cccgggacaccuccauacccc

SEQ ID NO: 1109822 - RNA, 24 nt, Human
cccgggacaccuccauaccccaga

SEQ ID NO: 1109823 - RNA, 20 nt, Human
cccuccacuaccccuucacc

SEQ ID NO: 1109824 - RNA, 22 nt, Human
cccugaagucugggcaugaggc

SEQ ID NO: 1109825 - RNA, 25 nt, Human
ccgaagcgcagccgcgccauccccg

SEQ ID NO: 1109826 - RNA, 23 nt, Human
ccgccagccgcacgcacagcccc

SEQ ID NO: 1109827 - RNA, 20 nt, Human
ccgcgcccgccucucgcugc

SEQ ID NO: 1109828 - RNA, 23 nt, Human
ccgcggcccccucccacgcuucc

SEQ ID NO: 1109829 - RNA, 28 nt, Human
ccuccgcgcccgccucucgcugcugcuc

SEQ ID NO: 1109830 - RNA, 23 nt, Human
cgcagcaggcgcaguccggcacc

SEQ ID NO: 1109831 - RNA, 24 nt, Human
cgccagcuccgccgccagccgcac

SEQ ID NO: 1109832 - RNA, 18 nt, Human
cggaggcacaggaggcgg

SEQ ID NO: 1109833 - RNA, 21 nt, Human
cucagcaccuccgcgcccgcc

SEQ ID NO: 1109834 - RNA, 23 nt, Human
cucauggaggaccccccgccccc

SEQ ID NO: 1109835 - RNA, 21 nt, Human
cugccgcagaaaguccuccuc

SEQ ID NO: 1109836 - RNA, 26 nt, Human
gaagcgcagccgcgccauccccgccg

SEQ ID NO: 1109837 - RNA, 21 nt, Human
gaccccccgcccccgaccacc

SEQ ID NO: 1109838 - RNA, 20 nt, Human
gagcggaggcacaggaggcg

SEQ ID NO: 1109839 - RNA, 22 nt, Human
gccggcucccuccacuaccccu

SEQ ID NO: 1109840 - RNA, 21 nt, Human
ggcauuuggggacucaggaau

SEQ ID NO: 1109841 - RNA, 22 nt, Human
uaccaaggaaagccuuaaacgg

SEQ ID NO: 1109842 - RNA, 27 nt, Human
uaccaaggaaagccuuaaacggacucc

SEQ ID NO: 1109843 - RNA, 21 nt, Human
uaccccagagccagcaggucc

SEQ ID NO: 1109844 - RNA, 18 nt, Human
uaggagauggggggcuug

SEQ ID NO: 1109845 - RNA, 23 nt, Human
ucaccaagggguggccuaggacu

SEQ ID NO: 1109846 - RNA, 22 nt, Human
ucaggaauaggagauggggggc

SEQ ID NO: 1109847 - RNA, 24 nt, Human
uccacuaccccuucaccaaggggu

SEQ ID NO: 1109848 - RNA, 22 nt, Human
ucccuccacuaccccuucacca

SEQ ID NO: 1109849 - RNA, 22 nt, Human
ucccuccacuaccccuucacca

SEQ ID NO: 1109850 - RNA, 19 nt, Human
uccugggccaccgcggccc

SEQ ID NO: 1109851 - RNA, 19 nt, Human
uccugggccaccgcggccc

SEQ ID NO: 1109852 - RNA, 18 nt, Human
ucucuggagaacaugguu

SEQ ID NO: 1109853 - RNA, 24 nt, Human
ugaggcgccccgcgacgccgcccc

SEQ ID NO: 1109854 - RNA, 19 nt, Human
uggagaacaugguucuugg

SEQ ID NO: 1109855 - RNA, 18 nt, Human
uuaaacggacuccccaga

SEQ ID NO: 1109856 - RNA, 20 nt, Human
aaaagaaaaaguaaaugacu

SEQ ID NO: 1109857 - RNA, 21 nt, Human
augguauaucaaaagaaaaag

SEQ ID NO: 1109858 - RNA, 23 nt, Human
augguauaucaaaagaaaaagua

SEQ ID NO: 1109859 - RNA, 19 nt, Human
cuccacaugaauaagcagg

SEQ ID NO: 1109860 - RNA, 22 nt, Human
cuccacaugaauaagcagggac

SEQ ID NO: 1109861 - RNA, 19 nt, Human
gauuacagaacaugugcca

SEQ ID NO: 1109862 - RNA, 22 nt, Human
gcagggcuggugucucagggcg

SEQ ID NO: 1109863 - RNA, 23 nt, Human
gggcguugggcaggagcagaggc

SEQ ID NO: 1109864 - RNA, 18 nt, Human
uaaagcagggcugguguc

SEQ ID NO: 1109865 - RNA, 24 nt, Human
uacagaacaugugccagacacugc

SEQ ID NO: 1109866 - RNA, 29 nt, Human
ucucagggcguugggcaggagcagaggcu

SEQ ID NO: 1109867 - RNA, 18 nt, Human
uggauuacagaacaugug

SEQ ID NO: 1109868 - RNA, 21 nt, Human
ugggcaggagcagaggcaggu

SEQ ID NO: 1109869 - RNA, 20 nt, Human
ugucucagggcguugggcag

SEQ ID NO: 1109870 - RNA, 18 nt, Human
aaagcuacugcugguguc

SEQ ID NO: 1109871 - RNA, 22 nt, Human
aacuuuuugucacagguggcau

SEQ ID NO: 1109872 - RNA, 19 nt, Human
aagaagucccuaaacccuu

SEQ ID NO: 1109873 - RNA, 25 nt, Human
acaccagagggaacagggaucugaa

SEQ ID NO: 1109874 - RNA, 18 nt, Human
acagaaaugaaaggaaug

SEQ ID NO: 1109875 - RNA, 22 nt, Human
acagggcuggagagauccacgc

SEQ ID NO: 1109876 - RNA, 21 nt, Human
acccagauuugucuaccuugg

SEQ ID NO: 1109877 - RNA, 21 nt, Human
acucuugccagguucuguggg

SEQ ID NO: 1109878 - RNA, 19 nt, Human
acugcaguugaccacacag

SEQ ID NO: 1109879 - RNA, 25 nt, Human
acugcaguuuauugauaauaccacu

SEQ ID NO: 1109880 - RNA, 28 nt, Human
acugcaguuuauugauaauuugcgugca

SEQ ID NO: 1109881 - RNA, 23 nt, Human
agcaaaauccucuguggcugccc

SEQ ID NO: 1109882 - RNA, 21 nt, Human
agccucuucaaugucuguggu

SEQ ID NO: 1109883 - RNA, 23 nt, Human
aggaaugguagagaagaugaggc

SEQ ID NO: 1109884 - RNA, 18 nt, Human
agggaucccuguuggcuc

SEQ ID NO: 1109885 - RNA, 20 nt, Human
agguaguugaaaccacagaa

SEQ ID NO: 1109886 - RNA, 25 nt, Human
auacaaaaaaaggguacagaaauga

SEQ ID NO: 1109887 - RNA, 18 nt, Human
aucugggacuuccacggu

SEQ ID NO: 1109888 - RNA, 20 nt, Human
auggcccccagggaucccuc

SEQ ID NO: 1109889 - RNA, 20 nt, Human
auuugaugucugccuucccc

SEQ ID NO: 1109890 - RNA, 18 nt, Human
caaaagaccaaauuuccu

SEQ ID NO: 1109891 - RNA, 18 nt, Human
caagaagucccuaaaccc

SEQ ID NO: 1109892 - RNA, 19 nt, Human
cacacuuuggaaaaugauc

SEQ ID NO: 1109893 - RNA, 20 nt, Human
cagcuuucaagcccauuccu

SEQ ID NO: 1109894 - RNA, 21 nt, Human
cagguaguugaaaccacagaa

SEQ ID NO: 1109895 - RNA, 22 nt, Human
cauacacuugacagaggccgug

SEQ ID NO: 1109896 - RNA, 21 nt, Human
cauucaccggggucagggcca

SEQ ID NO: 1109897 - RNA, 21 nt, Human
ccacagugcuucuuuggucaa

SEQ ID NO: 1109898 - RNA, 23 nt, Human
ccccugaaacuuuuugucacagg

SEQ ID NO: 1109899 - RNA, 22 nt, Human
ccuccacagcuuucaagcccau

SEQ ID NO: 1109900 - RNA, 21 nt, Human
ccucuuuuggaggauaaggau

SEQ ID NO: 1109901 - RNA, 22 nt, Human
ccuggaaggcccucagggaaac

SEQ ID NO: 1109902 - RNA, 25 nt, Human
ccuucccuaccccacacuuuggaaa

SEQ ID NO: 1109903 - RNA, 21 nt, Human
cgcccauucaagcaaugguca

SEQ ID NO: 1109904 - RNA, 26 nt, Human
cgcccauucaagcaaugguccacaca

SEQ ID NO: 1109905 - RNA, 19 nt, Human
cgcccuuggccugagggua

SEQ ID NO: 1109906 - RNA, 25 nt, Human
cuaugcuggaaacagggcuggagag

SEQ ID NO: 1109907 - RNA, 18 nt, Human
cugccucuucuaugaucc

SEQ ID NO: 1109908 - RNA, 19 nt, Human
cugcuccccagcaagugca

SEQ ID NO: 1109909 - RNA, 23 nt, Human
cugucuagucuuuccuuagucac

SEQ ID NO: 1109910 - RNA, 21 nt, Human
cuugcuccuuuacuugugucu

SEQ ID NO: 1109911 - RNA, 22 nt, Human
cuuuggaaaaugauccaccucc

SEQ ID NO: 1109912 - RNA, 22 nt, Human
gaaacaguauuuguacccagau

SEQ ID NO: 1109913 - RNA, 20 nt, Human
gaaggcauagugagggaaug

SEQ ID NO: 1109914 - RNA, 20 nt, Human
gagcuuguacagggauuuuc

SEQ ID NO: 1109915 - RNA, 22 nt, Human
gaugaaauacaagaagucccua

SEQ ID NO: 1109916 - RNA, 22 nt, Human
gccugcaugagugugacaucac

SEQ ID NO: 1109917 - RNA, 23 nt, Human
gcuccugauggccauccccaacu

SEQ ID NO: 1109918 - RNA, 20 nt, Human
ggaaaaugauccaccuccac

SEQ ID NO: 1109919 - RNA, 22 nt, Human
ggauaacaucauacacuugaca

SEQ ID NO: 1109920 - RNA, 22 nt, Human
ggaucuucagagacugcaguuu

SEQ ID NO: 1109921 - RNA, 23 nt, Human
ggcagugaaggcauagugaggga

SEQ ID NO: 1109922 - RNA, 28 nt, Human
ggcuggagagauccacgcuugggguuua

SEQ ID NO: 1109923 - RNA, 23 nt, Human
gggcaauuucuaugcuggaaaca

SEQ ID NO: 1109924 - RNA, 21 nt, Human
gggucagggccagcuggaaga

SEQ ID NO: 1109925 - RNA, 22 nt, Human
gucacaccagagggaacaggga

SEQ ID NO: 1109926 - RNA, 19 nt, Human
gugugaggauacagugagg

SEQ ID NO: 1109927 - RNA, 18 nt, Human
guuccugcuccguugcag

SEQ ID NO: 1109928 - RNA, 19 nt, Human
guuccugcuccguugcagc

SEQ ID NO: 1109929 - RNA, 24 nt, Human
uacagaaaugaaaggaaugguaga

SEQ ID NO: 1109930 - RNA, 22 nt, Human
uaccccagucuuccuaugcugu

SEQ ID NO: 1109931 - RNA, 20 nt, Human
uaggagauuccuaaagucaa

SEQ ID NO: 1109932 - RNA, 24 nt, Human
uauuucuggaauuuuucuuuugau

SEQ ID NO: 1109933 - RNA, 23 nt, Human
ucacaccagagggaacagggauc

SEQ ID NO: 1109934 - RNA, 22 nt, Human
ucacagguggcauugauggcuc

SEQ ID NO: 1109935 - RNA, 18 nt, Human
ucaguccggaucugggac

SEQ ID NO: 1109936 - RNA, 22 nt, Human
uccaaguauaaucguccccgac

SEQ ID NO: 1109937 - RNA, 21 nt, Human
uccacacagguuccuaccaca

SEQ ID NO: 1109938 - RNA, 19 nt, Human
uccccaacucagugauccg

SEQ ID NO: 1109939 - RNA, 20 nt, Human
uccccgacaugagguuccug

SEQ ID NO: 1109940 - RNA, 21 nt, Human
ucccuccagcucagcugguuc

SEQ ID NO: 1109941 - RNA, 20 nt, Human
ucccugaauggcccccaggg

SEQ ID NO: 1109942 - RNA, 23 nt, Human
ucccugaauggcccccagggauc

SEQ ID NO: 1109943 - RNA, 25 nt, Human
ucccugaauggcccccagggauccc

SEQ ID NO: 1109944 - RNA, 18 nt, Human
ucccuguuggcucugugu

SEQ ID NO: 1109945 - RNA, 19 nt, Human
uccuaaagucaagcugucu

SEQ ID NO: 1109946 - RNA, 22 nt, Human
ucuccugguuaucacuuggccu

SEQ ID NO: 1109947 - RNA, 22 nt, Human
ucugccuuccccugaaacuuuu

SEQ ID NO: 1109948 - RNA, 19 nt, Human
ucuggaauuuuucuuuuga

SEQ ID NO: 1109949 - RNA, 21 nt, Human
ucuguggcugcccccuaaaac

SEQ ID NO: 1109950 - RNA, 24 nt, Human
ucugugugaggauacagugagggu

SEQ ID NO: 1109951 - RNA, 18 nt, Human
ugaauuguuuauuucugg

SEQ ID NO: 1109952 - RNA, 22 nt, Human
ugacagaggccgugcuucaggu

SEQ ID NO: 1109953 - RNA, 22 nt, Human
ugauccagaagcugaguugcug

SEQ ID NO: 1109954 - RNA, 18 nt, Human
ugauccgugcucgcccuu

SEQ ID NO: 1109955 - RNA, 25 nt, Human
ugaugucugccuuccccugaaacuu

SEQ ID NO: 1109956 - RNA, 24 nt, Human
ugauucaaaagaccaaauuuccuc

SEQ ID NO: 1109957 - RNA, 18 nt, Human
ugccaguaaucgaaguga

SEQ ID NO: 1109958 - RNA, 22 nt, Human
ugcgcuucuugucuccaguaac

SEQ ID NO: 1109959 - RNA, 24 nt, Human
ugcucuguuccuauggcacggaua

SEQ ID NO: 1109960 - RNA, 18 nt, Human
uggaagaagugaaguuca

SEQ ID NO: 1109961 - RNA, 19 nt, Human
uggaagaagugaaguucac

SEQ ID NO: 1109962 - RNA, 18 nt, Human
uggagagagacaaaaugc

SEQ ID NO: 1109963 - RNA, 21 nt, Human
ugggggcugugguuaccuggu

SEQ ID NO: 1109964 - RNA, 21 nt, Human
ugucauuucuccaccagcugc

SEQ ID NO: 1109965 - RNA, 21 nt, Human
uguggugacaugcgccugagg

SEQ ID NO: 1109966 - RNA, 23 nt, Human
uuagucacaccagagggaacagg

SEQ ID NO: 1109967 - RNA, 20 nt, Human
uuaugggaacuugcugcggc

SEQ ID NO: 1109968 - RNA, 18 nt, Human
uucaaaagaccaaauuuc

SEQ ID NO: 1109969 - RNA, 19 nt, Human
uucaaaagaccaaauuucc

SEQ ID NO: 1109970 - RNA, 18 nt, Human
uucuaugauccagaagcu

SEQ ID NO: 1109971 - RNA, 22 nt, Human
uucuugucuccaguaacagggg

SEQ ID NO: 1109972 - RNA, 24 nt, Human
uugcuccugauggccauccccaac

SEQ ID NO: 1109973 - RNA, 22 nt, Human
uugcugcucucugguacccugg

SEQ ID NO: 1109974 - RNA, 21 nt, Human
uuggaaaaugauccaccucca

SEQ ID NO: 1109975 - RNA, 27 nt, Human
uuuauagccucuucaaugucugugguu

SEQ ID NO: 1109976 - RNA, 20 nt, Human
uggaagauggcaguuccggc

SEQ ID NO: 1109977 - RNA, 22 nt, Human
aaaaagagagagagaaagaaaa

SEQ ID NO: 1109978 - RNA, 21 nt, Human
aaagagagagagaaagaaaac

SEQ ID NO: 1109979 - RNA, 24 nt, Human
aaagugcugggauuacaggcguga

SEQ ID NO: 1109980 - RNA, 20 nt, Human
aaauaaauaauaaagaaaaa

SEQ ID NO: 1109981 - RNA, 21 nt, Human
aaauuuaaaaaaagauucuaa

SEQ ID NO: 1109982 - RNA, 19 nt, Human
aagugcugggauuacaggc

SEQ ID NO: 1109983 - RNA, 19 nt, Human
aagugcugggauuacaggc

SEQ ID NO: 1109984 - RNA, 24 nt, Human
aaucaccugaaccugcgaggcaga

SEQ ID NO: 1109985 - RNA, 19 nt, Human
aauguugaaaaagagagag

SEQ ID NO: 1109986 - RNA, 24 nt, Human
acagagcaauacccuaucucaaaa

SEQ ID NO: 1109987 - RNA, 24 nt, Human
acagagugagacuccaucucaaaa

SEQ ID NO: 1109988 - RNA, 24 nt, Human
accacugcauucuagccuggguga

SEQ ID NO: 1109989 - RNA, 24 nt, Human
accauguuggccaggcuggucuug

SEQ ID NO: 1109990 - RNA, 24 nt, Human
accccgucucuaguaaaaauacaa

SEQ ID NO: 1109991 - RNA, 24 nt, Human
accgcacuccagccugggugacag

SEQ ID NO: 1109992 - RNA, 26 nt, Human
accgcacuccagccugggugacagag

SEQ ID NO: 1109993 - RNA, 24 nt, Human
acuccagccugggugacagaguga

SEQ ID NO: 1109994 - RNA, 24 nt, Human
acugcauucuagccugggugacag

SEQ ID NO: 1109995 - RNA, 26 nt, Human
acugcauucuagccugggugacagag

SEQ ID NO: 1109996 - RNA, 22 nt, Human
acuuuuuucuuuuuuuuuuuga

SEQ ID NO: 1109997 - RNA, 19 nt, Human
agaaaaaaaagaaaaggaa

SEQ ID NO: 1109998 - RNA, 24 nt, Human
agaaaaaacucacuugauuauaaa

SEQ ID NO: 1109999 - RNA, 21 nt, Human
agaaagaaaacaaggaaacgu

SEQ ID NO: 1110000 - RNA, 24 nt, Human
agacaggcagaucacaaggucagg

SEQ ID NO: 1110001 - RNA, 22 nt, Human
agagguuguagugagccaagau

SEQ ID NO: 1110002 - RNA, 24 nt, Human
agagguuguagugagccaagauug

SEQ ID NO: 1110003 - RNA, 23 nt, Human
agaucacaaggucaggaguucga

SEQ ID NO: 1110004 - RNA, 19 nt, Human
agcacuuugggaggcugag

SEQ ID NO: 1110005 - RNA, 24 nt, Human
agccugggugacagagugagacuc

SEQ ID NO: 1110006 - RNA, 18 nt, Human
agccuggucaauaugcug

SEQ ID NO: 1110007 - RNA, 20 nt, Human
agccuggucaauaugcugaa

SEQ ID NO: 1110008 - RNA, 24 nt, Human
agccuggucaauaugcugaaaccc

SEQ ID NO: 1110009 - RNA, 21 nt, Human
aggaggccgacggggcuaggc

SEQ ID NO: 1110010 - RNA, 24 nt, Human
aggaucgcuugagcccaggaguuc

SEQ ID NO: 1110011 - RNA, 24 nt, Human
aggcagagguuguagugagccaag

SEQ ID NO: 1110012 - RNA, 24 nt, Human
aggcagaucacaaggucaggaguu

SEQ ID NO: 1110013 - RNA, 24 nt, Human
aggcaggauacucacuugagccca

SEQ ID NO: 1110014 - RNA, 21 nt, Human
aggcgugacgcccggcuaacc

SEQ ID NO: 1110015 - RNA, 19 nt, Human
aggcugcagugacccaugu

SEQ ID NO: 1110016 - RNA, 25 nt, Human
aggcuggagugcaguggugggaucu

SEQ ID NO: 1110017 - RNA, 23 nt, Human
aggguuccaccauguuggccagg

SEQ ID NO: 1110018 - RNA, 18 nt, Human
agguauauuuggaugcaa

SEQ ID NO: 1110019 - RNA, 19 nt, Human
agguugaggcugcagugac

SEQ ID NO: 1110020 - RNA, 23 nt, Human
aguagcugagauuacaggugugu

SEQ ID NO: 1110021 - RNA, 19 nt, Human
agugcaguggugggaucuc

SEQ ID NO: 1110022 - RNA, 21 nt, Human
agugcaguggugggaucucag

SEQ ID NO: 1110023 - RNA, 23 nt, Human
agugcaguggugggaucucagcu

SEQ ID NO: 1110024 - RNA, 18 nt, Human
agugcugggauuacaggc

SEQ ID NO: 1110025 - RNA, 24 nt, Human
aguggcucacgccuguaaucccag

SEQ ID NO: 1110026 - RNA, 24 nt, Human
aguggugggaucucagcucacugc

SEQ ID NO: 1110027 - RNA, 24 nt, Human
auaggguuccaccauguuggccag

SEQ ID NO: 1110028 - RNA, 21 nt, Human
aucacaaggucaggaguucga

SEQ ID NO: 1110029 - RNA, 22 nt, Human
aucgcccuaugcccugcaaaaa

SEQ ID NO: 1110030 - RNA, 24 nt, Human
auugcgccaccgcacuccagccug

SEQ ID NO: 1110031 - RNA, 24 nt, Human
auuuuuguauuuuuaguagagaua

SEQ ID NO: 1110032 - RNA, 25 nt, Human
caaaacaauccucaacccuacuaga

SEQ ID NO: 1110033 - RNA, 24 nt, Human
caaagugcugggauuacaggcgug

SEQ ID NO: 1110034 - RNA, 23 nt, Human
caaauuuccacauguaaguuaua

SEQ ID NO: 1110035 - RNA, 22 nt, Human
caacaaagugagacccugucuc

SEQ ID NO: 1110036 - RNA, 23 nt, Human
caacaagaaaaaaaagaaaagga

SEQ ID NO: 1110037 - RNA, 22 nt, Human
caagaaaaaaaagaaaaggaaa

SEQ ID NO: 1110038 - RNA, 22 nt, Human
caagugauucuugugccucagc

SEQ ID NO: 1110039 - RNA, 28 nt, Human
caagugauucuugugccucagccuccug

SEQ ID NO: 1110040 - RNA, 22 nt, Human
caauaugcugaaaccccgucuc

SEQ ID NO: 1110041 - RNA, 24 nt, Human
caauaugcugaaaccccgucucua

SEQ ID NO: 1110042 - RNA, 19 nt, Human
cacaguuuagguuaaagau

SEQ ID NO: 1110043 - RNA, 24 nt, Human
caccaugcccggcuaauuuuugua

SEQ ID NO: 1110044 - RNA, 21 nt, Human
caccauguuggccaggcuggu

SEQ ID NO: 1110045 - RNA, 23 nt, Human
caccauguuggccaggcuggucu

SEQ ID NO: 1110046 - RNA, 24 nt, Human
caccauguuggccaggcuggucuu

SEQ ID NO: 1110047 - RNA, 27 nt, Human
caccauguuggccaggcuggucuugaa

SEQ ID NO: 1110048 - RNA, 24 nt, Human
caccgcacuccagccugggugaca

SEQ ID NO: 1110049 - RNA, 23 nt, Human
caccuauagucccagcuacuugg

SEQ ID NO: 1110050 - RNA, 24 nt, Human
caccuauagucccagcuacuuggg

SEQ ID NO: 1110051 - RNA, 24 nt, Human
cacgccuguaaucccagcacuuug

SEQ ID NO: 1110052 - RNA, 22 nt, Human
cacuccagccugggugacagag

SEQ ID NO: 1110053 - RNA, 22 nt, Human
cacuccagccugggugacagag

SEQ ID NO: 1110054 - RNA, 24 nt, Human
cacuccagccugggugacagagug

SEQ ID NO: 1110055 - RNA, 19 nt, Human
cacugcauucuagccuggg

SEQ ID NO: 1110056 - RNA, 19 nt, Human
cacugcauucuagccuggg

SEQ ID NO: 1110057 - RNA, 22 nt, Human
cacugcauucuagccuggguga

SEQ ID NO: 1110058 - RNA, 24 nt, Human
cacugcauucuagccugggugaca

SEQ ID NO: 1110059 - RNA, 18 nt, Human
cagcacuuugggaggcug

SEQ ID NO: 1110060 - RNA, 24 nt, Human
cagcacuuugggaggcugagacag

SEQ ID NO: 1110061 - RNA, 20 nt, Human
cagccuccugaguagcugag

SEQ ID NO: 1110062 - RNA, 21 nt, Human
caggaguucgagaccagcaug

SEQ ID NO: 1110063 - RNA, 22 nt, Human
caggcagaucacaaggucagga

SEQ ID NO: 1110064 - RNA, 20 nt, Human
caugggcaacaaagugagac

SEQ ID NO: 1110065 - RNA, 24 nt, Human
cauguuggccaggcuggucuugaa

SEQ ID NO: 1110066 - RNA, 23 nt, Human
cauucuagccugggugacagagc

SEQ ID NO: 1110067 - RNA, 22 nt, Human
cauuuagaccccaugauuuaaa

SEQ ID NO: 1110068 - RNA, 20 nt, Human
ccaaagugcugggauuacag

SEQ ID NO: 1110069 - RNA, 22 nt, Human
ccaaagugcugggauuacaggc

SEQ ID NO: 1110070 - RNA, 22 nt, Human
ccaaagugcugggauuacaggc

SEQ ID NO: 1110071 - RNA, 24 nt, Human
ccaaagugcugggauuacaggcgu

SEQ ID NO: 1110072 - RNA, 21 nt, Human
ccaacaagaaaaaaaagaaaa

SEQ ID NO: 1110073 - RNA, 20 nt, Human
ccaccgcacuccagccuggg

SEQ ID NO: 1110074 - RNA, 20 nt, Human
ccaccgcacuccagccuggg

SEQ ID NO: 1110075 - RNA, 21 nt, Human
ccaccgcacuccagccugggu

SEQ ID NO: 1110076 - RNA, 24 nt, Human
ccaccgcacuccagccugggugac

SEQ ID NO: 1110077 - RNA, 20 nt, Human
ccacugcauucuagccuggg

SEQ ID NO: 1110078 - RNA, 20 nt, Human
ccacugcauucuagccuggg

SEQ ID NO: 1110079 - RNA, 20 nt, Human
ccacugcauucuagccuggg

SEQ ID NO: 1110080 - RNA, 21 nt, Human
ccacugcauucuagccugggu

SEQ ID NO: 1110081 - RNA, 21 nt, Human
ccacugcauucuagccugggu

SEQ ID NO: 1110082 - RNA, 24 nt, Human
ccacugcauucuagccugggugac

SEQ ID NO: 1110083 - RNA, 22 nt, Human
ccaggagguugaggcugcagug

SEQ ID NO: 1110084 - RNA, 25 nt, Human
ccaggaguucgagaccagcaugggc

SEQ ID NO: 1110085 - RNA, 20 nt, Human
cccaugauuuaaagcagugg

SEQ ID NO: 1110086 - RNA, 20 nt, Human
cccgaguucaagugauucuu

SEQ ID NO: 1110087 - RNA, 24 nt, Human
ccgccucgaccucccaaagugcug

SEQ ID NO: 1110088 - RNA, 21 nt, Human
ccuauagucccagcuacuugg

SEQ ID NO: 1110089 - RNA, 19 nt, Human
ccugaaaaucugauuaaaa

SEQ ID NO: 1110090 - RNA, 22 nt, Human
ccugacuucaagugaucugccc

SEQ ID NO: 1110091 - RNA, 19 nt, Human
ccugaguagcugagauuac

SEQ ID NO: 1110092 - RNA, 22 nt, Human
ccugaguagcugagauuacagg

SEQ ID NO: 1110093 - RNA, 22 nt, Human
ccugaguagcugagauuacagg

SEQ ID NO: 1110094 - RNA, 22 nt, Human
ccugggugacagagugagacuc

SEQ ID NO: 1110095 - RNA, 23 nt, Human
ccuggucaauaugcugaaacccc

SEQ ID NO: 1110096 - RNA, 24 nt, Human
ccuggucaauaugcugaaaccccg

SEQ ID NO: 1110097 - RNA, 24 nt, Human
cgcaccuauagucccagcuacuug

SEQ ID NO: 1110098 - RNA, 26 nt, Human
cgccaccgcacuccagccugggugac

SEQ ID NO: 1110099 - RNA, 23 nt, Human
cgccuguaaucccagcacuuugg

SEQ ID NO: 1110100 - RNA, 24 nt, Human
cgccuguaaucccagcacuuuggg

SEQ ID NO: 1110101 - RNA, 19 nt, Human
cgggaggggaaggaggccg

SEQ ID NO: 1110102 - RNA, 21 nt, Human
cuauagucccagcuacuuggg

SEQ ID NO: 1110103 - RNA, 22 nt, Human
cucacgccuguaaucccagcac

SEQ ID NO: 1110104 - RNA, 24 nt, Human
cucacgccuguaaucccagcacuu

SEQ ID NO: 1110105 - RNA, 23 nt, Human
cucacugcaaccucuuccucccg

SEQ ID NO: 1110106 - RNA, 24 nt, Human
cucacugcaaccucuuccucccga

SEQ ID NO: 1110107 - RNA, 19 nt, Human
cucccgaguucaagugauu

SEQ ID NO: 1110108 - RNA, 26 nt, Human
cuccugacuucaagugaucugcccgc

SEQ ID NO: 1110109 - RNA, 20 nt, Human
cucuguugcccaggcuggag

SEQ ID NO: 1110110 - RNA, 18 nt, Human
cugaguagcugagauuac

SEQ ID NO: 1110111 - RNA, 21 nt, Human
cugaguagcugagauuacagg

SEQ ID NO: 1110112 - RNA, 24 nt, Human
cugaguagcugagauuacaggugu

SEQ ID NO: 1110113 - RNA, 23 nt, Human
cugcaaccucuuccucccgaguu

SEQ ID NO: 1110114 - RNA, 24 nt, Human
cugcaaccucuuccucccgaguuc

SEQ ID NO: 1110115 - RNA, 24 nt, Human
cuguuguagccaacaagaaaaaaa

SEQ ID NO: 1110116 - RNA, 23 nt, Human
cuugagcccaggagguugaggcu

SEQ ID NO: 1110117 - RNA, 25 nt, Human
cuugugccucagccuccugaguagc

SEQ ID NO: 1110118 - RNA, 23 nt, Human
cuuuauggcaaaacuguguugcc

SEQ ID NO: 1110119 - RNA, 22 nt, Human
gaacaugcugaggacccucugu

SEQ ID NO: 1110120 - RNA, 24 nt, Human
gacagagugagacuccaucucaaa

SEQ ID NO: 1110121 - RNA, 23 nt, Human
gacgcaguggcucacgccuguaa

SEQ ID NO: 1110122 - RNA, 24 nt, Human
gacuucaagugaucugcccgccuc

SEQ ID NO: 1110123 - RNA, 22 nt, Human
gagaaagaaaacaaggaaacgu

SEQ ID NO: 1110124 - RNA, 18 nt, Human
gagcaauacccuaucuca

SEQ ID NO: 1110125 - RNA, 19 nt, Human
gaguagcugagauuacagg

SEQ ID NO: 1110126 - RNA, 20 nt, Human
gaguagcugagauuacaggu

SEQ ID NO: 1110127 - RNA, 20 nt, Human
gagucacagaccacccccuc

SEQ ID NO: 1110128 - RNA, 21 nt, Human
gaucacaaggucaggaguucg

SEQ ID NO: 1110129 - RNA, 24 nt, Human
gaucacaaggucaggaguucgaga

SEQ ID NO: 1110130 - RNA, 24 nt, Human
gaucgcuugagcccaggaguucga

SEQ ID NO: 1110131 - RNA, 18 nt, Human
gauuacaggcgugacgcc

SEQ ID NO: 1110132 - RNA, 24 nt, Human
gauuacaggugugugucaccaugc

SEQ ID NO: 1110133 - RNA, 21 nt, Human
gauucuugugccucagccucc

SEQ ID NO: 1110134 - RNA, 22 nt, Human
gcaaccucuuccucccgaguuc

SEQ ID NO: 1110135 - RNA, 24 nt, Human
gcacuccagccugggugacagagu

SEQ ID NO: 1110136 - RNA, 24 nt, Human
gcauucuagccugggugacagagc

SEQ ID NO: 1110137 - RNA, 19 nt, Human
gccaccgcacuccagccug

SEQ ID NO: 1110138 - RNA, 24 nt, Human
gccaccgcacuccagccuggguga

SEQ ID NO: 1110139 - RNA, 19 nt, Human
gcccaggcuggagugcagu

SEQ ID NO: 1110140 - RNA, 22 nt, Human
gcccggcuaauuuuuguauuuu

SEQ ID NO: 1110141 - RNA, 23 nt, Human
gccucgaccucccaaagugcugg

SEQ ID NO: 1110142 - RNA, 21 nt, Human
gcgcgccgcggguacaaggag

SEQ ID NO: 1110143 - RNA, 21 nt, Human
gcucacugcaaccucuuccuc

SEQ ID NO: 1110144 - RNA, 20 nt, Human
gcucuguugcccaggcugga

SEQ ID NO: 1110145 - RNA, 25 nt, Human
gcucuguugcccaggcuggagugca

SEQ ID NO: 1110146 - RNA, 19 nt, Human
ggaaggaggccgacggggc

SEQ ID NO: 1110147 - RNA, 21 nt, Human
ggaggcugagacaggcagauc

SEQ ID NO: 1110148 - RNA, 20 nt, Human
ggauacucacuugagcccag

SEQ ID NO: 1110149 - RNA, 23 nt, Human
ggaucgcuugagcccaggaguuc

SEQ ID NO: 1110150 - RNA, 22 nt, Human
ggcaguaggaucgcuugagccc

SEQ ID NO: 1110151 - RNA, 24 nt, Human
ggcuggucuugaacuccugacuuc

SEQ ID NO: 1110152 - RNA, 24 nt, Human
gggaacggggccgcgccacgggcc

SEQ ID NO: 1110153 - RNA, 24 nt, Human
gggaggggaaggaggccgacgggg

SEQ ID NO: 1110154 - RNA, 21 nt, Human
ggguuccaccauguuggccag

SEQ ID NO: 1110155 - RNA, 22 nt, Human
ggguuccaccauguuggccagg

SEQ ID NO: 1110156 - RNA, 24 nt, Human
gguggcacgcaccuauagucccag

SEQ ID NO: 1110157 - RNA, 19 nt, Human
guagcugagauuacaggug

SEQ ID NO: 1110158 - RNA, 21 nt, Human
gucacagaccacccccucaac

SEQ ID NO: 1110159 - RNA, 24 nt, Human
gugaucugcccgccucgaccuccc

SEQ ID NO: 1110160 - RNA, 24 nt, Human
gugauucuugugccucagccuccu

SEQ ID NO: 1110161 - RNA, 22 nt, Human
gugccucagccuccugaguagc

SEQ ID NO: 1110162 - RNA, 24 nt, Human
guuugugcauauauauauauauau

SEQ ID NO: 1110163 - RNA, 18 nt, Human
uaaaauguaagguauauu

SEQ ID NO: 1110164 - RNA, 20 nt, Human
uaagccagaagaaucaccug

SEQ ID NO: 1110165 - RNA, 24 nt, Human
uaagccagaagaaucaccugaacc

SEQ ID NO: 1110166 - RNA, 21 nt, Human
uaaguuaaugaaaaagaaaaa

SEQ ID NO: 1110167 - RNA, 23 nt, Human
uaauaaacacaaaaguuauuuca

SEQ ID NO: 1110168 - RNA, 24 nt, Human
uaauuuuuguauuuuuaguagaga

SEQ ID NO: 1110169 - RNA, 22 nt, Human
uacucaugaccuacugcacuaa

SEQ ID NO: 1110170 - RNA, 22 nt, Human
uagagauaggguuccaccaugu

SEQ ID NO: 1110171 - RNA, 22 nt, Human
uagccaacaagaaaaaaaagaa

SEQ ID NO: 1110172 - RNA, 20 nt, Human
uagcugggugugguggcacg

SEQ ID NO: 1110173 - RNA, 24 nt, Human
uaguagagauaggguuccaccaug

SEQ ID NO: 1110174 - RNA, 26 nt, Human
uaguagagauaggguuccaccauguu

SEQ ID NO: 1110175 - RNA, 23 nt, Human
uauugcucuguugcccaggcugg

SEQ ID NO: 1110176 - RNA, 24 nt, Human
uauugcucuguugcccaggcugga

SEQ ID NO: 1110177 - RNA, 22 nt, Human
ucacaaggucaggaguucgaga

SEQ ID NO: 1110178 - RNA, 24 nt, Human
ucacaaggucaggaguucgagauc

SEQ ID NO: 1110179 - RNA, 22 nt, Human
ucacugcaaccucuuccucccg

SEQ ID NO: 1110180 - RNA, 24 nt, Human
ucacugcaaccucuuccucccgag

SEQ ID NO: 1110181 - RNA, 23 nt, Human
uccagccugggugacagagugag

SEQ ID NO: 1110182 - RNA, 24 nt, Human
uccagccugggugacagagugaga

SEQ ID NO: 1110183 - RNA, 24 nt, Human
ucccaaagugcugggauuacaggc

SEQ ID NO: 1110184 - RNA, 22 nt, Human
ucccagugacacaggaagcuua

SEQ ID NO: 1110185 - RNA, 21 nt, Human
ucccgaguucaagugauucuu

SEQ ID NO: 1110186 - RNA, 22 nt, Human
ucccgaguucaagugauucuug

SEQ ID NO: 1110187 - RNA, 19 nt, Human
ucccuggaaacauauggcu

SEQ ID NO: 1110188 - RNA, 24 nt, Human
ucccuggaaacauauggcuucccc

SEQ ID NO: 1110189 - RNA, 24 nt, Human
uccugaguagcugagauuacaggu

SEQ ID NO: 1110190 - RNA, 20 nt, Human
ucgcuugagcccaggaguuc

SEQ ID NO: 1110191 - RNA, 21 nt, Human
ucgcuugagcccaggaguucg

SEQ ID NO: 1110192 - RNA, 18 nt, Human
ucuagccugggugacaga

SEQ ID NO: 1110193 - RNA, 19 nt, Human
ucuagccugggugacagag

SEQ ID NO: 1110194 - RNA, 19 nt, Human
ucucaaaaauaaauaaaua

SEQ ID NO: 1110195 - RNA, 23 nt, Human
ucuccaaaucacuccugcggccu

SEQ ID NO: 1110196 - RNA, 24 nt, Human
ucuggcuggacgcaguggcucacg

SEQ ID NO: 1110197 - RNA, 18 nt, Human
ucuguugcccaggcugga

SEQ ID NO: 1110198 - RNA, 24 nt, Human
ucuguugcccaggcuggagugcag

SEQ ID NO: 1110199 - RNA, 21 nt, Human
ucuugaacuccugacuucaag

SEQ ID NO: 1110200 - RNA, 25 nt, Human
ucuuuauggcaaaacuguguugccu

SEQ ID NO: 1110201 - RNA, 19 nt, Human
ugaaaaagaaaaaacucac

SEQ ID NO: 1110202 - RNA, 23 nt, Human
ugaaaaagagagagagaaagaaa

SEQ ID NO: 1110203 - RNA, 21 nt, Human
ugacacaggaagcuuaggcag

SEQ ID NO: 1110204 - RNA, 18 nt, Human
ugacuucaagugaucugc

SEQ ID NO: 1110205 - RNA, 21 nt, Human
ugacuucaagugaucugcccg

SEQ ID NO: 1110206 - RNA, 24 nt, Human
ugacuucaagugaucugcccgccu

SEQ ID NO: 1110207 - RNA, 26 nt, Human
ugagacaggcagaucacaaggucagg

SEQ ID NO: 1110208 - RNA, 18 nt, Human
ugagauuacaggugugug

SEQ ID NO: 1110209 - RNA, 20 nt, Human
ugagauuacagguguguguc

SEQ ID NO: 1110210 - RNA, 22 nt, Human
ugagauuacaggugugugucac

SEQ ID NO: 1110211 - RNA, 24 nt, Human
ugagauuacaggugugugucacca

SEQ ID NO: 1110212 - RNA, 25 nt, Human
ugagauuacaggugugugucaccau

SEQ ID NO: 1110213 - RNA, 22 nt, Human
ugagccaagauugcgccaccgc

SEQ ID NO: 1110214 - RNA, 22 nt, Human
ugagcccaggagguugaggcug

SEQ ID NO: 1110215 - RNA, 23 nt, Human
ugagcccaggaguucgagaccag

SEQ ID NO: 1110216 - RNA, 22 nt, Human
ugagguggugcaugccuggggu

SEQ ID NO: 1110217 - RNA, 22 nt, Human
ugauaaagaguauugcucuguu

SEQ ID NO: 1110218 - RNA, 20 nt, Human
ugauucuugugccucagccu

SEQ ID NO: 1110219 - RNA, 22 nt, Human
ugcaguggugggaucucagcuc

SEQ ID NO: 1110220 - RNA, 19 nt, Human
ugcauauauauauauauau

SEQ ID NO: 1110221 - RNA, 18 nt, Human
ugcccaggcuggagugca

SEQ ID NO: 1110222 - RNA, 21 nt, Human
ugcccaggcuggagugcagug

SEQ ID NO: 1110223 - RNA, 24 nt, Human
ugcccaggcuggagugcaguggug

SEQ ID NO: 1110224 - RNA, 21 nt, Human
ugcccgccucgaccucccaaa

SEQ ID NO: 1110225 - RNA, 24 nt, Human
ugcccggcuaauuuuuguauuuuu

SEQ ID NO: 1110226 - RNA, 22 nt, Human
ugccucagccuccugaguagcu

SEQ ID NO: 1110227 - RNA, 24 nt, Human
ugccucagccuccugaguagcuga

SEQ ID NO: 1110228 - RNA, 21 nt, Human
ugccuggggucccagugacac

SEQ ID NO: 1110229 - RNA, 24 nt, Human
ugcgaggcagagguuguagugagc

SEQ ID NO: 1110230 - RNA, 20 nt, Human
ugcugggauuacaggcguga

SEQ ID NO: 1110231 - RNA, 20 nt, Human
uggagugcaguggugggauc

SEQ ID NO: 1110232 - RNA, 23 nt, Human
uggagugcaguggugggaucuca

SEQ ID NO: 1110233 - RNA, 24 nt, Human
uggagugcaguggugggaucucag

SEQ ID NO: 1110234 - RNA, 22 nt, Human
uggcacgcaccuauagucccag

SEQ ID NO: 1110235 - RNA, 24 nt, Human
uggccaggcuggucuugaacuccu

SEQ ID NO: 1110236 - RNA, 22 nt, Human
uggcucacgccuguaaucccag

SEQ ID NO: 1110237 - RNA, 24 nt, Human
uggcucacgccuguaaucccagca

SEQ ID NO: 1110238 - RNA, 22 nt, Human
uggcuggacgcaguggcucacg

SEQ ID NO: 1110239 - RNA, 24 nt, Human
ugggaggcuaagccagaagaauca

SEQ ID NO: 1110240 - RNA, 24 nt, Human
ugggaggcugagacaggcagauca

SEQ ID NO: 1110241 - RNA, 18 nt, Human
ugggauuacaggcgugac

SEQ ID NO: 1110242 - RNA, 19 nt, Human
ugggauuacaggcgugacg

SEQ ID NO: 1110243 - RNA, 22 nt, Human
ugggauuacaggcgugacgccc

SEQ ID NO: 1110244 - RNA, 23 nt, Human
ugggauuacaggcgugacgcccg

SEQ ID NO: 1110245 - RNA, 24 nt, Human
ugggauuacaggcgugacgcccgg

SEQ ID NO: 1110246 - RNA, 24 nt, Human
ugggcaacaaagugagacccuguc

SEQ ID NO: 1110247 - RNA, 18 nt, Human
ugggcugggugcuauggc

SEQ ID NO: 1110248 - RNA, 22 nt, Human
uggggucccagugacacaggaa

SEQ ID NO: 1110249 - RNA, 18 nt, Human
uggugcaugccugggguc

SEQ ID NO: 1110250 - RNA, 24 nt, Human
uggugggaucucagcucacugcaa

SEQ ID NO: 1110251 - RNA, 18 nt, Human
ugugcauauauauauaua

SEQ ID NO: 1110252 - RNA, 20 nt, Human
ugugcauauauauauauaua

SEQ ID NO: 1110253 - RNA, 20 nt, Human
ugugcauauauauauauaua

SEQ ID NO: 1110254 - RNA, 18 nt, Human
uuagcugggugugguggc

SEQ ID NO: 1110255 - RNA, 20 nt, Human
uuagcugggugugguggcac

SEQ ID NO: 1110256 - RNA, 22 nt, Human
uuagcugggugugguggcacgc

SEQ ID NO: 1110257 - RNA, 24 nt, Human
uuagcuuggugagguggugcaugc

SEQ ID NO: 1110258 - RNA, 24 nt, Human
uuaguagagauaggguuccaccau

SEQ ID NO: 1110259 - RNA, 23 nt, Human
uucaagugauucuugugccucag

SEQ ID NO: 1110260 - RNA, 21 nt, Human
uuccaccauguuggccaggcu

SEQ ID NO: 1110261 - RNA, 21 nt, Human
uucugggcugggugcuauggc

SEQ ID NO: 1110262 - RNA, 23 nt, Human
uucugggcugggugcuauggcuc

SEQ ID NO: 1110263 - RNA, 22 nt, Human
uugagcccaggaguucgagacc

SEQ ID NO: 1110264 - RNA, 23 nt, Human
uugauuauaaaaauucugggcug

SEQ ID NO: 1110265 - RNA, 24 nt, Human
uugcccaggcuggagugcaguggu

SEQ ID NO: 1110266 - RNA, 22 nt, Human
uugcucuguugcccaggcugga

SEQ ID NO: 1110267 - RNA, 24 nt, Human
uugcucuguugcccaggcuggagu

SEQ ID NO: 1110268 - RNA, 25 nt, Human
uugggaggcuaagccagaagaauca

SEQ ID NO: 1110269 - RNA, 25 nt, Human
uugggaggcugagacaggcagauca

SEQ ID NO: 1110270 - RNA, 22 nt, Human
uuguagugagccaagauugcgc

SEQ ID NO: 1110271 - RNA, 24 nt, Human
uuugcaccacugcauucuagccug

SEQ ID NO: 1110272 - RNA, 19 nt, Human
uuugugcauauauauauau

SEQ ID NO: 1110273 - RNA, 20 nt, Human
uuugugcauauauauauaua

SEQ ID NO: 1110274 - RNA, 19 nt, Human
uuuuuaguagagauagggu

SEQ ID NO: 1110275 - RNA, 20 nt, Human
uuuuuguauuuuuaguagag

SEQ ID NO: 1110276 - RNA, 25 nt, Human
uuuuuucuuuuuuuuuuugauaaag

SEQ ID NO: 1110277 - RNA, 26 nt, Human
uuuuuuuuuuugauaaagaguauugc

SEQ ID NO: 1110278 - RNA, 22 nt, Human
aaaaaacccccaaaacgaaaug

SEQ ID NO: 1110279 - RNA, 25 nt, Human
aaaaaauccucuuacuuaauccaac

SEQ ID NO: 1110280 - RNA, 22 nt, Human
aaaaacaaaacaaaacaaaaac

SEQ ID NO: 1110281 - RNA, 22 nt, Human
aaaaacaaaauccaccccuaca

SEQ ID NO: 1110282 - RNA, 20 nt, Human
aaaacaaaacaaaacaaaaa

SEQ ID NO: 1110283 - RNA, 18 nt, Human
aaacaaaaaacccccaaa

SEQ ID NO: 1110284 - RNA, 23 nt, Human
aaacaaaacaaaaacaaaaucca

SEQ ID NO: 1110285 - RNA, 23 nt, Human
aaacaaaacaaaacaaaaacaaa

SEQ ID NO: 1110286 - RNA, 23 nt, Human
aaagcuagugagaauuuugcggc

SEQ ID NO: 1110287 - RNA, 23 nt, Human
aaagucuugacuucggagugcag

SEQ ID NO: 1110288 - RNA, 19 nt, Human
aacaaaaaacccccaaaac

SEQ ID NO: 1110289 - RNA, 25 nt, Human
aacaaaacaaaaacaaaauccaccc

SEQ ID NO: 1110290 - RNA, 18 nt, Human
aagcggcagagcuacaac

SEQ ID NO: 1110291 - RNA, 18 nt, Human
aaguguggaaacugaggc

SEQ ID NO: 1110292 - RNA, 22 nt, Human
aauuacucucugaauuacccac

SEQ ID NO: 1110293 - RNA, 20 nt, Human
acaaaaacaaaauccacccc

SEQ ID NO: 1110294 - RNA, 22 nt, Human
acaaaacaaaacaaaaacaaaa

SEQ ID NO: 1110295 - RNA, 19 nt, Human
acccuggcuccaaauccag

SEQ ID NO: 1110296 - RNA, 23 nt, Human
acuaucacuaagauuaaaugaaa

SEQ ID NO: 1110297 - RNA, 21 nt, Human
acugaaauuaaaaacaaaaca

SEQ ID NO: 1110298 - RNA, 23 nt, Human
agauauuuuucuaguuugaaagu

SEQ ID NO: 1110299 - RNA, 19 nt, Human
aguugacuaaaaagacuug

SEQ ID NO: 1110300 - RNA, 24 nt, Human
aucaagaccaacguccuaauuuua

SEQ ID NO: 1110301 - RNA, 20 nt, Human
augccuuuguaauauuucaa

SEQ ID NO: 1110302 - RNA, 22 nt, Human
caaaaacaaaauccaccccuac

SEQ ID NO: 1110303 - RNA, 24 nt, Human
caaaacaaaaacaaaauccacccc

SEQ ID NO: 1110304 - RNA, 22 nt, Human
caaaauccaccccuacacccac

SEQ ID NO: 1110305 - RNA, 24 nt, Human
caaaauccaccccuacacccacaa

SEQ ID NO: 1110306 - RNA, 24 nt, Human
caaacaaaaaacccccaaaacgaa

SEQ ID NO: 1110307 - RNA, 19 nt, Human
caacaauuaacuaaaucuu

SEQ ID NO: 1110308 - RNA, 26 nt, Human
caagaccaacguccuaauuuuacuaa

SEQ ID NO: 1110309 - RNA, 21 nt, Human
cacccacaacuaucacuaaga

SEQ ID NO: 1110310 - RNA, 22 nt, Human
cacccacaacuaucacuaagau

SEQ ID NO: 1110311 - RNA, 28 nt, Human
caccucugcagcaacccuccuaauacaa

SEQ ID NO: 1110312 - RNA, 22 nt, Human
caccugauugaucucuggcugu

SEQ ID NO: 1110313 - RNA, 20 nt, Human
cacugacguagaaaauauaa

SEQ ID NO: 1110314 - RNA, 23 nt, Human
cagaaacaaacaaaaaaccccca

SEQ ID NO: 1110315 - RNA, 19 nt, Human
ccacuaguagaaucaaagc

SEQ ID NO: 1110316 - RNA, 21 nt, Human
cccuacacccacaacuaucac

SEQ ID NO: 1110317 - RNA, 19 nt, Human
cccuggcuccaaauccagc

SEQ ID NO: 1110318 - RNA, 20 nt, Human
ccuacacccacaacuaucac

SEQ ID NO: 1110319 - RNA, 19 nt, Human
cuagcgccugggaaguuuc

SEQ ID NO: 1110320 - RNA, 20 nt, Human
cuggaauauacaacuauuuc

SEQ ID NO: 1110321 - RNA, 20 nt, Human
cuucugguucuaguuuuugg

SEQ ID NO: 1110322 - RNA, 22 nt, Human
gaaacaaacaaaaaacccccaa

SEQ ID NO: 1110323 - RNA, 23 nt, Human
gaaacaaacaaaaaacccccaaa

SEQ ID NO: 1110324 - RNA, 19 nt, Human
gaauaucugguacaucugg

SEQ ID NO: 1110325 - RNA, 20 nt, Human
gaccaagucacaagcggcag

SEQ ID NO: 1110326 - RNA, 21 nt, Human
gagcuacaaccuggacccugg

SEQ ID NO: 1110327 - RNA, 18 nt, Human
gaguucauccaucauucc

SEQ ID NO: 1110328 - RNA, 26 nt, Human
gaucauagaauucucucaacucggag

SEQ ID NO: 1110329 - RNA, 18 nt, Human
gcauagaagaccaaugac

SEQ ID NO: 1110330 - RNA, 22 nt, Human
gcuuuuuucccuuuuaauaugc

SEQ ID NO: 1110331 - RNA, 21 nt, Human
ggcaaacuccuuuaacaauau

SEQ ID NO: 1110332 - RNA, 26 nt, Human
gguauuuuccuuucuucaaccuucag

SEQ ID NO: 1110333 - RNA, 23 nt, Human
uaaaaacaaaacaaaacaaaaac

SEQ ID NO: 1110334 - RNA, 25 nt, Human
uaaaaacaaaacaaaacaaaaacaa

SEQ ID NO: 1110335 - RNA, 19 nt, Human
uagauucagaaacaaacaa

SEQ ID NO: 1110336 - RNA, 21 nt, Human
uagauucagaaacaaacaaaa

SEQ ID NO: 1110337 - RNA, 21 nt, Human
uagcauagaagaccaaugaca

SEQ ID NO: 1110338 - RNA, 20 nt, Human
uagcaugauuguauuuuugu

SEQ ID NO: 1110339 - RNA, 20 nt, Human
uaucaaaugacaguugacua

SEQ ID NO: 1110340 - RNA, 27 nt, Human
uaucacuaagauuaaaugaaaaaaaga

SEQ ID NO: 1110341 - RNA, 18 nt, Human
uaucuggaucauagaauu

SEQ ID NO: 1110342 - RNA, 26 nt, Human
ucagaaacaaacaaaaaacccccaaa

SEQ ID NO: 1110343 - RNA, 18 nt, Human
ucaucucaucuuuggccu

SEQ ID NO: 1110344 - RNA, 23 nt, Human
ucauucaaaucuugucuccuggg

SEQ ID NO: 1110345 - RNA, 18 nt, Human
uccaccccuacacccaca

SEQ ID NO: 1110346 - RNA, 22 nt, Human
ucuaguuuuuggaagagaugua

SEQ ID NO: 1110347 - RNA, 21 nt, Human
ugaaaucugugaacucaauga

SEQ ID NO: 1110348 - RNA, 23 nt, Human
ugaaauuaaaaacaaaacaaaac

SEQ ID NO: 1110349 - RNA, 24 nt, Human
ugaacuaaauaaacauagcuacug

SEQ ID NO: 1110350 - RNA, 23 nt, Human
ugaacucaaugaauauuagauau

SEQ ID NO: 1110351 - RNA, 18 nt, Human
ugaccaagucacaagcgg

SEQ ID NO: 1110352 - RNA, 23 nt, Human
ugaccaagucacaagcggcagag

SEQ ID NO: 1110353 - RNA, 19 nt, Human
ugcugaauuaacuaacugc

SEQ ID NO: 1110354 - RNA, 20 nt, Human
uggcuccaaauccagccccc

SEQ ID NO: 1110355 - RNA, 21 nt, Human
uguaauauuucaaugaucuau

SEQ ID NO: 1110356 - RNA, 19 nt, Human
uguguuugagaccuaucac

SEQ ID NO: 1110357 - RNA, 19 nt, Human
uucagaaacaaacaaaaaa

SEQ ID NO: 1110358 - RNA, 22 nt, Human
uucagaaacaaacaaaaaaccc

SEQ ID NO: 1110359 - RNA, 25 nt, Human
uucggagugcaggcuaguacaugcu

SEQ ID NO: 1110360 - RNA, 19 nt, Human
uugacuaaaaagacuugau

SEQ ID NO: 1110361 - RNA, 18 nt, Human
uuggucaucucaucuuug

SEQ ID NO: 1110362 - RNA, 21 nt, Human
uuugauaaccaauagaauacc

SEQ ID NO: 1110363 - RNA, 23 nt, Human
uuuguaauauuucaaugaucuau

SEQ ID NO: 1110364 - RNA, 19 nt, Human
cagaggccuccgagaggcc

SEQ ID NO: 1110365 - RNA, 19 nt, Human
ccucaauuuccuugacuga

SEQ ID NO: 1110366 - RNA, 20 nt, Human
ccuccgagaggccaaggcuu

SEQ ID NO: 1110367 - RNA, 24 nt, Human
cugaccagaggggcugaccugaga

SEQ ID NO: 1110368 - RNA, 20 nt, Human
cugggggcugagggggugau

SEQ ID NO: 1110369 - RNA, 20 nt, Human
ggccuccgguggggucccag

SEQ ID NO: 1110370 - RNA, 19 nt, Human
ggggugaugguccuggccu

SEQ ID NO: 1110371 - RNA, 24 nt, Human
gucccagaggccuccgagaggcca

SEQ ID NO: 1110372 - RNA, 19 nt, Human
ucugggggcugagggggug

SEQ ID NO: 1110373 - RNA, 23 nt, Human
ugaccugagaggccuccuggucu

SEQ ID NO: 1110374 - RNA, 20 nt, Human
ugagggggugaugguccugg

SEQ ID NO: 1110375 - RNA, 19 nt, Human
ugcugguuccaggaaaagg

SEQ ID NO: 1110376 - RNA, 21 nt, Human
uggccuccgguggggucccuc

SEQ ID NO: 1110377 - RNA, 19 nt, Human
uugacugaccagaggggcu

SEQ ID NO: 1110378 - RNA, 23 nt, Human
aggggaagggguugaggagggau

SEQ ID NO: 1110379 - RNA, 20 nt, Human
gaagagucgaucaguguccc

SEQ ID NO: 1110380 - RNA, 18 nt, Human
ggggaagggguugaggag

SEQ ID NO: 1110381 - RNA, 24 nt, Human
ggugcuguuuuaaugaccaagugu

SEQ ID NO: 1110382 - RNA, 24 nt, Human
guguagaaauccaccugcagcugu

SEQ ID NO: 1110383 - RNA, 28 nt, Human
uccaccugcagcugugguuccgaguacg

SEQ ID NO: 1110384 - RNA, 20 nt, Human
aaaacacaauaacugcaaug

SEQ ID NO: 1110385 - RNA, 20 nt, Human
gccacaaaccuucaguuugu

SEQ ID NO: 1110386 - RNA, 24 nt, Human
uacauugugaacaugacaacuacc

SEQ ID NO: 1110387 - RNA, 23 nt, Human
uaccaaaaugugacauaaagaca

SEQ ID NO: 1110388 - RNA, 27 nt, Human
uauaaaacacaauaacugcaaugcaca

SEQ ID NO: 1110389 - RNA, 19 nt, Human
uauuucauagggaguacau

SEQ ID NO: 1110390 - RNA, 22 nt, Human
ucccaaagcaauuacaauagca

SEQ ID NO: 1110391 - RNA, 19 nt, Human
ucuugcucaccacaggguu

SEQ ID NO: 1110392 - RNA, 18 nt, Human
ugacauaaagacaugaaa

SEQ ID NO: 1110393 - RNA, 23 nt, Human
ugcacaauucagcgagguaugcc

SEQ ID NO: 1110394 - RNA, 21 nt, Human
aaccaggccuaagggauugcu

SEQ ID NO: 1110395 - RNA, 23 nt, Human
aagcagcuccgcgggaggagggc

SEQ ID NO: 1110396 - RNA, 26 nt, Human
acacacacaccccaauuuccuggcaa

SEQ ID NO: 1110397 - RNA, 21 nt, Human
acacaugcacgcacacacaca

SEQ ID NO: 1110398 - RNA, 20 nt, Human
acagccaguagagccagagc

SEQ ID NO: 1110399 - RNA, 18 nt, Human
accccaauuuccuggcau

SEQ ID NO: 1110400 - RNA, 22 nt, Human
agaccccugucauccccuaccc

SEQ ID NO: 1110401 - RNA, 20 nt, Human
agagcccuuccccaaagccc

SEQ ID NO: 1110402 - RNA, 23 nt, Human
agcaggugacuuccacaccuccc

SEQ ID NO: 1110403 - RNA, 18 nt, Human
aggcaggggugggacggg

SEQ ID NO: 1110404 - RNA, 19 nt, Human
aggcaggggugggacgggg

SEQ ID NO: 1110405 - RNA, 18 nt, Human
agggaaccaggccuaagg

SEQ ID NO: 1110406 - RNA, 19 nt, Human
agguggguggcgcagcccu

SEQ ID NO: 1110407 - RNA, 25 nt, Human
aucuuccugccuguucccuccgcug

SEQ ID NO: 1110408 - RNA, 19 nt, Human
auggagaugacagugggug

SEQ ID NO: 1110409 - RNA, 20 nt, Human
auggagaugacagugggugg

SEQ ID NO: 1110410 - RNA, 31 nt, Human
auguguguaagugcacacaugcacgcacaca

SEQ ID NO: 1110411 - RNA, 19 nt, Human
auuggccucagccaauuac

SEQ ID NO: 1110412 - RNA, 18 nt, Human
caaaacacggacaggcgc

SEQ ID NO: 1110413 - RNA, 19 nt, Human
caagagcacuaaggccccg

SEQ ID NO: 1110414 - RNA, 20 nt, Human
caaguguuuuaccaacaaac

SEQ ID NO: 1110415 - RNA, 26 nt, Human
cacaacccugcaccuguuguaauccc

SEQ ID NO: 1110416 - RNA, 22 nt, Human
cacacaugcacgcacacacaca

SEQ ID NO: 1110417 - RNA, 21 nt, Human
cacagaccccugucauccccu

SEQ ID NO: 1110418 - RNA, 27 nt, Human
cacaugcacgcacacacacacacaccc

SEQ ID NO: 1110419 - RNA, 27 nt, Human
cacaugcacgcacacacacacacaccc

SEQ ID NO: 1110420 - RNA, 26 nt, Human
caccagugacaaguguuuuaccaaca

SEQ ID NO: 1110421 - RNA, 20 nt, Human
caccucugccccgccccgcc

SEQ ID NO: 1110422 - RNA, 20 nt, Human
cagccccuuuccccgcccug

SEQ ID NO: 1110423 - RNA, 22 nt, Human
cagcccuaccuagaagcagcuc

SEQ ID NO: 1110424 - RNA, 23 nt, Human
caggaagugaaugaauaggugug

SEQ ID NO: 1110425 - RNA, 25 nt, Human
caguagagccagagcccuuccccaa

SEQ ID NO: 1110426 - RNA, 18 nt, Human
caucugggugucccgggg

SEQ ID NO: 1110427 - RNA, 22 nt, Human
ccacaccucccuggcucacacc

SEQ ID NO: 1110428 - RNA, 20 nt, Human
ccacugucuucccgcuggag

SEQ ID NO: 1110429 - RNA, 19 nt, Human
ccaggugguagaaggcaau

SEQ ID NO: 1110430 - RNA, 21 nt, Human
ccaggugguagaaggcaaugc

SEQ ID NO: 1110431 - RNA, 24 nt, Human
ccagugacaaguguuuuaccaaca

SEQ ID NO: 1110432 - RNA, 18 nt, Human
cccaggugguagaaggca

SEQ ID NO: 1110433 - RNA, 22 nt, Human
ccccgcccugggcccagcccuc

SEQ ID NO: 1110434 - RNA, 20 nt, Human
ccccuggauuggccucagcc

SEQ ID NO: 1110435 - RNA, 22 nt, Human
cccgagucugggacccagcccc

SEQ ID NO: 1110436 - RNA, 23 nt, Human
cccgcggccggcacucucagagc

SEQ ID NO: 1110437 - RNA, 21 nt, Human
cccgucacacuucucauccuc

SEQ ID NO: 1110438 - RNA, 21 nt, Human
cccuccagccacagaccccug

SEQ ID NO: 1110439 - RNA, 18 nt, Human
cccugaucuuccugccug

SEQ ID NO: 1110440 - RNA, 26 nt, Human
cccugggcccagcccucaccucugcc

SEQ ID NO: 1110441 - RNA, 24 nt, Human
ccgagucugggacccagccccacu

SEQ ID NO: 1110442 - RNA, 22 nt, Human
ccgcuggaggcugcaacgauuc

SEQ ID NO: 1110443 - RNA, 21 nt, Human
ccggcaaccaggggcgccaau

SEQ ID NO: 1110444 - RNA, 24 nt, Human
ccuccgcugcagccccuuuccccg

SEQ ID NO: 1110445 - RNA, 22 nt, Human
ccugcaucccagcucccuccag

SEQ ID NO: 1110446 - RNA, 21 nt, Human
ccugcuggcacccccagaacc

SEQ ID NO: 1110447 - RNA, 23 nt, Human
ccugcuggcacccccagaaccca

SEQ ID NO: 1110448 - RNA, 21 nt, Human
cgcacaccucugugcgccugu

SEQ ID NO: 1110449 - RNA, 18 nt, Human
cgccacugggcgauccac

SEQ ID NO: 1110450 - RNA, 19 nt, Human
cgggggaaguuacauggug

SEQ ID NO: 1110451 - RNA, 21 nt, Human
cucaccucugccccgccccgc

SEQ ID NO: 1110452 - RNA, 18 nt, Human
cucagagccugcuggcac

SEQ ID NO: 1110453 - RNA, 21 nt, Human
cucagagccugcuggcacccc

SEQ ID NO: 1110454 - RNA, 23 nt, Human
cucugugcgccuguauuugcggc

SEQ ID NO: 1110455 - RNA, 22 nt, Human
cugaauacccgacccaaagacc

SEQ ID NO: 1110456 - RNA, 21 nt, Human
cugaguguugugucugcccuc

SEQ ID NO: 1110457 - RNA, 18 nt, Human
cugcagguagcgcagcgc

SEQ ID NO: 1110458 - RNA, 21 nt, Human
cugcccugaucuuccugccug

SEQ ID NO: 1110459 - RNA, 21 nt, Human
cugcuggcacccccagaaccc

SEQ ID NO: 1110460 - RNA, 21 nt, Human
cuguucccuccgcugcagccc

SEQ ID NO: 1110461 - RNA, 22 nt, Human
cuguucccuccgcugcagcccc

SEQ ID NO: 1110462 - RNA, 19 nt, Human
cuuccacaccucccuggcu

SEQ ID NO: 1110463 - RNA, 27 nt, Human
gagcaggugaauaggagauaucagaug

SEQ ID NO: 1110464 - RNA, 26 nt, Human
gagccgaggcuccaggcggcagggaa

SEQ ID NO: 1110465 - RNA, 19 nt, Human
gagccugcuggcaccccca

SEQ ID NO: 1110466 - RNA, 24 nt, Human
gcccugcugcuucuccaguaccuu

SEQ ID NO: 1110467 - RNA, 30 nt, Human
ggccaggggguggaaagaaugacucagggg

SEQ ID NO: 1110468 - RNA, 23 nt, Human
gggcgagggccgggaccucgaga

SEQ ID NO: 1110469 - RNA, 20 nt, Human
gucacacuucucauccucca

SEQ ID NO: 1110470 - RNA, 21 nt, Human
gugaauaggagauaucagaug

SEQ ID NO: 1110471 - RNA, 21 nt, Human
gugcgguaggcagggguggga

SEQ ID NO: 1110472 - RNA, 20 nt, Human
gugggcagggcaucaucugg

SEQ ID NO: 1110473 - RNA, 21 nt, Human
uaacaggaaaacuaaucucgu

SEQ ID NO: 1110474 - RNA, 23 nt, Human
uaccuagaagcagcuccgcggga

SEQ ID NO: 1110475 - RNA, 22 nt, Human
uagaagcagcuccgcgggagga

SEQ ID NO: 1110476 - RNA, 21 nt, Human
uaggagauaucagauguggca

SEQ ID NO: 1110477 - RNA, 21 nt, Human
ucacagcggagccaucgcaca

SEQ ID NO: 1110478 - RNA, 22 nt, Human
ucaccuguggguucccggcugc

SEQ ID NO: 1110479 - RNA, 19 nt, Human
ucagccaauuacaucccga

SEQ ID NO: 1110480 - RNA, 20 nt, Human
ucagccaauuacaucccgag

SEQ ID NO: 1110481 - RNA, 18 nt, Human
uccccagucacagcggag

SEQ ID NO: 1110482 - RNA, 22 nt, Human
ucccggcugcgggccuccugca

SEQ ID NO: 1110483 - RNA, 20 nt, Human
ucccggggcagcaggugacu

SEQ ID NO: 1110484 - RNA, 20 nt, Human
ucccuccagccacagacccc

SEQ ID NO: 1110485 - RNA, 18 nt, Human
ucccuccgcugcagcccc

SEQ ID NO: 1110486 - RNA, 22 nt, Human
ucccuccgcugcagccccuuuc

SEQ ID NO: 1110487 - RNA, 19 nt, Human
ucccucuuccuucuucauu

SEQ ID NO: 1110488 - RNA, 19 nt, Human
ucccuggcucacaccccau

SEQ ID NO: 1110489 - RNA, 23 nt, Human
uccgaaguauccagcagcucgcu

SEQ ID NO: 1110490 - RNA, 20 nt, Human
ugaaugaauaggugugcgug

SEQ ID NO: 1110491 - RNA, 23 nt, Human
ugacaguggguggauagggaagu

SEQ ID NO: 1110492 - RNA, 19 nt, Human
ugacucaggggaagcgagg

SEQ ID NO: 1110493 - RNA, 26 nt, Human
ugcacacaugcacgcacacacacaca

SEQ ID NO: 1110494 - RNA, 21 nt, Human
ugccaggaaugccucuucgca

SEQ ID NO: 1110495 - RNA, 22 nt, Human
ugcgaggagccgaggcuccagg

SEQ ID NO: 1110496 - RNA, 18 nt, Human
uggaaagaaugacucagg

SEQ ID NO: 1110497 - RNA, 21 nt, Human
uggaggaaugagugugugcgg

SEQ ID NO: 1110498 - RNA, 23 nt, Human
ugggacccagccccacugucuuc

SEQ ID NO: 1110499 - RNA, 21 nt, Human
ugggugucccggggcagcagg

SEQ ID NO: 1110500 - RNA, 20 nt, Human
uggugcaggaagugaaugaa

SEQ ID NO: 1110501 - RNA, 25 nt, Human
uggugcaggaagugaaugaauaggu

SEQ ID NO: 1110502 - RNA, 31 nt, Human
uguaagugcacacaugcacgcacacacacag

SEQ ID NO: 1110503 - RNA, 18 nt, Human
uguagggaguagguggga

SEQ ID NO: 1110504 - RNA, 25 nt, Human
uguguaagugcacacaugcacgcag

SEQ ID NO: 1110505 - RNA, 23 nt, Human
uucccggcugcgggccuccugca

SEQ ID NO: 1110506 - RNA, 19 nt, Human
uuccuggcaucguccaccu

SEQ ID NO: 1110507 - RNA, 23 nt, Human
uucuccaguaccuugagacagua

SEQ ID NO: 1110508 - RNA, 20 nt, Human
uugcggcacccucugccagg

SEQ ID NO: 1110509 - RNA, 22 nt, Human
uuuccuggcaucguccacccga

SEQ ID NO: 1110510 - RNA, 21 nt, Human
acagggcugggaacacggggu

SEQ ID NO: 1110511 - RNA, 22 nt, Human
acccugaaggccuucugaccuc

SEQ ID NO: 1110512 - RNA, 22 nt, Human
agcaggcaggcgccgagcggcu

SEQ ID NO: 1110513 - RNA, 19 nt, Human
aggcagacaucccgcccuc

SEQ ID NO: 1110514 - RNA, 20 nt, Human
agggagcgaggaagggucag

SEQ ID NO: 1110515 - RNA, 23 nt, Human
aggugucgguggccgcgggcgcc

SEQ ID NO: 1110516 - RNA, 24 nt, Human
agugagggacagggcugggaacac

SEQ ID NO: 1110517 - RNA, 25 nt, Human
auggaacuggaggcagacauccccu

SEQ ID NO: 1110518 - RNA, 19 nt, Human
cacucccccagccccgggg

SEQ ID NO: 1110519 - RNA, 20 nt, Human
cagccgcagcguggcaggug

SEQ ID NO: 1110520 - RNA, 18 nt, Human
cagcugccguucccaucc

SEQ ID NO: 1110521 - RNA, 21 nt, Human
cagcugccguucccaucccgg

SEQ ID NO: 1110522 - RNA, 21 nt, Human
caucccggggacccugaaggc

SEQ ID NO: 1110523 - RNA, 24 nt, Human
ccccgagggaugcuggccccggag

SEQ ID NO: 1110524 - RNA, 20 nt, Human
ccccgggccuccucggaccc

SEQ ID NO: 1110525 - RNA, 22 nt, Human
cccgcaaaacccgcacgcaacg

SEQ ID NO: 1110526 - RNA, 24 nt, Human
cccgcaaaacccgcacgcaacgug

SEQ ID NO: 1110527 - RNA, 22 nt, Human
cccggagccagaauccuggggc

SEQ ID NO: 1110528 - RNA, 19 nt, Human
cccugaaggccuucugacc

SEQ ID NO: 1110529 - RNA, 24 nt, Human
ccgcugggcucagugagggacagg

SEQ ID NO: 1110530 - RNA, 18 nt, Human
ccggggccgcagcccggg

SEQ ID NO: 1110531 - RNA, 21 nt, Human
ccucaggcucuggacggcccu

SEQ ID NO: 1110532 - RNA, 22 nt, Human
ccuccuccgggucuccccgggc

SEQ ID NO: 1110533 - RNA, 22 nt, Human
ccucgaguuucacggagagaag

SEQ ID NO: 1110534 - RNA, 21 nt, Human
cgagcggcugcuggcagaggc

SEQ ID NO: 1110535 - RNA, 19 nt, Human
cgcacugggaagaaggugu

SEQ ID NO: 1110536 - RNA, 20 nt, Human
cgccugagcagcugccguuc

SEQ ID NO: 1110537 - RNA, 22 nt, Human
cggcgcaucugccgccugagca

SEQ ID NO: 1110538 - RNA, 20 nt, Human
cguggcagguguuggggccg

SEQ ID NO: 1110539 - RNA, 21 nt, Human
cucccccagccccggggcucc

SEQ ID NO: 1110540 - RNA, 27 nt, Human
cuccgggucuccccgggccuccucgga

SEQ ID NO: 1110541 - RNA, 25 nt, Human
cuccucgaguuucacggagagaagc

SEQ ID NO: 1110542 - RNA, 21 nt, Human
cuccuuguauggaacuggagg

SEQ ID NO: 1110543 - RNA, 21 nt, Human
cucuggacggcccuggggccc

SEQ ID NO: 1110544 - RNA, 25 nt, Human
cugaaggccuucugaccuccuccgg

SEQ ID NO: 1110545 - RNA, 20 nt, Human
gaccaugcggccagcacucc

SEQ ID NO: 1110546 - RNA, 19 nt, Human
ggacccggggccgcagccc

SEQ ID NO: 1110547 - RNA, 20 nt, Human
ggcagccgcagcguggcagg

SEQ ID NO: 1110548 - RNA, 23 nt, Human
gggaagaaggugucgguggccgc

SEQ ID NO: 1110549 - RNA, 20 nt, Human
gggcucagugagggacaggg

SEQ ID NO: 1110550 - RNA, 19 nt, Human
ggggugcucugaggcuuug

SEQ ID NO: 1110551 - RNA, 18 nt, Human
gugccgccagccccgugg

SEQ ID NO: 1110552 - RNA, 21 nt, Human
guggcagguguuggggccgcu

SEQ ID NO: 1110553 - RNA, 22 nt, Human
ucagugagggacagggcuggga

SEQ ID NO: 1110554 - RNA, 22 nt, Human
ucugaccuccuccgggucuccc

SEQ ID NO: 1110555 - RNA, 23 nt, Human
ugaggcuuugggguucccgcugg

SEQ ID NO: 1110556 - RNA, 22 nt, Human
uggaacuggaggcagacauccc

SEQ ID NO: 1110557 - RNA, 20 nt, Human
uggccccggagccagaaucc

SEQ ID NO: 1110558 - RNA, 18 nt, Human
uggggcccggcugccggg

SEQ ID NO: 1110559 - RNA, 18 nt, Human
ugggggccuguaugugca

SEQ ID NO: 1110560 - RNA, 24 nt, Human
uguauggaacuggaggcagacauc

SEQ ID NO: 1110561 - RNA, 22 nt, Human
ugugaccagguguccggcagcc

SEQ ID NO: 1110562 - RNA, 18 nt, Human
uguuggggccgcuucuga

SEQ ID NO: 1110563 - RNA, 21 nt, Human
uuacuggggugcucugaggcu

SEQ ID NO: 1110564 - RNA, 21 nt, Human
uuugggguucccgcugggcuc

SEQ ID NO: 1110565 - RNA, 21 nt, Human
aaaguggcagaugaccucauc

SEQ ID NO: 1110566 - RNA, 19 nt, Human
aaguagcucuggagguagg

SEQ ID NO: 1110567 - RNA, 18 nt, Human
cagaugaccucaucuucc

SEQ ID NO: 1110568 - RNA, 22 nt, Human
gaccucaucuuccacuguccac

SEQ ID NO: 1110569 - RNA, 23 nt, Human
ggagguaggcugaguaggcugcg

SEQ ID NO: 1110570 - RNA, 23 nt, Human
ggguccagggguguuccccaggu

SEQ ID NO: 1110571 - RNA, 20 nt, Human
ugggguccuggccgaugccu

SEQ ID NO: 1110572 - RNA, 22 nt, Human
ugggguccuggccgaugccugg

SEQ ID NO: 1110573 - RNA, 18 nt, Human
uguccacagggcacaggg

SEQ ID NO: 1110574 - RNA, 23 nt, Human
acugccccccgccuucugcacgc

SEQ ID NO: 1110575 - RNA, 23 nt, Human
aggcauguuccacacugcccccc

SEQ ID NO: 1110576 - RNA, 26 nt, Human
auucaauaaauauuuauuauaauuaa

SEQ ID NO: 1110577 - RNA, 21 nt, Human
cagcagaagcuggagguggug

SEQ ID NO: 1110578 - RNA, 24 nt, Human
cagccuccggcagcagaagcugga

SEQ ID NO: 1110579 - RNA, 27 nt, Human
ccacacugccccccgccuucugcacgg

SEQ ID NO: 1110580 - RNA, 22 nt, Human
ccccccgccuucugcacgccca

SEQ ID NO: 1110581 - RNA, 21 nt, Human
cgcccaguguccccuacccau

SEQ ID NO: 1110582 - RNA, 18 nt, Human
cggcagcagaagcuggag

SEQ ID NO: 1110583 - RNA, 19 nt, Human
cugggggcuggggcuucug

SEQ ID NO: 1110584 - RNA, 21 nt, Human
gccacuggguccugggguccc

SEQ ID NO: 1110585 - RNA, 23 nt, Human
gggggcuggggcuucugcggagu

SEQ ID NO: 1110586 - RNA, 18 nt, Human
ggguccugggguccuggg

SEQ ID NO: 1110587 - RNA, 23 nt, Human
ggguccugggguccugggggcug

SEQ ID NO: 1110588 - RNA, 18 nt, Human
gguccugggguccugggg

SEQ ID NO: 1110589 - RNA, 19 nt, Human
uccggggcugccggcugcg

SEQ ID NO: 1110590 - RNA, 24 nt, Human
uccugggguccugggggcuggggc

SEQ ID NO: 1110591 - RNA, 25 nt, Human
uccugggguccugggggcuggggcu

SEQ ID NO: 1110592 - RNA, 27 nt, Human
uccugggguccugggggcuggggcuuu

SEQ ID NO: 1110593 - RNA, 24 nt, Human
uggguccugggguccugggggcug

SEQ ID NO: 1110594 - RNA, 18 nt, Human
aagcaggggagcaaagag

SEQ ID NO: 1110595 - RNA, 22 nt, Human
aagcuuaggggcagcccuuugg

SEQ ID NO: 1110596 - RNA, 22 nt, Human
aaggggacagugagccaaggga

SEQ ID NO: 1110597 - RNA, 19 nt, Human
aaucccuugcccugcccuc

SEQ ID NO: 1110598 - RNA, 18 nt, Human
acccagguggggcacugg

SEQ ID NO: 1110599 - RNA, 22 nt, Human
agaauaaauuccuacaagugga

SEQ ID NO: 1110600 - RNA, 23 nt, Human
agaauugcaaccaggccgaagga

SEQ ID NO: 1110601 - RNA, 20 nt, Human
agagagccuguuugcccaca

SEQ ID NO: 1110602 - RNA, 21 nt, Human
agccagcgcugucaaaccaca

SEQ ID NO: 1110603 - RNA, 23 nt, Human
agcgccuccuuaaaucuugcacc

SEQ ID NO: 1110604 - RNA, 22 nt, Human
aggaguuuccuuccuaaagcuu

SEQ ID NO: 1110605 - RNA, 21 nt, Human
agggaagaggggacugggggc

SEQ ID NO: 1110606 - RNA, 19 nt, Human
agggaccucaggaccuggg

SEQ ID NO: 1110607 - RNA, 23 nt, Human
aguuuccuuccuaaagcuuaggg

SEQ ID NO: 1110608 - RNA, 23 nt, Human
aucccuugcccugcccucugcca

SEQ ID NO: 1110609 - RNA, 24 nt, Human
caaccaggccgaaggagggagggc

SEQ ID NO: 1110610 - RNA, 24 nt, Human
cacaggcaccagcggguuuccggc

SEQ ID NO: 1110611 - RNA, 19 nt, Human
caccaacagccucacccua

SEQ ID NO: 1110612 - RNA, 25 nt, Human
caccaacagccucacccuaguccua

SEQ ID NO: 1110613 - RNA, 26 nt, Human
caccauaaacccagguggggcacugg

SEQ ID NO: 1110614 - RNA, 20 nt, Human
cacccuaguccuagcccugc

SEQ ID NO: 1110615 - RNA, 19 nt, Human
caggggagcaaagaguucc

SEQ ID NO: 1110616 - RNA, 20 nt, Human
ccaaagcaggggagcaaaga

SEQ ID NO: 1110617 - RNA, 18 nt, Human
ccacaauccucaucaacc

SEQ ID NO: 1110618 - RNA, 27 nt, Human
ccaggacuaggaaaaggacggugagga

SEQ ID NO: 1110619 - RNA, 21 nt, Human
cccacaauccucaucaaccca

SEQ ID NO: 1110620 - RNA, 23 nt, Human
cccacgauaguagcagacuuuuu

SEQ ID NO: 1110621 - RNA, 18 nt, Human
cccuugcccugcccucug

SEQ ID NO: 1110622 - RNA, 18 nt, Human
ccggagcccaggacuagg

SEQ ID NO: 1110623 - RNA, 25 nt, Human
ccucgggcuucugagcucgagccca

SEQ ID NO: 1110624 - RNA, 23 nt, Human
ccuggacuucuuaaacuuaaggg

SEQ ID NO: 1110625 - RNA, 22 nt, Human
ccuugcccugcccucugccagc

SEQ ID NO: 1110626 - RNA, 21 nt, Human
ccuuggggaggagggaccuca

SEQ ID NO: 1110627 - RNA, 23 nt, Human
cggaacuccuaagucaacagcau

SEQ ID NO: 1110628 - RNA, 18 nt, Human
cggagcccaggacuagga

SEQ ID NO: 1110629 - RNA, 20 nt, Human
cuaaagguuccugccuuccu

SEQ ID NO: 1110630 - RNA, 24 nt, Human
cucacuuuauuugccacaggcacc

SEQ ID NO: 1110631 - RNA, 24 nt, Human
cuccuuaaaucuugcaccaacagc

SEQ ID NO: 1110632 - RNA, 19 nt, Human
cucuuacuggcuagggcug

SEQ ID NO: 1110633 - RNA, 27 nt, Human
cugaccccugagcucauauuucuggga

SEQ ID NO: 1110634 - RNA, 21 nt, Human
gaacccggagcccaggacuag

SEQ ID NO: 1110635 - RNA, 19 nt, Human
gaagaggggacugggggcc

SEQ ID NO: 1110636 - RNA, 22 nt, Human
gaggaaggagcaucugggugcu

SEQ ID NO: 1110637 - RNA, 24 nt, Human
gaggcacucgcucucaggguccug

SEQ ID NO: 1110638 - RNA, 23 nt, Human
gcuagggcuggcggcagaagggg

SEQ ID NO: 1110639 - RNA, 20 nt, Human
gcuggaauucugagggcagg

SEQ ID NO: 1110640 - RNA, 19 nt, Human
gcuuaggggcagcccuuug

SEQ ID NO: 1110641 - RNA, 20 nt, Human
ggacagugagccaagggagg

SEQ ID NO: 1110642 - RNA, 24 nt, Human
ggcagaaggggacagugagccaag

SEQ ID NO: 1110643 - RNA, 18 nt, Human
ggccuggacuucuuaaac

SEQ ID NO: 1110644 - RNA, 19 nt, Human
ggcuucugagcucgagccc

SEQ ID NO: 1110645 - RNA, 20 nt, Human
gggaagaggggacugggggc

SEQ ID NO: 1110646 - RNA, 22 nt, Human
gggcaccauaaacccagguggg

SEQ ID NO: 1110647 - RNA, 18 nt, Human
gggcacuggggcaagagg

SEQ ID NO: 1110648 - RNA, 18 nt, Human
gggcagggcugagaagga

SEQ ID NO: 1110649 - RNA, 19 nt, Human
ggggacugggggccuggga

SEQ ID NO: 1110650 - RNA, 21 nt, Human
gugcuggguccccaagagggu

SEQ ID NO: 1110651 - RNA, 22 nt, Human
guguggggagaagcagagccag

SEQ ID NO: 1110652 - RNA, 21 nt, Human
uaaauuccuacaaguggaaga

SEQ ID NO: 1110653 - RNA, 20 nt, Human
uaagggaagaggggacuggg

SEQ ID NO: 1110654 - RNA, 23 nt, Human
uaccgucauauggccaaagugga

SEQ ID NO: 1110655 - RNA, 19 nt, Human
uagaacccggagcccagga

SEQ ID NO: 1110656 - RNA, 20 nt, Human
uagaauaaauuccuacaagu

SEQ ID NO: 1110657 - RNA, 19 nt, Human
uagggcuggcggcagaagg

SEQ ID NO: 1110658 - RNA, 21 nt, Human
uauggccaaaguggagacacc

SEQ ID NO: 1110659 - RNA, 19 nt, Human
uccaugguuugagaucucc

SEQ ID NO: 1110660 - RNA, 26 nt, Human
uccaugguuugagaucuccccaaagc

SEQ ID NO: 1110661 - RNA, 24 nt, Human
ucccuugcccugcccucugccagc

SEQ ID NO: 1110662 - RNA, 23 nt, Human
uccuuggggaggagggaccucag

SEQ ID NO: 1110663 - RNA, 28 nt, Human
ucugaccccugagcucauauuucuggga

SEQ ID NO: 1110664 - RNA, 22 nt, Human
ugaggacccuggagugcaacau

SEQ ID NO: 1110665 - RNA, 24 nt, Human
ugauuaggggcuggaauucugagg

SEQ ID NO: 1110666 - RNA, 19 nt, Human
ugcaggguccgcaccugug

SEQ ID NO: 1110667 - RNA, 18 nt, Human
ugccauguaagugugugg

SEQ ID NO: 1110668 - RNA, 23 nt, Human
ugccucacacugggaagucuaaa

SEQ ID NO: 1110669 - RNA, 19 nt, Human
uggaagaggcgagcucaua

SEQ ID NO: 1110670 - RNA, 19 nt, Human
uggcggcagaaggggacag

SEQ ID NO: 1110671 - RNA, 20 nt, Human
uggggagaagcagagccagc

SEQ ID NO: 1110672 - RNA, 24 nt, Human
uggggaggagggaccucaggaccu

SEQ ID NO: 1110673 - RNA, 19 nt, Human
uggggcacuggggcaagag

SEQ ID NO: 1110674 - RNA, 20 nt, Human
uggguuucugaccccugagc

SEQ ID NO: 1110675 - RNA, 24 nt, Human
uggguuucugaccccugagcucau

SEQ ID NO: 1110676 - RNA, 21 nt, Human
uguguggggagaagcagagcc

SEQ ID NO: 1110677 - RNA, 18 nt, Human
uuccucgggcuucugagc

SEQ ID NO: 1110678 - RNA, 21 nt, Human
uuugaggaaggagcaucuggg

SEQ ID NO: 1110679 - RNA, 22 nt, Human
cuucaagacuggcgugcccucu

SEQ ID NO: 1110680 - RNA, 21 nt, Human
ggcgugcccucugggggagga

SEQ ID NO: 1110681 - RNA, 21 nt, Human
uggcgugcccucugggggagg

SEQ ID NO: 1110682 - RNA, 23 nt, Human
aaccaggaaaaggcagaggcuca

SEQ ID NO: 1110683 - RNA, 20 nt, Human
aagcgggggucucuguacgc

SEQ ID NO: 1110684 - RNA, 19 nt, Human
acccccuccaacucccccc

SEQ ID NO: 1110685 - RNA, 21 nt, Human
acccccuccaacucccccccu

SEQ ID NO: 1110686 - RNA, 20 nt, Human
acuaccaggcacccccucca

SEQ ID NO: 1110687 - RNA, 23 nt, Human
agagaggcagggguccgcgcugg

SEQ ID NO: 1110688 - RNA, 23 nt, Human
agcgccccuggcuacccccaccu

SEQ ID NO: 1110689 - RNA, 25 nt, Human
aggagcaagugguggccauagaggg

SEQ ID NO: 1110690 - RNA, 23 nt, Human
aggcagggguccgcgcuggcuuc

SEQ ID NO: 1110691 - RNA, 19 nt, Human
agggaacgaugggcugggg

SEQ ID NO: 1110692 - RNA, 21 nt, Human
caccgcgcugacugcuggggc

SEQ ID NO: 1110693 - RNA, 19 nt, Human
cagaaccagggaacgaugg

SEQ ID NO: 1110694 - RNA, 18 nt, Human
cagcaaagcgggggucuc

SEQ ID NO: 1110695 - RNA, 22 nt, Human
cagccagccccccccccagucu

SEQ ID NO: 1110696 - RNA, 18 nt, Human
ccacccugcgugaguggc

SEQ ID NO: 1110697 - RNA, 24 nt, Human
cccccuccaacucccccccuacaa

SEQ ID NO: 1110698 - RNA, 22 nt, Human
cccuccaacucccccccuacaa

SEQ ID NO: 1110699 - RNA, 23 nt, Human
ccgcugacggggaguggggcggc

SEQ ID NO: 1110700 - RNA, 19 nt, Human
ccggccuagguccuggcua

SEQ ID NO: 1110701 - RNA, 18 nt, Human
ccggcugccgcugacggg

SEQ ID NO: 1110702 - RNA, 18 nt, Human
ccucccugacagccagcc

SEQ ID NO: 1110703 - RNA, 24 nt, Human
ccuccgaagacuuucuggggcaga

SEQ ID NO: 1110704 - RNA, 21 nt, Human
cugacugcuggggcugggggc

SEQ ID NO: 1110705 - RNA, 23 nt, Human
cuggcuucuuccaccagggcugg

SEQ ID NO: 1110706 - RNA, 20 nt, Human
cuggggcagagaggcagggg

SEQ ID NO: 1110707 - RNA, 21 nt, Human
cuggggcugggggcugggggc

SEQ ID NO: 1110708 - RNA, 21 nt, Human
gaagugagucugaggucagga

SEQ ID NO: 1110709 - RNA, 19 nt, Human
gacugcuggggcugggggc

SEQ ID NO: 1110710 - RNA, 22 nt, Human
gagaggcagggguccgcgcugg

SEQ ID NO: 1110711 - RNA, 26 nt, Human
gaggagcaagugguggccauagaggg

SEQ ID NO: 1110712 - RNA, 19 nt, Human
gcagcaaagcgggggucuc

SEQ ID NO: 1110713 - RNA, 21 nt, Human
gccagccccccccccagucuc

SEQ ID NO: 1110714 - RNA, 20 nt, Human
gccauagagggccccccaga

SEQ ID NO: 1110715 - RNA, 19 nt, Human
ggcgcuucgcaaaaccagg

SEQ ID NO: 1110716 - RNA, 22 nt, Human
ggcggccucccugacagccagc

SEQ ID NO: 1110717 - RNA, 24 nt, Human
gggcauguggcgcccgcgucuggg

SEQ ID NO: 1110718 - RNA, 18 nt, Human
gggcugggggcgcagauc

SEQ ID NO: 1110719 - RNA, 20 nt, Human
ggggagcucggugcugaugu

SEQ ID NO: 1110720 - RNA, 21 nt, Human
gugacuaccaggcacccccuc

SEQ ID NO: 1110721 - RNA, 20 nt, Human
guggaagugagucugagguc

SEQ ID NO: 1110722 - RNA, 21 nt, Human
uaagacuccccuccgccaacc

SEQ ID NO: 1110723 - RNA, 23 nt, Human
uacgcaauuaugcaggggccgcu

SEQ ID NO: 1110724 - RNA, 21 nt, Human
uagagggccccccagaggcuu

SEQ ID NO: 1110725 - RNA, 21 nt, Human
uauggaagucaguaccugccc

SEQ ID NO: 1110726 - RNA, 26 nt, Human
ucacuggagacagcgccccuggcuac

SEQ ID NO: 1110727 - RNA, 24 nt, Human
ucccugacagccagcccccccccc

SEQ ID NO: 1110728 - RNA, 19 nt, Human
ucuccagauggcggcggcu

SEQ ID NO: 1110729 - RNA, 19 nt, Human
ucugaggucaggagugggg

SEQ ID NO: 1110730 - RNA, 19 nt, Human
ucugaggucaggagugggg

SEQ ID NO: 1110731 - RNA, 22 nt, Human
ugaacacggcgcuucgcaaaac

SEQ ID NO: 1110732 - RNA, 22 nt, Human
ugaaugaacacggcgcuucgca

SEQ ID NO: 1110733 - RNA, 22 nt, Human
ugacagccagccccccccccag

SEQ ID NO: 1110734 - RNA, 24 nt, Human
ugacuaccaggcacccccuccaac

SEQ ID NO: 1110735 - RNA, 18 nt, Human
ugacugcuggggcugggg

SEQ ID NO: 1110736 - RNA, 20 nt, Human
ugacugcuggggcugggggc

SEQ ID NO: 1110737 - RNA, 18 nt, Human
ugagcccaugaggggucc

SEQ ID NO: 1110738 - RNA, 20 nt, Human
ugcgugaguggcugacgcag

SEQ ID NO: 1110739 - RNA, 23 nt, Human
ugcuggggcugggggcugggggc

SEQ ID NO: 1110740 - RNA, 23 nt, Human
ugcuggggcugggggcugggggc

SEQ ID NO: 1110741 - RNA, 21 nt, Human
uggggccgggauuucccuggg

SEQ ID NO: 1110742 - RNA, 22 nt, Human
ugggggcugggggcgcagauca

SEQ ID NO: 1110743 - RNA, 22 nt, Human
ugucucucuccuuuaauaacca

SEQ ID NO: 1110744 - RNA, 22 nt, Human
uugagcccaugaggggucccag

SEQ ID NO: 1110745 - RNA, 19 nt, Human
uugcucccaggcugggcau

SEQ ID NO: 1110746 - RNA, 22 nt, Human
ccgccuucggccccggcgaccc

SEQ ID NO: 1110747 - RNA, 24 nt, Human
cgacuucggcucccgcucugacuc

SEQ ID NO: 1110748 - RNA, 22 nt, Human
cucugccgccuucggccccggc

SEQ ID NO: 1110749 - RNA, 20 nt, Human
cugccgccuucggccccggc

SEQ ID NO: 1110750 - RNA, 23 nt, Human
ugcuccgacuucggcucccgcuc

SEQ ID NO: 1110751 - RNA, 18 nt, Human
aagcagcaggaggagcug

SEQ ID NO: 1110752 - RNA, 19 nt, Human
aggagaagcgcgcacggcg

SEQ ID NO: 1110753 - RNA, 22 nt, Human
cagcagagccugcaggagcggc

SEQ ID NO: 1110754 - RNA, 20 nt, Human
cagcaggaggagcugaugaa

SEQ ID NO: 1110755 - RNA, 21 nt, Human
cgcaagaagcgggagaagaug

SEQ ID NO: 1110756 - RNA, 22 nt, Human
cggaagcagcaggaggagcuga

SEQ ID NO: 1110757 - RNA, 20 nt, Human
cggcggcuggccaagaagga

SEQ ID NO: 1110758 - RNA, 20 nt, Human
cgggaggagcggaagcagca

SEQ ID NO: 1110759 - RNA, 19 nt, Human
cugcaggagcggcugcggc

SEQ ID NO: 1110760 - RNA, 19 nt, Human
cugcgggaggagcggaagc

SEQ ID NO: 1110761 - RNA, 18 nt, Human
gagcgcaagaagcgggag

SEQ ID NO: 1110762 - RNA, 20 nt, Human
gagcggcugcggcugcggga

SEQ ID NO: 1110763 - RNA, 19 nt, Human
gcugcccugagccagcagc

SEQ ID NO: 1110764 - RNA, 25 nt, Human
ggaagcagcaggaggagccgguacc

SEQ ID NO: 1110765 - RNA, 24 nt, Human
ggagaagaugggcuggggugagga

SEQ ID NO: 1110766 - RNA, 18 nt, Human
ugggcuggggugaggagu

SEQ ID NO: 1110767 - RNA, 24 nt, Human
ugggcuggggugaggaguacaugg

SEQ ID NO: 1110768 - RNA, 24 nt, Human
ugggcuggggugaggaguacaugg

SEQ ID NO: 1110769 - RNA, 23 nt, Human
auaaaucuucacauuggacaaag

SEQ ID NO: 1110770 - RNA, 22 nt, Human
caaaggacaucuaaaaacaaag

SEQ ID NO: 1110771 - RNA, 24 nt, Human
caacgguaaucaaaacaauaugaa

SEQ ID NO: 1110772 - RNA, 21 nt, Human
cucaacaauuucucacuucau

SEQ ID NO: 1110773 - RNA, 24 nt, Human
gacaucuaaaaacaaacuguaucc

SEQ ID NO: 1110774 - RNA, 24 nt, Human
uaaaaacaaacuguauccuucuca

SEQ ID NO: 1110775 - RNA, 25 nt, Human
uaaaaacaaacuguauccuucucaa

SEQ ID NO: 1110776 - RNA, 21 nt, Human
ugaauaaaucuucacauugga

SEQ ID NO: 1110777 - RNA, 23 nt, Human
agaaacauuccucauugcacccc

SEQ ID NO: 1110778 - RNA, 24 nt, Human
agaaacauuccucauugcaccccc

SEQ ID NO: 1110779 - RNA, 20 nt, Human
cauugcaccccccucccugc

SEQ ID NO: 1110780 - RNA, 22 nt, Human
ccucauugcaccccccucccug

SEQ ID NO: 1110781 - RNA, 24 nt, Human
cggacggcagagcggcaugcgucg

SEQ ID NO: 1110782 - RNA, 19 nt, Human
cggcaugcgucgugucuuu

SEQ ID NO: 1110783 - RNA, 23 nt, Human
ugcuggcgcagguggccuuucug

SEQ ID NO: 1110784 - RNA, 18 nt, Human
uugcaccccccucccugc

SEQ ID NO: 1110785 - RNA, 20 nt, Human
uugcaccccccucccugccc

SEQ ID NO: 1110786 - RNA, 21 nt, Human
acugcaaacugcugaccgugg

SEQ ID NO: 1110787 - RNA, 23 nt, Human
agccgcuacaaguccuccggcuu

SEQ ID NO: 1110788 - RNA, 19 nt, Human
agugcccaggacggcccca

SEQ ID NO: 1110789 - RNA, 23 nt, Human
ccaccccggagaacggcgcgccc

SEQ ID NO: 1110790 - RNA, 22 nt, Human
cccaggacggccccaccccgga

SEQ ID NO: 1110791 - RNA, 22 nt, Human
ccuccaaccuguccgaguucau

SEQ ID NO: 1110792 - RNA, 20 nt, Human
ccuucgccauugagggugag

SEQ ID NO: 1110793 - RNA, 18 nt, Human
cggcuucaucgaccugcu

SEQ ID NO: 1110794 - RNA, 20 nt, Human
cuccacgacaagugguacaa

SEQ ID NO: 1110795 - RNA, 22 nt, Human
cuccuggacuacgaggucucca

SEQ ID NO: 1110796 - RNA, 18 nt, Human
cugaccgugggaaagccc

SEQ ID NO: 1110797 - RNA, 18 nt, Human
cugggcgaggcggggcgc

SEQ ID NO: 1110798 - RNA, 24 nt, Human
cuucaucgaccugcuccacgacaa

SEQ ID NO: 1110799 - RNA, 20 nt, Human
uccuccggcuucaucgaccu

SEQ ID NO: 1110800 - RNA, 21 nt, Human
ucucuggggaccuccuccaac

SEQ ID NO: 1110801 - RNA, 23 nt, Human
uucaucgaccugcuccacgacaa

SEQ ID NO: 1110802 - RNA, 19 nt, Human
aaugcaaaagcacaauugg

SEQ ID NO: 1110803 - RNA, 26 nt, Human
aaugcaaaagcacaauuggggaaaaa

SEQ ID NO: 1110804 - RNA, 21 nt, Human
accccagcugccccccgugcc

SEQ ID NO: 1110805 - RNA, 21 nt, Human
acccuuaacaacgaccccagc

SEQ ID NO: 1110806 - RNA, 24 nt, Human
agaaaggaaauucaacuguacaga

SEQ ID NO: 1110807 - RNA, 22 nt, Human
agcaggcgcuucccccggcgcg

SEQ ID NO: 1110808 - RNA, 20 nt, Human
agccgccuuucucccaacau

SEQ ID NO: 1110809 - RNA, 21 nt, Human
augauaagagaaaggaaauuc

SEQ ID NO: 1110810 - RNA, 23 nt, Human
cagacacggacagaguccaggug

SEQ ID NO: 1110811 - RNA, 25 nt, Human
cagagauaggcagcaggcgcuuccc

SEQ ID NO: 1110812 - RNA, 27 nt, Human
cagcaggcgcuucccccggcgcggggc

SEQ ID NO: 1110813 - RNA, 22 nt, Human
cagggcgagacaggcugggccc

SEQ ID NO: 1110814 - RNA, 19 nt, Human
caucucagagcagggggag

SEQ ID NO: 1110815 - RNA, 18 nt, Human
ccaggcgugggacggggg

SEQ ID NO: 1110816 - RNA, 21 nt, Human
ccccggcgcggggcccaggcg

SEQ ID NO: 1110817 - RNA, 24 nt, Human
ccccgugccccgugcccacccucc

SEQ ID NO: 1110818 - RNA, 21 nt, Human
cccucccgccuuucuggacag

SEQ ID NO: 1110819 - RNA, 19 nt, Human
cccuuaacaacgaccccag

SEQ ID NO: 1110820 - RNA, 18 nt, Human
ccgugcccacccucccgc

SEQ ID NO: 1110821 - RNA, 19 nt, Human
ccgugcccacccucccgcc

SEQ ID NO: 1110822 - RNA, 22 nt, Human
cgugccccgugcccacccuccc

SEQ ID NO: 1110823 - RNA, 20 nt, Human
gaccugagguagacagagau

SEQ ID NO: 1110824 - RNA, 20 nt, Human
gcagccaggccccacggucc

SEQ ID NO: 1110825 - RNA, 21 nt, Human
uacaggccacccugccgcggc

SEQ ID NO: 1110826 - RNA, 22 nt, Human
uaccugaauguucugcgaaaac

SEQ ID NO: 1110827 - RNA, 22 nt, Human
uagacagagauaggcagcaggc

SEQ ID NO: 1110828 - RNA, 21 nt, Human
uaggcagcaggcgcuuccccc

SEQ ID NO: 1110829 - RNA, 20 nt, Human
uccagaagccgccuuucucc

SEQ ID NO: 1110830 - RNA, 24 nt, Human
ucccgggagaggagcccuggaggc

SEQ ID NO: 1110831 - RNA, 23 nt, Human
ucuggacagccacuuacgggucc

SEQ ID NO: 1110832 - RNA, 20 nt, Human
ugccaaggaaaaaaaugcaa

SEQ ID NO: 1110833 - RNA, 30 nt, Human
ugccaaggaaaaaaaugcaaaagcacaauu

SEQ ID NO: 1110834 - RNA, 21 nt, Human
uuccagaagccgccuuucucc

SEQ ID NO: 1110835 - RNA, 21 nt, Human
uuguuacaggccacccugccg

SEQ ID NO: 1110836 - RNA, 22 nt, Human
uuuuuuuuuuccuccuauuacc

SEQ ID NO: 1110837 - RNA, 20 nt, Human
aacuggcuguuucacuucuu

SEQ ID NO: 1110838 - RNA, 26 nt, Human
aacuggcuguuucacuucuuuguggu

SEQ ID NO: 1110839 - RNA, 22 nt, Human
aagcguuuuagacuuuugaccc

SEQ ID NO: 1110840 - RNA, 24 nt, Human
aagcguuuuagacuuuugacccag

SEQ ID NO: 1110841 - RNA, 23 nt, Human
agcagaggagggggucacaaggu

SEQ ID NO: 1110842 - RNA, 26 nt, Human
augguggacaagucauaaugguggga

SEQ ID NO: 1110843 - RNA, 21 nt, Human
ccugcaggccaccuggacgga

SEQ ID NO: 1110844 - RNA, 22 nt, Human
gaaaaaauuuuagaggauaggg

SEQ ID NO: 1110845 - RNA, 23 nt, Human
ggucacagggguuacaauggcua

SEQ ID NO: 1110846 - RNA, 18 nt, Human
gguggagagaugauggga

SEQ ID NO: 1110847 - RNA, 21 nt, Human
ucacaaggugcaugguggaga

SEQ ID NO: 1110848 - RNA, 18 nt, Human
ugggcaaggaucugaugg

SEQ ID NO: 1110849 - RNA, 24 nt, Human
ugucacaggguugauugaucaguu

SEQ ID NO: 1110850 - RNA, 25 nt, Human
ugugaccagggacugcguggacacc

SEQ ID NO: 1110851 - RNA, 24 nt, Human
uuaaggcaggaacuggcuguuuca

SEQ ID NO: 1110852 - RNA, 24 nt, Human
uucagcucacaggccugacauuuu

SEQ ID NO: 1110853 - RNA, 21 nt, Human
uuggggcagggcaggaacaag

SEQ ID NO: 1110854 - RNA, 22 nt, Human
aagccagagaggggcugggggc

SEQ ID NO: 1110855 - RNA, 19 nt, Human
aaggcuggagguuaugccu

SEQ ID NO: 1110856 - RNA, 22 nt, Human
acacagccucauccaauucucc

SEQ ID NO: 1110857 - RNA, 22 nt, Human
acacugaaagcaaucugaaagc

SEQ ID NO: 1110858 - RNA, 19 nt, Human
acagagccugcgggaaggc

SEQ ID NO: 1110859 - RNA, 23 nt, Human
acagccggauccugcgacgcgcc

SEQ ID NO: 1110860 - RNA, 19 nt, Human
acccugagagugauuuggg

SEQ ID NO: 1110861 - RNA, 21 nt, Human
acugccacgggccagcugggg

SEQ ID NO: 1110862 - RNA, 19 nt, Human
agaagccacuguacccuga

SEQ ID NO: 1110863 - RNA, 25 nt, Human
agacacugaaagcaaucugaaagcc

SEQ ID NO: 1110864 - RNA, 21 nt, Human
agacuacauuagaagccacug

SEQ ID NO: 1110865 - RNA, 18 nt, Human
agagccaugagugccucc

SEQ ID NO: 1110866 - RNA, 21 nt, Human
agccagagaggggcugggggc

SEQ ID NO: 1110867 - RNA, 20 nt, Human
agcugguaggcggaggccca

SEQ ID NO: 1110868 - RNA, 22 nt, Human
aggcagagugccugggacugcg

SEQ ID NO: 1110869 - RNA, 20 nt, Human
aggcagagugccugggacuu

SEQ ID NO: 1110870 - RNA, 21 nt, Human
aggcccaagacacugccccgg

SEQ ID NO: 1110871 - RNA, 20 nt, Human
agggguggcagggaaccacu

SEQ ID NO: 1110872 - RNA, 23 nt, Human
augccacuagcauggcugggagc

SEQ ID NO: 1110873 - RNA, 23 nt, Human
augcggcugccugggacucaggg

SEQ ID NO: 1110874 - RNA, 23 nt, Human
auggcuuacagccacaccccuga

SEQ ID NO: 1110875 - RNA, 24 nt, Human
caaagggccaccugccucuaagac

SEQ ID NO: 1110876 - RNA, 21 nt, Human
caacugggcucacccgacuca

SEQ ID NO: 1110877 - RNA, 20 nt, Human
cacagaaccagggggacaac

SEQ ID NO: 1110878 - RNA, 24 nt, Human
cacagccggauccugcgacgcgcc

SEQ ID NO: 1110879 - RNA, 21 nt, Human
cacagguaugacaggugcgag

SEQ ID NO: 1110880 - RNA, 23 nt, Human
caccaaccacaccagcguccgcg

SEQ ID NO: 1110881 - RNA, 18 nt, Human
caccacacgggugggcug

SEQ ID NO: 1110882 - RNA, 23 nt, Human
caccaugggccccuuggagcagc

SEQ ID NO: 1110883 - RNA, 23 nt, Human
cacccuccgaacucccggggcca

SEQ ID NO: 1110884 - RNA, 19 nt, Human
caccucccuuggggaagag

SEQ ID NO: 1110885 - RNA, 27 nt, Human
cacuagaggcccccaucaaccggaggg

SEQ ID NO: 1110886 - RNA, 22 nt, Human
cacugaaagcaaucugaaagcc

SEQ ID NO: 1110887 - RNA, 21 nt, Human
cacuggguugcaccagugacc

SEQ ID NO: 1110888 - RNA, 18 nt, Human
cagagugccugggacugc

SEQ ID NO: 1110889 - RNA, 25 nt, Human
caggacgcagcaccccuggcuggcu

SEQ ID NO: 1110890 - RNA, 23 nt, Human
caugaccccggcccggcugccca

SEQ ID NO: 1110891 - RNA, 19 nt, Human
ccaaguagcuuggaugacc

SEQ ID NO: 1110892 - RNA, 18 nt, Human
ccacagguaugacaggug

SEQ ID NO: 1110893 - RNA, 20 nt, Human
ccacagguaugacaggugcg

SEQ ID NO: 1110894 - RNA, 22 nt, Human
cccacagacacugaaagcaauc

SEQ ID NO: 1110895 - RNA, 26 nt, Human
cccagagagccaugagugccucccac

SEQ ID NO: 1110896 - RNA, 26 nt, Human
cccauccugcccacagacacugaaag

SEQ ID NO: 1110897 - RNA, 23 nt, Human
cccauggcgucccagcggcugcu

SEQ ID NO: 1110898 - RNA, 22 nt, Human
ccccagauggcauuauccuagc

SEQ ID NO: 1110899 - RNA, 23 nt, Human
ccccagugcggaugacgggccuu

SEQ ID NO: 1110900 - RNA, 19 nt, Human
cccggggcccucagugccc

SEQ ID NO: 1110901 - RNA, 23 nt, Human
cccucagugcccuggcccaugcc

SEQ ID NO: 1110902 - RNA, 19 nt, Human
cccugagacccacugggga

SEQ ID NO: 1110903 - RNA, 25 nt, Human
cccuggcccaugcccugcaccacac

SEQ ID NO: 1110904 - RNA, 28 nt, Human
ccuaacccuggccacagaacuuucuagc

SEQ ID NO: 1110905 - RNA, 22 nt, Human
ccuagcuuggcuugguccccug

SEQ ID NO: 1110906 - RNA, 22 nt, Human
ccuaugaucauggcccccaucu

SEQ ID NO: 1110907 - RNA, 24 nt, Human
ccucccacgaaguccccacugcag

SEQ ID NO: 1110908 - RNA, 18 nt, Human
ccuccugccgcaccacga

SEQ ID NO: 1110909 - RNA, 23 nt, Human
ccugcaccacacgggugggcugu

SEQ ID NO: 1110910 - RNA, 23 nt, Human
ccugccgucuccacggugacucc

SEQ ID NO: 1110911 - RNA, 25 nt, Human
ccuggcccaugcccugguccccugg

SEQ ID NO: 1110912 - RNA, 19 nt, Human
ccuggcucugccauccugg

SEQ ID NO: 1110913 - RNA, 21 nt, Human
ccugguuaaaaagggguggca

SEQ ID NO: 1110914 - RNA, 19 nt, Human
cgcugccauuugcugcugc

SEQ ID NO: 1110915 - RNA, 22 nt, Human
cggaaucacaucucucugcugg

SEQ ID NO: 1110916 - RNA, 22 nt, Human
cggaggcccaagacacugcccc

SEQ ID NO: 1110917 - RNA, 19 nt, Human
cggcugcccagcuccaccc

SEQ ID NO: 1110918 - RNA, 24 nt, Human
cgggguggagcaucugccagugcc

SEQ ID NO: 1110919 - RNA, 28 nt, Human
cucacuacugaaccugggaagguuuucc

SEQ ID NO: 1110920 - RNA, 21 nt, Human
cucacugugccacuagcugcc

SEQ ID NO: 1110921 - RNA, 22 nt, Human
cucccacgaaguccccacugca

SEQ ID NO: 1110922 - RNA, 22 nt, Human
cugaagccagagaggggcuggg

SEQ ID NO: 1110923 - RNA, 18 nt, Human
cugcagagggccuguggg

SEQ ID NO: 1110924 - RNA, 21 nt, Human
cuggaaccagcuucggucaga

SEQ ID NO: 1110925 - RNA, 25 nt, Human
cuggagcccacuagcaucaccacgc

SEQ ID NO: 1110926 - RNA, 18 nt, Human
cuggucccaagagcgccu

SEQ ID NO: 1110927 - RNA, 20 nt, Human
cuugauccugacacuuggaa

SEQ ID NO: 1110928 - RNA, 24 nt, Human
cuugguccccugugaccccagaug

SEQ ID NO: 1110929 - RNA, 20 nt, Human
gaccuggagccagacuggug

SEQ ID NO: 1110930 - RNA, 19 nt, Human
gagcccacuagcaucacca

SEQ ID NO: 1110931 - RNA, 18 nt, Human
gagcucagggaguggcag

SEQ ID NO: 1110932 - RNA, 19 nt, Human
gaucauggcccccaucagc

SEQ ID NO: 1110933 - RNA, 19 nt, Human
gauccacuugauccugaca

SEQ ID NO: 1110934 - RNA, 24 nt, Human
gcaggacuggaagcagcgaugguc

SEQ ID NO: 1110935 - RNA, 23 nt, Human
gccacacuagaggcccccaucau

SEQ ID NO: 1110936 - RNA, 18 nt, Human
gcucauucuacuggcuac

SEQ ID NO: 1110937 - RNA, 19 nt, Human
gcucccaugcgcgguucca

SEQ ID NO: 1110938 - RNA, 19 nt, Human
ggaccgccugggaggcacc

SEQ ID NO: 1110939 - RNA, 19 nt, Human
ggcacagaaccagggggac

SEQ ID NO: 1110940 - RNA, 19 nt, Human
ggccugugggugggguuug

SEQ ID NO: 1110941 - RNA, 21 nt, Human
ggcuuacagccacaccccuga

SEQ ID NO: 1110942 - RNA, 24 nt, Human
gggccccuuggagcagcucugagc

SEQ ID NO: 1110943 - RNA, 21 nt, Human
gggcccuggaguauaguggag

SEQ ID NO: 1110944 - RNA, 23 nt, Human
gggcucccgauccuggagcucag

SEQ ID NO: 1110945 - RNA, 21 nt, Human
gggggccaucccugugguucc

SEQ ID NO: 1110946 - RNA, 18 nt, Human
gucaaagggccaccugcc

SEQ ID NO: 1110947 - RNA, 21 nt, Human
guccccugagacccacugggg

SEQ ID NO: 1110948 - RNA, 20 nt, Human
gugccgggcuuggucccggc

SEQ ID NO: 1110949 - RNA, 20 nt, Human
guggagcaucugccagugcc

SEQ ID NO: 1110950 - RNA, 25 nt, Human
guggcagggaaccacuuggggaaga

SEQ ID NO: 1110951 - RNA, 19 nt, Human
guuaaaaagggguggcagg

SEQ ID NO: 1110952 - RNA, 22 nt, Human
uacagccacaccccugaacaga

SEQ ID NO: 1110953 - RNA, 21 nt, Human
uaccucugcagagggccugug

SEQ ID NO: 1110954 - RNA, 21 nt, Human
uauccuagcaucuuggcucaa

SEQ ID NO: 1110955 - RNA, 24 nt, Human
uccacggugacuccugguuaaaaa

SEQ ID NO: 1110956 - RNA, 23 nt, Human
uccaugcuguucagggaaagauu

SEQ ID NO: 1110957 - RNA, 24 nt, Human
ucccacgaaguccccacugcaggg

SEQ ID NO: 1110958 - RNA, 28 nt, Human
ucccagaggacuggaguacauccacuuc

SEQ ID NO: 1110959 - RNA, 19 nt, Human
ucccagcggcugcucggag

SEQ ID NO: 1110960 - RNA, 21 nt, Human
ucccugaccucugaagaagac

SEQ ID NO: 1110961 - RNA, 19 nt, Human
uccugccgcaccacgacca

SEQ ID NO: 1110962 - RNA, 23 nt, Human
uccugguuaaaaagggguggcag

SEQ ID NO: 1110963 - RNA, 21 nt, Human
ucuaaagguccuugaugggug

SEQ ID NO: 1110964 - RNA, 21 nt, Human
ucuccuagcuuggcuuggucc

SEQ ID NO: 1110965 - RNA, 18 nt, Human
ucugggagcugcuggggu

SEQ ID NO: 1110966 - RNA, 23 nt, Human
ucuucgcugccauuugcugcugc

SEQ ID NO: 1110967 - RNA, 18 nt, Human
ugaaagccucaguacugc

SEQ ID NO: 1110968 - RNA, 21 nt, Human
ugaaccugggagcaaguuugg

SEQ ID NO: 1110969 - RNA, 19 nt, Human
ugaagccagagaggggcug

SEQ ID NO: 1110970 - RNA, 20 nt, Human
ugaagccagagaggggcugg

SEQ ID NO: 1110971 - RNA, 21 nt, Human
ugacaggugcgagggcuggag

SEQ ID NO: 1110972 - RNA, 23 nt, Human
ugacauugacuuuggcccaugcc

SEQ ID NO: 1110973 - RNA, 19 nt, Human
ugacauugacuuuggcccc

SEQ ID NO: 1110974 - RNA, 27 nt, Human
ugaccccagauggcauuauccuagcau

SEQ ID NO: 1110975 - RNA, 23 nt, Human
ugaccccggcccggcugcccagc

SEQ ID NO: 1110976 - RNA, 18 nt, Human
ugacgugagugacagacc

SEQ ID NO: 1110977 - RNA, 23 nt, Human
ugagacuacauuagaagccacug

SEQ ID NO: 1110978 - RNA, 19 nt, Human
ugagcuggccgaggggucu

SEQ ID NO: 1110979 - RNA, 21 nt, Human
ugagucacggccagucuguug

SEQ ID NO: 1110980 - RNA, 22 nt, Human
ugagugccucccacgaaguccc

SEQ ID NO: 1110981 - RNA, 22 nt, Human
ugagugccucccacgaaguccc

SEQ ID NO: 1110982 - RNA, 21 nt, Human
ugauaaacugagggggacuua

SEQ ID NO: 1110983 - RNA, 18 nt, Human
ugcaccagugacccuggc

SEQ ID NO: 1110984 - RNA, 22 nt, Human
ugcagagggccugugggugggg

SEQ ID NO: 1110985 - RNA, 18 nt, Human
ugccacuagcugccgggg

SEQ ID NO: 1110986 - RNA, 21 nt, Human
ugccaggccaaugcaugugcc

SEQ ID NO: 1110987 - RNA, 22 nt, Human
ugcccagcuccacccacgugac

SEQ ID NO: 1110988 - RNA, 20 nt, Human
ugccccggggcccucagugc

SEQ ID NO: 1110989 - RNA, 18 nt, Human
ugccucagaagggugcca

SEQ ID NO: 1110990 - RNA, 22 nt, Human
ugccucagaagggugccagcag

SEQ ID NO: 1110991 - RNA, 23 nt, Human
ugccucagaagggugccagcagu

SEQ ID NO: 1110992 - RNA, 18 nt, Human
ugccugggacucagggca

SEQ ID NO: 1110993 - RNA, 19 nt, Human
ugccugggacucagggcag

SEQ ID NO: 1110994 - RNA, 22 nt, Human
ugccugggacucagggcagcca

SEQ ID NO: 1110995 - RNA, 18 nt, Human
uggagcagcuaagcuagc

SEQ ID NO: 1110996 - RNA, 23 nt, Human
uggagcccgggggaaggcuggag

SEQ ID NO: 1110997 - RNA, 24 nt, Human
uggcuggcucccaugcgcgguucc

SEQ ID NO: 1110998 - RNA, 20 nt, Human
uggcuuacagccacaccccu

SEQ ID NO: 1110999 - RNA, 18 nt, Human
uggcuugguccccuguga

SEQ ID NO: 1111000 - RNA, 22 nt, Human
ugggaccauggaugccucagaa

SEQ ID NO: 1111001 - RNA, 20 nt, Human
ugggagccacccaacuggac

SEQ ID NO: 1111002 - RNA, 19 nt, Human
ugggaugcaagggaagcca

SEQ ID NO: 1111003 - RNA, 21 nt, Human
uggggaacauagcaucagcca

SEQ ID NO: 1111004 - RNA, 20 nt, Human
ugggugggguuugcaccacu

SEQ ID NO: 1111005 - RNA, 21 nt, Human
uggugaccuuggucugaggcc

SEQ ID NO: 1111006 - RNA, 23 nt, Human
uguaagggccuaacccuggccac

SEQ ID NO: 1111007 - RNA, 19 nt, Human
uguagccgcgccaggcaga

SEQ ID NO: 1111008 - RNA, 21 nt, Human
ugucccaggacgcagcacccc

SEQ ID NO: 1111009 - RNA, 21 nt, Human
uguccuggcucugccauccug

SEQ ID NO: 1111010 - RNA, 23 nt, Human
uugcugcugccucaucugcuggc

SEQ ID NO: 1111011 - RNA, 24 nt, Human
uuggagcagcuaagcuagcggagg

SEQ ID NO: 1111012 - RNA, 19 nt, Human
uuggccaccugacauugac

SEQ ID NO: 1111013 - RNA, 22 nt, Human
uuggggacagcuucugucugga

SEQ ID NO: 1111014 - RNA, 20 nt, Human
uuggugaccuuggucugagg

SEQ ID NO: 1111015 - RNA, 22 nt, Human
uuucucagacagggaccuauga

SEQ ID NO: 1111016 - RNA, 23 nt, Human
uuugcugcugccucaucugcugg

SEQ ID NO: 1111017 - RNA, 21 nt, Human
auuuuauuuugcauacaugga

SEQ ID NO: 1111018 - RNA, 21 nt, Human
uacauggauguccucggagac

SEQ ID NO: 1111019 - RNA, 28 nt, Human
uugcauacauggauguccucggagacug

SEQ ID NO: 1111020 - RNA, 21 nt, Human
uuuugcauacauggauguccu

SEQ ID NO: 1111021 - RNA, 24 nt, Human
aaauauuggugaggcuggugagcc

SEQ ID NO: 1111022 - RNA, 19 nt, Human
accccagugccggggcagc

SEQ ID NO: 1111023 - RNA, 19 nt, Human
acugcuuaccacuggggca

SEQ ID NO: 1111024 - RNA, 24 nt, Human
auauuggugaggcuggugagccug

SEQ ID NO: 1111025 - RNA, 22 nt, Human
cacugcuuaccacuggggcagc

SEQ ID NO: 1111026 - RNA, 19 nt, Human
ccggggcagcaaaguggag

SEQ ID NO: 1111027 - RNA, 19 nt, Human
cuggugagccugcccuucu

SEQ ID NO: 1111028 - RNA, 18 nt, Human
gagccugcccuucuugcc

SEQ ID NO: 1111029 - RNA, 19 nt, Human
uaccagugcgcccccgagg

SEQ ID NO: 1111030 - RNA, 21 nt, Human
ugccggggcagcaaaguggag

SEQ ID NO: 1111031 - RNA, 23 nt, Human
aaaacaaagcucggggcagggga

SEQ ID NO: 1111032 - RNA, 22 nt, Human
aaccccuuccuccuuuucacug

SEQ ID NO: 1111033 - RNA, 24 nt, Human
acagcaacaauugucuuccuggug

SEQ ID NO: 1111034 - RNA, 23 nt, Human
accagcuccccacacuuuguuuc

SEQ ID NO: 1111035 - RNA, 22 nt, Human
accccacacccccacucacacc

SEQ ID NO: 1111036 - RNA, 20 nt, Human
acccccacucacacccacaa

SEQ ID NO: 1111037 - RNA, 21 nt, Human
acucugaguucuggaaagggg

SEQ ID NO: 1111038 - RNA, 25 nt, Human
agaagucagagacggcuucugagcu

SEQ ID NO: 1111039 - RNA, 22 nt, Human
agcccccggagggccugcccaa

SEQ ID NO: 1111040 - RNA, 20 nt, Human
agggaggugggaaagcgagg

SEQ ID NO: 1111041 - RNA, 21 nt, Human
caaaaacaaagcucggggcag

SEQ ID NO: 1111042 - RNA, 20 nt, Human
caaaagucaccaccagccgc

SEQ ID NO: 1111043 - RNA, 19 nt, Human
cacacccccacucacaccc

SEQ ID NO: 1111044 - RNA, 19 nt, Human
cacccacaaccagcucccc

SEQ ID NO: 1111045 - RNA, 23 nt, Human
cacccccacucacacccacaacc

SEQ ID NO: 1111046 - RNA, 20 nt, Human
cacucacacccacaaccagc

SEQ ID NO: 1111047 - RNA, 21 nt, Human
cacugggcccagccuggaccc

SEQ ID NO: 1111048 - RNA, 18 nt, Human
cagacaccuggggagggg

SEQ ID NO: 1111049 - RNA, 24 nt, Human
cagccgcuggguggagggcggcac

SEQ ID NO: 1111050 - RNA, 19 nt, Human
cagccuggaccccacaccc

SEQ ID NO: 1111051 - RNA, 24 nt, Human
cauuuuuaauucagcccccggagg

SEQ ID NO: 1111052 - RNA, 21 nt, Human
ccaaaaacaaagcucggggca

SEQ ID NO: 1111053 - RNA, 24 nt, Human
ccacacagcaacaauugucuuccu

SEQ ID NO: 1111054 - RNA, 21 nt, Human
ccagccuggaccccacacccc

SEQ ID NO: 1111055 - RNA, 20 nt, Human
cccacacccccacucacacc

SEQ ID NO: 1111056 - RNA, 27 nt, Human
cccacacccccacucacacccacaacc

SEQ ID NO: 1111057 - RNA, 20 nt, Human
cccacucacacccacaacca

SEQ ID NO: 1111058 - RNA, 26 nt, Human
cccagagucaccgcaaacuccauucc

SEQ ID NO: 1111059 - RNA, 23 nt, Human
ccccacacccccacucacaccca

SEQ ID NO: 1111060 - RNA, 27 nt, Human
ccccacacccccacucacacccacaac

SEQ ID NO: 1111061 - RNA, 18 nt, Human
cccccgcaugggaacccc

SEQ ID NO: 1111062 - RNA, 23 nt, Human
ccccggagggccugcccaacgcc

SEQ ID NO: 1111063 - RNA, 19 nt, Human
ccccuuccuccuuuucacu

SEQ ID NO: 1111064 - RNA, 19 nt, Human
cccucagccccagagccuc

SEQ ID NO: 1111065 - RNA, 21 nt, Human
cgccagaacucccaaggguag

SEQ ID NO: 1111066 - RNA, 18 nt, Human
cucccccgcaugggaacc

SEQ ID NO: 1111067 - RNA, 20 nt, Human
cucccccgcaugggaacccc

SEQ ID NO: 1111068 - RNA, 19 nt, Human
cugagcuccaaacaggcag

SEQ ID NO: 1111069 - RNA, 19 nt, Human
cuggaccccacacccccac

SEQ ID NO: 1111070 - RNA, 25 nt, Human
cuggaccccacacccccacucacac

SEQ ID NO: 1111071 - RNA, 24 nt, Human
cuuugugccaaacgccagaacucc

SEQ ID NO: 1111072 - RNA, 19 nt, Human
cuuuucacugggcccagcc

SEQ ID NO: 1111073 - RNA, 26 nt, Human
gaccccacacccccacucacacccac

SEQ ID NO: 1111074 - RNA, 20 nt, Human
ggaggggcaaaacuuccugg

SEQ ID NO: 1111075 - RNA, 24 nt, Human
gggaaaggggacccagacaccugg

SEQ ID NO: 1111076 - RNA, 21 nt, Human
gggucaaaggagucuggaggg

SEQ ID NO: 1111077 - RNA, 19 nt, Human
uaaauaaccccaaaaacaa

SEQ ID NO: 1111078 - RNA, 20 nt, Human
uaaauaaccccaaaaacaaa

SEQ ID NO: 1111079 - RNA, 19 nt, Human
uagaagauugaaaucaggg

SEQ ID NO: 1111080 - RNA, 21 nt, Human
uagaagauugaaaucaggguc

SEQ ID NO: 1111081 - RNA, 21 nt, Human
ucaaaauacgcacgagaaguc

SEQ ID NO: 1111082 - RNA, 19 nt, Human
ucaaugguaaagucgcccu

SEQ ID NO: 1111083 - RNA, 19 nt, Human
ucacugggcccagccugga

SEQ ID NO: 1111084 - RNA, 18 nt, Human
uccacaaaagucaccacc

SEQ ID NO: 1111085 - RNA, 18 nt, Human
uccauuccauaccacaca

SEQ ID NO: 1111086 - RNA, 19 nt, Human
uccccugggugcuggcccc

SEQ ID NO: 1111087 - RNA, 25 nt, Human
ugaguucuggaaaggggcgggaaag

SEQ ID NO: 1111088 - RNA, 23 nt, Human
ugccaaacgccagaacucccaag

SEQ ID NO: 1111089 - RNA, 18 nt, Human
ugguaaagucgcccuggu

SEQ ID NO: 1111090 - RNA, 23 nt, Human
uuaauucagcccccggagggccu

SEQ ID NO: 1111091 - RNA, 24 nt, Human
uuccauaccacacagcaacaauug

SEQ ID NO: 1111092 - RNA, 24 nt, Human
uuccccucagccccagagccuccc

SEQ ID NO: 1111093 - RNA, 24 nt, Human
uugucuuccugguguuucuaccau

SEQ ID NO: 1111094 - RNA, 21 nt, Human
aaaguacagcuggggcucaag

SEQ ID NO: 1111095 - RNA, 21 nt, Human
aacccaccaucuucuacccca

SEQ ID NO: 1111096 - RNA, 22 nt, Human
aagaaugucugcaacucaggcg

SEQ ID NO: 1111097 - RNA, 21 nt, Human
aagaggcccaaccccucaucc

SEQ ID NO: 1111098 - RNA, 26 nt, Human
aaguacagcuggggcucaagagacac

SEQ ID NO: 1111099 - RNA, 18 nt, Human
acagccuccaggaggggc

SEQ ID NO: 1111100 - RNA, 20 nt, Human
acccccucuucucccacccc

SEQ ID NO: 1111101 - RNA, 23 nt, Human
acccccucuucucccacccccag

SEQ ID NO: 1111102 - RNA, 20 nt, Human
acccugacccugccugccuu

SEQ ID NO: 1111103 - RNA, 18 nt, Human
accgggccucugcaucuc

SEQ ID NO: 1111104 - RNA, 21 nt, Human
agaaagaaacccaguagucac

SEQ ID NO: 1111105 - RNA, 24 nt, Human
agaaggaaaaucaaaaccccagaa

SEQ ID NO: 1111106 - RNA, 26 nt, Human
agaauaaacaaaccgcacuccgggcg

SEQ ID NO: 1111107 - RNA, 22 nt, Human
agcaaggaccccuucgaccucc

SEQ ID NO: 1111108 - RNA, 24 nt, Human
aggcaaggaggaaucuggacugug

SEQ ID NO: 1111109 - RNA, 23 nt, Human
aggcagaggggggcacauugggg

SEQ ID NO: 1111110 - RNA, 24 nt, Human
aggcagaggggggcacauuggggc

SEQ ID NO: 1111111 - RNA, 25 nt, Human
aggggggcacauuggggccuggggg

SEQ ID NO: 1111112 - RNA, 22 nt, Human
aggucagaggggaugguuagga

SEQ ID NO: 1111113 - RNA, 27 nt, Human
aggucuggaaacaugggcggggguggg

SEQ ID NO: 1111114 - RNA, 18 nt, Human
aguaaucugcugucugug

SEQ ID NO: 1111115 - RNA, 19 nt, Human
agugucuucuggugagugg

SEQ ID NO: 1111116 - RNA, 18 nt, Human
auagaauaugcccagugc

SEQ ID NO: 1111117 - RNA, 21 nt, Human
auccagaacagcucaccuccu

SEQ ID NO: 1111118 - RNA, 19 nt, Human
auccuguugccuccaggcc

SEQ ID NO: 1111119 - RNA, 23 nt, Human
augaacccaccaucuucuacccc

SEQ ID NO: 1111120 - RNA, 23 nt, Human
augggcgggggugggcccgcggu

SEQ ID NO: 1111121 - RNA, 19 nt, Human
caaaggccgcgcccgcccu

SEQ ID NO: 1111122 - RNA, 21 nt, Human
caagaggcccaaccccucauc

SEQ ID NO: 1111123 - RNA, 20 nt, Human
caagcugcuguccauccccc

SEQ ID NO: 1111124 - RNA, 20 nt, Human
cagagugccugucaggcggu

SEQ ID NO: 1111125 - RNA, 21 nt, Human
cagcggggaaacugaggcccc

SEQ ID NO: 1111126 - RNA, 23 nt, Human
cagugcccagcccacaugcccuc

SEQ ID NO: 1111127 - RNA, 19 nt, Human
cauccagaacagcucaccu

SEQ ID NO: 1111128 - RNA, 20 nt, Human
caucccagcaggugccacag

SEQ ID NO: 1111129 - RNA, 23 nt, Human
ccaaaggagaaggaaaaucaaaa

SEQ ID NO: 1111130 - RNA, 18 nt, Human
ccacccugacccugccug

SEQ ID NO: 1111131 - RNA, 26 nt, Human
ccacugaggucagcgcuggguggcaa

SEQ ID NO: 1111132 - RNA, 21 nt, Human
ccagaagccccucagucccag

SEQ ID NO: 1111133 - RNA, 21 nt, Human
ccagcccacaugcccucugcc

SEQ ID NO: 1111134 - RNA, 19 nt, Human
ccaggcagaggggggcaca

SEQ ID NO: 1111135 - RNA, 24 nt, Human
cccagaaagaaacccaguagucac

SEQ ID NO: 1111136 - RNA, 19 nt, Human
cccagcccacaugcccucu

SEQ ID NO: 1111137 - RNA, 20 nt, Human
cccaggugcagcucauuaac

SEQ ID NO: 1111138 - RNA, 21 nt, Human
ccccaagaggcccaaccccuc

SEQ ID NO: 1111139 - RNA, 23 nt, Human
ccccaagaggcccaaccccucau

SEQ ID NO: 1111140 - RNA, 20 nt, Human
ccccaggugaccccaggucu

SEQ ID NO: 1111141 - RNA, 22 nt, Human
ccccucauccagaacagcucac

SEQ ID NO: 1111142 - RNA, 18 nt, Human
ccccucgugagccuggac

SEQ ID NO: 1111143 - RNA, 18 nt, Human
ccccugugccccagcucc

SEQ ID NO: 1111144 - RNA, 20 nt, Human
ccccugugccccagcuccug

SEQ ID NO: 1111145 - RNA, 23 nt, Human
ccccugugccccagcuccugguc

SEQ ID NO: 1111146 - RNA, 22 nt, Human
cccuccguggggguggcuggac

SEQ ID NO: 1111147 - RNA, 19 nt, Human
cccugggccacccugaccc

SEQ ID NO: 1111148 - RNA, 19 nt, Human
cccugggccacccugaccc

SEQ ID NO: 1111149 - RNA, 24 nt, Human
cccuuccugagcuaccugcccacu

SEQ ID NO: 1111150 - RNA, 19 nt, Human
ccgguguggcugggaucgc

SEQ ID NO: 1111151 - RNA, 22 nt, Human
ccuacuccacagccuccaggag

SEQ ID NO: 1111152 - RNA, 22 nt, Human
ccuaggacagagaggguggcuc

SEQ ID NO: 1111153 - RNA, 21 nt, Human
ccucaaucuccccagcuugga

SEQ ID NO: 1111154 - RNA, 22 nt, Human
ccuccaccccagugcccagccc

SEQ ID NO: 1111155 - RNA, 21 nt, Human
ccuccaggcccaagccccauc

SEQ ID NO: 1111156 - RNA, 21 nt, Human
ccuccuguccuauccuguugc

SEQ ID NO: 1111157 - RNA, 22 nt, Human
ccuccuguccuauccuguugcc

SEQ ID NO: 1111158 - RNA, 21 nt, Human
ccucuccaggcaaggaggaau

SEQ ID NO: 1111159 - RNA, 21 nt, Human
ccugcacccgcgcgcuggcca

SEQ ID NO: 1111160 - RNA, 21 nt, Human
ccuggcgcucaguggccaacu

SEQ ID NO: 1111161 - RNA, 21 nt, Human
ccuguugccuccaggcccaag

SEQ ID NO: 1111162 - RNA, 23 nt, Human
cggagaauaaacaaaccgcacuc

SEQ ID NO: 1111163 - RNA, 22 nt, Human
cguggagccgggcgaggucggg

SEQ ID NO: 1111164 - RNA, 18 nt, Human
cuagucugaggguggugg

SEQ ID NO: 1111165 - RNA, 21 nt, Human
cuccccuacuccacagccucc

SEQ ID NO: 1111166 - RNA, 24 nt, Human
cuccccuacuccacagccuccagg

SEQ ID NO: 1111167 - RNA, 19 nt, Human
cucugcccaccccuggccc

SEQ ID NO: 1111168 - RNA, 21 nt, Human
cugaaagccccuugucugucc

SEQ ID NO: 1111169 - RNA, 23 nt, Human
cugaaagccccuugucuguccag

SEQ ID NO: 1111170 - RNA, 20 nt, Human
cugcaggcucagccuaggac

SEQ ID NO: 1111171 - RNA, 19 nt, Human
cuggcccaguugccugggc

SEQ ID NO: 1111172 - RNA, 19 nt, Human
cugggcagacgugagcuca

SEQ ID NO: 1111173 - RNA, 21 nt, Human
cugggcccgguguggcuggga

SEQ ID NO: 1111174 - RNA, 23 nt, Human
cuguccaucccccucgugagccu

SEQ ID NO: 1111175 - RNA, 18 nt, Human
cuucuaccccacacgcuc

SEQ ID NO: 1111176 - RNA, 24 nt, Human
gaacccaccaucuucuaccccaca

SEQ ID NO: 1111177 - RNA, 20 nt, Human
gaagauggacauccccuucc

SEQ ID NO: 1111178 - RNA, 24 nt, Human
gacggaacaaacagccgcuggcca

SEQ ID NO: 1111179 - RNA, 18 nt, Human
gagccuggacauccccuc

SEQ ID NO: 1111180 - RNA, 22 nt, Human
gaggucgggggccccugcaccc

SEQ ID NO: 1111181 - RNA, 20 nt, Human
gagucugacccccucuucuc

SEQ ID NO: 1111182 - RNA, 18 nt, Human
gaucgaggcugccacccc

SEQ ID NO: 1111183 - RNA, 25 nt, Human
gcacugaaagccccuugucugucca

SEQ ID NO: 1111184 - RNA, 21 nt, Human
gccccaagaggcccaaccccu

SEQ ID NO: 1111185 - RNA, 23 nt, Human
gcccugggccacccugacccugc

SEQ ID NO: 1111186 - RNA, 19 nt, Human
gccggacccuccguggggg

SEQ ID NO: 1111187 - RNA, 20 nt, Human
gcuggguggcaagcaagggg

SEQ ID NO: 1111188 - RNA, 20 nt, Human
gcuggugguggaugccguac

SEQ ID NO: 1111189 - RNA, 22 nt, Human
ggaaaaucaaaaccccagaaag

SEQ ID NO: 1111190 - RNA, 24 nt, Human
ggaaacaugggcgggggugggccc

SEQ ID NO: 1111191 - RNA, 20 nt, Human
ggaagcagaggacggugcug

SEQ ID NO: 1111192 - RNA, 19 nt, Human
ggacggugcuggucgugug

SEQ ID NO: 1111193 - RNA, 18 nt, Human
ggagaauaaacaaaccgc

SEQ ID NO: 1111194 - RNA, 22 nt, Human
ggagccgggcgaggucgggggc

SEQ ID NO: 1111195 - RNA, 19 nt, Human
ggaggauacuugaaagggg

SEQ ID NO: 1111196 - RNA, 23 nt, Human
ggcagagccugagaccgggccuc

SEQ ID NO: 1111197 - RNA, 21 nt, Human
ggcgggggugggcccgcggug

SEQ ID NO: 1111198 - RNA, 21 nt, Human
gggaggauacuugaaagggga

SEQ ID NO: 1111199 - RNA, 18 nt, Human
gggcacauuggggccugg

SEQ ID NO: 1111200 - RNA, 18 nt, Human
gggcaguggggcuggucu

SEQ ID NO: 1111201 - RNA, 20 nt, Human
gggccacccugacccugccu

SEQ ID NO: 1111202 - RNA, 20 nt, Human
gggccccugcacccgcgcgc

SEQ ID NO: 1111203 - RNA, 18 nt, Human
gggccucugcaucuccag

SEQ ID NO: 1111204 - RNA, 22 nt, Human
gggcgggggugggcccgcggug

SEQ ID NO: 1111205 - RNA, 22 nt, Human
gguggcuagggucagagaagga

SEQ ID NO: 1111206 - RNA, 23 nt, Human
ggugguggaugccguacugggcc

SEQ ID NO: 1111207 - RNA, 22 nt, Human
guacugggccccggcguggagc

SEQ ID NO: 1111208 - RNA, 19 nt, Human
guggaggccccugugcccc

SEQ ID NO: 1111209 - RNA, 22 nt, Human
guggcugggaucgcaggcaugu

SEQ ID NO: 1111210 - RNA, 18 nt, Human
guggggcuggucugugcc

SEQ ID NO: 1111211 - RNA, 19 nt, Human
guggggcuggucugugccc

SEQ ID NO: 1111212 - RNA, 23 nt, Human
guuuguauuuccaaaugaaauag

SEQ ID NO: 1111213 - RNA, 23 nt, Human
uaccaccaggcguucccguugcc

SEQ ID NO: 1111214 - RNA, 18 nt, Human
uagaauaugcccagugcu

SEQ ID NO: 1111215 - RNA, 26 nt, Human
uagaucccgggugaggcgcccaaagg

SEQ ID NO: 1111216 - RNA, 18 nt, Human
uagggucagagaaggauu

SEQ ID NO: 1111217 - RNA, 18 nt, Human
uagucugagggugguggc

SEQ ID NO: 1111218 - RNA, 18 nt, Human
uaugggcuggugguggau

SEQ ID NO: 1111219 - RNA, 20 nt, Human
uccaggcccaagccccaucc

SEQ ID NO: 1111220 - RNA, 23 nt, Human
ucccacccccaggaguaugaacc

SEQ ID NO: 1111221 - RNA, 22 nt, Human
uccccagcuuggauggacccac

SEQ ID NO: 1111222 - RNA, 20 nt, Human
uccccuacuccgggccucag

SEQ ID NO: 1111223 - RNA, 20 nt, Human
uccccuggcucucgggaucc

SEQ ID NO: 1111224 - RNA, 20 nt, Human
uccucuccaggcaaggagga

SEQ ID NO: 1111225 - RNA, 19 nt, Human
uccuguugccuccaggccc

SEQ ID NO: 1111226 - RNA, 22 nt, Human
ucuccagcggggaaacugaggc

SEQ ID NO: 1111227 - RNA, 22 nt, Human
ucucccggaagcagaggacggu

SEQ ID NO: 1111228 - RNA, 21 nt, Human
ucugcugucugugugguugga

SEQ ID NO: 1111229 - RNA, 21 nt, Human
ucugugcccggcaccugcggg

SEQ ID NO: 1111230 - RNA, 22 nt, Human
ucuucuggugaguggccccaga

SEQ ID NO: 1111231 - RNA, 20 nt, Human
ucuugggucuugggcucugg

SEQ ID NO: 1111232 - RNA, 19 nt, Human
ugaaaggggaguaaucugc

SEQ ID NO: 1111233 - RNA, 19 nt, Human
ugaaccucaaucuccccag

SEQ ID NO: 1111234 - RNA, 23 nt, Human
ugacccccucuucucccaccccc

SEQ ID NO: 1111235 - RNA, 20 nt, Human
ugacccugccugccuucccc

SEQ ID NO: 1111236 - RNA, 20 nt, Human
ugagaaagguggaagaaugu

SEQ ID NO: 1111237 - RNA, 21 nt, Human
ugaggccccaagaggcccaac

SEQ ID NO: 1111238 - RNA, 19 nt, Human
ugagggaggauccaguguc

SEQ ID NO: 1111239 - RNA, 22 nt, Human
ugcaacucaggcggagaauaaa

SEQ ID NO: 1111240 - RNA, 30 nt, Human
ugccccagcuccuggucgccccugccuguu

SEQ ID NO: 1111241 - RNA, 23 nt, Human
ugcccucugcccaccccuggccc

SEQ ID NO: 1111242 - RNA, 18 nt, Human
ugccugggcagacgugag

SEQ ID NO: 1111243 - RNA, 19 nt, Human
ugcgagaagauggacaucc

SEQ ID NO: 1111244 - RNA, 19 nt, Human
ugcuugucccaggcagggu

SEQ ID NO: 1111245 - RNA, 27 nt, Human
uggacauccccuuccugaggucaccga

SEQ ID NO: 1111246 - RNA, 22 nt, Human
uggacuccgggggauguccccu

SEQ ID NO: 1111247 - RNA, 20 nt, Human
uggaggccccugugccccag

SEQ ID NO: 1111248 - RNA, 20 nt, Human
uggaggccccugugccccag

SEQ ID NO: 1111249 - RNA, 18 nt, Human
uggcaagcaagggggaca

SEQ ID NO: 1111250 - RNA, 21 nt, Human
uggcccggagcagaacggggc

SEQ ID NO: 1111251 - RNA, 22 nt, Human
uggcccggagcagaacggggca

SEQ ID NO: 1111252 - RNA, 22 nt, Human
uggcucugucaggucagagggg

SEQ ID NO: 1111253 - RNA, 20 nt, Human
ugggaucgcaggcauguuca

SEQ ID NO: 1111254 - RNA, 23 nt, Human
ugggaucgcaggcauguucaugg

SEQ ID NO: 1111255 - RNA, 18 nt, Human
uggggaagaucgaggcug

SEQ ID NO: 1111256 - RNA, 20 nt, Human
uggggaggauacuugaaagg

SEQ ID NO: 1111257 - RNA, 22 nt, Human
uggggcucaagagacacccaga

SEQ ID NO: 1111258 - RNA, 18 nt, Human
uggggcuggucugugccc

SEQ ID NO: 1111259 - RNA, 19 nt, Human
ugggucuugggcucugggc

SEQ ID NO: 1111260 - RNA, 18 nt, Human
uggguggcaagcaagggg

SEQ ID NO: 1111261 - RNA, 19 nt, Human
uguccagaagccccucagu

SEQ ID NO: 1111262 - RNA, 24 nt, Human
ugucccaggcagggucuggugcug

SEQ ID NO: 1111263 - RNA, 21 nt, Human
uuccccuacuccgggccucag

SEQ ID NO: 1111264 - RNA, 18 nt, Human
uugccuccaggcccaagc

SEQ ID NO: 1111265 - RNA, 21 nt, Human
uugccuccaggcccaagcccc

SEQ ID NO: 1111266 - RNA, 20 nt, Human
aggcaggaaagaguuauggu

SEQ ID NO: 1111267 - RNA, 22 nt, Human
aggcaggaaagaguuaugguag

SEQ ID NO: 1111268 - RNA, 20 nt, Human
uggaaaauguuuuauuggag

SEQ ID NO: 1111269 - RNA, 25 nt, Human
uuccugaggcaggaaagaguuaugg

SEQ ID NO: 1111270 - RNA, 26 nt, Human
acgccaaagccuggaaccugccugac

SEQ ID NO: 1111271 - RNA, 20 nt, Human
acuccagugccaacugcuuc

SEQ ID NO: 1111272 - RNA, 22 nt, Human
agaguugcuggagccuccaccu

SEQ ID NO: 1111273 - RNA, 18 nt, Human
agcaggaggcaggccagg

SEQ ID NO: 1111274 - RNA, 19 nt, Human
agcaggaggcaggccaggg

SEQ ID NO: 1111275 - RNA, 18 nt, Human
agccuccccacugcccag

SEQ ID NO: 1111276 - RNA, 21 nt, Human
agcucccugaguguugguccc

SEQ ID NO: 1111277 - RNA, 24 nt, Human
aguugcuggagccuccaccugagc

SEQ ID NO: 1111278 - RNA, 18 nt, Human
auggccuuucccaccccu

SEQ ID NO: 1111279 - RNA, 19 nt, Human
cacugaaccauagccaggc

SEQ ID NO: 1111280 - RNA, 28 nt, Human
caggaggcaggccaggggccccuucuuu

SEQ ID NO: 1111281 - RNA, 26 nt, Human
ccaagggccuccccaauauuuguccc

SEQ ID NO: 1111282 - RNA, 21 nt, Human
ccaauggccuuucccaccccu

SEQ ID NO: 1111283 - RNA, 19 nt, Human
ccaccagggucuccuccuu

SEQ ID NO: 1111284 - RNA, 18 nt, Human
ccacugcugcccgacugu

SEQ ID NO: 1111285 - RNA, 19 nt, Human
cccagcccccucucucucc

SEQ ID NO: 1111286 - RNA, 20 nt, Human
cccaggccauguccaagggc

SEQ ID NO: 1111287 - RNA, 24 nt, Human
cccccagaguugcuggagccucca

SEQ ID NO: 1111288 - RNA, 19 nt, Human
ccccuccggccucuuugcc

SEQ ID NO: 1111289 - RNA, 27 nt, Human
ccccuccggccucuuugccaauggccu

SEQ ID NO: 1111290 - RNA, 20 nt, Human
ccccuggaacuucaucucug

SEQ ID NO: 1111291 - RNA, 21 nt, Human
cccuccauugccuccuugacc

SEQ ID NO: 1111292 - RNA, 19 nt, Human
cccuuggccaagggccuca

SEQ ID NO: 1111293 - RNA, 19 nt, Human
ccuccaccugagccagaug

SEQ ID NO: 1111294 - RNA, 18 nt, Human
ccuccuugccgcccuugc

SEQ ID NO: 1111295 - RNA, 24 nt, Human
ccucugggucugcagccuucucuc

SEQ ID NO: 1111296 - RNA, 21 nt, Human
ccuguccucccucccucuggg

SEQ ID NO: 1111297 - RNA, 24 nt, Human
ccuguccucccucccucugggucu

SEQ ID NO: 1111298 - RNA, 20 nt, Human
ccuucucucuccuguccuca

SEQ ID NO: 1111299 - RNA, 21 nt, Human
cuccggccucuuugccaaugg

SEQ ID NO: 1111300 - RNA, 24 nt, Human
cuccuuccgacucccuguccuccc

SEQ ID NO: 1111301 - RNA, 22 nt, Human
cuccuugccgcccuugcucugc

SEQ ID NO: 1111302 - RNA, 19 nt, Human
cucucacugaaccauagcc

SEQ ID NO: 1111303 - RNA, 21 nt, Human
cucugcgucucugugcccucc

SEQ ID NO: 1111304 - RNA, 18 nt, Human
cugaaccauagccaggcu

SEQ ID NO: 1111305 - RNA, 20 nt, Human
cuggagccuccaccugagcc

SEQ ID NO: 1111306 - RNA, 21 nt, Human
cuggagccuccaccugagcca

SEQ ID NO: 1111307 - RNA, 18 nt, Human
cuugcucugcgucucugu

SEQ ID NO: 1111308 - RNA, 18 nt, Human
gcagagggccagcaggag

SEQ ID NO: 1111309 - RNA, 18 nt, Human
gcccccucucucuccaga

SEQ ID NO: 1111310 - RNA, 21 nt, Human
gcccuccucuguccuccuccu

SEQ ID NO: 1111311 - RNA, 18 nt, Human
gccuccaccugagccaga

SEQ ID NO: 1111312 - RNA, 19 nt, Human
ggccagcaggaggcaggcc

SEQ ID NO: 1111313 - RNA, 18 nt, Human
gucuccuccuugccgccc

SEQ ID NO: 1111314 - RNA, 18 nt, Human
uagagccagcugccccuc

SEQ ID NO: 1111315 - RNA, 21 nt, Human
uccagagugucuuccucccac

SEQ ID NO: 1111316 - RNA, 19 nt, Human
ucccaggccauguccaagg

SEQ ID NO: 1111317 - RNA, 21 nt, Human
ucccaggccauguccaagggc

SEQ ID NO: 1111318 - RNA, 19 nt, Human
ucccagugcuuuccucucc

SEQ ID NO: 1111319 - RNA, 24 nt, Human
ucccccagaguugcuggagccucc

SEQ ID NO: 1111320 - RNA, 20 nt, Human
ucccucugggucugcagccu

SEQ ID NO: 1111321 - RNA, 18 nt, Human
ucccuguccucccucccu

SEQ ID NO: 1111322 - RNA, 23 nt, Human
uccucuguccuccuccuuccgac

SEQ ID NO: 1111323 - RNA, 18 nt, Human
uccuuccgacucccuguc

SEQ ID NO: 1111324 - RNA, 19 nt, Human
uccuugaccccagggagcu

SEQ ID NO: 1111325 - RNA, 20 nt, Human
uccuugaccccagggagcuc

SEQ ID NO: 1111326 - RNA, 23 nt, Human
uccuugaccccagggagcucccu

SEQ ID NO: 1111327 - RNA, 19 nt, Human
ucuccgcucugcagggggc

SEQ ID NO: 1111328 - RNA, 20 nt, Human
ucugcagccuucucucuccu

SEQ ID NO: 1111329 - RNA, 24 nt, Human
ucuguccuccuccuuccgacuccc

SEQ ID NO: 1111330 - RNA, 25 nt, Human
uggaaccugccugacuccagugcca

SEQ ID NO: 1111331 - RNA, 25 nt, Human
uggagccuccaccugagccagaugg

SEQ ID NO: 1111332 - RNA, 26 nt, Human
uggagccuccaccugagccagauggu

SEQ ID NO: 1111333 - RNA, 22 nt, Human
uggcccuccauugccuccuuga

SEQ ID NO: 1111334 - RNA, 22 nt, Human
ugggccacagcucccugagugu

SEQ ID NO: 1111335 - RNA, 24 nt, Human
ugggucugcagccuucucucuccu

SEQ ID NO: 1111336 - RNA, 20 nt, Human
uucauucugguugcuggcuc

SEQ ID NO: 1111337 - RNA, 22 nt, Human
uugcugccacugccacugcugc

SEQ ID NO: 1111338 - RNA, 23 nt, Human
uugguggcccuccauugccuccu

SEQ ID NO: 1111339 - RNA, 18 nt, Human
uuugccaauggccuuucc

SEQ ID NO: 1111340 - RNA, 22 nt, Human
aaaaaaaaaagaagcuggggag

SEQ ID NO: 1111341 - RNA, 24 nt, Human
aaaaaaaaaagaagcuggggagag

SEQ ID NO: 1111342 - RNA, 19 nt, Human
aaaaaaagagccucacugg

SEQ ID NO: 1111343 - RNA, 20 nt, Human
aaaauaaaggcggagauggc

SEQ ID NO: 1111344 - RNA, 19 nt, Human
aacacagugaaacaccguc

SEQ ID NO: 1111345 - RNA, 20 nt, Human
aacacagugaaacaccgucu

SEQ ID NO: 1111346 - RNA, 21 nt, Human
aacacagugaaacaccgucuc

SEQ ID NO: 1111347 - RNA, 18 nt, Human
aaccagaaaggagaucuu

SEQ ID NO: 1111348 - RNA, 21 nt, Human
aaccagaaaggagaucuuguu

SEQ ID NO: 1111349 - RNA, 18 nt, Human
aagcuugcagugagccga

SEQ ID NO: 1111350 - RNA, 20 nt, Human
aagugcuucaaggagggagg

SEQ ID NO: 1111351 - RNA, 24 nt, Human
aaucgcuugaacccgggaggugga

SEQ ID NO: 1111352 - RNA, 18 nt, Human
aauuagccgaccguggug

SEQ ID NO: 1111353 - RNA, 19 nt, Human
acaagggugaaacuccauc

SEQ ID NO: 1111354 - RNA, 20 nt, Human
acaagggugaaacuccaucu

SEQ ID NO: 1111355 - RNA, 19 nt, Human
acacagugaaacaccgucu

SEQ ID NO: 1111356 - RNA, 24 nt, Human
acaccgucucuacuaaaaauacaa

SEQ ID NO: 1111357 - RNA, 23 nt, Human
acagagcuagacuccauccaaaa

SEQ ID NO: 1111358 - RNA, 24 nt, Human
acagccgagcugccacuaccuggc

SEQ ID NO: 1111359 - RNA, 22 nt, Human
accuggaaggcuggcggcgagg

SEQ ID NO: 1111360 - RNA, 19 nt, Human
acuacagccugggcaacaa

SEQ ID NO: 1111361 - RNA, 25 nt, Human
acuacagccugggcaacaaggguga

SEQ ID NO: 1111362 - RNA, 24 nt, Human
acuauggcacuccagccuggguga

SEQ ID NO: 1111363 - RNA, 20 nt, Human
agaacccgugggagcugggg

SEQ ID NO: 1111364 - RNA, 20 nt, Human
agacagaagucaaagacagc

SEQ ID NO: 1111365 - RNA, 18 nt, Human
agagagugggaccucggg

SEQ ID NO: 1111366 - RNA, 21 nt, Human
agaggacacugagggaaaagg

SEQ ID NO: 1111367 - RNA, 23 nt, Human
agauaaccaguaacuguaugaaa

SEQ ID NO: 1111368 - RNA, 20 nt, Human
agcacgguggcucacgccug

SEQ ID NO: 1111369 - RNA, 24 nt, Human
agcacuuugggaggccgaggcggg

SEQ ID NO: 1111370 - RNA, 18 nt, Human
agccgaccgugguggcgg

SEQ ID NO: 1111371 - RNA, 18 nt, Human
agccgagcugccacuacc

SEQ ID NO: 1111372 - RNA, 25 nt, Human
agccugggcaacaagggugaaacuc

SEQ ID NO: 1111373 - RNA, 24 nt, Human
agccugggugacagagcuagacuc

SEQ ID NO: 1111374 - RNA, 19 nt, Human
agcggcaaaggacagagcc

SEQ ID NO: 1111375 - RNA, 23 nt, Human
agcugaggcaggagaaucgcuug

SEQ ID NO: 1111376 - RNA, 22 nt, Human
aggaagggguggggggcagggc

SEQ ID NO: 1111377 - RNA, 24 nt, Human
aggcaggagaaucgcuugaacccg

SEQ ID NO: 1111378 - RNA, 24 nt, Human
aggcaggagaauggcgugaacccg

SEQ ID NO: 1111379 - RNA, 21 nt, Human
aggcaggcuccaggggaagga

SEQ ID NO: 1111380 - RNA, 21 nt, Human
aggccgaggcggguggaucac

SEQ ID NO: 1111381 - RNA, 18 nt, Human
aggccucugguggaccag

SEQ ID NO: 1111382 - RNA, 21 nt, Human
aggcgaagcuugcagugagcc

SEQ ID NO: 1111383 - RNA, 24 nt, Human
aggcgaagcuugcagugagccgag

SEQ ID NO: 1111384 - RNA, 24 nt, Human
aggcggguggaucacgaggucagg

SEQ ID NO: 1111385 - RNA, 18 nt, Human
aggcugaggcaggagaau

SEQ ID NO: 1111386 - RNA, 23 nt, Human
agggaagccgggggcgcgagggu

SEQ ID NO: 1111387 - RNA, 27 nt, Human
agggcagagccauggggcagcggagga

SEQ ID NO: 1111388 - RNA, 20 nt, Human
agggguggggggcagggcag

SEQ ID NO: 1111389 - RNA, 20 nt, Human
aggucccuggccagcugcag

SEQ ID NO: 1111390 - RNA, 21 nt, Human
agguggagguugccgugagcc

SEQ ID NO: 1111391 - RNA, 24 nt, Human
agguggagguugccgugagccgag

SEQ ID NO: 1111392 - RNA, 18 nt, Human
aguuggggagggggggcc

SEQ ID NO: 1111393 - RNA, 24 nt, Human
aucacacuauggcacuccagccug

SEQ ID NO: 1111394 - RNA, 20 nt, Human
augcugggcuagugacuagg

SEQ ID NO: 1111395 - RNA, 23 nt, Human
auggagggggagugaccuugguu

SEQ ID NO: 1111396 - RNA, 24 nt, Human
auggcacuccagccugggugacag

SEQ ID NO: 1111397 - RNA, 26 nt, Human
auguagccucuaaagcaagugucaga

SEQ ID NO: 1111398 - RNA, 19 nt, Human
augucuuuuaaacccuugg

SEQ ID NO: 1111399 - RNA, 24 nt, Human
auuguacuacagccugggcaacaa

SEQ ID NO: 1111400 - RNA, 20 nt, Human
auuuccuuaaauuggcauga

SEQ ID NO: 1111401 - RNA, 21 nt, Human
caacacucugaugacccuagu

SEQ ID NO: 1111402 - RNA, 24 nt, Human
caagaccauccuggcuaacacagu

SEQ ID NO: 1111403 - RNA, 22 nt, Human
caagcaauucucuugccucagc

SEQ ID NO: 1111404 - RNA, 18 nt, Human
caagggauacccaaggcc

SEQ ID NO: 1111405 - RNA, 22 nt, Human
caccugcagcacgggaucgucc

SEQ ID NO: 1111406 - RNA, 23 nt, Human
caccuguagucccagcuacucgg

SEQ ID NO: 1111407 - RNA, 24 nt, Human
caccuguagucccagcuacucggg

SEQ ID NO: 1111408 - RNA, 24 nt, Human
cacgccugcaaucccagcacuuug

SEQ ID NO: 1111409 - RNA, 20 nt, Human
cacuccagccugggugacag

SEQ ID NO: 1111410 - RNA, 22 nt, Human
cacuccagccugggugacagag

SEQ ID NO: 1111411 - RNA, 21 nt, Human
cacuggagcaggagaggucug

SEQ ID NO: 1111412 - RNA, 24 nt, Human
cagcacuuugggaggccgaggcgg

SEQ ID NO: 1111413 - RNA, 18 nt, Human
cagcagcagggcggccug

SEQ ID NO: 1111414 - RNA, 19 nt, Human
cagcagcagggcggccugg

SEQ ID NO: 1111415 - RNA, 19 nt, Human
cagcgggcgggggcggggc

SEQ ID NO: 1111416 - RNA, 20 nt, Human
cagcgggcgggggcggggcc

SEQ ID NO: 1111417 - RNA, 25 nt, Human
cagcgggcgggggcggggccagggc

SEQ ID NO: 1111418 - RNA, 24 nt, Human
cagcuacucgggaggcugaggcag

SEQ ID NO: 1111419 - RNA, 24 nt, Human
cagcuggggaugcgaggguggagg

SEQ ID NO: 1111420 - RNA, 23 nt, Human
caggacaccccugagcugagggc

SEQ ID NO: 1111421 - RNA, 23 nt, Human
caggcccugggggacagcugggg

SEQ ID NO: 1111422 - RNA, 22 nt, Human
caggcugucagggaacagccga

SEQ ID NO: 1111423 - RNA, 19 nt, Human
cagggaacagccgagcugc

SEQ ID NO: 1111424 - RNA, 23 nt, Human
caggucuucagccugguccaaca

SEQ ID NO: 1111425 - RNA, 24 nt, Human
cauccaacacucugaugacccuag

SEQ ID NO: 1111426 - RNA, 19 nt, Human
cauuguacuacagccuggg

SEQ ID NO: 1111427 - RNA, 22 nt, Human
cauuguacuacagccugggcaa

SEQ ID NO: 1111428 - RNA, 24 nt, Human
cauuguacuacagccugggcaaca

SEQ ID NO: 1111429 - RNA, 18 nt, Human
ccacugcaaccucugccu

SEQ ID NO: 1111430 - RNA, 18 nt, Human
ccacugcaaccucugccu

SEQ ID NO: 1111431 - RNA, 22 nt, Human
ccacugcaaccucugccuucug

SEQ ID NO: 1111432 - RNA, 24 nt, Human
ccacugcaaccucugccuucugag

SEQ ID NO: 1111433 - RNA, 18 nt, Human
ccagccuuggguggaggg

SEQ ID NO: 1111434 - RNA, 24 nt, Human
ccaggcugucagggaacagccgag

SEQ ID NO: 1111435 - RNA, 20 nt, Human
ccauuguacuacagccuggg

SEQ ID NO: 1111436 - RNA, 21 nt, Human
ccauuguacuacagccugggc

SEQ ID NO: 1111437 - RNA, 24 nt, Human
ccauuguacuacagccugggcaac

SEQ ID NO: 1111438 - RNA, 24 nt, Human
ccauuugagccagggcuccugagu

SEQ ID NO: 1111439 - RNA, 23 nt, Human
cccaaggcccagacuguggggcc

SEQ ID NO: 1111440 - RNA, 23 nt, Human
cccaagggauacccaaggcccag

SEQ ID NO: 1111441 - RNA, 21 nt, Human
cccaggucuucagccuggucc

SEQ ID NO: 1111442 - RNA, 19 nt, Human
ccccaaggaagauauaacc

SEQ ID NO: 1111443 - RNA, 18 nt, Human
ccccaagggauacccaag

SEQ ID NO: 1111444 - RNA, 21 nt, Human
ccccugagcugagggccaggu

SEQ ID NO: 1111445 - RNA, 26 nt, Human
ccccugagcugagggccaggucccug

SEQ ID NO: 1111446 - RNA, 19 nt, Human
cccuccgcgcuuccggccg

SEQ ID NO: 1111447 - RNA, 19 nt, Human
cccugggggacagcugggg

SEQ ID NO: 1111448 - RNA, 20 nt, Human
ccgggguggaggcugggggu

SEQ ID NO: 1111449 - RNA, 18 nt, Human
ccuccgagacuugggccc

SEQ ID NO: 1111450 - RNA, 22 nt, Human
ccugcaaucccagcacuuuggg

SEQ ID NO: 1111451 - RNA, 26 nt, Human
ccugcagcacgggaucguccuggaac

SEQ ID NO: 1111452 - RNA, 19 nt, Human
ccugcucagcuggagagag

SEQ ID NO: 1111453 - RNA, 22 nt, Human
ccugggugacagagcuagacuc

SEQ ID NO: 1111454 - RNA, 21 nt, Human
ccuguagucccagcuacucgg

SEQ ID NO: 1111455 - RNA, 24 nt, Human
ccuucugaguucaagcaauucucu

SEQ ID NO: 1111456 - RNA, 18 nt, Human
ccuuggggaccuaggggg

SEQ ID NO: 1111457 - RNA, 22 nt, Human
ccuuggguagaaauggugauga

SEQ ID NO: 1111458 - RNA, 23 nt, Human
cgauaaucgggcauccgcuuccc

SEQ ID NO: 1111459 - RNA, 23 nt, Human
cgccugcaaucccagcacuuugg

SEQ ID NO: 1111460 - RNA, 19 nt, Human
cggaggauggggggcauuu

SEQ ID NO: 1111461 - RNA, 22 nt, Human
cggcaaaggacagagccgaaga

SEQ ID NO: 1111462 - RNA, 24 nt, Human
cgggagguggagguugccgugagc

SEQ ID NO: 1111463 - RNA, 21 nt, Human
cgggcaccuguagucccagcu

SEQ ID NO: 1111464 - RNA, 18 nt, Human
cgggguggaggcuggggg

SEQ ID NO: 1111465 - RNA, 21 nt, Human
cuauggcacuccagccugggu

SEQ ID NO: 1111466 - RNA, 24 nt, Human
cuauggcacuccagccugggugac

SEQ ID NO: 1111467 - RNA, 19 nt, Human
cucacagauaaccaguaac

SEQ ID NO: 1111468 - RNA, 22 nt, Human
cucacgccugcaaucccagcac

SEQ ID NO: 1111469 - RNA, 24 nt, Human
cucacgccugcaaucccagcacuu

SEQ ID NO: 1111470 - RNA, 18 nt, Human
cuccauccaaaaaaaaaa

SEQ ID NO: 1111471 - RNA, 23 nt, Human
cuccauccaaaaaaaaaaaaaaa

SEQ ID NO: 1111472 - RNA, 21 nt, Human
cuccuccgagacuugggcccc

SEQ ID NO: 1111473 - RNA, 19 nt, Human
cucggccuuggcccgacac

SEQ ID NO: 1111474 - RNA, 24 nt, Human
cugcaaccucugccuucugaguuc

SEQ ID NO: 1111475 - RNA, 20 nt, Human
cugcagccugcagcagcagg

SEQ ID NO: 1111476 - RNA, 27 nt, Human
cugccuucugaguucaagcaauucuuu

SEQ ID NO: 1111477 - RNA, 20 nt, Human
cuggcuaacacagugaaaca

SEQ ID NO: 1111478 - RNA, 19 nt, Human
cuguaugaaaaaaaaaaaa

SEQ ID NO: 1111479 - RNA, 19 nt, Human
cuugcagugagccgagauc

SEQ ID NO: 1111480 - RNA, 23 nt, Human
cuugccucagccucccgaguagc

SEQ ID NO: 1111481 - RNA, 20 nt, Human
gaacagccccaagggauacc

SEQ ID NO: 1111482 - RNA, 20 nt, Human
gaacccgggaggcgaagcuu

SEQ ID NO: 1111483 - RNA, 19 nt, Human
gaagggaaagacagaaguc

SEQ ID NO: 1111484 - RNA, 24 nt, Human
gaauagagacgggguuuagaguca

SEQ ID NO: 1111485 - RNA, 21 nt, Human
gaccaggcugggccacacugc

SEQ ID NO: 1111486 - RNA, 20 nt, Human
gaccgugguggcgggcaccu

SEQ ID NO: 1111487 - RNA, 20 nt, Human
gaccgugguggcgggcaccu

SEQ ID NO: 1111488 - RNA, 18 nt, Human
gacucagcucugcccuau

SEQ ID NO: 1111489 - RNA, 20 nt, Human
gacucagcucugcccuaugg

SEQ ID NO: 1111490 - RNA, 23 nt, Human
gagaaucgcuugaacccgggagg

SEQ ID NO: 1111491 - RNA, 18 nt, Human
gagagagagagaaagaga

SEQ ID NO: 1111492 - RNA, 20 nt, Human
gagaggguggaggguccuca

SEQ ID NO: 1111493 - RNA, 19 nt, Human
gagcugggguggaggccgg

SEQ ID NO: 1111494 - RNA, 21 nt, Human
gagcugggguggaggccgggg

SEQ ID NO: 1111495 - RNA, 23 nt, Human
gaggcggguggaucacgagguca

SEQ ID NO: 1111496 - RNA, 22 nt, Human
gaggguagagcccagaugugcu

SEQ ID NO: 1111497 - RNA, 21 nt, Human
gauaaucgggcauccgcuucc

SEQ ID NO: 1111498 - RNA, 23 nt, Human
gaucugagacagagagagagggu

SEQ ID NO: 1111499 - RNA, 22 nt, Human
gcaaccucugccuucugaguuc

SEQ ID NO: 1111500 - RNA, 19 nt, Human
gcacuccagccugggugac

SEQ ID NO: 1111501 - RNA, 23 nt, Human
gcacuccagccugggugacagag

SEQ ID NO: 1111502 - RNA, 24 nt, Human
gcacuccagccugggugacagagc

SEQ ID NO: 1111503 - RNA, 28 nt, Human
gccauggcccugggucaugccggcgccg

SEQ ID NO: 1111504 - RNA, 24 nt, Human
gccauuguacuacagccugggcaa

SEQ ID NO: 1111505 - RNA, 19 nt, Human
gcccagcacgguggcucac

SEQ ID NO: 1111506 - RNA, 22 nt, Human
gcccagcacgguggcucacgcc

SEQ ID NO: 1111507 - RNA, 19 nt, Human
gcccaggacaccccugagc

SEQ ID NO: 1111508 - RNA, 20 nt, Human
gcgggcaccuguagucccag

SEQ ID NO: 1111509 - RNA, 20 nt, Human
gcgggggcggggccagggcc

SEQ ID NO: 1111510 - RNA, 21 nt, Human
gcguguccuccaggcugucag

SEQ ID NO: 1111511 - RNA, 22 nt, Human
gcugaggcaggagaauggcgug

SEQ ID NO: 1111512 - RNA, 22 nt, Human
gcugcgugggaggaacagcccc

SEQ ID NO: 1111513 - RNA, 18 nt, Human
ggaaagacagaagucaaa

SEQ ID NO: 1111514 - RNA, 21 nt, Human
ggaggccaggggagcuggggu

SEQ ID NO: 1111515 - RNA, 21 nt, Human
ggaggcuggaggugcaggggu

SEQ ID NO: 1111516 - RNA, 23 nt, Human
ggagguugccgugagccgagauc

SEQ ID NO: 1111517 - RNA, 24 nt, Human
ggagguugccgugagccgagauca

SEQ ID NO: 1111518 - RNA, 19 nt, Human
ggcaccuguagucccagcu

SEQ ID NO: 1111519 - RNA, 20 nt, Human
ggcagggcagagccaugggg

SEQ ID NO: 1111520 - RNA, 21 nt, Human
ggcucacgccugcaaucccag

SEQ ID NO: 1111521 - RNA, 18 nt, Human
ggcuggaggugcaggggu

SEQ ID NO: 1111522 - RNA, 22 nt, Human
gggagccgggguggaggcuggg

SEQ ID NO: 1111523 - RNA, 19 nt, Human
gggagcugggggcccaaaa

SEQ ID NO: 1111524 - RNA, 23 nt, Human
gggagcugggguggaggccgggg

SEQ ID NO: 1111525 - RNA, 22 nt, Human
gggcacagcugcuugggucagg

SEQ ID NO: 1111526 - RNA, 21 nt, Human
gggcagcggaggauggggggc

SEQ ID NO: 1111527 - RNA, 24 nt, Human
gggcgggggcggggccagggccuc

SEQ ID NO: 1111528 - RNA, 22 nt, Human
ggggagaggcacgccuaggggg

SEQ ID NO: 1111529 - RNA, 22 nt, Human
ggggagggggggcccagcacgg

SEQ ID NO: 1111530 - RNA, 25 nt, Human
ggggcggggccagggccuccggaga

SEQ ID NO: 1111531 - RNA, 20 nt, Human
gggguggggggcagggcaga

SEQ ID NO: 1111532 - RNA, 21 nt, Human
ggguggggggcagggcagagc

SEQ ID NO: 1111533 - RNA, 21 nt, Human
ggucagcagcgggcgggggcg

SEQ ID NO: 1111534 - RNA, 21 nt, Human
ggucaggaagggguggggggc

SEQ ID NO: 1111535 - RNA, 21 nt, Human
gguggaagggaaagacagaag

SEQ ID NO: 1111536 - RNA, 22 nt, Human
gguggaggcuggaggugcaggg

SEQ ID NO: 1111537 - RNA, 21 nt, Human
gguggaggcugggggugcaag

SEQ ID NO: 1111538 - RNA, 20 nt, Human
gguggagguugccgugagcc

SEQ ID NO: 1111539 - RNA, 21 nt, Human
gguggaucacgaggucaggag

SEQ ID NO: 1111540 - RNA, 24 nt, Human
gguggcgggcaccuguagucccag

SEQ ID NO: 1111541 - RNA, 24 nt, Human
gguggcucacgccugcaaucccag

SEQ ID NO: 1111542 - RNA, 18 nt, Human
gucagggaugggcaggcc

SEQ ID NO: 1111543 - RNA, 23 nt, Human
guggagggcaguccuuuggucca

SEQ ID NO: 1111544 - RNA, 24 nt, Human
uaaccagaaaggagaucuuguuuc

SEQ ID NO: 1111545 - RNA, 21 nt, Human
uaagcuagacaagagcaccua

SEQ ID NO: 1111546 - RNA, 22 nt, Human
uaaggugggucccagucuugcc

SEQ ID NO: 1111547 - RNA, 24 nt, Human
uacaauucaaagucuucuggccuc

SEQ ID NO: 1111548 - RNA, 25 nt, Human
uacuacagccugggcaacaagggug

SEQ ID NO: 1111549 - RNA, 18 nt, Human
uagccugaccaucaucca

SEQ ID NO: 1111550 - RNA, 24 nt, Human
uaugaaaaaaaaaaaaagagccuc

SEQ ID NO: 1111551 - RNA, 24 nt, Human
uaugaaaaaaaaaaaaagagccuu

SEQ ID NO: 1111552 - RNA, 23 nt, Human
uauggcacuccagccugggugac

SEQ ID NO: 1111553 - RNA, 24 nt, Human
uauggcacuccagccugggugaca

SEQ ID NO: 1111554 - RNA, 25 nt, Human
uauggcacuccagccugggugacag

SEQ ID NO: 1111555 - RNA, 18 nt, Human
ucaaagacagcucuaagg

SEQ ID NO: 1111556 - RNA, 23 nt, Human
ucacacuauggcacuccagccug

SEQ ID NO: 1111557 - RNA, 18 nt, Human
ucacgaggucaggagacc

SEQ ID NO: 1111558 - RNA, 24 nt, Human
ucacgaggucaggagaccaagacc

SEQ ID NO: 1111559 - RNA, 23 nt, Human
ucagccucccgaguagcugaggc

SEQ ID NO: 1111560 - RNA, 25 nt, Human
ucagccucccgaguagcugaggcag

SEQ ID NO: 1111561 - RNA, 23 nt, Human
uccacagugggacaugguuaggc

SEQ ID NO: 1111562 - RNA, 24 nt, Human
uccagccugggugacagagcuaga

SEQ ID NO: 1111563 - RNA, 27 nt, Human
uccauccaaaaaaaaaaaaaaaaagaa

SEQ ID NO: 1111564 - RNA, 20 nt, Human
uccccagagaacugaggguc

SEQ ID NO: 1111565 - RNA, 24 nt, Human
uccccagagaacugagggucucca

SEQ ID NO: 1111566 - RNA, 24 nt, Human
uccguggucaggaagggguggggg

SEQ ID NO: 1111567 - RNA, 24 nt, Human
ucgcuugaacccgggagguggagg

SEQ ID NO: 1111568 - RNA, 19 nt, Human
ucggagauccagccuuggg

SEQ ID NO: 1111569 - RNA, 25 nt, Human
ucucuacuaaaaauacaaaaaaaau

SEQ ID NO: 1111570 - RNA, 20 nt, Human
ucugaguucaagcaauucuc

SEQ ID NO: 1111571 - RNA, 20 nt, Human
ucugaguucaagcaauucuc

SEQ ID NO: 1111572 - RNA, 23 nt, Human
ucuggccuccagggaaucuccuu

SEQ ID NO: 1111573 - RNA, 21 nt, Human
ugaaacucccucugccccaag

SEQ ID NO: 1111574 - RNA, 22 nt, Human
ugaaacucccucugccccaagg

SEQ ID NO: 1111575 - RNA, 19 nt, Human
ugacaugcugggcuaguga

SEQ ID NO: 1111576 - RNA, 18 nt, Human
ugagacagagagagaggg

SEQ ID NO: 1111577 - RNA, 22 nt, Human
ugagccgagaucaugccauugu

SEQ ID NO: 1111578 - RNA, 18 nt, Human
ugagcugagggccagguc

SEQ ID NO: 1111579 - RNA, 23 nt, Human
ugaggaggcguguccuccaggcu

SEQ ID NO: 1111580 - RNA, 20 nt, Human
ugaggcaggagaaucgcuug

SEQ ID NO: 1111581 - RNA, 24 nt, Human
ugaggcaggagaaucgcuugaacc

SEQ ID NO: 1111582 - RNA, 25 nt, Human
ugaggcaggagaaucgcuugaaccc

SEQ ID NO: 1111583 - RNA, 23 nt, Human
ugaggcaggagaauggcgugaac

SEQ ID NO: 1111584 - RNA, 24 nt, Human
ugaggcaggagaauggcgugaacc

SEQ ID NO: 1111585 - RNA, 25 nt, Human
ugaggcaggagaauggcgugaaccc

SEQ ID NO: 1111586 - RNA, 20 nt, Human
ugagguaggagcccaagguu

SEQ ID NO: 1111587 - RNA, 24 nt, Human
ugaguucaagcaauucucuugccu

SEQ ID NO: 1111588 - RNA, 22 nt, Human
ugcagcagcagggcggccuggg

SEQ ID NO: 1111589 - RNA, 20 nt, Human
ugccaaaguugacaugcugg

SEQ ID NO: 1111590 - RNA, 21 nt, Human
ugcccuaugggcucuuagcac

SEQ ID NO: 1111591 - RNA, 22 nt, Human
ugccgucggagucuucugcagc

SEQ ID NO: 1111592 - RNA, 22 nt, Human
ugccucagccucccgaguagcu

SEQ ID NO: 1111593 - RNA, 24 nt, Human
ugccucagccucccgaguagcuga

SEQ ID NO: 1111594 - RNA, 24 nt, Human
ugcgaggguggaggcuggaggugc

SEQ ID NO: 1111595 - RNA, 23 nt, Human
ugcugcugcucaagcaugugugg

SEQ ID NO: 1111596 - RNA, 18 nt, Human
ugcugcugcugcucaagc

SEQ ID NO: 1111597 - RNA, 22 nt, Human
ugcuugggucagggaugggcag

SEQ ID NO: 1111598 - RNA, 22 nt, Human
uggaagcagggagagaaagugc

SEQ ID NO: 1111599 - RNA, 20 nt, Human
uggaaggcuggcggcgaggc

SEQ ID NO: 1111600 - RNA, 20 nt, Human
uggaggccaggggagcuggg

SEQ ID NO: 1111601 - RNA, 19 nt, Human
uggaggccggggguucgag

SEQ ID NO: 1111602 - RNA, 21 nt, Human
uggaggcugggggugcaaggg

SEQ ID NO: 1111603 - RNA, 23 nt, Human
uggaggcugggggugcaagggug

SEQ ID NO: 1111604 - RNA, 21 nt, Human
uggagggggagugaccuuggu

SEQ ID NO: 1111605 - RNA, 22 nt, Human
uggcucacgccugcaaucccag

SEQ ID NO: 1111606 - RNA, 24 nt, Human
uggcucacgccugcaaucccagca

SEQ ID NO: 1111607 - RNA, 22 nt, Human
uggcuucgcucuuccguaucac

SEQ ID NO: 1111608 - RNA, 23 nt, Human
ugggaggccgaggcggguggauc

SEQ ID NO: 1111609 - RNA, 24 nt, Human
ugggaggccgaggcggguggauca

SEQ ID NO: 1111610 - RNA, 23 nt, Human
uggggaccuagggggcgacccgg

SEQ ID NO: 1111611 - RNA, 18 nt, Human
ugggguggaggccggggg

SEQ ID NO: 1111612 - RNA, 21 nt, Human
ugggucccagucuugccagaa

SEQ ID NO: 1111613 - RNA, 20 nt, Human
uggguggaagggaaagacag

SEQ ID NO: 1111614 - RNA, 22 nt, Human
uggucaggaagggguggggggg

SEQ ID NO: 1111615 - RNA, 24 nt, Human
ugguggcgggcaccuguaguccca

SEQ ID NO: 1111616 - RNA, 24 nt, Human
ugguuugggguuguguggccugga

SEQ ID NO: 1111617 - RNA, 22 nt, Human
uguacuacagccugggcaacaa

SEQ ID NO: 1111618 - RNA, 22 nt, Human
ugucagggaacagccgagcugc

SEQ ID NO: 1111619 - RNA, 24 nt, Human
uugaacccgggagguggagguugc

SEQ ID NO: 1111620 - RNA, 19 nt, Human
uugcagugagccgagauca

SEQ ID NO: 1111621 - RNA, 20 nt, Human
uugcagugagccgagaucac

SEQ ID NO: 1111622 - RNA, 20 nt, Human
uugccgugagccgagaucau

SEQ ID NO: 1111623 - RNA, 23 nt, Human
uuggaaacuccauuuaggaccua

SEQ ID NO: 1111624 - RNA, 21 nt, Human
uuggccuuuccaaacaacccc

SEQ ID NO: 1111625 - RNA, 25 nt, Human
uugggaggccgaggcggguggauca

SEQ ID NO: 1111626 - RNA, 21 nt, Human
aacauccagaggcuucggcac

SEQ ID NO: 1111627 - RNA, 24 nt, Human
agagggaaggccuuagggcagagc

SEQ ID NO: 1111628 - RNA, 18 nt, Human
agggcagagcgggcagcc

SEQ ID NO: 1111629 - RNA, 23 nt, Human
cagagcgggcagcccagcguccc

SEQ ID NO: 1111630 - RNA, 21 nt, Human
ggaaggccuuagggcagagcg

SEQ ID NO: 1111631 - RNA, 18 nt, Human
ggaggacgcuggcacacc

SEQ ID NO: 1111632 - RNA, 19 nt, Human
ucccagggccccugggagc

SEQ ID NO: 1111633 - RNA, 19 nt, Human
ugcagagggaaggccuuag

SEQ ID NO: 1111634 - RNA, 20 nt, Human
agaauaucuuaaaccucugg

SEQ ID NO: 1111635 - RNA, 19 nt, Human
ccauaagccaguccagaug

SEQ ID NO: 1111636 - RNA, 19 nt, Human
ccucugguaaaaucucugg

SEQ ID NO: 1111637 - RNA, 19 nt, Human
uaacagugggaacacugac

SEQ ID NO: 1111638 - RNA, 22 nt, Human
uaacagugggaacacugacacc

SEQ ID NO: 1111639 - RNA, 24 nt, Human
uccagguuuaauauuuugugacaa

SEQ ID NO: 1111640 - RNA, 24 nt, Human
uccuuuacauucacuggaaauguu

SEQ ID NO: 1111641 - RNA, 22 nt, Human
ucuacagcaaacccucaggaga

SEQ ID NO: 1111642 - RNA, 19 nt, Human
ucucagagguguccagggu

SEQ ID NO: 1111643 - RNA, 25 nt, Human
ugagcagauacaaggacuguacaga

SEQ ID NO: 1111644 - RNA, 19 nt, Human
uggaauaggugagcagaua

SEQ ID NO: 1111645 - RNA, 31 nt, Human
uuaacagugggaacacugacacccuucuuuu

SEQ ID NO: 1111646 - RNA, 25 nt, Human
uuuuuuuuuguuuuuuaacaguggg

SEQ ID NO: 1111647 - RNA, 21 nt, Human
aaaacaaacaaacaaacaaac

SEQ ID NO: 1111648 - RNA, 22 nt, Human
aaaaggaagaaauuggccaaaa

SEQ ID NO: 1111649 - RNA, 22 nt, Human
aaaauaacuuccuuugaccucc

SEQ ID NO: 1111650 - RNA, 22 nt, Human
aaacaaacaaacaaacuaccag

SEQ ID NO: 1111651 - RNA, 21 nt, Human
aaacaaccagaugucaugcaa

SEQ ID NO: 1111652 - RNA, 24 nt, Human
aaagugcugggauuacaggcguga

SEQ ID NO: 1111653 - RNA, 23 nt, Human
aacaaacaaacaaacaaacaaac

SEQ ID NO: 1111654 - RNA, 23 nt, Human
aacaaacaaacaaacaaacaaac

SEQ ID NO: 1111655 - RNA, 23 nt, Human
aacaaacaaacaaacaaacaaac

SEQ ID NO: 1111656 - RNA, 23 nt, Human
aacaaacaaacaaacaaacaaac

SEQ ID NO: 1111657 - RNA, 19 nt, Human
aacaaggugaaaccucauc

SEQ ID NO: 1111658 - RNA, 20 nt, Human
aacaaggugaaaccucaucu

SEQ ID NO: 1111659 - RNA, 21 nt, Human
aacaaggugaaaccucaucuc

SEQ ID NO: 1111660 - RNA, 18 nt, Human
aacaaguuuguuacuucc

SEQ ID NO: 1111661 - RNA, 22 nt, Human
aaccagaugucaugcaaacucu

SEQ ID NO: 1111662 - RNA, 23 nt, Human
aaggaagaaauuggccaaaagaa

SEQ ID NO: 1111663 - RNA, 22 nt, Human
aagggcuggccuugaguacuug

SEQ ID NO: 1111664 - RNA, 19 nt, Human
aagugcugggauuacaggc

SEQ ID NO: 1111665 - RNA, 19 nt, Human
aagugcugggauuacaggc

SEQ ID NO: 1111666 - RNA, 26 nt, Human
aagugcugggauuacaggcgugagcc

SEQ ID NO: 1111667 - RNA, 23 nt, Human
aaucacuuuccaccagguccuac

SEQ ID NO: 1111668 - RNA, 24 nt, Human
aaucaucugaacccaggaggcaga

SEQ ID NO: 1111669 - RNA, 18 nt, Human
aauuagccaggcauggug

SEQ ID NO: 1111670 - RNA, 18 nt, Human
acaaacaaacaaacaaac

SEQ ID NO: 1111671 - RNA, 18 nt, Human
acaaacaaacaaacaaac

SEQ ID NO: 1111672 - RNA, 18 nt, Human
acaaacaaacaaacaaac

SEQ ID NO: 1111673 - RNA, 18 nt, Human
acaaacaaacaaacaaac

SEQ ID NO: 1111674 - RNA, 18 nt, Human
acacagauucaaaccaua

SEQ ID NO: 1111675 - RNA, 24 nt, Human
acagagggagacucugucucaaaa

SEQ ID NO: 1111676 - RNA, 20 nt, Human
accauccuggccaacaaggu

SEQ ID NO: 1111677 - RNA, 28 nt, Human
acccuguaaaauaagaaacugagggguc

SEQ ID NO: 1111678 - RNA, 18 nt, Human
acgggguuucaccguguu

SEQ ID NO: 1111679 - RNA, 19 nt, Human
acgggguuucaccguguua

SEQ ID NO: 1111680 - RNA, 20 nt, Human
acgggguuucaccguguuag

SEQ ID NO: 1111681 - RNA, 30 nt, Human
acucugucucaaaaaacaaacaaacaaacc

SEQ ID NO: 1111682 - RNA, 23 nt, Human
acugcacuccagccuggugacag

SEQ ID NO: 1111683 - RNA, 25 nt, Human
acugcacuccagccuggugacagag

SEQ ID NO: 1111684 - RNA, 21 nt, Human
agaacagcgcuaaggggauag

SEQ ID NO: 1111685 - RNA, 19 nt, Human
agaagcauauuugugagag

SEQ ID NO: 1111686 - RNA, 19 nt, Human
agaccauccuggccaacaa

SEQ ID NO: 1111687 - RNA, 19 nt, Human
agagacgggguuucaccgu

SEQ ID NO: 1111688 - RNA, 23 nt, Human
agccaggcauggugauggaggcc

SEQ ID NO: 1111689 - RNA, 21 nt, Human
agccuggugacagagggagac

SEQ ID NO: 1111690 - RNA, 22 nt, Human
aggaagaaauuggccaaaagaa

SEQ ID NO: 1111691 - RNA, 18 nt, Human
aggaaguguggggggagg

SEQ ID NO: 1111692 - RNA, 24 nt, Human
aggaggacagugguucuccuuaaa

SEQ ID NO: 1111693 - RNA, 20 nt, Human
aggcagagauugcagugagc

SEQ ID NO: 1111694 - RNA, 27 nt, Human
aggcagagauugcagugagcugcgauc

SEQ ID NO: 1111695 - RNA, 24 nt, Human
aggcagaucagaaggucaggagau

SEQ ID NO: 1111696 - RNA, 20 nt, Human
aggcaggcagaucagaaggu

SEQ ID NO: 1111697 - RNA, 24 nt, Human
aggcaggcagaucagaaggucagg

SEQ ID NO: 1111698 - RNA, 18 nt, Human
aggcaggggaaucaucug

SEQ ID NO: 1111699 - RNA, 24 nt, Human
aggcggaagugcaguggcgcgauc

SEQ ID NO: 1111700 - RNA, 25 nt, Human
aggcggaagugcaguggcgcgaucu

SEQ ID NO: 1111701 - RNA, 20 nt, Human
aggcugaggcaggggaauca

SEQ ID NO: 1111702 - RNA, 24 nt, Human
aggcugaggcaggggaaucaucug

SEQ ID NO: 1111703 - RNA, 24 nt, Human
agggcugcugucacucaccaggcc

SEQ ID NO: 1111704 - RNA, 19 nt, Human
aggggcaauggagugaggc

SEQ ID NO: 1111705 - RNA, 21 nt, Human
aguagagacgggguuucaccg

SEQ ID NO: 1111706 - RNA, 18 nt, Human
aguagcugggacuacagg

SEQ ID NO: 1111707 - RNA, 19 nt, Human
aguagcugggacuacaggc

SEQ ID NO: 1111708 - RNA, 18 nt, Human
aguccaaaaccaagcaga

SEQ ID NO: 1111709 - RNA, 23 nt, Human
agugcaguggcgcgaucuuggcu

SEQ ID NO: 1111710 - RNA, 24 nt, Human
agugcaguggcgcgaucuuggcuc

SEQ ID NO: 1111711 - RNA, 18 nt, Human
agugcugggauuacaggc

SEQ ID NO: 1111712 - RNA, 24 nt, Human
agugguucacgccuguaaucccag

SEQ ID NO: 1111713 - RNA, 19 nt, Human
aucacuuuccaccaggucc

SEQ ID NO: 1111714 - RNA, 24 nt, Human
aucgcaccacugcacuccagccug

SEQ ID NO: 1111715 - RNA, 19 nt, Human
auucuccaugaggguucca

SEQ ID NO: 1111716 - RNA, 21 nt, Human
auucuccugccucagccuccc

SEQ ID NO: 1111717 - RNA, 20 nt, Human
caaaccauauuguuccaccu

SEQ ID NO: 1111718 - RNA, 24 nt, Human
caaagugcugggauuacaggcgug

SEQ ID NO: 1111719 - RNA, 23 nt, Human
caagccuacacaaguccaaaacc

SEQ ID NO: 1111720 - RNA, 25 nt, Human
caagccuacacaaguccaaaaccaa

SEQ ID NO: 1111721 - RNA, 23 nt, Human
caccacacuucucuguaggacag

SEQ ID NO: 1111722 - RNA, 21 nt, Human
caccaggccuggccuaggggc

SEQ ID NO: 1111723 - RNA, 19 nt, Human
caccgcaagcuccgccucc

SEQ ID NO: 1111724 - RNA, 24 nt, Human
caccguguuagccacgauggucuc

SEQ ID NO: 1111725 - RNA, 24 nt, Human
caccucagccucccaaagugcugg

SEQ ID NO: 1111726 - RNA, 23 nt, Human
caccuguagaugcucucaagggc

SEQ ID NO: 1111727 - RNA, 22 nt, Human
cacgccauucuccugccucagc

SEQ ID NO: 1111728 - RNA, 24 nt, Human
cacgccuguaaucccagcacuuug

SEQ ID NO: 1111729 - RNA, 23 nt, Human
cacuaggaaguccuccaguggga

SEQ ID NO: 1111730 - RNA, 18 nt, Human
cacugcacuccagccugg

SEQ ID NO: 1111731 - RNA, 18 nt, Human
cacugcacuccagccugg

SEQ ID NO: 1111732 - RNA, 22 nt, Human
cacugcacuccagccuggugac

SEQ ID NO: 1111733 - RNA, 23 nt, Human
cacugcacuccagccuggugaca

SEQ ID NO: 1111734 - RNA, 23 nt, Human
cacugcacuccagccuggugaca

SEQ ID NO: 1111735 - RNA, 20 nt, Human
cacuuguggcuuuccagggu

SEQ ID NO: 1111736 - RNA, 24 nt, Human
cagcacuuuggguggccgaggcag

SEQ ID NO: 1111737 - RNA, 25 nt, Human
cagcacuuuggguggccgaggcagg

SEQ ID NO: 1111738 - RNA, 23 nt, Human
cagcgcuaaggggauagugcuaa

SEQ ID NO: 1111739 - RNA, 18 nt, Human
caggaggacagugguucu

SEQ ID NO: 1111740 - RNA, 26 nt, Human
caggcacgucuuugcuuuuuuuuuuu

SEQ ID NO: 1111741 - RNA, 22 nt, Human
caggcagaucagaaggucagga

SEQ ID NO: 1111742 - RNA, 19 nt, Human
caguggcgcgaucuuggcu

SEQ ID NO: 1111743 - RNA, 24 nt, Human
caugauccaaucacuuuccaccag

SEQ ID NO: 1111744 - RNA, 22 nt, Human
cauggugauggaggccuguagu

SEQ ID NO: 1111745 - RNA, 23 nt, Human
cauucccauucuaaaaggaagaa

SEQ ID NO: 1111746 - RNA, 22 nt, Human
ccaaagugcugggauuacaggc

SEQ ID NO: 1111747 - RNA, 22 nt, Human
ccaaagugcugggauuacaggc

SEQ ID NO: 1111748 - RNA, 24 nt, Human
ccaaagugcugggauuacaggcgu

SEQ ID NO: 1111749 - RNA, 24 nt, Human
ccacauuuccccuccacacugccc

SEQ ID NO: 1111750 - RNA, 18 nt, Human
ccaccgcgcccggccaca

SEQ ID NO: 1111751 - RNA, 19 nt, Human
ccacugcacuccagccugg

SEQ ID NO: 1111752 - RNA, 19 nt, Human
ccacugcacuccagccugg

SEQ ID NO: 1111753 - RNA, 19 nt, Human
ccacugcacuccagccugg

SEQ ID NO: 1111754 - RNA, 20 nt, Human
ccacugcacuccagccuggu

SEQ ID NO: 1111755 - RNA, 22 nt, Human
ccacugcacuccagccugguga

SEQ ID NO: 1111756 - RNA, 23 nt, Human
ccacugcacuccagccuggugac

SEQ ID NO: 1111757 - RNA, 24 nt, Human
ccacugcacuccagccuggugaca

SEQ ID NO: 1111758 - RNA, 21 nt, Human
ccagcacuuuggguggccgag

SEQ ID NO: 1111759 - RNA, 20 nt, Human
cccagguucacgccauucuc

SEQ ID NO: 1111760 - RNA, 23 nt, Human
cccgaguagcugggacuacaggc

SEQ ID NO: 1111761 - RNA, 24 nt, Human
cccgaguagcugggacuacaggcg

SEQ ID NO: 1111762 - RNA, 21 nt, Human
cccuagcuguauucacucucc

SEQ ID NO: 1111763 - RNA, 24 nt, Human
ccgcaagcuccgccucccagguuc

SEQ ID NO: 1111764 - RNA, 26 nt, Human
ccgcccaccucagccucccaaagugc

SEQ ID NO: 1111765 - RNA, 18 nt, Human
ccgcgcccggccacaggc

SEQ ID NO: 1111766 - RNA, 21 nt, Human
ccuacacaaguccaaaaccaa

SEQ ID NO: 1111767 - RNA, 23 nt, Human
ccuagcuguauucacucucccug

SEQ ID NO: 1111768 - RNA, 24 nt, Human
ccucccagguucacgccauucucc

SEQ ID NO: 1111769 - RNA, 21 nt, Human
ccuccuaucccacaucaaggg

SEQ ID NO: 1111770 - RNA, 23 nt, Human
ccugccucagccucccgaguagc

SEQ ID NO: 1111771 - RNA, 24 nt, Human
ccuggccaacaaggugaaaccuca

SEQ ID NO: 1111772 - RNA, 24 nt, Human
ccuguaaucccagcacuuugggug

SEQ ID NO: 1111773 - RNA, 22 nt, Human
ccuguagucccagcuacugggg

SEQ ID NO: 1111774 - RNA, 24 nt, Human
cgagaccauccuggccaacaaggu

SEQ ID NO: 1111775 - RNA, 24 nt, Human
cgaggcaggcagaucagaagguca

SEQ ID NO: 1111776 - RNA, 21 nt, Human
cgcaccacugcacuccagccu

SEQ ID NO: 1111777 - RNA, 19 nt, Human
cgccucccagguucacgcc

SEQ ID NO: 1111778 - RNA, 23 nt, Human
cgccuguaaucccagcacuuugg

SEQ ID NO: 1111779 - RNA, 24 nt, Human
cgccuguaaucccagcacuuuggg

SEQ ID NO: 1111780 - RNA, 19 nt, Human
cgggguuucaccguguuag

SEQ ID NO: 1111781 - RNA, 24 nt, Human
cgugauccgcccaccucagccucc

SEQ ID NO: 1111782 - RNA, 19 nt, Human
cucaaaaaacaaacaaaca

SEQ ID NO: 1111783 - RNA, 21 nt, Human
cucaaaaguccacaguccaaa

SEQ ID NO: 1111784 - RNA, 19 nt, Human
cucaagggcuggccuugag

SEQ ID NO: 1111785 - RNA, 24 nt, Human
cucagccucccgaguagcugggac

SEQ ID NO: 1111786 - RNA, 22 nt, Human
cuccugaccucgugauccgccc

SEQ ID NO: 1111787 - RNA, 27 nt, Human
cucuaagaagcauauuugugagaggag

SEQ ID NO: 1111788 - RNA, 20 nt, Human
cucuacaaaaauacaaaaaa

SEQ ID NO: 1111789 - RNA, 23 nt, Human
cucugugugggggcuccaacccc

SEQ ID NO: 1111790 - RNA, 23 nt, Human
cugccucagccucccgaguagcu

SEQ ID NO: 1111791 - RNA, 19 nt, Human
cugcguggacauccagacu

SEQ ID NO: 1111792 - RNA, 24 nt, Human
cuggagcaggaggaaguguggggg

SEQ ID NO: 1111793 - RNA, 23 nt, Human
cuggccaacaaggugaaaccuca

SEQ ID NO: 1111794 - RNA, 21 nt, Human
cuuuuaaacaaccagauguca

SEQ ID NO: 1111795 - RNA, 23 nt, Human
gaagugcaguggcgcgaucuugg

SEQ ID NO: 1111796 - RNA, 21 nt, Human
gaaguguggggggaggugcca

SEQ ID NO: 1111797 - RNA, 24 nt, Human
gacagagggagacucugucucaaa

SEQ ID NO: 1111798 - RNA, 22 nt, Human
gaccucgugauccgcccaccuc

SEQ ID NO: 1111799 - RNA, 24 nt, Human
gaccucgugauccgcccaccucag

SEQ ID NO: 1111800 - RNA, 24 nt, Human
gacuacaggcgcccgccaccgugc

SEQ ID NO: 1111801 - RNA, 24 nt, Human
gagacgggguuucaccguguuagc

SEQ ID NO: 1111802 - RNA, 25 nt, Human
gaggcaggcagaucagaaggucagg

SEQ ID NO: 1111803 - RNA, 25 nt, Human
gaguagcugggacuacaggcgcccg

SEQ ID NO: 1111804 - RNA, 21 nt, Human
gaucucgggacugcaggauuu

SEQ ID NO: 1111805 - RNA, 18 nt, Human
gauuacaggcgugagcca

SEQ ID NO: 1111806 - RNA, 22 nt, Human
gauuacaggcgugagccaccgc

SEQ ID NO: 1111807 - RNA, 22 nt, Human
gauuacaggcgugagccaccgc

SEQ ID NO: 1111808 - RNA, 20 nt, Human
gcaccacugcacuccagccu

SEQ ID NO: 1111809 - RNA, 28 nt, Human
gcacuccagccuggugacagagggagag

SEQ ID NO: 1111810 - RNA, 30 nt, Human
gcagaucagaaggucaggagaucgagaccc

SEQ ID NO: 1111811 - RNA, 18 nt, Human
gcagugguucacgccugu

SEQ ID NO: 1111812 - RNA, 19 nt, Human
gccaggcauggugauggag

SEQ ID NO: 1111813 - RNA, 23 nt, Human
gccuggcuaauuuuuuguauuuu

SEQ ID NO: 1111814 - RNA, 24 nt, Human
gcgugcagugguucacgccuguaa

SEQ ID NO: 1111815 - RNA, 26 nt, Human
gcuccaaccccacauuuccccuccac

SEQ ID NO: 1111816 - RNA, 22 nt, Human
gcucccaaagccuugggcagca

SEQ ID NO: 1111817 - RNA, 20 nt, Human
gcugcgaucgcaccacugca

SEQ ID NO: 1111818 - RNA, 24 nt, Human
ggaagugcaguggcgcgaucuugg

SEQ ID NO: 1111819 - RNA, 24 nt, Human
ggaaguguggggggaggugccaca

SEQ ID NO: 1111820 - RNA, 20 nt, Human
ggaggaaguguggggggagg

SEQ ID NO: 1111821 - RNA, 24 nt, Human
ggcagcaccacacuuguggcuuuc

SEQ ID NO: 1111822 - RNA, 22 nt, Human
ggccuguagucccagcuacugg

SEQ ID NO: 1111823 - RNA, 23 nt, Human
ggccuguagucccagcuacuggg

SEQ ID NO: 1111824 - RNA, 23 nt, Human
gggaaucaucugaacccaggagg

SEQ ID NO: 1111825 - RNA, 23 nt, Human
gggaggcugaggcaggggaauca

SEQ ID NO: 1111826 - RNA, 24 nt, Human
ggggaggcugaggcaggggaauca

SEQ ID NO: 1111827 - RNA, 18 nt, Human
gggguuucaccguguuag

SEQ ID NO: 1111828 - RNA, 22 nt, Human
ggguggccgaggcaggcagauc

SEQ ID NO: 1111829 - RNA, 19 nt, Human
gguggccgaggcaggcaga

SEQ ID NO: 1111830 - RNA, 20 nt, Human
gguuccacucgugcagcagg

SEQ ID NO: 1111831 - RNA, 23 nt, Human
guagagacgggguuucaccgugu

SEQ ID NO: 1111832 - RNA, 24 nt, Human
gugauccgcccaccucagccuccc

SEQ ID NO: 1111833 - RNA, 20 nt, Human
guggaucuaccauuaugaug

SEQ ID NO: 1111834 - RNA, 24 nt, Human
uaauuuuuuguauuuuuaguagag

SEQ ID NO: 1111835 - RNA, 25 nt, Human
uaauuuuuuguauuuuuaguagaga

SEQ ID NO: 1111836 - RNA, 21 nt, Human
uacacaaguccaaaaccaagc

SEQ ID NO: 1111837 - RNA, 23 nt, Human
uacaggcgugagccaccgcgccc

SEQ ID NO: 1111838 - RNA, 19 nt, Human
uaccggcugcgugcagugg

SEQ ID NO: 1111839 - RNA, 26 nt, Human
uaccuccaacacuggggauuccaauu

SEQ ID NO: 1111840 - RNA, 21 nt, Human
uagccaggcauggugauggag

SEQ ID NO: 1111841 - RNA, 18 nt, Human
uagcuccacuaggaaguu

SEQ ID NO: 1111842 - RNA, 21 nt, Human
uaguagagacgggguuucacc

SEQ ID NO: 1111843 - RNA, 24 nt, Human
uaguagagacgggguuucaccgug

SEQ ID NO: 1111844 - RNA, 25 nt, Human
uaguagagacgggguuucaccgugu

SEQ ID NO: 1111845 - RNA, 26 nt, Human
uaugacccuguaaaauaagaaacaag

SEQ ID NO: 1111846 - RNA, 22 nt, Human
uauuucaaaauacuaccggcug

SEQ ID NO: 1111847 - RNA, 21 nt, Human
ucaaaauacuaccggcugcgu

SEQ ID NO: 1111848 - RNA, 24 nt, Human
ucaccgcaagcuccgccucccagg

SEQ ID NO: 1111849 - RNA, 24 nt, Human
ucaccguguuagccacgauggucu

SEQ ID NO: 1111850 - RNA, 23 nt, Human
ucacgccuguaaucccagcacuu

SEQ ID NO: 1111851 - RNA, 24 nt, Human
ucagaaggucaggagaucgagacc

SEQ ID NO: 1111852 - RNA, 18 nt, Human
ucagccucccaaagugcu

SEQ ID NO: 1111853 - RNA, 23 nt, Human
ucagccucccgaguagcugggac

SEQ ID NO: 1111854 - RNA, 20 nt, Human
ucauauuucaaaauacuacc

SEQ ID NO: 1111855 - RNA, 20 nt, Human
uccaaaauaacuuccuuuga

SEQ ID NO: 1111856 - RNA, 27 nt, Human
uccacaguccaaagucuuaucugagac

SEQ ID NO: 1111857 - RNA, 24 nt, Human
uccaccucuggucucucccaaauc

SEQ ID NO: 1111858 - RNA, 19 nt, Human
uccacuaggaaguccucca

SEQ ID NO: 1111859 - RNA, 18 nt, Human
ucccaaagccuugggcag

SEQ ID NO: 1111860 - RNA, 24 nt, Human
ucccaaagugcugggauuacaggc

SEQ ID NO: 1111861 - RNA, 19 nt, Human
ucccagguucacgccauuc

SEQ ID NO: 1111862 - RNA, 20 nt, Human
ucccagguucacgccauucu

SEQ ID NO: 1111863 - RNA, 21 nt, Human
ucccagguucacgccauucuc

SEQ ID NO: 1111864 - RNA, 24 nt, Human
ucccagguucacgccauucuccug

SEQ ID NO: 1111865 - RNA, 19 nt, Human
uccccguucuuucacgucc

SEQ ID NO: 1111866 - RNA, 24 nt, Human
ucccgaguagcugggacuacaggc

SEQ ID NO: 1111867 - RNA, 21 nt, Human
uccgcccaccucagccuccca

SEQ ID NO: 1111868 - RNA, 23 nt, Human
ucgcaccacugcacuccagccug

SEQ ID NO: 1111869 - RNA, 23 nt, Human
ucucaaaaaacaaacaaacaaac

SEQ ID NO: 1111870 - RNA, 19 nt, Human
ucucaagggcuggccuuga

SEQ ID NO: 1111871 - RNA, 24 nt, Human
ucuccugccucagccucccgagua

SEQ ID NO: 1111872 - RNA, 23 nt, Human
ucucuacaaaaauacaaaaaauu

SEQ ID NO: 1111873 - RNA, 19 nt, Human
ugaccuccuaucccacauc

SEQ ID NO: 1111874 - RNA, 23 nt, Human
ugaccucgugauccgcccaccuc

SEQ ID NO: 1111875 - RNA, 20 nt, Human
ugaggcaggggaaucaucug

SEQ ID NO: 1111876 - RNA, 24 nt, Human
ugaggcaggggaaucaucugaacc

SEQ ID NO: 1111877 - RNA, 25 nt, Human
ugaggcaggggaaucaucugaaccc

SEQ ID NO: 1111878 - RNA, 24 nt, Human
ugauccgcccaccucagccuccca

SEQ ID NO: 1111879 - RNA, 19 nt, Human
ugcagcaggcuucugcgug

SEQ ID NO: 1111880 - RNA, 21 nt, Human
ugcaggauuuaaguggcagca

SEQ ID NO: 1111881 - RNA, 24 nt, Human
ugccucagccucccgaguagcugg

SEQ ID NO: 1111882 - RNA, 24 nt, Human
ugcugggauuacaggcgugagcca

SEQ ID NO: 1111883 - RNA, 20 nt, Human
ugcugucacucaccaggccu

SEQ ID NO: 1111884 - RNA, 23 nt, Human
uggagucucgcucuuucgcccag

SEQ ID NO: 1111885 - RNA, 20 nt, Human
uggcagcacucaacugcagc

SEQ ID NO: 1111886 - RNA, 24 nt, Human
uggcagcacucaacugcagcagag

SEQ ID NO: 1111887 - RNA, 21 nt, Human
uggccuaggggcaauggagug

SEQ ID NO: 1111888 - RNA, 18 nt, Human
uggcucaccgcaagcucc

SEQ ID NO: 1111889 - RNA, 19 nt, Human
uggcucaugguucuaaagg

SEQ ID NO: 1111890 - RNA, 21 nt, Human
ugggacuacaggcgcccgcca

SEQ ID NO: 1111891 - RNA, 22 nt, Human
ugggacuacaggcgcccgccac

SEQ ID NO: 1111892 - RNA, 23 nt, Human
ugggacuacaggcgcccgccacc

SEQ ID NO: 1111893 - RNA, 23 nt, Human
ugggacuacaggcgcccgccacc

SEQ ID NO: 1111894 - RNA, 24 nt, Human
ugggacuacaggcgcccgccaccg

SEQ ID NO: 1111895 - RNA, 18 nt, Human
ugggauuacaggcgugag

SEQ ID NO: 1111896 - RNA, 19 nt, Human
ugggauuacaggcgugagc

SEQ ID NO: 1111897 - RNA, 21 nt, Human
ugggauuacaggcgugagcca

SEQ ID NO: 1111898 - RNA, 22 nt, Human
ugggauuacaggcgugagccac

SEQ ID NO: 1111899 - RNA, 23 nt, Human
ugggauuacaggcgugagccacc

SEQ ID NO: 1111900 - RNA, 24 nt, Human
ugggauuacaggcgugagccaccg

SEQ ID NO: 1111901 - RNA, 24 nt, Human
uggguggccgaggcaggcagauca

SEQ ID NO: 1111902 - RNA, 20 nt, Human
ugguaucuauucggcuucug

SEQ ID NO: 1111903 - RNA, 24 nt, Human
uggugauggaggccuguaguccca

SEQ ID NO: 1111904 - RNA, 24 nt, Human
ugguucacgccuguaaucccagca

SEQ ID NO: 1111905 - RNA, 21 nt, Human
uguauuuuuaguagagacggg

SEQ ID NO: 1111906 - RNA, 21 nt, Human
ugucaugcaaacucucucaca

SEQ ID NO: 1111907 - RNA, 23 nt, Human
uguuccaccucuggucucuccca

SEQ ID NO: 1111908 - RNA, 25 nt, Human
uguuccaccucuggucucucccaaa

SEQ ID NO: 1111909 - RNA, 18 nt, Human
uuaguagagacgggguuu

SEQ ID NO: 1111910 - RNA, 22 nt, Human
uuaguagagacgggguuucacc

SEQ ID NO: 1111911 - RNA, 24 nt, Human
uuaguagagacgggguuucaccgu

SEQ ID NO: 1111912 - RNA, 22 nt, Human
uucaaaauacuaccggcugcgu

SEQ ID NO: 1111913 - RNA, 19 nt, Human
uugcagugagcugcgaucg

SEQ ID NO: 1111914 - RNA, 22 nt, Human
uugcagugagcugcgaucgcac

SEQ ID NO: 1111915 - RNA, 23 nt, Human
uuguauuuuuaguagagacgggg

SEQ ID NO: 1111916 - RNA, 22 nt, Human
uuucaggcugagagugcaagcu

SEQ ID NO: 1111917 - RNA, 23 nt, Human
uuucucaaaccacccuucgguua

SEQ ID NO: 1111918 - RNA, 24 nt, Human
uuuuuaguagagacgggguuucac

SEQ ID NO: 1111919 - RNA, 21 nt, Human
uuuuuguauuuuuaguagaga

SEQ ID NO: 1111920 - RNA, 24 nt, Human
uuuuuuguauuuuuaguagagacg

SEQ ID NO: 1111921 - RNA, 25 nt, Human
uuuuuuuuuuuugagauggagucuc

SEQ ID NO: 1111922 - RNA, 22 nt, Human
uuuuuuuuuuuuuugagaugga

SEQ ID NO: 1111923 - RNA, 18 nt, Human
uuuuuuuuuuuuuuuuug

SEQ ID NO: 1111924 - RNA, 19 nt, Human
acugugccugggaggaguu

SEQ ID NO: 1111925 - RNA, 20 nt, Human
aggcuuccagggguccuggu

SEQ ID NO: 1111926 - RNA, 20 nt, Human
aggucuccgaaauggcagga

SEQ ID NO: 1111927 - RNA, 19 nt, Human
agugaagaggagaccugga

SEQ ID NO: 1111928 - RNA, 21 nt, Human
caggacacagaguagugaaga

SEQ ID NO: 1111929 - RNA, 21 nt, Human
ccaauaccugcaggucacagg

SEQ ID NO: 1111930 - RNA, 18 nt, Human
ccuggagcuccggcugca

SEQ ID NO: 1111931 - RNA, 18 nt, Human
cuaggcuuccaggggucc

SEQ ID NO: 1111932 - RNA, 21 nt, Human
cugcaggucacagggccacag

SEQ ID NO: 1111933 - RNA, 22 nt, Human
ggacacagaguagugaagagga

SEQ ID NO: 1111934 - RNA, 20 nt, Human
uaccugcaggucacagggcc

SEQ ID NO: 1111935 - RNA, 21 nt, Human
uccaggucuccgaaauggcag

SEQ ID NO: 1111936 - RNA, 18 nt, Human
ucccaauaccugcagguc

SEQ ID NO: 1111937 - RNA, 20 nt, Human
uccuggugucuuagcugugg

SEQ ID NO: 1111938 - RNA, 18 nt, Human
ugggaggaguuugggaug

SEQ ID NO: 1111939 - RNA, 25 nt, Human
aagcgauccucccaucucagccucc

SEQ ID NO: 1111940 - RNA, 18 nt, Human
aagcugccaggcugggcc

SEQ ID NO: 1111941 - RNA, 18 nt, Human
aagcugccaggcugggcc

SEQ ID NO: 1111942 - RNA, 18 nt, Human
aaucaugccgcugugcac

SEQ ID NO: 1111943 - RNA, 20 nt, Human
acuacaauguugugccgcca

SEQ ID NO: 1111944 - RNA, 24 nt, Human
acuauauugcccaggcuggucuug

SEQ ID NO: 1111945 - RNA, 25 nt, Human
acuauauugcccaggcuggucuuga

SEQ ID NO: 1111946 - RNA, 25 nt, Human
acucacucccugucccccuccccag

SEQ ID NO: 1111947 - RNA, 20 nt, Human
acucauccuacuuccugucu

SEQ ID NO: 1111948 - RNA, 25 nt, Human
acucccugucccccuccccagcccc

SEQ ID NO: 1111949 - RNA, 25 nt, Human
acucuagggacuucccaggaguggg

SEQ ID NO: 1111950 - RNA, 22 nt, Human
agauuacaggugugagccacug

SEQ ID NO: 1111951 - RNA, 23 nt, Human
agggucuguuucuccaucuccuc

SEQ ID NO: 1111952 - RNA, 24 nt, Human
agguugcugagauuacagguguga

SEQ ID NO: 1111953 - RNA, 21 nt, Human
aguagcuggggcugcagacau

SEQ ID NO: 1111954 - RNA, 20 nt, Human
agugcaguggugcgaucaug

SEQ ID NO: 1111955 - RNA, 23 nt, Human
agugcaguggugcgaucauggcu

SEQ ID NO: 1111956 - RNA, 24 nt, Human
agugcaguggugcgaucauggcuc

SEQ ID NO: 1111957 - RNA, 24 nt, Human
aucuguugcccaggccggacuaca

SEQ ID NO: 1111958 - RNA, 18 nt, Human
augcauauucucugugga

SEQ ID NO: 1111959 - RNA, 28 nt, Human
caagcaauccucccaccucggacuccca

SEQ ID NO: 1111960 - RNA, 27 nt, Human
caagcgauccucccaucucagccuccc

SEQ ID NO: 1111961 - RNA, 22 nt, Human
cacccccgucuccuccaaccac

SEQ ID NO: 1111962 - RNA, 21 nt, Human
caccucggacucccagguugc

SEQ ID NO: 1111963 - RNA, 24 nt, Human
cacuauauugcccaggcuggucuu

SEQ ID NO: 1111964 - RNA, 27 nt, Human
cacuauauugcccaggcuggucuugaa

SEQ ID NO: 1111965 - RNA, 24 nt, Human
cagcaugcacggcuaacuuaaaau

SEQ ID NO: 1111966 - RNA, 21 nt, Human
cagccucccgaguagcugggg

SEQ ID NO: 1111967 - RNA, 18 nt, Human
cagcugcuguuaggcuua

SEQ ID NO: 1111968 - RNA, 20 nt, Human
caucaccaccauccucucca

SEQ ID NO: 1111969 - RNA, 24 nt, Human
caucucagccucccgaguagcugg

SEQ ID NO: 1111970 - RNA, 22 nt, Human
caucuccucucccgcucuuguc

SEQ ID NO: 1111971 - RNA, 21 nt, Human
cauggcucacugcaaccuccg

SEQ ID NO: 1111972 - RNA, 22 nt, Human
ccaccagccacgcacgaggguc

SEQ ID NO: 1111973 - RNA, 21 nt, Human
ccaggccggacuacaguggca

SEQ ID NO: 1111974 - RNA, 21 nt, Human
ccagguugcugagauuacagg

SEQ ID NO: 1111975 - RNA, 24 nt, Human
ccagguugcugagauuacaggugu

SEQ ID NO: 1111976 - RNA, 23 nt, Human
ccaucucagccucccgaguagcu

SEQ ID NO: 1111977 - RNA, 20 nt, Human
cccagguucaagcgauucuc

SEQ ID NO: 1111978 - RNA, 19 nt, Human
cccccuccccagccccugg

SEQ ID NO: 1111979 - RNA, 26 nt, Human
ccccgucuccuccaaccacacaucca

SEQ ID NO: 1111980 - RNA, 18 nt, Human
cccgaguagcuggggcug

SEQ ID NO: 1111981 - RNA, 24 nt, Human
cccgucgccuaggcuggagugcag

SEQ ID NO: 1111982 - RNA, 21 nt, Human
cccugcugucaguucuguggg

SEQ ID NO: 1111983 - RNA, 19 nt, Human
cccuuccucucccucucuc

SEQ ID NO: 1111984 - RNA, 25 nt, Human
ccgccaucaccaccauccucuccag

SEQ ID NO: 1111985 - RNA, 21 nt, Human
ccguguuuaccaugugagaag

SEQ ID NO: 1111986 - RNA, 19 nt, Human
ccucucacugagcgugagg

SEQ ID NO: 1111987 - RNA, 22 nt, Human
ccugcugucaguucuguggggu

SEQ ID NO: 1111988 - RNA, 21 nt, Human
ccuggcacucacucauccuac

SEQ ID NO: 1111989 - RNA, 20 nt, Human
ccugggcucaagcgauccuc

SEQ ID NO: 1111990 - RNA, 26 nt, Human
ccugucccccuccccagccccuggca

SEQ ID NO: 1111991 - RNA, 19 nt, Human
ccuugaauuccugggcuca

SEQ ID NO: 1111992 - RNA, 23 nt, Human
ccuugaauuccugggcucaagcg

SEQ ID NO: 1111993 - RNA, 21 nt, Human
cgaucuguugcccaggccgga

SEQ ID NO: 1111994 - RNA, 24 nt, Human
cgccuaggcuggagugcaguggug

SEQ ID NO: 1111995 - RNA, 21 nt, Human
cgcugugcacuugugugugca

SEQ ID NO: 1111996 - RNA, 20 nt, Human
cgucgccuaggcuggagugc

SEQ ID NO: 1111997 - RNA, 25 nt, Human
cucaagcaauccucccaccucggac

SEQ ID NO: 1111998 - RNA, 24 nt, Human
cucaagcgauccucccaucucagc

SEQ ID NO: 1111999 - RNA, 23 nt, Human
cucacucccugucccccucccca

SEQ ID NO: 1112000 - RNA, 24 nt, Human
cucacugcaaccuccgucucccag

SEQ ID NO: 1112001 - RNA, 24 nt, Human
cucagccucccgaguagcuggggc

SEQ ID NO: 1112002 - RNA, 23 nt, Human
cuccaaggcugcuggcaggcccu

SEQ ID NO: 1112003 - RNA, 18 nt, Human
cuccagaacuuucuccuc

SEQ ID NO: 1112004 - RNA, 23 nt, Human
cucccaccucggacucccagguu

SEQ ID NO: 1112005 - RNA, 27 nt, Human
cuccuggucucaagcaauccucccacc

SEQ ID NO: 1112006 - RNA, 19 nt, Human
cucgugguuucuccaaggc

SEQ ID NO: 1112007 - RNA, 23 nt, Human
cugcaaccuccgucucccagguu

SEQ ID NO: 1112008 - RNA, 24 nt, Human
cugcaaccuccgucucccagguuc

SEQ ID NO: 1112009 - RNA, 18 nt, Human
cugccaggcugggccuug

SEQ ID NO: 1112010 - RNA, 22 nt, Human
cuggauccucucacugagcgug

SEQ ID NO: 1112011 - RNA, 21 nt, Human
cuggucucaagcaauccuccc

SEQ ID NO: 1112012 - RNA, 22 nt, Human
cuggucucaagcaauccuccca

SEQ ID NO: 1112013 - RNA, 22 nt, Human
cuguguuuauccacugaugggc

SEQ ID NO: 1112014 - RNA, 23 nt, Human
cuuccugucucugugaaucugac

SEQ ID NO: 1112015 - RNA, 19 nt, Human
gaucauggcucacugcaac

SEQ ID NO: 1112016 - RNA, 19 nt, Human
gauccucucacugagcgug

SEQ ID NO: 1112017 - RNA, 18 nt, Human
gauuacaggugugagcca

SEQ ID NO: 1112018 - RNA, 24 nt, Human
gauuacaggugugagccacugugc

SEQ ID NO: 1112019 - RNA, 22 nt, Human
gcaaccuccgucucccagguuc

SEQ ID NO: 1112020 - RNA, 22 nt, Human
gcaauccucccaccucggacuc

SEQ ID NO: 1112021 - RNA, 19 nt, Human
gccggaagauggggcuugg

SEQ ID NO: 1112022 - RNA, 20 nt, Human
gccuaggcuggagugcagug

SEQ ID NO: 1112023 - RNA, 23 nt, Human
gccuaggcuggagugcaguggug

SEQ ID NO: 1112024 - RNA, 22 nt, Human
gccuuguuccauccccaccagc

SEQ ID NO: 1112025 - RNA, 23 nt, Human
ggccuuguuccauccccaccagc

SEQ ID NO: 1112026 - RNA, 24 nt, Human
ggcuggucuugaacuccuggucuc

SEQ ID NO: 1112027 - RNA, 23 nt, Human
ggcuguugggaaucaugccgcug

SEQ ID NO: 1112028 - RNA, 18 nt, Human
gggaagaaaggcugguug

SEQ ID NO: 1112029 - RNA, 22 nt, Human
gggcgccugggguggcuuccac

SEQ ID NO: 1112030 - RNA, 19 nt, Human
guggaucugccuguucugg

SEQ ID NO: 1112031 - RNA, 21 nt, Human
guugcccaggccggacuacag

SEQ ID NO: 1112032 - RNA, 18 nt, Human
uaaauggaaaccccgucc

SEQ ID NO: 1112033 - RNA, 24 nt, Human
uaacgaucuguugcccaggccgga

SEQ ID NO: 1112034 - RNA, 21 nt, Human
uacaggugugagccacugugc

SEQ ID NO: 1112035 - RNA, 20 nt, Human
uauauugcccaggcuggucu

SEQ ID NO: 1112036 - RNA, 23 nt, Human
uauauugcccaggcuggucuuga

SEQ ID NO: 1112037 - RNA, 24 nt, Human
uauauugcccaggcuggucuugaa

SEQ ID NO: 1112038 - RNA, 18 nt, Human
ucacugagcgugaggucc

SEQ ID NO: 1112039 - RNA, 23 nt, Human
ucacugagcgugagguccucaag

SEQ ID NO: 1112040 - RNA, 19 nt, Human
ucacugcaaccuccgucuc

SEQ ID NO: 1112041 - RNA, 24 nt, Human
ucacugcaaccuccgucucccagg

SEQ ID NO: 1112042 - RNA, 25 nt, Human
ucacugcaaccuccgucucccaggu

SEQ ID NO: 1112043 - RNA, 21 nt, Human
ucagcccuuccucucccucuc

SEQ ID NO: 1112044 - RNA, 23 nt, Human
ucagccucccgaguagcuggggc

SEQ ID NO: 1112045 - RNA, 22 nt, Human
uccaaggcugcuggcaggcccu

SEQ ID NO: 1112046 - RNA, 22 nt, Human
uccagaacuuucuccucuuccc

SEQ ID NO: 1112047 - RNA, 19 nt, Human
uccauccccaccagccacg

SEQ ID NO: 1112048 - RNA, 23 nt, Human
uccaugcauauucucuguggauc

SEQ ID NO: 1112049 - RNA, 21 nt, Human
ucccagguucaagcgauucuc

SEQ ID NO: 1112050 - RNA, 24 nt, Human
ucccagguucaagcgauucucccg

SEQ ID NO: 1112051 - RNA, 23 nt, Human
ucccagguugcugagauuacagg

SEQ ID NO: 1112052 - RNA, 26 nt, Human
uccccagccccuggcacucacucauc

SEQ ID NO: 1112053 - RNA, 22 nt, Human
uccccaugaaacacucacuccc

SEQ ID NO: 1112054 - RNA, 20 nt, Human
ucccgaguagcuggggcugc

SEQ ID NO: 1112055 - RNA, 21 nt, Human
ucccucucucuuuucucacua

SEQ ID NO: 1112056 - RNA, 22 nt, Human
ucccugucccccuccccagccc

SEQ ID NO: 1112057 - RNA, 26 nt, Human
uccucccaucucagccucccgaguag

SEQ ID NO: 1112058 - RNA, 21 nt, Human
uccugggcucaagcgauccuc

SEQ ID NO: 1112059 - RNA, 24 nt, Human
uccugggcucaagcgauccuccca

SEQ ID NO: 1112060 - RNA, 18 nt, Human
uccuuuuuuuuuuuuuuu

SEQ ID NO: 1112061 - RNA, 18 nt, Human
uccuuuuuuuuuuuuuuu

SEQ ID NO: 1112062 - RNA, 24 nt, Human
ucgccuaggcuggagugcaguggu

SEQ ID NO: 1112063 - RNA, 24 nt, Human
ucggugaagccuugaauuccuggg

SEQ ID NO: 1112064 - RNA, 23 nt, Human
ucucacuacaauguugugccgcc

SEQ ID NO: 1112065 - RNA, 23 nt, Human
ucucacuauauugcccaggcugg

SEQ ID NO: 1112066 - RNA, 26 nt, Human
ucucacuauauugcccaggcuggucu

SEQ ID NO: 1112067 - RNA, 27 nt, Human
ucucacuauauugcccaggcuggucuu

SEQ ID NO: 1112068 - RNA, 24 nt, Human
ucucccagguucaagcgauucucc

SEQ ID NO: 1112069 - RNA, 19 nt, Human
ucuccucuucccaaacuga

SEQ ID NO: 1112070 - RNA, 20 nt, Human
ucucuuucuuuuuucuuuuu

SEQ ID NO: 1112071 - RNA, 18 nt, Human
ucuguccccaugaaacac

SEQ ID NO: 1112072 - RNA, 24 nt, Human
ucuguugcccaggccggacuacag

SEQ ID NO: 1112073 - RNA, 18 nt, Human
ucuguuucuccaucuccu

SEQ ID NO: 1112074 - RNA, 21 nt, Human
ucuugaacuccuggucucaag

SEQ ID NO: 1112075 - RNA, 23 nt, Human
ucuugccccgucgccuaggcugg

SEQ ID NO: 1112076 - RNA, 24 nt, Human
ucuugccccgucgccuaggcugga

SEQ ID NO: 1112077 - RNA, 21 nt, Human
ucuuucagucccugcugucag

SEQ ID NO: 1112078 - RNA, 20 nt, Human
ucuuuucuucuagagauggg

SEQ ID NO: 1112079 - RNA, 23 nt, Human
ugaaacacucacucccugucccc

SEQ ID NO: 1112080 - RNA, 24 nt, Human
ugaacuccuggucucaagcaaucc

SEQ ID NO: 1112081 - RNA, 19 nt, Human
ugagacagagucuugcccc

SEQ ID NO: 1112082 - RNA, 22 nt, Human
ugagacagagucuugccccguc

SEQ ID NO: 1112083 - RNA, 21 nt, Human
ugagauuacaggugugagcca

SEQ ID NO: 1112084 - RNA, 22 nt, Human
ugagauuacaggugugagccac

SEQ ID NO: 1112085 - RNA, 22 nt, Human
ugagauuacaggugugagccac

SEQ ID NO: 1112086 - RNA, 22 nt, Human
ugagauuacaggugugagccac

SEQ ID NO: 1112087 - RNA, 24 nt, Human
ugagauuacaggugugagccacug

SEQ ID NO: 1112088 - RNA, 22 nt, Human
ugcaaacaccucuuucaguccc

SEQ ID NO: 1112089 - RNA, 24 nt, Human
ugcagacaugaaccagcaugcacg

SEQ ID NO: 1112090 - RNA, 23 nt, Human
ugcaguggugcgaucauggcuca

SEQ ID NO: 1112091 - RNA, 20 nt, Human
ugcccaggccggacuacagu

SEQ ID NO: 1112092 - RNA, 24 nt, Human
ugcccaggcuggucuugaacuccu

SEQ ID NO: 1112093 - RNA, 24 nt, Human
ugccccgucgccuaggcuggagug

SEQ ID NO: 1112094 - RNA, 20 nt, Human
ugcugagauuacagguguga

SEQ ID NO: 1112095 - RNA, 24 nt, Human
ugcugagauuacaggugugagcca

SEQ ID NO: 1112096 - RNA, 21 nt, Human
uggagugcaguggugcgauca

SEQ ID NO: 1112097 - RNA, 24 nt, Human
uggagugcaguggugcgaucaugg

SEQ ID NO: 1112098 - RNA, 18 nt, Human
uggcugaauuccagaacu

SEQ ID NO: 1112099 - RNA, 21 nt, Human
ugggauugcugggcccuaugg

SEQ ID NO: 1112100 - RNA, 23 nt, Human
uggggcuuggggcuuucagcccu

SEQ ID NO: 1112101 - RNA, 24 nt, Human
uggggucucacuauauugcccagg

SEQ ID NO: 1112102 - RNA, 21 nt, Human
uggucucaagcaauccuccca

SEQ ID NO: 1112103 - RNA, 21 nt, Human
ugguuggaccaugcuguguuu

SEQ ID NO: 1112104 - RNA, 19 nt, Human
ugucugguuggaccaugcu

SEQ ID NO: 1112105 - RNA, 18 nt, Human
ugugagaagcugccaggc

SEQ ID NO: 1112106 - RNA, 20 nt, Human
uguucuggaaauuucuccuu

SEQ ID NO: 1112107 - RNA, 22 nt, Human
uuagcagucacccccgucuccu

SEQ ID NO: 1112108 - RNA, 19 nt, Human
uucaaacucaacggugagg

SEQ ID NO: 1112109 - RNA, 20 nt, Human
uucagcccuuccucucccuc

SEQ ID NO: 1112110 - RNA, 19 nt, Human
uucccuuccuuuucauggc

SEQ ID NO: 1112111 - RNA, 23 nt, Human
uuccugggcucaagcgauccucc

SEQ ID NO: 1112112 - RNA, 24 nt, Human
uugccccgucgccuaggcuggagu

SEQ ID NO: 1112113 - RNA, 22 nt, Human
uugcugggcccuaugguaauuc

SEQ ID NO: 1112114 - RNA, 25 nt, Human
uuucauggcugcguaauauuccacu

SEQ ID NO: 1112115 - RNA, 21 nt, Human
uuucuuuuuucuuuuucuuuu

SEQ ID NO: 1112116 - RNA, 18 nt, Human
uuuuuuuuuuuuuuuuug

SEQ ID NO: 1112117 - RNA, 23 nt, Human
uuuuuuuuuuuuuuuuuuguuuu

SEQ ID NO: 1112118 - RNA, 25 nt, Human
aaacauuuacauaaugguggaaaua

SEQ ID NO: 1112119 - RNA, 18 nt, Human
aaccaggaagaagagcug

SEQ ID NO: 1112120 - RNA, 23 nt, Human
aaccaggaagaagagcugggccc

SEQ ID NO: 1112121 - RNA, 22 nt, Human
aagauaaacaaauuagaggcca

SEQ ID NO: 1112122 - RNA, 21 nt, Human
aaguggccgaaaggcaggagc

SEQ ID NO: 1112123 - RNA, 20 nt, Human
agaggcugacuugaggaggu

SEQ ID NO: 1112124 - RNA, 23 nt, Human
agauaaacaaauuagaggccaag

SEQ ID NO: 1112125 - RNA, 19 nt, Human
aggaagaagagcugggccc

SEQ ID NO: 1112126 - RNA, 18 nt, Human
aggcaggagcuggaccug

SEQ ID NO: 1112127 - RNA, 26 nt, Human
auaauaaggaaaauaaaauaaaaaac

SEQ ID NO: 1112128 - RNA, 21 nt, Human
augggccugaagaggccacug

SEQ ID NO: 1112129 - RNA, 18 nt, Human
auuaccuaccaaaacauu

SEQ ID NO: 1112130 - RNA, 24 nt, Human
caaauaaauuaccuaccaaaacau

SEQ ID NO: 1112131 - RNA, 20 nt, Human
caaauaauaaggaaaauaaa

SEQ ID NO: 1112132 - RNA, 18 nt, Human
caucggagggcaggagcu

SEQ ID NO: 1112133 - RNA, 18 nt, Human
ccccaugggccugaagag

SEQ ID NO: 1112134 - RNA, 19 nt, Human
cgaccaaggccgccaggag

SEQ ID NO: 1112135 - RNA, 21 nt, Human
cgcccggagggugcaaguggg

SEQ ID NO: 1112136 - RNA, 18 nt, Human
cuaaagaggccacuggca

SEQ ID NO: 1112137 - RNA, 18 nt, Human
cugaagaggccacuggca

SEQ ID NO: 1112138 - RNA, 19 nt, Human
cugggcccggagaggccgc

SEQ ID NO: 1112139 - RNA, 18 nt, Human
cugggccuaaagaggcca

SEQ ID NO: 1112140 - RNA, 22 nt, Human
gagggcaggagcucauccugga

SEQ ID NO: 1112141 - RNA, 21 nt, Human
gcaagugggucuggagaggcu

SEQ ID NO: 1112142 - RNA, 25 nt, Human
gccgaaaggcaggagcuuuggacug

SEQ ID NO: 1112143 - RNA, 21 nt, Human
ggaagggaaaaacggggccug

SEQ ID NO: 1112144 - RNA, 19 nt, Human
ggagacccaaccaggaaga

SEQ ID NO: 1112145 - RNA, 18 nt, Human
ggccuggaauggccgacg

SEQ ID NO: 1112146 - RNA, 24 nt, Human
gggaaaaacggggccuggaauggc

SEQ ID NO: 1112147 - RNA, 23 nt, Human
gggcaggagcucauccuggagag

SEQ ID NO: 1112148 - RNA, 19 nt, Human
gguucugggcccggagagg

SEQ ID NO: 1112149 - RNA, 21 nt, Human
uaaacaaauuagaggccaaga

SEQ ID NO: 1112150 - RNA, 22 nt, Human
uaccuaccaaaacauuuacaua

SEQ ID NO: 1112151 - RNA, 20 nt, Human
ugaaagguugggagcuuggc

SEQ ID NO: 1112152 - RNA, 22 nt, Human
ugaaagguugggagcuuggcuu

SEQ ID NO: 1112153 - RNA, 25 nt, Human
ugccggaagggaaaaacggggccug

SEQ ID NO: 1112154 - RNA, 18 nt, Human
uggagaggccaccgugag

SEQ ID NO: 1112155 - RNA, 20 nt, Human
uggagaggcugacuugagga

SEQ ID NO: 1112156 - RNA, 22 nt, Human
uggcaggcaggagcuggaccug

SEQ ID NO: 1112157 - RNA, 20 nt, Human
ugggccgaccaaggccgcca

SEQ ID NO: 1112158 - RNA, 20 nt, Human
ugggccuaaagaggccacug

SEQ ID NO: 1112159 - RNA, 24 nt, Human
uggggccuggagaugccaucggag

SEQ ID NO: 1112160 - RNA, 19 nt, Human
uggguaggcacugagucca

SEQ ID NO: 1112161 - RNA, 23 nt, Human
aaagauaaacaaauuagaggcca

SEQ ID NO: 1112162 - RNA, 23 nt, Human
agauaaacaaauuagaggccaag

SEQ ID NO: 1112163 - RNA, 22 nt, Human
auaaacaaauuagaggccaaga

SEQ ID NO: 1112164 - RNA, 21 nt, Human
ggaagggaaaaacggggccug

SEQ ID NO: 1112165 - RNA, 18 nt, Human
ggccuggaauggccgacg

SEQ ID NO: 1112166 - RNA, 24 nt, Human
gggaaaaacggggccuggaauggc

SEQ ID NO: 1112167 - RNA, 23 nt, Human
ugccggaagggaaaaacggggcc

SEQ ID NO: 1112168 - RNA, 22 nt, Human
aaagacguuguugggaccugga

SEQ ID NO: 1112169 - RNA, 27 nt, Human
aaauggccucacagucauaaguugggc

SEQ ID NO: 1112170 - RNA, 20 nt, Human
aagacguuguugggaccugg

SEQ ID NO: 1112171 - RNA, 21 nt, Human
aagcggccgagaggcaggagc

SEQ ID NO: 1112172 - RNA, 24 nt, Human
agacagaaguugggcaaaagccug

SEQ ID NO: 1112173 - RNA, 26 nt, Human
agacagaaguugggcaaaagggaccc

SEQ ID NO: 1112174 - RNA, 19 nt, Human
aggcacuaggccuggaaau

SEQ ID NO: 1112175 - RNA, 22 nt, Human
aggcaggagcuucaccugagga

SEQ ID NO: 1112176 - RNA, 25 nt, Human
aggcaggagcuucaccugaggaugc

SEQ ID NO: 1112177 - RNA, 19 nt, Human
aggcaggaggagcugggcc

SEQ ID NO: 1112178 - RNA, 21 nt, Human
aggcaggaggagcugggccug

SEQ ID NO: 1112179 - RNA, 19 nt, Human
aggcaggaggcugggccuu

SEQ ID NO: 1112180 - RNA, 20 nt, Human
aggcaugagcugggcugggc

SEQ ID NO: 1112181 - RNA, 23 nt, Human
agggaaguugugggccuaccagg

SEQ ID NO: 1112182 - RNA, 19 nt, Human
aucugggucuggagggucc

SEQ ID NO: 1112183 - RNA, 19 nt, Human
caacuugggccugcggcgg

SEQ ID NO: 1112184 - RNA, 21 nt, Human
cacuaggccuggaaauggccu

SEQ ID NO: 1112185 - RNA, 19 nt, Human
caucggagggccaggagcu

SEQ ID NO: 1112186 - RNA, 21 nt, Human
ccaccgaaagucaaaagcggg

SEQ ID NO: 1112187 - RNA, 21 nt, Human
ccaccgaccggagaccauuug

SEQ ID NO: 1112188 - RNA, 25 nt, Human
cccaccgaccggagaccauuugggg

SEQ ID NO: 1112189 - RNA, 25 nt, Human
cccaccgaccggaggccauuugggg

SEQ ID NO: 1112190 - RNA, 22 nt, Human
cgaccggagaccauuuggggcc

SEQ ID NO: 1112191 - RNA, 22 nt, Human
cgaccggaggccauuuggggcc

SEQ ID NO: 1112192 - RNA, 20 nt, Human
cgccgggaggcaugagcugg

SEQ ID NO: 1112193 - RNA, 22 nt, Human
cgggagcugggccugccgaagc

SEQ ID NO: 1112194 - RNA, 19 nt, Human
cgggccagaguccggccug

SEQ ID NO: 1112195 - RNA, 18 nt, Human
cugaagaggccacuggca

SEQ ID NO: 1112196 - RNA, 19 nt, Human
gaggcaggaggagcugggc

SEQ ID NO: 1112197 - RNA, 24 nt, Human
gccgaaaggcaggagcuucaccug

SEQ ID NO: 1112198 - RNA, 23 nt, Human
gccugcggcggucgccgggaggc

SEQ ID NO: 1112199 - RNA, 18 nt, Human
gcgggagcugggccugcc

SEQ ID NO: 1112200 - RNA, 24 nt, Human
gcguggaggagcccaccgaccgga

SEQ ID NO: 1112201 - RNA, 18 nt, Human
ggaaggccgccgggaggc

SEQ ID NO: 1112202 - RNA, 24 nt, Human
ggagaggccaccgcgaggccugag

SEQ ID NO: 1112203 - RNA, 20 nt, Human
ggaggcaggaggcugggccc

SEQ ID NO: 1112204 - RNA, 20 nt, Human
gggaggcaugagcugggcug

SEQ ID NO: 1112205 - RNA, 23 nt, Human
gggaggcaugagcugggcugggc

SEQ ID NO: 1112206 - RNA, 25 nt, Human
gggcaaaagccugauuugaggaagu

SEQ ID NO: 1112207 - RNA, 22 nt, Human
gggccagaguccggccuggaga

SEQ ID NO: 1112208 - RNA, 19 nt, Human
gggccgcugggagcugggc

SEQ ID NO: 1112209 - RNA, 19 nt, Human
gggcugggccgaaagaggc

SEQ ID NO: 1112210 - RNA, 18 nt, Human
gggcuugggaaggccgcc

SEQ ID NO: 1112211 - RNA, 18 nt, Human
gugaggcagaggcugacc

SEQ ID NO: 1112212 - RNA, 19 nt, Human
gugaggcagaggcugggcc

SEQ ID NO: 1112213 - RNA, 19 nt, Human
uccacugugaggcagaggc

SEQ ID NO: 1112214 - RNA, 20 nt, Human
uccacugugaggcagaggcu

SEQ ID NO: 1112215 - RNA, 20 nt, Human
uccgcugugaggcagaggcu

SEQ ID NO: 1112216 - RNA, 23 nt, Human
ugagcugggcugggccgaaagag

SEQ ID NO: 1112217 - RNA, 25 nt, Human
ugaggaugccacagugagacaccau

SEQ ID NO: 1112218 - RNA, 19 nt, Human
ugaggcagaggcugaccug

SEQ ID NO: 1112219 - RNA, 18 nt, Human
ugaggcagaggcugggcc

SEQ ID NO: 1112220 - RNA, 18 nt, Human
ugaggcagaggcugggcc

SEQ ID NO: 1112221 - RNA, 23 nt, Human
ugaguccaaagacguuguuggga

SEQ ID NO: 1112222 - RNA, 22 nt, Human
uggcaggcgggagcugggccug

SEQ ID NO: 1112223 - RNA, 20 nt, Human
ugggaggcaggaggagcugg

SEQ ID NO: 1112224 - RNA, 21 nt, Human
ugggaggcaggaggagcuggg

SEQ ID NO: 1112225 - RNA, 21 nt, Human
ugggcaaaagccugauuugag

SEQ ID NO: 1112226 - RNA, 26 nt, Human
ugggcaaaagccugauuugaggaagu

SEQ ID NO: 1112227 - RNA, 24 nt, Human
uggggccuggagaugccaucggag

SEQ ID NO: 1112228 - RNA, 18 nt, Human
ugugaggcagaggcuggg

SEQ ID NO: 1112229 - RNA, 22 nt, Human
uguugggaccuggagucgggcc

SEQ ID NO: 1112230 - RNA, 19 nt, Human
uuuggggccuggagaugcc

SEQ ID NO: 1112231 - RNA, 24 nt, Human
aaauaagucuugggaagaagccaa

SEQ ID NO: 1112232 - RNA, 19 nt, Human
aacaagggcgggucagagc

SEQ ID NO: 1112233 - RNA, 18 nt, Human
aagaagacgggcgugcug

SEQ ID NO: 1112234 - RNA, 19 nt, Human
aaggagcuuguagcacagg

SEQ ID NO: 1112235 - RNA, 18 nt, Human
aaucaggaacaggcaggc

SEQ ID NO: 1112236 - RNA, 23 nt, Human
agagggguguguguguuucagag

SEQ ID NO: 1112237 - RNA, 19 nt, Human
agccaacacuauggcugca

SEQ ID NO: 1112238 - RNA, 24 nt, Human
caaaagagggcagaaguccagaga

SEQ ID NO: 1112239 - RNA, 23 nt, Human
cacccaguauuacugaggagcac

SEQ ID NO: 1112240 - RNA, 19 nt, Human
caggaacaggcaggcagag

SEQ ID NO: 1112241 - RNA, 23 nt, Human
ccccgacucccaggccagggaga

SEQ ID NO: 1112242 - RNA, 21 nt, Human
ccccuguacaguugacccacc

SEQ ID NO: 1112243 - RNA, 22 nt, Human
cccgacucccaggccagggaga

SEQ ID NO: 1112244 - RNA, 24 nt, Human
ccuauaacaagggcgggucagagc

SEQ ID NO: 1112245 - RNA, 20 nt, Human
cgaccccucagguugguccc

SEQ ID NO: 1112246 - RNA, 22 nt, Human
cucugagaccccgacucccagg

SEQ ID NO: 1112247 - RNA, 22 nt, Human
cugccucugcugccacauaugu

SEQ ID NO: 1112248 - RNA, 24 nt, Human
gcugcagaaaacagagaacacagg

SEQ ID NO: 1112249 - RNA, 22 nt, Human
gcuguaaucaagcugccugguc

SEQ ID NO: 1112250 - RNA, 20 nt, Human
ggcagagggguguguguguu

SEQ ID NO: 1112251 - RNA, 25 nt, Human
ggcccuugaugcuguaaucaagcug

SEQ ID NO: 1112252 - RNA, 19 nt, Human
gucacucaagugagucacc

SEQ ID NO: 1112253 - RNA, 20 nt, Human
uaagucuugggaagaagcca

SEQ ID NO: 1112254 - RNA, 18 nt, Human
uagguguuucucugagac

SEQ ID NO: 1112255 - RNA, 25 nt, Human
uauggcugcagaaaacagagaacac

SEQ ID NO: 1112256 - RNA, 19 nt, Human
ucaggaacaggcaggcaga

SEQ ID NO: 1112257 - RNA, 18 nt, Human
ucucugagaccccgacuc

SEQ ID NO: 1112258 - RNA, 27 nt, Human
ucucugagaccccgacucccaggccag

SEQ ID NO: 1112259 - RNA, 18 nt, Human
ugaggagcacuccacaug

SEQ ID NO: 1112260 - RNA, 24 nt, Human
ugcagaaaacagagaacacagggg

SEQ ID NO: 1112261 - RNA, 23 nt, Human
ugccugguccugaaacucucacu

SEQ ID NO: 1112262 - RNA, 21 nt, Human
ugggaagaagccaacacuaug

SEQ ID NO: 1112263 - RNA, 18 nt, Human
uggucccgggcagcacac

SEQ ID NO: 1112264 - RNA, 22 nt, Human
aaaaaucugcaucccguucccc

SEQ ID NO: 1112265 - RNA, 21 nt, Human
aagaaagaaaggggaaggaag

SEQ ID NO: 1112266 - RNA, 19 nt, Human
aaggaaggaaaagaaaaaa

SEQ ID NO: 1112267 - RNA, 20 nt, Human
accuuguaauucugacacug

SEQ ID NO: 1112268 - RNA, 18 nt, Human
aggaaggaaaagaaaaaa

SEQ ID NO: 1112269 - RNA, 23 nt, Human
aggaaggaaaagaaaaaaaaaau

SEQ ID NO: 1112270 - RNA, 21 nt, Human
aggaaggaaggaaggaaggaa

SEQ ID NO: 1112271 - RNA, 24 nt, Human
aggaaggaaggaaguuggaaggaa

SEQ ID NO: 1112272 - RNA, 22 nt, Human
agguaaaagccaagaggcucuc

SEQ ID NO: 1112273 - RNA, 24 nt, Human
augggagauguaucugugcagaga

SEQ ID NO: 1112274 - RNA, 24 nt, Human
cacacagucgcagccaaggcagcc

SEQ ID NO: 1112275 - RNA, 24 nt, Human
cagccaaggcagccugggccuggg

SEQ ID NO: 1112276 - RNA, 24 nt, Human
cagcuggacuagcacucgcaucca

SEQ ID NO: 1112277 - RNA, 22 nt, Human
cagguaaaagccaagaggcucu

SEQ ID NO: 1112278 - RNA, 19 nt, Human
ccugcucugcggcuucauc

SEQ ID NO: 1112279 - RNA, 18 nt, Human
ccuuguguucuauaugac

SEQ ID NO: 1112280 - RNA, 23 nt, Human
cgcagccaaggcagccugggccu

SEQ ID NO: 1112281 - RNA, 19 nt, Human
cugcaggcacacagucgca

SEQ ID NO: 1112282 - RNA, 23 nt, Human
cugcaucccguuccccaccgagu

SEQ ID NO: 1112283 - RNA, 21 nt, Human
cuuguaauucugacacugugu

SEQ ID NO: 1112284 - RNA, 20 nt, Human
gaaggaaaagaaaaaaaaaa

SEQ ID NO: 1112285 - RNA, 22 nt, Human
gaaggaaggaaggaaguuggaa

SEQ ID NO: 1112286 - RNA, 23 nt, Human
gacacugugucucccgggcuugu

SEQ ID NO: 1112287 - RNA, 20 nt, Human
gauguguguguuggccuugu

SEQ ID NO: 1112288 - RNA, 18 nt, Human
gcagaccagguaaaagcc

SEQ ID NO: 1112289 - RNA, 19 nt, Human
gccucagcucccugcucug

SEQ ID NO: 1112290 - RNA, 21 nt, Human
gcuguggugaguuuuucccca

SEQ ID NO: 1112291 - RNA, 22 nt, Human
gggaaggaaggaaggaaguugg

SEQ ID NO: 1112292 - RNA, 23 nt, Human
ggggaaggaaggaaggaaguugg

SEQ ID NO: 1112293 - RNA, 21 nt, Human
uagaugggauaguggucucuc

SEQ ID NO: 1112294 - RNA, 21 nt, Human
uagcuuggccgggcggcugau

SEQ ID NO: 1112295 - RNA, 22 nt, Human
ucagcuguggugaguuuuuccc

SEQ ID NO: 1112296 - RNA, 23 nt, Human
uccccaguguccacuggaucagg

SEQ ID NO: 1112297 - RNA, 23 nt, Human
ucgcagccaaggcagccugggcc

SEQ ID NO: 1112298 - RNA, 22 nt, Human
ucucugcagauugguccuuguu

SEQ ID NO: 1112299 - RNA, 18 nt, Human
ucugcaucccguucccca

SEQ ID NO: 1112300 - RNA, 23 nt, Human
uggugaguuuuuccccagugucc

SEQ ID NO: 1112301 - RNA, 20 nt, Human
uuccccaguguccacuggau

SEQ ID NO: 1112302 - RNA, 22 nt, Human
uuggaaggaaggaaggaaggaa

SEQ ID NO: 1112303 - RNA, 22 nt, Human
uuggaugcucuuucucugcaga

SEQ ID NO: 1112304 - RNA, 21 nt, Human
uuggugguagagaggcuccuu

SEQ ID NO: 1112305 - RNA, 20 nt, Human
uuuaugggagauguaucugu

SEQ ID NO: 1112306 - RNA, 23 nt, Human
uuucucgcagaccagguaaaagc

SEQ ID NO: 1112307 - RNA, 18 nt, Human
aaaaaaagcaaaaaauuc

SEQ ID NO: 1112308 - RNA, 22 nt, Human
aaaaaaccacaucaaacaaugg

SEQ ID NO: 1112309 - RNA, 21 nt, Human
aaaaaaguagauguggccagg

SEQ ID NO: 1112310 - RNA, 22 nt, Human
aaaaaaguagauguggccaggc

SEQ ID NO: 1112311 - RNA, 18 nt, Human
aaaagaaacaaacuaucc

SEQ ID NO: 1112312 - RNA, 18 nt, Human
aaaaucagcugggcgugg

SEQ ID NO: 1112313 - RNA, 21 nt, Human
aaacuauccaaauuggaaaug

SEQ ID NO: 1112314 - RNA, 24 nt, Human
aaagaaacaaacuauccaaauugg

SEQ ID NO: 1112315 - RNA, 18 nt, Human
aaaugcaucaaagaccua

SEQ ID NO: 1112316 - RNA, 19 nt, Human
aacauggugaaaccccguc

SEQ ID NO: 1112317 - RNA, 20 nt, Human
aacauggugaaaccccgucu

SEQ ID NO: 1112318 - RNA, 21 nt, Human
aacauggugaaaccccgucuc

SEQ ID NO: 1112319 - RNA, 20 nt, Human
aagcaggauuguagggcggu

SEQ ID NO: 1112320 - RNA, 25 nt, Human
aagcccgggagacacagugucagaa

SEQ ID NO: 1112321 - RNA, 22 nt, Human
aagccgacaagcccgggagaca

SEQ ID NO: 1112322 - RNA, 19 nt, Human
aagcucaggaacaaggcaa

SEQ ID NO: 1112323 - RNA, 24 nt, Human
aaucgcuugaacccaggaggugga

SEQ ID NO: 1112324 - RNA, 23 nt, Human
acagagcgagacucugucucaaa

SEQ ID NO: 1112325 - RNA, 24 nt, Human
accccgucucuacuaaaaauacaa

SEQ ID NO: 1112326 - RNA, 22 nt, Human
accucauggaugcagagaaaag

SEQ ID NO: 1112327 - RNA, 22 nt, Human
acgaggucaagagauugagacc

SEQ ID NO: 1112328 - RNA, 23 nt, Human
agaaaacaucaugacaauaucac

SEQ ID NO: 1112329 - RNA, 20 nt, Human
agaauuaaaaagaaacaaac

SEQ ID NO: 1112330 - RNA, 24 nt, Human
agaauuacaaggugagaucagccg

SEQ ID NO: 1112331 - RNA, 21 nt, Human
agccuggugacagagcgagac

SEQ ID NO: 1112332 - RNA, 23 nt, Human
agccuggugacagagcgagacuc

SEQ ID NO: 1112333 - RNA, 23 nt, Human
agcugggcgugguggcgcaugcc

SEQ ID NO: 1112334 - RNA, 24 nt, Human
aggcagccggauaacgaggucaag

SEQ ID NO: 1112335 - RNA, 24 nt, Human
aggcaugguggcucacgccuguaa

SEQ ID NO: 1112336 - RNA, 24 nt, Human
aggcugaggcauaagaaucgcuug

SEQ ID NO: 1112337 - RNA, 20 nt, Human
aggggcuccguagaggaggg

SEQ ID NO: 1112338 - RNA, 21 nt, Human
agguggagguugcagugagcc

SEQ ID NO: 1112339 - RNA, 24 nt, Human
agguggagguugcagugagccgag

SEQ ID NO: 1112340 - RNA, 21 nt, Human
auccuggucaacauggugaaa

SEQ ID NO: 1112341 - RNA, 18 nt, Human
auguggaaagcucuagag

SEQ ID NO: 1112342 - RNA, 18 nt, Human
auuacaguggcagcagcg

SEQ ID NO: 1112343 - RNA, 22 nt, Human
auucuuagaaugcaaggauauc

SEQ ID NO: 1112344 - RNA, 26 nt, Human
auuucuauuccacauaguguuggaag

SEQ ID NO: 1112345 - RNA, 20 nt, Human
caacauggugaaaccccguc

SEQ ID NO: 1112346 - RNA, 22 nt, Human
caacauggugaaaccccgucuc

SEQ ID NO: 1112347 - RNA, 24 nt, Human
caacauggugaaaccccgucucua

SEQ ID NO: 1112348 - RNA, 25 nt, Human
caagcacauuuacaauagcacugaa

SEQ ID NO: 1112349 - RNA, 19 nt, Human
caaggauaucuuaaaacau

SEQ ID NO: 1112350 - RNA, 18 nt, Human
caagugcaauuuauucuu

SEQ ID NO: 1112351 - RNA, 20 nt, Human
cacacaaaaaguauuacaac

SEQ ID NO: 1112352 - RNA, 24 nt, Human
caccacgaccaagugcaauuuauu

SEQ ID NO: 1112353 - RNA, 24 nt, Human
cacgccuguaaucccagcacuuug

SEQ ID NO: 1112354 - RNA, 20 nt, Human
cacuguacagccuggugaca

SEQ ID NO: 1112355 - RNA, 20 nt, Human
cacuguacagccuggugaca

SEQ ID NO: 1112356 - RNA, 24 nt, Human
cacuguacagccuggugacagagc

SEQ ID NO: 1112357 - RNA, 24 nt, Human
cagcacuuugggaggaggaggcag

SEQ ID NO: 1112358 - RNA, 24 nt, Human
cagcagcgucccugugcgaggucu

SEQ ID NO: 1112359 - RNA, 29 nt, Human
caggagguggagguugcagugacaacggu

SEQ ID NO: 1112360 - RNA, 24 nt, Human
caggagguggagguugcagugagc

SEQ ID NO: 1112361 - RNA, 19 nt, Human
cagugucagaauuacaagg

SEQ ID NO: 1112362 - RNA, 26 nt, Human
ccacacaaaaaguauuacaacuaaua

SEQ ID NO: 1112363 - RNA, 22 nt, Human
ccaggagguggagguugcagug

SEQ ID NO: 1112364 - RNA, 21 nt, Human
cccaggagguggagguugcag

SEQ ID NO: 1112365 - RNA, 22 nt, Human
cccgggagacacagugucagaa

SEQ ID NO: 1112366 - RNA, 19 nt, Human
cccgugaacagccaagcuc

SEQ ID NO: 1112367 - RNA, 21 nt, Human
ccgggagacacagugucagaa

SEQ ID NO: 1112368 - RNA, 22 nt, Human
ccuggucaacauggugaaaccc

SEQ ID NO: 1112369 - RNA, 23 nt, Human
ccuggucaacauggugaaacccc

SEQ ID NO: 1112370 - RNA, 24 nt, Human
ccuggucaacauggugaaaccccg

SEQ ID NO: 1112371 - RNA, 19 nt, Human
ccuggucugcgagaaauca

SEQ ID NO: 1112372 - RNA, 21 nt, Human
ccuggugacagagcgagacuc

SEQ ID NO: 1112373 - RNA, 22 nt, Human
ccuguaaucccagcacuuuggg

SEQ ID NO: 1112374 - RNA, 21 nt, Human
ccuguagucccagauacuugg

SEQ ID NO: 1112375 - RNA, 22 nt, Human
cgcaguaaaauugcuccuccag

SEQ ID NO: 1112376 - RNA, 19 nt, Human
cuaacccaggugugggccc

SEQ ID NO: 1112377 - RNA, 22 nt, Human
cucacgccuguaaucccagcac

SEQ ID NO: 1112378 - RNA, 24 nt, Human
cucacgccuguaaucccagcacuu

SEQ ID NO: 1112379 - RNA, 18 nt, Human
cuucugcucuaagcucag

SEQ ID NO: 1112380 - RNA, 21 nt, Human
cuuugggaggaggaggcagcc

SEQ ID NO: 1112381 - RNA, 24 nt, Human
gacagagcgagacucugucucaaa

SEQ ID NO: 1112382 - RNA, 21 nt, Human
gaccaagugcaauuuauucuu

SEQ ID NO: 1112383 - RNA, 23 nt, Human
gagaucagccgcccggccaagcu

SEQ ID NO: 1112384 - RNA, 21 nt, Human
gaggggcuccguagaggaggg

SEQ ID NO: 1112385 - RNA, 21 nt, Human
gagguugcagugagccgagac

SEQ ID NO: 1112386 - RNA, 18 nt, Human
gauaacgaggucaagaga

SEQ ID NO: 1112387 - RNA, 22 nt, Human
gcaaaaaauucuauuuugcaga

SEQ ID NO: 1112388 - RNA, 20 nt, Human
gcucuaagcucaggaacaag

SEQ ID NO: 1112389 - RNA, 18 nt, Human
ggagguugcagugagccg

SEQ ID NO: 1112390 - RNA, 20 nt, Human
ggagguugcagugagccgag

SEQ ID NO: 1112391 - RNA, 22 nt, Human
ggagguugcagugagccgagac

SEQ ID NO: 1112392 - RNA, 24 nt, Human
ggagguugcagugagccgagacag

SEQ ID NO: 1112393 - RNA, 19 nt, Human
ggccacggcacuguacagc

SEQ ID NO: 1112394 - RNA, 21 nt, Human
ggcucacgccuguaaucccag

SEQ ID NO: 1112395 - RNA, 20 nt, Human
gggaguaacaaaaaaagcaa

SEQ ID NO: 1112396 - RNA, 22 nt, Human
gggugaaagacaaaaagcuucu

SEQ ID NO: 1112397 - RNA, 24 nt, Human
gguggcucacgccuguaaucccag

SEQ ID NO: 1112398 - RNA, 30 nt, Human
guagauguggccaggcaugguggcucacgg

SEQ ID NO: 1112399 - RNA, 24 nt, Human
gugacagagcgagacucugucuca

SEQ ID NO: 1112400 - RNA, 23 nt, Human
guggcucacgccuguaaucccag

SEQ ID NO: 1112401 - RNA, 23 nt, Human
guugcagugagccgagacaggcc

SEQ ID NO: 1112402 - RNA, 22 nt, Human
uaaaaaaccacaucaaacaaug

SEQ ID NO: 1112403 - RNA, 20 nt, Human
uaaaaagaaacaaacuaucc

SEQ ID NO: 1112404 - RNA, 24 nt, Human
uaaaauauaaguagaaaacaucau

SEQ ID NO: 1112405 - RNA, 18 nt, Human
uaacaaaaaaagcaaaaa

SEQ ID NO: 1112406 - RNA, 22 nt, Human
uacaaucucagcacaaagcagg

SEQ ID NO: 1112407 - RNA, 19 nt, Human
uacacauuaacaaaauaaa

SEQ ID NO: 1112408 - RNA, 23 nt, Human
uacagccuggugacagagcgaga

SEQ ID NO: 1112409 - RNA, 23 nt, Human
uagcacugaaaagaauaaaauac

SEQ ID NO: 1112410 - RNA, 22 nt, Human
uauccaaauuggaaauguagag

SEQ ID NO: 1112411 - RNA, 18 nt, Human
ucagcugggcgugguggc

SEQ ID NO: 1112412 - RNA, 24 nt, Human
ucagcugggcgugguggcgcaugc

SEQ ID NO: 1112413 - RNA, 20 nt, Human
uccacacaaaaaguauuaca

SEQ ID NO: 1112414 - RNA, 20 nt, Human
uccacacaaaaaguauuaca

SEQ ID NO: 1112415 - RNA, 18 nt, Human
uccacauaguguuggaag

SEQ ID NO: 1112416 - RNA, 21 nt, Human
uccacauaguguuggaaguug

SEQ ID NO: 1112417 - RNA, 21 nt, Human
uccagacagauguccacggag

SEQ ID NO: 1112418 - RNA, 19 nt, Human
ucccugugcgaggucuaac

SEQ ID NO: 1112419 - RNA, 18 nt, Human
uccugcugcguccgccuu

SEQ ID NO: 1112420 - RNA, 24 nt, Human
ucgcuugaacccaggagguggagg

SEQ ID NO: 1112421 - RNA, 23 nt, Human
ucuaagcucaggaacaaggcaaa

SEQ ID NO: 1112422 - RNA, 21 nt, Human
ucucuacuaaaaauacaaaaa

SEQ ID NO: 1112423 - RNA, 24 nt, Human
ugaauuuuuuaacauauaaaaauu

SEQ ID NO: 1112424 - RNA, 18 nt, Human
ugacaauaucacaaauau

SEQ ID NO: 1112425 - RNA, 24 nt, Human
ugagaccauccuggucaacauggu

SEQ ID NO: 1112426 - RNA, 20 nt, Human
ugagccgagacaggccacgg

SEQ ID NO: 1112427 - RNA, 24 nt, Human
ugaggcauaagaaucgcuugaacc

SEQ ID NO: 1112428 - RNA, 24 nt, Human
ugccuguagucccagauacuuggg

SEQ ID NO: 1112429 - RNA, 24 nt, Human
uggcucacgccuguaaucccagca

SEQ ID NO: 1112430 - RNA, 23 nt, Human
ugggaggcugaggcauaagaauc

SEQ ID NO: 1112431 - RNA, 27 nt, Human
ugggaggcugaggcauaagaaucgcuu

SEQ ID NO: 1112432 - RNA, 20 nt, Human
ugggaugcggggagcuguag

SEQ ID NO: 1112433 - RNA, 18 nt, Human
ugggcccugcagccagcc

SEQ ID NO: 1112434 - RNA, 24 nt, Human
ugguggcgcaugccuguaguccca

SEQ ID NO: 1112435 - RNA, 24 nt, Human
ugguggcucacgccuguaauccca

SEQ ID NO: 1112436 - RNA, 22 nt, Human
uguguacacauuaacaaaauaa

SEQ ID NO: 1112437 - RNA, 23 nt, Human
uucagggugaaaacacucaaaaa

SEQ ID NO: 1112438 - RNA, 24 nt, Human
uugaacccaggagguggagguugc

SEQ ID NO: 1112439 - RNA, 19 nt, Human
uugcagugagccgagacag

SEQ ID NO: 1112440 - RNA, 24 nt, Human
uugcagugagccgagacaggccac

SEQ ID NO: 1112441 - RNA, 24 nt, Human
uugggaggcugaggcauaagaauc

SEQ ID NO: 1112442 - RNA, 19 nt, Human
uuguagggcggugcggauc

SEQ ID NO: 1112443 - RNA, 22 nt, Human
uuuuauguggaaagcucuagag

SEQ ID NO: 1112444 - RNA, 19 nt, Human
aagcaacaaaaccucuuca

SEQ ID NO: 1112445 - RNA, 24 nt, Human
aaucauaggauauugugaaaaaga

SEQ ID NO: 1112446 - RNA, 24 nt, Human
agcaaaugcaguguaucgcaaaau

SEQ ID NO: 1112447 - RNA, 20 nt, Human
cacuguacaagcaacaaaac

SEQ ID NO: 1112448 - RNA, 22 nt, Human
ccucggccacccgcgccgggag

SEQ ID NO: 1112449 - RNA, 21 nt, Human
cgccucggccacccgcgccgg

SEQ ID NO: 1112450 - RNA, 25 nt, Human
cucuucacuuccaguuauuuccaau

SEQ ID NO: 1112451 - RNA, 21 nt, Human
cugacacuguacaagcaacaa

SEQ ID NO: 1112452 - RNA, 23 nt, Human
cugacacuguacaagcaacaaaa

SEQ ID NO: 1112453 - RNA, 22 nt, Human
gugaaaaagaugcauauuauau

SEQ ID NO: 1112454 - RNA, 19 nt, Human
uaaaaauagcaccagcaaa

SEQ ID NO: 1112455 - RNA, 23 nt, Human
uaacaguaguuuuuuucccccau

SEQ ID NO: 1112456 - RNA, 30 nt, Human; identical to SEQ ID NO: 178135

SEQ ID NO: 1112457 - RNA, 21 nt, Human
ucgguaauauuaaaaguuucu

SEQ ID NO: 1112458 - RNA, 24 nt, Human
ucuauccaccacuaauuuaagaca

SEQ ID NO: 1112459 - RNA, 23 nt, Human
ucuuucauuagcaguguuaacag

SEQ ID NO: 1112460 - RNA, 20 nt, Human
ugacacuguacaagcaacaa

SEQ ID NO: 1112461 - RNA, 20 nt, Human
uuaaaggcauuuucuuucau

SEQ ID NO: 1112462 - RNA, 22 nt, Human
uuaagacaacucugcuggcuug

SEQ ID NO: 1112463 - RNA, 28 nt, Human
uuagcaguguuaacaguaguuuuuuucu

SEQ ID NO: 1112464 - RNA, 19 nt, Human
aaaaaggaggagaagaaga

SEQ ID NO: 1112465 - RNA, 22 nt, Human
aaaaauaguccuuagcaugcaa

SEQ ID NO: 1112466 - RNA, 20 nt, Human
aaaaggaggaggaaagagaa

SEQ ID NO: 1112467 - RNA, 24 nt, Human
aaaaggaggcuaaguccgauagaa

SEQ ID NO: 1112468 - RNA, 23 nt, Human
aaacggguucacacauuggagcu

SEQ ID NO: 1112469 - RNA, 29 nt, Human
aaacuggaggcagaaaauuaagggacccc

SEQ ID NO: 1112470 - RNA, 20 nt, Human
aacagagcaagacuccaccu

SEQ ID NO: 1112471 - RNA, 24 nt, Human
aacugaucuuccaaacagaaggcc

SEQ ID NO: 1112472 - RNA, 24 nt, Human
aagaaaagaaugaggaaaagagaa

SEQ ID NO: 1112473 - RNA, 23 nt, Human
aagaaaaggaggaggaaagagaa

SEQ ID NO: 1112474 - RNA, 19 nt, Human
aagaagaaaagaaugagga

SEQ ID NO: 1112475 - RNA, 19 nt, Human
aagaagagaggaaguggag

SEQ ID NO: 1112476 - RNA, 19 nt, Human
aagauaaaauggcuuaaaa

SEQ ID NO: 1112477 - RNA, 21 nt, Human
aagcaagauuuauacccugua

SEQ ID NO: 1112478 - RNA, 21 nt, Human
aagcaccagaaugcacagggc

SEQ ID NO: 1112479 - RNA, 25 nt, Human
aagcagauauuuggauauuuaugga

SEQ ID NO: 1112480 - RNA, 23 nt, Human
aaggaagaggagaagacgaagag

SEQ ID NO: 1112481 - RNA, 25 nt, Human
aaggaagaggagaagacgaagagaa

SEQ ID NO: 1112482 - RNA, 18 nt, Human
aaggaggaaaggaagaga

SEQ ID NO: 1112483 - RNA, 18 nt, Human
aaggaggagaagaagaaa

SEQ ID NO: 1112484 - RNA, 18 nt, Human
aagugaaaauauagaguu

SEQ ID NO: 1112485 - RNA, 24 nt, Human
aauugcuugaaaccgggaggcaga

SEQ ID NO: 1112486 - RNA, 19 nt, Human
acaaggaagaggagaagac

SEQ ID NO: 1112487 - RNA, 25 nt, Human
acagagcaagauuauuucucauaga

SEQ ID NO: 1112488 - RNA, 27 nt, Human
acagaggaaaauacacaagccuccuca

SEQ ID NO: 1112489 - RNA, 21 nt, Human
acagcagacagacuugauaga

SEQ ID NO: 1112490 - RNA, 18 nt, Human
acaugaugguauucucca

SEQ ID NO: 1112491 - RNA, 23 nt, Human
accaauguggugaaaccugucuc

SEQ ID NO: 1112492 - RNA, 22 nt, Human
accacaaagguugcugcagaga

SEQ ID NO: 1112493 - RNA, 23 nt, Human
accagaaugcacagggcacucug

SEQ ID NO: 1112494 - RNA, 26 nt, Human
accuaccuuaucuucuggguaucccu

SEQ ID NO: 1112495 - RNA, 23 nt, Human
accugcauccuggcauccuccau

SEQ ID NO: 1112496 - RNA, 18 nt, Human
accuuuucaaccucaggg

SEQ ID NO: 1112497 - RNA, 18 nt, Human
acguguugagaccccguc

SEQ ID NO: 1112498 - RNA, 22 nt, Human
acucaugccacuagugaaacaa

SEQ ID NO: 1112499 - RNA, 24 nt, Human
acugcacaccagccuggauaacag

SEQ ID NO: 1112500 - RNA, 26 nt, Human
acugcacaccagccuggauaacagag

SEQ ID NO: 1112501 - RNA, 19 nt, Human
acugcacugcagccuaggu

SEQ ID NO: 1112502 - RNA, 21 nt, Human
acugcacugcagccuagguga

SEQ ID NO: 1112503 - RNA, 24 nt, Human
acugcacugcagccuaggugacag

SEQ ID NO: 1112504 - RNA, 22 nt, Human
agaaaaaaggaggagaagaaga

SEQ ID NO: 1112505 - RNA, 18 nt, Human
agaaaaagaggaaaggag

SEQ ID NO: 1112506 - RNA, 23 nt, Human
agaaaagaaugaggaaaagagaa

SEQ ID NO: 1112507 - RNA, 19 nt, Human
agaaacuggaggcagaaaa

SEQ ID NO: 1112508 - RNA, 23 nt, Human
agaagaaaaggaggaggaaagag

SEQ ID NO: 1112509 - RNA, 18 nt, Human
agaagaagaaaagaauga

SEQ ID NO: 1112510 - RNA, 27 nt, Human
agaagaagaaaagaaugaggaaaagag

SEQ ID NO: 1112511 - RNA, 22 nt, Human
agaagagaaaaugagaagaaga

SEQ ID NO: 1112512 - RNA, 18 nt, Human
agaagagaagaaaaggag

SEQ ID NO: 1112513 - RNA, 22 nt, Human
agagaaacuggaggcagaaaau

SEQ ID NO: 1112514 - RNA, 21 nt, Human
agagaacaggcauugggcacc

SEQ ID NO: 1112515 - RNA, 21 nt, Human
agagaagaaaaggaggaggaa

SEQ ID NO: 1112516 - RNA, 21 nt, Human
agagaaggaguaggaguggag

SEQ ID NO: 1112517 - RNA, 26 nt, Human
agagaggaaguggagaaaagggaccc

SEQ ID NO: 1112518 - RNA, 19 nt, Human
agagccugcagugagccaa

SEQ ID NO: 1112519 - RNA, 24 nt, Human
agagccugcagugagccaagauug

SEQ ID NO: 1112520 - RNA, 19 nt, Human
agaggaaaggaggaaagga

SEQ ID NO: 1112521 - RNA, 23 nt, Human
agaggaaaggaggaaaggaagag

SEQ ID NO: 1112522 - RNA, 26 nt, Human
agaggaaguggagaaaaaaaggagga

SEQ ID NO: 1112523 - RNA, 20 nt, Human
agaggaggaggagaggauga

SEQ ID NO: 1112524 - RNA, 19 nt, Human
agaguucuuacaaucugcu

SEQ ID NO: 1112525 - RNA, 23 nt, Human
agcaagauuauuucucauagaau

SEQ ID NO: 1112526 - RNA, 21 nt, Human
agcaccaaaaucuuuuccacc

SEQ ID NO: 1112527 - RNA, 18 nt, Human
agcauucuuuuuccuucu

SEQ ID NO: 1112528 - RNA, 21 nt, Human
agcccagaccacuuugggggc

SEQ ID NO: 1112529 - RNA, 21 nt, Human
agcccuuucuuuucuggaauu

SEQ ID NO: 1112530 - RNA, 23 nt, Human
agccugaccaauguggugaaacc

SEQ ID NO: 1112531 - RNA, 24 nt, Human
agccuggauaacagagcaagacuc

SEQ ID NO: 1112532 - RNA, 23 nt, Human
agcuacuugggaggcugaggcag

SEQ ID NO: 1112533 - RNA, 23 nt, Human
agcuggacgugguggugggugcc

SEQ ID NO: 1112534 - RNA, 25 nt, Human
aggaaagagaagaacuagaagagaa

SEQ ID NO: 1112535 - RNA, 18 nt, Human
aggaagagaaggaggagg

SEQ ID NO: 1112536 - RNA, 19 nt, Human
aggaagagaaggaggagga

SEQ ID NO: 1112537 - RNA, 24 nt, Human
aggaagaggagaagacgaagagaa

SEQ ID NO: 1112538 - RNA, 20 nt, Human
aggacagccaucaguaaugu

SEQ ID NO: 1112539 - RNA, 18 nt, Human
aggagaaaagggaagcua

SEQ ID NO: 1112540 - RNA, 18 nt, Human
aggagaagaagaaaagaa

SEQ ID NO: 1112541 - RNA, 24 nt, Human
aggagaagaagaaaagaaugagga

SEQ ID NO: 1112542 - RNA, 20 nt, Human
aggagaaggaggaguagagg

SEQ ID NO: 1112543 - RNA, 21 nt, Human
aggaggaaagagaagaacuag

SEQ ID NO: 1112544 - RNA, 25 nt, Human
aggaggaaagagaagaacuagaaga

SEQ ID NO: 1112545 - RNA, 19 nt, Human
aggaggagaagagaagaaa

SEQ ID NO: 1112546 - RNA, 18 nt, Human
aggaggagaggaugagaa

SEQ ID NO: 1112547 - RNA, 24 nt, Human
aggaggaggggacaaggaagagga

SEQ ID NO: 1112548 - RNA, 18 nt, Human
aggaugagaaaaagagga

SEQ ID NO: 1112549 - RNA, 21 nt, Human
aggaugagaaaaagaggaaag

SEQ ID NO: 1112550 - RNA, 21 nt, Human
aggcagaaaauuaacucaaga

SEQ ID NO: 1112551 - RNA, 19 nt, Human
aggcagagccugcagugag

SEQ ID NO: 1112552 - RNA, 24 nt, Human
aggcagagccugcagugagccaag

SEQ ID NO: 1112553 - RNA, 18 nt, Human
aggcaggagaauugcuug

SEQ ID NO: 1112554 - RNA, 24 nt, Human
aggcaggagaauugcuugaaaccg

SEQ ID NO: 1112555 - RNA, 26 nt, Human
aggcaggcggcucaccugaggucagg

SEQ ID NO: 1112556 - RNA, 24 nt, Human
aggcauggugucuuaugccuguaa

SEQ ID NO: 1112557 - RNA, 23 nt, Human
aggccaaggcaggcggcucaccu

SEQ ID NO: 1112558 - RNA, 21 nt, Human
aggcugaggcaggagaauugc

SEQ ID NO: 1112559 - RNA, 24 nt, Human
aggcugaggcaggagaauugcuug

SEQ ID NO: 1112560 - RNA, 21 nt, Human
agggagaaaaaaggaggagaa

SEQ ID NO: 1112561 - RNA, 22 nt, Human
agggugagcgacuuguagugug

SEQ ID NO: 1112562 - RNA, 24 nt, Human
aggugugaugggccacgccuguag

SEQ ID NO: 1112563 - RNA, 20 nt, Human
aguaaaaaaaaaaaugggaa

SEQ ID NO: 1112564 - RNA, 25 nt, Human
auaaaauggcuuaaaaaaaucuauu

SEQ ID NO: 1112565 - RNA, 19 nt, Human
auagauggggguaaaaguu

SEQ ID NO: 1112566 - RNA, 25 nt, Human
auauauauguguauauauauaugua

SEQ ID NO: 1112567 - RNA, 19 nt, Human
auauauguguauauauaua

SEQ ID NO: 1112568 - RNA, 19 nt, Human
auauguguauauauauaug

SEQ ID NO: 1112569 - RNA, 18 nt, Human
aucaguuacauaaguaca

SEQ ID NO: 1112570 - RNA, 21 nt, Human
aucauacuacuuuuuggccca

SEQ ID NO: 1112571 - RNA, 23 nt, Human
auccaaucagcaagccucucuua

SEQ ID NO: 1112572 - RNA, 21 nt, Human
auccccaucccucucagccag

SEQ ID NO: 1112573 - RNA, 20 nt, Human
augccacuagugaaacaaaa

SEQ ID NO: 1112574 - RNA, 18 nt, Human
auuccugucauucaccuc

SEQ ID NO: 1112575 - RNA, 24 nt, Human
auuguaucacugcacaccagccug

SEQ ID NO: 1112576 - RNA, 19 nt, Human
auuucucauagaauauauc

SEQ ID NO: 1112577 - RNA, 24 nt, Human
caaaacucuaaauaaguagagaaa

SEQ ID NO: 1112578 - RNA, 19 nt, Human
caaagcuuuccagaguucu

SEQ ID NO: 1112579 - RNA, 19 nt, Human
caaauucagagaaacacaa

SEQ ID NO: 1112580 - RNA, 24 nt, Human
caaggcaggcggcucaccugaggu

SEQ ID NO: 1112581 - RNA, 26 nt, Human
caaggcaggcggcucaccugagguca

SEQ ID NO: 1112582 - RNA, 21 nt, Human
caaugaggcaccaccauccac

SEQ ID NO: 1112583 - RNA, 23 nt, Human
caauguggugaaaccugucucua

SEQ ID NO: 1112584 - RNA, 24 nt, Human
cacaaaucaaauucagagaaacac

SEQ ID NO: 1112585 - RNA, 23 nt, Human
cacaccagccuggauaacagagc

SEQ ID NO: 1112586 - RNA, 23 nt, Human
cacaguaagagaaggaguaggag

SEQ ID NO: 1112587 - RNA, 23 nt, Human
caccaaccaugcaauugugcuag

SEQ ID NO: 1112588 - RNA, 22 nt, Human
caccaaugggaugcuuacaguc

SEQ ID NO: 1112589 - RNA, 21 nt, Human
caccagccuggauaacagagc

SEQ ID NO: 1112590 - RNA, 18 nt, Human
cacccauaaugcaaacuu

SEQ ID NO: 1112591 - RNA, 21 nt, Human
cacgcagcccuuucuuuucug

SEQ ID NO: 1112592 - RNA, 18 nt, Human
cacgccuguagucccagc

SEQ ID NO: 1112593 - RNA, 18 nt, Human
cacugcacaccagccugg

SEQ ID NO: 1112594 - RNA, 19 nt, Human
cacugcacaccagccugga

SEQ ID NO: 1112595 - RNA, 20 nt, Human
cacugcacaccagccuggau

SEQ ID NO: 1112596 - RNA, 24 nt, Human
cacugcacaccagccuggauaaca

SEQ ID NO: 1112597 - RNA, 20 nt, Human
cacugcacugcagccuaggu

SEQ ID NO: 1112598 - RNA, 24 nt, Human
cacugcacugcagccuaggugaca

SEQ ID NO: 1112599 - RNA, 23 nt, Human
cacugcagccuaggugacagagc

SEQ ID NO: 1112600 - RNA, 23 nt, Human
cagacacuguacuucccccauuu

SEQ ID NO: 1112601 - RNA, 21 nt, Human
cagagcaagacuccaccucuc

SEQ ID NO: 1112602 - RNA, 20 nt, Human
cagcaggguggaagauaaac

SEQ ID NO: 1112603 - RNA, 19 nt, Human
cagcaguagagagaaacug

SEQ ID NO: 1112604 - RNA, 22 nt, Human
cagcaguagagagaaacuggag

SEQ ID NO: 1112605 - RNA, 19 nt, Human
cagcgcugaagagggugcc

SEQ ID NO: 1112606 - RNA, 24 nt, Human
caggcggcucaccugaggucagga

SEQ ID NO: 1112607 - RNA, 20 nt, Human
caguaauguuccuggccuag

SEQ ID NO: 1112608 - RNA, 26 nt, Human
caguagagagaaacuggaggcaguac

SEQ ID NO: 1112609 - RNA, 18 nt, Human
cagugaccggagcauggu

SEQ ID NO: 1112610 - RNA, 23 nt, Human
caguuaacacugauagaagugac

SEQ ID NO: 1112611 - RNA, 22 nt, Human
cauauguauauacguauauaua

SEQ ID NO: 1112612 - RNA, 18 nt, Human
caucaguaauguuccugg

SEQ ID NO: 1112613 - RNA, 22 nt, Human
caucauacuacuuuuuggccca

SEQ ID NO: 1112614 - RNA, 18 nt, Human
cauggacagaagaccugg

SEQ ID NO: 1112615 - RNA, 18 nt, Human
cauggcaaucaccuucca

SEQ ID NO: 1112616 - RNA, 22 nt, Human
cauuagagagcuugcgcccagg

SEQ ID NO: 1112617 - RNA, 22 nt, Human
cauugcuuaauccagcauucca

SEQ ID NO: 1112618 - RNA, 23 nt, Human
ccacgccuguagucccagcuacc

SEQ ID NO: 1112619 - RNA, 18 nt, Human
ccacucucucaagaggaa

SEQ ID NO: 1112620 - RNA, 20 nt, Human
ccacugcacugcagccuagg

SEQ ID NO: 1112621 - RNA, 20 nt, Human
ccacugcacugcagccuagg

SEQ ID NO: 1112622 - RNA, 21 nt, Human
ccacugcacugcagccuaggu

SEQ ID NO: 1112623 - RNA, 24 nt, Human
ccacugcacugcagccuaggugac

SEQ ID NO: 1112624 - RNA, 22 nt, Human
cccagguaugggaccacaaagg

SEQ ID NO: 1112625 - RNA, 24 nt, Human
ccuaaaacaguacacaugauucuu

SEQ ID NO: 1112626 - RNA, 21 nt, Human
ccugaccaauguggugaaacc

SEQ ID NO: 1112627 - RNA, 18 nt, Human
ccugccuucucccuugcc

SEQ ID NO: 1112628 - RNA, 22 nt, Human
ccuggauaacagagcaagacuc

SEQ ID NO: 1112629 - RNA, 24 nt, Human
ccuguaaucggagcuacuugggag

SEQ ID NO: 1112630 - RNA, 22 nt, Human
ccuguagucccagcuaccucgg

SEQ ID NO: 1112631 - RNA, 22 nt, Human
ccugucucuacugaaaauacaa

SEQ ID NO: 1112632 - RNA, 20 nt, Human
ccuucuaucacacauccuuc

SEQ ID NO: 1112633 - RNA, 24 nt, Human
cgccuguagucccagcuaccucgg

SEQ ID NO: 1112634 - RNA, 25 nt, Human
cgccuguagucccagcuaccucggg

SEQ ID NO: 1112635 - RNA, 24 nt, Human
cggcucaccugaggucaggaguuc

SEQ ID NO: 1112636 - RNA, 24 nt, Human
cgggagcagaagaaggaggaggag

SEQ ID NO: 1112637 - RNA, 23 nt, Human
cguauauacauacauauguauag

SEQ ID NO: 1112638 - RNA, 18 nt, Human
cguauauauauauauaua

SEQ ID NO: 1112639 - RNA, 23 nt, Human
cucaagaaacagcgcucuaugaa

SEQ ID NO: 1112640 - RNA, 19 nt, Human
cucaagaggacaugcaugg

SEQ ID NO: 1112641 - RNA, 24 nt, Human
cucaugccacuagugaaacaaaac

SEQ ID NO: 1112642 - RNA, 23 nt, Human
cucccauacacaaaggccaaacu

SEQ ID NO: 1112643 - RNA, 22 nt, Human
cucucccauacacaaaggccaa

SEQ ID NO: 1112644 - RNA, 22 nt, Human
cugcagugagccaagauuguau

SEQ ID NO: 1112645 - RNA, 20 nt, Human
cugcuuacugcacgcagccc

SEQ ID NO: 1112646 - RNA, 23 nt, Human
cuggcagcaggguggaagauaaa

SEQ ID NO: 1112647 - RNA, 22 nt, Human
cugggugcuguuuggcauggcc

SEQ ID NO: 1112648 - RNA, 20 nt, Human
cugugcauuuauuuuuccuu

SEQ ID NO: 1112649 - RNA, 25 nt, Human
cuuacaaucugcucuagccccuauc

SEQ ID NO: 1112650 - RNA, 23 nt, Human
cuuaugccuguaaucccagcauu

SEQ ID NO: 1112651 - RNA, 21 nt, Human
gaaagagaagaacuagaagag

SEQ ID NO: 1112652 - RNA, 18 nt, Human
gaagaggacgagaggagg

SEQ ID NO: 1112653 - RNA, 25 nt, Human
gaaguggagaaaaaaaggagagggg

SEQ ID NO: 1112654 - RNA, 18 nt, Human
gaauuuagucuccucauc

SEQ ID NO: 1112655 - RNA, 20 nt, Human
gacgugguggugggugccug

SEQ ID NO: 1112656 - RNA, 23 nt, Human
gacgugguggugggugccuguaa

SEQ ID NO: 1112657 - RNA, 19 nt, Human
gagaagaaaaggaggagga

SEQ ID NO: 1112658 - RNA, 22 nt, Human
gagaagaagaaaagaaugagga

SEQ ID NO: 1112659 - RNA, 21 nt, Human
gagaagaggacgagaggagga

SEQ ID NO: 1112660 - RNA, 23 nt, Human
gagaauugcuugaaaccgggagg

SEQ ID NO: 1112661 - RNA, 21 nt, Human
gagaggaggagaaucgggagc

SEQ ID NO: 1112662 - RNA, 18 nt, Human
gagccugcagugagccaa

SEQ ID NO: 1112663 - RNA, 24 nt, Human
gaggaaagagaagaacuagaagag

SEQ ID NO: 1112664 - RNA, 20 nt, Human
gaggagaaggaggaguagag

SEQ ID NO: 1112665 - RNA, 23 nt, Human
gaggagaaggaggaguagaggag

SEQ ID NO: 1112666 - RNA, 21 nt, Human
gaugagaaaaagaggaaagga

SEQ ID NO: 1112667 - RNA, 24 nt, Human
gaugggccacgccuguagucccag

SEQ ID NO: 1112668 - RNA, 28 nt, Human
gcacaguaagagaaggaguaggagugga

SEQ ID NO: 1112669 - RNA, 27 nt, Human
gcaccaaaaucuuuuccaaccggaggg

SEQ ID NO: 1112670 - RNA, 19 nt, Human
gcaguagagagaaacugga

SEQ ID NO: 1112671 - RNA, 23 nt, Human
gcccagguaugggaccacaaagg

SEQ ID NO: 1112672 - RNA, 21 nt, Human
gcuauaaaauccaagaucagg

SEQ ID NO: 1112673 - RNA, 24 nt, Human
gcuuacugcacgcagcccuuucuu

SEQ ID NO: 1112674 - RNA, 24 nt, Human
gcuucagaaaaauuguaagugaaa

SEQ ID NO: 1112675 - RNA, 19 nt, Human
ggaaaguggaagggcagaa

SEQ ID NO: 1112676 - RNA, 23 nt, Human
ggacagccaucaguaauguuccu

SEQ ID NO: 1112677 - RNA, 27 nt, Human
ggacuaaauacagaucuguaaaaguaa

SEQ ID NO: 1112678 - RNA, 20 nt, Human
ggagaaaaaaaggagagggg

SEQ ID NO: 1112679 - RNA, 19 nt, Human
ggagaggagaggagaaaag

SEQ ID NO: 1112680 - RNA, 18 nt, Human
ggagaggaggagaaucgg

SEQ ID NO: 1112681 - RNA, 19 nt, Human
ggagagggggacaacagga

SEQ ID NO: 1112682 - RNA, 20 nt, Human
ggagcagaagaaggaggagg

SEQ ID NO: 1112683 - RNA, 25 nt, Human
ggaggaaagagaagaacuagaagag

SEQ ID NO: 1112684 - RNA, 29 nt, Human
ggaggaggagaagagaagaaaaggaggag

SEQ ID NO: 1112685 - RNA, 20 nt, Human
ggaggaggagaaggaggagu

SEQ ID NO: 1112686 - RNA, 25 nt, Human
ggaugagaaaaagaggaaaggagga

SEQ ID NO: 1112687 - RNA, 22 nt, Human
ggcaaucaccuuccagaaggaa

SEQ ID NO: 1112688 - RNA, 20 nt, Human
ggcauccuccauuccucucc

SEQ ID NO: 1112689 - RNA, 22 nt, Human
ggcucaccugaggucaggaguu

SEQ ID NO: 1112690 - RNA, 23 nt, Human
ggcucaccugaggucaggaguuc

SEQ ID NO: 1112691 - RNA, 23 nt, Human
gggagcccagaccacuuuggggg

SEQ ID NO: 1112692 - RNA, 25 nt, Human
gggcaccuggcaacugacaccaaug

SEQ ID NO: 1112693 - RNA, 18 nt, Human
gggguaaaaguuauuagg

SEQ ID NO: 1112694 - RNA, 24 nt, Human
ggugucuuaugccuguaaucccag

SEQ ID NO: 1112695 - RNA, 19 nt, Human
guaaaaaaaaaaaugggaa

SEQ ID NO: 1112696 - RNA, 18 nt, Human
guauauauauauauauac

SEQ ID NO: 1112697 - RNA, 19 nt, Human
guauauauauauguauaca

SEQ ID NO: 1112698 - RNA, 22 nt, Human
guauugcauucaauuuuuaaaa

SEQ ID NO: 1112699 - RNA, 21 nt, Human
uaaaaggaggcuaaguccgau

SEQ ID NO: 1112700 - RNA, 19 nt, Human
uaaaauaaauaaaucaaca

SEQ ID NO: 1112701 - RNA, 31 nt, Human
uaaaauaaauaaaucaacauguaguagucaa

SEQ ID NO: 1112702 - RNA, 23 nt, Human
uaacacugauagaagugaccugu

SEQ ID NO: 1112703 - RNA, 26 nt, Human
uaacagagcaagacuccaccucucaa

SEQ ID NO: 1112704 - RNA, 24 nt, Human
uaagguaagugggagcccagacca

SEQ ID NO: 1112705 - RNA, 18 nt, Human
uaaguuagaaucuuaugu

SEQ ID NO: 1112706 - RNA, 24 nt, Human
uacauauagauuuaaccaaccaaa

SEQ ID NO: 1112707 - RNA, 24 nt, Human
uacccuguagguuucugguauugc

SEQ ID NO: 1112708 - RNA, 28 nt, Human
uacguauauacauacauauguauauacg

SEQ ID NO: 1112709 - RNA, 20 nt, Human
uacguauauauauauauaua

SEQ ID NO: 1112710 - RNA, 23 nt, Human
uacugaaaauacaaaaauuagcu

SEQ ID NO: 1112711 - RNA, 18 nt, Human
uagcauguaagcacuuau

SEQ ID NO: 1112712 - RNA, 21 nt, Human
uagcgcagcgcugaagagggu

SEQ ID NO: 1112713 - RNA, 18 nt, Human
uagcuggacgugguggug

SEQ ID NO: 1112714 - RNA, 21 nt, Human
uaggaggaaguagggagaagg

SEQ ID NO: 1112715 - RNA, 20 nt, Human
uaggcaacguguugagaccc

SEQ ID NO: 1112716 - RNA, 23 nt, Human
uaguaagaagagaggaaguggag

SEQ ID NO: 1112717 - RNA, 18 nt, Human
uaguaguuagaacaaugc

SEQ ID NO: 1112718 - RNA, 19 nt, Human
uauaaaauccaagaucagg

SEQ ID NO: 1112719 - RNA, 18 nt, Human
uauaaauauauaugugua

SEQ ID NO: 1112720 - RNA, 21 nt, Human
uauacauacauauguauauac

SEQ ID NO: 1112721 - RNA, 20 nt, Human
uauacauacguauauacaua

SEQ ID NO: 1112722 - RNA, 22 nt, Human
uauacauacguauauacauaca

SEQ ID NO: 1112723 - RNA, 19 nt, Human
uauacguauauauauauau

SEQ ID NO: 1112724 - RNA, 22 nt, Human
uauagauuuaaccaaccaaauc

SEQ ID NO: 1112725 - RNA, 24 nt, Human
uauauacauacauauguauauacg

SEQ ID NO: 1112726 - RNA, 18 nt, Human
uauauacguauauauaua

SEQ ID NO: 1112727 - RNA, 18 nt, Human
uauauacguauauauaua

SEQ ID NO: 1112728 - RNA, 18 nt, Human
uauauauauguauacaua

SEQ ID NO: 1112729 - RNA, 20 nt, Human
uauauauguguauauauaua

SEQ ID NO: 1112730 - RNA, 24 nt, Human
uauauguauacauacguauauaca

SEQ ID NO: 1112731 - RNA, 18 nt, Human
uauauguguauauauaua

SEQ ID NO: 1112732 - RNA, 24 nt, Human
uaugccuguaaucccagcauuuug

SEQ ID NO: 1112733 - RNA, 26 nt, Human
uauguacauugcacacacaucaagca

SEQ ID NO: 1112734 - RNA, 25 nt, Human
uauguguauauauauauguauacaa

SEQ ID NO: 1112735 - RNA, 22 nt, Human
ucaaaaccagccugaccaaugu

SEQ ID NO: 1112736 - RNA, 23 nt, Human
ucaccucauucagugucuuuucu

SEQ ID NO: 1112737 - RNA, 21 nt, Human
ucaccugaggucaggaguuca

SEQ ID NO: 1112738 - RNA, 22 nt, Human
ucaccugaggucaggaguucaa

SEQ ID NO: 1112739 - RNA, 18 nt, Human
ucacgcccagguauggga

SEQ ID NO: 1112740 - RNA, 20 nt, Human
ucacugcacaccagccugga

SEQ ID NO: 1112741 - RNA, 20 nt, Human
ucacugucuccuuuauugca

SEQ ID NO: 1112742 - RNA, 19 nt, Human
ucagccaggguagcuggcu

SEQ ID NO: 1112743 - RNA, 19 nt, Human
ucagugucuuuucuucuuc

SEQ ID NO: 1112744 - RNA, 20 nt, Human
ucaguucuuucuagcgcagc

SEQ ID NO: 1112745 - RNA, 19 nt, Human
ucaucauacuacuuuuugg

SEQ ID NO: 1112746 - RNA, 23 nt, Human
ucauccugccuucucccuugccu

SEQ ID NO: 1112747 - RNA, 24 nt, Human
ucccagaucauauaaauuaucacu

SEQ ID NO: 1112748 - RNA, 21 nt, Human
ucccuguauuauccccauccc

SEQ ID NO: 1112749 - RNA, 21 nt, Human
uccucaucauccugccuucuc

SEQ ID NO: 1112750 - RNA, 19 nt, Human
uccugccuucucccuugcc

SEQ ID NO: 1112751 - RNA, 24 nt, Human
uccuggcauccuccauuccucucc

SEQ ID NO: 1112752 - RNA, 20 nt, Human
ucuccaaaaucuucaaaaau

SEQ ID NO: 1112753 - RNA, 23 nt, Human
ucucuacugaaaauacaaaaauu

SEQ ID NO: 1112754 - RNA, 18 nt, Human
ucucucucauugugaucu

SEQ ID NO: 1112755 - RNA, 19 nt, Human
ucuggugugaggccugggg

SEQ ID NO: 1112756 - RNA, 24 nt, Human
ugaaaagggcggauaguuauguaa

SEQ ID NO: 1112757 - RNA, 23 nt, Human
ugaccaauguggugaaaccuguc

SEQ ID NO: 1112758 - RNA, 21 nt, Human
ugaccugcauccuggcauccu

SEQ ID NO: 1112759 - RNA, 20 nt, Human
ugagaagaagauaguaagaa

SEQ ID NO: 1112760 - RNA, 25 nt, Human
ugaggcaggagaauugcuugaaacc

SEQ ID NO: 1112761 - RNA, 23 nt, Human
ugaggucaggaguucaaaaccag

SEQ ID NO: 1112762 - RNA, 21 nt, Human
ugaggugagaggaucucuuga

SEQ ID NO: 1112763 - RNA, 24 nt, Human
ugaggugagaggaucucuugaggc

SEQ ID NO: 1112764 - RNA, 20 nt, Human
ugauagauggggguaaaagu

SEQ ID NO: 1112765 - RNA, 24 nt, Human
ugaugggccacgccuguaguccca

SEQ ID NO: 1112766 - RNA, 22 nt, Human
ugcaagcaggcauuagcaagca

SEQ ID NO: 1112767 - RNA, 25 nt, Human
ugcacaccagccuggauaacagagc

SEQ ID NO: 1112768 - RNA, 20 nt, Human
ugcacagggcacucugcagg

SEQ ID NO: 1112769 - RNA, 21 nt, Human
ugcaugacagaugugccaaag

SEQ ID NO: 1112770 - RNA, 23 nt, Human
ugccaaaguuguuaguuuauacc

SEQ ID NO: 1112771 - RNA, 24 nt, Human
ugccuguaaucggagcuacuuggg

SEQ ID NO: 1112772 - RNA, 18 nt, Human
ugcugggugcuguuuggc

SEQ ID NO: 1112773 - RNA, 20 nt, Human
uggaaaaaauauucuugagg

SEQ ID NO: 1112774 - RNA, 21 nt, Human
uggaaaguggaagggcagaac

SEQ ID NO: 1112775 - RNA, 20 nt, Human
uggaagggcagaacaaggcu

SEQ ID NO: 1112776 - RNA, 30 nt, Human
uggaauaaagagaauuuauguacaaagcaa

SEQ ID NO: 1112777 - RNA, 24 nt, Human
uggagaaaaaaaggagagggggaa

SEQ ID NO: 1112778 - RNA, 22 nt, Human
uggaggagugaagaaagaggag

SEQ ID NO: 1112779 - RNA, 23 nt, Human
uggcauggccaguggcacaguaa

SEQ ID NO: 1112780 - RNA, 24 nt, Human
uggccaguggcacaguaagagaag

SEQ ID NO: 1112781 - RNA, 22 nt, Human
uggcugacauccacucucucaa

SEQ ID NO: 1112782 - RNA, 19 nt, Human
ugggaggcugaggcaggag

SEQ ID NO: 1112783 - RNA, 22 nt, Human
ugggaggcugaggcaggagaau

SEQ ID NO: 1112784 - RNA, 21 nt, Human
ugggugcuguuuggcauggga

SEQ ID NO: 1112785 - RNA, 22 nt, Human
ugguaaagacagaaccuucaca

SEQ ID NO: 1112786 - RNA, 18 nt, Human
uggugaaaccugucucua

SEQ ID NO: 1112787 - RNA, 21 nt, Human
ugguggugggugccuguaauc

SEQ ID NO: 1112788 - RNA, 23 nt, Human
ugguggugggugccuguaaucgg

SEQ ID NO: 1112789 - RNA, 24 nt, Human
uggugucuuaugccuguaauccca

SEQ ID NO: 1112790 - RNA, 20 nt, Human
uguauacauacguauauaca

SEQ ID NO: 1112791 - RNA, 29 nt, Human
uguauacauacguauauacauacauaugg

SEQ ID NO: 1112792 - RNA, 18 nt, Human
uguauauauauauguaua

SEQ ID NO: 1112793 - RNA, 21 nt, Human
uguauauauauauguauacau

SEQ ID NO: 1112794 - RNA, 31 nt, Human
uguauauauauauguauacauacguauagug

SEQ ID NO: 1112795 - RNA, 22 nt, Human
uguauuauccccaucccucuca

SEQ ID NO: 1112796 - RNA, 24 nt, Human
ugucuuaugccuguaaucccagca

SEQ ID NO: 1112797 - RNA, 18 nt, Human
uguguauauauauaugua

SEQ ID NO: 1112798 - RNA, 19 nt, Human
uguguauauauauauguau

SEQ ID NO: 1112799 - RNA, 24 nt, Human
uguguauauauauauguauacaua

SEQ ID NO: 1112800 - RNA, 20 nt, Human
uuacugucacgaugcugcag

SEQ ID NO: 1112801 - RNA, 24 nt, Human
uuagcuggacgugguggugggugc

SEQ ID NO: 1112802 - RNA, 23 nt, Human
uucaaagcuuuccagaguucuua

SEQ ID NO: 1112803 - RNA, 24 nt, Human
uucaucauuccugucauucaccuc

SEQ ID NO: 1112804 - RNA, 20 nt, Human
uuccuugaccugcauccugg

SEQ ID NO: 1112805 - RNA, 19 nt, Human
uucucuuuaagcugagcca

SEQ ID NO: 1112806 - RNA, 18 nt, Human
uugcuugaaaccgggagg

SEQ ID NO: 1112807 - RNA, 23 nt, Human
uugggaggcugaggcaggagaau

SEQ ID NO: 1112808 - RNA, 22 nt, Human
uuguaagugaaaauauagaguu

SEQ ID NO: 1112809 - RNA, 23 nt, Human
uuguaucacugcacaccagccug

SEQ ID NO: 1112810 - RNA, 21 nt, Human
uugugcugggugcuguuuggc

SEQ ID NO: 1112811 - RNA, 20 nt, Human
uuuagaauuauuaaaggcca

SEQ ID NO: 1112812 - RNA, 22 nt, Human
aaaaaaaaagaaaaagaaaaaa

SEQ ID NO: 1112813 - RNA, 18 nt, Human
aaaaaagaaaaagaaaaa

SEQ ID NO: 1112814 - RNA, 18 nt, Human
aaaaagaaaaaagaaaaa

SEQ ID NO: 1112815 - RNA, 20 nt, Human
aaaaauaaauacuaaaggug

SEQ ID NO: 1112816 - RNA, 24 nt, Human
aaaagaaaaagaaaaaagaaaaag

SEQ ID NO: 1112817 - RNA, 20 nt, Human
aaaagaaaaagaaaaacuaa

SEQ ID NO: 1112818 - RNA, 23 nt, Human
aaacccuggcuccauuaaaaaua

SEQ ID NO: 1112819 - RNA, 24 nt, Human
aaagugcugggauuacaggcguga

SEQ ID NO: 1112820 - RNA, 19 nt, Human
aacaaaaguaaauuuaaau

SEQ ID NO: 1112821 - RNA, 20 nt, Human
aacaagaucuguguuacaag

SEQ ID NO: 1112822 - RNA, 22 nt, Human
aacaccuguaauuccagcauug

SEQ ID NO: 1112823 - RNA, 22 nt, Human
aacauggcaaaacccuggcucc

SEQ ID NO: 1112824 - RNA, 19 nt, Human
aagaaaaagaaaaaagaaa

SEQ ID NO: 1112825 - RNA, 18 nt, Human
aagaaucuucuacucuuu

SEQ ID NO: 1112826 - RNA, 21 nt, Human
aagcugggcggaucaccuaaa

SEQ ID NO: 1112827 - RNA, 19 nt, Human
aagugcugggauuacaggc

SEQ ID NO: 1112828 - RNA, 19 nt, Human
aagugcugggauuacaggc

SEQ ID NO: 1112829 - RNA, 26 nt, Human
aagugcugggauuacaggcgugagcc

SEQ ID NO: 1112830 - RNA, 20 nt, Human
aaugcuauuaaguauaaauu

SEQ ID NO: 1112831 - RNA, 23 nt, Human
acagagcaagacuccaucuaaaa

SEQ ID NO: 1112832 - RNA, 19 nt, Human
acauuccuuauuugcagga

SEQ ID NO: 1112833 - RNA, 25 nt, Human
accuuuuaccuacacccuugaguaa

SEQ ID NO: 1112834 - RNA, 27 nt, Human
acuccaucuaaaaaaaaagaaaaagaa

SEQ ID NO: 1112835 - RNA, 22 nt, Human
acuguacuccagccuggguggg

SEQ ID NO: 1112836 - RNA, 28 nt, Human
acuguacuccagccugggugggcgacag

SEQ ID NO: 1112837 - RNA, 19 nt, Human
acuuugucacccaggaugg

SEQ ID NO: 1112838 - RNA, 23 nt, Human
agaaaaagaaaaaagaaaaagaa

SEQ ID NO: 1112839 - RNA, 22 nt, Human
agaaacaacaucagccaggagc

SEQ ID NO: 1112840 - RNA, 25 nt, Human
agaaccucuuuacuuagauuuucau

SEQ ID NO: 1112841 - RNA, 20 nt, Human
agauggagguugcagugagc

SEQ ID NO: 1112842 - RNA, 24 nt, Human
agauggagguugcagugagcugag

SEQ ID NO: 1112843 - RNA, 23 nt, Human
agauggcguuucuccaugugggu

SEQ ID NO: 1112844 - RNA, 24 nt, Human
agcauugugggaggccaagcuggg

SEQ ID NO: 1112845 - RNA, 23 nt, Human
agccaggcauggugguuugugcc

SEQ ID NO: 1112846 - RNA, 18 nt, Human
agccuggccaacauggca

SEQ ID NO: 1112847 - RNA, 24 nt, Human
agccuggccaacauggcaaaaccc

SEQ ID NO: 1112848 - RNA, 24 nt, Human
aggagcaguggcuaacaccuguaa

SEQ ID NO: 1112849 - RNA, 18 nt, Human
aggcaggagaaucacuug

SEQ ID NO: 1112850 - RNA, 23 nt, Human
aggcaggagaaucacuugaaacc

SEQ ID NO: 1112851 - RNA, 24 nt, Human
aggcauggugguuugugccuguaa

SEQ ID NO: 1112852 - RNA, 24 nt, Human
aggcugaggcaggagaaucacuug

SEQ ID NO: 1112853 - RNA, 24 nt, Human
aggugauccgcccgccuuugccuc

SEQ ID NO: 1112854 - RNA, 21 nt, Human
aguagcugggauuacaggcau

SEQ ID NO: 1112855 - RNA, 23 nt, Human
aguagcugggauuacaggcaugc

SEQ ID NO: 1112856 - RNA, 18 nt, Human
agugccauggcaugaucu

SEQ ID NO: 1112857 - RNA, 18 nt, Human
agugcugggauuacaggc

SEQ ID NO: 1112858 - RNA, 24 nt, Human
aguggcuaacaccuguaauuccag

SEQ ID NO: 1112859 - RNA, 25 nt, Human
auaaauucucugauguugaacaaag

SEQ ID NO: 1112860 - RNA, 19 nt, Human
augaauuaccuuaccuaca

SEQ ID NO: 1112861 - RNA, 24 nt, Human
auggagugccauggcaugaucucg

SEQ ID NO: 1112862 - RNA, 24 nt, Human
augugccugaaaaaacuaacaaaa

SEQ ID NO: 1112863 - RNA, 21 nt, Human
auuuuguauuuuuaguagaga

SEQ ID NO: 1112864 - RNA, 24 nt, Human
caaagugcugggauuacaggcgug

SEQ ID NO: 1112865 - RNA, 22 nt, Human
caagugauucuccugccucagc

SEQ ID NO: 1112866 - RNA, 18 nt, Human
cacacuguucacacuugu

SEQ ID NO: 1112867 - RNA, 21 nt, Human
caccgcaaccucugccuccug

SEQ ID NO: 1112868 - RNA, 23 nt, Human
caccgcaaccucugccuccuggg

SEQ ID NO: 1112869 - RNA, 23 nt, Human
caccuguaauuccagcauugugg

SEQ ID NO: 1112870 - RNA, 24 nt, Human
caccuguaauuccagcauuguggg

SEQ ID NO: 1112871 - RNA, 19 nt, Human
cacuguacuccagccuggg

SEQ ID NO: 1112872 - RNA, 19 nt, Human
cacuguacuccagccuggg

SEQ ID NO: 1112873 - RNA, 19 nt, Human
cacuguacuccagccuggg

SEQ ID NO: 1112874 - RNA, 21 nt, Human
cacuguacuccagccugggug

SEQ ID NO: 1112875 - RNA, 21 nt, Human
cacuguacuccagccugggug

SEQ ID NO: 1112876 - RNA, 25 nt, Human
cacuguacuccagccugggugggcg

SEQ ID NO: 1112877 - RNA, 28 nt, Human
cacuguacuccagccugggugggcgaca

SEQ ID NO: 1112878 - RNA, 24 nt, Human
cacuuugucacccaggauggagug

SEQ ID NO: 1112879 - RNA, 22 nt, Human
cagaauaugccauauauaacau

SEQ ID NO: 1112880 - RNA, 22 nt, Human
cagaaugaauacaacaagaucu

SEQ ID NO: 1112881 - RNA, 20 nt, Human
cagcacuuuaaaugcuuaua

SEQ ID NO: 1112882 - RNA, 20 nt, Human
cagcauugugggaggccaag

SEQ ID NO: 1112883 - RNA, 28 nt, Human
cagcauugugggaggccaagcugggcgg

SEQ ID NO: 1112884 - RNA, 24 nt, Human
cagcuacuugggaggcugaggcag

SEQ ID NO: 1112885 - RNA, 24 nt, Human
caugugggucaggcuggucuugaa

SEQ ID NO: 1112886 - RNA, 21 nt, Human
ccaaagaaucuucuacucuuu

SEQ ID NO: 1112887 - RNA, 20 nt, Human
ccaaagugcugggauuacag

SEQ ID NO: 1112888 - RNA, 22 nt, Human
ccaaagugcugggauuacaggc

SEQ ID NO: 1112889 - RNA, 22 nt, Human
ccaaagugcugggauuacaggc

SEQ ID NO: 1112890 - RNA, 24 nt, Human
ccaaagugcugggauuacaggcgu

SEQ ID NO: 1112891 - RNA, 20 nt, Human
ccacuguacuccagccuggg

SEQ ID NO: 1112892 - RNA, 20 nt, Human
ccacuguacuccagccuggg

SEQ ID NO: 1112893 - RNA, 21 nt, Human
ccacuguacuccagccugggu

SEQ ID NO: 1112894 - RNA, 21 nt, Human
ccacuguacuccagccugggu

SEQ ID NO: 1112895 - RNA, 22 nt, Human
ccacuguacuccagccugggug

SEQ ID NO: 1112896 - RNA, 23 nt, Human
ccacuguacuccagccugggugg

SEQ ID NO: 1112897 - RNA, 24 nt, Human
ccacuguacuccagccuggguggg

SEQ ID NO: 1112898 - RNA, 25 nt, Human
ccacuguacuccagccugggugggc

SEQ ID NO: 1112899 - RNA, 19 nt, Human
ccaugugggucaggcuggu

SEQ ID NO: 1112900 - RNA, 21 nt, Human
ccaugugggucaggcuggucu

SEQ ID NO: 1112901 - RNA, 21 nt, Human
ccaugugggucaggcuggucu

SEQ ID NO: 1112902 - RNA, 23 nt, Human
cccgaguagcugggauuacaggc

SEQ ID NO: 1112903 - RNA, 24 nt, Human
cccgaguagcugggauuacaggca

SEQ ID NO: 1112904 - RNA, 23 nt, Human
ccgaguagcugggauuacaggca

SEQ ID NO: 1112905 - RNA, 24 nt, Human
ccgaguagcugggauuacaggcau

SEQ ID NO: 1112906 - RNA, 23 nt, Human
ccgcaaccucugccuccuggguu

SEQ ID NO: 1112907 - RNA, 24 nt, Human
ccgcaaccucugccuccuggguuc

SEQ ID NO: 1112908 - RNA, 24 nt, Human
ccgccuuugccucccaaagugcug

SEQ ID NO: 1112909 - RNA, 21 nt, Human
ccuccuggguucaagugauuc

SEQ ID NO: 1112910 - RNA, 24 nt, Human
ccuccuggguucaagugauucucc

SEQ ID NO: 1112911 - RNA, 22 nt, Human
ccucugccuccuggguucaagu

SEQ ID NO: 1112912 - RNA, 18 nt, Human
ccugaccucaggugaucc

SEQ ID NO: 1112913 - RNA, 22 nt, Human
ccugaccucaggugauccgccc

SEQ ID NO: 1112914 - RNA, 20 nt, Human
ccuggagauggagguugcag

SEQ ID NO: 1112915 - RNA, 22 nt, Human
ccuggccaacauggcaaaaccc

SEQ ID NO: 1112916 - RNA, 24 nt, Human
ccuggccaacauggcaaaacccug

SEQ ID NO: 1112917 - RNA, 26 nt, Human
ccugggugggcgacagagcaagacuc

SEQ ID NO: 1112918 - RNA, 23 nt, Human
ccuggguucaagugauucuccuc

SEQ ID NO: 1112919 - RNA, 23 nt, Human
ccuggguucaagugauucuccug

SEQ ID NO: 1112920 - RNA, 21 nt, Human
ccuguaaucccagcuacuugg

SEQ ID NO: 1112921 - RNA, 22 nt, Human
ccuugaguaagguggacuaggu

SEQ ID NO: 1112922 - RNA, 24 nt, Human
cggaucaccuaaagucucgaguuc

SEQ ID NO: 1112923 - RNA, 20 nt, Human
cuagaccagccuggccaaca

SEQ ID NO: 1112924 - RNA, 24 nt, Human
cucaccgcaaccucugccuccugg

SEQ ID NO: 1112925 - RNA, 23 nt, Human
cucagccucccgaguagcuggga

SEQ ID NO: 1112926 - RNA, 26 nt, Human
cuccugaccucaggugauccgcccgc

SEQ ID NO: 1112927 - RNA, 21 nt, Human
cuccuggguucaagugauucu

SEQ ID NO: 1112928 - RNA, 23 nt, Human
cugccucagccucccgaguagcu

SEQ ID NO: 1112929 - RNA, 23 nt, Human
cugccuccuggguucaagugauu

SEQ ID NO: 1112930 - RNA, 23 nt, Human
cugggcggaucaccuaaagucuc

SEQ ID NO: 1112931 - RNA, 19 nt, Human
cuuagauuuucaucaugca

SEQ ID NO: 1112932 - RNA, 21 nt, Human
gaaaaagaaaaaagaaaaaga

SEQ ID NO: 1112933 - RNA, 24 nt, Human
gaccucaggugauccgcccgccuu

SEQ ID NO: 1112934 - RNA, 21 nt, Human
gagagggagucucacuuuguc

SEQ ID NO: 1112935 - RNA, 24 nt, Human
gagauggcguuucuccaugugggu

SEQ ID NO: 1112936 - RNA, 23 nt, Human
gagguugcagugagcugagaucg

SEQ ID NO: 1112937 - RNA, 18 nt, Human
gauuacaggcaugcgcca

SEQ ID NO: 1112938 - RNA, 22 nt, Human
gauuacaggcaugcgccaccau

SEQ ID NO: 1112939 - RNA, 18 nt, Human
gauuacaggcgugagcca

SEQ ID NO: 1112940 - RNA, 22 nt, Human
gauuacaggcgugagccaccgc

SEQ ID NO: 1112941 - RNA, 22 nt, Human
gauuacaggcgugagccaccgc

SEQ ID NO: 1112942 - RNA, 21 nt, Human
gauucuccugccucagccucc

SEQ ID NO: 1112943 - RNA, 18 nt, Human
gcaggagaaucacuugaa

SEQ ID NO: 1112944 - RNA, 19 nt, Human
gccacuguacuccagccug

SEQ ID NO: 1112945 - RNA, 19 nt, Human
gccacuguacuccagccug

SEQ ID NO: 1112946 - RNA, 24 nt, Human
gccacuguacuccagccugggugg

SEQ ID NO: 1112947 - RNA, 20 nt, Human
gccucagccucccgaguagc

SEQ ID NO: 1112948 - RNA, 20 nt, Human
gccuguaaucccagcuacuu

SEQ ID NO: 1112949 - RNA, 22 nt, Human
gccuuugccucccaaagugcug

SEQ ID NO: 1112950 - RNA, 23 nt, Human
gcuggucuugaacuccugaccuc

SEQ ID NO: 1112951 - RNA, 22 nt, Human
ggagaaucacuugaaaccugga

SEQ ID NO: 1112952 - RNA, 22 nt, Human
ggagcaguggcuaacaccugua

SEQ ID NO: 1112953 - RNA, 20 nt, Human
ggagguugcagugagcugag

SEQ ID NO: 1112954 - RNA, 22 nt, Human
ggagguugcagugagcugagau

SEQ ID NO: 1112955 - RNA, 24 nt, Human
ggagguugcagugagcugagaucg

SEQ ID NO: 1112956 - RNA, 24 nt, Human
ggauuacaggcaugcgccaccaug

SEQ ID NO: 1112957 - RNA, 24 nt, Human
ggcuggucuugaacuccugaccuc

SEQ ID NO: 1112958 - RNA, 18 nt, Human
gggaaaaaauaaauaaaa

SEQ ID NO: 1112959 - RNA, 23 nt, Human
ggucaggcuggucuugaacuccu

SEQ ID NO: 1112960 - RNA, 19 nt, Human
ggucuugaacuccugaccu

SEQ ID NO: 1112961 - RNA, 24 nt, Human
ggugguuugugccuguaaucccag

SEQ ID NO: 1112962 - RNA, 28 nt, Human
guacuccagccugggugggcgacagagc

SEQ ID NO: 1112963 - RNA, 20 nt, Human
guagcugggauuacaggcau

SEQ ID NO: 1112964 - RNA, 24 nt, Human
gugauucuccugccucagccuccc

SEQ ID NO: 1112965 - RNA, 23 nt, Human
gugguuugugccuguaaucccag

SEQ ID NO: 1112966 - RNA, 24 nt, Human
guugcagugagcugagaucgugcc

SEQ ID NO: 1112967 - RNA, 19 nt, Human
uaaaaaaacuaaaacugua

SEQ ID NO: 1112968 - RNA, 20 nt, Human
uaaaaauacaaaauuuagcc

SEQ ID NO: 1112969 - RNA, 21 nt, Human
uaaaaauacaaaauuuagcca

SEQ ID NO: 1112970 - RNA, 18 nt, Human
uaaaguuaccacaacuuc

SEQ ID NO: 1112971 - RNA, 25 nt, Human
uaaaugcucaccuaauaaaaaauaa

SEQ ID NO: 1112972 - RNA, 24 nt, Human
uaacuaaaacaaaauuugucucuc

SEQ ID NO: 1112973 - RNA, 26 nt, Human
uaacuaaaacaaaauuugucucucaa

SEQ ID NO: 1112974 - RNA, 24 nt, Human
uaaucguauauuuuaaaaaaacua

SEQ ID NO: 1112975 - RNA, 24 nt, Human
uaaugugauuauuauauauuguau

SEQ ID NO: 1112976 - RNA, 22 nt, Human
uacaaaaaauaaauacuaaagg

SEQ ID NO: 1112977 - RNA, 22 nt, Human
uacaggcaugcgccaccaugcc

SEQ ID NO: 1112978 - RNA, 22 nt, Human
uacaggcgugagccaccgcgcc

SEQ ID NO: 1112979 - RNA, 23 nt, Human
uacaggcgugagccaccgcgccu

SEQ ID NO: 1112980 - RNA, 23 nt, Human
uacauuuguucucaucaaguaua

SEQ ID NO: 1112981 - RNA, 18 nt, Human
uacuccagccuggguggg

SEQ ID NO: 1112982 - RNA, 19 nt, Human
uacuccagccugggugggc

SEQ ID NO: 1112983 - RNA, 27 nt, Human
uacuccagccugggugggcgacagagc

SEQ ID NO: 1112984 - RNA, 18 nt, Human
uacuguauaugcaaaaau

SEQ ID NO: 1112985 - RNA, 27 nt, Human
uaggaauaaagaaacaacaucagccaa

SEQ ID NO: 1112986 - RNA, 24 nt, Human
uaguagagauggcguuucuccaug

SEQ ID NO: 1112987 - RNA, 19 nt, Human
uaucagaauaugccauaua

SEQ ID NO: 1112988 - RNA, 24 nt, Human
uauuuauuuuuugagagggagucu

SEQ ID NO: 1112989 - RNA, 20 nt, Human
uauuuuaauaugaacucugg

SEQ ID NO: 1112990 - RNA, 19 nt, Human
ucaagugauucuccugccu

SEQ ID NO: 1112991 - RNA, 24 nt, Human
ucaccgcaaccucugccuccuggg

SEQ ID NO: 1112992 - RNA, 25 nt, Human
ucaccgcaaccucugccuccugggu

SEQ ID NO: 1112993 - RNA, 27 nt, Human
ucaccgcaaccucugccuccuggguuc

SEQ ID NO: 1112994 - RNA, 18 nt, Human
ucagccaggagcaguggc

SEQ ID NO: 1112995 - RNA, 20 nt, Human
ucagccucccgaguagcugg

SEQ ID NO: 1112996 - RNA, 23 nt, Human
uccagccugggugggcgacagag

SEQ ID NO: 1112997 - RNA, 22 nt, Human
uccaugugggucaggcuggucu

SEQ ID NO: 1112998 - RNA, 24 nt, Human
ucccaaagugcugggauuacaggc

SEQ ID NO: 1112999 - RNA, 24 nt, Human
ucccgaguagcugggauuacaggc

SEQ ID NO: 1113000 - RNA, 21 nt, Human
uccuggguucaagugauucuc

SEQ ID NO: 1113001 - RNA, 24 nt, Human
uccuggguucaagugauucuccug

SEQ ID NO: 1113002 - RNA, 23 nt, Human
ucgugccacuguacuccagccug

SEQ ID NO: 1113003 - RNA, 21 nt, Human
ucuaaaaaaaaagaaaaagaa

SEQ ID NO: 1113004 - RNA, 19 nt, Human
ucucacuuugucacccagg

SEQ ID NO: 1113005 - RNA, 20 nt, Human
ucucacuuugucacccagga

SEQ ID NO: 1113006 - RNA, 24 nt, Human
ucucacuuugucacccaggaugga

SEQ ID NO: 1113007 - RNA, 24 nt, Human
ucuccugccucagccucccgagua

SEQ ID NO: 1113008 - RNA, 18 nt, Human
ucugcugugcggugucca

SEQ ID NO: 1113009 - RNA, 23 nt, Human
ucuugaacuccugaccucaggug

SEQ ID NO: 1113010 - RNA, 20 nt, Human
ugaagugucauugccuuaua

SEQ ID NO: 1113011 - RNA, 18 nt, Human
ugaccucaggugauccgc

SEQ ID NO: 1113012 - RNA, 21 nt, Human
ugaccucaggugauccgcccg

SEQ ID NO: 1113013 - RNA, 24 nt, Human
ugaccucaggugauccgcccgccu

SEQ ID NO: 1113014 - RNA, 22 nt, Human
ugagcugagaucgugccacugu

SEQ ID NO: 1113015 - RNA, 25 nt, Human
ugaggcaggagaaucacuugaaacc

SEQ ID NO: 1113016 - RNA, 20 nt, Human
ugauucuccugccucagccu

SEQ ID NO: 1113017 - RNA, 19 nt, Human
ugcauucuuuuaccaaaua

SEQ ID NO: 1113018 - RNA, 24 nt, Human
ugccucagccucccgaguagcugg

SEQ ID NO: 1113019 - RNA, 22 nt, Human
ugccuccuggguucaagugauu

SEQ ID NO: 1113020 - RNA, 23 nt, Human
ugccuguaaucccagcuacuugg

SEQ ID NO: 1113021 - RNA, 24 nt, Human
ugccuguaaucccagcuacuuggg

SEQ ID NO: 1113022 - RNA, 24 nt, Human
ugcugggauuacaggcgugagcca

SEQ ID NO: 1113023 - RNA, 18 nt, Human
uggaauaaugugacuuga

SEQ ID NO: 1113024 - RNA, 23 nt, Human
uggagauggagguugcagugagc

SEQ ID NO: 1113025 - RNA, 18 nt, Human
uggagguugcagugagcu

SEQ ID NO: 1113026 - RNA, 24 nt, Human
uggagugccauggcaugaucucgg

SEQ ID NO: 1113027 - RNA, 24 nt, Human
uggcuaacaccuguaauuccagca

SEQ ID NO: 1113028 - RNA, 24 nt, Human
ugggaggccaagcugggcggauca

SEQ ID NO: 1113029 - RNA, 19 nt, Human
ugggaggcugaggcaggag

SEQ ID NO: 1113030 - RNA, 24 nt, Human
ugggaggcugaggcaggagaauca

SEQ ID NO: 1113031 - RNA, 18 nt, Human
ugggauuacaggcaugcg

SEQ ID NO: 1113032 - RNA, 21 nt, Human
ugggauuacaggcaugcgcca

SEQ ID NO: 1113033 - RNA, 22 nt, Human
ugggauuacaggcaugcgccac

SEQ ID NO: 1113034 - RNA, 24 nt, Human
ugggauuacaggcaugcgccacca

SEQ ID NO: 1113035 - RNA, 18 nt, Human
ugggauuacaggcgugag

SEQ ID NO: 1113036 - RNA, 19 nt, Human
ugggauuacaggcgugagc

SEQ ID NO: 1113037 - RNA, 21 nt, Human
ugggauuacaggcgugagcca

SEQ ID NO: 1113038 - RNA, 22 nt, Human
ugggauuacaggcgugagccac

SEQ ID NO: 1113039 - RNA, 23 nt, Human
ugggauuacaggcgugagccacc

SEQ ID NO: 1113040 - RNA, 24 nt, Human
ugggauuacaggcgugagccaccg

SEQ ID NO: 1113041 - RNA, 24 nt, Human
ugggcggaucaccuaaagucucga

SEQ ID NO: 1113042 - RNA, 23 nt, Human
uggguucaagugauucuccugcc

SEQ ID NO: 1113043 - RNA, 24 nt, Human
uggugguuugugccuguaauccca

SEQ ID NO: 1113044 - RNA, 21 nt, Human
ugguuugugccuguaauccca

SEQ ID NO: 1113045 - RNA, 22 nt, Human
ugguuugugccuguaaucccag

SEQ ID NO: 1113046 - RNA, 24 nt, Human
ugguuugugccuguaaucccagcu

SEQ ID NO: 1113047 - RNA, 24 nt, Human
ugugccuguaaucccagcuacuug

SEQ ID NO: 1113048 - RNA, 21 nt, Human
uguuacaaguaaaguuaccac

SEQ ID NO: 1113049 - RNA, 23 nt, Human
uuaacaugaaguaauuugaguua

SEQ ID NO: 1113050 - RNA, 29 nt, Human
uuacuuauuuauuuuuugagagggagucc

SEQ ID NO: 1113051 - RNA, 18 nt, Human
uuaguagagauggcguuu

SEQ ID NO: 1113052 - RNA, 24 nt, Human
uuaguagagauggcguuucuccau

SEQ ID NO: 1113053 - RNA, 20 nt, Human
uuagugcauucuuuuaccaa

SEQ ID NO: 1113054 - RNA, 21 nt, Human
uucaagugauucuccugccuc

SEQ ID NO: 1113055 - RNA, 23 nt, Human
uucaagugauucuccugccucag

SEQ ID NO: 1113056 - RNA, 24 nt, Human
uucaagugauucuccugccucagc

SEQ ID NO: 1113057 - RNA, 19 nt, Human
uucauaauacaaaaaauaa

SEQ ID NO: 1113058 - RNA, 22 nt, Human
uuccuauauaaauucugcugug

SEQ ID NO: 1113059 - RNA, 21 nt, Human
uugaacaaaguuugagcaauu

SEQ ID NO: 1113060 - RNA, 18 nt, Human
uugcagugagcugagauc

SEQ ID NO: 1113061 - RNA, 22 nt, Human
uugcagugagcugagaucgugc

SEQ ID NO: 1113062 - RNA, 25 nt, Human
uugggaggcugaggcaggagaauca

SEQ ID NO: 1113063 - RNA, 20 nt, Human
uugugccuguaaucccagcu

SEQ ID NO: 1113064 - RNA, 21 nt, Human
uuucuaaacucagaacucuga

SEQ ID NO: 1113065 - RNA, 19 nt, Human
uuuuguauuuuuaguagag

SEQ ID NO: 1113066 - RNA, 20 nt, Human
uuuuguauuuuuaguagaga

SEQ ID NO: 1113067 - RNA, 19 nt, Human
uuuuuaguagagauggcgu

SEQ ID NO: 1113068 - RNA, 19 nt, Human
uuuuucauaaaaguacaau

SEQ ID NO: 1113069 - RNA, 19 nt, Human
aaaauaguauuacaaaagc

SEQ ID NO: 1113070 - RNA, 22 nt, Human
aaagccacaucuuaagucaaaa

SEQ ID NO: 1113071 - RNA, 26 nt, Human
aaauuuugugugugugugugugugug

SEQ ID NO: 1113072 - RNA, 24 nt, Human
aaccaagauccaauuugccuuucu

SEQ ID NO: 1113073 - RNA, 19 nt, Human
aagaggucaaaauaguauu

SEQ ID NO: 1113074 - RNA, 21 nt, Human
aagaggucaaaauaguauuac

SEQ ID NO: 1113075 - RNA, 19 nt, Human
aagauccaauuugccuuuc

SEQ ID NO: 1113076 - RNA, 20 nt, Human
aauagaacaacaaaaaaaag

SEQ ID NO: 1113077 - RNA, 22 nt, Human
acaaagaaagacauuaaacaau

SEQ ID NO: 1113078 - RNA, 22 nt, Human
acugcaaagagacaaagaaaga

SEQ ID NO: 1113079 - RNA, 22 nt, Human
agacccggaguuccagcggcag

SEQ ID NO: 1113080 - RNA, 25 nt, Human
aggagcagaggacacagagcaguga

SEQ ID NO: 1113081 - RNA, 21 nt, Human
caaaaaaaauuaguaagucuc

SEQ ID NO: 1113082 - RNA, 24 nt, Human
caaaagccacaucuuaagucaaaa

SEQ ID NO: 1113083 - RNA, 21 nt, Human
cacagagcagugaagacgaga

SEQ ID NO: 1113084 - RNA, 20 nt, Human
cagaagaggucaaaauagua

SEQ ID NO: 1113085 - RNA, 21 nt, Human
ccaauaccugcaggucacagg

SEQ ID NO: 1113086 - RNA, 22 nt, Human
cuaugacaaauuuugugugugu

SEQ ID NO: 1113087 - RNA, 19 nt, Human
gcaaagagacaaagaaaga

SEQ ID NO: 1113088 - RNA, 20 nt, Human
ggucacaggaccagaggcug

SEQ ID NO: 1113089 - RNA, 23 nt, Human
uaagucaaaaacugucauaucuu

SEQ ID NO: 1113090 - RNA, 20 nt, Human
uaccugcaggucacaggacc

SEQ ID NO: 1113091 - RNA, 28 nt, Human
uaguaagucucuuuguuucagaaaacuu

SEQ ID NO: 1113092 - RNA, 19 nt, Human
uccaaucaagagacauacu

SEQ ID NO: 1113093 - RNA, 18 nt, Human
ucccaauaccugcagguc

SEQ ID NO: 1113094 - RNA, 24 nt, Human
ugacaaauuuugugugugugugug

SEQ ID NO: 1113095 - RNA, 23 nt, Human
ugcaugcaaauauuaaccaaaug

SEQ ID NO: 1113096 - RNA, 21 nt, Human
uggcaagauagauuuagacau

SEQ ID NO: 1113097 - RNA, 21 nt, Human
ugucauaucuuacauaaagua

SEQ ID NO: 1113098 - RNA, 21 nt, Human
ugugugugcacgucugugugu

SEQ ID NO: 1113099 - RNA, 22 nt, Human
ugugugugugcacgucugugug

SEQ ID NO: 1113100 - RNA, 22 nt, Human
ugugugugugugugcacgucug

SEQ ID NO: 1113101 - RNA, 21 nt, Human
ugugugugugugugugcacgu

SEQ ID NO: 1113102 - RNA, 21 nt, Human
ugugugugugugugugcacgu

SEQ ID NO: 1113103 - RNA, 24 nt, Human
ugugugugugugugugcacgucug

SEQ ID NO: 1113104 - RNA, 18 nt, Human
ugugugugugugugugug

SEQ ID NO: 1113105 - RNA, 18 nt, Human
ugugugugugugugugug

SEQ ID NO: 1113106 - RNA, 21 nt, Human
ugugugugugugugugugugu

SEQ ID NO: 1113107 - RNA, 21 nt, Human
ugugugugugugugugugugu

SEQ ID NO: 1113108 - RNA, 24 nt, Human
uuugugugugugugugugugugug

SEQ ID NO: 1113109 - RNA, 20 nt, Human
agacagagucuugccuugug

SEQ ID NO: 1113110 - RNA, 23 nt, Human
agguucaaaugauucuccugccu

SEQ ID NO: 1113111 - RNA, 28 nt, Human
caaaugauucuccugccucugccuccca

SEQ ID NO: 1113112 - RNA, 19 nt, Human
cacagggcagugaaggcga

SEQ ID NO: 1113113 - RNA, 18 nt, Human
cacugcaaccucugccuc

SEQ ID NO: 1113114 - RNA, 21 nt, Human
cacugcaaccucugccuccca

SEQ ID NO: 1113115 - RNA, 24 nt, Human
ccucccagguucaaaugauucucc

SEQ ID NO: 1113116 - RNA, 25 nt, Human
ccucugcgagcagaggacacagggc

SEQ ID NO: 1113117 - RNA, 21 nt, Human
ccuuguggcccaggcuggagu

SEQ ID NO: 1113118 - RNA, 22 nt, Human
cgagaccugcagcuccagcugc

SEQ ID NO: 1113119 - RNA, 24 nt, Human
cucacugcaaccucugccucccag

SEQ ID NO: 1113120 - RNA, 24 nt, Human
cucacugcaaccucugccucccag

SEQ ID NO: 1113121 - RNA, 23 nt, Human
cugcaaccucugccucccagguu

SEQ ID NO: 1113122 - RNA, 24 nt, Human
cugcaaccucugccucccagguuc

SEQ ID NO: 1113123 - RNA, 21 nt, Human
cugcaggucacagggccacag

SEQ ID NO: 1113124 - RNA, 19 nt, Human
cuuguggcccaggcuggag

SEQ ID NO: 1113125 - RNA, 22 nt, Human
gcaaccucugccucccagguuc

SEQ ID NO: 1113126 - RNA, 20 nt, Human
gcccaggcuggaguagaaug

SEQ ID NO: 1113127 - RNA, 21 nt, Human
gcucacugcaaccucugccuc

SEQ ID NO: 1113128 - RNA, 20 nt, Human
uaccugcaggucacagggcc

SEQ ID NO: 1113129 - RNA, 19 nt, Human
ucaaaugauucuccugccu

SEQ ID NO: 1113130 - RNA, 21 nt, Human
ucaauaccugcaggucacagg

SEQ ID NO: 1113131 - RNA, 19 nt, Human
ucacugcaaccucugccuc

SEQ ID NO: 1113132 - RNA, 24 nt, Human
ucacugcaaccucugccucccagg

SEQ ID NO: 1113133 - RNA, 25 nt, Human
ucacugcaaccucugccucccaggu

SEQ ID NO: 1113134 - RNA, 21 nt, Human
ucccagguucaaaugauucuc

SEQ ID NO: 1113135 - RNA, 24 nt, Human
ucccagguucaaaugauucuccug

SEQ ID NO: 1113136 - RNA, 18 nt, Human
ucucaauaccugcagguc

SEQ ID NO: 1113137 - RNA, 18 nt, Human
ucuugccuuguggcccag

SEQ ID NO: 1113138 - RNA, 22 nt, Human
ucuugccuuguggcccaggcug

SEQ ID NO: 1113139 - RNA, 23 nt, Human
ucuugccuuguggcccaggcugg

SEQ ID NO: 1113140 - RNA, 24 nt, Human
ucuugccuuguggcccaggcugga

SEQ ID NO: 1113141 - RNA, 24 nt, Human
ugccucugccucccaaguagcugg

SEQ ID NO: 1113142 - RNA, 19 nt, Human
ugccuuguggcccaggcug

SEQ ID NO: 1113143 - RNA, 23 nt, Human
uucaaaugauucuccugccucug

SEQ ID NO: 1113144 - RNA, 24 nt, Human
uucaaaugauucuccugccucugc

SEQ ID NO: 1113145 - RNA, 18 nt, Human
ccaauaccugcaggucag

SEQ ID NO: 1113146 - RNA, 19 nt, Human
ccugugcaauaagguguga

SEQ ID NO: 1113147 - RNA, 19 nt, Human
ugacaacuuuuaaagguuu

SEQ ID NO: 1113148 - RNA, 22 nt, Human
ugccacauucuucacacuuaua

SEQ ID NO: 1113149 - RNA, 24 nt, Human
ugcuuuccugugcaauaaggugug

SEQ ID NO: 1113150 - RNA, 21 nt, Human
uuaauggcuuuuucacauucu

SEQ ID NO: 1113151 - RNA, 23 nt, Human
aaacaaagcuggcugugggucug

SEQ ID NO: 1113152 - RNA, 21 nt, Human
aacaccucgaucccaacaccu

SEQ ID NO: 1113153 - RNA, 18 nt, Human
aaccgcagccccagcauc

SEQ ID NO: 1113154 - RNA, 19 nt, Human
acagaauugcugagacccc

SEQ ID NO: 1113155 - RNA, 21 nt, Human
acccaucccuccccagcuucc

SEQ ID NO: 1113156 - RNA, 25 nt, Human
acccgaaagcccagcgucgacgacg

SEQ ID NO: 1113157 - RNA, 19 nt, Human
acccgcagggaagcaggcc

SEQ ID NO: 1113158 - RNA, 22 nt, Human
acggccagacacacacgaaagc

SEQ ID NO: 1113159 - RNA, 19 nt, Human
agaaggaaguggggucagg

SEQ ID NO: 1113160 - RNA, 22 nt, Human
agaaggaaguggggucaggggc

SEQ ID NO: 1113161 - RNA, 24 nt, Human
agagagggugaggcagccccaggu

SEQ ID NO: 1113162 - RNA, 19 nt, Human
agagggugaggcagcccca

SEQ ID NO: 1113163 - RNA, 21 nt, Human
agcagaaacugggggcacagg

SEQ ID NO: 1113164 - RNA, 21 nt, Human
agccagaaagcagaaacuggg

SEQ ID NO: 1113165 - RNA, 22 nt, Human
agcugggauggggcagccacag

SEQ ID NO: 1113166 - RNA, 25 nt, Human
agcuggggggacaaggaaagcuaug

SEQ ID NO: 1113167 - RNA, 22 nt, Human
aggaaguggggucaggggcuca

SEQ ID NO: 1113168 - RNA, 22 nt, Human
aggcacccaugagccacuagga

SEQ ID NO: 1113169 - RNA, 22 nt, Human
aggcacuggcugaggccaggag

SEQ ID NO: 1113170 - RNA, 20 nt, Human
aggcccaggaccugcugcag

SEQ ID NO: 1113171 - RNA, 18 nt, Human
agggaaagccugggugca

SEQ ID NO: 1113172 - RNA, 19 nt, Human
agggcaguggcugggagac

SEQ ID NO: 1113173 - RNA, 21 nt, Human
agggccagaacccgcagggaa

SEQ ID NO: 1113174 - RNA, 24 nt, Human
agggcccagccucugggccgccuu

SEQ ID NO: 1113175 - RNA, 18 nt, Human
agugcagggugggaaggg

SEQ ID NO: 1113176 - RNA, 23 nt, Human
aucaccucuuccucaaaaugggc

SEQ ID NO: 1113177 - RNA, 20 nt, Human
augguggacaggggcugcgg

SEQ ID NO: 1113178 - RNA, 19 nt, Human
caaagccacuucagggagc

SEQ ID NO: 1113179 - RNA, 18 nt, Human
cacagcaccccagacagg

SEQ ID NO: 1113180 - RNA, 23 nt, Human
cacagcagccacuaccggggaga

SEQ ID NO: 1113181 - RNA, 21 nt, Human
caccuggacucagaaguggac

SEQ ID NO: 1113182 - RNA, 23 nt, Human
cacugccgggaccucccucggcc

SEQ ID NO: 1113183 - RNA, 23 nt, Human
cagcaagggcaguggcugggaga

SEQ ID NO: 1113184 - RNA, 20 nt, Human
cagcagccacuaccggggag

SEQ ID NO: 1113185 - RNA, 22 nt, Human
cagccucugggccgccuugccc

SEQ ID NO: 1113186 - RNA, 21 nt, Human
cagccuggcugggucucaggg

SEQ ID NO: 1113187 - RNA, 18 nt, Human
caggcccaggaccugcug

SEQ ID NO: 1113188 - RNA, 21 nt, Human
caggccccaguguggggcagg

SEQ ID NO: 1113189 - RNA, 19 nt, Human
caggcgagugccugccccc

SEQ ID NO: 1113190 - RNA, 21 nt, Human
cagggugggaagggauggcag

SEQ ID NO: 1113191 - RNA, 18 nt, Human
caugaccagugagaaguc

SEQ ID NO: 1113192 - RNA, 18 nt, Human
cauucagacggccagaca

SEQ ID NO: 1113193 - RNA, 22 nt, Human
cauugggugggcacucgcugga

SEQ ID NO: 1113194 - RNA, 20 nt, Human
ccacauucaagaaacaaagc

SEQ ID NO: 1113195 - RNA, 23 nt, Human
ccacugugagcugacgacagaau

SEQ ID NO: 1113196 - RNA, 22 nt, Human
ccagcuggggggacaaggaaag

SEQ ID NO: 1113197 - RNA, 20 nt, Human
cccacugcagagcacggcca

SEQ ID NO: 1113198 - RNA, 18 nt, Human
cccagaaggaaguggggu

SEQ ID NO: 1113199 - RNA, 20 nt, Human
cccagccuggcugggucuca

SEQ ID NO: 1113200 - RNA, 18 nt, Human
ccccagcggcccaggguc

SEQ ID NO: 1113201 - RNA, 21 nt, Human
ccccagcuuccggggccccgg

SEQ ID NO: 1113202 - RNA, 19 nt, Human
cccccagggccagaacccg

SEQ ID NO: 1113203 - RNA, 18 nt, Human
cccccucccccagggcca

SEQ ID NO: 1113204 - RNA, 20 nt, Human
ccccuccccaccuuccaccc

SEQ ID NO: 1113205 - RNA, 21 nt, Human
cccgaaagcccagcgucgacg

SEQ ID NO: 1113206 - RNA, 22 nt, Human
cccucccccagggccagaaccc

SEQ ID NO: 1113207 - RNA, 19 nt, Human
cccuccgccgcacuaacgc

SEQ ID NO: 1113208 - RNA, 21 nt, Human
ccggggcccagaaggaagugg

SEQ ID NO: 1113209 - RNA, 23 nt, Human
ccugcaugcagugcccggcagga

SEQ ID NO: 1113210 - RNA, 22 nt, Human
ccuggcccagcuggggggacaa

SEQ ID NO: 1113211 - RNA, 25 nt, Human
ccuggcccagcuggggguccccugg

SEQ ID NO: 1113212 - RNA, 22 nt, Human
cgacggacccccagggaaagcc

SEQ ID NO: 1113213 - RNA, 19 nt, Human
cggcaggacugagcagggu

SEQ ID NO: 1113214 - RNA, 22 nt, Human
cggccagacacacacgaaagcu

SEQ ID NO: 1113215 - RNA, 23 nt, Human
cgggacccgaaagcccagcgucg

SEQ ID NO: 1113216 - RNA, 24 nt, Human
cgggcugcucugacauuggguggg

SEQ ID NO: 1113217 - RNA, 19 nt, Human
cgguacccaucccucccca

SEQ ID NO: 1113218 - RNA, 18 nt, Human
cguggagcuaggcccagc

SEQ ID NO: 1113219 - RNA, 19 nt, Human
cuaggagcuguggcuggug

SEQ ID NO: 1113220 - RNA, 21 nt, Human
cuccagggggugcacagcacc

SEQ ID NO: 1113221 - RNA, 22 nt, Human
cugcaagcagcacagaagugca

SEQ ID NO: 1113222 - RNA, 19 nt, Human
cugcugcagcuggcagggu

SEQ ID NO: 1113223 - RNA, 22 nt, Human
cuggcugugggucuggagagag

SEQ ID NO: 1113224 - RNA, 20 nt, Human
cugggucucagggcugcuuc

SEQ ID NO: 1113225 - RNA, 22 nt, Human
cuggucccaagggagggcaggc

SEQ ID NO: 1113226 - RNA, 22 nt, Human
cuuccacauucaagaaacaaag

SEQ ID NO: 1113227 - RNA, 21 nt, Human
gaaagcagaaacugggggcac

SEQ ID NO: 1113228 - RNA, 23 nt, Human
gaagcagagccagaaagcagaaa

SEQ ID NO: 1113229 - RNA, 26 nt, Human
gaagucccuagggcccaggccgggcu

SEQ ID NO: 1113230 - RNA, 18 nt, Human
gaaguggacaggcgagug

SEQ ID NO: 1113231 - RNA, 23 nt, Human
gacacacacgaaagcuuuaugug

SEQ ID NO: 1113232 - RNA, 21 nt, Human
gagagggugaggcagccccag

SEQ ID NO: 1113233 - RNA, 19 nt, Human
gagcacggccacugugagc

SEQ ID NO: 1113234 - RNA, 24 nt, Human
gagcagcuucagaagcaugaccag

SEQ ID NO: 1113235 - RNA, 22 nt, Human
gagcaggguucccggggucgcc

SEQ ID NO: 1113236 - RNA, 19 nt, Human
gagccacuaggagcugugg

SEQ ID NO: 1113237 - RNA, 19 nt, Human
gagcugggacggccccacg

SEQ ID NO: 1113238 - RNA, 21 nt, Human
gcagggcccagccucugggcc

SEQ ID NO: 1113239 - RNA, 21 nt, Human
gcccccuccccaccuuccacc

SEQ ID NO: 1113240 - RNA, 19 nt, Human
gccccgggacggagccgcu

SEQ ID NO: 1113241 - RNA, 23 nt, Human
gccugggugcaggccaccuuggc

SEQ ID NO: 1113242 - RNA, 18 nt, Human
gcugcucugacauugggu

SEQ ID NO: 1113243 - RNA, 23 nt, Human
ggacacugccgggaccucccucg

SEQ ID NO: 1113244 - RNA, 18 nt, Human
ggacccgaaagcccagcg

SEQ ID NO: 1113245 - RNA, 18 nt, Human
ggacucagaaguggacag

SEQ ID NO: 1113246 - RNA, 20 nt, Human
ggaggagcccggggcccaga

SEQ ID NO: 1113247 - RNA, 21 nt, Human
ggcacaggguuugugggcacc

SEQ ID NO: 1113248 - RNA, 24 nt, Human
ggcacuggcugaggccaggagucu

SEQ ID NO: 1113249 - RNA, 29 nt, Human
ggcccagaaggaaguggggucaggggcuc

SEQ ID NO: 1113250 - RNA, 19 nt, Human
gggaagcaggcccaggacc

SEQ ID NO: 1113251 - RNA, 23 nt, Human
gggaagggauggcaggagccggc

SEQ ID NO: 1113252 - RNA, 18 nt, Human
gggcuccuggccagugac

SEQ ID NO: 1113253 - RNA, 18 nt, Human
ggggcagccacagcagcc

SEQ ID NO: 1113254 - RNA, 21 nt, Human
gggucaggcggacggucccug

SEQ ID NO: 1113255 - RNA, 25 nt, Human
ggucaggggcucaggcuggcccucg

SEQ ID NO: 1113256 - RNA, 21 nt, Human
ggugaccccagcggcccaggg

SEQ ID NO: 1113257 - RNA, 23 nt, Human
gugagaagucccuagggcccagg

SEQ ID NO: 1113258 - RNA, 20 nt, Human
gugcagggugggaagggaug

SEQ ID NO: 1113259 - RNA, 19 nt, Human
gugggcaccccacccagau

SEQ ID NO: 1113260 - RNA, 23 nt, Human
uacccaucccuccccagcuuccg

SEQ ID NO: 1113261 - RNA, 26 nt, Human
uagaucccuggaagcagagccagaaa

SEQ ID NO: 1113262 - RNA, 21 nt, Human
ucaaagccacuucagggagca

SEQ ID NO: 1113263 - RNA, 18 nt, Human
ucaggacacccugggcuc

SEQ ID NO: 1113264 - RNA, 21 nt, Human
uccagaaccccaguggggccc

SEQ ID NO: 1113265 - RNA, 20 nt, Human
uccagggggugcacagcacc

SEQ ID NO: 1113266 - RNA, 18 nt, Human
ucccaagggagggcaggc

SEQ ID NO: 1113267 - RNA, 25 nt, Human
ucccaggcuguguguggcaggcccc

SEQ ID NO: 1113268 - RNA, 18 nt, Human
ucccugcaugcagugccc

SEQ ID NO: 1113269 - RNA, 22 nt, Human
ucccuggaagcagagccagaaa

SEQ ID NO: 1113270 - RNA, 19 nt, Human
ucgccgguacccaucccuc

SEQ ID NO: 1113271 - RNA, 23 nt, Human
ucucagggcugcuucucuugggu

SEQ ID NO: 1113272 - RNA, 22 nt, Human
ucuugggugaccccagcggccc

SEQ ID NO: 1113273 - RNA, 18 nt, Human
ugacucacagcgguccuc

SEQ ID NO: 1113274 - RNA, 20 nt, Human
ugagaagucccuagggccca

SEQ ID NO: 1113275 - RNA, 19 nt, Human
ugagcaggguucccggggu

SEQ ID NO: 1113276 - RNA, 24 nt, Human
ugaggcagccccaggucucugggu

SEQ ID NO: 1113277 - RNA, 18 nt, Human
ugcaagcagcacagaagu

SEQ ID NO: 1113278 - RNA, 20 nt, Human
ugcaggccaccuugugcgcu

SEQ ID NO: 1113279 - RNA, 23 nt, Human
ugcagggugggaagggauggcag

SEQ ID NO: 1113280 - RNA, 20 nt, Human
uggagcuaggcccagccugg

SEQ ID NO: 1113281 - RNA, 20 nt, Human
uggcugugggucuggagaga

SEQ ID NO: 1113282 - RNA, 19 nt, Human
uggcuugugggaggagccc

SEQ ID NO: 1113283 - RNA, 24 nt, Human
ugggaagggauggcaggagccggc

SEQ ID NO: 1113284 - RNA, 22 nt, Human
ugggcugggaccccgugaaugc

SEQ ID NO: 1113285 - RNA, 18 nt, Human
uggggcaggaggcaccca

SEQ ID NO: 1113286 - RNA, 21 nt, Human
uggggcaggaggcacccauga

SEQ ID NO: 1113287 - RNA, 24 nt, Human
uggggcaggaggcacccaugagcc

SEQ ID NO: 1113288 - RNA, 21 nt, Human
uggggccgacggacccccagg

SEQ ID NO: 1113289 - RNA, 21 nt, Human
ugggggcacaggguuuguggg

SEQ ID NO: 1113290 - RNA, 21 nt, Human
ugggucuggagagagggugag

SEQ ID NO: 1113291 - RNA, 20 nt, Human
ugggugggucccaccaacuc

SEQ ID NO: 1113292 - RNA, 20 nt, Human
ugugcagggcccagccucug

SEQ ID NO: 1113293 - RNA, 20 nt, Human
ugugcgcugcccaagccugc

SEQ ID NO: 1113294 - RNA, 21 nt, Human
uguguguggcaggcccccuuu

SEQ ID NO: 1113295 - RNA, 18 nt, Human
uuccggggccccgggacg

SEQ ID NO: 1113296 - RNA, 21 nt, Human
uuuggcaagacccuccgccgc

SEQ ID NO: 1113297 - RNA, 21 nt, Human
uuugugggcaccccacccaga

SEQ ID NO: 1113298 - RNA, 18 nt, Human
aaaccaaggcugaggagg

SEQ ID NO: 1113299 - RNA, 21 nt, Human
aagaaguugaccagagaggug

SEQ ID NO: 1113300 - RNA, 24 nt, Human
aagagccaggaaccauccuucaua

SEQ ID NO: 1113301 - RNA, 21 nt, Human
aagagcucguccuucugcccc

SEQ ID NO: 1113302 - RNA, 22 nt, Human
aaguugaccagagaggugguca

SEQ ID NO: 1113303 - RNA, 18 nt, Human
acagcuccggcuucucca

SEQ ID NO: 1113304 - RNA, 18 nt, Human
accaccagcaggauggag

SEQ ID NO: 1113305 - RNA, 19 nt, Human
accaccagcaggauggagg

SEQ ID NO: 1113306 - RNA, 18 nt, Human
acucugaagagccagaag

SEQ ID NO: 1113307 - RNA, 19 nt, Human
agacagggccaccacgacc

SEQ ID NO: 1113308 - RNA, 22 nt, Human
agagcccaauguagagaacugg

SEQ ID NO: 1113309 - RNA, 19 nt, Human
agguggucacaccaugggc

SEQ ID NO: 1113310 - RNA, 22 nt, Human
caccacgaccgcaaaggacugg

SEQ ID NO: 1113311 - RNA, 22 nt, Human
cagcuccggcuucuccaggcuc

SEQ ID NO: 1113312 - RNA, 20 nt, Human
caucaugcuggccaugcucu

SEQ ID NO: 1113313 - RNA, 19 nt, Human
ccaggcucugcucugcgcu

SEQ ID NO: 1113314 - RNA, 21 nt, Human
ccccaccacguacagcuccgg

SEQ ID NO: 1113315 - RNA, 21 nt, Human
ccucgcuggggcccuccucca

SEQ ID NO: 1113316 - RNA, 21 nt, Human
ccugcaccaucaugcuggcca

SEQ ID NO: 1113317 - RNA, 20 nt, Human
cgcggcugauccacaguguc

SEQ ID NO: 1113318 - RNA, 21 nt, Human
cgcuggggucagauggacccu

SEQ ID NO: 1113319 - RNA, 22 nt, Human
cguuguagcaggcaaaccagac

SEQ ID NO: 1113320 - RNA, 20 nt, Human
cucgaagaugccucuucauc

SEQ ID NO: 1113321 - RNA, 20 nt, Human
cucgcuggggcccuccucca

SEQ ID NO: 1113322 - RNA, 18 nt, Human
cugaagagccagaagcuc

SEQ ID NO: 1113323 - RNA, 19 nt, Human
cugaccccugguccccucc

SEQ ID NO: 1113324 - RNA, 23 nt, Human
cuggcagggugcuguacaggagg

SEQ ID NO: 1113325 - RNA, 19 nt, Human
cuucauacaggggcugagc

SEQ ID NO: 1113326 - RNA, 21 nt, Human
gaccccugguccccuccgcag

SEQ ID NO: 1113327 - RNA, 21 nt, Human
gcaccagcaggaggcgcugca

SEQ ID NO: 1113328 - RNA, 19 nt, Human
gcaggaacuugcagauccg

SEQ ID NO: 1113329 - RNA, 22 nt, Human
gcaggcaaaccagaccugcacc

SEQ ID NO: 1113330 - RNA, 20 nt, Human
gcccuccuccaccuucuccu

SEQ ID NO: 1113331 - RNA, 18 nt, Human
gcguagaaaccaaggcug

SEQ ID NO: 1113332 - RNA, 23 nt, Human
ggaccaccagcaggauggaggga

SEQ ID NO: 1113333 - RNA, 21 nt, Human
ggaccagcggccgugcaccag

SEQ ID NO: 1113334 - RNA, 21 nt, Human
ggagggccaggacagggaagg

SEQ ID NO: 1113335 - RNA, 21 nt, Human
ggaguccuugucuuuagagga

SEQ ID NO: 1113336 - RNA, 24 nt, Human
ggcaagacagggccaccacgaccg

SEQ ID NO: 1113337 - RNA, 19 nt, Human
ggcccuccuccaccuucuc

SEQ ID NO: 1113338 - RNA, 20 nt, Human
ggcugaggaggauggucgcc

SEQ ID NO: 1113339 - RNA, 22 nt, Human
gggaagguguuuauggacacac

SEQ ID NO: 1113340 - RNA, 20 nt, Human
gggcugagccggugaagccg

SEQ ID NO: 1113341 - RNA, 21 nt, Human
ggugauggacagcaggcaaga

SEQ ID NO: 1113342 - RNA, 19 nt, Human
uagcaggcaaaccagaccu

SEQ ID NO: 1113343 - RNA, 20 nt, Human
uagcuggaacggcgggcacg

SEQ ID NO: 1113344 - RNA, 20 nt, Human
uccucgcuggggcccuccuc

SEQ ID NO: 1113345 - RNA, 22 nt, Human
uccuugagggcugggaagauga

SEQ ID NO: 1113346 - RNA, 23 nt, Human
ucgcggcugauccacagugucau

SEQ ID NO: 1113347 - RNA, 23 nt, Human
ucgcugaagcuggcgggucccgc

SEQ ID NO: 1113348 - RNA, 19 nt, Human
ucuccaggcucugcucugc

SEQ ID NO: 1113349 - RNA, 20 nt, Human
ugaaaagagccaggaaccau

SEQ ID NO: 1113350 - RNA, 21 nt, Human
ugaagaaguugaccagagagg

SEQ ID NO: 1113351 - RNA, 22 nt, Human
ugaccagagagguggucacacc

SEQ ID NO: 1113352 - RNA, 21 nt, Human
ugacucggagggccaggacag

SEQ ID NO: 1113353 - RNA, 22 nt, Human
ugaggucggcauacagaaacgg

SEQ ID NO: 1113354 - RNA, 22 nt, Human
uggcguagaaaccaaggcugag

SEQ ID NO: 1113355 - RNA, 23 nt, Human
uggcguagaaaccaaggcugagg

SEQ ID NO: 1113356 - RNA, 18 nt, Human
ugggagaaagcauagcug

SEQ ID NO: 1113357 - RNA, 19 nt, Human
uguagagaacuggcagggu

SEQ ID NO: 1113358 - RNA, 21 nt, Human
uugcagcagaacuggcuggag

SEQ ID NO: 1113359 - RNA, 23 nt, Human
auaggaaauaaagagcgaacaug

SEQ ID NO: 1113360 - RNA, 24 nt, Human
auggugauggaguagaaacagcac

SEQ ID NO: 1113361 - RNA, 24 nt, Human
cacagagugccuuccagcagccag

SEQ ID NO: 1113362 - RNA, 24 nt, Human
cagagugccuuccagcagccagcg

SEQ ID NO: 1113363 - RNA, 18 nt, Human
cagcagccagcgcaggau

SEQ ID NO: 1113364 - RNA, 22 nt, Human
cagcuccaugacggugaacgau

SEQ ID NO: 1113365 - RNA, 18 nt, Human
cagcuggugccaccacag

SEQ ID NO: 1113366 - RNA, 19 nt, Human
ccaggaccccaaugaccag

SEQ ID NO: 1113367 - RNA, 19 nt, Human
cccacugugccauggccau

SEQ ID NO: 1113368 - RNA, 18 nt, Human
ccgcaaccucaaccgcua

SEQ ID NO: 1113369 - RNA, 22 nt, Human
ccguggccucagcagcuccuug

SEQ ID NO: 1113370 - RNA, 21 nt, Human
ccucaaccgcuacucugccuu

SEQ ID NO: 1113371 - RNA, 18 nt, Human
ccucagcagcuccuuggu

SEQ ID NO: 1113372 - RNA, 19 nt, Human
ccucccagcauugggcauc

SEQ ID NO: 1113373 - RNA, 25 nt, Human
ccucccagcauugggcauccccugg

SEQ ID NO: 1113374 - RNA, 20 nt, Human
ccuuccugcugucugagccu

SEQ ID NO: 1113375 - RNA, 18 nt, Human
ccuuccuucucuccuucc

SEQ ID NO: 1113376 - RNA, 23 nt, Human
ccuuccuucucuccuuccugcug

SEQ ID NO: 1113377 - RNA, 21 nt, Human
cggaaguuccuuccuuccuuc

SEQ ID NO: 1113378 - RNA, 24 nt, Human
cucacuauccaggacccacugaug

SEQ ID NO: 1113379 - RNA, 19 nt, Human
cucagugcuuuccagcugc

SEQ ID NO: 1113380 - RNA, 21 nt, Human
cugaagccguggccucagcag

SEQ ID NO: 1113381 - RNA, 19 nt, Human
cugcagccgcagcuggugc

SEQ ID NO: 1113382 - RNA, 24 nt, Human
cugcagccgcagcuggugccacca

SEQ ID NO: 1113383 - RNA, 22 nt, Human
gacgacaagugggauggcagcu

SEQ ID NO: 1113384 - RNA, 18 nt, Human
gagguuucaaggcccugc

SEQ ID NO: 1113385 - RNA, 18 nt, Human
gcccugaagccguggccu

SEQ ID NO: 1113386 - RNA, 22 nt, Human
uaggaaauaaagagcgaacaug

SEQ ID NO: 1113387 - RNA, 18 nt, Human
uauccaggacccacugau

SEQ ID NO: 1113388 - RNA, 21 nt, Human
ucagcagcuccuugguggcaa

SEQ ID NO: 1113389 - RNA, 20 nt, Human
uccagcugcuacugcagccg

SEQ ID NO: 1113390 - RNA, 22 nt, Human
uccagcugcuacugcagccgca

SEQ ID NO: 1113391 - RNA, 19 nt, Human
uccaggcgguagggaugcc

SEQ ID NO: 1113392 - RNA, 24 nt, Human
uccccacgugggcaggagcucggu

SEQ ID NO: 1113393 - RNA, 23 nt, Human
ucgguacuacggaaguuccuucc

SEQ ID NO: 1113394 - RNA, 21 nt, Human
ugccauggccauuguaccacc

SEQ ID NO: 1113395 - RNA, 26 nt, Human
ugcccugaagccguggccucagcagc

SEQ ID NO: 1113396 - RNA, 21 nt, Human
uggaguagaaacagcaccacg

SEQ ID NO: 1113397 - RNA, 20 nt, Human
ugggcauccccugggccugg

SEQ ID NO: 1113398 - RNA, 23 nt, Human
uuccagcugcuacugcagccgca

SEQ ID NO: 1113399 - RNA, 20 nt, Human
uuccaggcgguagggaugcc

SEQ ID NO: 1113400 - RNA, 23 nt, Human
aaaaacgggcaacuuuagagccc

SEQ ID NO: 1113401 - RNA, 20 nt, Human
acaaauacugacaaaaggaa

SEQ ID NO: 1113402 - RNA, 24 nt, Human
agcaacaaauacugacaaaaggaa

SEQ ID NO: 1113403 - RNA, 21 nt, Human
caaaauugggagggggcaugc

SEQ ID NO: 1113404 - RNA, 19 nt, Human
cagcaacaaauacugacaa

SEQ ID NO: 1113405 - RNA, 26 nt, Human
caggaagagcaggaaugaucaguuca

SEQ ID NO: 1113406 - RNA, 24 nt, Human
ccaaacaucuuuguugagguuuca

SEQ ID NO: 1113407 - RNA, 22 nt, Human
gggcaacuuuagagcccacuaa

SEQ ID NO: 1113408 - RNA, 21 nt, Human
guuuucagcaacaaauacuga

SEQ ID NO: 1113409 - RNA, 21 nt, Human
uagagcccacuaaagcuauac

SEQ ID NO: 1113410 - RNA, 23 nt, Human
uagguuuucagcaacaaauacug

SEQ ID NO: 1113411 - RNA, 20 nt, Human
ugggagggggcaugcucuga

SEQ ID NO: 1113412 - RNA, 23 nt, Human
ugggagggggcaugcucugauuu

SEQ ID NO: 1113413 - RNA, 19 nt, Human
uuagagcccacuaaagcua

SEQ ID NO: 1113414 - RNA, 23 nt, Human
uuccauuuuuaguuccagggucc

SEQ ID NO: 1113415 - RNA, 22 nt, Human
uugaagcacugaaccaaacauc

SEQ ID NO: 1113416 - RNA, 18 nt, Human
uuucuggguuuuucuagg

SEQ ID NO: 1113417 - RNA, 22 nt, Human
uuuucuagguuuucagcaacaa

SEQ ID NO: 1113418 - RNA, 20 nt, Human
aaaagguggaaaauauaaua

SEQ ID NO: 1113419 - RNA, 24 nt, Human
aaagugcagggauuacaggcauga

SEQ ID NO: 1113420 - RNA, 22 nt, Human
aaaucauccaugaguccaaaac

SEQ ID NO: 1113421 - RNA, 20 nt, Human
aacaauaaaaauacucccag

SEQ ID NO: 1113422 - RNA, 22 nt, Human
aacagaaaucucccuaaaucua

SEQ ID NO: 1113423 - RNA, 25 nt, Human
aacuacuucuuaaaaaauggaauua

SEQ ID NO: 1113424 - RNA, 18 nt, Human
aagcaaagacaaacagca

SEQ ID NO: 1113425 - RNA, 18 nt, Human
aagcaaagacaaacagca

SEQ ID NO: 1113426 - RNA, 19 nt, Human
aagguguucacuauauaaa

SEQ ID NO: 1113427 - RNA, 19 nt, Human
aaguagcugggguuacagg

SEQ ID NO: 1113428 - RNA, 18 nt, Human
aaucauccaugaguccaa

SEQ ID NO: 1113429 - RNA, 24 nt, Human
acacaguggaaaucaagcacuuaa

SEQ ID NO: 1113430 - RNA, 18 nt, Human
acaggguuucaccauguu

SEQ ID NO: 1113431 - RNA, 19 nt, Human
acaggguuucaccauguua

SEQ ID NO: 1113432 - RNA, 24 nt, Human
acaggguuucaccauguuaaccag

SEQ ID NO: 1113433 - RNA, 21 nt, Human
acagguacucaccaccaugcc

SEQ ID NO: 1113434 - RNA, 22 nt, Human
agacaaacagcaaugggcaaac

SEQ ID NO: 1113435 - RNA, 21 nt, Human
aggaagguauuuguucucaca

SEQ ID NO: 1113436 - RNA, 25 nt, Human
aggcuggagugcaguggugugaucu

SEQ ID NO: 1113437 - RNA, 22 nt, Human
agggauuacaggcaugagcuac

SEQ ID NO: 1113438 - RNA, 24 nt, Human
agggauuacaggcaugagcuacug

SEQ ID NO: 1113439 - RNA, 19 nt, Human
aggguuuugagaaaaaucc

SEQ ID NO: 1113440 - RNA, 22 nt, Human
aguagagacaggguuucaccau

SEQ ID NO: 1113441 - RNA, 23 nt, Human
agugcaguggugugaucuuggcu

SEQ ID NO: 1113442 - RNA, 24 nt, Human
agugcaguggugugaucuuggcuc

SEQ ID NO: 1113443 - RNA, 20 nt, Human
aucuacagaagguuuuccuu

SEQ ID NO: 1113444 - RNA, 21 nt, Human
augaacuacagacacacuccu

SEQ ID NO: 1113445 - RNA, 21 nt, Human
caaaauucugccaacuacuuc

SEQ ID NO: 1113446 - RNA, 24 nt, Human
caaagugcagggauuacaggcaug

SEQ ID NO: 1113447 - RNA, 22 nt, Human
caagcacuucuccugucucagc

SEQ ID NO: 1113448 - RNA, 23 nt, Human
caaugcagaagaacuaucugcaa

SEQ ID NO: 1113449 - RNA, 18 nt, Human
cacaagcaaagacaaaca

SEQ ID NO: 1113450 - RNA, 23 nt, Human
caccaugccuggcuaauuuuugu

SEQ ID NO: 1113451 - RNA, 21 nt, Human
caccauguuaaccaggcuggu

SEQ ID NO: 1113452 - RNA, 24 nt, Human
caccauguuaaccaggcuggucuc

SEQ ID NO: 1113453 - RNA, 27 nt, Human
caccauguuaaccaggcuggucucaaa

SEQ ID NO: 1113454 - RNA, 22 nt, Human
cacucuaagaugaaaguuuuau

SEQ ID NO: 1113455 - RNA, 20 nt, Human
cacugacaacaaugcagaag

SEQ ID NO: 1113456 - RNA, 21 nt, Human
cacugcaaccuccgccuccua

SEQ ID NO: 1113457 - RNA, 23 nt, Human
cacuucaaaucauccaugagucc

SEQ ID NO: 1113458 - RNA, 23 nt, Human
cagaacgggagaaucagaagcuc

SEQ ID NO: 1113459 - RNA, 18 nt, Human
cagaagcucagagacugc

SEQ ID NO: 1113460 - RNA, 24 nt, Human
caggguuucaccauguuaaccagg

SEQ ID NO: 1113461 - RNA, 18 nt, Human
caucacaagucaaagccu

SEQ ID NO: 1113462 - RNA, 26 nt, Human
caucuccauuuaaugugaccccaaaa

SEQ ID NO: 1113463 - RNA, 24 nt, Human
cauguuaaccaggcuggucucaaa

SEQ ID NO: 1113464 - RNA, 24 nt, Human
ccaaagugcagggauuacaggcau

SEQ ID NO: 1113465 - RNA, 21 nt, Human
ccacacaggaauaucccuaau

SEQ ID NO: 1113466 - RNA, 22 nt, Human
cccaaguagcugggguuacagg

SEQ ID NO: 1113467 - RNA, 23 nt, Human
cccaaguagcugggguuacaggu

SEQ ID NO: 1113468 - RNA, 24 nt, Human
cccacacugacaacaaugcagaag

SEQ ID NO: 1113469 - RNA, 19 nt, Human
cccaggcuggagugcagug

SEQ ID NO: 1113470 - RNA, 22 nt, Human
cccaggcuggagugcaguggug

SEQ ID NO: 1113471 - RNA, 18 nt, Human
ccccgucucccaggcugg

SEQ ID NO: 1113472 - RNA, 21 nt, Human
cccuaugcaucuguccaucuc

SEQ ID NO: 1113473 - RNA, 21 nt, Human
ccuaacacuacccacacugac

SEQ ID NO: 1113474 - RNA, 21 nt, Human
ccuagguucaagcacuucucc

SEQ ID NO: 1113475 - RNA, 23 nt, Human
ccuagguucaagcacuucuccug

SEQ ID NO: 1113476 - RNA, 19 nt, Human
ccucccaaagugcagggau

SEQ ID NO: 1113477 - RNA, 20 nt, Human
ccucccaaagugcagggauu

SEQ ID NO: 1113478 - RNA, 18 nt, Human
ccucugacacaguggaaa

SEQ ID NO: 1113479 - RNA, 21 nt, Human
cgccuccuagguucaagcacu

SEQ ID NO: 1113480 - RNA, 18 nt, Human
cguaagaaacuaccuguu

SEQ ID NO: 1113481 - RNA, 27 nt, Human
cuaacacuacccacacugacaacaaug

SEQ ID NO: 1113482 - RNA, 22 nt, Human
cuacagaacgggagaaucagaa

SEQ ID NO: 1113483 - RNA, 22 nt, Human
cuacugugcccagcuaaacagg

SEQ ID NO: 1113484 - RNA, 24 nt, Human
cucagccucccaaguagcuggggu

SEQ ID NO: 1113485 - RNA, 23 nt, Human
cuccuugaguguccacuuucagg

SEQ ID NO: 1113486 - RNA, 24 nt, Human
cucuugauuggcaggaauaagaau

SEQ ID NO: 1113487 - RNA, 24 nt, Human
cugaccucaagccucccaaagugc

SEQ ID NO: 1113488 - RNA, 23 nt, Human
cugcaaccuccgccuccuagguu

SEQ ID NO: 1113489 - RNA, 23 nt, Human
cuggccaaacaauaaaaauacuc

SEQ ID NO: 1113490 - RNA, 23 nt, Human
cugucucagccucccaaguagcu

SEQ ID NO: 1113491 - RNA, 19 nt, Human
cuucuucauucuaaauuuc

SEQ ID NO: 1113492 - RNA, 24 nt, Human
cuuuccccgucucccaggcuggag

SEQ ID NO: 1113493 - RNA, 19 nt, Human
gaacuacagacacacuccu

SEQ ID NO: 1113494 - RNA, 22 nt, Human
gaaguuccuaacacuacccaca

SEQ ID NO: 1113495 - RNA, 22 nt, Human
gacuuacuucuucuucauucua

SEQ ID NO: 1113496 - RNA, 21 nt, Human
gauuacaggcaugagcuacug

SEQ ID NO: 1113497 - RNA, 24 nt, Human
gauuacaggcaugagcuacugugc

SEQ ID NO: 1113498 - RNA, 22 nt, Human
gcaaccuccgccuccuagguuc

SEQ ID NO: 1113499 - RNA, 23 nt, Human
gcuggucucaaacuccugaccuc

SEQ ID NO: 1113500 - RNA, 18 nt, Human
ggagaaucagaagcucag

SEQ ID NO: 1113501 - RNA, 24 nt, Human
ggauuacaggcaugagcuacugug

SEQ ID NO: 1113502 - RNA, 21 nt, Human
ggcaggcacacuuaaaaaugc

SEQ ID NO: 1113503 - RNA, 22 nt, Human
ggccaaacaauaaaaauacucc

SEQ ID NO: 1113504 - RNA, 22 nt, Human
ggcuggagugcaguggugugau

SEQ ID NO: 1113505 - RNA, 24 nt, Human
ggcuggucucaaacuccugaccuc

SEQ ID NO: 1113506 - RNA, 18 nt, Human
gggauuacaggcaugagc

SEQ ID NO: 1113507 - RNA, 21 nt, Human
gggauuacaggcaugagcuac

SEQ ID NO: 1113508 - RNA, 20 nt, Human
gguggaaucaggaucacaga

SEQ ID NO: 1113509 - RNA, 24 nt, Human
gguuacagguacucaccaccaugc

SEQ ID NO: 1113510 - RNA, 20 nt, Human
gucucccaggcuggagugca

SEQ ID NO: 1113511 - RNA, 24 nt, Human
uaauuuuuguguuuuuaguagaga

SEQ ID NO: 1113512 - RNA, 24 nt, Human
uacaggcaugagcuacugugccca

SEQ ID NO: 1113513 - RNA, 22 nt, Human
uacagguacucaccaccaugcc

SEQ ID NO: 1113514 - RNA, 22 nt, Human
uagagacaggguuucaccaugu

SEQ ID NO: 1113515 - RNA, 24 nt, Human
uaguagagacaggguuucaccaug

SEQ ID NO: 1113516 - RNA, 26 nt, Human
uaguagagacaggguuucaccauguu

SEQ ID NO: 1113517 - RNA, 20 nt, Human
uauacuccuuaaacaacuuu

SEQ ID NO: 1113518 - RNA, 24 nt, Human
uauccaauaccugucacacuaagu

SEQ ID NO: 1113519 - RNA, 23 nt, Human
ucacaagcaaagacaaacagcaa

SEQ ID NO: 1113520 - RNA, 19 nt, Human
ucacugcaaccuccgccuc

SEQ ID NO: 1113521 - RNA, 24 nt, Human
ucacugcaaccuccgccuccuagg

SEQ ID NO: 1113522 - RNA, 25 nt, Human
ucacugcaaccuccgccuccuaggu

SEQ ID NO: 1113523 - RNA, 27 nt, Human
ucacugcaaccuccgccuccuagguuc

SEQ ID NO: 1113524 - RNA, 20 nt, Human
ucagccucccaaguagcugg

SEQ ID NO: 1113525 - RNA, 20 nt, Human
ucagccucccaaguagcugg

SEQ ID NO: 1113526 - RNA, 24 nt, Human
ucccaaagugcagggauuacaggc

SEQ ID NO: 1113527 - RNA, 23 nt, Human
ucccaaguagcugggguuacagg

SEQ ID NO: 1113528 - RNA, 21 nt, Human
ucccaggcuggagugcagugg

SEQ ID NO: 1113529 - RNA, 22 nt, Human
ucccaguaaaaaagguggaaaa

SEQ ID NO: 1113530 - RNA, 21 nt, Human
uccuagguucaagcacuucuc

SEQ ID NO: 1113531 - RNA, 24 nt, Human
uccuagguucaagcacuucuccug

SEQ ID NO: 1113532 - RNA, 25 nt, Human
ucucaaacuccugaccucaagccuc

SEQ ID NO: 1113533 - RNA, 21 nt, Human
ucucacauaggacucggcagg

SEQ ID NO: 1113534 - RNA, 24 nt, Human
ucucccaggcuggagugcaguggu

SEQ ID NO: 1113535 - RNA, 26 nt, Human
ucuccugucucagccucccaaguagc

SEQ ID NO: 1113536 - RNA, 24 nt, Human
ucuuuccccgucucccaggcugga

SEQ ID NO: 1113537 - RNA, 19 nt, Human
ugaaacaaaauccacauua

SEQ ID NO: 1113538 - RNA, 20 nt, Human
ugaaacaaaauccacauuau

SEQ ID NO: 1113539 - RNA, 21 nt, Human
ugaacuacagacacacuccuu

SEQ ID NO: 1113540 - RNA, 22 nt, Human
ugcaguggugugaucuuggcuc

SEQ ID NO: 1113541 - RNA, 18 nt, Human
uggaaaauaagcugaagg

SEQ ID NO: 1113542 - RNA, 19 nt, Human
uggagugcaguggugugau

SEQ ID NO: 1113543 - RNA, 23 nt, Human
uggagugcaguggugugaucuug

SEQ ID NO: 1113544 - RNA, 24 nt, Human
uggagugcaguggugugaucuugg

SEQ ID NO: 1113545 - RNA, 19 nt, Human
uggccaaacaauaaaaaua

SEQ ID NO: 1113546 - RNA, 24 nt, Human
uggccaaacaauaaaaauacuccc

SEQ ID NO: 1113547 - RNA, 26 nt, Human
uggccaaacaauaaaaauacucccag

SEQ ID NO: 1113548 - RNA, 19 nt, Human
ugggguuacagguacucac

SEQ ID NO: 1113549 - RNA, 21 nt, Human
ugggguuacagguacucacca

SEQ ID NO: 1113550 - RNA, 24 nt, Human
ugucucagccucccaaguagcugg

SEQ ID NO: 1113551 - RNA, 22 nt, Human
ugugauggagucuuuccccguc

SEQ ID NO: 1113552 - RNA, 21 nt, Human
uuaaccuauaucaagaaacug

SEQ ID NO: 1113553 - RNA, 24 nt, Human
uuaguagagacaggguuucaccau

SEQ ID NO: 1113554 - RNA, 23 nt, Human
uugcaaaugaacuacagacacac

SEQ ID NO: 1113555 - RNA, 24 nt, Human
uuuccccgucucccaggcuggagu

SEQ ID NO: 1113556 - RNA, 23 nt, Human
uuugacugcaacacuguggcuuu

SEQ ID NO: 1113557 - RNA, 22 nt, Human
uuuuguguuuuuaguagagaca

SEQ ID NO: 1113558 - RNA, 24 nt, Human
uuuuuaguagagacaggguuucac

SEQ ID NO: 1113559 - RNA, 20 nt, Human
uuuuuguguuuuuaguagag

SEQ ID NO: 1113560 - RNA, 24 nt, Human
aaccaucugaacaucaaagaauga

SEQ ID NO: 1113561 - RNA, 22 nt, Human
accuguuacacagaagaacauc

SEQ ID NO: 1113562 - RNA, 20 nt, Human
agccccugacacggcucaua

SEQ ID NO: 1113563 - RNA, 18 nt, Human
cagagggccacaaccauc

SEQ ID NO: 1113564 - RNA, 20 nt, Human
cccccgaacccuaaaggaag

SEQ ID NO: 1113565 - RNA, 18 nt, Human
ccccuacgacauuagcuu

SEQ ID NO: 1113566 - RNA, 19 nt, Human
ccucccugagcccucacug

SEQ ID NO: 1113567 - RNA, 22 nt, Human
ggccacaaccaucugaacauca

SEQ ID NO: 1113568 - RNA, 20 nt, Human
gggaacaaggauauuuuguc

SEQ ID NO: 1113569 - RNA, 18 nt, Human
ggugcugguggugguggu

SEQ ID NO: 1113570 - RNA, 24 nt, Human
guacaauucauuaauaacucugag

SEQ ID NO: 1113571 - RNA, 20 nt, Human
uauuuugucucuucuguuca

SEQ ID NO: 1113572 - RNA, 19 nt, Human
ucacugcagcaccuaggac

SEQ ID NO: 1113573 - RNA, 19 nt, Human
ucccugagcccucacuguc

SEQ ID NO: 1113574 - RNA, 21 nt, Human
ucccuuguggaaggaggagau

SEQ ID NO: 1113575 - RNA, 20 nt, Human
ucugaacaucaaagaaugag

SEQ ID NO: 1113576 - RNA, 19 nt, Human
ugauggagugguggugcug

SEQ ID NO: 1113577 - RNA, 18 nt, Human
ugcugguggugguggugg

SEQ ID NO: 1113578 - RNA, 20 nt, Human
uggaaggaggagaucccccg

SEQ ID NO: 1113579 - RNA, 23 nt, Human
uggaaggaggagaucccccgaac

SEQ ID NO: 1113580 - RNA, 19 nt, Human
ugguggugcuggugguggu

SEQ ID NO: 1113581 - RNA, 20 nt, Human
ugguggugcuggugguggug

SEQ ID NO: 1113582 - RNA, 19 nt, Human
ugguggugguggugggagc

SEQ ID NO: 1113583 - RNA, 18 nt, Human
uggugguggugguggugg

SEQ ID NO: 1113584 - RNA, 22 nt, Human
uggugguggugguggugggagc

SEQ ID NO: 1113585 - RNA, 20 nt, Human
uguuuugggccccuacgaca

SEQ ID NO: 1113586 - RNA, 19 nt, Human
uucacugcagcaccuagga

SEQ ID NO: 1113587 - RNA, 24 nt, Human
uugacuugcauuccuuuuuuuugu

SEQ ID NO: 1113588 - RNA, 19 nt, Human
uugauggagugguggugcu

SEQ ID NO: 1113589 - RNA, 20 nt, Human
uuuuguuuguuugcuuuguu

SEQ ID NO: 1113590 - RNA, 24 nt, Human
augacagcagcuuuaaauaaguac

SEQ ID NO: 1113591 - RNA, 19 nt, Human
auuuguaagacugcucccu

SEQ ID NO: 1113592 - RNA, 20 nt, Human
caguaugaacuuucugaugu

SEQ ID NO: 1113593 - RNA, 19 nt, Human
caguaugaauucuuugaug

SEQ ID NO: 1113594 - RNA, 21 nt, Human
cauucauuacaugcauaaggu

SEQ ID NO: 1113595 - RNA, 23 nt, Human
ccuguaucuucuuggauuuuugu

SEQ ID NO: 1113596 - RNA, 21 nt, Human
cuccaguaugaauuuuuucau

SEQ ID NO: 1113597 - RNA, 23 nt, Human
cuccaguaugaauuuuuucauga

SEQ ID NO: 1113598 - RNA, 22 nt, Human
ggaagaauucucuaauguuuca

SEQ ID NO: 1113599 - RNA, 22 nt, Human
gucaagucuuuucagacaaaau

SEQ ID NO: 1113600 - RNA, 18 nt, Human
gugcaaugagguguuaau

SEQ ID NO: 1113601 - RNA, 20 nt, Human
uaaauaagccauucauuccc

SEQ ID NO: 1113602 - RNA, 19 nt, Human
uaaauaaguacaugauaua

SEQ ID NO: 1113603 - RNA, 22 nt, Human
uaccacauucauuacaugcaua

SEQ ID NO: 1113604 - RNA, 21 nt, Human
ucauguaaugugcaaugaggu

SEQ ID NO: 1113605 - RNA, 23 nt, Human
ucauuguuguguuuauucuuagg

SEQ ID NO: 1113606 - RNA, 18 nt, Human
ugaugugcaaugaggcuu

SEQ ID NO: 1113607 - RNA, 24 nt, Human
ugcuuugucaaguuuguuucagcu

SEQ ID NO: 1113608 - RNA, 19 nt, Human
uggaagugaucauguaaug

SEQ ID NO: 1113609 - RNA, 20 nt, Human
uggcugaaugcuuuuccaca

SEQ ID NO: 1113610 - RNA, 24 nt, Human
uggcugaaugcuuuuccacacuca

SEQ ID NO: 1113611 - RNA, 18 nt, Human
uguggcuuuuucagaagg

SEQ ID NO: 1113612 - RNA, 21 nt, Human
uguuguuaugcugauggaaga

SEQ ID NO: 1113613 - RNA, 18 nt, Human
uguuucuuuacuuuucca

SEQ ID NO: 1113614 - RNA, 24 nt, Human
uuaaaugacagcagcuuuaaauaa

SEQ ID NO: 1113615 - RNA, 19 nt, Human
uucauaagguuucucucca

SEQ ID NO: 1113616 - RNA, 21 nt, Human
uugcuuugucaaguuuguuuc

SEQ ID NO: 1113617 - RNA, 21 nt, Human
uuuccacacucauuacauuca

SEQ ID NO: 1113618 - RNA, 18 nt, Human
uuuguggcuuuuucagaa

SEQ ID NO: 1113619 - RNA, 23 nt, Human
aaacuccuggacucaagcaaucc

SEQ ID NO: 1113620 - RNA, 24 nt, Human
aaagugcugggacuauagguauga

SEQ ID NO: 1113621 - RNA, 25 nt, Human
aagcaauccuuccaccuuggcuucc

SEQ ID NO: 1113622 - RNA, 27 nt, Human
aagcaauccuuccaccuuggcuuccca

SEQ ID NO: 1113623 - RNA, 19 nt, Human
aagugcugggacuauaggu

SEQ ID NO: 1113624 - RNA, 26 nt, Human
aagugcugggacuauagguaugaacc

SEQ ID NO: 1113625 - RNA, 25 nt, Human
aaguucuuuccagcuguuuacaucc

SEQ ID NO: 1113626 - RNA, 25 nt, Human
acuauguugcccaggcuggucccaa

SEQ ID NO: 1113627 - RNA, 22 nt, Human
aggucucacuauguugcccagg

SEQ ID NO: 1113628 - RNA, 19 nt, Human
auuuaagauuacuugguug

SEQ ID NO: 1113629 - RNA, 25 nt, Human
caaacuccuggacucaagcaauccu

SEQ ID NO: 1113630 - RNA, 24 nt, Human
caaagugcugggacuauagguaug

SEQ ID NO: 1113631 - RNA, 27 nt, Human
caagcaauccuuccaccuuggcuuccc

SEQ ID NO: 1113632 - RNA, 19 nt, Human
cacuauguugcccaggcug

SEQ ID NO: 1113633 - RNA, 22 nt, Human
cacuauguugcccaggcugguc

SEQ ID NO: 1113634 - RNA, 27 nt, Human
cacuauguugcccaggcuggucccaaa

SEQ ID NO: 1113635 - RNA, 21 nt, Human
ccaaagugcugggacuauagg

SEQ ID NO: 1113636 - RNA, 22 nt, Human
ccaaagugcugggacuauaggu

SEQ ID NO: 1113637 - RNA, 24 nt, Human
ccaaagugcugggacuauagguau

SEQ ID NO: 1113638 - RNA, 22 nt, Human
cccaaagugcugggacuauagg

SEQ ID NO: 1113639 - RNA, 23 nt, Human
ccucaccugucugguucccuucc

SEQ ID NO: 1113640 - RNA, 24 nt, Human
ccucugaaaauaucuuugaagaau

SEQ ID NO: 1113641 - RNA, 20 nt, Human
ccuggacucaagcaauccuu

SEQ ID NO: 1113642 - RNA, 19 nt, Human
ccugucugguucccuucca

SEQ ID NO: 1113643 - RNA, 24 nt, Human
cucaagcaauccuuccaccuuggc

SEQ ID NO: 1113644 - RNA, 21 nt, Human
cucugaaggguccuagaaaaa

SEQ ID NO: 1113645 - RNA, 23 nt, Human
cuuugaagaauauuuuagaggga

SEQ ID NO: 1113646 - RNA, 19 nt, Human
gacuauagguaugaaccac

SEQ ID NO: 1113647 - RNA, 21 nt, Human
gacuauagguaugaaccacug

SEQ ID NO: 1113648 - RNA, 19 nt, Human
gcuggucccaaacuccugg

SEQ ID NO: 1113649 - RNA, 22 nt, Human
guccuguuucucucagcuggca

SEQ ID NO: 1113650 - RNA, 25 nt, Human
uaauaggcccugaccucuccucacc

SEQ ID NO: 1113651 - RNA, 21 nt, Human
uagguaugaaccacugugcca

SEQ ID NO: 1113652 - RNA, 23 nt, Human
uauguugcccaggcuggucccaa

SEQ ID NO: 1113653 - RNA, 24 nt, Human
uauguugcccaggcuggucccaaa

SEQ ID NO: 1113654 - RNA, 23 nt, Human
ucccaaagugcugggacuauagg

SEQ ID NO: 1113655 - RNA, 24 nt, Human
ucccaaagugcugggacuauaggu

SEQ ID NO: 1113656 - RNA, 23 nt, Human
uccccagauuuaagauuacuugg

SEQ ID NO: 1113657 - RNA, 19 nt, Human
ucucacuauguugcccagg

SEQ ID NO: 1113658 - RNA, 23 nt, Human
ucucacuauguugcccaggcugg

SEQ ID NO: 1113659 - RNA, 24 nt, Human
ucucacuauguugcccaggcuggu

SEQ ID NO: 1113660 - RNA, 26 nt, Human
ucucacuauguugcccaggcuggucc

SEQ ID NO: 1113661 - RNA, 27 nt, Human
ucucacuauguugcccaggcugguccc

SEQ ID NO: 1113662 - RNA, 24 nt, Human
ugaggucucacuauguugcccagg

SEQ ID NO: 1113663 - RNA, 24 nt, Human
ugcccaggcuggucccaaacuccu

SEQ ID NO: 1113664 - RNA, 22 nt, Human
ugggacuauagguaugaaccac

SEQ ID NO: 1113665 - RNA, 24 nt, Human
ugggacuauagguaugaaccacug

SEQ ID NO: 1113666 - RNA, 30 nt, Human
ugggacuauagguaugaaccacugugccaa

SEQ ID NO: 1113667 - RNA, 22 nt, Human
uugcccugugaccucaguucuc

SEQ ID NO: 1113668 - RNA, 22 nt, Human
uugguugcccugugaccucagu

SEQ ID NO: 1113669 - RNA, 22 nt, Human
uuuaagauuacuugguugcccu

SEQ ID NO: 1113670 - RNA, 22 nt, Human
aauccuggaacuuuucccacua

SEQ ID NO: 1113671 - RNA, 19 nt, Human
cagcaggaaguuaaaaaca

SEQ ID NO: 1113672 - RNA, 22 nt, Human
cgaaacaagcaguuuucagccc

SEQ ID NO: 1113673 - RNA, 20 nt, Human
uaaaaacacugguaaaucaa

SEQ ID NO: 1113674 - RNA, 25 nt, Human
uaauccuggaacuuuucccacuagc

SEQ ID NO: 1113675 - RNA, 27 nt, Human
uaguuuccugacauguaauccuggaac

SEQ ID NO: 1113676 - RNA, 22 nt, Human
ugaauucccaggaaucaaucac

SEQ ID NO: 1113677 - RNA, 24 nt, Human
uguaauccuggaacuuuucccacu

SEQ ID NO: 1113678 - RNA, 22 nt, Human
uuagauguuugcugucaaguuu

SEQ ID NO: 1113679 - RNA, 21 nt, Human
uuuccugacauguaauccugg

SEQ ID NO: 1113680 - RNA, 19 nt, Human
aaaugucuuuaaauagaua

SEQ ID NO: 1113681 - RNA, 23 nt, Human
agcuucuaauggugcaacaaucu

SEQ ID NO: 1113682 - RNA, 20 nt, Human
cgagaaaaacauuaaguugg

SEQ ID NO: 1113683 - RNA, 18 nt, Human
uauuugaauauuauaauu

SEQ ID NO: 1113684 - RNA, 20 nt, Human
ucuguggaucaaccuagcuu

SEQ ID NO: 1113685 - RNA, 22 nt, Human
uguggaucaaccuagcuucuaa

SEQ ID NO: 1113686 - RNA, 22 nt, Human
uucacauucuucgagaaaaaca

SEQ ID NO: 1113687 - RNA, 19 nt, Human
aaaaauauauauuccuauc

SEQ ID NO: 1113688 - RNA, 21 nt, Human
aaaacaaaaucauacuccucc

SEQ ID NO: 1113689 - RNA, 22 nt, Human
aaaacaaaaucauacuccuccu

SEQ ID NO: 1113690 - RNA, 23 nt, Human
aaaauauauauuccuaucuuuug

SEQ ID NO: 1113691 - RNA, 25 nt, Human
aaagugcuugagauuacaggcauga

SEQ ID NO: 1113692 - RNA, 18 nt, Human
aacaaguguaacuaacuu

SEQ ID NO: 1113693 - RNA, 19 nt, Human
aaccaccacaccuggccug

SEQ ID NO: 1113694 - RNA, 21 nt, Human
aacuaaaaacaaaaucauacu

SEQ ID NO: 1113695 - RNA, 20 nt, Human
aagaaagaaguuaaaaagaa

SEQ ID NO: 1113696 - RNA, 22 nt, Human
aagaaagaaguuaaaaagaaga

SEQ ID NO: 1113697 - RNA, 25 nt, Human
aagaaagaaguuaaaaagaagaggu

SEQ ID NO: 1113698 - RNA, 22 nt, Human
aagacuggguaauaauccauua

SEQ ID NO: 1113699 - RNA, 23 nt, Human
aagauuucuugaaguaagccacu

SEQ ID NO: 1113700 - RNA, 19 nt, Human
aagcugcuuuucuaauucu

SEQ ID NO: 1113701 - RNA, 20 nt, Human
aaggaucggguagcucaaaa

SEQ ID NO: 1113702 - RNA, 18 nt, Human
aagugauccucccacuuc

SEQ ID NO: 1113703 - RNA, 21 nt, Human
aagugauccucccacuucaga

SEQ ID NO: 1113704 - RNA, 27 nt, Human
aagugcuugagauuacaggcaugaacc

SEQ ID NO: 1113705 - RNA, 18 nt, Human
aaugacaucuuggggacc

SEQ ID NO: 1113706 - RNA, 21 nt, Human
aaugagguuaaaaaugggugu

SEQ ID NO: 1113707 - RNA, 24 nt, Human
acagaauuuccaucauuuuuaaag

SEQ ID NO: 1113708 - RNA, 23 nt, Human
acagggcuucuaaaagggcagga

SEQ ID NO: 1113709 - RNA, 20 nt, Human
accacauuuccuuuauccau

SEQ ID NO: 1113710 - RNA, 21 nt, Human
acccugaaauauuuuggaaaa

SEQ ID NO: 1113711 - RNA, 22 nt, Human
acuacaggugcaugccaccauu

SEQ ID NO: 1113712 - RNA, 19 nt, Human
acugcagccuugaccuccu

SEQ ID NO: 1113713 - RNA, 24 nt, Human
agaaauagcccuuuggcccacagg

SEQ ID NO: 1113714 - RNA, 18 nt, Human
agagaauccagucuauga

SEQ ID NO: 1113715 - RNA, 21 nt, Human
agagaauccagucuaugaaaa

SEQ ID NO: 1113716 - RNA, 22 nt, Human
agauuacaggcaugaaccacca

SEQ ID NO: 1113717 - RNA, 18 nt, Human
agcucaaaagaaggcaag

SEQ ID NO: 1113718 - RNA, 20 nt, Human
agcuggucucaaacuccugg

SEQ ID NO: 1113719 - RNA, 25 nt, Human
aggaaaaggugaguuacauuuagaa

SEQ ID NO: 1113720 - RNA, 18 nt, Human
aggauauacuguuugaaa

SEQ ID NO: 1113721 - RNA, 22 nt, Human
aggcaagcuuccucagagcuca

SEQ ID NO: 1113722 - RNA, 19 nt, Human
aggcaugaaccaccacacc

SEQ ID NO: 1113723 - RNA, 20 nt, Human
aggcugggguccagugagcu

SEQ ID NO: 1113724 - RNA, 22 nt, Human
agggaaccagguuugcaaaagu

SEQ ID NO: 1113725 - RNA, 18 nt, Human
auaaagaagcaaguuuaa

SEQ ID NO: 1113726 - RNA, 24 nt, Human
aucauacauaaguaaauguauuug

SEQ ID NO: 1113727 - RNA, 24 nt, Human
auuggcugacaaguugcuuuuugu

SEQ ID NO: 1113728 - RNA, 20 nt, Human
auuucuugaaguaagccacu

SEQ ID NO: 1113729 - RNA, 25 nt, Human
caaagugcuugagauuacaggcaug

SEQ ID NO: 1113730 - RNA, 21 nt, Human
caagaauaaagcugcuuuucu

SEQ ID NO: 1113731 - RNA, 19 nt, Human
cacauaguucaaaaucagg

SEQ ID NO: 1113732 - RNA, 19 nt, Human
caccucaaauacuuaacac

SEQ ID NO: 1113733 - RNA, 20 nt, Human
cacugagcacaauauucucc

SEQ ID NO: 1113734 - RNA, 19 nt, Human
cacugcagccuugaccucc

SEQ ID NO: 1113735 - RNA, 21 nt, Human
cacugcagccuugaccuccug

SEQ ID NO: 1113736 - RNA, 21 nt, Human
cacugcagccuugaccuccug

SEQ ID NO: 1113737 - RNA, 21 nt, Human
cacuguguugccuuagcuggu

SEQ ID NO: 1113738 - RNA, 24 nt, Human
cacuguguugccuuagcuggucuc

SEQ ID NO: 1113739 - RNA, 23 nt, Human
cagaauuuccaucauuuuuaaag

SEQ ID NO: 1113740 - RNA, 20 nt, Human
cagccuugaccuccuggacu

SEQ ID NO: 1113741 - RNA, 21 nt, Human
cauuaauaauugccaccuggc

SEQ ID NO: 1113742 - RNA, 25 nt, Human
ccaaagugcuugagauuacaggcau

SEQ ID NO: 1113743 - RNA, 19 nt, Human
ccacugcagccuugaccuc

SEQ ID NO: 1113744 - RNA, 20 nt, Human
cccugaaauauuuuggaaaa

SEQ ID NO: 1113745 - RNA, 22 nt, Human
ccuagaagugguauuacugaau

SEQ ID NO: 1113746 - RNA, 23 nt, Human
ccucuguaaccaccauucugcuc

SEQ ID NO: 1113747 - RNA, 20 nt, Human
ccugauuuuuuucuugagua

SEQ ID NO: 1113748 - RNA, 18 nt, Human
ccuggcuuauuucacuga

SEQ ID NO: 1113749 - RNA, 20 nt, Human
ccugggcugaagugauccuc

SEQ ID NO: 1113750 - RNA, 23 nt, Human
ccuguagcugggacuacaggugc

SEQ ID NO: 1113751 - RNA, 22 nt, Human
ccuugaccuccuggacucacgu

SEQ ID NO: 1113752 - RNA, 21 nt, Human
cggagauguaacagggcuucu

SEQ ID NO: 1113753 - RNA, 23 nt, Human
cgugauguggcagaagcgaaggg

SEQ ID NO: 1113754 - RNA, 24 nt, Human
cucauucugucaucuaggcugggg

SEQ ID NO: 1113755 - RNA, 21 nt, Human
cugagcacaauauucuccacu

SEQ ID NO: 1113756 - RNA, 22 nt, Human
cugcagccuugaccuccuggac

SEQ ID NO: 1113757 - RNA, 23 nt, Human
cugcagccuugaccuccuggacu

SEQ ID NO: 1113758 - RNA, 26 nt, Human
cuguagcugggacuacaggugcaugc

SEQ ID NO: 1113759 - RNA, 24 nt, Human
gaaauuuauucucuuaauugugaa

SEQ ID NO: 1113760 - RNA, 21 nt, Human
gaaccagguuugcaaaaguaa

SEQ ID NO: 1113761 - RNA, 21 nt, Human
gaagggaaccagguuugcaaa

SEQ ID NO: 1113762 - RNA, 19 nt, Human
gagacaggucucacugugu

SEQ ID NO: 1113763 - RNA, 19 nt, Human
ggcuuagaaggacaagaua

SEQ ID NO: 1113764 - RNA, 20 nt, Human
guaaaccaugcuauuaaccc

SEQ ID NO: 1113765 - RNA, 23 nt, Human
guccuguagcugggacuacaggu

SEQ ID NO: 1113766 - RNA, 22 nt, Human
gugauccucccacuucagacuc

SEQ ID NO: 1113767 - RNA, 18 nt, Human
gugcuugagauuacaggc

SEQ ID NO: 1113768 - RNA, 23 nt, Human
uaaaaacaaaaucauacuccucc

SEQ ID NO: 1113769 - RNA, 23 nt, Human
uaaaaguggcagguuucuuaaaa

SEQ ID NO: 1113770 - RNA, 22 nt, Human
uaaagugaugugauggcccaca

SEQ ID NO: 1113771 - RNA, 19 nt, Human
uaagaugucaguuuugaag

SEQ ID NO: 1113772 - RNA, 22 nt, Human
uacaggcaugaaccaccacacc

SEQ ID NO: 1113773 - RNA, 23 nt, Human
uacgagagaauccagucuaugaa

SEQ ID NO: 1113774 - RNA, 18 nt, Human
uacugcauuuuuuuauug

SEQ ID NO: 1113775 - RNA, 22 nt, Human
uacuguuugaaaauggaaaguu

SEQ ID NO: 1113776 - RNA, 24 nt, Human
uagaacuaaaaacaaaaucauacu

SEQ ID NO: 1113777 - RNA, 22 nt, Human
uagaagugguauuacugaaucu

SEQ ID NO: 1113778 - RNA, 21 nt, Human
uaggcugggguccagugagcu

SEQ ID NO: 1113779 - RNA, 19 nt, Human
uagggcacaugaaaugaaa

SEQ ID NO: 1113780 - RNA, 21 nt, Human
uaguuccuuuugagaaucugg

SEQ ID NO: 1113781 - RNA, 18 nt, Human
uauacuguuugaaaaugg

SEQ ID NO: 1113782 - RNA, 24 nt, Human
uauaguagggcacaugaaaugaaa

SEQ ID NO: 1113783 - RNA, 19 nt, Human
uauguauauguauaccaca

SEQ ID NO: 1113784 - RNA, 22 nt, Human
ucaaacuccugggcugaaguga

SEQ ID NO: 1113785 - RNA, 25 nt, Human
uccacaauaauguuuuuagguuauu

SEQ ID NO: 1113786 - RNA, 25 nt, Human
ucccaaagugcuugagauuacaggc

SEQ ID NO: 1113787 - RNA, 19 nt, Human
ucccuaaaaauuuggcaag

SEQ ID NO: 1113788 - RNA, 21 nt, Human
uccuccuguuggagauuuuau

SEQ ID NO: 1113789 - RNA, 23 nt, Human
uccuguagcugggacuacaggug

SEQ ID NO: 1113790 - RNA, 21 nt, Human
ucucaaacuccugggcugaag

SEQ ID NO: 1113791 - RNA, 24 nt, Human
ucucaaacuccugggcugaaguga

SEQ ID NO: 1113792 - RNA, 23 nt, Human
ucucacuguguugccuuagcugg

SEQ ID NO: 1113793 - RNA, 24 nt, Human
ucucauucugucaucuaggcuggg

SEQ ID NO: 1113794 - RNA, 21 nt, Human
ucucccuaaaaauuuggcaag

SEQ ID NO: 1113795 - RNA, 20 nt, Human
ucucuuggacaaacugauuu

SEQ ID NO: 1113796 - RNA, 25 nt, Human
ugaaaagaagcccaagaaagaaguu

SEQ ID NO: 1113797 - RNA, 20 nt, Human
ugaaaccaaguacuguuugc

SEQ ID NO: 1113798 - RNA, 18 nt, Human
ugaaaugaaaccaaguac

SEQ ID NO: 1113799 - RNA, 22 nt, Human
ugaaaugaaaccaaguacuguu

SEQ ID NO: 1113800 - RNA, 18 nt, Human
ugaagccauuuuuuuuua

SEQ ID NO: 1113801 - RNA, 19 nt, Human
ugaaguaagccacuugaac

SEQ ID NO: 1113802 - RNA, 20 nt, Human
ugaaugagguuaaaaauggg

SEQ ID NO: 1113803 - RNA, 18 nt, Human
ugagagcaauacaagaau

SEQ ID NO: 1113804 - RNA, 24 nt, Human
ugagauuacaggcaugaaccacca

SEQ ID NO: 1113805 - RNA, 24 nt, Human
ugagauuacaggcaugaaccacca

SEQ ID NO: 1113806 - RNA, 22 nt, Human
ugagcugugauugugccacugc

SEQ ID NO: 1113807 - RNA, 19 nt, Human
ugcaaacuuuaccaugcua

SEQ ID NO: 1113808 - RNA, 24 nt, Human
ugcaugccaccauuaauaauugcc

SEQ ID NO: 1113809 - RNA, 21 nt, Human
ugcauuaauauaguagggcac

SEQ ID NO: 1113810 - RNA, 21 nt, Human
ugccucuuuaagaaauagccc

SEQ ID NO: 1113811 - RNA, 19 nt, Human
ugcuauuaacccaacaucu

SEQ ID NO: 1113812 - RNA, 19 nt, Human
ugcucagaagaaggaucgg

SEQ ID NO: 1113813 - RNA, 19 nt, Human
ugcugcaaugaacauggga

SEQ ID NO: 1113814 - RNA, 24 nt, Human
uggaauagaaaguaauacuuaaug

SEQ ID NO: 1113815 - RNA, 21 nt, Human
uggcuucucaggccugggggg

SEQ ID NO: 1113816 - RNA, 21 nt, Human
ugggacuacaggugcaugcca

SEQ ID NO: 1113817 - RNA, 22 nt, Human
ugggacuacaggugcaugccac

SEQ ID NO: 1113818 - RNA, 24 nt, Human
ugggacuacaggugcaugccacca

SEQ ID NO: 1113819 - RNA, 25 nt, Human
ugggacuacaggugcaugccaccau

SEQ ID NO: 1113820 - RNA, 22 nt, Human
ugggagugccacucucuuggac

SEQ ID NO: 1113821 - RNA, 24 nt, Human
ugguagagaugaggucucauucug

SEQ ID NO: 1113822 - RNA, 19 nt, Human
uguacugucaaguauaaga

SEQ ID NO: 1113823 - RNA, 19 nt, Human
uguaguccuguagcuggga

SEQ ID NO: 1113824 - RNA, 24 nt, Human
ugugccacugcagccuugaccucc

SEQ ID NO: 1113825 - RNA, 24 nt, Human
uguguugccuuagcuggucucaaa

SEQ ID NO: 1113826 - RNA, 18 nt, Human
uuaagcucuuauucuuau

SEQ ID NO: 1113827 - RNA, 24 nt, Human
uuaagcucuuauucuuaugaaccu

SEQ ID NO: 1113828 - RNA, 22 nt, Human
uuaguuccuuuugagaaucugg

SEQ ID NO: 1113829 - RNA, 24 nt, Human
uucaagaaaacagguugggaaugg

SEQ ID NO: 1113830 - RNA, 19 nt, Human
uucugcucucugcuucugu

SEQ ID NO: 1113831 - RNA, 20 nt, Human
uucuuguugaacagcagcuu

SEQ ID NO: 1113832 - RNA, 27 nt, Human
uugccaccuggcuaauuaguuuuuuua

SEQ ID NO: 1113833 - RNA, 22 nt, Human
uuggcaagcaacagaccaacca

SEQ ID NO: 1113834 - RNA, 21 nt, Human
uugggaaugguucccacgugg

SEQ ID NO: 1113835 - RNA, 21 nt, Human
uugguagagaugaggucucau

SEQ ID NO: 1113836 - RNA, 19 nt, Human
uugguauuuuggcuaaggu

SEQ ID NO: 1113837 - RNA, 23 nt, Human
uuucuuguugaacagcagcuuca

SEQ ID NO: 1113838 - RNA, 23 nt, Human
uuuugugccuggcuuauuucacu

SEQ ID NO: 1113839 - RNA, 19 nt, Human
uuuuugguagagaugaggu

SEQ ID NO: 1113840 - RNA, 28 nt, Human
uuuuuuuuuuuaauuuuugguagagaug

SEQ ID NO: 1113841 - RNA, 20 nt, Human
aaacaugcagaaaagccccc

SEQ ID NO: 1113842 - RNA, 18 nt, Human
aaagcccccagcccuacu

SEQ ID NO: 1113843 - RNA, 22 nt, Human
aaagcccccagcccuacuuucc

SEQ ID NO: 1113844 - RNA, 24 nt, Human
aagcccccagcccuacuuuccuag

SEQ ID NO: 1113845 - RNA, 20 nt, Human
acccugcuuuuccucuauca

SEQ ID NO: 1113846 - RNA, 18 nt, Human
agaaaagcccccagcccu

SEQ ID NO: 1113847 - RNA, 18 nt, Human
agaaaggcagcuaguccc

SEQ ID NO: 1113848 - RNA, 19 nt, Human
aguucccuucccugggugg

SEQ ID NO: 1113849 - RNA, 22 nt, Human
aguucccuucccuggguggcau

SEQ ID NO: 1113850 - RNA, 20 nt, Human
caaguaacacuggaaaaccc

SEQ ID NO: 1113851 - RNA, 21 nt, Human
caaguauguacuaucuaccaa

SEQ ID NO: 1113852 - RNA, 25 nt, Human
cacccugcuuuuccucuaucaucuc

SEQ ID NO: 1113853 - RNA, 19 nt, Human
cacuggaaaacccgccugc

SEQ ID NO: 1113854 - RNA, 21 nt, Human
cagaaaggcagcuaguccccc

SEQ ID NO: 1113855 - RNA, 21 nt, Human
cagcccgcucugcuccagucc

SEQ ID NO: 1113856 - RNA, 19 nt, Human
cccagcccuacuuuccuag

SEQ ID NO: 1113857 - RNA, 22 nt, Human
cccccagcccuacuuuccuagc

SEQ ID NO: 1113858 - RNA, 20 nt, Human
cccgcucugcuccagucccg

SEQ ID NO: 1113859 - RNA, 21 nt, Human
ccuuccuucuaucuuuuaucc

SEQ ID NO: 1113860 - RNA, 22 nt, Human
cgccugcgcugggaagacccuc

SEQ ID NO: 1113861 - RNA, 20 nt, Human
cuacagcauugugccuuagu

SEQ ID NO: 1113862 - RNA, 19 nt, Human
cuccagucccgcaggcacc

SEQ ID NO: 1113863 - RNA, 21 nt, Human
cugaguaccuucuauauggga

SEQ ID NO: 1113864 - RNA, 21 nt, Human
cuuuccuagcaugcagcaccc

SEQ ID NO: 1113865 - RNA, 24 nt, Human
gaaaacaucuccacuaagaggacu

SEQ ID NO: 1113866 - RNA, 23 nt, Human
gcuccagucccgcaggcaccuuc

SEQ ID NO: 1113867 - RNA, 18 nt, Human
uaacacuggaaaacccgc

SEQ ID NO: 1113868 - RNA, 21 nt, Human
ucuacagcauugugccuuagu

SEQ ID NO: 1113869 - RNA, 18 nt, Human
ugaaaacaucuccacuaa

SEQ ID NO: 1113870 - RNA, 20 nt, Human
ugaaaacaucuccacuaaga

SEQ ID NO: 1113871 - RNA, 25 nt, Human
ugaaaacaucuccacuaagaggacu

SEQ ID NO: 1113872 - RNA, 21 nt, Human
ugaucuacagcauugugccuu

SEQ ID NO: 1113873 - RNA, 21 nt, Human
ugccagaaaggcagcuagucc

SEQ ID NO: 1113874 - RNA, 22 nt, Human
ugccagaaaggcagcuaguccc

SEQ ID NO: 1113875 - RNA, 19 nt, Human
uuacaagguuaccaugcaa

SEQ ID NO: 1113876 - RNA, 23 nt, Human
uugcggcuuccugccugcugcca

SEQ ID NO: 1113877 - RNA, 18 nt, Human
uuuacugaguaccuucua

SEQ ID NO: 1113878 - RNA, 25 nt, Human
uuuacugaguaccuucuauauggga

SEQ ID NO: 1113879 - RNA, 19 nt, Human
uaagagcccaugcaagaac

SEQ ID NO: 1113880 - RNA, 20 nt, Human
ugcuuaagagcccaugcaag

SEQ ID NO: 1113881 - RNA, 22 nt, Human
ugugaaaauuucccuuuaaguu

SEQ ID NO: 1113882 - RNA, 22 nt, Human
aaaaagaacucaauaagaagca

SEQ ID NO: 1113883 - RNA, 21 nt, Human
aaagagcagccacccuccaca

SEQ ID NO: 1113884 - RNA, 24 nt, Human
aaagugcggggauuacaggcauga

SEQ ID NO: 1113885 - RNA, 18 nt, Human
aagaaggccccugaaggc

SEQ ID NO: 1113886 - RNA, 20 nt, Human
aagaugccugggugacuugu

SEQ ID NO: 1113887 - RNA, 24 nt, Human
aagcaauccacccgccuuggcauc

SEQ ID NO: 1113888 - RNA, 21 nt, Human
aaggaagagccaggaccagug

SEQ ID NO: 1113889 - RNA, 21 nt, Human
aaggagccagaacuacaggug

SEQ ID NO: 1113890 - RNA, 20 nt, Human
aaggucuggaagccugagug

SEQ ID NO: 1113891 - RNA, 25 nt, Human
aaguaauccucccacuuuagccucc

SEQ ID NO: 1113892 - RNA, 22 nt, Human
aaguagccagcaaggcugggag

SEQ ID NO: 1113893 - RNA, 21 nt, Human
aauuugcaguuucucuuccuc

SEQ ID NO: 1113894 - RNA, 18 nt, Human
aauuuuaaaaaagaacuc

SEQ ID NO: 1113895 - RNA, 19 nt, Human
acacaugcugugccccaug

SEQ ID NO: 1113896 - RNA, 18 nt, Human
acagagcagcgaggggag

SEQ ID NO: 1113897 - RNA, 23 nt, Human
accaugguguggcugcccugggg

SEQ ID NO: 1113898 - RNA, 18 nt, Human
acccagagagacagcagg

SEQ ID NO: 1113899 - RNA, 25 nt, Human
acccugucgcccaggcuggugugca

SEQ ID NO: 1113900 - RNA, 21 nt, Human
acccuucucucccaccucuuc

SEQ ID NO: 1113901 - RNA, 19 nt, Human
acuacaggugugcgccacc

SEQ ID NO: 1113902 - RNA, 24 nt, Human
acuccuggccucaagcaauccacc

SEQ ID NO: 1113903 - RNA, 19 nt, Human
acugcagccuccaccuccu

SEQ ID NO: 1113904 - RNA, 24 nt, Human
acuguauugcccaggcuggucuug

SEQ ID NO: 1113905 - RNA, 25 nt, Human
acuguauugcccaggcuggucuuga

SEQ ID NO: 1113906 - RNA, 27 nt, Human
agaaacaggagggaggagccgguaccc

SEQ ID NO: 1113907 - RNA, 22 nt, Human
agaaccccaaagagagggccca

SEQ ID NO: 1113908 - RNA, 23 nt, Human
agaacuacaggugugcgccaccg

SEQ ID NO: 1113909 - RNA, 22 nt, Human
agagacagcaggggugaccccc

SEQ ID NO: 1113910 - RNA, 21 nt, Human
agagccaggaccaguggggga

SEQ ID NO: 1113911 - RNA, 21 nt, Human
aggaccagugggggagguggc

SEQ ID NO: 1113912 - RNA, 18 nt, Human
aggagcugguggcccugu

SEQ ID NO: 1113913 - RNA, 19 nt, Human
aggagggaggagcugcaac

SEQ ID NO: 1113914 - RNA, 21 nt, Human
aggagggaggagcugcagggc

SEQ ID NO: 1113915 - RNA, 23 nt, Human
aggcaugugcuagagaggucaag

SEQ ID NO: 1113916 - RNA, 28 nt, Human
aggccccugaaggcucuuuggggagugg

SEQ ID NO: 1113917 - RNA, 25 nt, Human
aguaauccucccacuuuagccuccc

SEQ ID NO: 1113918 - RNA, 24 nt, Human
auagcucacugcagccuccaccuc

SEQ ID NO: 1113919 - RNA, 24 nt, Human
caaagugcggggauuacaggcaug

SEQ ID NO: 1113920 - RNA, 21 nt, Human
caaggcugggagaacggggag

SEQ ID NO: 1113921 - RNA, 24 nt, Human
cacccgccuuggcaucccaaagug

SEQ ID NO: 1113922 - RNA, 21 nt, Human
cacccugggcccgggccccug

SEQ ID NO: 1113923 - RNA, 22 nt, Human
cacccugucgcccaggcuggug

SEQ ID NO: 1113924 - RNA, 25 nt, Human
cacccugucgcccaggcuggugugc

SEQ ID NO: 1113925 - RNA, 21 nt, Human
caccguggccacccugggccc

SEQ ID NO: 1113926 - RNA, 24 nt, Human
caccuccugggcucaaguaauccu

SEQ ID NO: 1113927 - RNA, 22 nt, Human
caccuugcggcuucccaggucu

SEQ ID NO: 1113928 - RNA, 23 nt, Human
cacugcagccuccaccuccuggg

SEQ ID NO: 1113929 - RNA, 24 nt, Human
cacuguauugcccaggcuggucuu

SEQ ID NO: 1113930 - RNA, 25 nt, Human
cagaaccccaaagagagggcccaga

SEQ ID NO: 1113931 - RNA, 21 nt, Human
cagaacuacaggugugcgcca

SEQ ID NO: 1113932 - RNA, 24 nt, Human
cagcaaaauuuuaaaaaagaacuc

SEQ ID NO: 1113933 - RNA, 19 nt, Human
cagccuccaccuccugggc

SEQ ID NO: 1113934 - RNA, 23 nt, Human
cagccuccaccuccugggcucaa

SEQ ID NO: 1113935 - RNA, 24 nt, Human
cagccuccaccuccugggcucaag

SEQ ID NO: 1113936 - RNA, 21 nt, Human
caggcgcacacaccccccucg

SEQ ID NO: 1113937 - RNA, 18 nt, Human
caggggggcagcuuuccu

SEQ ID NO: 1113938 - RNA, 24 nt, Human
cagggucucacuguauugcccagg

SEQ ID NO: 1113939 - RNA, 23 nt, Human
caugcugugccccaugcccuucc

SEQ ID NO: 1113940 - RNA, 24 nt, Human
ccaaagugcggggauuacaggcau

SEQ ID NO: 1113941 - RNA, 24 nt, Human
ccaaggagccagaacuacaggugu

SEQ ID NO: 1113942 - RNA, 24 nt, Human
ccaccuccugggcucaaguaaucc

SEQ ID NO: 1113943 - RNA, 22 nt, Human
ccccaggcgcacacaccccccu

SEQ ID NO: 1113944 - RNA, 24 nt, Human
ccccaggcgcacacaccccccucg

SEQ ID NO: 1113945 - RNA, 19 nt, Human
cccccggacccccagcaaa

SEQ ID NO: 1113946 - RNA, 21 nt, Human
cccuggccgggacauuugggc

SEQ ID NO: 1113947 - RNA, 18 nt, Human
ccuaugggguugcagaga

SEQ ID NO: 1113948 - RNA, 21 nt, Human
ccucaagcaauccacccgccu

SEQ ID NO: 1113949 - RNA, 22 nt, Human
ccuccaccuccugggcucaagu

SEQ ID NO: 1113950 - RNA, 26 nt, Human
ccucccacuuuagccucccaaggagc

SEQ ID NO: 1113951 - RNA, 22 nt, Human
ccugaaauuuuucugauuuuac

SEQ ID NO: 1113952 - RNA, 22 nt, Human
ccugcuucuagacccuucucuc

SEQ ID NO: 1113953 - RNA, 22 nt, Human
ccuggccucaagcaauccaccc

SEQ ID NO: 1113954 - RNA, 23 nt, Human
ccuggccucaagcaauccacccg

SEQ ID NO: 1113955 - RNA, 22 nt, Human
ccugggaggguuucccucgcgg

SEQ ID NO: 1113956 - RNA, 20 nt, Human
ccugggcucaaguaauccuc

SEQ ID NO: 1113957 - RNA, 22 nt, Human
cgcagcugcagguugcaccgca

SEQ ID NO: 1113958 - RNA, 23 nt, Human
cggugacacucacagaguggcac

SEQ ID NO: 1113959 - RNA, 19 nt, Human
cuacccagagagacagcag

SEQ ID NO: 1113960 - RNA, 24 nt, Human
cuagacccuucucucccaccucuu

SEQ ID NO: 1113961 - RNA, 24 nt, Human
cucaagcaauccacccgccuuggc

SEQ ID NO: 1113962 - RNA, 24 nt, Human
cucaaguaauccucccacuuuagc

SEQ ID NO: 1113963 - RNA, 21 nt, Human
cucacugcagccuccaccucc

SEQ ID NO: 1113964 - RNA, 24 nt, Human
cucacugcagccuccaccuccugg

SEQ ID NO: 1113965 - RNA, 22 nt, Human
cucccaccucuucugagcucug

SEQ ID NO: 1113966 - RNA, 22 nt, Human
cuccuccucaccguggccaccc

SEQ ID NO: 1113967 - RNA, 23 nt, Human
cuccuggccucaagcaauccacc

SEQ ID NO: 1113968 - RNA, 20 nt, Human
cugaaggcucuuuggggagu

SEQ ID NO: 1113969 - RNA, 23 nt, Human
cugcagccuccaccuccugggcu

SEQ ID NO: 1113970 - RNA, 22 nt, Human
cugcgcaugugguccuccuccu

SEQ ID NO: 1113971 - RNA, 23 nt, Human
cugcuucuagacccuucucuccc

SEQ ID NO: 1113972 - RNA, 19 nt, Human
cugggcccgggccccuggg

SEQ ID NO: 1113973 - RNA, 21 nt, Human
cuucccaggucucagccucaa

SEQ ID NO: 1113974 - RNA, 20 nt, Human
cuucccugcgcauguggucc

SEQ ID NO: 1113975 - RNA, 24 nt, Human
cuugccucucugagccucacucuu

SEQ ID NO: 1113976 - RNA, 24 nt, Human
gacaagaaggccccugaaggcucu

SEQ ID NO: 1113977 - RNA, 18 nt, Human
gagaaacaggagggagga

SEQ ID NO: 1113978 - RNA, 23 nt, Human
gagcugguggcccuguuguuuug

SEQ ID NO: 1113979 - RNA, 19 nt, Human
gaucauagcucacugcagc

SEQ ID NO: 1113980 - RNA, 24 nt, Human
gauuacaggcaugagcgauugugc

SEQ ID NO: 1113981 - RNA, 22 nt, Human
gcaaaauuuuaaaaaagaacuc

SEQ ID NO: 1113982 - RNA, 22 nt, Human
gcagccuccaccuccugggcuc

SEQ ID NO: 1113983 - RNA, 20 nt, Human
gcccggggggcggagggcuc

SEQ ID NO: 1113984 - RNA, 18 nt, Human
gcggagggcucagggaaa

SEQ ID NO: 1113985 - RNA, 23 nt, Human
gcuggucuugaacuccuggccuc

SEQ ID NO: 1113986 - RNA, 24 nt, Human
ggauuacaggcaugagcgauugug

SEQ ID NO: 1113987 - RNA, 18 nt, Human
ggcucagggaaaggucug

SEQ ID NO: 1113988 - RNA, 24 nt, Human
ggcuggucuugaacuccuggccuc

SEQ ID NO: 1113989 - RNA, 18 nt, Human
gggaaaggucuggaagcc

SEQ ID NO: 1113990 - RNA, 18 nt, Human
gggauuacaggcaugagc

SEQ ID NO: 1113991 - RNA, 22 nt, Human
gggccuuugacacagagccacc

SEQ ID NO: 1113992 - RNA, 21 nt, Human
gggcuggugcuggccaggggg

SEQ ID NO: 1113993 - RNA, 19 nt, Human
ggggagugggcccgggggg

SEQ ID NO: 1113994 - RNA, 20 nt, Human
ggggagugggcccggggggc

SEQ ID NO: 1113995 - RNA, 24 nt, Human
ggggauuacaggcaugagcgauug

SEQ ID NO: 1113996 - RNA, 19 nt, Human
gguugcagagaggagugag

SEQ ID NO: 1113997 - RNA, 18 nt, Human
guccuccuccuccucacc

SEQ ID NO: 1113998 - RNA, 24 nt, Human
gugugcagugaagcgaucauagcu

SEQ ID NO: 1113999 - RNA, 19 nt, Human
gugugcgccaccgcaacca

SEQ ID NO: 1114000 - RNA, 23 nt, Human
uaaaaaagaacucaauaagaagc

SEQ ID NO: 1114001 - RNA, 24 nt, Human
uaaaaaagaacucaauaagaagca

SEQ ID NO: 1114002 - RNA, 22 nt, Human
uagccucccaaggagccagaac

SEQ ID NO: 1114003 - RNA, 21 nt, Human
uagcucacugcagccuccacc

SEQ ID NO: 1114004 - RNA, 18 nt, Human
uauugcccaggcuggucu

SEQ ID NO: 1114005 - RNA, 22 nt, Human
uauugcccaggcuggucuugaa

SEQ ID NO: 1114006 - RNA, 23 nt, Human
ucacugcagccuccaccuccugg

SEQ ID NO: 1114007 - RNA, 24 nt, Human
ucacugcagccuccaccuccuggg

SEQ ID NO: 1114008 - RNA, 25 nt, Human
ucacugcagccuccaccuccugggc

SEQ ID NO: 1114009 - RNA, 27 nt, Human
ucacugcagccuccaccuccugggcuc

SEQ ID NO: 1114010 - RNA, 22 nt, Human
ucagcggggaaggaagagccag

SEQ ID NO: 1114011 - RNA, 21 nt, Human
uccaccuccugcuucuagacc

SEQ ID NO: 1114012 - RNA, 24 nt, Human
ucccaaagugcggggauuacaggc

SEQ ID NO: 1114013 - RNA, 19 nt, Human
ucccaaggagccagaacua

SEQ ID NO: 1114014 - RNA, 22 nt, Human
ucccaggucucagccucaacuc

SEQ ID NO: 1114015 - RNA, 21 nt, Human
ucccugaacgacugaguuucg

SEQ ID NO: 1114016 - RNA, 22 nt, Human
uccugggcucaaguaauccucc

SEQ ID NO: 1114017 - RNA, 24 nt, Human
uccugggcucaaguaauccuccca

SEQ ID NO: 1114018 - RNA, 18 nt, Human
ucgcccaggcuggugugc

SEQ ID NO: 1114019 - RNA, 18 nt, Human
ucguuauuguuguugcuu

SEQ ID NO: 1114020 - RNA, 23 nt, Human
ucuagacccuucucucccaccuc

SEQ ID NO: 1114021 - RNA, 23 nt, Human
ucucacccugucgcccaggcugg

SEQ ID NO: 1114022 - RNA, 26 nt, Human
ucucacccugucgcccaggcuggugu

SEQ ID NO: 1114023 - RNA, 27 nt, Human
ucucacccugucgcccaggcuggugug

SEQ ID NO: 1114024 - RNA, 23 nt, Human
ucucacuguauugcccaggcugg

SEQ ID NO: 1114025 - RNA, 26 nt, Human
ucucacuguauugcccaggcuggucu

SEQ ID NO: 1114026 - RNA, 20 nt, Human
ucucagccucaacucauuuc

SEQ ID NO: 1114027 - RNA, 22 nt, Human
ucuucugagcucugcuuggccu

SEQ ID NO: 1114028 - RNA, 21 nt, Human
ucuugaacuccuggccucaag

SEQ ID NO: 1114029 - RNA, 28 nt, Human
ucuuuggggaguggaaguaacguaaacg

SEQ ID NO: 1114030 - RNA, 22 nt, Human
ugaaaagagcagccacccucca

SEQ ID NO: 1114031 - RNA, 24 nt, Human
ugaacuccuggccucaagcaaucc

SEQ ID NO: 1114032 - RNA, 18 nt, Human
ugaaggcucuuuggggag

SEQ ID NO: 1114033 - RNA, 23 nt, Human
ugacauagaaucgguaacucgua

SEQ ID NO: 1114034 - RNA, 24 nt, Human
ugacccccaggcgcacacaccccc

SEQ ID NO: 1114035 - RNA, 19 nt, Human
ugagcuucaccugcacccc

SEQ ID NO: 1114036 - RNA, 24 nt, Human
ugcccaggcuggucuugaacuccu

SEQ ID NO: 1114037 - RNA, 19 nt, Human
ugcuagagaggucaagguu

SEQ ID NO: 1114038 - RNA, 18 nt, Human
ugcuggccaggggggcag

SEQ ID NO: 1114039 - RNA, 23 nt, Human
ugcuucuagacccuucucuccca

SEQ ID NO: 1114040 - RNA, 26 nt, Human
uggaagccugagugggcgcagcugac

SEQ ID NO: 1114041 - RNA, 23 nt, Human
uggcaaaaggcaugugcuagaga

SEQ ID NO: 1114042 - RNA, 22 nt, Human
uggccucaagcaauccacccgc

SEQ ID NO: 1114043 - RNA, 23 nt, Human
uggccucaagcaauccacccgcc

SEQ ID NO: 1114044 - RNA, 21 nt, Human
uggccucccagccuguugccu

SEQ ID NO: 1114045 - RNA, 19 nt, Human
ugggcccggggggcggagg

SEQ ID NO: 1114046 - RNA, 19 nt, Human
uggggaguggaaguagcca

SEQ ID NO: 1114047 - RNA, 21 nt, Human
uggggaguggaaguagccagc

SEQ ID NO: 1114048 - RNA, 21 nt, Human
ugggguggugguaauuggcau

SEQ ID NO: 1114049 - RNA, 24 nt, Human
uguauugcccaggcuggucuugaa

SEQ ID NO: 1114050 - RNA, 18 nt, Human
ugugugggccacacacau

SEQ ID NO: 1114051 - RNA, 21 nt, Human
ugugugggccacacacaugcu

SEQ ID NO: 1114052 - RNA, 19 nt, Human
uucccccggacccccagca

SEQ ID NO: 1114053 - RNA, 24 nt, Human
uucucuuccuccaccuccugcuuc

SEQ ID NO: 1114054 - RNA, 19 nt, Human
uucugauuuuacuaagcac

SEQ ID NO: 1114055 - RNA, 21 nt, Human
uuggacucuugaggagcuggu

SEQ ID NO: 1114056 - RNA, 20 nt, Human
uuuccuauggggugguggua

SEQ ID NO: 1114057 - RNA, 25 nt, Human
uuuucugauuuuacuaagcacuucc

SEQ ID NO: 1114058 - RNA, 24 nt, Human
agggagccuggggacagcuggguc

SEQ ID NO: 1114059 - RNA, 19 nt, Human
caaaucccacuuccaguga

SEQ ID NO: 1114060 - RNA, 19 nt, Human
cagcugggcaucuaagcca

SEQ ID NO: 1114061 - RNA, 19 nt, Human
ccagagcacguuuccugga

SEQ ID NO: 1114062 - RNA, 18 nt, Human
ccucuccaccuccguucc

SEQ ID NO: 1114063 - RNA, 21 nt, Human
ccuggaggugggcgucugggg

SEQ ID NO: 1114064 - RNA, 19 nt, Human
ccuggggacagcuggguca

SEQ ID NO: 1114065 - RNA, 24 nt, Human
cgggcguugccgacggucuccucu

SEQ ID NO: 1114066 - RNA, 22 nt, Human
ggacagcugggucacugagggu

SEQ ID NO: 1114067 - RNA, 23 nt, Human
ggcgucuggggguccaccuuucc

SEQ ID NO: 1114068 - RNA, 22 nt, Human
gggagccuggggacagcugggu

SEQ ID NO: 1114069 - RNA, 22 nt, Human
ggggacagcugggucacugagg

SEQ ID NO: 1114070 - RNA, 21 nt, Human
ucacuggggcuguccaagcca

SEQ ID NO: 1114071 - RNA, 21 nt, Human
ucccuggggagaccaggcccu

SEQ ID NO: 1114072 - RNA, 20 nt, Human
uggcugcauuucaaauccca

SEQ ID NO: 1114073 - RNA, 19 nt, Human
uggggacagcugggucacu

SEQ ID NO: 1114074 - RNA, 20 nt, Human
uuauuuauuuauuuauuucu

SEQ ID NO: 1114075 - RNA, 26 nt, Human
aacacucccauccccuccacacaccu

SEQ ID NO: 1114076 - RNA, 24 nt, Human
aagaccccagcccccacucaccgc

SEQ ID NO: 1114077 - RNA, 20 nt, Human
aagaccccagcccccacucu

SEQ ID NO: 1114078 - RNA, 22 nt, Human
aagcagccuucccacccccuga

SEQ ID NO: 1114079 - RNA, 19 nt, Human
agaagaagagcuaacacuc

SEQ ID NO: 1114080 - RNA, 24 nt, Human
agcaaagcagccuucccacccccu

SEQ ID NO: 1114081 - RNA, 24 nt, Human
agcaaagcagccuucccacccccu

SEQ ID NO: 1114082 - RNA, 19 nt, Human
agcagccuucccacccccu

SEQ ID NO: 1114083 - RNA, 19 nt, Human
auacuugcaagccccacac

SEQ ID NO: 1114084 - RNA, 19 nt, Human
augccuuaaacuagaagaa

SEQ ID NO: 1114085 - RNA, 21 nt, Human
cauuacugaugccaccuccuc

SEQ ID NO: 1114086 - RNA, 24 nt, Human
ccacacaguucccuccaccagaug

SEQ ID NO: 1114087 - RNA, 21 nt, Human
ccaucaagaccccagccccca

SEQ ID NO: 1114088 - RNA, 22 nt, Human
cccaucaagaccccagccccca

SEQ ID NO: 1114089 - RNA, 21 nt, Human
ccccacacaguucccuccacc

SEQ ID NO: 1114090 - RNA, 24 nt, Human
ccugacucccaucaagaccccagc

SEQ ID NO: 1114091 - RNA, 25 nt, Human
cucaccgcuaaacuuccgauucaga

SEQ ID NO: 1114092 - RNA, 19 nt, Human
cuccaggaagcacucccuc

SEQ ID NO: 1114093 - RNA, 21 nt, Human
cucccaucaagaccccagccc

SEQ ID NO: 1114094 - RNA, 23 nt, Human
cucccauccccuccacacaccug

SEQ ID NO: 1114095 - RNA, 27 nt, Human
cucucuccaucucuaccuuccaggcuc

SEQ ID NO: 1114096 - RNA, 24 nt, Human
cuuaaacuagaagaagagcuaaca

SEQ ID NO: 1114097 - RNA, 19 nt, Human
gagcagcugaggagacagg

SEQ ID NO: 1114098 - RNA, 23 nt, Human
gagcagcugaggagacaggugau

SEQ ID NO: 1114099 - RNA, 22 nt, Human
gagcuaacacucccauccccuc

SEQ ID NO: 1114100 - RNA, 24 nt, Human
gaugugcucucucuccaucucuac

SEQ ID NO: 1114101 - RNA, 22 nt, Human
gccccacacaguucccuccacc

SEQ ID NO: 1114102 - RNA, 20 nt, Human
gccuucccacccccugacuc

SEQ ID NO: 1114103 - RNA, 23 nt, Human
uagaagaagagcuaacacuccca

SEQ ID NO: 1114104 - RNA, 26 nt, Human
uagacauccaacauacuugcaagccc

SEQ ID NO: 1114105 - RNA, 25 nt, Human
uagcaaagcagccuucccacccccu

SEQ ID NO: 1114106 - RNA, 21 nt, Human
uaugccuuaaacuagaagaag

SEQ ID NO: 1114107 - RNA, 22 nt, Human
uccaacauacuugcaagcccca

SEQ ID NO: 1114108 - RNA, 22 nt, Human
uccaccagaugugcucucucuc

SEQ ID NO: 1114109 - RNA, 24 nt, Human
uccaccagaugugcucucucucca

SEQ ID NO: 1114110 - RNA, 22 nt, Human
uccaggaagcacucccucucau

SEQ ID NO: 1114111 - RNA, 22 nt, Human
uccauagcaaagcagccuuccc

SEQ ID NO: 1114112 - RNA, 18 nt, Human
ucccacccccugacuccc

SEQ ID NO: 1114113 - RNA, 21 nt, Human
ucccaucaagaccccagcccc

SEQ ID NO: 1114114 - RNA, 20 nt, Human
ucucuccaucucuaccuucc

SEQ ID NO: 1114115 - RNA, 21 nt, Human
uggggugguggugagcagcug

SEQ ID NO: 1114116 - RNA, 22 nt, Human
uuaaacuagaagaagagcuaac

SEQ ID NO: 1114117 - RNA, 26 nt, Human
aaaaacuaaacaggcauuuuggacaa

SEQ ID NO: 1114118 - RNA, 28 nt, Human
aaacaggcauuuuggacaacacauucuu

SEQ ID NO: 1114119 - RNA, 18 nt, Human
agacggagauaaaugaac

SEQ ID NO: 1114120 - RNA, 24 nt, Human
aggcauuuuggacaacacauucuu

SEQ ID NO: 1114121 - RNA, 21 nt, Human
auucuuggcaauggaaccugg

SEQ ID NO: 1114122 - RNA, 22 nt, Human
ccagauaucaacuguuacagaa

SEQ ID NO: 1114123 - RNA, 19 nt, Human
cgguagggaaaguucucac

SEQ ID NO: 1114124 - RNA, 26 nt, Human
cucacucugcauuauaaaaaggacaa

SEQ ID NO: 1114125 - RNA, 23 nt, Human
cugcauuauaaaaaggacagcca

SEQ ID NO: 1114126 - RNA, 20 nt, Human
gcauuuuggacaacacauuc

SEQ ID NO: 1114127 - RNA, 22 nt, Human
gggacagaaggcagacggagau

SEQ ID NO: 1114128 - RNA, 22 nt, Human
gugggacagaaggcagacggag

SEQ ID NO: 1114129 - RNA, 21 nt, Human
uagggaaaguucucacucugc

SEQ ID NO: 1114130 - RNA, 18 nt, Human
uaggugggacagaaggca

SEQ ID NO: 1114131 - RNA, 20 nt, Human
uaggugggacagaaggcaga

SEQ ID NO: 1114132 - RNA, 19 nt, Human
uauuuuugucuucccacaa

SEQ ID NO: 1114133 - RNA, 20 nt, Human
uccauacauauuuaaaacca

SEQ ID NO: 1114134 - RNA, 23 nt, Human
uggaaccuggacaacauuuauca

SEQ ID NO: 1114135 - RNA, 24 nt, Human
uggaaccuggacaacauuuaucaa

SEQ ID NO: 1114136 - RNA, 25 nt, Human
ugucugaccaccgcuacuacuaugu

SEQ ID NO: 1114137 - RNA, 24 nt, Human
aaaaaguacugauuuuaaaaacua

SEQ ID NO: 1114138 - RNA, 23 nt, Human
aaaaccaaagugguccacaaaac

SEQ ID NO: 1114139 - RNA, 18 nt, Human
aaacaaacaguucugaga

SEQ ID NO: 1114140 - RNA, 20 nt, Human
aaagaaaaccaaaguggucc

SEQ ID NO: 1114141 - RNA, 24 nt, Human
aacaguucugagaccguucuucca

SEQ ID NO: 1114142 - RNA, 21 nt, Human
aacuuuuuuaaugggucucaa

SEQ ID NO: 1114143 - RNA, 18 nt, Human
accacguucacgcucagc

SEQ ID NO: 1114144 - RNA, 23 nt, Human
acguucacgcucagcuuucaguu

SEQ ID NO: 1114145 - RNA, 24 nt, Human
acuugaaggagcccuuucccaucu

SEQ ID NO: 1114146 - RNA, 23 nt, Human
agaaaaccaaagugguccacaaa

SEQ ID NO: 1114147 - RNA, 20 nt, Human
agaaauuggcacaaaugcua

SEQ ID NO: 1114148 - RNA, 20 nt, Human
agcaacaauuaggacagcac

SEQ ID NO: 1114149 - RNA, 24 nt, Human
auaccagcuucaaauucaccaaca

SEQ ID NO: 1114150 - RNA, 26 nt, Human
auguuuuugaugaagucucugugucc

SEQ ID NO: 1114151 - RNA, 18 nt, Human
caaggagauaucaauggu

SEQ ID NO: 1114152 - RNA, 22 nt, Human
cagcaacaauuaggacagcaca

SEQ ID NO: 1114153 - RNA, 23 nt, Human
cagcacaaccagccugagauguc

SEQ ID NO: 1114154 - RNA, 22 nt, Human
cagcagccucuuucugcaauuu

SEQ ID NO: 1114155 - RNA, 18 nt, Human
ccacugauuaagaguggg

SEQ ID NO: 1114156 - RNA, 18 nt, Human
ccagcuucaaauucacca

SEQ ID NO: 1114157 - RNA, 23 nt, Human
cguucacgcucagcuuucaguuu

SEQ ID NO: 1114158 - RNA, 26 nt, Human
cugagaugucccuguaaucauguuuu

SEQ ID NO: 1114159 - RNA, 18 nt, Human
cugcugcaugcgaaaaag

SEQ ID NO: 1114160 - RNA, 24 nt, Human
cugcugcaugcgaaaaagaaaacc

SEQ ID NO: 1114161 - RNA, 21 nt, Human
cuuucaguuuauccaagacuc

SEQ ID NO: 1114162 - RNA, 24 nt, Human
gaaaaagaaaaccaaaguggucca

SEQ ID NO: 1114163 - RNA, 19 nt, Human
gaagucucuguguccuggg

SEQ ID NO: 1114164 - RNA, 19 nt, Human
gagcccuuucccaucucag

SEQ ID NO: 1114165 - RNA, 20 nt, Human
gcacaaaugcuacuguguug

SEQ ID NO: 1114166 - RNA, 23 nt, Human
ggagcccuuucccaucucagcag

SEQ ID NO: 1114167 - RNA, 25 nt, Human
gucaaguuguuuccauuuaaaaagu

SEQ ID NO: 1114168 - RNA, 23 nt, Human
gucuuuucuuuucccauuuuggc

SEQ ID NO: 1114169 - RNA, 24 nt, Human
uaauaacuuaaaacugcugcaugc

SEQ ID NO: 1114170 - RNA, 24 nt, Human
uaaugggucucaaaauucugugac

SEQ ID NO: 1114171 - RNA, 25 nt, Human
uaaugggucucaaaauucugugaca

SEQ ID NO: 1114172 - RNA, 19 nt, Human
uauuaucauuaaccagucu

SEQ ID NO: 1114173 - RNA, 23 nt, Human
ucaguuuauccaagacucaggca

SEQ ID NO: 1114174 - RNA, 23 nt, Human
uccacaaaacauucuccuuuccu

SEQ ID NO: 1114175 - RNA, 21 nt, Human
uccuucugaagguuuuauguu

SEQ ID NO: 1114176 - RNA, 18 nt, Human
ucuccuuuccuucugaag

SEQ ID NO: 1114177 - RNA, 23 nt, Human
ucuguguccuggggcaucaauga

SEQ ID NO: 1114178 - RNA, 23 nt, Human
ucuuaauguaagugcugauuucc

SEQ ID NO: 1114179 - RNA, 18 nt, Human
ucuuuugucgaugccacc

SEQ ID NO: 1114180 - RNA, 23 nt, Human
ugcauuauuaucauuaaccaguc

SEQ ID NO: 1114181 - RNA, 24 nt, Human
ugcauuauuaucauuaaccagucu

SEQ ID NO: 1114182 - RNA, 19 nt, Human
ugcccgaaucuacgugucc

SEQ ID NO: 1114183 - RNA, 23 nt, Human
ugcgaaaaagaaaaccaaagugg

SEQ ID NO: 1114184 - RNA, 24 nt, Human
ugcgaaaaagaaaaccaaaguggu

SEQ ID NO: 1114185 - RNA, 22 nt, Human
uggcagguauuagggauaauau

SEQ ID NO: 1114186 - RNA, 22 nt, Human
ugguccacaaaacauucuccuu

SEQ ID NO: 1114187 - RNA, 24 nt, Human
uuaaacuuuuuuaaugggucucaa

SEQ ID NO: 1114188 - RNA, 24 nt, Human
uuaaauggccaauugaaacaaaca

SEQ ID NO: 1114189 - RNA, 23 nt, Human
uucaccaacaccagcagcaacaa

SEQ ID NO: 1114190 - RNA, 18 nt, Human
uuccaccacugauuaaga

SEQ ID NO: 1114191 - RNA, 20 nt, Human
uucuuuucccauuuuggcuu

SEQ ID NO: 1114192 - RNA, 21 nt, Human
uugaugaagucucuguguccu

SEQ ID NO: 1114193 - RNA, 24 nt, Human
uugaugaagucucuguguccuggg

SEQ ID NO: 1114194 - RNA, 26 nt, Human
uuuacuacuaaacuuaaaagguuuuc

SEQ ID NO: 1114195 - RNA, 26 nt, Human
uuucccauuuuggcuuuuaggggaag

SEQ ID NO: 1114196 - RNA, 19 nt, Human
cauucauuacaucuaaagg

SEQ ID NO: 1114197 - RNA, 21 nt, Human
cauucauuacaucuaaagggu

SEQ ID NO: 1114198 - RNA, 27 nt, Human
uaaaggguuuuuccucugugugaguuc

SEQ ID NO: 1114199 - RNA, 25 nt, Human
uacauucauuacaucuaaaggguuu

SEQ ID NO: 1114200 - RNA, 20 nt, Human
ucucugauguauggugagac

SEQ ID NO: 1114201 - RNA, 23 nt, Human
ugggagaaaauuuuccuacauuc

SEQ ID NO: 1114202 - RNA, 22 nt, Human
aaggaagagcaagaaggcgagg

SEQ ID NO: 1114203 - RNA, 22 nt, Human
aaugcacucgaaacacguuuaa

SEQ ID NO: 1114204 - RNA, 18 nt, Human
acacaaaucgagcaaaua

SEQ ID NO: 1114205 - RNA, 22 nt, Human
acaggacagaggcaggaccuug

SEQ ID NO: 1114206 - RNA, 18 nt, Human
agcaagaaggcgagagcc

SEQ ID NO: 1114207 - RNA, 21 nt, Human
agcaggacaaacccaaaccca

SEQ ID NO: 1114208 - RNA, 23 nt, Human
agcaggacaaacccaaacccauc

SEQ ID NO: 1114209 - RNA, 18 nt, Human
agccaggcaaggcuggca

SEQ ID NO: 1114210 - RNA, 18 nt, Human
aggaagagcaagaaggcg

SEQ ID NO: 1114211 - RNA, 23 nt, Human
aggaagagcaagaaggcgagagc

SEQ ID NO: 1114212 - RNA, 25 nt, Human
aggcaggaaggugagcagacuccag

SEQ ID NO: 1114213 - RNA, 18 nt, Human
aggcaggaccuuggaucc

SEQ ID NO: 1114214 - RNA, 24 nt, Human
agguggcucaggggacaggacaga

SEQ ID NO: 1114215 - RNA, 30 nt, Human
agguggggaaggaagagcaagaaggcgagg

SEQ ID NO: 1114216 - RNA, 20 nt, Human
agucacaggaagaacuugca

SEQ ID NO: 1114217 - RNA, 22 nt, Human
aucugauguccucccuccaccc

SEQ ID NO: 1114218 - RNA, 21 nt, Human
auggagacaaggcgucugugg

SEQ ID NO: 1114219 - RNA, 19 nt, Human
caaacccaaacccaucucc

SEQ ID NO: 1114220 - RNA, 20 nt, Human
caaaucgagcaaauaugacu

SEQ ID NO: 1114221 - RNA, 22 nt, Human
cacagcaggacaaacccaaacc

SEQ ID NO: 1114222 - RNA, 18 nt, Human
caccuaggagcuuuagag

SEQ ID NO: 1114223 - RNA, 23 nt, Human
caccugaccugagaguggcgggc

SEQ ID NO: 1114224 - RNA, 21 nt, Human
cagacuccagaguucaagaga

SEQ ID NO: 1114225 - RNA, 18 nt, Human
cagagcacagcaggacaa

SEQ ID NO: 1114226 - RNA, 27 nt, Human
cagcaagcugcuuccucaacgaugcuu

SEQ ID NO: 1114227 - RNA, 19 nt, Human
cagcaggacaaacccaaac

SEQ ID NO: 1114228 - RNA, 21 nt, Human
cagcaggacaaacccaaaccc

SEQ ID NO: 1114229 - RNA, 22 nt, Human
ccggucccaccugaccugagag

SEQ ID NO: 1114230 - RNA, 19 nt, Human
ccucugauuaaacaggagu

SEQ ID NO: 1114231 - RNA, 22 nt, Human
cuccacccguaacuccccugaa

SEQ ID NO: 1114232 - RNA, 22 nt, Human
cuggaccacgugggagaggggc

SEQ ID NO: 1114233 - RNA, 19 nt, Human
cugggcacuugaccaggug

SEQ ID NO: 1114234 - RNA, 18 nt, Human
cuggggaggcuggagucc

SEQ ID NO: 1114235 - RNA, 21 nt, Human
gacagaggcaggaccuuggau

SEQ ID NO: 1114236 - RNA, 21 nt, Human
gagaaccaaguguucaggaac

SEQ ID NO: 1114237 - RNA, 21 nt, Human
gaggggcuugaggcaggaagg

SEQ ID NO: 1114238 - RNA, 24 nt, Human
gcacagcaggacaaacccaaaccc

SEQ ID NO: 1114239 - RNA, 18 nt, Human
ggagaggggcuugaggca

SEQ ID NO: 1114240 - RNA, 19 nt, Human
ggagcagagcacagcagga

SEQ ID NO: 1114241 - RNA, 22 nt, Human
guccucccuccacccguaacuc

SEQ ID NO: 1114242 - RNA, 19 nt, Human
guggcucaggggacaggac

SEQ ID NO: 1114243 - RNA, 23 nt, Human
uacaaaugaaauauguugaacac

SEQ ID NO: 1114244 - RNA, 24 nt, Human
uauaaaagaguagauauggagaca

SEQ ID NO: 1114245 - RNA, 24 nt, Human
uccacccguaacuccccugaaauc

SEQ ID NO: 1114246 - RNA, 25 nt, Human
ucugcaggcacacgagagucgcugg

SEQ ID NO: 1114247 - RNA, 21 nt, Human
ucuguggcccauaguauuuaa

SEQ ID NO: 1114248 - RNA, 18 nt, Human
ugagauggaauuuaaaau

SEQ ID NO: 1114249 - RNA, 20 nt, Human
uggcucaggggacaggacag

SEQ ID NO: 1114250 - RNA, 25 nt, Human
uguggccaguauugagaaccaagug

SEQ ID NO: 1114251 - RNA, 21 nt, Human
uguggcuguggccaguauuga

SEQ ID NO: 1114252 - RNA, 20 nt, Human
aacaggcagagggggucagg

SEQ ID NO: 1114253 - RNA, 18 nt, Human
aaccuagcucagcccuga

SEQ ID NO: 1114254 - RNA, 19 nt, Human
aagcaggagcguuggaucu

SEQ ID NO: 1114255 - RNA, 23 nt, Human
aauagcuaggauuacaggcaugc

SEQ ID NO: 1114256 - RNA, 23 nt, Human
aauuugcuggacaacagacccuc

SEQ ID NO: 1114257 - RNA, 23 nt, Human
acagugcccugcaugccugcggg

SEQ ID NO: 1114258 - RNA, 24 nt, Human
acagugccgggauuacaggcguga

SEQ ID NO: 1114259 - RNA, 25 nt, Human
accccugaacacaccugggucccca

SEQ ID NO: 1114260 - RNA, 23 nt, Human
accucacaccucagccuccccag

SEQ ID NO: 1114261 - RNA, 21 nt, Human
accucagccuccccagacucc

SEQ ID NO: 1114262 - RNA, 23 nt, Human
accucagccuccccagacuccca

SEQ ID NO: 1114263 - RNA, 19 nt, Human
accuggaggaggcgcuggg

SEQ ID NO: 1114264 - RNA, 22 nt, Human
acucccagcuuggucuccuucc

SEQ ID NO: 1114265 - RNA, 18 nt, Human
acucuuguugcccaggcu

SEQ ID NO: 1114266 - RNA, 20 nt, Human
acucuuguugcccaggcugg

SEQ ID NO: 1114267 - RNA, 20 nt, Human
acucuuguugcccaggcugg

SEQ ID NO: 1114268 - RNA, 21 nt, Human
agaagggggcaugaggggcug

SEQ ID NO: 1114269 - RNA, 18 nt, Human
agaccccugaacacaccu

SEQ ID NO: 1114270 - RNA, 24 nt, Human
agagcugcaaacccaggaagacag

SEQ ID NO: 1114271 - RNA, 19 nt, Human
agagggggucaggacgggg

SEQ ID NO: 1114272 - RNA, 18 nt, Human
agcagugaagccucaggg

SEQ ID NO: 1114273 - RNA, 23 nt, Human
agccuccccagacucccagcuug

SEQ ID NO: 1114274 - RNA, 27 nt, Human
agccugacacugccuggcacugaggac

SEQ ID NO: 1114275 - RNA, 21 nt, Human
agcucagcccugagcuccugg

SEQ ID NO: 1114276 - RNA, 20 nt, Human
agcuucugaacccacauccu

SEQ ID NO: 1114277 - RNA, 21 nt, Human
aggaagcuccaagcuugcacc

SEQ ID NO: 1114278 - RNA, 20 nt, Human
aggaggggacccaggaggac

SEQ ID NO: 1114279 - RNA, 18 nt, Human
aggaggggcaggaggggc

SEQ ID NO: 1114280 - RNA, 19 nt, Human
aggaucccugacccuuggc

SEQ ID NO: 1114281 - RNA, 21 nt, Human
aggcagagggggucaggacgg

SEQ ID NO: 1114282 - RNA, 25 nt, Human
aggcuggggugcaguggugcgauuu

SEQ ID NO: 1114283 - RNA, 22 nt, Human
agggaggggugcgggggcugcc

SEQ ID NO: 1114284 - RNA, 20 nt, Human
aggggccagccggcacucag

SEQ ID NO: 1114285 - RNA, 25 nt, Human
aggugauccucccaccucagccucc

SEQ ID NO: 1114286 - RNA, 19 nt, Human
aggugguggagguuugagg

SEQ ID NO: 1114287 - RNA, 21 nt, Human
aggugguggagguuugaggcc

SEQ ID NO: 1114288 - RNA, 20 nt, Human
aucuccuuuaggcuccugca

SEQ ID NO: 1114289 - RNA, 24 nt, Human
augaguccauuguccuugagcuuc

SEQ ID NO: 1114290 - RNA, 20 nt, Human
augggguuucuccauguugg

SEQ ID NO: 1114291 - RNA, 20 nt, Human
caaaggcuuugucaccaggg

SEQ ID NO: 1114292 - RNA, 24 nt, Human
caacagacccucaacccauccccu

SEQ ID NO: 1114293 - RNA, 21 nt, Human
cacaccucagccuccccagac

SEQ ID NO: 1114294 - RNA, 24 nt, Human
cacagugccgggauuacaggcgug

SEQ ID NO: 1114295 - RNA, 19 nt, Human
caccacagccuggacacug

SEQ ID NO: 1114296 - RNA, 24 nt, Human
caccucagccucccacagugccgg

SEQ ID NO: 1114297 - RNA, 19 nt, Human
cacgacagugcccugcaug

SEQ ID NO: 1114298 - RNA, 25 nt, Human
cacggcccucagaugaacaggcaga

SEQ ID NO: 1114299 - RNA, 18 nt, Human
cacugggggcagugagcu

SEQ ID NO: 1114300 - RNA, 21 nt, Human
cagaacugggccugcuggcuu

SEQ ID NO: 1114301 - RNA, 21 nt, Human
cagacucccagcuuggucucc

SEQ ID NO: 1114302 - RNA, 18 nt, Human
cagagcaggcagggggcc

SEQ ID NO: 1114303 - RNA, 20 nt, Human
cagccugacacugccuggca

SEQ ID NO: 1114304 - RNA, 24 nt, Human
cagcugccugggccugagccgaga

SEQ ID NO: 1114305 - RNA, 18 nt, Human
caggaggggcaggagggg

SEQ ID NO: 1114306 - RNA, 19 nt, Human
caggaggggcaggaggggc

SEQ ID NO: 1114307 - RNA, 22 nt, Human
caggaggggcugaucgcccuca

SEQ ID NO: 1114308 - RNA, 21 nt, Human
caggcagccccuguuacccaa

SEQ ID NO: 1114309 - RNA, 21 nt, Human
caggucccaggaucccugacc

SEQ ID NO: 1114310 - RNA, 25 nt, Human
cagugccgggauuacaggcgugagc

SEQ ID NO: 1114311 - RNA, 25 nt, Human
cauaacuggacuguaggccccacag

SEQ ID NO: 1114312 - RNA, 23 nt, Human
caucuccuuuaggcuccugcagu

SEQ ID NO: 1114313 - RNA, 22 nt, Human
cauugccagcugcgugugagca

SEQ ID NO: 1114314 - RNA, 19 nt, Human
ccaaaggcuuugucaccag

SEQ ID NO: 1114315 - RNA, 20 nt, Human
ccacaggggucucaucucug

SEQ ID NO: 1114316 - RNA, 24 nt, Human
ccacagugccgggauuacaggcgu

SEQ ID NO: 1114317 - RNA, 22 nt, Human
ccacauccuggccuuuccagaa

SEQ ID NO: 1114318 - RNA, 23 nt, Human
ccaggcccaggccuuggcucacg

SEQ ID NO: 1114319 - RNA, 19 nt, Human
ccauguuggucaggcuggu

SEQ ID NO: 1114320 - RNA, 22 nt, Human
ccauguuggucaggcuggucuc

SEQ ID NO: 1114321 - RNA, 23 nt, Human
ccauguuggucaggcuggucucg

SEQ ID NO: 1114322 - RNA, 20 nt, Human
ccauuguuccccagccuugc

SEQ ID NO: 1114323 - RNA, 22 nt, Human
cccaccuccuucacaggugcca

SEQ ID NO: 1114324 - RNA, 20 nt, Human
ccccagaacagcgcuuuggc

SEQ ID NO: 1114325 - RNA, 19 nt, Human
ccccuguuacccaaggugg

SEQ ID NO: 1114326 - RNA, 24 nt, Human
cccgaccucaggugauccucccac

SEQ ID NO: 1114327 - RNA, 19 nt, Human
cccgagccucauaguucag

SEQ ID NO: 1114328 - RNA, 23 nt, Human
cccggguucaagugauucuccuc

SEQ ID NO: 1114329 - RNA, 23 nt, Human
cccggguucaagugauucuccug

SEQ ID NO: 1114330 - RNA, 24 nt, Human
cccugcagccacugugaggugggu

SEQ ID NO: 1114331 - RNA, 20 nt, Human
cccuggcgggaugggggucu

SEQ ID NO: 1114332 - RNA, 24 nt, Human
ccgaauagcuaggauuacaggcau

SEQ ID NO: 1114333 - RNA, 24 nt, Human
ccgccucccggguucaagugauuc

SEQ ID NO: 1114334 - RNA, 25 nt, Human
ccuagcucagcccugagcuccuggc

SEQ ID NO: 1114335 - RNA, 20 nt, Human
ccucacaccucagccucccc

SEQ ID NO: 1114336 - RNA, 24 nt, Human
ccucacaccucagccuccccagac

SEQ ID NO: 1114337 - RNA, 26 nt, Human
ccucccaccucagccucccacagugc

SEQ ID NO: 1114338 - RNA, 24 nt, Human
ccucccggguucaagugauucucc

SEQ ID NO: 1114339 - RNA, 19 nt, Human
ccugacacugccuggcacu

SEQ ID NO: 1114340 - RNA, 26 nt, Human
ccugcaccacagccuggacacugggg

SEQ ID NO: 1114341 - RNA, 19 nt, Human
ccuuggccaggcccaggcc

SEQ ID NO: 1114342 - RNA, 20 nt, Human
cgaccucaggugauccuccc

SEQ ID NO: 1114343 - RNA, 24 nt, Human
cgaccucaggugauccucccaccu

SEQ ID NO: 1114344 - RNA, 22 nt, Human
cgcccucaccccagaacagcgc

SEQ ID NO: 1114345 - RNA, 23 nt, Human
cgcggucauaacacgugugugcc

SEQ ID NO: 1114346 - RNA, 21 nt, Human
cgggauuacaggcgugagcca

SEQ ID NO: 1114347 - RNA, 22 nt, Human
cgggauuacaggcgugagccac

SEQ ID NO: 1114348 - RNA, 24 nt, Human
cgggauuacaggcgugagccacug

SEQ ID NO: 1114349 - RNA, 21 nt, Human
cgggcucaggguggggguuug

SEQ ID NO: 1114350 - RNA, 24 nt, Human
cggguucaagugauucuccuguuu

SEQ ID NO: 1114351 - RNA, 18 nt, Human
cguugcugacacugcggg

SEQ ID NO: 1114352 - RNA, 20 nt, Human
cuagcucagcccugagcucc

SEQ ID NO: 1114353 - RNA, 23 nt, Human
cucacaccucagccuccccagac

SEQ ID NO: 1114354 - RNA, 20 nt, Human
cucacucuuuaccugcuguc

SEQ ID NO: 1114355 - RNA, 23 nt, Human
cucagcccugagcuccuggcaag

SEQ ID NO: 1114356 - RNA, 21 nt, Human
cucagccugacacugccuggc

SEQ ID NO: 1114357 - RNA, 24 nt, Human
cucaggugauccucccaccucagc

SEQ ID NO: 1114358 - RNA, 20 nt, Human
cuccacgaagccuuccugga

SEQ ID NO: 1114359 - RNA, 24 nt, Human
cuccauguuggucaggcuggucuc

SEQ ID NO: 1114360 - RNA, 22 nt, Human
cucccaccucagccucccacag

SEQ ID NO: 1114361 - RNA, 24 nt, Human
cucccgaauagcuaggauuacagg

SEQ ID NO: 1114362 - RNA, 20 nt, Human
cucccggguucaagugauuc

SEQ ID NO: 1114363 - RNA, 21 nt, Human
cuccuguuuaacccucccgaa

SEQ ID NO: 1114364 - RNA, 21 nt, Human
cucugugccaggcgcagagcu

SEQ ID NO: 1114365 - RNA, 24 nt, Human
cugcagccacugugaggugggugc

SEQ ID NO: 1114366 - RNA, 20 nt, Human
cuggccuuuccagaacuggg

SEQ ID NO: 1114367 - RNA, 24 nt, Human
cuucacgcagacaccaguccccuc

SEQ ID NO: 1114368 - RNA, 24 nt, Human
cuuguugcccaggcuggggugcag

SEQ ID NO: 1114369 - RNA, 24 nt, Human
gaaaugggguuucuccauguuggu

SEQ ID NO: 1114370 - RNA, 19 nt, Human
gacacugggggcagugagc

SEQ ID NO: 1114371 - RNA, 26 nt, Human
gacacugggggcagugagcugggcag

SEQ ID NO: 1114372 - RNA, 23 nt, Human
gaccucaggugauccucccaccu

SEQ ID NO: 1114373 - RNA, 24 nt, Human
gaccucaggugauccucccaccuc

SEQ ID NO: 1114374 - RNA, 19 nt, Human
gagagcagugaagccucag

SEQ ID NO: 1114375 - RNA, 18 nt, Human
gauuacaggcaugcgcca

SEQ ID NO: 1114376 - RNA, 22 nt, Human
gauuacaggcaugcgccaccau

SEQ ID NO: 1114377 - RNA, 18 nt, Human
gauuacaggcgugagcca

SEQ ID NO: 1114378 - RNA, 22 nt, Human
gauuacaggcgugagccacugc

SEQ ID NO: 1114379 - RNA, 22 nt, Human
gauuacaggcgugagccacugc

SEQ ID NO: 1114380 - RNA, 18 nt, Human
gcagaaaaggaagcucca

SEQ ID NO: 1114381 - RNA, 22 nt, Human
gcagagccaccuucugccaaag

SEQ ID NO: 1114382 - RNA, 19 nt, Human
gcagcaccuggcucuggcu

SEQ ID NO: 1114383 - RNA, 23 nt, Human
gccaggcgcagagcugcaaaccc

SEQ ID NO: 1114384 - RNA, 20 nt, Human
gcccagggaggggugcgggg

SEQ ID NO: 1114385 - RNA, 22 nt, Human
gccugcaccacagccuggacac

SEQ ID NO: 1114386 - RNA, 19 nt, Human
gccuggacgucugucccca

SEQ ID NO: 1114387 - RNA, 22 nt, Human
gcggucauaacacgugugugcc

SEQ ID NO: 1114388 - RNA, 23 nt, Human
gcuggucucgaacucccgaccuc

SEQ ID NO: 1114389 - RNA, 23 nt, Human
ggaaauaugugucccgauggcuc

SEQ ID NO: 1114390 - RNA, 25 nt, Human
ggagauagaagggggcaugaggggc

SEQ ID NO: 1114391 - RNA, 18 nt, Human
ggaggaccuggaggaggc

SEQ ID NO: 1114392 - RNA, 19 nt, Human
ggaggaggcgcugggugcu

SEQ ID NO: 1114393 - RNA, 19 nt, Human
ggaggggcaggaggggcug

SEQ ID NO: 1114394 - RNA, 22 nt, Human
ggauuacaggcaugcgccacca

SEQ ID NO: 1114395 - RNA, 24 nt, Human
ggauuacaggcaugcgccaccaug

SEQ ID NO: 1114396 - RNA, 20 nt, Human
ggcaggcuggcagcaccugg

SEQ ID NO: 1114397 - RNA, 22 nt, Human
ggcaggcuggcagcaccuggcu

SEQ ID NO: 1114398 - RNA, 24 nt, Human
ggcaggcuggcagcaccuggcucu

SEQ ID NO: 1114399 - RNA, 26 nt, Human
ggcugggggcagcagccgcggucaua

SEQ ID NO: 1114400 - RNA, 19 nt, Human
ggcugucauugugaaggag

SEQ ID NO: 1114401 - RNA, 18 nt, Human
gggaugggggucuggcug

SEQ ID NO: 1114402 - RNA, 18 nt, Human
gggauuacaggcgugagc

SEQ ID NO: 1114403 - RNA, 21 nt, Human
gggauuacaggcgugagccac

SEQ ID NO: 1114404 - RNA, 23 nt, Human
gggauuacaggcgugagccacug

SEQ ID NO: 1114405 - RNA, 25 nt, Human
gggauuacaggcgugagccacugcg

SEQ ID NO: 1114406 - RNA, 20 nt, Human
gggcaggaggggcugaucgc

SEQ ID NO: 1114407 - RNA, 23 nt, Human
gggcaggcuggcagcaccuggcu

SEQ ID NO: 1114408 - RNA, 25 nt, Human
gggcaggcuggcagcaccuggcucu

SEQ ID NO: 1114409 - RNA, 23 nt, Human
ggggagauagaagggggcaugag

SEQ ID NO: 1114410 - RNA, 22 nt, Human
gggggucuggcugcucccuccu

SEQ ID NO: 1114411 - RNA, 22 nt, Human
gggguuucuccauguuggucag

SEQ ID NO: 1114412 - RNA, 20 nt, Human
gggucuggcugcucccuccu

SEQ ID NO: 1114413 - RNA, 27 nt, Human
ggguggggcccgggcaauuugcugggg

SEQ ID NO: 1114414 - RNA, 19 nt, Human
ggguucaagugauucuccu

SEQ ID NO: 1114415 - RNA, 23 nt, Human
ggugcaguggugcgauuuuggcu

SEQ ID NO: 1114416 - RNA, 24 nt, Human
ggugcaguggugcgauuuuggcuc

SEQ ID NO: 1114417 - RNA, 18 nt, Human
guccuugccucuccaaag

SEQ ID NO: 1114418 - RNA, 24 nt, Human
gugauccucccaccucagccuccc

SEQ ID NO: 1114419 - RNA, 22 nt, Human
gugcaguggugcgauuuuggcu

SEQ ID NO: 1114420 - RNA, 23 nt, Human
gugcaguggugcgauuuuggcuc

SEQ ID NO: 1114421 - RNA, 24 nt, Human
uacaggcaugcgccaccaugccca

SEQ ID NO: 1114422 - RNA, 19 nt, Human
uacaggcgugagccacugc

SEQ ID NO: 1114423 - RNA, 24 nt, Human
uacaggcgugagccacugcgccca

SEQ ID NO: 1114424 - RNA, 24 nt, Human
uacucuuguugcccaggcuggggu

SEQ ID NO: 1114425 - RNA, 19 nt, Human
uagaaaugggguuucucca

SEQ ID NO: 1114426 - RNA, 21 nt, Human
uaggauuacaggcaugcgcca

SEQ ID NO: 1114427 - RNA, 22 nt, Human
uaggauuacaggcaugcgccac

SEQ ID NO: 1114428 - RNA, 24 nt, Human
uaggauuacaggcaugcgccacca

SEQ ID NO: 1114429 - RNA, 19 nt, Human
uaggcuccugcaguuccuc

SEQ ID NO: 1114430 - RNA, 24 nt, Human
uaguagaaaugggguuucuccaug

SEQ ID NO: 1114431 - RNA, 22 nt, Human
ucaacccauccccugccaaccu

SEQ ID NO: 1114432 - RNA, 25 nt, Human
ucacacugcccuucuuccugcugug

SEQ ID NO: 1114433 - RNA, 22 nt, Human
ucacagagauucccgggcugaa

SEQ ID NO: 1114434 - RNA, 21 nt, Human
ucacaggugccagcuggcagg

SEQ ID NO: 1114435 - RNA, 18 nt, Human
ucaccuggugacccuggc

SEQ ID NO: 1114436 - RNA, 21 nt, Human
ucacgacagugcccugcaugc

SEQ ID NO: 1114437 - RNA, 25 nt, Human
ucacugugauuauucauuaaccccu

SEQ ID NO: 1114438 - RNA, 18 nt, Human
ucagccucccacagugcc

SEQ ID NO: 1114439 - RNA, 20 nt, Human
ucagccucccacagugccgg

SEQ ID NO: 1114440 - RNA, 20 nt, Human
ucaggaggggcaggaggggc

SEQ ID NO: 1114441 - RNA, 18 nt, Human
ucagggugcuggauuacc

SEQ ID NO: 1114442 - RNA, 21 nt, Human
ucaugugaaaaugcugauugu

SEQ ID NO: 1114443 - RNA, 19 nt, Human
uccaagcuugcaccugggg

SEQ ID NO: 1114444 - RNA, 26 nt, Human
uccacugugggggccaggacaggggc

SEQ ID NO: 1114445 - RNA, 24 nt, Human
ucccacagugccgggauuacaggc

SEQ ID NO: 1114446 - RNA, 18 nt, Human
ucccaggaucccugaccc

SEQ ID NO: 1114447 - RNA, 26 nt, Human
ucccaggaucccugacccuuggccag

SEQ ID NO: 1114448 - RNA, 23 nt, Human
uccccagacucccagcuuggucu

SEQ ID NO: 1114449 - RNA, 19 nt, Human
ucccgaauagcuaggauua

SEQ ID NO: 1114450 - RNA, 24 nt, Human
ucccgaauagcuaggauuacaggc

SEQ ID NO: 1114451 - RNA, 21 nt, Human
ucccggguucaagugauucuc

SEQ ID NO: 1114452 - RNA, 24 nt, Human
ucccggguucaagugauucuccug

SEQ ID NO: 1114453 - RNA, 18 nt, Human
ucccugacccuuggccag

SEQ ID NO: 1114454 - RNA, 19 nt, Human
ucccugacccuuggccagg

SEQ ID NO: 1114455 - RNA, 19 nt, Human
uccgccuccauuguucccc

SEQ ID NO: 1114456 - RNA, 22 nt, Human
uccuaaauccacugacuugcca

SEQ ID NO: 1114457 - RNA, 19 nt, Human
uccugcggacgcacggcca

SEQ ID NO: 1114458 - RNA, 21 nt, Human
uccugcggacgcacggccaug

SEQ ID NO: 1114459 - RNA, 24 nt, Human
ucuccauaaccuccgccucccggg

SEQ ID NO: 1114460 - RNA, 20 nt, Human
ucuccgauuccuucaaccgu

SEQ ID NO: 1114461 - RNA, 18 nt, Human
ucuuguugcccaggcugg

SEQ ID NO: 1114462 - RNA, 22 nt, Human
ucuuguugcccaggcuggggug

SEQ ID NO: 1114463 - RNA, 19 nt, Human
ugaaagaaaggaggggacc

SEQ ID NO: 1114464 - RNA, 23 nt, Human
ugaaagaaaggaggggacccagg

SEQ ID NO: 1114465 - RNA, 24 nt, Human
ugaaagaaaggaggggacccagga

SEQ ID NO: 1114466 - RNA, 19 nt, Human
ugacccuggcgggaugggg

SEQ ID NO: 1114467 - RNA, 21 nt, Human
ugagcugggcagucgcggggc

SEQ ID NO: 1114468 - RNA, 19 nt, Human
ugagcuucugaacccacau

SEQ ID NO: 1114469 - RNA, 21 nt, Human
ugaggacagggcguugcugac

SEQ ID NO: 1114470 - RNA, 22 nt, Human
ugaggggcugucuccuugguuu

SEQ ID NO: 1114471 - RNA, 21 nt, Human
ugaguccauuguccuugagcu

SEQ ID NO: 1114472 - RNA, 22 nt, Human
ugauucuccuguuuaacccucc

SEQ ID NO: 1114473 - RNA, 18 nt, Human
ugcagaaaaggaagcucc

SEQ ID NO: 1114474 - RNA, 18 nt, Human
ugcccacugugaaugccc

SEQ ID NO: 1114475 - RNA, 18 nt, Human
ugcccaggcuggggugca

SEQ ID NO: 1114476 - RNA, 24 nt, Human
ugcccaggcuggggugcaguggug

SEQ ID NO: 1114477 - RNA, 24 nt, Human
ugccgggauuacaggcgugagcca

SEQ ID NO: 1114478 - RNA, 21 nt, Human
ugccuggacgucuguccccac

SEQ ID NO: 1114479 - RNA, 22 nt, Human
ugccuggcacugaggacagggc

SEQ ID NO: 1114480 - RNA, 22 nt, Human
ugccugggccugagccgagagc

SEQ ID NO: 1114481 - RNA, 22 nt, Human
ugcuggucccaccuccuucaca

SEQ ID NO: 1114482 - RNA, 22 nt, Human
uggacaacagacccucaaccca

SEQ ID NO: 1114483 - RNA, 19 nt, Human
uggcagcaccuggcucugg

SEQ ID NO: 1114484 - RNA, 20 nt, Human
uggcagcaccuggcucuggc

SEQ ID NO: 1114485 - RNA, 24 nt, Human
uggcagcaccuggcucuggcuugc

SEQ ID NO: 1114486 - RNA, 18 nt, Human
uggccuccacgcugcccc

SEQ ID NO: 1114487 - RNA, 20 nt, Human
uggcgggaugggggucuggc

SEQ ID NO: 1114488 - RNA, 18 nt, Human
ugggccugcuggcuuaca

SEQ ID NO: 1114489 - RNA, 21 nt, Human
uggggcccgggcaauuugcug

SEQ ID NO: 1114490 - RNA, 22 nt, Human
uggggcccgggcaauuugcugg

SEQ ID NO: 1114491 - RNA, 18 nt, Human
ugggggcagugagcuggg

SEQ ID NO: 1114492 - RNA, 24 nt, Human
uggggugcaguggugcgauuuugg

SEQ ID NO: 1114493 - RNA, 24 nt, Human
ugggguuucuccauguuggucagg

SEQ ID NO: 1114494 - RNA, 19 nt, Human
ugggugcuggucccaccuc

SEQ ID NO: 1114495 - RNA, 23 nt, Human
uggucaggcuggucucgaacucc

SEQ ID NO: 1114496 - RNA, 19 nt, Human
uggucucgaacucccgacc

SEQ ID NO: 1114497 - RNA, 22 nt, Human
ugguggagguuugaggccugau

SEQ ID NO: 1114498 - RNA, 20 nt, Human
uguccugcggacgcacggcc

SEQ ID NO: 1114499 - RNA, 20 nt, Human
ugugaaggagauuuaaucuu

SEQ ID NO: 1114500 - RNA, 25 nt, Human
ugugcucacgacagugcccugcaug

SEQ ID NO: 1114501 - RNA, 21 nt, Human
ugugggggccaggacaggggc

SEQ ID NO: 1114502 - RNA, 19 nt, Human
ugugugccacaccaggaaa

SEQ ID NO: 1114503 - RNA, 23 nt, Human
uguuuaacccucccgaauagcua

SEQ ID NO: 1114504 - RNA, 22 nt, Human
uuacucuuguugcccaggcugg

SEQ ID NO: 1114505 - RNA, 22 nt, Human
uuacucuuguugcccaggcugg

SEQ ID NO: 1114506 - RNA, 18 nt, Human
uuaguagaaaugggguuu

SEQ ID NO: 1114507 - RNA, 24 nt, Human
uuaguagaaaugggguuucuccau

SEQ ID NO: 1114508 - RNA, 23 nt, Human
uucaagugauucuccuguuuaac

SEQ ID NO: 1114509 - RNA, 23 nt, Human
uucccgggcugaaagugaaagaa

SEQ ID NO: 1114510 - RNA, 20 nt, Human
uucccugaaggagaccccug

SEQ ID NO: 1114511 - RNA, 25 nt, Human
uucucgguuuuauccuaaauccacu

SEQ ID NO: 1114512 - RNA, 23 nt, Human
uucugaguggccuggguggggcc

SEQ ID NO: 1114513 - RNA, 24 nt, Human
uugcccaggcuggggugcaguggu

SEQ ID NO: 1114514 - RNA, 18 nt, Human
uuggaucagguggcccgg

SEQ ID NO: 1114515 - RNA, 19 nt, Human
uuguuccccagccuugcuc

SEQ ID NO: 1114516 - RNA, 24 nt, Human
uuuacucuuguugcccaggcuggg

SEQ ID NO: 1114517 - RNA, 21 nt, Human
uuucuccauguuggucaggcu

SEQ ID NO: 1114518 - RNA, 24 nt, Human
uuuuacucuuguugcccaggcugg

SEQ ID NO: 1114519 - RNA, 22 nt, Human
uuuuuaguagaaaugggguuuc

SEQ ID NO: 1114520 - RNA, 21 nt, Human
agccuagcccccgucaucucc

SEQ ID NO: 1114521 - RNA, 18 nt, Human
aggccccuggcccuucca

SEQ ID NO: 1114522 - RNA, 22 nt, Human
auuugcaccagguucugccuuc

SEQ ID NO: 1114523 - RNA, 18 nt, Human
cagcaugaaagaccaaac

SEQ ID NO: 1114524 - RNA, 19 nt, Human
ccagguucugccuucacuc

SEQ ID NO: 1114525 - RNA, 19 nt, Human
ccccacaacugugggcugc

SEQ ID NO: 1114526 - RNA, 19 nt, Human
ccccuggcccuuccaccca

SEQ ID NO: 1114527 - RNA, 21 nt, Human
ccuccagcuggagcuuggccc

SEQ ID NO: 1114528 - RNA, 20 nt, Human
ccuggcccuuccacccaccu

SEQ ID NO: 1114529 - RNA, 21 nt, Human
ccugggaaaagccccuucccc

SEQ ID NO: 1114530 - RNA, 21 nt, Human
cucggcgccggccccuccagc

SEQ ID NO: 1114531 - RNA, 27 nt, Human
cucgggguccucuccguccccuaaggg

SEQ ID NO: 1114532 - RNA, 21 nt, Human
gaaagaccaaacguaucgaga

SEQ ID NO: 1114533 - RNA, 22 nt, Human
gaaagaccaaacguaucgagag

SEQ ID NO: 1114534 - RNA, 22 nt, Human
gccccuggcccuuccacccacc

SEQ ID NO: 1114535 - RNA, 20 nt, Human
gccccuuccccucggcgccg

SEQ ID NO: 1114536 - RNA, 18 nt, Human
ggaagcccaggggcagug

SEQ ID NO: 1114537 - RNA, 20 nt, Human
ggacccugggaaaagccccu

SEQ ID NO: 1114538 - RNA, 20 nt, Human
ggcccggaguggcgcccugc

SEQ ID NO: 1114539 - RNA, 23 nt, Human
ggcccggaguggcgcccugcacc

SEQ ID NO: 1114540 - RNA, 23 nt, Human
gggaaaagccccuuccccucggc

SEQ ID NO: 1114541 - RNA, 21 nt, Human
gggcugggcugguguggcugc

SEQ ID NO: 1114542 - RNA, 20 nt, Human
uagcccccgucaucuccuug

SEQ ID NO: 1114543 - RNA, 24 nt, Human
uaggggcugacggcauaagggaag

SEQ ID NO: 1114544 - RNA, 24 nt, Human
uccgagccaucuugugcccagagc

SEQ ID NO: 1114545 - RNA, 22 nt, Human
ucgagagcugggcugggcuggg

SEQ ID NO: 1114546 - RNA, 23 nt, Human
ucgagagcugggcugggcugggc

SEQ ID NO: 1114547 - RNA, 22 nt, Human
ugaaagaccaaacguaucgaga

SEQ ID NO: 1114548 - RNA, 23 nt, Human
ugaaagaccaaacguaucgagag

SEQ ID NO: 1114549 - RNA, 21 nt, Human
ugcccagagccuagcccccgu

SEQ ID NO: 1114550 - RNA, 21 nt, Human
ugccuucacuccaccaagucu

SEQ ID NO: 1114551 - RNA, 21 nt, Human
uggcccggaguggcgcccugc

SEQ ID NO: 1114552 - RNA, 19 nt, Human
uggcugcugaagccccaca

SEQ ID NO: 1114553 - RNA, 19 nt, Human
uggcugcugaagccccaca

SEQ ID NO: 1114554 - RNA, 19 nt, Human
ugggcugggcugggcuggu

SEQ ID NO: 1114555 - RNA, 20 nt, Human
ugggcugggcugggcuggug

SEQ ID NO: 1114556 - RNA, 23 nt, Human
ugggcugguguggcugcugaagc

SEQ ID NO: 1114557 - RNA, 18 nt, Human
ugguguggcugcugaagc

SEQ ID NO: 1114558 - RNA, 21 nt, Human
uguggcugcugaagccccaca

SEQ ID NO: 1114559 - RNA, 21 nt, Human
uuccacccaccuuugcccuca

SEQ ID NO: 1114560 - RNA, 23 nt, Human
aaacaguccuggacaacaggguc

SEQ ID NO: 1114561 - RNA, 20 nt, Human
aacaccagccucagcuuccc

SEQ ID NO: 1114562 - RNA, 23 nt, Human
aacccaauaacagacaugaggga

SEQ ID NO: 1114563 - RNA, 21 nt, Human
aagacagggauguggcagagc

SEQ ID NO: 1114564 - RNA, 21 nt, Human
aagaggucccccuccuggccc

SEQ ID NO: 1114565 - RNA, 25 nt, Human
acccacccuggcuccccucaagggc

SEQ ID NO: 1114566 - RNA, 25 nt, Human
acccugcuuccaaggcugcugccuu

SEQ ID NO: 1114567 - RNA, 21 nt, Human
accuccaaccugcgcagaaca

SEQ ID NO: 1114568 - RNA, 22 nt, Human
accuccaaccugcgcagaacaa

SEQ ID NO: 1114569 - RNA, 19 nt, Human
acuacgcccuaagccuuug

SEQ ID NO: 1114570 - RNA, 25 nt, Human
acucagugccugucagcccuuggua

SEQ ID NO: 1114571 - RNA, 22 nt, Human
agaacaaucagcguccugacca

SEQ ID NO: 1114572 - RNA, 20 nt, Human
agaugauguccauguuuugu

SEQ ID NO: 1114573 - RNA, 20 nt, Human
agcaguugcuggggagucuu

SEQ ID NO: 1114574 - RNA, 22 nt, Human
agccaucuccaggaagcaacac

SEQ ID NO: 1114575 - RNA, 19 nt, Human
agcccuugguaaacagucc

SEQ ID NO: 1114576 - RNA, 18 nt, Human
agccuuuggaggccaggg

SEQ ID NO: 1114577 - RNA, 24 nt, Human
aggagcacacccugcuuccaaggc

SEQ ID NO: 1114578 - RNA, 22 nt, Human
augcacacuucuccccuggucu

SEQ ID NO: 1114579 - RNA, 23 nt, Human
cacacagugggggauccccaccc

SEQ ID NO: 1114580 - RNA, 21 nt, Human
cacagcagugcgcagacccuu

SEQ ID NO: 1114581 - RNA, 22 nt, Human
caccaccuaccuccaaccugcg

SEQ ID NO: 1114582 - RNA, 22 nt, Human
cacccuggcuccccucaagggc

SEQ ID NO: 1114583 - RNA, 25 nt, Human
cacccuggcuccccucaagggcuuc

SEQ ID NO: 1114584 - RNA, 21 nt, Human
caccuagcagacaacuguccc

SEQ ID NO: 1114585 - RNA, 26 nt, Human
cacuccauccucacugcaggccuuca

SEQ ID NO: 1114586 - RNA, 21 nt, Human
cacuguccuuuccgcugcaug

SEQ ID NO: 1114587 - RNA, 18 nt, Human
cagaacaccagccucagc

SEQ ID NO: 1114588 - RNA, 22 nt, Human
cagaacaccagccucagcuucc

SEQ ID NO: 1114589 - RNA, 22 nt, Human
cagagcccugcggguugcuccc

SEQ ID NO: 1114590 - RNA, 18 nt, Human
cagcagcccagcagggau

SEQ ID NO: 1114591 - RNA, 19 nt, Human
cagcccuugguaaacaguc

SEQ ID NO: 1114592 - RNA, 24 nt, Human
caguugcuggggagucuuuccggg

SEQ ID NO: 1114593 - RNA, 22 nt, Human
ccacccacccuggcuccccuca

SEQ ID NO: 1114594 - RNA, 19 nt, Human
ccauaguccuccuguuccc

SEQ ID NO: 1114595 - RNA, 27 nt, Human
cccaauaacagacaugagggauggccc

SEQ ID NO: 1114596 - RNA, 24 nt, Human
ccccacccacccuggcuccccuca

SEQ ID NO: 1114597 - RNA, 24 nt, Human
ccccacccacccuggcuccccuca

SEQ ID NO: 1114598 - RNA, 21 nt, Human
cccccuccuggcccuugucac

SEQ ID NO: 1114599 - RNA, 19 nt, Human
cccuaagaggucccccucc

SEQ ID NO: 1114600 - RNA, 19 nt, Human
cccuccuggcccuugucac

SEQ ID NO: 1114601 - RNA, 24 nt, Human
cccugcggguugcucccaucacuc

SEQ ID NO: 1114602 - RNA, 18 nt, Human
cccugggcggccacauuc

SEQ ID NO: 1114603 - RNA, 20 nt, Human
cccuugguaaacaguccugg

SEQ ID NO: 1114604 - RNA, 19 nt, Human
ccgaccacuccauccucac

SEQ ID NO: 1114605 - RNA, 21 nt, Human
ccgcugcaugagugcaguguc

SEQ ID NO: 1114606 - RNA, 22 nt, Human
ccgcuuuccaguuaccugaccc

SEQ ID NO: 1114607 - RNA, 19 nt, Human
ccuaugucccccagauuca

SEQ ID NO: 1114608 - RNA, 26 nt, Human
ccucaagggcugcgugcacagugccc

SEQ ID NO: 1114609 - RNA, 19 nt, Human
ccuccaaaggcagcuggcu

SEQ ID NO: 1114610 - RNA, 24 nt, Human
ccucccacuccucuggcagucaca

SEQ ID NO: 1114611 - RNA, 23 nt, Human
ccuucacccuuugccagcaguug

SEQ ID NO: 1114612 - RNA, 24 nt, Human
ccuugccgcaaccugcuugucuug

SEQ ID NO: 1114613 - RNA, 22 nt, Human
cgaccacaccgaggagcacacc

SEQ ID NO: 1114614 - RNA, 20 nt, Human
cgaggagcacacccugcuuc

SEQ ID NO: 1114615 - RNA, 19 nt, Human
cgcccuaagccuuuggagg

SEQ ID NO: 1114616 - RNA, 22 nt, Human
cuacucagaacaccagccucag

SEQ ID NO: 1114617 - RNA, 21 nt, Human
cucaccaccuaccuccaaccu

SEQ ID NO: 1114618 - RNA, 21 nt, Human
cuccccuggucuuucugcccc

SEQ ID NO: 1114619 - RNA, 21 nt, Human
cucucugggacagagccucac

SEQ ID NO: 1114620 - RNA, 21 nt, Human
cugagucccuauuccauuuug

SEQ ID NO: 1114621 - RNA, 21 nt, Human
cugccuucugcacacaguggg

SEQ ID NO: 1114622 - RNA, 20 nt, Human
cugcugccuucugcacacag

SEQ ID NO: 1114623 - RNA, 22 nt, Human
cugcugccuucugcacacagug

SEQ ID NO: 1114624 - RNA, 22 nt, Human
cuguccuuuccgcugcaugagu

SEQ ID NO: 1114625 - RNA, 18 nt, Human
gaaacucaaacacucuuc

SEQ ID NO: 1114626 - RNA, 20 nt, Human
gaaaugcucccacaucaggu

SEQ ID NO: 1114627 - RNA, 23 nt, Human
gacucaccaccuaccuccaaccu

SEQ ID NO: 1114628 - RNA, 18 nt, Human
gagcccugcggguugcuc

SEQ ID NO: 1114629 - RNA, 18 nt, Human
gaggagcacacccugcuu

SEQ ID NO: 1114630 - RNA, 20 nt, Human
gcuggggagucuuuccggcc

SEQ ID NO: 1114631 - RNA, 20 nt, Human
ggacaacagggucaaggaca

SEQ ID NO: 1114632 - RNA, 25 nt, Human
ggauggcccugucucucugggacag

SEQ ID NO: 1114633 - RNA, 18 nt, Human
ggauguggcagagcccug

SEQ ID NO: 1114634 - RNA, 23 nt, Human
ggauugggggaaaugcucccaca

SEQ ID NO: 1114635 - RNA, 24 nt, Human
ggccagggacaaagucucguucac

SEQ ID NO: 1114636 - RNA, 20 nt, Human
uaccugacccacccugaguc

SEQ ID NO: 1114637 - RNA, 18 nt, Human
ucagcuucccuauguccc

SEQ ID NO: 1114638 - RNA, 21 nt, Human
ucccagggccugccccugaug

SEQ ID NO: 1114639 - RNA, 25 nt, Human
uccccacccacccuggcuccccuca

SEQ ID NO: 1114640 - RNA, 22 nt, Human
ucucagacucaccaccuaccuc

SEQ ID NO: 1114641 - RNA, 19 nt, Human
ucucucugggacagagccu

SEQ ID NO: 1114642 - RNA, 21 nt, Human
ucugccacuacucagaacacc

SEQ ID NO: 1114643 - RNA, 23 nt, Human
ugaccacuugcuagagauggcuu

SEQ ID NO: 1114644 - RNA, 19 nt, Human
ugagggauggcccugucuc

SEQ ID NO: 1114645 - RNA, 24 nt, Human
ugaugcacacuucuccccuggucu

SEQ ID NO: 1114646 - RNA, 21 nt, Human
ugccuucugcacacagugggg

SEQ ID NO: 1114647 - RNA, 22 nt, Human
uggaggccagggacaaagucuc

SEQ ID NO: 1114648 - RNA, 21 nt, Human
uggccaggugcacggggcacu

SEQ ID NO: 1114649 - RNA, 22 nt, Human
uggcccccuaagaggucccccu

SEQ ID NO: 1114650 - RNA, 18 nt, Human
uggcuugaauccuguggg

SEQ ID NO: 1114651 - RNA, 21 nt, Human
ugggugguggccuggucccug

SEQ ID NO: 1114652 - RNA, 22 nt, Human
ugucccccagauucagcagccc

SEQ ID NO: 1114653 - RNA, 21 nt, Human
ugucuggccaggugcacgggg

SEQ ID NO: 1114654 - RNA, 19 nt, Human
ugugccauaguccuccugu

SEQ ID NO: 1114655 - RNA, 18 nt, Human
uguggcagagcccugcgg

SEQ ID NO: 1114656 - RNA, 18 nt, Human
uuccaaggcugcugccuu

SEQ ID NO: 1114657 - RNA, 20 nt, Human
aaaaacaaguacuuaaccca

SEQ ID NO: 1114658 - RNA, 26 nt, Human
aaacacugcagcauaucccaauaaaa

SEQ ID NO: 1114659 - RNA, 20 nt, Human
aaaugucucuuugaacagag

SEQ ID NO: 1114660 - RNA, 18 nt, Human
aacagagauguagcaagc

SEQ ID NO: 1114661 - RNA, 22 nt, Human
aaccacaaagcaccaauucaac

SEQ ID NO: 1114662 - RNA, 19 nt, Human
aacccucuauaaaaaaggg

SEQ ID NO: 1114663 - RNA, 18 nt, Human
aagccuuuguggggagga

SEQ ID NO: 1114664 - RNA, 18 nt, Human
aaggaacagaggaauuca

SEQ ID NO: 1114665 - RNA, 24 nt, Human
aauucuuucuucagaaacaaagaa

SEQ ID NO: 1114666 - RNA, 21 nt, Human
acaaaauccaugaggaaaacc

SEQ ID NO: 1114667 - RNA, 20 nt, Human
acaaagcaccaauucaacaa

SEQ ID NO: 1114668 - RNA, 18 nt, Human
acacaagcucuaaggaac

SEQ ID NO: 1114669 - RNA, 23 nt, Human
acagcaaucccuuucuucuuucu

SEQ ID NO: 1114670 - RNA, 24 nt, Human
acauguauguauucuguuuacaaa

SEQ ID NO: 1114671 - RNA, 25 nt, Human
acggagcuucucuuuucagagcuau

SEQ ID NO: 1114672 - RNA, 24 nt, Human
agcauaucccaauaaaaccuuaau

SEQ ID NO: 1114673 - RNA, 25 nt, Human
aucccuuucuucuuucucccccuuc

SEQ ID NO: 1114674 - RNA, 18 nt, Human
caagcccacuuuuuccaa

SEQ ID NO: 1114675 - RNA, 19 nt, Human
caaggcguugacacacaga

SEQ ID NO: 1114676 - RNA, 21 nt, Human
caaguacuuaacccaggaacc

SEQ ID NO: 1114677 - RNA, 22 nt, Human
cccgcgcggagcucggcggccg

SEQ ID NO: 1114678 - RNA, 20 nt, Human
cccugugcgcaucuuguccu

SEQ ID NO: 1114679 - RNA, 22 nt, Human
ccuuucuucuuucucccccucc

SEQ ID NO: 1114680 - RNA, 24 nt, Human
cggccgccacgcgcaaagccccgg

SEQ ID NO: 1114681 - RNA, 23 nt, Human
cuaaucgugucaaagaucaucua

SEQ ID NO: 1114682 - RNA, 23 nt, Human
cuuaauaaggucaaguggagaac

SEQ ID NO: 1114683 - RNA, 23 nt, Human
gaaccgaacaaagcauaggacaa

SEQ ID NO: 1114684 - RNA, 19 nt, Human
gggggucggaggggcgggg

SEQ ID NO: 1114685 - RNA, 20 nt, Human
gggggucggaggggcggggg

SEQ ID NO: 1114686 - RNA, 21 nt, Human
gggggucggaggggcgggggc

SEQ ID NO: 1114687 - RNA, 21 nt, Human
gucuguaaccaaaagacuguc

SEQ ID NO: 1114688 - RNA, 24 nt, Human
uaacaaggcuuuuugaccuguaac

SEQ ID NO: 1114689 - RNA, 19 nt, Human
uaacccaggaaccgaacaa

SEQ ID NO: 1114690 - RNA, 25 nt, Human
uacauauacacauguauguauucug

SEQ ID NO: 1114691 - RNA, 23 nt, Human
uacuagaagggacaagaucuggg

SEQ ID NO: 1114692 - RNA, 21 nt, Human
uagaagggacaagaucugggc

SEQ ID NO: 1114693 - RNA, 22 nt, Human
uagaagggacaagaucugggca

SEQ ID NO: 1114694 - RNA, 25 nt, Human
uagcaagcccacuuuuuccaagcuc

SEQ ID NO: 1114695 - RNA, 22 nt, Human
uaugucauuauguauuuuuuga

SEQ ID NO: 1114696 - RNA, 19 nt, Human
uccuaagucuguaaccaaa

SEQ ID NO: 1114697 - RNA, 23 nt, Human
ucucuuugaacagagauguagca

SEQ ID NO: 1114698 - RNA, 23 nt, Human
ucuucuuucucccccuccccaag

SEQ ID NO: 1114699 - RNA, 19 nt, Human
ucuuugaacagagauguag

SEQ ID NO: 1114700 - RNA, 23 nt, Human
ugacaaaauccaugaggaaaacc

SEQ ID NO: 1114701 - RNA, 18 nt, Human
ugaggaaaauccuuauga

SEQ ID NO: 1114702 - RNA, 28 nt, Human
ugauuucaggugagcugaugaauugccu

SEQ ID NO: 1114703 - RNA, 21 nt, Human
ugcgcaucuuguccuugcucc

SEQ ID NO: 1114704 - RNA, 23 nt, Human
uuacaaaguuucauuacaugaaa

SEQ ID NO: 1114705 - RNA, 21 nt, Human
uuacauauacacauguaugua

SEQ ID NO: 1114706 - RNA, 25 nt, Human
uugaacagagauguagcaagcccac

SEQ ID NO: 1114707 - RNA, 24 nt, Human
uugcaaccacaaagcaccaauuca

SEQ ID NO: 1114708 - RNA, 20 nt, Human
uuuacauauacacauguaug

SEQ ID NO: 1114709 - RNA, 18 nt, Human
uuucagagcuaugauucu

SEQ ID NO: 1114710 - RNA, 22 nt, Human
aaacccgcuccuuugcgcugcc

SEQ ID NO: 1114711 - RNA, 20 nt, Human
aagcgcucagguuccaauug

SEQ ID NO: 1114712 - RNA, 20 nt, Human
accacuccauacuccuccac

SEQ ID NO: 1114713 - RNA, 23 nt, Human
accagucccccaugggaucccag

SEQ ID NO: 1114714 - RNA, 22 nt, Human
accuaaauugaagauagaccuc

SEQ ID NO: 1114715 - RNA, 19 nt, Human
acuccauacuccuccacaa

SEQ ID NO: 1114716 - RNA, 22 nt, Human
aggaacuccaggguccuguagu

SEQ ID NO: 1114717 - RNA, 23 nt, Human
aggaucuugaccaagcgcucagg

SEQ ID NO: 1114718 - RNA, 23 nt, Human
agugcuucugccucaggcuccug

SEQ ID NO: 1114719 - RNA, 25 nt, Human
auagaaucguucuccaagcucucag

SEQ ID NO: 1114720 - RNA, 19 nt, Human
auggccagagccccagggc

SEQ ID NO: 1114721 - RNA, 19 nt, Human
augggcuuggccgggggcu

SEQ ID NO: 1114722 - RNA, 21 nt, Human
auugaagauagaccuccacuu

SEQ ID NO: 1114723 - RNA, 26 nt, Human
cacccaaaaacccgcuccuuugcgcu

SEQ ID NO: 1114724 - RNA, 19 nt, Human
cagcagguugggagcccac

SEQ ID NO: 1114725 - RNA, 18 nt, Human
caggugcuccugcaaguc

SEQ ID NO: 1114726 - RNA, 27 nt, Human
cauccaccacuccauacuccuccacaa

SEQ ID NO: 1114727 - RNA, 21 nt, Human
ccacuccauacuccuccacaa

SEQ ID NO: 1114728 - RNA, 22 nt, Human
ccacuccauacuccuccacaaa

SEQ ID NO: 1114729 - RNA, 22 nt, Human
ccagagcgaccuaaauugaaga

SEQ ID NO: 1114730 - RNA, 18 nt, Human
ccagccagcugcugggcu

SEQ ID NO: 1114731 - RNA, 28 nt, Human
ccagcucguggugugccuggccaccugg

SEQ ID NO: 1114732 - RNA, 18 nt, Human
cccaaaaacccgcuccuu

SEQ ID NO: 1114733 - RNA, 22 nt, Human
cccauccaccacuccauacucc

SEQ ID NO: 1114734 - RNA, 21 nt, Human
ccccaagaccugugcccuacc

SEQ ID NO: 1114735 - RNA, 18 nt, Human
cccccagcccggauggcu

SEQ ID NO: 1114736 - RNA, 21 nt, Human
cccccguggaaguuuacgcuu

SEQ ID NO: 1114737 - RNA, 24 nt, Human
cccguggaaguuuacgcuuagucu

SEQ ID NO: 1114738 - RNA, 23 nt, Human
cccucugcugccucuauagaauc

SEQ ID NO: 1114739 - RNA, 18 nt, Human
cccuucuucuuuccuuuc

SEQ ID NO: 1114740 - RNA, 23 nt, Human
cccuucuucuuuccuuucugccg

SEQ ID NO: 1114741 - RNA, 20 nt, Human
ccgcccagcucguggugugc

SEQ ID NO: 1114742 - RNA, 18 nt, Human
ccuacagccucagcaaac

SEQ ID NO: 1114743 - RNA, 23 nt, Human
ccuacagccucagcaaacuuguc

SEQ ID NO: 1114744 - RNA, 23 nt, Human
ccucuggcucaucacuggccccc

SEQ ID NO: 1114745 - RNA, 33 nt, Human
ccuguaguuugggacagggaguucccgaagccg

SEQ ID NO: 1114746 - RNA, 24 nt, Human
ccuuguuggauuuauccucccugu

SEQ ID NO: 1114747 - RNA, 20 nt, Human
cgcucagguuccaauugcac

SEQ ID NO: 1114748 - RNA, 18 nt, Human
cucccuguccucagcccc

SEQ ID NO: 1114749 - RNA, 22 nt, Human
cuccugcaagucgcacccaaaa

SEQ ID NO: 1114750 - RNA, 19 nt, Human
cuccugccccuggggcccc

SEQ ID NO: 1114751 - RNA, 22 nt, Human
cuccuuugcgcugcccuucuuc

SEQ ID NO: 1114752 - RNA, 21 nt, Human
cugccucaggcuccuguucac

SEQ ID NO: 1114753 - RNA, 21 nt, Human
cugcugccucuauagaaucgu

SEQ ID NO: 1114754 - RNA, 19 nt, Human
cuggccgcaguguccccuu

SEQ ID NO: 1114755 - RNA, 19 nt, Human
cuguucacccucugcugcc

SEQ ID NO: 1114756 - RNA, 22 nt, Human
cuugaccaagcgcucagguucc

SEQ ID NO: 1114757 - RNA, 22 nt, Human
cuuggcccggccccaggggggc

SEQ ID NO: 1114758 - RNA, 18 nt, Human
cuuugcgcugcccuucuu

SEQ ID NO: 1114759 - RNA, 19 nt, Human
gagacuucauggccagagc

SEQ ID NO: 1114760 - RNA, 22 nt, Human
gagccgguaagugagcagggga

SEQ ID NO: 1114761 - RNA, 19 nt, Human
gcaagucgcacccaaaaac

SEQ ID NO: 1114762 - RNA, 24 nt, Human
gcaagucgcacccaaaaacccgcu

SEQ ID NO: 1114763 - RNA, 18 nt, Human
gccccagggcacuggccc

SEQ ID NO: 1114764 - RNA, 19 nt, Human
gccccaggggggcagggcu

SEQ ID NO: 1114765 - RNA, 20 nt, Human
gcccggauggcugaccgccc

SEQ ID NO: 1114766 - RNA, 23 nt, Human
gccugggcaacgggcagcagcuc

SEQ ID NO: 1114767 - RNA, 21 nt, Human
ggcagggcucccaauuggggg

SEQ ID NO: 1114768 - RNA, 18 nt, Human
ggccugggcaacgggcag

SEQ ID NO: 1114769 - RNA, 23 nt, Human
ggcucccaauuggggguggaggg

SEQ ID NO: 1114770 - RNA, 21 nt, Human
gggcagggcucccaauugggg

SEQ ID NO: 1114771 - RNA, 22 nt, Human
gggcagggcucccaauuggggg

SEQ ID NO: 1114772 - RNA, 20 nt, Human
ggggcagggcucccaauugg

SEQ ID NO: 1114773 - RNA, 22 nt, Human
gggggcugcugggccccaccag

SEQ ID NO: 1114774 - RNA, 20 nt, Human
ggggguggaggguggccugg

SEQ ID NO: 1114775 - RNA, 24 nt, Human
gucccccaugggaucccagccagc

SEQ ID NO: 1114776 - RNA, 21 nt, Human
uagagaugauguucgggggca

SEQ ID NO: 1114777 - RNA, 24 nt, Human
uaggaucuugaccaagcgcucagg

SEQ ID NO: 1114778 - RNA, 19 nt, Human
ucagccccccguggaaguu

SEQ ID NO: 1114779 - RNA, 23 nt, Human
ucagugaguccaugcuuuuggcu

SEQ ID NO: 1114780 - RNA, 23 nt, Human
ucccagccagcugcugggcuugg

SEQ ID NO: 1114781 - RNA, 22 nt, Human
uccugcaagucgcacccaaaaa

SEQ ID NO: 1114782 - RNA, 20 nt, Human
uccuggccugagugcugcag

SEQ ID NO: 1114783 - RNA, 25 nt, Human
ucucauggccagagcgaccuaaauu

SEQ ID NO: 1114784 - RNA, 21 nt, Human
ucugccgagacuucauggcca

SEQ ID NO: 1114785 - RNA, 22 nt, Human
ugaagauagaccuccacuuccu

SEQ ID NO: 1114786 - RNA, 20 nt, Human
ugaccaagcgcucagguucc

SEQ ID NO: 1114787 - RNA, 19 nt, Human
ugaggaacuccaggguccu

SEQ ID NO: 1114788 - RNA, 21 nt, Human
ugaggccauguguaccaagug

SEQ ID NO: 1114789 - RNA, 23 nt, Human
ugccccuggggccccggccacac

SEQ ID NO: 1114790 - RNA, 19 nt, Human
ugccucaggcuccuguuca

SEQ ID NO: 1114791 - RNA, 19 nt, Human
ugcugggccccaccagccc

SEQ ID NO: 1114792 - RNA, 19 nt, Human
uggaggagaccccugagag

SEQ ID NO: 1114793 - RNA, 26 nt, Human
uggcaagaaauuguguccccggaagc

SEQ ID NO: 1114794 - RNA, 20 nt, Human
uggccugagugcugcaggug

SEQ ID NO: 1114795 - RNA, 18 nt, Human
ugggcuuggccgggggcu

SEQ ID NO: 1114796 - RNA, 22 nt, Human
uggucugggcacugaaugaggc

SEQ ID NO: 1114797 - RNA, 20 nt, Human
uugcgcugcccuucuucuuu

SEQ ID NO: 1114798 - RNA, 21 nt, Human
caccagggccuccgggccccc

SEQ ID NO: 1114799 - RNA, 19 nt, Human
ccaccacgguucccuaucc

SEQ ID NO: 1114800 - RNA, 19 nt, Human
ccaccagggccuccgggcc

SEQ ID NO: 1114801 - RNA, 20 nt, Human
ccagggccuuggccccagcc

SEQ ID NO: 1114802 - RNA, 19 nt, Human
cccagggccaccagggccu

SEQ ID NO: 1114803 - RNA, 19 nt, Human
ccccagccccguccauggc

SEQ ID NO: 1114804 - RNA, 21 nt, Human
cccccccccacccgcugcacc

SEQ ID NO: 1114805 - RNA, 18 nt, Human
ccccccccccccccaccc

SEQ ID NO: 1114806 - RNA, 18 nt, Human
ccccccccccccccaccc

SEQ ID NO: 1114807 - RNA, 23 nt, Human
ccccccccccccccacccgcugc

SEQ ID NO: 1114808 - RNA, 24 nt, Human
ccccguccauggccgcgaccccgg

SEQ ID NO: 1114809 - RNA, 23 nt, Human
ccgcgaucuccagggccuuggcc

SEQ ID NO: 1114810 - RNA, 19 nt, Human
ccgggcccccccccccccc

SEQ ID NO: 1114811 - RNA, 18 nt, Human
ccuccgggcccccccccc

SEQ ID NO: 1114812 - RNA, 22 nt, Human
ccuccgggcccccccccccccc

SEQ ID NO: 1114813 - RNA, 26 nt, Human
ccuccgggccccccccccccccaccc

SEQ ID NO: 1114814 - RNA, 22 nt, Human
cgggccccccccccccccaccc

SEQ ID NO: 1114815 - RNA, 22 nt, Human
cuccagggccuuggccccagcc

SEQ ID NO: 1114816 - RNA, 23 nt, Human
cuccgcgaucuccagggccuugg

SEQ ID NO: 1114817 - RNA, 24 nt, Human
cuuggccccagccccguccauggc

SEQ ID NO: 1114818 - RNA, 21 nt, Human
gggccccccccccccccaccc

SEQ ID NO: 1114819 - RNA, 26 nt, Human
uauccuuggccuugccuccgcgaucu

SEQ ID NO: 1114820 - RNA, 23 nt, Human
ucccagggccaccagggccuccg

SEQ ID NO: 1114821 - RNA, 24 nt, Human
uccguggaagccaccacgguuccc

SEQ ID NO: 1114822 - RNA, 18 nt, Human
ucuccagggccuuggccc

SEQ ID NO: 1114823 - RNA, 22 nt, Human
ucuccagggccuuggccccagc

SEQ ID NO: 1114824 - RNA, 21 nt, Human
ugccaaaaccuccguggaagc

SEQ ID NO: 1114825 - RNA, 19 nt, Human
uggaugccacugccaaaac

SEQ ID NO: 1114826 - RNA, 22 nt, Human
uggaugccacugccaaaaccuc

SEQ ID NO: 1114827 - RNA, 18 nt, Human
uggccccagccccgucca

SEQ ID NO: 1114828 - RNA, 21 nt, Human
aaaaaucauuucccgaaagcc

SEQ ID NO: 1114829 - RNA, 25 nt, Human
aaacagauagggaauauuuuuccag

SEQ ID NO: 1114830 - RNA, 22 nt, Human
aaagaacuuaaccagcaaaaac

SEQ ID NO: 1114831 - RNA, 21 nt, Human
aagacugcagaguagaggaau

SEQ ID NO: 1114832 - RNA, 23 nt, Human
aagcaagaggaagaaaaagggac

SEQ ID NO: 1114833 - RNA, 20 nt, Human
acccucugccucugcucuuu

SEQ ID NO: 1114834 - RNA, 23 nt, Human
agagauaggaacaaguuuaaaga

SEQ ID NO: 1114835 - RNA, 21 nt, Human
agcaaauacccucugccucug

SEQ ID NO: 1114836 - RNA, 20 nt, Human
agccacacaaagaaagcugc

SEQ ID NO: 1114837 - RNA, 18 nt, Human
aggaagaaaaaugauucu

SEQ ID NO: 1114838 - RNA, 24 nt, Human
aggcaagguuuuuuuucuucuucu

SEQ ID NO: 1114839 - RNA, 19 nt, Human
aguuuuugagaucuuggaa

SEQ ID NO: 1114840 - RNA, 21 nt, Human
auagcaaauacccucugccuc

SEQ ID NO: 1114841 - RNA, 26 nt, Human
aucucuuuuaagagacuggguugugc

SEQ ID NO: 1114842 - RNA, 24 nt, Human
cacuuaaaaaaaucauuucccgaa

SEQ ID NO: 1114843 - RNA, 21 nt, Human
caguugaaaagaacuuaacca

SEQ ID NO: 1114844 - RNA, 24 nt, Human
caugacaccagcucuuaagcagca

SEQ ID NO: 1114845 - RNA, 18 nt, Human
ccacacaaagaaagcugc

SEQ ID NO: 1114846 - RNA, 22 nt, Human
ccacacaaagaaagcugcuuaa

SEQ ID NO: 1114847 - RNA, 20 nt, Human
ccuacugcaggaagugaggu

SEQ ID NO: 1114848 - RNA, 20 nt, Human
ccuuuuccuuugcuguaguu

SEQ ID NO: 1114849 - RNA, 20 nt, Human
cugcucuuuuucuuccuauu

SEQ ID NO: 1114850 - RNA, 22 nt, Human
cugcugugguucaaagccacac

SEQ ID NO: 1114851 - RNA, 22 nt, Human
cuggagucagggaagaugagca

SEQ ID NO: 1114852 - RNA, 25 nt, Human
gaacacuuaacuacuacugguccau

SEQ ID NO: 1114853 - RNA, 21 nt, Human
gagcacagucaugcacccuac

SEQ ID NO: 1114854 - RNA, 22 nt, Human
gcaagguuuuuuuucuucuucu

SEQ ID NO: 1114855 - RNA, 18 nt, Human
gcuucaggcaagagguuu

SEQ ID NO: 1114856 - RNA, 21 nt, Human
gguguuggcuuucuuuuggcu

SEQ ID NO: 1114857 - RNA, 20 nt, Human
gucagcucuuuuuuaaaguu

SEQ ID NO: 1114858 - RNA, 20 nt, Human
gugauccuuuggaaaucuug

SEQ ID NO: 1114859 - RNA, 21 nt, Human
uaaacuucugaaaugcaggcc

SEQ ID NO: 1114860 - RNA, 19 nt, Human
uaaccagcaaaaacuuggc

SEQ ID NO: 1114861 - RNA, 20 nt, Human
uacacuaaaaaugguguugg

SEQ ID NO: 1114862 - RNA, 18 nt, Human
ucaaagccacacaaagaa

SEQ ID NO: 1114863 - RNA, 18 nt, Human
uccuuuuccuuugcugua

SEQ ID NO: 1114864 - RNA, 23 nt, Human
ucugccucugcucuuuuucuucc

SEQ ID NO: 1114865 - RNA, 23 nt, Human
ucugcugugguucaaagccacac

SEQ ID NO: 1114866 - RNA, 24 nt, Human
ugaaaagaacuuaaccagcaaaaa

SEQ ID NO: 1114867 - RNA, 21 nt, Human
ugaaaagcaagaggaagaaaa

SEQ ID NO: 1114868 - RNA, 18 nt, Human
ugaaaagcaagaggaagg

SEQ ID NO: 1114869 - RNA, 19 nt, Human
ugaaaugcaggccaucaaa

SEQ ID NO: 1114870 - RNA, 23 nt, Human
ugacaccagcucuuaagcagcaa

SEQ ID NO: 1114871 - RNA, 19 nt, Human
ugagagcacagucaugcac

SEQ ID NO: 1114872 - RNA, 22 nt, Human
ugagcaggcaguugaaaagaac

SEQ ID NO: 1114873 - RNA, 23 nt, Human
ugauuugcuugaaauuaaacuuc

SEQ ID NO: 1114874 - RNA, 24 nt, Human
ugauuuucuucacaaucuguuuuu

SEQ ID NO: 1114875 - RNA, 19 nt, Human
ugcagaguagaggaaucuu

SEQ ID NO: 1114876 - RNA, 22 nt, Human
uggcuuuuuuccuccucuuaca

SEQ ID NO: 1114877 - RNA, 18 nt, Human
ugggaaagccacugggug

SEQ ID NO: 1114878 - RNA, 21 nt, Human
ugguucaacugcaaagacugc

SEQ ID NO: 1114879 - RNA, 21 nt, Human
ugugguccagugaaaagcaag

SEQ ID NO: 1114880 - RNA, 19 nt, Human
uuaagcagcaacaucugcu

SEQ ID NO: 1114881 - RNA, 24 nt, Human
uuacacuaaaaaugguguuggcuu

SEQ ID NO: 1114882 - RNA, 18 nt, Human
uuggcauucaugaucuug

SEQ ID NO: 1114883 - RNA, 21 nt, Human
uuuggcuuuuuuccuccucuu

SEQ ID NO: 1114884 - RNA, 19 nt, Human
uuugucucuacucugauga

SEQ ID NO: 1114885 - RNA, 22 nt, Human
uuuuccagccaacuuaucccaa

SEQ ID NO: 1114886 - RNA, 19 nt, Human
aaaagcuacaaaaacaugc

SEQ ID NO: 1114887 - RNA, 22 nt, Human
aaaggcauuccauguuccaaaa

SEQ ID NO: 1114888 - RNA, 19 nt, Human
aagcuacaaaaacaugcca

SEQ ID NO: 1114889 - RNA, 24 nt, Human
aaggugggaggauugcuugaggcc

SEQ ID NO: 1114890 - RNA, 18 nt, Human
aaguagcuucucagauca

SEQ ID NO: 1114891 - RNA, 24 nt, Human
aaucucugucucauuuaccagggg

SEQ ID NO: 1114892 - RNA, 24 nt, Human
aaugaacgcuucaaaaacuggagg

SEQ ID NO: 1114893 - RNA, 18 nt, Human
accaggggucauucaaaa

SEQ ID NO: 1114894 - RNA, 18 nt, Human
acugcaucccagccuggg

SEQ ID NO: 1114895 - RNA, 24 nt, Human
acugcaucccagccugggugacag

SEQ ID NO: 1114896 - RNA, 19 nt, Human
acugugacaugaauuggag

SEQ ID NO: 1114897 - RNA, 18 nt, Human
agcauuuugagaggcuaa

SEQ ID NO: 1114898 - RNA, 24 nt, Human
agcauuuugagaggcuaagguggg

SEQ ID NO: 1114899 - RNA, 22 nt, Human
agccugggugacagagugaggc

SEQ ID NO: 1114900 - RNA, 24 nt, Human
agcuacuugggaggcugagguggg

SEQ ID NO: 1114901 - RNA, 24 nt, Human
aggauugcuugaggccaggaauuu

SEQ ID NO: 1114902 - RNA, 24 nt, Human
aggcuaaggugggaggauugcuug

SEQ ID NO: 1114903 - RNA, 24 nt, Human
aggcugaggugggagggucacuug

SEQ ID NO: 1114904 - RNA, 19 nt, Human
aggcugcagugagcugugu

SEQ ID NO: 1114905 - RNA, 22 nt, Human
aggcugggcaacauggugagac

SEQ ID NO: 1114906 - RNA, 24 nt, Human
aggcugggcaacauggugagaccc

SEQ ID NO: 1114907 - RNA, 23 nt, Human
aggugggaggauugcuugaggcc

SEQ ID NO: 1114908 - RNA, 24 nt, Human
aggugggagggucacuugagcccg

SEQ ID NO: 1114909 - RNA, 21 nt, Human
auaaaaacuguggcucacacc

SEQ ID NO: 1114910 - RNA, 19 nt, Human
augcugcuguaguccuagc

SEQ ID NO: 1114911 - RNA, 20 nt, Human
augcugcuguaguccuagcu

SEQ ID NO: 1114912 - RNA, 24 nt, Human
augggucaguuauuugcucucuca

SEQ ID NO: 1114913 - RNA, 20 nt, Human
auugcccagggaugucauug

SEQ ID NO: 1114914 - RNA, 24 nt, Human
caacauggugagacccugugucug

SEQ ID NO: 1114915 - RNA, 24 nt, Human
cacaccuguaaucccagcauuuug

SEQ ID NO: 1114916 - RNA, 26 nt, Human
cacagucuugguguaauuaaccgccu

SEQ ID NO: 1114917 - RNA, 23 nt, Human
cacugcaucccagccugggugac

SEQ ID NO: 1114918 - RNA, 24 nt, Human
cacugcaucccagccugggugaca

SEQ ID NO: 1114919 - RNA, 24 nt, Human
cagauucaccauuucugauugugu

SEQ ID NO: 1114920 - RNA, 21 nt, Human
cagcauuuugagaggcuaagg

SEQ ID NO: 1114921 - RNA, 24 nt, Human
cagcauuuugagaggcuaaggugg

SEQ ID NO: 1114922 - RNA, 23 nt, Human
caucccagccugggugacagagu

SEQ ID NO: 1114923 - RNA, 24 nt, Human
caucccagccugggugacagagug

SEQ ID NO: 1114924 - RNA, 22 nt, Human
cauuucugauugugucuggaga

SEQ ID NO: 1114925 - RNA, 20 nt, Human
ccacugcaucccagccuggg

SEQ ID NO: 1114926 - RNA, 20 nt, Human
ccacugcaucccagccuggg

SEQ ID NO: 1114927 - RNA, 21 nt, Human
ccacugcaucccagccugggu

SEQ ID NO: 1114928 - RNA, 23 nt, Human
ccacugcaucccagccuggguga

SEQ ID NO: 1114929 - RNA, 24 nt, Human
ccacugcaucccagccugggugac

SEQ ID NO: 1114930 - RNA, 19 nt, Human
cccagccugggugacagag

SEQ ID NO: 1114931 - RNA, 24 nt, Human
cccagccugggugacagagugagg

SEQ ID NO: 1114932 - RNA, 20 nt, Human
ccccucucccuccuucccuc

SEQ ID NO: 1114933 - RNA, 19 nt, Human
cccuccuucccucuuuuuu

SEQ ID NO: 1114934 - RNA, 18 nt, Human
ccgggaaaucaaggcugc

SEQ ID NO: 1114935 - RNA, 18 nt, Human
ccugggugacagagugag

SEQ ID NO: 1114936 - RNA, 27 nt, Human
cuagaaaaucucugucucauuuaccag

SEQ ID NO: 1114937 - RNA, 21 nt, Human
cucacaccuguaaucccagca

SEQ ID NO: 1114938 - RNA, 21 nt, Human
cucacaccuguaaucccagca

SEQ ID NO: 1114939 - RNA, 21 nt, Human
cucauaagcaguacugugaca

SEQ ID NO: 1114940 - RNA, 22 nt, Human
cucauaagcaguacugugacau

SEQ ID NO: 1114941 - RNA, 20 nt, Human
cucccccucucccuccuucc

SEQ ID NO: 1114942 - RNA, 21 nt, Human
cugggcaacauggugagaccc

SEQ ID NO: 1114943 - RNA, 21 nt, Human
cuguaguccuagcuacuuggg

SEQ ID NO: 1114944 - RNA, 20 nt, Human
cugucacagcuguaugcacc

SEQ ID NO: 1114945 - RNA, 20 nt, Human
cuucucagaucacagauuuu

SEQ ID NO: 1114946 - RNA, 19 nt, Human
gaaaucaaggcugcaguga

SEQ ID NO: 1114947 - RNA, 23 nt, Human
gauacucccuuucuaacauaaaa

SEQ ID NO: 1114948 - RNA, 24 nt, Human
gauugcuugaggccaggaauuuga

SEQ ID NO: 1114949 - RNA, 24 nt, Human
gccacugcaucccagccuggguga

SEQ ID NO: 1114950 - RNA, 24 nt, Human
gcccgggaaaucaaggcugcagug

SEQ ID NO: 1114951 - RNA, 18 nt, Human
gcucagaaugugaaaaua

SEQ ID NO: 1114952 - RNA, 18 nt, Human
gcuuguucuuucagagcc

SEQ ID NO: 1114953 - RNA, 20 nt, Human
ggaggcugaggugggagggu

SEQ ID NO: 1114954 - RNA, 21 nt, Human
ggcucacaccuguaaucccag

SEQ ID NO: 1114955 - RNA, 20 nt, Human
gggaggcugaggugggaggg

SEQ ID NO: 1114956 - RNA, 20 nt, Human
gucauuguaaauauaugugc

SEQ ID NO: 1114957 - RNA, 22 nt, Human
guggcucacaccuguaauccca

SEQ ID NO: 1114958 - RNA, 24 nt, Human
uaaggugggaggauugcuugaggc

SEQ ID NO: 1114959 - RNA, 26 nt, Human
uaaggugggaggauugcuugaggcca

SEQ ID NO: 1114960 - RNA, 24 nt, Human
uagcuacuugggaggcugaggugg

SEQ ID NO: 1114961 - RNA, 18 nt, Human
uagguggacauuguggca

SEQ ID NO: 1114962 - RNA, 27 nt, Human
uauacacauaaacacagucuuggugua

SEQ ID NO: 1114963 - RNA, 19 nt, Human
uaucacuguccauauuuga

SEQ ID NO: 1114964 - RNA, 23 nt, Human
uccccaugaugaacucuuccuac

SEQ ID NO: 1114965 - RNA, 23 nt, Human
ucccuccuucccucuuuuuuuuu

SEQ ID NO: 1114966 - RNA, 26 nt, Human
ucuaaagugacuguuguuugguguug

SEQ ID NO: 1114967 - RNA, 20 nt, Human
ucucagugccccagauucac

SEQ ID NO: 1114968 - RNA, 22 nt, Human
ucucccuccuucccucuuuuuu

SEQ ID NO: 1114969 - RNA, 22 nt, Human
ugagaggcuaaggugggaggau

SEQ ID NO: 1114970 - RNA, 24 nt, Human
ugagauguauauuaucaugaaaua

SEQ ID NO: 1114971 - RNA, 24 nt, Human
ugagcccgggaaaucaaggcugca

SEQ ID NO: 1114972 - RNA, 22 nt, Human
ugaggugggagggucacuugag

SEQ ID NO: 1114973 - RNA, 23 nt, Human
ugaggugggagggucacuugagc

SEQ ID NO: 1114974 - RNA, 24 nt, Human
ugaggugggagggucacuugagcc

SEQ ID NO: 1114975 - RNA, 21 nt, Human
ugcaacuaugggucaguuauu

SEQ ID NO: 1114976 - RNA, 27 nt, Human
ugccuagagguucauacuucuggucau

SEQ ID NO: 1114977 - RNA, 23 nt, Human
ugcuguaguccuagcuacuuggg

SEQ ID NO: 1114978 - RNA, 21 nt, Human
uggcucacaccuguaauccca

SEQ ID NO: 1114979 - RNA, 22 nt, Human
uggcucacaccuguaaucccag

SEQ ID NO: 1114980 - RNA, 24 nt, Human
uggcucacaccuguaaucccagca

SEQ ID NO: 1114981 - RNA, 19 nt, Human
ugggaggcugaggugggag

SEQ ID NO: 1114982 - RNA, 24 nt, Human
ugggaggcugaggugggaggguca

SEQ ID NO: 1114983 - RNA, 21 nt, Human
ugggugacagagugaggcccu

SEQ ID NO: 1114984 - RNA, 18 nt, Human
uguaauuaaccgccuucu

SEQ ID NO: 1114985 - RNA, 21 nt, Human
uguaauuaaccgccuucuuca

SEQ ID NO: 1114986 - RNA, 22 nt, Human
ugucauuguaaauauaugugca

SEQ ID NO: 1114987 - RNA, 19 nt, Human
ugucuggagaacguuuucc

SEQ ID NO: 1114988 - RNA, 25 nt, Human
uuauuugcucucucaaugucucaug

SEQ ID NO: 1114989 - RNA, 19 nt, Human
uugagucagacucauaagc

SEQ ID NO: 1114990 - RNA, 21 nt, Human
uugauaugccaaaauuauaug

SEQ ID NO: 1114991 - RNA, 25 nt, Human
uugggaggcugaggugggaggguca

SEQ ID NO: 1114992 - RNA, 19 nt, Human
aagaaguaugauaguaucu

SEQ ID NO: 1114993 - RNA, 22 nt, Human
aaguaauacagucaucuggaac

SEQ ID NO: 1114994 - RNA, 21 nt, Human
aucaagaaggacaaggguuua

SEQ ID NO: 1114995 - RNA, 22 nt, Human
caucuggaaccaaaaauaagaa

SEQ ID NO: 1114996 - RNA, 18 nt, Human
uaucaagaaggacaaggg

SEQ ID NO: 1114997 - RNA, 20 nt, Human
uaucaagaaggacaaggguu

SEQ ID NO: 1114998 - RNA, 22 nt, Human
uaucaagaaggacaaggguuua

SEQ ID NO: 1114999 - RNA, 22 nt, Human
uaucaagaaggacaaggguuua

SEQ ID NO: 1115000 - RNA, 21 nt, Human
uaugauaucaagaaggacaag

SEQ ID NO: 1115001 - RNA, 21 nt, Human
ucaagaaggacaaggguuuau

SEQ ID NO: 1115002 - RNA, 23 nt, Human
ugagacuuugggcaaaucauuua

SEQ ID NO: 1115003 - RNA, 21 nt, Human
uuuuaaagccuguucuggaug

SEQ ID NO: 1115004 - RNA, 23 nt, Human
aaaagaacaaaaaugcaaucaag

SEQ ID NO: 1115005 - RNA, 18 nt, Human
aaacagaaaaagaaagac

SEQ ID NO: 1115006 - RNA, 23 nt, Human
aaacagaaaaagaaagacucaag

SEQ ID NO: 1115007 - RNA, 20 nt, Human
aaacagaaggaaaccuaaga

SEQ ID NO: 1115008 - RNA, 23 nt, Human
aaacagcuggccugagcccacca

SEQ ID NO: 1115009 - RNA, 21 nt, Human
aaaccgaacaccucuccccaa

SEQ ID NO: 1115010 - RNA, 18 nt, Human
aaacuggcuucagaaacu

SEQ ID NO: 1115011 - RNA, 22 nt, Human
aaagaaacaaugcuuaugaaaa

SEQ ID NO: 1115012 - RNA, 21 nt, Human
aacacaaaaaccaaggugucc

SEQ ID NO: 1115013 - RNA, 24 nt, Human
aaccgaacaccucuccccaacaca

SEQ ID NO: 1115014 - RNA, 20 nt, Human
acaaaauggagaugaguauc

SEQ ID NO: 1115015 - RNA, 21 nt, Human
acacaccaacuaagagggcac

SEQ ID NO: 1115016 - RNA, 23 nt, Human
acacucaagaaaaagcuuacacg

SEQ ID NO: 1115017 - RNA, 24 nt, Human
acagaaacagcuucgcuuuauaca

SEQ ID NO: 1115018 - RNA, 22 nt, Human
acagaaccauguaaacgaugug

SEQ ID NO: 1115019 - RNA, 24 nt, Human
acagaaccuaugaguucccacacu

SEQ ID NO: 1115020 - RNA, 21 nt, Human
acagaacuuuuaaaaaaauaa

SEQ ID NO: 1115021 - RNA, 18 nt, Human
accaagaccucacacacc

SEQ ID NO: 1115022 - RNA, 24 nt, Human
accaagguguccgacuucuuagac

SEQ ID NO: 1115023 - RNA, 21 nt, Human
accggcuccccgaccugacgc

SEQ ID NO: 1115024 - RNA, 24 nt, Human
acucccagguuuuuccagagcugg

SEQ ID NO: 1115025 - RNA, 20 nt, Human
agaaaaagaaagacucaagu

SEQ ID NO: 1115026 - RNA, 22 nt, Human
agaaccuaugaguucccacacu

SEQ ID NO: 1115027 - RNA, 18 nt, Human
agaacuaccaguguucca

SEQ ID NO: 1115028 - RNA, 21 nt, Human
agaaggaaaccuaagaaccac

SEQ ID NO: 1115029 - RNA, 21 nt, Human
agagccgggaggccugucggg

SEQ ID NO: 1115030 - RNA, 23 nt, Human
agaggcgggagaguggcugcagg

SEQ ID NO: 1115031 - RNA, 25 nt, Human
agaguucuuccacagccuccggcau

SEQ ID NO: 1115032 - RNA, 25 nt, Human
agaguucuuccacagccuccggcau

SEQ ID NO: 1115033 - RNA, 19 nt, Human
agcagaaaaacacuuugga

SEQ ID NO: 1115034 - RNA, 22 nt, Human
agccccucucccucccagcccc

SEQ ID NO: 1115035 - RNA, 20 nt, Human
agccuccggcaucaacuccc

SEQ ID NO: 1115036 - RNA, 21 nt, Human
agcgcccuuccaggggagccc

SEQ ID NO: 1115037 - RNA, 21 nt, Human
aggcaggcagagggcaagcca

SEQ ID NO: 1115038 - RNA, 25 nt, Human
aggcaggcagagggcaagccacuaa

SEQ ID NO: 1115039 - RNA, 22 nt, Human
aggcgggagaguggcugcaggg

SEQ ID NO: 1115040 - RNA, 23 nt, Human
aggcuccgcggcggcggccccgg

SEQ ID NO: 1115041 - RNA, 24 nt, Human
agggacagaucugcuaaaagaaca

SEQ ID NO: 1115042 - RNA, 19 nt, Human
agggcaaaaaagcccgcgg

SEQ ID NO: 1115043 - RNA, 21 nt, Human
agggccuacuuuuggggugac

SEQ ID NO: 1115044 - RNA, 18 nt, Human
aguuccauucuaaaguca

SEQ ID NO: 1115045 - RNA, 18 nt, Human
aguuucuaccuuggacag

SEQ ID NO: 1115046 - RNA, 23 nt, Human
auaaacuuuaaaauuacacagaa

SEQ ID NO: 1115047 - RNA, 22 nt, Human
aucagccaauacuuuuggcugu

SEQ ID NO: 1115048 - RNA, 19 nt, Human
aucccucccuccccucacu

SEQ ID NO: 1115049 - RNA, 20 nt, Human
caaaacaggaaacugaguua

SEQ ID NO: 1115050 - RNA, 18 nt, Human
caaacagcuggccugagc

SEQ ID NO: 1115051 - RNA, 22 nt, Human
caaacagcuggccugagcccac

SEQ ID NO: 1115052 - RNA, 23 nt, Human
caaagcagaaaaacacuuuggag

SEQ ID NO: 1115053 - RNA, 20 nt, Human
caacacaguggaagcagaau

SEQ ID NO: 1115054 - RNA, 20 nt, Human
caaccccccaaccaacuccc

SEQ ID NO: 1115055 - RNA, 18 nt, Human
caacggagagggcucccu

SEQ ID NO: 1115056 - RNA, 22 nt, Human
caagaccucacacaccaacuaa

SEQ ID NO: 1115057 - RNA, 23 nt, Human
caaggggucauccugaaggccca

SEQ ID NO: 1115058 - RNA, 22 nt, Human
cacacgugacaguugccagggc

SEQ ID NO: 1115059 - RNA, 23 nt, Human
cacagaaccauguaaacgaugug

SEQ ID NO: 1115060 - RNA, 21 nt, Human
cacaguuccaaggggucaucc

SEQ ID NO: 1115061 - RNA, 23 nt, Human
caccaacucaaaacagaaaaaga

SEQ ID NO: 1115062 - RNA, 19 nt, Human
caccaagaccucacacacc

SEQ ID NO: 1115063 - RNA, 24 nt, Human
caccaagaccucacacaccaacua

SEQ ID NO: 1115064 - RNA, 23 nt, Human
cacgggccaucucaaccccccaa

SEQ ID NO: 1115065 - RNA, 20 nt, Human
cacuucauuagccaccaacc

SEQ ID NO: 1115066 - RNA, 19 nt, Human
cagaaccuaugaguuccca

SEQ ID NO: 1115067 - RNA, 22 nt, Human
cagaaccuaugaguucccacac

SEQ ID NO: 1115068 - RNA, 28 nt, Human
cagagaaagccggagccccucucccucc

SEQ ID NO: 1115069 - RNA, 21 nt, Human
cagaguucuuccacagccucc

SEQ ID NO: 1115070 - RNA, 21 nt, Human
cagcgcccuuccaggggagcc

SEQ ID NO: 1115071 - RNA, 23 nt, Human
cagcugacccgccagcccagcgc

SEQ ID NO: 1115072 - RNA, 22 nt, Human
caggaaccacagaugggucgug

SEQ ID NO: 1115073 - RNA, 24 nt, Human
cagggggcggcggcggcggcggug

SEQ ID NO: 1115074 - RNA, 21 nt, Human
caguuccaaggggucauccug

SEQ ID NO: 1115075 - RNA, 20 nt, Human
caucucaaccccccaaccaa

SEQ ID NO: 1115076 - RNA, 22 nt, Human
caucucaaccccccaaccaacu

SEQ ID NO: 1115077 - RNA, 18 nt, Human
cauuagccaccaaccagg

SEQ ID NO: 1115078 - RNA, 22 nt, Human
ccaacucaaaacagaaaaagaa

SEQ ID NO: 1115079 - RNA, 19 nt, Human
ccaaggggucauccugaag

SEQ ID NO: 1115080 - RNA, 26 nt, Human
ccacagagaaguggccacauuguccc

SEQ ID NO: 1115081 - RNA, 23 nt, Human
cccaccaagaccucacacaccaa

SEQ ID NO: 1115082 - RNA, 21 nt, Human
cccacugaaaacaaacaugac

SEQ ID NO: 1115083 - RNA, 18 nt, Human
ccccaacacaguggaagc

SEQ ID NO: 1115084 - RNA, 19 nt, Human
ccccaaccaacucccuuuc

SEQ ID NO: 1115085 - RNA, 20 nt, Human
ccccaaccaacucccuuucc

SEQ ID NO: 1115086 - RNA, 20 nt, Human
cccgcaccagagcugagggu

SEQ ID NO: 1115087 - RNA, 24 nt, Human
cccgccagugccucccccagccgg

SEQ ID NO: 1115088 - RNA, 20 nt, Human
cccgggaggggucgcccggg

SEQ ID NO: 1115089 - RNA, 20 nt, Human
cccucucccucccagcccca

SEQ ID NO: 1115090 - RNA, 21 nt, Human
cccucucccucccagccccag

SEQ ID NO: 1115091 - RNA, 23 nt, Human
ccgccgaccggaguggacgaugc

SEQ ID NO: 1115092 - RNA, 18 nt, Human
ccgcgccggcucggccgc

SEQ ID NO: 1115093 - RNA, 22 nt, Human
ccggcuccccgaccugacgccc

SEQ ID NO: 1115094 - RNA, 19 nt, Human
ccucacaggggccucccag

SEQ ID NO: 1115095 - RNA, 18 nt, Human
ccucccagccccagaacu

SEQ ID NO: 1115096 - RNA, 21 nt, Human
ccucccagcucuccuuuaccc

SEQ ID NO: 1115097 - RNA, 23 nt, Human
ccucccagguccaggaucccagc

SEQ ID NO: 1115098 - RNA, 22 nt, Human
ccucccgccagugccuccccca

SEQ ID NO: 1115099 - RNA, 19 nt, Human
ccucccuccccucacuuca

SEQ ID NO: 1115100 - RNA, 18 nt, Human
ccuccggcaucaacuccc

SEQ ID NO: 1115101 - RNA, 20 nt, Human
ccuggcuguuugcccucguc

SEQ ID NO: 1115102 - RNA, 20 nt, Human
ccuugugggagugguagucc

SEQ ID NO: 1115103 - RNA, 20 nt, Human
cgacuggaagccagcggcga

SEQ ID NO: 1115104 - RNA, 18 nt, Human
cgagagugcaggagcugg

SEQ ID NO: 1115105 - RNA, 21 nt, Human
cgaggccgcgcgagcggggga

SEQ ID NO: 1115106 - RNA, 22 nt, Human
cgagggcggacccgggaggggu

SEQ ID NO: 1115107 - RNA, 20 nt, Human
cgagggggcguggcgcggga

SEQ ID NO: 1115108 - RNA, 20 nt, Human
cgcacagcuaccacggaccc

SEQ ID NO: 1115109 - RNA, 19 nt, Human
cgcccaguucggcucgugu

SEQ ID NO: 1115110 - RNA, 24 nt, Human
cgcgggaggcgggcgcggugccuu

SEQ ID NO: 1115111 - RNA, 18 nt, Human
cggcggcggcggcgguga

SEQ ID NO: 1115112 - RNA, 22 nt, Human
cggggcugggggcucgggcgac

SEQ ID NO: 1115113 - RNA, 24 nt, Human
cgguguguggaggcgggucuucug

SEQ ID NO: 1115114 - RNA, 19 nt, Human
cgguuggacaagugugaaa

SEQ ID NO: 1115115 - RNA, 18 nt, Human
cuauguacaguuucuacc

SEQ ID NO: 1115116 - RNA, 23 nt, Human
cucaaaacagaaaaagaaagacu

SEQ ID NO: 1115117 - RNA, 21 nt, Human
cucccagguccaggaucccag

SEQ ID NO: 1115118 - RNA, 22 nt, Human
cucccagguccaggaucccagc

SEQ ID NO: 1115119 - RNA, 18 nt, Human
cuccccgaccugacgccc

SEQ ID NO: 1115120 - RNA, 20 nt, Human
cucgcagccuccucgccagc

SEQ ID NO: 1115121 - RNA, 28 nt, Human
cugagcccaccaagaccucacacaccaa

SEQ ID NO: 1115122 - RNA, 20 nt, Human
cuuaugaaaaccuaccaauc

SEQ ID NO: 1115123 - RNA, 21 nt, Human
cuucagaaacuauuucucucu

SEQ ID NO: 1115124 - RNA, 21 nt, Human
cuuuuggggugacaucccucc

SEQ ID NO: 1115125 - RNA, 20 nt, Human
gaaacaaugcuuaugaaaac

SEQ ID NO: 1115126 - RNA, 25 nt, Human
gaacacgggccaucucaacccccca

SEQ ID NO: 1115127 - RNA, 23 nt, Human
gaaggaaaccuaagaaccaccag

SEQ ID NO: 1115128 - RNA, 22 nt, Human
gaaggggaagcccccagcagug

SEQ ID NO: 1115129 - RNA, 24 nt, Human
gacacuggacaggcguuaucucag

SEQ ID NO: 1115130 - RNA, 18 nt, Human
gaccggcuccccgaccug

SEQ ID NO: 1115131 - RNA, 19 nt, Human
gagcggggccgcccggggc

SEQ ID NO: 1115132 - RNA, 21 nt, Human
gagcgggggaggugcgggggc

SEQ ID NO: 1115133 - RNA, 24 nt, Human
gaggcuccgcggcggcggccccgg

SEQ ID NO: 1115134 - RNA, 22 nt, Human
gcaagccacuaaguaggggcaa

SEQ ID NO: 1115135 - RNA, 24 nt, Human
gcacaaaggaaaccuuggggacuc

SEQ ID NO: 1115136 - RNA, 18 nt, Human
gcacagcuaccacggacc

SEQ ID NO: 1115137 - RNA, 18 nt, Human
gcccgcgccggcucggcc

SEQ ID NO: 1115138 - RNA, 24 nt, Human
gcccgggcuggaggugaugggggg

SEQ ID NO: 1115139 - RNA, 20 nt, Human
gccggagccccucucccucc

SEQ ID NO: 1115140 - RNA, 25 nt, Human
gcgagagugcaggagcugggaugcu

SEQ ID NO: 1115141 - RNA, 18 nt, Human
gcggcggcggcggugagc

SEQ ID NO: 1115142 - RNA, 20 nt, Human
gcggcggcggcggugagcga

SEQ ID NO: 1115143 - RNA, 22 nt, Human
gcgggagaguggcugcaggggg

SEQ ID NO: 1115144 - RNA, 24 nt, Human
gcggugccuugugggagugguagu

SEQ ID NO: 1115145 - RNA, 19 nt, Human
gcugcagggggcggcggcg

SEQ ID NO: 1115146 - RNA, 23 nt, Human
ggaacccgaccggcuccccgacc

SEQ ID NO: 1115147 - RNA, 18 nt, Human
ggacccucauuuucaaau

SEQ ID NO: 1115148 - RNA, 22 nt, Human
ggacucgaggccgcgcgagcgg

SEQ ID NO: 1115149 - RNA, 19 nt, Human
ggcggcggcggcggcggug

SEQ ID NO: 1115150 - RNA, 23 nt, Human
ggcggcggcggugagcgggaacc

SEQ ID NO: 1115151 - RNA, 23 nt, Human
ggcucgggcggcugcgcaggggu

SEQ ID NO: 1115152 - RNA, 18 nt, Human
ggcugcgcagggcgaggg

SEQ ID NO: 1115153 - RNA, 22 nt, Human
ggcugggggcucgggcggcugc

SEQ ID NO: 1115154 - RNA, 24 nt, Human
gggcacucagcaagaaaucagcca

SEQ ID NO: 1115155 - RNA, 21 nt, Human
gggcgcggugccuugugggag

SEQ ID NO: 1115156 - RNA, 19 nt, Human
gggcggcggcggcggcggu

SEQ ID NO: 1115157 - RNA, 19 nt, Human
ggggccgcccggggcuggg

SEQ ID NO: 1115158 - RNA, 19 nt, Human
gggggcggcggcggcugcg

SEQ ID NO: 1115159 - RNA, 18 nt, Human
ggggggcggcggcggcug

SEQ ID NO: 1115160 - RNA, 19 nt, Human
ggucaggcagcagcugagg

SEQ ID NO: 1115161 - RNA, 18 nt, Human
gugguaguccaaggcccc

SEQ ID NO: 1115162 - RNA, 20 nt, Human
guguccgacuucuuagacac

SEQ ID NO: 1115163 - RNA, 21 nt, Human
guucauuucagagaaagccgg

SEQ ID NO: 1115164 - RNA, 21 nt, Human
uaacaggcuggggaaaccgaa

SEQ ID NO: 1115165 - RNA, 23 nt, Human
uaacuguacccuguggaaccggc

SEQ ID NO: 1115166 - RNA, 24 nt, Human
uaacuguacccuguggaaccggca

SEQ ID NO: 1115167 - RNA, 24 nt, Human
uaagaaccaccagcugacccgcca

SEQ ID NO: 1115168 - RNA, 22 nt, Human
uaagagaagggcaaaaaagccc

SEQ ID NO: 1115169 - RNA, 21 nt, Human
uaauacaagcaacagaacuuu

SEQ ID NO: 1115170 - RNA, 19 nt, Human
uacacagaaccauguaaac

SEQ ID NO: 1115171 - RNA, 20 nt, Human
uacagacacuuuugguaaaa

SEQ ID NO: 1115172 - RNA, 24 nt, Human
uacaucgugcaaaacaggaaacug

SEQ ID NO: 1115173 - RNA, 18 nt, Human
uacccuguggaaccggca

SEQ ID NO: 1115174 - RNA, 24 nt, Human
uagcaaugauagcaaaacgcacag

SEQ ID NO: 1115175 - RNA, 20 nt, Human
uaggacaaaaaaaaugccuc

SEQ ID NO: 1115176 - RNA, 21 nt, Human
uaucucaggguagaucuuugg

SEQ ID NO: 1115177 - RNA, 24 nt, Human
ucaaaacagaaaaagaaagacuca

SEQ ID NO: 1115178 - RNA, 20 nt, Human
ucaacuaagagaagggcaaa

SEQ ID NO: 1115179 - RNA, 24 nt, Human
uccaacccccaugaggcuccgcgg

SEQ ID NO: 1115180 - RNA, 24 nt, Human
uccaccuccacugcagggaacgca

SEQ ID NO: 1115181 - RNA, 20 nt, Human
uccaguccaccuccacugca

SEQ ID NO: 1115182 - RNA, 19 nt, Human
ucccagccccagaacuacc

SEQ ID NO: 1115183 - RNA, 22 nt, Human
ucccagcugagauuuaaggaac

SEQ ID NO: 1115184 - RNA, 21 nt, Human
ucccccagccggucaggcagc

SEQ ID NO: 1115185 - RNA, 22 nt, Human
uccccgaccugacgcccaguuc

SEQ ID NO: 1115186 - RNA, 19 nt, Human
uccuuuugcuuaggcaccu

SEQ ID NO: 1115187 - RNA, 19 nt, Human
ucgcagccuccucgccagc

SEQ ID NO: 1115188 - RNA, 18 nt, Human
ucgcccgggcuggaggug

SEQ ID NO: 1115189 - RNA, 18 nt, Human
ucgggaaauguagucugg

SEQ ID NO: 1115190 - RNA, 21 nt, Human
ucguguuaauacaagcaacag

SEQ ID NO: 1115191 - RNA, 21 nt, Human
ucuaccgaaccucccccuugg

SEQ ID NO: 1115192 - RNA, 23 nt, Human
ucucuaccgaaccucccccuugg

SEQ ID NO: 1115193 - RNA, 21 nt, Human
ugaacacgggccaucucaacc

SEQ ID NO: 1115194 - RNA, 23 nt, Human
ugaggcaggcagagggcaagcca

SEQ ID NO: 1115195 - RNA, 23 nt, Human
ugaguuaugaacacgggccaucu

SEQ ID NO: 1115196 - RNA, 20 nt, Human
ugauagcaaaacgcacagcu

SEQ ID NO: 1115197 - RNA, 18 nt, Human
ugcaaaaagacaggguuu

SEQ ID NO: 1115198 - RNA, 21 nt, Human
ugcaggagcugggaugcugga

SEQ ID NO: 1115199 - RNA, 19 nt, Human
ugccuuaaagaaacaaugc

SEQ ID NO: 1115200 - RNA, 25 nt, Human
ugcgagagugcaggagcugggaugc

SEQ ID NO: 1115201 - RNA, 26 nt, Human
ugcgggggcccgcgccggcucggccg

SEQ ID NO: 1115202 - RNA, 22 nt, Human
uggagcgcugguuauucacgug

SEQ ID NO: 1115203 - RNA, 21 nt, Human
uggcacaaaggugccacauga

SEQ ID NO: 1115204 - RNA, 18 nt, Human
uggcagcagcucuggcug

SEQ ID NO: 1115205 - RNA, 20 nt, Human
uggcagcagcucuggcuggc

SEQ ID NO: 1115206 - RNA, 21 nt, Human
uggcagcagcucuggcuggca

SEQ ID NO: 1115207 - RNA, 23 nt, Human
ugggagaaggugggaagagucug

SEQ ID NO: 1115208 - RNA, 24 nt, Human
ugggagaaggugggaagagucugc

SEQ ID NO: 1115209 - RNA, 20 nt, Human
ugggaugcuggagcggggcc

SEQ ID NO: 1115210 - RNA, 25 nt, Human
uggggaaaccgaacaccucucccca

SEQ ID NO: 1115211 - RNA, 19 nt, Human
uggguggcgacuggaagcc

SEQ ID NO: 1115212 - RNA, 20 nt, Human
uggguggcgacuggaagcca

SEQ ID NO: 1115213 - RNA, 20 nt, Human
ugucuaaagggcacacaaga

SEQ ID NO: 1115214 - RNA, 18 nt, Human
uuacccuauucuuuggag

SEQ ID NO: 1115215 - RNA, 18 nt, Human
uuagacaccacccacagg

SEQ ID NO: 1115216 - RNA, 22 nt, Human
uucaaagcagaaaaacacuuug

SEQ ID NO: 1115217 - RNA, 24 nt, Human
uucacaauaaacuggcuucagaaa

SEQ ID NO: 1115218 - RNA, 19 nt, Human
uucacagaaacagcuucgc

SEQ ID NO: 1115219 - RNA, 19 nt, Human
uucacguggugaagacacu

SEQ ID NO: 1115220 - RNA, 22 nt, Human
uucccacacucgcaaacagcug

SEQ ID NO: 1115221 - RNA, 27 nt, Human
uucccacacucgcaaacagcuggccug

SEQ ID NO: 1115222 - RNA, 21 nt, Human
uugcuuaggcaccuaaauggc

SEQ ID NO: 1115223 - RNA, 21 nt, Human
uuggauggcugcuguacagac

SEQ ID NO: 1115224 - RNA, 26 nt, Human
aaacaccaaaguaugcucgugcaagc

SEQ ID NO: 1115225 - RNA, 19 nt, Human
aacagacuccugaacaccu

SEQ ID NO: 1115226 - RNA, 19 nt, Human
aacuuaauuccccaacugg

SEQ ID NO: 1115227 - RNA, 22 nt, Human
aagaaccaaugggcccagauaa

SEQ ID NO: 1115228 - RNA, 22 nt, Human
aagcacccccuggaaccugucc

SEQ ID NO: 1115229 - RNA, 22 nt, Human
aagugggcaaccacagacacac

SEQ ID NO: 1115230 - RNA, 20 nt, Human
acauccagacaggagaggcc

SEQ ID NO: 1115231 - RNA, 28 nt, Human
accacagacacacagcaggagcaagccu

SEQ ID NO: 1115232 - RNA, 21 nt, Human
acgccagucccucagaagccc

SEQ ID NO: 1115233 - RNA, 24 nt, Human
acucagcuggacuucaccuggggc

SEQ ID NO: 1115234 - RNA, 18 nt, Human
acucauggcugcuugugg

SEQ ID NO: 1115235 - RNA, 23 nt, Human
acuccugaacaccugaaucaguc

SEQ ID NO: 1115236 - RNA, 24 nt, Human
acuccuggagcccagaccagccuc

SEQ ID NO: 1115237 - RNA, 19 nt, Human
agaaagacagggacccaag

SEQ ID NO: 1115238 - RNA, 22 nt, Human
agaaagugggcaaccacagaca

SEQ ID NO: 1115239 - RNA, 18 nt, Human
agaaccaaugggcccaga

SEQ ID NO: 1115240 - RNA, 26 nt, Human
agacuccugaacaccugaaucagucu

SEQ ID NO: 1115241 - RNA, 21 nt, Human
agccacagaaacuggacaucc

SEQ ID NO: 1115242 - RNA, 20 nt, Human
aggagaggccgacgucaguu

SEQ ID NO: 1115243 - RNA, 18 nt, Human
aggagcaagccugaggca

SEQ ID NO: 1115244 - RNA, 24 nt, Human
aggcagaagggugccaagaccaag

SEQ ID NO: 1115245 - RNA, 19 nt, Human
agggacccaagaaccaaug

SEQ ID NO: 1115246 - RNA, 25 nt, Human
caacacaaacaccaaaguaugcucg

SEQ ID NO: 1115247 - RNA, 20 nt, Human
cacaaggaggugauguaaua

SEQ ID NO: 1115248 - RNA, 18 nt, Human
cacaugcaugcucuggcc

SEQ ID NO: 1115249 - RNA, 22 nt, Human
cacccucagucccagaugaucu

SEQ ID NO: 1115250 - RNA, 23 nt, Human
cacccuggagccacgccaguccc

SEQ ID NO: 1115251 - RNA, 24 nt, Human
caccugaaucagucucucggagac

SEQ ID NO: 1115252 - RNA, 18 nt, Human
cagaagcccggugucccc

SEQ ID NO: 1115253 - RNA, 19 nt, Human
cagaccagccuccacuccu

SEQ ID NO: 1115254 - RNA, 19 nt, Human
cagaccagccuccacuccu

SEQ ID NO: 1115255 - RNA, 19 nt, Human
cagaccagccuccacuccu

SEQ ID NO: 1115256 - RNA, 22 nt, Human
cagcagaaagugggcaaccaca

SEQ ID NO: 1115257 - RNA, 22 nt, Human
cagccuccacuccugcuggaga

SEQ ID NO: 1115258 - RNA, 22 nt, Human
cagcucaccuggcugcuccuca

SEQ ID NO: 1115259 - RNA, 21 nt, Human
cagcuggacuucaccuggggc

SEQ ID NO: 1115260 - RNA, 21 nt, Human
cagggcuuccagcugggcccu

SEQ ID NO: 1115261 - RNA, 21 nt, Human
caugcaugcucuggccugcca

SEQ ID NO: 1115262 - RNA, 19 nt, Human
caugccaccagcucaccug

SEQ ID NO: 1115263 - RNA, 22 nt, Human
ccacagaaacuggacauccaga

SEQ ID NO: 1115264 - RNA, 20 nt, Human
ccaccagcucaccuggcugc

SEQ ID NO: 1115265 - RNA, 23 nt, Human
ccacuccuggagcccagaccagc

SEQ ID NO: 1115266 - RNA, 27 nt, Human
ccacuuuauuucucacaaggaggugau

SEQ ID NO: 1115267 - RNA, 18 nt, Human
ccagaccagccuccacuc

SEQ ID NO: 1115268 - RNA, 22 nt, Human
ccagaccagccuccacuccugc

SEQ ID NO: 1115269 - RNA, 22 nt, Human
ccagaccagccuccacuccugc

SEQ ID NO: 1115270 - RNA, 22 nt, Human
ccagaccagccuccacuccugc

SEQ ID NO: 1115271 - RNA, 19 nt, Human
ccagcacaugcaugcucug

SEQ ID NO: 1115272 - RNA, 21 nt, Human
ccagcagaaagugggcaacca

SEQ ID NO: 1115273 - RNA, 18 nt, Human
ccaguauaaggcagaagg

SEQ ID NO: 1115274 - RNA, 19 nt, Human
cccagaccagccuccacuc

SEQ ID NO: 1115275 - RNA, 19 nt, Human
cccagaccagccuccacuc

SEQ ID NO: 1115276 - RNA, 19 nt, Human
cccagaccagccuccacuc

SEQ ID NO: 1115277 - RNA, 24 nt, Human
ccccagaccagccuccacuccugc

SEQ ID NO: 1115278 - RNA, 19 nt, Human
cccccuggaaccuguccca

SEQ ID NO: 1115279 - RNA, 22 nt, Human
ccccuggaaccugucccagacc

SEQ ID NO: 1115280 - RNA, 21 nt, Human
ccucagaagcccggugucccc

SEQ ID NO: 1115281 - RNA, 19 nt, Human
ccuccacuccugcuggaga

SEQ ID NO: 1115282 - RNA, 22 nt, Human
ccuccuugcuuugcugucugga

SEQ ID NO: 1115283 - RNA, 19 nt, Human
ccugcuggagaccagucca

SEQ ID NO: 1115284 - RNA, 19 nt, Human
ccugcuggagaccagucca

SEQ ID NO: 1115285 - RNA, 19 nt, Human
ccuggagcccagaccagcc

SEQ ID NO: 1115286 - RNA, 20 nt, Human
ccuguugagaaagacaggga

SEQ ID NO: 1115287 - RNA, 26 nt, Human
ccuugccacaaacgccuuugucucuc

SEQ ID NO: 1115288 - RNA, 18 nt, Human
ccuugcuuugcugucugg

SEQ ID NO: 1115289 - RNA, 24 nt, Human
cgcuucaaccaggcugcuccccac

SEQ ID NO: 1115290 - RNA, 22 nt, Human
cgguguccccaacacaaacacc

SEQ ID NO: 1115291 - RNA, 18 nt, Human
cucacgcucccuccuugc

SEQ ID NO: 1115292 - RNA, 21 nt, Human
cuccugcuggagaccagucca

SEQ ID NO: 1115293 - RNA, 21 nt, Human
cuccugcuggagaccagucca

SEQ ID NO: 1115294 - RNA, 22 nt, Human
cuccuugcuuugcugucuggau

SEQ ID NO: 1115295 - RNA, 24 nt, Human
cucgugcaagccagcacaugcaug

SEQ ID NO: 1115296 - RNA, 21 nt, Human
cucguggaaaccucagcaccc

SEQ ID NO: 1115297 - RNA, 18 nt, Human
cucugcacaggcggcccc

SEQ ID NO: 1115298 - RNA, 21 nt, Human
cuggaugaggcugcuccacuu

SEQ ID NO: 1115299 - RNA, 22 nt, Human
cuggggagguguagcucucucc

SEQ ID NO: 1115300 - RNA, 18 nt, Human
cuggggcugccuguugag

SEQ ID NO: 1115301 - RNA, 20 nt, Human
cuucaaccaggcugcucccc

SEQ ID NO: 1115302 - RNA, 18 nt, Human
cuugcuuugcugucugga

SEQ ID NO: 1115303 - RNA, 23 nt, Human
cuuucgugagaccugggccuggg

SEQ ID NO: 1115304 - RNA, 18 nt, Human
gaacagacuccugaacac

SEQ ID NO: 1115305 - RNA, 22 nt, Human
gacuaaaacaaguucacuaaca

SEQ ID NO: 1115306 - RNA, 18 nt, Human
gacuguggacacagcagg

SEQ ID NO: 1115307 - RNA, 20 nt, Human
gagaaagacagggacccaag

SEQ ID NO: 1115308 - RNA, 18 nt, Human
gcaguggagcugggaucu

SEQ ID NO: 1115309 - RNA, 24 nt, Human
gcccagaccagccuccacuccugc

SEQ ID NO: 1115310 - RNA, 24 nt, Human
gcccagaccagccuccacuccugc

SEQ ID NO: 1115311 - RNA, 24 nt, Human
gcccuucgaugcuccuuucgugag

SEQ ID NO: 1115312 - RNA, 19 nt, Human
gccgcgcuucaaccaggcu

SEQ ID NO: 1115313 - RNA, 24 nt, Human
gcuucaaccaggcugcuccccacc

SEQ ID NO: 1115314 - RNA, 20 nt, Human
ggacaggagagggcuaagug

SEQ ID NO: 1115315 - RNA, 23 nt, Human
ggacccaagaaccaaugggccca

SEQ ID NO: 1115316 - RNA, 20 nt, Human
ggccuggggagguguagcuc

SEQ ID NO: 1115317 - RNA, 20 nt, Human
gguuucaaauugcagcuauc

SEQ ID NO: 1115318 - RNA, 19 nt, Human
uaaggcagaagggugccaa

SEQ ID NO: 1115319 - RNA, 21 nt, Human
uaaggcagaagggugccaaga

SEQ ID NO: 1115320 - RNA, 24 nt, Human
uaaggcagaagggugccaagacca

SEQ ID NO: 1115321 - RNA, 22 nt, Human
uacaggagcccagaggccaccc

SEQ ID NO: 1115322 - RNA, 22 nt, Human
ucaaccaggcugcuccccaccc

SEQ ID NO: 1115323 - RNA, 21 nt, Human
ucaccuggggcaugggugccu

SEQ ID NO: 1115324 - RNA, 22 nt, Human
uccagacaggagaggccgacgu

SEQ ID NO: 1115325 - RNA, 18 nt, Human
ucccagaccucauggcug

SEQ ID NO: 1115326 - RNA, 18 nt, Human
uccccaacuggggcugcc

SEQ ID NO: 1115327 - RNA, 22 nt, Human
ucgaugcuccuuucgugagacc

SEQ ID NO: 1115328 - RNA, 18 nt, Human
ucggugcccuucgaugcu

SEQ ID NO: 1115329 - RNA, 22 nt, Human
ucuggccugccagggcuuccag

SEQ ID NO: 1115330 - RNA, 19 nt, Human
ugaacaccugaaucagucu

SEQ ID NO: 1115331 - RNA, 24 nt, Human
ugagaaagacagggacccaagaac

SEQ ID NO: 1115332 - RNA, 18 nt, Human
ugagaccugggccugggg

SEQ ID NO: 1115333 - RNA, 20 nt, Human
ugaggagacuguggacacag

SEQ ID NO: 1115334 - RNA, 25 nt, Human
ugauguaauagcgaacagacuccug

SEQ ID NO: 1115335 - RNA, 28 nt, Human
ugcacaggcggccccaugcuguaaugac

SEQ ID NO: 1115336 - RNA, 19 nt, Human
ugccaccagcucaccuggc

SEQ ID NO: 1115337 - RNA, 22 nt, Human
ugccaccagcucaccuggcugc

SEQ ID NO: 1115338 - RNA, 19 nt, Human
uggaaaccucagcacccuc

SEQ ID NO: 1115339 - RNA, 25 nt, Human
uggaaaccucagcacccucccgcca

SEQ ID NO: 1115340 - RNA, 20 nt, Human
ugggcccuugccacaaacgc

SEQ ID NO: 1115341 - RNA, 22 nt, Human
uggggagggaugugaaauccug

SEQ ID NO: 1115342 - RNA, 20 nt, Human
ugggugccuuccuucagacu

SEQ ID NO: 1115343 - RNA, 18 nt, Human
uguaauagcgaacagacu

SEQ ID NO: 1115344 - RNA, 27 nt, Human
uguaauagcgaacagacuccugaacac

SEQ ID NO: 1115345 - RNA, 22 nt, Human
uuccccaacuggggcugccugu

SEQ ID NO: 1115346 - RNA, 21 nt, Human
uugacaggugaggagacugug

SEQ ID NO: 1115347 - RNA, 24 nt, Human
ccuuuuuuuuuuuuuuuuuuuuuu

SEQ ID NO: 1115348 - RNA, 18 nt, Human
ucuuuuuuuuuuuuuuuu

SEQ ID NO: 1115349 - RNA, 20 nt, Human
ugcacgucgucuccagacuc

SEQ ID NO: 1115350 - RNA, 30 nt, Human
uuucuuucuucuuuuuuuuuuuuuuuuuuu

SEQ ID NO: 1115351 - RNA, 31 nt, Human
uuuucuuucuucuuuuuuuuuuuuuuuuuuu

SEQ ID NO: 1115352 - RNA, 31 nt, Human
uuuuucuuucuucuuuuuuuuuuuuuuuuuu

SEQ ID NO: 1115353 - RNA, 31 nt, Human
uuuuuucuuucuucuuuuuuuuuuuuuuuuu

SEQ ID NO: 1115354 - RNA, 31 nt, Human
uuuuuuucuuucuucuuuuuuuuuuuuuuuu

SEQ ID NO: 1115355 - RNA, 24 nt, Human
uuuuuuuuuuucuuucuucuuuuu

SEQ ID NO: 1115356 - RNA, 26 nt, Human
uuuuuuuuuuuuuuuucuuucuucuu

SEQ ID NO: 1115357 - RNA, 24 nt, Human
uuuuuuuuuuuuuuuuucuuucuu

SEQ ID NO: 1115358 - RNA, 24 nt, Human
uuuuuuuuuuuuuuuuuuuucuuu

SEQ ID NO: 1115359 - RNA, 26 nt, Human
uuuuuuuuuuuuuuuuuuuuuucuuu

SEQ ID NO: 1115360 - RNA, 20 nt, Human
aaacaacaugcccaaaggcc

SEQ ID NO: 1115361 - RNA, 22 nt, Human
aaacaacaugcccaaaggccaa

SEQ ID NO: 1115362 - RNA, 23 nt, Human
aaacaacaugcccaaaggccaga

SEQ ID NO: 1115363 - RNA, 25 nt, Human
aaacagcccaaauacaaauuggcaa

SEQ ID NO: 1115364 - RNA, 19 nt, Human
aacaugcccaaaggccaga

SEQ ID NO: 1115365 - RNA, 22 nt, Human
aagaaaagcaaguacaggucua

SEQ ID NO: 1115366 - RNA, 21 nt, Human
aagcaaguacaggucuaccac

SEQ ID NO: 1115367 - RNA, 21 nt, Human
acaauaagaacaccccccccc

SEQ ID NO: 1115368 - RNA, 23 nt, Human
acaauaagaacacccccccccgc

SEQ ID NO: 1115369 - RNA, 18 nt, Human
accacagcuaugcauaaa

SEQ ID NO: 1115370 - RNA, 18 nt, Human
accuguuuggugugaaua

SEQ ID NO: 1115371 - RNA, 18 nt, Human
agaacacccccccccgcc

SEQ ID NO: 1115372 - RNA, 23 nt, Human
agaacacccccccccgccccccc

SEQ ID NO: 1115373 - RNA, 19 nt, Human
agaugcaccugcuagaaca

SEQ ID NO: 1115374 - RNA, 22 nt, Human
agaugcaccugcuagaacacag

SEQ ID NO: 1115375 - RNA, 21 nt, Human
aggagucauaaucuauuaaac

SEQ ID NO: 1115376 - RNA, 20 nt, Human
aggcuacaacgaucaacuaa

SEQ ID NO: 1115377 - RNA, 24 nt, Human
aggcuacaacgaucaacuaaacaa

SEQ ID NO: 1115378 - RNA, 23 nt, Human
aggugcugcuccaaacuucacug

SEQ ID NO: 1115379 - RNA, 22 nt, Human
auacaguauuaacugccuaaaa

SEQ ID NO: 1115380 - RNA, 19 nt, Human
augaauggugagggauagc

SEQ ID NO: 1115381 - RNA, 20 nt, Human
augagaagcagugcaccaca

SEQ ID NO: 1115382 - RNA, 23 nt, Human
augcuggaucucguaugccuagc

SEQ ID NO: 1115383 - RNA, 22 nt, Human
auguaauacaauaagaacaccc

SEQ ID NO: 1115384 - RNA, 22 nt, Human
caacccaaagcauuucaaauac

SEQ ID NO: 1115385 - RNA, 18 nt, Human
caauaagaacaccccccc

SEQ ID NO: 1115386 - RNA, 27 nt, Human
caauaagaacacccccccccgcccccc

SEQ ID NO: 1115387 - RNA, 24 nt, Human
caccacagcuaugcauaaacagcu

SEQ ID NO: 1115388 - RNA, 23 nt, Human
cacccccccccgcccccccgacc

SEQ ID NO: 1115389 - RNA, 26 nt, Human
caccugaacuggaccuuuggggaaga

SEQ ID NO: 1115390 - RNA, 21 nt, Human
cacuuuaaacuaacuuaauua

SEQ ID NO: 1115391 - RNA, 22 nt, Human
cagcccaaauacaaauuggcaa

SEQ ID NO: 1115392 - RNA, 19 nt, Human
caggcagagggagaugugg

SEQ ID NO: 1115393 - RNA, 24 nt, Human
cauuccaggcagggaaaacaacau

SEQ ID NO: 1115394 - RNA, 26 nt, Human
ccacacuucuucaacccaaagcauuu

SEQ ID NO: 1115395 - RNA, 19 nt, Human
ccaggcagggaaaacaaca

SEQ ID NO: 1115396 - RNA, 24 nt, Human
ccccccgcccccccgaccauagaa

SEQ ID NO: 1115397 - RNA, 23 nt, Human
cgcccccccgaccauagaauuug

SEQ ID NO: 1115398 - RNA, 19 nt, Human
cucuaugcucaaacaucuc

SEQ ID NO: 1115399 - RNA, 18 nt, Human
cuguuaccguaucacuuu

SEQ ID NO: 1115400 - RNA, 18 nt, Human
cuucaacccaaagcauuu

SEQ ID NO: 1115401 - RNA, 18 nt, Human
cuugaacuugugauuugg

SEQ ID NO: 1115402 - RNA, 20 nt, Human
cuuuucaaucaguuuuacau

SEQ ID NO: 1115403 - RNA, 21 nt, Human
gaaaacaacaugcccaaaggc

SEQ ID NO: 1115404 - RNA, 22 nt, Human
gaacacaggaugaauggugagg

SEQ ID NO: 1115405 - RNA, 22 nt, Human
gagggccuuaggaaggugacac

SEQ ID NO: 1115406 - RNA, 22 nt, Human
ggaaaacaacaugcccaaaggc

SEQ ID NO: 1115407 - RNA, 21 nt, Human
ggaagacgcacacacggacag

SEQ ID NO: 1115408 - RNA, 24 nt, Human
ggggaagacgcacacacggacagu

SEQ ID NO: 1115409 - RNA, 21 nt, Human
uaaacgugguggaggaaggga

SEQ ID NO: 1115410 - RNA, 23 nt, Human
uaaauauuuccucaaccaacaga

SEQ ID NO: 1115411 - RNA, 18 nt, Human
uaacuaagaacccaaggu

SEQ ID NO: 1115412 - RNA, 19 nt, Human
uaagaacacccccccccgc

SEQ ID NO: 1115413 - RNA, 23 nt, Human
uaagaacacccccccccgccccc

SEQ ID NO: 1115414 - RNA, 26 nt, Human
uaagaacacccccccccgcccccccg

SEQ ID NO: 1115415 - RNA, 23 nt, Human
uaccacacuucuucaacccaaag

SEQ ID NO: 1115416 - RNA, 24 nt, Human
uaccacacuucuucaacccaaagc

SEQ ID NO: 1115417 - RNA, 22 nt, Human
uagaauucaaacaagcgugugc

SEQ ID NO: 1115418 - RNA, 20 nt, Human
uaucagagguagacaggggc

SEQ ID NO: 1115419 - RNA, 23 nt, Human
uauuguauauauacaguauuaac

SEQ ID NO: 1115420 - RNA, 21 nt, Human
ucacaauucauuugaugguaa

SEQ ID NO: 1115421 - RNA, 19 nt, Human
ucagagguagacaggggca

SEQ ID NO: 1115422 - RNA, 19 nt, Human
uccaaacuucacuggcagu

SEQ ID NO: 1115423 - RNA, 22 nt, Human
uccaagcuucaguuuccucauc

SEQ ID NO: 1115424 - RNA, 21 nt, Human
uccauagaauucaaacaagcg

SEQ ID NO: 1115425 - RNA, 22 nt, Human
ucugugaccucuccaagcuuca

SEQ ID NO: 1115426 - RNA, 24 nt, Human
ugaauggaucaagccauuuaaagc

SEQ ID NO: 1115427 - RNA, 18 nt, Human
ugggaaagacagagaaug

SEQ ID NO: 1115428 - RNA, 22 nt, Human
ugggaaagacagagaaugagaa

SEQ ID NO: 1115429 - RNA, 19 nt, Human
ugggaguaacaacauagua

SEQ ID NO: 1115430 - RNA, 20 nt, Human
uggggggauguaauacaaua

SEQ ID NO: 1115431 - RNA, 22 nt, Human
uggugugaauauucauauguuu

SEQ ID NO: 1115432 - RNA, 22 nt, Human
ugugaaggcccagaggagucau

SEQ ID NO: 1115433 - RNA, 25 nt, Human
uguuaugcauuauauuguauauaua

SEQ ID NO: 1115434 - RNA, 20 nt, Human
uuaaagcugacuuaaccugu

SEQ ID NO: 1115435 - RNA, 19 nt, Human
uuagucuuugccuggugcc

SEQ ID NO: 1115436 - RNA, 19 nt, Human
uuccucaucuaaacacugg

SEQ ID NO: 1115437 - RNA, 21 nt, Human
aauggauucucgauucaccau

SEQ ID NO: 1115438 - RNA, 18 nt, Human
agacaggacagacaugua

SEQ ID NO: 1115439 - RNA, 22 nt, Human
agacauguacaccuggauccuc

SEQ ID NO: 1115440 - RNA, 21 nt, Human
agacccagccaagggccagga

SEQ ID NO: 1115441 - RNA, 20 nt, Human
agaccugggaccugacccca

SEQ ID NO: 1115442 - RNA, 18 nt, Human
aggacagacauguacacc

SEQ ID NO: 1115443 - RNA, 22 nt, Human
aggggcggcuucccacccagag

SEQ ID NO: 1115444 - RNA, 20 nt, Human
caccauguagccucccaggc

SEQ ID NO: 1115445 - RNA, 22 nt, Human
cagaccuugauuuccucaucug

SEQ ID NO: 1115446 - RNA, 21 nt, Human
caguccucccgugugaccuug

SEQ ID NO: 1115447 - RNA, 22 nt, Human
ccaagggccaggagcagccagg

SEQ ID NO: 1115448 - RNA, 20 nt, Human
cccccgaacagagaaauaag

SEQ ID NO: 1115449 - RNA, 18 nt, Human
cccgaacagagaaauaag

SEQ ID NO: 1115450 - RNA, 25 nt, Human
ccugaccccaguccucccgugugac

SEQ ID NO: 1115451 - RNA, 22 nt, Human
cgaagacccagccaagggccag

SEQ ID NO: 1115452 - RNA, 23 nt, Human
cuggcccccaaaucgcuucuuca

SEQ ID NO: 1115453 - RNA, 27 nt, Human
gagaagaagaagguauccagguccugg

SEQ ID NO: 1115454 - RNA, 23 nt, Human
gagcagccagguugccugggaga

SEQ ID NO: 1115455 - RNA, 19 nt, Human
gauggaucccucugucucc

SEQ ID NO: 1115456 - RNA, 23 nt, Human
ggagaguggggagaagaagaagg

SEQ ID NO: 1115457 - RNA, 19 nt, Human
uccagaccuugauuuccuc

SEQ ID NO: 1115458 - RNA, 21 nt, Human
ucccucugucuccuccagacc

SEQ ID NO: 1115459 - RNA, 20 nt, Human
ugggagaguggggagaagaa

SEQ ID NO: 1115460 - RNA, 24 nt, Human
uucccacccagaggcagugcugug

SEQ ID NO: 1115461 - RNA, 23 nt, Human
aagcgccgcucacgagaaaucuc

SEQ ID NO: 1115462 - RNA, 22 nt, Human
ggcgguugcugggcgaccagac

SEQ ID NO: 1115463 - RNA, 23 nt, Human
uccaagcgccgcucacgagaaau

SEQ ID NO: 1115464 - RNA, 21 nt, Human
uugcugggcgaccagacgcgc

SEQ ID NO: 1115465 - RNA, 22 nt, Human
aacagcuccuggaguacccaaa

SEQ ID NO: 1115466 - RNA, 24 nt, Human
acccaaagaucggaaccugcaacu

SEQ ID NO: 1115467 - RNA, 27 nt, Human
auagaacagcuccuggaguacccaaag

SEQ ID NO: 1115468 - RNA, 23 nt, Human
cagaagcaggggcuauagaacag

SEQ ID NO: 1115469 - RNA, 18 nt, Human
cggaaccugcaacuguug

SEQ ID NO: 1115470 - RNA, 24 nt, Human
cucagcccuggcucgguuuccagc

SEQ ID NO: 1115471 - RNA, 25 nt, Human
cuccuggaguacccaaagaucggaa

SEQ ID NO: 1115472 - RNA, 21 nt, Human
gaacagcuccuggaguaccca

SEQ ID NO: 1115473 - RNA, 21 nt, Human
gaagucacaguggacagcugu

SEQ ID NO: 1115474 - RNA, 21 nt, Human
gcccuggcucgguuuccagcu

SEQ ID NO: 1115475 - RNA, 19 nt, Human
guaaaaauacauauauaca

SEQ ID NO: 1115476 - RNA, 25 nt, Human
guaaaaauacauauauacauaaaua

SEQ ID NO: 1115477 - RNA, 21 nt, Human
gucagccggcucagcccuggc

SEQ ID NO: 1115478 - RNA, 20 nt, Human
uacauauauacauaaauauu

SEQ ID NO: 1115479 - RNA, 19 nt, Human
ucaacacaaaugcacacau

SEQ ID NO: 1115480 - RNA, 18 nt, Human
uggcucgguuuccagcuc

SEQ ID NO: 1115481 - RNA, 24 nt, Human
uuccagcuccuucgccgucucucc

SEQ ID NO: 1115482 - RNA, 19 nt, Human
uuuccagcuccuucgccgu

SEQ ID NO: 1115483 - RNA, 25 nt, Human
uuuuuuuuuuuuuuuuuuuuuuagg

SEQ ID NO: 1115484 - RNA, 21 nt, Human
aagaccgacaccgacccccga

SEQ ID NO: 1115485 - RNA, 19 nt, Human
aagacgaaggccuuuaaaa

SEQ ID NO: 1115486 - RNA, 23 nt, Human
acaguaccugaaaggaauaccaa

SEQ ID NO: 1115487 - RNA, 26 nt, Human
agacaagagagcuauauaaaccaaaa

SEQ ID NO: 1115488 - RNA, 24 nt, Human
agacccaagaccgacaccgacccc

SEQ ID NO: 1115489 - RNA, 20 nt, Human
aggcugugcgcaugacgcug

SEQ ID NO: 1115490 - RNA, 20 nt, Human
cccccgagaacgcaagcaga

SEQ ID NO: 1115491 - RNA, 22 nt, Human
cccccgagaacgcaagcagagc

SEQ ID NO: 1115492 - RNA, 21 nt, Human
ccccgagaacgcaagcagagc

SEQ ID NO: 1115493 - RNA, 22 nt, Human
cugcaggaaaagggauaggugc

SEQ ID NO: 1115494 - RNA, 24 nt, Human
gcuuuaucuuauauuccucuccca

SEQ ID NO: 1115495 - RNA, 18 nt, Human
ggaaaagggauaggugcu

SEQ ID NO: 1115496 - RNA, 21 nt, Human
ggaaggaaaguuuauauggug

SEQ ID NO: 1115497 - RNA, 20 nt, Human
uaaguagaacucacaguaaa

SEQ ID NO: 1115498 - RNA, 23 nt, Human
uauccagucucaaagacgaaggc

SEQ ID NO: 1115499 - RNA, 21 nt, Human
ugaaacccagaaauaaauacc

SEQ ID NO: 1115500 - RNA, 19 nt, Human
ugacuaaaaagcuuuacua

SEQ ID NO: 1115501 - RNA, 20 nt, Human
ugacuaaaaagcuuuacuau

SEQ ID NO: 1115502 - RNA, 24 nt, Human
ugagacaagagagcuauauaaacc

SEQ ID NO: 1115503 - RNA, 21 nt, Human
ugcggaaggaaaguuuauaug

SEQ ID NO: 1115504 - RNA, 19 nt, Human
uggaggucuacaggugcgg

SEQ ID NO: 1115505 - RNA, 20 nt, Human
uguuuaggaaacacuauugu

SEQ ID NO: 1115506 - RNA, 19 nt, Human
aaacgcagugccuaguaca

SEQ ID NO: 1115507 - RNA, 19 nt, Human
aaaggaagggaggaguggc

SEQ ID NO: 1115508 - RNA, 18 nt, Human
aauugcuaguuuuguacc

SEQ ID NO: 1115509 - RNA, 18 nt, Human
acgugugugugugugugu

SEQ ID NO: 1115510 - RNA, 21 nt, Human
agaauuccucacacccggccu

SEQ ID NO: 1115511 - RNA, 24 nt, Human
agacaggggcaccgggacaggaug

SEQ ID NO: 1115512 - RNA, 20 nt, Human
aggaaauuuugaacaucuua

SEQ ID NO: 1115513 - RNA, 19 nt, Human
aggaagggaggaguggccc

SEQ ID NO: 1115514 - RNA, 20 nt, Human
aggaagggaggaguggcccg

SEQ ID NO: 1115515 - RNA, 21 nt, Human
aggacaaagggaguggccucg

SEQ ID NO: 1115516 - RNA, 19 nt, Human
auccuggucuugaucaccu

SEQ ID NO: 1115517 - RNA, 18 nt, Human
auuugcugugucuucccu

SEQ ID NO: 1115518 - RNA, 19 nt, Human
cacaguguuuuuauacuug

SEQ ID NO: 1115519 - RNA, 21 nt, Human
cacccccauucuccuguggcu

SEQ ID NO: 1115520 - RNA, 18 nt, Human
cacggcucagggucuugg

SEQ ID NO: 1115521 - RNA, 18 nt, Human
cacgugcgcacgugugug

SEQ ID NO: 1115522 - RNA, 23 nt, Human
cacugcacgugcgcacgugugug

SEQ ID NO: 1115523 - RNA, 25 nt, Human
cagaauuccugggcaauuucaacau

SEQ ID NO: 1115524 - RNA, 18 nt, Human
caggacaaagcccuggcc

SEQ ID NO: 1115525 - RNA, 21 nt, Human
caguccccaggcuucccuccu

SEQ ID NO: 1115526 - RNA, 19 nt, Human
ccauggucacucauauuug

SEQ ID NO: 1115527 - RNA, 18 nt, Human
cccagccugggucaggug

SEQ ID NO: 1115528 - RNA, 21 nt, Human
cccaggacaaagcccuggccu

SEQ ID NO: 1115529 - RNA, 18 nt, Human
cccaggcuucccuccucc

SEQ ID NO: 1115530 - RNA, 18 nt, Human
ccccaggcuucccuccuc

SEQ ID NO: 1115531 - RNA, 21 nt, Human
ccccccaucccucuccccacc

SEQ ID NO: 1115532 - RNA, 24 nt, Human
ccccccaucccucuccccaccuuu

SEQ ID NO: 1115533 - RNA, 18 nt, Human
cccccccaucccucuccc

SEQ ID NO: 1115534 - RNA, 21 nt, Human
cccccccaucccucuccccac

SEQ ID NO: 1115535 - RNA, 19 nt, Human
ccgaaaggacaaagggagu

SEQ ID NO: 1115536 - RNA, 23 nt, Human
ccgggacaggaugggaauaagca

SEQ ID NO: 1115537 - RNA, 20 nt, Human
ccucacacccggccucaacc

SEQ ID NO: 1115538 - RNA, 26 nt, Human
ccuccaacucaaagucagauugcuau

SEQ ID NO: 1115539 - RNA, 21 nt, Human
ccucccacucgccuaagaccc

SEQ ID NO: 1115540 - RNA, 22 nt, Human
ccucuugcuccuucuucccagg

SEQ ID NO: 1115541 - RNA, 21 nt, Human
ccuggaagcccccccuucccc

SEQ ID NO: 1115542 - RNA, 21 nt, Human
ccugugccuccaacucaaagu

SEQ ID NO: 1115543 - RNA, 20 nt, Human
cgugcgcacgugugugugug

SEQ ID NO: 1115544 - RNA, 18 nt, Human
cucaagucccagaucuuc

SEQ ID NO: 1115545 - RNA, 24 nt, Human
cucaggaccuccugagggcugugu

SEQ ID NO: 1115546 - RNA, 23 nt, Human
cuccugagggcugugucacgggc

SEQ ID NO: 1115547 - RNA, 25 nt, Human
cucuagauucagaagacccagaucu

SEQ ID NO: 1115548 - RNA, 18 nt, Human
cuguguuuauacuucucu

SEQ ID NO: 1115549 - RNA, 21 nt, Human
cuuagccuaaccgcaagagau

SEQ ID NO: 1115550 - RNA, 23 nt, Human
cuucccccccaucccucucccca

SEQ ID NO: 1115551 - RNA, 21 nt, Human
cuucucuuuucauauccuggu

SEQ ID NO: 1115552 - RNA, 19 nt, Human
cuuuccaaccugacucugg

SEQ ID NO: 1115553 - RNA, 18 nt, Human
cuuucuggaccgacccaa

SEQ ID NO: 1115554 - RNA, 22 nt, Human
gaagacccagaucucaaguccc

SEQ ID NO: 1115555 - RNA, 19 nt, Human
gaauuccucacacccggcc

SEQ ID NO: 1115556 - RNA, 21 nt, Human
gacuucgguccccccaccccc

SEQ ID NO: 1115557 - RNA, 20 nt, Human
gagaauuccucacacccggc

SEQ ID NO: 1115558 - RNA, 18 nt, Human
gaggaagggaggcaagaa

SEQ ID NO: 1115559 - RNA, 21 nt, Human
gaguugucccgccuuucugga

SEQ ID NO: 1115560 - RNA, 21 nt, Human
gcacgugcgcacgugugugug

SEQ ID NO: 1115561 - RNA, 18 nt, Human
gcccggacaacaucaagg

SEQ ID NO: 1115562 - RNA, 20 nt, Human
ggcccggacaacaucaaggu

SEQ ID NO: 1115563 - RNA, 21 nt, Human
gucccugggcugcagucccca

SEQ ID NO: 1115564 - RNA, 25 nt, Human
gugcgcacgugugugugugugugug

SEQ ID NO: 1115565 - RNA, 21 nt, Human
guguguguguguguguggugu

SEQ ID NO: 1115566 - RNA, 22 nt, Human
guuuuauuuaacccuauauaug

SEQ ID NO: 1115567 - RNA, 18 nt, Human
uaaaaccaagcugugcca

SEQ ID NO: 1115568 - RNA, 19 nt, Human
uaaaaccaagcugugccag

SEQ ID NO: 1115569 - RNA, 23 nt, Human
uaaauucuaauuuuuuuuuuuau

SEQ ID NO: 1115570 - RNA, 19 nt, Human
uacauugccugauacauag

SEQ ID NO: 1115571 - RNA, 18 nt, Human
uaccuuaggcaaaugacu

SEQ ID NO: 1115572 - RNA, 25 nt, Human
uaccuuaggcaaaugacuucggucc

SEQ ID NO: 1115573 - RNA, 22 nt, Human
uacuuuauaucacuggcacggg

SEQ ID NO: 1115574 - RNA, 19 nt, Human
uauuucucuggaaaagcua

SEQ ID NO: 1115575 - RNA, 21 nt, Human
uauuucucuggaaaagcuaag

SEQ ID NO: 1115576 - RNA, 23 nt, Human
uauuucucuggaaaagcuaagag

SEQ ID NO: 1115577 - RNA, 19 nt, Human
ucaccgcuuccacaguguu

SEQ ID NO: 1115578 - RNA, 19 nt, Human
uccccaggcuucccuccuc

SEQ ID NO: 1115579 - RNA, 21 nt, Human
uccuguggcuguguuuauacu

SEQ ID NO: 1115580 - RNA, 23 nt, Human
ucgguccccccacccccauucuc

SEQ ID NO: 1115581 - RNA, 22 nt, Human
ucucaggaccuccugagggcug

SEQ ID NO: 1115582 - RNA, 22 nt, Human
ucuccccaccuuugaguugucc

SEQ ID NO: 1115583 - RNA, 24 nt, Human
ucucuaaaauguauaaaaccaagc

SEQ ID NO: 1115584 - RNA, 18 nt, Human
ucugcugggaaguggaag

SEQ ID NO: 1115585 - RNA, 23 nt, Human
ucuuuucauauccuggucuugau

SEQ ID NO: 1115586 - RNA, 21 nt, Human
ugacuucgguccccccacccc

SEQ ID NO: 1115587 - RNA, 23 nt, Human
ugccuggccacugcacgugcgca

SEQ ID NO: 1115588 - RNA, 19 nt, Human
ugcgcacgugugugugugu

SEQ ID NO: 1115589 - RNA, 21 nt, Human
ugcgcacgugugugugugugu

SEQ ID NO: 1115590 - RNA, 19 nt, Human
uggaaaggaagggaggagu

SEQ ID NO: 1115591 - RNA, 20 nt, Human
uggaaaggaagggaggagug

SEQ ID NO: 1115592 - RNA, 23 nt, Human
uggaagcccccccuuccccccca

SEQ ID NO: 1115593 - RNA, 19 nt, Human
uggcacaggcaaaucaggu

SEQ ID NO: 1115594 - RNA, 22 nt, Human
uggcccagccugggucaggugu

SEQ ID NO: 1115595 - RNA, 21 nt, Human
uggcuguagacaggggcaccg

SEQ ID NO: 1115596 - RNA, 22 nt, Human
uggguuggaagaggccucuuug

SEQ ID NO: 1115597 - RNA, 22 nt, Human
ugugccaggaccaccuugggca

SEQ ID NO: 1115598 - RNA, 19 nt, Human
uguggcuguagacaggggc

SEQ ID NO: 1115599 - RNA, 18 nt, Human
uguguguguguggugugu

SEQ ID NO: 1115600 - RNA, 20 nt, Human
uguguguguguguggugugu

SEQ ID NO: 1115601 - RNA, 22 nt, Human
uguguguguguguguggugugu

SEQ ID NO: 1115602 - RNA, 26 nt, Human
uguuuauacuucucuuaucaccuugg

SEQ ID NO: 1115603 - RNA, 21 nt, Human
uucaccuguagccuggaagcc

SEQ ID NO: 1115604 - RNA, 22 nt, Human
uucccccccaucccucucccca

SEQ ID NO: 1115605 - RNA, 19 nt, Human
uuccugggcaauuucaaca

SEQ ID NO: 1115606 - RNA, 18 nt, Human
uucguguuuaccucuugc

SEQ ID NO: 1115607 - RNA, 19 nt, Human
uucucaucgaugaguuuua

SEQ ID NO: 1115608 - RNA, 20 nt, Human
uugaacaucuuaauauaaau

SEQ ID NO: 1115609 - RNA, 22 nt, Human
uuucuggaccgacccaauguau

SEQ ID NO: 1115610 - RNA, 23 nt, Human
uuucuggaccgacccaauguauu

SEQ ID NO: 1115611 - RNA, 21 nt, Human
uuuugagugaauauuuuucag

SEQ ID NO: 1115612 - RNA, 23 nt, Human
aaaaacacaagcagagcuacacc

SEQ ID NO: 1115613 - RNA, 22 nt, Human
aagugguggcaagagaugaagc

SEQ ID NO: 1115614 - RNA, 21 nt, Human
aaugggacugcgaaaaaaaug

SEQ ID NO: 1115615 - RNA, 18 nt, Human
acaagaaagaauucaggg

SEQ ID NO: 1115616 - RNA, 22 nt, Human
acgugggguuugggacgagcug

SEQ ID NO: 1115617 - RNA, 19 nt, Human
acuccugggcggcagcggg

SEQ ID NO: 1115618 - RNA, 24 nt, Human
agaagcaggugucgguggaggccc

SEQ ID NO: 1115619 - RNA, 20 nt, Human
aggaacagggucccgaucca

SEQ ID NO: 1115620 - RNA, 25 nt, Human
aggaggcagacggaggcggcggguc

SEQ ID NO: 1115621 - RNA, 21 nt, Human
aggaggcagacggaggcggga

SEQ ID NO: 1115622 - RNA, 23 nt, Human
auuccccaggauuuuuucgcacc

SEQ ID NO: 1115623 - RNA, 22 nt, Human
caaaaacacaagcagagcuaca

SEQ ID NO: 1115624 - RNA, 25 nt, Human
caaaaacacaagcagagcuacacca

SEQ ID NO: 1115625 - RNA, 26 nt, Human
caaaaacacaagcagagcuggagacc

SEQ ID NO: 1115626 - RNA, 27 nt, Human
cacaagaaagaauucagggcgaguuuc

SEQ ID NO: 1115627 - RNA, 18 nt, Human
cagcagcgggcggagggg

SEQ ID NO: 1115628 - RNA, 23 nt, Human
caggcggggggcgaagguucugu

SEQ ID NO: 1115629 - RNA, 25 nt, Human
ccagaaaagcacuugaaaugcccag

SEQ ID NO: 1115630 - RNA, 27 nt, Human
ccagaaagugguggcaagagaugaagc

SEQ ID NO: 1115631 - RNA, 20 nt, Human
ccagcugcucaggcgggggg

SEQ ID NO: 1115632 - RNA, 22 nt, Human
ccccggugggcuuccgcucccc

SEQ ID NO: 1115633 - RNA, 23 nt, Human
ccggcccagaggcuccaacgcug

SEQ ID NO: 1115634 - RNA, 19 nt, Human
ccuccggcccagaggcucc

SEQ ID NO: 1115635 - RNA, 23 nt, Human
ccugguuccaugaucucuucugg

SEQ ID NO: 1115636 - RNA, 21 nt, Human
cggacaugaaaucuaccuauu

SEQ ID NO: 1115637 - RNA, 20 nt, Human
cgugggguuugggacgagcu

SEQ ID NO: 1115638 - RNA, 18 nt, Human
gagcccgggaggaggcag

SEQ ID NO: 1115639 - RNA, 19 nt, Human
gaggaggcugaccucggcc

SEQ ID NO: 1115640 - RNA, 24 nt, Human
gaggcggcgggucagcggcgggcc

SEQ ID NO: 1115641 - RNA, 23 nt, Human
gccaaaagccuuagguuacuccu

SEQ ID NO: 1115642 - RNA, 20 nt, Human
gccccgggauucaaaaacac

SEQ ID NO: 1115643 - RNA, 23 nt, Human
gccuuagguuacuccugggcggc

SEQ ID NO: 1115644 - RNA, 18 nt, Human
gcggcagcggggcagagg

SEQ ID NO: 1115645 - RNA, 23 nt, Human
gcggcagcggggcagaggucaga

SEQ ID NO: 1115646 - RNA, 22 nt, Human
ggaaaugggacugcgaaaaaaa

SEQ ID NO: 1115647 - RNA, 19 nt, Human
ggaaguaaaugagauaaug

SEQ ID NO: 1115648 - RNA, 21 nt, Human
ggagggguccugcccggcauc

SEQ ID NO: 1115649 - RNA, 18 nt, Human
ggauuuuuucgcaccgca

SEQ ID NO: 1115650 - RNA, 19 nt, Human
ggcagacggaggcggcggg

SEQ ID NO: 1115651 - RNA, 21 nt, Human
ggcccagaggcuccaacgcug

SEQ ID NO: 1115652 - RNA, 18 nt, Human
ggccccaguuccuccggc

SEQ ID NO: 1115653 - RNA, 24 nt, Human
ggcgcgcugggcccagagcccggg

SEQ ID NO: 1115654 - RNA, 22 nt, Human
ggcggcgggucagcggcgggcc

SEQ ID NO: 1115655 - RNA, 26 nt, Human
ucaaaaacacaagcagagcuacacca

SEQ ID NO: 1115656 - RNA, 20 nt, Human
ucaaaguuucagcuuucuca

SEQ ID NO: 1115657 - RNA, 22 nt, Human
ucaaauggcuuuaaaaucagaa

SEQ ID NO: 1115658 - RNA, 25 nt, Human
uccccaggauuuuuucgcaccgcau

SEQ ID NO: 1115659 - RNA, 27 nt, Human
ucucaagcagcuuuccacaccugguuc

SEQ ID NO: 1115660 - RNA, 20 nt, Human
ugcgaaaaaaauggaggcug

SEQ ID NO: 1115661 - RNA, 20 nt, Human
uggaggccccaguuccuccg

SEQ ID NO: 1115662 - RNA, 21 nt, Human
uggcaagagaugaagcuucgg

SEQ ID NO: 1115663 - RNA, 22 nt, Human
ugggacgagcugaauuccggau

SEQ ID NO: 1115664 - RNA, 18 nt, Human
ugugguucucuuuaauuc

SEQ ID NO: 1115665 - RNA, 21 nt, Human
ugugguucucuuuaauucucu

SEQ ID NO: 1115666 - RNA, 25 nt, Human
uuccggauaaagaugccuguaaaga

SEQ ID NO: 1115667 - RNA, 21 nt, Human
uuucgcaccgcauuuagaggu

SEQ ID NO: 1115668 - RNA, 22 nt, Human
uuugugguucucuuuaauucuc

SEQ ID NO: 1115669 - RNA, 18 nt, Human
aaagaaaggcagaaaaga

SEQ ID NO: 1115670 - RNA, 24 nt, Human
aaagugcugggauuacaggcauga

SEQ ID NO: 1115671 - RNA, 21 nt, Human
aacaauuuagaaauuaaaccc

SEQ ID NO: 1115672 - RNA, 20 nt, Human
aacaugccaacaauuuagaa

SEQ ID NO: 1115673 - RNA, 23 nt, Human
aacucaucucuuaaggaggucua

SEQ ID NO: 1115674 - RNA, 24 nt, Human
aagaagaggccuauuucaggagca

SEQ ID NO: 1115675 - RNA, 20 nt, Human
aagacuuugguacugauggu

SEQ ID NO: 1115676 - RNA, 20 nt, Human
aagauagaaauucaaagcac

SEQ ID NO: 1115677 - RNA, 20 nt, Human
aagguuuaaaaaaaaugaca

SEQ ID NO: 1115678 - RNA, 19 nt, Human
aagugcugggauuacaggc

SEQ ID NO: 1115679 - RNA, 21 nt, Human
aagugcugggauuacaggcau

SEQ ID NO: 1115680 - RNA, 26 nt, Human
aagugcugggauuacaggcaugagcc

SEQ ID NO: 1115681 - RNA, 20 nt, Human
aaugcuaaaauagaaaugaa

SEQ ID NO: 1115682 - RNA, 24 nt, Human
accauguuggccaagcuagucucg

SEQ ID NO: 1115683 - RNA, 22 nt, Human
accuccgucucucggguucaag

SEQ ID NO: 1115684 - RNA, 18 nt, Human
agaaaaagugcaaggaaa

SEQ ID NO: 1115685 - RNA, 19 nt, Human
agaaagguacacaagaaca

SEQ ID NO: 1115686 - RNA, 22 nt, Human
agaaagguacacaagaacauga

SEQ ID NO: 1115687 - RNA, 21 nt, Human
agagggcggcgggugucuaca

SEQ ID NO: 1115688 - RNA, 27 nt, Human
agccuuauuauaaaauaaaaaagcaau

SEQ ID NO: 1115689 - RNA, 24 nt, Human
agcgauucuccugccucagccucc

SEQ ID NO: 1115690 - RNA, 24 nt, Human
agcuagucucgaacuccugaccuc

SEQ ID NO: 1115691 - RNA, 26 nt, Human
aggcaaaagaaaggcagaagggaccc

SEQ ID NO: 1115692 - RNA, 21 nt, Human
aggcaugagccaccgugcccg

SEQ ID NO: 1115693 - RNA, 23 nt, Human
aggcaugagccaccgugcccggc

SEQ ID NO: 1115694 - RNA, 19 nt, Human
aggcuggagugcaguggca

SEQ ID NO: 1115695 - RNA, 22 nt, Human
agggaagauuuugcaaacagaa

SEQ ID NO: 1115696 - RNA, 21 nt, Human
agggauaaacaguguuaaaac

SEQ ID NO: 1115697 - RNA, 22 nt, Human
aguagagaugagguuucaccau

SEQ ID NO: 1115698 - RNA, 18 nt, Human
aguagcugggauuacagg

SEQ ID NO: 1115699 - RNA, 19 nt, Human
agucucgaacuccugaccu

SEQ ID NO: 1115700 - RNA, 22 nt, Human
agugaucgacccaccuuggccu

SEQ ID NO: 1115701 - RNA, 18 nt, Human
agugcugggauuacaggc

SEQ ID NO: 1115702 - RNA, 22 nt, Human
auaaggcaaaagaaaggcagaa

SEQ ID NO: 1115703 - RNA, 22 nt, Human
auagggauaaacaguguuaaaa

SEQ ID NO: 1115704 - RNA, 20 nt, Human
aucaagaagaggccuauuuc

SEQ ID NO: 1115705 - RNA, 20 nt, Human
augagguuucaccauguugg

SEQ ID NO: 1115706 - RNA, 22 nt, Human
augcauuuuuagaagaagaaac

SEQ ID NO: 1115707 - RNA, 18 nt, Human
caaagcacuaaaaugcca

SEQ ID NO: 1115708 - RNA, 24 nt, Human
caaagcacuaaaaugccaacuaag

SEQ ID NO: 1115709 - RNA, 24 nt, Human
caaagugcugggauuacaggcaug

SEQ ID NO: 1115710 - RNA, 21 nt, Human
caacuaaguaagcacggguau

SEQ ID NO: 1115711 - RNA, 22 nt, Human
caagcgauucuccugccucagc

SEQ ID NO: 1115712 - RNA, 21 nt, Human
caccauguuggccaagcuagu

SEQ ID NO: 1115713 - RNA, 24 nt, Human
caccauguuggccaagcuagucuc

SEQ ID NO: 1115714 - RNA, 27 nt, Human
caccauguuggccaagcuagucucgaa

SEQ ID NO: 1115715 - RNA, 23 nt, Human
cacugcaaccuccgucucucggg

SEQ ID NO: 1115716 - RNA, 24 nt, Human
cagagucuugcucugucgcccagg

SEQ ID NO: 1115717 - RNA, 21 nt, Human
caggcgccaaccaccacgccc

SEQ ID NO: 1115718 - RNA, 24 nt, Human
cauguuggccaagcuagucucgaa

SEQ ID NO: 1115719 - RNA, 23 nt, Human
ccaaagugcugggauuacaggca

SEQ ID NO: 1115720 - RNA, 24 nt, Human
ccaaagugcugggauuacaggcau

SEQ ID NO: 1115721 - RNA, 24 nt, Human
cccaaagugcugggauuacaggca

SEQ ID NO: 1115722 - RNA, 23 nt, Human
cccgaguagcugggauuacaggc

SEQ ID NO: 1115723 - RNA, 24 nt, Human
cccgaguagcugggauuacaggcg

SEQ ID NO: 1115724 - RNA, 18 nt, Human
ccgagccgggagagggcg

SEQ ID NO: 1115725 - RNA, 22 nt, Human
ccgaguagcugggauuacaggc

SEQ ID NO: 1115726 - RNA, 22 nt, Human
ccgggccgcuuggaggugcagu

SEQ ID NO: 1115727 - RNA, 23 nt, Human
ccgggccggcccgagggcuggcg

SEQ ID NO: 1115728 - RNA, 23 nt, Human
ccugagaaaaagaacaugccaac

SEQ ID NO: 1115729 - RNA, 23 nt, Human
ccugccucagccucccgaguagc

SEQ ID NO: 1115730 - RNA, 19 nt, Human
ccugugccgggucccgggg

SEQ ID NO: 1115731 - RNA, 23 nt, Human
cggccuucucuuuucuaagguuu

SEQ ID NO: 1115732 - RNA, 21 nt, Human
cgggccgcuuggaggugcagu

SEQ ID NO: 1115733 - RNA, 21 nt, Human
cggguucaagcgauucuccug

SEQ ID NO: 1115734 - RNA, 24 nt, Human
cucacugcaaccuccgucucucgg

SEQ ID NO: 1115735 - RNA, 23 nt, Human
cucagccucccgaguagcuggga

SEQ ID NO: 1115736 - RNA, 21 nt, Human
cuccugaccucagugaucgac

SEQ ID NO: 1115737 - RNA, 23 nt, Human
cugccucagccucccgaguagcu

SEQ ID NO: 1115738 - RNA, 21 nt, Human
cuugcucugucgcccaggcug

SEQ ID NO: 1115739 - RNA, 23 nt, Human
gaccucagugaucgacccaccuu

SEQ ID NO: 1115740 - RNA, 23 nt, Human
gagaaaaagaacaugccaacaau

SEQ ID NO: 1115741 - RNA, 18 nt, Human
gagguuucaccauguugg

SEQ ID NO: 1115742 - RNA, 27 nt, Human
gaguagcugggauuacaggcgccaacc

SEQ ID NO: 1115743 - RNA, 18 nt, Human
gauuacaggcaugagcca

SEQ ID NO: 1115744 - RNA, 21 nt, Human
gauuacaggcaugagccaccg

SEQ ID NO: 1115745 - RNA, 24 nt, Human
gauuacaggcaugagccaccgugc

SEQ ID NO: 1115746 - RNA, 22 nt, Human
gcaaccuccgucucucggguuc

SEQ ID NO: 1115747 - RNA, 22 nt, Human
gcagcaaaauuggugacauaaa

SEQ ID NO: 1115748 - RNA, 25 nt, Human
gcccagcuacuuuuuuuuguauuuu

SEQ ID NO: 1115749 - RNA, 23 nt, Human
gcccaggcuggagugcaguggca

SEQ ID NO: 1115750 - RNA, 24 nt, Human
gcgauucuccugccucagccuccc

SEQ ID NO: 1115751 - RNA, 25 nt, Human
gcucugucgcccaggcuggagugca

SEQ ID NO: 1115752 - RNA, 19 nt, Human
gcuggagugcaguggcaca

SEQ ID NO: 1115753 - RNA, 24 nt, Human
ggauuacaggcaugagccaccgug

SEQ ID NO: 1115754 - RNA, 22 nt, Human
ggcaaaagaaaggcagaaaaga

SEQ ID NO: 1115755 - RNA, 23 nt, Human
ggggcgagucgcgcgcgggcggc

SEQ ID NO: 1115756 - RNA, 22 nt, Human
ggguucaagcgauucuccugcc

SEQ ID NO: 1115757 - RNA, 24 nt, Human
gugaucgacccaccuuggccuccc

SEQ ID NO: 1115758 - RNA, 20 nt, Human
gugcaaggaaagcagauagg

SEQ ID NO: 1115759 - RNA, 19 nt, Human
uaagaaaagagugcauaca

SEQ ID NO: 1115760 - RNA, 27 nt, Human
uaagaaagguacacaagaacaugccaa

SEQ ID NO: 1115761 - RNA, 23 nt, Human
uacaggcaugagccaccgugccc

SEQ ID NO: 1115762 - RNA, 20 nt, Human
uaccagauuaucauagucau

SEQ ID NO: 1115763 - RNA, 22 nt, Human
uagagaugagguuucaccaugu

SEQ ID NO: 1115764 - RNA, 24 nt, Human
uaguagagaugagguuucaccaug

SEQ ID NO: 1115765 - RNA, 26 nt, Human
uaguagagaugagguuucaccauguu

SEQ ID NO: 1115766 - RNA, 25 nt, Human
uaguuucucucuuuuuuuuuuuuuu

SEQ ID NO: 1115767 - RNA, 18 nt, Human
uaucagcagauaugcugg

SEQ ID NO: 1115768 - RNA, 19 nt, Human
uaucagcagauaugcuggg

SEQ ID NO: 1115769 - RNA, 23 nt, Human
ucaaagcacuaaaaugccaacua

SEQ ID NO: 1115770 - RNA, 23 nt, Human
ucacugcaaccuccgucucucgg

SEQ ID NO: 1115771 - RNA, 24 nt, Human
ucacugcaaccuccgucucucggg

SEQ ID NO: 1115772 - RNA, 25 nt, Human
ucacugcaaccuccgucucucgggu

SEQ ID NO: 1115773 - RNA, 20 nt, Human
ucagccucccgaguagcugg

SEQ ID NO: 1115774 - RNA, 21 nt, Human
ucauuuaucuucauauaauca

SEQ ID NO: 1115775 - RNA, 24 nt, Human
ucccaaagugcugggauuacaggc

SEQ ID NO: 1115776 - RNA, 24 nt, Human
ucccgaguagcugggauuacaggc

SEQ ID NO: 1115777 - RNA, 24 nt, Human
ucgcccaggcuggagugcaguggc

SEQ ID NO: 1115778 - RNA, 24 nt, Human
ucuccugccucagccucccgagua

SEQ ID NO: 1115779 - RNA, 21 nt, Human
ucucggguucaagcgauucuc

SEQ ID NO: 1115780 - RNA, 24 nt, Human
ucucggguucaagcgauucuccug

SEQ ID NO: 1115781 - RNA, 24 nt, Human
ucucucggguucaagcgauucucc

SEQ ID NO: 1115782 - RNA, 24 nt, Human
ucugucgcccaggcuggagugcag

SEQ ID NO: 1115783 - RNA, 23 nt, Human
ucuugcucugucgcccaggcugg

SEQ ID NO: 1115784 - RNA, 24 nt, Human
ucuugcucugucgcccaggcugga

SEQ ID NO: 1115785 - RNA, 19 nt, Human
ugaaaaauguuguuacuuc

SEQ ID NO: 1115786 - RNA, 22 nt, Human
ugaaaaauguuguuacuucuga

SEQ ID NO: 1115787 - RNA, 18 nt, Human
ugagacagagucuugcuc

SEQ ID NO: 1115788 - RNA, 22 nt, Human
ugagacagagucuugcucuguc

SEQ ID NO: 1115789 - RNA, 24 nt, Human
ugagguuucaccauguuggccaag

SEQ ID NO: 1115790 - RNA, 21 nt, Human
ugcaaggaaagcagauaggga

SEQ ID NO: 1115791 - RNA, 24 nt, Human
ugccucagccucccgaguagcugg

SEQ ID NO: 1115792 - RNA, 24 nt, Human
ugcucugucgcccaggcuggagug

SEQ ID NO: 1115793 - RNA, 18 nt, Human
uggagugcaguggcacaa

SEQ ID NO: 1115794 - RNA, 19 nt, Human
uggagugcaguggcacaau

SEQ ID NO: 1115795 - RNA, 24 nt, Human
uggcacaauaucagcucacugcaa

SEQ ID NO: 1115796 - RNA, 28 nt, Human
uggcacaauaucagcucacugcaaccuc

SEQ ID NO: 1115797 - RNA, 24 nt, Human
uggccaagcuagucucgaacuccu

SEQ ID NO: 1115798 - RNA, 18 nt, Human
ugggauuacaggcaugag

SEQ ID NO: 1115799 - RNA, 21 nt, Human
ugggauuacaggcaugagcca

SEQ ID NO: 1115800 - RNA, 22 nt, Human
ugggauuacaggcaugagccac

SEQ ID NO: 1115801 - RNA, 23 nt, Human
ugggauuacaggcaugagccacc

SEQ ID NO: 1115802 - RNA, 23 nt, Human
ugggauuacaggcaugagccacc

SEQ ID NO: 1115803 - RNA, 24 nt, Human
ugggauuacaggcaugagccaccg

SEQ ID NO: 1115804 - RNA, 22 nt, Human
ugggauuacaggcgccaaccac

SEQ ID NO: 1115805 - RNA, 24 nt, Human
ugggauuacaggcgccaaccacca

SEQ ID NO: 1115806 - RNA, 24 nt, Human
uguaccagauuaucauagucaucu

SEQ ID NO: 1115807 - RNA, 18 nt, Human
uguuaagagcuauuuaca

SEQ ID NO: 1115808 - RNA, 24 nt, Human
uuaaaagcaguucccauucuugca

SEQ ID NO: 1115809 - RNA, 18 nt, Human
uuaguagagaugagguuu

SEQ ID NO: 1115810 - RNA, 22 nt, Human
uuaguagagaugagguuucacc

SEQ ID NO: 1115811 - RNA, 24 nt, Human
uuaguagagaugagguuucaccau

SEQ ID NO: 1115812 - RNA, 21 nt, Human
uucaagcgauucuccugccuc

SEQ ID NO: 1115813 - RNA, 23 nt, Human
uucaagcgauucuccugccucag

SEQ ID NO: 1115814 - RNA, 24 nt, Human
uucaagcgauucuccugccucagc

SEQ ID NO: 1115815 - RNA, 18 nt, Human
uucacagaaaaagugcaa

SEQ ID NO: 1115816 - RNA, 23 nt, Human
uucacagaaaaagugcaaggaaa

SEQ ID NO: 1115817 - RNA, 20 nt, Human
uucacagagaaaaaauacca

SEQ ID NO: 1115818 - RNA, 20 nt, Human
uuccuccgauuagccuaaau

SEQ ID NO: 1115819 - RNA, 22 nt, Human
uucugugcuuuaagauagaaau

SEQ ID NO: 1115820 - RNA, 20 nt, Human
uucuugcagcaaaauuggug

SEQ ID NO: 1115821 - RNA, 22 nt, Human
uugaugauagaauacuuggauu

SEQ ID NO: 1115822 - RNA, 24 nt, Human
uugcucugucgcccaggcuggagu

SEQ ID NO: 1115823 - RNA, 18 nt, Human
uuggccucccaaagugcu

SEQ ID NO: 1115824 - RNA, 21 nt, Human
uuuaagauagaaauucaaagc

SEQ ID NO: 1115825 - RNA, 21 nt, Human
uuucaccauguuggccaagcu

SEQ ID NO: 1115826 - RNA, 24 nt, Human
uuuuuaguagagaugagguuucac

SEQ ID NO: 1115827 - RNA, 21 nt, Human
uuuuuguauuuuuaguagaga

SEQ ID NO: 1115828 - RNA, 21 nt, Human
uuuuuuguauuuuuaguagag

SEQ ID NO: 1115829 - RNA, 24 nt, Human
uuuuuuguauuuuuaguagagaug

SEQ ID NO: 1115830 - RNA, 24 nt, Human
uuuuuuuuguauuuuuaguagaga

SEQ ID NO: 1115831 - RNA, 20 nt, Human
uuuuuuuuuuugagacagag

SEQ ID NO: 1115832 - RNA, 24 nt, Human
uuuuuuuuuuuugagacagagucu

SEQ ID NO: 1115833 - RNA, 25 nt, Human
aaacagggaccgggaugccugagcu

SEQ ID NO: 1115834 - RNA, 22 nt, Human
aaauucaauccucagugaagga

SEQ ID NO: 1115835 - RNA, 20 nt, Human
aauccucagugaaggacccc

SEQ ID NO: 1115836 - RNA, 21 nt, Human
acaacacuuuagaguccuuaa

SEQ ID NO: 1115837 - RNA, 21 nt, Human
acagaaugccagcaaaaagaa

SEQ ID NO: 1115838 - RNA, 18 nt, Human
acagcugaccuguccucc

SEQ ID NO: 1115839 - RNA, 19 nt, Human
accgcacuggggauggaca

SEQ ID NO: 1115840 - RNA, 18 nt, Human
agaagagguagagccagg

SEQ ID NO: 1115841 - RNA, 23 nt, Human
agacagcugaccuguccuccaca

SEQ ID NO: 1115842 - RNA, 18 nt, Human
caaaaacagggaccggga

SEQ ID NO: 1115843 - RNA, 24 nt, Human
caacagaaugccagcaaaaagaaa

SEQ ID NO: 1115844 - RNA, 25 nt, Human
cacaacagaaugccagcaaaaagaa

SEQ ID NO: 1115845 - RNA, 23 nt, Human
cacgacacaacacuuuagagucc

SEQ ID NO: 1115846 - RNA, 19 nt, Human
cacugggccuucucugccu

SEQ ID NO: 1115847 - RNA, 22 nt, Human
cacugggccuucucugccugca

SEQ ID NO: 1115848 - RNA, 19 nt, Human
cagagcuccuagaccccuc

SEQ ID NO: 1115849 - RNA, 21 nt, Human
cagagucccggcugacaugcu

SEQ ID NO: 1115850 - RNA, 19 nt, Human
cagauaacuucagaaugua

SEQ ID NO: 1115851 - RNA, 18 nt, Human
ccagcagcugcggacucc

SEQ ID NO: 1115852 - RNA, 26 nt, Human
ccgggaugccugagcucagagcugaa

SEQ ID NO: 1115853 - RNA, 23 nt, Human
ccuggcaaaauguuuaggcugaa

SEQ ID NO: 1115854 - RNA, 21 nt, Human
cugaaauucaauccucaguga

SEQ ID NO: 1115855 - RNA, 19 nt, Human
gaacauggcauugcucaua

SEQ ID NO: 1115856 - RNA, 18 nt, Human
gaccgggaugccugagcc

SEQ ID NO: 1115857 - RNA, 20 nt, Human
gagcucagagcugaaggcac

SEQ ID NO: 1115858 - RNA, 19 nt, Human
gagcuccuagaccccuccu

SEQ ID NO: 1115859 - RNA, 19 nt, Human
gcaaaaacagggaccggga

SEQ ID NO: 1115860 - RNA, 22 nt, Human
gcucacagcauggacucugcag

SEQ ID NO: 1115861 - RNA, 25 nt, Human
ggaugaaaguuauaauuggggcaga

SEQ ID NO: 1115862 - RNA, 29 nt, Human
gggauggacacacugggccuucucugccc

SEQ ID NO: 1115863 - RNA, 21 nt, Human
uaaauauaauaacugacacag

SEQ ID NO: 1115864 - RNA, 23 nt, Human
uaaccgcaaaaacagggaccggg

SEQ ID NO: 1115865 - RNA, 22 nt, Human
uaacugauggacuaaaauuaau

SEQ ID NO: 1115866 - RNA, 23 nt, Human
uacaagggacagagcuccuagac

SEQ ID NO: 1115867 - RNA, 22 nt, Human
uauuucaaaccacuuuccaaau

SEQ ID NO: 1115868 - RNA, 23 nt, Human
uccuuaaccgcaaaaacagggac

SEQ ID NO: 1115869 - RNA, 22 nt, Human
ucuccugccagcagcugcggac

SEQ ID NO: 1115870 - RNA, 18 nt, Human
ugacaugcugucuccugc

SEQ ID NO: 1115871 - RNA, 24 nt, Human
ugacaugcugucuccugccagcag

SEQ ID NO: 1115872 - RNA, 23 nt, Human
ugaccauccuaguaucaccgcac

SEQ ID NO: 1115873 - RNA, 22 nt, Human
ugaccuguccuccacaaacaag

SEQ ID NO: 1115874 - RNA, 22 nt, Human
ugagauagacaauuuucaaugu

SEQ ID NO: 1115875 - RNA, 18 nt, Human
ugagccagacagcugacc

SEQ ID NO: 1115876 - RNA, 18 nt, Human
ugagcucagagcugaagg

SEQ ID NO: 1115877 - RNA, 20 nt, Human
ugagggagguagcagccagc

SEQ ID NO: 1115878 - RNA, 19 nt, Human
ugcccuggcagagucccgg

SEQ ID NO: 1115879 - RNA, 23 nt, Human
ugccugagcucagagcugaaggc

SEQ ID NO: 1115880 - RNA, 24 nt, Human
ugccugcagaugggcugagguagg

SEQ ID NO: 1115881 - RNA, 25 nt, Human
ugcuuugcuguuuuaguuguuuuua

SEQ ID NO: 1115882 - RNA, 23 nt, Human
uggaaaagcugcuuuuugugaca

SEQ ID NO: 1115883 - RNA, 24 nt, Human
uggcagaagagguagagccaggga

SEQ ID NO: 1115884 - RNA, 23 nt, Human
uggucucccuagguauugaucac

SEQ ID NO: 1115885 - RNA, 23 nt, Human
uuaaccgcaaaaacagggaccgg

SEQ ID NO: 1115886 - RNA, 20 nt, Human
uuaccgccuaugaaacucag

SEQ ID NO: 1115887 - RNA, 23 nt, Human
uuagaguccuuaaccgcaaaaac

SEQ ID NO: 1115888 - RNA, 20 nt, Human
uugagaaaaaguugaugaac

SEQ ID NO: 1115889 - RNA, 22 nt, Human
uuuaaaauuuuaacugauggac

SEQ ID NO: 1115890 - RNA, 28 nt, Human
aagucauuuauuuguucagcaaacauuu

SEQ ID NO: 1115891 - RNA, 18 nt, Human
cagaaucagaacagaagc

SEQ ID NO: 1115892 - RNA, 21 nt, Human
ugccagaaucagaacagaagc

SEQ ID NO: 1115893 - RNA, 24 nt, Human
uggccugagcaguuucacgagugu

SEQ ID NO: 1115894 - RNA, 19 nt, Human
aaagcaccgaaaucuuuuc

SEQ ID NO: 1115895 - RNA, 20 nt, Human
acacaagaucuaauauaaau

SEQ ID NO: 1115896 - RNA, 22 nt, Human
accaagugaagcccuguuccug

SEQ ID NO: 1115897 - RNA, 22 nt, Human
acuuuuuccagcuuuuccuuuu

SEQ ID NO: 1115898 - RNA, 19 nt, Human
agcauuuacuucagaaaua

SEQ ID NO: 1115899 - RNA, 19 nt, Human
agcuuucucucucuccuuc

SEQ ID NO: 1115900 - RNA, 18 nt, Human
auaucuuuguugaucuug

SEQ ID NO: 1115901 - RNA, 19 nt, Human
caagugaagcccuguuccu

SEQ ID NO: 1115902 - RNA, 21 nt, Human
caaucuuuguuuugcuagaaa

SEQ ID NO: 1115903 - RNA, 21 nt, Human
cagcauuuacuucagaaauau

SEQ ID NO: 1115904 - RNA, 20 nt, Human
cagcuuucucucucuccuuc

SEQ ID NO: 1115905 - RNA, 22 nt, Human
cauucuuauccuagauugcagg

SEQ ID NO: 1115906 - RNA, 23 nt, Human
ccaagugaagcccuguuccugcu

SEQ ID NO: 1115907 - RNA, 25 nt, Human
cugaaugauaacaacacaagaucua

SEQ ID NO: 1115908 - RNA, 22 nt, Human
uaaauaagcacgccaaugcugu

SEQ ID NO: 1115909 - RNA, 24 nt, Human
uaaaugccauucucuaaaagcucu

SEQ ID NO: 1115910 - RNA, 21 nt, Human
uaaccaccaagugaagcccug

SEQ ID NO: 1115911 - RNA, 19 nt, Human
uaacucuuuuucucaaucu

SEQ ID NO: 1115912 - RNA, 24 nt, Human
uagcagaauuuucuucuuuagcuu

SEQ ID NO: 1115913 - RNA, 24 nt, Human
uauguugauucucuauucccaaaa

SEQ ID NO: 1115914 - RNA, 21 nt, Human
ucagaaaucuuugucuagugg

SEQ ID NO: 1115915 - RNA, 21 nt, Human
ucuaguggaauaucuucucca

SEQ ID NO: 1115916 - RNA, 29 nt, Human
ucuauaccaugauuguaugauaauagcaa

SEQ ID NO: 1115917 - RNA, 22 nt, Human
ucuccaauaucccugaauaagu

SEQ ID NO: 1115918 - RNA, 18 nt, Human
ugaagucaucagggguua

SEQ ID NO: 1115919 - RNA, 20 nt, Human
ugaauaauucuugcagcuua

SEQ ID NO: 1115920 - RNA, 22 nt, Human
ugcuagaaaauugauuacagcc

SEQ ID NO: 1115921 - RNA, 21 nt, Human
ugcuuuuccuuccagcguuca

SEQ ID NO: 1115922 - RNA, 18 nt, Human
aaacugauauaaguuacu

SEQ ID NO: 1115923 - RNA, 26 nt, Human
auaaaaaaacaaguucagagugguua

SEQ ID NO: 1115924 - RNA, 18 nt, Human
augcaaaacaacuuugca

SEQ ID NO: 1115925 - RNA, 18 nt, Human
caaaacaacuuugcaaga

SEQ ID NO: 1115926 - RNA, 19 nt, Human
caaugacuuuuucuccuga

SEQ ID NO: 1115927 - RNA, 18 nt, Human
cagcggagggucugacac

SEQ ID NO: 1115928 - RNA, 22 nt, Human
ccaaaugccucagguuuacucu

SEQ ID NO: 1115929 - RNA, 19 nt, Human
cccuaugcugcuuccaaag

SEQ ID NO: 1115930 - RNA, 22 nt, Human
cucuaaacgagaacuucccgaa

SEQ ID NO: 1115931 - RNA, 26 nt, Human
cugaagcucaugcucuuccccuaugc

SEQ ID NO: 1115932 - RNA, 19 nt, Human
cuugcuuucuagaaccuca

SEQ ID NO: 1115933 - RNA, 20 nt, Human
ggcagauguuugaaguuaug

SEQ ID NO: 1115934 - RNA, 23 nt, Human
uaaaaaaacaaguucagaguggu

SEQ ID NO: 1115935 - RNA, 23 nt, Human
uaauaagcgucaaaugcaaaaca

SEQ ID NO: 1115936 - RNA, 19 nt, Human
uaccaagauaagcggcuuc

SEQ ID NO: 1115937 - RNA, 21 nt, Human
uagaaccucagaacgguacca

SEQ ID NO: 1115938 - RNA, 18 nt, Human
ucagaacgguaccaagau

SEQ ID NO: 1115939 - RNA, 21 nt, Human
uccauuuaacagauaaaaaaa

SEQ ID NO: 1115940 - RNA, 19 nt, Human
ucccgaaggaagacuuggg

SEQ ID NO: 1115941 - RNA, 18 nt, Human
uuccccuaugcugcuucc

SEQ ID NO: 1115942 - RNA, 19 nt, Human
uuccccuaugcugcuucca

SEQ ID NO: 1115943 - RNA, 25 nt, Human
uucuccaacaucuguuugacucuga

SEQ ID NO: 1115944 - RNA, 25 nt, Human
uugggauauaacaaugacuuuuucu

SEQ ID NO: 1115945 - RNA, 24 nt, Human
uuuauuuauaucucgaaugaaauc

SEQ ID NO: 1115946 - RNA, 18 nt, Human
aaccaagccaaucacagc

SEQ ID NO: 1115947 - RNA, 22 nt, Human
acugaaccaagccaaucacagc

SEQ ID NO: 1115948 - RNA, 19 nt, Human
agagaggaacuauguugug

SEQ ID NO: 1115949 - RNA, 20 nt, Human
augugugugugugugugugu

SEQ ID NO: 1115950 - RNA, 21 nt, Human
auuguguguguguaugugugu

SEQ ID NO: 1115951 - RNA, 19 nt, Human
cauucgugguuggcagggu

SEQ ID NO: 1115952 - RNA, 19 nt, Human
ccaagggacugaaccaagc

SEQ ID NO: 1115953 - RNA, 24 nt, Human
ccauuaguggggggaagaugccuu

SEQ ID NO: 1115954 - RNA, 22 nt, Human
cugaaccaagccaaucacagcc

SEQ ID NO: 1115955 - RNA, 18 nt, Human
cuucaggaaaggagagag

SEQ ID NO: 1115956 - RNA, 18 nt, Human
uaugugugugugugugug

SEQ ID NO: 1115957 - RNA, 25 nt, Human
uauguguguguguguguguguugua

SEQ ID NO: 1115958 - RNA, 23 nt, Human
uauguugugauugugugugugua

SEQ ID NO: 1115959 - RNA, 23 nt, Human
uccaagggacugaaccaagccaa

SEQ ID NO: 1115960 - RNA, 19 nt, Human
ucuaugcugaauuuugaga

SEQ ID NO: 1115961 - RNA, 21 nt, Human
ucuaugcugaauuuugagacc

SEQ ID NO: 1115962 - RNA, 22 nt, Human
ugcuguggggauggcagcucca

SEQ ID NO: 1115963 - RNA, 26 nt, Human
uggcagcuccaagggacugaaccaag

SEQ ID NO: 1115964 - RNA, 21 nt, Human
uguaugugugugugugugugu

SEQ ID NO: 1115965 - RNA, 19 nt, Human
ugugauuguguguguguau

SEQ ID NO: 1115966 - RNA, 20 nt, Human
uguguaugugugugugugug

SEQ ID NO: 1115967 - RNA, 20 nt, Human
ugugugauuacacuucuaug

SEQ ID NO: 1115968 - RNA, 19 nt, Human
uguguguaugugugugugu

SEQ ID NO: 1115969 - RNA, 24 nt, Human
uguguguaugugugugugugugug

SEQ ID NO: 1115970 - RNA, 20 nt, Human
uguguguguguaugugugug

SEQ ID NO: 1115971 - RNA, 21 nt, Human
uguguguguguaugugugugu

SEQ ID NO: 1115972 - RNA, 21 nt, Human
uguguguguguaugugugugu

SEQ ID NO: 1115973 - RNA, 21 nt, Human
uguguguguguaugugugugu

SEQ ID NO: 1115974 - RNA, 18 nt, Human
ugugugugugugugugug

SEQ ID NO: 1115975 - RNA, 19 nt, Human
uguguguguguguguguug

SEQ ID NO: 1115976 - RNA, 25 nt, Human
uguguguguguguguuguauugugu

SEQ ID NO: 1115977 - RNA, 18 nt, Human
uguguguguguguuguau

SEQ ID NO: 1115978 - RNA, 23 nt, Human
uguguguguguguuguauugugu

SEQ ID NO: 1115979 - RNA, 23 nt, Human
uguuguauugugugauuacacuu

SEQ ID NO: 1115980 - RNA, 24 nt, Human
uuacacuucuaugcugaauuuuga

SEQ ID NO: 1115981 - RNA, 19 nt, Human
uuugcaaauacuuuagcag

SEQ ID NO: 1115982 - RNA, 23 nt, Human
aaaaaguuuuaacuacagagacu

SEQ ID NO: 1115983 - RNA, 20 nt, Human
aaacagauagugagcuagau

SEQ ID NO: 1115984 - RNA, 23 nt, Human
aaagaaaaaguuuuaacuacaga

SEQ ID NO: 1115985 - RNA, 19 nt, Human
aaaugucaaagauuauccu

SEQ ID NO: 1115986 - RNA, 22 nt, Human
agacaacauuaugaucuuuagu

SEQ ID NO: 1115987 - RNA, 19 nt, Human
agacuggaguuagauacaa

SEQ ID NO: 1115988 - RNA, 23 nt, Human
auaaucuuuaauacuuaacaaag

SEQ ID NO: 1115989 - RNA, 18 nt, Human
caaaaugucaaagauuau

SEQ ID NO: 1115990 - RNA, 24 nt, Human
ccucacaagaucagcugcucugaa

SEQ ID NO: 1115991 - RNA, 20 nt, Human
cuuuuuagaucuagcugaaa

SEQ ID NO: 1115992 - RNA, 22 nt, Human
gagcaaugaaaaaaaaaaucuu

SEQ ID NO: 1115993 - RNA, 22 nt, Human
uaaagggccucccaaaguagca

SEQ ID NO: 1115994 - RNA, 21 nt, Human
uaacagaccaguauacuuccu

SEQ ID NO: 1115995 - RNA, 26 nt, Human
uaaccaagaacuaaguauauaccuca

SEQ ID NO: 1115996 - RNA, 18 nt, Human
uacuugaaagauacacuu

SEQ ID NO: 1115997 - RNA, 24 nt, Human
uagguaucuuucauuguaaauucc

SEQ ID NO: 1115998 - RNA, 19 nt, Human
uauguaaagggccucccaa

SEQ ID NO: 1115999 - RNA, 21 nt, Human
ucaauucuuauuuuuccaaaa

SEQ ID NO: 1116000 - RNA, 18 nt, Human
ucucugcuaacagaccag

SEQ ID NO: 1116001 - RNA, 21 nt, Human
ucugaguuccaauuccagcug

SEQ ID NO: 1116002 - RNA, 25 nt, Human
ugacauuccauuguucuacgucccu

SEQ ID NO: 1116003 - RNA, 19 nt, Human
ugcuuugcaucuacuugaa

SEQ ID NO: 1116004 - RNA, 21 nt, Human
ugggagcaaugaaaaaaaaaa

SEQ ID NO: 1116005 - RNA, 20 nt, Human
uguaaauucugguguaacuu

SEQ ID NO: 1116006 - RNA, 22 nt, Human
uuaguauuauuaauacaaugac

SEQ ID NO: 1116007 - RNA, 24 nt, Human
uuaguauuauuaauacaaugacuu

SEQ ID NO: 1116008 - RNA, 21 nt, Human
uuaguucuagaguucaacaaa

SEQ ID NO: 1116009 - RNA, 18 nt, Human
uuaucuguaagacuggag

SEQ ID NO: 1116010 - RNA, 23 nt, Human
uuggucauauuuggcaaaaagaa

SEQ ID NO: 1116011 - RNA, 21 nt, Human
uuuaccaaauguuagagguua

SEQ ID NO: 1116012 - RNA, 22 nt, Human
uuuuaccaaauguuagagguua

SEQ ID NO: 1116013 - RNA, 26 nt, Human
aauaaacagcagaaauuuauuuucuc

SEQ ID NO: 1116014 - RNA, 22 nt, Human
agcuuguuuuccugcaacuaga

SEQ ID NO: 1116015 - RNA, 21 nt, Human
aggcugggcuagggacagagu

SEQ ID NO: 1116016 - RNA, 27 nt, Human
cagcagguuugguuucucccaaggccu

SEQ ID NO: 1116017 - RNA, 24 nt, Human
cagcuuguuuuccugcaacuagau

SEQ ID NO: 1116018 - RNA, 19 nt, Human
ccaagaucaaggugacagc

SEQ ID NO: 1116019 - RNA, 22 nt, Human
ccucacucagcuuguuuuccug

SEQ ID NO: 1116020 - RNA, 20 nt, Human
ccucucuucuuggcuugcgg

SEQ ID NO: 1116021 - RNA, 24 nt, Human
cuggaaguccaagaucaaggugac

SEQ ID NO: 1116022 - RNA, 19 nt, Human
cugggcuagggacagagug

SEQ ID NO: 1116023 - RNA, 26 nt, Human
gacugcuuuacaugcccuauuucuau

SEQ ID NO: 1116024 - RNA, 21 nt, Human
gagccaauccauaugaccuua

SEQ ID NO: 1116025 - RNA, 24 nt, Human
gauucuucccuuacaggguggguu

SEQ ID NO: 1116026 - RNA, 19 nt, Human
gcagugcucgccauaccgu

SEQ ID NO: 1116027 - RNA, 22 nt, Human
gcuugcggauggcaucuucuca

SEQ ID NO: 1116028 - RNA, 22 nt, Human
ggaaaaaccaggcugggcuagg

SEQ ID NO: 1116029 - RNA, 22 nt, Human
gggaauccucacucagcuuguu

SEQ ID NO: 1116030 - RNA, 22 nt, Human
uagaaucagugggaauccucac

SEQ ID NO: 1116031 - RNA, 30 nt, Human
ucaaggugacagcagguuugguuucucccu

SEQ ID NO: 1116032 - RNA, 24 nt, Human
ucacagugugcucacauggccauu

SEQ ID NO: 1116033 - RNA, 19 nt, Human
ucacucagcuuguuuuccu

SEQ ID NO: 1116034 - RNA, 18 nt, Human
ucccaggauucuucccuu

SEQ ID NO: 1116035 - RNA, 22 nt, Human
uccugggacuucauaggcuugc

SEQ ID NO: 1116036 - RNA, 22 nt, Human
ucucacaguucuugaggcugga

SEQ ID NO: 1116037 - RNA, 20 nt, Human
ucucacaguucuugaggcuu

SEQ ID NO: 1116038 - RNA, 21 nt, Human
ucucccaaggccucucuucuu

SEQ ID NO: 1116039 - RNA, 18 nt, Human
ucugagguguacuggggu

SEQ ID NO: 1116040 - RNA, 18 nt, Human
ugauuuauguugugguua

SEQ ID NO: 1116041 - RNA, 21 nt, Human
ugcucacauggccauugugug

SEQ ID NO: 1116042 - RNA, 25 nt, Human
ugcucacauggccauugugugcgug

SEQ ID NO: 1116043 - RNA, 23 nt, Human
uggguuucccgcaugcgcagugc

SEQ ID NO: 1116044 - RNA, 25 nt, Human
uuagugguuguagugauugggcuuc

SEQ ID NO: 1116045 - RNA, 22 nt, Human
uucccuuacaggguggguuucc

SEQ ID NO: 1116046 - RNA, 22 nt, Human
aaaagaacugaaaauccacaaa

SEQ ID NO: 1116047 - RNA, 24 nt, Human
aaaagaacugaaaauccacaaagg

SEQ ID NO: 1116048 - RNA, 21 nt, Human
aagaacugaaaauccacaaag

SEQ ID NO: 1116049 - RNA, 22 nt, Human
aauaaaagaacugaaaauccac

SEQ ID NO: 1116050 - RNA, 23 nt, Human
caauaaaagaacugaaaauccac

SEQ ID NO: 1116051 - RNA, 20 nt, Human
gucaauaaaagaacugaaaa

SEQ ID NO: 1116052 - RNA, 24 nt, Human
uaaaagaacugaaaauccacaaag

SEQ ID NO: 1116053 - RNA, 19 nt, Human
uauuccacuuugguaaagu

SEQ ID NO: 1116054 - RNA, 22 nt, Human
uccacaaagguuuccccaugga

SEQ ID NO: 1116055 - RNA, 22 nt, Human
ugaaugucaauaaaagaacuga

SEQ ID NO: 1116056 - RNA, 21 nt, Human
ugcaggugaugaagaggaugu

SEQ ID NO: 1116057 - RNA, 18 nt, Human
aacacagugagacccugu

SEQ ID NO: 1116058 - RNA, 24 nt, Human
aacagagugaggcccugucucaaa

SEQ ID NO: 1116059 - RNA, 20 nt, Human
aacuucugaaaauucuccuu

SEQ ID NO: 1116060 - RNA, 24 nt, Human
acagagugaggcccugucucaaaa

SEQ ID NO: 1116061 - RNA, 24 nt, Human
acugcauuccagccuuggcaacag

SEQ ID NO: 1116062 - RNA, 24 nt, Human
acugcauuccagccuuggcaacag

SEQ ID NO: 1116063 - RNA, 18 nt, Human
acugccgcacuccagccu

SEQ ID NO: 1116064 - RNA, 25 nt, Human
acugcugccucucccuucuuucucc

SEQ ID NO: 1116065 - RNA, 24 nt, Human
agaacaaauaccaaucugugccag

SEQ ID NO: 1116066 - RNA, 24 nt, Human
agccuggccaacacagugagaccc

SEQ ID NO: 1116067 - RNA, 22 nt, Human
agcgcagcucucugagcuaccu

SEQ ID NO: 1116068 - RNA, 19 nt, Human
agcuaggcgcaguggugca

SEQ ID NO: 1116069 - RNA, 24 nt, Human
aggaucacuugggcccaggaguuc

SEQ ID NO: 1116070 - RNA, 18 nt, Human
aggcaggaggauggccug

SEQ ID NO: 1116071 - RNA, 24 nt, Human
aggcaggaggauggccugagccca

SEQ ID NO: 1116072 - RNA, 27 nt, Human
aggcaggaggauggccugagcccagga

SEQ ID NO: 1116073 - RNA, 18 nt, Human
aggccgaggcaggaggau

SEQ ID NO: 1116074 - RNA, 24 nt, Human
aggcgcaguggugcacgccugucg

SEQ ID NO: 1116075 - RNA, 22 nt, Human
agugcuuugugaggcugauugg

SEQ ID NO: 1116076 - RNA, 24 nt, Human
aguggugcacgccugucgucccag

SEQ ID NO: 1116077 - RNA, 25 nt, Human
aucucgccacugcauuccagccuug

SEQ ID NO: 1116078 - RNA, 23 nt, Human
aucugcuuccucuccuuucuccu

SEQ ID NO: 1116079 - RNA, 20 nt, Human
augggcagaggagagagcau

SEQ ID NO: 1116080 - RNA, 22 nt, Human
caacagagugaggcccugucuc

SEQ ID NO: 1116081 - RNA, 20 nt, Human
caacuucugaaaauucuccu

SEQ ID NO: 1116082 - RNA, 19 nt, Human
cacugcauuccagccuugg

SEQ ID NO: 1116083 - RNA, 21 nt, Human
cacugcauuccagccuuggca

SEQ ID NO: 1116084 - RNA, 22 nt, Human
cacugcauuccagccuuggcaa

SEQ ID NO: 1116085 - RNA, 24 nt, Human
cacugcauuccagccuuggcaaca

SEQ ID NO: 1116086 - RNA, 24 nt, Human
cagcuacucaggaggccgaggcag

SEQ ID NO: 1116087 - RNA, 22 nt, Human
caggcucuccauccagcuuccc

SEQ ID NO: 1116088 - RNA, 21 nt, Human
cagguaccagagcuccugccg

SEQ ID NO: 1116089 - RNA, 23 nt, Human
cauuccagccuuggcaacagagu

SEQ ID NO: 1116090 - RNA, 20 nt, Human
ccacugcauuccagccuugg

SEQ ID NO: 1116091 - RNA, 20 nt, Human
ccacugcauuccagccuugg

SEQ ID NO: 1116092 - RNA, 21 nt, Human
ccacugcauuccagccuuggc

SEQ ID NO: 1116093 - RNA, 24 nt, Human
ccacugcauuccagccuuggcaac

SEQ ID NO: 1116094 - RNA, 18 nt, Human
ccagagaaauaaggaucc

SEQ ID NO: 1116095 - RNA, 23 nt, Human
ccagcaacuucugaaaauucucc

SEQ ID NO: 1116096 - RNA, 19 nt, Human
ccaggacuggcuuuucucc

SEQ ID NO: 1116097 - RNA, 18 nt, Human
cccaggcucuccauccag

SEQ ID NO: 1116098 - RNA, 24 nt, Human
ccccacuguacaggaaauggaggu

SEQ ID NO: 1116099 - RNA, 18 nt, Human
ccccgaguggcaacaguc

SEQ ID NO: 1116100 - RNA, 20 nt, Human
cccugcauggggucugcgug

SEQ ID NO: 1116101 - RNA, 20 nt, Human
cccuucuuucucccuucucc

SEQ ID NO: 1116102 - RNA, 22 nt, Human
ccgcacuccagccuggccaaca

SEQ ID NO: 1116103 - RNA, 18 nt, Human
ccgggauucuggcccagg

SEQ ID NO: 1116104 - RNA, 22 nt, Human
ccuccagcgcagcucucugagc

SEQ ID NO: 1116105 - RNA, 22 nt, Human
ccuggccaacacagugagaccc

SEQ ID NO: 1116106 - RNA, 21 nt, Human
ccugucgucccagcuacucag

SEQ ID NO: 1116107 - RNA, 20 nt, Human
cgaggcaggaggauggccug

SEQ ID NO: 1116108 - RNA, 24 nt, Human
cgccugucgucccagcuacucagg

SEQ ID NO: 1116109 - RNA, 21 nt, Human
cucuacaaccccgaguggcaa

SEQ ID NO: 1116110 - RNA, 18 nt, Human
cucucccuucuuucuccc

SEQ ID NO: 1116111 - RNA, 20 nt, Human
cucucccuucuuucucccuu

SEQ ID NO: 1116112 - RNA, 28 nt, Human
cucucccuucuuucucccuucuccaaaa

SEQ ID NO: 1116113 - RNA, 28 nt, Human
cugaaaauucuccuucccuggaguccgg

SEQ ID NO: 1116114 - RNA, 20 nt, Human
cugcaugugacuuuguuccu

SEQ ID NO: 1116115 - RNA, 21 nt, Human
cugccaggacuggcuuuucuc

SEQ ID NO: 1116116 - RNA, 20 nt, Human
cugccgcacuccagccuggc

SEQ ID NO: 1116117 - RNA, 22 nt, Human
cugugccagagaaauaaggauc

SEQ ID NO: 1116118 - RNA, 21 nt, Human
cuuucucccuucuccaaaaug

SEQ ID NO: 1116119 - RNA, 19 nt, Human
gaagagggaggggccaagg

SEQ ID NO: 1116120 - RNA, 19 nt, Human
gacugcugccucucccuuc

SEQ ID NO: 1116121 - RNA, 26 nt, Human
gacuuuguuccucugguuugaugccc

SEQ ID NO: 1116122 - RNA, 18 nt, Human
gagcccaggaguuugagg

SEQ ID NO: 1116123 - RNA, 19 nt, Human
gaggcugauuggaggauca

SEQ ID NO: 1116124 - RNA, 21 nt, Human
gaucucgccacugcauuccag

SEQ ID NO: 1116125 - RNA, 18 nt, Human
gaucugcuuccucuccuu

SEQ ID NO: 1116126 - RNA, 24 nt, Human
gauggccugagcccaggaguuuga

SEQ ID NO: 1116127 - RNA, 21 nt, Human
gcaguggugcacgccugucgu

SEQ ID NO: 1116128 - RNA, 24 nt, Human
gcauuccagccuuggcaacagagu

SEQ ID NO: 1116129 - RNA, 24 nt, Human
gcccaggaguuugaggcugcagug

SEQ ID NO: 1116130 - RNA, 24 nt, Human
gcccugacagauucggcaacucca

SEQ ID NO: 1116131 - RNA, 25 nt, Human
gccgcacuccagccuggccaacaca

SEQ ID NO: 1116132 - RNA, 28 nt, Human
gccucucccuucuuucucccuucuccaa

SEQ ID NO: 1116133 - RNA, 19 nt, Human
gcguguuucugugcaucuc

SEQ ID NO: 1116134 - RNA, 20 nt, Human
gcugugguucuccagucugg

SEQ ID NO: 1116135 - RNA, 23 nt, Human
gcuuccucuccuuucuccuccau

SEQ ID NO: 1116136 - RNA, 20 nt, Human
ggacuggcuuuucuccucca

SEQ ID NO: 1116137 - RNA, 23 nt, Human
ggaucacuugggcccaggaguuc

SEQ ID NO: 1116138 - RNA, 19 nt, Human
ggcaacagagugaggcccu

SEQ ID NO: 1116139 - RNA, 18 nt, Human
ggcccaggaguuccagac

SEQ ID NO: 1116140 - RNA, 19 nt, Human
gggaggggccaaggggagg

SEQ ID NO: 1116141 - RNA, 22 nt, Human
gggcugaugaagagggaggggc

SEQ ID NO: 1116142 - RNA, 24 nt, Human
gggcuuuacagaacaaauaccaau

SEQ ID NO: 1116143 - RNA, 18 nt, Human
ggggaggugaugggcaga

SEQ ID NO: 1116144 - RNA, 23 nt, Human
ggucccugcauggggucugcgug

SEQ ID NO: 1116145 - RNA, 22 nt, Human
guuccagacugccgcacuccag

SEQ ID NO: 1116146 - RNA, 20 nt, Human
guuuaaacaugguacuggag

SEQ ID NO: 1116147 - RNA, 19 nt, Human
uacauauuacucuacaacc

SEQ ID NO: 1116148 - RNA, 22 nt, Human
uagaauggauuugccaagguca

SEQ ID NO: 1116149 - RNA, 22 nt, Human
uaugugcagcccucugcaugug

SEQ ID NO: 1116150 - RNA, 21 nt, Human
ucacugcucugugaacccugg

SEQ ID NO: 1116151 - RNA, 22 nt, Human
uccaaaauggggcugaugaaga

SEQ ID NO: 1116152 - RNA, 23 nt, Human
uccagccuuggcaacagagugag

SEQ ID NO: 1116153 - RNA, 23 nt, Human
uccagccuuggcaacagagugag

SEQ ID NO: 1116154 - RNA, 24 nt, Human
uccagccuuggcaacagagugagg

SEQ ID NO: 1116155 - RNA, 21 nt, Human
uccagugcuuugugaggcuga

SEQ ID NO: 1116156 - RNA, 18 nt, Human
ucccagguaccagagcuc

SEQ ID NO: 1116157 - RNA, 19 nt, Human
uccccaagcauggagggcu

SEQ ID NO: 1116158 - RNA, 19 nt, Human
ucccuggggguaaaucagg

SEQ ID NO: 1116159 - RNA, 25 nt, Human
uccguguguguguuucccugugucu

SEQ ID NO: 1116160 - RNA, 20 nt, Human
ucucccuucuccaaaauggg

SEQ ID NO: 1116161 - RNA, 24 nt, Human
ucucugagcuaccugcuguaauuc

SEQ ID NO: 1116162 - RNA, 19 nt, Human
ucugaaaauucuccuuccc

SEQ ID NO: 1116163 - RNA, 25 nt, Human
ucugaaaauucuccuucccuggagu

SEQ ID NO: 1116164 - RNA, 19 nt, Human
ucugagcaccguuuaaaca

SEQ ID NO: 1116165 - RNA, 22 nt, Human
ucugugcaucuccgugugugug

SEQ ID NO: 1116166 - RNA, 22 nt, Human
ucuuucucccuucuccaaaaug

SEQ ID NO: 1116167 - RNA, 22 nt, Human
ugacagauucggcaacuccagc

SEQ ID NO: 1116168 - RNA, 20 nt, Human
ugaggcugauuggaggauca

SEQ ID NO: 1116169 - RNA, 23 nt, Human
ugaggcugcagugagcuaugauc

SEQ ID NO: 1116170 - RNA, 19 nt, Human
ugaucagauugcuuuccuc

SEQ ID NO: 1116171 - RNA, 18 nt, Human
ugccaaggucacaaagcu

SEQ ID NO: 1116172 - RNA, 24 nt, Human
ugcugccucucccuucuuucuccc

SEQ ID NO: 1116173 - RNA, 23 nt, Human
ugcuuccucuccuuucuccucca

SEQ ID NO: 1116174 - RNA, 20 nt, Human
ugggcagaggagagagcauu

SEQ ID NO: 1116175 - RNA, 22 nt, Human
uggggucugcguguuucugugc

SEQ ID NO: 1116176 - RNA, 18 nt, Human
ugguacuggagcuaggcc

SEQ ID NO: 1116177 - RNA, 21 nt, Human
ugguacugggcuuuacagaac

SEQ ID NO: 1116178 - RNA, 22 nt, Human
uuacauauuacucuacaacccc

SEQ ID NO: 1116179 - RNA, 19 nt, Human
uuacucuacaaccccgagu

SEQ ID NO: 1116180 - RNA, 25 nt, Human
uuagaucugcuuccucuccuuucuc

SEQ ID NO: 1116181 - RNA, 26 nt, Human
uucuccuccaucacugcucugugaac

SEQ ID NO: 1116182 - RNA, 22 nt, Human
uucugugcaucuccgugugugu

SEQ ID NO: 1116183 - RNA, 23 nt, Human
uucuuucucccuucuccaaaaug

SEQ ID NO: 1116184 - RNA, 18 nt, Human
uuggaggaucacuugggc

SEQ ID NO: 1116185 - RNA, 23 nt, Human
uugugaggcugauuggaggauca

SEQ ID NO: 1116186 - RNA, 19 nt, Human
uuuguagguguguuguccc

SEQ ID NO: 1116187 - RNA, 22 nt, Human
uuuucugagcaccguuuaaaca

SEQ ID NO: 1116188 - RNA, 20 nt, Human
agcagcagcaguggcuccag

SEQ ID NO: 1116189 - RNA, 21 nt, Human
cagcagcagcaguggcuccag

SEQ ID NO: 1116190 - RNA, 22 nt, Human
cagcagcaguggcuccagacag

SEQ ID NO: 1116191 - RNA, 21 nt, Human
cagcucgguggucacuggcaa

SEQ ID NO: 1116192 - RNA, 18 nt, Human
ccagcagcagcaguggcu

SEQ ID NO: 1116193 - RNA, 21 nt, Human
ccccagcagcagcaguggcuc

SEQ ID NO: 1116194 - RNA, 30 nt, Human
cugguuaguggccgacucugacuuccuccu

SEQ ID NO: 1116195 - RNA, 21 nt, Human
cuuuccuacuggggaggggca

SEQ ID NO: 1116196 - RNA, 18 nt, Human
gacucugacuuccuccuc

SEQ ID NO: 1116197 - RNA, 19 nt, Human
uggggaggggcaguggggc

SEQ ID NO: 1116198 - RNA, 21 nt, Human
uggggaggggcaguggggccc

SEQ ID NO: 1116199 - RNA, 20 nt, Human
uggggccuaagcccccugcc

SEQ ID NO: 1116200 - RNA, 20 nt, Human
uuuccuacuggggaggggca

SEQ ID NO: 1116201 - RNA, 20 nt, Human
caucaccccucucuccaaca

SEQ ID NO: 1116202 - RNA, 23 nt, Human
ccagcaccaggcaucaccccucu

SEQ ID NO: 1116203 - RNA, 18 nt, Human
cucugugcagggguucca

SEQ ID NO: 1116204 - RNA, 19 nt, Human
cuuccagaaaacuugguca

SEQ ID NO: 1116205 - RNA, 23 nt, Human
ucucuccaacaccuacuugaggg

SEQ ID NO: 1116206 - RNA, 20 nt, Human
uuccaccagcaccaggcauc

SEQ ID NO: 1116207 - RNA, 18 nt, Human
aaaagcacagcagaggca

SEQ ID NO: 1116208 - RNA, 25 nt, Human
aagcuugaggacaaaaguggugguu

SEQ ID NO: 1116209 - RNA, 25 nt, Human
acagaacauccuucugagugccccc

SEQ ID NO: 1116210 - RNA, 22 nt, Human
acccuaccuucuugcuccccag

SEQ ID NO: 1116211 - RNA, 25 nt, Human
acuccccuugucacuggcuuccccu

SEQ ID NO: 1116212 - RNA, 21 nt, Human
acugcaaucccugggagggcu

SEQ ID NO: 1116213 - RNA, 22 nt, Human
agagugggcggggggcgggggc

SEQ ID NO: 1116214 - RNA, 20 nt, Human
aggcaggcacagugguggcu

SEQ ID NO: 1116215 - RNA, 21 nt, Human
aggggaagggggggcaaaagc

SEQ ID NO: 1116216 - RNA, 21 nt, Human
auaacugagggcauggcacgc

SEQ ID NO: 1116217 - RNA, 20 nt, Human
aucuggaagcgcagugcgcc

SEQ ID NO: 1116218 - RNA, 18 nt, Human
aucuugucuuucuugcuc

SEQ ID NO: 1116219 - RNA, 18 nt, Human
caaaagcacagcagaggc

SEQ ID NO: 1116220 - RNA, 19 nt, Human
cacucaugucccaucugau

SEQ ID NO: 1116221 - RNA, 19 nt, Human
cacucaugucccaucugau

SEQ ID NO: 1116222 - RNA, 22 nt, Human
cagcuguaguccucuugugagg

SEQ ID NO: 1116223 - RNA, 24 nt, Human
cagggucccggcucucuccccgag

SEQ ID NO: 1116224 - RNA, 18 nt, Human
caucuugucuuucuugcu

SEQ ID NO: 1116225 - RNA, 25 nt, Human
caucuugucuuucuugcucagaaac

SEQ ID NO: 1116226 - RNA, 20 nt, Human
ccccucucuccaggcccuuc

SEQ ID NO: 1116227 - RNA, 18 nt, Human
cccgugacugcgcaucug

SEQ ID NO: 1116228 - RNA, 18 nt, Human
cccguucccccucucucc

SEQ ID NO: 1116229 - RNA, 21 nt, Human
cccuucuuucacucauguccc

SEQ ID NO: 1116230 - RNA, 23 nt, Human
ccuauggccccuagggccucucu

SEQ ID NO: 1116231 - RNA, 21 nt, Human
ccugggucucuggccuaggac

SEQ ID NO: 1116232 - RNA, 18 nt, Human
ccuguacagucuuaccuc

SEQ ID NO: 1116233 - RNA, 23 nt, Human
ccuucugcgugcagcggccaucu

SEQ ID NO: 1116234 - RNA, 23 nt, Human
ccuucuuauuacauaacugaggg

SEQ ID NO: 1116235 - RNA, 22 nt, Human
ccuuugguugggggagggaggc

SEQ ID NO: 1116236 - RNA, 23 nt, Human
cuagggaaugaggagaaucagaa

SEQ ID NO: 1116237 - RNA, 18 nt, Human
cuaggggcagagccgccu

SEQ ID NO: 1116238 - RNA, 20 nt, Human
cuccuccaugcccccugcca

SEQ ID NO: 1116239 - RNA, 20 nt, Human
cugaaggaaaagaugugaug

SEQ ID NO: 1116240 - RNA, 24 nt, Human
cuggcuuccccucuuuucccuggg

SEQ ID NO: 1116241 - RNA, 19 nt, Human
cuggucuccgacauggugg

SEQ ID NO: 1116242 - RNA, 25 nt, Human
cuguaguccucuugugaggcucccc

SEQ ID NO: 1116243 - RNA, 20 nt, Human
cuguccgccuuugguugggg

SEQ ID NO: 1116244 - RNA, 21 nt, Human
cuguuuuucuucucuuucucc

SEQ ID NO: 1116245 - RNA, 23 nt, Human
cuuccccucuuuucccugggugg

SEQ ID NO: 1116246 - RNA, 24 nt, Human
gaaugagaguggaggcagaggcuc

SEQ ID NO: 1116247 - RNA, 21 nt, Human
gacccgugguuuguguucccc

SEQ ID NO: 1116248 - RNA, 23 nt, Human
gaggcagaggcucggcagcucau

SEQ ID NO: 1116249 - RNA, 20 nt, Human
gaggggguuuaccaagcccu

SEQ ID NO: 1116250 - RNA, 19 nt, Human
gaguaguucggaaaagcug

SEQ ID NO: 1116251 - RNA, 21 nt, Human
gagugucugaaugagagugga

SEQ ID NO: 1116252 - RNA, 23 nt, Human
gcacagugguggcugccgcaaug

SEQ ID NO: 1116253 - RNA, 19 nt, Human
gcagcuuugaggaucuguu

SEQ ID NO: 1116254 - RNA, 21 nt, Human
gcccguucccccucucuccag

SEQ ID NO: 1116255 - RNA, 18 nt, Human
gccucaucuuggggaaga

SEQ ID NO: 1116256 - RNA, 20 nt, Human
gcgcaguggcccccacccgu

SEQ ID NO: 1116257 - RNA, 23 nt, Human
gcugcccguucccccucucucca

SEQ ID NO: 1116258 - RNA, 24 nt, Human
gcuuggaguaguucggaaaagcug

SEQ ID NO: 1116259 - RNA, 20 nt, Human
ggagacgggagguuuggagg

SEQ ID NO: 1116260 - RNA, 18 nt, Human
ggaggaggggaagggggg

SEQ ID NO: 1116261 - RNA, 23 nt, Human
ggaggggguggcacccuucuuuc

SEQ ID NO: 1116262 - RNA, 20 nt, Human
ggagggucugacuggguaga

SEQ ID NO: 1116263 - RNA, 23 nt, Human
ggcagcaggcuguccgccuuugg

SEQ ID NO: 1116264 - RNA, 18 nt, Human
ggcggggggcgggggcua

SEQ ID NO: 1116265 - RNA, 20 nt, Human
ggcggggggcgggggcuaug

SEQ ID NO: 1116266 - RNA, 19 nt, Human
gggaaugaggagaaucaga

SEQ ID NO: 1116267 - RNA, 22 nt, Human
gggagguuuggaggccccgggu

SEQ ID NO: 1116268 - RNA, 20 nt, Human
gggauuuccagaaaagucag

SEQ ID NO: 1116269 - RNA, 22 nt, Human
gggcagcaggcuguccgccuuu

SEQ ID NO: 1116270 - RNA, 25 nt, Human
gggcagcaggcuguccgccuuuggu

SEQ ID NO: 1116271 - RNA, 22 nt, Human
gggcgggggcuaugacggagga

SEQ ID NO: 1116272 - RNA, 25 nt, Human
ggggcaaaagcacagcagaggcagg

SEQ ID NO: 1116273 - RNA, 20 nt, Human
gggggagggaggccucgaaa

SEQ ID NO: 1116274 - RNA, 21 nt, Human
gggggcuaugacggaggaggg

SEQ ID NO: 1116275 - RNA, 21 nt, Human
guggggacagggaagugaggu

SEQ ID NO: 1116276 - RNA, 21 nt, Human
gugucagacccgugguuugug

SEQ ID NO: 1116277 - RNA, 18 nt, Human
guuucuuuugguggacca

SEQ ID NO: 1116278 - RNA, 26 nt, Human
guuuuucuucucuuucuccuccaugc

SEQ ID NO: 1116279 - RNA, 21 nt, Human
uagcagugaaggacugcaauc

SEQ ID NO: 1116280 - RNA, 22 nt, Human
uaggcucugucuccagcagccu

SEQ ID NO: 1116281 - RNA, 18 nt, Human
ucaacaccugggcccggc

SEQ ID NO: 1116282 - RNA, 21 nt, Human
ucccagaguaaaauuccuucc

SEQ ID NO: 1116283 - RNA, 19 nt, Human
ucccugggagggcuaacuc

SEQ ID NO: 1116284 - RNA, 20 nt, Human
ucccugggagggcuaacucu

SEQ ID NO: 1116285 - RNA, 21 nt, Human
uccgcagagugggcggggggc

SEQ ID NO: 1116286 - RNA, 21 nt, Human
ucucacguuuguggggagggg

SEQ ID NO: 1116287 - RNA, 20 nt, Human
ucucugguggaggggguggc

SEQ ID NO: 1116288 - RNA, 19 nt, Human
ucugucuccagcagccucc

SEQ ID NO: 1116289 - RNA, 23 nt, Human
ucuugugaggcuccccgcugccc

SEQ ID NO: 1116290 - RNA, 27 nt, Human
ucuuucuugcucagaaacuuaaaaugg

SEQ ID NO: 1116291 - RNA, 24 nt, Human
ugaggagaaucagaauaaaacuag

SEQ ID NO: 1116292 - RNA, 18 nt, Human
ugagugccccauaccacc

SEQ ID NO: 1116293 - RNA, 18 nt, Human
ugccaugguuccagcugu

SEQ ID NO: 1116294 - RNA, 20 nt, Human
ugcccguucccccucucucc

SEQ ID NO: 1116295 - RNA, 20 nt, Human
ugcgugcagcggccaucuug

SEQ ID NO: 1116296 - RNA, 20 nt, Human
uggaggcagaggcucggcag

SEQ ID NO: 1116297 - RNA, 22 nt, Human
uggcacccuucuuucacucaug

SEQ ID NO: 1116298 - RNA, 22 nt, Human
uggcacgcgccuucucggcccu

SEQ ID NO: 1116299 - RNA, 21 nt, Human
uggcccccacccgugacugcg

SEQ ID NO: 1116300 - RNA, 19 nt, Human
uggccuaggacgagcaccg

SEQ ID NO: 1116301 - RNA, 24 nt, Human
uggcguugguuuuucuguccugcu

SEQ ID NO: 1116302 - RNA, 19 nt, Human
ugggauuuccagaaaaguc

SEQ ID NO: 1116303 - RNA, 23 nt, Human
uggggaggggguuuaccaagccc

SEQ ID NO: 1116304 - RNA, 21 nt, Human
uggggauucagguggaaggcg

SEQ ID NO: 1116305 - RNA, 24 nt, Human
uggguagggguucaacaccugggc

SEQ ID NO: 1116306 - RNA, 23 nt, Human
ugguggaggggguggcacccuuc

SEQ ID NO: 1116307 - RNA, 24 nt, Human
uguuuuucuucucuuucuccucca

SEQ ID NO: 1116308 - RNA, 21 nt, Human
uucacucaugucccaucugau

SEQ ID NO: 1116309 - RNA, 18 nt, Human
uuccagaaaagucagugg

SEQ ID NO: 1116310 - RNA, 21 nt, Human
uuccccucuuuucccugggug

SEQ ID NO: 1116311 - RNA, 22 nt, Human
uucucggcccuuccuugcaacc

SEQ ID NO: 1116312 - RNA, 22 nt, Human
uuguggggaggggguuuaccaa

SEQ ID NO: 1116313 - RNA, 24 nt, Human
uuuaugaucuuucuggacuccucu

SEQ ID NO: 1116314 - RNA, 20 nt, Human
uuucuggacuccucugauga

SEQ ID NO: 1116315 - RNA, 24 nt, Human
uuuucuagccucaucuuggggaag

SEQ ID NO: 1116316 - RNA, 18 nt, Human
uuuuucuucucuuucucc

SEQ ID NO: 1116317 - RNA, 23 nt, Human
aaaacaacaaaaccagacaacca

SEQ ID NO: 1116318 - RNA, 24 nt, Human
aaaaugguuuugagagcccugcug

SEQ ID NO: 1116319 - RNA, 23 nt, Human
aaacaacaaaaccagacaaccau

SEQ ID NO: 1116320 - RNA, 20 nt, Human
aagcagcaggugaagugcag

SEQ ID NO: 1116321 - RNA, 22 nt, Human
aaggaugcuaccauuuuucuca

SEQ ID NO: 1116322 - RNA, 23 nt, Human
acaccuguaaaaacaacaaaacc

SEQ ID NO: 1116323 - RNA, 20 nt, Human
acagaagcaccugaccccau

SEQ ID NO: 1116324 - RNA, 20 nt, Human
agacagcucaggcugaaggg

SEQ ID NO: 1116325 - RNA, 23 nt, Human
agagagcuugucccuucugcccu

SEQ ID NO: 1116326 - RNA, 22 nt, Human
agagagguaggacagcaagcac

SEQ ID NO: 1116327 - RNA, 29 nt, Human
agauacuaaaacgucacacuucagggaaa

SEQ ID NO: 1116328 - RNA, 20 nt, Human
agaugcauugaguuaagggc

SEQ ID NO: 1116329 - RNA, 21 nt, Human
agauuccagugugucaagagg

SEQ ID NO: 1116330 - RNA, 19 nt, Human
agcagaaagaagacagcuc

SEQ ID NO: 1116331 - RNA, 24 nt, Human
agcagcaggggccagcuggaggga

SEQ ID NO: 1116332 - RNA, 20 nt, Human
agcaggcugcacugcagcag

SEQ ID NO: 1116333 - RNA, 19 nt, Human
agcaggggccagcuggagg

SEQ ID NO: 1116334 - RNA, 21 nt, Human
agcaggugaagugcagccaga

SEQ ID NO: 1116335 - RNA, 18 nt, Human
agcagguuaaugggggca

SEQ ID NO: 1116336 - RNA, 21 nt, Human
agccagaagcuuucaaaugcu

SEQ ID NO: 1116337 - RNA, 21 nt, Human
aggcagcagcaggggccagcu

SEQ ID NO: 1116338 - RNA, 19 nt, Human
agguaaggcagcuggguug

SEQ ID NO: 1116339 - RNA, 23 nt, Human
aggugaagugcagccagaagaga

SEQ ID NO: 1116340 - RNA, 22 nt, Human
auaauacagauuccaguguguc

SEQ ID NO: 1116341 - RNA, 19 nt, Human
aucauucuccacgcucucc

SEQ ID NO: 1116342 - RNA, 20 nt, Human
augccaagaugaaggccaaa

SEQ ID NO: 1116343 - RNA, 26 nt, Human
caaaccacucacagccagcuccggcu

SEQ ID NO: 1116344 - RNA, 22 nt, Human
caaagcauguuccugagacaag

SEQ ID NO: 1116345 - RNA, 21 nt, Human
caacaaaaccagacaaccauc

SEQ ID NO: 1116346 - RNA, 19 nt, Human
caagaagguucccagauga

SEQ ID NO: 1116347 - RNA, 18 nt, Human
caagacacagcguggcug

SEQ ID NO: 1116348 - RNA, 20 nt, Human
cacuaggggaggagaacugu

SEQ ID NO: 1116349 - RNA, 20 nt, Human
cacucacagccagcuccggc

SEQ ID NO: 1116350 - RNA, 20 nt, Human
cagcagaaagaagacagcuc

SEQ ID NO: 1116351 - RNA, 19 nt, Human
cagcagcaggggccagcug

SEQ ID NO: 1116352 - RNA, 22 nt, Human
cagcagcaggggccagcuggag

SEQ ID NO: 1116353 - RNA, 22 nt, Human
cagcucaggcugaagggagagc

SEQ ID NO: 1116354 - RNA, 19 nt, Human
cagcucucaucgcuggggg

SEQ ID NO: 1116355 - RNA, 20 nt, Human
cagcuuuuucccuuuucuua

SEQ ID NO: 1116356 - RNA, 18 nt, Human
caugcaagacacagcgug

SEQ ID NO: 1116357 - RNA, 19 nt, Human
caugcaagacacagcgugg

SEQ ID NO: 1116358 - RNA, 19 nt, Human
cauuguauuuucuuaaaaa

SEQ ID NO: 1116359 - RNA, 18 nt, Human
ccacccuccaauuggcca

SEQ ID NO: 1116360 - RNA, 22 nt, Human
ccacugagccuccugagucuca

SEQ ID NO: 1116361 - RNA, 20 nt, Human
ccagaaaaucuucacccaaa

SEQ ID NO: 1116362 - RNA, 24 nt, Human
ccccaucauucuccacgcucucca

SEQ ID NO: 1116363 - RNA, 19 nt, Human
ccugccaccuuccaugcca

SEQ ID NO: 1116364 - RNA, 20 nt, Human
ccuugaggccaggguaggag

SEQ ID NO: 1116365 - RNA, 20 nt, Human
ccuuugcuggaccacuuuuc

SEQ ID NO: 1116366 - RNA, 23 nt, Human
ccuuugcuggaccacuuuuccua

SEQ ID NO: 1116367 - RNA, 23 nt, Human
cggcucuucacucuccacccucc

SEQ ID NO: 1116368 - RNA, 21 nt, Human
cuacugagauguccgacugcc

SEQ ID NO: 1116369 - RNA, 23 nt, Human
cucaaagcauguuccugagacaa

SEQ ID NO: 1116370 - RNA, 19 nt, Human
cucaggacuuucccuagca

SEQ ID NO: 1116371 - RNA, 18 nt, Human
cucaugggauagagagcu

SEQ ID NO: 1116372 - RNA, 24 nt, Human
cuccacgcucuccacaaaccuuca

SEQ ID NO: 1116373 - RNA, 18 nt, Human
cuccugagucucaauucu

SEQ ID NO: 1116374 - RNA, 22 nt, Human
cucuccacaaaccuucaaggaa

SEQ ID NO: 1116375 - RNA, 18 nt, Human
cuugaguccagcuuuuuc

SEQ ID NO: 1116376 - RNA, 22 nt, Human
cuuucaaaugcucccuauuugu

SEQ ID NO: 1116377 - RNA, 22 nt, Human
gaaaaucuucacccaaacagag

SEQ ID NO: 1116378 - RNA, 22 nt, Human
gaaggcccugaaguucaucucc

SEQ ID NO: 1116379 - RNA, 20 nt, Human
gaggacgggaggcagcagca

SEQ ID NO: 1116380 - RNA, 19 nt, Human
gcacugcagcagaaagaag

SEQ ID NO: 1116381 - RNA, 22 nt, Human
gcagcagcaggggccagcugga

SEQ ID NO: 1116382 - RNA, 19 nt, Human
gccauugccccaucauucu

SEQ ID NO: 1116383 - RNA, 20 nt, Human
gcccaggccccaggagucuc

SEQ ID NO: 1116384 - RNA, 18 nt, Human
gccccaggcuacuuccuu

SEQ ID NO: 1116385 - RNA, 18 nt, Human
gcucuccacaaaccuuca

SEQ ID NO: 1116386 - RNA, 20 nt, Human
gcuugaguccagcuuuuucc

SEQ ID NO: 1116387 - RNA, 22 nt, Human
gcuuuuucccuuuucuuaauuc

SEQ ID NO: 1116388 - RNA, 24 nt, Human
gggggcaggcguggcaaccgggau

SEQ ID NO: 1116389 - RNA, 20 nt, Human
ggguuugagcaggaaaaguu

SEQ ID NO: 1116390 - RNA, 23 nt, Human
guucuguuuggggggaguauuuc

SEQ ID NO: 1116391 - RNA, 23 nt, Human
guuguggggaaaggcaggugggc

SEQ ID NO: 1116392 - RNA, 23 nt, Human
uaaaaacaacaaaaccagacaac

SEQ ID NO: 1116393 - RNA, 24 nt, Human
uaaaaacaacaaaaccagacaacc

SEQ ID NO: 1116394 - RNA, 21 nt, Human
uaacaaaaaaccccacuuuau

SEQ ID NO: 1116395 - RNA, 22 nt, Human
uaacaaaaaaccccacuuuauu

SEQ ID NO: 1116396 - RNA, 22 nt, Human
uaacugcugggagaugccaggu

SEQ ID NO: 1116397 - RNA, 20 nt, Human
uaagucaaagugaggacuuu

SEQ ID NO: 1116398 - RNA, 24 nt, Human
uacaaaacugguacccugugccac

SEQ ID NO: 1116399 - RNA, 22 nt, Human
uagaaaauaccaagagugaaac

SEQ ID NO: 1116400 - RNA, 18 nt, Human
uagaauaacaaaaaaccc

SEQ ID NO: 1116401 - RNA, 25 nt, Human
uagaauaacaaaaaaccccacuuua

SEQ ID NO: 1116402 - RNA, 20 nt, Human
uagauggggugggcugaacu

SEQ ID NO: 1116403 - RNA, 24 nt, Human
uauuagaauaacaaaaaaccccac

SEQ ID NO: 1116404 - RNA, 25 nt, Human
ucaaagugaggacuuugaaaugcag

SEQ ID NO: 1116405 - RNA, 24 nt, Human
ucacagccagcuccggcucuucac

SEQ ID NO: 1116406 - RNA, 24 nt, Human
ucaggcugaagggagagcuucucu

SEQ ID NO: 1116407 - RNA, 18 nt, Human
uccacaaaccuucaagga

SEQ ID NO: 1116408 - RNA, 18 nt, Human
uccacaacaccuguaaaa

SEQ ID NO: 1116409 - RNA, 24 nt, Human
uccaugcuuuuaaugacugaacuc

SEQ ID NO: 1116410 - RNA, 19 nt, Human
uccauucugccugccaccu

SEQ ID NO: 1116411 - RNA, 18 nt, Human
uccugagucucaauucuu

SEQ ID NO: 1116412 - RNA, 19 nt, Human
ucucaauucuuuucucucu

SEQ ID NO: 1116413 - RNA, 19 nt, Human
ucuccacgcucuccacaaa

SEQ ID NO: 1116414 - RNA, 21 nt, Human
ucucucauggaauccugagaa

SEQ ID NO: 1116415 - RNA, 19 nt, Human
ugaagagcaaacacuuugg

SEQ ID NO: 1116416 - RNA, 23 nt, Human
ugaagagcaaacacuuuggcuua

SEQ ID NO: 1116417 - RNA, 21 nt, Human
ugaaggaaggucagaagcuca

SEQ ID NO: 1116418 - RNA, 22 nt, Human
ugaaugaaugcaggaaacaguu

SEQ ID NO: 1116419 - RNA, 19 nt, Human
ugacugaacucuguaaaga

SEQ ID NO: 1116420 - RNA, 18 nt, Human
ugagaagaaugagaugug

SEQ ID NO: 1116421 - RNA, 19 nt, Human
ugagaagaaugagaugugg

SEQ ID NO: 1116422 - RNA, 19 nt, Human
ugagaagaaugagaugugg

SEQ ID NO: 1116423 - RNA, 21 nt, Human
ugagacaaggcgucggaaggc

SEQ ID NO: 1116424 - RNA, 19 nt, Human
ugagagcccugcuguggag

SEQ ID NO: 1116425 - RNA, 22 nt, Human
ugagauguggguguccacgaga

SEQ ID NO: 1116426 - RNA, 21 nt, Human
ugagcagccaugcggccagaa

SEQ ID NO: 1116427 - RNA, 23 nt, Human
ugagugcuaugaagagcaaacac

SEQ ID NO: 1116428 - RNA, 18 nt, Human
ugcaagacacagcguggc

SEQ ID NO: 1116429 - RNA, 20 nt, Human
ugcaagacacagcguggcuc

SEQ ID NO: 1116430 - RNA, 23 nt, Human
ugccaagaugaaggccaaauaag

SEQ ID NO: 1116431 - RNA, 19 nt, Human
ugccaagcaguggcuguga

SEQ ID NO: 1116432 - RNA, 23 nt, Human
uggcaggaaccagcuuccugaag

SEQ ID NO: 1116433 - RNA, 19 nt, Human
uggcaguagaaacaagagc

SEQ ID NO: 1116434 - RNA, 20 nt, Human
ugggcugaacuuuuuuacag

SEQ ID NO: 1116435 - RNA, 22 nt, Human
uggguuugagcaggaaaaguug

SEQ ID NO: 1116436 - RNA, 19 nt, Human
ugguagagaugcuacugag

SEQ ID NO: 1116437 - RNA, 22 nt, Human
ugguagagaugcuacugagaug

SEQ ID NO: 1116438 - RNA, 20 nt, Human
uguaaaaacaacaaaaccag

SEQ ID NO: 1116439 - RNA, 24 nt, Human
uguaaaaacaacaaaaccagacaa

SEQ ID NO: 1116440 - RNA, 18 nt, Human
uguccgacugccuuuaac

SEQ ID NO: 1116441 - RNA, 22 nt, Human
uguggccaaaccacucacagcc

SEQ ID NO: 1116442 - RNA, 18 nt, Human
uuagaauaacaaaaaacc

SEQ ID NO: 1116443 - RNA, 19 nt, Human
uuccacaacaccuguaaaa

SEQ ID NO: 1116444 - RNA, 20 nt, Human
uuccagugugucaagaggag

SEQ ID NO: 1116445 - RNA, 21 nt, Human
uuccccgucgaucugcuccca

SEQ ID NO: 1116446 - RNA, 24 nt, Human
uucuucguccagcacucauccauu

SEQ ID NO: 1116447 - RNA, 24 nt, Human
uuuacagguagcauaaggucuccu

SEQ ID NO: 1116448 - RNA, 24 nt, Human
uuugcuggaccacuuuuccuacaa

SEQ ID NO: 1116449 - RNA, 20 nt, Human
uuuggcuuagugcggaaggc

SEQ ID NO: 1116450 - RNA, 22 nt, Human
uuuuccuacaaaacugguaccc

SEQ ID NO: 1116451 - RNA, 24 nt, Human
accuuccuccaugccccuguccac

SEQ ID NO: 1116452 - RNA, 22 nt, Human
agaauuccacagaguuccacau

SEQ ID NO: 1116453 - RNA, 21 nt, Human
agagaccagguguuacaggug

SEQ ID NO: 1116454 - RNA, 24 nt, Human
agcaacaccacgaaucccaacgcg

SEQ ID NO: 1116455 - RNA, 23 nt, Human
agcucaccuuccuccaugccccu

SEQ ID NO: 1116456 - RNA, 19 nt, Human
cacaucgcuugcaauaucc

SEQ ID NO: 1116457 - RNA, 20 nt, Human
cagcaacaccacgaauccca

SEQ ID NO: 1116458 - RNA, 19 nt, Human
cagccagguccucucaggc

SEQ ID NO: 1116459 - RNA, 21 nt, Human
cagccagguccucucaggccc

SEQ ID NO: 1116460 - RNA, 24 nt, Human
caggucaaacuuuugguugaggcg

SEQ ID NO: 1116461 - RNA, 25 nt, Human
caggugccaggaccccuagaacucc

SEQ ID NO: 1116462 - RNA, 23 nt, Human
ccaaagauucugugccuacuuca

SEQ ID NO: 1116463 - RNA, 24 nt, Human
ccacauaacagugcauaaaugccc

SEQ ID NO: 1116464 - RNA, 23 nt, Human
cuccagggcagccagguccucuc

SEQ ID NO: 1116465 - RNA, 22 nt, Human
cucgcuguccaaagauucugug

SEQ ID NO: 1116466 - RNA, 20 nt, Human
gaccagguguuacaggugcc

SEQ ID NO: 1116467 - RNA, 21 nt, Human
gagauacacacacaacugugg

SEQ ID NO: 1116468 - RNA, 21 nt, Human
gcaacaccacgaaucccaacg

SEQ ID NO: 1116469 - RNA, 25 nt, Human
gggucuccagcaacaccacgaaucc

SEQ ID NO: 1116470 - RNA, 27 nt, Human
gucuccagcaacaccacgaaucccaag

SEQ ID NO: 1116471 - RNA, 21 nt, Human
uacacacacaacuguggugcg

SEQ ID NO: 1116472 - RNA, 18 nt, Human
ucaccuuccuccaugccc

SEQ ID NO: 1116473 - RNA, 24 nt, Human
ucauaauccuucuccagggcagcc

SEQ ID NO: 1116474 - RNA, 25 nt, Human
uccacauaacagugcauaaaugccc

SEQ ID NO: 1116475 - RNA, 18 nt, Human
ucucaggcccagagagcu

SEQ ID NO: 1116476 - RNA, 19 nt, Human
ucucaggcccagagagcuc

SEQ ID NO: 1116477 - RNA, 21 nt, Human
ugagauacacacacaacugug

SEQ ID NO: 1116478 - RNA, 21 nt, Human
ugccaggaccccuagaacucc

SEQ ID NO: 1116479 - RNA, 19 nt, Human
uggcauacaucaggucaaa

SEQ ID NO: 1116480 - RNA, 20 nt, Human
uguccacauaacagugcaua

SEQ ID NO: 1116481 - RNA, 20 nt, Human
aaaaaaaggaaaauccugga

SEQ ID NO: 1116482 - RNA, 18 nt, Human
aagcaggagaaucacuug

SEQ ID NO: 1116483 - RNA, 24 nt, Human
aagcaggagaaucacuuggaccca

SEQ ID NO: 1116484 - RNA, 24 nt, Human
aaucacuuggacccaggaggcgga

SEQ ID NO: 1116485 - RNA, 18 nt, Human
acaagcuucaaggaccag

SEQ ID NO: 1116486 - RNA, 18 nt, Human
acaccaccgcacuccagc

SEQ ID NO: 1116487 - RNA, 20 nt, Human
acaccaccgcacuccagccu

SEQ ID NO: 1116488 - RNA, 24 nt, Human
accaacauggagaaacccugucuc

SEQ ID NO: 1116489 - RNA, 18 nt, Human
accagagacuugccucaa

SEQ ID NO: 1116490 - RNA, 24 nt, Human
acccaggaggcggagguuguagug

SEQ ID NO: 1116491 - RNA, 27 nt, Human
acccagugauggaggggaacauggcuc

SEQ ID NO: 1116492 - RNA, 24 nt, Human
acccugucucuacuaaaaauacaa

SEQ ID NO: 1116493 - RNA, 18 nt, Human
accgcacuccagccugag

SEQ ID NO: 1116494 - RNA, 28 nt, Human
acucugucucaaaaaaaaaaaaaaaaaa

SEQ ID NO: 1116495 - RNA, 21 nt, Human
agaagguguggugccagaucu

SEQ ID NO: 1116496 - RNA, 22 nt, Human
agaaugaauaaauuuacaggug

SEQ ID NO: 1116497 - RNA, 25 nt, Human
agacacuggaaccacuuggacagcu

SEQ ID NO: 1116498 - RNA, 21 nt, Human
agacagaaaugaaacugguuc

SEQ ID NO: 1116499 - RNA, 25 nt, Human
agacagaaaugaaacugguucagga

SEQ ID NO: 1116500 - RNA, 18 nt, Human
agacccaccaagccacag

SEQ ID NO: 1116501 - RNA, 19 nt, Human
agagaagacggucgagcug

SEQ ID NO: 1116502 - RNA, 18 nt, Human
agagcgaaacucugucuc

SEQ ID NO: 1116503 - RNA, 18 nt, Human
agcaagacagaaaugaaa

SEQ ID NO: 1116504 - RNA, 23 nt, Human
agccgggugugguggcgcaugcc

SEQ ID NO: 1116505 - RNA, 24 nt, Human
agccuggauggcuguguaccuugc

SEQ ID NO: 1116506 - RNA, 27 nt, Human
aggaauagucggggagccagguguggc

SEQ ID NO: 1116507 - RNA, 20 nt, Human
aggaggaggacgcuguggug

SEQ ID NO: 1116508 - RNA, 23 nt, Human
aggaggaggacgcugugguggcc

SEQ ID NO: 1116509 - RNA, 19 nt, Human
aggcaggagaauugcuuga

SEQ ID NO: 1116510 - RNA, 23 nt, Human
aggcaggagaauugcuugaguuc

SEQ ID NO: 1116511 - RNA, 21 nt, Human
aggcggagguuguagugaacc

SEQ ID NO: 1116512 - RNA, 24 nt, Human
aggcggagguuguagugaaccgag

SEQ ID NO: 1116513 - RNA, 24 nt, Human
aggcugaagcaggagaaucacuug

SEQ ID NO: 1116514 - RNA, 19 nt, Human
agugauaggagaacccaga

SEQ ID NO: 1116515 - RNA, 21 nt, Human
agugauaggagaacccagagu

SEQ ID NO: 1116516 - RNA, 24 nt, Human
aucacaccaccgcacuccagccug

SEQ ID NO: 1116517 - RNA, 23 nt, Human
aucaccuaaggucgggaguuuga

SEQ ID NO: 1116518 - RNA, 25 nt, Human
auccagacgcaggauggcauggggg

SEQ ID NO: 1116519 - RNA, 24 nt, Human
caacauggagaaacccugucucua

SEQ ID NO: 1116520 - RNA, 23 nt, Human
caagggaacgguuaacaaaguca

SEQ ID NO: 1116521 - RNA, 23 nt, Human
cacacagacccaccaagccacag

SEQ ID NO: 1116522 - RNA, 25 nt, Human
cacacagacccaccaagccacagac

SEQ ID NO: 1116523 - RNA, 21 nt, Human
cacaccaccgcacuccagccu

SEQ ID NO: 1116524 - RNA, 24 nt, Human
cacaccugcaaucccagcacuuug

SEQ ID NO: 1116525 - RNA, 25 nt, Human
cacagacccaccaagccacagacuu

SEQ ID NO: 1116526 - RNA, 18 nt, Human
cacagauaaggagacugc

SEQ ID NO: 1116527 - RNA, 26 nt, Human
caccaccgcacuccagccugaguacc

SEQ ID NO: 1116528 - RNA, 23 nt, Human
caccugcaaucccagcacuuugg

SEQ ID NO: 1116529 - RNA, 24 nt, Human
caccugcaaucccagcacuuuggg

SEQ ID NO: 1116530 - RNA, 19 nt, Human
caccuuaguaccugcacag

SEQ ID NO: 1116531 - RNA, 19 nt, Human
cacuaauagaccagcaaga

SEQ ID NO: 1116532 - RNA, 24 nt, Human
cacucuagugugggcaacuagagc

SEQ ID NO: 1116533 - RNA, 24 nt, Human
cagcaaagccagcuuugcaugugg

SEQ ID NO: 1116534 - RNA, 24 nt, Human
cagcacuuugggaggccaaggcag

SEQ ID NO: 1116535 - RNA, 25 nt, Human
cagcacuuugggaggccaaggcagg

SEQ ID NO: 1116536 - RNA, 20 nt, Human
cagcagcacugggugcuccu

SEQ ID NO: 1116537 - RNA, 22 nt, Human
cagccugaguaccagagacuug

SEQ ID NO: 1116538 - RNA, 19 nt, Human
caggagcucuugccaggcu

SEQ ID NO: 1116539 - RNA, 24 nt, Human
cagggaggaggaggacgcuguggu

SEQ ID NO: 1116540 - RNA, 21 nt, Human
caggugccagucauccagacg

SEQ ID NO: 1116541 - RNA, 21 nt, Human
cagugauggaggggaacaugg

SEQ ID NO: 1116542 - RNA, 19 nt, Human
caucacccagguaggaguc

SEQ ID NO: 1116543 - RNA, 24 nt, Human
caucaccuaaggucgggaguuuga

SEQ ID NO: 1116544 - RNA, 24 nt, Human
caugcccguaaucccagcuacuug

SEQ ID NO: 1116545 - RNA, 19 nt, Human
cauugcacucuaguguggg

SEQ ID NO: 1116546 - RNA, 21 nt, Human
cauugcacucuagugugggca

SEQ ID NO: 1116547 - RNA, 22 nt, Human
cauugcacucuagugugggcaa

SEQ ID NO: 1116548 - RNA, 20 nt, Human
ccaccgcacuccagccugag

SEQ ID NO: 1116549 - RNA, 20 nt, Human
ccaccgcacuccagccugag

SEQ ID NO: 1116550 - RNA, 21 nt, Human
ccaccgcacuccagccugagu

SEQ ID NO: 1116551 - RNA, 25 nt, Human
ccaccgcacuccagccugaguacca

SEQ ID NO: 1116552 - RNA, 18 nt, Human
ccauggggugguugguca

SEQ ID NO: 1116553 - RNA, 19 nt, Human
ccauggguuuauacaucau

SEQ ID NO: 1116554 - RNA, 20 nt, Human
ccauugcacucuaguguggg

SEQ ID NO: 1116555 - RNA, 21 nt, Human
ccauugcacucuagugugggc

SEQ ID NO: 1116556 - RNA, 24 nt, Human
ccauugcacucuagugugggcaac

SEQ ID NO: 1116557 - RNA, 19 nt, Human
cccacaagcauguccucac

SEQ ID NO: 1116558 - RNA, 22 nt, Human
cccaccaagccacagacuuccc

SEQ ID NO: 1116559 - RNA, 18 nt, Human
cccguaaucccagcuacu

SEQ ID NO: 1116560 - RNA, 20 nt, Human
cccugggguucagcggggcc

SEQ ID NO: 1116561 - RNA, 21 nt, Human
cccugggguucagcggggccu

SEQ ID NO: 1116562 - RNA, 18 nt, Human
cccuggugccagggauac

SEQ ID NO: 1116563 - RNA, 21 nt, Human
cccuguguccugaaugggccc

SEQ ID NO: 1116564 - RNA, 18 nt, Human
cccuucuccccugugucc

SEQ ID NO: 1116565 - RNA, 22 nt, Human
ccuaaggucgggaguuugagac

SEQ ID NO: 1116566 - RNA, 22 nt, Human
ccuccagacacuggaaccacuu

SEQ ID NO: 1116567 - RNA, 22 nt, Human
ccugaccaacauggagaaaccc

SEQ ID NO: 1116568 - RNA, 24 nt, Human
ccugaccaacauggagaaacccug

SEQ ID NO: 1116569 - RNA, 24 nt, Human
cgccauugcacucuagugugggca

SEQ ID NO: 1116570 - RNA, 24 nt, Human
cuagagcgaaacucugucucaaaa

SEQ ID NO: 1116571 - RNA, 18 nt, Human
cucaaaaaaaaaaaaaaa

SEQ ID NO: 1116572 - RNA, 26 nt, Human
cucaaaaaaaaaaaaaaaaaaggaaa

SEQ ID NO: 1116573 - RNA, 24 nt, Human
cucaggcagcagcacugggugcuc

SEQ ID NO: 1116574 - RNA, 20 nt, Human
cucaucacccagguaggagu

SEQ ID NO: 1116575 - RNA, 21 nt, Human
cucaucacccagguaggaguc

SEQ ID NO: 1116576 - RNA, 19 nt, Human
cucugucucaaaaaaaaaa

SEQ ID NO: 1116577 - RNA, 20 nt, Human
cugcagcacuuuauuuuucc

SEQ ID NO: 1116578 - RNA, 19 nt, Human
cugggugcuccuugggagc

SEQ ID NO: 1116579 - RNA, 24 nt, Human
cuguguccugaaugggcccccaau

SEQ ID NO: 1116580 - RNA, 21 nt, Human
cuuaacacuaauagaccagca

SEQ ID NO: 1116581 - RNA, 21 nt, Human
cuucuggccuaugcccaccuu

SEQ ID NO: 1116582 - RNA, 18 nt, Human
gaaaugaaacugguucag

SEQ ID NO: 1116583 - RNA, 19 nt, Human
gaaaugaaacugguucagg

SEQ ID NO: 1116584 - RNA, 21 nt, Human
gaacuauacccagcaaagcca

SEQ ID NO: 1116585 - RNA, 24 nt, Human
gacagcuccuagaucuucuccagg

SEQ ID NO: 1116586 - RNA, 21 nt, Human
gagaaacccugucucuacuaa

SEQ ID NO: 1116587 - RNA, 23 nt, Human
gagaaucacuuggacccaggagg

SEQ ID NO: 1116588 - RNA, 20 nt, Human
gaggaggacgcugugguggc

SEQ ID NO: 1116589 - RNA, 23 nt, Human
gagguuguagugaaccgagguug

SEQ ID NO: 1116590 - RNA, 19 nt, Human
gagugagcaacuccauggg

SEQ ID NO: 1116591 - RNA, 20 nt, Human
gccaagaucacaccaccgca

SEQ ID NO: 1116592 - RNA, 23 nt, Human
gccagggauacccagugauggag

SEQ ID NO: 1116593 - RNA, 24 nt, Human
gccauugcacucuagugugggcaa

SEQ ID NO: 1116594 - RNA, 24 nt, Human
gcccguaaucccagcuacuuggga

SEQ ID NO: 1116595 - RNA, 19 nt, Human
gcggggccucaggcagcag

SEQ ID NO: 1116596 - RNA, 20 nt, Human
gcuugaguucaggagcuuga

SEQ ID NO: 1116597 - RNA, 23 nt, Human
ggaggaggaggacgcuguggugg

SEQ ID NO: 1116598 - RNA, 20 nt, Human
ggagguuguagugaaccgag

SEQ ID NO: 1116599 - RNA, 24 nt, Human
ggagguuguagugaaccgagguug

SEQ ID NO: 1116600 - RNA, 19 nt, Human
ggcucuagaaaaauccugg

SEQ ID NO: 1116601 - RNA, 20 nt, Human
ggcuguguaccuugcugggg

SEQ ID NO: 1116602 - RNA, 19 nt, Human
ggggagccagguguggcag

SEQ ID NO: 1116603 - RNA, 24 nt, Human
gggugugguggcgcaugcccguaa

SEQ ID NO: 1116604 - RNA, 21 nt, Human
ggucgggaguuugagacuagc

SEQ ID NO: 1116605 - RNA, 24 nt, Human
gguggcgcaugcccguaaucccag

SEQ ID NO: 1116606 - RNA, 21 nt, Human
gguguaaccagagguguacag

SEQ ID NO: 1116607 - RNA, 23 nt, Human
guagaagguguggugccagaucu

SEQ ID NO: 1116608 - RNA, 19 nt, Human
guuggugaugaugcggugg

SEQ ID NO: 1116609 - RNA, 19 nt, Human
guuuauacaucaucccuuc

SEQ ID NO: 1116610 - RNA, 22 nt, Human
uaaaaauacaaaauuagccggg

SEQ ID NO: 1116611 - RNA, 23 nt, Human
uaaaaauacaaaauuagccgggu

SEQ ID NO: 1116612 - RNA, 21 nt, Human
uaaaagaaugaauaaauuuac

SEQ ID NO: 1116613 - RNA, 28 nt, Human
uaaauuuacagguguaaauguaaaccgg

SEQ ID NO: 1116614 - RNA, 24 nt, Human
uaacaaagucaaaaucagcaccaa

SEQ ID NO: 1116615 - RNA, 19 nt, Human
uaaggagacugcaggucac

SEQ ID NO: 1116616 - RNA, 25 nt, Human
uacaagcuucaaggaccaguucuuu

SEQ ID NO: 1116617 - RNA, 22 nt, Human
uagagcgaaacucugucucaaa

SEQ ID NO: 1116618 - RNA, 25 nt, Human
uagaucuucuccagggaggaggagg

SEQ ID NO: 1116619 - RNA, 18 nt, Human
uagcaugagguguaugca

SEQ ID NO: 1116620 - RNA, 24 nt, Human
uagccugaccaacauggagaaacc

SEQ ID NO: 1116621 - RNA, 20 nt, Human
uagcugggcucccugaagau

SEQ ID NO: 1116622 - RNA, 24 nt, Human
ucacacagacccaccaagccacag

SEQ ID NO: 1116623 - RNA, 23 nt, Human
ucacaccugcaaucccagcacuu

SEQ ID NO: 1116624 - RNA, 19 nt, Human
ucaccuaaggucgggaguu

SEQ ID NO: 1116625 - RNA, 21 nt, Human
uccgcagcuucuccuugaugu

SEQ ID NO: 1116626 - RNA, 23 nt, Human
uccuggaacacugagcucucuga

SEQ ID NO: 1116627 - RNA, 22 nt, Human
ucucuacuaaaaauacaaaauu

SEQ ID NO: 1116628 - RNA, 23 nt, Human
ucugucucaaaaaaaaaaaaaaa

SEQ ID NO: 1116629 - RNA, 21 nt, Human
ucuucuuucuguuggcccugg

SEQ ID NO: 1116630 - RNA, 22 nt, Human
ugaaccgagguugcgccauugc

SEQ ID NO: 1116631 - RNA, 20 nt, Human
ugaagcaggagaaucacuug

SEQ ID NO: 1116632 - RNA, 22 nt, Human
ugaagcaggagaaucacuugga

SEQ ID NO: 1116633 - RNA, 24 nt, Human
ugaagcaggagaaucacuuggacc

SEQ ID NO: 1116634 - RNA, 24 nt, Human
ugaauaaauuuacagguguaaaug

SEQ ID NO: 1116635 - RNA, 24 nt, Human
ugaccaacauggagaaacccuguc

SEQ ID NO: 1116636 - RNA, 24 nt, Human
ugagacuagccugaccaacaugga

SEQ ID NO: 1116637 - RNA, 23 nt, Human
ugagcucucugacaccuuaguac

SEQ ID NO: 1116638 - RNA, 23 nt, Human
ugagugggugaguuacauuucug

SEQ ID NO: 1116639 - RNA, 24 nt, Human
ugcaucaccuaaggucgggaguuu

SEQ ID NO: 1116640 - RNA, 24 nt, Human
ugcccguaaucccagcuacuuggg

SEQ ID NO: 1116641 - RNA, 19 nt, Human
uggaaaaccaaaauuugug

SEQ ID NO: 1116642 - RNA, 20 nt, Human
uggaauggcugggcacagug

SEQ ID NO: 1116643 - RNA, 19 nt, Human
uggacccaggaggcggagg

SEQ ID NO: 1116644 - RNA, 20 nt, Human
uggcuguguaccuugcuggg

SEQ ID NO: 1116645 - RNA, 24 nt, Human
ugggaggcugaagcaggagaauca

SEQ ID NO: 1116646 - RNA, 19 nt, Human
uggugccagaucuucucca

SEQ ID NO: 1116647 - RNA, 24 nt, Human
ugguggcgcaugcccguaauccca

SEQ ID NO: 1116648 - RNA, 25 nt, Human
ugguuggucaggugccagucaucca

SEQ ID NO: 1116649 - RNA, 21 nt, Human
uguaugcauuugccaggggca

SEQ ID NO: 1116650 - RNA, 18 nt, Human
uuagccgggugugguggc

SEQ ID NO: 1116651 - RNA, 19 nt, Human
uuagccgggugugguggcg

SEQ ID NO: 1116652 - RNA, 24 nt, Human
uuagccgggugugguggcgcaugc

SEQ ID NO: 1116653 - RNA, 21 nt, Human
uugcuugaguucaggagcuug

SEQ ID NO: 1116654 - RNA, 24 nt, Human
uuggacccaggaggcggagguugu

SEQ ID NO: 1116655 - RNA, 25 nt, Human
uugggaggcugaagcaggagaauca

SEQ ID NO: 1116656 - RNA, 22 nt, Human
uuguagugaaccgagguugcgc

SEQ ID NO: 1116657 - RNA, 18 nt, Human
aaaggucccugggacuuc

SEQ ID NO: 1116658 - RNA, 24 nt, Human
aaaugguccccuccaccuucccca

SEQ ID NO: 1116659 - RNA, 19 nt, Human
aagcagaagugggaaugag

SEQ ID NO: 1116660 - RNA, 21 nt, Human
aagcagaagugggaaugagga

SEQ ID NO: 1116661 - RNA, 18 nt, Human
aagcagcaaaucaagucc

SEQ ID NO: 1116662 - RNA, 25 nt, Human
aaggagacgcaguucauuacaaaau

SEQ ID NO: 1116663 - RNA, 20 nt, Human
acaguugccaggccugaggc

SEQ ID NO: 1116664 - RNA, 18 nt, Human
agacaagaacaagagucc

SEQ ID NO: 1116665 - RNA, 23 nt, Human
agacagaugcucucucaacucuu

SEQ ID NO: 1116666 - RNA, 20 nt, Human
agaguccacauaagggagau

SEQ ID NO: 1116667 - RNA, 25 nt, Human
agcaagacaugucuucacuggucca

SEQ ID NO: 1116668 - RNA, 20 nt, Human
agcagaagugggaaugagag

SEQ ID NO: 1116669 - RNA, 22 nt, Human
agcagaagugggaaugagaggg

SEQ ID NO: 1116670 - RNA, 18 nt, Human
agcaggugugaaggucag

SEQ ID NO: 1116671 - RNA, 21 nt, Human
agccccuguauucaccggccu

SEQ ID NO: 1116672 - RNA, 20 nt, Human
aguucccagcacaaaggucc

SEQ ID NO: 1116673 - RNA, 20 nt, Human
augguccccuccaccuuccc

SEQ ID NO: 1116674 - RNA, 21 nt, Human
auuugucucugcugugggugu

SEQ ID NO: 1116675 - RNA, 23 nt, Human
caagaacaagaguccacauaagg

SEQ ID NO: 1116676 - RNA, 18 nt, Human
caagggcuguacaugugu

SEQ ID NO: 1116677 - RNA, 19 nt, Human
cacacugcucccaucaccu

SEQ ID NO: 1116678 - RNA, 21 nt, Human
caccggccucucccugagucc

SEQ ID NO: 1116679 - RNA, 18 nt, Human
cagaugugcagcaaacag

SEQ ID NO: 1116680 - RNA, 20 nt, Human
caugcaguacugcccucagg

SEQ ID NO: 1116681 - RNA, 26 nt, Human
ccagauaccaggcuggacacugcacc

SEQ ID NO: 1116682 - RNA, 25 nt, Human
ccaugcacacugcucccaucaccuc

SEQ ID NO: 1116683 - RNA, 18 nt, Human
ccaugcaguacugcccuc

SEQ ID NO: 1116684 - RNA, 20 nt, Human
cccaccccacucucagggga

SEQ ID NO: 1116685 - RNA, 24 nt, Human
cccaccccacucucaggggaucgc

SEQ ID NO: 1116686 - RNA, 19 nt, Human
cccaugcacacugcuccca

SEQ ID NO: 1116687 - RNA, 22 nt, Human
ccccccuaaaguccugaucgcu

SEQ ID NO: 1116688 - RNA, 29 nt, Human
ccccuaaaguccugaucgcuaaggcaggg

SEQ ID NO: 1116689 - RNA, 19 nt, Human
ccccucuacucaccucugc

SEQ ID NO: 1116690 - RNA, 24 nt, Human
cccuaaaguccugaucgcuaaggc

SEQ ID NO: 1116691 - RNA, 23 nt, Human
cccucaggugcccauggggccag

SEQ ID NO: 1116692 - RNA, 20 nt, Human
cccugggacuucugugugca

SEQ ID NO: 1116693 - RNA, 23 nt, Human
ccggccucucccugagucccucc

SEQ ID NO: 1116694 - RNA, 20 nt, Human
ccuauggagacgaaggcagg

SEQ ID NO: 1116695 - RNA, 20 nt, Human
ccucacacuacagaggugag

SEQ ID NO: 1116696 - RNA, 20 nt, Human
ccuccuccaucaccacccac

SEQ ID NO: 1116697 - RNA, 23 nt, Human
ccuccuccaucaccacccacaga

SEQ ID NO: 1116698 - RNA, 24 nt, Human
ccucgaaugcgcccugccugauuc

SEQ ID NO: 1116699 - RNA, 24 nt, Human
ccugagucccuccuccaucaccac

SEQ ID NO: 1116700 - RNA, 21 nt, Human
ccuuggaagcccccaggcccc

SEQ ID NO: 1116701 - RNA, 23 nt, Human
cgaagcuaggcucugccaggccc

SEQ ID NO: 1116702 - RNA, 22 nt, Human
cggccucucccugagucccucc

SEQ ID NO: 1116703 - RNA, 21 nt, Human
cgggggcaagggcuguacaug

SEQ ID NO: 1116704 - RNA, 21 nt, Human
cuaaaguccugaucgcuaagg

SEQ ID NO: 1116705 - RNA, 25 nt, Human
cuccuccaucaccacccacagaccc

SEQ ID NO: 1116706 - RNA, 23 nt, Human
cucugaaaugguccccuccaccu

SEQ ID NO: 1116707 - RNA, 19 nt, Human
cugcccaccccacucucag

SEQ ID NO: 1116708 - RNA, 21 nt, Human
cuucccguucucucuccuucc

SEQ ID NO: 1116709 - RNA, 24 nt, Human
cuucuguugugguuugugcagggc

SEQ ID NO: 1116710 - RNA, 19 nt, Human
cuuucaguucccagcacaa

SEQ ID NO: 1116711 - RNA, 19 nt, Human
gaaccugcccaccccacuc

SEQ ID NO: 1116712 - RNA, 23 nt, Human
gaagcccccaggccccucuacuc

SEQ ID NO: 1116713 - RNA, 19 nt, Human
gaccuggggccuuggaagc

SEQ ID NO: 1116714 - RNA, 20 nt, Human
gcagcaaacaggccuucagg

SEQ ID NO: 1116715 - RNA, 24 nt, Human
gcauugccaagcagaagugggaau

SEQ ID NO: 1116716 - RNA, 23 nt, Human
gccaggggccgcaggcagggggg

SEQ ID NO: 1116717 - RNA, 22 nt, Human
gccugccucgccaccucuggcc

SEQ ID NO: 1116718 - RNA, 19 nt, Human
gcuuucugucagacugcag

SEQ ID NO: 1116719 - RNA, 21 nt, Human
ggccccagagagagcuggagg

SEQ ID NO: 1116720 - RNA, 21 nt, Human
ggccugaggcauccugggcuc

SEQ ID NO: 1116721 - RNA, 21 nt, Human
gggagcaggugugaaggucag

SEQ ID NO: 1116722 - RNA, 19 nt, Human
gggcaggagucagggcaga

SEQ ID NO: 1116723 - RNA, 19 nt, Human
gggccgggggcaagggcug

SEQ ID NO: 1116724 - RNA, 19 nt, Human
ggugcaacuggcuggggcu

SEQ ID NO: 1116725 - RNA, 22 nt, Human
guacugcccucaggugcccaug

SEQ ID NO: 1116726 - RNA, 24 nt, Human
gugggauggaggaacuccuggugc

SEQ ID NO: 1116727 - RNA, 24 nt, Human
uaaggagacgcaguucauuacaaa

SEQ ID NO: 1116728 - RNA, 25 nt, Human
uaagggagauggagagcauugccaa

SEQ ID NO: 1116729 - RNA, 24 nt, Human
ucaacucuugccucaauuugucuc

SEQ ID NO: 1116730 - RNA, 23 nt, Human
ucaccagacagaugcucucucaa

SEQ ID NO: 1116731 - RNA, 26 nt, Human
ucaccggccucucccugagucccucc

SEQ ID NO: 1116732 - RNA, 22 nt, Human
ucaccucaccagacagaugcuc

SEQ ID NO: 1116733 - RNA, 20 nt, Human
ucagggcgacaggguccucc

SEQ ID NO: 1116734 - RNA, 25 nt, Human
uccaucaccacccacagacccucac

SEQ ID NO: 1116735 - RNA, 23 nt, Human
uccccacucuuucaguucccagc

SEQ ID NO: 1116736 - RNA, 22 nt, Human
ucccguucucucuccuuccuca

SEQ ID NO: 1116737 - RNA, 19 nt, Human
ucccugggacuucugugug

SEQ ID NO: 1116738 - RNA, 18 nt, Human
uccuauggagacgaaggc

SEQ ID NO: 1116739 - RNA, 19 nt, Human
uccucauacuugucacagu

SEQ ID NO: 1116740 - RNA, 19 nt, Human
uccuccaucaccacccaca

SEQ ID NO: 1116741 - RNA, 23 nt, Human
uccuccaucaccacccacagacc

SEQ ID NO: 1116742 - RNA, 19 nt, Human
uccugaucgcuaaggcagg

SEQ ID NO: 1116743 - RNA, 18 nt, Human
ucucuggggagcaggugu

SEQ ID NO: 1116744 - RNA, 28 nt, Human
ucucuggggagcaggugugacguaaacg

SEQ ID NO: 1116745 - RNA, 25 nt, Human
ucugcuguggguguggagaguggga

SEQ ID NO: 1116746 - RNA, 20 nt, Human
ucuucacugguccaagcacc

SEQ ID NO: 1116747 - RNA, 22 nt, Human
ucuuugaagaggccccccuaaa

SEQ ID NO: 1116748 - RNA, 23 nt, Human
ugaaggucaggggacuuagucca

SEQ ID NO: 1116749 - RNA, 21 nt, Human
ugaaguuuucagccccagggu

SEQ ID NO: 1116750 - RNA, 22 nt, Human
ugaggcauccugggcucuuccc

SEQ ID NO: 1116751 - RNA, 20 nt, Human
ugaguaagcagggaugguuc

SEQ ID NO: 1116752 - RNA, 19 nt, Human
ugauucccuucccguucuc

SEQ ID NO: 1116753 - RNA, 20 nt, Human
ugccaggccugaggcauccu

SEQ ID NO: 1116754 - RNA, 21 nt, Human
ugccaggccugaggcauccug

SEQ ID NO: 1116755 - RNA, 24 nt, Human
ugccugagccucucucacagcuga

SEQ ID NO: 1116756 - RNA, 22 nt, Human
ugcucugccugagccucucuca

SEQ ID NO: 1116757 - RNA, 24 nt, Human
ugcucugccugagccucucucaca

SEQ ID NO: 1116758 - RNA, 21 nt, Human
ugggauggaggaacuccuggu

SEQ ID NO: 1116759 - RNA, 24 nt, Human
uggggccaggggccgcaggcaggg

SEQ ID NO: 1116760 - RNA, 19 nt, Human
ugguagcccugagguugcc

SEQ ID NO: 1116761 - RNA, 25 nt, Human
ugugugcaacuucuguugugguuug

SEQ ID NO: 1116762 - RNA, 21 nt, Human
uucccguucucucuccuuccu

SEQ ID NO: 1116763 - RNA, 23 nt, Human
uugucacaguugccaggccugag

SEQ ID NO: 1116764 - RNA, 23 nt, Human
agacaagcacaugagccccgugc

SEQ ID NO: 1116765 - RNA, 19 nt, Human
cagcacagggcccagugga

SEQ ID NO: 1116766 - RNA, 26 nt, Human
cagcacagggcccaguggaggccgcc

SEQ ID NO: 1116767 - RNA, 24 nt, Human
ccacaggucuuuauuccaagaccc

SEQ ID NO: 1116768 - RNA, 20 nt, Human
ccaguggaggccgcccuucu

SEQ ID NO: 1116769 - RNA, 24 nt, Human
guggaggccgcccuucuggggagc

SEQ ID NO: 1116770 - RNA, 23 nt, Human
aaaagcugaaaauuccaaaaacc

SEQ ID NO: 1116771 - RNA, 24 nt, Human
aaaccagagcacaaaagcugaaaa

SEQ ID NO: 1116772 - RNA, 24 nt, Human
aaagugcugggauuacaggcguga

SEQ ID NO: 1116773 - RNA, 18 nt, Human
aaccacaaagguggggag

SEQ ID NO: 1116774 - RNA, 19 nt, Human
aagugcugggauuacaggc

SEQ ID NO: 1116775 - RNA, 19 nt, Human
aagugcugggauuacaggc

SEQ ID NO: 1116776 - RNA, 26 nt, Human
aagugcugggauuacaggcgugagcc

SEQ ID NO: 1116777 - RNA, 26 nt, Human
acaaagguggggagaaaccagagcac

SEQ ID NO: 1116778 - RNA, 19 nt, Human
acaggcaccugccaccacg

SEQ ID NO: 1116779 - RNA, 18 nt, Human
accacaaagguggggaga

SEQ ID NO: 1116780 - RNA, 24 nt, Human
accuugugauccgcccaccucggc

SEQ ID NO: 1116781 - RNA, 19 nt, Human
acucuguuagccaggaugg

SEQ ID NO: 1116782 - RNA, 18 nt, Human
acugcaagcuccgccucc

SEQ ID NO: 1116783 - RNA, 18 nt, Human
agagcacaaaagcugaaa

SEQ ID NO: 1116784 - RNA, 20 nt, Human
agcaauggaacaaagcagga

SEQ ID NO: 1116785 - RNA, 19 nt, Human
aguagagaugggguuucac

SEQ ID NO: 1116786 - RNA, 18 nt, Human
aguagcugggauuacagg

SEQ ID NO: 1116787 - RNA, 20 nt, Human
augggguuucacucuguuag

SEQ ID NO: 1116788 - RNA, 21 nt, Human
auucuccugccucagccuccc

SEQ ID NO: 1116789 - RNA, 19 nt, Human
caaagaccaaggguagaua

SEQ ID NO: 1116790 - RNA, 25 nt, Human
caaagaccaaggguagauaaaacca

SEQ ID NO: 1116791 - RNA, 24 nt, Human
caaagugcugggauuacaggcgug

SEQ ID NO: 1116792 - RNA, 25 nt, Human
caccacguccggcuaauuuuuugua

SEQ ID NO: 1116793 - RNA, 24 nt, Human
caccucggccucccaaagugcugg

SEQ ID NO: 1116794 - RNA, 22 nt, Human
cacgccauucuccugccucagc

SEQ ID NO: 1116795 - RNA, 24 nt, Human
cacucuguuagccaggauggucuc

SEQ ID NO: 1116796 - RNA, 22 nt, Human
cagcuccucgccagcaauggaa

SEQ ID NO: 1116797 - RNA, 21 nt, Human
caggcaccugccaccacgucc

SEQ ID NO: 1116798 - RNA, 25 nt, Human
caguagcugggauuacaggcaccug

SEQ ID NO: 1116799 - RNA, 22 nt, Human
ccaaagugcugggauuacaggc

SEQ ID NO: 1116800 - RNA, 22 nt, Human
ccaaagugcugggauuacaggc

SEQ ID NO: 1116801 - RNA, 24 nt, Human
ccaaagugcugggauuacaggcgu

SEQ ID NO: 1116802 - RNA, 20 nt, Human
ccaccacguccggcuaauuu

SEQ ID NO: 1116803 - RNA, 22 nt, Human
ccaguagcugggauuacaggca

SEQ ID NO: 1116804 - RNA, 23 nt, Human
cccaguagcugggauuacaggca

SEQ ID NO: 1116805 - RNA, 23 nt, Human
ccccaguagcugggauuacaggc

SEQ ID NO: 1116806 - RNA, 24 nt, Human
ccucccggguucacgccauucucc

SEQ ID NO: 1116807 - RNA, 19 nt, Human
cgccucccggguucacgcc

SEQ ID NO: 1116808 - RNA, 24 nt, Human
cucagccuccccaguagcugggau

SEQ ID NO: 1116809 - RNA, 21 nt, Human
cucccggguucacgccauucu

SEQ ID NO: 1116810 - RNA, 24 nt, Human
cuccuccaaaggaucgcagcuccc

SEQ ID NO: 1116811 - RNA, 22 nt, Human
cuccugaccuugugauccgccc

SEQ ID NO: 1116812 - RNA, 19 nt, Human
cugacaucccuucuccucc

SEQ ID NO: 1116813 - RNA, 22 nt, Human
cugccucagccuccccaguagc

SEQ ID NO: 1116814 - RNA, 23 nt, Human
cugccucagccuccccaguagcu

SEQ ID NO: 1116815 - RNA, 18 nt, Human
gaaaauuccaaaaaccug

SEQ ID NO: 1116816 - RNA, 22 nt, Human
gaccuugugauccgcccaccuc

SEQ ID NO: 1116817 - RNA, 22 nt, Human
gaccuugugauccgcccaccuc

SEQ ID NO: 1116818 - RNA, 24 nt, Human
gaccuugugauccgcccaccucgg

SEQ ID NO: 1116819 - RNA, 18 nt, Human
gauuacaggcgugagcca

SEQ ID NO: 1116820 - RNA, 22 nt, Human
gauuacaggcgugagccaccgc

SEQ ID NO: 1116821 - RNA, 22 nt, Human
gauuacaggcgugagccaccgc

SEQ ID NO: 1116822 - RNA, 24 nt, Human
ggauggucucgaucuccugaccuu

SEQ ID NO: 1116823 - RNA, 18 nt, Human
gggguuucacucuguuag

SEQ ID NO: 1116824 - RNA, 20 nt, Human
ggucucgaucuccugaccuu

SEQ ID NO: 1116825 - RNA, 18 nt, Human
guagcugggauuacaggc

SEQ ID NO: 1116826 - RNA, 24 nt, Human
gugauccgcccaccucggccuccc

SEQ ID NO: 1116827 - RNA, 24 nt, Human
uaauuuuuuguauuuuuaguagag

SEQ ID NO: 1116828 - RNA, 25 nt, Human
uaauuuuuuguauuuuuaguagaga

SEQ ID NO: 1116829 - RNA, 23 nt, Human
uacaggcaccugccaccacgucc

SEQ ID NO: 1116830 - RNA, 23 nt, Human
uacaggcgugagccaccgcgccc

SEQ ID NO: 1116831 - RNA, 19 nt, Human
uaguagagaugggguuuca

SEQ ID NO: 1116832 - RNA, 24 nt, Human
uaguagagaugggguuucacucug

SEQ ID NO: 1116833 - RNA, 24 nt, Human
ucacucuguuagccaggauggucu

SEQ ID NO: 1116834 - RNA, 18 nt, Human
ucacugcaagcuccgccu

SEQ ID NO: 1116835 - RNA, 19 nt, Human
ucacugcaagcuccgccuc

SEQ ID NO: 1116836 - RNA, 24 nt, Human
ucacugcaagcuccgccucccggg

SEQ ID NO: 1116837 - RNA, 20 nt, Human
ucagccuccccaguagcugg

SEQ ID NO: 1116838 - RNA, 19 nt, Human
uccaaaaaccugacauccc

SEQ ID NO: 1116839 - RNA, 24 nt, Human
ucccaaagugcugggauuacaggc

SEQ ID NO: 1116840 - RNA, 24 nt, Human
uccccaguagcugggauuacaggc

SEQ ID NO: 1116841 - RNA, 21 nt, Human
ucccggguucacgccauucuc

SEQ ID NO: 1116842 - RNA, 24 nt, Human
ucccggguucacgccauucuccug

SEQ ID NO: 1116843 - RNA, 20 nt, Human
ucccuucuccuccaaaggau

SEQ ID NO: 1116844 - RNA, 18 nt, Human
ucggccucccaaagugcu

SEQ ID NO: 1116845 - RNA, 25 nt, Human
ucuccugccucagccuccccaguag

SEQ ID NO: 1116846 - RNA, 22 nt, Human
ugaaaauuccaaaaaccugaca

SEQ ID NO: 1116847 - RNA, 22 nt, Human
ugacgcagugcagacacagauc

SEQ ID NO: 1116848 - RNA, 24 nt, Human
ugauccgcccaccucggccuccca

SEQ ID NO: 1116849 - RNA, 21 nt, Human
ugcagacacagaucuugugua

SEQ ID NO: 1116850 - RNA, 24 nt, Human
ugccucagccuccccaguagcugg

SEQ ID NO: 1116851 - RNA, 24 nt, Human
ugcugggauuacaggcgugagcca

SEQ ID NO: 1116852 - RNA, 21 nt, Human
ugggauuacaggcaccugcca

SEQ ID NO: 1116853 - RNA, 22 nt, Human
ugggauuacaggcaccugccac

SEQ ID NO: 1116854 - RNA, 24 nt, Human
ugggauuacaggcaccugccacca

SEQ ID NO: 1116855 - RNA, 18 nt, Human
ugggauuacaggcgugag

SEQ ID NO: 1116856 - RNA, 19 nt, Human
ugggauuacaggcgugagc

SEQ ID NO: 1116857 - RNA, 21 nt, Human
ugggauuacaggcgugagcca

SEQ ID NO: 1116858 - RNA, 22 nt, Human
ugggauuacaggcgugagccac

SEQ ID NO: 1116859 - RNA, 23 nt, Human
ugggauuacaggcgugagccacc

SEQ ID NO: 1116860 - RNA, 24 nt, Human
ugggauuacaggcgugagccaccg

SEQ ID NO: 1116861 - RNA, 22 nt, Human
uggggagaaaccagagcacaaa

SEQ ID NO: 1116862 - RNA, 24 nt, Human
ugggguuucacucuguuagccagg

SEQ ID NO: 1116863 - RNA, 18 nt, Human
uuaguagagaugggguuu

SEQ ID NO: 1116864 - RNA, 21 nt, Human
uuaguagagaugggguuucac

SEQ ID NO: 1116865 - RNA, 25 nt, Human
uuaguagagaugggguuucacucug

SEQ ID NO: 1116866 - RNA, 25 nt, Human
uuccaaaaaccugacaucccuucuc

SEQ ID NO: 1116867 - RNA, 23 nt, Human
uuguauuuuuaguagagaugggg

SEQ ID NO: 1116868 - RNA, 24 nt, Human
uuuuuaguagagaugggguuucac

SEQ ID NO: 1116869 - RNA, 21 nt, Human
uuuuuguauuuuuaguagaga

SEQ ID NO: 1116870 - RNA, 24 nt, Human
uuuuuuguauuuuuaguagagaug

SEQ ID NO: 1116871 - RNA, 20 nt, Human
aaaaaucucaacccuuaaau

SEQ ID NO: 1116872 - RNA, 24 nt, Human
aaacauuacucugcuauccaauuc

SEQ ID NO: 1116873 - RNA, 18 nt, Human
aaaucauuuccaaacuag

SEQ ID NO: 1116874 - RNA, 18 nt, Human
aaaugaggcuggaaaaau

SEQ ID NO: 1116875 - RNA, 21 nt, Human
aaauuggugaagagccccaca

SEQ ID NO: 1116876 - RNA, 21 nt, Human
aauagacuucuuucccuaauu

SEQ ID NO: 1116877 - RNA, 19 nt, Human
acucugcuauccaauucuc

SEQ ID NO: 1116878 - RNA, 20 nt, Human
agacucccuucaccuaagag

SEQ ID NO: 1116879 - RNA, 21 nt, Human
augauacuucuguccuaccug

SEQ ID NO: 1116880 - RNA, 18 nt, Human
augucuucugcuuucagc

SEQ ID NO: 1116881 - RNA, 22 nt, Human
auuaguuaggggguagggauga

SEQ ID NO: 1116882 - RNA, 20 nt, Human
caaaagcagagacucccuuc

SEQ ID NO: 1116883 - RNA, 22 nt, Human
cacagagauccggaaugcagua

SEQ ID NO: 1116884 - RNA, 24 nt, Human
cagccucaucugacucuggauaau

SEQ ID NO: 1116885 - RNA, 18 nt, Human
caggggguccuccguguc

SEQ ID NO: 1116886 - RNA, 21 nt, Human
ccacagagauccggaaugcag

SEQ ID NO: 1116887 - RNA, 18 nt, Human
ccaggccggcugcugucu

SEQ ID NO: 1116888 - RNA, 21 nt, Human
cccccagguccccaggccggc

SEQ ID NO: 1116889 - RNA, 24 nt, Human
cccccagguccccaggccggcugc

SEQ ID NO: 1116890 - RNA, 22 nt, Human
ccucuaaacuuauaagggugaa

SEQ ID NO: 1116891 - RNA, 21 nt, Human
ccuuauucugugauaauuuca

SEQ ID NO: 1116892 - RNA, 24 nt, Human
cuaaugaucaugucuucugcuuug

SEQ ID NO: 1116893 - RNA, 22 nt, Human
cuacucugugggucagcuccag

SEQ ID NO: 1116894 - RNA, 19 nt, Human
cucugcuauccaauucucc

SEQ ID NO: 1116895 - RNA, 21 nt, Human
cuucaaaagcagagacucccu

SEQ ID NO: 1116896 - RNA, 21 nt, Human
gcagagacucccuucaccuaa

SEQ ID NO: 1116897 - RNA, 22 nt, Human
gcagagacucccuucaccuaag

SEQ ID NO: 1116898 - RNA, 18 nt, Human
gcugcugucucacugagg

SEQ ID NO: 1116899 - RNA, 23 nt, Human
ggaaaaauuggugaagagcccca

SEQ ID NO: 1116900 - RNA, 23 nt, Human
ggucagcuccagccagggggucc

SEQ ID NO: 1116901 - RNA, 20 nt, Human
gugauaauuucaacccugga

SEQ ID NO: 1116902 - RNA, 23 nt, Human
uaccugugccauucuucaaaagc

SEQ ID NO: 1116903 - RNA, 20 nt, Human
uaguuaggggguagggauga

SEQ ID NO: 1116904 - RNA, 21 nt, Human
ucacugaggucagggaaccag

SEQ ID NO: 1116905 - RNA, 20 nt, Human
ucauuguuucacgugucucc

SEQ ID NO: 1116906 - RNA, 19 nt, Human
uccaaacuaguaaugggac

SEQ ID NO: 1116907 - RNA, 22 nt, Human
ucugcaguaaauggauuagaac

SEQ ID NO: 1116908 - RNA, 19 nt, Human
ugaaucaagaaagcagaac

SEQ ID NO: 1116909 - RNA, 20 nt, Human
uggcuaaugaucaugucuuc

SEQ ID NO: 1116910 - RNA, 20 nt, Human
ugggucagcuccagccaggg

SEQ ID NO: 1116911 - RNA, 22 nt, Human
ugucuccuaggcccugcuuccu

SEQ ID NO: 1116912 - RNA, 22 nt, Human
ugucuuccuccuuugaguuucu

SEQ ID NO: 1116913 - RNA, 21 nt, Human
ugucuucugcuuucagcucuu

SEQ ID NO: 1116914 - RNA, 19 nt, Human
ugugccauucuucaaaagc

SEQ ID NO: 1116915 - RNA, 23 nt, Human
uuaaugauucuuuacauucuucu

SEQ ID NO: 1116916 - RNA, 21 nt, Human
uuccagaggucaaacauuacu

SEQ ID NO: 1116917 - RNA, 18 nt, Human
uuuuuuuuuuuuuuuuug

SEQ ID NO: 1116918 - RNA, 23 nt, Human
uuuuuuuuuuuuuuuuugaugug

SEQ ID NO: 1116919 - RNA, 24 nt, Human
aaagugcugggauuacaggcguga

SEQ ID NO: 1116920 - RNA, 19 nt, Human
aagugcugggauuacaggc

SEQ ID NO: 1116921 - RNA, 19 nt, Human
aagugcugggauuacaggc

SEQ ID NO: 1116922 - RNA, 26 nt, Human
aagugcugggauuacaggcgugagcc

SEQ ID NO: 1116923 - RNA, 24 nt, Human
acgccuccaccucccaaagugcug

SEQ ID NO: 1116924 - RNA, 18 nt, Human
agugcugggauuacaggc

SEQ ID NO: 1116925 - RNA, 18 nt, Human
augggguuucaccauguu

SEQ ID NO: 1116926 - RNA, 19 nt, Human
augggguuucaccauguua

SEQ ID NO: 1116927 - RNA, 24 nt, Human
augggguuucaccauguuacucag

SEQ ID NO: 1116928 - RNA, 24 nt, Human
caaagugcugggauuacaggcgug

SEQ ID NO: 1116929 - RNA, 18 nt, Human
caccaugccuggccuagg

SEQ ID NO: 1116930 - RNA, 18 nt, Human
caccauguuacucaggau

SEQ ID NO: 1116931 - RNA, 22 nt, Human
caccauguuacucaggaugguc

SEQ ID NO: 1116932 - RNA, 24 nt, Human
caccauguuacucaggauggucuc

SEQ ID NO: 1116933 - RNA, 23 nt, Human
cagaugauccgcacgccuccacc

SEQ ID NO: 1116934 - RNA, 22 nt, Human
ccaaagugcugggauuacaggc

SEQ ID NO: 1116935 - RNA, 22 nt, Human
ccaaagugcugggauuacaggc

SEQ ID NO: 1116936 - RNA, 24 nt, Human
ccaaagugcugggauuacaggcgu

SEQ ID NO: 1116937 - RNA, 23 nt, Human
ccaccaugccuggccuaggugac

SEQ ID NO: 1116938 - RNA, 21 nt, Human
ccgcacgccuccaccucccaa

SEQ ID NO: 1116939 - RNA, 21 nt, Human
cucagaugauccgcacgccuc

SEQ ID NO: 1116940 - RNA, 18 nt, Human
gagaugggguuucaccau

SEQ ID NO: 1116941 - RNA, 20 nt, Human
gagaugggguuucaccaugu

SEQ ID NO: 1116942 - RNA, 18 nt, Human
gauuacaggcgugagcca

SEQ ID NO: 1116943 - RNA, 21 nt, Human
gauuacaggcgugagccacca

SEQ ID NO: 1116944 - RNA, 24 nt, Human
gauuacaggcgugagccaccaugc

SEQ ID NO: 1116945 - RNA, 23 nt, Human
gccuccaccucccaaagugcugg

SEQ ID NO: 1116946 - RNA, 24 nt, Human
ggauggucucaaacuccugaucuc

SEQ ID NO: 1116947 - RNA, 24 nt, Human
ggauuacaggcgugagccaccaug

SEQ ID NO: 1116948 - RNA, 22 nt, Human
gggguuucaccauguuacucag

SEQ ID NO: 1116949 - RNA, 24 nt, Human
gguuucaccauguuacucaggaug

SEQ ID NO: 1116950 - RNA, 19 nt, Human
guagagaugggguuucacc

SEQ ID NO: 1116951 - RNA, 21 nt, Human
guagagaugggguuucaccau

SEQ ID NO: 1116952 - RNA, 22 nt, Human
guagagaugggguuucaccaug

SEQ ID NO: 1116953 - RNA, 23 nt, Human
guagagaugggguuucaccaugu

SEQ ID NO: 1116954 - RNA, 24 nt, Human
uaauuuuuguauuuuucguagaga

SEQ ID NO: 1116955 - RNA, 22 nt, Human
uacaggcgugagccaccaugcc

SEQ ID NO: 1116956 - RNA, 22 nt, Human
uacaggcgugagccaccaugcc

SEQ ID NO: 1116957 - RNA, 23 nt, Human
uacaggcgugagccaccaugccu

SEQ ID NO: 1116958 - RNA, 22 nt, Human
uagagaugggguuucaccaugu

SEQ ID NO: 1116959 - RNA, 24 nt, Human
ucccaaagugcugggauuacaggc

SEQ ID NO: 1116960 - RNA, 23 nt, Human
uccgcacgccuccaccucccaaa

SEQ ID NO: 1116961 - RNA, 21 nt, Human
ucguagagaugggguuucacc

SEQ ID NO: 1116962 - RNA, 24 nt, Human
ucguagagaugggguuucaccaug

SEQ ID NO: 1116963 - RNA, 26 nt, Human
ugauccgcacgccuccaccucccaaa

SEQ ID NO: 1116964 - RNA, 24 nt, Human
ugaucucagaugauccgcacgccu

SEQ ID NO: 1116965 - RNA, 25 nt, Human
ugaucucagaugauccgcacgccuc

SEQ ID NO: 1116966 - RNA, 24 nt, Human
ugcugggauuacaggcgugagcca

SEQ ID NO: 1116967 - RNA, 18 nt, Human
ugggauuacaggcgugag

SEQ ID NO: 1116968 - RNA, 22 nt, Human
ugggauuacaggcgugagccac

SEQ ID NO: 1116969 - RNA, 23 nt, Human
ugggauuacaggcgugagccacc

SEQ ID NO: 1116970 - RNA, 24 nt, Human
ugggauuacaggcgugagccacca

SEQ ID NO: 1116971 - RNA, 25 nt, Human
ugggauuacaggcgugagccaccau

SEQ ID NO: 1116972 - RNA, 24 nt, Human
ugggguuucaccauguuacucagg

SEQ ID NO: 1116973 - RNA, 24 nt, Human
uucguagagaugggguuucaccau

SEQ ID NO: 1116974 - RNA, 20 nt, Human
uuucaccauguuacucagga

SEQ ID NO: 1116975 - RNA, 24 nt, Human
uuuuucguagagaugggguuucac

SEQ ID NO: 1116976 - RNA, 20 nt, Human
uuuuuguauuuuucguagag

SEQ ID NO: 1116977 - RNA, 23 nt, Human
uuuuuguauuuuucguagagaug

SEQ ID NO: 1116978 - RNA, 23 nt, Human
aaaagccaaagaaacagaaacaa

SEQ ID NO: 1116979 - RNA, 20 nt, Human
aaagaaacagaaacaacccc

SEQ ID NO: 1116980 - RNA, 26 nt, Human
aaagaugugcauuccccucuuccucc

SEQ ID NO: 1116981 - RNA, 24 nt, Human
aagcuaccagaagucggcuaacaa

SEQ ID NO: 1116982 - RNA, 24 nt, Human
aaggauuucggggaacacaagguu

SEQ ID NO: 1116983 - RNA, 19 nt, Human
acaacccauguggggcugu

SEQ ID NO: 1116984 - RNA, 23 nt, Human
acacaagguuagacacuuucugg

SEQ ID NO: 1116985 - RNA, 19 nt, Human
acacaauaaauggcucauc

SEQ ID NO: 1116986 - RNA, 20 nt, Human
acucggcguggugggcuggg

SEQ ID NO: 1116987 - RNA, 21 nt, Human
acugggcuguugcucugguga

SEQ ID NO: 1116988 - RNA, 22 nt, Human
agaaaagccaaagaaacagaaa

SEQ ID NO: 1116989 - RNA, 20 nt, Human
agaaacagaaacaacccaug

SEQ ID NO: 1116990 - RNA, 20 nt, Human
agagggagugcucugggccg

SEQ ID NO: 1116991 - RNA, 18 nt, Human
agcgagaaaagccaaaga

SEQ ID NO: 1116992 - RNA, 21 nt, Human
aggggacuggggcacacugca

SEQ ID NO: 1116993 - RNA, 19 nt, Human
agguggccagggcuggggg

SEQ ID NO: 1116994 - RNA, 24 nt, Human
aguccccacaagccaccuuaggcu

SEQ ID NO: 1116995 - RNA, 23 nt, Human
auccaggggacuggggcacacug

SEQ ID NO: 1116996 - RNA, 21 nt, Human
caaagugugaccagagcccag

SEQ ID NO: 1116997 - RNA, 24 nt, Human
caaccaagaaacuggcgaagcugc

SEQ ID NO: 1116998 - RNA, 22 nt, Human
cacacaagcuacucggcguggu

SEQ ID NO: 1116999 - RNA, 25 nt, Human
cacccuccucgaauucagugacuca

SEQ ID NO: 1117000 - RNA, 20 nt, Human
caccucuggcccacagaguu

SEQ ID NO: 1117001 - RNA, 24 nt, Human
caccuuaggcuuuaaagucaacuu

SEQ ID NO: 1117002 - RNA, 21 nt, Human
caccuuucguucaagcuguuu

SEQ ID NO: 1117003 - RNA, 21 nt, Human
cagagcccaggucugcuucuc

SEQ ID NO: 1117004 - RNA, 22 nt, Human
cagcaguugggggugcgucugg

SEQ ID NO: 1117005 - RNA, 20 nt, Human
cagcggcacccugaccuucc

SEQ ID NO: 1117006 - RNA, 23 nt, Human
cagcggcacccugaccuuccuca

SEQ ID NO: 1117007 - RNA, 25 nt, Human
cagcuccugaauguacaaagccccu

SEQ ID NO: 1117008 - RNA, 19 nt, Human
caggucugcuucucaaccc

SEQ ID NO: 1117009 - RNA, 21 nt, Human
caucacccccauggcccccgc

SEQ ID NO: 1117010 - RNA, 21 nt, Human
caucagcaagcaucccugcac

SEQ ID NO: 1117011 - RNA, 26 nt, Human
caucgccaggaaacuggggaguaggg

SEQ ID NO: 1117012 - RNA, 18 nt, Human
cauggcccccgccagggc

SEQ ID NO: 1117013 - RNA, 18 nt, Human
cauucaucacccccaugg

SEQ ID NO: 1117014 - RNA, 21 nt, Human
ccaaagugugaccagagccca

SEQ ID NO: 1117015 - RNA, 20 nt, Human
ccagaggagugucccaacca

SEQ ID NO: 1117016 - RNA, 19 nt, Human
cccacaagccaccuuaggc

SEQ ID NO: 1117017 - RNA, 19 nt, Human
cccacagaguuggagccag

SEQ ID NO: 1117018 - RNA, 19 nt, Human
cccacccuccucgaauuca

SEQ ID NO: 1117019 - RNA, 19 nt, Human
ccccauggcccccgccagg

SEQ ID NO: 1117020 - RNA, 18 nt, Human
ccccucuuccucccuccc

SEQ ID NO: 1117021 - RNA, 19 nt, Human
ccccucuuccucccucccc

SEQ ID NO: 1117022 - RNA, 25 nt, Human
ccccucuuccucccuccccgcuccc

SEQ ID NO: 1117023 - RNA, 19 nt, Human
ccccuggugccuacccgug

SEQ ID NO: 1117024 - RNA, 20 nt, Human
ccccuggugccuacccgugg

SEQ ID NO: 1117025 - RNA, 21 nt, Human
ccccuggugccuacccguggu

SEQ ID NO: 1117026 - RNA, 20 nt, Human
cccgcggcugagcagcuccg

SEQ ID NO: 1117027 - RNA, 20 nt, Human
cccgggaggccuccugagcc

SEQ ID NO: 1117028 - RNA, 18 nt, Human
cccucuguccccuuuucc

SEQ ID NO: 1117029 - RNA, 23 nt, Human
cccucuguccccuuuuccuaggc

SEQ ID NO: 1117030 - RNA, 18 nt, Human
ccucaucgccccuccagg

SEQ ID NO: 1117031 - RNA, 21 nt, Human
ccuccagguggccagggcugg

SEQ ID NO: 1117032 - RNA, 20 nt, Human
ccuccagguggccagggcuu

SEQ ID NO: 1117033 - RNA, 19 nt, Human
ccucccauccucaggacug

SEQ ID NO: 1117034 - RNA, 22 nt, Human
ccucccauccucaggacugggc

SEQ ID NO: 1117035 - RNA, 26 nt, Human
ccucucugcagcuccugaauguacaa

SEQ ID NO: 1117036 - RNA, 21 nt, Human
ccugcuccacggcgucacagg

SEQ ID NO: 1117037 - RNA, 18 nt, Human
ccugcuccgggcguggag

SEQ ID NO: 1117038 - RNA, 21 nt, Human
ccuggagaaaauggagucuca

SEQ ID NO: 1117039 - RNA, 19 nt, Human
ccuuugcugagcuuucccu

SEQ ID NO: 1117040 - RNA, 21 nt, Human
cgacucccgcguucggcuccc

SEQ ID NO: 1117041 - RNA, 24 nt, Human
cgagaaaagccaaagaaacagaaa

SEQ ID NO: 1117042 - RNA, 19 nt, Human
cgagcguggaaucccaagg

SEQ ID NO: 1117043 - RNA, 23 nt, Human
cgagcguggaaucccaaggcuaa

SEQ ID NO: 1117044 - RNA, 18 nt, Human
cgcggccuccccggcgcu

SEQ ID NO: 1117045 - RNA, 22 nt, Human
cguuucagcaagcgcguccuga

SEQ ID NO: 1117046 - RNA, 21 nt, Human
cuacaccugagcagacagcag

SEQ ID NO: 1117047 - RNA, 21 nt, Human
cuagcagucccccaccucugg

SEQ ID NO: 1117048 - RNA, 19 nt, Human
cucacaaagccacugccac

SEQ ID NO: 1117049 - RNA, 19 nt, Human
cucacaggacugcauccac

SEQ ID NO: 1117050 - RNA, 20 nt, Human
cuccccgcucccugcucccc

SEQ ID NO: 1117051 - RNA, 19 nt, Human
cucccuccccgcucccugc

SEQ ID NO: 1117052 - RNA, 21 nt, Human
cuccgaggacugcccugcucc

SEQ ID NO: 1117053 - RNA, 18 nt, Human
cugcccugcuccgggcgu

SEQ ID NO: 1117054 - RNA, 21 nt, Human
cuggccaagggcaucaguccc

SEQ ID NO: 1117055 - RNA, 21 nt, Human
gaaaagccaaagaaacagaaa

SEQ ID NO: 1117056 - RNA, 24 nt, Human
gaauucagugacucaggaguggga

SEQ ID NO: 1117057 - RNA, 21 nt, Human
gaccuagcagucccccaccuc

SEQ ID NO: 1117058 - RNA, 24 nt, Human
gcagcagugugggugugugugcgg

SEQ ID NO: 1117059 - RNA, 21 nt, Human
gcagugccguugacgccccgc

SEQ ID NO: 1117060 - RNA, 18 nt, Human
gcauuccccucuuccucc

SEQ ID NO: 1117061 - RNA, 18 nt, Human
gccaggauuagggcaaga

SEQ ID NO: 1117062 - RNA, 21 nt, Human
gcccggcgccccaucaaacua

SEQ ID NO: 1117063 - RNA, 19 nt, Human
gcggccuccccggcgcucc

SEQ ID NO: 1117064 - RNA, 22 nt, Human
ggauuucggggaacacaagguu

SEQ ID NO: 1117065 - RNA, 22 nt, Human
ggcagcgacucccgcguucggc

SEQ ID NO: 1117066 - RNA, 22 nt, Human
ggcguggugggcugggccgaga

SEQ ID NO: 1117067 - RNA, 19 nt, Human
ggcuacaccugagcagaca

SEQ ID NO: 1117068 - RNA, 20 nt, Human
gggcugggggcagguaccgc

SEQ ID NO: 1117069 - RNA, 26 nt, Human
ggggacuggggcacacugcaaggggu

SEQ ID NO: 1117070 - RNA, 22 nt, Human
gguugugguggugcuggggcug

SEQ ID NO: 1117071 - RNA, 22 nt, Human
gugcaguccccacaagccaccu

SEQ ID NO: 1117072 - RNA, 23 nt, Human
guggugcuggggcugccagagga

SEQ ID NO: 1117073 - RNA, 21 nt, Human
gugguggugcuggggcugcca

SEQ ID NO: 1117074 - RNA, 28 nt, Human
gugguuacugugugugugugugugugug

SEQ ID NO: 1117075 - RNA, 21 nt, Human
gugugugugugugugugugug

SEQ ID NO: 1117076 - RNA, 21 nt, Human
gugugugugugugugugugug

SEQ ID NO: 1117077 - RNA, 21 nt, Human
gugugugugugugugugugug

SEQ ID NO: 1117078 - RNA, 21 nt, Human
gugugugugugugugugugug

SEQ ID NO: 1117079 - RNA, 24 nt, Human
guuagucuaucugggcaagccucg

SEQ ID NO: 1117080 - RNA, 18 nt, Human
guuccuaagucagagaaa

SEQ ID NO: 1117081 - RNA, 21 nt, Human
uaacaaaaugaaaaaacuucu

SEQ ID NO: 1117082 - RNA, 20 nt, Human
uaaccaccuuucguucaagc

SEQ ID NO: 1117083 - RNA, 22 nt, Human
uaagcuaccagaagucggcuaa

SEQ ID NO: 1117084 - RNA, 22 nt, Human
uaccgcgcgaccugauuggcgc

SEQ ID NO: 1117085 - RNA, 24 nt, Human
uacucggcguggugggcugggccg

SEQ ID NO: 1117086 - RNA, 23 nt, Human
uaggcacggaugcuucaucuccc

SEQ ID NO: 1117087 - RNA, 23 nt, Human
ucacaggacugcauccacacaag

SEQ ID NO: 1117088 - RNA, 21 nt, Human
ucauccaucagcaagcauccc

SEQ ID NO: 1117089 - RNA, 26 nt, Human
uccaucagcaagcaucccugcacgca

SEQ ID NO: 1117090 - RNA, 27 nt, Human
uccaucagcaagcaucccugcacgcaa

SEQ ID NO: 1117091 - RNA, 21 nt, Human
ucccauccucaggacugggcu

SEQ ID NO: 1117092 - RNA, 23 nt, Human
uccccacaagccaccuuaggcuu

SEQ ID NO: 1117093 - RNA, 22 nt, Human
ucccccagcggcacccugaccu

SEQ ID NO: 1117094 - RNA, 20 nt, Human
ucccuggagaaaauggaguc

SEQ ID NO: 1117095 - RNA, 18 nt, Human
uccuaagucagagaaagg

SEQ ID NO: 1117096 - RNA, 23 nt, Human
uccuaagucagagaaaggauuuc

SEQ ID NO: 1117097 - RNA, 21 nt, Human
uccuagagcuaaugagugacc

SEQ ID NO: 1117098 - RNA, 19 nt, Human
uccugaauguacaaagccc

SEQ ID NO: 1117099 - RNA, 21 nt, Human
ucggaaauucucacuucuugg

SEQ ID NO: 1117100 - RNA, 22 nt, Human
ucggaguuggaaaugaggcugg

SEQ ID NO: 1117101 - RNA, 20 nt, Human
ucguuucagcaagcgcgucc

SEQ ID NO: 1117102 - RNA, 20 nt, Human
ucugcagcuccugaauguac

SEQ ID NO: 1117103 - RNA, 20 nt, Human
ugacagcaguagcuauggua

SEQ ID NO: 1117104 - RNA, 24 nt, Human
ugaccaaagugugaccagagccca

SEQ ID NO: 1117105 - RNA, 21 nt, Human
ugaccagagcccaggucugcu

SEQ ID NO: 1117106 - RNA, 19 nt, Human
ugagaugugauacguucag

SEQ ID NO: 1117107 - RNA, 20 nt, Human
ugagcagacagcaguugggg

SEQ ID NO: 1117108 - RNA, 22 nt, Human
ugagcagcuccgcucgggcagc

SEQ ID NO: 1117109 - RNA, 18 nt, Human
ugcaagggguuguggugg

SEQ ID NO: 1117110 - RNA, 19 nt, Human
ugcauccacacaagcuacu

SEQ ID NO: 1117111 - RNA, 19 nt, Human
ugcccucuguccccuuuuc

SEQ ID NO: 1117112 - RNA, 19 nt, Human
ugccuuaauaguggcgcaa

SEQ ID NO: 1117113 - RNA, 22 nt, Human
ugcgcgcgcgcgcgcgugcgua

SEQ ID NO: 1117114 - RNA, 21 nt, Human
ugcuccgggcguggagccuca

SEQ ID NO: 1117115 - RNA, 20 nt, Human
ugcuggggcugccagaggag

SEQ ID NO: 1117116 - RNA, 22 nt, Human
ugcuggggcugccagaggagug

SEQ ID NO: 1117117 - RNA, 20 nt, Human
uggagcagcggugacucagu

SEQ ID NO: 1117118 - RNA, 23 nt, Human
uggccagggcugggggcagguac

SEQ ID NO: 1117119 - RNA, 19 nt, Human
uggcccccgccagggcagc

SEQ ID NO: 1117120 - RNA, 18 nt, Human
uggcgcaaaagaugugca

SEQ ID NO: 1117121 - RNA, 22 nt, Human
ugggagaccuuuccucucugca

SEQ ID NO: 1117122 - RNA, 22 nt, Human
uggggauuggucacguguuaac

SEQ ID NO: 1117123 - RNA, 23 nt, Human
uggugggcugggccgagagacag

SEQ ID NO: 1117124 - RNA, 22 nt, Human
ugguuacugugugugugugugu

SEQ ID NO: 1117125 - RNA, 22 nt, Human
uguaaggugacaggugccuuaa

SEQ ID NO: 1117126 - RNA, 18 nt, Human
ugugcgcgcgcgcgcgcg

SEQ ID NO: 1117127 - RNA, 24 nt, Human
ugugcgcgcgcgcgcgcgugcgua

SEQ ID NO: 1117128 - RNA, 22 nt, Human
ugugugucugugcgcgcgcgcg

SEQ ID NO: 1117129 - RNA, 18 nt, Human
ugugugugugugucugug

SEQ ID NO: 1117130 - RNA, 21 nt, Human
ugugugugugugugugucugu

SEQ ID NO: 1117131 - RNA, 22 nt, Human
ugugugugugugugugucugug

SEQ ID NO: 1117132 - RNA, 18 nt, Human
ugugugugugugugugug

SEQ ID NO: 1117133 - RNA, 18 nt, Human
ugugugugugugugugug

SEQ ID NO: 1117134 - RNA, 18 nt, Human
ugugugugugugugugug

SEQ ID NO: 1117135 - RNA, 18 nt, Human
ugugugugugugugugug

SEQ ID NO: 1117136 - RNA, 18 nt, Human
ugugugugugugugugug

SEQ ID NO: 1117137 - RNA, 18 nt, Human
ugugugugugugugugug

SEQ ID NO: 1117138 - RNA, 18 nt, Human
ugugugugugugugugug

SEQ ID NO: 1117139 - RNA, 18 nt, Human
ugugugugugugugugug

SEQ ID NO: 1117140 - RNA, 18 nt, Human
ugugugugugugugugug

SEQ ID NO: 1117141 - RNA, 18 nt, Human
ugugugugugugugugug

SEQ ID NO: 1117142 - RNA, 22 nt, Human
ugugugugugugugugugucug

SEQ ID NO: 1117143 - RNA, 22 nt, Human
ugugugugugugugugugugag

SEQ ID NO: 1117144 - RNA, 21 nt, Human
ugugugugugugugugugugu

SEQ ID NO: 1117145 - RNA, 21 nt, Human
ugugugugugugugugugugu

SEQ ID NO: 1117146 - RNA, 21 nt, Human
ugugugugugugugugugugu

SEQ ID NO: 1117147 - RNA, 21 nt, Human
ugugugugugugugugugugu

SEQ ID NO: 1117148 - RNA, 21 nt, Human
ugugugugugugugugugugu

SEQ ID NO: 1117149 - RNA, 21 nt, Human
ugugugugugugugugugugu

SEQ ID NO: 1117150 - RNA, 21 nt, Human
ugugugugugugugugugugu

SEQ ID NO: 1117151 - RNA, 21 nt, Human
ugugugugugugugugugugu

SEQ ID NO: 1117152 - RNA, 21 nt, Human
ugugugugugugugugugugu

SEQ ID NO: 1117153 - RNA, 21 nt, Human
ugugugugugugugugugugu

SEQ ID NO: 1117154 - RNA, 21 nt, Human
ugugugugugugugugugugu

SEQ ID NO: 1117155 - RNA, 21 nt, Human
ugugugugugugugugugugu

SEQ ID NO: 1117156 - RNA, 21 nt, Human
ugugugugugugugugugugu

SEQ ID NO: 1117157 - RNA, 21 nt, Human
ugugugugugugugugugugu

SEQ ID NO: 1117158 - RNA, 21 nt, Human
ugugugugugugugugugugu

SEQ ID NO: 1117159 - RNA, 21 nt, Human
ugugugugugugugugugugu

SEQ ID NO: 1117160 - RNA, 21 nt, Human
ugugugugugugugugugugu

SEQ ID NO: 1117161 - RNA, 21 nt, Human
ugugugugugugugugugugu

SEQ ID NO: 1117162 - RNA, 22 nt, Human
ugugugugugugugugugugug

SEQ ID NO: 1117163 - RNA, 22 nt, Human
ugugugugugugugugugugug

SEQ ID NO: 1117164 - RNA, 22 nt, Human
ugugugugugugugugugugug

SEQ ID NO: 1117165 - RNA, 22 nt, Human
ugugugugugugugugugugug

SEQ ID NO: 1117166 - RNA, 22 nt, Human
uuccccucuuccucccuccccc

SEQ ID NO: 1117167 - RNA, 22 nt, Human
aaaugcuaccuuuaaaaagcac

SEQ ID NO: 1117168 - RNA, 21 nt, Human
accucaagaaggccaaaggga

SEQ ID NO: 1117169 - RNA, 23 nt, Human
acgaagcaggagaguccauuuuu

SEQ ID NO: 1117170 - RNA, 20 nt, Human
agacaguuguggaugguggg

SEQ ID NO: 1117171 - RNA, 19 nt, Human
aguguguggccuugcaccu

SEQ ID NO: 1117172 - RNA, 24 nt, Human
caggagaguccauuuuuaaugaua

SEQ ID NO: 1117173 - RNA, 18 nt, Human
ccucagagucauggcagg

SEQ ID NO: 1117174 - RNA, 20 nt, Human
ccuccauacagcugccucag

SEQ ID NO: 1117175 - RNA, 23 nt, Human
ccuccauacagcugccucaguuc

SEQ ID NO: 1117176 - RNA, 21 nt, Human
cugccucaguuccacguggcu

SEQ ID NO: 1117177 - RNA, 20 nt, Human
gacaguuguggauggugggg

SEQ ID NO: 1117178 - RNA, 22 nt, Human
gccucaguuccacguggcuggg

SEQ ID NO: 1117179 - RNA, 19 nt, Human
gcuccauuugcacuagccu

SEQ ID NO: 1117180 - RNA, 24 nt, Human
ggggguggugaaaggcacuucuua

SEQ ID NO: 1117181 - RNA, 18 nt, Human
gguguggggguggugaaa

SEQ ID NO: 1117182 - RNA, 19 nt, Human
gugaaaggcacuucuuaca

SEQ ID NO: 1117183 - RNA, 20 nt, Human
uaccuuuaaaaagcacugua

SEQ ID NO: 1117184 - RNA, 18 nt, Human
uagcuccauuugcacuag

SEQ ID NO: 1117185 - RNA, 19 nt, Human
uauuuuuauuauuuguggc

SEQ ID NO: 1117186 - RNA, 30 nt, Human
ucagaacagcagucaguucagucuuuucuu

SEQ ID NO: 1117187 - RNA, 22 nt, Human
ucagagucauggcagggugugg

SEQ ID NO: 1117188 - RNA, 22 nt, Human
uccagaguuuauucaaguucau

SEQ ID NO: 1117189 - RNA, 23 nt, Human
uccauacagcugccucaguucca

SEQ ID NO: 1117190 - RNA, 25 nt, Human
uccauacagcugccucaguuccacg

SEQ ID NO: 1117191 - RNA, 23 nt, Human
ucucuucuuucuguaccucuccc

SEQ ID NO: 1117192 - RNA, 27 nt, Human
ugaacagauuuguagcugcuguguaaa

SEQ ID NO: 1117193 - RNA, 22 nt, Human
ugccucaguuccacguggcugg

SEQ ID NO: 1117194 - RNA, 20 nt, Human
uggcaggguguggggguggu

SEQ ID NO: 1117195 - RNA, 22 nt, Human
uggccuccauacagcugccuuc

SEQ ID NO: 1117196 - RNA, 20 nt, Human
ugggugaaaugcuaccuuua

SEQ ID NO: 1117197 - RNA, 20 nt, Human
uguccagaguuuauucaagu

SEQ ID NO: 1117198 - RNA, 19 nt, Human
uguggcuagaugggguaag

SEQ ID NO: 1117199 - RNA, 19 nt, Human
uuacuucccuugucugcau

SEQ ID NO: 1117200 - RNA, 20 nt, Human
uucauuggguugaauuccaa

SEQ ID NO: 1117201 - RNA, 23 nt, Human
uuguccuucagauucuucuuauu

SEQ ID NO: 1117202 - RNA, 21 nt, Human
uuucucuucuuucuguaccuc

SEQ ID NO: 1117203 - RNA, 18 nt, Human
aaagacucauggaugggg

SEQ ID NO: 1117204 - RNA, 25 nt, Human
aaagccuccccacacuccugucuau

SEQ ID NO: 1117205 - RNA, 23 nt, Human
aaagggacugcugagaaccagca

SEQ ID NO: 1117206 - RNA, 24 nt, Human
aaaguucugggauuacaggcauga

SEQ ID NO: 1117207 - RNA, 19 nt, Human
aaauggccuuuguugagga

SEQ ID NO: 1117208 - RNA, 21 nt, Human
aagcacaggacucaacccccc

SEQ ID NO: 1117209 - RNA, 18 nt, Human
aagcagaaggcaaagccu

SEQ ID NO: 1117210 - RNA, 24 nt, Human
aagcagaaggcaaagccugcuguu

SEQ ID NO: 1117211 - RNA, 21 nt, Human
aagccuccccacacuccuguc

SEQ ID NO: 1117212 - RNA, 25 nt, Human
aagcgacccucugcuguuggaggau

SEQ ID NO: 1117213 - RNA, 19 nt, Human
aagggagcaaaaagggacu

SEQ ID NO: 1117214 - RNA, 22 nt, Human
aaguagcugggauuauaggcau

SEQ ID NO: 1117215 - RNA, 24 nt, Human
aaguagcugggauuauaggcaugc

SEQ ID NO: 1117216 - RNA, 22 nt, Human
aauuuuguauuuuuaguagaca

SEQ ID NO: 1117217 - RNA, 18 nt, Human
acaccccagucagaggcc

SEQ ID NO: 1117218 - RNA, 18 nt, Human
acaggcucauauagaguc

SEQ ID NO: 1117219 - RNA, 23 nt, Human
acauaacaagaguacacauuuua

SEQ ID NO: 1117220 - RNA, 24 nt, Human
accaugugggccagacuggucucg

SEQ ID NO: 1117221 - RNA, 23 nt, Human
acccccucccgcacacuccccac

SEQ ID NO: 1117222 - RNA, 22 nt, Human
acccucacauacgugucuuccu

SEQ ID NO: 1117223 - RNA, 18 nt, Human
acucugggggaggguggg

SEQ ID NO: 1117224 - RNA, 23 nt, Human
acuggucucgaacuccugaccuc

SEQ ID NO: 1117225 - RNA, 29 nt, Human
agaaugauguccaggacuucucccugccu

SEQ ID NO: 1117226 - RNA, 20 nt, Human
agacccagagcacaccccag

SEQ ID NO: 1117227 - RNA, 24 nt, Human
agaguacacauuuuauagauacaa

SEQ ID NO: 1117228 - RNA, 18 nt, Human
agaugucaucagacagca

SEQ ID NO: 1117229 - RNA, 21 nt, Human
agccaaagaccagaaaagccu

SEQ ID NO: 1117230 - RNA, 27 nt, Human
agccauggggcugaggaacuucgaaga

SEQ ID NO: 1117231 - RNA, 23 nt, Human
agccuccccacacuccugucuau

SEQ ID NO: 1117232 - RNA, 21 nt, Human
aggcaugcgccaccacgccca

SEQ ID NO: 1117233 - RNA, 25 nt, Human
aggcauuuauugucugcuggaaaug

SEQ ID NO: 1117234 - RNA, 25 nt, Human
aggcgccucggccucccaaaguucu

SEQ ID NO: 1117235 - RNA, 23 nt, Human
agggagcaaaaagggacucuggg

SEQ ID NO: 1117236 - RNA, 22 nt, Human
aggugcagacuccuagagagcc

SEQ ID NO: 1117237 - RNA, 20 nt, Human
agugcaauggcgcaaucucg

SEQ ID NO: 1117238 - RNA, 24 nt, Human
agugcaauggcgcaaucucggcuc

SEQ ID NO: 1117239 - RNA, 18 nt, Human
augcgccaccacgcccag

SEQ ID NO: 1117240 - RNA, 22 nt, Human
augggcccuugagaugcauucu

SEQ ID NO: 1117241 - RNA, 21 nt, Human
auucuccugccucagccuccc

SEQ ID NO: 1117242 - RNA, 23 nt, Human
auuucuuuuuuuuuuuccuuuga

SEQ ID NO: 1117243 - RNA, 23 nt, Human
caaaccugccaacucuacccccu

SEQ ID NO: 1117244 - RNA, 24 nt, Human
caaagggacugcugagaaccagca

SEQ ID NO: 1117245 - RNA, 24 nt, Human
caaaguucugggauuacaggcaug

SEQ ID NO: 1117246 - RNA, 23 nt, Human
caaccucuaccucccggguucaa

SEQ ID NO: 1117247 - RNA, 22 nt, Human
caagcaauucuccugccucagc

SEQ ID NO: 1117248 - RNA, 27 nt, Human
caagcaauucuccugccucagccuccc

SEQ ID NO: 1117249 - RNA, 22 nt, Human
caauucagaaagagccccugag

SEQ ID NO: 1117250 - RNA, 21 nt, Human
caccaugugggccagacuggu

SEQ ID NO: 1117251 - RNA, 24 nt, Human
caccaugugggccagacuggucuc

SEQ ID NO: 1117252 - RNA, 18 nt, Human
caccccagucagaggccu

SEQ ID NO: 1117253 - RNA, 21 nt, Human
cacugcaaccucuaccucccg

SEQ ID NO: 1117254 - RNA, 23 nt, Human
cacugcaaccucuaccucccggg

SEQ ID NO: 1117255 - RNA, 19 nt, Human
cagaaaagccuccccacac

SEQ ID NO: 1117256 - RNA, 23 nt, Human
cagaaagagccccugaggggaga

SEQ ID NO: 1117257 - RNA, 20 nt, Human
cagaagccgaaagugccccc

SEQ ID NO: 1117258 - RNA, 18 nt, Human
cagcccuccucacagccc

SEQ ID NO: 1117259 - RNA, 20 nt, Human
caggaccagggagugccugg

SEQ ID NO: 1117260 - RNA, 24 nt, Human
cauccucauuucacagauuaggga

SEQ ID NO: 1117261 - RNA, 21 nt, Human
caugcgccaccacgcccagcu

SEQ ID NO: 1117262 - RNA, 24 nt, Human
ccaaaguucugggauuacaggcau

SEQ ID NO: 1117263 - RNA, 24 nt, Human
ccaacucuacccccucccgcacac

SEQ ID NO: 1117264 - RNA, 24 nt, Human
ccaaguagcugggauuauaggcau

SEQ ID NO: 1117265 - RNA, 26 nt, Human
ccacaucaaagggacugcugagaacc

SEQ ID NO: 1117266 - RNA, 22 nt, Human
ccaccaacgcacucucagcugc

SEQ ID NO: 1117267 - RNA, 24 nt, Human
ccaccaacgcacucucagcugcag

SEQ ID NO: 1117268 - RNA, 20 nt, Human
ccaccacgcccagcuaauuu

SEQ ID NO: 1117269 - RNA, 19 nt, Human
ccacugcgcccggccuaag

SEQ ID NO: 1117270 - RNA, 20 nt, Human
ccacugcgcccggccuaagc

SEQ ID NO: 1117271 - RNA, 24 nt, Human
cccaaaguucugggauuacaggca

SEQ ID NO: 1117272 - RNA, 23 nt, Human
cccaaguagcugggauuauaggc

SEQ ID NO: 1117273 - RNA, 24 nt, Human
cccaaguagcugggauuauaggca

SEQ ID NO: 1117274 - RNA, 21 nt, Human
cccagacauacuccacagccg

SEQ ID NO: 1117275 - RNA, 19 nt, Human
cccaugauggcagcaggac

SEQ ID NO: 1117276 - RNA, 19 nt, Human
ccccagcacucgccaggcu

SEQ ID NO: 1117277 - RNA, 22 nt, Human
ccccccaucggcagagcccggc

SEQ ID NO: 1117278 - RNA, 19 nt, Human
ccccuccuuccccacccuc

SEQ ID NO: 1117279 - RNA, 19 nt, Human
ccccugaggggagaagccu

SEQ ID NO: 1117280 - RNA, 24 nt, Human
ccccugaggggagaagccuagucc

SEQ ID NO: 1117281 - RNA, 22 nt, Human
cccggccgcagcaggcuucugu

SEQ ID NO: 1117282 - RNA, 23 nt, Human
cccggguucaagcaauucuccug

SEQ ID NO: 1117283 - RNA, 20 nt, Human
cccucuggcucuccucugca

SEQ ID NO: 1117284 - RNA, 24 nt, Human
cccugcucaagugucaucuucuca

SEQ ID NO: 1117285 - RNA, 24 nt, Human
cccuggacaauucagaaagagccc

SEQ ID NO: 1117286 - RNA, 20 nt, Human
cccugggucacuagagaccc

SEQ ID NO: 1117287 - RNA, 20 nt, Human
cccugucugggguucucuuc

SEQ ID NO: 1117288 - RNA, 22 nt, Human
ccgguucagugcggggcgcaag

SEQ ID NO: 1117289 - RNA, 22 nt, Human
ccucacagccccuuggagccug

SEQ ID NO: 1117290 - RNA, 22 nt, Human
ccucccgcacacuccccaccaa

SEQ ID NO: 1117291 - RNA, 24 nt, Human
ccucccggguucaagcaauucucc

SEQ ID NO: 1117292 - RNA, 22 nt, Human
ccucucuuccucuuacaugucc

SEQ ID NO: 1117293 - RNA, 21 nt, Human
ccucugccuucacaccaccug

SEQ ID NO: 1117294 - RNA, 19 nt, Human
ccugaccucaggugaucca

SEQ ID NO: 1117295 - RNA, 19 nt, Human
ccugaccucaggugaucca

SEQ ID NO: 1117296 - RNA, 23 nt, Human
ccugccucagccucccaaguagc

SEQ ID NO: 1117297 - RNA, 20 nt, Human
ccugcucaagugucaucuuc

SEQ ID NO: 1117298 - RNA, 24 nt, Human
ccuguccugcuccccuaacgggag

SEQ ID NO: 1117299 - RNA, 20 nt, Human
ccuuccuuccccuccccucc

SEQ ID NO: 1117300 - RNA, 23 nt, Human
cgagggugccgggggcccugggu

SEQ ID NO: 1117301 - RNA, 21 nt, Human
cgcaagccagcccuccucaca

SEQ ID NO: 1117302 - RNA, 18 nt, Human
cgcccggccuaagcuucu

SEQ ID NO: 1117303 - RNA, 22 nt, Human
cggcagagcccggccgcagcag

SEQ ID NO: 1117304 - RNA, 20 nt, Human
cuacccccucccgcacacuc

SEQ ID NO: 1117305 - RNA, 24 nt, Human
cucacugcaaccucuaccucccgg

SEQ ID NO: 1117306 - RNA, 24 nt, Human
cucagccucccaaguagcugggau

SEQ ID NO: 1117307 - RNA, 21 nt, Human
cucccuuucucucuccuuccc

SEQ ID NO: 1117308 - RNA, 25 nt, Human
cuccucugcaaagauggccuucaaa

SEQ ID NO: 1117309 - RNA, 18 nt, Human
cucuagaucacauagcca

SEQ ID NO: 1117310 - RNA, 19 nt, Human
cucuagaucacauagccag

SEQ ID NO: 1117311 - RNA, 21 nt, Human
cucugcuguuggaggauggcc

SEQ ID NO: 1117312 - RNA, 21 nt, Human
cucuuguugcccaggcuggag

SEQ ID NO: 1117313 - RNA, 20 nt, Human
cugaauucccagagcugcac

SEQ ID NO: 1117314 - RNA, 23 nt, Human
cugcaaccucuaccucccggguu

SEQ ID NO: 1117315 - RNA, 23 nt, Human
cugccucagccucccaaguagcu

SEQ ID NO: 1117316 - RNA, 18 nt, Human
cugccucugccuucacac

SEQ ID NO: 1117317 - RNA, 20 nt, Human
cuggcucuccucugcaaaga

SEQ ID NO: 1117318 - RNA, 18 nt, Human
cuguccugcuccccuaac

SEQ ID NO: 1117319 - RNA, 19 nt, Human
cuguuggaggauggccugg

SEQ ID NO: 1117320 - RNA, 20 nt, Human
cuucucagaaaagccucccc

SEQ ID NO: 1117321 - RNA, 23 nt, Human
cuuucugaauucccagagcugca

SEQ ID NO: 1117322 - RNA, 22 nt, Human
cuuuuuauccuccugaggucca

SEQ ID NO: 1117323 - RNA, 19 nt, Human
gaaauggccuuuguugagg

SEQ ID NO: 1117324 - RNA, 18 nt, Human
gaacauaaucaucgggca

SEQ ID NO: 1117325 - RNA, 18 nt, Human
gaagaagcgacccucugc

SEQ ID NO: 1117326 - RNA, 24 nt, Human
gaccucaggugauccaggcgccuc

SEQ ID NO: 1117327 - RNA, 19 nt, Human
gaccuguccucucuuccuc

SEQ ID NO: 1117328 - RNA, 20 nt, Human
gaccuguccucucuuccucu

SEQ ID NO: 1117329 - RNA, 18 nt, Human
gagcugcacggcucagcc

SEQ ID NO: 1117330 - RNA, 18 nt, Human
gaggauagggauuugguc

SEQ ID NO: 1117331 - RNA, 18 nt, Human
gauuacaggcaugagcca

SEQ ID NO: 1117332 - RNA, 19 nt, Human
gauuacaggcaugagccac

SEQ ID NO: 1117333 - RNA, 22 nt, Human
gauuacaggcaugagccacugc

SEQ ID NO: 1117334 - RNA, 18 nt, Human
gauuauaggcaugcgcca

SEQ ID NO: 1117335 - RNA, 22 nt, Human
gcaaccucuaccucccggguuc

SEQ ID NO: 1117336 - RNA, 20 nt, Human
gcagaagccgaaagugcccc

SEQ ID NO: 1117337 - RNA, 22 nt, Human
gccagcccuccucacagccccu

SEQ ID NO: 1117338 - RNA, 19 nt, Human
gcccaggcuggagugcaau

SEQ ID NO: 1117339 - RNA, 19 nt, Human
gccgccccagccauggggc

SEQ ID NO: 1117340 - RNA, 23 nt, Human
gccucggccucccaaaguucugg

SEQ ID NO: 1117341 - RNA, 21 nt, Human
gcgccucggccucccaaaguu

SEQ ID NO: 1117342 - RNA, 20 nt, Human
gcucuccucugcaaagaugg

SEQ ID NO: 1117343 - RNA, 21 nt, Human
gcucuuguugcccaggcugga

SEQ ID NO: 1117344 - RNA, 19 nt, Human
gcuggagugcaauggcgca

SEQ ID NO: 1117345 - RNA, 21 nt, Human
ggaugugaaagccagcaaguu

SEQ ID NO: 1117346 - RNA, 22 nt, Human
ggauuacaggcaugagccacug

SEQ ID NO: 1117347 - RNA, 19 nt, Human
ggauuauaggcaugcgcca

SEQ ID NO: 1117348 - RNA, 20 nt, Human
gggacugcugagaaccagca

SEQ ID NO: 1117349 - RNA, 19 nt, Human
gggagggugggcggcagag

SEQ ID NO: 1117350 - RNA, 24 nt, Human
gggccagacuggucucgaacuccu

SEQ ID NO: 1117351 - RNA, 21 nt, Human
ggguuucaccaugugggccag

SEQ ID NO: 1117352 - RNA, 19 nt, Human
ggucucgaacuccugaccu

SEQ ID NO: 1117353 - RNA, 18 nt, Human
guagcugggauuauaggc

SEQ ID NO: 1117354 - RNA, 22 nt, Human
gucacguugcccugaaagacuc

SEQ ID NO: 1117355 - RNA, 24 nt, Human
gugaaagccagcaaguuaauacca

SEQ ID NO: 1117356 - RNA, 24 nt, Human
gugauccaggcgccucggccuccc

SEQ ID NO: 1117357 - RNA, 23 nt, Human
uacaggcaugagccacugcgccc

SEQ ID NO: 1117358 - RNA, 23 nt, Human
uaccaaaugcuccuuaugacucu

SEQ ID NO: 1117359 - RNA, 19 nt, Human
uaccagcaccugccacacc

SEQ ID NO: 1117360 - RNA, 23 nt, Human
uaccagcauccugccgguucagu

SEQ ID NO: 1117361 - RNA, 26 nt, Human
uacccccucccgcacacuccccaccc

SEQ ID NO: 1117362 - RNA, 19 nt, Human
uaccugagucugggcgccc

SEQ ID NO: 1117363 - RNA, 21 nt, Human
uagagucggaugugaaagcca

SEQ ID NO: 1117364 - RNA, 19 nt, Human
uagcaggcagacuuuuuuc

SEQ ID NO: 1117365 - RNA, 24 nt, Human
uaggagaucaaagcacaggacuca

SEQ ID NO: 1117366 - RNA, 23 nt, Human
uaguagacauggguuucaccaug

SEQ ID NO: 1117367 - RNA, 26 nt, Human
uauuuauuucuuuuuuuuuuuccuuu

SEQ ID NO: 1117368 - RNA, 25 nt, Human
ucacaccaccuguccggggggccug

SEQ ID NO: 1117369 - RNA, 22 nt, Human
ucacauacgugucuuccuuccc

SEQ ID NO: 1117370 - RNA, 24 nt, Human
ucacugcaaccucuaccucccggg

SEQ ID NO: 1117371 - RNA, 25 nt, Human
ucacugcaaccucuaccucccgggu

SEQ ID NO: 1117372 - RNA, 19 nt, Human
ucagaaaagccuccccaca

SEQ ID NO: 1117373 - RNA, 24 nt, Human
ucagaggcuuucugaauucccagg

SEQ ID NO: 1117374 - RNA, 20 nt, Human
ucagccucccaaguagcugg

SEQ ID NO: 1117375 - RNA, 22 nt, Human
uccacagccggaggaaaggaac

SEQ ID NO: 1117376 - RNA, 24 nt, Human
ucccaaaguucugggauuacaggc

SEQ ID NO: 1117377 - RNA, 24 nt, Human
ucccaaguagcugggauuauaggc

SEQ ID NO: 1117378 - RNA, 22 nt, Human
uccccacacuccugucuauacc

SEQ ID NO: 1117379 - RNA, 19 nt, Human
uccccacccucacauacgu

SEQ ID NO: 1117380 - RNA, 19 nt, Human
ucccccguaucuauaacac

SEQ ID NO: 1117381 - RNA, 20 nt, Human
ucccgcacacuccccaccaa

SEQ ID NO: 1117382 - RNA, 21 nt, Human
ucccggguucaagcaauucuc

SEQ ID NO: 1117383 - RNA, 24 nt, Human
ucccggguucaagcaauucuccug

SEQ ID NO: 1117384 - RNA, 18 nt, Human
ucccucuggcucuccucu

SEQ ID NO: 1117385 - RNA, 20 nt, Human
ucccugauccucuggggaau

SEQ ID NO: 1117386 - RNA, 19 nt, Human
uccuuccuuccccuccccu

SEQ ID NO: 1117387 - RNA, 22 nt, Human
ucggcagagcccggccgcagca

SEQ ID NO: 1117388 - RNA, 25 nt, Human
ucucccugccauugccuggguugaa

SEQ ID NO: 1117389 - RNA, 26 nt, Human
ucuccugccucagccucccaaguagc

SEQ ID NO: 1117390 - RNA, 23 nt, Human
ucucgaacuccugaccucaggug

SEQ ID NO: 1117391 - RNA, 19 nt, Human
ucugggggagggugggcgg

SEQ ID NO: 1117392 - RNA, 26 nt, Human
ucuguaucugucucucccuuucucuc

SEQ ID NO: 1117393 - RNA, 20 nt, Human
ucugucucucccuuucucuc

SEQ ID NO: 1117394 - RNA, 22 nt, Human
ucuuguugcccaggcuggagug

SEQ ID NO: 1117395 - RNA, 22 nt, Human
ugaacauaaucaucgggcacag

SEQ ID NO: 1117396 - RNA, 24 nt, Human
ugaccucaggugauccaggcgccu

SEQ ID NO: 1117397 - RNA, 25 nt, Human
ugaccucaggugauccaggcgccuc

SEQ ID NO: 1117398 - RNA, 21 nt, Human
ugagacccagagcacacccca

SEQ ID NO: 1117399 - RNA, 20 nt, Human
ugaggaagaggagagggcau

SEQ ID NO: 1117400 - RNA, 23 nt, Human
ugagggagggacgggaugcaaca

SEQ ID NO: 1117401 - RNA, 23 nt, Human
ugcaauggcgcaaucucggcuca

SEQ ID NO: 1117402 - RNA, 18 nt, Human
ugccacaccugcuuuauc

SEQ ID NO: 1117403 - RNA, 18 nt, Human
ugcccaggcuggagugca

SEQ ID NO: 1117404 - RNA, 21 nt, Human
ugcccaggcuggagugcaaug

SEQ ID NO: 1117405 - RNA, 21 nt, Human
ugcccaggcuggagugcaaug

SEQ ID NO: 1117406 - RNA, 24 nt, Human
ugcccaggcuggagugcaauggcg

SEQ ID NO: 1117407 - RNA, 18 nt, Human
ugccgguucagugcgggg

SEQ ID NO: 1117408 - RNA, 24 nt, Human
ugccucagccucccaaguagcugg

SEQ ID NO: 1117409 - RNA, 21 nt, Human
ugccugggcacaacggggagc

SEQ ID NO: 1117410 - RNA, 19 nt, Human
ugccuggguugaauugaga

SEQ ID NO: 1117411 - RNA, 27 nt, Human
ugccuuguuugcuaaggccgccccagc

SEQ ID NO: 1117412 - RNA, 24 nt, Human
ugcucuuguugcccaggcuggagu

SEQ ID NO: 1117413 - RNA, 21 nt, Human
ugcuuuaucugucuguuucuc

SEQ ID NO: 1117414 - RNA, 18 nt, Human
uggaagaagcgacccucu

SEQ ID NO: 1117415 - RNA, 20 nt, Human
uggaagaagcgacccucugc

SEQ ID NO: 1117416 - RNA, 22 nt, Human
uggagucaaaccugccaacucc

SEQ ID NO: 1117417 - RNA, 23 nt, Human
uggagugcaauggcgcaaucucg

SEQ ID NO: 1117418 - RNA, 24 nt, Human
uggagugcaauggcgcaaucucgg

SEQ ID NO: 1117419 - RNA, 18 nt, Human
ugggauuacaggcaugag

SEQ ID NO: 1117420 - RNA, 19 nt, Human
ugggauuacaggcaugagc

SEQ ID NO: 1117421 - RNA, 21 nt, Human
ugggauuacaggcaugagcca

SEQ ID NO: 1117422 - RNA, 22 nt, Human
ugggauuacaggcaugagccac

SEQ ID NO: 1117423 - RNA, 22 nt, Human
ugggauuacaggcaugagccac

SEQ ID NO: 1117424 - RNA, 23 nt, Human
ugggauuacaggcaugagccacu

SEQ ID NO: 1117425 - RNA, 24 nt, Human
ugggauuacaggcaugagccacug

SEQ ID NO: 1117426 - RNA, 26 nt, Human
ugggauuacaggcaugagccacugcg

SEQ ID NO: 1117427 - RNA, 18 nt, Human
ugggauuauaggcaugcg

SEQ ID NO: 1117428 - RNA, 21 nt, Human
ugggauuauaggcaugcgcca

SEQ ID NO: 1117429 - RNA, 22 nt, Human
ugggauuauaggcaugcgccac

SEQ ID NO: 1117430 - RNA, 24 nt, Human
ugggauuauaggcaugcgccacca

SEQ ID NO: 1117431 - RNA, 18 nt, Human
ugggcgugggcuuuugca

SEQ ID NO: 1117432 - RNA, 20 nt, Human
ugggcgugggcuuuugcaag

SEQ ID NO: 1117433 - RNA, 23 nt, Human
ugggcgugggcuuuugcaaguca

SEQ ID NO: 1117434 - RNA, 18 nt, Human
ugggggagggugggcggc

SEQ ID NO: 1117435 - RNA, 19 nt, Human
ugggggagggugggcggca

SEQ ID NO: 1117436 - RNA, 18 nt, Human
uggguuucaccauguggg

SEQ ID NO: 1117437 - RNA, 21 nt, Human
uggucucgaacuccugaccuc

SEQ ID NO: 1117438 - RNA, 18 nt, Human
uggucugcaaauguggua

SEQ ID NO: 1117439 - RNA, 25 nt, Human
ugucaucagacagcagggggacagu

SEQ ID NO: 1117440 - RNA, 20 nt, Human
ugucaucuucucagaaaagc

SEQ ID NO: 1117441 - RNA, 19 nt, Human
uguccaggacuucucccug

SEQ ID NO: 1117442 - RNA, 22 nt, Human
ugugugcacucacaucgacagg

SEQ ID NO: 1117443 - RNA, 20 nt, Human
uguguucgucuuucuguauc

SEQ ID NO: 1117444 - RNA, 20 nt, Human
uguugcccaggcuggagugc

SEQ ID NO: 1117445 - RNA, 22 nt, Human
uguugcccaggcuggagugcaa

SEQ ID NO: 1117446 - RNA, 19 nt, Human
uuaauaccagcauccugcc

SEQ ID NO: 1117447 - RNA, 23 nt, Human
uuaguagacauggguuucaccau

SEQ ID NO: 1117448 - RNA, 24 nt, Human
uuaguagacauggguuucaccaug

SEQ ID NO: 1117449 - RNA, 22 nt, Human
uuauacauaacaagaguacaca

SEQ ID NO: 1117450 - RNA, 21 nt, Human
uucaagcaauucuccugccuc

SEQ ID NO: 1117451 - RNA, 24 nt, Human
uucaagcaauucuccugccucagc

SEQ ID NO: 1117452 - RNA, 21 nt, Human
uucaugaggauagggauuugg

SEQ ID NO: 1117453 - RNA, 20 nt, Human
uucuggaccacagaccuugg

SEQ ID NO: 1117454 - RNA, 18 nt, Human
uugcccaggcuggagugc

SEQ ID NO: 1117455 - RNA, 23 nt, Human
uugcucuuguugcccaggcugga

SEQ ID NO: 1117456 - RNA, 24 nt, Human
uuuaguagacauggguuucaccau

SEQ ID NO: 1117457 - RNA, 18 nt, Human
uuucacagauuagggaac

SEQ ID NO: 1117458 - RNA, 21 nt, Human
uuucaccaugugggccagacu

SEQ ID NO: 1117459 - RNA, 24 nt, Human
uuucucuuucugaaggggagggaa

SEQ ID NO: 1117460 - RNA, 18 nt, Human
uuucugaauucccagagc

SEQ ID NO: 1117461 - RNA, 18 nt, Human
uuugcuaaggccgcccca

SEQ ID NO: 1117462 - RNA, 24 nt, Human
uuugcucuuguugcccaggcugga

SEQ ID NO: 1117463 - RNA, 24 nt, Human
uuuugcucuuguugcccaggcugg

SEQ ID NO: 1117464 - RNA, 18 nt, Human
uuuuguauuuuuaguaga

SEQ ID NO: 1117465 - RNA, 23 nt, Human
uuuuuaguagacauggguuucac

SEQ ID NO: 1117466 - RNA, 21 nt, Human
aaccaggcuuggauguggcuc

SEQ ID NO: 1117467 - RNA, 21 nt, Human
aaugggucuccuuccaugucu

SEQ ID NO: 1117468 - RNA, 24 nt, Human
acagcaccucaucaacauggucag

SEQ ID NO: 1117469 - RNA, 24 nt, Human
accugucccacggugacccagaag

SEQ ID NO: 1117470 - RNA, 18 nt, Human
agaaaaagaaaaaaaugg

SEQ ID NO: 1117471 - RNA, 18 nt, Human
agaacuagaaaaagaaaa

SEQ ID NO: 1117472 - RNA, 18 nt, Human
agagaugcacuucuucga

SEQ ID NO: 1117473 - RNA, 22 nt, Human
agauccuggcagcaucuaaccc

SEQ ID NO: 1117474 - RNA, 22 nt, Human
agaugcuuccccaucccaauug

SEQ ID NO: 1117475 - RNA, 19 nt, Human
agcacucagggugguuggc

SEQ ID NO: 1117476 - RNA, 21 nt, Human
agccuguuugcauauuuuguu

SEQ ID NO: 1117477 - RNA, 20 nt, Human
aggcagagaccugucccacg

SEQ ID NO: 1117478 - RNA, 22 nt, Human
agguauaaauaaaugacaacag

SEQ ID NO: 1117479 - RNA, 18 nt, Human
caacacugcgagagagag

SEQ ID NO: 1117480 - RNA, 22 nt, Human
cacccugaauccauacggcaac

SEQ ID NO: 1117481 - RNA, 18 nt, Human
cacggccucggaagcccu

SEQ ID NO: 1117482 - RNA, 22 nt, Human
cagaacuagaaaaagaaaaaaa

SEQ ID NO: 1117483 - RNA, 24 nt, Human
cagagaagugccugguaugagcac

SEQ ID NO: 1117484 - RNA, 20 nt, Human
cagcaacuggaucauagugc

SEQ ID NO: 1117485 - RNA, 23 nt, Human
cauuuccacuuuaaaagcagaga

SEQ ID NO: 1117486 - RNA, 23 nt, Human
ccaccaccccggccuuuacgcug

SEQ ID NO: 1117487 - RNA, 22 nt, Human
ccucaucaacauggucagcauu

SEQ ID NO: 1117488 - RNA, 20 nt, Human
ccuccucccugugccacaca

SEQ ID NO: 1117489 - RNA, 21 nt, Human
ccugaauccauacggcaacac

SEQ ID NO: 1117490 - RNA, 26 nt, Human
ccugggguuuuuugcucagaugcuuc

SEQ ID NO: 1117491 - RNA, 23 nt, Human
ccugucccacggugacccagaag

SEQ ID NO: 1117492 - RNA, 21 nt, Human
ccuugggcuguggcagggcuu

SEQ ID NO: 1117493 - RNA, 18 nt, Human
cggaagcccugaagcacu

SEQ ID NO: 1117494 - RNA, 22 nt, Human
cuagaaaaagaaaaaaaugggu

SEQ ID NO: 1117495 - RNA, 19 nt, Human
cucacugucacggccucgg

SEQ ID NO: 1117496 - RNA, 23 nt, Human
cuguacucagggcugcugggggu

SEQ ID NO: 1117497 - RNA, 24 nt, Human
cuguggcggaaacagauccuggca

SEQ ID NO: 1117498 - RNA, 21 nt, Human
gaccugaggcagcaacuggau

SEQ ID NO: 1117499 - RNA, 18 nt, Human
gagcauggccaagcugua

SEQ ID NO: 1117500 - RNA, 21 nt, Human
gaggcagcaacuggaucauag

SEQ ID NO: 1117501 - RNA, 18 nt, Human
gcagcaacuggaucauag

SEQ ID NO: 1117502 - RNA, 20 nt, Human
gcuguacucagggcugcugg

SEQ ID NO: 1117503 - RNA, 21 nt, Human
ggcagggcugggcuuggcuca

SEQ ID NO: 1117504 - RNA, 20 nt, Human
ggccaagcuguacucagggc

SEQ ID NO: 1117505 - RNA, 20 nt, Human
guaucuaugucuaaagccag

SEQ ID NO: 1117506 - RNA, 21 nt, Human
uaaaugacaacaguuuaacgc

SEQ ID NO: 1117507 - RNA, 18 nt, Human
uaaggagcuccuggccca

SEQ ID NO: 1117508 - RNA, 18 nt, Human
uacgcugggccuggguga

SEQ ID NO: 1117509 - RNA, 21 nt, Human
uagaaaaagaaaaaaaugggu

SEQ ID NO: 1117510 - RNA, 24 nt, Human
uauuuuuccugggguuuuuugcuc

SEQ ID NO: 1117511 - RNA, 24 nt, Human
uccagaacuagaaaaagaaaaaaa

SEQ ID NO: 1117512 - RNA, 27 nt, Human
uccagaacuagaaaaagaaaaaaaugg

SEQ ID NO: 1117513 - RNA, 26 nt, Human
ucccacggugacccagaagugccgcu

SEQ ID NO: 1117514 - RNA, 19 nt, Human
uccccaucccaauugagga

SEQ ID NO: 1117515 - RNA, 21 nt, Human
ucuaaccccuugggcuguggc

SEQ ID NO: 1117516 - RNA, 19 nt, Human
ucucagaaaaagauuagcu

SEQ ID NO: 1117517 - RNA, 24 nt, Human
ucuguggcggaaacagauccuggc

SEQ ID NO: 1117518 - RNA, 20 nt, Human
ugaacggggccaagguggca

SEQ ID NO: 1117519 - RNA, 21 nt, Human
ugaguaagacugaggccagug

SEQ ID NO: 1117520 - RNA, 18 nt, Human
ugccacacaaacagcacc

SEQ ID NO: 1117521 - RNA, 19 nt, Human
ugcccucacugucacggcc

SEQ ID NO: 1117522 - RNA, 22 nt, Human
ugcucagaugcuuccccauccc

SEQ ID NO: 1117523 - RNA, 18 nt, Human
uggcagggcugggcuugg

SEQ ID NO: 1117524 - RNA, 19 nt, Human
uggcagggcuucuguggug

SEQ ID NO: 1117525 - RNA, 26 nt, Human
uggcagggcuucuguggugggcugcc

SEQ ID NO: 1117526 - RNA, 23 nt, Human
ugggcugccuuugggagacgcaa

SEQ ID NO: 1117527 - RNA, 22 nt, Human
uggugggcugccuuugggagac

SEQ ID NO: 1117528 - RNA, 21 nt, Human
ugucaauccguguccugaggc

SEQ ID NO: 1117529 - RNA, 23 nt, Human
uguggcggaaacagauccuggca

SEQ ID NO: 1117530 - RNA, 24 nt, Human
uguguguaugugugcaugcgcaca

SEQ ID NO: 1117531 - RNA, 18 nt, Human
uuugggugucauugugaa

SEQ ID NO: 1117532 - RNA, 23 nt, Human
aacaaccagaagauaggagggaa

SEQ ID NO: 1117533 - RNA, 23 nt, Human
aacugcuuucaccaucagggaug

SEQ ID NO: 1117534 - RNA, 18 nt, Human
aagaauucagaccagucc

SEQ ID NO: 1117535 - RNA, 22 nt, Human
aagcaggaggggagcuuguugg

SEQ ID NO: 1117536 - RNA, 23 nt, Human
aagcaggaggggagcuuguugga

SEQ ID NO: 1117537 - RNA, 21 nt, Human
aaggcaucagcaucuccccuc

SEQ ID NO: 1117538 - RNA, 21 nt, Human
aaugacauuuugugacuucca

SEQ ID NO: 1117539 - RNA, 19 nt, Human
acacaaagccaugcaugca

SEQ ID NO: 1117540 - RNA, 20 nt, Human
acacagugguucugguucua

SEQ ID NO: 1117541 - RNA, 21 nt, Human
accaugauaggauuauguaac

SEQ ID NO: 1117542 - RNA, 26 nt, Human
acguacaaggcaucaugcaaacagac

SEQ ID NO: 1117543 - RNA, 19 nt, Human
acuacccuuggaaaccagu

SEQ ID NO: 1117544 - RNA, 21 nt, Human
agaagcuggugggcaaauagg

SEQ ID NO: 1117545 - RNA, 22 nt, Human
agccaggcaggcaucagaagcc

SEQ ID NO: 1117546 - RNA, 28 nt, Human
agccuggaacagauccuuucccaguccc

SEQ ID NO: 1117547 - RNA, 21 nt, Human
aggcaucagaagccucaggcu

SEQ ID NO: 1117548 - RNA, 19 nt, Human
agggaaccuacagagguug

SEQ ID NO: 1117549 - RNA, 19 nt, Human
agggaugaaaguugaagac

SEQ ID NO: 1117550 - RNA, 23 nt, Human
aggggagcuuguuggagaaggug

SEQ ID NO: 1117551 - RNA, 22 nt, Human
aggguuguugcagauguaauuu

SEQ ID NO: 1117552 - RNA, 18 nt, Human
agguagucagucucacug

SEQ ID NO: 1117553 - RNA, 19 nt, Human
auggggaagcaggagggga

SEQ ID NO: 1117554 - RNA, 23 nt, Human
caaaauggccacaaugauaucuc

SEQ ID NO: 1117555 - RNA, 19 nt, Human
caaacuagauuuacaacca

SEQ ID NO: 1117556 - RNA, 18 nt, Human
caagaacacuuccuuguc

SEQ ID NO: 1117557 - RNA, 18 nt, Human
cacaaaccagaaacagaa

SEQ ID NO: 1117558 - RNA, 23 nt, Human
cacagugguucugguucuaccag

SEQ ID NO: 1117559 - RNA, 20 nt, Human
cagaaggcaaggaacaacca

SEQ ID NO: 1117560 - RNA, 22 nt, Human
cagagccaccauguaggcuugu

SEQ ID NO: 1117561 - RNA, 18 nt, Human
cagcaucuccccucuggu

SEQ ID NO: 1117562 - RNA, 22 nt, Human
cagggagaacaccaaaugaaga

SEQ ID NO: 1117563 - RNA, 19 nt, Human
caucagaagccucaggcuc

SEQ ID NO: 1117564 - RNA, 19 nt, Human
caugcaaacagacugugca

SEQ ID NO: 1117565 - RNA, 21 nt, Human
caugcaaacagacugugcagu

SEQ ID NO: 1117566 - RNA, 21 nt, Human
cauggcaagccgcucaugcac

SEQ ID NO: 1117567 - RNA, 21 nt, Human
cauguugcaucuuucccaaaa

SEQ ID NO: 1117568 - RNA, 24 nt, Human
cauuuugugacuuccaagauuaga

SEQ ID NO: 1117569 - RNA, 18 nt, Human
ccacaguuuggggcuucu

SEQ ID NO: 1117570 - RNA, 21 nt, Human
ccacuggggaacaaacgggac

SEQ ID NO: 1117571 - RNA, 21 nt, Human
ccagccaggcaggcaucagaa

SEQ ID NO: 1117572 - RNA, 18 nt, Human
cccagaagaaggguucau

SEQ ID NO: 1117573 - RNA, 22 nt, Human
cccauuucugucuauuuucuaa

SEQ ID NO: 1117574 - RNA, 18 nt, Human
ccccaaaucuuaugucca

SEQ ID NO: 1117575 - RNA, 23 nt, Human
ccccaguaccucagaauguggcc

SEQ ID NO: 1117576 - RNA, 19 nt, Human
cccccaaaugcucccaaac

SEQ ID NO: 1117577 - RNA, 26 nt, Human
ccuccugcccccaaaugcucccaaac

SEQ ID NO: 1117578 - RNA, 18 nt, Human
ccucugguugaacuugac

SEQ ID NO: 1117579 - RNA, 22 nt, Human
ccugcacaaggauagauacccc

SEQ ID NO: 1117580 - RNA, 23 nt, Human
ccuuucaauucaauucauucauu

SEQ ID NO: 1117581 - RNA, 22 nt, Human
cgggaccaaaaucuacucugug

SEQ ID NO: 1117582 - RNA, 21 nt, Human
cgggcugugcucaguguccuu

SEQ ID NO: 1117583 - RNA, 23 nt, Human
cugaacucauauuuaaguacuga

SEQ ID NO: 1117584 - RNA, 18 nt, Human
cuuacugagaaccagcca

SEQ ID NO: 1117585 - RNA, 19 nt, Human
gaaauaggguuguugcaga

SEQ ID NO: 1117586 - RNA, 21 nt, Human
gaagauaggagggaagccugg

SEQ ID NO: 1117587 - RNA, 18 nt, Human
gagaauguuaauacagcu

SEQ ID NO: 1117588 - RNA, 18 nt, Human
gcagccagaaggcaagga

SEQ ID NO: 1117589 - RNA, 21 nt, Human
gcucaugcacgggcugugcuc

SEQ ID NO: 1117590 - RNA, 21 nt, Human
gcuccagaggagaagcuggug

SEQ ID NO: 1117591 - RNA, 22 nt, Human
ggagaacaccaaaugaagacua

SEQ ID NO: 1117592 - RNA, 19 nt, Human
ggagaagguggccucaaug

SEQ ID NO: 1117593 - RNA, 19 nt, Human
ggccugggcuggcguccuc

SEQ ID NO: 1117594 - RNA, 24 nt, Human
ggcuccagaggagaagcugguggg

SEQ ID NO: 1117595 - RNA, 18 nt, Human
gggugaccuggccugggc

SEQ ID NO: 1117596 - RNA, 18 nt, Human
ggguugggauggaggggu

SEQ ID NO: 1117597 - RNA, 18 nt, Human
gguggauugagggaaccu

SEQ ID NO: 1117598 - RNA, 21 nt, Human
guccuuuuuccucagccaugc

SEQ ID NO: 1117599 - RNA, 22 nt, Human
gugcagggguugggauggaggg

SEQ ID NO: 1117600 - RNA, 23 nt, Human
guuccaagccacccaguuuuugu

SEQ ID NO: 1117601 - RNA, 19 nt, Human
guuuggggcuucucccuca

SEQ ID NO: 1117602 - RNA, 19 nt, Human
uaaaauacuauacuaguuc

SEQ ID NO: 1117603 - RNA, 26 nt, Human
uaaacgacuacccuuggaaaccagua

SEQ ID NO: 1117604 - RNA, 21 nt, Human
uaaauaaacaccaugauagga

SEQ ID NO: 1117605 - RNA, 20 nt, Human
uacaaccaaggcuugcugag

SEQ ID NO: 1117606 - RNA, 24 nt, Human
uacaaccaaggcuugcugaguggc

SEQ ID NO: 1117607 - RNA, 22 nt, Human
uacaugcucuucuuacaaugua

SEQ ID NO: 1117608 - RNA, 21 nt, Human
uaccuggaauguuauaugauc

SEQ ID NO: 1117609 - RNA, 20 nt, Human
uagcuaauuaaaauacuaua

SEQ ID NO: 1117610 - RNA, 23 nt, Human
uauacacccucuuuuugaaccuu

SEQ ID NO: 1117611 - RNA, 21 nt, Human
uaugacugauggccucaugaa

SEQ ID NO: 1117612 - RNA, 20 nt, Human
ucacuguaguugcggugaau

SEQ ID NO: 1117613 - RNA, 20 nt, Human
ucagaagccucaggcuccaa

SEQ ID NO: 1117614 - RNA, 18 nt, Human
ucagaauguggccuucuu

SEQ ID NO: 1117615 - RNA, 19 nt, Human
ucagcaggggucuccacag

SEQ ID NO: 1117616 - RNA, 20 nt, Human
ucaugcaaacagacugugca

SEQ ID NO: 1117617 - RNA, 25 nt, Human
ucauuugauuacaaauguaaucaaa

SEQ ID NO: 1117618 - RNA, 23 nt, Human
uccaggccccagggucugaacuc

SEQ ID NO: 1117619 - RNA, 24 nt, Human
ucccaaaauggccacaaugauauc

SEQ ID NO: 1117620 - RNA, 18 nt, Human
ucccagaagaaggguuca

SEQ ID NO: 1117621 - RNA, 20 nt, Human
ucccucagcaggggucucca

SEQ ID NO: 1117622 - RNA, 22 nt, Human
uccucaaaccauucauccuggu

SEQ ID NO: 1117623 - RNA, 23 nt, Human
uccuuguccuguggugcaggggu

SEQ ID NO: 1117624 - RNA, 23 nt, Human
ucucccaacuacaugcucuucuu

SEQ ID NO: 1117625 - RNA, 19 nt, Human
ucuugguuuccuaacugcu

SEQ ID NO: 1117626 - RNA, 18 nt, Human
ugaaaggcaucagcaucu

SEQ ID NO: 1117627 - RNA, 20 nt, Human
ugacauugugacauguugca

SEQ ID NO: 1117628 - RNA, 18 nt, Human
ugacuucuucaccaauga

SEQ ID NO: 1117629 - RNA, 23 nt, Human
ugacuuguuuuuuuuuccaccau

SEQ ID NO: 1117630 - RNA, 19 nt, Human
ugagagccuuggugcauuc

SEQ ID NO: 1117631 - RNA, 22 nt, Human
ugagggaaccuacagagguugg

SEQ ID NO: 1117632 - RNA, 18 nt, Human
ugauuuaaaggaagaaca

SEQ ID NO: 1117633 - RNA, 19 nt, Human
ugcacaaggauagauaccc

SEQ ID NO: 1117634 - RNA, 21 nt, Human
ugcacacaugugcuauuugug

SEQ ID NO: 1117635 - RNA, 19 nt, Human
ugcagggguugggauggag

SEQ ID NO: 1117636 - RNA, 21 nt, Human
ugcccccaaaugcucccaaac

SEQ ID NO: 1117637 - RNA, 24 nt, Human
ugccuccugcccccaaaugcuccc

SEQ ID NO: 1117638 - RNA, 24 nt, Human
ugcuagauaauccaguggagccaa

SEQ ID NO: 1117639 - RNA, 21 nt, Human
uggguuagcugaggcccugcu

SEQ ID NO: 1117640 - RNA, 24 nt, Human
uggugcagggguugggauggaggg

SEQ ID NO: 1117641 - RNA, 23 nt, Human
ugugcagcccauuucugucuauu

SEQ ID NO: 1117642 - RNA, 27 nt, Human
uguggugcagggguugggauggagggg

SEQ ID NO: 1117643 - RNA, 19 nt, Human
uguugaaguuauaaccccc

SEQ ID NO: 1117644 - RNA, 18 nt, Human
uuaaugaucuugguuucc

SEQ ID NO: 1117645 - RNA, 23 nt, Human
uucacaaaccagaaacagaacaa

SEQ ID NO: 1117646 - RNA, 24 nt, Human
uuccaccaucacuccucccuuuca

SEQ ID NO: 1117647 - RNA, 20 nt, Human
uucugcuggccaagccgggu

SEQ ID NO: 1117648 - RNA, 20 nt, Human
uucuuacaauguaacucuga

SEQ ID NO: 1117649 - RNA, 26 nt, Human
aacauccaucccauucacucagugac

SEQ ID NO: 1117650 - RNA, 23 nt, Human
aacugcaugagcugcaggaacca

SEQ ID NO: 1117651 - RNA, 23 nt, Human
accuagccaggcagcccccacag

SEQ ID NO: 1117652 - RNA, 22 nt, Human
accuuggugaggcauccccggc

SEQ ID NO: 1117653 - RNA, 21 nt, Human
agagaagugggagaaaugcca

SEQ ID NO: 1117654 - RNA, 19 nt, Human
agcaggcggcacccuccau

SEQ ID NO: 1117655 - RNA, 22 nt, Human
agccaggcagcccccacagucc

SEQ ID NO: 1117656 - RNA, 18 nt, Human
agcccccacaguccagcc

SEQ ID NO: 1117657 - RNA, 20 nt, Human
agcugcaggaaccagggacg

SEQ ID NO: 1117658 - RNA, 23 nt, Human
aucuguggccacauggguauucu

SEQ ID NO: 1117659 - RNA, 23 nt, Human
cacaguccagccacaccuccuuc

SEQ ID NO: 1117660 - RNA, 18 nt, Human
cacccuguggucugcgug

SEQ ID NO: 1117661 - RNA, 23 nt, Human
caccucagccaugccccaggggc

SEQ ID NO: 1117662 - RNA, 20 nt, Human
cagaaugaggaggaccccac

SEQ ID NO: 1117663 - RNA, 19 nt, Human
cagcccccacaguccagcc

SEQ ID NO: 1117664 - RNA, 24 nt, Human
cagcugcacagacaucugaaagcc

SEQ ID NO: 1117665 - RNA, 22 nt, Human
cagcuuccuuuucagcuucucc

SEQ ID NO: 1117666 - RNA, 25 nt, Human
caguccagccacaccuccuucccug

SEQ ID NO: 1117667 - RNA, 21 nt, Human
cagugguugcacacccugugg

SEQ ID NO: 1117668 - RNA, 18 nt, Human
cauccaucccauucacuc

SEQ ID NO: 1117669 - RNA, 25 nt, Human
cauccccggccuggcucuggcccug

SEQ ID NO: 1117670 - RNA, 26 nt, Human
caucugaaagccccaaacauccaucc

SEQ ID NO: 1117671 - RNA, 21 nt, Human
caugaaagaccuggcucuuaa

SEQ ID NO: 1117672 - RNA, 22 nt, Human
ccagaaugaggaggaccccaca

SEQ ID NO: 1117673 - RNA, 23 nt, Human
ccaggcagcccccacaguccagc

SEQ ID NO: 1117674 - RNA, 20 nt, Human
cccacagccucuagcugugc

SEQ ID NO: 1117675 - RNA, 24 nt, Human
ccccggccuggcucuggcccuggc

SEQ ID NO: 1117676 - RNA, 21 nt, Human
cccuggugugaaguggcgugg

SEQ ID NO: 1117677 - RNA, 21 nt, Human
cccuggugugaaguggcgugg

SEQ ID NO: 1117678 - RNA, 22 nt, Human
ccucagccaugccccaggggcc

SEQ ID NO: 1117679 - RNA, 19 nt, Human
ccuccugcagacgccgagg

SEQ ID NO: 1117680 - RNA, 24 nt, Human
ccuggcucuggcccuggcagaguc

SEQ ID NO: 1117681 - RNA, 21 nt, Human
ccugugguuuggucccaggac

SEQ ID NO: 1117682 - RNA, 23 nt, Human
cgaacccugacauuuuuauuauu

SEQ ID NO: 1117683 - RNA, 22 nt, Human
cuagccaggcagcccccacagu

SEQ ID NO: 1117684 - RNA, 20 nt, Human
cuccuaaucucagguacagc

SEQ ID NO: 1117685 - RNA, 18 nt, Human
cugauaaauguagaugug

SEQ ID NO: 1117686 - RNA, 21 nt, Human
cuguggccacauggguauucc

SEQ ID NO: 1117687 - RNA, 21 nt, Human
cuugcagcuauguaaaacuac

SEQ ID NO: 1117688 - RNA, 22 nt, Human
cuuguuuucuuaaccuuacauu

SEQ ID NO: 1117689 - RNA, 21 nt, Human
gaagugggagaaaugccaccc

SEQ ID NO: 1117690 - RNA, 18 nt, Human
gaucaggguagguggugc

SEQ ID NO: 1117691 - RNA, 21 nt, Human
gccagaaugaggaggacccca

SEQ ID NO: 1117692 - RNA, 19 nt, Human
gccuggaucuugcacaagg

SEQ ID NO: 1117693 - RNA, 22 nt, Human
gcugccagaaugaggaggaccc

SEQ ID NO: 1117694 - RNA, 19 nt, Human
ggagaagguggguggggcu

SEQ ID NO: 1117695 - RNA, 19 nt, Human
ggaucaggguagguggugc

SEQ ID NO: 1117696 - RNA, 20 nt, Human
ggcaugguguccagugcagc

SEQ ID NO: 1117697 - RNA, 21 nt, Human
gggaaaacgcuugucugcagg

SEQ ID NO: 1117698 - RNA, 24 nt, Human
gugaggcauccccggccuggcucu

SEQ ID NO: 1117699 - RNA, 19 nt, Human
gugcugagugccaugcccc

SEQ ID NO: 1117700 - RNA, 22 nt, Human
guuaguacgcguacguguuacu

SEQ ID NO: 1117701 - RNA, 26 nt, Human
uaaugaaauggggcccuuccccucuc

SEQ ID NO: 1117702 - RNA, 19 nt, Human
uacagccgaccuucaguac

SEQ ID NO: 1117703 - RNA, 21 nt, Human
uagaugugaaaacaugauagg

SEQ ID NO: 1117704 - RNA, 19 nt, Human
uagccaggcagcccccaca

SEQ ID NO: 1117705 - RNA, 22 nt, Human
uauguaaaacuacauacgcaca

SEQ ID NO: 1117706 - RNA, 23 nt, Human
uccaagacuuuccaaacuguacu

SEQ ID NO: 1117707 - RNA, 23 nt, Human
uccucauacaauuaaggucccau

SEQ ID NO: 1117708 - RNA, 19 nt, Human
uccugcacucgugccugga

SEQ ID NO: 1117709 - RNA, 25 nt, Human
ucugcugucagaaccuuggugaggc

SEQ ID NO: 1117710 - RNA, 21 nt, Human
ugacagguuguugccaaggag

SEQ ID NO: 1117711 - RNA, 19 nt, Human
ugagaagggaaaacgcuug

SEQ ID NO: 1117712 - RNA, 21 nt, Human
ugagagaagugggagaaaugc

SEQ ID NO: 1117713 - RNA, 18 nt, Human
ugaggcauccccggccug

SEQ ID NO: 1117714 - RNA, 22 nt, Human
ugcacacccuguggucugcgug

SEQ ID NO: 1117715 - RNA, 21 nt, Human
ugccagaaugaggaggacccc

SEQ ID NO: 1117716 - RNA, 18 nt, Human
ugccauggaaagcccaca

SEQ ID NO: 1117717 - RNA, 19 nt, Human
ugccccaggggcccagcug

SEQ ID NO: 1117718 - RNA, 20 nt, Human
ugcugccagaaugaggagga

SEQ ID NO: 1117719 - RNA, 23 nt, Human
uggcacauagcaggacucaugaa

SEQ ID NO: 1117720 - RNA, 23 nt, Human
uggcucuggcccuggcagagucc

SEQ ID NO: 1117721 - RNA, 22 nt, Human
uggggcccuuccccucucauga

SEQ ID NO: 1117722 - RNA, 30 nt, Human
uggugaggcauccccggccuggcucuggcc

SEQ ID NO: 1117723 - RNA, 18 nt, Human
uguagaacgcuauaaggu

SEQ ID NO: 1117724 - RNA, 20 nt, Human
ugucuagacuuguguugggg

SEQ ID NO: 1117725 - RNA, 22 nt, Human
ugucuagacuuguguugggggc

SEQ ID NO: 1117726 - RNA, 22 nt, Human
uguguguugaugauagaauucu

SEQ ID NO: 1117727 - RNA, 19 nt, Human
uguguugaugauagaauuc

SEQ ID NO: 1117728 - RNA, 20 nt, Human
uuaauauagcagcuuccuuu

SEQ ID NO: 1117729 - RNA, 19 nt, Human
uuacagugaaauucuguga

SEQ ID NO: 1117730 - RNA, 24 nt, Human
uuacuuaauauagcagcuuccuuu

SEQ ID NO: 1117731 - RNA, 24 nt, Human
uucugugagagaagugggagaaau

SEQ ID NO: 1117732 - RNA, 21 nt, Human
uuuucagcuucuccuaaucuc

SEQ ID NO: 1117733 - RNA, 22 nt, Human
aggagaaaccaaaauugcaauc

SEQ ID NO: 1117734 - RNA, 20 nt, Human
caaaauugcaauccagggac

SEQ ID NO: 1117735 - RNA, 22 nt, Human
ugagaacagaaggagaaaccaa

SEQ ID NO: 1117736 - RNA, 24 nt, Human
acagugccucccagccugggcggg

SEQ ID NO: 1117737 - RNA, 19 nt, Human
agccugccccgccagggcc

SEQ ID NO: 1117738 - RNA, 18 nt, Human
cagcagugcguggguggc

SEQ ID NO: 1117739 - RNA, 19 nt, Human
cagggcccuggaaucagag

SEQ ID NO: 1117740 - RNA, 23 nt, Human
ccaccugaagcgucggaucccua

SEQ ID NO: 1117741 - RNA, 19 nt, Human
ccagcgccgcggggcagag

SEQ ID NO: 1117742 - RNA, 22 nt, Human
ccccacagaccuucggccuccg

SEQ ID NO: 1117743 - RNA, 20 nt, Human
ccccgcugccacguguggca

SEQ ID NO: 1117744 - RNA, 22 nt, Human
ccuacagugccucccagccugg

SEQ ID NO: 1117745 - RNA, 26 nt, Human
ccuacagugccucccagccugggcgg

SEQ ID NO: 1117746 - RNA, 21 nt, Human
ccucccagccugggcgggagc

SEQ ID NO: 1117747 - RNA, 22 nt, Human
ccugccccgccagggcccugga

SEQ ID NO: 1117748 - RNA, 22 nt, Human
ccuggaaucagagaaagucgcu

SEQ ID NO: 1117749 - RNA, 23 nt, Human
cgacggcacgaggaacuccuguc

SEQ ID NO: 1117750 - RNA, 19 nt, Human
cggaucccuacagugccuc

SEQ ID NO: 1117751 - RNA, 23 nt, Human
cucagccccaccccagaagcggc

SEQ ID NO: 1117752 - RNA, 19 nt, Human
cugcaccuuggcccuccgc

SEQ ID NO: 1117753 - RNA, 20 nt, Human
cugcagccucagccccaccu

SEQ ID NO: 1117754 - RNA, 23 nt, Human
cuggagccugccccgccagggcc

SEQ ID NO: 1117755 - RNA, 18 nt, Human
gccccaccccagaagcgg

SEQ ID NO: 1117756 - RNA, 19 nt, Human
gccccgccagggcccugga

SEQ ID NO: 1117757 - RNA, 22 nt, Human
gcucuuuggccaccugaagccg

SEQ ID NO: 1117758 - RNA, 26 nt, Human
ggcacugaguccgccaggaccacggu

SEQ ID NO: 1117759 - RNA, 19 nt, Human
gggguccuuggugcgaaag

SEQ ID NO: 1117760 - RNA, 21 nt, Human
guacuggagccugccccgcca

SEQ ID NO: 1117761 - RNA, 20 nt, Human
uagcgcccuccuucguccuc

SEQ ID NO: 1117762 - RNA, 22 nt, Human
ucccuacagugccucccagccu

SEQ ID NO: 1117763 - RNA, 24 nt, Human
uccuucguccucggcccuuccgac

SEQ ID NO: 1117764 - RNA, 22 nt, Human
uccuuggugcgaaagggaggca

SEQ ID NO: 1117765 - RNA, 21 nt, Human
ucgcugcggugggcguucucg

SEQ ID NO: 1117766 - RNA, 18 nt, Human
ugaauuagcgcccuccuu

SEQ ID NO: 1117767 - RNA, 22 nt, Human
ugccucccagccugggcgggag

SEQ ID NO: 1117768 - RNA, 19 nt, Human
uggccaccugaagcgucgg

SEQ ID NO: 1117769 - RNA, 23 nt, Human
uggccaccugaagcgucggaucc

SEQ ID NO: 1117770 - RNA, 21 nt, Human
agaacaaacauuaccugaaga

SEQ ID NO: 1117771 - RNA, 24 nt, Human
aucaugcaccacagaacaaacauu

SEQ ID NO: 1117772 - RNA, 20 nt, Human
caccacagaacaaacauuac

SEQ ID NO: 1117773 - RNA, 18 nt, Human
ccaaacuaauggguuucu

SEQ ID NO: 1117774 - RNA, 24 nt, Human
uaauggguuucuuccugaagaaca

SEQ ID NO: 1117775 - RNA, 18 nt, Human
uaccugaagaagauucca

SEQ ID NO: 1117776 - RNA, 21 nt, Human
uagagcagaaaagcucugucu

SEQ ID NO: 1117777 - RNA, 27 nt, Human
uagcuuuacuguaugcagagaaacaau

SEQ ID NO: 1117778 - RNA, 23 nt, Human
ucacucguagucucaaucauuuc

SEQ ID NO: 1117779 - RNA, 21 nt, Human
uuacuguaugcagagaaacaa

SEQ ID NO: 1117780 - RNA, 19 nt, Human
uuccugaagaacaguuucc

SEQ ID NO: 1117781 - RNA, 18 nt, Human
cagcucccggccccgcuc

SEQ ID NO: 1117782 - RNA, 20 nt, Human
cagcucccggccccgcuccu

SEQ ID NO: 1117783 - RNA, 21 nt, Human
cauacagucuacugcuaaacc

SEQ ID NO: 1117784 - RNA, 19 nt, Human
ccacuccgagcacgcccgc

SEQ ID NO: 1117785 - RNA, 25 nt, Human
cccccgccgcgagccgggcucuccc

SEQ ID NO: 1117786 - RNA, 22 nt, Human
cgaagccccgcccccuccgccu

SEQ ID NO: 1117787 - RNA, 18 nt, Human
cgaccacuccgagcacgc

SEQ ID NO: 1117788 - RNA, 24 nt, Human
cggccccgcuccuccggucccuca

SEQ ID NO: 1117789 - RNA, 19 nt, Human
cucagacuugcacucagau

SEQ ID NO: 1117790 - RNA, 20 nt, Human
cucgcagcucccggccccgc

SEQ ID NO: 1117791 - RNA, 20 nt, Human
cucgcagcucccggccccgc

SEQ ID NO: 1117792 - RNA, 22 nt, Human
cuggaacucucuugaaagacca

SEQ ID NO: 1117793 - RNA, 21 nt, Human
ucuacugcuaaacccugggac

SEQ ID NO: 1117794 - RNA, 21 nt, Human
ucugggugaaagugccagucu

SEQ ID NO: 1117795 - RNA, 22 nt, Human
ucugggugaaagugccagucug

SEQ ID NO: 1117796 - RNA, 18 nt, Human
ugaaagugccagucugga

SEQ ID NO: 1117797 - RNA, 25 nt, Human
uucugggugaaagugccagucugga

SEQ ID NO: 1117798 - RNA, 23 nt, Human
uugaaagaccauacagucuacug

SEQ ID NO: 1117799 - RNA, 19 nt, Human
uugguucugggugaaagug

SEQ ID NO: 1117800 - RNA, 22 nt, Human
uugguucugggugaaagugcca

SEQ ID NO: 1117801 - RNA, 24 nt, Human
uagccagcugcuucaggaaaacca

SEQ ID NO: 1117802 - RNA, 19 nt, Human
uccagucacaaguaacaaa

SEQ ID NO: 1117803 - RNA, 19 nt, Human
aaagaugggugagggaugg

SEQ ID NO: 1117804 - RNA, 24 nt, Human
aaagugcugggauuacaggcguga

SEQ ID NO: 1117805 - RNA, 23 nt, Human
aaccagugccuguuaguagcaca

SEQ ID NO: 1117806 - RNA, 22 nt, Human
aagaagcugggauuauaggcau

SEQ ID NO: 1117807 - RNA, 19 nt, Human
aagccaaagaaacucagau

SEQ ID NO: 1117808 - RNA, 21 nt, Human
aagcugcagggagagacugug

SEQ ID NO: 1117809 - RNA, 18 nt, Human
aaggaagugaaacugcac

SEQ ID NO: 1117810 - RNA, 22 nt, Human
aaguagcugggauuacaggugc

SEQ ID NO: 1117811 - RNA, 24 nt, Human
aagugauccacccgccucagccuc

SEQ ID NO: 1117812 - RNA, 19 nt, Human
aagugcugggauuacaggc

SEQ ID NO: 1117813 - RNA, 19 nt, Human
aagugcugggauuacaggc

SEQ ID NO: 1117814 - RNA, 26 nt, Human
aagugcugggauuacaggcgugagcc

SEQ ID NO: 1117815 - RNA, 20 nt, Human
acacugagugccugugaguc

SEQ ID NO: 1117816 - RNA, 19 nt, Human
acccaggcuggagugcaau

SEQ ID NO: 1117817 - RNA, 21 nt, Human
acccaucugucuguuccacuc

SEQ ID NO: 1117818 - RNA, 25 nt, Human
acccgccucagccucccaaagugcu

SEQ ID NO: 1117819 - RNA, 18 nt, Human
acuguguuggccaggcug

SEQ ID NO: 1117820 - RNA, 19 nt, Human
agacaaggagacaagccaa

SEQ ID NO: 1117821 - RNA, 21 nt, Human
agacaaggagacaagccaaga

SEQ ID NO: 1117822 - RNA, 20 nt, Human
agagguaaggcccaaucacu

SEQ ID NO: 1117823 - RNA, 23 nt, Human
agauaaccuagguacaaaagucu

SEQ ID NO: 1117824 - RNA, 23 nt, Human
agaucuggagguugugaucagcu

SEQ ID NO: 1117825 - RNA, 23 nt, Human
aggagccagaagccaaagaaacu

SEQ ID NO: 1117826 - RNA, 23 nt, Human
aggcaagacugaagacaaggaga

SEQ ID NO: 1117827 - RNA, 19 nt, Human
aggcaugccccaccacacc

SEQ ID NO: 1117828 - RNA, 18 nt, Human
agggaggagucugagggc

SEQ ID NO: 1117829 - RNA, 20 nt, Human
agggauggaggugauuagaa

SEQ ID NO: 1117830 - RNA, 23 nt, Human
agguagaucuggagguugugauc

SEQ ID NO: 1117831 - RNA, 23 nt, Human
agugcaaucucagcucgcugcaa

SEQ ID NO: 1117832 - RNA, 24 nt, Human
agugcccccacucagaggagccag

SEQ ID NO: 1117833 - RNA, 24 nt, Human
agugccucagccucccaagaagcu

SEQ ID NO: 1117834 - RNA, 21 nt, Human
auagaucacuggcaaaaacca

SEQ ID NO: 1117835 - RNA, 21 nt, Human
augagaaaauugaggcucaga

SEQ ID NO: 1117836 - RNA, 18 nt, Human
augggguuccaccauguu

SEQ ID NO: 1117837 - RNA, 22 nt, Human
augggguuccaccauguuggcc

SEQ ID NO: 1117838 - RNA, 24 nt, Human
augggguuccaccauguuggccag

SEQ ID NO: 1117839 - RNA, 19 nt, Human
auuacaggugccugccacc

SEQ ID NO: 1117840 - RNA, 21 nt, Human
auucuccugccucagccuccc

SEQ ID NO: 1117841 - RNA, 19 nt, Human
auuugcaugucauccuugg

SEQ ID NO: 1117842 - RNA, 23 nt, Human
auuuuccucucugcuuuucuaga

SEQ ID NO: 1117843 - RNA, 24 nt, Human
auuuuuguauuuuuaguagagaug

SEQ ID NO: 1117844 - RNA, 24 nt, Human
caaagugcugggauuacaggcgug

SEQ ID NO: 1117845 - RNA, 26 nt, Human
caaauuccugacuucaagugauccaa

SEQ ID NO: 1117846 - RNA, 23 nt, Human
caaccuccaccuccuggguucaa

SEQ ID NO: 1117847 - RNA, 22 nt, Human
caagcaauucuccugccucagc

SEQ ID NO: 1117848 - RNA, 27 nt, Human
caagcaauucuccugccucagccuccc

SEQ ID NO: 1117849 - RNA, 22 nt, Human
caagccaagacccaucaaagaa

SEQ ID NO: 1117850 - RNA, 20 nt, Human
caaggagacaagccaagacc

SEQ ID NO: 1117851 - RNA, 23 nt, Human
cacaaaacaauccuaaaaggcag

SEQ ID NO: 1117852 - RNA, 24 nt, Human
cacaaaacaauccuaaaaggcagg

SEQ ID NO: 1117853 - RNA, 18 nt, Human
cacagcccgugcucuuac

SEQ ID NO: 1117854 - RNA, 22 nt, Human
cacauuagaaucacccagcagc

SEQ ID NO: 1117855 - RNA, 24 nt, Human
caccacaccuggcuaauuuuugua

SEQ ID NO: 1117856 - RNA, 24 nt, Human
caccacgccuagcuaauuuuugua

SEQ ID NO: 1117857 - RNA, 20 nt, Human
caccauguuggccagcuggu

SEQ ID NO: 1117858 - RNA, 22 nt, Human
caccauguuggccagcugguuc

SEQ ID NO: 1117859 - RNA, 23 nt, Human
cacccaucugucuguuccacuca

SEQ ID NO: 1117860 - RNA, 23 nt, Human
cacccgccucagccucccaaagu

SEQ ID NO: 1117861 - RNA, 19 nt, Human
cacucugcaccugcucuca

SEQ ID NO: 1117862 - RNA, 23 nt, Human
cacugccccacccuacccaggaa

SEQ ID NO: 1117863 - RNA, 19 nt, Human
cacuguguuggccaggcug

SEQ ID NO: 1117864 - RNA, 21 nt, Human
cacuguguuggccaggcuggu

SEQ ID NO: 1117865 - RNA, 22 nt, Human
cacuguguuggccaggcugguc

SEQ ID NO: 1117866 - RNA, 21 nt, Human
cagaagccaaagaaacucaga

SEQ ID NO: 1117867 - RNA, 24 nt, Human
cagagucuugcucugucgcccagg

SEQ ID NO: 1117868 - RNA, 21 nt, Human
cagaugauguguagugccccc

SEQ ID NO: 1117869 - RNA, 24 nt, Human
cagcccuguuuuaccauguggagg

SEQ ID NO: 1117870 - RNA, 22 nt, Human
cagccucccaagaagcugggau

SEQ ID NO: 1117871 - RNA, 20 nt, Human
cagcucacaucccauccccu

SEQ ID NO: 1117872 - RNA, 20 nt, Human
caggagaggauggccaugcc

SEQ ID NO: 1117873 - RNA, 19 nt, Human
caggugccugccaccacgc

SEQ ID NO: 1117874 - RNA, 21 nt, Human
caggugccugccaccacgccu

SEQ ID NO: 1117875 - RNA, 23 nt, Human
cauccccauuuuacagaugagaa

SEQ ID NO: 1117876 - RNA, 24 nt, Human
cauguguugaucacuuaaaacucu

SEQ ID NO: 1117877 - RNA, 21 nt, Human
cauucuguucacugccccacc

SEQ ID NO: 1117878 - RNA, 22 nt, Human
cauuuguuuaaaaaacugagga

SEQ ID NO: 1117879 - RNA, 22 nt, Human
ccaaagugcugggauuacaggc

SEQ ID NO: 1117880 - RNA, 22 nt, Human
ccaaagugcugggauuacaggc

SEQ ID NO: 1117881 - RNA, 24 nt, Human
ccaaagugcugggauuacaggcgu

SEQ ID NO: 1117882 - RNA, 24 nt, Human
ccaagaagcugggauuauaggcau

SEQ ID NO: 1117883 - RNA, 21 nt, Human
ccaaguagcugggauuacagg

SEQ ID NO: 1117884 - RNA, 20 nt, Human
ccaccacgccuagcuaauuu

SEQ ID NO: 1117885 - RNA, 26 nt, Human
ccacccgccucagccucccaaagugc

SEQ ID NO: 1117886 - RNA, 27 nt, Human
ccaccuccuggguucaagcaauucuuu

SEQ ID NO: 1117887 - RNA, 19 nt, Human
ccacugcacccagccucac

SEQ ID NO: 1117888 - RNA, 23 nt, Human
cccaagaagcugggauuauaggc

SEQ ID NO: 1117889 - RNA, 24 nt, Human
cccaagaagcugggauuauaggca

SEQ ID NO: 1117890 - RNA, 22 nt, Human
cccaaguagcugggauuacagg

SEQ ID NO: 1117891 - RNA, 23 nt, Human
cccaaguagcugggauuacaggu

SEQ ID NO: 1117892 - RNA, 24 nt, Human
cccaaguagcugggauuacaggug

SEQ ID NO: 1117893 - RNA, 21 nt, Human
cccugaauuccagcagcaccc

SEQ ID NO: 1117894 - RNA, 23 nt, Human
ccgccucagccucccaaagugcu

SEQ ID NO: 1117895 - RNA, 25 nt, Human
ccucacucccuucccugaauuccag

SEQ ID NO: 1117896 - RNA, 19 nt, Human
ccuccaccuccuggguuca

SEQ ID NO: 1117897 - RNA, 24 nt, Human
ccuccuggguucaagcaauucucc

SEQ ID NO: 1117898 - RNA, 22 nt, Human
ccugacuucaagugauccaccc

SEQ ID NO: 1117899 - RNA, 23 nt, Human
ccuggguucaagcaauucuccug

SEQ ID NO: 1117900 - RNA, 24 nt, Human
ccuguuguuaggacaagccggggc

SEQ ID NO: 1117901 - RNA, 24 nt, Human
cgccucagccucccaaagugcugg

SEQ ID NO: 1117902 - RNA, 23 nt, Human
cuaauuuuuguauuuuuaguaga

SEQ ID NO: 1117903 - RNA, 20 nt, Human
cuaguccaagcaggucaaug

SEQ ID NO: 1117904 - RNA, 24 nt, Human
cucagccucccaaguagcugggau

SEQ ID NO: 1117905 - RNA, 21 nt, Human
cucaguuuucaccguggccag

SEQ ID NO: 1117906 - RNA, 21 nt, Human
cuccuggguucaagcaauucu

SEQ ID NO: 1117907 - RNA, 24 nt, Human
cucgcugcaaccuccaccuccugg

SEQ ID NO: 1117908 - RNA, 24 nt, Human
cucucaccacacugucuguugacc

SEQ ID NO: 1117909 - RNA, 18 nt, Human
cugcaaccuccaccuccu

SEQ ID NO: 1117910 - RNA, 21 nt, Human
cugcaaccuccaccuccuggg

SEQ ID NO: 1117911 - RNA, 23 nt, Human
cugcaaccuccaccuccuggguu

SEQ ID NO: 1117912 - RNA, 20 nt, Human
cugcaccugcucucaccaca

SEQ ID NO: 1117913 - RNA, 21 nt, Human
cugcccccucacucccuuccc

SEQ ID NO: 1117914 - RNA, 23 nt, Human
cugccucagccucccaaguagcu

SEQ ID NO: 1117915 - RNA, 24 nt, Human
cugggguuucacuguguuggccag

SEQ ID NO: 1117916 - RNA, 18 nt, Human
cugucacccaggcuggag

SEQ ID NO: 1117917 - RNA, 19 nt, Human
cugucgcccaggcuggagu

SEQ ID NO: 1117918 - RNA, 24 nt, Human
cuuuuaguagagcugggguuucac

SEQ ID NO: 1117919 - RNA, 20 nt, Human
cuuuuuuuuuuuuuuuuugg

SEQ ID NO: 1117920 - RNA, 22 nt, Human
gaagugaaacugcacaagguca

SEQ ID NO: 1117921 - RNA, 20 nt, Human
gacaaggagacaagccaaga

SEQ ID NO: 1117922 - RNA, 20 nt, Human
gacugaagacaaggagacaa

SEQ ID NO: 1117923 - RNA, 24 nt, Human
gacuucaagugauccacccgccuc

SEQ ID NO: 1117924 - RNA, 21 nt, Human
gagacagagucuugcucuguc

SEQ ID NO: 1117925 - RNA, 19 nt, Human
gaggcaggacugccaggug

SEQ ID NO: 1117926 - RNA, 22 nt, Human
gagggaggagucugagggcucc

SEQ ID NO: 1117927 - RNA, 18 nt, Human
gauuacaggcgugagcca

SEQ ID NO: 1117928 - RNA, 22 nt, Human
gauuacaggcgugagccacugc

SEQ ID NO: 1117929 - RNA, 23 nt, Human
gauuacaggcgugagccacugca

SEQ ID NO: 1117930 - RNA, 18 nt, Human
gauuacaggugccugcca

SEQ ID NO: 1117931 - RNA, 22 nt, Human
gcaaccuccaccuccuggguuc

SEQ ID NO: 1117932 - RNA, 22 nt, Human
gcaagacugaagacaaggagac

SEQ ID NO: 1117933 - RNA, 21 nt, Human
gccaggcuggucccaaauucc

SEQ ID NO: 1117934 - RNA, 19 nt, Human
gcccaggcuggaguacagu

SEQ ID NO: 1117935 - RNA, 20 nt, Human
gcccccucacucccuucccu

SEQ ID NO: 1117936 - RNA, 20 nt, Human
gccucagccucccaaguagc

SEQ ID NO: 1117937 - RNA, 25 nt, Human
gcucugucacccaggcuggagugca

SEQ ID NO: 1117938 - RNA, 25 nt, Human
gcucugucgcccaggcuggaguaca

SEQ ID NO: 1117939 - RNA, 18 nt, Human
gcugcaaccuccaccucc

SEQ ID NO: 1117940 - RNA, 19 nt, Human
ggagaagcagauaaccuag

SEQ ID NO: 1117941 - RNA, 25 nt, Human
ggagaagcagauaaccuagguacaa

SEQ ID NO: 1117942 - RNA, 22 nt, Human
ggaguacagugccucagccucc

SEQ ID NO: 1117943 - RNA, 22 nt, Human
ggcuggagugcaaucucagcuc

SEQ ID NO: 1117944 - RNA, 24 nt, Human
ggcuggucccaaauuccugacuuc

SEQ ID NO: 1117945 - RNA, 20 nt, Human
gggaacacuucacacauuug

SEQ ID NO: 1117946 - RNA, 20 nt, Human
gggcuccugggcccucgccc

SEQ ID NO: 1117947 - RNA, 22 nt, Human
gggguuccaccauguuggccag

SEQ ID NO: 1117948 - RNA, 22 nt, Human
gggguuucacuguguuggccag

SEQ ID NO: 1117949 - RNA, 23 nt, Human
gggguuucacuguguuggccagg

SEQ ID NO: 1117950 - RNA, 20 nt, Human
gguacaaaagucuugagaug

SEQ ID NO: 1117951 - RNA, 21 nt, Human
ggugauuagaacuuggaaaaa

SEQ ID NO: 1117952 - RNA, 23 nt, Human
guagagaugggguuccaccaugu

SEQ ID NO: 1117953 - RNA, 18 nt, Human
guagcugggauuacaggu

SEQ ID NO: 1117954 - RNA, 25 nt, Human
guccaauuauaguacaugugcugcu

SEQ ID NO: 1117955 - RNA, 24 nt, Human
gugauccacccgccucagccuccc

SEQ ID NO: 1117956 - RNA, 20 nt, Human
guggaggguggcuuaguaca

SEQ ID NO: 1117957 - RNA, 23 nt, Human
guggaggguggcuuaguacaugg

SEQ ID NO: 1117958 - RNA, 21 nt, Human
uaaaaaacugaggaccacugg

SEQ ID NO: 1117959 - RNA, 18 nt, Human
uaaaaggcagguauuugc

SEQ ID NO: 1117960 - RNA, 20 nt, Human
uaaaucaacacugcccccuc

SEQ ID NO: 1117961 - RNA, 22 nt, Human
uaaccacugaggaugcucaggu

SEQ ID NO: 1117962 - RNA, 25 nt, Human
uaaggcccaaucacuggguuuuggu

SEQ ID NO: 1117963 - RNA, 22 nt, Human
uaauuuuuguacuuuuaguaga

SEQ ID NO: 1117964 - RNA, 24 nt, Human
uaauuuuuguauuuuuaguagaga

SEQ ID NO: 1117965 - RNA, 19 nt, Human
uacaggcgugagccacugc

SEQ ID NO: 1117966 - RNA, 24 nt, Human
uacaggcgugagccacugcaccca

SEQ ID NO: 1117967 - RNA, 22 nt, Human
uacaggugccugccaccacgcc

SEQ ID NO: 1117968 - RNA, 19 nt, Human
uacccaggaaggccuuucc

SEQ ID NO: 1117969 - RNA, 22 nt, Human
uagagaugggguuccaccaugu

SEQ ID NO: 1117970 - RNA, 25 nt, Human
uagauggaggcaagacugaagacaa

SEQ ID NO: 1117971 - RNA, 19 nt, Human
uagauucugguccagcuca

SEQ ID NO: 1117972 - RNA, 24 nt, Human
uaggagaagcagauaaccuaggua

SEQ ID NO: 1117973 - RNA, 24 nt, Human
uaguagagaugggguuccaccaug

SEQ ID NO: 1117974 - RNA, 26 nt, Human
uaguagagaugggguuccaccauguu

SEQ ID NO: 1117975 - RNA, 20 nt, Human
uaguagagcugggguuucac

SEQ ID NO: 1117976 - RNA, 20 nt, Human
uaguagagcugggguuucac

SEQ ID NO: 1117977 - RNA, 24 nt, Human
uaguagagcugggguuucacugug

SEQ ID NO: 1117978 - RNA, 21 nt, Human
uaugaagcuacuuuuauuuaa

SEQ ID NO: 1117979 - RNA, 23 nt, Human
ucaacacugcccccucacucccu

SEQ ID NO: 1117980 - RNA, 19 nt, Human
ucaagcaauucuccugccu

SEQ ID NO: 1117981 - RNA, 20 nt, Human
ucacccagcagcuccggacc

SEQ ID NO: 1117982 - RNA, 22 nt, Human
ucacccaggcuggagugcaauc

SEQ ID NO: 1117983 - RNA, 22 nt, Human
ucacuguguuggccaggcuggu

SEQ ID NO: 1117984 - RNA, 21 nt, Human
ucacuuaucauuauuaaacuc

SEQ ID NO: 1117985 - RNA, 20 nt, Human
ucagccucccaaguagcugg

SEQ ID NO: 1117986 - RNA, 21 nt, Human
uccacccgccucagccuccca

SEQ ID NO: 1117987 - RNA, 24 nt, Human
ucccaaagugcugggauuacaggc

SEQ ID NO: 1117988 - RNA, 24 nt, Human
ucccaagaagcugggauuauaggc

SEQ ID NO: 1117989 - RNA, 23 nt, Human
ucccaaguagcugggauuacagg

SEQ ID NO: 1117990 - RNA, 24 nt, Human
ucccaaguagcugggauuacaggu

SEQ ID NO: 1117991 - RNA, 18 nt, Human
ucccuucccugaauucca

SEQ ID NO: 1117992 - RNA, 24 nt, Human
uccugggcccucgccccucgggag

SEQ ID NO: 1117993 - RNA, 21 nt, Human
uccuggguucaagcaauucuc

SEQ ID NO: 1117994 - RNA, 24 nt, Human
uccuggguucaagcaauucuccug

SEQ ID NO: 1117995 - RNA, 23 nt, Human
ucgcccaggcuggaguacagugc

SEQ ID NO: 1117996 - RNA, 24 nt, Human
ucgcugcaaccuccaccuccuggg

SEQ ID NO: 1117997 - RNA, 25 nt, Human
ucgcugcaaccuccaccuccugggu

SEQ ID NO: 1117998 - RNA, 27 nt, Human
ucgcugcaaccuccaccuccuggguuc

SEQ ID NO: 1117999 - RNA, 26 nt, Human
ucuccugccucagccucccaaguagc

SEQ ID NO: 1118000 - RNA, 22 nt, Human
ucucugugcugugauaucacuc

SEQ ID NO: 1118001 - RNA, 24 nt, Human
ucugucacccaggcuggagugcaa

SEQ ID NO: 1118002 - RNA, 18 nt, Human
ucugucgcccaggcugga

SEQ ID NO: 1118003 - RNA, 23 nt, Human
ucuugcucugucacccaggcugg

SEQ ID NO: 1118004 - RNA, 24 nt, Human
ucuugcucugucacccaggcugga

SEQ ID NO: 1118005 - RNA, 23 nt, Human
ucuugcucugucgcccaggcugg

SEQ ID NO: 1118006 - RNA, 24 nt, Human
ucuugcucugucgcccaggcugga

SEQ ID NO: 1118007 - RNA, 19 nt, Human
ugaccagcuagcccucccc

SEQ ID NO: 1118008 - RNA, 21 nt, Human
ugacuucaagugauccacccg

SEQ ID NO: 1118009 - RNA, 24 nt, Human
ugacuucaagugauccacccgccu

SEQ ID NO: 1118010 - RNA, 18 nt, Human
ugagacagagucuugcuc

SEQ ID NO: 1118011 - RNA, 22 nt, Human
ugagacagagucuugcucuguc

SEQ ID NO: 1118012 - RNA, 25 nt, Human
ugaggcucagagaggggaaggaagu

SEQ ID NO: 1118013 - RNA, 23 nt, Human
ugagugccugugagucagcuuug

SEQ ID NO: 1118014 - RNA, 20 nt, Human
ugauaucacucugcaccugc

SEQ ID NO: 1118015 - RNA, 22 nt, Human
ugaugcgugagggaggagucug

SEQ ID NO: 1118016 - RNA, 19 nt, Human
ugauuuggggguguuucuc

SEQ ID NO: 1118017 - RNA, 20 nt, Human
ugcacagcccgugcucuuac

SEQ ID NO: 1118018 - RNA, 24 nt, Human
ugccucagccucccaagaagcugg

SEQ ID NO: 1118019 - RNA, 24 nt, Human
ugccucagccucccaaguagcugg

SEQ ID NO: 1118020 - RNA, 24 nt, Human
ugcucugucacccaggcuggagug

SEQ ID NO: 1118021 - RNA, 22 nt, Human
ugcucugucgcccaggcuggag

SEQ ID NO: 1118022 - RNA, 23 nt, Human
ugcucuuacccuugucccuuggu

SEQ ID NO: 1118023 - RNA, 24 nt, Human
ugcugggauuacaggcgugagcca

SEQ ID NO: 1118024 - RNA, 22 nt, Human
uggauggguugcuucucugugc

SEQ ID NO: 1118025 - RNA, 24 nt, Human
uggccaggcuggucccaaauuccu

SEQ ID NO: 1118026 - RNA, 18 nt, Human
ugggauuacaggcgugag

SEQ ID NO: 1118027 - RNA, 19 nt, Human
ugggauuacaggcgugagc

SEQ ID NO: 1118028 - RNA, 21 nt, Human
ugggauuacaggcgugagcca

SEQ ID NO: 1118029 - RNA, 22 nt, Human
ugggauuacaggcgugagccac

SEQ ID NO: 1118030 - RNA, 22 nt, Human
ugggauuacaggcgugagccac

SEQ ID NO: 1118031 - RNA, 24 nt, Human
ugggauuacaggcgugagccacug

SEQ ID NO: 1118032 - RNA, 26 nt, Human
ugggauuacaggcgugagccacugca

SEQ ID NO: 1118033 - RNA, 21 nt, Human
ugggauuacaggugccugcca

SEQ ID NO: 1118034 - RNA, 22 nt, Human
ugggauuacaggugccugccac

SEQ ID NO: 1118035 - RNA, 24 nt, Human
ugggauuacaggugccugccacca

SEQ ID NO: 1118036 - RNA, 21 nt, Human
ugggauuauaggcaugcccca

SEQ ID NO: 1118037 - RNA, 24 nt, Human
ugggauuauaggcaugccccacca

SEQ ID NO: 1118038 - RNA, 19 nt, Human
ugggguuccaccauguugg

SEQ ID NO: 1118039 - RNA, 24 nt, Human
ugggguuucacuguguuggccagg

SEQ ID NO: 1118040 - RNA, 23 nt, Human
ugggugagggaugggcugccugg

SEQ ID NO: 1118041 - RNA, 21 nt, Human
uggguucaagcaauucuccug

SEQ ID NO: 1118042 - RNA, 23 nt, Human
uggguucaagcaauucuccugcc

SEQ ID NO: 1118043 - RNA, 24 nt, Human
uggguucaagcaauucuccugccu

SEQ ID NO: 1118044 - RNA, 21 nt, Human
ugguugucaucauugucuacu

SEQ ID NO: 1118045 - RNA, 21 nt, Human
uguauuuuuaguagagauggg

SEQ ID NO: 1118046 - RNA, 20 nt, Human
ugucacccaggcuggagugc

SEQ ID NO: 1118047 - RNA, 25 nt, Human
ugucuuauagaucacuggcaaaaac

SEQ ID NO: 1118048 - RNA, 23 nt, Human
ugugacaugugauagcuaccuua

SEQ ID NO: 1118049 - RNA, 24 nt, Human
ugugauaucacucugcaccugcuc

SEQ ID NO: 1118050 - RNA, 20 nt, Human
uguguagugcccccacucag

SEQ ID NO: 1118051 - RNA, 24 nt, Human
uguguuggccaggcuggucccaaa

SEQ ID NO: 1118052 - RNA, 19 nt, Human
uguuaggacaagcugcagg

SEQ ID NO: 1118053 - RNA, 23 nt, Human
uguucagacuugucucugugccu

SEQ ID NO: 1118054 - RNA, 22 nt, Human
uguuggccaggcuggucccaaa

SEQ ID NO: 1118055 - RNA, 21 nt, Human
uuaaaaaacugaggaccacug

SEQ ID NO: 1118056 - RNA, 22 nt, Human
uuaguagagaugggguuccacc

SEQ ID NO: 1118057 - RNA, 24 nt, Human
uuaguagagaugggguuccaccau

SEQ ID NO: 1118058 - RNA, 18 nt, Human
uuaguagagcugggguuu

SEQ ID NO: 1118059 - RNA, 21 nt, Human
uuaguagagcugggguuucac

SEQ ID NO: 1118060 - RNA, 24 nt, Human
uuaguagagcugggguuucacugu

SEQ ID NO: 1118061 - RNA, 21 nt, Human
uucaagcaauucuccugccuc

SEQ ID NO: 1118062 - RNA, 24 nt, Human
uucaagcaauucuccugccucagc

SEQ ID NO: 1118063 - RNA, 23 nt, Human
uucaagugauccacccgccucag

SEQ ID NO: 1118064 - RNA, 20 nt, Human
uucagacuugucucugugcc

SEQ ID NO: 1118065 - RNA, 18 nt, Human
uuccaccauguuggccag

SEQ ID NO: 1118066 - RNA, 21 nt, Human
uugaugcuaagucaaaagcuu

SEQ ID NO: 1118067 - RNA, 24 nt, Human
uugcucugucacccaggcuggagu

SEQ ID NO: 1118068 - RNA, 23 nt, Human
uuguauuuuuaguagagaugggg

SEQ ID NO: 1118069 - RNA, 24 nt, Human
uuucacuguguuggccaggcuggu

SEQ ID NO: 1118070 - RNA, 20 nt, Human
uuuucuagauucugguccag

SEQ ID NO: 1118071 - RNA, 24 nt, Human
uuuuuaguagagaugggguuccac

SEQ ID NO: 1118072 - RNA, 20 nt, Human
uuuuuguacuuuuaguagag

SEQ ID NO: 1118073 - RNA, 20 nt, Human
uuuuuguauuuuuaguagag

SEQ ID NO: 1118074 - RNA, 20 nt, Human
uuuuuuuuuuugagacagag

SEQ ID NO: 1118075 - RNA, 24 nt, Human
uuuuuuuuuuuugagacagagucu

SEQ ID NO: 1118076 - RNA, 20 nt, Human
ccuugagcggggaagguggc

SEQ ID NO: 1118077 - RNA, 18 nt, Human
ugagcggggaagguggcg

SEQ ID NO: 1118078 - RNA, 26 nt, Human
aaagacuccuaucaguuaacaacugg

SEQ ID NO: 1118079 - RNA, 19 nt, Human
aaaggcacucaacacaugg

SEQ ID NO: 1118080 - RNA, 27 nt, Human
aagaagaaauauauaagcucuggagaa

SEQ ID NO: 1118081 - RNA, 19 nt, Human
acacauggaacuggacucu

SEQ ID NO: 1118082 - RNA, 22 nt, Human
agagaggggaauaaaaggggga

SEQ ID NO: 1118083 - RNA, 21 nt, Human
agaugccaguggugagguuug

SEQ ID NO: 1118084 - RNA, 18 nt, Human
agcaagagugcccuaaau

SEQ ID NO: 1118085 - RNA, 22 nt, Human
aggagagaugaagagacagcuc

SEQ ID NO: 1118086 - RNA, 18 nt, Human
agggggucaaaggcacuc

SEQ ID NO: 1118087 - RNA, 25 nt, Human
aguaaggggagagaugcaggagaga

SEQ ID NO: 1118088 - RNA, 21 nt, Human
auaagcucuggagaaagcauc

SEQ ID NO: 1118089 - RNA, 20 nt, Human
auaggcuuggacugagauuu

SEQ ID NO: 1118090 - RNA, 18 nt, Human
augcacagaucacuuuau

SEQ ID NO: 1118091 - RNA, 19 nt, Human
auggugacaauuaugguag

SEQ ID NO: 1118092 - RNA, 23 nt, Human
cagaaguagaauaaauugaagag

SEQ ID NO: 1118093 - RNA, 20 nt, Human
caggccccuugaccucacag

SEQ ID NO: 1118094 - RNA, 28 nt, Human
cagguccagaaguagaauaaauugaaga

SEQ ID NO: 1118095 - RNA, 24 nt, Human
cagugaaauaaccagcauaagaca

SEQ ID NO: 1118096 - RNA, 21 nt, Human
cauaagacagauaagggacaa

SEQ ID NO: 1118097 - RNA, 23 nt, Human
caucccagcaagagugcccuaaa

SEQ ID NO: 1118098 - RNA, 23 nt, Human
ccuaacccagcaggccccuugac

SEQ ID NO: 1118099 - RNA, 21 nt, Human
ccucacaguuugugcagguga

SEQ ID NO: 1118100 - RNA, 21 nt, Human
cugacuuuaccuuaccccggc

SEQ ID NO: 1118101 - RNA, 20 nt, Human
gaaagcaucccagcaagagg

SEQ ID NO: 1118102 - RNA, 19 nt, Human
gaugcacagaucacuuuau

SEQ ID NO: 1118103 - RNA, 19 nt, Human
gaugcagaugucgggagga

SEQ ID NO: 1118104 - RNA, 22 nt, Human
gaugcaggagagagaggagaga

SEQ ID NO: 1118105 - RNA, 18 nt, Human
gcagcaaaugccagugga

SEQ ID NO: 1118106 - RNA, 23 nt, Human
gcagugaaauaaccagcauaaga

SEQ ID NO: 1118107 - RNA, 18 nt, Human
gccccuugaccucacagu

SEQ ID NO: 1118108 - RNA, 19 nt, Human
gcggagcagcugguagccc

SEQ ID NO: 1118109 - RNA, 21 nt, Human
ggagcagcugguagcccaagg

SEQ ID NO: 1118110 - RNA, 21 nt, Human
ggccccuugaccucacaguuu

SEQ ID NO: 1118111 - RNA, 19 nt, Human
gggaauaaaagggggaaga

SEQ ID NO: 1118112 - RNA, 24 nt, Human
guagaaccuguagaugccaguggu

SEQ ID NO: 1118113 - RNA, 21 nt, Human
guaguaucacaguuuggguaa

SEQ ID NO: 1118114 - RNA, 22 nt, Human
uaagaagaaauauauaagcucu

SEQ ID NO: 1118115 - RNA, 23 nt, Human
uaugguaguaucacaguuugggu

SEQ ID NO: 1118116 - RNA, 22 nt, Human
ucaaaaguuucaucaacacuag

SEQ ID NO: 1118117 - RNA, 24 nt, Human
uccagaaguagaauaaauugaaga

SEQ ID NO: 1118118 - RNA, 20 nt, Human
uccagguccagaaguagaau

SEQ ID NO: 1118119 - RNA, 19 nt, Human
ucucucgagcuccugcugu

SEQ ID NO: 1118120 - RNA, 22 nt, Human
ugaagagacagcucaugagucc

SEQ ID NO: 1118121 - RNA, 22 nt, Human
ugaauuucacuugggucucaua

SEQ ID NO: 1118122 - RNA, 22 nt, Human
ugacuccauggaugcguuugaa

SEQ ID NO: 1118123 - RNA, 23 nt, Human
ugagaaacuggcuccuggucugu

SEQ ID NO: 1118124 - RNA, 18 nt, Human
ugagauuuucucguugac

SEQ ID NO: 1118125 - RNA, 23 nt, Human
ugagcaagacagaugggcaaugu

SEQ ID NO: 1118126 - RNA, 22 nt, Human
ugggagaguuuaagagugagca

SEQ ID NO: 1118127 - RNA, 22 nt, Human
ugggguagaaccuguagaugcc

SEQ ID NO: 1118128 - RNA, 21 nt, Human
uggguuaguccugucccgggg

SEQ ID NO: 1118129 - RNA, 25 nt, Human
ugguagcccaaggccuugucaucag

SEQ ID NO: 1118130 - RNA, 23 nt, Human
uguagaugggguagaaccuguag

SEQ ID NO: 1118131 - RNA, 23 nt, Human
uugucaucagaagggcugacggg

SEQ ID NO: 1118132 - RNA, 19 nt, Human
uuucugcugacuuuaccuu

SEQ ID NO: 1118133 - RNA, 20 nt, Human
uuugaagucuucaggcugua

SEQ ID NO: 1118134 - RNA, 23 nt, Human
aaauccaaaaauaaaucugaaau

SEQ ID NO: 1118135 - RNA, 22 nt, Human
aaccagaaacuacacauccacc

SEQ ID NO: 1118136 - RNA, 23 nt, Human
aagagguugauucugagccaaca

SEQ ID NO: 1118137 - RNA, 23 nt, Human
aaugucagguuagcaaaggguug

SEQ ID NO: 1118138 - RNA, 20 nt, Human
acaagcaaaaacacauagaa

SEQ ID NO: 1118139 - RNA, 19 nt, Human
acacuucugcuuucugaug

SEQ ID NO: 1118140 - RNA, 18 nt, Human
accuucaggcuauucaga

SEQ ID NO: 1118141 - RNA, 20 nt, Human
acuaccucagccuccugagu

SEQ ID NO: 1118142 - RNA, 25 nt, Human
acucuguugcccaagcuggaaugug

SEQ ID NO: 1118143 - RNA, 23 nt, Human
agaaaaagaaaaauugaaguaaa

SEQ ID NO: 1118144 - RNA, 18 nt, Human
agacaaagucucauagau

SEQ ID NO: 1118145 - RNA, 18 nt, Human
agguggucaggucaccgu

SEQ ID NO: 1118146 - RNA, 24 nt, Human
auaaaauuaccuucaggcuauuca

SEQ ID NO: 1118147 - RNA, 25 nt, Human
auaaaauuaccuucaggcuauucag

SEQ ID NO: 1118148 - RNA, 20 nt, Human
caaaacacuucuggucccaa

SEQ ID NO: 1118149 - RNA, 18 nt, Human
caaacuuuacaagcaaaa

SEQ ID NO: 1118150 - RNA, 24 nt, Human
caaaguacucggaucacuggcaug

SEQ ID NO: 1118151 - RNA, 23 nt, Human
caaccucccagucucaaacaauc

SEQ ID NO: 1118152 - RNA, 20 nt, Human
caagauccuggcucaguuca

SEQ ID NO: 1118153 - RNA, 22 nt, Human
caaggugugucucaccucccuu

SEQ ID NO: 1118154 - RNA, 22 nt, Human
caccuaagccacagagaugcca

SEQ ID NO: 1118155 - RNA, 22 nt, Human
caccuaagccacagagaugcca

SEQ ID NO: 1118156 - RNA, 18 nt, Human
caccuccauguccucaaa

SEQ ID NO: 1118157 - RNA, 23 nt, Human
caccuggcuaauuuuuuaauuau

SEQ ID NO: 1118158 - RNA, 18 nt, Human
caccugucuuggcuuccc

SEQ ID NO: 1118159 - RNA, 23 nt, Human
caccugucuuggcuucccaaagu

SEQ ID NO: 1118160 - RNA, 19 nt, Human
cacucuguugcccaagcug

SEQ ID NO: 1118161 - RNA, 19 nt, Human
cacuggcaugaacugcauc

SEQ ID NO: 1118162 - RNA, 25 nt, Human
cagaaacuacacauccaaccuucag

SEQ ID NO: 1118163 - RNA, 18 nt, Human
cagaauccuucgauucuc

SEQ ID NO: 1118164 - RNA, 24 nt, Human
cagccucaaccucccagucucaaa

SEQ ID NO: 1118165 - RNA, 20 nt, Human
cagccuccugaguaccuggg

SEQ ID NO: 1118166 - RNA, 21 nt, Human
cagcuccugaguuucacuccc

SEQ ID NO: 1118167 - RNA, 21 nt, Human
cagucuggccucaaacuccug

SEQ ID NO: 1118168 - RNA, 22 nt, Human
caguucagccucaaccucccag

SEQ ID NO: 1118169 - RNA, 22 nt, Human
caugacuuaccauggccuggga

SEQ ID NO: 1118170 - RNA, 21 nt, Human
ccaaaacacuucuggucccaa

SEQ ID NO: 1118171 - RNA, 23 nt, Human
ccacagagaugccacauaucaga

SEQ ID NO: 1118172 - RNA, 22 nt, Human
ccaguacauagaaaaagaaaaa

SEQ ID NO: 1118173 - RNA, 19 nt, Human
ccagucucaaacaauccua

SEQ ID NO: 1118174 - RNA, 22 nt, Human
ccagucucaaacaauccuacua

SEQ ID NO: 1118175 - RNA, 20 nt, Human
cccagucucaaacaauccua

SEQ ID NO: 1118176 - RNA, 24 nt, Human
ccuacuaccucagccuccugagua

SEQ ID NO: 1118177 - RNA, 22 nt, Human
ccugaguaccugggacuacagg

SEQ ID NO: 1118178 - RNA, 22 nt, Human
ccuggcucaguucagccucaac

SEQ ID NO: 1118179 - RNA, 21 nt, Human
ccugggcucaagagauccacc

SEQ ID NO: 1118180 - RNA, 22 nt, Human
ccugggcucaagagauccaccu

SEQ ID NO: 1118181 - RNA, 23 nt, Human
cuaaagacuuaagaagucaguag

SEQ ID NO: 1118182 - RNA, 24 nt, Human
cucaaacaauccuacuaccucagc

SEQ ID NO: 1118183 - RNA, 22 nt, Human
cucagaaaagccaaugucaaaa

SEQ ID NO: 1118184 - RNA, 19 nt, Human
cuccugaguuucacucccc

SEQ ID NO: 1118185 - RNA, 26 nt, Human
cucuucucagaaaagccaaugucaaa

SEQ ID NO: 1118186 - RNA, 22 nt, Human
cugcuuucugaugguccaaugu

SEQ ID NO: 1118187 - RNA, 22 nt, Human
cuuauugguaaccaaaacccaa

SEQ ID NO: 1118188 - RNA, 21 nt, Human
cuucucagaaaagccaauguc

SEQ ID NO: 1118189 - RNA, 23 nt, Human
cuucuggucccaagcaucucauc

SEQ ID NO: 1118190 - RNA, 20 nt, Human
gagacagggucucacucugu

SEQ ID NO: 1118191 - RNA, 21 nt, Human
gagagcuuacaggucauaggu

SEQ ID NO: 1118192 - RNA, 24 nt, Human
gagauccaccugucuuggcuuccc

SEQ ID NO: 1118193 - RNA, 19 nt, Human
gagguggucaggucaccgu

SEQ ID NO: 1118194 - RNA, 20 nt, Human
gcaaacaaaauauaagcaca

SEQ ID NO: 1118195 - RNA, 18 nt, Human
gcagucuggccucaaacu

SEQ ID NO: 1118196 - RNA, 19 nt, Human
ggauggggagauguuggca

SEQ ID NO: 1118197 - RNA, 18 nt, Human
ggcaauugguugaaagag

SEQ ID NO: 1118198 - RNA, 21 nt, Human
ggugauaaagcagcuugagga

SEQ ID NO: 1118199 - RNA, 21 nt, Human
guagaaacgaggucucacugu

SEQ ID NO: 1118200 - RNA, 18 nt, Human
gugucucaccucccuucc

SEQ ID NO: 1118201 - RNA, 23 nt, Human
uaaaaccagaaacuacacaucca

SEQ ID NO: 1118202 - RNA, 23 nt, Human
uaacaaggugugucucaccuccc

SEQ ID NO: 1118203 - RNA, 22 nt, Human
uaaccaaaacccaaauucugua

SEQ ID NO: 1118204 - RNA, 22 nt, Human
uaacuaguguguugcaaacaaa

SEQ ID NO: 1118205 - RNA, 21 nt, Human
uaagcuuugucuaaagacuua

SEQ ID NO: 1118206 - RNA, 22 nt, Human
uacaggugugcaccaccacacc

SEQ ID NO: 1118207 - RNA, 24 nt, Human
uaccucagccuccugaguaccugg

SEQ ID NO: 1118208 - RNA, 19 nt, Human
uagccagaaaggaauguuu

SEQ ID NO: 1118209 - RNA, 19 nt, Human
uaggaagcuggcauaucau

SEQ ID NO: 1118210 - RNA, 21 nt, Human
uaugcaaaaauauccaguaca

SEQ ID NO: 1118211 - RNA, 18 nt, Human
ucacuugugcauaaacuc

SEQ ID NO: 1118212 - RNA, 21 nt, Human
ucacuugugcauaaacuccaa

SEQ ID NO: 1118213 - RNA, 21 nt, Human
ucaguucagccucaaccuccc

SEQ ID NO: 1118214 - RNA, 23 nt, Human
ucaguucagccucaaccucccag

SEQ ID NO: 1118215 - RNA, 22 nt, Human
ucaucuaagggauacucaacuc

SEQ ID NO: 1118216 - RNA, 24 nt, Human
uccugaguaccugggacuacaggu

SEQ ID NO: 1118217 - RNA, 18 nt, Human
uccugaguuucacucccc

SEQ ID NO: 1118218 - RNA, 18 nt, Human
uccugggcucaagagauc

SEQ ID NO: 1118219 - RNA, 19 nt, Human
uccugggcucaagagaucc

SEQ ID NO: 1118220 - RNA, 23 nt, Human
ucucacucuguugcccaagcugg

SEQ ID NO: 1118221 - RNA, 24 nt, Human
ucucacucuguugcccaagcugga

SEQ ID NO: 1118222 - RNA, 18 nt, Human
ucuguuucaggcauaaaa

SEQ ID NO: 1118223 - RNA, 20 nt, Human
ugaaacuuuuugagcacuga

SEQ ID NO: 1118224 - RNA, 20 nt, Human
ugacuuaccauggccuggga

SEQ ID NO: 1118225 - RNA, 23 nt, Human
ugacuuaccauggccugggauac

SEQ ID NO: 1118226 - RNA, 20 nt, Human
ugagacagggucucacucug

SEQ ID NO: 1118227 - RNA, 22 nt, Human
ugagacagggucucacucuguu

SEQ ID NO: 1118228 - RNA, 23 nt, Human
ugcaaacaaaauauaagcacaag

SEQ ID NO: 1118229 - RNA, 21 nt, Human
ugcccaagcuggaauguggug

SEQ ID NO: 1118230 - RNA, 23 nt, Human
ugccugagguggucaggucaccg

SEQ ID NO: 1118231 - RNA, 18 nt, Human
uggaaaccaaggucucug

SEQ ID NO: 1118232 - RNA, 24 nt, Human
uggaaugugguggcaagauccugg

SEQ ID NO: 1118233 - RNA, 20 nt, Human
uggacauauauuuguggaga

SEQ ID NO: 1118234 - RNA, 22 nt, Human
uggacauauauuuguggagacu

SEQ ID NO: 1118235 - RNA, 22 nt, Human
uggcauaucauuaaaaaacuuc

SEQ ID NO: 1118236 - RNA, 21 nt, Human
ugggacuacaggugugcacca

SEQ ID NO: 1118237 - RNA, 24 nt, Human
ugggacuacaggugugcaccacca

SEQ ID NO: 1118238 - RNA, 26 nt, Human
ugggacucuuauugccacaaucaguc

SEQ ID NO: 1118239 - RNA, 24 nt, Human
ugggcucaagagauccaccugucu

SEQ ID NO: 1118240 - RNA, 22 nt, Human
ugucucaccucccuuccuauca

SEQ ID NO: 1118241 - RNA, 19 nt, Human
uguggaaaccaaggucucu

SEQ ID NO: 1118242 - RNA, 18 nt, Human
ugugguggcaagauccug

SEQ ID NO: 1118243 - RNA, 25 nt, Human
ugugguggcaagauccuggcucaac

SEQ ID NO: 1118244 - RNA, 20 nt, Human
uuaaagagguugauucugag

SEQ ID NO: 1118245 - RNA, 21 nt, Human
uucgauucucuguuggcuaga

SEQ ID NO: 1118246 - RNA, 21 nt, Human
uuggauggggagauguuggca

SEQ ID NO: 1118247 - RNA, 21 nt, Human
uuucucuucucagaaaagcca

SEQ ID NO: 1118248 - RNA, 23 nt, Human
uuuuuuuuuugagacagggucuc

SEQ ID NO: 1118249 - RNA, 20 nt, Human
uuuuuuuuuuugagacaggg

SEQ ID NO: 1118250 - RNA, 23 nt, Human
uuuuuuuuuuuugagacaggguc

SEQ ID NO: 1118251 - RNA, 26 nt, Human
uuuuuuuuuuuugagacagggucuca

SEQ ID NO: 1118252 - RNA, 18 nt, Human
uuuuuuuuuuuuuuuuug

SEQ ID NO: 1118253 - RNA, 30 nt, Human; identical to SEQ ID NO: 526987

SEQ ID NO: 1118254 - RNA, 25 nt, Human
aaaaaaacaauuuauugaagaaaca

SEQ ID NO: 1118255 - RNA, 18 nt, Human
aaacaaaacauagcaaaa

SEQ ID NO: 1118256 - RNA, 18 nt, Human
aaacaaacaaaacauagc

SEQ ID NO: 1118257 - RNA, 21 nt, Human
aaauauaugcuucagaguaua

SEQ ID NO: 1118258 - RNA, 24 nt, Human
aagaaaaaaacaauuuauugaaga

SEQ ID NO: 1118259 - RNA, 25 nt, Human
aagaaacacaaauagccccaaaaca

SEQ ID NO: 1118260 - RNA, 21 nt, Human
aaggaaacaaacaaaacauag

SEQ ID NO: 1118261 - RNA, 22 nt, Human
acagcccccuucuuggguucaa

SEQ ID NO: 1118262 - RNA, 24 nt, Human
acauucaucccuucuucccuccau

SEQ ID NO: 1118263 - RNA, 24 nt, Human
accacaaaggaaacaaacaaaaca

SEQ ID NO: 1118264 - RNA, 24 nt, Human
agaaacacaaauagccccaaaaca

SEQ ID NO: 1118265 - RNA, 19 nt, Human
agaagcuggaagauaaacu

SEQ ID NO: 1118266 - RNA, 24 nt, Human
agcuguaagucuggguuaccacag

SEQ ID NO: 1118267 - RNA, 18 nt, Human
agggugagguauagggaa

SEQ ID NO: 1118268 - RNA, 22 nt, Human
auagccccaaaacauaccagaa

SEQ ID NO: 1118269 - RNA, 20 nt, Human
auauaccugugcacagcaug

SEQ ID NO: 1118270 - RNA, 21 nt, Human
auuuauuugccaagaaaucuu

SEQ ID NO: 1118271 - RNA, 18 nt, Human
caacacagaagacuucug

SEQ ID NO: 1118272 - RNA, 20 nt, Human
caagcaaacaaucaauccuu

SEQ ID NO: 1118273 - RNA, 24 nt, Human
caauuaauuugcuagagcagccca

SEQ ID NO: 1118274 - RNA, 23 nt, Human
cacaaauagccccaaaacauacc

SEQ ID NO: 1118275 - RNA, 22 nt, Human
cacagcauguguugagaugaga

SEQ ID NO: 1118276 - RNA, 23 nt, Human
caccaccuuccaggaaccuccac

SEQ ID NO: 1118277 - RNA, 23 nt, Human
cacuagaaaaacgauucaacacu

SEQ ID NO: 1118278 - RNA, 24 nt, Human
cagaacucauggaggcaucuacau

SEQ ID NO: 1118279 - RNA, 25 nt, Human
cagaagcuggaagauaaacugguga

SEQ ID NO: 1118280 - RNA, 24 nt, Human
caucccuucuucccuccauggagg

SEQ ID NO: 1118281 - RNA, 19 nt, Human
ccaaauaaaaugauacuga

SEQ ID NO: 1118282 - RNA, 21 nt, Human
ccacaaaggaaacaaacaaaa

SEQ ID NO: 1118283 - RNA, 22 nt, Human
ccacgucuucagcuaucuggaa

SEQ ID NO: 1118284 - RNA, 24 nt, Human
ccagugcacauguucugugauccc

SEQ ID NO: 1118285 - RNA, 18 nt, Human
cccacagaacucauggag

SEQ ID NO: 1118286 - RNA, 21 nt, Human
cccacagaacucauggaggca

SEQ ID NO: 1118287 - RNA, 23 nt, Human
cccacagaacucauggaggcauc

SEQ ID NO: 1118288 - RNA, 23 nt, Human
cccacuagaaaaacgauucaaca

SEQ ID NO: 1118289 - RNA, 18 nt, Human
cccauacaccaagcaaac

SEQ ID NO: 1118290 - RNA, 22 nt, Human
cccauacaccaagcaaacaauc

SEQ ID NO: 1118291 - RNA, 19 nt, Human
ccccaaaacauaccagaag

SEQ ID NO: 1118292 - RNA, 23 nt, Human
ccgcuacaaaucaguaagcaaaa

SEQ ID NO: 1118293 - RNA, 23 nt, Human
ccugugcacagcauguguugaga

SEQ ID NO: 1118294 - RNA, 22 nt, Human
cgucuucagcuaucuggaagcc

SEQ ID NO: 1118295 - RNA, 23 nt, Human
cucauaauaccugaccuaaaguu

SEQ ID NO: 1118296 - RNA, 22 nt, Human
cugacagaagcuggaagauaaa

SEQ ID NO: 1118297 - RNA, 20 nt, Human
cuggaagcccucugaaccca

SEQ ID NO: 1118298 - RNA, 22 nt, Human
gaaacaaacaaaacauagcaaa

SEQ ID NO: 1118299 - RNA, 19 nt, Human
gagcagcccacagaacuca

SEQ ID NO: 1118300 - RNA, 21 nt, Human
gagcuugcaugcucucuccag

SEQ ID NO: 1118301 - RNA, 19 nt, Human
gagguugggggcugggucu

SEQ ID NO: 1118302 - RNA, 18 nt, Human
ggugugugagaaauuacc

SEQ ID NO: 1118303 - RNA, 18 nt, Human
gguugggggcugggucug

SEQ ID NO: 1118304 - RNA, 24 nt, Human
guaaaacuaaaguuacuaacaaaa

SEQ ID NO: 1118305 - RNA, 23 nt, Human
uaacauacaaguaccacuuuaag

SEQ ID NO: 1118306 - RNA, 23 nt, Human
uaagcaaaaagguaaaacaauga

SEQ ID NO: 1118307 - RNA, 22 nt, Human
uaagucuggguuaccacagccc

SEQ ID NO: 1118308 - RNA, 23 nt, Human
uaaugaaaaugagaaauuccacg

SEQ ID NO: 1118309 - RNA, 24 nt, Human
uacaaaucaguaagcaaaaaggua

SEQ ID NO: 1118310 - RNA, 18 nt, Human
uacacauuauuggcaaaa

SEQ ID NO: 1118311 - RNA, 20 nt, Human
uacacauuauuggcaaaagu

SEQ ID NO: 1118312 - RNA, 23 nt, Human
uacaccaagcaaacaaucaaucc

SEQ ID NO: 1118313 - RNA, 21 nt, Human
uaccacaaaggaaacaaacaa

SEQ ID NO: 1118314 - RNA, 24 nt, Human
uaccacaaaggaaacaaacaaaac

SEQ ID NO: 1118315 - RNA, 23 nt, Human
uaccgcuacaaaucaguaagcaa

SEQ ID NO: 1118316 - RNA, 19 nt, Human
uaccugaccuaaaguucug

SEQ ID NO: 1118317 - RNA, 22 nt, Human
uaccugaccuaaaguucugaca

SEQ ID NO: 1118318 - RNA, 20 nt, Human
uagagcagcccacagaacuc

SEQ ID NO: 1118319 - RNA, 23 nt, Human
uagcaaaaggauaaaacguccca

SEQ ID NO: 1118320 - RNA, 27 nt, Human
uagcaaaaggauaaaacgucccacuag

SEQ ID NO: 1118321 - RNA, 24 nt, Human
uagccauuugucaacucauuaaca

SEQ ID NO: 1118322 - RNA, 22 nt, Human
uagccccaaaacauaccagaag

SEQ ID NO: 1118323 - RNA, 24 nt, Human
uaguuucugaauucuugcauuccu

SEQ ID NO: 1118324 - RNA, 25 nt, Human
uauagggaaaggcuguggagcuugc

SEQ ID NO: 1118325 - RNA, 24 nt, Human
uaugccuggaaaccuguugaagac

SEQ ID NO: 1118326 - RNA, 18 nt, Human
uauggaggcaucauucug

SEQ ID NO: 1118327 - RNA, 20 nt, Human
uauuuaauacauauaacauu

SEQ ID NO: 1118328 - RNA, 26 nt, Human
ucaaugccaaauaaaaugauacugag

SEQ ID NO: 1118329 - RNA, 20 nt, Human
ucagaguauauacaugugaa

SEQ ID NO: 1118330 - RNA, 18 nt, Human
ucuuacuucaggaagugu

SEQ ID NO: 1118331 - RNA, 20 nt, Human
ugaccaagggugacuggugc

SEQ ID NO: 1118332 - RNA, 28 nt, Human
ugacuggugcuccauccuucuggaaacu

SEQ ID NO: 1118333 - RNA, 19 nt, Human
ugagggugauuauaauuuu

SEQ ID NO: 1118334 - RNA, 21 nt, Human
ugcauagggugagguauaggg

SEQ ID NO: 1118335 - RNA, 18 nt, Human
ugccuuggucuuucaggu

SEQ ID NO: 1118336 - RNA, 21 nt, Human
ugcuccauccuucuggaaacu

SEQ ID NO: 1118337 - RNA, 24 nt, Human
uggagcuugcaugcucucuccagg

SEQ ID NO: 1118338 - RNA, 18 nt, Human
uggccaugaccaagggug

SEQ ID NO: 1118339 - RNA, 20 nt, Human
ugggguuaagcccauacacc

SEQ ID NO: 1118340 - RNA, 18 nt, Human
uguaauaaugaaaaugag

SEQ ID NO: 1118341 - RNA, 23 nt, Human
uuaaaacuuuuguaccacaaagg

SEQ ID NO: 1118342 - RNA, 18 nt, Human
uucuauaaggaaaaacaa

SEQ ID NO: 1118343 - RNA, 20 nt, Human
uugauaguuuauuuaauaca

SEQ ID NO: 1118344 - RNA, 18 nt, Human
uuguacacauuauuggca

SEQ ID NO: 1118345 - RNA, 23 nt, Human
uuucaggugcccagcucccaucc

SEQ ID NO: 1118346 - RNA, 24 nt, Human
aaaccccuaaaccuaguaacuccu

SEQ ID NO: 1118347 - RNA, 26 nt, Human
aaaccccuaaaccuaguaacuccuuu

SEQ ID NO: 1118348 - RNA, 19 nt, Human
aaaccuaguaacuccucuc

SEQ ID NO: 1118349 - RNA, 23 nt, Human
agccuggagcaccuuccagcccc

SEQ ID NO: 1118350 - RNA, 22 nt, Human
agggaggggcacuccagagcuc

SEQ ID NO: 1118351 - RNA, 18 nt, Human
aggggcacuccagagcuc

SEQ ID NO: 1118352 - RNA, 20 nt, Human
cagccccuggccagaguccu

SEQ ID NO: 1118353 - RNA, 24 nt, Human
caucucuggccuggccccugggag

SEQ ID NO: 1118354 - RNA, 22 nt, Human
ccagucugugcgguucgugaug

SEQ ID NO: 1118355 - RNA, 18 nt, Human
ccccuaaaccuaguaacu

SEQ ID NO: 1118356 - RNA, 26 nt, Human
ccccuaaaccuaguaacuccucuccu

SEQ ID NO: 1118357 - RNA, 19 nt, Human
ccccugggcugacugaacc

SEQ ID NO: 1118358 - RNA, 20 nt, Human
ccucuuuguugcugaaucuc

SEQ ID NO: 1118359 - RNA, 22 nt, Human
ccuggcccaucucuggccuggc

SEQ ID NO: 1118360 - RNA, 19 nt, Human
ccugggccagagggcagcc

SEQ ID NO: 1118361 - RNA, 19 nt, Human
ccugggccagagggcagcc

SEQ ID NO: 1118362 - RNA, 24 nt, Human
ccuuccagccccuggccagagucc

SEQ ID NO: 1118363 - RNA, 22 nt, Human
cucaggucagccagggguucau

SEQ ID NO: 1118364 - RNA, 20 nt, Human
cuggccccugggcugacuga

SEQ ID NO: 1118365 - RNA, 24 nt, Human
gguguucugggaaaaaccccuaaa

SEQ ID NO: 1118366 - RNA, 21 nt, Human
guucugggaaaaaccccuaaa

SEQ ID NO: 1118367 - RNA, 24 nt, Human
uaacuccucucccuacuaggccuc

SEQ ID NO: 1118368 - RNA, 21 nt, Human
uaccaggcucuuucgcauucc

SEQ ID NO: 1118369 - RNA, 19 nt, Human
uacuuuauuuggagggagg

SEQ ID NO: 1118370 - RNA, 26 nt, Human
uaguaacuccucucccuacuaggccu

SEQ ID NO: 1118371 - RNA, 24 nt, Human
uccuggguguucugggaaaaaccc

SEQ ID NO: 1118372 - RNA, 18 nt, Human
ucucccuacuaggccucu

SEQ ID NO: 1118373 - RNA, 20 nt, Human
ucucuggccccugggcugac

SEQ ID NO: 1118374 - RNA, 19 nt, Human
ucucuggccuggccccugg

SEQ ID NO: 1118375 - RNA, 21 nt, Human
ucuggccccugggcugacuga

SEQ ID NO: 1118376 - RNA, 18 nt, Human
ugccuggcccaucucugg

SEQ ID NO: 1118377 - RNA, 18 nt, Human
ugcuuugcauuugcacaa

SEQ ID NO: 1118378 - RNA, 23 nt, Human
uggagcaccuuccagccccuggc

SEQ ID NO: 1118379 - RNA, 22 nt, Human
uggccccugggaggaauuuccu

SEQ ID NO: 1118380 - RNA, 19 nt, Human
uggccccugggcugacuga

SEQ ID NO: 1118381 - RNA, 20 nt, Human
uuugcauuugcacaagucca

SEQ ID NO: 1118382 - RNA, 23 nt, Human
caucucaauguggcaggaagagc

SEQ ID NO: 1118383 - RNA, 21 nt, Human
ccgugccauaaguuuuuguuu

SEQ ID NO: 1118384 - RNA, 22 nt, Human
gugcaucuuaggugcuuuguuc

SEQ ID NO: 1118385 - RNA, 19 nt, Human
uaucuuuuucuucugggca

SEQ ID NO: 1118386 - RNA, 25 nt, Human
ucuucugggcaaccuccucuucugg

SEQ ID NO: 1118387 - RNA, 23 nt, Human
ugagcucuguaaguccguuggug

SEQ ID NO: 1118388 - RNA, 21 nt, Human
ugcaucuuaggugcuuuguuc

SEQ ID NO: 1118389 - RNA, 19 nt, Human
ugcuuuguucacuuggaua

SEQ ID NO: 1118390 - RNA, 22 nt, Human
uguggcaggaagagcucaugua

SEQ ID NO: 1118391 - RNA, 19 nt, Human
uguuucuucaguuucuucu

SEQ ID NO: 1118392 - RNA, 28 nt, Human
uucccgugccauaaguuuuuguuucuuc

SEQ ID NO: 1118393 - RNA, 23 nt, Human
uucuucugggcaaccuccucuuc

SEQ ID NO: 1118394 - RNA, 20 nt, Human
cuuguaaacauaaguuuuac

SEQ ID NO: 1118395 - RNA, 19 nt, Human
gcagcaaagugauguugga

SEQ ID NO: 1118396 - RNA, 19 nt, Human
gggcagcaaagugauguug

SEQ ID NO: 1118397 - RNA, 24 nt, Human
uaaauaaaaaauuaacaguaauau

SEQ ID NO: 1118398 - RNA, 23 nt, Human
uaaaugacaaauuuauauccuua

SEQ ID NO: 1118399 - RNA, 21 nt, Human
uacauaccugggcagcaaagu

SEQ ID NO: 1118400 - RNA, 20 nt, Human
ucuugcucugugaggagggc

SEQ ID NO: 1118401 - RNA, 23 nt, Human
uguuggaaaugcuuuagguguua

SEQ ID NO: 1118402 - RNA, 23 nt, Human
uugcaggccaacuauagauacau

SEQ ID NO: 1118403 - RNA, 20 nt, Human
agaucagcuuccagagcucc

SEQ ID NO: 1118404 - RNA, 19 nt, Human
agcaggacgcauggugggg

SEQ ID NO: 1118405 - RNA, 19 nt, Human
aggagaucagcuuccagag

SEQ ID NO: 1118406 - RNA, 23 nt, Human
cagcuuccagagcuccagguccu

SEQ ID NO: 1118407 - RNA, 20 nt, Human
caggacgcauggugggggcg

SEQ ID NO: 1118408 - RNA, 23 nt, Human
ccagagcuccagguccugugggc

SEQ ID NO: 1118409 - RNA, 21 nt, Human
gaccguauuugggggccuggc

SEQ ID NO: 1118410 - RNA, 20 nt, Human
ggaggagaucagcuuccaga

SEQ ID NO: 1118411 - RNA, 21 nt, Human
gguucuggagcugggccccgg

SEQ ID NO: 1118412 - RNA, 22 nt, Human
gugcagugggaggagaucagcu

SEQ ID NO: 1118413 - RNA, 24 nt, Human
gugguucuggagcugggccccggc

SEQ ID NO: 1118414 - RNA, 25 nt, Human
ucagcuuccagagcuccagguccug

SEQ ID NO: 1118415 - RNA, 18 nt, Human
uccagguccugugggcuc

SEQ ID NO: 1118416 - RNA, 19 nt, Human
uccugggagcagugguggc

SEQ ID NO: 1118417 - RNA, 22 nt, Human
ugaccguauuugggggccuggc

SEQ ID NO: 1118418 - RNA, 23 nt, Human
ugagagcaggacgcauggugggg

SEQ ID NO: 1118419 - RNA, 25 nt, Human
ugcugggcugaccguauuugggggc

SEQ ID NO: 1118420 - RNA, 21 nt, Human
uucuggagcugggccccggcc

SEQ ID NO: 1118421 - RNA, 18 nt, Human
cacaacaaagggcaggga

SEQ ID NO: 1118422 - RNA, 18 nt, Human
cagcgcauccaggcaaca

SEQ ID NO: 1118423 - RNA, 19 nt, Human
cagcguucuggagcgucgc

SEQ ID NO: 1118424 - RNA, 20 nt, Human
cagcguucuggagcgucgcu

SEQ ID NO: 1118425 - RNA, 24 nt, Human
cagggagggcaaggccaggagccu

SEQ ID NO: 1118426 - RNA, 19 nt, Human
ccacuccacggcugcgggc

SEQ ID NO: 1118427 - RNA, 21 nt, Human
ccccgcccgcgcgcggccgaa

SEQ ID NO: 1118428 - RNA, 20 nt, Human
ccccgggguugcgggcggca

SEQ ID NO: 1118429 - RNA, 18 nt, Human
ccuccuuuaacgcggagg

SEQ ID NO: 1118430 - RNA, 24 nt, Human
cggcagcgucuacgcaagcagcgu

SEQ ID NO: 1118431 - RNA, 20 nt, Human
cgucgcucugccaccuuccc

SEQ ID NO: 1118432 - RNA, 19 nt, Human
cuccacggcugcgggcgcg

SEQ ID NO: 1118433 - RNA, 18 nt, Human
cuuagaucaagagggaaa

SEQ ID NO: 1118434 - RNA, 20 nt, Human
cuuagaucaagagggaaagc

SEQ ID NO: 1118435 - RNA, 22 nt, Human
gcagcgucuacgcaagcagcgu

SEQ ID NO: 1118436 - RNA, 21 nt, Human
gccccgggguugcgggcggca

SEQ ID NO: 1118437 - RNA, 19 nt, Human
gcgcagaccggcggccccg

SEQ ID NO: 1118438 - RNA, 29 nt, Human
ucucgggguuucucagggcugcugcguuu

SEQ ID NO: 1118439 - RNA, 18 nt, Human
ugaaggcagcggcagcgu

SEQ ID NO: 1118440 - RNA, 20 nt, Human
uuaacgcggaggcgcggagu

SEQ ID NO: 1118441 - RNA, 21 nt, Human
uuucucagggcugcugcguuu

SEQ ID NO: 1118442 - RNA, 22 nt, Human
uuucucagggcugcugcguuuc

SEQ ID NO: 1118443 - RNA, 20 nt, Human
aaaaaaaaccgugacugcac

SEQ ID NO: 1118444 - RNA, 22 nt, Human
aaaaaaaccgugacugcacaug

SEQ ID NO: 1118445 - RNA, 25 nt, Human
aaaaacaaaaaaaaaaccgugacug

SEQ ID NO: 1118446 - RNA, 19 nt, Human
aaaaggcaggacggcgggu

SEQ ID NO: 1118447 - RNA, 26 nt, Human
aaacaagggacggggccaccccaggg

SEQ ID NO: 1118448 - RNA, 20 nt, Human
aacaagggacggggccaccc

SEQ ID NO: 1118449 - RNA, 19 nt, Human
aacacagagacagacagga

SEQ ID NO: 1118450 - RNA, 20 nt, Human
aacacagagacagacaggag

SEQ ID NO: 1118451 - RNA, 24 nt, Human
aacacagagacagacaggagcccg

SEQ ID NO: 1118452 - RNA, 20 nt, Human
aacauggugaaacccugucu

SEQ ID NO: 1118453 - RNA, 21 nt, Human
aacauggugaaacccugucuc

SEQ ID NO: 1118454 - RNA, 19 nt, Human
aagcugugucucaacaagc

SEQ ID NO: 1118455 - RNA, 24 nt, Human
aaucgcuugaacccgggaggcaga

SEQ ID NO: 1118456 - RNA, 19 nt, Human
acaaaaaaaaaaccgugac

SEQ ID NO: 1118457 - RNA, 24 nt, Human
acagagcgagacaccgucucaaaa

SEQ ID NO: 1118458 - RNA, 24 nt, Human
acagagcgagacccugucucaaaa

SEQ ID NO: 1118459 - RNA, 24 nt, Human
accaacauggugaaacccugucuc

SEQ ID NO: 1118460 - RNA, 19 nt, Human
accccaggggcucaugcac

SEQ ID NO: 1118461 - RNA, 24 nt, Human
acccggagaaaaggcaggacggcg

SEQ ID NO: 1118462 - RNA, 24 nt, Human
acccugucucuacuaaaaauacaa

SEQ ID NO: 1118463 - RNA, 24 nt, Human
accggcgugcaggcugccaaccug

SEQ ID NO: 1118464 - RNA, 19 nt, Human
acgcggccccugcaccucu

SEQ ID NO: 1118465 - RNA, 24 nt, Human
acugcacuccagccugggcgacag

SEQ ID NO: 1118466 - RNA, 26 nt, Human
acugcacuccagccugggcgacagag

SEQ ID NO: 1118467 - RNA, 22 nt, Human
agacgggcggaucaccugagag

SEQ ID NO: 1118468 - RNA, 24 nt, Human
agacugaggcaggagaaucgcuug

SEQ ID NO: 1118469 - RNA, 18 nt, Human
agacuugggccuagaucu

SEQ ID NO: 1118470 - RNA, 20 nt, Human
agagcaccgucuggaccucc

SEQ ID NO: 1118471 - RNA, 18 nt, Human
agagcguguccgggcgcc

SEQ ID NO: 1118472 - RNA, 26 nt, Human
agaggcggggcugcuggcgggggagc

SEQ ID NO: 1118473 - RNA, 18 nt, Human
agauguugcagugagccg

SEQ ID NO: 1118474 - RNA, 24 nt, Human
agcacuuugggaggccgagacggg

SEQ ID NO: 1118475 - RNA, 23 nt, Human
agccaccuucuauccccggccuc

SEQ ID NO: 1118476 - RNA, 24 nt, Human
agccugaccaacauggugaaaccc

SEQ ID NO: 1118477 - RNA, 18 nt, Human
agcugugucucaacaagc

SEQ ID NO: 1118478 - RNA, 28 nt, Human
aggagcccgcccugcuuuaaugcgcaug

SEQ ID NO: 1118479 - RNA, 22 nt, Human
aggauccggcuggucagaaaca

SEQ ID NO: 1118480 - RNA, 21 nt, Human
aggcagauguugcagugagcc

SEQ ID NO: 1118481 - RNA, 24 nt, Human
aggcagauguugcagugagccgag

SEQ ID NO: 1118482 - RNA, 24 nt, Human
aggcaggagaaucgcuugaacccg

SEQ ID NO: 1118483 - RNA, 18 nt, Human
aggcagggguggcaggag

SEQ ID NO: 1118484 - RNA, 21 nt, Human
aggccgagacgggcggaucac

SEQ ID NO: 1118485 - RNA, 19 nt, Human
aggggucagcuuccccgcc

SEQ ID NO: 1118486 - RNA, 20 nt, Human
agguguggugacgccuguaa

SEQ ID NO: 1118487 - RNA, 24 nt, Human
aucaugccacugcacuccagccug

SEQ ID NO: 1118488 - RNA, 22 nt, Human
aucugcccuaaaccaaacguca

SEQ ID NO: 1118489 - RNA, 22 nt, Human
augccacugcacuccagccugg

SEQ ID NO: 1118490 - RNA, 24 nt, Human
caacacagagacagacaggagccc

SEQ ID NO: 1118491 - RNA, 24 nt, Human
caacauggugaaacccugucucua

SEQ ID NO: 1118492 - RNA, 22 nt, Human
cacaacacagagacagacagga

SEQ ID NO: 1118493 - RNA, 26 nt, Human
cacaacacagagacagacaggagccc

SEQ ID NO: 1118494 - RNA, 19 nt, Human
cacaugagcuaaccacgcc

SEQ ID NO: 1118495 - RNA, 20 nt, Human
cacaugagcuaaccacgccu

SEQ ID NO: 1118496 - RNA, 23 nt, Human
caccacggagaaggacgccguca

SEQ ID NO: 1118497 - RNA, 24 nt, Human
cacccagugccuucugaagccccc

SEQ ID NO: 1118498 - RNA, 25 nt, Human
caccgugcccgugaggaggccacgc

SEQ ID NO: 1118499 - RNA, 24 nt, Human
cacgccuguaaucccagcacuuug

SEQ ID NO: 1118500 - RNA, 18 nt, Human
cacgccuguccacaaagu

SEQ ID NO: 1118501 - RNA, 24 nt, Human
cacgccuguccacaaaguuaggaa

SEQ ID NO: 1118502 - RNA, 23 nt, Human
cacuccagccugggcgacagagc

SEQ ID NO: 1118503 - RNA, 24 nt, Human
cacuccagccugggcgacagagcg

SEQ ID NO: 1118504 - RNA, 19 nt, Human
cacugcacuccagccuggg

SEQ ID NO: 1118505 - RNA, 20 nt, Human
cacugcacuccagccugggc

SEQ ID NO: 1118506 - RNA, 22 nt, Human
cacugcacuccagccugggcga

SEQ ID NO: 1118507 - RNA, 23 nt, Human
cacugcacuccagccugggcgac

SEQ ID NO: 1118508 - RNA, 24 nt, Human
cacugcacuccagccugggcgaca

SEQ ID NO: 1118509 - RNA, 21 nt, Human
cagagcccacccagugccuuc

SEQ ID NO: 1118510 - RNA, 24 nt, Human
cagcacuuugggaggccgagacgg

SEQ ID NO: 1118511 - RNA, 26 nt, Human
cagcacuuugggaggccgagacgggc

SEQ ID NO: 1118512 - RNA, 28 nt, Human
cagcccaacuggagcggcuggaaaugac

SEQ ID NO: 1118513 - RNA, 20 nt, Human
cagccccucccuccagaagc

SEQ ID NO: 1118514 - RNA, 21 nt, Human
cagccccucccuccagaagcu

SEQ ID NO: 1118515 - RNA, 21 nt, Human
caggagggcgcuggcgcuggg

SEQ ID NO: 1118516 - RNA, 23 nt, Human
caggccccugcguccgagcuggg

SEQ ID NO: 1118517 - RNA, 21 nt, Human
caggggagcagggcugcaggg

SEQ ID NO: 1118518 - RNA, 24 nt, Human
cagugaaucugcccuaaaccaaac

SEQ ID NO: 1118519 - RNA, 24 nt, Human
cagugccuucugaagcccccgagg

SEQ ID NO: 1118520 - RNA, 23 nt, Human
ccacggagaaggacgccgucacc

SEQ ID NO: 1118521 - RNA, 20 nt, Human
ccacugcacuccagccuggg

SEQ ID NO: 1118522 - RNA, 20 nt, Human
ccacugcacuccagccuggg

SEQ ID NO: 1118523 - RNA, 21 nt, Human
ccacugcacuccagccugggc

SEQ ID NO: 1118524 - RNA, 21 nt, Human
ccacugcacuccagccugggc

SEQ ID NO: 1118525 - RNA, 23 nt, Human
ccacugcacuccagccugggcga

SEQ ID NO: 1118526 - RNA, 24 nt, Human
ccacugcacuccagccugggcgac

SEQ ID NO: 1118527 - RNA, 19 nt, Human
ccaggccuggccaaggugu

SEQ ID NO: 1118528 - RNA, 21 nt, Human
cccccgagggucacucagucu

SEQ ID NO: 1118529 - RNA, 19 nt, Human
cccggcugcaggacagugg

SEQ ID NO: 1118530 - RNA, 20 nt, Human
cccggggcugagugggcggc

SEQ ID NO: 1118531 - RNA, 23 nt, Human
cccugucucaaaaaaaaaaaaac

SEQ ID NO: 1118532 - RNA, 18 nt, Human
cccugugguguggacagg

SEQ ID NO: 1118533 - RNA, 23 nt, Human
ccgcccugcuuuaaugcgcaugc

SEQ ID NO: 1118534 - RNA, 20 nt, Human
ccgcuguccacagugggggc

SEQ ID NO: 1118535 - RNA, 21 nt, Human
ccggccucauguggccccauc

SEQ ID NO: 1118536 - RNA, 25 nt, Human
ccuaaaccaaacgucagaaagaaaa

SEQ ID NO: 1118537 - RNA, 19 nt, Human
ccuccgcggcaugcuggcc

SEQ ID NO: 1118538 - RNA, 19 nt, Human
ccucugagaugccuucaga

SEQ ID NO: 1118539 - RNA, 22 nt, Human
ccugaccaacauggugaaaccc

SEQ ID NO: 1118540 - RNA, 24 nt, Human
ccugaccaacauggugaaacccug

SEQ ID NO: 1118541 - RNA, 19 nt, Human
ccuggccaagguguggccc

SEQ ID NO: 1118542 - RNA, 20 nt, Human
ccuggccaagguguggcccu

SEQ ID NO: 1118543 - RNA, 20 nt, Human
ccuggccugaucugcccugu

SEQ ID NO: 1118544 - RNA, 22 nt, Human
ccugggaaccagccccucccuc

SEQ ID NO: 1118545 - RNA, 22 nt, Human
ccuguaaucccagcacuuuggg

SEQ ID NO: 1118546 - RNA, 21 nt, Human
ccuguaaucccagcuacucag

SEQ ID NO: 1118547 - RNA, 21 nt, Human
cgagacaccgucucaaaaaaa

SEQ ID NO: 1118548 - RNA, 26 nt, Human
cgagacgggcggaucaccugagauca

SEQ ID NO: 1118549 - RNA, 18 nt, Human
cgaggucaucuugucccg

SEQ ID NO: 1118550 - RNA, 26 nt, Human
cgcagagagcaccgucuggaccuccg

SEQ ID NO: 1118551 - RNA, 23 nt, Human
cgccuguaaucccagcacuuugg

SEQ ID NO: 1118552 - RNA, 24 nt, Human
cgccuguaaucccagcuacucagg

SEQ ID NO: 1118553 - RNA, 21 nt, Human
cggaucaccugagaucaguuc

SEQ ID NO: 1118554 - RNA, 22 nt, Human
cggcaugcuggccgcagagagc

SEQ ID NO: 1118555 - RNA, 24 nt, Human
cgggaggcagauguugcagugagc

SEQ ID NO: 1118556 - RNA, 19 nt, Human
cgggaggggugucugagcg

SEQ ID NO: 1118557 - RNA, 27 nt, Human
cgggcggaucaccugagaucaguucaa

SEQ ID NO: 1118558 - RNA, 24 nt, Human
cggggcugcuggcgggggagagcg

SEQ ID NO: 1118559 - RNA, 18 nt, Human
cgggggagccgagaggcg

SEQ ID NO: 1118560 - RNA, 21 nt, Human
cgucagaaagaaaagcggcag

SEQ ID NO: 1118561 - RNA, 28 nt, Human
cgucagaaagaaaagcggcagacguuuc

SEQ ID NO: 1118562 - RNA, 18 nt, Human
cucaaaaaaaaaaaaaca

SEQ ID NO: 1118563 - RNA, 25 nt, Human
cucaaaaaaaaaaaaacaaaaaaaa

SEQ ID NO: 1118564 - RNA, 22 nt, Human
cucacgccuguaaucccagcac

SEQ ID NO: 1118565 - RNA, 24 nt, Human
cucacgccuguaaucccagcacuu

SEQ ID NO: 1118566 - RNA, 23 nt, Human
cucugagaugccuucagaccccc

SEQ ID NO: 1118567 - RNA, 24 nt, Human
cugaccaacauggugaaacccugu

SEQ ID NO: 1118568 - RNA, 23 nt, Human
cugagacuuuccggcuucugccc

SEQ ID NO: 1118569 - RNA, 18 nt, Human
cuggccgcagagagcacc

SEQ ID NO: 1118570 - RNA, 21 nt, Human
cuguccacaaaguuaggaaaa

SEQ ID NO: 1118571 - RNA, 25 nt, Human
cugucucaaaaaaaaaaaaacaaaa

SEQ ID NO: 1118572 - RNA, 19 nt, Human
gaaacccugucucuacuaa

SEQ ID NO: 1118573 - RNA, 19 nt, Human
gaaaggggucagcuucccc

SEQ ID NO: 1118574 - RNA, 18 nt, Human
gaacccgggaggcagaug

SEQ ID NO: 1118575 - RNA, 24 nt, Human
gaaucugcccuaaaccaaacguca

SEQ ID NO: 1118576 - RNA, 21 nt, Human
gacagagcgagacccugucuc

SEQ ID NO: 1118577 - RNA, 19 nt, Human
gacgccuguaaucccagcu

SEQ ID NO: 1118578 - RNA, 19 nt, Human
gagaaaaggcaggacggcg

SEQ ID NO: 1118579 - RNA, 22 nt, Human
gagaaaaggcaggacggcgggu

SEQ ID NO: 1118580 - RNA, 23 nt, Human
gagaaucgcuugaacccgggagg

SEQ ID NO: 1118581 - RNA, 23 nt, Human
gagaucaugccacugcacuccag

SEQ ID NO: 1118582 - RNA, 18 nt, Human
gaggagggaccaagccuc

SEQ ID NO: 1118583 - RNA, 23 nt, Human
gaggcggggcugcuggcggggga

SEQ ID NO: 1118584 - RNA, 23 nt, Human
gaggcggggcugcuggcggggga

SEQ ID NO: 1118585 - RNA, 21 nt, Human
gaucaccugagaucaguucaa

SEQ ID NO: 1118586 - RNA, 23 nt, Human
gaucaccugagaucaguucaaga

SEQ ID NO: 1118587 - RNA, 22 nt, Human
gaucaguucaagaccagccuga

SEQ ID NO: 1118588 - RNA, 21 nt, Human
gcaagggaggggccacacuca

SEQ ID NO: 1118589 - RNA, 24 nt, Human
gcacuccagccugggcgacagagc

SEQ ID NO: 1118590 - RNA, 19 nt, Human
gcagauguugcagugagcc

SEQ ID NO: 1118591 - RNA, 24 nt, Human
gcagggcugcagggugggcuggca

SEQ ID NO: 1118592 - RNA, 19 nt, Human
gcaggggagcagggcugca

SEQ ID NO: 1118593 - RNA, 22 nt, Human
gccacugcacuccagccugggc

SEQ ID NO: 1118594 - RNA, 24 nt, Human
gccacugcacuccagccugggcga

SEQ ID NO: 1118595 - RNA, 21 nt, Human
gccaggggaaaggggucagcu

SEQ ID NO: 1118596 - RNA, 20 nt, Human
gccgagaucaugccacugca

SEQ ID NO: 1118597 - RNA, 19 nt, Human
gccgcagagagcaccgucu

SEQ ID NO: 1118598 - RNA, 23 nt, Human
gccugacccggagaaaaggcagg

SEQ ID NO: 1118599 - RNA, 23 nt, Human
gccuguaaucccagcuacucagg

SEQ ID NO: 1118600 - RNA, 23 nt, Human
gcgacagagcgagacccugucuc

SEQ ID NO: 1118601 - RNA, 18 nt, Human
gcgcaugcgggggagccg

SEQ ID NO: 1118602 - RNA, 19 nt, Human
gcgcugggaugguggccgg

SEQ ID NO: 1118603 - RNA, 19 nt, Human
gcggaagagcuuuguccug

SEQ ID NO: 1118604 - RNA, 23 nt, Human
gcgggggagccgagaggcggggc

SEQ ID NO: 1118605 - RNA, 19 nt, Human
ggaaaugaccaucaccagg

SEQ ID NO: 1118606 - RNA, 23 nt, Human
ggaccaagccucaccacggagaa

SEQ ID NO: 1118607 - RNA, 23 nt, Human
ggcaggggagcagggcugcaggg

SEQ ID NO: 1118608 - RNA, 21 nt, Human
ggccgggcgcgguggcucacg

SEQ ID NO: 1118609 - RNA, 22 nt, Human
ggcgccugcucagcuugagaac

SEQ ID NO: 1118610 - RNA, 20 nt, Human
ggcgcgguggcucacgccug

SEQ ID NO: 1118611 - RNA, 20 nt, Human
ggcgcgguggcucacgccug

SEQ ID NO: 1118612 - RNA, 23 nt, Human
ggcgcgguggcucacgccuguaa

SEQ ID NO: 1118613 - RNA, 21 nt, Human
ggggagccgagaggcggggcu

SEQ ID NO: 1118614 - RNA, 22 nt, Human
gggggagccgagaggcggggcu

SEQ ID NO: 1118615 - RNA, 20 nt, Human
ggugacgccuguaaucccag

SEQ ID NO: 1118616 - RNA, 23 nt, Human
gguggccggccaggcaggggugg

SEQ ID NO: 1118617 - RNA, 23 nt, Human
gguggcucacgccuguaauccca

SEQ ID NO: 1118618 - RNA, 24 nt, Human
gguggcucacgccuguaaucccag

SEQ ID NO: 1118619 - RNA, 24 nt, Human
guguggugacgccuguaaucccag

SEQ ID NO: 1118620 - RNA, 24 nt, Human
guugcagugagccgagaucaugcc

SEQ ID NO: 1118621 - RNA, 21 nt, Human
uaaaaauacaaaaauuagcca

SEQ ID NO: 1118622 - RNA, 22 nt, Human
uauccccggccucauguggccc

SEQ ID NO: 1118623 - RNA, 19 nt, Human
ucacaacacagagacagac

SEQ ID NO: 1118624 - RNA, 23 nt, Human
ucaugccacugcacuccagccug

SEQ ID NO: 1118625 - RNA, 28 nt, Human
uccacaaaguuaggaaaacggcggaccg

SEQ ID NO: 1118626 - RNA, 23 nt, Human
uccagccugggcgacagagcgag

SEQ ID NO: 1118627 - RNA, 24 nt, Human
uccagccugggcgacagagcgaga

SEQ ID NO: 1118628 - RNA, 20 nt, Human
ucccuccagaagcuuucucu

SEQ ID NO: 1118629 - RNA, 18 nt, Human
uccgagcugggggugggg

SEQ ID NO: 1118630 - RNA, 24 nt, Human
uccgcggcaugcuggccgcagaga

SEQ ID NO: 1118631 - RNA, 20 nt, Human
uccgggcgccgcacucugcg

SEQ ID NO: 1118632 - RNA, 18 nt, Human
ucgcuugaacccgggagg

SEQ ID NO: 1118633 - RNA, 23 nt, Human
ucucaaaaaaaaaaaaacaaaaa

SEQ ID NO: 1118634 - RNA, 26 nt, Human
ucucaaaaaaaaaaaaacaaaaaaaa

SEQ ID NO: 1118635 - RNA, 23 nt, Human
ucucuacuaaaaauacaaaaauu

SEQ ID NO: 1118636 - RNA, 22 nt, Human
ucucugcuccugccgcuggaga

SEQ ID NO: 1118637 - RNA, 20 nt, Human
ucugaagcccccgaggguca

SEQ ID NO: 1118638 - RNA, 24 nt, Human
ucugcccuaaaccaaacgucagaa

SEQ ID NO: 1118639 - RNA, 19 nt, Human
ucuggcgccugcucagcuu

SEQ ID NO: 1118640 - RNA, 23 nt, Human
ucugggaggccccacgcggcccc

SEQ ID NO: 1118641 - RNA, 24 nt, Human
ugaccaacauggugaaacccuguc

SEQ ID NO: 1118642 - RNA, 19 nt, Human
ugacccggagaaaaggcag

SEQ ID NO: 1118643 - RNA, 21 nt, Human
ugacuuccggccaugacuccc

SEQ ID NO: 1118644 - RNA, 20 nt, Human
ugagaugccuucagaccccc

SEQ ID NO: 1118645 - RNA, 22 nt, Human
ugagccgagaucaugccacugc

SEQ ID NO: 1118646 - RNA, 21 nt, Human
ugaggaggccacgccaggccc

SEQ ID NO: 1118647 - RNA, 20 nt, Human
ugaggcaggagaaucgcuug

SEQ ID NO: 1118648 - RNA, 24 nt, Human
ugaggcaggagaaucgcuugaacc

SEQ ID NO: 1118649 - RNA, 25 nt, Human
ugaggcaggagaaucgcuugaaccc

SEQ ID NO: 1118650 - RNA, 20 nt, Human
ugcaggcugccaaccugcca

SEQ ID NO: 1118651 - RNA, 21 nt, Human
ugcagugaaucugcccuaaac

SEQ ID NO: 1118652 - RNA, 33 nt, Human
ugccaaccugccacucugggaggccccacgccg

SEQ ID NO: 1118653 - RNA, 22 nt, Human
ugccagaaggugcuaagaucug

SEQ ID NO: 1118654 - RNA, 21 nt, Human
ugccggagcuggcgugcucag

SEQ ID NO: 1118655 - RNA, 21 nt, Human
ugccuucagacccccgccugu

SEQ ID NO: 1118656 - RNA, 21 nt, Human
uggaaaugaccaucaccaggc

SEQ ID NO: 1118657 - RNA, 19 nt, Human
uggacaggccagcccggcu

SEQ ID NO: 1118658 - RNA, 27 nt, Human
uggaccuccgggcccucucugcuccuu

SEQ ID NO: 1118659 - RNA, 24 nt, Human
uggccaagguguggcccuggaagc

SEQ ID NO: 1118660 - RNA, 25 nt, Human
uggccaagguguggcccuggaagcc

SEQ ID NO: 1118661 - RNA, 20 nt, Human
uggccugaucugcccugucc

SEQ ID NO: 1118662 - RNA, 24 nt, Human
uggcucacgccuguaaucccagca

SEQ ID NO: 1118663 - RNA, 21 nt, Human
ugggaaccagccccucccucc

SEQ ID NO: 1118664 - RNA, 19 nt, Human
ugggaggccgagacgggcg

SEQ ID NO: 1118665 - RNA, 24 nt, Human
ugggaggccgagacgggcggauca

SEQ ID NO: 1118666 - RNA, 18 nt, Human
ugggaugguggccggcca

SEQ ID NO: 1118667 - RNA, 20 nt, Human
ugggauucuggcgccugcuc

SEQ ID NO: 1118668 - RNA, 19 nt, Human
ugggcgacagagcgagaca

SEQ ID NO: 1118669 - RNA, 19 nt, Human
uggggguggggaagcuggu

SEQ ID NO: 1118670 - RNA, 19 nt, Human
uggggguggggaagcugug

SEQ ID NO: 1118671 - RNA, 21 nt, Human
uggugacgccuguaaucccag

SEQ ID NO: 1118672 - RNA, 21 nt, Human
ugucccggggcugagugggcg

SEQ ID NO: 1118673 - RNA, 22 nt, Human
ugucccggggcugagugggcgg

SEQ ID NO: 1118674 - RNA, 19 nt, Human
ugucccgggguuuccaggc

SEQ ID NO: 1118675 - RNA, 20 nt, Human
uguggacaggccagcccggc

SEQ ID NO: 1118676 - RNA, 18 nt, Human
uguggccccaucagccca

SEQ ID NO: 1118677 - RNA, 21 nt, Human
uuagccagguguggugacgcc

SEQ ID NO: 1118678 - RNA, 23 nt, Human
uuccccgccuggggcugugucug

SEQ ID NO: 1118679 - RNA, 18 nt, Human
uugcagugagccgagauc

SEQ ID NO: 1118680 - RNA, 20 nt, Human
uugcagugagccgagaucau

SEQ ID NO: 1118681 - RNA, 21 nt, Human
uugcagugagccgagaucaug

SEQ ID NO: 1118682 - RNA, 19 nt, Human
uuuccggcuucugcccauc

SEQ ID NO: 1118683 - RNA, 25 nt, Human
uuugggggcccucugagaugccuuc

SEQ ID NO: 1118684 - RNA, 25 nt, Human
aaaaacaaggcccagaaaaacaauu

SEQ ID NO: 1118685 - RNA, 22 nt, Human
aaaagcagcucuuuccaaagca

SEQ ID NO: 1118686 - RNA, 19 nt, Human
aaagaacucauuuuacaga

SEQ ID NO: 1118687 - RNA, 19 nt, Human
aaagacaagaauuauuggc

SEQ ID NO: 1118688 - RNA, 24 nt, Human
aaauaacuguuacaagcaaauccu

SEQ ID NO: 1118689 - RNA, 20 nt, Human
aacaaugaagucagcuugaa

SEQ ID NO: 1118690 - RNA, 18 nt, Human
aacaauugagggcaggag

SEQ ID NO: 1118691 - RNA, 25 nt, Human
aacaauugagggcaggagggaagaa

SEQ ID NO: 1118692 - RNA, 18 nt, Human
aacuaaaaaacaaggccc

SEQ ID NO: 1118693 - RNA, 21 nt, Human
aagaaaaagcacugccaagaa

SEQ ID NO: 1118694 - RNA, 22 nt, Human
aagaagacaaugacucacccaa

SEQ ID NO: 1118695 - RNA, 19 nt, Human
aauguuauuuucugcaaug

SEQ ID NO: 1118696 - RNA, 19 nt, Human
acaaaaccucauaacaagg

SEQ ID NO: 1118697 - RNA, 19 nt, Human
acaaagagccucagagacc

SEQ ID NO: 1118698 - RNA, 23 nt, Human
acaaagagccucagagaccaucc

SEQ ID NO: 1118699 - RNA, 18 nt, Human
acaaccauacaccugcca

SEQ ID NO: 1118700 - RNA, 19 nt, Human
acagcaaggaaguaaagcc

SEQ ID NO: 1118701 - RNA, 22 nt, Human
acaggaacaggagauacacaga

SEQ ID NO: 1118702 - RNA, 18 nt, Human
acauacagaaacuaaaaa

SEQ ID NO: 1118703 - RNA, 24 nt, Human
acauacagaaacuaaaaaacaagg

SEQ ID NO: 1118704 - RNA, 18 nt, Human
accugcagcuuucucugg

SEQ ID NO: 1118705 - RNA, 18 nt, Human
acuaaaaaacaaggccca

SEQ ID NO: 1118706 - RNA, 19 nt, Human
acucacuaggaacccucca

SEQ ID NO: 1118707 - RNA, 20 nt, Human
acuguguggcacugggcaag

SEQ ID NO: 1118708 - RNA, 22 nt, Human
agaaaaagcacugccaagaaua

SEQ ID NO: 1118709 - RNA, 24 nt, Human
agaaaacugucauaaaaguggguu

SEQ ID NO: 1118710 - RNA, 19 nt, Human
agaacacuauagugccccc

SEQ ID NO: 1118711 - RNA, 19 nt, Human
agaacccugcuccccacuc

SEQ ID NO: 1118712 - RNA, 20 nt, Human
agaacgccaggagauacugu

SEQ ID NO: 1118713 - RNA, 23 nt, Human
agagaagagccacagacuuaguu

SEQ ID NO: 1118714 - RNA, 19 nt, Human
agagaccaucccaucuaau

SEQ ID NO: 1118715 - RNA, 20 nt, Human
agauuucaagauggcagccc

SEQ ID NO: 1118716 - RNA, 26 nt, Human
agcccagagaaacagccuccagccuu

SEQ ID NO: 1118717 - RNA, 20 nt, Human
aggagggaguagucucacag

SEQ ID NO: 1118718 - RNA, 20 nt, Human
aggcagaggaugcuggguca

SEQ ID NO: 1118719 - RNA, 21 nt, Human
aggcagaggaugcugggucag

SEQ ID NO: 1118720 - RNA, 24 nt, Human
aggcagcacagaccccuuucugcu

SEQ ID NO: 1118721 - RNA, 18 nt, Human
agggacccagccucuggg

SEQ ID NO: 1118722 - RNA, 23 nt, Human
agggacccagccucugggucccc

SEQ ID NO: 1118723 - RNA, 23 nt, Human
agugucuacuucauaaagguagc

SEQ ID NO: 1118724 - RNA, 20 nt, Human
auaacaagguagccagggac

SEQ ID NO: 1118725 - RNA, 19 nt, Human
auacagaaacuaaaaaaca

SEQ ID NO: 1118726 - RNA, 20 nt, Human
aucaccuuuccuccagcgaa

SEQ ID NO: 1118727 - RNA, 18 nt, Human
aucaugauagucgacuug

SEQ ID NO: 1118728 - RNA, 21 nt, Human
auuggcgagaucuuuuuaggc

SEQ ID NO: 1118729 - RNA, 25 nt, Human
caaaaaaagcagcagcacguggaag

SEQ ID NO: 1118730 - RNA, 22 nt, Human
caaaagcaaaaaacagccacag

SEQ ID NO: 1118731 - RNA, 21 nt, Human
caaaagcaaaaaacagccacc

SEQ ID NO: 1118732 - RNA, 22 nt, Human
caaaggggccuauaaugcaaua

SEQ ID NO: 1118733 - RNA, 18 nt, Human
caacacucaaagacaaga

SEQ ID NO: 1118734 - RNA, 22 nt, Human
caacucacuaggaacccuccaa

SEQ ID NO: 1118735 - RNA, 20 nt, Human
caagaacacuauagugcccc

SEQ ID NO: 1118736 - RNA, 22 nt, Human
caagaagacaaugacucacccc

SEQ ID NO: 1118737 - RNA, 27 nt, Human
caaggcccagaaaaacaauugagggca

SEQ ID NO: 1118738 - RNA, 22 nt, Human
caagguggaaacaaugaaguca

SEQ ID NO: 1118739 - RNA, 19 nt, Human
cacagcaaggaaguaaagc

SEQ ID NO: 1118740 - RNA, 20 nt, Human
cacagcuucuuuauccaccu

SEQ ID NO: 1118741 - RNA, 19 nt, Human
caccuuuccuccagcgaag

SEQ ID NO: 1118742 - RNA, 24 nt, Human
cacuggagagaaagcaggcgaugc

SEQ ID NO: 1118743 - RNA, 20 nt, Human
cagaaaaacaauugagggca

SEQ ID NO: 1118744 - RNA, 18 nt, Human
cagacagggaaacugagg

SEQ ID NO: 1118745 - RNA, 22 nt, Human
cagagaaacagccuccagccuu

SEQ ID NO: 1118746 - RNA, 25 nt, Human
cagcaaggaaguaaagccaugggga

SEQ ID NO: 1118747 - RNA, 18 nt, Human
cagcagagaagagccaca

SEQ ID NO: 1118748 - RNA, 25 nt, Human
cagcagcacguggaagagaucagcu

SEQ ID NO: 1118749 - RNA, 22 nt, Human
cagccucuggguccccauuccu

SEQ ID NO: 1118750 - RNA, 23 nt, Human
caggaccccugaugaugaggccu

SEQ ID NO: 1118751 - RNA, 20 nt, Human
caggagauacuguguggcac

SEQ ID NO: 1118752 - RNA, 24 nt, Human
cauccuuggccccacugcagaucc

SEQ ID NO: 1118753 - RNA, 22 nt, Human
ccaaaagcaaaaaacagccaca

SEQ ID NO: 1118754 - RNA, 18 nt, Human
ccaagaagacaaugacuc

SEQ ID NO: 1118755 - RNA, 24 nt, Human
ccaagcagcucuauugccaggucc

SEQ ID NO: 1118756 - RNA, 23 nt, Human
ccaagcugcggaagaaaacuguc

SEQ ID NO: 1118757 - RNA, 23 nt, Human
ccaaugauacacaugcacccaag

SEQ ID NO: 1118758 - RNA, 20 nt, Human
ccacaaagagccucagagac

SEQ ID NO: 1118759 - RNA, 21 nt, Human
ccagaaaaacaauugagggca

SEQ ID NO: 1118760 - RNA, 21 nt, Human
ccagcgacagguucuggccuc

SEQ ID NO: 1118761 - RNA, 21 nt, Human
ccagggacccagccucugggu

SEQ ID NO: 1118762 - RNA, 22 nt, Human
cccaaaagcaaaaaacagccac

SEQ ID NO: 1118763 - RNA, 24 nt, Human
cccaaaagcaaaaaacagccacag

SEQ ID NO: 1118764 - RNA, 23 nt, Human
cccaugagauuaaaacauacaga

SEQ ID NO: 1118765 - RNA, 19 nt, Human
ccccaggacgacaagucca

SEQ ID NO: 1118766 - RNA, 20 nt, Human
cccccaacaaaggggccuau

SEQ ID NO: 1118767 - RNA, 26 nt, Human
cccucaaugcguauguacguaucacc

SEQ ID NO: 1118768 - RNA, 19 nt, Human
cccugcaucccgaacacuc

SEQ ID NO: 1118769 - RNA, 26 nt, Human
cccugcaucccgaacacuccacugac

SEQ ID NO: 1118770 - RNA, 20 nt, Human
ccuccaggugccuuuggaag

SEQ ID NO: 1118771 - RNA, 24 nt, Human
ccugaugaugaggccuggguccaa

SEQ ID NO: 1118772 - RNA, 23 nt, Human
ccuuucugcuuuaagucugaaga

SEQ ID NO: 1118773 - RNA, 21 nt, Human
ccuuuggaaggugagcagaga

SEQ ID NO: 1118774 - RNA, 20 nt, Human
cucacuaggaacccuccaac

SEQ ID NO: 1118775 - RNA, 26 nt, Human
cugcuccccacucgggguauucaaaa

SEQ ID NO: 1118776 - RNA, 19 nt, Human
cugguaguuuaauguucuc

SEQ ID NO: 1118777 - RNA, 19 nt, Human
cugguaguuuaauguucuc

SEQ ID NO: 1118778 - RNA, 18 nt, Human
cuggugcucaggaaagga

SEQ ID NO: 1118779 - RNA, 19 nt, Human
cuggugcucaggaaaggag

SEQ ID NO: 1118780 - RNA, 21 nt, Human
cuugccagccauuugaagccc

SEQ ID NO: 1118781 - RNA, 23 nt, Human
cuuggccccacugcagaucccuu

SEQ ID NO: 1118782 - RNA, 23 nt, Human
gacaaauuccucuggaggaaguc

SEQ ID NO: 1118783 - RNA, 18 nt, Human
gacccagccucugggucc

SEQ ID NO: 1118784 - RNA, 19 nt, Human
gacgacaaguccaagaaca

SEQ ID NO: 1118785 - RNA, 22 nt, Human
gacuugcagaaauccggggccc

SEQ ID NO: 1118786 - RNA, 23 nt, Human
gagaaauaacaaaaccucauaac

SEQ ID NO: 1118787 - RNA, 21 nt, Human
gagagagcugggguuggggag

SEQ ID NO: 1118788 - RNA, 21 nt, Human
gagcugggaagcagcaggaaa

SEQ ID NO: 1118789 - RNA, 19 nt, Human
gaggaacaggagggaguag

SEQ ID NO: 1118790 - RNA, 22 nt, Human
gauacuguguggcacugggcaa

SEQ ID NO: 1118791 - RNA, 24 nt, Human
gaugaugaggccuggguccaaaca

SEQ ID NO: 1118792 - RNA, 18 nt, Human
gauggugaaaacaggaga

SEQ ID NO: 1118793 - RNA, 20 nt, Human
gcaaggaaguaaagccaugg

SEQ ID NO: 1118794 - RNA, 18 nt, Human
gcagagaagagccacaga

SEQ ID NO: 1118795 - RNA, 24 nt, Human
gccauggggaaaaaaauccagcuu

SEQ ID NO: 1118796 - RNA, 18 nt, Human
gccccacugcagaucccu

SEQ ID NO: 1118797 - RNA, 26 nt, Human
gcccccaacaaaggggccuauaaugc

SEQ ID NO: 1118798 - RNA, 21 nt, Human
gcuuugaggagaacccugcuc

SEQ ID NO: 1118799 - RNA, 19 nt, Human
ggaaacaaugaagucagcc

SEQ ID NO: 1118800 - RNA, 21 nt, Human
ggaacccuccaacaaccauac

SEQ ID NO: 1118801 - RNA, 25 nt, Human
ggagcuucucugagcucauccccau

SEQ ID NO: 1118802 - RNA, 25 nt, Human
ggcagccccagcaaaaggggaacgc

SEQ ID NO: 1118803 - RNA, 20 nt, Human
gggacccagccucugggucc

SEQ ID NO: 1118804 - RNA, 19 nt, Human
gguuuguugaccgggggca

SEQ ID NO: 1118805 - RNA, 18 nt, Human
guaaagugcgaugccucc

SEQ ID NO: 1118806 - RNA, 24 nt, Human
gugagcagagagagcugggguugg

SEQ ID NO: 1118807 - RNA, 28 nt, Human
guggaccaacaggcugcccccaacaaag

SEQ ID NO: 1118808 - RNA, 18 nt, Human
uaaaaaacaaggcccaga

SEQ ID NO: 1118809 - RNA, 19 nt, Human
uaaaaauaaaaucuaucua

SEQ ID NO: 1118810 - RNA, 26 nt, Human
uaaaacauacagaaacuaaaaaacaa

SEQ ID NO: 1118811 - RNA, 24 nt, Human
uaaaagcagcucuuuccaaagcaa

SEQ ID NO: 1118812 - RNA, 22 nt, Human
uaaagaacuaaaacugccccag

SEQ ID NO: 1118813 - RNA, 23 nt, Human
uaacaaaaccucauaacaaggua

SEQ ID NO: 1118814 - RNA, 20 nt, Human
uacguggcuuucugaaaagu

SEQ ID NO: 1118815 - RNA, 24 nt, Human
uacuguguggcacugggcaaggcu

SEQ ID NO: 1118816 - RNA, 21 nt, Human
uaggaacccuccaacaaccau

SEQ ID NO: 1118817 - RNA, 18 nt, Human
uauaaagaacuaaaacug

SEQ ID NO: 1118818 - RNA, 19 nt, Human
uauaaugcaauaacaguuu

SEQ ID NO: 1118819 - RNA, 23 nt, Human
uauagugcccccugcaucccgaa

SEQ ID NO: 1118820 - RNA, 21 nt, Human
uaucagaguggcaaaaaaagc

SEQ ID NO: 1118821 - RNA, 19 nt, Human
ucagagaccaucccaucua

SEQ ID NO: 1118822 - RNA, 20 nt, Human
ucaggaaaggagaugcauga

SEQ ID NO: 1118823 - RNA, 18 nt, Human
ucaguauauguucugagc

SEQ ID NO: 1118824 - RNA, 22 nt, Human
uccaagaagacaaugacucacc

SEQ ID NO: 1118825 - RNA, 19 nt, Human
uccaaggggaaagaaauga

SEQ ID NO: 1118826 - RNA, 19 nt, Human
uccagcgacagguucuggc

SEQ ID NO: 1118827 - RNA, 23 nt, Human
uccauaauaccuagacuccuaga

SEQ ID NO: 1118828 - RNA, 19 nt, Human
ucuauugccagguccccca

SEQ ID NO: 1118829 - RNA, 24 nt, Human
ucuguaggaaugcaucagcuuggu

SEQ ID NO: 1118830 - RNA, 20 nt, Human
ugaaaacaggagaaccuuag

SEQ ID NO: 1118831 - RNA, 19 nt, Human
ugaaauaacuguuacaagc

SEQ ID NO: 1118832 - RNA, 18 nt, Human
ugaaggcagagaagacaa

SEQ ID NO: 1118833 - RNA, 18 nt, Human
ugagagagaccagagcac

SEQ ID NO: 1118834 - RNA, 18 nt, Human
ugagggcaggagggaaga

SEQ ID NO: 1118835 - RNA, 19 nt, Human
ugagugaaggcagagaaga

SEQ ID NO: 1118836 - RNA, 24 nt, Human
ugauccuaugguugugaggcuuug

SEQ ID NO: 1118837 - RNA, 24 nt, Human
ugcaagcuugccuacagcugaggg

SEQ ID NO: 1118838 - RNA, 22 nt, Human
ugccacaaagagccucagagac

SEQ ID NO: 1118839 - RNA, 18 nt, Human
ugccaggaaauucauagg

SEQ ID NO: 1118840 - RNA, 18 nt, Human
ugccaggaaauucauagg

SEQ ID NO: 1118841 - RNA, 22 nt, Human
ugccuuuggaaggugagcagag

SEQ ID NO: 1118842 - RNA, 25 nt, Human
ugcggaagaaaacugucauaaaagu

SEQ ID NO: 1118843 - RNA, 22 nt, Human
uggaaacaaugaagucagcuug

SEQ ID NO: 1118844 - RNA, 22 nt, Human
uggaaagauccagacuuuggca

SEQ ID NO: 1118845 - RNA, 22 nt, Human
uggaagagaucagcugcuggua

SEQ ID NO: 1118846 - RNA, 22 nt, Human
uggcagccccagcaaaagggca

SEQ ID NO: 1118847 - RNA, 21 nt, Human
uggcgagaucuuuuuaggcau

SEQ ID NO: 1118848 - RNA, 18 nt, Human
uggggagggaugauguca

SEQ ID NO: 1118849 - RNA, 24 nt, Human
ugggguggcauccuuggccccacu

SEQ ID NO: 1118850 - RNA, 23 nt, Human
ugguaaagugcgaugccuccucc

SEQ ID NO: 1118851 - RNA, 25 nt, Human
ugguaagccaggagccaggucaaac

SEQ ID NO: 1118852 - RNA, 24 nt, Human
ugguugugaggcuuugaggagaac

SEQ ID NO: 1118853 - RNA, 18 nt, Human
ugguuuccagcgacaggu

SEQ ID NO: 1118854 - RNA, 24 nt, Human
uguggaccaacaggcugcccccaa

SEQ ID NO: 1118855 - RNA, 19 nt, Human
uguugaccgggggcagugg

SEQ ID NO: 1118856 - RNA, 18 nt, Human
uguuggugcugcugaaau

SEQ ID NO: 1118857 - RNA, 26 nt, Human
uguuggugcugcugaaauguggaaag

SEQ ID NO: 1118858 - RNA, 24 nt, Human
uuacaagcaaauccuauugcacuc

SEQ ID NO: 1118859 - RNA, 20 nt, Human
uuagagaucauccauuucaa

SEQ ID NO: 1118860 - RNA, 24 nt, Human
uuaguaucagaguggcaaaaaaag

SEQ ID NO: 1118861 - RNA, 24 nt, Human
uuggugcccuuagagaucauccau

SEQ ID NO: 1118862 - RNA, 20 nt, Human
uuggugcugcugaaaugugg

SEQ ID NO: 1118863 - RNA, 23 nt, Human
uugucagagaaauaacaaaaccu

SEQ ID NO: 1118864 - RNA, 18 nt, Human
uuuccauaauaccuagac

SEQ ID NO: 1118865 - RNA, 18 nt, Human
uuuucaacuuccccaugu

SEQ ID NO: 1118866 - RNA, 21 nt, Human
aaaaaaaagcacuuacagaag

SEQ ID NO: 1118867 - RNA, 22 nt, Human
aagaaaaaaaaagcacuuacag

SEQ ID NO: 1118868 - RNA, 24 nt, Human
aagaaaaaaaaagcacuuacagaa

SEQ ID NO: 1118869 - RNA, 21 nt, Human
acagggacugcuaacauccug

SEQ ID NO: 1118870 - RNA, 23 nt, Human
accuccgggaccugcccgugcuu

SEQ ID NO: 1118871 - RNA, 25 nt, Human
agaaaaaaaaagcacuuacagaagg

SEQ ID NO: 1118872 - RNA, 24 nt, Human
agccucucuucucuuuccaaccuc

SEQ ID NO: 1118873 - RNA, 23 nt, Human
cagaaggaggcaggcagccaagc

SEQ ID NO: 1118874 - RNA, 21 nt, Human
cagccucucuucucuuuccaa

SEQ ID NO: 1118875 - RNA, 21 nt, Human
ccagccucucuucucuuucca

SEQ ID NO: 1118876 - RNA, 20 nt, Human
cccccgccccgcaggccugc

SEQ ID NO: 1118877 - RNA, 19 nt, Human
cccggaucagggccucaga

SEQ ID NO: 1118878 - RNA, 24 nt, Human
ccucucuucucuuuccaaccucua

SEQ ID NO: 1118879 - RNA, 19 nt, Human
cgccaccccgcccccgccc

SEQ ID NO: 1118880 - RNA, 22 nt, Human
cuccacaggcacaguggccugg

SEQ ID NO: 1118881 - RNA, 18 nt, Human
cucccagccucucuucuc

SEQ ID NO: 1118882 - RNA, 21 nt, Human
cugcccgugcucucuagaauc

SEQ ID NO: 1118883 - RNA, 22 nt, Human
cugguaauagaguacagguuuu

SEQ ID NO: 1118884 - RNA, 23 nt, Human
cuuacagaaggaggcaggcagcc

SEQ ID NO: 1118885 - RNA, 20 nt, Human
gccaccccgcccccgccccg

SEQ ID NO: 1118886 - RNA, 21 nt, Human
gccaccccgcccccgccccgc

SEQ ID NO: 1118887 - RNA, 20 nt, Human
gcccagggucccuucggugc

SEQ ID NO: 1118888 - RNA, 25 nt, Human
ggaggcaggcagccaagcugagccc

SEQ ID NO: 1118889 - RNA, 24 nt, Human
gguaauagaguacagguuuaagga

SEQ ID NO: 1118890 - RNA, 23 nt, Human
guaagucuguucgucccccacuc

SEQ ID NO: 1118891 - RNA, 21 nt, Human
ucccaggugaagaaaaaaaaa

SEQ ID NO: 1118892 - RNA, 19 nt, Human
ucccaucagccaguggagc

SEQ ID NO: 1118893 - RNA, 20 nt, Human
uccugggcgccaccccgccc

SEQ ID NO: 1118894 - RNA, 21 nt, Human
uccugggcgccaccccgcccc

SEQ ID NO: 1118895 - RNA, 20 nt, Human
ucugagaccuccgggaccuu

SEQ ID NO: 1118896 - RNA, 22 nt, Human
ugagagaacgcugcggcucugg

SEQ ID NO: 1118897 - RNA, 19 nt, Human
ugaucccaucagccagugg

SEQ ID NO: 1118898 - RNA, 23 nt, Human
uggaacccguucgcggucucuca

SEQ ID NO: 1118899 - RNA, 22 nt, Human
aggaagcagauccagagaggca

SEQ ID NO: 1118900 - RNA, 24 nt, Human
auuccauucaugauccuggaauag

SEQ ID NO: 1118901 - RNA, 26 nt, Human
auuccauucaugauccuggaauagaa

SEQ ID NO: 1118902 - RNA, 23 nt, Human
gcuguuuacaugccuuccuugag

SEQ ID NO: 1118903 - RNA, 19 nt, Human
gggcaugaaagccaguggc

SEQ ID NO: 1118904 - RNA, 21 nt, Human
ucaggaagcagauccagagag

SEQ ID NO: 1118905 - RNA, 20 nt, Human
uccuggaauagggcaugaaa

SEQ ID NO: 1118906 - RNA, 22 nt, Human
uccuggaauagggcaugaaagc

SEQ ID NO: 1118907 - RNA, 18 nt, Human
uucaaggcuggagaacua

SEQ ID NO: 1118908 - RNA, 20 nt, Human
aacaacuuuucacaagccga

SEQ ID NO: 1118909 - RNA, 22 nt, Human
aacucccuucuucaauggacua

SEQ ID NO: 1118910 - RNA, 21 nt, Human
acaacaacuuucaaacucccu

SEQ ID NO: 1118911 - RNA, 23 nt, Human
agaaagccgcuauaaaacccaaa

SEQ ID NO: 1118912 - RNA, 20 nt, Human
caaacuguauccagcuuuau

SEQ ID NO: 1118913 - RNA, 18 nt, Human
cagcuuuauuaaagauac

SEQ ID NO: 1118914 - RNA, 20 nt, Human
ccacaaucuagaaauggaac

SEQ ID NO: 1118915 - RNA, 21 nt, Human
ggcaucacuggaaaguccaga

SEQ ID NO: 1118916 - RNA, 20 nt, Human
uacgaaaaaucagaaagccg

SEQ ID NO: 1118917 - RNA, 25 nt, Human
uagaaauggaaccacugcucuuuug

SEQ ID NO: 1118918 - RNA, 24 nt, Human
ucaauggacuacgaaaaaucagaa

SEQ ID NO: 1118919 - RNA, 22 nt, Human
ucaggcaggacaugggcagaca

SEQ ID NO: 1118920 - RNA, 22 nt, Human
ucaggucccaacagaugccugg

SEQ ID NO: 1118921 - RNA, 20 nt, Human
ugaaaauggcagaauuuauc

SEQ ID NO: 1118922 - RNA, 21 nt, Human
ugaaaauggcagaauuuaucu

SEQ ID NO: 1118923 - RNA, 23 nt, Human
uggaaccacugcucuuuugacag

SEQ ID NO: 1118924 - RNA, 18 nt, Human
uggcaucacuggaaaguc

SEQ ID NO: 1118925 - RNA, 20 nt, Human
uuaucugaagauccacaauc

SEQ ID NO: 1118926 - RNA, 29 nt, Human
uuuagagugaggguugacauuucacauuu

SEQ ID NO: 1118927 - RNA, 26 nt, Human
uuucaaacucccuucuucaauggacu

SEQ ID NO: 1118928 - RNA, 22 nt, Human
aaaaagucaaaauuuagccagg

SEQ ID NO: 1118929 - RNA, 18 nt, Human
aaacccaagcuacggcaa

SEQ ID NO: 1118930 - RNA, 25 nt, Human
aaacuaagaaguaaauaagccagaa

SEQ ID NO: 1118931 - RNA, 19 nt, Human
aaagugcuaggguuacagg

SEQ ID NO: 1118932 - RNA, 24 nt, Human
aaagugcuaggguuacagguguga

SEQ ID NO: 1118933 - RNA, 24 nt, Human
aaagugcugggauuacaggcguga

SEQ ID NO: 1118934 - RNA, 20 nt, Human
aaccccucccuacucauccc

SEQ ID NO: 1118935 - RNA, 22 nt, Human
aagaagaggaggauucuaagaa

SEQ ID NO: 1118936 - RNA, 18 nt, Human
aagacuucagcuuccacc

SEQ ID NO: 1118937 - RNA, 20 nt, Human
aagcaaauuccugaauuuuc

SEQ ID NO: 1118938 - RNA, 19 nt, Human
aagcauuuugggaggcuga

SEQ ID NO: 1118939 - RNA, 24 nt, Human
aagcauuuugggaggcugaggugg

SEQ ID NO: 1118940 - RNA, 21 nt, Human
aaggagcuggagagacagugg

SEQ ID NO: 1118941 - RNA, 24 nt, Human
aaggagcuggagagacaguggggu

SEQ ID NO: 1118942 - RNA, 22 nt, Human
aagucaaaauuuagccaggccu

SEQ ID NO: 1118943 - RNA, 26 nt, Human
aagugcuaggguuacaggugugagcc

SEQ ID NO: 1118944 - RNA, 19 nt, Human
aagugcugggauuacaggc

SEQ ID NO: 1118945 - RNA, 19 nt, Human
aagugcugggauuacaggc

SEQ ID NO: 1118946 - RNA, 26 nt, Human
aagugcugggauuacaggcgugagcc

SEQ ID NO: 1118947 - RNA, 24 nt, Human
aauaagccagaaccccucccuacu

SEQ ID NO: 1118948 - RNA, 21 nt, Human
aauaagccagaaccccuccuc

SEQ ID NO: 1118949 - RNA, 18 nt, Human
acaggguuucaccauguu

SEQ ID NO: 1118950 - RNA, 23 nt, Human
acaggguuucaccauguuggcca

SEQ ID NO: 1118951 - RNA, 24 nt, Human
acaggguuucaccauguuggccag

SEQ ID NO: 1118952 - RNA, 25 nt, Human
acagugcugugugguccucaggaca

SEQ ID NO: 1118953 - RNA, 24 nt, Human
accaugcaaccucaggggaaccuu

SEQ ID NO: 1118954 - RNA, 18 nt, Human
accauguuggccaggcug

SEQ ID NO: 1118955 - RNA, 24 nt, Human
accugaggucaggaguucgagacc

SEQ ID NO: 1118956 - RNA, 22 nt, Human
accuggucaccaccauucacag

SEQ ID NO: 1118957 - RNA, 24 nt, Human
acucauccccuuuggucuccccaa

SEQ ID NO: 1118958 - RNA, 21 nt, Human
acugguuccucuguugagcaa

SEQ ID NO: 1118959 - RNA, 23 nt, Human
agagacaguggggucuucggggg

SEQ ID NO: 1118960 - RNA, 22 nt, Human
agaggcuauuucugccaagugg

SEQ ID NO: 1118961 - RNA, 20 nt, Human
agcauuuugggaggcugagg

SEQ ID NO: 1118962 - RNA, 24 nt, Human
agcauuuugggaggcugagguggg

SEQ ID NO: 1118963 - RNA, 23 nt, Human
agccaugauugcaucaugcaacc

SEQ ID NO: 1118964 - RNA, 20 nt, Human
aggaggcccggggagacugc

SEQ ID NO: 1118965 - RNA, 24 nt, Human
aggcacaguggcucaugccugcaa

SEQ ID NO: 1118966 - RNA, 24 nt, Human
aggcugagguggguggaucaccug

SEQ ID NO: 1118967 - RNA, 28 nt, Human
aggcugcagugagccaugauugcaucau

SEQ ID NO: 1118968 - RNA, 24 nt, Human
aggugaucugcccaccuuggucuc

SEQ ID NO: 1118969 - RNA, 24 nt, Human
aggugaucugccugccuuggccuc

SEQ ID NO: 1118970 - RNA, 19 nt, Human
agguggaggcugcagugag

SEQ ID NO: 1118971 - RNA, 24 nt, Human
agguggaggcugcagugagccaug

SEQ ID NO: 1118972 - RNA, 24 nt, Human
aggugggaggaucgcuugagccug

SEQ ID NO: 1118973 - RNA, 22 nt, Human
agguggguggaucaccugaggu

SEQ ID NO: 1118974 - RNA, 24 nt, Human
agugccuacccccaggaaggcagc

SEQ ID NO: 1118975 - RNA, 18 nt, Human
agugcugggauuacaggc

SEQ ID NO: 1118976 - RNA, 24 nt, Human
aguggcucaugccugcaaucgaag

SEQ ID NO: 1118977 - RNA, 21 nt, Human
aucaccugaggucaggaguuc

SEQ ID NO: 1118978 - RNA, 24 nt, Human
aucaccugaggucaggaguucgag

SEQ ID NO: 1118979 - RNA, 24 nt, Human
aucaugcaaccucugccuucuggg

SEQ ID NO: 1118980 - RNA, 23 nt, Human
aucgcuugagccugggaggugga

SEQ ID NO: 1118981 - RNA, 20 nt, Human
augcaaccucugccuucugg

SEQ ID NO: 1118982 - RNA, 24 nt, Human
augcaaccucugccuucuggguuc

SEQ ID NO: 1118983 - RNA, 22 nt, Human
caaaaacucacacuuuugaugc

SEQ ID NO: 1118984 - RNA, 20 nt, Human
caaagucuccaaggaaagcc

SEQ ID NO: 1118985 - RNA, 24 nt, Human
caaagugcuaggguuacaggugug

SEQ ID NO: 1118986 - RNA, 24 nt, Human
caaagugcugggauuacaggcgug

SEQ ID NO: 1118987 - RNA, 22 nt, Human
caagcaauucuccugccucagc

SEQ ID NO: 1118988 - RNA, 18 nt, Human
caagccccugcccugccc

SEQ ID NO: 1118989 - RNA, 19 nt, Human
caccaugcaaccucagggg

SEQ ID NO: 1118990 - RNA, 21 nt, Human
caccauguuggccaggcuggu

SEQ ID NO: 1118991 - RNA, 24 nt, Human
caccauguuggccaggcuggucuc

SEQ ID NO: 1118992 - RNA, 27 nt, Human
caccauguuggccaggcuggucucaaa

SEQ ID NO: 1118993 - RNA, 23 nt, Human
caccugaggucaggaguucgaga

SEQ ID NO: 1118994 - RNA, 22 nt, Human
cacugcgccuggcccccuccug

SEQ ID NO: 1118995 - RNA, 18 nt, Human
cagagacauacccagaga

SEQ ID NO: 1118996 - RNA, 19 nt, Human
cagccuccugaguagcugg

SEQ ID NO: 1118997 - RNA, 20 nt, Human
cagcugcgccgggcugugcu

SEQ ID NO: 1118998 - RNA, 26 nt, Human
cagcugcucucccaauggagccgaga

SEQ ID NO: 1118999 - RNA, 22 nt, Human
cagcuuauuuaaucacacagag

SEQ ID NO: 1119000 - RNA, 24 nt, Human
caggguuucaccauguuggccagg

SEQ ID NO: 1119001 - RNA, 24 nt, Human
caggugugagccacugugcccggc

SEQ ID NO: 1119002 - RNA, 22 nt, Human
caucaagguccacugggugggg

SEQ ID NO: 1119003 - RNA, 24 nt, Human
caugccugcaaucgaagcauuuug

SEQ ID NO: 1119004 - RNA, 24 nt, Human
cauguuggccaggcuggucucaaa

SEQ ID NO: 1119005 - RNA, 20 nt, Human
ccaaagugcuaggguuacag

SEQ ID NO: 1119006 - RNA, 21 nt, Human
ccaaagugcuaggguuacagg

SEQ ID NO: 1119007 - RNA, 24 nt, Human
ccaaagugcuaggguuacaggugu

SEQ ID NO: 1119008 - RNA, 22 nt, Human
ccaaagugcugggauuacaggc

SEQ ID NO: 1119009 - RNA, 22 nt, Human
ccaaagugcugggauuacaggc

SEQ ID NO: 1119010 - RNA, 24 nt, Human
ccaaagugcugggauuacaggcgu

SEQ ID NO: 1119011 - RNA, 23 nt, Human
ccaccauucacagugaucacuca

SEQ ID NO: 1119012 - RNA, 24 nt, Human
ccaccuuggucucccaaagugcug

SEQ ID NO: 1119013 - RNA, 25 nt, Human
ccacugcgccuggcccccuccugga

SEQ ID NO: 1119014 - RNA, 18 nt, Human
ccagagacauacccagag

SEQ ID NO: 1119015 - RNA, 22 nt, Human
ccaucaagaaaucuguuuucuu

SEQ ID NO: 1119016 - RNA, 18 nt, Human
ccccucccuacucauccc

SEQ ID NO: 1119017 - RNA, 22 nt, Human
ccccugcagcagggacucacag

SEQ ID NO: 1119018 - RNA, 19 nt, Human
cccucccuacucauccccu

SEQ ID NO: 1119019 - RNA, 19 nt, Human
cccucuacaggccuuuccu

SEQ ID NO: 1119020 - RNA, 22 nt, Human
cccugaccagccgggaaucugc

SEQ ID NO: 1119021 - RNA, 20 nt, Human
cccugcccaccuggucacca

SEQ ID NO: 1119022 - RNA, 23 nt, Human
ccuacccccaggaaggcagcacc

SEQ ID NO: 1119023 - RNA, 23 nt, Human
ccucuguggccuauauugucuuu

SEQ ID NO: 1119024 - RNA, 20 nt, Human
ccucuuccugcccuuguucc

SEQ ID NO: 1119025 - RNA, 20 nt, Human
ccucuuccugcccuuguucc

SEQ ID NO: 1119026 - RNA, 24 nt, Human
ccugaccucaggugaucugcccac

SEQ ID NO: 1119027 - RNA, 22 nt, Human
ccugaggucaggaguucgagac

SEQ ID NO: 1119028 - RNA, 25 nt, Human
ccugcaaucgaagcauuuugggagg

SEQ ID NO: 1119029 - RNA, 24 nt, Human
ccugccucagccuccugaguagcu

SEQ ID NO: 1119030 - RNA, 22 nt, Human
ccugccuuggccucccaaagug

SEQ ID NO: 1119031 - RNA, 21 nt, Human
ccuggccucaggugaucugcc

SEQ ID NO: 1119032 - RNA, 19 nt, Human
ccugggagguggaggcugc

SEQ ID NO: 1119033 - RNA, 21 nt, Human
ccugggcuaaggcacuuagac

SEQ ID NO: 1119034 - RNA, 24 nt, Human
ccuucuggguucaagcaauucucc

SEQ ID NO: 1119035 - RNA, 22 nt, Human
cgagaccagccuggccucaggu

SEQ ID NO: 1119036 - RNA, 22 nt, Human
cgccucuuccugcccuuguucc

SEQ ID NO: 1119037 - RNA, 22 nt, Human
cgugggccaggacgcugguacc

SEQ ID NO: 1119038 - RNA, 22 nt, Human
cucacacuuuugaugccacaac

SEQ ID NO: 1119039 - RNA, 24 nt, Human
cucacagaagugccuacccccaau

SEQ ID NO: 1119040 - RNA, 18 nt, Human
cucagggagcugaggugg

SEQ ID NO: 1119041 - RNA, 24 nt, Human
cucaggugaucugcccaccuuggu

SEQ ID NO: 1119042 - RNA, 23 nt, Human
cucauccccuuuggucuccccaa

SEQ ID NO: 1119043 - RNA, 24 nt, Human
cucaugccugcaaucgaagcauuu

SEQ ID NO: 1119044 - RNA, 21 nt, Human
cucucccaauggagccgagag

SEQ ID NO: 1119045 - RNA, 19 nt, Human
cugagcccucagcucccuc

SEQ ID NO: 1119046 - RNA, 21 nt, Human
cugcagugagccaugauugca

SEQ ID NO: 1119047 - RNA, 25 nt, Human
cugcccaccuggucaccaccauuca

SEQ ID NO: 1119048 - RNA, 20 nt, Human
cugcccugcccaccugguca

SEQ ID NO: 1119049 - RNA, 23 nt, Human
cugccuuggccucccaaagugcu

SEQ ID NO: 1119050 - RNA, 20 nt, Human
cugggugggggcacuguggc

SEQ ID NO: 1119051 - RNA, 23 nt, Human
cuugacacucaaacccaagcuac

SEQ ID NO: 1119052 - RNA, 20 nt, Human
gaaagccggguucuccagag

SEQ ID NO: 1119053 - RNA, 20 nt, Human
gaccacagccaguccaucug

SEQ ID NO: 1119054 - RNA, 24 nt, Human
gaccucaggugaucugcccaccuu

SEQ ID NO: 1119055 - RNA, 22 nt, Human
gagaggccaggaggcccgggga

SEQ ID NO: 1119056 - RNA, 24 nt, Human
gagcugaggugggaggaucgcuug

SEQ ID NO: 1119057 - RNA, 26 nt, Human
gagcugaggugggaggaucgcuugag

SEQ ID NO: 1119058 - RNA, 23 nt, Human
gaggcugcagugagccaugauug

SEQ ID NO: 1119059 - RNA, 20 nt, Human
gagggagaggccaggaggcc

SEQ ID NO: 1119060 - RNA, 23 nt, Human
gagguggguggaucaccugaggu

SEQ ID NO: 1119061 - RNA, 24 nt, Human
gaguagcuggcacuacaggcacac

SEQ ID NO: 1119062 - RNA, 24 nt, Human
gaucaccugaggucaggaguucga

SEQ ID NO: 1119063 - RNA, 24 nt, Human
gaucgcuugagccugggaggugga

SEQ ID NO: 1119064 - RNA, 18 nt, Human
gauuacaggcgugagcca

SEQ ID NO: 1119065 - RNA, 22 nt, Human
gauuacaggcgugagccacugc

SEQ ID NO: 1119066 - RNA, 22 nt, Human
gauuacaggcgugagccacugc

SEQ ID NO: 1119067 - RNA, 23 nt, Human
gcacuacaggcacacgaaaccac

SEQ ID NO: 1119068 - RNA, 22 nt, Human
gcagcggaggaagcugacuaga

SEQ ID NO: 1119069 - RNA, 20 nt, Human
gccaggaggcccggggagac

SEQ ID NO: 1119070 - RNA, 19 nt, Human
gcccuuguuccagcuuugg

SEQ ID NO: 1119071 - RNA, 20 nt, Human
gccucagccuccugaguagc

SEQ ID NO: 1119072 - RNA, 24 nt, Human
gccugggagguggaggcugcagug

SEQ ID NO: 1119073 - RNA, 22 nt, Human
gccugggcuaaggcacuuagac

SEQ ID NO: 1119074 - RNA, 23 nt, Human
gcuggucucaaacuccugaccuc

SEQ ID NO: 1119075 - RNA, 21 nt, Human
ggacaggcacaguggcucaug

SEQ ID NO: 1119076 - RNA, 21 nt, Human
ggagaggccaggaggcccggg

SEQ ID NO: 1119077 - RNA, 21 nt, Human
ggaggaagcugacuagagaua

SEQ ID NO: 1119078 - RNA, 22 nt, Human
ggaggcugcagugagccaugau

SEQ ID NO: 1119079 - RNA, 24 nt, Human
ggaggcugcagugagccaugauug

SEQ ID NO: 1119080 - RNA, 19 nt, Human
ggagggagaggccaggagg

SEQ ID NO: 1119081 - RNA, 26 nt, Human
ggauaggugcacagaugugggucccu

SEQ ID NO: 1119082 - RNA, 22 nt, Human
ggaucaccugaggucaggaguu

SEQ ID NO: 1119083 - RNA, 20 nt, Human
ggaucgcuugagccugggag

SEQ ID NO: 1119084 - RNA, 24 nt, Human
ggccucaggugaucugccugccuu

SEQ ID NO: 1119085 - RNA, 24 nt, Human
ggccuguggucccagcuucucagg

SEQ ID NO: 1119086 - RNA, 25 nt, Human
ggccuguggucccagcuucucaggg

SEQ ID NO: 1119087 - RNA, 24 nt, Human
ggcuggucucaaacuccugaccuc

SEQ ID NO: 1119088 - RNA, 20 nt, Human
gggaggcugaggugggugga

SEQ ID NO: 1119089 - RNA, 24 nt, Human
ggggcuucuggugcagcagacaug

SEQ ID NO: 1119090 - RNA, 22 nt, Human
gggucccucagauuguaaacag

SEQ ID NO: 1119091 - RNA, 20 nt, Human
ggguuacaggugugagccac

SEQ ID NO: 1119092 - RNA, 20 nt, Human
ggguuacaggugugagccac

SEQ ID NO: 1119093 - RNA, 22 nt, Human
ggguuacaggugugagccacug

SEQ ID NO: 1119094 - RNA, 20 nt, Human
ggguucaagcaauucuccug

SEQ ID NO: 1119095 - RNA, 22 nt, Human
ggguuucaccauguuggccagg

SEQ ID NO: 1119096 - RNA, 21 nt, Human
gguaacuggaucuaagaagga

SEQ ID NO: 1119097 - RNA, 19 nt, Human
ggugcaaaaacucacacuu

SEQ ID NO: 1119098 - RNA, 21 nt, Human
gguggaucaccugaggucagg

SEQ ID NO: 1119099 - RNA, 18 nt, Human
gguuacaggugugagcca

SEQ ID NO: 1119100 - RNA, 24 nt, Human
gguuacaggugugagccacugugc

SEQ ID NO: 1119101 - RNA, 19 nt, Human
gguucaagcaauucuccug

SEQ ID NO: 1119102 - RNA, 19 nt, Human
uaaaacagcaagacuucag

SEQ ID NO: 1119103 - RNA, 20 nt, Human
uaaaacagcaagacuucagc

SEQ ID NO: 1119104 - RNA, 22 nt, Human
uaaauaagccagaaccccuccc

SEQ ID NO: 1119105 - RNA, 22 nt, Human
uaacuuuuuggagguuuuuaca

SEQ ID NO: 1119106 - RNA, 20 nt, Human
uaagaaggaggcgauauugc

SEQ ID NO: 1119107 - RNA, 21 nt, Human
uaagaaguaaauaagccagaa

SEQ ID NO: 1119108 - RNA, 22 nt, Human
uaagaaguaaauaagccagaac

SEQ ID NO: 1119109 - RNA, 19 nt, Human
uaaggcacuuagacaagcc

SEQ ID NO: 1119110 - RNA, 22 nt, Human
uacaggcgugagccacugcgcc

SEQ ID NO: 1119111 - RNA, 22 nt, Human
uacaggcgugagccacugcgcc

SEQ ID NO: 1119112 - RNA, 23 nt, Human
uacaggcgugagccacugcgccu

SEQ ID NO: 1119113 - RNA, 23 nt, Human
uacaggugugagccacugugccc

SEQ ID NO: 1119114 - RNA, 23 nt, Human
uacaggugugagccacugugccc

SEQ ID NO: 1119115 - RNA, 18 nt, Human
uaccagagacauacccag

SEQ ID NO: 1119116 - RNA, 22 nt, Human
uagaaacaggguuucaccaugu

SEQ ID NO: 1119117 - RNA, 20 nt, Human
uagaagaagcugaguuggca

SEQ ID NO: 1119118 - RNA, 20 nt, Human
uagacugacuugguaacugg

SEQ ID NO: 1119119 - RNA, 23 nt, Human
uagccaggccuguggucccagcu

SEQ ID NO: 1119120 - RNA, 18 nt, Human
uagcuggcacuacaggca

SEQ ID NO: 1119121 - RNA, 24 nt, Human
uaggguuacaggugugagccacug

SEQ ID NO: 1119122 - RNA, 24 nt, Human
uaguagaaacaggguuucaccaug

SEQ ID NO: 1119123 - RNA, 25 nt, Human
uaguagaaacaggguuucaccaugu

SEQ ID NO: 1119124 - RNA, 24 nt, Human
uauuuaguagaaacaggguuucac

SEQ ID NO: 1119125 - RNA, 19 nt, Human
ucaagcaauucuccugccu

SEQ ID NO: 1119126 - RNA, 21 nt, Human
ucacagaagugccuaccccca

SEQ ID NO: 1119127 - RNA, 20 nt, Human
ucagccuccugaguagcugg

SEQ ID NO: 1119128 - RNA, 23 nt, Human
ucaugcaaccucugccuucuggg

SEQ ID NO: 1119129 - RNA, 23 nt, Human
ucccaaagugcuaggguuacagg

SEQ ID NO: 1119130 - RNA, 24 nt, Human
ucccaaagugcugggauuacaggc

SEQ ID NO: 1119131 - RNA, 24 nt, Human
uccccuuuggucuccccaagaaga

SEQ ID NO: 1119132 - RNA, 18 nt, Human
ucccucagauuguaaaca

SEQ ID NO: 1119133 - RNA, 29 nt, Human
ucccucuacaggccuuuccugaccacagg

SEQ ID NO: 1119134 - RNA, 22 nt, Human
ucccugagcagcugcgccgggc

SEQ ID NO: 1119135 - RNA, 20 nt, Human
ucccuggagcagcccagagc

SEQ ID NO: 1119136 - RNA, 21 nt, Human
ucccuggagcagcccagagcu

SEQ ID NO: 1119137 - RNA, 22 nt, Human
ucccuggagcagcccagagcuc

SEQ ID NO: 1119138 - RNA, 24 nt, Human
uccugaguagcuggcacuacaggc

SEQ ID NO: 1119139 - RNA, 21 nt, Human
ucgaagcauuuugggaggcug

SEQ ID NO: 1119140 - RNA, 24 nt, Human
ucgcuugagccugggagguggagg

SEQ ID NO: 1119141 - RNA, 23 nt, Human
ucuccagagaaucuuaacacccu

SEQ ID NO: 1119142 - RNA, 24 nt, Human
ucuccugccucagccuccugagua

SEQ ID NO: 1119143 - RNA, 24 nt, Human
ucucuacaaaaagucaaaauuuag

SEQ ID NO: 1119144 - RNA, 23 nt, Human
ucucugagggccccugacagcuu

SEQ ID NO: 1119145 - RNA, 18 nt, Human
ucugaagugauugacagg

SEQ ID NO: 1119146 - RNA, 21 nt, Human
ucugaagugauugacaggugg

SEQ ID NO: 1119147 - RNA, 24 nt, Human
ucugccuucuggguucaagcaauu

SEQ ID NO: 1119148 - RNA, 21 nt, Human
ucuguggcaagaggugggcag

SEQ ID NO: 1119149 - RNA, 19 nt, Human
ugacagguggggacaggag

SEQ ID NO: 1119150 - RNA, 18 nt, Human
ugaccucaggugaucugc

SEQ ID NO: 1119151 - RNA, 20 nt, Human
ugaccucaggugaucugccc

SEQ ID NO: 1119152 - RNA, 21 nt, Human
ugaccucaggugaucugccca

SEQ ID NO: 1119153 - RNA, 24 nt, Human
ugaccucaggugaucugcccaccu

SEQ ID NO: 1119154 - RNA, 18 nt, Human
ugagcacuacccacccag

SEQ ID NO: 1119155 - RNA, 18 nt, Human
ugagccugggagguggag

SEQ ID NO: 1119156 - RNA, 24 nt, Human
ugagccugggagguggaggcugca

SEQ ID NO: 1119157 - RNA, 18 nt, Human
ugaggugggaggaucgcu

SEQ ID NO: 1119158 - RNA, 20 nt, Human
ugaggugggaggaucgcuug

SEQ ID NO: 1119159 - RNA, 22 nt, Human
ugaggugggaggaucgcuugag

SEQ ID NO: 1119160 - RNA, 23 nt, Human
ugaggugggaggaucgcuugagc

SEQ ID NO: 1119161 - RNA, 24 nt, Human
ugaggugggaggaucgcuugagcc

SEQ ID NO: 1119162 - RNA, 20 nt, Human
ugagguggguggaucaccug

SEQ ID NO: 1119163 - RNA, 24 nt, Human
ugagguggguggaucaccugaggu

SEQ ID NO: 1119164 - RNA, 26 nt, Human
ugagguggguggaucaccugagguca

SEQ ID NO: 1119165 - RNA, 24 nt, Human
ugaucugcccaccuuggucuccca

SEQ ID NO: 1119166 - RNA, 21 nt, Human
ugcaaaaacucacacuuuuga

SEQ ID NO: 1119167 - RNA, 20 nt, Human
ugcaaccucugccuucuggg

SEQ ID NO: 1119168 - RNA, 23 nt, Human
ugcaaccucugccuucuggguuc

SEQ ID NO: 1119169 - RNA, 20 nt, Human
ugcccuuguuccagcuuugg

SEQ ID NO: 1119170 - RNA, 22 nt, Human
ugccuacccccaggaaggcagc

SEQ ID NO: 1119171 - RNA, 24 nt, Human
ugccucagccuccugaguagcugg

SEQ ID NO: 1119172 - RNA, 19 nt, Human
ugccugaggaucuaggagg

SEQ ID NO: 1119173 - RNA, 23 nt, Human
ugccugaggaucuaggagguaga

SEQ ID NO: 1119174 - RNA, 18 nt, Human
ugccugccuuggccuccc

SEQ ID NO: 1119175 - RNA, 24 nt, Human
ugcugggauuacaggcgugagcca

SEQ ID NO: 1119176 - RNA, 20 nt, Human
ugcuguaacgucuucagggg

SEQ ID NO: 1119177 - RNA, 22 nt, Human
ugcugucccugagcagcugcgc

SEQ ID NO: 1119178 - RNA, 24 nt, Human
uggaucaccugaggucaggaguuc

SEQ ID NO: 1119179 - RNA, 27 nt, Human
uggaucaccugaggucaggaguucgag

SEQ ID NO: 1119180 - RNA, 21 nt, Human
uggauuacucaucucuccggc

SEQ ID NO: 1119181 - RNA, 22 nt, Human
uggcaagaggugggcagcggag

SEQ ID NO: 1119182 - RNA, 24 nt, Human
uggcacuacaggcacacgaaacca

SEQ ID NO: 1119183 - RNA, 23 nt, Human
uggccacagcugugggccaccgg

SEQ ID NO: 1119184 - RNA, 24 nt, Human
uggccacagcugugggccaccggc

SEQ ID NO: 1119185 - RNA, 24 nt, Human
uggccaggcuggucucaaacuccu

SEQ ID NO: 1119186 - RNA, 24 nt, Human
uggccucaggugaucugccugccu

SEQ ID NO: 1119187 - RNA, 18 nt, Human
uggcucaugccugcaauc

SEQ ID NO: 1119188 - RNA, 18 nt, Human
uggcucaugccugcaauc

SEQ ID NO: 1119189 - RNA, 24 nt, Human
uggcucaugccugcaaucgaagca

SEQ ID NO: 1119190 - RNA, 21 nt, Human
uggcuuggguacagcagggag

SEQ ID NO: 1119191 - RNA, 23 nt, Human
ugggaggcugagguggguggauc

SEQ ID NO: 1119192 - RNA, 24 nt, Human
ugggaggcugagguggguggauca

SEQ ID NO: 1119193 - RNA, 18 nt, Human
ugggagguggaggcugca

SEQ ID NO: 1119194 - RNA, 24 nt, Human
ugggagguggaggcugcagugagc

SEQ ID NO: 1119195 - RNA, 18 nt, Human
ugggauuacaggcgugag

SEQ ID NO: 1119196 - RNA, 19 nt, Human
ugggauuacaggcgugagc

SEQ ID NO: 1119197 - RNA, 21 nt, Human
ugggauuacaggcgugagcca

SEQ ID NO: 1119198 - RNA, 22 nt, Human
ugggauuacaggcgugagccac

SEQ ID NO: 1119199 - RNA, 22 nt, Human
ugggauuacaggcgugagccac

SEQ ID NO: 1119200 - RNA, 24 nt, Human
ugggauuacaggcgugagccacug

SEQ ID NO: 1119201 - RNA, 24 nt, Human
ugggauuacaggcgugagccacug

SEQ ID NO: 1119202 - RNA, 24 nt, Human
uggguggaucaccugaggucagga

SEQ ID NO: 1119203 - RNA, 22 nt, Human
ugggugggggcacuguggccac

SEQ ID NO: 1119204 - RNA, 21 nt, Human
uggguucaagcaauucuccug

SEQ ID NO: 1119205 - RNA, 23 nt, Human
uggguucaagcaauucuccugcc

SEQ ID NO: 1119206 - RNA, 24 nt, Human
uggguucaagcaauucuccugccu

SEQ ID NO: 1119207 - RNA, 22 nt, Human
uggugcagcagacaugcacuuc

SEQ ID NO: 1119208 - RNA, 20 nt, Human
ugucucagcucuggcuuggg

SEQ ID NO: 1119209 - RNA, 22 nt, Human
ugucucuacaaaaagucaaaau

SEQ ID NO: 1119210 - RNA, 19 nt, Human
uuaaucauguucucuuuug

SEQ ID NO: 1119211 - RNA, 19 nt, Human
uuacaggugugagccacug

SEQ ID NO: 1119212 - RNA, 24 nt, Human
uuaguagaaacaggguuucaccau

SEQ ID NO: 1119213 - RNA, 21 nt, Human
uucaagcaauucuccugccuc

SEQ ID NO: 1119214 - RNA, 24 nt, Human
uucaagcaauucuccugccucagc

SEQ ID NO: 1119215 - RNA, 24 nt, Human
uuccaucaagaaaucuguuuucuu

SEQ ID NO: 1119216 - RNA, 19 nt, Human
uucuaagaaaggagcugga

SEQ ID NO: 1119217 - RNA, 24 nt, Human
uucuguuugcacccucagccuggg

SEQ ID NO: 1119218 - RNA, 19 nt, Human
uugacacucaaacccaagc

SEQ ID NO: 1119219 - RNA, 21 nt, Human
uugagccugggagguggaggc

SEQ ID NO: 1119220 - RNA, 25 nt, Human
uugggaggcugagguggguggauca

SEQ ID NO: 1119221 - RNA, 23 nt, Human
uuuaccagagacauacccagaga

SEQ ID NO: 1119222 - RNA, 24 nt, Human
uuucaccauguuggccaggcuggu

SEQ ID NO: 1119223 - RNA, 18 nt, Human
uuugcuguaacgucuuca

SEQ ID NO: 1119224 - RNA, 23 nt, Human
uuuugggaggcugaggugggugg

SEQ ID NO: 1119225 - RNA, 22 nt, Human
aagagaaugaggaaaccacgug

SEQ ID NO: 1119226 - RNA, 19 nt, Human
aagggucucaggccugggc

SEQ ID NO: 1119227 - RNA, 22 nt, Human
aaguugccuccucugaccccca

SEQ ID NO: 1119228 - RNA, 19 nt, Human
acccuggggagagcauggc

SEQ ID NO: 1119229 - RNA, 23 nt, Human
acccuggggcaucucuggggcac

SEQ ID NO: 1119230 - RNA, 24 nt, Human
acuuugguuuuuccaacauccacu

SEQ ID NO: 1119231 - RNA, 21 nt, Human
agaggacagcagaagauagag

SEQ ID NO: 1119232 - RNA, 22 nt, Human
agcagugagaagaugggaggaa

SEQ ID NO: 1119233 - RNA, 21 nt, Human
agccagcauuuguggaaggca

SEQ ID NO: 1119234 - RNA, 26 nt, Human
aggaagagagaagucagaucacaaaa

SEQ ID NO: 1119235 - RNA, 20 nt, Human
aggcagccccuucauggagg

SEQ ID NO: 1119236 - RNA, 24 nt, Human
aggcagccccuucauggaggucug

SEQ ID NO: 1119237 - RNA, 19 nt, Human
aggcaggaugugguccagg

SEQ ID NO: 1119238 - RNA, 21 nt, Human
aggcaggaugugguccagguu

SEQ ID NO: 1119239 - RNA, 22 nt, Human
aggcaucggggauuccauagcc

SEQ ID NO: 1119240 - RNA, 19 nt, Human
aggggcagggaauaggcag

SEQ ID NO: 1119241 - RNA, 20 nt, Human
agggucccugucugugguuc

SEQ ID NO: 1119242 - RNA, 22 nt, Human
agggucccugucugugguucuu

SEQ ID NO: 1119243 - RNA, 25 nt, Human
agguguggagggaggaacaauguuu

SEQ ID NO: 1119244 - RNA, 24 nt, Human
aguuguuuguaccugucccuuugu

SEQ ID NO: 1119245 - RNA, 21 nt, Human
auaggcagacagaagcaggga

SEQ ID NO: 1119246 - RNA, 22 nt, Human
aucuugucuagccccucuauug

SEQ ID NO: 1119247 - RNA, 19 nt, Human
auucccacccccuccaccc

SEQ ID NO: 1119248 - RNA, 20 nt, Human
auuuguggaaggcagccccu

SEQ ID NO: 1119249 - RNA, 21 nt, Human
cacagcucagucuccacaucc

SEQ ID NO: 1119250 - RNA, 23 nt, Human
cacagcucagucuccacaucccc

SEQ ID NO: 1119251 - RNA, 24 nt, Human
cacagcucagucuccacauccccc

SEQ ID NO: 1119252 - RNA, 23 nt, Human
cacagggcaaagcuuggagacag

SEQ ID NO: 1119253 - RNA, 19 nt, Human
caccaagggucucaggccu

SEQ ID NO: 1119254 - RNA, 24 nt, Human
cacccccuccacccuggggcaucu

SEQ ID NO: 1119255 - RNA, 24 nt, Human
cacgguagaugggacuuugaagug

SEQ ID NO: 1119256 - RNA, 21 nt, Human
cagaagcagggagggugcugg

SEQ ID NO: 1119257 - RNA, 19 nt, Human
cagcagaagauagagccuu

SEQ ID NO: 1119258 - RNA, 24 nt, Human
cagcagaagauagagccuuggaua

SEQ ID NO: 1119259 - RNA, 20 nt, Human
cagcagccugagauauuguu

SEQ ID NO: 1119260 - RNA, 23 nt, Human
cagcauuuguggaaggcagcccc

SEQ ID NO: 1119261 - RNA, 24 nt, Human
caggaugugguccagguugaaccu

SEQ ID NO: 1119262 - RNA, 23 nt, Human
cagguugaaccgagccuucagga

SEQ ID NO: 1119263 - RNA, 20 nt, Human
caucccccauucccaccccc

SEQ ID NO: 1119264 - RNA, 22 nt, Human
ccaagaugaggagcccugagaa

SEQ ID NO: 1119265 - RNA, 18 nt, Human
ccacacucuccacagcuc

SEQ ID NO: 1119266 - RNA, 20 nt, Human
ccagcagccugagauauugu

SEQ ID NO: 1119267 - RNA, 22 nt, Human
ccauuggugcuggaucuuccuu

SEQ ID NO: 1119268 - RNA, 22 nt, Human
cccacccccuccacccuggggc

SEQ ID NO: 1119269 - RNA, 24 nt, Human
cccacgguagaugggaccgggguc

SEQ ID NO: 1119270 - RNA, 20 nt, Human
ccccagcaucucucucugcc

SEQ ID NO: 1119271 - RNA, 21 nt, Human
ccccauucccacccccuccac

SEQ ID NO: 1119272 - RNA, 22 nt, Human
ccccauucccacccccuccacc

SEQ ID NO: 1119273 - RNA, 23 nt, Human
cccccauucccacccccuccacc

SEQ ID NO: 1119274 - RNA, 21 nt, Human
ccccggguccccggcuucagc

SEQ ID NO: 1119275 - RNA, 20 nt, Human
ccccugggcuagaccguggg

SEQ ID NO: 1119276 - RNA, 20 nt, Human
cccucugcucccacucucaa

SEQ ID NO: 1119277 - RNA, 25 nt, Human
cccugggcuagaccgugggggugga

SEQ ID NO: 1119278 - RNA, 18 nt, Human
ccuggcccucugcuccca

SEQ ID NO: 1119279 - RNA, 18 nt, Human
ccugucccugaggaacug

SEQ ID NO: 1119280 - RNA, 22 nt, Human
cggcuucagcuucuccaggguc

SEQ ID NO: 1119281 - RNA, 18 nt, Human
cggguccccggcuucagc

SEQ ID NO: 1119282 - RNA, 19 nt, Human
cucugcucccacucucaag

SEQ ID NO: 1119283 - RNA, 18 nt, Human
cugccacuugugcagagg

SEQ ID NO: 1119284 - RNA, 18 nt, Human
cugccuggcccugccagg

SEQ ID NO: 1119285 - RNA, 22 nt, Human
gaaacccuggggcugggaagca

SEQ ID NO: 1119286 - RNA, 21 nt, Human
gaagcacagugaagucagggg

SEQ ID NO: 1119287 - RNA, 22 nt, Human
gaaguugccuccucugaccccc

SEQ ID NO: 1119288 - RNA, 21 nt, Human
gacagagguugguggaagaga

SEQ ID NO: 1119289 - RNA, 19 nt, Human
gagaccuggcugcaggccu

SEQ ID NO: 1119290 - RNA, 18 nt, Human
gagccccccaaauucccc

SEQ ID NO: 1119291 - RNA, 18 nt, Human
gagccccugggcuagacc

SEQ ID NO: 1119292 - RNA, 20 nt, Human
gaggaucgaagauggauagg

SEQ ID NO: 1119293 - RNA, 18 nt, Human
gagggaaacccuggggcu

SEQ ID NO: 1119294 - RNA, 23 nt, Human
gaguccuuuuuccaguggggccu

SEQ ID NO: 1119295 - RNA, 19 nt, Human
gccgucuccauugauccug

SEQ ID NO: 1119296 - RNA, 22 nt, Human
ggaagaaggacgugauuucuag

SEQ ID NO: 1119297 - RNA, 18 nt, Human
ggacaggcugcugcgggc

SEQ ID NO: 1119298 - RNA, 24 nt, Human
ggagaacacagggcaaagcuugga

SEQ ID NO: 1119299 - RNA, 19 nt, Human
ggagggaaacccuggggcu

SEQ ID NO: 1119300 - RNA, 20 nt, Human
ggagggaaacccuggggcug

SEQ ID NO: 1119301 - RNA, 22 nt, Human
ggagggucccugucugugguuc

SEQ ID NO: 1119302 - RNA, 19 nt, Human
ggcagggaauaggcagcag

SEQ ID NO: 1119303 - RNA, 23 nt, Human
ggcuagaccguggggguggaggg

SEQ ID NO: 1119304 - RNA, 20 nt, Human
gggaggcuucuaagaggaag

SEQ ID NO: 1119305 - RNA, 20 nt, Human
gggcacugaggugaggaucg

SEQ ID NO: 1119306 - RNA, 28 nt, Human
gggcagggaauaggcagcagcugggugg

SEQ ID NO: 1119307 - RNA, 21 nt, Human
gggccucagcuuucccaucug

SEQ ID NO: 1119308 - RNA, 18 nt, Human
ggguggagaggagggcag

SEQ ID NO: 1119309 - RNA, 21 nt, Human
gguccagguugaaccgagccu

SEQ ID NO: 1119310 - RNA, 23 nt, Human
gguccccggcuucagcuucucca

SEQ ID NO: 1119311 - RNA, 20 nt, Human
ggucugccccuggaugggga

SEQ ID NO: 1119312 - RNA, 20 nt, Human
gguggagaggagggcaguuc

SEQ ID NO: 1119313 - RNA, 21 nt, Human
gguggagggucccugucugug

SEQ ID NO: 1119314 - RNA, 21 nt, Human
guccccagcaucucucucugc

SEQ ID NO: 1119315 - RNA, 18 nt, Human
guggaaggcagccccuuc

SEQ ID NO: 1119316 - RNA, 20 nt, Human
gugguucuugugggccugug

SEQ ID NO: 1119317 - RNA, 19 nt, Human
guucaaagagaggaaguug

SEQ ID NO: 1119318 - RNA, 18 nt, Human
uaagcaccuacuggucug

SEQ ID NO: 1119319 - RNA, 21 nt, Human
uacuggucuggugcuagacac

SEQ ID NO: 1119320 - RNA, 22 nt, Human
ucaggggaggcuucuaagagga

SEQ ID NO: 1119321 - RNA, 21 nt, Human
ucauugauugaggagggacca

SEQ ID NO: 1119322 - RNA, 20 nt, Human
uccacagcucagucuccaca

SEQ ID NO: 1119323 - RNA, 22 nt, Human
uccccagcaucucucucugccu

SEQ ID NO: 1119324 - RNA, 19 nt, Human
ucccccauucccacccccu

SEQ ID NO: 1119325 - RNA, 21 nt, Human
ucccuuugugagccccccaaa

SEQ ID NO: 1119326 - RNA, 23 nt, Human
uccucagccccccggguccccgg

SEQ ID NO: 1119327 - RNA, 19 nt, Human
ucuacccacgguagauggg

SEQ ID NO: 1119328 - RNA, 19 nt, Human
ucugacccccaggcgaagu

SEQ ID NO: 1119329 - RNA, 22 nt, Human
ugaaggaaacgaagucucuaca

SEQ ID NO: 1119330 - RNA, 19 nt, Human
ugaaggaaaggagaagggg

SEQ ID NO: 1119331 - RNA, 22 nt, Human
ugagaagaugggaggaagagag

SEQ ID NO: 1119332 - RNA, 19 nt, Human
ugagagggguugaugggca

SEQ ID NO: 1119333 - RNA, 19 nt, Human
ugagccccccaaauucccc

SEQ ID NO: 1119334 - RNA, 18 nt, Human
ugaggaacugccaggagu

SEQ ID NO: 1119335 - RNA, 19 nt, Human
ugauugaggagggaccagc

SEQ ID NO: 1119336 - RNA, 19 nt, Human
ugccugaaagguggcaaga

SEQ ID NO: 1119337 - RNA, 20 nt, Human
ugccuggagggugcaggugu

SEQ ID NO: 1119338 - RNA, 22 nt, Human
ugcucagagccugucccugagg

SEQ ID NO: 1119339 - RNA, 18 nt, Human
uggaagagaaugaggaaa

SEQ ID NO: 1119340 - RNA, 22 nt, Human
uggagggucccugucugugguu

SEQ ID NO: 1119341 - RNA, 23 nt, Human
ugggcucagcugagaaguugccu

SEQ ID NO: 1119342 - RNA, 22 nt, Human
uggggccucagcuuucccaucu

SEQ ID NO: 1119343 - RNA, 21 nt, Human
uggggguggagggucccuguc

SEQ ID NO: 1119344 - RNA, 21 nt, Human
uguagaggucaaacaacucug

SEQ ID NO: 1119345 - RNA, 24 nt, Human
uguugccauuggugcuggaucuuc

SEQ ID NO: 1119346 - RNA, 25 nt, Human
uuccuuguugccauuggugcuggau

SEQ ID NO: 1119347 - RNA, 19 nt, Human
uugaugggcaggggggagg

SEQ ID NO: 1119348 - RNA, 25 nt, Human
uuguugccauuggugcuggaucuuc

SEQ ID NO: 1119349 - RNA, 20 nt, Human
uuugaaguggcuucccaggg

SEQ ID NO: 1119350 - RNA, 19 nt, Human
uuuuccaacauccacuggg

SEQ ID NO: 1119351 - RNA, 21 nt, Human
aaaaaaguccagaccuggggg

SEQ ID NO: 1119352 - RNA, 19 nt, Human
aaagagauuucugcgcuuc

SEQ ID NO: 1119353 - RNA, 21 nt, Human
aaagcagaaacaguugugucc

SEQ ID NO: 1119354 - RNA, 19 nt, Human
aacaauaaagucuucccuc

SEQ ID NO: 1119355 - RNA, 23 nt, Human
accagcauggaagggucaagugu

SEQ ID NO: 1119356 - RNA, 23 nt, Human
acccuacucccagacuucaugcc

SEQ ID NO: 1119357 - RNA, 20 nt, Human
agccuacccuacucccagac

SEQ ID NO: 1119358 - RNA, 18 nt, Human
aggaggacacguauaaua

SEQ ID NO: 1119359 - RNA, 20 nt, Human
aggcagaagucccaggccca

SEQ ID NO: 1119360 - RNA, 22 nt, Human
aggcagaagucccaggcccagc

SEQ ID NO: 1119361 - RNA, 18 nt, Human
aggcagguacuuuuagga

SEQ ID NO: 1119362 - RNA, 24 nt, Human
aggcccagcuggcugggcccaaga

SEQ ID NO: 1119363 - RNA, 25 nt, Human
caacaauaaagucuucccucuguuu

SEQ ID NO: 1119364 - RNA, 18 nt, Human
cacacacacacacacaca

SEQ ID NO: 1119365 - RNA, 21 nt, Human
cacacacacacacacacaccc

SEQ ID NO: 1119366 - RNA, 18 nt, Human
cacaccccacagugaaaa

SEQ ID NO: 1119367 - RNA, 21 nt, Human
cagacuccugagaaccagaag

SEQ ID NO: 1119368 - RNA, 24 nt, Human
cagacuccugagaaccagaagucc

SEQ ID NO: 1119369 - RNA, 22 nt, Human
cagcuagcucucacagacacac

SEQ ID NO: 1119370 - RNA, 25 nt, Human
cagcuccaugaaugccucccuguga

SEQ ID NO: 1119371 - RNA, 20 nt, Human
caggcuccuggggguccccu

SEQ ID NO: 1119372 - RNA, 21 nt, Human
cagggugggaccccaguuucc

SEQ ID NO: 1119373 - RNA, 26 nt, Human
cagguuagaaauuauugcucaaagca

SEQ ID NO: 1119374 - RNA, 24 nt, Human
cauugaguggggcaugauauugga

SEQ ID NO: 1119375 - RNA, 25 nt, Human
cccaaucuauuuauccauccaucca

SEQ ID NO: 1119376 - RNA, 22 nt, Human
cccaggaggacacguauaauac

SEQ ID NO: 1119377 - RNA, 20 nt, Human
cccccagcucuccaggacuc

SEQ ID NO: 1119378 - RNA, 21 nt, Human
cccccuagccuacccuacucc

SEQ ID NO: 1119379 - RNA, 26 nt, Human
cccccuagccuacccuacucccagac

SEQ ID NO: 1119380 - RNA, 18 nt, Human
ccccucugccagccaccc

SEQ ID NO: 1119381 - RNA, 24 nt, Human
cccucugccagccacccuauguuc

SEQ ID NO: 1119382 - RNA, 21 nt, Human
cccucuggcuuuccauucugg

SEQ ID NO: 1119383 - RNA, 18 nt, Human
cccugguuucuccagcuc

SEQ ID NO: 1119384 - RNA, 22 nt, Human
ccuagaugcucuccccuucucc

SEQ ID NO: 1119385 - RNA, 24 nt, Human
ccucgcuccacagccucuggcaaa

SEQ ID NO: 1119386 - RNA, 20 nt, Human
ccugugucugcagugggucg

SEQ ID NO: 1119387 - RNA, 23 nt, Human
cggucagggcgacagguaggcag

SEQ ID NO: 1119388 - RNA, 18 nt, Human
cucacagacacaccccac

SEQ ID NO: 1119389 - RNA, 23 nt, Human
cucugcuuggggcaagugcuucc

SEQ ID NO: 1119390 - RNA, 22 nt, Human
cugggcccaagagcuccaucug

SEQ ID NO: 1119391 - RNA, 24 nt, Human
cuuggcucaggaaacaaccccagc

SEQ ID NO: 1119392 - RNA, 22 nt, Human
cuuuccauguguaucucuaugu

SEQ ID NO: 1119393 - RNA, 21 nt, Human
gaaacaaccccagccaaccca

SEQ ID NO: 1119394 - RNA, 24 nt, Human
gaaacccccuagccuacccuacuc

SEQ ID NO: 1119395 - RNA, 19 nt, Human
gauccaacuggcuggaaug

SEQ ID NO: 1119396 - RNA, 20 nt, Human
gcaagugcuuccaaaauccc

SEQ ID NO: 1119397 - RNA, 26 nt, Human
gcccuggacaguuucucccucuucuu

SEQ ID NO: 1119398 - RNA, 21 nt, Human
gccucaguuuccccaccugug

SEQ ID NO: 1119399 - RNA, 22 nt, Human
gcuucauuugccaucuccauuu

SEQ ID NO: 1119400 - RNA, 22 nt, Human
ggaaacaaccccagccaaccca

SEQ ID NO: 1119401 - RNA, 22 nt, Human
ggaacucaaggcaaggcuccuc

SEQ ID NO: 1119402 - RNA, 23 nt, Human
ggaguauaugauucccagaugaa

SEQ ID NO: 1119403 - RNA, 19 nt, Human
ggcugggaaggaggcaggu

SEQ ID NO: 1119404 - RNA, 19 nt, Human
gguaagagaaucagagccu

SEQ ID NO: 1119405 - RNA, 20 nt, Human
gguaagagaaucagagccug

SEQ ID NO: 1119406 - RNA, 23 nt, Human
ggucaggaucccugguuucucca

SEQ ID NO: 1119407 - RNA, 19 nt, Human
guagccuggaagguuugaa

SEQ ID NO: 1119408 - RNA, 22 nt, Human
gucaucucauccaucccgacuc

SEQ ID NO: 1119409 - RNA, 24 nt, Human
gugaaaaucacacacacacacaca

SEQ ID NO: 1119410 - RNA, 27 nt, Human
gugaaaaucacacacacacacacacag

SEQ ID NO: 1119411 - RNA, 21 nt, Human
guguagccuggaagguuugaa

SEQ ID NO: 1119412 - RNA, 27 nt, Human
uaaaaauaaauuuuccaacccuccccc

SEQ ID NO: 1119413 - RNA, 22 nt, Human
uaccaaaaauaacaacaauaaa

SEQ ID NO: 1119414 - RNA, 21 nt, Human
uagaagaaacccccuagccua

SEQ ID NO: 1119415 - RNA, 24 nt, Human
uagaagaaacccccuagccuaccc

SEQ ID NO: 1119416 - RNA, 19 nt, Human
uagaugcucuccccuucuc

SEQ ID NO: 1119417 - RNA, 27 nt, Human
uaggcagacuccugagaaccagaaguc

SEQ ID NO: 1119418 - RNA, 21 nt, Human
uauaauacaggccuucuugga

SEQ ID NO: 1119419 - RNA, 24 nt, Human
ucacaggcagacugcucacuuucu

SEQ ID NO: 1119420 - RNA, 23 nt, Human
ucauggucugauggucccauggu

SEQ ID NO: 1119421 - RNA, 21 nt, Human
uccacagccucuggcaaagcu

SEQ ID NO: 1119422 - RNA, 22 nt, Human
uccauguguaucucuauguagc

SEQ ID NO: 1119423 - RNA, 24 nt, Human
uccauucuggcaucccagagugga

SEQ ID NO: 1119424 - RNA, 21 nt, Human
ucccagaaaucagcccuugcc

SEQ ID NO: 1119425 - RNA, 20 nt, Human
ucccaggcccagcuggcugg

SEQ ID NO: 1119426 - RNA, 23 nt, Human
ucccaggcccagcuggcugggcc

SEQ ID NO: 1119427 - RNA, 24 nt, Human
ucccaggcccagcuggcugggccc

SEQ ID NO: 1119428 - RNA, 22 nt, Human
uccccagggugggaccccaguu

SEQ ID NO: 1119429 - RNA, 23 nt, Human
uccccagggugggaccccaguuu

SEQ ID NO: 1119430 - RNA, 21 nt, Human
uccugccucaguuuccccacc

SEQ ID NO: 1119431 - RNA, 20 nt, Human
ucuccauccacaagcgguca

SEQ ID NO: 1119432 - RNA, 18 nt, Human
ucugccagccacccuaug

SEQ ID NO: 1119433 - RNA, 20 nt, Human
ugaaaaucacacacacacac

SEQ ID NO: 1119434 - RNA, 25 nt, Human
ugaauguagagcaacaucuacaacc

SEQ ID NO: 1119435 - RNA, 23 nt, Human
ugaguaauggagugcugcgugaa

SEQ ID NO: 1119436 - RNA, 23 nt, Human
ugauggaagaguguagccuggaa

SEQ ID NO: 1119437 - RNA, 19 nt, Human
ugccaaggagggguaaggc

SEQ ID NO: 1119438 - RNA, 23 nt, Human
ugccagagguuuaacuccacuuc

SEQ ID NO: 1119439 - RNA, 25 nt, Human
ugccagagguuuaacuccacuuccc

SEQ ID NO: 1119440 - RNA, 19 nt, Human
ugccaggccacucuggagg

SEQ ID NO: 1119441 - RNA, 21 nt, Human
ugccucaguuuccccaccugu

SEQ ID NO: 1119442 - RNA, 23 nt, Human
ugccuucagauuccuucaggcuc

SEQ ID NO: 1119443 - RNA, 21 nt, Human
uggagguacugaguaauggag

SEQ ID NO: 1119444 - RNA, 22 nt, Human
uggaguauaugauucccagaug

SEQ ID NO: 1119445 - RNA, 19 nt, Human
uggcuggaaugugucaggg

SEQ ID NO: 1119446 - RNA, 23 nt, Human
ugggagggcagaacccuguuccu

SEQ ID NO: 1119447 - RNA, 19 nt, Human
uggucccauggucugaugg

SEQ ID NO: 1119448 - RNA, 24 nt, Human
uguagcaauugaugggcccugcgg

SEQ ID NO: 1119449 - RNA, 18 nt, Human
uguccaggggcucggacc

SEQ ID NO: 1119450 - RNA, 25 nt, Human
ugugcacuuacacacauggucagau

SEQ ID NO: 1119451 - RNA, 22 nt, Human
uuagaaauuauugcucaaagca

SEQ ID NO: 1119452 - RNA, 22 nt, Human
uuauuuugugcugggcuucaga

SEQ ID NO: 1119453 - RNA, 22 nt, Human
uuccccguauguacauugagac

SEQ ID NO: 1119454 - RNA, 18 nt, Human
uucucccucuucuucucc

SEQ ID NO: 1119455 - RNA, 19 nt, Human
uugcucaaagcagaaacag

SEQ ID NO: 1119456 - RNA, 19 nt, Human
uuggcucaggaaacaaccc

SEQ ID NO: 1119457 - RNA, 21 nt, Human
uuugugcacuuacacacaugg

SEQ ID NO: 1119458 - RNA, 19 nt, Human
uuuugugcugggcuucaga

SEQ ID NO: 1119459 - RNA, 19 nt, Human
aaaaaacagaaaacaaaca

SEQ ID NO: 1119460 - RNA, 22 nt, Human
aaaacaaagaggcuacaggccc

SEQ ID NO: 1119461 - RNA, 27 nt, Human
aaacaaaugcauaaagucccugucccc

SEQ ID NO: 1119462 - RNA, 23 nt, Human
aaacagaaaacaaacagauauag

SEQ ID NO: 1119463 - RNA, 25 nt, Human
aaacagaaaacaaacagauauagga

SEQ ID NO: 1119464 - RNA, 20 nt, Human
aaacagauauaggauguaau

SEQ ID NO: 1119465 - RNA, 24 nt, Human
aaagugcugggauuacagguguga

SEQ ID NO: 1119466 - RNA, 24 nt, Human
aaaugcauaaagucccugucccca

SEQ ID NO: 1119467 - RNA, 19 nt, Human
aagcgauucucccaccucu

SEQ ID NO: 1119468 - RNA, 18 nt, Human
aagugcugggauuacagg

SEQ ID NO: 1119469 - RNA, 19 nt, Human
aagugcugggauuacaggu

SEQ ID NO: 1119470 - RNA, 26 nt, Human
aagugcugggauuacaggugugagcc

SEQ ID NO: 1119471 - RNA, 20 nt, Human
aauggcuacuuucaaagaca

SEQ ID NO: 1119472 - RNA, 21 nt, Human
aauggcuacuuucaaagacau

SEQ ID NO: 1119473 - RNA, 24 nt, Human
acacugcgaaccauauuaccuaau

SEQ ID NO: 1119474 - RNA, 22 nt, Human
accaagucccuaggcugcacac

SEQ ID NO: 1119475 - RNA, 20 nt, Human
accauucuggggucuggagg

SEQ ID NO: 1119476 - RNA, 19 nt, Human
acguagucaggguucccca

SEQ ID NO: 1119477 - RNA, 20 nt, Human
acuuugaauucaaacaaaag

SEQ ID NO: 1119478 - RNA, 21 nt, Human
agaaaacaaacagauauagga

SEQ ID NO: 1119479 - RNA, 23 nt, Human
agaaaacaaacagauauaggaug

SEQ ID NO: 1119480 - RNA, 21 nt, Human
agaaacuguuccugauucugg

SEQ ID NO: 1119481 - RNA, 23 nt, Human
agacaaagacagcuugugcagag

SEQ ID NO: 1119482 - RNA, 24 nt, Human
agacccaacagccugggauccuga

SEQ ID NO: 1119483 - RNA, 23 nt, Human
aggaccccgggccuggccaacaa

SEQ ID NO: 1119484 - RNA, 20 nt, Human
aggcgaagguuuccaaaccc

SEQ ID NO: 1119485 - RNA, 18 nt, Human
aggcugagaagucccaca

SEQ ID NO: 1119486 - RNA, 24 nt, Human
agggauaaauacuuugaauucaaa

SEQ ID NO: 1119487 - RNA, 23 nt, Human
aggugugagccacugugccuggc

SEQ ID NO: 1119488 - RNA, 22 nt, Human
aguagaaaugggguuucaccau

SEQ ID NO: 1119489 - RNA, 24 nt, Human
agugcaguguuaugauuuuggcuc

SEQ ID NO: 1119490 - RNA, 22 nt, Human
auccaagggcaggaauggaagc

SEQ ID NO: 1119491 - RNA, 18 nt, Human
augggguuucaccauguu

SEQ ID NO: 1119492 - RNA, 22 nt, Human
augggguuucaccauguuggcc

SEQ ID NO: 1119493 - RNA, 23 nt, Human
augggguuucaccauguuggcca

SEQ ID NO: 1119494 - RNA, 24 nt, Human
augggguuucaccauguuggccag

SEQ ID NO: 1119495 - RNA, 22 nt, Human
auuccacccauggccccuccca

SEQ ID NO: 1119496 - RNA, 22 nt, Human
caaaaccaaucacaccauccca

SEQ ID NO: 1119497 - RNA, 22 nt, Human
caaacuucugccuggccaucca

SEQ ID NO: 1119498 - RNA, 20 nt, Human
caaaggccuuagaaccccuc

SEQ ID NO: 1119499 - RNA, 24 nt, Human
caaagugcugggauuacaggugug

SEQ ID NO: 1119500 - RNA, 19 nt, Human
caaaugggauaaauugguc

SEQ ID NO: 1119501 - RNA, 24 nt, Human
caaccaaacccuaucauuccaccc

SEQ ID NO: 1119502 - RNA, 26 nt, Human
caaccaaacccuaucauuccaccccg

SEQ ID NO: 1119503 - RNA, 19 nt, Human
caagcgauucucccaccuc

SEQ ID NO: 1119504 - RNA, 20 nt, Human
caagucccaaagucucagaa

SEQ ID NO: 1119505 - RNA, 27 nt, Human
caagucccaaagucucagaaucaggaa

SEQ ID NO: 1119506 - RNA, 19 nt, Human
caagugauccuccugccuc

SEQ ID NO: 1119507 - RNA, 22 nt, Human
caagugauccuccugccucggc

SEQ ID NO: 1119508 - RNA, 27 nt, Human
caagugauccuccugccucggccuucc

SEQ ID NO: 1119509 - RNA, 27 nt, Human
caauuugccuuucuuccguuuuuguuc

SEQ ID NO: 1119510 - RNA, 23 nt, Human
cacaaccaaacccuaucauucca

SEQ ID NO: 1119511 - RNA, 22 nt, Human
cacaggcacacgccaccacacc

SEQ ID NO: 1119512 - RNA, 18 nt, Human
caccauguuggccaggau

SEQ ID NO: 1119513 - RNA, 22 nt, Human
caccauguuggccaggaugguc

SEQ ID NO: 1119514 - RNA, 31 nt, Human
caccauguuggccaggauggucccgaacucc

SEQ ID NO: 1119515 - RNA, 23 nt, Human
caccuaaaauuaaccaucacaaa

SEQ ID NO: 1119516 - RNA, 23 nt, Human
caccucugccucccguguagcug

SEQ ID NO: 1119517 - RNA, 24 nt, Human
caccucugccucccguguagcugg

SEQ ID NO: 1119518 - RNA, 25 nt, Human
cacugcccuggcagaggaucuccau

SEQ ID NO: 1119519 - RNA, 26 nt, Human
cagagaaacucccccuuauagagcca

SEQ ID NO: 1119520 - RNA, 21 nt, Human
cagauggaagggguggguucc

SEQ ID NO: 1119521 - RNA, 18 nt, Human
cagcaguaaacaaaugca

SEQ ID NO: 1119522 - RNA, 19 nt, Human
cagccucccucucagcugc

SEQ ID NO: 1119523 - RNA, 24 nt, Human
caggaugagauuuggguggggaca

SEQ ID NO: 1119524 - RNA, 22 nt, Human
caggauggucccgaacuccuga

SEQ ID NO: 1119525 - RNA, 18 nt, Human
caggcccaugagagucca

SEQ ID NO: 1119526 - RNA, 19 nt, Human
caggcugcaaauuuuccga

SEQ ID NO: 1119527 - RNA, 24 nt, Human
cauguuggccaggauggucccgaa

SEQ ID NO: 1119528 - RNA, 25 nt, Human
cauuccacccauggccccucccaaa

SEQ ID NO: 1119529 - RNA, 21 nt, Human
ccaaagugcugggauuacagg

SEQ ID NO: 1119530 - RNA, 21 nt, Human
ccaaagugcugggauuacagg

SEQ ID NO: 1119531 - RNA, 24 nt, Human
ccaaagugcugggauuacaggugu

SEQ ID NO: 1119532 - RNA, 24 nt, Human
ccacauuucccuucugcacugccc

SEQ ID NO: 1119533 - RNA, 19 nt, Human
ccagucaagcugacaccua

SEQ ID NO: 1119534 - RNA, 23 nt, Human
ccaguucuugacuucugugcacu

SEQ ID NO: 1119535 - RNA, 19 nt, Human
ccauggccccucccaaauu

SEQ ID NO: 1119536 - RNA, 19 nt, Human
ccauguucaagcgauucuc

SEQ ID NO: 1119537 - RNA, 24 nt, Human
cccauggucuugggcagcucugcc

SEQ ID NO: 1119538 - RNA, 19 nt, Human
cccuaucauuccacccaug

SEQ ID NO: 1119539 - RNA, 23 nt, Human
ccgaagcuacagcccaagcucua

SEQ ID NO: 1119540 - RNA, 20 nt, Human
ccuauaaaauccaaagcaag

SEQ ID NO: 1119541 - RNA, 26 nt, Human
ccuccugccucggccuuccaaagugc

SEQ ID NO: 1119542 - RNA, 20 nt, Human
ccucuucucacagcuccacu

SEQ ID NO: 1119543 - RNA, 22 nt, Human
ccucuuuaaucuaggcgaaggu

SEQ ID NO: 1119544 - RNA, 18 nt, Human
ccugaccucaagugaucc

SEQ ID NO: 1119545 - RNA, 23 nt, Human
ccugaccucaagugauccuccug

SEQ ID NO: 1119546 - RNA, 21 nt, Human
ccugggauccugaaauccaag

SEQ ID NO: 1119547 - RNA, 21 nt, Human
ccuuucuuccguuuuuguucc

SEQ ID NO: 1119548 - RNA, 21 nt, Human
cgccaccacaccuagcuacuu

SEQ ID NO: 1119549 - RNA, 22 nt, Human
cggaugguucccucuuagccca

SEQ ID NO: 1119550 - RNA, 24 nt, Human
cucaagugauccuccugccucggc

SEQ ID NO: 1119551 - RNA, 21 nt, Human
cuccugccucggccuuccaaa

SEQ ID NO: 1119552 - RNA, 23 nt, Human
cucuugacuccacaucucacauc

SEQ ID NO: 1119553 - RNA, 18 nt, Human
cugccccuguaccuuugc

SEQ ID NO: 1119554 - RNA, 23 nt, Human
cuuagaaccccagcggugacgga

SEQ ID NO: 1119555 - RNA, 19 nt, Human
cuugcacuccccgaagcua

SEQ ID NO: 1119556 - RNA, 21 nt, Human
cuuguauucuaauggaaaaaa

SEQ ID NO: 1119557 - RNA, 22 nt, Human
gaaaacaaacagauauaggaug

SEQ ID NO: 1119558 - RNA, 22 nt, Human
gaagcguguauuccagcuccaa

SEQ ID NO: 1119559 - RNA, 25 nt, Human
gacaaagacagcuugugcagagaaa

SEQ ID NO: 1119560 - RNA, 22 nt, Human
gaccucaagugauccuccugcc

SEQ ID NO: 1119561 - RNA, 24 nt, Human
gaccucaagugauccuccugccuc

SEQ ID NO: 1119562 - RNA, 21 nt, Human
gagauggagucuugcucuguu

SEQ ID NO: 1119563 - RNA, 18 nt, Human
gaggaccccgggccuggc

SEQ ID NO: 1119564 - RNA, 18 nt, Human
gauuacaggugugagcca

SEQ ID NO: 1119565 - RNA, 21 nt, Human
gauuacaggugugagccacug

SEQ ID NO: 1119566 - RNA, 24 nt, Human
gauuacaggugugagccacugugc

SEQ ID NO: 1119567 - RNA, 18 nt, Human
gauuuuggcucacugcaa

SEQ ID NO: 1119568 - RNA, 18 nt, Human
gcaaccucuaccauguuc

SEQ ID NO: 1119569 - RNA, 23 nt, Human
gcaagcuggagacccagggauac

SEQ ID NO: 1119570 - RNA, 21 nt, Human
ggaagcguguauuccagcucc

SEQ ID NO: 1119571 - RNA, 21 nt, Human
ggagacccagggauacuggua

SEQ ID NO: 1119572 - RNA, 24 nt, Human
ggauggucccgaacuccugaccuc

SEQ ID NO: 1119573 - RNA, 20 nt, Human
gggcuugcacuccccgaagc

SEQ ID NO: 1119574 - RNA, 18 nt, Human
gggguugccauaaagacc

SEQ ID NO: 1119575 - RNA, 22 nt, Human
gggguuucaccauguuggccag

SEQ ID NO: 1119576 - RNA, 24 nt, Human
gguuucaccauguuggccaggaug

SEQ ID NO: 1119577 - RNA, 19 nt, Human
gucaugcagauggaagggg

SEQ ID NO: 1119578 - RNA, 18 nt, Human
guggaucuaccauucugg

SEQ ID NO: 1119579 - RNA, 24 nt, Human
guguagcugggaucacaggcacac

SEQ ID NO: 1119580 - RNA, 21 nt, Human
guucaagcgauucucccaccu

SEQ ID NO: 1119581 - RNA, 22 nt, Human
uaaaaaaaaauggcuacuuuca

SEQ ID NO: 1119582 - RNA, 23 nt, Human
uaaugccuuuccaguucucuagg

SEQ ID NO: 1119583 - RNA, 19 nt, Human
uaauggaaaaaacagaaaa

SEQ ID NO: 1119584 - RNA, 21 nt, Human
uacagcaguaaacaaaugcau

SEQ ID NO: 1119585 - RNA, 22 nt, Human
uacagcccaagcucuaccuugc

SEQ ID NO: 1119586 - RNA, 22 nt, Human
uacaggugugagccacugugcc

SEQ ID NO: 1119587 - RNA, 22 nt, Human
uacaggugugagccacugugcc

SEQ ID NO: 1119588 - RNA, 23 nt, Human
uacaggugugagccacugugccu

SEQ ID NO: 1119589 - RNA, 24 nt, Human
uacucaugcaaauuucugcagcca

SEQ ID NO: 1119590 - RNA, 22 nt, Human
uacuuuuuguauuuuuaguaga

SEQ ID NO: 1119591 - RNA, 22 nt, Human
uagaaaugggguuucaccaugu

SEQ ID NO: 1119592 - RNA, 19 nt, Human
uagcuaugucuauugagca

SEQ ID NO: 1119593 - RNA, 24 nt, Human
uaguagaaaugggguuucaccaug

SEQ ID NO: 1119594 - RNA, 26 nt, Human
uaguagaaaugggguuucaccauguu

SEQ ID NO: 1119595 - RNA, 23 nt, Human
uauaauagcuaugucuauugagc

SEQ ID NO: 1119596 - RNA, 19 nt, Human
uaugagccuauaaaaucca

SEQ ID NO: 1119597 - RNA, 21 nt, Human
uaugagccuauaaaauccaaa

SEQ ID NO: 1119598 - RNA, 26 nt, Human
ucaaaacaaagaggcuacaggcccau

SEQ ID NO: 1119599 - RNA, 22 nt, Human
ucaaaaccaaucacaccauccc

SEQ ID NO: 1119600 - RNA, 21 nt, Human
ucaaagacaucuuggaguuca

SEQ ID NO: 1119601 - RNA, 20 nt, Human
ucacugcaaccucuaccaug

SEQ ID NO: 1119602 - RNA, 26 nt, Human
ucacugcaaccucuaccauguucaag

SEQ ID NO: 1119603 - RNA, 24 nt, Human
ucauuccacccauggccccuccca

SEQ ID NO: 1119604 - RNA, 22 nt, Human
uccaaagugcugggauuacagg

SEQ ID NO: 1119605 - RNA, 24 nt, Human
uccaaagugcugggauuacaggug

SEQ ID NO: 1119606 - RNA, 22 nt, Human
uccacccauggccccucccaaa

SEQ ID NO: 1119607 - RNA, 24 nt, Human
uccacccauggccccucccaaauu

SEQ ID NO: 1119608 - RNA, 19 nt, Human
uccacuagguggugcccca

SEQ ID NO: 1119609 - RNA, 25 nt, Human
uccagguacacggugcaagcuggcc

SEQ ID NO: 1119610 - RNA, 22 nt, Human
ucccaaagucucagaaucagga

SEQ ID NO: 1119611 - RNA, 19 nt, Human
uccugccucggccuuccaa

SEQ ID NO: 1119612 - RNA, 21 nt, Human
ucuaauggaaaaaacagaaaa

SEQ ID NO: 1119613 - RNA, 19 nt, Human
ucuccucagaaaaugggaa

SEQ ID NO: 1119614 - RNA, 24 nt, Human
ucuguugcccaaccuggagugcag

SEQ ID NO: 1119615 - RNA, 25 nt, Human
ucuucuggaaauacccucacagaca

SEQ ID NO: 1119616 - RNA, 23 nt, Human
ucuugcucuguugcccaaccugg

SEQ ID NO: 1119617 - RNA, 24 nt, Human
ucuugcucuguugcccaaccugga

SEQ ID NO: 1119618 - RNA, 23 nt, Human
ugacaugcccuggagacauuuuc

SEQ ID NO: 1119619 - RNA, 18 nt, Human
ugaccccacauuucccuu

SEQ ID NO: 1119620 - RNA, 21 nt, Human
ugaccccacauuucccuucug

SEQ ID NO: 1119621 - RNA, 18 nt, Human
ugaccucaagugauccuc

SEQ ID NO: 1119622 - RNA, 20 nt, Human
ugaccucaagugauccuccu

SEQ ID NO: 1119623 - RNA, 21 nt, Human
ugaccucaagugauccuccug

SEQ ID NO: 1119624 - RNA, 24 nt, Human
ugaccucaagugauccuccugccu

SEQ ID NO: 1119625 - RNA, 20 nt, Human
ugacuaaaccauuagaaauu

SEQ ID NO: 1119626 - RNA, 22 nt, Human
ugacuccacaucucacauccag

SEQ ID NO: 1119627 - RNA, 23 nt, Human
ugacuccacaucucacauccagg

SEQ ID NO: 1119628 - RNA, 23 nt, Human
ugagacccaacagccugggaucc

SEQ ID NO: 1119629 - RNA, 19 nt, Human
ugagcacucaagcguauuc

SEQ ID NO: 1119630 - RNA, 19 nt, Human
ugaggaccccgggccuggc

SEQ ID NO: 1119631 - RNA, 24 nt, Human
ugaguuagaaagggcucacaugau

SEQ ID NO: 1119632 - RNA, 25 nt, Human
ugaucuccucuugacuccacaucuc

SEQ ID NO: 1119633 - RNA, 24 nt, Human
ugcaagcuggagacccagggauac

SEQ ID NO: 1119634 - RNA, 23 nt, Human
ugcacucgcagucucaacaccac

SEQ ID NO: 1119635 - RNA, 22 nt, Human
ugcagagaaacucccccuuaau

SEQ ID NO: 1119636 - RNA, 20 nt, Human
ugcagcaaacuucugccugg

SEQ ID NO: 1119637 - RNA, 26 nt, Human
ugcauaaagucccuguccccaugaaa

SEQ ID NO: 1119638 - RNA, 21 nt, Human
ugcccuggagacauuuucccc

SEQ ID NO: 1119639 - RNA, 22 nt, Human
ugcucuguugcccaaccuggag

SEQ ID NO: 1119640 - RNA, 24 nt, Human
ugcugggauuacaggugugagcca

SEQ ID NO: 1119641 - RNA, 24 nt, Human
uggaaaaaacagaaaacaaacaga

SEQ ID NO: 1119642 - RNA, 28 nt, Human
uggaaaaaacagaaaacaaacagauaua

SEQ ID NO: 1119643 - RNA, 21 nt, Human
uggaagggguggguucccaug

SEQ ID NO: 1119644 - RNA, 21 nt, Human
uggagugcaguguuaugauuc

SEQ ID NO: 1119645 - RNA, 21 nt, Human
uggagugcaguguuaugauuu

SEQ ID NO: 1119646 - RNA, 23 nt, Human
uggagugcaguguuaugauuuug

SEQ ID NO: 1119647 - RNA, 24 nt, Human
uggagugcaguguuaugauuuugg

SEQ ID NO: 1119648 - RNA, 24 nt, Human
uggccaggauggucccgaacuccu

SEQ ID NO: 1119649 - RNA, 18 nt, Human
uggcugggaugcagggca

SEQ ID NO: 1119650 - RNA, 21 nt, Human
ugggaauuagcauuuggcucc

SEQ ID NO: 1119651 - RNA, 24 nt, Human
ugggauaaauuggucaaaacaaag

SEQ ID NO: 1119652 - RNA, 21 nt, Human
ugggaucacaggcacacgcca

SEQ ID NO: 1119653 - RNA, 22 nt, Human
ugggaucacaggcacacgccac

SEQ ID NO: 1119654 - RNA, 24 nt, Human
ugggaucacaggcacacgccacca

SEQ ID NO: 1119655 - RNA, 22 nt, Human
ugggaugcagggcaccaagucc

SEQ ID NO: 1119656 - RNA, 18 nt, Human
ugggauuacaggugugag

SEQ ID NO: 1119657 - RNA, 21 nt, Human
ugggauuacaggugugagcca

SEQ ID NO: 1119658 - RNA, 22 nt, Human
ugggauuacaggugugagccac

SEQ ID NO: 1119659 - RNA, 22 nt, Human
ugggauuacaggugugagccac

SEQ ID NO: 1119660 - RNA, 22 nt, Human
ugggauuacaggugugagccac

SEQ ID NO: 1119661 - RNA, 24 nt, Human
ugggauuacaggugugagccacug

SEQ ID NO: 1119662 - RNA, 20 nt, Human
uggggacacaaccaaacccu

SEQ ID NO: 1119663 - RNA, 21 nt, Human
uggggacacaaccaaacccua

SEQ ID NO: 1119664 - RNA, 24 nt, Human
ugggguuucaccauguuggccagg

SEQ ID NO: 1119665 - RNA, 25 nt, Human
ugggucccucccacaacgcauggga

SEQ ID NO: 1119666 - RNA, 18 nt, Human
uggguucccauggucuug

SEQ ID NO: 1119667 - RNA, 20 nt, Human
uggucccgaacuccugaccu

SEQ ID NO: 1119668 - RNA, 21 nt, Human
uguauuuuuaguagaaauggg

SEQ ID NO: 1119669 - RNA, 24 nt, Human
uuagaaauuaaaaaaaaauggcua

SEQ ID NO: 1119670 - RNA, 24 nt, Human
uuagcccaaaggccuuagaacccc

SEQ ID NO: 1119671 - RNA, 18 nt, Human
uuaguagaaaugggguuu

SEQ ID NO: 1119672 - RNA, 22 nt, Human
uuaguagaaaugggguuucacc

SEQ ID NO: 1119673 - RNA, 24 nt, Human
uuaguagaaaugggguuucaccau

SEQ ID NO: 1119674 - RNA, 24 nt, Human
uucaagcgauucucccaccucugc

SEQ ID NO: 1119675 - RNA, 24 nt, Human
uucaggaugagauuugggugggga

SEQ ID NO: 1119676 - RNA, 22 nt, Human
uuccacccauggccccucccaa

SEQ ID NO: 1119677 - RNA, 22 nt, Human
uuccagguacacggugcaagcu

SEQ ID NO: 1119678 - RNA, 24 nt, Human
uugcccaaccuggagugcaguguu

SEQ ID NO: 1119679 - RNA, 19 nt, Human
uuucaccauguuggccagg

SEQ ID NO: 1119680 - RNA, 20 nt, Human
uuucaccauguuggccagga

SEQ ID NO: 1119681 - RNA, 24 nt, Human
uuuccaguucucuagguauucuuu

SEQ ID NO: 1119682 - RNA, 24 nt, Human
uuuuuaguagaaaugggguuucac

SEQ ID NO: 1119683 - RNA, 19 nt, Human
uuuuuguauuuuuaguaga

SEQ ID NO: 1119684 - RNA, 22 nt, Human
aaaacaaagaggcuacaggccc

SEQ ID NO: 1119685 - RNA, 23 nt, Human
aaacagaaaacaaacagauauag

SEQ ID NO: 1119686 - RNA, 25 nt, Human
aaacagaaaacaaacagauauagga

SEQ ID NO: 1119687 - RNA, 20 nt, Human
aaacagauauaggauguaau

SEQ ID NO: 1119688 - RNA, 28 nt, Human
aaagacaaagacagcuugugcagagaaa

SEQ ID NO: 1119689 - RNA, 24 nt, Human
aaagugcugggauuacagguguga

SEQ ID NO: 1119690 - RNA, 24 nt, Human
aaccaaacccuaucauuccacccc

SEQ ID NO: 1119691 - RNA, 21 nt, Human
aaccccaauucuugacuucug

SEQ ID NO: 1119692 - RNA, 19 nt, Human
aagaaacagaaaacaaaca

SEQ ID NO: 1119693 - RNA, 19 nt, Human
aagcgauucucccaccucu

SEQ ID NO: 1119694 - RNA, 19 nt, Human
aagcucuaccuugccuccc

SEQ ID NO: 1119695 - RNA, 27 nt, Human
aagugauccuccugccucggccuccca

SEQ ID NO: 1119696 - RNA, 18 nt, Human
aagugcugggauuacagg

SEQ ID NO: 1119697 - RNA, 19 nt, Human
aagugcugggauuacaggu

SEQ ID NO: 1119698 - RNA, 26 nt, Human
aagugcugggauuacaggugugagcc

SEQ ID NO: 1119699 - RNA, 20 nt, Human
aauagcuaugucuauugagc

SEQ ID NO: 1119700 - RNA, 24 nt, Human
acacugcgaaccauauuaccuaau

SEQ ID NO: 1119701 - RNA, 22 nt, Human
accaagucccuaggcugcacac

SEQ ID NO: 1119702 - RNA, 20 nt, Human
accauucuggggucuggagg

SEQ ID NO: 1119703 - RNA, 22 nt, Human
accuaaaauuaaccaucacaaa

SEQ ID NO: 1119704 - RNA, 23 nt, Human
accucugccucccguguagcugg

SEQ ID NO: 1119705 - RNA, 24 nt, Human
acgcagauggaagggguggguucc

SEQ ID NO: 1119706 - RNA, 22 nt, Human
acuuugaauucaaacaaaagua

SEQ ID NO: 1119707 - RNA, 21 nt, Human
agaaaacaaacagauauagga

SEQ ID NO: 1119708 - RNA, 23 nt, Human
agaaaacaaacagauauaggaug

SEQ ID NO: 1119709 - RNA, 21 nt, Human
agaaacuguuccugauucugg

SEQ ID NO: 1119710 - RNA, 23 nt, Human
agacaaagacagcuugugcagag

SEQ ID NO: 1119711 - RNA, 25 nt, Human
agacccaacagccugggauccugaa

SEQ ID NO: 1119712 - RNA, 20 nt, Human
aggcgaagguuuccaaaccc

SEQ ID NO: 1119713 - RNA, 24 nt, Human
agggauaaauacuuugaauucaaa

SEQ ID NO: 1119714 - RNA, 24 nt, Human
agugcaguguuaugauuuuggcuc

SEQ ID NO: 1119715 - RNA, 20 nt, Human
auagcuaugucuauugagca

SEQ ID NO: 1119716 - RNA, 22 nt, Human
auccaagggcaggaauggaagc

SEQ ID NO: 1119717 - RNA, 18 nt, Human
augggguuucaccauguu

SEQ ID NO: 1119718 - RNA, 22 nt, Human
augggguuucaccauguuggcc

SEQ ID NO: 1119719 - RNA, 23 nt, Human
augggguuucaccauguuggcca

SEQ ID NO: 1119720 - RNA, 24 nt, Human
augggguuucaccauguuggccag

SEQ ID NO: 1119721 - RNA, 22 nt, Human
auuccacccauggccccuccca

SEQ ID NO: 1119722 - RNA, 22 nt, Human
caaaaccaaucacaccauccca

SEQ ID NO: 1119723 - RNA, 22 nt, Human
caaacuucugacugggcaucca

SEQ ID NO: 1119724 - RNA, 20 nt, Human
caaaggccuuagaaccccuc

SEQ ID NO: 1119725 - RNA, 24 nt, Human
caaagugcugggauuacaggugug

SEQ ID NO: 1119726 - RNA, 24 nt, Human
caaccaaacccuaucauuccaccc

SEQ ID NO: 1119727 - RNA, 20 nt, Human
caagucccaaagccucagaa

SEQ ID NO: 1119728 - RNA, 27 nt, Human
caagucccaaagccucagaaucaggaa

SEQ ID NO: 1119729 - RNA, 22 nt, Human
caagugauccuccugccucggc

SEQ ID NO: 1119730 - RNA, 27 nt, Human
caagugauccuccugccucggccuccc

SEQ ID NO: 1119731 - RNA, 27 nt, Human
caauuugccuuucuuccguuuuuguuu

SEQ ID NO: 1119732 - RNA, 23 nt, Human
cacaaccaaacccuaucauucca

SEQ ID NO: 1119733 - RNA, 22 nt, Human
cacaggcacacgccaccacacc

SEQ ID NO: 1119734 - RNA, 18 nt, Human
caccauguuggccaggau

SEQ ID NO: 1119735 - RNA, 22 nt, Human
caccauguuggccaggaugguc

SEQ ID NO: 1119736 - RNA, 31 nt, Human; identical to SEQ ID NO: 1119514

SEQ ID NO: 1119737 - RNA, 21 nt, Human
caccucugccucccguguagc

SEQ ID NO: 1119738 - RNA, 25 nt, Human
cacugcccuggcagaggaucuccau

SEQ ID NO: 1119739 - RNA, 26 nt, Human
cagagaaacucccccuuauagagcca

SEQ ID NO: 1119740 - RNA, 19 nt, Human
cagcaaacuucugacuggg

SEQ ID NO: 1119741 - RNA, 20 nt, Human
cagccucccucucagcugcu

SEQ ID NO: 1119742 - RNA, 24 nt, Human
caggaugagauuuggguggggaca

SEQ ID NO: 1119743 - RNA, 22 nt, Human
caggauggucccgaacuccuga

SEQ ID NO: 1119744 - RNA, 18 nt, Human
caggcccaugagagucca

SEQ ID NO: 1119745 - RNA, 19 nt, Human
caggcugcaaauuuuccga

SEQ ID NO: 1119746 - RNA, 24 nt, Human
caggugugagccacugugccuggc

SEQ ID NO: 1119747 - RNA, 24 nt, Human
cauguuggccaggauggucccgaa

SEQ ID NO: 1119748 - RNA, 24 nt, Human
cauuagaaauuuaaaaaauggcua

SEQ ID NO: 1119749 - RNA, 25 nt, Human
cauuccacccauggccccucccaaa

SEQ ID NO: 1119750 - RNA, 25 nt, Human
ccaaaaugaucuccuuugacuccac

SEQ ID NO: 1119751 - RNA, 21 nt, Human
ccaaagugcugggauuacagg

SEQ ID NO: 1119752 - RNA, 21 nt, Human
ccaaagugcugggauuacagg

SEQ ID NO: 1119753 - RNA, 24 nt, Human
ccaaagugcugggauuacaggugu

SEQ ID NO: 1119754 - RNA, 24 nt, Human
ccacauuucccuucugcacugccc

SEQ ID NO: 1119755 - RNA, 21 nt, Human
ccaccugcacauugagggcgg

SEQ ID NO: 1119756 - RNA, 19 nt, Human
ccagucaagcugacaccua

SEQ ID NO: 1119757 - RNA, 19 nt, Human
ccauguucaagcgauucuc

SEQ ID NO: 1119758 - RNA, 21 nt, Human
cccauggccccucccaaauuu

SEQ ID NO: 1119759 - RNA, 24 nt, Human
cccauggucuugggcagcucugcc

SEQ ID NO: 1119760 - RNA, 19 nt, Human
cccuaucauuccacccaug

SEQ ID NO: 1119761 - RNA, 23 nt, Human
ccgaagcuacagcccaagcucua

SEQ ID NO: 1119762 - RNA, 20 nt, Human
ccuauaaaauccaaagcaag

SEQ ID NO: 1119763 - RNA, 26 nt, Human
ccuccugccucggccucccaaagugc

SEQ ID NO: 1119764 - RNA, 20 nt, Human
ccucuucucacagcuccacu

SEQ ID NO: 1119765 - RNA, 22 nt, Human
ccucuuuaaucuaggcgaaggu

SEQ ID NO: 1119766 - RNA, 18 nt, Human
ccugaccucaagugaucc

SEQ ID NO: 1119767 - RNA, 23 nt, Human
ccugaccucaagugauccuccug

SEQ ID NO: 1119768 - RNA, 19 nt, Human
ccugcacauugagggcgga

SEQ ID NO: 1119769 - RNA, 24 nt, Human
ccugccucggccucccaaagugcu

SEQ ID NO: 1119770 - RNA, 21 nt, Human
ccugggauccugaaauccaag

SEQ ID NO: 1119771 - RNA, 21 nt, Human
cgccaccacaccuagcuacuu

SEQ ID NO: 1119772 - RNA, 24 nt, Human
cguagucaggguucgccaaagaga

SEQ ID NO: 1119773 - RNA, 24 nt, Human
cucaagugauccuccugccucggc

SEQ ID NO: 1119774 - RNA, 19 nt, Human
cucacugcaaccucugucu

SEQ ID NO: 1119775 - RNA, 22 nt, Human
cucacugcaaccucugucuacc

SEQ ID NO: 1119776 - RNA, 24 nt, Human
cugcaaccucugucuaccauguuc

SEQ ID NO: 1119777 - RNA, 18 nt, Human
cugccccuguaccuuugc

SEQ ID NO: 1119778 - RNA, 23 nt, Human
cuuagaaccccagcggugacgga

SEQ ID NO: 1119779 - RNA, 19 nt, Human
cuugcacuccccgaagcua

SEQ ID NO: 1119780 - RNA, 21 nt, Human
cuuguauucuaauggaagaaa

SEQ ID NO: 1119781 - RNA, 22 nt, Human
gaaaacaaacagauauaggaug

SEQ ID NO: 1119782 - RNA, 22 nt, Human
gaagcguguauuccagcuccaa

SEQ ID NO: 1119783 - RNA, 22 nt, Human
gaccucaagugauccuccugcc

SEQ ID NO: 1119784 - RNA, 24 nt, Human
gaccucaagugauccuccugccuc

SEQ ID NO: 1119785 - RNA, 18 nt, Human
gaggaccccgggccuggc

SEQ ID NO: 1119786 - RNA, 24 nt, Human
gaggaccccgggccuggccaacaa

SEQ ID NO: 1119787 - RNA, 21 nt, Human
gagucuugcuguguugcccag

SEQ ID NO: 1119788 - RNA, 18 nt, Human
gauuacaggugugagcca

SEQ ID NO: 1119789 - RNA, 21 nt, Human
gauuacaggugugagccacug

SEQ ID NO: 1119790 - RNA, 24 nt, Human
gauuacaggugugagccacugugc

SEQ ID NO: 1119791 - RNA, 18 nt, Human
gauuuuggcucacugcaa

SEQ ID NO: 1119792 - RNA, 23 nt, Human
gcaagcuggagacccagggauac

SEQ ID NO: 1119793 - RNA, 21 nt, Human
ggaagcguguauuccagcucc

SEQ ID NO: 1119794 - RNA, 21 nt, Human
ggagacccagggauacuggua

SEQ ID NO: 1119795 - RNA, 24 nt, Human
ggauggucccgaacuccugaccuc

SEQ ID NO: 1119796 - RNA, 20 nt, Human
gggcuugcacuccccgaagc

SEQ ID NO: 1119797 - RNA, 18 nt, Human
gggguugccauaaagacc

SEQ ID NO: 1119798 - RNA, 22 nt, Human
gggguuucaccauguuggccag

SEQ ID NO: 1119799 - RNA, 21 nt, Human
ggucccucccacaacgcaugg

SEQ ID NO: 1119800 - RNA, 24 nt, Human
gguuucaccauguuggccaggaug

SEQ ID NO: 1119801 - RNA, 22 nt, Human
guagucaggguucgccaaagag

SEQ ID NO: 1119802 - RNA, 18 nt, Human
guggaucuaccauucugg

SEQ ID NO: 1119803 - RNA, 24 nt, Human
guguagcugggaucacaggcacac

SEQ ID NO: 1119804 - RNA, 23 nt, Human
uaaugccuuuccaguucucuagg

SEQ ID NO: 1119805 - RNA, 19 nt, Human
uaauggaagaaacagaaaa

SEQ ID NO: 1119806 - RNA, 24 nt, Human
uacagcaguaaacaaauggauaaa

SEQ ID NO: 1119807 - RNA, 23 nt, Human
uacagcccaagcucuaccuugcc

SEQ ID NO: 1119808 - RNA, 22 nt, Human
uacaggugugagccacugugcc

SEQ ID NO: 1119809 - RNA, 22 nt, Human
uacaggugugagccacugugcc

SEQ ID NO: 1119810 - RNA, 23 nt, Human
uacaggugugagccacugugccu

SEQ ID NO: 1119811 - RNA, 24 nt, Human
uacucaugcaaauuucugcagcca

SEQ ID NO: 1119812 - RNA, 22 nt, Human
uacuuuuuguauuuuuaguaga

SEQ ID NO: 1119813 - RNA, 22 nt, Human
uagaaaugggguuucaccaugu

SEQ ID NO: 1119814 - RNA, 24 nt, Human
uaguagaaaugggguuucaccaug

SEQ ID NO: 1119815 - RNA, 26 nt, Human
uaguagaaaugggguuucaccauguu

SEQ ID NO: 1119816 - RNA, 24 nt, Human
uauauccaugaaucaacuauaguc

SEQ ID NO: 1119817 - RNA, 21 nt, Human
uaugagccuauaaaauccaaa

SEQ ID NO: 1119818 - RNA, 24 nt, Human
ucaaaacaaagaggcuacaggccc

SEQ ID NO: 1119819 - RNA, 26 nt, Human
ucaaaacaaagaggcuacaggcccau

SEQ ID NO: 1119820 - RNA, 22 nt, Human
ucaaaaccaaucacaccauccc

SEQ ID NO: 1119821 - RNA, 21 nt, Human
ucaaagacaucuuggaguuca

SEQ ID NO: 1119822 - RNA, 18 nt, Human
ucacauccaggucacgca

SEQ ID NO: 1119823 - RNA, 18 nt, Human
ucacugcaaccucugucu

SEQ ID NO: 1119824 - RNA, 19 nt, Human
ucacugcaaccucugucua

SEQ ID NO: 1119825 - RNA, 24 nt, Human
ucacugcaaccucugucuaccaug

SEQ ID NO: 1119826 - RNA, 28 nt, Human
ucacugcaaccucugucuagggcccucc

SEQ ID NO: 1119827 - RNA, 28 nt, Human
ucacugcaaccucugucuaggguccucc

SEQ ID NO: 1119828 - RNA, 24 nt, Human
ucauuccacccauggccccuccca

SEQ ID NO: 1119829 - RNA, 22 nt, Human
uccacccauggccccucccaaa

SEQ ID NO: 1119830 - RNA, 24 nt, Human
uccacccauggccccucccaaauu

SEQ ID NO: 1119831 - RNA, 19 nt, Human
uccacuagguggugcccca

SEQ ID NO: 1119832 - RNA, 25 nt, Human
uccagguacacggugcaagcuggcc

SEQ ID NO: 1119833 - RNA, 19 nt, Human
uccaugagggcccugcucc

SEQ ID NO: 1119834 - RNA, 20 nt, Human
ucccaaagccucagaaucag

SEQ ID NO: 1119835 - RNA, 23 nt, Human
ucccaaagugcugggauuacagg

SEQ ID NO: 1119836 - RNA, 23 nt, Human
uccguuuuuguuucaagccaccu

SEQ ID NO: 1119837 - RNA, 19 nt, Human
uccuggaguccugagaccc

SEQ ID NO: 1119838 - RNA, 18 nt, Human
ucggccucccaaagugcu

SEQ ID NO: 1119839 - RNA, 19 nt, Human
ucuccucagaaaaugggaa

SEQ ID NO: 1119840 - RNA, 25 nt, Human
ucuucuggaaauacccucacagaca

SEQ ID NO: 1119841 - RNA, 24 nt, Human
ucuugcuguguugcccagccugga

SEQ ID NO: 1119842 - RNA, 23 nt, Human
ugacaugcccuggagacauuuuc

SEQ ID NO: 1119843 - RNA, 18 nt, Human
ugaccccacauuucccuu

SEQ ID NO: 1119844 - RNA, 21 nt, Human
ugaccccacauuucccuucug

SEQ ID NO: 1119845 - RNA, 18 nt, Human
ugaccucaagugauccuc

SEQ ID NO: 1119846 - RNA, 20 nt, Human
ugaccucaagugauccuccu

SEQ ID NO: 1119847 - RNA, 21 nt, Human
ugaccucaagugauccuccug

SEQ ID NO: 1119848 - RNA, 24 nt, Human
ugaccucaagugauccuccugccu

SEQ ID NO: 1119849 - RNA, 20 nt, Human
ugacuaaaccauuagaaauu

SEQ ID NO: 1119850 - RNA, 22 nt, Human
ugacuccacaucucacauccag

SEQ ID NO: 1119851 - RNA, 23 nt, Human
ugacuccacaucucacauccagg

SEQ ID NO: 1119852 - RNA, 23 nt, Human
ugagacccaacagccugggaucc

SEQ ID NO: 1119853 - RNA, 19 nt, Human
ugagcacucaaguguauuc

SEQ ID NO: 1119854 - RNA, 19 nt, Human
ugaggaccccgggccuggc

SEQ ID NO: 1119855 - RNA, 25 nt, Human
ugaguuagaaagggcucacaugauu

SEQ ID NO: 1119856 - RNA, 24 nt, Human
ugaucuccuuugacuccacaucuc

SEQ ID NO: 1119857 - RNA, 21 nt, Human
ugauguagguccuggaguccu

SEQ ID NO: 1119858 - RNA, 24 nt, Human
ugcaagcuggagacccagggauac

SEQ ID NO: 1119859 - RNA, 23 nt, Human
ugcacucgcagucucaacaccac

SEQ ID NO: 1119860 - RNA, 22 nt, Human
ugcagagaaacucccccuuaau

SEQ ID NO: 1119861 - RNA, 22 nt, Human
ugcccagccuggagugcagugu

SEQ ID NO: 1119862 - RNA, 21 nt, Human
ugcccuggagacauuuucccc

SEQ ID NO: 1119863 - RNA, 21 nt, Human
ugccucggccucccaaagugc

SEQ ID NO: 1119864 - RNA, 24 nt, Human
ugccucggccucccaaagugcugg

SEQ ID NO: 1119865 - RNA, 24 nt, Human
ugcugggauuacaggugugagcca

SEQ ID NO: 1119866 - RNA, 18 nt, Human
ugcuguguugcccagccu

SEQ ID NO: 1119867 - RNA, 24 nt, Human
uggaagaaacagaaaacaaacaga

SEQ ID NO: 1119868 - RNA, 28 nt, Human
uggaagaaacagaaaacaaacagauaua

SEQ ID NO: 1119869 - RNA, 21 nt, Human
uggaagggguggguucccaug

SEQ ID NO: 1119870 - RNA, 24 nt, Human
uggaguccugagacccaacagccu

SEQ ID NO: 1119871 - RNA, 18 nt, Human
uggagucuugcuguguug

SEQ ID NO: 1119872 - RNA, 21 nt, Human
uggagugcaguguuaugauuc

SEQ ID NO: 1119873 - RNA, 23 nt, Human
uggagugcaguguuaugauuuug

SEQ ID NO: 1119874 - RNA, 24 nt, Human
uggagugcaguguuaugauuuugg

SEQ ID NO: 1119875 - RNA, 24 nt, Human
uggccaggauggucccgaacuccu

SEQ ID NO: 1119876 - RNA, 18 nt, Human
uggcugggaugcagggca

SEQ ID NO: 1119877 - RNA, 21 nt, Human
ugggaauuagcauuuggcucc

SEQ ID NO: 1119878 - RNA, 24 nt, Human
ugggauaaauuggucaaaacaaag

SEQ ID NO: 1119879 - RNA, 21 nt, Human
ugggaucacaggcacacgcca

SEQ ID NO: 1119880 - RNA, 22 nt, Human
ugggaucacaggcacacgccac

SEQ ID NO: 1119881 - RNA, 24 nt, Human
ugggaucacaggcacacgccacca

SEQ ID NO: 1119882 - RNA, 22 nt, Human
ugggaugcagggcaccaagucc

SEQ ID NO: 1119883 - RNA, 18 nt, Human
ugggauuacaggugugag

SEQ ID NO: 1119884 - RNA, 21 nt, Human
ugggauuacaggugugagcca

SEQ ID NO: 1119885 - RNA, 22 nt, Human
ugggauuacaggugugagccac

SEQ ID NO: 1119886 - RNA, 22 nt, Human
ugggauuacaggugugagccac

SEQ ID NO: 1119887 - RNA, 22 nt, Human
ugggauuacaggugugagccac

SEQ ID NO: 1119888 - RNA, 24 nt, Human
ugggauuacaggugugagccacug

SEQ ID NO: 1119889 - RNA, 20 nt, Human
uggggacacaaccaaacccu

SEQ ID NO: 1119890 - RNA, 21 nt, Human
uggggacacaaccaaacccua

SEQ ID NO: 1119891 - RNA, 24 nt, Human
ugggguuucaccauguuggccagg

SEQ ID NO: 1119892 - RNA, 18 nt, Human
uggguucccauggucuug

SEQ ID NO: 1119893 - RNA, 20 nt, Human
uggucccgaacuccugaccu

SEQ ID NO: 1119894 - RNA, 21 nt, Human
uguauuuuuaguagaaauggg

SEQ ID NO: 1119895 - RNA, 24 nt, Human
uguguugcccagccuggagugcag

SEQ ID NO: 1119896 - RNA, 24 nt, Human
uuagcccaaaggccuuagaacccc

SEQ ID NO: 1119897 - RNA, 18 nt, Human
uuaguagaaaugggguuu

SEQ ID NO: 1119898 - RNA, 22 nt, Human
uuaguagaaaugggguuucacc

SEQ ID NO: 1119899 - RNA, 24 nt, Human
uuaguagaaaugggguuucaccau

SEQ ID NO: 1119900 - RNA, 24 nt, Human
uucaagcgauucucccaccucugc

SEQ ID NO: 1119901 - RNA, 24 nt, Human
uucaggaugagauuugggugggga

SEQ ID NO: 1119902 - RNA, 22 nt, Human
uuccacccauggccccucccaa

SEQ ID NO: 1119903 - RNA, 22 nt, Human
uuccagguacacggugcaagcu

SEQ ID NO: 1119904 - RNA, 24 nt, Human
uugcccagccuggagugcaguguu

SEQ ID NO: 1119905 - RNA, 23 nt, Human
uuguauuuuuaguagaaaugggg

SEQ ID NO: 1119906 - RNA, 19 nt, Human
uuucaccauguuggccagg

SEQ ID NO: 1119907 - RNA, 20 nt, Human
uuucaccauguuggccagga

SEQ ID NO: 1119908 - RNA, 24 nt, Human
uuuccaguucucuagguauucuuu

SEQ ID NO: 1119909 - RNA, 24 nt, Human
uuuuuaguagaaaugggguuucac

SEQ ID NO: 1119910 - RNA, 19 nt, Human
uuuuuguauuuuuaguaga

SEQ ID NO: 1119911 - RNA, 24 nt, Human
aaaccacuuaaggaaacaaagccc

SEQ ID NO: 1119912 - RNA, 19 nt, Human
aaagugcuaggauuacagg

SEQ ID NO: 1119913 - RNA, 24 nt, Human
aaagugcuaggauuacaggcauga

SEQ ID NO: 1119914 - RNA, 20 nt, Human
aacagugcagaguaagggga

SEQ ID NO: 1119915 - RNA, 24 nt, Human
aacgaguuucgaacuccugaccuc

SEQ ID NO: 1119916 - RNA, 19 nt, Human
aagaaaaggaaaaaaaccc

SEQ ID NO: 1119917 - RNA, 18 nt, Human
aagaauuccggagucggu

SEQ ID NO: 1119918 - RNA, 21 nt, Human
aagcucuuagcgcucaggucu

SEQ ID NO: 1119919 - RNA, 26 nt, Human
aagugcuaggauuacaggcaugagcc

SEQ ID NO: 1119920 - RNA, 22 nt, Human
acacggcucgcccugcgucucc

SEQ ID NO: 1119921 - RNA, 20 nt, Human
accacuuaaggaaacaaagc

SEQ ID NO: 1119922 - RNA, 21 nt, Human
acggguuucaccauguuggcc

SEQ ID NO: 1119923 - RNA, 23 nt, Human
acggguuucaccauguuggccug

SEQ ID NO: 1119924 - RNA, 24 nt, Human
acggguuucaccauguuggccugg

SEQ ID NO: 1119925 - RNA, 20 nt, Human
agaaaagagcuucuggaaua

SEQ ID NO: 1119926 - RNA, 27 nt, Human
agagagcggaggcgguggugguggcgg

SEQ ID NO: 1119927 - RNA, 22 nt, Human
agaguaaggggauagaggagga

SEQ ID NO: 1119928 - RNA, 18 nt, Human
aggcaggugcuagaucag

SEQ ID NO: 1119929 - RNA, 21 nt, Human
aggcgguggugguggcggccg

SEQ ID NO: 1119930 - RNA, 21 nt, Human
agguguugagauuacaaagau

SEQ ID NO: 1119931 - RNA, 19 nt, Human
aguaaggggauagaggagg

SEQ ID NO: 1119932 - RNA, 20 nt, Human
aguaaggggauagaggagga

SEQ ID NO: 1119933 - RNA, 18 nt, Human
aucugugugucucucccc

SEQ ID NO: 1119934 - RNA, 26 nt, Human
caaaaacggcaaaacuggccaucauc

SEQ ID NO: 1119935 - RNA, 24 nt, Human
caaagugcuaggauuacaggcaug

SEQ ID NO: 1119936 - RNA, 18 nt, Human
caacucuggguagccccu

SEQ ID NO: 1119937 - RNA, 26 nt, Human
caagacgggaagcgggcugcugagcc

SEQ ID NO: 1119938 - RNA, 19 nt, Human
caaguucccaggcccagca

SEQ ID NO: 1119939 - RNA, 18 nt, Human
caccauguuggccugguu

SEQ ID NO: 1119940 - RNA, 21 nt, Human
cacccccccucccuugaccua

SEQ ID NO: 1119941 - RNA, 23 nt, Human
cacccccccucccuugaccuacc

SEQ ID NO: 1119942 - RNA, 22 nt, Human
cacccggcccacucuugggaac

SEQ ID NO: 1119943 - RNA, 22 nt, Human
cagaaaagagcuucuggaauag

SEQ ID NO: 1119944 - RNA, 20 nt, Human
cagaagaaauccuuguggca

SEQ ID NO: 1119945 - RNA, 22 nt, Human
caggcgccucucgcucuguuuu

SEQ ID NO: 1119946 - RNA, 22 nt, Human
cauuccaagaaaaggaaaaaaa

SEQ ID NO: 1119947 - RNA, 19 nt, Human
ccaaagugcuaggauuaca

SEQ ID NO: 1119948 - RNA, 24 nt, Human
ccaaagugcuaggauuacaggcau

SEQ ID NO: 1119949 - RNA, 19 nt, Human
ccaaguucccaggcccagc

SEQ ID NO: 1119950 - RNA, 18 nt, Human
ccacauccgccucccaaa

SEQ ID NO: 1119951 - RNA, 21 nt, Human
ccaggcccagcaccuuguacg

SEQ ID NO: 1119952 - RNA, 25 nt, Human
ccaugugugcgcuccuauuucuccc

SEQ ID NO: 1119953 - RNA, 22 nt, Human
cccagcaccuuguacggaaggc

SEQ ID NO: 1119954 - RNA, 20 nt, Human
cccauuuggucccuguuagu

SEQ ID NO: 1119955 - RNA, 19 nt, Human
ccccaagagccagccgcac

SEQ ID NO: 1119956 - RNA, 19 nt, Human
ccccagccggacacccccc

SEQ ID NO: 1119957 - RNA, 22 nt, Human
ccccaucccaaguucccaggcc

SEQ ID NO: 1119958 - RNA, 25 nt, Human
cccccaagagccagccgcacaguuc

SEQ ID NO: 1119959 - RNA, 19 nt, Human
cccccucccccaucccaag

SEQ ID NO: 1119960 - RNA, 21 nt, Human
ccccuaaggaugggccugacc

SEQ ID NO: 1119961 - RNA, 22 nt, Human
ccccucccccaucccaaguucc

SEQ ID NO: 1119962 - RNA, 18 nt, Human
cccggcccacucuuggga

SEQ ID NO: 1119963 - RNA, 22 nt, Human
cccgugcuuguaacugccccag

SEQ ID NO: 1119964 - RNA, 20 nt, Human
cccuaaggaugggccugacc

SEQ ID NO: 1119965 - RNA, 21 nt, Human
cccugcgucuccccgucaccu

SEQ ID NO: 1119966 - RNA, 22 nt, Human
ccgcccacauccgccucccaaa

SEQ ID NO: 1119967 - RNA, 21 nt, Human
ccggcccacucuugggaaccu

SEQ ID NO: 1119968 - RNA, 19 nt, Human
ccuaaggaugggccugacc

SEQ ID NO: 1119969 - RNA, 28 nt, Human
ccucagggccaccgcgcaaugugucccc

SEQ ID NO: 1119970 - RNA, 23 nt, Human
ccucagucuucucgagcacaucg

SEQ ID NO: 1119971 - RNA, 22 nt, Human
ccuccuccuaugcucccaaccc

SEQ ID NO: 1119972 - RNA, 19 nt, Human
ccugaccucaagugauccg

SEQ ID NO: 1119973 - RNA, 24 nt, Human
ccugaccucaagugauccgcccac

SEQ ID NO: 1119974 - RNA, 23 nt, Human
ccugcgcccccccucgcuuccca

SEQ ID NO: 1119975 - RNA, 21 nt, Human
ccuuguacggaaggcggaggu

SEQ ID NO: 1119976 - RNA, 20 nt, Human
cgacccgaagucaucgcugg

SEQ ID NO: 1119977 - RNA, 19 nt, Human
cgauaguauagaaaccacu

SEQ ID NO: 1119978 - RNA, 18 nt, Human
cgcaggcgccucucgcuc

SEQ ID NO: 1119979 - RNA, 22 nt, Human
cgcccccccucgcuucccagcc

SEQ ID NO: 1119980 - RNA, 25 nt, Human
cgcccugcgucuccccgucaccuca

SEQ ID NO: 1119981 - RNA, 23 nt, Human
cgcucuguuuuccguuggccuua

SEQ ID NO: 1119982 - RNA, 22 nt, Human
cggcguuggugguggcagugga

SEQ ID NO: 1119983 - RNA, 24 nt, Human
cgggaagcgggcugcugagccucg

SEQ ID NO: 1119984 - RNA, 24 nt, Human
cucaagugauccgcccacauccgc

SEQ ID NO: 1119985 - RNA, 22 nt, Human
cucaggucagcccugguguugc

SEQ ID NO: 1119986 - RNA, 24 nt, Human
cucccccaucccaaguucccaggc

SEQ ID NO: 1119987 - RNA, 21 nt, Human
cucccuugaccuacccggucu

SEQ ID NO: 1119988 - RNA, 22 nt, Human
cucucaggggaaaaugggccuc

SEQ ID NO: 1119989 - RNA, 20 nt, Human
cucuggguagccccuaacuc

SEQ ID NO: 1119990 - RNA, 23 nt, Human
cucuucagaaaagagcuucugga

SEQ ID NO: 1119991 - RNA, 23 nt, Human
cuggccaucauccaggaaguggc

SEQ ID NO: 1119992 - RNA, 19 nt, Human
cuucccagccgguuucccc

SEQ ID NO: 1119993 - RNA, 20 nt, Human
cuuugugcuguagcccucuu

SEQ ID NO: 1119994 - RNA, 21 nt, Human
cuuugugcuguagcccucuuc

SEQ ID NO: 1119995 - RNA, 24 nt, Human
gaccucaagugauccgcccacauc

SEQ ID NO: 1119996 - RNA, 21 nt, Human
gaguuucgaacuccugaccuc

SEQ ID NO: 1119997 - RNA, 25 nt, Human
gauggcggcggcguuggugguggca

SEQ ID NO: 1119998 - RNA, 18 nt, Human
gauuacaggcaugagcca

SEQ ID NO: 1119999 - RNA, 22 nt, Human
gauuacaggcaugagccaccgc

SEQ ID NO: 1120000 - RNA, 22 nt, Human
gauuacaggcaugagccaccgc

SEQ ID NO: 1120001 - RNA, 22 nt, Human
gcccacucuugggaaccuuuac

SEQ ID NO: 1120002 - RNA, 22 nt, Human
gcggcggcguuggugguggcag

SEQ ID NO: 1120003 - RNA, 18 nt, Human
gcggcugggccuggaaca

SEQ ID NO: 1120004 - RNA, 24 nt, Human
ggaaacggggauuuucagaagaaa

SEQ ID NO: 1120005 - RNA, 19 nt, Human
ggacucucaggggaaaaug

SEQ ID NO: 1120006 - RNA, 22 nt, Human
ggauuacaggcaugagccaccg

SEQ ID NO: 1120007 - RNA, 20 nt, Human
ggcaaaacuggccaucaucc

SEQ ID NO: 1120008 - RNA, 19 nt, Human
gggaaccuuuacccacacc

SEQ ID NO: 1120009 - RNA, 23 nt, Human
gguguugagauuacaaagaugau

SEQ ID NO: 1120010 - RNA, 20 nt, Human
guagagacggguuucaccau

SEQ ID NO: 1120011 - RNA, 21 nt, Human
guagagacggguuucaccaug

SEQ ID NO: 1120012 - RNA, 22 nt, Human
guaggguccuccuuagaggcaa

SEQ ID NO: 1120013 - RNA, 20 nt, Human
gugguggcaguggacggggc

SEQ ID NO: 1120014 - RNA, 19 nt, Human
guggugguggcggccgcug

SEQ ID NO: 1120015 - RNA, 21 nt, Human
guguugagauuacaaagauga

SEQ ID NO: 1120016 - RNA, 22 nt, Human
uaaaaacacaguccuugcccuc

SEQ ID NO: 1120017 - RNA, 22 nt, Human
uaagccccgccccuugugcguc

SEQ ID NO: 1120018 - RNA, 21 nt, Human
uaaggaaacaaagcccugaaa

SEQ ID NO: 1120019 - RNA, 23 nt, Human
uaaggaaacaaagcccugaaagg

SEQ ID NO: 1120020 - RNA, 18 nt, Human
uaaggggauagaggagga

SEQ ID NO: 1120021 - RNA, 23 nt, Human
uacaggcaugagccaccgcgccc

SEQ ID NO: 1120022 - RNA, 21 nt, Human
uagagacggguuucaccaugu

SEQ ID NO: 1120023 - RNA, 18 nt, Human
uaggauuacaggcaugag

SEQ ID NO: 1120024 - RNA, 21 nt, Human
uaggauuacaggcaugagcca

SEQ ID NO: 1120025 - RNA, 22 nt, Human
uaggauuacaggcaugagccac

SEQ ID NO: 1120026 - RNA, 23 nt, Human
uaggauuacaggcaugagccacc

SEQ ID NO: 1120027 - RNA, 24 nt, Human
uaggauuacaggcaugagccaccg

SEQ ID NO: 1120028 - RNA, 24 nt, Human
uaggauuacaggcaugagccaccg

SEQ ID NO: 1120029 - RNA, 22 nt, Human
uauagaaaccacuuaaggaaac

SEQ ID NO: 1120030 - RNA, 23 nt, Human
uauagaaaccacuuaaggaaaca

SEQ ID NO: 1120031 - RNA, 28 nt, Human
uaucuuaguuuaccuccucuaacuccca

SEQ ID NO: 1120032 - RNA, 20 nt, Human
ucaagcuacugagccccuuc

SEQ ID NO: 1120033 - RNA, 19 nt, Human
ucaccauguuggccugguu

SEQ ID NO: 1120034 - RNA, 19 nt, Human
uccaagaaaaggaaaaaaa

SEQ ID NO: 1120035 - RNA, 21 nt, Human
uccaagaaaaggaaaaaaacc

SEQ ID NO: 1120036 - RNA, 24 nt, Human
ucccaaagugcuaggauuacaggc

SEQ ID NO: 1120037 - RNA, 18 nt, Human
ucccaaguucccaggccc

SEQ ID NO: 1120038 - RNA, 23 nt, Human
uccggagucgguuguugucuugu

SEQ ID NO: 1120039 - RNA, 23 nt, Human
ucguagagacggguuucaccaug

SEQ ID NO: 1120040 - RNA, 21 nt, Human
ucucgcucuguuuuccguugg

SEQ ID NO: 1120041 - RNA, 18 nt, Human
ugacaguaaggcuaguga

SEQ ID NO: 1120042 - RNA, 20 nt, Human
ugacccaagacgggaagcgg

SEQ ID NO: 1120043 - RNA, 18 nt, Human
ugaccucaagugauccgc

SEQ ID NO: 1120044 - RNA, 19 nt, Human
ugaggcuagagcagagcua

SEQ ID NO: 1120045 - RNA, 25 nt, Human
ugcccccaagagccagccgcacugc

SEQ ID NO: 1120046 - RNA, 22 nt, Human
uggcagcgcaggcgcaagcgca

SEQ ID NO: 1120047 - RNA, 20 nt, Human
uggccuuaagccccgccccu

SEQ ID NO: 1120048 - RNA, 19 nt, Human
uggcggccgcuggccagug

SEQ ID NO: 1120049 - RNA, 20 nt, Human
uggcggcggcguugguggug

SEQ ID NO: 1120050 - RNA, 21 nt, Human
uggcggcggcguugguggugg

SEQ ID NO: 1120051 - RNA, 21 nt, Human
ugggaggagaugaaucagaua

SEQ ID NO: 1120052 - RNA, 27 nt, Human
uggugguggcaguggacggggcggcug

SEQ ID NO: 1120053 - RNA, 19 nt, Human
ugucuuguggucuuguacc

SEQ ID NO: 1120054 - RNA, 18 nt, Human
uguggucuuguacccuuu

SEQ ID NO: 1120055 - RNA, 20 nt, Human
uguuuagaguaucacaagau

SEQ ID NO: 1120056 - RNA, 24 nt, Human
uuaucugugugucucuccccuccu

SEQ ID NO: 1120057 - RNA, 24 nt, Human
uucaaaaacggcaaaacuggccau

SEQ ID NO: 1120058 - RNA, 20 nt, Human
uuccaagaaaaggaaaaaaa

SEQ ID NO: 1120059 - RNA, 23 nt, Human
uucguagagacggguuucaccau

SEQ ID NO: 1120060 - RNA, 23 nt, Human
uucguugggugacccaugugugc

SEQ ID NO: 1120061 - RNA, 20 nt, Human
uugcuucguugggugaccca

SEQ ID NO: 1120062 - RNA, 23 nt, Human
uuuauuaugugaugggaauugga

SEQ ID NO: 1120063 - RNA, 27 nt, Human
uuuauuuuuuuuuuuuuuuguauuuuu

SEQ ID NO: 1120064 - RNA, 19 nt, Human
uuucaccauguuggccugg

SEQ ID NO: 1120065 - RNA, 21 nt, Human
uuucgaacuccugaccucaag

SEQ ID NO: 1120066 - RNA, 25 nt, Human
uuuucagaagaaauccuuguggcaa

SEQ ID NO: 1120067 - RNA, 23 nt, Human
uuuuucguagagacggguuucac

SEQ ID NO: 1120068 - RNA, 24 nt, Human
uuuuuuguauuuuucguagagacg

SEQ ID NO: 1120069 - RNA, 20 nt, Human
agaacuucccgagccagcau

SEQ ID NO: 1120070 - RNA, 21 nt, Human
cagaacuucccgagccagcau

SEQ ID NO: 1120071 - RNA, 22 nt, Human
cagcagcagccugcucuucuuu

SEQ ID NO: 1120072 - RNA, 19 nt, Human
gaucaggcacgaccuccca

SEQ ID NO: 1120073 - RNA, 20 nt, Human
ucccgagccagcauccauca

SEQ ID NO: 1120074 - RNA, 23 nt, Human
ucccuuuaaguuaugacgggaau

SEQ ID NO: 1120075 - RNA, 24 nt, Human
ucucuucaggaucuuuguagaagu

SEQ ID NO: 1120076 - RNA, 22 nt, Human
uguagaaguagagaucaggcac

SEQ ID NO: 1120077 - RNA, 19 nt, Human
ccccgcugcacugguguca

SEQ ID NO: 1120078 - RNA, 19 nt, Human
ccuccgggcccccccccgc

SEQ ID NO: 1120079 - RNA, 20 nt, Human
ccuccgggcccccccccgcu

SEQ ID NO: 1120080 - RNA, 22 nt, Human
gccuccgggcccccccccgcug

SEQ ID NO: 1120081 - RNA, 20 nt, Human
uaauucgcuuuauuuuccuu

SEQ ID NO: 1120082 - RNA, 19 nt, Human
aacccgggugcuggcacag

SEQ ID NO: 1120083 - RNA, 20 nt, Human
agcagccagggaucugacag

SEQ ID NO: 1120084 - RNA, 20 nt, Human
agcagccagggaucugacag

SEQ ID NO: 1120085 - RNA, 22 nt, Human
agggagcuggggucuguguagc

SEQ ID NO: 1120086 - RNA, 20 nt, Human
agggccaggccgggcccgcu

SEQ ID NO: 1120087 - RNA, 20 nt, Human
cgucagaggggggcuccgga

SEQ ID NO: 1120088 - RNA, 19 nt, Human
cgugucuaggugggugcgc

SEQ ID NO: 1120089 - RNA, 23 nt, Human
cugaaggccuucuggcaacccgg

SEQ ID NO: 1120090 - RNA, 19 nt, Human
gaaggccuucuggcaaccc

SEQ ID NO: 1120091 - RNA, 24 nt, Human
gggccaggccgggcccgcuuggaa

SEQ ID NO: 1120092 - RNA, 19 nt, Human
uagcgcuuggagcagccag

SEQ ID NO: 1120093 - RNA, 20 nt, Human
ucgcuggaguugcugaaggc

SEQ ID NO: 1120094 - RNA, 18 nt, Human
ugggaggagcggaugaug

SEQ ID NO: 1120095 - RNA, 19 nt, Human
ugggaggagcggaugaugg

SEQ ID NO: 1120096 - RNA, 20 nt, Human
ugggaggagcggaugaugga

SEQ ID NO: 1120097 - RNA, 24 nt, Human
uggggucuguguagcgcuuggagc

SEQ ID NO: 1120098 - RNA, 28 nt, Human
ugggugcgcuggugcuugggggucuccu

SEQ ID NO: 1120099 - RNA, 22 nt, Human
uucuggcaacccgggugcuggc

SEQ ID NO: 1120100 - RNA, 19 nt, Human
uuuacacaggugaccagag

SEQ ID NO: 1120101 - RNA, 19 nt, Human
aaaaaaagauauaacagga

SEQ ID NO: 1120102 - RNA, 23 nt, Human
aaagaaaaaaagauauaacagga

SEQ ID NO: 1120103 - RNA, 26 nt, Human
aagaaaaaaagauauaacaggaaugu

SEQ ID NO: 1120104 - RNA, 18 nt, Human
acuaccacaauuuacagg

SEQ ID NO: 1120105 - RNA, 19 nt, Human
acucccaccaccagaucca

SEQ ID NO: 1120106 - RNA, 21 nt, Human
agaaaaaaagauauaacagga

SEQ ID NO: 1120107 - RNA, 24 nt, Human
agauccauaaccaccaucauaggg

SEQ ID NO: 1120108 - RNA, 18 nt, Human
auuaccuccaccaccucc

SEQ ID NO: 1120109 - RNA, 22 nt, Human
caccaaaguuuccaccacagcc

SEQ ID NO: 1120110 - RNA, 22 nt, Human
caccaccagauccauaaccacc

SEQ ID NO: 1120111 - RNA, 24 nt, Human
caccagauccauaaccaccaucau

SEQ ID NO: 1120112 - RNA, 22 nt, Human
ccaaaguuuccaccacagccaa

SEQ ID NO: 1120113 - RNA, 20 nt, Human
ccacucccaccaccagaucc

SEQ ID NO: 1120114 - RNA, 21 nt, Human
cccaccaccagauccauaacc

SEQ ID NO: 1120115 - RNA, 24 nt, Human
cccaccaccagauccauaaccacc

SEQ ID NO: 1120116 - RNA, 27 nt, Human
ccugcagcuuuccugacaacuccuugc

SEQ ID NO: 1120117 - RNA, 19 nt, Human
ccuucugcuaccauaucua

SEQ ID NO: 1120118 - RNA, 23 nt, Human
cuaccacucccaccaccagaucc

SEQ ID NO: 1120119 - RNA, 23 nt, Human
cuccaccaaaguuuccaccacag

SEQ ID NO: 1120120 - RNA, 25 nt, Human
cugacuauggaucauugcuccuucu

SEQ ID NO: 1120121 - RNA, 24 nt, Human
cugauguaaugaaaagaaaaaaag

SEQ ID NO: 1120122 - RNA, 22 nt, Human
cugcuguuuuuagaaccuucug

SEQ ID NO: 1120123 - RNA, 20 nt, Human
gccaaaauuaccuccaccac

SEQ ID NO: 1120124 - RNA, 27 nt, Human
gccuccuccuccaccaaaguuuccacc

SEQ ID NO: 1120125 - RNA, 22 nt, Human
uaagcugcaguaacuuuucuga

SEQ ID NO: 1120126 - RNA, 18 nt, Human
uaaucaguagcugcacuu

SEQ ID NO: 1120127 - RNA, 18 nt, Human
uagcugcacuuuuuggaa

SEQ ID NO: 1120128 - RNA, 18 nt, Human
uccugacaacuccuugcu

SEQ ID NO: 1120129 - RNA, 21 nt, Human
uggcugugucaguccugaaca

SEQ ID NO: 1120130 - RNA, 21 nt, Human
ugucucaaaguaaccugcagc

SEQ ID NO: 1120131 - RNA, 18 nt, Human
uuuuuuuuuuuuuuuuug

SEQ ID NO: 1120132 - RNA, 20 nt, Human
augcugcccaagaggcaggg

SEQ ID NO: 1120133 - RNA, 24 nt, Human
caacggcgagcacggucgccuccc

SEQ ID NO: 1120134 - RNA, 25 nt, Human
cagcuuggcggagacagguagucag

SEQ ID NO: 1120135 - RNA, 26 nt, Human
cgccgccaacccuagccugccaacgg

SEQ ID NO: 1120136 - RNA, 19 nt, Human
cgccucccgugccgcuucc

SEQ ID NO: 1120137 - RNA, 26 nt, Human
cuggagguuuucauacagagaacugg

SEQ ID NO: 1120138 - RNA, 21 nt, Human
gagcacggucgccucccgugc

SEQ ID NO: 1120139 - RNA, 18 nt, Human
ggaugcugcccaagaggc

SEQ ID NO: 1120140 - RNA, 20 nt, Human
ggcgagcacggucgccuccc

SEQ ID NO: 1120141 - RNA, 21 nt, Human
ugccaacggcgagcacggucc

SEQ ID NO: 1120142 - RNA, 22 nt, Human
ugccaacggcgagcacggucgc

SEQ ID NO: 1120143 - RNA, 23 nt, Human
ugccaacggcgagcacggucgcc

SEQ ID NO: 1120144 - RNA, 22 nt, Human
ugcugcccaagaggcagggaca

SEQ ID NO: 1120145 - RNA, 18 nt, Human
uggcggagacagguaguc

SEQ ID NO: 1120146 - RNA, 22 nt, Human
ugggaaggugauguccacgaug

SEQ ID NO: 1120147 - RNA, 27 nt, Human
uuggacucucaggggcuuucccuccgg

SEQ ID NO: 1120148 - RNA, 21 nt, Human
ugggagaacuugccgagcgcc

SEQ ID NO: 1120149 - RNA, 18 nt, Human
aaaauaacuuuggacaaa

SEQ ID NO: 1120150 - RNA, 20 nt, Human
aacaacacacacuagcaaaa

SEQ ID NO: 1120151 - RNA, 21 nt, Human
aaggugucucuaaaagggaca

SEQ ID NO: 1120152 - RNA, 21 nt, Human
aauaauagacacaggcaggga

SEQ ID NO: 1120153 - RNA, 19 nt, Human
aaugacaacaacaaaaaga

SEQ ID NO: 1120154 - RNA, 20 nt, Human
aauugucaagagcaguuggu

SEQ ID NO: 1120155 - RNA, 21 nt, Human
acacugaagauacaaagaaug

SEQ ID NO: 1120156 - RNA, 19 nt, Human
acuauaguuucauucaaau

SEQ ID NO: 1120157 - RNA, 21 nt, Human
agagcugaccuguccucuaua

SEQ ID NO: 1120158 - RNA, 19 nt, Human
agaguccugggugacaugc

SEQ ID NO: 1120159 - RNA, 23 nt, Human
agcaguuggugguucugaaauac

SEQ ID NO: 1120160 - RNA, 19 nt, Human
aggcagaaacaguuuccca

SEQ ID NO: 1120161 - RNA, 23 nt, Human
auagagccaugcccacugaccca

SEQ ID NO: 1120162 - RNA, 25 nt, Human
augacaacaacaaaaagaugaggaa

SEQ ID NO: 1120163 - RNA, 22 nt, Human
auugucucugcaguguucccgg

SEQ ID NO: 1120164 - RNA, 24 nt, Human
caaaaacaaaggcacaguaaacaa

SEQ ID NO: 1120165 - RNA, 27 nt, Human
caacacacacuagcaaaaacaaaggca

SEQ ID NO: 1120166 - RNA, 22 nt, Human
caauugcccaggcuuugcugaa

SEQ ID NO: 1120167 - RNA, 19 nt, Human
cacagggugccacuggcau

SEQ ID NO: 1120168 - RNA, 21 nt, Human
cacaguuaugugaacguguca

SEQ ID NO: 1120169 - RNA, 21 nt, Human
caccggcagaguccuggguga

SEQ ID NO: 1120170 - RNA, 20 nt, Human
cacuguuuaucucuugucug

SEQ ID NO: 1120171 - RNA, 19 nt, Human
cagacaacuucagaaugua

SEQ ID NO: 1120172 - RNA, 18 nt, Human
cagcauugucucugcagg

SEQ ID NO: 1120173 - RNA, 19 nt, Human
cagcauugucucugcagug

SEQ ID NO: 1120174 - RNA, 25 nt, Human
cagcggcuccugacuccuguucucu

SEQ ID NO: 1120175 - RNA, 21 nt, Human
caugugcugcacaguuaugug

SEQ ID NO: 1120176 - RNA, 20 nt, Human
ccaauggggaucauuccuuc

SEQ ID NO: 1120177 - RNA, 22 nt, Human
cccaaaauaucucuucuccuuu

SEQ ID NO: 1120178 - RNA, 26 nt, Human
ccccuccuuaaccaaguaaccagucc

SEQ ID NO: 1120179 - RNA, 21 nt, Human
cguagagauaugaauauaaua

SEQ ID NO: 1120180 - RNA, 23 nt, Human
cuaaaacaauucaacacugaaga

SEQ ID NO: 1120181 - RNA, 25 nt, Human
cuaaaacaauucaacacugaagaua

SEQ ID NO: 1120182 - RNA, 19 nt, Human
cuaacuuggguccauuguc

SEQ ID NO: 1120183 - RNA, 21 nt, Human
cuaagcguuuucugcaagaac

SEQ ID NO: 1120184 - RNA, 24 nt, Human
cuauagguccugccugcaggaaug

SEQ ID NO: 1120185 - RNA, 22 nt, Human
cugaccuugagcagguauagaa

SEQ ID NO: 1120186 - RNA, 26 nt, Human
cugcauuccaauugcccaggcuuugc

SEQ ID NO: 1120187 - RNA, 20 nt, Human
cuguggucuuccuaaguacu

SEQ ID NO: 1120188 - RNA, 18 nt, Human
cuuucccaauacaucuaa

SEQ ID NO: 1120189 - RNA, 18 nt, Human
gaagacauuuucagacaa

SEQ ID NO: 1120190 - RNA, 22 nt, Human
gaccuucucugcccgcagaugg

SEQ ID NO: 1120191 - RNA, 20 nt, Human
gcugaaacacaggcacccua

SEQ ID NO: 1120192 - RNA, 25 nt, Human
ggauggaaucgagaggagcagggcu

SEQ ID NO: 1120193 - RNA, 26 nt, Human
ggcuaaggccucccaaugcuguuugu

SEQ ID NO: 1120194 - RNA, 23 nt, Human
gggguucaaaauaacuaaagaaa

SEQ ID NO: 1120195 - RNA, 21 nt, Human
guacaacaucaucaaggcaga

SEQ ID NO: 1120196 - RNA, 25 nt, Human
gugguucugaaauacaauccucagc

SEQ ID NO: 1120197 - RNA, 18 nt, Human
uaacuaaagaaaugcagc

SEQ ID NO: 1120198 - RNA, 22 nt, Human
uaacuaaagaaaugcagcuaua

SEQ ID NO: 1120199 - RNA, 22 nt, Human
uacaacaucaucaaggcagaaa

SEQ ID NO: 1120200 - RNA, 22 nt, Human
uagagccaugcccacugacccc

SEQ ID NO: 1120201 - RNA, 19 nt, Human
uagcaaaaacaaaggcaca

SEQ ID NO: 1120202 - RNA, 21 nt, Human
uagcaaaaacaaaggcacagu

SEQ ID NO: 1120203 - RNA, 22 nt, Human
uagcuguggucuuccuaaguac

SEQ ID NO: 1120204 - RNA, 24 nt, Human
uaggaauagagccaugcccacuga

SEQ ID NO: 1120205 - RNA, 21 nt, Human
uaggcaaaagcuuuuaauugu

SEQ ID NO: 1120206 - RNA, 24 nt, Human
uagguucauugaaaccaggguaac

SEQ ID NO: 1120207 - RNA, 23 nt, Human
uauuccucacuguuuaucucuug

SEQ ID NO: 1120208 - RNA, 23 nt, Human
ucaaaauaacuaaagaaaugcag

SEQ ID NO: 1120209 - RNA, 24 nt, Human
ucaccaccaucaaugacaacaaca

SEQ ID NO: 1120210 - RNA, 25 nt, Human
ucagagacaugacugcaaaaugaaa

SEQ ID NO: 1120211 - RNA, 18 nt, Human
ucauucaaaucuucacgu

SEQ ID NO: 1120212 - RNA, 21 nt, Human
ucauugaaaccaggguaacac

SEQ ID NO: 1120213 - RNA, 18 nt, Human
ucccggcaugugcugcac

SEQ ID NO: 1120214 - RNA, 25 nt, Human
ucuauaaacaaguccaugucaccac

SEQ ID NO: 1120215 - RNA, 19 nt, Human
ucucucggcuuaguaaggg

SEQ ID NO: 1120216 - RNA, 27 nt, Human
ugaaacacaggcacccuagucucaccu

SEQ ID NO: 1120217 - RNA, 21 nt, Human
ugaaaccaggguaacaccuuu

SEQ ID NO: 1120218 - RNA, 21 nt, Human
ugaaauacaauccucagccaa

SEQ ID NO: 1120219 - RNA, 18 nt, Human
ugaaaucccugaggaacu

SEQ ID NO: 1120220 - RNA, 21 nt, Human
ugaauauaauaauagacacag

SEQ ID NO: 1120221 - RNA, 24 nt, Human
ugacaacaacaaaaagaugaggaa

SEQ ID NO: 1120222 - RNA, 18 nt, Human
ugacaugcugucuccugc

SEQ ID NO: 1120223 - RNA, 24 nt, Human
ugacaugcugucuccugccagcgg

SEQ ID NO: 1120224 - RNA, 18 nt, Human
ugagccagagagcugacc

SEQ ID NO: 1120225 - RNA, 24 nt, Human
ugaggaacuuuguagcuacccaga

SEQ ID NO: 1120226 - RNA, 18 nt, Human
ugccacagacccgugucu

SEQ ID NO: 1120227 - RNA, 21 nt, Human
ugcugauggacaaacuagacc

SEQ ID NO: 1120228 - RNA, 21 nt, Human
ugcugcacaguuaugugaacg

SEQ ID NO: 1120229 - RNA, 22 nt, Human
uggaaacucacagcauugucuc

SEQ ID NO: 1120230 - RNA, 20 nt, Human
uggaauacaggacauuucua

SEQ ID NO: 1120231 - RNA, 21 nt, Human
ugucaagagcaguuggugguu

SEQ ID NO: 1120232 - RNA, 19 nt, Human
uguguuaaagauggaucag

SEQ ID NO: 1120233 - RNA, 20 nt, Human
uuaaugguagucaugaaguc

SEQ ID NO: 1120234 - RNA, 20 nt, Human
uugaaaaccacccucccaaa

SEQ ID NO: 1120235 - RNA, 22 nt, Human
uuugaaaaccacccucccaaau

SEQ ID NO: 1120236 - RNA, 22 nt, Human
uuugcugaaacacaggcacccu

SEQ ID NO: 1120237 - RNA, 20 nt, Human
uuuuguugugugauuugugg

SEQ ID NO: 1120238 - RNA, 21 nt, Human
aaaaaaccuauuguccauguc

SEQ ID NO: 1120239 - RNA, 21 nt, Human
aaaguaaaaaaccuauugucc

SEQ ID NO: 1120240 - RNA, 19 nt, Human
aagcguuuucugcaagaac

SEQ ID NO: 1120241 - RNA, 20 nt, Human
aaggaucccuccuguguuac

SEQ ID NO: 1120242 - RNA, 21 nt, Human
aaggugucucuaaaagggaca

SEQ ID NO: 1120243 - RNA, 21 nt, Human
aauaauagacacaggcaggga

SEQ ID NO: 1120244 - RNA, 20 nt, Human
aauugucaagagcaguuggu

SEQ ID NO: 1120245 - RNA, 21 nt, Human
acacugaagacacaaagaaug

SEQ ID NO: 1120246 - RNA, 18 nt, Human
acagcugaccuguccucu

SEQ ID NO: 1120247 - RNA, 21 nt, Human
acaguaaaaauugagacccaa

SEQ ID NO: 1120248 - RNA, 22 nt, Human
acaguaaaaauugagacccaaa

SEQ ID NO: 1120249 - RNA, 18 nt, Human
acccagagauacgugguu

SEQ ID NO: 1120250 - RNA, 19 nt, Human
acuauaguuucauucaaau

SEQ ID NO: 1120251 - RNA, 18 nt, Human
agacacuaguaaaaacaa

SEQ ID NO: 1120252 - RNA, 23 nt, Human
agacagcugaccuguccucuaua

SEQ ID NO: 1120253 - RNA, 19 nt, Human
agaguccugggugacaugc

SEQ ID NO: 1120254 - RNA, 23 nt, Human
agcaguuggugguucugaaauac

SEQ ID NO: 1120255 - RNA, 19 nt, Human
agccaacacugaagacaca

SEQ ID NO: 1120256 - RNA, 23 nt, Human
auagagccaugcccacugaccca

SEQ ID NO: 1120257 - RNA, 25 nt, Human
augacaacaacaaaaagaugaggaa

SEQ ID NO: 1120258 - RNA, 25 nt, Human
caacagcagacacuaguaaaaacaa

SEQ ID NO: 1120259 - RNA, 26 nt, Human
caagccaacacugaagacacaaagaa

SEQ ID NO: 1120260 - RNA, 21 nt, Human
cacaguuaugugaacguguca

SEQ ID NO: 1120261 - RNA, 21 nt, Human
caccggcagaguccuggguga

SEQ ID NO: 1120262 - RNA, 19 nt, Human
cagacaacuucagaaugua

SEQ ID NO: 1120263 - RNA, 18 nt, Human
cagcauugucucugcagg

SEQ ID NO: 1120264 - RNA, 19 nt, Human
cagcauugucucugcagug

SEQ ID NO: 1120265 - RNA, 19 nt, Human
caguaaaaauugagaccca

SEQ ID NO: 1120266 - RNA, 22 nt, Human
cagucugcaagcacagucagcc

SEQ ID NO: 1120267 - RNA, 21 nt, Human
caugugcugcacaguuaugug

SEQ ID NO: 1120268 - RNA, 26 nt, Human
ccagcggcuccugacuccuguucucu

SEQ ID NO: 1120269 - RNA, 26 nt, Human
ccccuccuuaaccaaguaaccagucc

SEQ ID NO: 1120270 - RNA, 21 nt, Human
cguagagauaugaauauaaua

SEQ ID NO: 1120271 - RNA, 23 nt, Human
cuaaaacaagccaacacugaaga

SEQ ID NO: 1120272 - RNA, 24 nt, Human
cuauagguccugccugcaggaaug

SEQ ID NO: 1120273 - RNA, 22 nt, Human
cugaccuugagcagguauagaa

SEQ ID NO: 1120274 - RNA, 20 nt, Human
cuguggucuuccuaaguacu

SEQ ID NO: 1120275 - RNA, 24 nt, Human
cuucucaccgucaaaguaaaaaac

SEQ ID NO: 1120276 - RNA, 21 nt, Human
cuugaaaaccacuuucccaag

SEQ ID NO: 1120277 - RNA, 18 nt, Human
gaagacauuuucagacaa

SEQ ID NO: 1120278 - RNA, 22 nt, Human
gaccuucucugcccgcagaugg

SEQ ID NO: 1120279 - RNA, 18 nt, Human
gauuaccuccuaugaaac

SEQ ID NO: 1120280 - RNA, 19 nt, Human
gcagacacuaguaaaaaca

SEQ ID NO: 1120281 - RNA, 21 nt, Human
gcaguguucccgucaaaaagu

SEQ ID NO: 1120282 - RNA, 23 nt, Human
gcaugggucaccguucaacugaa

SEQ ID NO: 1120283 - RNA, 21 nt, Human
gcugcuuauugugggaauaug

SEQ ID NO: 1120284 - RNA, 22 nt, Human
ggaauaugacucccaucuggaa

SEQ ID NO: 1120285 - RNA, 21 nt, Human
ggaauugagaggagcagggcu

SEQ ID NO: 1120286 - RNA, 26 nt, Human
ggcuaaggccucccaaugcuguuugu

SEQ ID NO: 1120287 - RNA, 23 nt, Human
gggguucaaaauaacuaaagaaa

SEQ ID NO: 1120288 - RNA, 25 nt, Human
gugguucugaaauacaauccucagc

SEQ ID NO: 1120289 - RNA, 21 nt, Human
uaaccaguccugauaucauaa

SEQ ID NO: 1120290 - RNA, 22 nt, Human
uaacuaaagaaaugcagcuaca

SEQ ID NO: 1120291 - RNA, 23 nt, Human
uaacuaaagaaaugcagcuacau

SEQ ID NO: 1120292 - RNA, 24 nt, Human
uacagauggaucagcuaaaacaag

SEQ ID NO: 1120293 - RNA, 22 nt, Human
uacaggauauuuauacucuuga

SEQ ID NO: 1120294 - RNA, 22 nt, Human
uagagccaugcccacugacccc

SEQ ID NO: 1120295 - RNA, 22 nt, Human
uagcuguggucuuccuaaguac

SEQ ID NO: 1120296 - RNA, 24 nt, Human
uaggaauagagccaugcccacuga

SEQ ID NO: 1120297 - RNA, 19 nt, Human
uaguaaaaacaaaggcaca

SEQ ID NO: 1120298 - RNA, 23 nt, Human
ucaaaauaacuaaagaaaugcag

SEQ ID NO: 1120299 - RNA, 18 nt, Human
ucagagacaugccugcaa

SEQ ID NO: 1120300 - RNA, 19 nt, Human
ucauucaaaucuucaggug

SEQ ID NO: 1120301 - RNA, 21 nt, Human
ucauugaaaccaggguaacac

SEQ ID NO: 1120302 - RNA, 18 nt, Human
ucccggcaugugcugcac

SEQ ID NO: 1120303 - RNA, 18 nt, Human
ucuaggcaugggucaccg

SEQ ID NO: 1120304 - RNA, 25 nt, Human
ucuauaaacaaguccaugucaccac

SEQ ID NO: 1120305 - RNA, 22 nt, Human
ucugaaauacaauccucagcca

SEQ ID NO: 1120306 - RNA, 21 nt, Human
ucuucaggugccuauaggucc

SEQ ID NO: 1120307 - RNA, 21 nt, Human
ugaaaccaggguaacaccuuu

SEQ ID NO: 1120308 - RNA, 21 nt, Human
ugaaauacaauccucagccaa

SEQ ID NO: 1120309 - RNA, 21 nt, Human
ugaauauaauaauagacacag

SEQ ID NO: 1120310 - RNA, 24 nt, Human
ugacaacaacaaaaagaugaggaa

SEQ ID NO: 1120311 - RNA, 18 nt, Human
ugacaugcugucuccugc

SEQ ID NO: 1120312 - RNA, 24 nt, Human
ugacaugcugucuccugccagcgg

SEQ ID NO: 1120313 - RNA, 20 nt, Human
ugagaggagcagggcuaagg

SEQ ID NO: 1120314 - RNA, 18 nt, Human
ugagccagacagcugacc

SEQ ID NO: 1120315 - RNA, 22 nt, Human
ugaggaauuuuguagcuaccca

SEQ ID NO: 1120316 - RNA, 26 nt, Human
ugaugugcuguuccucaaaugaguaa

SEQ ID NO: 1120317 - RNA, 23 nt, Human
ugcaacagcagacacuaguaaaa

SEQ ID NO: 1120318 - RNA, 21 nt, Human
ugcugcacaguuaugugaacg

SEQ ID NO: 1120319 - RNA, 18 nt, Human
ugcuggaaugagucaggu

SEQ ID NO: 1120320 - RNA, 22 nt, Human
uggaaacucacagcauugucuc

SEQ ID NO: 1120321 - RNA, 21 nt, Human
uggagucgaauaauaucuauc

SEQ ID NO: 1120322 - RNA, 21 nt, Human
ugucaagagcaguuggugguu

SEQ ID NO: 1120323 - RNA, 18 nt, Human
uucuucuuuuugcaacag

SEQ ID NO: 1120324 - RNA, 18 nt, Human
uuuugcaacagcagacac

SEQ ID NO: 1120325 - RNA, 20 nt, Human
uuuuguugugugauuugugg

SEQ ID NO: 1120326 - RNA, 22 nt, Human
aaaaagccagaacugggaagug

SEQ ID NO: 1120327 - RNA, 23 nt, Human
caaaaagccagaacugggaagug

SEQ ID NO: 1120328 - RNA, 24 nt, Human
cuggaggccccuugguggggcugg

SEQ ID NO: 1120329 - RNA, 22 nt, Human
gacacuuauuguuccugggguc

SEQ ID NO: 1120330 - RNA, 23 nt, Human
ggggucucuggaggccccuuggu

SEQ ID NO: 1120331 - RNA, 22 nt, Human
gggucucuggaggccccuuggu

SEQ ID NO: 1120332 - RNA, 23 nt, Human
ucucuggaggccccuuggugggg

SEQ ID NO: 1120333 - RNA, 20 nt, Human
uggaggccccuugguggggc

SEQ ID NO: 1120334 - RNA, 21 nt, Human
uggaggccccuugguggggcu

SEQ ID NO: 1120335 - RNA, 23 nt, Human
uggggucucuggaggccccuugg

SEQ ID NO: 1120336 - RNA, 19 nt, Human
uuguuccuggggucucugg

SEQ ID NO: 1120337 - RNA, 19 nt, Human
ccagccccacagcguugua

SEQ ID NO: 1120338 - RNA, 20 nt, Human
uggagguggcagugguggug

SEQ ID NO: 1120339 - RNA, 19 nt, Human
uggcagugguggugggguu

SEQ ID NO: 1120340 - RNA, 20 nt, Human
uggcagugguggugggguug

SEQ ID NO: 1120341 - RNA, 24 nt, Human
uugguggugaacuugacaagcagu

SEQ ID NO: 1120342 - RNA, 22 nt, Human
aaggcguccaaaguuauuaaaa

SEQ ID NO: 1120343 - RNA, 24 nt, Human
aauaucuuuuuuuuuuaaagcccu

SEQ ID NO: 1120344 - RNA, 19 nt, Human
agagaaaaaguuuagaagu

SEQ ID NO: 1120345 - RNA, 20 nt, Human
agcagaagauaaaaguagga

SEQ ID NO: 1120346 - RNA, 21 nt, Human
auaccaaaauacaagaaaacc

SEQ ID NO: 1120347 - RNA, 18 nt, Human
aucuagacuaggaugagg

SEQ ID NO: 1120348 - RNA, 23 nt, Human
gugaacuaugugcaggguuuguu

SEQ ID NO: 1120349 - RNA, 23 nt, Human
uaccaaaauacaagaaaaccuac

SEQ ID NO: 1120350 - RNA, 24 nt, Human
uaggagcagaagauaaaaguagga

SEQ ID NO: 1120351 - RNA, 23 nt, Human
ugaauugcuugcagauacugcua

SEQ ID NO: 1120352 - RNA, 20 nt, Human
uucacagaacaaaaacaaau

SEQ ID NO: 1120353 - RNA, 18 nt, Human
uuuuuaguagugguguuu

SEQ ID NO: 1120354 - RNA, 23 nt, Human
acucucagagggcaaaccccagc

SEQ ID NO: 1120355 - RNA, 19 nt, Human
aggcggccagcuucugaac

SEQ ID NO: 1120356 - RNA, 20 nt, Human
auccugguuaggauguguuc

SEQ ID NO: 1120357 - RNA, 18 nt, Human
auggagcuaagcuucucc

SEQ ID NO: 1120358 - RNA, 24 nt, Human
ccaagcccaugacauagaugcuga

SEQ ID NO: 1120359 - RNA, 21 nt, Human
ccucccacagacacguagaau

SEQ ID NO: 1120360 - RNA, 22 nt, Human
cguguuguacaaggagcuguuu

SEQ ID NO: 1120361 - RNA, 18 nt, Human
cuccauggccgcggcacc

SEQ ID NO: 1120362 - RNA, 21 nt, Human
gcaccuccauuguuuuuaauc

SEQ ID NO: 1120363 - RNA, 18 nt, Human
guguuguacaaggagcug

SEQ ID NO: 1120364 - RNA, 21 nt, Human
uagaugcugaaacauggaggc

SEQ ID NO: 1120365 - RNA, 23 nt, Human
ucauagcugaugcaucuccaaaa

SEQ ID NO: 1120366 - RNA, 22 nt, Human
ucuccaaaaaauuuuucaugaa

SEQ ID NO: 1120367 - RNA, 22 nt, Human
ucuccauggccgcggcaccucc

SEQ ID NO: 1120368 - RNA, 24 nt, Human
uuaauccacuccaggaccaagccc

SEQ ID NO: 1120369 - RNA, 26 nt, Human
aaaaaauccaaaaugauuaguaaaga

SEQ ID NO: 1120370 - RNA, 22 nt, Human
aaaaagacaagccaaaaugcuu

SEQ ID NO: 1120371 - RNA, 18 nt, Human
aaaaugcuucaggaacca

SEQ ID NO: 1120372 - RNA, 22 nt, Human
acacugguuuguauuauugcga

SEQ ID NO: 1120373 - RNA, 18 nt, Human
agaaggucagagguacac

SEQ ID NO: 1120374 - RNA, 23 nt, Human
aguaucuucccugcccaauaauu

SEQ ID NO: 1120375 - RNA, 18 nt, Human
caaagcaccccagcucuc

SEQ ID NO: 1120376 - RNA, 25 nt, Human
caggaaccacauauccaaccuucag

SEQ ID NO: 1120377 - RNA, 21 nt, Human
cauuuaaaaagacaagccaaa

SEQ ID NO: 1120378 - RNA, 24 nt, Human
ccucaaaugaguuuaguuugccuc

SEQ ID NO: 1120379 - RNA, 21 nt, Human
gauuaguaaagaaaaauauaa

SEQ ID NO: 1120380 - RNA, 19 nt, Human
guaaagaaaaauauaagaa

SEQ ID NO: 1120381 - RNA, 24 nt, Human
uaaaaagacaagccaaaaugcuuc

SEQ ID NO: 1120382 - RNA, 25 nt, Human
uaacagacccuuuaaauuuguuuua

SEQ ID NO: 1120383 - RNA, 22 nt, Human
uaagaauuaacagacccuuuaa

SEQ ID NO: 1120384 - RNA, 25 nt, Human
ugaaugaauacccuaauggcaaacc

SEQ ID NO: 1120385 - RNA, 27 nt, Human
ugcauuugggggagaaggguaggggag

SEQ ID NO: 1120386 - RNA, 19 nt, Human
ugccucgcacuaauaaacu

SEQ ID NO: 1120387 - RNA, 18 nt, Human
uucaaaggaaaaaaaucc

SEQ ID NO: 1120388 - RNA, 22 nt, Human
uucaaaggaaaaaaauccaaaa

SEQ ID NO: 1120389 - RNA, 20 nt, Human
uugcuuuuccuucagcaagg

SEQ ID NO: 1120390 - RNA, 18 nt, Human
uuuaagguuuaaaaagug

SEQ ID NO: 1120391 - RNA, 27 nt, Human
aaaacaaacaucaacaccccugcuccc

SEQ ID NO: 1120392 - RNA, 21 nt, Human
acaaacaucaacaccccugcu

SEQ ID NO: 1120393 - RNA, 26 nt, Human
acaaacaucaacaccccugcucccuc

SEQ ID NO: 1120394 - RNA, 23 nt, Human
acuugcacacagccccacucugc

SEQ ID NO: 1120395 - RNA, 25 nt, Human
agacaaaaagccugguaagggggag

SEQ ID NO: 1120396 - RNA, 22 nt, Human
agccugggacagcuucagacua

SEQ ID NO: 1120397 - RNA, 21 nt, Human
auccucagccacagcugaagc

SEQ ID NO: 1120398 - RNA, 20 nt, Human
cacacagccccacucugcaa

SEQ ID NO: 1120399 - RNA, 19 nt, Human
cacucugcaacuugaccuu

SEQ ID NO: 1120400 - RNA, 24 nt, Human
cagaggcuccuagaacaaacccaa

SEQ ID NO: 1120401 - RNA, 19 nt, Human
cagggccagcaauaaccau

SEQ ID NO: 1120402 - RNA, 25 nt, Human
ccacagcugaagccaguggcgaggc

SEQ ID NO: 1120403 - RNA, 22 nt, Human
ccacuacccucuuggcugcugg

SEQ ID NO: 1120404 - RNA, 31 nt, Human
ccagcaauaaccauaacacuggucucucuuu

SEQ ID NO: 1120405 - RNA, 23 nt, Human
ccaguggcgaggcucucuuuggg

SEQ ID NO: 1120406 - RNA, 20 nt, Human
cccaguccuggcuggcagcc

SEQ ID NO: 1120407 - RNA, 20 nt, Human
ccccauuccugaacacacug

SEQ ID NO: 1120408 - RNA, 21 nt, Human
ccuacaugugaggggaagggu

SEQ ID NO: 1120409 - RNA, 19 nt, Human
cgguacaccacuacccucu

SEQ ID NO: 1120410 - RNA, 24 nt, Human
cuaaaacaaacaucaacaccccug

SEQ ID NO: 1120411 - RNA, 24 nt, Human
cuaaaugggggacuuaccaggucc

SEQ ID NO: 1120412 - RNA, 20 nt, Human
cuagaacaaacccaacacca

SEQ ID NO: 1120413 - RNA, 25 nt, Human
cuccuagaacaaacccaacaccauu

SEQ ID NO: 1120414 - RNA, 20 nt, Human
cucgcaguccccauacucac

SEQ ID NO: 1120415 - RNA, 24 nt, Human
cuucuacauucccaacaguaacca

SEQ ID NO: 1120416 - RNA, 24 nt, Human
cuuggcugcuggacugccaccugc

SEQ ID NO: 1120417 - RNA, 20 nt, Human
gcugcuggacugccaccugc

SEQ ID NO: 1120418 - RNA, 26 nt, Human
ggccagcaauaaccauaacacugguc

SEQ ID NO: 1120419 - RNA, 23 nt, Human
uaaaacaaacaucaacaccccug

SEQ ID NO: 1120420 - RNA, 22 nt, Human
ucaacacaguuucccaguccug

SEQ ID NO: 1120421 - RNA, 22 nt, Human
ucaacaccccugcucccucaca

SEQ ID NO: 1120422 - RNA, 25 nt, Human
ucacccaucaagcaugcuggacuuc

SEQ ID NO: 1120423 - RNA, 27 nt, Human
ucaggagcuucaacacaguuucccagu

SEQ ID NO: 1120424 - RNA, 20 nt, Human
uccccaggagucccuacaug

SEQ ID NO: 1120425 - RNA, 23 nt, Human
ugaggggaaggguggcacagggc

SEQ ID NO: 1120426 - RNA, 20 nt, Human
uggcuggcagccugggacag

SEQ ID NO: 1120427 - RNA, 21 nt, Human
uggcuggcagccugggacagc

SEQ ID NO: 1120428 - RNA, 21 nt, Human
ugggagccugggaagaauggg

SEQ ID NO: 1120429 - RNA, 25 nt, Human
uuucuuggccuuacuaaaacaaaca

SEQ ID NO: 1120430 - RNA, 19 nt, Human
aaaaaagacacagaaacac

SEQ ID NO: 1120431 - RNA, 20 nt, Human
aaacaaaaaagacacagaaa

SEQ ID NO: 1120432 - RNA, 22 nt, Human
aaagaagaaaaugcaugcaaag

SEQ ID NO: 1120433 - RNA, 18 nt, Human
aaagaagcuucugagaug

SEQ ID NO: 1120434 - RNA, 21 nt, Human
aacacaugcauucucucagca

SEQ ID NO: 1120435 - RNA, 18 nt, Human
aagaagaaaaugcaugca

SEQ ID NO: 1120436 - RNA, 20 nt, Human
aagggucagcccaucuccuc

SEQ ID NO: 1120437 - RNA, 19 nt, Human
acaaacaaaaaagacacag

SEQ ID NO: 1120438 - RNA, 25 nt, Human
acuacaaacaaaaaagacacagaaa

SEQ ID NO: 1120439 - RNA, 20 nt, Human
agaaacacuauucuccaggc

SEQ ID NO: 1120440 - RNA, 27 nt, Human
agcccaucuccucccuucugcccacaa

SEQ ID NO: 1120441 - RNA, 19 nt, Human
aggaucacagacuacaaac

SEQ ID NO: 1120442 - RNA, 21 nt, Human
augaggcuuaaagaagaaaau

SEQ ID NO: 1120443 - RNA, 18 nt, Human
augcugcccugggaaggg

SEQ ID NO: 1120444 - RNA, 23 nt, Human
augugaugaggcuuaaagaagaa

SEQ ID NO: 1120445 - RNA, 19 nt, Human
caaaaaagacacagaaaca

SEQ ID NO: 1120446 - RNA, 21 nt, Human
caagaccaagucccggcaugg

SEQ ID NO: 1120447 - RNA, 19 nt, Human
caagucccggcauggcgug

SEQ ID NO: 1120448 - RNA, 20 nt, Human
cacagaaacacuauucucca

SEQ ID NO: 1120449 - RNA, 18 nt, Human
cacagacuacaaacaaaa

SEQ ID NO: 1120450 - RNA, 25 nt, Human
cacagacuacaaacaaaaaagacac

SEQ ID NO: 1120451 - RNA, 18 nt, Human
cacaguaccuggcaguga

SEQ ID NO: 1120452 - RNA, 22 nt, Human
caccaagaacacucuucccaag

SEQ ID NO: 1120453 - RNA, 21 nt, Human
cacccccacucugucaggucu

SEQ ID NO: 1120454 - RNA, 19 nt, Human
cacucugucaggucuuuac

SEQ ID NO: 1120455 - RNA, 22 nt, Human
cagaauaagaggaaaaggcugg

SEQ ID NO: 1120456 - RNA, 19 nt, Human
caggcacagagagccagag

SEQ ID NO: 1120457 - RNA, 22 nt, Human
ccguugcugaagggucagccca

SEQ ID NO: 1120458 - RNA, 19 nt, Human
ccucccgacaacacaugca

SEQ ID NO: 1120459 - RNA, 20 nt, Human
cuccgucuaggccaggaccc

SEQ ID NO: 1120460 - RNA, 20 nt, Human
cuccucagaagugaccuccc

SEQ ID NO: 1120461 - RNA, 24 nt, Human
cugcaggaugcugcccugggaagg

SEQ ID NO: 1120462 - RNA, 22 nt, Human
cugccaccggugcuuccaccug

SEQ ID NO: 1120463 - RNA, 19 nt, Human
cugugccccagcuaugugu

SEQ ID NO: 1120464 - RNA, 18 nt, Human
gaaaaggcugggguugcc

SEQ ID NO: 1120465 - RNA, 19 nt, Human
gaaaaggcugggguugccu

SEQ ID NO: 1120466 - RNA, 21 nt, Human
gcacaguaccuggcagugagu

SEQ ID NO: 1120467 - RNA, 22 nt, Human
gccccagggcucccaggaucac

SEQ ID NO: 1120468 - RNA, 18 nt, Human
ggcagugaccucacuucc

SEQ ID NO: 1120469 - RNA, 26 nt, Human
uacaaacaaaaaagacacagaaacac

SEQ ID NO: 1120470 - RNA, 25 nt, Human
ucagcccaucuccucccuucugccc

SEQ ID NO: 1120471 - RNA, 26 nt, Human
uccaccaagaacacucuucccaagcu

SEQ ID NO: 1120472 - RNA, 24 nt, Human
ucccugggccugcuugaguuucug

SEQ ID NO: 1120473 - RNA, 23 nt, Human
ucucucagcauuuacugugcccc

SEQ ID NO: 1120474 - RNA, 24 nt, Human
ucucucagcauuuacugugcccca

SEQ ID NO: 1120475 - RNA, 21 nt, Human
ucugccaccggugcuuccacc

SEQ ID NO: 1120476 - RNA, 21 nt, Human
ucuggaagcggcugaccaucc

SEQ ID NO: 1120477 - RNA, 18 nt, Human
ucugucaggucuuuacug

SEQ ID NO: 1120478 - RNA, 19 nt, Human
ucugucuauaaaguaggug

SEQ ID NO: 1120479 - RNA, 20 nt, Human
ucugucuauaaaguaggugu

SEQ ID NO: 1120480 - RNA, 23 nt, Human
ucugugguuagacaggacgaaga

SEQ ID NO: 1120481 - RNA, 21 nt, Human
ucuuuacugggcucuccgucc

SEQ ID NO: 1120482 - RNA, 21 nt, Human
ugagauaauggaugccaaaga

SEQ ID NO: 1120483 - RNA, 21 nt, Human
ugaguauaugugcaauaauau

SEQ ID NO: 1120484 - RNA, 24 nt, Human
ugccacuguuuucccucccugggc

SEQ ID NO: 1120485 - RNA, 20 nt, Human
ugcccugggaaggagccaga

SEQ ID NO: 1120486 - RNA, 20 nt, Human
uggagggaagggaaaucggg

SEQ ID NO: 1120487 - RNA, 21 nt, Human
uggcagugaguauaugugcaa

SEQ ID NO: 1120488 - RNA, 21 nt, Human
ugggaaggagccagaggucgu

SEQ ID NO: 1120489 - RNA, 18 nt, Human
uggggaggaguugcuucc

SEQ ID NO: 1120490 - RNA, 21 nt, Human
uggggaggaguugcuuccagg

SEQ ID NO: 1120491 - RNA, 21 nt, Human
uggggcccuguuuaaacuggc

SEQ ID NO: 1120492 - RNA, 24 nt, Human
ugugaugaggcuuaaagaagaaaa

SEQ ID NO: 1120493 - RNA, 21 nt, Human
uguuuaaacuggccccagggc

SEQ ID NO: 1120494 - RNA, 21 nt, Human
uuuaagacuugccuccucaga

SEQ ID NO: 1120495 - RNA, 20 nt, Human
aaaaagguuaucuguccuuu

SEQ ID NO: 1120496 - RNA, 18 nt, Human
aaagcccucagaaaccaa

SEQ ID NO: 1120497 - RNA, 24 nt, Human
aaagcccucagaaaccaagggcac

SEQ ID NO: 1120498 - RNA, 24 nt, Human
aaagugcugggauuauaggcguga

SEQ ID NO: 1120499 - RNA, 20 nt, Human
aacaaguuuuaaaaccuccu

SEQ ID NO: 1120500 - RNA, 21 nt, Human
aacagaacgagcacuaacaag

SEQ ID NO: 1120501 - RNA, 22 nt, Human
aaccagacagggaaaccaucca

SEQ ID NO: 1120502 - RNA, 20 nt, Human
aaccuccucuuccccaccaa

SEQ ID NO: 1120503 - RNA, 21 nt, Human
aaccucugcaccauguggccc

SEQ ID NO: 1120504 - RNA, 21 nt, Human
aagaaaaacaggagaccucag

SEQ ID NO: 1120505 - RNA, 19 nt, Human
aagugcugggauuauaggc

SEQ ID NO: 1120506 - RNA, 19 nt, Human
aagugcugggauuauaggc

SEQ ID NO: 1120507 - RNA, 26 nt, Human
aagugcugggauuauaggcgugagcc

SEQ ID NO: 1120508 - RNA, 19 nt, Human
aaucgucaaaugccaaacc

SEQ ID NO: 1120509 - RNA, 20 nt, Human
aaugguuuuuagagaaagag

SEQ ID NO: 1120510 - RNA, 22 nt, Human
acacagcaagaaaaacaggaga

SEQ ID NO: 1120511 - RNA, 24 nt, Human
acacuguugcccaggcuggagugg

SEQ ID NO: 1120512 - RNA, 23 nt, Human
acagugaaaaaauguuccucuca

SEQ ID NO: 1120513 - RNA, 18 nt, Human
accacacaaaaagguuau

SEQ ID NO: 1120514 - RNA, 24 nt, Human
accauugccauggcaacaccugga

SEQ ID NO: 1120515 - RNA, 21 nt, Human
accuggggucauagccucccu

SEQ ID NO: 1120516 - RNA, 22 nt, Human
accugugauaagagaaguuuua

SEQ ID NO: 1120517 - RNA, 18 nt, Human
acgggguuucgccauguu

SEQ ID NO: 1120518 - RNA, 23 nt, Human
acgggguuucgccauguugguca

SEQ ID NO: 1120519 - RNA, 24 nt, Human
acgggguuucgccauguuggucag

SEQ ID NO: 1120520 - RNA, 26 nt, Human
acucaacuccaaaggccggacucgga

SEQ ID NO: 1120521 - RNA, 18 nt, Human
acuugaucccaaaacuua

SEQ ID NO: 1120522 - RNA, 23 nt, Human
agaaagaggaugauaacaaagga

SEQ ID NO: 1120523 - RNA, 18 nt, Human
agacaaggucucacacug

SEQ ID NO: 1120524 - RNA, 18 nt, Human
agauagucuaauaaaaau

SEQ ID NO: 1120525 - RNA, 21 nt, Human
agcugcugucuaacaccacug

SEQ ID NO: 1120526 - RNA, 24 nt, Human
aggacugaaucaauauaaaaacaa

SEQ ID NO: 1120527 - RNA, 18 nt, Human
aggcgugagccaccgcac

SEQ ID NO: 1120528 - RNA, 23 nt, Human
aguagcugggauuacaggcacau

SEQ ID NO: 1120529 - RNA, 23 nt, Human
aguagcugggauuacaggcacau

SEQ ID NO: 1120530 - RNA, 21 nt, Human
agucauugucugugucgcucu

SEQ ID NO: 1120531 - RNA, 19 nt, Human
auaaaaacaagccuggaga

SEQ ID NO: 1120532 - RNA, 21 nt, Human
auaaguauuccaagccuuuaa

SEQ ID NO: 1120533 - RNA, 23 nt, Human
aucaauauaaaaacaagccugga

SEQ ID NO: 1120534 - RNA, 19 nt, Human
augguguagcccugcucca

SEQ ID NO: 1120535 - RNA, 22 nt, Human
caaagcccucagaaaccaaggg

SEQ ID NO: 1120536 - RNA, 18 nt, Human
caaaggccggacucggac

SEQ ID NO: 1120537 - RNA, 24 nt, Human
caaagugcugggauuauaggcgug

SEQ ID NO: 1120538 - RNA, 25 nt, Human
caacaacagaacgagcacuaacaag

SEQ ID NO: 1120539 - RNA, 23 nt, Human
caaccucugcaccauguggcccu

SEQ ID NO: 1120540 - RNA, 20 nt, Human
caaccuuuuccaggcucaag

SEQ ID NO: 1120541 - RNA, 21 nt, Human
caagaaaaacaggagaccuca

SEQ ID NO: 1120542 - RNA, 22 nt, Human
caagggcaccacacaaaaaggu

SEQ ID NO: 1120543 - RNA, 24 nt, Human
caaggucucacacuguugcccagg

SEQ ID NO: 1120544 - RNA, 24 nt, Human
caauuaccauugccauggcaacac

SEQ ID NO: 1120545 - RNA, 24 nt, Human
cacacuguugcccaggcuggagug

SEQ ID NO: 1120546 - RNA, 22 nt, Human
caccaagcuaagguugaugggc

SEQ ID NO: 1120547 - RNA, 21 nt, Human
caccauguggcccucuagcug

SEQ ID NO: 1120548 - RNA, 20 nt, Human
caccgcacacagccaagaau

SEQ ID NO: 1120549 - RNA, 24 nt, Human
caccugcccuacaucagcauaaac

SEQ ID NO: 1120550 - RNA, 26 nt, Human
cagaacgagcacuaacaaguuuuaaa

SEQ ID NO: 1120551 - RNA, 21 nt, Human
cagaccaauacgugguccugc

SEQ ID NO: 1120552 - RNA, 20 nt, Human
cagcaagaaaaacaggagac

SEQ ID NO: 1120553 - RNA, 18 nt, Human
cagcccgaagcgccgcag

SEQ ID NO: 1120554 - RNA, 20 nt, Human
cagccuccugaguagcuggg

SEQ ID NO: 1120555 - RNA, 20 nt, Human
cagugcguggcuccgcaggu

SEQ ID NO: 1120556 - RNA, 23 nt, Human
caucaucaucaucgggugugucu

SEQ ID NO: 1120557 - RNA, 19 nt, Human
cauguucgucugcccauaa

SEQ ID NO: 1120558 - RNA, 24 nt, Human
ccaaaccagacagggaaaccaucc

SEQ ID NO: 1120559 - RNA, 22 nt, Human
ccaaagugcugggauuauaggc

SEQ ID NO: 1120560 - RNA, 24 nt, Human
ccaaagugcugggauuauaggcgu

SEQ ID NO: 1120561 - RNA, 23 nt, Human
ccacacaaaaagguuaucugucc

SEQ ID NO: 1120562 - RNA, 19 nt, Human
ccauguuggucaggcuggu

SEQ ID NO: 1120563 - RNA, 19 nt, Human
cccaggcuggaguggagug

SEQ ID NO: 1120564 - RNA, 18 nt, Human
ccccaauuuuugggcuca

SEQ ID NO: 1120565 - RNA, 20 nt, Human
cccuugaauucuuuccuggg

SEQ ID NO: 1120566 - RNA, 19 nt, Human
ccucagggccugcuuugac

SEQ ID NO: 1120567 - RNA, 22 nt, Human
ccucugggcuaagccccaauuu

SEQ ID NO: 1120568 - RNA, 23 nt, Human
ccugaccucaaguguuccaucug

SEQ ID NO: 1120569 - RNA, 23 nt, Human
ccugaguagcugggauuacaggc

SEQ ID NO: 1120570 - RNA, 24 nt, Human
ccugaguagcugggauuacaggca

SEQ ID NO: 1120571 - RNA, 18 nt, Human
ccuggaagucacugcccc

SEQ ID NO: 1120572 - RNA, 22 nt, Human
ccuugaauucuuuccuggguga

SEQ ID NO: 1120573 - RNA, 24 nt, Human
cgccacagccuccugaguagcugg

SEQ ID NO: 1120574 - RNA, 24 nt, Human
cgccauguuggucaggcugguauc

SEQ ID NO: 1120575 - RNA, 24 nt, Human
cgggguuucgccauguuggucagg

SEQ ID NO: 1120576 - RNA, 18 nt, Human
cgugaauguucuccugca

SEQ ID NO: 1120577 - RNA, 21 nt, Human
cucaaguguuccucucgccac

SEQ ID NO: 1120578 - RNA, 19 nt, Human
cuccucugggcuaagcccc

SEQ ID NO: 1120579 - RNA, 24 nt, Human
cucgccacagccuccugaguagcu

SEQ ID NO: 1120580 - RNA, 23 nt, Human
cugaguagcugggauuacaggca

SEQ ID NO: 1120581 - RNA, 27 nt, Human
cuggagauuuucuuaucuuucuccuaa

SEQ ID NO: 1120582 - RNA, 27 nt, Human
cuuggcaaagguaaacuugaucccaaa

SEQ ID NO: 1120583 - RNA, 23 nt, Human
gaccucaaguguuccaucugccu

SEQ ID NO: 1120584 - RNA, 23 nt, Human
gagacgggguuucgccauguugg

SEQ ID NO: 1120585 - RNA, 24 nt, Human
gagacgggguuucgccauguuggu

SEQ ID NO: 1120586 - RNA, 23 nt, Human
gaugccauaaugagccuuucaga

SEQ ID NO: 1120587 - RNA, 18 nt, Human
gauuauaggcgugagcca

SEQ ID NO: 1120588 - RNA, 22 nt, Human
gauuauaggcgugagccaccgc

SEQ ID NO: 1120589 - RNA, 23 nt, Human
gauuauaggcgugagccaccgca

SEQ ID NO: 1120590 - RNA, 19 nt, Human
gccauggcaacaccuggaa

SEQ ID NO: 1120591 - RNA, 24 nt, Human
gccauguuggucaggcugguaucg

SEQ ID NO: 1120592 - RNA, 19 nt, Human
gccuuggccucccaaagug

SEQ ID NO: 1120593 - RNA, 22 nt, Human
gccuuggccucccaaagugcug

SEQ ID NO: 1120594 - RNA, 18 nt, Human
gcugcuguugggcacugc

SEQ ID NO: 1120595 - RNA, 23 nt, Human
gcugguaucgaacuccugaccuc

SEQ ID NO: 1120596 - RNA, 25 nt, Human
ggacaggugacucgugaauguucuc

SEQ ID NO: 1120597 - RNA, 21 nt, Human
ggaguaccuuuuaugaucaug

SEQ ID NO: 1120598 - RNA, 21 nt, Human
ggcgguggugggaggguggug

SEQ ID NO: 1120599 - RNA, 24 nt, Human
ggcugguaucgaacuccugaccuc

SEQ ID NO: 1120600 - RNA, 21 nt, Human
gggaaaccauccagaccuggg

SEQ ID NO: 1120601 - RNA, 19 nt, Human
gggaggguggugcaggaag

SEQ ID NO: 1120602 - RNA, 23 nt, Human
gggguuucgccauguuggucagg

SEQ ID NO: 1120603 - RNA, 19 nt, Human
ggugcagcugucacacagc

SEQ ID NO: 1120604 - RNA, 19 nt, Human
guaaaagaaugccagaggc

SEQ ID NO: 1120605 - RNA, 18 nt, Human
guagcugggauuacaggc

SEQ ID NO: 1120606 - RNA, 21 nt, Human
guauccaaccucugcaccaug

SEQ ID NO: 1120607 - RNA, 22 nt, Human
uaaaagaaugccagaggcagcu

SEQ ID NO: 1120608 - RNA, 19 nt, Human
uaacaaaggaaugcagagg

SEQ ID NO: 1120609 - RNA, 21 nt, Human
uaaguaaaagaaugccagagg

SEQ ID NO: 1120610 - RNA, 24 nt, Human
uaauuuuuguauuuuugcuagaga

SEQ ID NO: 1120611 - RNA, 25 nt, Human
uacaagcugcugucuaacaccacug

SEQ ID NO: 1120612 - RNA, 19 nt, Human
uacaggcugguauccaacc

SEQ ID NO: 1120613 - RNA, 18 nt, Human
uagaaucgucaaaugcca

SEQ ID NO: 1120614 - RNA, 20 nt, Human
uagagacgggguuucgccau

SEQ ID NO: 1120615 - RNA, 21 nt, Human
uagagacgggguuucgccaug

SEQ ID NO: 1120616 - RNA, 22 nt, Human
uagagacgggguuucgccaugu

SEQ ID NO: 1120617 - RNA, 21 nt, Human
uauaauaacagugaaaaaaug

SEQ ID NO: 1120618 - RNA, 24 nt, Human
ucacacuguugcccaggcuggagu

SEQ ID NO: 1120619 - RNA, 19 nt, Human
ucacugcaaccuuuuccag

SEQ ID NO: 1120620 - RNA, 20 nt, Human
ucacugcaaccuuuuccagg

SEQ ID NO: 1120621 - RNA, 21 nt, Human
ucagaucauucccauguucgu

SEQ ID NO: 1120622 - RNA, 24 nt, Human
ucaucaucaucaucgggugugucu

SEQ ID NO: 1120623 - RNA, 19 nt, Human
uccagcagggucauuuucc

SEQ ID NO: 1120624 - RNA, 19 nt, Human
uccaggcucaaguguuccu

SEQ ID NO: 1120625 - RNA, 23 nt, Human
uccauaccucacucaagaagaca

SEQ ID NO: 1120626 - RNA, 18 nt, Human
uccaucugccuuggccuc

SEQ ID NO: 1120627 - RNA, 24 nt, Human
ucccaaagugcugggauuauaggc

SEQ ID NO: 1120628 - RNA, 23 nt, Human
ucccucaugaagaucuuuuaaaa

SEQ ID NO: 1120629 - RNA, 20 nt, Human
uccucugggcuaagccccaa

SEQ ID NO: 1120630 - RNA, 24 nt, Human
uccugaguagcugggauuacaggc

SEQ ID NO: 1120631 - RNA, 23 nt, Human
uccuuugagucacaaaauccaac

SEQ ID NO: 1120632 - RNA, 22 nt, Human
ucgccauguuggucaggcuggu

SEQ ID NO: 1120633 - RNA, 22 nt, Human
ucucacacuguugcccaggcug

SEQ ID NO: 1120634 - RNA, 23 nt, Human
ucucacacuguugcccaggcugg

SEQ ID NO: 1120635 - RNA, 24 nt, Human
ucucacacuguugcccaggcugga

SEQ ID NO: 1120636 - RNA, 19 nt, Human
ucuccugcagcccuugcag

SEQ ID NO: 1120637 - RNA, 24 nt, Human
ucugccuuggccucccaaagugcu

SEQ ID NO: 1120638 - RNA, 21 nt, Human
ugaacugguccauaccucacu

SEQ ID NO: 1120639 - RNA, 21 nt, Human
ugaagccuccaccaagcuaag

SEQ ID NO: 1120640 - RNA, 18 nt, Human
ugaccagaacugaacugg

SEQ ID NO: 1120641 - RNA, 26 nt, Human
ugaccagaacugaacugguccauacc

SEQ ID NO: 1120642 - RNA, 19 nt, Human
ugaccucaaguguuccauc

SEQ ID NO: 1120643 - RNA, 20 nt, Human
ugacucgugaauguucuccu

SEQ ID NO: 1120644 - RNA, 23 nt, Human
ugacucgugaauguucuccugca

SEQ ID NO: 1120645 - RNA, 22 nt, Human
ugagacaaggucucacacuguu

SEQ ID NO: 1120646 - RNA, 25 nt, Human
ugccaccacuccugacuaauuuuug

SEQ ID NO: 1120647 - RNA, 19 nt, Human
ugcccaggcuggaguggag

SEQ ID NO: 1120648 - RNA, 21 nt, Human
ugcccaggcuggaguggagug

SEQ ID NO: 1120649 - RNA, 24 nt, Human
ugcccaggcuggaguggaguggca

SEQ ID NO: 1120650 - RNA, 31 nt, Human
ugcccaggcuggaguggaguggcacgauucc

SEQ ID NO: 1120651 - RNA, 19 nt, Human
ugcccuacaucagcauaaa

SEQ ID NO: 1120652 - RNA, 24 nt, Human
ugcccuugaauucuuuccuggggg

SEQ ID NO: 1120653 - RNA, 24 nt, Human
ugcuagagacgggguuucgccaug

SEQ ID NO: 1120654 - RNA, 19 nt, Human
ugcuguugggcacugcugc

SEQ ID NO: 1120655 - RNA, 18 nt, Human
uggaaagugggcgaaagg

SEQ ID NO: 1120656 - RNA, 19 nt, Human
uggaguggaguggcacgau

SEQ ID NO: 1120657 - RNA, 19 nt, Human
uggaguggaguggcacgau

SEQ ID NO: 1120658 - RNA, 24 nt, Human
uggcacgauuccagcucacugcaa

SEQ ID NO: 1120659 - RNA, 23 nt, Human
uggccagcaaagcccucagaaac

SEQ ID NO: 1120660 - RNA, 19 nt, Human
uggcccucuagcugaccag

SEQ ID NO: 1120661 - RNA, 19 nt, Human
ugggaggguggugcaggaa

SEQ ID NO: 1120662 - RNA, 21 nt, Human
ugggauuacaggcacaugcca

SEQ ID NO: 1120663 - RNA, 22 nt, Human
ugggauuacaggcacaugccac

SEQ ID NO: 1120664 - RNA, 24 nt, Human
ugggauuacaggcacaugccacca

SEQ ID NO: 1120665 - RNA, 18 nt, Human
ugggauuauaggcgugag

SEQ ID NO: 1120666 - RNA, 19 nt, Human
ugggauuauaggcgugagc

SEQ ID NO: 1120667 - RNA, 21 nt, Human
ugggauuauaggcgugagcca

SEQ ID NO: 1120668 - RNA, 22 nt, Human
ugggauuauaggcgugagccac

SEQ ID NO: 1120669 - RNA, 23 nt, Human
ugggauuauaggcgugagccacc

SEQ ID NO: 1120670 - RNA, 24 nt, Human
ugggauuauaggcgugagccaccg

SEQ ID NO: 1120671 - RNA, 24 nt, Human
uggguauaaauauaagugccgacc

SEQ ID NO: 1120672 - RNA, 24 nt, Human
uggucaggcugguaucgaacuccu

SEQ ID NO: 1120673 - RNA, 19 nt, Human
uggugggaggguggugcag

SEQ ID NO: 1120674 - RNA, 19 nt, Human
ugguuuuuagagaaagagg

SEQ ID NO: 1120675 - RNA, 19 nt, Human
uguagccagaccgcccugc

SEQ ID NO: 1120676 - RNA, 22 nt, Human
ugucgcucuuuucuuggcuuuc

SEQ ID NO: 1120677 - RNA, 18 nt, Human
ugugucgcucuuuucuug

SEQ ID NO: 1120678 - RNA, 23 nt, Human
ugugucgcucuuuucuuggcuuu

SEQ ID NO: 1120679 - RNA, 21 nt, Human
uguguggcuggaaagugggcg

SEQ ID NO: 1120680 - RNA, 24 nt, Human
uguuccaucugccuuggccuccca

SEQ ID NO: 1120681 - RNA, 20 nt, Human
uucaacaacagaacgagcac

SEQ ID NO: 1120682 - RNA, 21 nt, Human
uugcccaggcuggaguggagu

SEQ ID NO: 1120683 - RNA, 24 nt, Human
uugcuagagacgggguuucgccau

SEQ ID NO: 1120684 - RNA, 18 nt, Human
uuggccucccaaagugcu

SEQ ID NO: 1120685 - RNA, 20 nt, Human
uuuaaaagaugaacauuuua

SEQ ID NO: 1120686 - RNA, 18 nt, Human
uuuaauacuuugccagaa

SEQ ID NO: 1120687 - RNA, 21 nt, Human
uuuaugaucauguagccagac

SEQ ID NO: 1120688 - RNA, 25 nt, Human
uuuccaggcucaaguguuccucucg

SEQ ID NO: 1120689 - RNA, 24 nt, Human
uuucgccauguuggucaggcuggu

SEQ ID NO: 1120690 - RNA, 26 nt, Human
uuuuaugaucauguagccagaccgcc

SEQ ID NO: 1120691 - RNA, 21 nt, Human
uuuuguauuuuugcuagagac

SEQ ID NO: 1120692 - RNA, 23 nt, Human
uuuuugcuagagacgggguuucg

SEQ ID NO: 1120693 - RNA, 24 nt, Human
uuuuugcuagagacgggguuucgc

SEQ ID NO: 1120694 - RNA, 20 nt, Human
uuuuuguauuuuugcuagag

SEQ ID NO: 1120695 - RNA, 25 nt, Human
aaaaaaaaaaaacagugaagcaagu

SEQ ID NO: 1120696 - RNA, 26 nt, Human
aaaaaaaaaaaacagugaagcaagug

SEQ ID NO: 1120697 - RNA, 27 nt, Human
aaaaaaaaaaaacagugaagcaaguga

SEQ ID NO: 1120698 - RNA, 20 nt, Human
aaaaaaaaaaaacgaaaaaa

SEQ ID NO: 1120699 - RNA, 21 nt, Human
aaaaagaaaacucaacagaga

SEQ ID NO: 1120700 - RNA, 22 nt, Human
aaaaagaaaacucaacagagag

SEQ ID NO: 1120701 - RNA, 18 nt, Human
aaacuuaaaaaaaaaaaa

SEQ ID NO: 1120702 - RNA, 24 nt, Human
aaagaaaacucaacagagagguuc

SEQ ID NO: 1120703 - RNA, 20 nt, Human
aagcugccgcaccccucugc

SEQ ID NO: 1120704 - RNA, 20 nt, Human
aagggccgggggugggggca

SEQ ID NO: 1120705 - RNA, 19 nt, Human
aauuccuuuguuucuugcc

SEQ ID NO: 1120706 - RNA, 22 nt, Human
acagcucgagaggugcgagcca

SEQ ID NO: 1120707 - RNA, 20 nt, Human
acccagcccauccccacccc

SEQ ID NO: 1120708 - RNA, 21 nt, Human
agaaauacaaagagcagaggg

SEQ ID NO: 1120709 - RNA, 23 nt, Human
agaccugaggccauggcaagaga

SEQ ID NO: 1120710 - RNA, 21 nt, Human
agagguucaaagugcucugag

SEQ ID NO: 1120711 - RNA, 18 nt, Human
agauccaggcccacuccc

SEQ ID NO: 1120712 - RNA, 18 nt, Human
agcaagugaagggugggg

SEQ ID NO: 1120713 - RNA, 24 nt, Human
aguuucugucuaguuuucuuuuuu

SEQ ID NO: 1120714 - RNA, 20 nt, Human
aucuggaggaaauucuggag

SEQ ID NO: 1120715 - RNA, 23 nt, Human
aucuggaggaaauucuggaggga

SEQ ID NO: 1120716 - RNA, 18 nt, Human
caaaacggaacuccagau

SEQ ID NO: 1120717 - RNA, 20 nt, Human
caacagagaaauacaaagaa

SEQ ID NO: 1120718 - RNA, 23 nt, Human
caccccucucguuucugccuccu

SEQ ID NO: 1120719 - RNA, 19 nt, Human
cacccuuugguccugugga

SEQ ID NO: 1120720 - RNA, 23 nt, Human
cacccuuugguccuguggaucuc

SEQ ID NO: 1120721 - RNA, 21 nt, Human
caccuguacgucuugcccucc

SEQ ID NO: 1120722 - RNA, 24 nt, Human
cacucccuccccaucccccugccc

SEQ ID NO: 1120723 - RNA, 21 nt, Human
cagcaccaacuuccuggccaa

SEQ ID NO: 1120724 - RNA, 24 nt, Human
cagcccauccccaccccauuuccc

SEQ ID NO: 1120725 - RNA, 24 nt, Human
caggcacucaggggcgaagggcuc

SEQ ID NO: 1120726 - RNA, 23 nt, Human
cagggcuucugcggaccaagcuu

SEQ ID NO: 1120727 - RNA, 18 nt, Human
caucccccugcccacagu

SEQ ID NO: 1120728 - RNA, 22 nt, Human
ccacucccuccccaucccccug

SEQ ID NO: 1120729 - RNA, 22 nt, Human
cccauccccaccccauuucccu

SEQ ID NO: 1120730 - RNA, 23 nt, Human
ccccaccccauuucccugggccc

SEQ ID NO: 1120731 - RNA, 18 nt, Human
ccccaugggcaaagaaac

SEQ ID NO: 1120732 - RNA, 18 nt, Human
ccccggagggagcugggg

SEQ ID NO: 1120733 - RNA, 18 nt, Human
ccccggggaucccuuccc

SEQ ID NO: 1120734 - RNA, 22 nt, Human
cccugggcccgccacccagccc

SEQ ID NO: 1120735 - RNA, 18 nt, Human
ccucaccucccugccucc

SEQ ID NO: 1120736 - RNA, 20 nt, Human
ccucaccucccugccuccaa

SEQ ID NO: 1120737 - RNA, 23 nt, Human
ccucggcuggggauucccacucc

SEQ ID NO: 1120738 - RNA, 19 nt, Human
ccucugguucucugcgucc

SEQ ID NO: 1120739 - RNA, 20 nt, Human
ccucugguucucugcgucca

SEQ ID NO: 1120740 - RNA, 19 nt, Human
ccugaagcugccgcacccc

SEQ ID NO: 1120741 - RNA, 21 nt, Human
ccugggaccugccuccccggg

SEQ ID NO: 1120742 - RNA, 28 nt, Human
cgucuugcccuccuuggcagucucgccc

SEQ ID NO: 1120743 - RNA, 18 nt, Human
cuacaaggacaggcggac

SEQ ID NO: 1120744 - RNA, 23 nt, Human
cuauauacaccgacacgcauggu

SEQ ID NO: 1120745 - RNA, 22 nt, Human
cuccggcugcuuccugccccuc

SEQ ID NO: 1120746 - RNA, 24 nt, Human
cuccugaagcugccgcaccccucu

SEQ ID NO: 1120747 - RNA, 19 nt, Human
cuccugggaccugccuccc

SEQ ID NO: 1120748 - RNA, 21 nt, Human
cuccuuggcagucucgcccga

SEQ ID NO: 1120749 - RNA, 20 nt, Human
cucugcucagugaugcccag

SEQ ID NO: 1120750 - RNA, 18 nt, Human
cugaagcugccgcacccc

SEQ ID NO: 1120751 - RNA, 23 nt, Human
cugaagcugccgcaccccucugc

SEQ ID NO: 1120752 - RNA, 18 nt, Human
cuuggugguuccuggagg

SEQ ID NO: 1120753 - RNA, 18 nt, Human
cuuggugguuccuggagg

SEQ ID NO: 1120754 - RNA, 20 nt, Human
cuuuggaugccaccaaaaca

SEQ ID NO: 1120755 - RNA, 24 nt, Human
gaacaaaaagaaaacucaacagag

SEQ ID NO: 1120756 - RNA, 23 nt, Human
gaagcugccgcaccccucugcuc

SEQ ID NO: 1120757 - RNA, 20 nt, Human
gacuuggugaaaaaggucag

SEQ ID NO: 1120758 - RNA, 20 nt, Human
gagaggugcgagccaggcac

SEQ ID NO: 1120759 - RNA, 24 nt, Human
gagccaggcacucaggggcgaagg

SEQ ID NO: 1120760 - RNA, 22 nt, Human
gagggcccccggagggagcugg

SEQ ID NO: 1120761 - RNA, 25 nt, Human
gagggcccccggagggagcuggggc

SEQ ID NO: 1120762 - RNA, 19 nt, Human
gccaagcaggccguggccc

SEQ ID NO: 1120763 - RNA, 21 nt, Human
gcccagggcacagcucgagag

SEQ ID NO: 1120764 - RNA, 19 nt, Human
gccgcaccccucugcucag

SEQ ID NO: 1120765 - RNA, 25 nt, Human
ggacaggcggaccccccggguucuc

SEQ ID NO: 1120766 - RNA, 22 nt, Human
ggaccccccggguucuccgccu

SEQ ID NO: 1120767 - RNA, 22 nt, Human
ggaugccaccaaaacaguccag

SEQ ID NO: 1120768 - RNA, 18 nt, Human
ggcagggucugcuccugg

SEQ ID NO: 1120769 - RNA, 22 nt, Human
ggccagcaccgagguagacugg

SEQ ID NO: 1120770 - RNA, 23 nt, Human
ggcccgagccuucccucaagacc

SEQ ID NO: 1120771 - RNA, 24 nt, Human
ggccgggggugggggcagagaacc

SEQ ID NO: 1120772 - RNA, 22 nt, Human
gggaacaaaaagaaaacucaac

SEQ ID NO: 1120773 - RNA, 24 nt, Human
gggauaggggacuacaaggacagg

SEQ ID NO: 1120774 - RNA, 19 nt, Human
gggcagcaggggagggcca

SEQ ID NO: 1120775 - RNA, 21 nt, Human
ggguggucuucagggcagcag

SEQ ID NO: 1120776 - RNA, 18 nt, Human
gugaaaaaggucaguggg

SEQ ID NO: 1120777 - RNA, 19 nt, Human
guucggacuugggggggcc

SEQ ID NO: 1120778 - RNA, 21 nt, Human
uacccagcccauccccacccc

SEQ ID NO: 1120779 - RNA, 20 nt, Human
uaccuuacaccuguacgucu

SEQ ID NO: 1120780 - RNA, 23 nt, Human
uagaugaguuucugucuaguuuu

SEQ ID NO: 1120781 - RNA, 21 nt, Human
uagcagcaccaacuuccuggc

SEQ ID NO: 1120782 - RNA, 21 nt, Human
ucaaagugcucugagaucguc

SEQ ID NO: 1120783 - RNA, 19 nt, Human
ucaccucccugccuccaag

SEQ ID NO: 1120784 - RNA, 23 nt, Human
ucagugaugcccagggcacagcu

SEQ ID NO: 1120785 - RNA, 23 nt, Human
uccauggcagggaagaccggggc

SEQ ID NO: 1120786 - RNA, 20 nt, Human
ucccagauccaggcccacuc

SEQ ID NO: 1120787 - RNA, 23 nt, Human
uccccaccccauuucccugggcc

SEQ ID NO: 1120788 - RNA, 23 nt, Human
ucccugggcccgccacccagccc

SEQ ID NO: 1120789 - RNA, 19 nt, Human
ucggucuuagcagcaccaa

SEQ ID NO: 1120790 - RNA, 19 nt, Human
ucugacuuggugaaaaagg

SEQ ID NO: 1120791 - RNA, 21 nt, Human
ucuguacaugguuccuauaua

SEQ ID NO: 1120792 - RNA, 24 nt, Human
ucuugauggaguccaggagagggg

SEQ ID NO: 1120793 - RNA, 21 nt, Human
ucuuuggaugccaccaaaaca

SEQ ID NO: 1120794 - RNA, 21 nt, Human
ugagaucgucuuuggaugcca

SEQ ID NO: 1120795 - RNA, 25 nt, Human
ugcccagggcacagcucgagaggug

SEQ ID NO: 1120796 - RNA, 24 nt, Human
ugccuccugaagcugccgcacccc

SEQ ID NO: 1120797 - RNA, 26 nt, Human
ugccugggucugugucugccagugga

SEQ ID NO: 1120798 - RNA, 18 nt, Human
ugcgagccaggcacucag

SEQ ID NO: 1120799 - RNA, 24 nt, Human
uggcagggaagacaaauaaccccu

SEQ ID NO: 1120800 - RNA, 24 nt, Human
uggcagucucgcccgaggccagga

SEQ ID NO: 1120801 - RNA, 21 nt, Human
ugggccggguggggcggcgcc

SEQ ID NO: 1120802 - RNA, 18 nt, Human
ugggguggucuucagggc

SEQ ID NO: 1120803 - RNA, 21 nt, Human
ugggguggucuucagggcagc

SEQ ID NO: 1120804 - RNA, 20 nt, Human
uggggugugucugugggggc

SEQ ID NO: 1120805 - RNA, 19 nt, Human
uguagggggcuucucuggg

SEQ ID NO: 1120806 - RNA, 18 nt, Human
ugugggggcugggggcag

SEQ ID NO: 1120807 - RNA, 23 nt, Human
uuccugccccucccaccuggggg

SEQ ID NO: 1120808 - RNA, 19 nt, Human
uuccuggccagcaccgagg

SEQ ID NO: 1120809 - RNA, 20 nt, Human
uucucggucuuagcagcacc

SEQ ID NO: 1120810 - RNA, 23 nt, Human
uugauuuucauuugcuccccacu

SEQ ID NO: 1120811 - RNA, 20 nt, Human
uugcuccccacucccuuuuu

SEQ ID NO: 1120812 - RNA, 22 nt, Human
uuggugguuccuggagggcccc

SEQ ID NO: 1120813 - RNA, 20 nt, Human
uuucuuuuuuuucccggggg

SEQ ID NO: 1120814 - RNA, 21 nt, Human
aaaaggaagaggaaaacaaaa

SEQ ID NO: 1120815 - RNA, 22 nt, Human
aacaguucuucguaggagucuu

SEQ ID NO: 1120816 - RNA, 24 nt, Human
aaggaagaggaaaacaaaaacagu

SEQ ID NO: 1120817 - RNA, 20 nt, Human
accuacugccacagcagaga

SEQ ID NO: 1120818 - RNA, 24 nt, Human
acuccuuucucggaguuggcuguu

SEQ ID NO: 1120819 - RNA, 22 nt, Human
aggcacaccuacugccacagca

SEQ ID NO: 1120820 - RNA, 22 nt, Human
aggcugugcccugauuuucccu

SEQ ID NO: 1120821 - RNA, 26 nt, Human
caaauuuccauauaucaaaaaaaagc

SEQ ID NO: 1120822 - RNA, 23 nt, Human
cacaccuacugccacagcagaga

SEQ ID NO: 1120823 - RNA, 21 nt, Human
ccuugggggguugaagaauuc

SEQ ID NO: 1120824 - RNA, 25 nt, Human
cucaaaaggaagaggaaaacaaaaa

SEQ ID NO: 1120825 - RNA, 24 nt, Human
cugcugacaucagugauccucucu

SEQ ID NO: 1120826 - RNA, 29 nt, Human
cugugcccugauuuucccuuucugaaagg

SEQ ID NO: 1120827 - RNA, 23 nt, Human
gcaugaggcacaccuacugccac

SEQ ID NO: 1120828 - RNA, 18 nt, Human
ggaaaacaaaaacaguuc

SEQ ID NO: 1120829 - RNA, 22 nt, Human
gugaauauuuggggaacacaga

SEQ ID NO: 1120830 - RNA, 22 nt, Human
uauaugucuuaaccaacuugga

SEQ ID NO: 1120831 - RNA, 21 nt, Human
uauucuucuuucaaccuggau

SEQ ID NO: 1120832 - RNA, 20 nt, Human
ucaaaaggaagaggaaaaca

SEQ ID NO: 1120833 - RNA, 20 nt, Human
ucccuugggggguugaagaa

SEQ ID NO: 1120834 - RNA, 24 nt, Human
uccucucuggggugaggcuggagg

SEQ ID NO: 1120835 - RNA, 19 nt, Human
uggggugaggcuggagggc

SEQ ID NO: 1120836 - RNA, 23 nt, Human
uuaaagugugaauauuuggggaa

SEQ ID NO: 1120837 - RNA, 20 nt, Human
uuagucccuacccugccgcu

SEQ ID NO: 1120838 - RNA, 21 nt, Human
uuggcgcacacccuuaaagga

SEQ ID NO: 1120839 - RNA, 24 nt, Human
uuuggggaacacagaccaaggcug

SEQ ID NO: 1120840 - RNA, 21 nt, Human
aaacaaacacagggucuccua

SEQ ID NO: 1120841 - RNA, 19 nt, Human
aaauacacacacgaagaca

SEQ ID NO: 1120842 - RNA, 23 nt, Human
aacacagacuccccacacacacc

SEQ ID NO: 1120843 - RNA, 22 nt, Human
aaccaaagaaggacaggaguug

SEQ ID NO: 1120844 - RNA, 22 nt, Human
aagaggaaacagaaguugagag

SEQ ID NO: 1120845 - RNA, 21 nt, Human
aagcagcaggccaggaccugc

SEQ ID NO: 1120846 - RNA, 21 nt, Human
aaggaccagccccauguccuc

SEQ ID NO: 1120847 - RNA, 23 nt, Human
aauaugggcaacuaaaauugaaa

SEQ ID NO: 1120848 - RNA, 23 nt, Human
acacacccaugccugggcacaca

SEQ ID NO: 1120849 - RNA, 23 nt, Human
acacagagauacaugcaugaaca

SEQ ID NO: 1120850 - RNA, 23 nt, Human
acacagagcacagagauacacca

SEQ ID NO: 1120851 - RNA, 21 nt, Human
acacgaagacacacacccaga

SEQ ID NO: 1120852 - RNA, 25 nt, Human
acagacuccccacacacacccaugc

SEQ ID NO: 1120853 - RNA, 21 nt, Human
acagagauacaugcaugaaca

SEQ ID NO: 1120854 - RNA, 33 nt, Human
acaugcacauacacacauacccaccugugcagu

SEQ ID NO: 1120855 - RNA, 21 nt, Human
acaugcaugcaaacacacguc

SEQ ID NO: 1120856 - RNA, 22 nt, Human
acgaagacacacacccagaaac

SEQ ID NO: 1120857 - RNA, 18 nt, Human
agaaguugagagacagga

SEQ ID NO: 1120858 - RNA, 25 nt, Human
agacuccacauagaagcagccaggc

SEQ ID NO: 1120859 - RNA, 19 nt, Human
agagagaccuaaacacaca

SEQ ID NO: 1120860 - RNA, 19 nt, Human
agagauacaccagagagac

SEQ ID NO: 1120861 - RNA, 24 nt, Human
agagauacaccagagagaccuaaa

SEQ ID NO: 1120862 - RNA, 18 nt, Human
agagcacagagauacacc

SEQ ID NO: 1120863 - RNA, 18 nt, Human
agagcccaacccucugcc

SEQ ID NO: 1120864 - RNA, 18 nt, Human
agccaagacaugcacaua

SEQ ID NO: 1120865 - RNA, 20 nt, Human
agcccaacccucugcccuuc

SEQ ID NO: 1120866 - RNA, 22 nt, Human
agguccugggccagggcagcac

SEQ ID NO: 1120867 - RNA, 18 nt, Human
auaaaggaccagccccau

SEQ ID NO: 1120868 - RNA, 24 nt, Human
auacacacacgaagacacacaccc

SEQ ID NO: 1120869 - RNA, 27 nt, Human
auacacacauacccaccugugcacaca

SEQ ID NO: 1120870 - RNA, 23 nt, Human
auccagaacucacuccuuccgau

SEQ ID NO: 1120871 - RNA, 18 nt, Human
augaacacagacucccca

SEQ ID NO: 1120872 - RNA, 19 nt, Human
augaacacagacuccccac

SEQ ID NO: 1120873 - RNA, 26 nt, Human
augggguggagggacagcaggaagag

SEQ ID NO: 1120874 - RNA, 20 nt, Human
caaagcaguguggcccggac

SEQ ID NO: 1120875 - RNA, 21 nt, Human
caaggcaccucaagguaaggg

SEQ ID NO: 1120876 - RNA, 19 nt, Human
cacacccagaaacacuuca

SEQ ID NO: 1120877 - RNA, 18 nt, Human
cacacgaagacacacacc

SEQ ID NO: 1120878 - RNA, 21 nt, Human
cacagacuccccacacacacc

SEQ ID NO: 1120879 - RNA, 26 nt, Human
cacauacacacauacccaccugugca

SEQ ID NO: 1120880 - RNA, 25 nt, Human
cacauacaugaccaaaugugugcac

SEQ ID NO: 1120881 - RNA, 27 nt, Human
cacaugcaugcaaacacacgucacaua

SEQ ID NO: 1120882 - RNA, 22 nt, Human
caccagagagaccuaaacacac

SEQ ID NO: 1120883 - RNA, 22 nt, Human
caccaggaagaaggaauggcuc

SEQ ID NO: 1120884 - RNA, 22 nt, Human
cacccagaaacacuucacacac

SEQ ID NO: 1120885 - RNA, 24 nt, Human
cacccccagcgcccguaccagcuc

SEQ ID NO: 1120886 - RNA, 20 nt, Human
caccuggacaguggcauccc

SEQ ID NO: 1120887 - RNA, 30 nt, Human
cacgucacauacaugaccaaaugugugcag

SEQ ID NO: 1120888 - RNA, 20 nt, Human
cagacuccccacacacaccc

SEQ ID NO: 1120889 - RNA, 18 nt, Human
cagagcccaacccucugc

SEQ ID NO: 1120890 - RNA, 19 nt, Human
cagcacagccacuguuccc

SEQ ID NO: 1120891 - RNA, 18 nt, Human
cagcccucuuggcaauga

SEQ ID NO: 1120892 - RNA, 22 nt, Human
cagccuccagugccugccuccc

SEQ ID NO: 1120893 - RNA, 24 nt, Human
caggaccugccucugggguccagc

SEQ ID NO: 1120894 - RNA, 20 nt, Human
cauccccgaggcacccugca

SEQ ID NO: 1120895 - RNA, 24 nt, Human
caugaccaaaugugugcacacacc

SEQ ID NO: 1120896 - RNA, 27 nt, Human
caugcaaacacacgucacauacaugac

SEQ ID NO: 1120897 - RNA, 21 nt, Human
caugcagacagacuccacaua

SEQ ID NO: 1120898 - RNA, 23 nt, Human
caugcagacagacuccacauaga

SEQ ID NO: 1120899 - RNA, 20 nt, Human
cauguacguguccacaugug

SEQ ID NO: 1120900 - RNA, 25 nt, Human
ccaaaaaaacuacuuguauccaagu

SEQ ID NO: 1120901 - RNA, 21 nt, Human
ccaccgggcuccagcacagcc

SEQ ID NO: 1120902 - RNA, 20 nt, Human
ccagaccacagccuucaacc

SEQ ID NO: 1120903 - RNA, 21 nt, Human
ccagcacguguugaugugcca

SEQ ID NO: 1120904 - RNA, 18 nt, Human
ccagggccuggggacacc

SEQ ID NO: 1120905 - RNA, 19 nt, Human
ccauccuggcccacccacc

SEQ ID NO: 1120906 - RNA, 24 nt, Human
cccacacacacccaugccugggca

SEQ ID NO: 1120907 - RNA, 18 nt, Human
cccagaaacacuucacac

SEQ ID NO: 1120908 - RNA, 21 nt, Human
cccggacaccaacccaucaca

SEQ ID NO: 1120909 - RNA, 21 nt, Human
cccguaccagcucaccuccuc

SEQ ID NO: 1120910 - RNA, 19 nt, Human
cccucggaaacuagcugga

SEQ ID NO: 1120911 - RNA, 19 nt, Human
cccuucuaucucucuuucc

SEQ ID NO: 1120912 - RNA, 22 nt, Human
ccucagggagguccugggccag

SEQ ID NO: 1120913 - RNA, 25 nt, Human
ccugacuuccucauuggcgcuucca

SEQ ID NO: 1120914 - RNA, 19 nt, Human
ccuugacaccacgcuccuc

SEQ ID NO: 1120915 - RNA, 20 nt, Human
cggaucaucuccaaaaaaac

SEQ ID NO: 1120916 - RNA, 22 nt, Human
cguacacacucgcacaugcaug

SEQ ID NO: 1120917 - RNA, 22 nt, Human
cguacacacucgcacaugcaug

SEQ ID NO: 1120918 - RNA, 18 nt, Human
cguaccagcucaccuccu

SEQ ID NO: 1120919 - RNA, 20 nt, Human
cuccaaaaaaacuacuugua

SEQ ID NO: 1120920 - RNA, 24 nt, Human
cucgcacaugcaugcaaacacacg

SEQ ID NO: 1120921 - RNA, 18 nt, Human
cucuccuccagggccugg

SEQ ID NO: 1120922 - RNA, 21 nt, Human
cucugcccuuccucuccucca

SEQ ID NO: 1120923 - RNA, 20 nt, Human
cugacccccagcuccuggga

SEQ ID NO: 1120924 - RNA, 23 nt, Human
cugcaucaguccuuucauccccg

SEQ ID NO: 1120925 - RNA, 22 nt, Human
cuggggacaccuggacaguggc

SEQ ID NO: 1120926 - RNA, 21 nt, Human
cuggugcagcggcccacagug

SEQ ID NO: 1120927 - RNA, 24 nt, Human
cuuccucuccuccagggccugggg

SEQ ID NO: 1120928 - RNA, 21 nt, Human
cuugacaccacgcuccucagg

SEQ ID NO: 1120929 - RNA, 21 nt, Human
gacaugcacauacacacauag

SEQ ID NO: 1120930 - RNA, 29 nt, Human
gcacauacacacauacccaccugugcaca

SEQ ID NO: 1120931 - RNA, 19 nt, Human
gcaugcaaacacacgucac

SEQ ID NO: 1120932 - RNA, 21 nt, Human
gcccacccaccgggcuccagc

SEQ ID NO: 1120933 - RNA, 19 nt, Human
gcccggacaccaacccauc

SEQ ID NO: 1120934 - RNA, 18 nt, Human
gccuccuggggagugcuc

SEQ ID NO: 1120935 - RNA, 20 nt, Human
gcucuuaagccaccagggag

SEQ ID NO: 1120936 - RNA, 19 nt, Human
gcuuccggcugccuccugg

SEQ ID NO: 1120937 - RNA, 22 nt, Human
ggagggacugagcagcaagagu

SEQ ID NO: 1120938 - RNA, 19 nt, Human
gggacaggcucucgguagc

SEQ ID NO: 1120939 - RNA, 21 nt, Human
gggguccagcacagccacugu

SEQ ID NO: 1120940 - RNA, 20 nt, Human
ggguccagcacagccacugu

SEQ ID NO: 1120941 - RNA, 20 nt, Human
guacguguccacauguguuc

SEQ ID NO: 1120942 - RNA, 20 nt, Human
gucaagauauuuacaaagca

SEQ ID NO: 1120943 - RNA, 19 nt, Human
gugcagcggcccacagugg

SEQ ID NO: 1120944 - RNA, 19 nt, Human
guggcccggacaccaaccc

SEQ ID NO: 1120945 - RNA, 22 nt, Human
guggcccggacaccaacccauc

SEQ ID NO: 1120946 - RNA, 19 nt, Human
uacaugaccaaaugugugc

SEQ ID NO: 1120947 - RNA, 22 nt, Human
uacccaccugugcacacagagc

SEQ ID NO: 1120948 - RNA, 20 nt, Human
uagaagcagccaggcucugc

SEQ ID NO: 1120949 - RNA, 23 nt, Human
uagcagaggcggaaggagccaua

SEQ ID NO: 1120950 - RNA, 22 nt, Human
uagugggaugauucugagguuc

SEQ ID NO: 1120951 - RNA, 19 nt, Human
uccacauccagaacucacu

SEQ ID NO: 1120952 - RNA, 18 nt, Human
uccacauguguucuaagc

SEQ ID NO: 1120953 - RNA, 23 nt, Human
uccacggaucaucuccaaaaaaa

SEQ ID NO: 1120954 - RNA, 29 nt, Human
uccaggcagcucauaucaugcccagcccu

SEQ ID NO: 1120955 - RNA, 21 nt, Human
uccggcugccuccuggggagu

SEQ ID NO: 1120956 - RNA, 21 nt, Human
ucucagagucugcuuuugggg

SEQ ID NO: 1120957 - RNA, 24 nt, Human
ucucauucugugggcuuucuccag

SEQ ID NO: 1120958 - RNA, 23 nt, Human
ucuccagcacccucggaaacuag

SEQ ID NO: 1120959 - RNA, 20 nt, Human
ucucuuuccugacuuccuca

SEQ ID NO: 1120960 - RNA, 18 nt, Human
ucugcccuuccucuccuc

SEQ ID NO: 1120961 - RNA, 19 nt, Human
ugauguugacagcggccau

SEQ ID NO: 1120962 - RNA, 23 nt, Human
ugcaaaaugauuuccagccucca

SEQ ID NO: 1120963 - RNA, 27 nt, Human
ugcaugcaaacacacgucacauacaug

SEQ ID NO: 1120964 - RNA, 18 nt, Human
ugcccgugcaaaaugauu

SEQ ID NO: 1120965 - RNA, 21 nt, Human
ugcccuuccucuccuccaggg

SEQ ID NO: 1120966 - RNA, 18 nt, Human
ugccucugggguccagca

SEQ ID NO: 1120967 - RNA, 19 nt, Human
ugccugggcacacaugcgg

SEQ ID NO: 1120968 - RNA, 20 nt, Human
ugcugcacacgcucugaucu

SEQ ID NO: 1120969 - RNA, 19 nt, Human
uggaaaacaacccacgccu

SEQ ID NO: 1120970 - RNA, 18 nt, Human
uggaaugggguggaggga

SEQ ID NO: 1120971 - RNA, 21 nt, Human
uggaaugggguggagggacag

SEQ ID NO: 1120972 - RNA, 21 nt, Human
uggaggaagauccuguuggcc

SEQ ID NO: 1120973 - RNA, 21 nt, Human
uggccaucuuugagauaauac

SEQ ID NO: 1120974 - RNA, 24 nt, Human
uggcccacccaccgggcuccagca

SEQ ID NO: 1120975 - RNA, 24 nt, Human
uggcucuuaagccaccagggagaa

SEQ ID NO: 1120976 - RNA, 24 nt, Human
ugggacagagcccaacccucugcc

SEQ ID NO: 1120977 - RNA, 19 nt, Human
ugggagggacugagcagca

SEQ ID NO: 1120978 - RNA, 18 nt, Human
ugggaugauucugagguu

SEQ ID NO: 1120979 - RNA, 22 nt, Human
ugggaugauucugagguucuac

SEQ ID NO: 1120980 - RNA, 21 nt, Human
ugucucagagucugcuuuugg

SEQ ID NO: 1120981 - RNA, 23 nt, Human
ugucucagagucugcuuuugggg

SEQ ID NO: 1120982 - RNA, 23 nt, Human
ugugugcacacaccaagacggug

SEQ ID NO: 1120983 - RNA, 23 nt, Human
uuccagccuccagugccugccuc

SEQ ID NO: 1120984 - RNA, 23 nt, Human
uuccggggaagcccccuccaaug

SEQ ID NO: 1120985 - RNA, 20 nt, Human
uuccuccacauccagaacuc

SEQ ID NO: 1120986 - RNA, 18 nt, Human
uuccucuccuccagggcc

SEQ ID NO: 1120987 - RNA, 24 nt, Human
uugacuuuucucccuucuaucucu

SEQ ID NO: 1120988 - RNA, 21 nt, Human
uugggcccggagcccuccauu

SEQ ID NO: 1120989 - RNA, 19 nt, Human
acucaucccaggucuccug

SEQ ID NO: 1120990 - RNA, 18 nt, Human
caggucuccugaaggacc

SEQ ID NO: 1120991 - RNA, 21 nt, Human
uaaccgggaaggacggugcgg

SEQ ID NO: 1120992 - RNA, 22 nt, Human
uuuuggggaagcaccacucauc

SEQ ID NO: 1120993 - RNA, 21 nt, Human
aaaaaagaaaaacaaccaaaa

SEQ ID NO: 1120994 - RNA, 27 nt, Human
aaaaaagaaaaacaaccaaaacaagcc

SEQ ID NO: 1120995 - RNA, 20 nt, Human
aacuuuguuuagguccuugu

SEQ ID NO: 1120996 - RNA, 19 nt, Human
agaaaaacaaccaaaacaa

SEQ ID NO: 1120997 - RNA, 21 nt, Human
aguacagucuauuaaaaugcc

SEQ ID NO: 1120998 - RNA, 19 nt, Human
caacaaacaacaaagguuu

SEQ ID NO: 1120999 - RNA, 24 nt, Human
cacaauaccaacaaagaauacgga

SEQ ID NO: 1121000 - RNA, 21 nt, Human
cagcuauaucuuaaacuccaa

SEQ ID NO: 1121001 - RNA, 22 nt, Human
cauaagcaaugcuacugcaucu

SEQ ID NO: 1121002 - RNA, 24 nt, Human
caugucacauugcaaguauauaua

SEQ ID NO: 1121003 - RNA, 23 nt, Human
ccacacugccaccgacaugaaua

SEQ ID NO: 1121004 - RNA, 23 nt, Human
ccauugcagcaguugucugcaug

SEQ ID NO: 1121005 - RNA, 20 nt, Human
cuaaauauaaacucugcacu

SEQ ID NO: 1121006 - RNA, 18 nt, Human
cuauauaaaggaaaagaa

SEQ ID NO: 1121007 - RNA, 19 nt, Human
cucauagcaauacuguuga

SEQ ID NO: 1121008 - RNA, 19 nt, Human
cugcauguguugcggugaa

SEQ ID NO: 1121009 - RNA, 18 nt, Human
gaaauuauauuauguuca

SEQ ID NO: 1121010 - RNA, 18 nt, Human
gaccugaacugaugggaa

SEQ ID NO: 1121011 - RNA, 19 nt, Human
gcacauuaaaaaaaauggu

SEQ ID NO: 1121012 - RNA, 20 nt, Human
gcagcaguugucugcaugug

SEQ ID NO: 1121013 - RNA, 19 nt, Human
gcugaucugcaggcuggag

SEQ ID NO: 1121014 - RNA, 19 nt, Human
guggcacaauaccaacaaa

SEQ ID NO: 1121015 - RNA, 18 nt, Human
guuauuugguguuggaag

SEQ ID NO: 1121016 - RNA, 19 nt, Human
uaaaaugccuuauuuggag

SEQ ID NO: 1121017 - RNA, 20 nt, Human
uaaacauauguaacauaagc

SEQ ID NO: 1121018 - RNA, 28 nt, Human
uaaaggaaaagaacuucucaaaaacaau

SEQ ID NO: 1121019 - RNA, 25 nt, Human
uaaauauaaugcuggucagcaaugc

SEQ ID NO: 1121020 - RNA, 23 nt, Human
uaauaaaucucacaacaaugcac

SEQ ID NO: 1121021 - RNA, 22 nt, Human
uauauuauguucagauauuuca

SEQ ID NO: 1121022 - RNA, 22 nt, Human
ucagugguuuccuuaaaacuag

SEQ ID NO: 1121023 - RNA, 22 nt, Human
uccaaauacauacuuuuuacaa

SEQ ID NO: 1121024 - RNA, 23 nt, Human
uccuaaaaaagaaaaacaaccaa

SEQ ID NO: 1121025 - RNA, 24 nt, Human
ucuacagaaccaugucacauugca

SEQ ID NO: 1121026 - RNA, 20 nt, Human
ugaauauaaacauauguaac

SEQ ID NO: 1121027 - RNA, 19 nt, Human
ugcaaauaaacaaaaaaau

SEQ ID NO: 1121028 - RNA, 20 nt, Human
ugcaggcuggagccccuggu

SEQ ID NO: 1121029 - RNA, 22 nt, Human
ugcugguuuaagaagcaguaca

SEQ ID NO: 1121030 - RNA, 19 nt, Human
uggaauuuccacacugcca

SEQ ID NO: 1121031 - RNA, 18 nt, Human
uggagccccuggucugga

SEQ ID NO: 1121032 - RNA, 18 nt, Human
uggcacaauaccaacaaa

SEQ ID NO: 1121033 - RNA, 19 nt, Human
uggcacaauaccaacaaag

SEQ ID NO: 1121034 - RNA, 18 nt, Human
uggcugaucugcaggcug

SEQ ID NO: 1121035 - RNA, 19 nt, Human
ugggaagacaugccaaauc

SEQ ID NO: 1121036 - RNA, 23 nt, Human
ugggaagacaugccaaauccauu

SEQ ID NO: 1121037 - RNA, 20 nt, Human
uuuaauaaaucucacaacaa

SEQ ID NO: 1121038 - RNA, 21 nt, Human
uuuccuuauaaaaucuuuuua

SEQ ID NO: 1121039 - RNA, 22 nt, Human
aacccaucuuugcaugugggca

SEQ ID NO: 1121040 - RNA, 24 nt, Human
aggcaauucccaaagaggacugaa

SEQ ID NO: 1121041 - RNA, 21 nt, Human
agugaucuugggugaggugac

SEQ ID NO: 1121042 - RNA, 26 nt, Human
caccaucagcaacugggggaguaguc

SEQ ID NO: 1121043 - RNA, 20 nt, Human
cagaguagucucaaguuggg

SEQ ID NO: 1121044 - RNA, 22 nt, Human
cugaaaacugagggcugaccac

SEQ ID NO: 1121045 - RNA, 20 nt, Human
ucagaaugugcuguucucau

SEQ ID NO: 1121046 - RNA, 21 nt, Human
ugagggcugaccacaccauca

SEQ ID NO: 1121047 - RNA, 24 nt, Human
ugauauacuacaccacaucagaau

SEQ ID NO: 1121048 - RNA, 19 nt, Human
ugggggaguagucuccaau

SEQ ID NO: 1121049 - RNA, 21 nt, Human
uugggugaggugacuuucuuc

SEQ ID NO: 1121050 - RNA, 26 nt, Human
aagaacaagcuuugacuuaggcucug

SEQ ID NO: 1121051 - RNA, 27 nt, Human
aggaagacauaccauucacuggaagga

SEQ ID NO: 1121052 - RNA, 24 nt, Human
ccagcuguucucacaagugcguca

SEQ ID NO: 1121053 - RNA, 19 nt, Human
ccuggguccaagaacaagc

SEQ ID NO: 1121054 - RNA, 18 nt, Human
gauauaucagcucugaaa

SEQ ID NO: 1121055 - RNA, 26 nt, Human
ggcuggaagcuagcugucccgccgac

SEQ ID NO: 1121056 - RNA, 26 nt, Human
uaggaagacauaccauucacuggaag

SEQ ID NO: 1121057 - RNA, 18 nt, Human
uggaagcuagcuguccuu

SEQ ID NO: 1121058 - RNA, 22 nt, Human
uggaaggauuugacauauuucc

SEQ ID NO: 1121059 - RNA, 24 nt, Human
uggaaggauuugacauauuuccug

SEQ ID NO: 1121060 - RNA, 19 nt, Human
uuuccuggguccaagaaca

SEQ ID NO: 1121061 - RNA, 22 nt, Human
aaaagaaaagaaguuuggggaa

SEQ ID NO: 1121062 - RNA, 25 nt, Human
aaacagggugacacagaccggaccc

SEQ ID NO: 1121063 - RNA, 18 nt, Human
aaacauagcacacaaugu

SEQ ID NO: 1121064 - RNA, 23 nt, Human
aaacauagcacacaauguguugc

SEQ ID NO: 1121065 - RNA, 26 nt, Human
aacccccagcauaacucccacccaag

SEQ ID NO: 1121066 - RNA, 22 nt, Human
aagacaaaucccacacacccuc

SEQ ID NO: 1121067 - RNA, 19 nt, Human
aagcagcaauucucucuca

SEQ ID NO: 1121068 - RNA, 24 nt, Human
aaucccaccacacacgccaagaag

SEQ ID NO: 1121069 - RNA, 20 nt, Human
acagguuucagaugggagcu

SEQ ID NO: 1121070 - RNA, 23 nt, Human
accccaaucccaccacacacgcc

SEQ ID NO: 1121071 - RNA, 18 nt, Human
accuacucccccacacca

SEQ ID NO: 1121072 - RNA, 21 nt, Human
accuuguggccuuccagccuc

SEQ ID NO: 1121073 - RNA, 21 nt, Human
agaaaaagggcauggccaugg

SEQ ID NO: 1121074 - RNA, 21 nt, Human
agaaaugcaccucuccgucuc

SEQ ID NO: 1121075 - RNA, 21 nt, Human
agacaaaucccacacacccuc

SEQ ID NO: 1121076 - RNA, 22 nt, Human
agauugacaaacagggugacac

SEQ ID NO: 1121077 - RNA, 20 nt, Human
agcugaagacaaaucccaca

SEQ ID NO: 1121078 - RNA, 22 nt, Human
aggccucucccaucucagucuc

SEQ ID NO: 1121079 - RNA, 19 nt, Human
aucccacacacccuccagc

SEQ ID NO: 1121080 - RNA, 21 nt, Human
augcagcaucauaaaacaaag

SEQ ID NO: 1121081 - RNA, 24 nt, Human
caacccccagcauaacucccaccc

SEQ ID NO: 1121082 - RNA, 20 nt, Human
caacccccagcauaacuccu

SEQ ID NO: 1121083 - RNA, 22 nt, Human
caagaagccccuaggagcccga

SEQ ID NO: 1121084 - RNA, 24 nt, Human
caagaagccccuaggagcccgaug

SEQ ID NO: 1121085 - RNA, 20 nt, Human
cacacacccuccagccccuc

SEQ ID NO: 1121086 - RNA, 20 nt, Human
cacacacgccaagaagcccc

SEQ ID NO: 1121087 - RNA, 20 nt, Human
cacacccuccagccccuccc

SEQ ID NO: 1121088 - RNA, 24 nt, Human
cacagguuucagaugggagcuggg

SEQ ID NO: 1121089 - RNA, 20 nt, Human
caccacacacgccaagaagc

SEQ ID NO: 1121090 - RNA, 27 nt, Human
caccccuccucagcugaaaauagccca

SEQ ID NO: 1121091 - RNA, 19 nt, Human
caccuuguggccuuccagc

SEQ ID NO: 1121092 - RNA, 19 nt, Human
caccuuguggccuuccagc

SEQ ID NO: 1121093 - RNA, 21 nt, Human
caccuuguggccuuccagccu

SEQ ID NO: 1121094 - RNA, 23 nt, Human
cacgccaagaagccccuaggagc

SEQ ID NO: 1121095 - RNA, 19 nt, Human
cacgcuccucuccaggcua

SEQ ID NO: 1121096 - RNA, 21 nt, Human
cacugaugcucagaagggcuc

SEQ ID NO: 1121097 - RNA, 26 nt, Human
cagcaauucucucucaggagaggucu

SEQ ID NO: 1121098 - RNA, 21 nt, Human
cauucuguuccuuagcaagca

SEQ ID NO: 1121099 - RNA, 19 nt, Human
ccacacacgccaagaagcu

SEQ ID NO: 1121100 - RNA, 21 nt, Human
ccagccccucccauuugagaa

SEQ ID NO: 1121101 - RNA, 21 nt, Human
ccagccuccgcucccaggaac

SEQ ID NO: 1121102 - RNA, 20 nt, Human
ccagucaccagcagaaaugc

SEQ ID NO: 1121103 - RNA, 23 nt, Human
ccagucaccagcagaaaugcacc

SEQ ID NO: 1121104 - RNA, 23 nt, Human
cccacaccacugaugcucagaag

SEQ ID NO: 1121105 - RNA, 18 nt, Human
cccacgguacagagcagc

SEQ ID NO: 1121106 - RNA, 21 nt, Human
cccacgguacagagcagccac

SEQ ID NO: 1121107 - RNA, 25 nt, Human
ccccaaucccaccacacacgccaag

SEQ ID NO: 1121108 - RNA, 25 nt, Human
ccccuaggagcccgaugccucccuu

SEQ ID NO: 1121109 - RNA, 24 nt, Human
ccccuccucagcugaaaauagccc

SEQ ID NO: 1121110 - RNA, 23 nt, Human
cccuaggagcccgaugccucccu

SEQ ID NO: 1121111 - RNA, 21 nt, Human
cccugcagacuuggccuugac

SEQ ID NO: 1121112 - RNA, 22 nt, Human
ccucauucuggucccuccucca

SEQ ID NO: 1121113 - RNA, 23 nt, Human
ccucauucuggucccuccuccag

SEQ ID NO: 1121114 - RNA, 28 nt, Human
ccuccagucaccagcagaaaugcaccuc

SEQ ID NO: 1121115 - RNA, 24 nt, Human
ccuccuccagucaccagcagaaau

SEQ ID NO: 1121116 - RNA, 24 nt, Human
ccucuccgucucaggccucuccca

SEQ ID NO: 1121117 - RNA, 19 nt, Human
cgguacagagcagccacuc

SEQ ID NO: 1121118 - RNA, 21 nt, Human
cguguauaaauagccugugua

SEQ ID NO: 1121119 - RNA, 20 nt, Human
cuaaauaagaugauguccuc

SEQ ID NO: 1121120 - RNA, 19 nt, Human
cuaggagcccgaugccucc

SEQ ID NO: 1121121 - RNA, 22 nt, Human
cucccccacaccacugaugcuc

SEQ ID NO: 1121122 - RNA, 23 nt, Human
cucccuagaggaccgcacucccu

SEQ ID NO: 1121123 - RNA, 21 nt, Human
cuccgucucaggccucuccca

SEQ ID NO: 1121124 - RNA, 21 nt, Human
cugagcucugagcugucuggg

SEQ ID NO: 1121125 - RNA, 22 nt, Human
cugccgggucuauuucucacgu

SEQ ID NO: 1121126 - RNA, 19 nt, Human
cuugacucugggucauucu

SEQ ID NO: 1121127 - RNA, 19 nt, Human
cuuggccuugacucugggu

SEQ ID NO: 1121128 - RNA, 20 nt, Human
cuuguggccuuccagccucc

SEQ ID NO: 1121129 - RNA, 23 nt, Human
gaaaauagcccagcaggcucaag

SEQ ID NO: 1121130 - RNA, 21 nt, Human
gaagcagcaauucucucucag

SEQ ID NO: 1121131 - RNA, 21 nt, Human
gaccaauugauuugcauuuaa

SEQ ID NO: 1121132 - RNA, 20 nt, Human
gacucugggucauucuguuc

SEQ ID NO: 1121133 - RNA, 21 nt, Human
gcaagcaccuuguggccuucc

SEQ ID NO: 1121134 - RNA, 19 nt, Human
gcacagcuagcgaagcgac

SEQ ID NO: 1121135 - RNA, 21 nt, Human
gccuguguauguuaaacagua

SEQ ID NO: 1121136 - RNA, 19 nt, Human
gcgacucgagggucagcga

SEQ ID NO: 1121137 - RNA, 20 nt, Human
gcucccagcugcugcgugau

SEQ ID NO: 1121138 - RNA, 19 nt, Human
gcuuucaacaggucccugc

SEQ ID NO: 1121139 - RNA, 19 nt, Human
ggaccccaaucccaccaca

SEQ ID NO: 1121140 - RNA, 24 nt, Human
gguuucagaugggagcuggggacg

SEQ ID NO: 1121141 - RNA, 21 nt, Human
guacagagcagccacuccaca

SEQ ID NO: 1121142 - RNA, 19 nt, Human
gucugcacgcuccucucca

SEQ ID NO: 1121143 - RNA, 22 nt, Human
uaaacaguagaaaagaaaagaa

SEQ ID NO: 1121144 - RNA, 24 nt, Human
uacacaaacaccauucauaaaccu

SEQ ID NO: 1121145 - RNA, 22 nt, Human
ucaccccuccucagcugaaaau

SEQ ID NO: 1121146 - RNA, 21 nt, Human
ucagaugggagcuggggacgu

SEQ ID NO: 1121147 - RNA, 25 nt, Human
ucauucuggucccuccuccagucac

SEQ ID NO: 1121148 - RNA, 19 nt, Human
uccaggcuagugcccagga

SEQ ID NO: 1121149 - RNA, 29 nt, Human
ucccaccacacacgccaagaagccccuag

SEQ ID NO: 1121150 - RNA, 18 nt, Human
ucccugcagacuuggccu

SEQ ID NO: 1121151 - RNA, 19 nt, Human
ucgaaugccaaagauugac

SEQ ID NO: 1121152 - RNA, 19 nt, Human
ucgaccuaaacaguacaaa

SEQ ID NO: 1121153 - RNA, 23 nt, Human
ucugagcucugagcugucugggg

SEQ ID NO: 1121154 - RNA, 23 nt, Human
ucuugggcagccaagacauucuc

SEQ ID NO: 1121155 - RNA, 22 nt, Human
ugacaaacagggugacacagac

SEQ ID NO: 1121156 - RNA, 21 nt, Human
ugacugccugccgggucuauu

SEQ ID NO: 1121157 - RNA, 22 nt, Human
ugagguggcaaaagaagaauac

SEQ ID NO: 1121158 - RNA, 20 nt, Human
ugauuugcauuuaaagacuc

SEQ ID NO: 1121159 - RNA, 19 nt, Human
ugccaaagauugacaaaca

SEQ ID NO: 1121160 - RNA, 20 nt, Human
ugccaaagauugacaaacag

SEQ ID NO: 1121161 - RNA, 20 nt, Human
uggaagaaaggcaacaagaa

SEQ ID NO: 1121162 - RNA, 21 nt, Human
uguauaaauagccuguguaug

SEQ ID NO: 1121163 - RNA, 22 nt, Human
uguauaaauagccuguguaugu

SEQ ID NO: 1121164 - RNA, 19 nt, Human
ugugguggagaacuaacac

SEQ ID NO: 1121165 - RNA, 18 nt, Human
ugugguggagaacuaacc

SEQ ID NO: 1121166 - RNA, 22 nt, Human
uguuucgucaccuacuccccca

SEQ ID NO: 1121167 - RNA, 18 nt, Human
uucaccccuccucagcug

SEQ ID NO: 1121168 - RNA, 18 nt, Human
uucauaaaccugagucac

SEQ ID NO: 1121169 - RNA, 24 nt, Human
uucgucaccuacucccccacacca

SEQ ID NO: 1121170 - RNA, 21 nt, Human
uugcuacacaaacaccauuca

SEQ ID NO: 1121171 - RNA, 22 nt, Human
uuuaaagacucugugaugguuu

SEQ ID NO: 1121172 - RNA, 22 nt, Human
uuuacaacccccagcauaacuc

SEQ ID NO: 1121173 - RNA, 20 nt, Human
uuucugagcucugagcuguc

SEQ ID NO: 1121174 - RNA, 23 nt, Human
aaacaccacaaaucuaccaucuu

SEQ ID NO: 1121175 - RNA, 24 nt, Human
aaagugcugggauuacaggcguga

SEQ ID NO: 1121176 - RNA, 20 nt, Human
aaaguucugggauuacaggc

SEQ ID NO: 1121177 - RNA, 24 nt, Human
aaaguucugggauuacaggcguga

SEQ ID NO: 1121178 - RNA, 21 nt, Human
aacaccacaaaucuaccaucu

SEQ ID NO: 1121179 - RNA, 19 nt, Human
aaccguaacaugagguccc

SEQ ID NO: 1121180 - RNA, 19 nt, Human
aagaguuagagaucagccu

SEQ ID NO: 1121181 - RNA, 26 nt, Human
aagccacccccauuccuugacuuacc

SEQ ID NO: 1121182 - RNA, 21 nt, Human
aagcgauccucccaccucagc

SEQ ID NO: 1121183 - RNA, 25 nt, Human
aagcgauccucccaccucagccucc

SEQ ID NO: 1121184 - RNA, 19 nt, Human
aaguagcugggauuacagg

SEQ ID NO: 1121185 - RNA, 25 nt, Human
aaguagcugggauuacaggcaccca

SEQ ID NO: 1121186 - RNA, 19 nt, Human
aagugcugggauuacaggc

SEQ ID NO: 1121187 - RNA, 19 nt, Human
aagugcugggauuacaggc

SEQ ID NO: 1121188 - RNA, 26 nt, Human
aagugcugggauuacaggcgugagcc

SEQ ID NO: 1121189 - RNA, 22 nt, Human
acaaccuccaccucccggguuc

SEQ ID NO: 1121190 - RNA, 21 nt, Human
acaggcacccaccaccacacc

SEQ ID NO: 1121191 - RNA, 24 nt, Human
acaggcgugagcaaccguaacaug

SEQ ID NO: 1121192 - RNA, 24 nt, Human
accaucuuggcuaggcuggucuug

SEQ ID NO: 1121193 - RNA, 23 nt, Human
accauguuggucaggcuggucuc

SEQ ID NO: 1121194 - RNA, 26 nt, Human
accucgugacuccauauucaaggcca

SEQ ID NO: 1121195 - RNA, 19 nt, Human
accucgugauccacccucc

SEQ ID NO: 1121196 - RNA, 22 nt, Human
agaggaaggauugcuugaggcc

SEQ ID NO: 1121197 - RNA, 20 nt, Human
agccaccgcaccuggcccca

SEQ ID NO: 1121198 - RNA, 21 nt, Human
agcugccagagaaagcaacca

SEQ ID NO: 1121199 - RNA, 22 nt, Human
agcugccagagaaagcaaccac

SEQ ID NO: 1121200 - RNA, 23 nt, Human
agcuggacauggugaugcaugcc

SEQ ID NO: 1121201 - RNA, 19 nt, Human
aggaggagggcuagcugcc

SEQ ID NO: 1121202 - RNA, 18 nt, Human
aggcuaaggugggaggau

SEQ ID NO: 1121203 - RNA, 22 nt, Human
aguagagaugggguuucaccau

SEQ ID NO: 1121204 - RNA, 23 nt, Human
aguagcuggaauuauagggaugu

SEQ ID NO: 1121205 - RNA, 18 nt, Human
agugcugggauuacaggc

SEQ ID NO: 1121206 - RNA, 24 nt, Human
agugguccaugugccucagccuuc

SEQ ID NO: 1121207 - RNA, 18 nt, Human
aguucugggauuacaggc

SEQ ID NO: 1121208 - RNA, 22 nt, Human
aucccaacauuuugggaggcca

SEQ ID NO: 1121209 - RNA, 20 nt, Human
augggguuucaccaucuugg

SEQ ID NO: 1121210 - RNA, 22 nt, Human
augggguuucaccaucuuggcu

SEQ ID NO: 1121211 - RNA, 24 nt, Human
augggguuucaccaucuuggcuag

SEQ ID NO: 1121212 - RNA, 21 nt, Human
augggguuucaccauguuggu

SEQ ID NO: 1121213 - RNA, 23 nt, Human
augggguuucaccauguugguca

SEQ ID NO: 1121214 - RNA, 24 nt, Human
augggguuucaccauguuggucag

SEQ ID NO: 1121215 - RNA, 24 nt, Human
auguuuguauuuuuaguagagaug

SEQ ID NO: 1121216 - RNA, 21 nt, Human
auuuuuuguuguugcuacaac

SEQ ID NO: 1121217 - RNA, 26 nt, Human
caaacucuugaccucaagugguccaa

SEQ ID NO: 1121218 - RNA, 24 nt, Human
caaacugcuaggauuacaggagug

SEQ ID NO: 1121219 - RNA, 24 nt, Human
caaagugcugggauuacaggcgug

SEQ ID NO: 1121220 - RNA, 21 nt, Human
caacauuuugggaggccaaag

SEQ ID NO: 1121221 - RNA, 23 nt, Human
caaccuccaccucccggguucaa

SEQ ID NO: 1121222 - RNA, 22 nt, Human
caagcaauucuccugccucggc

SEQ ID NO: 1121223 - RNA, 19 nt, Human
caagugauucucugccucc

SEQ ID NO: 1121224 - RNA, 20 nt, Human
caagugguccaugugccuca

SEQ ID NO: 1121225 - RNA, 22 nt, Human
caagugguccaugugccucagc

SEQ ID NO: 1121226 - RNA, 21 nt, Human
caccaucuuggcuaggcuggu

SEQ ID NO: 1121227 - RNA, 24 nt, Human
caccaucuuggcuaggcuggucuu

SEQ ID NO: 1121228 - RNA, 21 nt, Human
caccauguuggucaggcuggu

SEQ ID NO: 1121229 - RNA, 24 nt, Human
caccauguuggucaggcuggucuc

SEQ ID NO: 1121230 - RNA, 18 nt, Human
cacccaccaccacaccug

SEQ ID NO: 1121231 - RNA, 24 nt, Human
caccucagccuccuaaaguucugg

SEQ ID NO: 1121232 - RNA, 21 nt, Human
cacuacaaccuccaccucccg

SEQ ID NO: 1121233 - RNA, 23 nt, Human
cacugcaaugucugccuuuuggg

SEQ ID NO: 1121234 - RNA, 21 nt, Human
cagcuucuagaagccaccccc

SEQ ID NO: 1121235 - RNA, 22 nt, Human
caguucugggggccagaagccc

SEQ ID NO: 1121236 - RNA, 22 nt, Human
caucuguaaucccaacauuuug

SEQ ID NO: 1121237 - RNA, 24 nt, Human
cauuauguuguccaggcuggucuu

SEQ ID NO: 1121238 - RNA, 22 nt, Human
ccaaagugcugggauuacaggc

SEQ ID NO: 1121239 - RNA, 22 nt, Human
ccaaagugcugggauuacaggc

SEQ ID NO: 1121240 - RNA, 24 nt, Human
ccaaagugcugggauuacaggcgu

SEQ ID NO: 1121241 - RNA, 23 nt, Human
ccaaguagcugggauuacaggca

SEQ ID NO: 1121242 - RNA, 20 nt, Human
ccaccacaccuggcuaaugu

SEQ ID NO: 1121243 - RNA, 19 nt, Human
ccacccccauuccuugacu

SEQ ID NO: 1121244 - RNA, 18 nt, Human
ccaccgcaccuggcccca

SEQ ID NO: 1121245 - RNA, 27 nt, Human
ccaccucccggguucaagcaauucuuu

SEQ ID NO: 1121246 - RNA, 24 nt, Human
cccaacauuuugggaggccaaaga

SEQ ID NO: 1121247 - RNA, 23 nt, Human
cccaaguagcugggauuacaggc

SEQ ID NO: 1121248 - RNA, 24 nt, Human
cccaaguagcugggauuacaggca

SEQ ID NO: 1121249 - RNA, 19 nt, Human
cccgaguagcuggaauuau

SEQ ID NO: 1121250 - RNA, 23 nt, Human
cccggguucaagcaauucuccug

SEQ ID NO: 1121251 - RNA, 25 nt, Human
ccucaccugcugaacuccaggaggc

SEQ ID NO: 1121252 - RNA, 23 nt, Human
ccucccaccucagccuccuaaag

SEQ ID NO: 1121253 - RNA, 24 nt, Human
ccucccggguucaagcaauucucc

SEQ ID NO: 1121254 - RNA, 21 nt, Human
ccucgugauccacccuccucg

SEQ ID NO: 1121255 - RNA, 18 nt, Human
ccucucugaccucuucuu

SEQ ID NO: 1121256 - RNA, 23 nt, Human
ccugccucggccucccgaguagc

SEQ ID NO: 1121257 - RNA, 20 nt, Human
ccugggcuuaagcgauccuc

SEQ ID NO: 1121258 - RNA, 18 nt, Human
ccuguaguuccagcuacu

SEQ ID NO: 1121259 - RNA, 21 nt, Human
ccuuuuggguucaagugauuc

SEQ ID NO: 1121260 - RNA, 24 nt, Human
cuaaaguucugggauuacaggcgu

SEQ ID NO: 1121261 - RNA, 23 nt, Human
cuacaaccuccaccucccggguu

SEQ ID NO: 1121262 - RNA, 23 nt, Human
cucaagugguccaugugccucag

SEQ ID NO: 1121263 - RNA, 19 nt, Human
cucaccugcugaacuccag

SEQ ID NO: 1121264 - RNA, 24 nt, Human
cucacuacaaccuccaccucccgg

SEQ ID NO: 1121265 - RNA, 25 nt, Human
cucacuacaaccuccaccucccggg

SEQ ID NO: 1121266 - RNA, 19 nt, Human
cucacugcaaugucugccu

SEQ ID NO: 1121267 - RNA, 25 nt, Human
cucagccuccuaaaguucugggauu

SEQ ID NO: 1121268 - RNA, 23 nt, Human
cuccugggcuuaagcgauccucc

SEQ ID NO: 1121269 - RNA, 19 nt, Human
cucggucgcccaggcugaa

SEQ ID NO: 1121270 - RNA, 24 nt, Human
cucuccuaccucauucucuuauaa

SEQ ID NO: 1121271 - RNA, 18 nt, Human
cucuuguagcccaggcug

SEQ ID NO: 1121272 - RNA, 19 nt, Human
cucuuguagcccaggcugg

SEQ ID NO: 1121273 - RNA, 22 nt, Human
cucuuguagcccaggcuggagu

SEQ ID NO: 1121274 - RNA, 23 nt, Human
cugccucggccucccgaguagcu

SEQ ID NO: 1121275 - RNA, 23 nt, Human
cugccuuuuggguucaagugauu

SEQ ID NO: 1121276 - RNA, 23 nt, Human
cugggggccagaagcccaacuag

SEQ ID NO: 1121277 - RNA, 21 nt, Human
cuguaaucccaacauuuuggg

SEQ ID NO: 1121278 - RNA, 22 nt, Human
cuucaaaucucccucucugacc

SEQ ID NO: 1121279 - RNA, 21 nt, Human
cuuccaaacugcuaggauuac

SEQ ID NO: 1121280 - RNA, 21 nt, Human
cuucuagaagccacccccauu

SEQ ID NO: 1121281 - RNA, 18 nt, Human
cuucugaccucgugaucc

SEQ ID NO: 1121282 - RNA, 21 nt, Human
cuugaccucaagugguccaug

SEQ ID NO: 1121283 - RNA, 19 nt, Human
cuuguagcccaggcuggag

SEQ ID NO: 1121284 - RNA, 24 nt, Human
cuuguagcccaggcuggagugcaa

SEQ ID NO: 1121285 - RNA, 25 nt, Human
cuuucagccucaccugcugaacucc

SEQ ID NO: 1121286 - RNA, 24 nt, Human
gaaaugggguuucaccauguuggu

SEQ ID NO: 1121287 - RNA, 24 nt, Human
gaccucaagugguccaugugccuc

SEQ ID NO: 1121288 - RNA, 22 nt, Human
gaccucgugauccacccuccuc

SEQ ID NO: 1121289 - RNA, 22 nt, Human
gaccucgugauccacccuccuc

SEQ ID NO: 1121290 - RNA, 24 nt, Human
gaccucgugauccacccuccucgg

SEQ ID NO: 1121291 - RNA, 21 nt, Human
gaccucuucuuccauuaccac

SEQ ID NO: 1121292 - RNA, 18 nt, Human
gagaugggguuucaccau

SEQ ID NO: 1121293 - RNA, 24 nt, Human
gagaugggguuucaccaucuuggc

SEQ ID NO: 1121294 - RNA, 18 nt, Human
gauuacaggagugagcca

SEQ ID NO: 1121295 - RNA, 18 nt, Human
gauuacaggcgugagcca

SEQ ID NO: 1121296 - RNA, 22 nt, Human
gauuacaggcgugagccacugc

SEQ ID NO: 1121297 - RNA, 22 nt, Human
gauuacaggcgugagccacugc

SEQ ID NO: 1121298 - RNA, 23 nt, Human
gauugcuugaggccaagaguuag

SEQ ID NO: 1121299 - RNA, 19 nt, Human
gcaucaaacaccacaaauc

SEQ ID NO: 1121300 - RNA, 21 nt, Human
gccacaacgccuagcuaacug

SEQ ID NO: 1121301 - RNA, 19 nt, Human
gcccaggcuggagugcaau

SEQ ID NO: 1121302 - RNA, 23 nt, Human
gcccaggcuggagugcaauggca

SEQ ID NO: 1121303 - RNA, 21 nt, Human
gccucggccucccgaguagcu

SEQ ID NO: 1121304 - RNA, 23 nt, Human
gccuggggaaaaaaaggaagauc

SEQ ID NO: 1121305 - RNA, 23 nt, Human
gcuacaacaaaguacccuacauu

SEQ ID NO: 1121306 - RNA, 20 nt, Human
gcucacugcaaugucugccu

SEQ ID NO: 1121307 - RNA, 19 nt, Human
gcucuuguagcccaggcug

SEQ ID NO: 1121308 - RNA, 20 nt, Human
gcucuuguagcccaggcugg

SEQ ID NO: 1121309 - RNA, 24 nt, Human
gcucuuguagcccaggcuggagug

SEQ ID NO: 1121310 - RNA, 19 nt, Human
gcuggagugcaauggcaca

SEQ ID NO: 1121311 - RNA, 22 nt, Human
ggaugcuguugagcuaacaggg

SEQ ID NO: 1121312 - RNA, 22 nt, Human
ggauuacaggagugagccaccg

SEQ ID NO: 1121313 - RNA, 21 nt, Human
ggccaaagaggaaggauugcu

SEQ ID NO: 1121314 - RNA, 24 nt, Human
ggcuggucuugaacuucugaccuc

SEQ ID NO: 1121315 - RNA, 19 nt, Human
gggguuucaccaucuuggc

SEQ ID NO: 1121316 - RNA, 22 nt, Human
gggguuucaccauguuggucag

SEQ ID NO: 1121317 - RNA, 19 nt, Human
ggguucaagugauucucug

SEQ ID NO: 1121318 - RNA, 22 nt, Human
ggguuucaccaucuuggcuagg

SEQ ID NO: 1121319 - RNA, 22 nt, Human
ggguuucaccauguuggucagg

SEQ ID NO: 1121320 - RNA, 24 nt, Human
ggucucauuauguuguccaggcug

SEQ ID NO: 1121321 - RNA, 20 nt, Human
ggucuugaacuucugaccuc

SEQ ID NO: 1121322 - RNA, 18 nt, Human
guagcugggauuacaggc

SEQ ID NO: 1121323 - RNA, 24 nt, Human
gugauccacccuccucggccuccc

SEQ ID NO: 1121324 - RNA, 25 nt, Human
gugauucucugccucccaaguagcu

SEQ ID NO: 1121325 - RNA, 19 nt, Human
gugccucagccuuccaaac

SEQ ID NO: 1121326 - RNA, 24 nt, Human
gugguccaugugccucagccuucc

SEQ ID NO: 1121327 - RNA, 22 nt, Human
guugcuacaacaaaguacccua

SEQ ID NO: 1121328 - RNA, 20 nt, Human
uaagcgauccucccaccuca

SEQ ID NO: 1121329 - RNA, 27 nt, Human
uaagcgauccucccaccucagccuccu

SEQ ID NO: 1121330 - RNA, 21 nt, Human
uaagcuccugggcuuaagcga

SEQ ID NO: 1121331 - RNA, 18 nt, Human
uaaggugggaggauugcu

SEQ ID NO: 1121332 - RNA, 24 nt, Human
uaauguuuguauuuuuaguagaga

SEQ ID NO: 1121333 - RNA, 22 nt, Human
uacaggagugagccaccgcacc

SEQ ID NO: 1121334 - RNA, 22 nt, Human
uacaggagugagccaccgcacc

SEQ ID NO: 1121335 - RNA, 23 nt, Human
uacaggagugagccaccgcaccu

SEQ ID NO: 1121336 - RNA, 23 nt, Human
uacaggagugagccaccgcaccu

SEQ ID NO: 1121337 - RNA, 22 nt, Human
uacaggcgugagccacugcgcc

SEQ ID NO: 1121338 - RNA, 23 nt, Human
uacaggcgugagccacugcgccu

SEQ ID NO: 1121339 - RNA, 22 nt, Human
uagaaaugggguuucaccaugu

SEQ ID NO: 1121340 - RNA, 22 nt, Human
uaggauuacaggagugagccac

SEQ ID NO: 1121341 - RNA, 23 nt, Human
uaggauuacaggagugagccacc

SEQ ID NO: 1121342 - RNA, 24 nt, Human
uaggauuacaggagugagccaccg

SEQ ID NO: 1121343 - RNA, 24 nt, Human
uaguagaaaugggguuucaccaug

SEQ ID NO: 1121344 - RNA, 26 nt, Human
uaguagaaaugggguuucaccauguu

SEQ ID NO: 1121345 - RNA, 19 nt, Human
uaguagagaugggguuuca

SEQ ID NO: 1121346 - RNA, 23 nt, Human
uaguagagaugggguuucaccau

SEQ ID NO: 1121347 - RNA, 26 nt, Human
uaguagagaugggguuucaccaucuu

SEQ ID NO: 1121348 - RNA, 23 nt, Human
uauguuguccaggcuggucuuaa

SEQ ID NO: 1121349 - RNA, 24 nt, Human
uauguuguccaggcuggucuuaag

SEQ ID NO: 1121350 - RNA, 24 nt, Human
ucacuacaaccuccaccucccggg

SEQ ID NO: 1121351 - RNA, 25 nt, Human
ucacuacaaccuccaccucccgggu

SEQ ID NO: 1121352 - RNA, 27 nt, Human
ucacuacaaccuccaccucccggguuc

SEQ ID NO: 1121353 - RNA, 24 nt, Human
ucacugcaaugucugccuuuuggg

SEQ ID NO: 1121354 - RNA, 27 nt, Human
ucacuuucucuaauucugacucuccua

SEQ ID NO: 1121355 - RNA, 21 nt, Human
uccacccuccucggccuccca

SEQ ID NO: 1121356 - RNA, 24 nt, Human
ucccaaagugcugggauuacaggc

SEQ ID NO: 1121357 - RNA, 24 nt, Human
ucccaaguagcugggauuacaggc

SEQ ID NO: 1121358 - RNA, 21 nt, Human
ucccggguucaagcaauucuc

SEQ ID NO: 1121359 - RNA, 24 nt, Human
ucccggguucaagcaauucuccug

SEQ ID NO: 1121360 - RNA, 25 nt, Human
ucccucucugaccucuucuuccauu

SEQ ID NO: 1121361 - RNA, 24 nt, Human
uccuaaaguucugggauuacaggc

SEQ ID NO: 1121362 - RNA, 20 nt, Human
uccucccaccucagccuccc

SEQ ID NO: 1121363 - RNA, 21 nt, Human
uccucggccucccaaagugcu

SEQ ID NO: 1121364 - RNA, 21 nt, Human
uccugggcuuaagcgauccuc

SEQ ID NO: 1121365 - RNA, 24 nt, Human
uccugggcuuaagcgauccuccca

SEQ ID NO: 1121366 - RNA, 18 nt, Human
ucgcccaggcugaagugu

SEQ ID NO: 1121367 - RNA, 23 nt, Human
ucggccucccgaguagcuggaau

SEQ ID NO: 1121368 - RNA, 25 nt, Human
ucuagaaagaaugugcuccuuugcc

SEQ ID NO: 1121369 - RNA, 21 nt, Human
ucuagaagccacccccauucc

SEQ ID NO: 1121370 - RNA, 21 nt, Human
ucucaaacucuugaccucaag

SEQ ID NO: 1121371 - RNA, 23 nt, Human
ucucauuauguuguccaggcugg

SEQ ID NO: 1121372 - RNA, 24 nt, Human
ucucauuauguuguccaggcuggu

SEQ ID NO: 1121373 - RNA, 19 nt, Human
ucucggucgcccaggcuga

SEQ ID NO: 1121374 - RNA, 28 nt, Human
ucucuaauucugacucuccuaccucauu

SEQ ID NO: 1121375 - RNA, 18 nt, Human
ucucugaccucuucuucc

SEQ ID NO: 1121376 - RNA, 19 nt, Human
ucucuuauaaagauccuug

SEQ ID NO: 1121377 - RNA, 24 nt, Human
ugaccucaagugguccaugugccu

SEQ ID NO: 1121378 - RNA, 20 nt, Human
ugaggcuuggaacuuucagc

SEQ ID NO: 1121379 - RNA, 18 nt, Human
ugaugcaugccuguaguu

SEQ ID NO: 1121380 - RNA, 24 nt, Human
ugccucagccuuccaaacugcuag

SEQ ID NO: 1121381 - RNA, 20 nt, Human
ugccucggccucccgaguaa

SEQ ID NO: 1121382 - RNA, 21 nt, Human
ugccucggccucccgaguagc

SEQ ID NO: 1121383 - RNA, 24 nt, Human
ugccucggccucccgaguagcugg

SEQ ID NO: 1121384 - RNA, 22 nt, Human
ugccuguaguuccagcuacugg

SEQ ID NO: 1121385 - RNA, 22 nt, Human
ugccuuuuggguucaagugauu

SEQ ID NO: 1121386 - RNA, 24 nt, Human
ugcugggauuacaggcgugagcca

SEQ ID NO: 1121387 - RNA, 21 nt, Human
uggaauuauagggaugugcca

SEQ ID NO: 1121388 - RNA, 22 nt, Human
uggaauuauagggaugugccac

SEQ ID NO: 1121389 - RNA, 23 nt, Human
uggagugcaauggcacaaucuca

SEQ ID NO: 1121390 - RNA, 24 nt, Human
uggagugcaauggcacaaucucag

SEQ ID NO: 1121391 - RNA, 24 nt, Human
uggcacaaucucagcucacuacaa

SEQ ID NO: 1121392 - RNA, 24 nt, Human
uggcuaggcuggucuugaacuucu

SEQ ID NO: 1121393 - RNA, 22 nt, Human
ugggaggccaaagaggaaggau

SEQ ID NO: 1121394 - RNA, 19 nt, Human
ugggauuacaggcacccac

SEQ ID NO: 1121395 - RNA, 21 nt, Human
ugggauuacaggcacccacca

SEQ ID NO: 1121396 - RNA, 24 nt, Human
ugggauuacaggcacccaccacca

SEQ ID NO: 1121397 - RNA, 18 nt, Human
ugggauuacaggcgugag

SEQ ID NO: 1121398 - RNA, 18 nt, Human
ugggauuacaggcgugag

SEQ ID NO: 1121399 - RNA, 19 nt, Human
ugggauuacaggcgugagc

SEQ ID NO: 1121400 - RNA, 19 nt, Human
ugggauuacaggcgugagc

SEQ ID NO: 1121401 - RNA, 23 nt, Human
ugggauuacaggcgugagcaacc

SEQ ID NO: 1121402 - RNA, 23 nt, Human
ugggauuacaggcgugagcaacc

SEQ ID NO: 1121403 - RNA, 24 nt, Human
ugggauuacaggcgugagcaaccg

SEQ ID NO: 1121404 - RNA, 27 nt, Human
ugggauuacaggcgugagcaaccguaa

SEQ ID NO: 1121405 - RNA, 21 nt, Human
ugggauuacaggcgugagcca

SEQ ID NO: 1121406 - RNA, 22 nt, Human
ugggauuacaggcgugagccac

SEQ ID NO: 1121407 - RNA, 22 nt, Human
ugggauuacaggcgugagccac

SEQ ID NO: 1121408 - RNA, 24 nt, Human
ugggauuacaggcgugagccacug

SEQ ID NO: 1121409 - RNA, 24 nt, Human
ugggauuacaggcgugagccacug

SEQ ID NO: 1121410 - RNA, 24 nt, Human
ugggggcucccaucuguaauccca

SEQ ID NO: 1121411 - RNA, 24 nt, Human
ugggguuucaccaucuuggcuagg

SEQ ID NO: 1121412 - RNA, 24 nt, Human
ugggguuucaccauguuggucagg

SEQ ID NO: 1121413 - RNA, 18 nt, Human
uggguucaagugauucuc

SEQ ID NO: 1121414 - RNA, 20 nt, Human
uggguucaagugauucucuu

SEQ ID NO: 1121415 - RNA, 24 nt, Human
uggucaggcuggucucaaacucuu

SEQ ID NO: 1121416 - RNA, 20 nt, Human
ugguccaugugccucagccu

SEQ ID NO: 1121417 - RNA, 23 nt, Human
uggugaugcaugccuguaguucc

SEQ ID NO: 1121418 - RNA, 24 nt, Human
uggugaugcaugccuguaguucca

SEQ ID NO: 1121419 - RNA, 21 nt, Human
uguauuuuuaguagagauggg

SEQ ID NO: 1121420 - RNA, 24 nt, Human
uguccaggcuggucuuaagcuccu

SEQ ID NO: 1121421 - RNA, 21 nt, Human
ugugauugguggguauggggg

SEQ ID NO: 1121422 - RNA, 21 nt, Human
uguuuguauuuuuaguagaga

SEQ ID NO: 1121423 - RNA, 18 nt, Human
uuaagguuaaagucaagg

SEQ ID NO: 1121424 - RNA, 18 nt, Human
uuaguagaaaugggguuu

SEQ ID NO: 1121425 - RNA, 22 nt, Human
uuaguagaaaugggguuucacc

SEQ ID NO: 1121426 - RNA, 24 nt, Human
uuaguagaaaugggguuucaccau

SEQ ID NO: 1121427 - RNA, 18 nt, Human
uuaguagagaugggguuu

SEQ ID NO: 1121428 - RNA, 22 nt, Human
uuaguagagaugggguuucacc

SEQ ID NO: 1121429 - RNA, 24 nt, Human
uuaguagagaugggguuucaccau

SEQ ID NO: 1121430 - RNA, 21 nt, Human
uucaagcaauucuccugccuc

SEQ ID NO: 1121431 - RNA, 24 nt, Human
uucaagcaauucuccugccucggc

SEQ ID NO: 1121432 - RNA, 22 nt, Human
uucaggaggagggcuagcugcc

SEQ ID NO: 1121433 - RNA, 20 nt, Human
uugaggccaagaguuagaga

SEQ ID NO: 1121434 - RNA, 19 nt, Human
uuuaaaacggaguuuggcu

SEQ ID NO: 1121435 - RNA, 24 nt, Human
uuucaccaucuuggcuaggcuggu

SEQ ID NO: 1121436 - RNA, 24 nt, Human
uuucaccauguuggucaggcuggu

SEQ ID NO: 1121437 - RNA, 22 nt, Human
uuugccuuuuccagcuucuaga

SEQ ID NO: 1121438 - RNA, 18 nt, Human
uuuguauuuuuaguagag

SEQ ID NO: 1121439 - RNA, 18 nt, Human
uuuuguuguugcuacaac

SEQ ID NO: 1121440 - RNA, 24 nt, Human
uuuuuaguagaaaugggguuucac

SEQ ID NO: 1121441 - RNA, 24 nt, Human
uuuuuaguagagaugggguuucac

SEQ ID NO: 1121442 - RNA, 24 nt, Human
uuuuugaggcuuggaacuuucagc

SEQ ID NO: 1121443 - RNA, 24 nt, Human
uuuuuuuuuuaaaacggaguuugg

SEQ ID NO: 1121444 - RNA, 24 nt, Human
aaacuguaaucccagcuacuuggg

SEQ ID NO: 1121445 - RNA, 18 nt, Human
aacuuauuuccacauucu

SEQ ID NO: 1121446 - RNA, 21 nt, Human
aagcagaggucgcagugagcc

SEQ ID NO: 1121447 - RNA, 24 nt, Human
aagcagaggucgcagugagccgag

SEQ ID NO: 1121448 - RNA, 19 nt, Human
aagcagcgcggacccacgg

SEQ ID NO: 1121449 - RNA, 19 nt, Human
accuggagguuguguaacu

SEQ ID NO: 1121450 - RNA, 23 nt, Human
agacacuggcagggccagaaacg

SEQ ID NO: 1121451 - RNA, 24 nt, Human
agaggagcuauugcagcugcugug

SEQ ID NO: 1121452 - RNA, 23 nt, Human
agaggucgcagugagccgagauc

SEQ ID NO: 1121453 - RNA, 21 nt, Human
aggaagcagaggucgcaguga

SEQ ID NO: 1121454 - RNA, 22 nt, Human
aggcaggagaauccuugaaccc

SEQ ID NO: 1121455 - RNA, 23 nt, Human
aggcaggagaauccuugaaccca

SEQ ID NO: 1121456 - RNA, 23 nt, Human
aggcugaggcaggagaauccuug

SEQ ID NO: 1121457 - RNA, 18 nt, Human
aguuaccugcagaaccca

SEQ ID NO: 1121458 - RNA, 19 nt, Human
caauagagaggagcuauug

SEQ ID NO: 1121459 - RNA, 21 nt, Human
cacauguaguaacacaacuua

SEQ ID NO: 1121460 - RNA, 18 nt, Human
cagaagccuugacagcaa

SEQ ID NO: 1121461 - RNA, 24 nt, Human
cagcuacuugggaggcugaggcag

SEQ ID NO: 1121462 - RNA, 22 nt, Human
cccacggcgcaccgaacgcacu

SEQ ID NO: 1121463 - RNA, 23 nt, Human
cccacggcgcaccgaacgcacuc

SEQ ID NO: 1121464 - RNA, 19 nt, Human
cggcgcaccgaacgcacuc

SEQ ID NO: 1121465 - RNA, 19 nt, Human
cuaacaggaaguugggugg

SEQ ID NO: 1121466 - RNA, 22 nt, Human
cuccagccucauccauacaccc

SEQ ID NO: 1121467 - RNA, 24 nt, Human
cuggagguuguguaacugcaccug

SEQ ID NO: 1121468 - RNA, 21 nt, Human
cuguaaucccagcuacuuggg

SEQ ID NO: 1121469 - RNA, 20 nt, Human
gaacgcacuccaacagaacc

SEQ ID NO: 1121470 - RNA, 24 nt, Human
gaauccuugaacccaggaagcaga

SEQ ID NO: 1121471 - RNA, 22 nt, Human
gagaauccuugaacccaggaag

SEQ ID NO: 1121472 - RNA, 21 nt, Human
gcggagacacuggcagggcca

SEQ ID NO: 1121473 - RNA, 22 nt, Human
ggaagcagcgcggacccacggc

SEQ ID NO: 1121474 - RNA, 22 nt, Human
ggcgcaccgaacgcacuccaac

SEQ ID NO: 1121475 - RNA, 20 nt, Human
guccucuucuuuaucgcacc

SEQ ID NO: 1121476 - RNA, 23 nt, Human
guguccugcacccuaggauuaca

SEQ ID NO: 1121477 - RNA, 22 nt, Human
uaaaaguaucuuugugucuuca

SEQ ID NO: 1121478 - RNA, 21 nt, Human
uaaauccaguccuuaaacagg

SEQ ID NO: 1121479 - RNA, 21 nt, Human
uaaccucuaaguaguuauccu

SEQ ID NO: 1121480 - RNA, 22 nt, Human
uaaccucuaaguaguuauccuu

SEQ ID NO: 1121481 - RNA, 23 nt, Human
uaccugcagaacccaucacucua

SEQ ID NO: 1121482 - RNA, 20 nt, Human
uaggagcuuacagaggacua

SEQ ID NO: 1121483 - RNA, 20 nt, Human
uauggaaccucccggccggu

SEQ ID NO: 1121484 - RNA, 20 nt, Human
ucgcagugagccgagaucau

SEQ ID NO: 1121485 - RNA, 19 nt, Human
ucuauggaaccucccggcc

SEQ ID NO: 1121486 - RNA, 22 nt, Human
ucuguagccaaagccuaauggg

SEQ ID NO: 1121487 - RNA, 19 nt, Human
ucuuuggucccagaucacu

SEQ ID NO: 1121488 - RNA, 22 nt, Human
ugagccgagaucaugccauugu

SEQ ID NO: 1121489 - RNA, 19 nt, Human
ugaggcaggagaauccuug

SEQ ID NO: 1121490 - RNA, 23 nt, Human
ugaggcaggagaauccuugaacc

SEQ ID NO: 1121491 - RNA, 24 nt, Human
ugaggcaggagaauccuugaaccc

SEQ ID NO: 1121492 - RNA, 23 nt, Human
ugcagaacccaucacucuaugga

SEQ ID NO: 1121493 - RNA, 22 nt, Human
ugcagcugcugugacgacuggc

SEQ ID NO: 1121494 - RNA, 21 nt, Human
uggaagcagcgcggacccacg

SEQ ID NO: 1121495 - RNA, 18 nt, Human
ugggaggcugaggcagga

SEQ ID NO: 1121496 - RNA, 19 nt, Human
ugggaggcugaggcaggag

SEQ ID NO: 1121497 - RNA, 24 nt, Human
uguagccaaagccuaaugggucag

SEQ ID NO: 1121498 - RNA, 20 nt, Human
ugugacaggagagaaacuaa

SEQ ID NO: 1121499 - RNA, 19 nt, Human
uucuguagccaaagccuaa

SEQ ID NO: 1121500 - RNA, 21 nt, Human
uugcagcugcugugacgacug

SEQ ID NO: 1121501 - RNA, 18 nt, Human
aaccaggaagaagagcug

SEQ ID NO: 1121502 - RNA, 23 nt, Human
aaccaggaagaagagcugggccc

SEQ ID NO: 1121503 - RNA, 20 nt, Human
agaggcugacuugaggaggu

SEQ ID NO: 1121504 - RNA, 19 nt, Human
aggaagaagagcugggccc

SEQ ID NO: 1121505 - RNA, 21 nt, Human
augggccugaagaggccacug

SEQ ID NO: 1121506 - RNA, 19 nt, Human
cagcaaacaagcucuuuug

SEQ ID NO: 1121507 - RNA, 18 nt, Human
caucggagggcaggagcu

SEQ ID NO: 1121508 - RNA, 18 nt, Human
ccccaugggccugaagag

SEQ ID NO: 1121509 - RNA, 19 nt, Human
cgaccaaggccgccaggag

SEQ ID NO: 1121510 - RNA, 21 nt, Human
cgcccggagggugcaaguggg

SEQ ID NO: 1121511 - RNA, 18 nt, Human
cugaagaggccacuggca

SEQ ID NO: 1121512 - RNA, 19 nt, Human
cugggcccggagaggccgc

SEQ ID NO: 1121513 - RNA, 22 nt, Human
gagggcaggagcucauccugga

SEQ ID NO: 1121514 - RNA, 21 nt, Human
gcaagugggucuggagaggcu

SEQ ID NO: 1121515 - RNA, 19 nt, Human
ggagacccaaccaggaaga

SEQ ID NO: 1121516 - RNA, 23 nt, Human
gggcaggagcucauccuggagag

SEQ ID NO: 1121517 - RNA, 19 nt, Human
gguucugggcccggagagg

SEQ ID NO: 1121518 - RNA, 20 nt, Human
ugaaagguugggagcuuggc

SEQ ID NO: 1121519 - RNA, 22 nt, Human
ugaaagguugggagcuuggcuu

SEQ ID NO: 1121520 - RNA, 18 nt, Human
uggagaggccaccgugag

SEQ ID NO: 1121521 - RNA, 20 nt, Human
uggagaggcugacuugagga

SEQ ID NO: 1121522 - RNA, 20 nt, Human
ugggccgaccaaggccgcca

SEQ ID NO: 1121523 - RNA, 24 nt, Human
uggggccuggagaugccaucggag

SEQ ID NO: 1121524 - RNA, 19 nt, Human
uggguaggcacugagucca

SEQ ID NO: 1121525 - RNA, 25 nt, Human
aagccggcccccaucuccucugacc

SEQ ID NO: 1121526 - RNA, 24 nt, Human
aauaccaguaaagugagaagcaga

SEQ ID NO: 1121527 - RNA, 21 nt, Human
aauaccuccccucgaacaucc

SEQ ID NO: 1121528 - RNA, 19 nt, Human
accagucggagagcugggg

SEQ ID NO: 1121529 - RNA, 21 nt, Human
accuccuccccaccucuugcc

SEQ ID NO: 1121530 - RNA, 22 nt, Human
agaccuucuccugggaccacag

SEQ ID NO: 1121531 - RNA, 21 nt, Human
agcuacaaauauccaaaaucc

SEQ ID NO: 1121532 - RNA, 20 nt, Human
aucuccucugaccuccuccc

SEQ ID NO: 1121533 - RNA, 21 nt, Human
auggacccugauuauccauug

SEQ ID NO: 1121534 - RNA, 21 nt, Human
auuugcuguuuucuuucugau

SEQ ID NO: 1121535 - RNA, 22 nt, Human
caaacaccagucggagagcugg

SEQ ID NO: 1121536 - RNA, 21 nt, Human
caaucuaugcagccugugacu

SEQ ID NO: 1121537 - RNA, 21 nt, Human
cacacccaagucagaccaggu

SEQ ID NO: 1121538 - RNA, 18 nt, Human
cacaguuauccacacagu

SEQ ID NO: 1121539 - RNA, 20 nt, Human
cacauugcuacuccucugcc

SEQ ID NO: 1121540 - RNA, 21 nt, Human
caccagucggagagcuggggu

SEQ ID NO: 1121541 - RNA, 22 nt, Human
cacccuucccuccaaacagcca

SEQ ID NO: 1121542 - RNA, 21 nt, Human
caccuccgcgaaggacagcuu

SEQ ID NO: 1121543 - RNA, 22 nt, Human
caccucuccccuggagacagcc

SEQ ID NO: 1121544 - RNA, 18 nt, Human
caccucucucccucagcu

SEQ ID NO: 1121545 - RNA, 19 nt, Human
cacuacacccgaggcccgc

SEQ ID NO: 1121546 - RNA, 24 nt, Human
cagcaaagccggcccccaucuccu

SEQ ID NO: 1121547 - RNA, 18 nt, Human
cagcacccagagugcucg

SEQ ID NO: 1121548 - RNA, 18 nt, Human
cagcacccagagugcucg

SEQ ID NO: 1121549 - RNA, 18 nt, Human
cagcacccagagugcucg

SEQ ID NO: 1121550 - RNA, 24 nt, Human
cagcagagccagccuccaucuccu

SEQ ID NO: 1121551 - RNA, 24 nt, Human
cagcagagccggcccccaucuccu

SEQ ID NO: 1121552 - RNA, 18 nt, Human
cagcagagccggcccccc

SEQ ID NO: 1121553 - RNA, 22 nt, Human
cagcaggagcugccccauaaua

SEQ ID NO: 1121554 - RNA, 20 nt, Human
cagcccucuuggcccugugg

SEQ ID NO: 1121555 - RNA, 24 nt, Human
cagcuucauccuuucagcuacuca

SEQ ID NO: 1121556 - RNA, 22 nt, Human
cagggaugcccauggacccuga

SEQ ID NO: 1121557 - RNA, 22 nt, Human
caggucacuguggugggagugu

SEQ ID NO: 1121558 - RNA, 23 nt, Human
cagucggagagcugggguccucc

SEQ ID NO: 1121559 - RNA, 21 nt, Human
caucuccuucuccaggaaauc

SEQ ID NO: 1121560 - RNA, 21 nt, Human
cauggcuccaaaacaagcagg

SEQ ID NO: 1121561 - RNA, 20 nt, Human
cauucagaaaacauacuaag

SEQ ID NO: 1121562 - RNA, 20 nt, Human
cauucuggcugugugcagag

SEQ ID NO: 1121563 - RNA, 19 nt, Human
cauuuggaggaaaacccag

SEQ ID NO: 1121564 - RNA, 25 nt, Human
ccacauugcuacuccucugccugua

SEQ ID NO: 1121565 - RNA, 24 nt, Human
ccaccucuccccuggagacagccc

SEQ ID NO: 1121566 - RNA, 23 nt, Human
ccagccuccaucuccucugaccu

SEQ ID NO: 1121567 - RNA, 25 nt, Human
cccaucuccucugaccuccucccca

SEQ ID NO: 1121568 - RNA, 26 nt, Human
cccgacccugauggcagagaagcaaa

SEQ ID NO: 1121569 - RNA, 24 nt, Human
cccgccacccauuuuugccugaau

SEQ ID NO: 1121570 - RNA, 18 nt, Human
cccuacccgcuucucugu

SEQ ID NO: 1121571 - RNA, 23 nt, Human
ccggcccccaucuccucugaccu

SEQ ID NO: 1121572 - RNA, 23 nt, Human
ccggcccccaucuccucugaccu

SEQ ID NO: 1121573 - RNA, 23 nt, Human
ccggcccccaucuccucugaccu

SEQ ID NO: 1121574 - RNA, 20 nt, Human
ccucccaccucucucccuca

SEQ ID NO: 1121575 - RNA, 25 nt, Human
ccucccaccucucucccucagcuag

SEQ ID NO: 1121576 - RNA, 19 nt, Human
ccucccagcccucuuggcc

SEQ ID NO: 1121577 - RNA, 22 nt, Human
ccucucgcccucugcacccaga

SEQ ID NO: 1121578 - RNA, 23 nt, Human
cgcccucagcacccagagugcuc

SEQ ID NO: 1121579 - RNA, 24 nt, Human
cggcccccaucuccucugaccucc

SEQ ID NO: 1121580 - RNA, 24 nt, Human
cggcccccaucuccucugaccucc

SEQ ID NO: 1121581 - RNA, 18 nt, Human
cgugacggccagcagagc

SEQ ID NO: 1121582 - RNA, 21 nt, Human
cuacacccgaggcccgccacc

SEQ ID NO: 1121583 - RNA, 21 nt, Human
cuagugacccccagaccuucu

SEQ ID NO: 1121584 - RNA, 23 nt, Human
cucaauaccuccccucgaacauc

SEQ ID NO: 1121585 - RNA, 23 nt, Human
cucacaguggcccugacccaacu

SEQ ID NO: 1121586 - RNA, 21 nt, Human
cucagcacccagagugcucgu

SEQ ID NO: 1121587 - RNA, 20 nt, Human
cuccaaacagccaccucucc

SEQ ID NO: 1121588 - RNA, 21 nt, Human
cucccagcccucuuggcccug

SEQ ID NO: 1121589 - RNA, 20 nt, Human
cucgugacggccagcagagc

SEQ ID NO: 1121590 - RNA, 20 nt, Human
cucguguuggccagcaaagc

SEQ ID NO: 1121591 - RNA, 20 nt, Human
cucguguuggccggcagagc

SEQ ID NO: 1121592 - RNA, 20 nt, Human
cucugaccuccuccccaccu

SEQ ID NO: 1121593 - RNA, 24 nt, Human
cucugccuguagggguacccacag

SEQ ID NO: 1121594 - RNA, 18 nt, Human
cucugcucuucucucucc

SEQ ID NO: 1121595 - RNA, 19 nt, Human
cucugcucuucucucucca

SEQ ID NO: 1121596 - RNA, 21 nt, Human
cucugcucuucucucuccacc

SEQ ID NO: 1121597 - RNA, 23 nt, Human
cugaccucccaccucucgcccuc

SEQ ID NO: 1121598 - RNA, 23 nt, Human
cugaccucccaccucucgcccuc

SEQ ID NO: 1121599 - RNA, 24 nt, Human
cugggguccucccagcccucuugg

SEQ ID NO: 1121600 - RNA, 19 nt, Human
cuugggacccacauugcua

SEQ ID NO: 1121601 - RNA, 23 nt, Human
gaaggcuuggaagcaugcaagug

SEQ ID NO: 1121602 - RNA, 27 nt, Human
gagaucugcucacacccaagucagacc

SEQ ID NO: 1121603 - RNA, 18 nt, Human
gccccauacuccacucag

SEQ ID NO: 1121604 - RNA, 22 nt, Human
gcgaaggacagcuucauccuuu

SEQ ID NO: 1121605 - RNA, 23 nt, Human
gcuacuuauucauucagaaaaca

SEQ ID NO: 1121606 - RNA, 24 nt, Human
gcuucauccuuucagcuacucagg

SEQ ID NO: 1121607 - RNA, 18 nt, Human
ggaagacagcaggagcug

SEQ ID NO: 1121608 - RNA, 23 nt, Human
ggcccccaucuccucugaccucc

SEQ ID NO: 1121609 - RNA, 23 nt, Human
ggguacccacaguuauccacaca

SEQ ID NO: 1121610 - RNA, 19 nt, Human
guccucccagcccucuugg

SEQ ID NO: 1121611 - RNA, 21 nt, Human
guccugguacucugcucuucu

SEQ ID NO: 1121612 - RNA, 18 nt, Human
gugacuccauccaugggc

SEQ ID NO: 1121613 - RNA, 18 nt, Human
uaccuccccucgaacauc

SEQ ID NO: 1121614 - RNA, 23 nt, Human
ucaauggcccguccugguacucu

SEQ ID NO: 1121615 - RNA, 21 nt, Human
ucacacccaagucagaccagg

SEQ ID NO: 1121616 - RNA, 22 nt, Human
ucagaccagguuacuccucugc

SEQ ID NO: 1121617 - RNA, 23 nt, Human
ucauuugcuguuuucuuucugau

SEQ ID NO: 1121618 - RNA, 19 nt, Human
uccauggcuaaaacugagc

SEQ ID NO: 1121619 - RNA, 18 nt, Human
uccccuggagacagcccc

SEQ ID NO: 1121620 - RNA, 23 nt, Human
uccucugaccucccaccucucgc

SEQ ID NO: 1121621 - RNA, 23 nt, Human
uccucugaccucccaccucucgc

SEQ ID NO: 1121622 - RNA, 29 nt, Human
uccucugaccucccaccucucucccucaa

SEQ ID NO: 1121623 - RNA, 21 nt, Human
uccugauacucucucccuacc

SEQ ID NO: 1121624 - RNA, 20 nt, Human
uccugguacucugcucuucu

SEQ ID NO: 1121625 - RNA, 21 nt, Human
uccugguacucugcucuucuc

SEQ ID NO: 1121626 - RNA, 24 nt, Human
ucucaaaguuugaaggguauuguc

SEQ ID NO: 1121627 - RNA, 22 nt, Human
ucuccaccuucgcuuuccugca

SEQ ID NO: 1121628 - RNA, 24 nt, Human
ucuccccuggagacagccccauac

SEQ ID NO: 1121629 - RNA, 20 nt, Human
ucucgcccucugcacccaga

SEQ ID NO: 1121630 - RNA, 23 nt, Human
ucugcucacacccaagucagacc

SEQ ID NO: 1121631 - RNA, 23 nt, Human
ucugguauccuugucaccugcuu

SEQ ID NO: 1121632 - RNA, 22 nt, Human
ugaagucaucuccuucuccagg

SEQ ID NO: 1121633 - RNA, 20 nt, Human
ugacccccagaccuucuccu

SEQ ID NO: 1121634 - RNA, 21 nt, Human
ugaccuccuccccaccucuug

SEQ ID NO: 1121635 - RNA, 18 nt, Human
ugagggagcuacaaauau

SEQ ID NO: 1121636 - RNA, 22 nt, Human
ugauggcagagaagcaaacacc

SEQ ID NO: 1121637 - RNA, 24 nt, Human
ugcaagugggagaagaaaggaguc

SEQ ID NO: 1121638 - RNA, 23 nt, Human
ugcccucagcacccagagugcuc

SEQ ID NO: 1121639 - RNA, 22 nt, Human
ugcucgugacggccagcagagc

SEQ ID NO: 1121640 - RNA, 22 nt, Human
ugcucgugacggccagcagagc

SEQ ID NO: 1121641 - RNA, 19 nt, Human
ugcucguguuggccagcaa

SEQ ID NO: 1121642 - RNA, 19 nt, Human
uggaagcaugcaaguggga

SEQ ID NO: 1121643 - RNA, 18 nt, Human
uggaggaaaacccagagu

SEQ ID NO: 1121644 - RNA, 19 nt, Human
uggcagagaagcaaacacc

SEQ ID NO: 1121645 - RNA, 20 nt, Human
uggcuacuuauucauucaga

SEQ ID NO: 1121646 - RNA, 19 nt, Human
ugggagaagaaaggaguca

SEQ ID NO: 1121647 - RNA, 19 nt, Human
ugguauccuugucaccugc

SEQ ID NO: 1121648 - RNA, 21 nt, Human
ugucacccuucccuccaaaca

SEQ ID NO: 1121649 - RNA, 18 nt, Human
ugugcagaggcaggucac

SEQ ID NO: 1121650 - RNA, 23 nt, Human
uguggucccaccuugggacccac

SEQ ID NO: 1121651 - RNA, 19 nt, Human
uucauccuuucagcuacuc

SEQ ID NO: 1121652 - RNA, 21 nt, Human
uucaugugcuguuggcuacuu

SEQ ID NO: 1121653 - RNA, 21 nt, Human
uucccuccaaacagccaccuc

SEQ ID NO: 1121654 - RNA, 21 nt, Human
uuggaucaugucauuugcugu

SEQ ID NO: 1121655 - RNA, 18 nt, Human
aaaguucugggccuggag

SEQ ID NO: 1121656 - RNA, 23 nt, Human
aagcuuguuuuccugcaacugga

SEQ ID NO: 1121657 - RNA, 24 nt, Human
aagcuuguuuuccugcaacuggau

SEQ ID NO: 1121658 - RNA, 24 nt, Human
aagcuuguuuuccugcaacuggau

SEQ ID NO: 1121659 - RNA, 19 nt, Human
aaugagccaugauaggacc

SEQ ID NO: 1121660 - RNA, 18 nt, Human
acuacacuccagccuugg

SEQ ID NO: 1121661 - RNA, 18 nt, Human
acuacacuccagccuugg

SEQ ID NO: 1121662 - RNA, 19 nt, Human
acuacacuccagccuugga

SEQ ID NO: 1121663 - RNA, 25 nt, Human
acuacacuccagccuuggacaacag

SEQ ID NO: 1121664 - RNA, 19 nt, Human
acuacacuccagccuuggg

SEQ ID NO: 1121665 - RNA, 18 nt, Human
agaggcugccgggaggua

SEQ ID NO: 1121666 - RNA, 19 nt, Human
agaggcugccgggagguag

SEQ ID NO: 1121667 - RNA, 24 nt, Human
agcaccuguagucucagccacgug

SEQ ID NO: 1121668 - RNA, 22 nt, Human
agcugugccuguggaggcuguu

SEQ ID NO: 1121669 - RNA, 19 nt, Human
aggcaggaggcugggccuu

SEQ ID NO: 1121670 - RNA, 19 nt, Human
aggcugccgugacguaggg

SEQ ID NO: 1121671 - RNA, 23 nt, Human
agguugacgugggaggaucgcuu

SEQ ID NO: 1121672 - RNA, 24 nt, Human
aguggcaagcaccuguagucucag

SEQ ID NO: 1121673 - RNA, 19 nt, Human
aguucugggccuggagagg

SEQ ID NO: 1121674 - RNA, 19 nt, Human
aguucugggccuggagagg

SEQ ID NO: 1121675 - RNA, 20 nt, Human
augguaggauugcuugagcc

SEQ ID NO: 1121676 - RNA, 25 nt, Human
caacaggaaaacuccuucaccucau

SEQ ID NO: 1121677 - RNA, 25 nt, Human
caccugaauaacauguugcccaguc

SEQ ID NO: 1121678 - RNA, 23 nt, Human
caccuguagucucagccacgugg

SEQ ID NO: 1121679 - RNA, 24 nt, Human
caccuguagucucagccacguggg

SEQ ID NO: 1121680 - RNA, 23 nt, Human
cagccuuggacaacagagggaga

SEQ ID NO: 1121681 - RNA, 23 nt, Human
cagcuccucgcugaugaagcaau

SEQ ID NO: 1121682 - RNA, 22 nt, Human
cagcuguagucccagcuacugg

SEQ ID NO: 1121683 - RNA, 23 nt, Human
cagcuguagucccagcuacuggg

SEQ ID NO: 1121684 - RNA, 24 nt, Human
cagucagucucucuuccuggauuc

SEQ ID NO: 1121685 - RNA, 21 nt, Human
cauuucugugcugcuugggag

SEQ ID NO: 1121686 - RNA, 22 nt, Human
ccaccugaauaacauguugccc

SEQ ID NO: 1121687 - RNA, 19 nt, Human
ccacugaacucuauccuga

SEQ ID NO: 1121688 - RNA, 20 nt, Human
ccuguuucugaagaaaaaaa

SEQ ID NO: 1121689 - RNA, 19 nt, Human
cgaguaaacaucacccucc

SEQ ID NO: 1121690 - RNA, 23 nt, Human
cgcugucaccccucuggaaucca

SEQ ID NO: 1121691 - RNA, 26 nt, Human
cggcaaacgaguaaacaucacccucc

SEQ ID NO: 1121692 - RNA, 22 nt, Human
cuacuacacuccagccuuggac

SEQ ID NO: 1121693 - RNA, 22 nt, Human
cucggcaaacgaguaaacauca

SEQ ID NO: 1121694 - RNA, 23 nt, Human
cucucucggcaaacgaguaaaca

SEQ ID NO: 1121695 - RNA, 23 nt, Human
cugagaauguucagggccuggag

SEQ ID NO: 1121696 - RNA, 23 nt, Human
cuggaagguugaggcugcaguca

SEQ ID NO: 1121697 - RNA, 22 nt, Human
cuuccuggauucacaagucuuu

SEQ ID NO: 1121698 - RNA, 19 nt, Human
gaaaguucugggccuggag

SEQ ID NO: 1121699 - RNA, 18 nt, Human
gaaucagggcccucucca

SEQ ID NO: 1121700 - RNA, 19 nt, Human
gaauccacguauaugaaaa

SEQ ID NO: 1121701 - RNA, 22 nt, Human
gacaacagagggagaccugaga

SEQ ID NO: 1121702 - RNA, 18 nt, Human
gaggcuguugugaggcag

SEQ ID NO: 1121703 - RNA, 21 nt, Human
gagugacagggcaagguccug

SEQ ID NO: 1121704 - RNA, 18 nt, Human
gauugcuugagccuggga

SEQ ID NO: 1121705 - RNA, 22 nt, Human
gauugcuugagccugggaguuu

SEQ ID NO: 1121706 - RNA, 18 nt, Human
gcugcagucagcugcgau

SEQ ID NO: 1121707 - RNA, 24 nt, Human
gcuguagucccagcuacugggaag

SEQ ID NO: 1121708 - RNA, 20 nt, Human
ggaaggcugacaugguagga

SEQ ID NO: 1121709 - RNA, 18 nt, Human
ggaguuugaggcuauaau

SEQ ID NO: 1121710 - RNA, 20 nt, Human
ggcugggaggcaggagcugg

SEQ ID NO: 1121711 - RNA, 24 nt, Human
gggcauaguggcaagcaccuguag

SEQ ID NO: 1121712 - RNA, 19 nt, Human
gugaggcagaggcugggcc

SEQ ID NO: 1121713 - RNA, 25 nt, Human
uacuacacuccagccuuggacaaca

SEQ ID NO: 1121714 - RNA, 20 nt, Human
uagcacuacuacacuccagc

SEQ ID NO: 1121715 - RNA, 23 nt, Human
uaguggcaagcaccuguagucuc

SEQ ID NO: 1121716 - RNA, 24 nt, Human
uaguggcaagcaccuguagucuca

SEQ ID NO: 1121717 - RNA, 20 nt, Human
uaguugggcauaguggcaag

SEQ ID NO: 1121718 - RNA, 19 nt, Human
ucagggccuggagagaagg

SEQ ID NO: 1121719 - RNA, 23 nt, Human
uccaugcugaggugccuacaagg

SEQ ID NO: 1121720 - RNA, 20 nt, Human
uccgcugugaggcagaggcu

SEQ ID NO: 1121721 - RNA, 21 nt, Human
ugacagggcaagguccuguuu

SEQ ID NO: 1121722 - RNA, 18 nt, Human
ugacaugguaggauugcu

SEQ ID NO: 1121723 - RNA, 23 nt, Human
ugagaauguucagggccuggaga

SEQ ID NO: 1121724 - RNA, 22 nt, Human
ugagccugggaguuugaggcua

SEQ ID NO: 1121725 - RNA, 23 nt, Human
ugagcuuggucuguagaggcuga

SEQ ID NO: 1121726 - RNA, 23 nt, Human
ugagcuuggucuguagaggcuga

SEQ ID NO: 1121727 - RNA, 18 nt, Human
ugaggcagaggcugggcc

SEQ ID NO: 1121728 - RNA, 18 nt, Human
ugaggcagaggcugggcc

SEQ ID NO: 1121729 - RNA, 20 nt, Human
ugaggcaguagccucaucug

SEQ ID NO: 1121730 - RNA, 19 nt, Human
uggaagguugaggcugcag

SEQ ID NO: 1121731 - RNA, 22 nt, Human
uggaagguugaggcugcaguca

SEQ ID NO: 1121732 - RNA, 19 nt, Human
uggaaucagggcccucucc

SEQ ID NO: 1121733 - RNA, 19 nt, Human
uggagcugugccuguggag

SEQ ID NO: 1121734 - RNA, 18 nt, Human
ugggaggcaggagcuggg

SEQ ID NO: 1121735 - RNA, 18 nt, Human
ugggaggccuggacagcc

SEQ ID NO: 1121736 - RNA, 23 nt, Human
ugggagguugacgugggaggauc

SEQ ID NO: 1121737 - RNA, 18 nt, Human
ugggccuggagaggcugc

SEQ ID NO: 1121738 - RNA, 18 nt, Human
ugugaggcagaggcuggg

SEQ ID NO: 1121739 - RNA, 19 nt, Human
ugugccuguggaggcuguu

SEQ ID NO: 1121740 - RNA, 22 nt, Human
uguucagggccuggagagaagg

SEQ ID NO: 1121741 - RNA, 18 nt, Human
uuaguugggcauaguggc

SEQ ID NO: 1121742 - RNA, 22 nt, Human
uucagggccuggagagaaggcu

SEQ ID NO: 1121743 - RNA, 24 nt, Human
uugcuugagccugggaguuugagg

SEQ ID NO: 1121744 - RNA, 18 nt, Human
aaaagccaaguucaucaa

SEQ ID NO: 1121745 - RNA, 20 nt, Human
aaacaaaaaaugccggacau

SEQ ID NO: 1121746 - RNA, 24 nt, Human
aaacuggugccugauaaaugcuga

SEQ ID NO: 1121747 - RNA, 18 nt, Human
aagagcugggaggggaca

SEQ ID NO: 1121748 - RNA, 22 nt, Human
accaagaaaauuuccacuguga

SEQ ID NO: 1121749 - RNA, 19 nt, Human
agagccagugcugacagag

SEQ ID NO: 1121750 - RNA, 24 nt, Human
agauaccagaacuuuaucugaagc

SEQ ID NO: 1121751 - RNA, 25 nt, Human
agauaccagaacuuuaucugaagcu

SEQ ID NO: 1121752 - RNA, 19 nt, Human
agauuuccccuuucccuug

SEQ ID NO: 1121753 - RNA, 23 nt, Human
agccccgaagccuuccaacacuc

SEQ ID NO: 1121754 - RNA, 22 nt, Human
agcggcaggcuguuguccugga

SEQ ID NO: 1121755 - RNA, 23 nt, Human
aggccacauccugguagacacca

SEQ ID NO: 1121756 - RNA, 18 nt, Human
aggggacagucaugugag

SEQ ID NO: 1121757 - RNA, 18 nt, Human
aucacagacguggcagga

SEQ ID NO: 1121758 - RNA, 24 nt, Human
aucaccaccaggacaaagcugcag

SEQ ID NO: 1121759 - RNA, 21 nt, Human
auccugguagacaccaagaaa

SEQ ID NO: 1121760 - RNA, 21 nt, Human
auuuauuuucaaaauaaauua

SEQ ID NO: 1121761 - RNA, 21 nt, Human
caaaauaaauauagagaugcc

SEQ ID NO: 1121762 - RNA, 21 nt, Human
caacaaaagacgaaacugaca

SEQ ID NO: 1121763 - RNA, 18 nt, Human
caagccggcucugaccga

SEQ ID NO: 1121764 - RNA, 20 nt, Human
cacugcuggagggacaggcc

SEQ ID NO: 1121765 - RNA, 20 nt, Human
cacuguguggucuugggcaa

SEQ ID NO: 1121766 - RNA, 24 nt, Human
cagaggcccuguccucacccagug

SEQ ID NO: 1121767 - RNA, 23 nt, Human
cagcauuugguaaacuuuccugc

SEQ ID NO: 1121768 - RNA, 18 nt, Human
cagcugggccucaugguc

SEQ ID NO: 1121769 - RNA, 22 nt, Human
cagcugggccucauggucacag

SEQ ID NO: 1121770 - RNA, 22 nt, Human
caggacaagcagggacacugcc

SEQ ID NO: 1121771 - RNA, 18 nt, Human
cagguuuguuuccucucc

SEQ ID NO: 1121772 - RNA, 21 nt, Human
cagugcugacagaggcccugu

SEQ ID NO: 1121773 - RNA, 24 nt, Human
caucaugggccacagcacacagga

SEQ ID NO: 1121774 - RNA, 23 nt, Human
cauggcaccacugcuggagggac

SEQ ID NO: 1121775 - RNA, 24 nt, Human
cauuacagaaggcugcaccgagcu

SEQ ID NO: 1121776 - RNA, 22 nt, Human
ccaaaauaaauauagagaugcc

SEQ ID NO: 1121777 - RNA, 22 nt, Human
ccaacacucugaagaucagcgg

SEQ ID NO: 1121778 - RNA, 22 nt, Human
ccacugcuggagggacaggccu

SEQ ID NO: 1121779 - RNA, 21 nt, Human
ccagcuccucugccaccaugg

SEQ ID NO: 1121780 - RNA, 23 nt, Human
cccagagaaagagauacauaaau

SEQ ID NO: 1121781 - RNA, 18 nt, Human
cccccccaagagcuggga

SEQ ID NO: 1121782 - RNA, 19 nt, Human
cccucuggaaucccuccuc

SEQ ID NO: 1121783 - RNA, 20 nt, Human
ccgcucaggaacauuaacag

SEQ ID NO: 1121784 - RNA, 26 nt, Human
ccuaggucccccccaagagcugggag

SEQ ID NO: 1121785 - RNA, 19 nt, Human
ccucuggaaucccuccucc

SEQ ID NO: 1121786 - RNA, 21 nt, Human
ccuggaucugcugugcacugg

SEQ ID NO: 1121787 - RNA, 22 nt, Human
ccuguccucacccagugaggag

SEQ ID NO: 1121788 - RNA, 23 nt, Human
cgugggguuuccuucggaguggg

SEQ ID NO: 1121789 - RNA, 23 nt, Human
cugacacuggagcugggcgacug

SEQ ID NO: 1121790 - RNA, 20 nt, Human
cuggaaucccuccuccugug

SEQ ID NO: 1121791 - RNA, 24 nt, Human
cuggucaaggugagagacugcucc

SEQ ID NO: 1121792 - RNA, 24 nt, Human
cugugcacuggguguggaccccuc

SEQ ID NO: 1121793 - RNA, 24 nt, Human
cuuccagcuggagagggcggcugg

SEQ ID NO: 1121794 - RNA, 19 nt, Human
cuuucagguucauguggca

SEQ ID NO: 1121795 - RNA, 22 nt, Human
gaagcugacacuggagcugggc

SEQ ID NO: 1121796 - RNA, 25 nt, Human
gagaaagagauacauaaaucaaugu

SEQ ID NO: 1121797 - RNA, 25 nt, Human
gagcaggagacggaaccgcucagga

SEQ ID NO: 1121798 - RNA, 22 nt, Human
gagccaaaugugcacacagcaa

SEQ ID NO: 1121799 - RNA, 18 nt, Human
gcccuguggcucgagaug

SEQ ID NO: 1121800 - RNA, 21 nt, Human
gccguuugcugggugucuuug

SEQ ID NO: 1121801 - RNA, 20 nt, Human
gccuaccugcucacggaaac

SEQ ID NO: 1121802 - RNA, 22 nt, Human
ggcaagagggcagcuuuucaga

SEQ ID NO: 1121803 - RNA, 18 nt, Human
gggacacugcccaggucu

SEQ ID NO: 1121804 - RNA, 19 nt, Human
guacauaggacacuaaagu

SEQ ID NO: 1121805 - RNA, 20 nt, Human
guggucuugggcaagucacu

SEQ ID NO: 1121806 - RNA, 25 nt, Human
uaaacucugcucaccauacacacac

SEQ ID NO: 1121807 - RNA, 24 nt, Human
uacgugggguuuccuucggagugg

SEQ ID NO: 1121808 - RNA, 20 nt, Human
uagaaugccaccaaaauaaa

SEQ ID NO: 1121809 - RNA, 20 nt, Human
ucaaggugagagacugcucc

SEQ ID NO: 1121810 - RNA, 26 nt, Human
ucaccaccaggacaaagcugcagcau

SEQ ID NO: 1121811 - RNA, 24 nt, Human
ucaccauacacacacucccauccc

SEQ ID NO: 1121812 - RNA, 20 nt, Human
ucacggaaaccgccguuugc

SEQ ID NO: 1121813 - RNA, 19 nt, Human
ucacuucacuccucugacc

SEQ ID NO: 1121814 - RNA, 21 nt, Human
uccacauagcaaaugcaaggu

SEQ ID NO: 1121815 - RNA, 22 nt, Human
ucccaugguagcaaacauugcc

SEQ ID NO: 1121816 - RNA, 18 nt, Human
uccuacauuugggaugug

SEQ ID NO: 1121817 - RNA, 20 nt, Human
ucugaagaucagcgggauga

SEQ ID NO: 1121818 - RNA, 21 nt, Human
ucugaccucaccuguacgugg

SEQ ID NO: 1121819 - RNA, 23 nt, Human
ucugcagagccacacagucugca

SEQ ID NO: 1121820 - RNA, 20 nt, Human
ucugccaccauggcuugggg

SEQ ID NO: 1121821 - RNA, 18 nt, Human
ucuuugacucucaucuuc

SEQ ID NO: 1121822 - RNA, 21 nt, Human
ugcagaugauacaacaaaaga

SEQ ID NO: 1121823 - RNA, 22 nt, Human
ugcaggacaagcagggacacug

SEQ ID NO: 1121824 - RNA, 20 nt, Human
ugcccugugagauuuccccu

SEQ ID NO: 1121825 - RNA, 19 nt, Human
ugcugugcacugggugugg

SEQ ID NO: 1121826 - RNA, 19 nt, Human
ugcuugacguuccuucccc

SEQ ID NO: 1121827 - RNA, 21 nt, Human
uggaccccucuguguuuccag

SEQ ID NO: 1121828 - RNA, 19 nt, Human
uggcuucagguuuguuucc

SEQ ID NO: 1121829 - RNA, 21 nt, Human
ugggaggggacagucauguga

SEQ ID NO: 1121830 - RNA, 26 nt, Human
ugggccucauggucacaggacccguc

SEQ ID NO: 1121831 - RNA, 23 nt, Human
ugggugucuuugacucucaucuu

SEQ ID NO: 1121832 - RNA, 19 nt, Human
ugguagacaccaagaaaau

SEQ ID NO: 1121833 - RNA, 23 nt, Human
ugguagcaaacauugccagucuc

SEQ ID NO: 1121834 - RNA, 21 nt, Human
uguacgugggguuuccuucgg

SEQ ID NO: 1121835 - RNA, 23 nt, Human
uguccuaggucccccccaagagc

SEQ ID NO: 1121836 - RNA, 22 nt, Human
ugugcacacagcaagccggcuc

SEQ ID NO: 1121837 - RNA, 20 nt, Human
ugugcacaugagaaagguca

SEQ ID NO: 1121838 - RNA, 18 nt, Human
uguguggucuugggcaag

SEQ ID NO: 1121839 - RNA, 24 nt, Human
uuauuuucaaaauaaauuauaucu

SEQ ID NO: 1121840 - RNA, 19 nt, Human
uuccaacacucugaagauc

SEQ ID NO: 1121841 - RNA, 21 nt, Human
uuccaccucagccccgaagcc

SEQ ID NO: 1121842 - RNA, 18 nt, Human
uucccuccugugcacaug

SEQ ID NO: 1121843 - RNA, 22 nt, Human
uugcugggugucuuugacucuc

SEQ ID NO: 1121844 - RNA, 20 nt, Human
uuugacugugucucucccca

SEQ ID NO: 1121845 - RNA, 20 nt, Human
uuugacugugucucucccca

SEQ ID NO: 1121846 - RNA, 19 nt, Human
acaaagccuggcccacagc

SEQ ID NO: 1121847 - RNA, 23 nt, Human
accuaacaacaaagccuggccca

SEQ ID NO: 1121848 - RNA, 18 nt, Human
agcuagucuuuccaggug

SEQ ID NO: 1121849 - RNA, 19 nt, Human
aggcagguucauuuuaagg

SEQ ID NO: 1121850 - RNA, 21 nt, Human
caacaaagccuggcccacagc

SEQ ID NO: 1121851 - RNA, 21 nt, Human
cccuggucgucccaaaccccc

SEQ ID NO: 1121852 - RNA, 19 nt, Human
ccucccagauggggguggg

SEQ ID NO: 1121853 - RNA, 18 nt, Human
ccuggcccacagcuggua

SEQ ID NO: 1121854 - RNA, 22 nt, Human
ccuugcuucccucuugaggucc

SEQ ID NO: 1121855 - RNA, 24 nt, Human
cugaagccagagcuagucuuucca

SEQ ID NO: 1121856 - RNA, 19 nt, Human
cuggggacugugugacucc

SEQ ID NO: 1121857 - RNA, 21 nt, Human
gaaaauaccuaacaacaaagg

SEQ ID NO: 1121858 - RNA, 20 nt, Human
gcuucggaggccccucccuc

SEQ ID NO: 1121859 - RNA, 19 nt, Human
guuagucgaaaccucgugg

SEQ ID NO: 1121860 - RNA, 21 nt, Human
ucccuggggacugugugacuc

SEQ ID NO: 1121861 - RNA, 22 nt, Human
ucggaggccccucccucacuga

SEQ ID NO: 1121862 - RNA, 27 nt, Human
ugggggugggguaucacuugcagcugg

SEQ ID NO: 1121863 - RNA, 23 nt, Human
ugggguaucacuugcagcuggaa

SEQ ID NO: 1121864 - RNA, 23 nt, Human
uugcuucccucuugagguccuua

SEQ ID NO: 1121865 - RNA, 18 nt, Human
aaaacagcagacuugauu

SEQ ID NO: 1121866 - RNA, 19 nt, Human
aaacagauaucuaaacacu

SEQ ID NO: 1121867 - RNA, 22 nt, Human
aaacagauaucuaaacacuaca

SEQ ID NO: 1121868 - RNA, 24 nt, Human
aaacagauaucuaaacacuacaac

SEQ ID NO: 1121869 - RNA, 18 nt, Human
aagauucugccaaucuga

SEQ ID NO: 1121870 - RNA, 24 nt, Human
acaggucuugcuuugugggugggu

SEQ ID NO: 1121871 - RNA, 26 nt, Human
accccaaagcccaccuuucagacccu

SEQ ID NO: 1121872 - RNA, 21 nt, Human
acggggcccugacgggucccg

SEQ ID NO: 1121873 - RNA, 20 nt, Human
agacccucugcccacagccu

SEQ ID NO: 1121874 - RNA, 23 nt, Human
agagagauuuguagaaacaacca

SEQ ID NO: 1121875 - RNA, 23 nt, Human
agcgagaguuguuacuguggugu

SEQ ID NO: 1121876 - RNA, 19 nt, Human
agggggggguggggacggg

SEQ ID NO: 1121877 - RNA, 22 nt, Human
auucucuucccccuccucacca

SEQ ID NO: 1121878 - RNA, 24 nt, Human
caaccacuucuacuacgaaaggcc

SEQ ID NO: 1121879 - RNA, 24 nt, Human
caaguuucugacccuggaaaugua

SEQ ID NO: 1121880 - RNA, 19 nt, Human
cacccccagcugccaagca

SEQ ID NO: 1121881 - RNA, 18 nt, Human
cacuacaaccacuucuac

SEQ ID NO: 1121882 - RNA, 24 nt, Human
cacucuaggaaaacuguugccaag

SEQ ID NO: 1121883 - RNA, 21 nt, Human
cagauaucuaaacacuacaac

SEQ ID NO: 1121884 - RNA, 21 nt, Human
cagcugccaagcaucccccca

SEQ ID NO: 1121885 - RNA, 23 nt, Human
ccaaagcccaccuuucagacccu

SEQ ID NO: 1121886 - RNA, 20 nt, Human
ccagcgguggaggggggggu

SEQ ID NO: 1121887 - RNA, 22 nt, Human
ccccaaagcccaccuuucagac

SEQ ID NO: 1121888 - RNA, 24 nt, Human
ccccaaagcccaccuuucagaccc

SEQ ID NO: 1121889 - RNA, 22 nt, Human
cccccagcugccaagcaucccc

SEQ ID NO: 1121890 - RNA, 22 nt, Human
cccccuccucaccauuucuacc

SEQ ID NO: 1121891 - RNA, 24 nt, Human
ccuggaaauguaauucucuucccc

SEQ ID NO: 1121892 - RNA, 21 nt, Human
cuaaagauucugccaaucuga

SEQ ID NO: 1121893 - RNA, 22 nt, Human
cuacuacgaaaggccaaaacag

SEQ ID NO: 1121894 - RNA, 19 nt, Human
cuaggaaaacuguugccaa

SEQ ID NO: 1121895 - RNA, 19 nt, Human
cucacccccagcugccaag

SEQ ID NO: 1121896 - RNA, 22 nt, Human
cucccugagcccucggcuuaua

SEQ ID NO: 1121897 - RNA, 18 nt, Human
cuccucacccccagcugc

SEQ ID NO: 1121898 - RNA, 24 nt, Human
cugccaaucugauucugcugcccg

SEQ ID NO: 1121899 - RNA, 21 nt, Human
cuucccccuccucaccauuuc

SEQ ID NO: 1121900 - RNA, 24 nt, Human
cuuuuuguuguuguuuauugaaaa

SEQ ID NO: 1121901 - RNA, 20 nt, Human
gaaaaaaaugcaauacaaga

SEQ ID NO: 1121902 - RNA, 25 nt, Human
gaagcaagaccaaacagauaucuaa

SEQ ID NO: 1121903 - RNA, 24 nt, Human
gcaagaccaaacagauaucuaaac

SEQ ID NO: 1121904 - RNA, 19 nt, Human
gcaauacaagaagcaagac

SEQ ID NO: 1121905 - RNA, 23 nt, Human
gcaauacaagaagcaagaccaaa

SEQ ID NO: 1121906 - RNA, 23 nt, Human
gcgguggagggggggguggggac

SEQ ID NO: 1121907 - RNA, 18 nt, Human
gcucuggcuccaguuccc

SEQ ID NO: 1121908 - RNA, 22 nt, Human
ggaaauguaauucucuuccccc

SEQ ID NO: 1121909 - RNA, 21 nt, Human
ggagggggggguggggacggg

SEQ ID NO: 1121910 - RNA, 24 nt, Human
guaauucucuucccccuccucacc

SEQ ID NO: 1121911 - RNA, 20 nt, Human
gucuccucacccccagcugc

SEQ ID NO: 1121912 - RNA, 22 nt, Human
uacaagaagcaagaccaaacag

SEQ ID NO: 1121913 - RNA, 19 nt, Human
uaccccaaagcccaccuuu

SEQ ID NO: 1121914 - RNA, 20 nt, Human
uacgaaaggccaaaacagca

SEQ ID NO: 1121915 - RNA, 23 nt, Human
uagaaacaaccagccuggggcug

SEQ ID NO: 1121916 - RNA, 21 nt, Human
ucuaggaaaacuguugccaag

SEQ ID NO: 1121917 - RNA, 19 nt, Human
ugagauccugggcagaaau

SEQ ID NO: 1121918 - RNA, 28 nt, Human
ugagcccucggcuuauaaauacaggucu

SEQ ID NO: 1121919 - RNA, 19 nt, Human
ugaugggcccagcggugga

SEQ ID NO: 1121920 - RNA, 20 nt, Human
ugccagaguccucauguggc

SEQ ID NO: 1121921 - RNA, 21 nt, Human
ugcuuugugggugggugccag

SEQ ID NO: 1121922 - RNA, 23 nt, Human
ugggucacggggcccugacgggu

SEQ ID NO: 1121923 - RNA, 18 nt, Human
uggugugucugagucacu

SEQ ID NO: 1121924 - RNA, 20 nt, Human
uuaaaaaaaauuuacaaagg

SEQ ID NO: 1121925 - RNA, 20 nt, Human
uucucuucccccuccucacc

SEQ ID NO: 1121926 - RNA, 22 nt, Human
uuucccgugagcaucaaaaggc

SEQ ID NO: 1121927 - RNA, 21 nt, Human
aaaacaaaacaaaacaaaaaa

SEQ ID NO: 1121928 - RNA, 28 nt, Human
aaaacaagaaauagaacaaaagggaccc

SEQ ID NO: 1121929 - RNA, 22 nt, Human
aaaaccugugaaaaaagaggcc

SEQ ID NO: 1121930 - RNA, 20 nt, Human
aaacaaaaaacagagcuuac

SEQ ID NO: 1121931 - RNA, 19 nt, Human
aaacaaaacaaaacaaaaa

SEQ ID NO: 1121932 - RNA, 22 nt, Human
aaacaaaacaaaacaaaacaaa

SEQ ID NO: 1121933 - RNA, 22 nt, Human
aaacaaaacaaaacaaaacaaa

SEQ ID NO: 1121934 - RNA, 20 nt, Human
aaacagagcuuacgacugcg

SEQ ID NO: 1121935 - RNA, 18 nt, Human
aaacgcuagugaaaaaca

SEQ ID NO: 1121936 - RNA, 21 nt, Human
aaagaugcauuucaaagcuaa

SEQ ID NO: 1121937 - RNA, 23 nt, Human
aaagcccuuucucccuucugccc

SEQ ID NO: 1121938 - RNA, 24 nt, Human
aaagcccuuucucccuucugcccc

SEQ ID NO: 1121939 - RNA, 19 nt, Human
aaagucaaacauccaaaug

SEQ ID NO: 1121940 - RNA, 21 nt, Human
aaauaaaugcaaugagaccug

SEQ ID NO: 1121941 - RNA, 22 nt, Human
aacaaaacaaaacaaaaaacag

SEQ ID NO: 1121942 - RNA, 18 nt, Human
aacauucaaugcaaaacc

SEQ ID NO: 1121943 - RNA, 19 nt, Human
aaccucugugugucaccuc

SEQ ID NO: 1121944 - RNA, 24 nt, Human
aagugacaccguaucuaagagcac

SEQ ID NO: 1121945 - RNA, 22 nt, Human
aauccugcuccucacaguuucu

SEQ ID NO: 1121946 - RNA, 26 nt, Human
acaaaacaaaacaaaaaacagagcuu

SEQ ID NO: 1121947 - RNA, 27 nt, Human
acaaaacaaaacaaaacaaaacaaaaa

SEQ ID NO: 1121948 - RNA, 18 nt, Human
acaccguaucuaagagca

SEQ ID NO: 1121949 - RNA, 24 nt, Human
agcuauccccaauuuucuaggggc

SEQ ID NO: 1121950 - RNA, 22 nt, Human
aggaggaggggggacaaugggc

SEQ ID NO: 1121951 - RNA, 23 nt, Human
aggaggaggggggacaaugggcu

SEQ ID NO: 1121952 - RNA, 27 nt, Human
agugaaaaacaagaaauagaacaaaag

SEQ ID NO: 1121953 - RNA, 18 nt, Human
auagaacaaaacacaucu

SEQ ID NO: 1121954 - RNA, 18 nt, Human
auauucccgggguuccug

SEQ ID NO: 1121955 - RNA, 26 nt, Human
aucaacaucaacacuaagaaauuuug

SEQ ID NO: 1121956 - RNA, 25 nt, Human
auccuggcuuuuagucccacucacc

SEQ ID NO: 1121957 - RNA, 18 nt, Human
auggccaaugcuugaugu

SEQ ID NO: 1121958 - RNA, 23 nt, Human
caaaacaaaaaacagagcuuacg

SEQ ID NO: 1121959 - RNA, 27 nt, Human
caaaacaaaacaaaacaaaaaacagag

SEQ ID NO: 1121960 - RNA, 24 nt, Human
caaaacaaaacaaaacaaaacaaa

SEQ ID NO: 1121961 - RNA, 25 nt, Human
caaaacaaaacaaaacaaaacaaaa

SEQ ID NO: 1121962 - RNA, 23 nt, Human
caaacauccaaaugguugaccac

SEQ ID NO: 1121963 - RNA, 21 nt, Human
caaacgcuagugaaaaacaag

SEQ ID NO: 1121964 - RNA, 22 nt, Human
caaagaugcauuucaaagcuaa

SEQ ID NO: 1121965 - RNA, 18 nt, Human
caaagcccuuucucccuu

SEQ ID NO: 1121966 - RNA, 24 nt, Human
caaagcuauccccaauuuucuagg

SEQ ID NO: 1121967 - RNA, 20 nt, Human
caacaggagaggguuccccu

SEQ ID NO: 1121968 - RNA, 24 nt, Human
caacaggagaggguuccccuggga

SEQ ID NO: 1121969 - RNA, 18 nt, Human
caaugcauggccucaagc

SEQ ID NO: 1121970 - RNA, 21 nt, Human
caaugggcuccaucuuuaaau

SEQ ID NO: 1121971 - RNA, 21 nt, Human
caccccagaauagacugcgga

SEQ ID NO: 1121972 - RNA, 19 nt, Human
caccccugcaguucccugu

SEQ ID NO: 1121973 - RNA, 21 nt, Human
cagcaaagcccuuucucccuu

SEQ ID NO: 1121974 - RNA, 24 nt, Human
caguuuauuguaucagaaaauaau

SEQ ID NO: 1121975 - RNA, 19 nt, Human
cauggccaaagcuaucccc

SEQ ID NO: 1121976 - RNA, 21 nt, Human
cauggccaaagcuauccccaa

SEQ ID NO: 1121977 - RNA, 21 nt, Human
ccaacccagaagcuaucaaca

SEQ ID NO: 1121978 - RNA, 25 nt, Human
ccagaagcuaucaacaucaacacua

SEQ ID NO: 1121979 - RNA, 22 nt, Human
ccaguugccccgcuugucuucc

SEQ ID NO: 1121980 - RNA, 22 nt, Human
cccauggccaaagcuaucccca

SEQ ID NO: 1121981 - RNA, 19 nt, Human
ccccugggagcagcagcug

SEQ ID NO: 1121982 - RNA, 21 nt, Human
cccucuggcuucagaggaagc

SEQ ID NO: 1121983 - RNA, 26 nt, Human
ccgaaaacaaaacaaaacaaaacaaa

SEQ ID NO: 1121984 - RNA, 19 nt, Human
ccucccauggccaaagcua

SEQ ID NO: 1121985 - RNA, 21 nt, Human
ccuuagagaauccugcuccuc

SEQ ID NO: 1121986 - RNA, 19 nt, Human
ccuucugccccaggugagu

SEQ ID NO: 1121987 - RNA, 24 nt, Human
cgaaaacaaaacaaaacaaaacaa

SEQ ID NO: 1121988 - RNA, 18 nt, Human
cuagggccuuucacccuc

SEQ ID NO: 1121989 - RNA, 19 nt, Human
cucugugacuuguccccac

SEQ ID NO: 1121990 - RNA, 24 nt, Human
cucugugacuuguccccacucauu

SEQ ID NO: 1121991 - RNA, 21 nt, Human
cugaggaggaggggggacaau

SEQ ID NO: 1121992 - RNA, 19 nt, Human
cuuccagccccuuaacugg

SEQ ID NO: 1121993 - RNA, 18 nt, Human
cuugcuccucccauggcc

SEQ ID NO: 1121994 - RNA, 23 nt, Human
gaaaaacaagaaauagaacaaaa

SEQ ID NO: 1121995 - RNA, 18 nt, Human
gaagagugaacaagaaug

SEQ ID NO: 1121996 - RNA, 24 nt, Human
gaccugguccuucuauuucucaga

SEQ ID NO: 1121997 - RNA, 20 nt, Human
gagaggguuccccugggagc

SEQ ID NO: 1121998 - RNA, 25 nt, Human
gagccaugccaucagcuugcuccua

SEQ ID NO: 1121999 - RNA, 19 nt, Human
gccaaagcuauccccaauu

SEQ ID NO: 1122000 - RNA, 24 nt, Human
gcccggggauugguacaauggugu

SEQ ID NO: 1122001 - RNA, 21 nt, Human
gccgaaaacaaaacaaaacaa

SEQ ID NO: 1122002 - RNA, 26 nt, Human
gcuuacgacugcguaguguucuugcu

SEQ ID NO: 1122003 - RNA, 19 nt, Human
ggcagccugagacuucagc

SEQ ID NO: 1122004 - RNA, 20 nt, Human
gggggacaaugggcuccauc

SEQ ID NO: 1122005 - RNA, 21 nt, Human
gggugagcugaggaggagggg

SEQ ID NO: 1122006 - RNA, 21 nt, Human
gggugagcugaggaggagggg

SEQ ID NO: 1122007 - RNA, 19 nt, Human
ggugagcugaggaggaggg

SEQ ID NO: 1122008 - RNA, 23 nt, Human
ggugugggcaaacacccccucug

SEQ ID NO: 1122009 - RNA, 25 nt, Human
gguuuuguaggccuuaagugguagg

SEQ ID NO: 1122010 - RNA, 19 nt, Human
guaaacauguguuccuuuu

SEQ ID NO: 1122011 - RNA, 24 nt, Human
gugaaaaaagaggccauguggccg

SEQ ID NO: 1122012 - RNA, 25 nt, Human
gugaaaaacaagaaauagaacaaaa

SEQ ID NO: 1122013 - RNA, 22 nt, Human
gugaaagucaaacauccaaaug

SEQ ID NO: 1122014 - RNA, 20 nt, Human
guguuccuuuugagaaaaua

SEQ ID NO: 1122015 - RNA, 26 nt, Human
uaacuaacuuugcuagggccuuucac

SEQ ID NO: 1122016 - RNA, 19 nt, Human
uaacugggagaauugugcu

SEQ ID NO: 1122017 - RNA, 21 nt, Human
uaagagcaccuuagagaaucc

SEQ ID NO: 1122018 - RNA, 22 nt, Human
uagaacaaaacacaucugcgga

SEQ ID NO: 1122019 - RNA, 24 nt, Human
uagggccuuucacccucuggcuuc

SEQ ID NO: 1122020 - RNA, 24 nt, Human
ucaaacauccaaaugguugacuag

SEQ ID NO: 1122021 - RNA, 24 nt, Human
ucaaugcaaaaccugugaaaaaag

SEQ ID NO: 1122022 - RNA, 24 nt, Human
ucaauguccaguucaauacuuucu

SEQ ID NO: 1122023 - RNA, 19 nt, Human
uccacauguaugugagaga

SEQ ID NO: 1122024 - RNA, 23 nt, Human
uccaugggugagcugaggaggag

SEQ ID NO: 1122025 - RNA, 27 nt, Human
uccaugggugagcugaggaggaggggg

SEQ ID NO: 1122026 - RNA, 22 nt, Human
uccccaauuuucuaggggcaag

SEQ ID NO: 1122027 - RNA, 24 nt, Human
uccucacaguuucuagggucccau

SEQ ID NO: 1122028 - RNA, 22 nt, Human
ucucugugacuuguccccacuc

SEQ ID NO: 1122029 - RNA, 21 nt, Human
ucugugacuuguccccacuca

SEQ ID NO: 1122030 - RNA, 22 nt, Human
ugaaaaacaagaaauagaacaa

SEQ ID NO: 1122031 - RNA, 18 nt, Human
ugaaagucaaacauccaa

SEQ ID NO: 1122032 - RNA, 21 nt, Human
ugacucuuagacagaugcccc

SEQ ID NO: 1122033 - RNA, 24 nt, Human
ugagagaaauaauagagaauggug

SEQ ID NO: 1122034 - RNA, 19 nt, Human
ugagcugaggaggaggggg

SEQ ID NO: 1122035 - RNA, 20 nt, Human
ugaggaggaggggggacaau

SEQ ID NO: 1122036 - RNA, 21 nt, Human
ugaggaggaggggggacaaug

SEQ ID NO: 1122037 - RNA, 23 nt, Human
ugcauggccucaagcuucauuca

SEQ ID NO: 1122038 - RNA, 18 nt, Human
ugcccagauacgcccaau

SEQ ID NO: 1122039 - RNA, 19 nt, Human
ugccccgcuugucuuccag

SEQ ID NO: 1122040 - RNA, 21 nt, Human
ugccccgcuugucuuccagcc

SEQ ID NO: 1122041 - RNA, 23 nt, Human
ugccccgcuugucuuccagcccc

SEQ ID NO: 1122042 - RNA, 21 nt, Human
ugccgaaaacaaaacaaaaca

SEQ ID NO: 1122043 - RNA, 23 nt, Human
ugccgaaaacaaaacaaaacaaa

SEQ ID NO: 1122044 - RNA, 24 nt, Human
ugcuguauuagcaguggcuguaag

SEQ ID NO: 1122045 - RNA, 21 nt, Human
uggcaaagaugcauuucaaag

SEQ ID NO: 1122046 - RNA, 21 nt, Human
uggcuugggaugacugaagag

SEQ ID NO: 1122047 - RNA, 19 nt, Human
ugggaugacugaagaguga

SEQ ID NO: 1122048 - RNA, 18 nt, Human
ugggcaaacacccccucu

SEQ ID NO: 1122049 - RNA, 18 nt, Human
ugggugagcugaggagga

SEQ ID NO: 1122050 - RNA, 25 nt, Human
uggugccgaaaacaaaacaaaacaa

SEQ ID NO: 1122051 - RNA, 24 nt, Human
uguuucacugaguauccuguuuau

SEQ ID NO: 1122052 - RNA, 18 nt, Human
uuaaaguucacgugaggc

SEQ ID NO: 1122053 - RNA, 25 nt, Human
uucacugaguauccuguuuauucca

SEQ ID NO: 1122054 - RNA, 23 nt, Human
uuccacuuaaucguagacacucu

SEQ ID NO: 1122055 - RNA, 19 nt, Human
uucgaauuuucccuuuugg

SEQ ID NO: 1122056 - RNA, 19 nt, Human
uucgugaacaguuucuaca

SEQ ID NO: 1122057 - RNA, 24 nt, Human
uugcugucauucuccuuuccauuu

SEQ ID NO: 1122058 - RNA, 19 nt, Human
uuguaguaaacauguguuc

SEQ ID NO: 1122059 - RNA, 25 nt, Human
uuucuuguccugugguucagcuuca

SEQ ID NO: 1122060 - RNA, 20 nt, Human
aagugagaacaugcgguguu

SEQ ID NO: 1122061 - RNA, 21 nt, Human
accacauuuucuuuauccagu

SEQ ID NO: 1122062 - RNA, 19 nt, Human
acuaauuuacauucccacc

SEQ ID NO: 1122063 - RNA, 23 nt, Human
agggaagacaucauuccagggcu

SEQ ID NO: 1122064 - RNA, 18 nt, Human
augauaguuucuuuugcu

SEQ ID NO: 1122065 - RNA, 18 nt, Human
auggcuagccaguucucc

SEQ ID NO: 1122066 - RNA, 21 nt, Human
auggcugcaugguauuccaug

SEQ ID NO: 1122067 - RNA, 24 nt, Human
augguauuucugguucuaaaucuu

SEQ ID NO: 1122068 - RNA, 18 nt, Human
caaaauaucccaaguguc

SEQ ID NO: 1122069 - RNA, 19 nt, Human
caacagcguaaaaacguug

SEQ ID NO: 1122070 - RNA, 24 nt, Human
cacucugaugauaguuucuuuugc

SEQ ID NO: 1122071 - RNA, 25 nt, Human
cagaaugugauccagaaaagcaggu

SEQ ID NO: 1122072 - RNA, 22 nt, Human
caguuuucagaaugugauccag

SEQ ID NO: 1122073 - RNA, 20 nt, Human
caucccugucccugcaaagg

SEQ ID NO: 1122074 - RNA, 23 nt, Human
ccauuugucaauuuuugcuuuug

SEQ ID NO: 1122075 - RNA, 21 nt, Human
ccgcugggagccuggcuucug

SEQ ID NO: 1122076 - RNA, 21 nt, Human
ccuaucaacccuuccuucacc

SEQ ID NO: 1122077 - RNA, 22 nt, Human
ccuaucaacccuuccuucaccu

SEQ ID NO: 1122078 - RNA, 22 nt, Human
ccuccagcuccaucccuguccc

SEQ ID NO: 1122079 - RNA, 24 nt, Human
ccuuccccauugcuuguuuuuguc

SEQ ID NO: 1122080 - RNA, 24 nt, Human
cuauacugucuuccacaaugguug

SEQ ID NO: 1122081 - RNA, 23 nt, Human
cuccaccccgcacucccccaacu

SEQ ID NO: 1122082 - RNA, 19 nt, Human
cuccgcuguccucccaggu

SEQ ID NO: 1122083 - RNA, 20 nt, Human
cucucuccaccccgcacucc

SEQ ID NO: 1122084 - RNA, 22 nt, Human
cucuggcucccccuuuggcucc

SEQ ID NO: 1122085 - RNA, 24 nt, Human
cugcaccuaucaacccuuccuuca

SEQ ID NO: 1122086 - RNA, 19 nt, Human
cugucucuuucucucugga

SEQ ID NO: 1122087 - RNA, 24 nt, Human
cuuccacaaugguugaacuaauuu

SEQ ID NO: 1122088 - RNA, 23 nt, Human
gaagaucagaugguuguagaugu

SEQ ID NO: 1122089 - RNA, 23 nt, Human
gcaccauuuauuaaauagggaau

SEQ ID NO: 1122090 - RNA, 24 nt, Human
gcccacuuuuuaaugggguuguuu

SEQ ID NO: 1122091 - RNA, 24 nt, Human
gcuccuggcuccgcuguccuccca

SEQ ID NO: 1122092 - RNA, 21 nt, Human
ggaaucccuuccccauugcuu

SEQ ID NO: 1122093 - RNA, 19 nt, Human
ggcugcaugguauuccaug

SEQ ID NO: 1122094 - RNA, 18 nt, Human
gguuacuguagccuugua

SEQ ID NO: 1122095 - RNA, 23 nt, Human
guaguauaguuugaaguugggua

SEQ ID NO: 1122096 - RNA, 21 nt, Human
guuaauuuuuguguaaggugu

SEQ ID NO: 1122097 - RNA, 24 nt, Human
uaagcccggcaugcauuagcuauu

SEQ ID NO: 1122098 - RNA, 24 nt, Human
uaagugagaacaugcgguguuugg

SEQ ID NO: 1122099 - RNA, 21 nt, Human
uacaagcucuuguuugguucu

SEQ ID NO: 1122100 - RNA, 22 nt, Human
uagaauuauuuauauuccuuug

SEQ ID NO: 1122101 - RNA, 23 nt, Human
uagcuauuuuuccugaugcucuc

SEQ ID NO: 1122102 - RNA, 24 nt, Human
uagcuauuuuuccugaugcucucu

SEQ ID NO: 1122103 - RNA, 29 nt, Human
uaucaacccuuccuucaccuagguauuaa

SEQ ID NO: 1122104 - RNA, 24 nt, Human
uauugugaauagugcggcauugaa

SEQ ID NO: 1122105 - RNA, 19 nt, Human
ucagcucccauuuauaagu

SEQ ID NO: 1122106 - RNA, 24 nt, Human
uccacaaugguugaacuaauuuac

SEQ ID NO: 1122107 - RNA, 21 nt, Human
ucccccuuuggcucccuggaa

SEQ ID NO: 1122108 - RNA, 20 nt, Human
ucccugcaaaggauaugauc

SEQ ID NO: 1122109 - RNA, 19 nt, Human
ucccuguguccauguguuc

SEQ ID NO: 1122110 - RNA, 24 nt, Human
ucucuaaugaucaguaauguugag

SEQ ID NO: 1122111 - RNA, 19 nt, Human
ucucucuggaccaggcugg

SEQ ID NO: 1122112 - RNA, 21 nt, Human
ucucuggaccaggcuggagcc

SEQ ID NO: 1122113 - RNA, 19 nt, Human
ucuuucucucuggaccagg

SEQ ID NO: 1122114 - RNA, 24 nt, Human
ucuuucucucuggaccaggcugga

SEQ ID NO: 1122115 - RNA, 18 nt, Human
ugaauguuauugccuaga

SEQ ID NO: 1122116 - RNA, 19 nt, Human
ugacacagcugcggagcuc

SEQ ID NO: 1122117 - RNA, 24 nt, Human
ugagaugguaucucauugugguuu

SEQ ID NO: 1122118 - RNA, 22 nt, Human
ugauaguuucuuuugcugugca

SEQ ID NO: 1122119 - RNA, 21 nt, Human
ugcaccuaucaacccuuccuu

SEQ ID NO: 1122120 - RNA, 22 nt, Human
ugcggcauugaacauaugcaug

SEQ ID NO: 1122121 - RNA, 26 nt, Human
ugcucucuccaccccgcacuccccca

SEQ ID NO: 1122122 - RNA, 21 nt, Human
uguaaggaaggggccaguuuc

SEQ ID NO: 1122123 - RNA, 19 nt, Human
ugugaagaaugucaguggu

SEQ ID NO: 1122124 - RNA, 23 nt, Human
ugugauccagaaaagcagguuuc

SEQ ID NO: 1122125 - RNA, 22 nt, Human
uguuuugguuacuguagccuug

SEQ ID NO: 1122126 - RNA, 19 nt, Human
uuacauagguaaacaugug

SEQ ID NO: 1122127 - RNA, 21 nt, Human
uuauaagugagaacaugcggu

SEQ ID NO: 1122128 - RNA, 24 nt, Human
uuauaagugagaacaugcgguguu

SEQ ID NO: 1122129 - RNA, 25 nt, Human
uuccaugguguauauauaccacauu

SEQ ID NO: 1122130 - RNA, 18 nt, Human
uucccaguaaugggauug

SEQ ID NO: 1122131 - RNA, 24 nt, Human
uuccuuguagauucuggauauuag

SEQ ID NO: 1122132 - RNA, 18 nt, Human
uuggguagcaugaugccu

SEQ ID NO: 1122133 - RNA, 20 nt, Human
uugguuuuacguuuaagucu

SEQ ID NO: 1122134 - RNA, 23 nt, Human
uuguaguauaguuugaaguuggg

SEQ ID NO: 1122135 - RNA, 20 nt, Human
uugucuguucacucugauga

SEQ ID NO: 1122136 - RNA, 19 nt, Human
uuuccugaugcucucucca

SEQ ID NO: 1122137 - RNA, 18 nt, Human
uuucggaagaucagaugg

SEQ ID NO: 1122138 - RNA, 21 nt, Human
uuucucucuggaccaggcugg

SEQ ID NO: 1122139 - RNA, 18 nt, Human
uuucugguucuaaaucuu

SEQ ID NO: 1122140 - RNA, 22 nt, Human
uuugcugaggauaaugccucca

SEQ ID NO: 1122141 - RNA, 21 nt, Human
uuuguagcauaccaugcuguu

SEQ ID NO: 1122142 - RNA, 19 nt, Human
aacauggagaaaccccauc

SEQ ID NO: 1122143 - RNA, 20 nt, Human
aacauggagaaaccccaucu

SEQ ID NO: 1122144 - RNA, 21 nt, Human
aacauggagaaaccccaucuc

SEQ ID NO: 1122145 - RNA, 18 nt, Human
aagcccauuaaaaaccaa

SEQ ID NO: 1122146 - RNA, 25 nt, Human
aaggugggcagaucaccugagguca

SEQ ID NO: 1122147 - RNA, 24 nt, Human
aaucacucgaauccgggagacaga

SEQ ID NO: 1122148 - RNA, 24 nt, Human
accccaucucuacuaaaaauacaa

SEQ ID NO: 1122149 - RNA, 25 nt, Human
accuuccccagggccuccaggagca

SEQ ID NO: 1122150 - RNA, 20 nt, Human
agacagagguugcagugagc

SEQ ID NO: 1122151 - RNA, 18 nt, Human
agagguugcagugagcag

SEQ ID NO: 1122152 - RNA, 23 nt, Human
agcacuuuggaggccaagguggg

SEQ ID NO: 1122153 - RNA, 23 nt, Human
agcagggugugguugugcaugcc

SEQ ID NO: 1122154 - RNA, 24 nt, Human
aggcaggagaaucacucgaauccg

SEQ ID NO: 1122155 - RNA, 21 nt, Human
aggccaaggugggcagaucac

SEQ ID NO: 1122156 - RNA, 19 nt, Human
aggcugaggcaggagaauc

SEQ ID NO: 1122157 - RNA, 22 nt, Human
aggugggcagaucaccugaggg

SEQ ID NO: 1122158 - RNA, 18 nt, Human
caagcuccuggccgggca

SEQ ID NO: 1122159 - RNA, 24 nt, Human
caaggugggcagaucaccugaggu

SEQ ID NO: 1122160 - RNA, 24 nt, Human
cacaccuguaauuccagcacuuug

SEQ ID NO: 1122161 - RNA, 18 nt, Human
caccuguaauuccagcac

SEQ ID NO: 1122162 - RNA, 23 nt, Human
caccuguaauuccagcacuuugg

SEQ ID NO: 1122163 - RNA, 27 nt, Human
cagaucaccugaggucagaaguucgag

SEQ ID NO: 1122164 - RNA, 23 nt, Human
cagcacuuuggaggccaaggugg

SEQ ID NO: 1122165 - RNA, 24 nt, Human
cagccugaccaacauggagaaacc

SEQ ID NO: 1122166 - RNA, 24 nt, Human
cagcuacucgggaggcugaggcag

SEQ ID NO: 1122167 - RNA, 33 nt, Human
ccaagcuccuggccgggcacgguggcucacagu

SEQ ID NO: 1122168 - RNA, 24 nt, Human
ccagcacuuuggaggccaaggugg

SEQ ID NO: 1122169 - RNA, 21 nt, Human
ccccaaccuuccaucaaggcc

SEQ ID NO: 1122170 - RNA, 21 nt, Human
ccccagggccuccaggagcag

SEQ ID NO: 1122171 - RNA, 23 nt, Human
ccccagggccuccaggagcagug

SEQ ID NO: 1122172 - RNA, 23 nt, Human
ccuccagggcaaggcugccgcuu

SEQ ID NO: 1122173 - RNA, 24 nt, Human
ccugaccaacauggagaaacccca

SEQ ID NO: 1122174 - RNA, 22 nt, Human
ccugaggucagaaguucgagac

SEQ ID NO: 1122175 - RNA, 21 nt, Human
ccuguaaucccagcuacucgg

SEQ ID NO: 1122176 - RNA, 21 nt, Human
cggcaagcccauuaaaaacca

SEQ ID NO: 1122177 - RNA, 24 nt, Human
cggcaagcccauuaaaaaccaagc

SEQ ID NO: 1122178 - RNA, 24 nt, Human
cgggagacagagguugcagugagc

SEQ ID NO: 1122179 - RNA, 24 nt, Human
cucacaccuguaauuccagcacuu

SEQ ID NO: 1122180 - RNA, 20 nt, Human
cuccaggagcagugcuucuc

SEQ ID NO: 1122181 - RNA, 23 nt, Human
cuccagggcaaggcugccgcuuc

SEQ ID NO: 1122182 - RNA, 23 nt, Human
gagaccagccugaccaacaugga

SEQ ID NO: 1122183 - RNA, 24 nt, Human
gaucaccugaggucagaaguucga

SEQ ID NO: 1122184 - RNA, 23 nt, Human
gcaggagaaucacucgaauccgg

SEQ ID NO: 1122185 - RNA, 22 nt, Human
gccacggcaagcccauuaaaaa

SEQ ID NO: 1122186 - RNA, 18 nt, Human
gccuccaggagcagugcu

SEQ ID NO: 1122187 - RNA, 22 nt, Human
ggaggccaaggugggcagauca

SEQ ID NO: 1122188 - RNA, 23 nt, Human
ggcacgguggcucacaccuguaa

SEQ ID NO: 1122189 - RNA, 23 nt, Human
gggaggcugaggcaggagaauca

SEQ ID NO: 1122190 - RNA, 22 nt, Human
gggugugguugugcaugccugu

SEQ ID NO: 1122191 - RNA, 23 nt, Human
gguggcucacaccuguaauucca

SEQ ID NO: 1122192 - RNA, 24 nt, Human
gguggcucacaccuguaauuccag

SEQ ID NO: 1122193 - RNA, 24 nt, Human
gguugugcaugccuguaaucccag

SEQ ID NO: 1122194 - RNA, 23 nt, Human
guggcucacaccuguaauuccag

SEQ ID NO: 1122195 - RNA, 22 nt, Human
uaaaaauacaaaauuagcaggg

SEQ ID NO: 1122196 - RNA, 23 nt, Human
uaaaaauacaaaauuagcagggu

SEQ ID NO: 1122197 - RNA, 24 nt, Human
uaggcucuggaucucucggccccc

SEQ ID NO: 1122198 - RNA, 24 nt, Human
ucacaaguccccucccauaggcuc

SEQ ID NO: 1122199 - RNA, 20 nt, Human
ucccauaggcucuggaucuc

SEQ ID NO: 1122200 - RNA, 25 nt, Human
uccccagggccuccaggagcagugc

SEQ ID NO: 1122201 - RNA, 21 nt, Human
uccgggagacagagguugcag

SEQ ID NO: 1122202 - RNA, 25 nt, Human
ucgggaggcugaggcaggagaauca

SEQ ID NO: 1122203 - RNA, 20 nt, Human
ucucuacuaaaaauacaaaa

SEQ ID NO: 1122204 - RNA, 20 nt, Human
ugaggcaggagaaucacucg

SEQ ID NO: 1122205 - RNA, 24 nt, Human
ugaggcaggagaaucacucgaauc

SEQ ID NO: 1122206 - RNA, 25 nt, Human
ugaggcaggagaaucacucgaaucc

SEQ ID NO: 1122207 - RNA, 21 nt, Human
ugccagcacucacaagucccc

SEQ ID NO: 1122208 - RNA, 23 nt, Human
ugccuguaaucccagcuacucgg

SEQ ID NO: 1122209 - RNA, 24 nt, Human
ugccuguaaucccagcuacucggg

SEQ ID NO: 1122210 - RNA, 23 nt, Human
uggaucucucggccccccaaccu

SEQ ID NO: 1122211 - RNA, 20 nt, Human
uggccuggcuuggccacggc

SEQ ID NO: 1122212 - RNA, 21 nt, Human
uggcucacaccuguaauucca

SEQ ID NO: 1122213 - RNA, 22 nt, Human
uggcucacaccuguaauuccag

SEQ ID NO: 1122214 - RNA, 24 nt, Human
uggcucacaccuguaauuccagca

SEQ ID NO: 1122215 - RNA, 18 nt, Human
ugggcagaucaccugagg

SEQ ID NO: 1122216 - RNA, 24 nt, Human
ugggcagaucaccugaggucagaa

SEQ ID NO: 1122217 - RNA, 24 nt, Human
ugguugugcaugccuguaauccca

SEQ ID NO: 1122218 - RNA, 18 nt, Human
ugugcaugccuguaaucc

SEQ ID NO: 1122219 - RNA, 21 nt, Human
ugugcaugccuguaaucccag

SEQ ID NO: 1122220 - RNA, 27 nt, Human
ugugcaugccuguaauccccggagccc

SEQ ID NO: 1122221 - RNA, 20 nt, Human
uuagcagggugugguugugc

SEQ ID NO: 1122222 - RNA, 19 nt, Human
aaagugcugggauuacagg

SEQ ID NO: 1122223 - RNA, 24 nt, Human
aaagugcugggauuacaggaguga

SEQ ID NO: 1122224 - RNA, 19 nt, Human
aaguagcugggacuacagg

SEQ ID NO: 1122225 - RNA, 20 nt, Human
aaguagcugggacuacaggc

SEQ ID NO: 1122226 - RNA, 25 nt, Human
aaguagcugggacuacaggcgccca

SEQ ID NO: 1122227 - RNA, 18 nt, Human
aagugcugggauuacagg

SEQ ID NO: 1122228 - RNA, 22 nt, Human
aagugcugggauuacaggaguc

SEQ ID NO: 1122229 - RNA, 26 nt, Human
aagugcugggauuacaggagugagcc

SEQ ID NO: 1122230 - RNA, 18 nt, Human
acagagcaccucagcacc

SEQ ID NO: 1122231 - RNA, 21 nt, Human
acagcaccagccugcugcaga

SEQ ID NO: 1122232 - RNA, 21 nt, Human
acaggcgcccaccacuacgcc

SEQ ID NO: 1122233 - RNA, 19 nt, Human
acccuguuagccaggaugg

SEQ ID NO: 1122234 - RNA, 20 nt, Human
accucugaccugggaacgag

SEQ ID NO: 1122235 - RNA, 20 nt, Human
acgugguuucacccuguuag

SEQ ID NO: 1122236 - RNA, 21 nt, Human
acugcaaaaagaaaaacaccu

SEQ ID NO: 1122237 - RNA, 20 nt, Human
acugcaagcuccgccucccg

SEQ ID NO: 1122238 - RNA, 19 nt, Human
agagguauuuuucuagagg

SEQ ID NO: 1122239 - RNA, 19 nt, Human
aggccacaccagaaaagga

SEQ ID NO: 1122240 - RNA, 25 nt, Human
aggcuggagugcaguggcgugaucu

SEQ ID NO: 1122241 - RNA, 20 nt, Human
aguagcacugaacauggcuc

SEQ ID NO: 1122242 - RNA, 19 nt, Human
agugcaguggcgugaucuc

SEQ ID NO: 1122243 - RNA, 20 nt, Human
agugcaguggcgugaucucg

SEQ ID NO: 1122244 - RNA, 23 nt, Human
agugcaguggcgugaucucggcu

SEQ ID NO: 1122245 - RNA, 24 nt, Human
agugcaguggcgugaucucggcuc

SEQ ID NO: 1122246 - RNA, 24 nt, Human
aucuaaggucagaaucugugaggu

SEQ ID NO: 1122247 - RNA, 24 nt, Human
caaagugcugggauuacaggagug

SEQ ID NO: 1122248 - RNA, 21 nt, Human
cacaccagaaaaggaaagcuu

SEQ ID NO: 1122249 - RNA, 19 nt, Human
cacagaaucuaaggucaga

SEQ ID NO: 1122250 - RNA, 20 nt, Human
cacagcaccagccugcugca

SEQ ID NO: 1122251 - RNA, 24 nt, Human
caccagaaaaggaaagcugggucc

SEQ ID NO: 1122252 - RNA, 19 nt, Human
caccagccugcugcagagu

SEQ ID NO: 1122253 - RNA, 18 nt, Human
cacccaucugcugaccuc

SEQ ID NO: 1122254 - RNA, 24 nt, Human
cacccuguuagccaggauggucuc

SEQ ID NO: 1122255 - RNA, 21 nt, Human
caccucagcaccacucgccug

SEQ ID NO: 1122256 - RNA, 22 nt, Human
cacgccauucuccugccucagc

SEQ ID NO: 1122257 - RNA, 22 nt, Human
cagcacuagguaaaacugcaaa

SEQ ID NO: 1122258 - RNA, 24 nt, Human
cagcugaaccccacauggugacau

SEQ ID NO: 1122259 - RNA, 25 nt, Human
caggcacuagcuacaaggccacacc

SEQ ID NO: 1122260 - RNA, 21 nt, Human
caggcgcccaccacuacgccu

SEQ ID NO: 1122261 - RNA, 23 nt, Human
cauuguuuaguaauuucuuaagc

SEQ ID NO: 1122262 - RNA, 19 nt, Human
ccaaagugcugggauuaca

SEQ ID NO: 1122263 - RNA, 21 nt, Human
ccaaagugcugggauuacagg

SEQ ID NO: 1122264 - RNA, 24 nt, Human
ccaaagugcugggauuacaggagu

SEQ ID NO: 1122265 - RNA, 22 nt, Human
ccacccagaaacacccaucugc

SEQ ID NO: 1122266 - RNA, 23 nt, Human
cccaaguagcugggacuacaggc

SEQ ID NO: 1122267 - RNA, 23 nt, Human
cccaaguagcugggacuacaggc

SEQ ID NO: 1122268 - RNA, 22 nt, Human
cccagaaacacccaucugcuga

SEQ ID NO: 1122269 - RNA, 22 nt, Human
cccaggcuggagugcaguggcg

SEQ ID NO: 1122270 - RNA, 24 nt, Human
cccaugccugacggcccacccaga

SEQ ID NO: 1122271 - RNA, 20 nt, Human
ccccacauggugacaucuuc

SEQ ID NO: 1122272 - RNA, 21 nt, Human
cccucgcgccgcgggcucccg

SEQ ID NO: 1122273 - RNA, 22 nt, Human
cccucgcgccgcgggcucccgu

SEQ ID NO: 1122274 - RNA, 23 nt, Human
ccucacgcccauuuacaggcccc

SEQ ID NO: 1122275 - RNA, 18 nt, Human
ccucgcgccgcgggcucc

SEQ ID NO: 1122276 - RNA, 20 nt, Human
ccugcugcagaguucaaaac

SEQ ID NO: 1122277 - RNA, 19 nt, Human
cgccucccggguucacgcc

SEQ ID NO: 1122278 - RNA, 24 nt, Human
cgcucugucgcccaggcuggagug

SEQ ID NO: 1122279 - RNA, 24 nt, Human
cuaaucacaguagcacugaacaug

SEQ ID NO: 1122280 - RNA, 24 nt, Human
cucagccucccaaguagcugggac

SEQ ID NO: 1122281 - RNA, 21 nt, Human
cucccggguucacgccauucu

SEQ ID NO: 1122282 - RNA, 22 nt, Human
cuccugaccucgugauccgccc

SEQ ID NO: 1122283 - RNA, 24 nt, Human
cucgcucugucgcccaggcuggag

SEQ ID NO: 1122284 - RNA, 23 nt, Human
cugccucagccucccaaguagcu

SEQ ID NO: 1122285 - RNA, 24 nt, Human
cuggagcacagagguauuuuucua

SEQ ID NO: 1122286 - RNA, 19 nt, Human
cugucgcccaggcuggagu

SEQ ID NO: 1122287 - RNA, 21 nt, Human
cuucaggacaggaacucuucc

SEQ ID NO: 1122288 - RNA, 23 nt, Human
gaaaaagaacugaacucccagca

SEQ ID NO: 1122289 - RNA, 21 nt, Human
gaaaaggaaagcuggguccug

SEQ ID NO: 1122290 - RNA, 21 nt, Human
gaacauggcucuagugagugg

SEQ ID NO: 1122291 - RNA, 22 nt, Human
gaccucgugauccgcccaucuc

SEQ ID NO: 1122292 - RNA, 22 nt, Human
gaccucgugauccgcccaucuc

SEQ ID NO: 1122293 - RNA, 24 nt, Human
gaccucgugauccgcccaucucgg

SEQ ID NO: 1122294 - RNA, 19 nt, Human
gagaagacagaugaugugg

SEQ ID NO: 1122295 - RNA, 21 nt, Human
gagacggagucucgcucuguc

SEQ ID NO: 1122296 - RNA, 18 nt, Human
gagcaccucagcaccacu

SEQ ID NO: 1122297 - RNA, 23 nt, Human
gagcugcccugggcuaaguucag

SEQ ID NO: 1122298 - RNA, 24 nt, Human
gaggaaaaagaacugaacucccag

SEQ ID NO: 1122299 - RNA, 21 nt, Human
gaugcaggcuggcagaaggga

SEQ ID NO: 1122300 - RNA, 18 nt, Human
gauuacaggagugagcca

SEQ ID NO: 1122301 - RNA, 24 nt, Human
gcaaggcaaggacaucagcaccuc

SEQ ID NO: 1122302 - RNA, 22 nt, Human
gccacuacacagcaccagccug

SEQ ID NO: 1122303 - RNA, 20 nt, Human
gcccaggcuggagugcagug

SEQ ID NO: 1122304 - RNA, 24 nt, Human
gcccaggcuggagugcaguggcgu

SEQ ID NO: 1122305 - RNA, 20 nt, Human
gccucagccucccaaguagc

SEQ ID NO: 1122306 - RNA, 25 nt, Human
gccucccggguucacgccauucucc

SEQ ID NO: 1122307 - RNA, 18 nt, Human
gccugacggcccacccag

SEQ ID NO: 1122308 - RNA, 24 nt, Human
gccuggcuaauuuuuuuguauuuu

SEQ ID NO: 1122309 - RNA, 25 nt, Human
gcucugucgcccaggcuggagugca

SEQ ID NO: 1122310 - RNA, 19 nt, Human
gcuggagugcaguggcgug

SEQ ID NO: 1122311 - RNA, 19 nt, Human
ggaaagcuggguccuggaa

SEQ ID NO: 1122312 - RNA, 24 nt, Human
ggauggucucgaucuccugaccuc

SEQ ID NO: 1122313 - RNA, 22 nt, Human
ggcuggagugcaguggcgugau

SEQ ID NO: 1122314 - RNA, 24 nt, Human
gggaaggaggccugaggagaggau

SEQ ID NO: 1122315 - RNA, 21 nt, Human
gugaucucggcucacugcaag

SEQ ID NO: 1122316 - RNA, 20 nt, Human
guugugguaaagccauagcc

SEQ ID NO: 1122317 - RNA, 21 nt, Human
uaaagccauagccagcccagc

SEQ ID NO: 1122318 - RNA, 26 nt, Human
uaaagccauagccagcccagcuccug

SEQ ID NO: 1122319 - RNA, 26 nt, Human
uaauuuuuuuguauuuuuaguagaga

SEQ ID NO: 1122320 - RNA, 18 nt, Human
uacaaggccacaccagaa

SEQ ID NO: 1122321 - RNA, 24 nt, Human
uacaggagugagccaccacgccca

SEQ ID NO: 1122322 - RNA, 21 nt, Human
uacuacuaaucacaguagcac

SEQ ID NO: 1122323 - RNA, 24 nt, Human
uaguagagacgugguuucacccug

SEQ ID NO: 1122324 - RNA, 26 nt, Human
uaguagagacgugguuucacccuguu

SEQ ID NO: 1122325 - RNA, 24 nt, Human
ucaaauaugguucccuaacuuaga

SEQ ID NO: 1122326 - RNA, 24 nt, Human
ucacccuguuagccaggauggucu

SEQ ID NO: 1122327 - RNA, 18 nt, Human
ucacugcaagcuccgccu

SEQ ID NO: 1122328 - RNA, 19 nt, Human
ucacugcaagcuccgccuc

SEQ ID NO: 1122329 - RNA, 24 nt, Human
ucacugcaagcuccgccucccggg

SEQ ID NO: 1122330 - RNA, 23 nt, Human
ucagcaccacucgccugaggaac

SEQ ID NO: 1122331 - RNA, 18 nt, Human
ucagccucccaaguagcu

SEQ ID NO: 1122332 - RNA, 20 nt, Human
ucagccucccaaguagcugg

SEQ ID NO: 1122333 - RNA, 24 nt, Human
ucaggacaggaacucuuccuuggu

SEQ ID NO: 1122334 - RNA, 18 nt, Human
ucccaaagugcugggauu

SEQ ID NO: 1122335 - RNA, 23 nt, Human
ucccaaagugcugggauuacagg

SEQ ID NO: 1122336 - RNA, 24 nt, Human
ucccaaguagcugggacuacaggc

SEQ ID NO: 1122337 - RNA, 21 nt, Human
ucccggguucacgccauucuc

SEQ ID NO: 1122338 - RNA, 24 nt, Human
ucccggguucacgccauucuccug

SEQ ID NO: 1122339 - RNA, 24 nt, Human
ucgcccaggcuggagugcaguggc

SEQ ID NO: 1122340 - RNA, 21 nt, Human
ucuagaggaaaaagaacugaa

SEQ ID NO: 1122341 - RNA, 26 nt, Human
ucuccugccucagccucccaaguagc

SEQ ID NO: 1122342 - RNA, 19 nt, Human
ucucgcucugucgcccagg

SEQ ID NO: 1122343 - RNA, 23 nt, Human
ucucgcucugucgcccaggcugg

SEQ ID NO: 1122344 - RNA, 24 nt, Human
ucucgcucugucgcccaggcugga

SEQ ID NO: 1122345 - RNA, 26 nt, Human
ucucgcucugucgcccaggcuggagu

SEQ ID NO: 1122346 - RNA, 27 nt, Human
ucucgcucugucgcccaggcuggagug

SEQ ID NO: 1122347 - RNA, 20 nt, Human
ucucggccucccaaagugcu

SEQ ID NO: 1122348 - RNA, 18 nt, Human
ucuuccagcaaggcaagg

SEQ ID NO: 1122349 - RNA, 24 nt, Human
ugaaccccacauggugacaucuua

SEQ ID NO: 1122350 - RNA, 23 nt, Human
ugagugggccucagucaguucag

SEQ ID NO: 1122351 - RNA, 24 nt, Human
ugauccgcccaucucggccuccca

SEQ ID NO: 1122352 - RNA, 20 nt, Human
ugaugugggaaggaggccug

SEQ ID NO: 1122353 - RNA, 22 nt, Human
ugcaguggcgugaucucggcuc

SEQ ID NO: 1122354 - RNA, 18 nt, Human
ugcccugggcuaaguuca

SEQ ID NO: 1122355 - RNA, 20 nt, Human
ugcccugggcuaaguucagu

SEQ ID NO: 1122356 - RNA, 24 nt, Human
ugccucagccucccaaguagcugg

SEQ ID NO: 1122357 - RNA, 19 nt, Human
ugcugaccucugaccuggg

SEQ ID NO: 1122358 - RNA, 19 nt, Human
uggagugcaguggcgugau

SEQ ID NO: 1122359 - RNA, 23 nt, Human
uggagugcaguggcgugaucucg

SEQ ID NO: 1122360 - RNA, 24 nt, Human
uggagugcaguggcgugaucucgg

SEQ ID NO: 1122361 - RNA, 18 nt, Human
uggcagaagggagcaggg

SEQ ID NO: 1122362 - RNA, 20 nt, Human
uggcagaagggagcagggug

SEQ ID NO: 1122363 - RNA, 20 nt, Human
uggcgugaucucggcucacu

SEQ ID NO: 1122364 - RNA, 19 nt, Human
uggcuacaaccucagcuga

SEQ ID NO: 1122365 - RNA, 18 nt, Human
ugggaaggaggccugagg

SEQ ID NO: 1122366 - RNA, 21 nt, Human
ugggacuacaggcgcccacca

SEQ ID NO: 1122367 - RNA, 24 nt, Human
ugggacuacaggcgcccaccacua

SEQ ID NO: 1122368 - RNA, 19 nt, Human
ugggaggagcuuaaaccua

SEQ ID NO: 1122369 - RNA, 21 nt, Human
ugggaggagcuuaaaccuaga

SEQ ID NO: 1122370 - RNA, 18 nt, Human
ugggauuacaggagugag

SEQ ID NO: 1122371 - RNA, 19 nt, Human
ugggauuacaggagugagc

SEQ ID NO: 1122372 - RNA, 22 nt, Human
ugggauuacaggagugagccac

SEQ ID NO: 1122373 - RNA, 23 nt, Human
ugggauuacaggagugagccacc

SEQ ID NO: 1122374 - RNA, 24 nt, Human
ugggauuacaggagugagccacca

SEQ ID NO: 1122375 - RNA, 19 nt, Human
ugggccucagucaguucag

SEQ ID NO: 1122376 - RNA, 20 nt, Human
uggguggccacuacacagca

SEQ ID NO: 1122377 - RNA, 22 nt, Human
ugguaaagccauagccagccca

SEQ ID NO: 1122378 - RNA, 20 nt, Human
ugucacagaaucuaagguca

SEQ ID NO: 1122379 - RNA, 21 nt, Human
ugucgcccaggcuggagugca

SEQ ID NO: 1122380 - RNA, 18 nt, Human
uuaguagagacgugguuu

SEQ ID NO: 1122381 - RNA, 25 nt, Human
uuaguagagacgugguuucacccug

SEQ ID NO: 1122382 - RNA, 21 nt, Human
uuuuguauuuuuaguagagac

SEQ ID NO: 1122383 - RNA, 24 nt, Human
uuuuuaguagagacgugguuucac

SEQ ID NO: 1122384 - RNA, 21 nt, Human
uuuuuguauuuuuaguagaga

SEQ ID NO: 1122385 - RNA, 21 nt, Human
uuuuuuguauuuuuaguagag

SEQ ID NO: 1122386 - RNA, 20 nt, Human
aaaccucuuuccuuuauaaa

SEQ ID NO: 1122387 - RNA, 21 nt, Human
aacaucucacccugcacaaga

SEQ ID NO: 1122388 - RNA, 22 nt, Human
aagacgccccuucccccaugcc

SEQ ID NO: 1122389 - RNA, 19 nt, Human
aagcaaguggggcaggggc

SEQ ID NO: 1122390 - RNA, 19 nt, Human
aauccucaagguugcucug

SEQ ID NO: 1122391 - RNA, 20 nt, Human
acacacacagcaugggcaua

SEQ ID NO: 1122392 - RNA, 24 nt, Human
acaguccuuaccacccaccacuac

SEQ ID NO: 1122393 - RNA, 21 nt, Human
accacuaccugcucuaaacag

SEQ ID NO: 1122394 - RNA, 22 nt, Human
acuggaaccccaagcagccagg

SEQ ID NO: 1122395 - RNA, 20 nt, Human
agagauguguacacauccuc

SEQ ID NO: 1122396 - RNA, 24 nt, Human
agcauucccagagcaggagacgcc

SEQ ID NO: 1122397 - RNA, 24 nt, Human
agcauuuacuggaaccccaagcag

SEQ ID NO: 1122398 - RNA, 25 nt, Human
agcauuuacuggaaccccaagcagc

SEQ ID NO: 1122399 - RNA, 21 nt, Human
agcccagagcuugccuuggag

SEQ ID NO: 1122400 - RNA, 18 nt, Human
aggguuguccaagcagca

SEQ ID NO: 1122401 - RNA, 19 nt, Human
auugagcaaaugagggaaa

SEQ ID NO: 1122402 - RNA, 22 nt, Human
caaccaaaucucaucuugaacu

SEQ ID NO: 1122403 - RNA, 18 nt, Human
caagcagcauucccagag

SEQ ID NO: 1122404 - RNA, 26 nt, Human
cacacacacagcaugggcauaaacac

SEQ ID NO: 1122405 - RNA, 23 nt, Human
caccccauguguguuuuugaagu

SEQ ID NO: 1122406 - RNA, 24 nt, Human
cacccgucucagucucuccagagc

SEQ ID NO: 1122407 - RNA, 23 nt, Human
cagcagccaucaacaaagauacu

SEQ ID NO: 1122408 - RNA, 21 nt, Human
cagcaugaaggguggucugug

SEQ ID NO: 1122409 - RNA, 22 nt, Human
cagcauucccagagcaggagac

SEQ ID NO: 1122410 - RNA, 19 nt, Human
caggagacgccuuguccac

SEQ ID NO: 1122411 - RNA, 19 nt, Human
caucaacaaagauacugua

SEQ ID NO: 1122412 - RNA, 25 nt, Human
caucaacaaagauacuguagaaaag

SEQ ID NO: 1122413 - RNA, 24 nt, Human
caucucacccugcacaagacuuuc

SEQ ID NO: 1122414 - RNA, 20 nt, Human
caucugcuuuucuucauuuu

SEQ ID NO: 1122415 - RNA, 19 nt, Human
cauguacacagagaugugu

SEQ ID NO: 1122416 - RNA, 19 nt, Human
cauuggaauagggaaauuc

SEQ ID NO: 1122417 - RNA, 20 nt, Human
ccaaagacgccccuuccccc

SEQ ID NO: 1122418 - RNA, 19 nt, Human
ccaacagaggcacacacac

SEQ ID NO: 1122419 - RNA, 19 nt, Human
ccaaccaaaucucaucuug

SEQ ID NO: 1122420 - RNA, 19 nt, Human
ccaagcagcauucccagag

SEQ ID NO: 1122421 - RNA, 27 nt, Human
cccaaagacgccccuucccccaugccu

SEQ ID NO: 1122422 - RNA, 18 nt, Human
cccacaugucaugggagg

SEQ ID NO: 1122423 - RNA, 23 nt, Human
cccaccacuaccugcucuaaaca

SEQ ID NO: 1122424 - RNA, 25 nt, Human
cccaccacuaccugcucuaaacaga

SEQ ID NO: 1122425 - RNA, 19 nt, Human
cccaugugccccacccacc

SEQ ID NO: 1122426 - RNA, 24 nt, Human
ccccacccaccugugccuccgcag

SEQ ID NO: 1122427 - RNA, 20 nt, Human
ccugaggccuccccagcccu

SEQ ID NO: 1122428 - RNA, 25 nt, Human
ccuucccccaugccugccuuuccug

SEQ ID NO: 1122429 - RNA, 19 nt, Human
cgccccuucccccaugccu

SEQ ID NO: 1122430 - RNA, 22 nt, Human
cucaagguugcucugauuauuc

SEQ ID NO: 1122431 - RNA, 21 nt, Human
cucugauuauucaaagaagag

SEQ ID NO: 1122432 - RNA, 19 nt, Human
cugguggccucuuuccgug

SEQ ID NO: 1122433 - RNA, 21 nt, Human
cugugccuccgcagaccuggg

SEQ ID NO: 1122434 - RNA, 23 nt, Human
cugugccuccgcagaccuggguu

SEQ ID NO: 1122435 - RNA, 19 nt, Human
cugugguaggcaccccaug

SEQ ID NO: 1122436 - RNA, 21 nt, Human
cuuggagucaacaucucaccc

SEQ ID NO: 1122437 - RNA, 22 nt, Human
gcagaggggaaaaccaagccca

SEQ ID NO: 1122438 - RNA, 21 nt, Human
gcaggagacgccuuguccaca

SEQ ID NO: 1122439 - RNA, 21 nt, Human
gcuguucucgugguagugagg

SEQ ID NO: 1122440 - RNA, 18 nt, Human
ggaaccccaagcagccag

SEQ ID NO: 1122441 - RNA, 22 nt, Human
ggccagcuccaagcaggagucc

SEQ ID NO: 1122442 - RNA, 18 nt, Human
gggagaagcugccaggua

SEQ ID NO: 1122443 - RNA, 22 nt, Human
gggcauuccaggcuaagggaga

SEQ ID NO: 1122444 - RNA, 22 nt, Human
gugccuccgcagaccuggguuc

SEQ ID NO: 1122445 - RNA, 20 nt, Human
guggccucuuuccguggcau

SEQ ID NO: 1122446 - RNA, 22 nt, Human
gugguagugagcgaguucucac

SEQ ID NO: 1122447 - RNA, 18 nt, Human
uaagcuccugagaugugc

SEQ ID NO: 1122448 - RNA, 21 nt, Human
uaccuccaugcuguucucgug

SEQ ID NO: 1122449 - RNA, 21 nt, Human
uacuggaaccccaagcagcca

SEQ ID NO: 1122450 - RNA, 20 nt, Human
uaggagacaguccuuaccac

SEQ ID NO: 1122451 - RNA, 21 nt, Human
ucaacaaagauacuguagaaa

SEQ ID NO: 1122452 - RNA, 23 nt, Human
ucaggacacucacugcugguggc

SEQ ID NO: 1122453 - RNA, 22 nt, Human
uccaagcaaguggggcaggggc

SEQ ID NO: 1122454 - RNA, 18 nt, Human
uccaggcuaagggagaag

SEQ ID NO: 1122455 - RNA, 22 nt, Human
ucccaaagacgccccuuccccc

SEQ ID NO: 1122456 - RNA, 18 nt, Human
ucccagagcaggagacgc

SEQ ID NO: 1122457 - RNA, 19 nt, Human
uccugaggccuccccagcc

SEQ ID NO: 1122458 - RNA, 19 nt, Human
ugaaugguggugggauugg

SEQ ID NO: 1122459 - RNA, 20 nt, Human
ugacucacggagugauugcc

SEQ ID NO: 1122460 - RNA, 21 nt, Human
ugacucacggagugauugccu

SEQ ID NO: 1122461 - RNA, 18 nt, Human
ugcacaucuccuugcugc

SEQ ID NO: 1122462 - RNA, 25 nt, Human
ugccccacccaccugugccuccgca

SEQ ID NO: 1122463 - RNA, 21 nt, Human
ugccuccgcagaccuggguuc

SEQ ID NO: 1122464 - RNA, 22 nt, Human
ugccugccuuuccugucugguc

SEQ ID NO: 1122465 - RNA, 24 nt, Human
ugccuggcuaaaggaagagagagc

SEQ ID NO: 1122466 - RNA, 18 nt, Human
ugggagggacccccuggg

SEQ ID NO: 1122467 - RNA, 21 nt, Human
uguagaaaaguaagcuccuga

SEQ ID NO: 1122468 - RNA, 21 nt, Human
ugucccaugugccccacccac

SEQ ID NO: 1122469 - RNA, 23 nt, Human
uuaaaccucuuuccuuuauaaau

SEQ ID NO: 1122470 - RNA, 21 nt, Human
uucacaaaugcacauguacac

SEQ ID NO: 1122471 - RNA, 24 nt, Human
uucacaaaugcacauguacacaga

SEQ ID NO: 1122472 - RNA, 24 nt, Human
uucaucauacauucagcagccauc

SEQ ID NO: 1122473 - RNA, 18 nt, Human
uucauuuugcacagugag

SEQ ID NO: 1122474 - RNA, 23 nt, Human
uucccccaugccugccuuuccug

SEQ ID NO: 1122475 - RNA, 23 nt, Human
uugagcaaaugagggaaauucau

SEQ ID NO: 1122476 - RNA, 23 nt, Human
uugcaucauccccacaugucaug

SEQ ID NO: 1122477 - RNA, 19 nt, Human
uuuacucuacuccuucugu

SEQ ID NO: 1122478 - RNA, 23 nt, Human
uuuacuggaaccccaagcagcca

SEQ ID NO: 1122479 - RNA, 22 nt, Human
uuucacaaaugcacauguacac

SEQ ID NO: 1122480 - RNA, 19 nt, Human
aaagugcugggauuacaga

SEQ ID NO: 1122481 - RNA, 24 nt, Human
aaagugcugggauuacagacguga

SEQ ID NO: 1122482 - RNA, 19 nt, Human
aaccacuggucucuauggg

SEQ ID NO: 1122483 - RNA, 22 nt, Human
aaccagagguccuguccucaag

SEQ ID NO: 1122484 - RNA, 18 nt, Human
aaccugggcuugcuuucu

SEQ ID NO: 1122485 - RNA, 19 nt, Human
aagcagaagccacgucaug

SEQ ID NO: 1122486 - RNA, 25 nt, Human
aagcagaagccacgucaugagccug

SEQ ID NO: 1122487 - RNA, 21 nt, Human
aagccagccucccagaggccc

SEQ ID NO: 1122488 - RNA, 22 nt, Human
aagugagcuauccugucacaaa

SEQ ID NO: 1122489 - RNA, 19 nt, Human
aagugcugggauuacagac

SEQ ID NO: 1122490 - RNA, 26 nt, Human
aagugcugggauuacagacgugagcc

SEQ ID NO: 1122491 - RNA, 24 nt, Human
aauuggagaccagccugggcaaca

SEQ ID NO: 1122492 - RNA, 18 nt, Human
acagacgugagccaccgc

SEQ ID NO: 1122493 - RNA, 22 nt, Human
acaggugcccaccaccagagac

SEQ ID NO: 1122494 - RNA, 20 nt, Human
accaagcacuuuaacauccc

SEQ ID NO: 1122495 - RNA, 24 nt, Human
accauguuagccaggcuggucucg

SEQ ID NO: 1122496 - RNA, 25 nt, Human
acccgccuuggccucccaaagugcu

SEQ ID NO: 1122497 - RNA, 20 nt, Human
acgcggguuucaccauguua

SEQ ID NO: 1122498 - RNA, 20 nt, Human
acgcggguuucaccauguuu

SEQ ID NO: 1122499 - RNA, 21 nt, Human
acgugagccaccgcgcccggc

SEQ ID NO: 1122500 - RNA, 23 nt, Human
agaaagaaaggaggcaaacuugg

SEQ ID NO: 1122501 - RNA, 28 nt, Human
agaaaggaggcaaacuuggggagugaga

SEQ ID NO: 1122502 - RNA, 23 nt, Human
agaaauuggagaccagccugggc

SEQ ID NO: 1122503 - RNA, 18 nt, Human
agaagccacgucaugagc

SEQ ID NO: 1122504 - RNA, 20 nt, Human
agaagcuaucagggccaugu

SEQ ID NO: 1122505 - RNA, 19 nt, Human
agacuuguuuuuguuuguu

SEQ ID NO: 1122506 - RNA, 18 nt, Human
agagagagguuuagccau

SEQ ID NO: 1122507 - RNA, 18 nt, Human
agccuccugaguagcugg

SEQ ID NO: 1122508 - RNA, 24 nt, Human
agccugggcaacaaaaugagaucc

SEQ ID NO: 1122509 - RNA, 21 nt, Human
aggaagcuguccaggggcugu

SEQ ID NO: 1122510 - RNA, 20 nt, Human
aggccgaggugagaggaucg

SEQ ID NO: 1122511 - RNA, 24 nt, Human
aggccgaggugagaggaucguuug

SEQ ID NO: 1122512 - RNA, 24 nt, Human
aggugauccacccgccuuggccuc

SEQ ID NO: 1122513 - RNA, 18 nt, Human
aguagcugggauuacagg

SEQ ID NO: 1122514 - RNA, 24 nt, Human
agugauucgugcuaguaaucccag

SEQ ID NO: 1122515 - RNA, 20 nt, Human
agugggaagcugggacucug

SEQ ID NO: 1122516 - RNA, 20 nt, Human
agugggaagcugggacucug

SEQ ID NO: 1122517 - RNA, 24 nt, Human
caaagugcugggauuacagacgug

SEQ ID NO: 1122518 - RNA, 20 nt, Human
caagugauucucccgccuua

SEQ ID NO: 1122519 - RNA, 22 nt, Human
caagugauucucccgccuuagc

SEQ ID NO: 1122520 - RNA, 26 nt, Human
caaucugcgccaccucgguagcccca

SEQ ID NO: 1122521 - RNA, 23 nt, Human
cacagcccagaccggcguccucc

SEQ ID NO: 1122522 - RNA, 20 nt, Human
cacaggaccuccgcacagcc

SEQ ID NO: 1122523 - RNA, 23 nt, Human
caccaagcacuuuaacaucccuc

SEQ ID NO: 1122524 - RNA, 25 nt, Human
caccagagacgcggguuucaccaug

SEQ ID NO: 1122525 - RNA, 21 nt, Human
caccauguuagccaggcuggu

SEQ ID NO: 1122526 - RNA, 24 nt, Human
caccauguuagccaggcuggucuc

SEQ ID NO: 1122527 - RNA, 27 nt, Human
caccauguuagccaggcuggucucgaa

SEQ ID NO: 1122528 - RNA, 23 nt, Human
cacccgccuuggccucccaaagu

SEQ ID NO: 1122529 - RNA, 24 nt, Human
cacccgccuuggccucccaaagug

SEQ ID NO: 1122530 - RNA, 21 nt, Human
cacugcaaccucugccucccg

SEQ ID NO: 1122531 - RNA, 23 nt, Human
cacugcaaccucugccucccggg

SEQ ID NO: 1122532 - RNA, 20 nt, Human
cacuuaagaagaccugguca

SEQ ID NO: 1122533 - RNA, 19 nt, Human
cagagcagaaagaaaggag

SEQ ID NO: 1122534 - RNA, 18 nt, Human
cagcacuuuuggaggccg

SEQ ID NO: 1122535 - RNA, 20 nt, Human
cagcacuuuuggaggccgag

SEQ ID NO: 1122536 - RNA, 19 nt, Human
cagccucgggcaagcugcg

SEQ ID NO: 1122537 - RNA, 20 nt, Human
cagccuuucccugagccagu

SEQ ID NO: 1122538 - RNA, 24 nt, Human
cagcgcccagaggugugacggagg

SEQ ID NO: 1122539 - RNA, 18 nt, Human
cagcggacgcgaaaggag

SEQ ID NO: 1122540 - RNA, 24 nt, Human
cagggccauguuuagcacacugaa

SEQ ID NO: 1122541 - RNA, 21 nt, Human
caggugcccaccaccagagac

SEQ ID NO: 1122542 - RNA, 23 nt, Human
cagucuuagccgcagccucgggc

SEQ ID NO: 1122543 - RNA, 21 nt, Human
cauguuagccaggcuggucuc

SEQ ID NO: 1122544 - RNA, 24 nt, Human
cauguuagccaggcuggucucgaa

SEQ ID NO: 1122545 - RNA, 18 nt, Human
cauuuugcaugaacuucu

SEQ ID NO: 1122546 - RNA, 22 nt, Human
ccaaagugcugggauuacagac

SEQ ID NO: 1122547 - RNA, 24 nt, Human
ccaaagugcugggauuacagacgu

SEQ ID NO: 1122548 - RNA, 18 nt, Human
ccagaggugugacggagg

SEQ ID NO: 1122549 - RNA, 18 nt, Human
ccagaggugugacggagg

SEQ ID NO: 1122550 - RNA, 22 nt, Human
ccagcacugguuuuauguugag

SEQ ID NO: 1122551 - RNA, 23 nt, Human
ccaggccucguguuccccaccuc

SEQ ID NO: 1122552 - RNA, 18 nt, Human
cccaaaagacuugcuccc

SEQ ID NO: 1122553 - RNA, 23 nt, Human
cccaccagagcagaaagaaagga

SEQ ID NO: 1122554 - RNA, 22 nt, Human
cccagccucacauuucccuggc

SEQ ID NO: 1122555 - RNA, 20 nt, Human
cccaggcuggagugcaauga

SEQ ID NO: 1122556 - RNA, 19 nt, Human
ccccagccucacauuuccc

SEQ ID NO: 1122557 - RNA, 23 nt, Human
cccgccuuagccuccugaguagc

SEQ ID NO: 1122558 - RNA, 19 nt, Human
cccggcccaaaagacuugc

SEQ ID NO: 1122559 - RNA, 22 nt, Human
cccggguucaagugauucuccc

SEQ ID NO: 1122560 - RNA, 23 nt, Human
ccgccuuagccuccugaguagcu

SEQ ID NO: 1122561 - RNA, 21 nt, Human
ccgcgcccggcccaaaagacu

SEQ ID NO: 1122562 - RNA, 24 nt, Human
ccucccggguucaagugauucucc

SEQ ID NO: 1122563 - RNA, 24 nt, Human
ccucccuucccuucaccuuguuaa

SEQ ID NO: 1122564 - RNA, 19 nt, Human
ccuccuccuccucccuucc

SEQ ID NO: 1122565 - RNA, 23 nt, Human
ccucgguagccccacuuuccuug

SEQ ID NO: 1122566 - RNA, 22 nt, Human
ccucuccccgucugggaguggg

SEQ ID NO: 1122567 - RNA, 22 nt, Human
ccugaguagcugggauuacagg

SEQ ID NO: 1122568 - RNA, 22 nt, Human
ccugaguagcugggauuacagg

SEQ ID NO: 1122569 - RNA, 23 nt, Human
ccugaguagcugggauuacaggu

SEQ ID NO: 1122570 - RNA, 24 nt, Human
ccugaguagcugggauuacaggug

SEQ ID NO: 1122571 - RNA, 22 nt, Human
ccugaugucaggugauccaccc

SEQ ID NO: 1122572 - RNA, 19 nt, Human
ccuggcccgugccugaggc

SEQ ID NO: 1122573 - RNA, 25 nt, Human
ccuggcccgugccugaggccuggga

SEQ ID NO: 1122574 - RNA, 24 nt, Human
ccugggcaacaaaaugagauccca

SEQ ID NO: 1122575 - RNA, 25 nt, Human
cgagaaggcagcggacgcgaaagga

SEQ ID NO: 1122576 - RNA, 21 nt, Human
cgagguggagucaagccuggg

SEQ ID NO: 1122577 - RNA, 20 nt, Human
cgcaagcggccgcgcguggc

SEQ ID NO: 1122578 - RNA, 22 nt, Human
cgcccagaggugugacggaggu

SEQ ID NO: 1122579 - RNA, 24 nt, Human
cgccuuagccuccugaguagcugg

SEQ ID NO: 1122580 - RNA, 20 nt, Human
cgcgaaaggagcccagccag

SEQ ID NO: 1122581 - RNA, 20 nt, Human
cgcggguuucaccauguuag

SEQ ID NO: 1122582 - RNA, 22 nt, Human
cggguuucaccauguuagccag

SEQ ID NO: 1122583 - RNA, 21 nt, Human
cuaggauuacagcccagagau

SEQ ID NO: 1122584 - RNA, 20 nt, Human
cuaggucccuggcccgugcc

SEQ ID NO: 1122585 - RNA, 24 nt, Human
cucacugcaaccucugccucccgg

SEQ ID NO: 1122586 - RNA, 22 nt, Human
cuccagucaaucucaggaugcc

SEQ ID NO: 1122587 - RNA, 20 nt, Human
cucccggguucaagugauuc

SEQ ID NO: 1122588 - RNA, 22 nt, Human
cuccgcacagcccagaccggcg

SEQ ID NO: 1122589 - RNA, 18 nt, Human
cucuccucugugagggau

SEQ ID NO: 1122590 - RNA, 20 nt, Human
cucuuguugcccaggcugga

SEQ ID NO: 1122591 - RNA, 21 nt, Human
cucuuguugcccaggcuggag

SEQ ID NO: 1122592 - RNA, 21 nt, Human
cugaguagcugggauuacagg

SEQ ID NO: 1122593 - RNA, 19 nt, Human
cugcaaccucugccucccg

SEQ ID NO: 1122594 - RNA, 23 nt, Human
cugcaaccucugccucccggguu

SEQ ID NO: 1122595 - RNA, 24 nt, Human
cugcaaccucugccucccggguuc

SEQ ID NO: 1122596 - RNA, 19 nt, Human
cugcacuggcaaccugggc

SEQ ID NO: 1122597 - RNA, 23 nt, Human
cugcccucuccccgucugggagu

SEQ ID NO: 1122598 - RNA, 23 nt, Human
cugccucccggguucaagugauu

SEQ ID NO: 1122599 - RNA, 23 nt, Human
cuggaaggaacugggcaguccca

SEQ ID NO: 1122600 - RNA, 18 nt, Human
cugugcggauucgagaag

SEQ ID NO: 1122601 - RNA, 23 nt, Human
cuuagccgcagccucgggcaagc

SEQ ID NO: 1122602 - RNA, 23 nt, Human
cuuagccuccugaguagcuggga

SEQ ID NO: 1122603 - RNA, 24 nt, Human
cuuguugcccaggcuggagugcaa

SEQ ID NO: 1122604 - RNA, 21 nt, Human
cuuuucuuuccuucgaaaggu

SEQ ID NO: 1122605 - RNA, 21 nt, Human
gaaaggugagguuuuugucgu

SEQ ID NO: 1122606 - RNA, 18 nt, Human
gaacuugcacugagccag

SEQ ID NO: 1122607 - RNA, 18 nt, Human
gaagcuguccaggggcug

SEQ ID NO: 1122608 - RNA, 18 nt, Human
gaccuggucauuggucca

SEQ ID NO: 1122609 - RNA, 22 nt, Human
gagccugggggcugcccucucc

SEQ ID NO: 1122610 - RNA, 21 nt, Human
gagcuauccugucacaaaaga

SEQ ID NO: 1122611 - RNA, 19 nt, Human
gaggggcuuggccugggac

SEQ ID NO: 1122612 - RNA, 21 nt, Human
gagguccuguccucaagggcu

SEQ ID NO: 1122613 - RNA, 22 nt, Human
gagugagaagccagccucccag

SEQ ID NO: 1122614 - RNA, 24 nt, Human
gaugucaggugauccacccgccuu

SEQ ID NO: 1122615 - RNA, 18 nt, Human
gauguuccauaggcuggg

SEQ ID NO: 1122616 - RNA, 18 nt, Human
gauuacagacgugagcca

SEQ ID NO: 1122617 - RNA, 22 nt, Human
gauuacagacgugagccaccgc

SEQ ID NO: 1122618 - RNA, 24 nt, Human
gcaaggaagagcccagcgcccaga

SEQ ID NO: 1122619 - RNA, 25 nt, Human
gcagaagccacgucaugagccuggg

SEQ ID NO: 1122620 - RNA, 18 nt, Human
gccaaggcucuccucugu

SEQ ID NO: 1122621 - RNA, 21 nt, Human
gccaucauauuucagcuccag

SEQ ID NO: 1122622 - RNA, 19 nt, Human
gcccagaggugugacggag

SEQ ID NO: 1122623 - RNA, 19 nt, Human
gcccaggcuggagugcaau

SEQ ID NO: 1122624 - RNA, 21 nt, Human
gccccgggccccagucuuagc

SEQ ID NO: 1122625 - RNA, 22 nt, Human
gccuuggccucccaaagugcug

SEQ ID NO: 1122626 - RNA, 23 nt, Human
gcggguuucaccauguuagccag

SEQ ID NO: 1122627 - RNA, 19 nt, Human
gcuaguaaucccagcacuu

SEQ ID NO: 1122628 - RNA, 21 nt, Human
gcucuuguugcccaggcugga

SEQ ID NO: 1122629 - RNA, 30 nt, Human
gcuggagugcaaugaugcaaucucagcucc

SEQ ID NO: 1122630 - RNA, 21 nt, Human
gcugggauuacagacgugagc

SEQ ID NO: 1122631 - RNA, 21 nt, Human
gcugggugcagugauucgugc

SEQ ID NO: 1122632 - RNA, 19 nt, Human
ggaccuccgcacagcccag

SEQ ID NO: 1122633 - RNA, 21 nt, Human
ggagccuggacaaaccacugg

SEQ ID NO: 1122634 - RNA, 18 nt, Human
ggcaagcugcguaacauc

SEQ ID NO: 1122635 - RNA, 21 nt, Human
ggcaagcugcguaacaucucu

SEQ ID NO: 1122636 - RNA, 21 nt, Human
ggcagccuuucccugagccag

SEQ ID NO: 1122637 - RNA, 22 nt, Human
ggccccagucuuagccgcagcc

SEQ ID NO: 1122638 - RNA, 19 nt, Human
ggccucguguuccccaccu

SEQ ID NO: 1122639 - RNA, 20 nt, Human
ggccucguguuccccaccuc

SEQ ID NO: 1122640 - RNA, 20 nt, Human
gggcuugcuuucugcuucug

SEQ ID NO: 1122641 - RNA, 23 nt, Human
ggguucaagugauucucccgccu

SEQ ID NO: 1122642 - RNA, 22 nt, Human
ggguuucaccauguuagccagg

SEQ ID NO: 1122643 - RNA, 22 nt, Human
guacuggagccuggacaaacca

SEQ ID NO: 1122644 - RNA, 18 nt, Human
guagcugggauuacaggu

SEQ ID NO: 1122645 - RNA, 24 nt, Human
gucaggugauccacccgccuuggc

SEQ ID NO: 1122646 - RNA, 24 nt, Human
gugauccacccgccuuggccuccc

SEQ ID NO: 1122647 - RNA, 21 nt, Human
guuacagagagggcaagguuu

SEQ ID NO: 1122648 - RNA, 23 nt, Human
uacagacgugagccaccgcgccc

SEQ ID NO: 1122649 - RNA, 20 nt, Human
uagauguuccauaggcuggg

SEQ ID NO: 1122650 - RNA, 24 nt, Human
uagccaggcuggucucgaacuccu

SEQ ID NO: 1122651 - RNA, 18 nt, Human
uagccccacuuuccuugc

SEQ ID NO: 1122652 - RNA, 28 nt, Human
uagccccgagguggagucaagccugggg

SEQ ID NO: 1122653 - RNA, 20 nt, Human
uagccuccugaguagcuggg

SEQ ID NO: 1122654 - RNA, 18 nt, Human
uaggucccuggcccgugc

SEQ ID NO: 1122655 - RNA, 19 nt, Human
ucaagugauucucccgccu

SEQ ID NO: 1122656 - RNA, 23 nt, Human
ucacugcaaccucugccucccgg

SEQ ID NO: 1122657 - RNA, 24 nt, Human
ucacugcaaccucugccucccggg

SEQ ID NO: 1122658 - RNA, 19 nt, Human
ucaguggauauaucuauag

SEQ ID NO: 1122659 - RNA, 18 nt, Human
ucccaaagugcugggauu

SEQ ID NO: 1122660 - RNA, 24 nt, Human
ucccaaagugcugggauuacagac

SEQ ID NO: 1122661 - RNA, 23 nt, Human
uccccaccuccaacccucccgug

SEQ ID NO: 1122662 - RNA, 21 nt, Human
ucccggguucaagugauucuc

SEQ ID NO: 1122663 - RNA, 24 nt, Human
ucccggguucaagugauucucccg

SEQ ID NO: 1122664 - RNA, 21 nt, Human
ucccugagccaguacggggac

SEQ ID NO: 1122665 - RNA, 21 nt, Human
ucccuggcccgugccugaggc

SEQ ID NO: 1122666 - RNA, 21 nt, Human
uccgcacagcccagaccggcg

SEQ ID NO: 1122667 - RNA, 25 nt, Human
uccgcacagcccagaccggcguccu

SEQ ID NO: 1122668 - RNA, 22 nt, Human
uccuccuccuccucccuucccc

SEQ ID NO: 1122669 - RNA, 24 nt, Human
uccucugugagggauggguuuuac

SEQ ID NO: 1122670 - RNA, 24 nt, Human
uccugaguagcugggauuacaggu

SEQ ID NO: 1122671 - RNA, 23 nt, Human
ucguguuccccaccuccaacccu

SEQ ID NO: 1122672 - RNA, 24 nt, Human
ucucccgccuuagccuccugagua

SEQ ID NO: 1122673 - RNA, 20 nt, Human
ucucgaacuccugaugucag

SEQ ID NO: 1122674 - RNA, 20 nt, Human
ucucuuauugaagcagaagc

SEQ ID NO: 1122675 - RNA, 21 nt, Human
ucugcacuggcaaccugggcu

SEQ ID NO: 1122676 - RNA, 18 nt, Human
ucuguacuggagccugga

SEQ ID NO: 1122677 - RNA, 22 nt, Human
ucuuguugcccaggcuggagug

SEQ ID NO: 1122678 - RNA, 20 nt, Human
ugaauuaccuguguggagaa

SEQ ID NO: 1122679 - RNA, 28 nt, Human
ugagaagccagccucccagaggcccagg

SEQ ID NO: 1122680 - RNA, 18 nt, Human
ugagccugggggcugccc

SEQ ID NO: 1122681 - RNA, 24 nt, Human
ugaugcaaucucagcucacugcaa

SEQ ID NO: 1122682 - RNA, 24 nt, Human
ugaugucaggugauccacccgccu

SEQ ID NO: 1122683 - RNA, 24 nt, Human
ugauucgugcuaguaaucccagca

SEQ ID NO: 1122684 - RNA, 20 nt, Human
ugauucucccgccuuagccu

SEQ ID NO: 1122685 - RNA, 19 nt, Human
ugccacaggaccuccgcac

SEQ ID NO: 1122686 - RNA, 18 nt, Human
ugcccaggcuggagugca

SEQ ID NO: 1122687 - RNA, 21 nt, Human
ugcccaggcuggagugcaaug

SEQ ID NO: 1122688 - RNA, 22 nt, Human
ugcccaggcuggagugcaauga

SEQ ID NO: 1122689 - RNA, 22 nt, Human
ugccugaggccugggaucucug

SEQ ID NO: 1122690 - RNA, 24 nt, Human
ugcucuuguugcccaggcuggagu

SEQ ID NO: 1122691 - RNA, 24 nt, Human
ugcugggauuacagacgugagcca

SEQ ID NO: 1122692 - RNA, 19 nt, Human
uggaaggaacugggcaguc

SEQ ID NO: 1122693 - RNA, 21 nt, Human
uggagccuggacaaaccacug

SEQ ID NO: 1122694 - RNA, 24 nt, Human
uggaggccgaggugagaggaucgu

SEQ ID NO: 1122695 - RNA, 23 nt, Human
uggagugcaaugaugcaaucuca

SEQ ID NO: 1122696 - RNA, 18 nt, Human
ugggauuacagacgugag

SEQ ID NO: 1122697 - RNA, 19 nt, Human
ugggauuacagacgugagc

SEQ ID NO: 1122698 - RNA, 21 nt, Human
ugggauuacagacgugagcca

SEQ ID NO: 1122699 - RNA, 22 nt, Human
ugggauuacagacgugagccac

SEQ ID NO: 1122700 - RNA, 23 nt, Human
ugggauuacagacgugagccacc

SEQ ID NO: 1122701 - RNA, 24 nt, Human
ugggauuacagacgugagccaccg

SEQ ID NO: 1122702 - RNA, 21 nt, Human
ugggauuacaggugcccacca

SEQ ID NO: 1122703 - RNA, 24 nt, Human
ugggauuacaggugcccaccacca

SEQ ID NO: 1122704 - RNA, 21 nt, Human
ugggcuugcuuucugcuucug

SEQ ID NO: 1122705 - RNA, 23 nt, Human
uggggagugagaagccagccucc

SEQ ID NO: 1122706 - RNA, 24 nt, Human
uggucucuaugggaggccccagcc

SEQ ID NO: 1122707 - RNA, 23 nt, Human
uggugaauuaccuguguggagaa

SEQ ID NO: 1122708 - RNA, 21 nt, Human
ugucacaaaagauagaaggaa

SEQ ID NO: 1122709 - RNA, 20 nt, Human
uguugcccaggcuggagugc

SEQ ID NO: 1122710 - RNA, 23 nt, Human
uucaagugauucucccgccuuag

SEQ ID NO: 1122711 - RNA, 24 nt, Human
uucaagugauucucccgccuuagc

SEQ ID NO: 1122712 - RNA, 18 nt, Human
uugcccaggcuggagugc

SEQ ID NO: 1122713 - RNA, 23 nt, Human
uugcucuuguugcccaggcugga

SEQ ID NO: 1122714 - RNA, 22 nt, Human
uugcuucagauugucugcuaca

SEQ ID NO: 1122715 - RNA, 18 nt, Human
uuggccucccaaagugcu

SEQ ID NO: 1122716 - RNA, 21 nt, Human
uuucaccauguuagccaggcu

SEQ ID NO: 1122717 - RNA, 24 nt, Human
uuugcucuuguugcccaggcugga

SEQ ID NO: 1122718 - RNA, 21 nt, Human
uuuuccuaggucccuggcccg

SEQ ID NO: 1122719 - RNA, 24 nt, Human
uuuugcucuuguugcccaggcugg

SEQ ID NO: 1122720 - RNA, 20 nt, Human
aaagacuuccauccugccca

SEQ ID NO: 1122721 - RNA, 21 nt, Human
aaagguugcagaggggggaug

SEQ ID NO: 1122722 - RNA, 24 nt, Human
aagacuuccauccugcccaaaucc

SEQ ID NO: 1122723 - RNA, 27 nt, Human
accccaucuccucaccucauuugccaa

SEQ ID NO: 1122724 - RNA, 22 nt, Human
acccuccuuggcccagaggcug

SEQ ID NO: 1122725 - RNA, 22 nt, Human
acgugugugugugugugugugu

SEQ ID NO: 1122726 - RNA, 23 nt, Human
acguguguguguguguguguguu

SEQ ID NO: 1122727 - RNA, 21 nt, Human
acuuugaugguugacaaaggc

SEQ ID NO: 1122728 - RNA, 23 nt, Human
acuuugaugguugacaaaggcua

SEQ ID NO: 1122729 - RNA, 19 nt, Human
agacuuccauccugcccaa

SEQ ID NO: 1122730 - RNA, 18 nt, Human
agcaggauguucuaggcu

SEQ ID NO: 1122731 - RNA, 19 nt, Human
agcuuggaaggcugagcug

SEQ ID NO: 1122732 - RNA, 18 nt, Human
aggagugugacaagucca

SEQ ID NO: 1122733 - RNA, 21 nt, Human
aggauggaaggaagccacugu

SEQ ID NO: 1122734 - RNA, 19 nt, Human
aggccaggacuuccgaggg

SEQ ID NO: 1122735 - RNA, 19 nt, Human
agggacaggcacaggguug

SEQ ID NO: 1122736 - RNA, 18 nt, Human
auauauauauauauauaa

SEQ ID NO: 1122737 - RNA, 19 nt, Human
auauauauauauauauaua

SEQ ID NO: 1122738 - RNA, 25 nt, Human
auaugugcauaaauagauauacgug

SEQ ID NO: 1122739 - RNA, 23 nt, Human
auggcccagaggaucccaagccg

SEQ ID NO: 1122740 - RNA, 21 nt, Human
auuccaucuaucuaaccuuca

SEQ ID NO: 1122741 - RNA, 19 nt, Human
caaacgcuggccaggagcu

SEQ ID NO: 1122742 - RNA, 25 nt, Human
caagauacaaaugcagaacucacug

SEQ ID NO: 1122743 - RNA, 22 nt, Human
cacuuagcucuggacccccauc

SEQ ID NO: 1122744 - RNA, 19 nt, Human
cagcccccagagagaaagg

SEQ ID NO: 1122745 - RNA, 18 nt, Human
cagcccugcccaagaaca

SEQ ID NO: 1122746 - RNA, 22 nt, Human
cagccucuugguuauugaucau

SEQ ID NO: 1122747 - RNA, 24 nt, Human
caggagcucugcucuagauuccca

SEQ ID NO: 1122748 - RNA, 20 nt, Human
caggccagagagggaucaag

SEQ ID NO: 1122749 - RNA, 25 nt, Human
caguagcaguauuugacugcagccu

SEQ ID NO: 1122750 - RNA, 20 nt, Human
caucugggcucuguucauuc

SEQ ID NO: 1122751 - RNA, 21 nt, Human
ccagagacccuuuccccacuu

SEQ ID NO: 1122752 - RNA, 21 nt, Human
ccagagagaaagguugcagag

SEQ ID NO: 1122753 - RNA, 18 nt, Human
cccaagaacaugccucuc

SEQ ID NO: 1122754 - RNA, 18 nt, Human
cccaggugggaggccagg

SEQ ID NO: 1122755 - RNA, 19 nt, Human
ccccaucugggcucuguuc

SEQ ID NO: 1122756 - RNA, 25 nt, Human
cccuuagaaaaucuucaaagugaca

SEQ ID NO: 1122757 - RNA, 20 nt, Human
cccuuucgugacuggggaau

SEQ ID NO: 1122758 - RNA, 25 nt, Human
ccgccuccucugggcuucgcaccgu

SEQ ID NO: 1122759 - RNA, 19 nt, Human
ccucugggcuucgcaccgu

SEQ ID NO: 1122760 - RNA, 22 nt, Human
ccucugggcuucgcaccgucuc

SEQ ID NO: 1122761 - RNA, 21 nt, Human
ccucuugccguagccagcccu

SEQ ID NO: 1122762 - RNA, 18 nt, Human
cuaagcagcuuggaaggc

SEQ ID NO: 1122763 - RNA, 20 nt, Human
cugaaagggggaagcaaacc

SEQ ID NO: 1122764 - RNA, 18 nt, Human
cugcccccggcaagaugc

SEQ ID NO: 1122765 - RNA, 18 nt, Human
cugcccccggcaagaugc

SEQ ID NO: 1122766 - RNA, 20 nt, Human
cugcccccggcaagaugcuu

SEQ ID NO: 1122767 - RNA, 22 nt, Human
cuggggagggggcucauuggcu

SEQ ID NO: 1122768 - RNA, 20 nt, Human
cuuucugggugagcucuggg

SEQ ID NO: 1122769 - RNA, 26 nt, Human
gacaguagcaguauuugacugcagcc

SEQ ID NO: 1122770 - RNA, 21 nt, Human
gagcuggcuuaguucggugcc

SEQ ID NO: 1122771 - RNA, 20 nt, Human
gcaguuaccccaucuccuca

SEQ ID NO: 1122772 - RNA, 22 nt, Human
gccccaggugggaggccaggcu

SEQ ID NO: 1122773 - RNA, 23 nt, Human
gcccccggcaagaugcuuucugg

SEQ ID NO: 1122774 - RNA, 22 nt, Human
gccuuugguacagcccccagag

SEQ ID NO: 1122775 - RNA, 18 nt, Human
gggaauaggauggaagga

SEQ ID NO: 1122776 - RNA, 20 nt, Human
ggggaauaggauggaaggaa

SEQ ID NO: 1122777 - RNA, 22 nt, Human
gguuucuugggugagguugaga

SEQ ID NO: 1122778 - RNA, 19 nt, Human
guauauauauauauauaua

SEQ ID NO: 1122779 - RNA, 21 nt, Human
gucuguaggacccuccuuggc

SEQ ID NO: 1122780 - RNA, 19 nt, Human
guggcagagggacaggcac

SEQ ID NO: 1122781 - RNA, 23 nt, Human
guguguauauauauauauaaaau

SEQ ID NO: 1122782 - RNA, 20 nt, Human
guguguauauauauauauau

SEQ ID NO: 1122783 - RNA, 21 nt, Human
uaaaaagaaugcugcugaaag

SEQ ID NO: 1122784 - RNA, 23 nt, Human
uaaaggcaguuaccccaucuccu

SEQ ID NO: 1122785 - RNA, 24 nt, Human
uaaaugccccaggugggaggccag

SEQ ID NO: 1122786 - RNA, 27 nt, Human
uaauacuagcaaaucaaauuggcccca

SEQ ID NO: 1122787 - RNA, 18 nt, Human
uaauguguguguauaucc

SEQ ID NO: 1122788 - RNA, 24 nt, Human
uacaguuuauugucuaauacuagc

SEQ ID NO: 1122789 - RNA, 23 nt, Human
uaccagacugagguaccaugccu

SEQ ID NO: 1122790 - RNA, 19 nt, Human
uaccccaucuccucaccuc

SEQ ID NO: 1122791 - RNA, 19 nt, Human
uaccccaucuccucaccuc

SEQ ID NO: 1122792 - RNA, 23 nt, Human
uacgugugugugugugugugugu

SEQ ID NO: 1122793 - RNA, 23 nt, Human
uacgugugugugugugugugugu

SEQ ID NO: 1122794 - RNA, 21 nt, Human
uagaaagaugcuaaggggaug

SEQ ID NO: 1122795 - RNA, 25 nt, Human
uagacaaagacuuccauccugccca

SEQ ID NO: 1122796 - RNA, 31 nt, Human
uagauauacgugugugugugugugugugugg

SEQ ID NO: 1122797 - RNA, 20 nt, Human
uagcaguauuugacugcagc

SEQ ID NO: 1122798 - RNA, 19 nt, Human
uauacgugugugugugugu

SEQ ID NO: 1122799 - RNA, 19 nt, Human
uauacgugugugugugugu

SEQ ID NO: 1122800 - RNA, 23 nt, Human
uauauauauaauguguguguaua

SEQ ID NO: 1122801 - RNA, 19 nt, Human
uauauauauauauauauau

SEQ ID NO: 1122802 - RNA, 21 nt, Human
uaugugcauaaauagauauac

SEQ ID NO: 1122803 - RNA, 31 nt, Human
uaugugcauaaauagauauacgugugugugg

SEQ ID NO: 1122804 - RNA, 24 nt, Human
ucagagcaggauguucuaggcugg

SEQ ID NO: 1122805 - RNA, 24 nt, Human
ucccaaaggccggagagcaagugu

SEQ ID NO: 1122806 - RNA, 23 nt, Human
uccccaggugggucacuuagcuc

SEQ ID NO: 1122807 - RNA, 20 nt, Human
ucccuccuccuggggagggg

SEQ ID NO: 1122808 - RNA, 23 nt, Human
uccgagggaaugcccugcccccg

SEQ ID NO: 1122809 - RNA, 22 nt, Human
uccuggggagggggcucauugg

SEQ ID NO: 1122810 - RNA, 20 nt, Human
uccuuaggccaggacuuccg

SEQ ID NO: 1122811 - RNA, 20 nt, Human
ucuaggcuggcgacagggug

SEQ ID NO: 1122812 - RNA, 23 nt, Human
ucuguaggacccuccuuggccca

SEQ ID NO: 1122813 - RNA, 21 nt, Human
ucugugcuacagggccaggga

SEQ ID NO: 1122814 - RNA, 23 nt, Human
ucuuaguuuuaagagcugccagg

SEQ ID NO: 1122815 - RNA, 20 nt, Human
ugaaaaggagugugacaagu

SEQ ID NO: 1122816 - RNA, 22 nt, Human
ugacaaguccaaggaacuugua

SEQ ID NO: 1122817 - RNA, 22 nt, Human
ugagaugccaccuugucuguag

SEQ ID NO: 1122818 - RNA, 18 nt, Human
ugagcucuggggaccagc

SEQ ID NO: 1122819 - RNA, 22 nt, Human
ugaugguugacaaaggcuaagc

SEQ ID NO: 1122820 - RNA, 20 nt, Human
ugcaagauacaaaugcagaa

SEQ ID NO: 1122821 - RNA, 21 nt, Human
uggaaggaagccacuguggca

SEQ ID NO: 1122822 - RNA, 19 nt, Human
uggaaggcugagcuggcuu

SEQ ID NO: 1122823 - RNA, 21 nt, Human
uggcagagggacaggcacagg

SEQ ID NO: 1122824 - RNA, 25 nt, Human
uggcuuaguucggugccccaguggg

SEQ ID NO: 1122825 - RNA, 22 nt, Human
ugggaggccaggcuucaaacgc

SEQ ID NO: 1122826 - RNA, 21 nt, Human
ugggguaaagucccggggguu

SEQ ID NO: 1122827 - RNA, 20 nt, Human
ugggucacuuagcucuggac

SEQ ID NO: 1122828 - RNA, 18 nt, Human
uguauauauauauauaua

SEQ ID NO: 1122829 - RNA, 22 nt, Human
uguauauauauauauauauaua

SEQ ID NO: 1122830 - RNA, 19 nt, Human
ugucuguaggacccuccuu

SEQ ID NO: 1122831 - RNA, 18 nt, Human
uguguauauauauauaua

SEQ ID NO: 1122832 - RNA, 20 nt, Human
uguguauauauauauauaua

SEQ ID NO: 1122833 - RNA, 22 nt, Human
uguguauauauauauauauaua

SEQ ID NO: 1122834 - RNA, 22 nt, Human
uguguguauauauauauauaua

SEQ ID NO: 1122835 - RNA, 18 nt, Human
uguguguguauauauaua

SEQ ID NO: 1122836 - RNA, 18 nt, Human
uguguguguauauauaua

SEQ ID NO: 1122837 - RNA, 23 nt, Human
uguguguguguauauauauauau

SEQ ID NO: 1122838 - RNA, 18 nt, Human
uguguguguguguauaua

SEQ ID NO: 1122839 - RNA, 23 nt, Human
uguguguguguguauauauauau

SEQ ID NO: 1122840 - RNA, 18 nt, Human
uguguguguguguguaua

SEQ ID NO: 1122841 - RNA, 20 nt, Human
uguguguguguguguauaua

SEQ ID NO: 1122842 - RNA, 18 nt, Human
ugugugugugugugugug

SEQ ID NO: 1122843 - RNA, 18 nt, Human
ugugugugugugugugug

SEQ ID NO: 1122844 - RNA, 22 nt, Human
uguguguguguguguguguaua

SEQ ID NO: 1122845 - RNA, 24 nt, Human
uguguguguguguguguguauaua

SEQ ID NO: 1122846 - RNA, 19 nt, Human
uucagaccuagacaaagac

SEQ ID NO: 1122847 - RNA, 19 nt, Human
uugcagaggggggauguca

SEQ ID NO: 1122848 - RNA, 21 nt, Human
uugcaugggucuccuuugugc

SEQ ID NO: 1122849 - RNA, 23 nt, Human
uuucacagucuggauaccagacu

SEQ ID NO: 1122850 - RNA, 20 nt, Human
uuucuugggugagguugaga

SEQ ID NO: 1122851 - RNA, 24 nt, Human
uuuguccccugacagagauuccau

SEQ ID NO: 1122852 - RNA, 24 nt, Human
aaagugcugggauuacaggcguga

SEQ ID NO: 1122853 - RNA, 26 nt, Human
aaccacugaguaagguaguagccacc

SEQ ID NO: 1122854 - RNA, 25 nt, Human
aagcaaagggcagaacaccccagga

SEQ ID NO: 1122855 - RNA, 19 nt, Human
aagcuugaagguuaagagc

SEQ ID NO: 1122856 - RNA, 19 nt, Human
aaguagcugggauuacagg

SEQ ID NO: 1122857 - RNA, 23 nt, Human
aaguagcugggauuacaggggcu

SEQ ID NO: 1122858 - RNA, 19 nt, Human
aagugcugggauuacaggc

SEQ ID NO: 1122859 - RNA, 19 nt, Human
aagugcugggauuacaggc

SEQ ID NO: 1122860 - RNA, 26 nt, Human
aagugcugggauuacaggcgugagcc

SEQ ID NO: 1122861 - RNA, 19 nt, Human
aauucacuucauuuucccu

SEQ ID NO: 1122862 - RNA, 20 nt, Human
aauucauggaaguccaucuu

SEQ ID NO: 1122863 - RNA, 23 nt, Human
acacaccauacugcuugugggga

SEQ ID NO: 1122864 - RNA, 18 nt, Human
acaggguuucaccauguu

SEQ ID NO: 1122865 - RNA, 19 nt, Human
acaggguuucaccauguug

SEQ ID NO: 1122866 - RNA, 24 nt, Human
acaggguuucaccauguugaccag

SEQ ID NO: 1122867 - RNA, 20 nt, Human
acucaucccugcaucccccg

SEQ ID NO: 1122868 - RNA, 24 nt, Human
acucuuguugcccaggcuggagug

SEQ ID NO: 1122869 - RNA, 23 nt, Human
agagaugggacccuggggaagga

SEQ ID NO: 1122870 - RNA, 24 nt, Human
agagccgacauaggaggcuuugcu

SEQ ID NO: 1122871 - RNA, 18 nt, Human
agcaaaauuuagcuccau

SEQ ID NO: 1122872 - RNA, 27 nt, Human
agccacugagugaaugaacuggaguuc

SEQ ID NO: 1122873 - RNA, 19 nt, Human
agccauuagaagguagggg

SEQ ID NO: 1122874 - RNA, 19 nt, Human
agccugggaugaggagcuu

SEQ ID NO: 1122875 - RNA, 21 nt, Human
aggacagcacuggauuugacu

SEQ ID NO: 1122876 - RNA, 18 nt, Human
aggcccagcaaccuguga

SEQ ID NO: 1122877 - RNA, 21 nt, Human
aggcuggcuucagcugagaga

SEQ ID NO: 1122878 - RNA, 23 nt, Human
aggcuuugcuuugcaaaugaaaa

SEQ ID NO: 1122879 - RNA, 18 nt, Human
agggaauuggagacucug

SEQ ID NO: 1122880 - RNA, 24 nt, Human
aggugauccacccaccuugguguc

SEQ ID NO: 1122881 - RNA, 20 nt, Human
aguaguucuugaccuuucug

SEQ ID NO: 1122882 - RNA, 21 nt, Human
agucgugugggaggccaagcc

SEQ ID NO: 1122883 - RNA, 19 nt, Human
agucuugaacuucugaccu

SEQ ID NO: 1122884 - RNA, 24 nt, Human
agugcaauggcucgaucuuggcuc

SEQ ID NO: 1122885 - RNA, 18 nt, Human
agugcugggauuacaggc

SEQ ID NO: 1122886 - RNA, 22 nt, Human
aucucaccccuagagaccugga

SEQ ID NO: 1122887 - RNA, 22 nt, Human
augcauccugggaccacccugu

SEQ ID NO: 1122888 - RNA, 21 nt, Human
auuacaggggcucaccaccau

SEQ ID NO: 1122889 - RNA, 21 nt, Human
caaagcugagacacaccauac

SEQ ID NO: 1122890 - RNA, 24 nt, Human
caaagugcugggauuacaggcgug

SEQ ID NO: 1122891 - RNA, 24 nt, Human
caaaugaaaacacugggaauucac

SEQ ID NO: 1122892 - RNA, 22 nt, Human
caaccuuggcugcauauguaag

SEQ ID NO: 1122893 - RNA, 22 nt, Human
caagugauucuccugccucagc

SEQ ID NO: 1122894 - RNA, 27 nt, Human
caagugauucuccugccucagccuccc

SEQ ID NO: 1122895 - RNA, 24 nt, Human
caccaugccuggcuaauuuuugua

SEQ ID NO: 1122896 - RNA, 21 nt, Human
caccauguugaccaggcuagu

SEQ ID NO: 1122897 - RNA, 22 nt, Human
caccauguugaccaggcuaguc

SEQ ID NO: 1122898 - RNA, 24 nt, Human
caccauguugaccaggcuagucuu

SEQ ID NO: 1122899 - RNA, 23 nt, Human
cacccaccuuggugucccaaagu

SEQ ID NO: 1122900 - RNA, 19 nt, Human
caccccugagaggaguaca

SEQ ID NO: 1122901 - RNA, 19 nt, Human
cacgugguccucagcaucc

SEQ ID NO: 1122902 - RNA, 24 nt, Human
cacucuuguugcccaggcuggagu

SEQ ID NO: 1122903 - RNA, 23 nt, Human
cacugcaaacucugccuccuggg

SEQ ID NO: 1122904 - RNA, 25 nt, Human
cagaacaccccaggauucacucuaa

SEQ ID NO: 1122905 - RNA, 22 nt, Human
cagagacaggguuucaccaugu

SEQ ID NO: 1122906 - RNA, 24 nt, Human
cagaguuuagagcuaacgaguggg

SEQ ID NO: 1122907 - RNA, 21 nt, Human
cagcccuucccugagucagga

SEQ ID NO: 1122908 - RNA, 23 nt, Human
cagcuggguugaugaugacugag

SEQ ID NO: 1122909 - RNA, 18 nt, Human
caggcuagucuugaacuu

SEQ ID NO: 1122910 - RNA, 24 nt, Human
caggguuucaccauguugaccagg

SEQ ID NO: 1122911 - RNA, 18 nt, Human
cagugcugagcaucuggu

SEQ ID NO: 1122912 - RNA, 20 nt, Human
caucuggagcucaguugcuc

SEQ ID NO: 1122913 - RNA, 25 nt, Human
cauguacacagaaaaauuugucagc

SEQ ID NO: 1122914 - RNA, 24 nt, Human
cauguugaccaggcuagucuugaa

SEQ ID NO: 1122915 - RNA, 19 nt, Human
ccaaagccaagguuaggcu

SEQ ID NO: 1122916 - RNA, 22 nt, Human
ccaaagugcugggauuacaggc

SEQ ID NO: 1122917 - RNA, 22 nt, Human
ccaaagugcugggauuacaggc

SEQ ID NO: 1122918 - RNA, 24 nt, Human
ccaaagugcugggauuacaggcgu

SEQ ID NO: 1122919 - RNA, 21 nt, Human
ccaagccccacuccagacuua

SEQ ID NO: 1122920 - RNA, 24 nt, Human
ccaaguagcugggauuacaggggc

SEQ ID NO: 1122921 - RNA, 25 nt, Human
ccacacacgcagcuccuauaauccc

SEQ ID NO: 1122922 - RNA, 19 nt, Human
ccacugaguaagguaguag

SEQ ID NO: 1122923 - RNA, 23 nt, Human
ccagcaaccugugauuuugccac

SEQ ID NO: 1122924 - RNA, 18 nt, Human
ccaucuggagcucaguug

SEQ ID NO: 1122925 - RNA, 25 nt, Human
cccaaguagcugggauuacaggggc

SEQ ID NO: 1122926 - RNA, 18 nt, Human
cccaggcuggagugcaau

SEQ ID NO: 1122927 - RNA, 22 nt, Human
cccuugguugacucuuucuccu

SEQ ID NO: 1122928 - RNA, 24 nt, Human
cccuuuaaugcaguaguucuugac

SEQ ID NO: 1122929 - RNA, 20 nt, Human
ccgagcaccucgugggugcc

SEQ ID NO: 1122930 - RNA, 21 nt, Human
ccguaaaggcagcuggguuga

SEQ ID NO: 1122931 - RNA, 21 nt, Human
ccuccuggguucaagugauuc

SEQ ID NO: 1122932 - RNA, 24 nt, Human
ccuccuggguucaagugauucucc

SEQ ID NO: 1122933 - RNA, 23 nt, Human
ccugccucagccucccaaguagc

SEQ ID NO: 1122934 - RNA, 24 nt, Human
ccugccucagccucccaaguagcu

SEQ ID NO: 1122935 - RNA, 21 nt, Human
ccuggggaaggaggaggagag

SEQ ID NO: 1122936 - RNA, 23 nt, Human
ccuggguucaagugauucuccuc

SEQ ID NO: 1122937 - RNA, 23 nt, Human
ccuggguucaagugauucuccug

SEQ ID NO: 1122938 - RNA, 20 nt, Human
cguaaaggcagcuggguuga

SEQ ID NO: 1122939 - RNA, 21 nt, Human
cguaagcgaugccaucucuuc

SEQ ID NO: 1122940 - RNA, 19 nt, Human
cuaaugcacagccaagguu

SEQ ID NO: 1122941 - RNA, 23 nt, Human
cucacugcaaacucugccuccug

SEQ ID NO: 1122942 - RNA, 24 nt, Human
cucacugcaaacucugccuccugg

SEQ ID NO: 1122943 - RNA, 24 nt, Human
cucagccucccaaguagcugggau

SEQ ID NO: 1122944 - RNA, 24 nt, Human
cucaggugauccacccaccuuggu

SEQ ID NO: 1122945 - RNA, 18 nt, Human
cucagugccacccccaug

SEQ ID NO: 1122946 - RNA, 21 nt, Human
cuccuggguucaagugauucu

SEQ ID NO: 1122947 - RNA, 18 nt, Human
cucuuguugcccaggcug

SEQ ID NO: 1122948 - RNA, 23 nt, Human
cugaccucaggugauccacccac

SEQ ID NO: 1122949 - RNA, 20 nt, Human
cugagucaggagaccugggu

SEQ ID NO: 1122950 - RNA, 18 nt, Human
cugcagugcugagcaucu

SEQ ID NO: 1122951 - RNA, 23 nt, Human
cugccuccuggguucaagugauu

SEQ ID NO: 1122952 - RNA, 21 nt, Human
cuggcuucagcugagagagcu

SEQ ID NO: 1122953 - RNA, 24 nt, Human
cuggggaagcaaagggcagggacc

SEQ ID NO: 1122954 - RNA, 19 nt, Human
cuggguugaugaugacuga

SEQ ID NO: 1122955 - RNA, 22 nt, Human
cuuaccauggaaggaauuugga

SEQ ID NO: 1122956 - RNA, 20 nt, Human
cuugaacuucugaccucagg

SEQ ID NO: 1122957 - RNA, 24 nt, Human
cuuguugcccaggcuggagugcaa

SEQ ID NO: 1122958 - RNA, 19 nt, Human
cuuuuguucuuuguuacca

SEQ ID NO: 1122959 - RNA, 19 nt, Human
gaaaacacugggaauucac

SEQ ID NO: 1122960 - RNA, 18 nt, Human
gaaggaggaggagaggga

SEQ ID NO: 1122961 - RNA, 19 nt, Human
gaaggaggaggagagggag

SEQ ID NO: 1122962 - RNA, 21 nt, Human
gaauucacuucauuuucccua

SEQ ID NO: 1122963 - RNA, 20 nt, Human
gacccuggggaaggaggagg

SEQ ID NO: 1122964 - RNA, 27 nt, Human
gacccuggggaaggaggaggagaggga

SEQ ID NO: 1122965 - RNA, 23 nt, Human
gaccucaggugauccacccaccu

SEQ ID NO: 1122966 - RNA, 22 nt, Human
gagacagaguuucacucuuguu

SEQ ID NO: 1122967 - RNA, 20 nt, Human
gagcuuuuuaaaagguggua

SEQ ID NO: 1122968 - RNA, 21 nt, Human
gaggagagggaggcuguuagg

SEQ ID NO: 1122969 - RNA, 22 nt, Human
gagggcccugagaaaaauggcc

SEQ ID NO: 1122970 - RNA, 21 nt, Human
gagguggggagguuugguuac

SEQ ID NO: 1122971 - RNA, 19 nt, Human
gaguacacaccauccacau

SEQ ID NO: 1122972 - RNA, 18 nt, Human
gauuacaggcgugagcca

SEQ ID NO: 1122973 - RNA, 21 nt, Human
gauuacaggcgugagccacca

SEQ ID NO: 1122974 - RNA, 24 nt, Human
gauuacaggcgugagccaccaugc

SEQ ID NO: 1122975 - RNA, 19 nt, Human
gauuacaggggcucaccac

SEQ ID NO: 1122976 - RNA, 21 nt, Human
gauucuccugccucagccucc

SEQ ID NO: 1122977 - RNA, 21 nt, Human
gccacccccaugcauccuggg

SEQ ID NO: 1122978 - RNA, 21 nt, Human
gcccuugguugacucuuucuc

SEQ ID NO: 1122979 - RNA, 21 nt, Human
gcucacugcaaacucugccuc

SEQ ID NO: 1122980 - RNA, 19 nt, Human
gcugcagucuagucgugug

SEQ ID NO: 1122981 - RNA, 23 nt, Human
gcugcagucuagucgugugggag

SEQ ID NO: 1122982 - RNA, 25 nt, Human
gcuggagugcaauggcucgaucuug

SEQ ID NO: 1122983 - RNA, 21 nt, Human
gcuucagcugagagagcuugg

SEQ ID NO: 1122984 - RNA, 19 nt, Human
ggacagcacuggauuugac

SEQ ID NO: 1122985 - RNA, 26 nt, Human
ggagcucaguugcucuugcccugggg

SEQ ID NO: 1122986 - RNA, 20 nt, Human
ggaggcuguuaggauggggg

SEQ ID NO: 1122987 - RNA, 20 nt, Human
ggaggcuguuaggauggggg

SEQ ID NO: 1122988 - RNA, 24 nt, Human
ggauuacaggcgugagccaccaug

SEQ ID NO: 1122989 - RNA, 24 nt, Human
ggcuagucuugaacuucugaccuc

SEQ ID NO: 1122990 - RNA, 24 nt, Human
ggcuucacucaggucuucccaugg

SEQ ID NO: 1122991 - RNA, 21 nt, Human
gggaagagaugauggggaggu

SEQ ID NO: 1122992 - RNA, 23 nt, Human
gggaagcaaagggcagaacaccc

SEQ ID NO: 1122993 - RNA, 18 nt, Human
gggaaggaggaggagagg

SEQ ID NO: 1122994 - RNA, 20 nt, Human
ggggguuacagggcaguggg

SEQ ID NO: 1122995 - RNA, 22 nt, Human
ggugagguggggagguuugguu

SEQ ID NO: 1122996 - RNA, 21 nt, Human
ggugggugggagguggggcug

SEQ ID NO: 1122997 - RNA, 20 nt, Human
guagcugggauuacaggggc

SEQ ID NO: 1122998 - RNA, 21 nt, Human
guagucucgaauccugcagcu

SEQ ID NO: 1122999 - RNA, 24 nt, Human
gugauccacccaccuugguguccc

SEQ ID NO: 1123000 - RNA, 24 nt, Human
gugauucuccugccucagccuccc

SEQ ID NO: 1123001 - RNA, 23 nt, Human
gugccacccccaugcauccuggg

SEQ ID NO: 1123002 - RNA, 22 nt, Human
guggggguuacagggcaguggg

SEQ ID NO: 1123003 - RNA, 27 nt, Human
guucuaguuccuccuccaucacucacu

SEQ ID NO: 1123004 - RNA, 20 nt, Human
uaaagcuccccaggugauuc

SEQ ID NO: 1123005 - RNA, 20 nt, Human
uaauguacguaucucacccc

SEQ ID NO: 1123006 - RNA, 24 nt, Human
uaauuuuuguauuuuuagcagaga

SEQ ID NO: 1123007 - RNA, 20 nt, Human
uacaaagcugagacacacca

SEQ ID NO: 1123008 - RNA, 18 nt, Human
uacaggcgugagccacca

SEQ ID NO: 1123009 - RNA, 24 nt, Human
uacaggggcucaccaccaugccug

SEQ ID NO: 1123010 - RNA, 18 nt, Human
uacuaugugccaggugcu

SEQ ID NO: 1123011 - RNA, 21 nt, Human
uagaagccaaagccaagguua

SEQ ID NO: 1123012 - RNA, 24 nt, Human
uagcagagacaggguuucaccaug

SEQ ID NO: 1123013 - RNA, 26 nt, Human
uagcagagacaggguuucaccauguu

SEQ ID NO: 1123014 - RNA, 19 nt, Human
uagcccaaggauguuauag

SEQ ID NO: 1123015 - RNA, 21 nt, Human
uaggauggggguggcugggua

SEQ ID NO: 1123016 - RNA, 24 nt, Human
uagucuugaacuucugaccucagg

SEQ ID NO: 1123017 - RNA, 19 nt, Human
ucaagugauucuccugccu

SEQ ID NO: 1123018 - RNA, 22 nt, Human
ucacucuuguugcccaggcugg

SEQ ID NO: 1123019 - RNA, 23 nt, Human
ucacucuuguugcccaggcugga

SEQ ID NO: 1123020 - RNA, 18 nt, Human
ucacugcaaacucugccu

SEQ ID NO: 1123021 - RNA, 24 nt, Human
ucacugcaaacucugccuccuggg

SEQ ID NO: 1123022 - RNA, 20 nt, Human
ucagccucccaaguagcugg

SEQ ID NO: 1123023 - RNA, 23 nt, Human
uccaucacucacuguaaaaugaa

SEQ ID NO: 1123024 - RNA, 24 nt, Human
ucccaaagugcugggauuacaggc

SEQ ID NO: 1123025 - RNA, 23 nt, Human
ucccaaguagcugggauuacagg

SEQ ID NO: 1123026 - RNA, 18 nt, Human
ucccugagucaggagacc

SEQ ID NO: 1123027 - RNA, 23 nt, Human
ucccugagucaggagaccugggu

SEQ ID NO: 1123028 - RNA, 23 nt, Human
ucccugcaucccccgagcaccuc

SEQ ID NO: 1123029 - RNA, 20 nt, Human
ucccuggaccagcaaucacu

SEQ ID NO: 1123030 - RNA, 24 nt, Human
ucccuggaccagcaaucacuuggg

SEQ ID NO: 1123031 - RNA, 18 nt, Human
ucccuuggcaacucccag

SEQ ID NO: 1123032 - RNA, 22 nt, Human
uccucuguaguuagccccugau

SEQ ID NO: 1123033 - RNA, 21 nt, Human
uccuggguucaagugauucuc

SEQ ID NO: 1123034 - RNA, 24 nt, Human
uccuggguucaagugauucuccug

SEQ ID NO: 1123035 - RNA, 20 nt, Human
uccuugaggcuggcuucagc

SEQ ID NO: 1123036 - RNA, 18 nt, Human
ucuaaagugcccucucuc

SEQ ID NO: 1123037 - RNA, 20 nt, Human
ucuaaagugcccucucucca

SEQ ID NO: 1123038 - RNA, 19 nt, Human
ucuccagaaauguuacauc

SEQ ID NO: 1123039 - RNA, 26 nt, Human
ucuccuccucuucacuugguagcaaa

SEQ ID NO: 1123040 - RNA, 26 nt, Human
ucuccugccucagccucccaaguagc

SEQ ID NO: 1123041 - RNA, 18 nt, Human
ucuguacuuugacgggau

SEQ ID NO: 1123042 - RNA, 23 nt, Human
ucuguggugggugggaggugggg

SEQ ID NO: 1123043 - RNA, 22 nt, Human
ucuuguugcccaggcuggagug

SEQ ID NO: 1123044 - RNA, 21 nt, Human
ucuuugacccacugacucuag

SEQ ID NO: 1123045 - RNA, 24 nt, Human
ugaccaggcuagucuugaacuucu

SEQ ID NO: 1123046 - RNA, 20 nt, Human
ugacccacugacucuagugg

SEQ ID NO: 1123047 - RNA, 21 nt, Human
ugaccucaggugauccaccca

SEQ ID NO: 1123048 - RNA, 24 nt, Human
ugaccucaggugauccacccaccu

SEQ ID NO: 1123049 - RNA, 19 nt, Human
ugacucuaguggagggccc

SEQ ID NO: 1123050 - RNA, 24 nt, Human
ugagagaugggacccuggggaagg

SEQ ID NO: 1123051 - RNA, 26 nt, Human
ugagaugaggcccagcaaccugugau

SEQ ID NO: 1123052 - RNA, 26 nt, Human
ugagcaucugguuuuuuuaaagcucc

SEQ ID NO: 1123053 - RNA, 20 nt, Human
ugagccacugagugaaugaa

SEQ ID NO: 1123054 - RNA, 21 nt, Human
ugaggcuggcuucagcugaga

SEQ ID NO: 1123055 - RNA, 18 nt, Human
ugagucaggagaccuggg

SEQ ID NO: 1123056 - RNA, 20 nt, Human
ugagucaggagaccuggguu

SEQ ID NO: 1123057 - RNA, 21 nt, Human
ugaugcugggaagagaugaug

SEQ ID NO: 1123058 - RNA, 21 nt, Human
ugauggggagguuguaaagac

SEQ ID NO: 1123059 - RNA, 20 nt, Human
ugauucuccugccucagccu

SEQ ID NO: 1123060 - RNA, 24 nt, Human
ugccaggugcuuugcauguuuucu

SEQ ID NO: 1123061 - RNA, 18 nt, Human
ugccaucucuucuuuauc

SEQ ID NO: 1123062 - RNA, 21 nt, Human
ugcccaggcuggagugcaaug

SEQ ID NO: 1123063 - RNA, 25 nt, Human
ugcccaggcuggagugcaauggcuc

SEQ ID NO: 1123064 - RNA, 18 nt, Human
ugcccucucuccagaaau

SEQ ID NO: 1123065 - RNA, 24 nt, Human
ugcccuggggaagcaaagggcaga

SEQ ID NO: 1123066 - RNA, 24 nt, Human
ugccucagccucccaaguagcugg

SEQ ID NO: 1123067 - RNA, 19 nt, Human
ugcugggaagagaugaugg

SEQ ID NO: 1123068 - RNA, 24 nt, Human
ugcugggauuacaggcgugagcca

SEQ ID NO: 1123069 - RNA, 23 nt, Human
ugcuuguggggaggucacuaggg

SEQ ID NO: 1123070 - RNA, 18 nt, Human
uggaggacccuucggaau

SEQ ID NO: 1123071 - RNA, 19 nt, Human
uggagugcaauggcucgau

SEQ ID NO: 1123072 - RNA, 23 nt, Human
uggagugcaauggcucgaucuug

SEQ ID NO: 1123073 - RNA, 24 nt, Human
uggagugcaauggcucgaucuugg

SEQ ID NO: 1123074 - RNA, 23 nt, Human
ugggagccagagugagagauggg

SEQ ID NO: 1123075 - RNA, 18 nt, Human
ugggagguggggcuggag

SEQ ID NO: 1123076 - RNA, 18 nt, Human
ugggaugaggagcuucca

SEQ ID NO: 1123077 - RNA, 18 nt, Human
ugggauuacaggcgugag

SEQ ID NO: 1123078 - RNA, 22 nt, Human
ugggauuacaggcgugagccac

SEQ ID NO: 1123079 - RNA, 23 nt, Human
ugggauuacaggcgugagccacc

SEQ ID NO: 1123080 - RNA, 24 nt, Human
ugggauuacaggcgugagccacca

SEQ ID NO: 1123081 - RNA, 25 nt, Human
ugggauuacaggcgugagccaccau

SEQ ID NO: 1123082 - RNA, 18 nt, Human
ugggauuacaggggcuca

SEQ ID NO: 1123083 - RNA, 19 nt, Human
ugggauuacaggggcucac

SEQ ID NO: 1123084 - RNA, 21 nt, Human
ugggauuacaggggcucacca

SEQ ID NO: 1123085 - RNA, 24 nt, Human
ugggauuacaggggcucaccacca

SEQ ID NO: 1123086 - RNA, 25 nt, Human
ugggauuacaggggcucaccaccau

SEQ ID NO: 1123087 - RNA, 18 nt, Human
uggggaagcaaagggcag

SEQ ID NO: 1123088 - RNA, 19 nt, Human
uggggaggucacuaggguc

SEQ ID NO: 1123089 - RNA, 21 nt, Human
uggggguuacagggcaguggg

SEQ ID NO: 1123090 - RNA, 20 nt, Human
ugggugggagguggggcugg

SEQ ID NO: 1123091 - RNA, 23 nt, Human
uggguucaagugauucuccugcc

SEQ ID NO: 1123092 - RNA, 24 nt, Human
uggguucaagugauucuccugccu

SEQ ID NO: 1123093 - RNA, 19 nt, Human
ugguagcaaaauuuagcuc

SEQ ID NO: 1123094 - RNA, 22 nt, Human
uggugggugggagguggggcuc

SEQ ID NO: 1123095 - RNA, 22 nt, Human
uguaugauucccgcacccuuua

SEQ ID NO: 1123096 - RNA, 23 nt, Human
ugugaagugaugugcuuucuguc

SEQ ID NO: 1123097 - RNA, 22 nt, Human
ugugauuuugccaccccuccag

SEQ ID NO: 1123098 - RNA, 21 nt, Human
uguuacaucuacauguacaca

SEQ ID NO: 1123099 - RNA, 23 nt, Human
uguuacaucuacauguacacaga

SEQ ID NO: 1123100 - RNA, 20 nt, Human
uguugcccaggcuggagugc

SEQ ID NO: 1123101 - RNA, 22 nt, Human
uguuuucucauuuaaucuucac

SEQ ID NO: 1123102 - RNA, 24 nt, Human
uuagcagagacaggguuucaccau

SEQ ID NO: 1123103 - RNA, 21 nt, Human
uucaagugauucuccugccuc

SEQ ID NO: 1123104 - RNA, 23 nt, Human
uucaagugauucuccugccucag

SEQ ID NO: 1123105 - RNA, 24 nt, Human
uucaagugauucuccugccucagc

SEQ ID NO: 1123106 - RNA, 24 nt, Human
uucacucuuguugcccaggcugga

SEQ ID NO: 1123107 - RNA, 20 nt, Human
uucuguggugggugggaggu

SEQ ID NO: 1123108 - RNA, 19 nt, Human
uugaguguuacacaccccu

SEQ ID NO: 1123109 - RNA, 18 nt, Human
uugcccaggcuggagugc

SEQ ID NO: 1123110 - RNA, 23 nt, Human
uugcuccugccugccacacacgc

SEQ ID NO: 1123111 - RNA, 24 nt, Human
uuucaccauguugaccaggcuagu

SEQ ID NO: 1123112 - RNA, 24 nt, Human
uuucacucuuguugcccaggcugg

SEQ ID NO: 1123113 - RNA, 20 nt, Human
uuugacccacugacucuagu

SEQ ID NO: 1123114 - RNA, 22 nt, Human
uuuuguauuuuuagcagagaca

SEQ ID NO: 1123115 - RNA, 22 nt, Human
uuuuuaaagcuccccaggugau

SEQ ID NO: 1123116 - RNA, 24 nt, Human
uuuuuagcagagacaggguuucac

SEQ ID NO: 1123117 - RNA, 20 nt, Human
uuuuuguauuuuuagcagag

SEQ ID NO: 1123118 - RNA, 21 nt, Human
aaaacugguuuccccccacag

SEQ ID NO: 1123119 - RNA, 27 nt, Human
aaacugguuuccccccacaguucuucu

SEQ ID NO: 1123120 - RNA, 24 nt, Human
aagcaucuccucuggccuccaccc

SEQ ID NO: 1123121 - RNA, 21 nt, Human
aagcccuggguaucccagagc

SEQ ID NO: 1123122 - RNA, 18 nt, Human
aaggccagacuguugaga

SEQ ID NO: 1123123 - RNA, 18 nt, Human
aaggcuggaugaaccugg

SEQ ID NO: 1123124 - RNA, 22 nt, Human
acaaagcacuuccacuuaauua

SEQ ID NO: 1123125 - RNA, 20 nt, Human
acaagcacaaagcacuucca

SEQ ID NO: 1123126 - RNA, 21 nt, Human
acaagcacaaagcacuuccac

SEQ ID NO: 1123127 - RNA, 18 nt, Human
acccccaaguuccugggc

SEQ ID NO: 1123128 - RNA, 21 nt, Human
acccccuuacaggaucugcug

SEQ ID NO: 1123129 - RNA, 23 nt, Human
agaccagacaccagucucagaga

SEQ ID NO: 1123130 - RNA, 18 nt, Human
agcacaagcacaaagcac

SEQ ID NO: 1123131 - RNA, 20 nt, Human
agccccuagacccuagcacc

SEQ ID NO: 1123132 - RNA, 22 nt, Human
agcucugaaugccaagaccacc

SEQ ID NO: 1123133 - RNA, 19 nt, Human
aggaggaggaugccgcacc

SEQ ID NO: 1123134 - RNA, 18 nt, Human
aggcaagggcagggcggg

SEQ ID NO: 1123135 - RNA, 22 nt, Human
aggccaagcucccagagaagcu

SEQ ID NO: 1123136 - RNA, 21 nt, Human
aggcccaggcccugaaacggc

SEQ ID NO: 1123137 - RNA, 22 nt, Human
aggcuuggagaugagaagagcu

SEQ ID NO: 1123138 - RNA, 19 nt, Human
aggcuuuggauggaaagcu

SEQ ID NO: 1123139 - RNA, 19 nt, Human
agggcggggccgcuccagu

SEQ ID NO: 1123140 - RNA, 21 nt, Human
agugguggugggaaggggagg

SEQ ID NO: 1123141 - RNA, 22 nt, Human
agugugcuaggccgcaucugcu

SEQ ID NO: 1123142 - RNA, 22 nt, Human
auccugaagcaggaaaaagccc

SEQ ID NO: 1123143 - RNA, 18 nt, Human
augaaguggcuugcuccc

SEQ ID NO: 1123144 - RNA, 24 nt, Human
auggauccugaagcaggaaaaagc

SEQ ID NO: 1123145 - RNA, 22 nt, Human
auggcagugguggugggaaggg

SEQ ID NO: 1123146 - RNA, 22 nt, Human
caaagcacaaaccaugcuccug

SEQ ID NO: 1123147 - RNA, 22 nt, Human
caaccuggugggauccuuuugc

SEQ ID NO: 1123148 - RNA, 23 nt, Human
caaguuccugggcccuccccaca

SEQ ID NO: 1123149 - RNA, 24 nt, Human
caauaggccccuggugggagaccu

SEQ ID NO: 1123150 - RNA, 24 nt, Human
caccagguacuaugugcagcaucu

SEQ ID NO: 1123151 - RNA, 19 nt, Human
cacccuggcaaugguccug

SEQ ID NO: 1123152 - RNA, 18 nt, Human
cagaaaauuacuaaaaau

SEQ ID NO: 1123153 - RNA, 23 nt, Human
cagaaugcccacauuuuguguuc

SEQ ID NO: 1123154 - RNA, 23 nt, Human
cagaauuaggaucacccccuuac

SEQ ID NO: 1123155 - RNA, 20 nt, Human
cagcacaagcacaaagcacu

SEQ ID NO: 1123156 - RNA, 22 nt, Human
cagcacaagcacaaagcacuuc

SEQ ID NO: 1123157 - RNA, 18 nt, Human
cagcagggggacgggcag

SEQ ID NO: 1123158 - RNA, 20 nt, Human
cagcaucuaagaccagacac

SEQ ID NO: 1123159 - RNA, 19 nt, Human
cagccuccugccagguucu

SEQ ID NO: 1123160 - RNA, 22 nt, Human
caggaaaaagcccaccagcauc

SEQ ID NO: 1123161 - RNA, 23 nt, Human
caggaaaaagcccaccagcauca

SEQ ID NO: 1123162 - RNA, 24 nt, Human
caggaaaaagcccaccagcaucag

SEQ ID NO: 1123163 - RNA, 23 nt, Human
caggcccaggcccugaaacggca

SEQ ID NO: 1123164 - RNA, 24 nt, Human
caguucuucucacauuccaaucuu

SEQ ID NO: 1123165 - RNA, 25 nt, Human
cauaaaagaaaggcaggcaagggca

SEQ ID NO: 1123166 - RNA, 25 nt, Human
cauacacaacauucagauacacuuc

SEQ ID NO: 1123167 - RNA, 23 nt, Human
caugcuucauucuggcucucaca

SEQ ID NO: 1123168 - RNA, 18 nt, Human
cauggacugggcuaacug

SEQ ID NO: 1123169 - RNA, 20 nt, Human
ccaagaccacccccaaguuu

SEQ ID NO: 1123170 - RNA, 23 nt, Human
ccaagcucccagagaagcuggac

SEQ ID NO: 1123171 - RNA, 27 nt, Human
ccagagccgcccugggcuccaggaaag

SEQ ID NO: 1123172 - RNA, 21 nt, Human
ccaggcuacagucacaggaag

SEQ ID NO: 1123173 - RNA, 23 nt, Human
cccacaguucuucucacauucca

SEQ ID NO: 1123174 - RNA, 24 nt, Human
cccaccagcaucagcauaaaagaa

SEQ ID NO: 1123175 - RNA, 24 nt, Human
ccccacaguucuucucacauucca

SEQ ID NO: 1123176 - RNA, 21 nt, Human
ccccuagacccuagcaccagg

SEQ ID NO: 1123177 - RNA, 23 nt, Human
ccccugaaaagcuguucugaucc

SEQ ID NO: 1123178 - RNA, 18 nt, Human
cccuggcaaugguccugg

SEQ ID NO: 1123179 - RNA, 19 nt, Human
ccgcaucugcuggggccug

SEQ ID NO: 1123180 - RNA, 19 nt, Human
ccuccaccccaggggcaga

SEQ ID NO: 1123181 - RNA, 22 nt, Human
ccuccccacaaaaccaaaucag

SEQ ID NO: 1123182 - RNA, 22 nt, Human
ccuccugccagguucuggaagc

SEQ ID NO: 1123183 - RNA, 28 nt, Human
ccucucauggacugggcuaacugaaggc

SEQ ID NO: 1123184 - RNA, 23 nt, Human
ccugcugaggcuccuaguugugu

SEQ ID NO: 1123185 - RNA, 18 nt, Human
ccuggacaaccugguggg

SEQ ID NO: 1123186 - RNA, 21 nt, Human
cgggccagagccgcccugggc

SEQ ID NO: 1123187 - RNA, 23 nt, Human
cuaacugaaggccaagcucccag

SEQ ID NO: 1123188 - RNA, 23 nt, Human
cuacagucacaggaaggccagac

SEQ ID NO: 1123189 - RNA, 21 nt, Human
cucauggacugggcuaacuga

SEQ ID NO: 1123190 - RNA, 23 nt, Human
cuccccacaaaaccaaaucagag

SEQ ID NO: 1123191 - RNA, 22 nt, Human
cugaccagaugggagaaaccuu

SEQ ID NO: 1123192 - RNA, 19 nt, Human
cugcaccugcaauaccugu

SEQ ID NO: 1123193 - RNA, 18 nt, Human
cugcugggcuuugggcag

SEQ ID NO: 1123194 - RNA, 21 nt, Human
cuggacaaccuggugggaucc

SEQ ID NO: 1123195 - RNA, 23 nt, Human
cuggggccuggcucucccugucg

SEQ ID NO: 1123196 - RNA, 22 nt, Human
cuggucugggccaaggccucug

SEQ ID NO: 1123197 - RNA, 19 nt, Human
gaaaaagaacguucuccuc

SEQ ID NO: 1123198 - RNA, 19 nt, Human
gaaagcuggucugggccaa

SEQ ID NO: 1123199 - RNA, 18 nt, Human
gaggaugccgcaccgccg

SEQ ID NO: 1123200 - RNA, 20 nt, Human
gaggcuuuggauggaaagcu

SEQ ID NO: 1123201 - RNA, 22 nt, Human
gccaagaccacccccaaguucc

SEQ ID NO: 1123202 - RNA, 24 nt, Human
gccccagagugcaggggcuugcuu

SEQ ID NO: 1123203 - RNA, 24 nt, Human
gcucccaggauguguguuugggga

SEQ ID NO: 1123204 - RNA, 22 nt, Human
gcucuggguuuuuagcaccagc

SEQ ID NO: 1123205 - RNA, 18 nt, Human
ggaaagcuggucugggcc

SEQ ID NO: 1123206 - RNA, 22 nt, Human
ggaggcccaggcaacuucagaa

SEQ ID NO: 1123207 - RNA, 19 nt, Human
ggagguuauggugggguug

SEQ ID NO: 1123208 - RNA, 21 nt, Human
ggagguuauggugggguuggg

SEQ ID NO: 1123209 - RNA, 21 nt, Human
ggaguaacaaggagauaaaag

SEQ ID NO: 1123210 - RNA, 22 nt, Human
ggccagagccgcccugggcucc

SEQ ID NO: 1123211 - RNA, 22 nt, Human
ggccggacgugccauucccagc

SEQ ID NO: 1123212 - RNA, 23 nt, Human
gguaagcaucuccucuggccucc

SEQ ID NO: 1123213 - RNA, 21 nt, Human
gucagucccuuacauggaucc

SEQ ID NO: 1123214 - RNA, 21 nt, Human
gugcaggggcuugcuagguuu

SEQ ID NO: 1123215 - RNA, 22 nt, Human
gugcgggauuacugagggugug

SEQ ID NO: 1123216 - RNA, 20 nt, Human
guggugggaaggggagcaga

SEQ ID NO: 1123217 - RNA, 20 nt, Human
guuuuuagcaccagcucuga

SEQ ID NO: 1123218 - RNA, 18 nt, Human
uaaaagaccuuguggucc

SEQ ID NO: 1123219 - RNA, 23 nt, Human
uaagaaaggcugcaccugcaaua

SEQ ID NO: 1123220 - RNA, 20 nt, Human
uacaccagccuccugccagg

SEQ ID NO: 1123221 - RNA, 22 nt, Human
uaccccaaaccauucugggaac

SEQ ID NO: 1123222 - RNA, 18 nt, Human
uagaacaggggaggccac

SEQ ID NO: 1123223 - RNA, 21 nt, Human
uagacccuagcaccagguacu

SEQ ID NO: 1123224 - RNA, 19 nt, Human
uagcaauccugcugaggcu

SEQ ID NO: 1123225 - RNA, 19 nt, Human
uagcaccagcucugaaugc

SEQ ID NO: 1123226 - RNA, 19 nt, Human
uaucccagagcuuaugggu

SEQ ID NO: 1123227 - RNA, 22 nt, Human
uauuuuaggcugcaaggugggg

SEQ ID NO: 1123228 - RNA, 18 nt, Human
ucaguaucagacacaggu

SEQ ID NO: 1123229 - RNA, 21 nt, Human
ucccagagaagcuggacucac

SEQ ID NO: 1123230 - RNA, 18 nt, Human
uccccaguggucgcucuu

SEQ ID NO: 1123231 - RNA, 20 nt, Human
ucccugcuucugcucugggu

SEQ ID NO: 1123232 - RNA, 18 nt, Human
uccgaacuggagccaauc

SEQ ID NO: 1123233 - RNA, 22 nt, Human
uccuccucauuacccugcccuc

SEQ ID NO: 1123234 - RNA, 22 nt, Human
ucuaagaccagacaccagucuc

SEQ ID NO: 1123235 - RNA, 23 nt, Human
ucucccagggaaccggccaccuu

SEQ ID NO: 1123236 - RNA, 19 nt, Human
ucuguaaucuuccuccucc

SEQ ID NO: 1123237 - RNA, 21 nt, Human
ugagaagagcugggaagcaag

SEQ ID NO: 1123238 - RNA, 22 nt, Human
ugagaagagcugggaagcaagc

SEQ ID NO: 1123239 - RNA, 26 nt, Human
ugagaagagcugggaagcaagcccug

SEQ ID NO: 1123240 - RNA, 19 nt, Human
ugagauggacauggaaacc

SEQ ID NO: 1123241 - RNA, 21 nt, Human
ugagauggacauggaaaccaa

SEQ ID NO: 1123242 - RNA, 24 nt, Human
ugaguaggagguuauggugggguu

SEQ ID NO: 1123243 - RNA, 23 nt, Human
ugcagcagggggacgggcagguu

SEQ ID NO: 1123244 - RNA, 21 nt, Human
ugcaggaugaguaguagcugu

SEQ ID NO: 1123245 - RNA, 19 nt, Human
uggacauggaaaccaggug

SEQ ID NO: 1123246 - RNA, 21 nt, Human
uggacugggcuaacugaaggc

SEQ ID NO: 1123247 - RNA, 20 nt, Human
uggagaugagaagagcuggg

SEQ ID NO: 1123248 - RNA, 22 nt, Human
uggagcagggucccauggcacu

SEQ ID NO: 1123249 - RNA, 20 nt, Human
ugggaaggggagcagaggcu

SEQ ID NO: 1123250 - RNA, 21 nt, Human
ugggaaggggagcagaggcuu

SEQ ID NO: 1123251 - RNA, 20 nt, Human
ugggagaaaccuugggaacc

SEQ ID NO: 1123252 - RNA, 23 nt, Human
ugggagaaaccuugggaacccug

SEQ ID NO: 1123253 - RNA, 19 nt, Human
ugggcuauagaguggaggc

SEQ ID NO: 1123254 - RNA, 24 nt, Human
uggggccuggcucucccugucuuc

SEQ ID NO: 1123255 - RNA, 18 nt, Human
uggguuuuuagcaccagc

SEQ ID NO: 1123256 - RNA, 18 nt, Human
uggugggaaggggagcag

SEQ ID NO: 1123257 - RNA, 19 nt, Human
uggugggaaggggagcaga

SEQ ID NO: 1123258 - RNA, 25 nt, Human
ugguggugggaaggggagcagaggc

SEQ ID NO: 1123259 - RNA, 26 nt, Human
ugguggugggaaggggagcagaggcu

SEQ ID NO: 1123260 - RNA, 24 nt, Human
uguaugucuuccauaucagccaca

SEQ ID NO: 1123261 - RNA, 24 nt, Human
ugugcaauuuccuucuaccagaaa

SEQ ID NO: 1123262 - RNA, 23 nt, Human
uguucaagaaaaagaacguucuc

SEQ ID NO: 1123263 - RNA, 22 nt, Human
uguucgacaucugaccagaugg

SEQ ID NO: 1123264 - RNA, 21 nt, Human
uuaaaacugguuuccccccac

SEQ ID NO: 1123265 - RNA, 23 nt, Human
uucuaccagaaaauuacuaaaaa

SEQ ID NO: 1123266 - RNA, 22 nt, Human
uucucugucccauccucacucc

SEQ ID NO: 1123267 - RNA, 22 nt, Human
uuuagcaccagcucugaaugcc

SEQ ID NO: 1123268 - RNA, 20 nt, Human
uuuauauggcagugguggug

SEQ ID NO: 1123269 - RNA, 23 nt, Human
aauggugaaaaauacuaaaguac

SEQ ID NO: 1123270 - RNA, 20 nt, Human
agcugcucgguuucccauag

SEQ ID NO: 1123271 - RNA, 23 nt, Human
aggcagcugcccauagcugcuuu

SEQ ID NO: 1123272 - RNA, 19 nt, Human
agguacuguaauccaugga

SEQ ID NO: 1123273 - RNA, 20 nt, Human
auaagcaccagugccauacc

SEQ ID NO: 1123274 - RNA, 18 nt, Human
auagcugacaucaauggg

SEQ ID NO: 1123275 - RNA, 22 nt, Human
caacauuauaaauauggaauua

SEQ ID NO: 1123276 - RNA, 21 nt, Human
caaugggcuguccauagguuc

SEQ ID NO: 1123277 - RNA, 22 nt, Human
cacaaauggugaaaaauacuaa

SEQ ID NO: 1123278 - RNA, 20 nt, Human
cagugggcuuguuuccauuc

SEQ ID NO: 1123279 - RNA, 20 nt, Human
ccuggguauagcugacauca

SEQ ID NO: 1123280 - RNA, 22 nt, Human
cucugcugcccguagcugcugc

SEQ ID NO: 1123281 - RNA, 24 nt, Human
cucugcuguccauagcugcucggu

SEQ ID NO: 1123282 - RNA, 21 nt, Human
cugcuguccauagcugcucgg

SEQ ID NO: 1123283 - RNA, 19 nt, Human
cuguagcccugcugcgcug

SEQ ID NO: 1123284 - RNA, 19 nt, Human
gcaguuggaguaguauaac

SEQ ID NO: 1123285 - RNA, 23 nt, Human
gccuggguauagcugacaucaau

SEQ ID NO: 1123286 - RNA, 23 nt, Human
gcuuuguugaccauagcuacucu

SEQ ID NO: 1123287 - RNA, 20 nt, Human
ggccugggugguggugacug

SEQ ID NO: 1123288 - RNA, 24 nt, Human
gggugguggugacuguagcagugg

SEQ ID NO: 1123289 - RNA, 24 nt, Human
guaguauaaccagugggaggcugu

SEQ ID NO: 1123290 - RNA, 19 nt, Human
guccauauccuaggcuggg

SEQ ID NO: 1123291 - RNA, 19 nt, Human
gugggaggcagcugcccau

SEQ ID NO: 1123292 - RNA, 19 nt, Human
guuugggguggguaacuag

SEQ ID NO: 1123293 - RNA, 24 nt, Human
uaaaacauuuucugguuuaaaaaa

SEQ ID NO: 1123294 - RNA, 21 nt, Human
uaacugcucugaucauaacua

SEQ ID NO: 1123295 - RNA, 23 nt, Human
uaauccauggaugccauuuucuc

SEQ ID NO: 1123296 - RNA, 18 nt, Human
uaccuggggauaacugca

SEQ ID NO: 1123297 - RNA, 19 nt, Human
uaccuggggauaacugcag

SEQ ID NO: 1123298 - RNA, 25 nt, Human
uacuaaaguacagagaaagaauaau

SEQ ID NO: 1123299 - RNA, 21 nt, Human
uagcucccagguaccugggga

SEQ ID NO: 1123300 - RNA, 19 nt, Human
uaggaggguaggauggagg

SEQ ID NO: 1123301 - RNA, 19 nt, Human
uaggaggguaggauggagg

SEQ ID NO: 1123302 - RNA, 18 nt, Human
uaggauggaggugcggug

SEQ ID NO: 1123303 - RNA, 21 nt, Human
uaugcagauugagcugcauag

SEQ ID NO: 1123304 - RNA, 19 nt, Human
uccuugagugggcugggug

SEQ ID NO: 1123305 - RNA, 22 nt, Human
ucuccuuccuccucguucucuc

SEQ ID NO: 1123306 - RNA, 24 nt, Human
ucugcagucuuguaggugcagugg

SEQ ID NO: 1123307 - RNA, 24 nt, Human
ugaaaaauacuaaaguacagagaa

SEQ ID NO: 1123308 - RNA, 19 nt, Human
ugaccauagcuacucugcu

SEQ ID NO: 1123309 - RNA, 18 nt, Human
ugccauaccccuggacag

SEQ ID NO: 1123310 - RNA, 19 nt, Human
ugccauaccccuggacagg

SEQ ID NO: 1123311 - RNA, 18 nt, Human
ugcccauaugccugggug

SEQ ID NO: 1123312 - RNA, 19 nt, Human
ugcccauaugccugggugg

SEQ ID NO: 1123313 - RNA, 19 nt, Human
ugcccguagcugcugcucu

SEQ ID NO: 1123314 - RNA, 20 nt, Human
uggcugcauggaguagcucc

SEQ ID NO: 1123315 - RNA, 19 nt, Human
ugggaggcuguccauaaga

SEQ ID NO: 1123316 - RNA, 24 nt, Human
ugggaggcuguccauaagaaguug

SEQ ID NO: 1123317 - RNA, 23 nt, Human
ugggcugguuguaacccccugug

SEQ ID NO: 1123318 - RNA, 18 nt, Human
ugggcuguccauagguuc

SEQ ID NO: 1123319 - RNA, 22 nt, Human
uggguaacuagugggaggcagc

SEQ ID NO: 1123320 - RNA, 24 nt, Human
ugggugguggugacuguagcagug

SEQ ID NO: 1123321 - RNA, 25 nt, Human
ugguaggaggguaggauggaggugc

SEQ ID NO: 1123322 - RNA, 23 nt, Human
ugguaucauaagcaccagugcca

SEQ ID NO: 1123323 - RNA, 26 nt, Human
uguagcaguggugguaucauaagcac

SEQ ID NO: 1123324 - RNA, 23 nt, Human
uguagcccugcugcgcugcagcu

SEQ ID NO: 1123325 - RNA, 22 nt, Human
uguaggaucaaguuuggggugg

SEQ ID NO: 1123326 - RNA, 21 nt, Human
uguaggugcaguggcuacugg

SEQ ID NO: 1123327 - RNA, 19 nt, Human
uugcaguggucugagccug

SEQ ID NO: 1123328 - RNA, 19 nt, Human
agaggucugcuuuggcuca

SEQ ID NO: 1123329 - RNA, 22 nt, Human
agcagcccuacucuucaaaagu

SEQ ID NO: 1123330 - RNA, 21 nt, Human
aggaggcggcagcggcggcgg

SEQ ID NO: 1123331 - RNA, 19 nt, Human
aggcggcagcggcggcggc

SEQ ID NO: 1123332 - RNA, 19 nt, Human
aggcggcagcggcggcggc

SEQ ID NO: 1123333 - RNA, 21 nt, Human
aggcggcgggugcccucgccg

SEQ ID NO: 1123334 - RNA, 22 nt, Human
caccgacacuccucggcccggc

SEQ ID NO: 1123335 - RNA, 19 nt, Human
cacugcaugucucagaggc

SEQ ID NO: 1123336 - RNA, 18 nt, Human
cagcccggccccgccccg

SEQ ID NO: 1123337 - RNA, 21 nt, Human
ccccccgccccucgccggaga

SEQ ID NO: 1123338 - RNA, 18 nt, Human
cccccuccucuugcagcc

SEQ ID NO: 1123339 - RNA, 20 nt, Human
ccccgacguccgcccacgcc

SEQ ID NO: 1123340 - RNA, 23 nt, Human
ccccgccccucgccggagaggag

SEQ ID NO: 1123341 - RNA, 27 nt, Human
ccccgcugccccgacguccgcccacgc

SEQ ID NO: 1123342 - RNA, 20 nt, Human
ccccguagccggaccacacc

SEQ ID NO: 1123343 - RNA, 18 nt, Human
cccgcccccucgcuccgg

SEQ ID NO: 1123344 - RNA, 21 nt, Human
cccgccccucgccggagagga

SEQ ID NO: 1123345 - RNA, 20 nt, Human
cccggccccgccccguagcc

SEQ ID NO: 1123346 - RNA, 23 nt, Human
cccggccccgccccguagccgga

SEQ ID NO: 1123347 - RNA, 24 nt, Human
cccgggccggagccccccgccccu

SEQ ID NO: 1123348 - RNA, 21 nt, Human
cccguagccggaccacaccga

SEQ ID NO: 1123349 - RNA, 21 nt, Human
ccgccgggcauccuuggggaa

SEQ ID NO: 1123350 - RNA, 25 nt, Human
ccucgccggcuccagcgcccgggcg

SEQ ID NO: 1123351 - RNA, 24 nt, Human
ccucggcccggcugccucggcccg

SEQ ID NO: 1123352 - RNA, 23 nt, Human
cggagccccccgccccucgccgg

SEQ ID NO: 1123353 - RNA, 22 nt, Human
cggcagcggcggcggcauggag

SEQ ID NO: 1123354 - RNA, 22 nt, Human
cggcggcagcagcagcagcccg

SEQ ID NO: 1123355 - RNA, 19 nt, Human
cggcggcauggagccgggg

SEQ ID NO: 1123356 - RNA, 19 nt, Human
cggcguggggcagcgcggg

SEQ ID NO: 1123357 - RNA, 28 nt, Human
cgggccggagccccccgccccucgccgg

SEQ ID NO: 1123358 - RNA, 24 nt, Human
cgggugcccucgccggcuccagcg

SEQ ID NO: 1123359 - RNA, 21 nt, Human
cggucagacucagcucgcacc

SEQ ID NO: 1123360 - RNA, 23 nt, Human
cggucagacucagcucgcaccua

SEQ ID NO: 1123361 - RNA, 22 nt, Human
cucccggucagacucagcucgc

SEQ ID NO: 1123362 - RNA, 19 nt, Human
cucggcccggcugccucgg

SEQ ID NO: 1123363 - RNA, 25 nt, Human
cuugcagccgcgcgggguccccgaa

SEQ ID NO: 1123364 - RNA, 24 nt, Human
gagggcggcgguggcagcgcccgg

SEQ ID NO: 1123365 - RNA, 20 nt, Human
gccccguagccggaccacac

SEQ ID NO: 1123366 - RNA, 21 nt, Human
gcgcggcguggggcagcgcgg

SEQ ID NO: 1123367 - RNA, 20 nt, Human
gcggcgguggcagcgcccgg

SEQ ID NO: 1123368 - RNA, 21 nt, Human
gcggcgguggcagcgcccggu

SEQ ID NO: 1123369 - RNA, 19 nt, Human
gcucgcaccuaggagcggg

SEQ ID NO: 1123370 - RNA, 25 nt, Human
ggaccacaccgacacuccucggccc

SEQ ID NO: 1123371 - RNA, 18 nt, Human
ggagaggaggaggcggca

SEQ ID NO: 1123372 - RNA, 20 nt, Human
ggccggagccccccgccccu

SEQ ID NO: 1123373 - RNA, 21 nt, Human
ggcggcagcagcagcagcccg

SEQ ID NO: 1123374 - RNA, 19 nt, Human
ggcggcagcggcggcggca

SEQ ID NO: 1123375 - RNA, 23 nt, Human
ggcggcggcauggagccggggga

SEQ ID NO: 1123376 - RNA, 18 nt, Human
ggcggcgguggcagcgcc

SEQ ID NO: 1123377 - RNA, 19 nt, Human
gggcagggaggggagcggc

SEQ ID NO: 1123378 - RNA, 23 nt, Human
gggcggcgguggcagcgcccggu

SEQ ID NO: 1123379 - RNA, 23 nt, Human
gggggagggcggcgguggcagcg

SEQ ID NO: 1123380 - RNA, 21 nt, Human
uccccgcugccccgacguccg

SEQ ID NO: 1123381 - RNA, 19 nt, Human
uccugccaccccuggcacc

SEQ ID NO: 1123382 - RNA, 20 nt, Human
ugcagccgcgcggggucccc

SEQ ID NO: 1123383 - RNA, 25 nt, Human
uggggaagcccccuccucuugcagc

SEQ ID NO: 1123384 - RNA, 24 nt, Human
ugguucuaccacccaaggagcagc

SEQ ID NO: 1123385 - RNA, 18 nt, Human
aacccugccuucccuccc

SEQ ID NO: 1123386 - RNA, 23 nt, Human
aacgggggauuuguaucucccuu

SEQ ID NO: 1123387 - RNA, 19 nt, Human
acagaguuucugagccaaa

SEQ ID NO: 1123388 - RNA, 22 nt, Human
agaugggguucauucagauccc

SEQ ID NO: 1123389 - RNA, 20 nt, Human
aguuucugagccaaagcaga

SEQ ID NO: 1123390 - RNA, 20 nt, Human
aucccaaguccuuuccccaa

SEQ ID NO: 1123391 - RNA, 24 nt, Human
aucccaaguccuuuccccaacccu

SEQ ID NO: 1123392 - RNA, 21 nt, Human
auggggagcuguguuaaagug

SEQ ID NO: 1123393 - RNA, 22 nt, Human
caaacagaguuucugagccaaa

SEQ ID NO: 1123394 - RNA, 18 nt, Human
cagaguuucugagccaaa

SEQ ID NO: 1123395 - RNA, 27 nt, Human
cagaucccaaguccuuuccccaacccu

SEQ ID NO: 1123396 - RNA, 24 nt, Human
caggagccaaacagaguuucugag

SEQ ID NO: 1123397 - RNA, 19 nt, Human
ccuucccucccuaugcuuu

SEQ ID NO: 1123398 - RNA, 23 nt, Human
ccuugguucccaaacccugccuu

SEQ ID NO: 1123399 - RNA, 22 nt, Human
gcccagccuugguucccaaacc

SEQ ID NO: 1123400 - RNA, 20 nt, Human
gccugcuuggcccaugggga

SEQ ID NO: 1123401 - RNA, 20 nt, Human
uaaauaccuaauguggccca

SEQ ID NO: 1123402 - RNA, 21 nt, Human
uagaaagaugggguucauuca

SEQ ID NO: 1123403 - RNA, 18 nt, Human
uaucucccuuccuccucc

SEQ ID NO: 1123404 - RNA, 24 nt, Human
ucccaaacccugccuucccucccu

SEQ ID NO: 1123405 - RNA, 19 nt, Human
ucccuaugcuuuugggugg

SEQ ID NO: 1123406 - RNA, 24 nt, Human
ucugagccaaagcagaccgggguc

SEQ ID NO: 1123407 - RNA, 19 nt, Human
ugauuugacagacuugcug

SEQ ID NO: 1123408 - RNA, 19 nt, Human
ugcuuggcccauggggagc

SEQ ID NO: 1123409 - RNA, 19 nt, Human
uguguagaaagaugggguu

SEQ ID NO: 1123410 - RNA, 18 nt, Human
uugggugggaaacggggg

SEQ ID NO: 1123411 - RNA, 22 nt, Human
uuugccagccuuugcagccacu

SEQ ID NO: 1123412 - RNA, 24 nt, Human
aaacuccaucaagugaaagauaac

SEQ ID NO: 1123413 - RNA, 25 nt, Human
aaagaaucucccuuacuggcccaac

SEQ ID NO: 1123414 - RNA, 19 nt, Human
aaccugcucuucuguccuc

SEQ ID NO: 1123415 - RNA, 21 nt, Human
aaccugcucuucuguccucca

SEQ ID NO: 1123416 - RNA, 19 nt, Human
aacuuaaaaaacuccgaug

SEQ ID NO: 1123417 - RNA, 21 nt, Human
aagugaaagauaacaaaagcc

SEQ ID NO: 1123418 - RNA, 19 nt, Human
aauacagugaaacuccauc

SEQ ID NO: 1123419 - RNA, 22 nt, Human
acuccagagaaagcuugggaag

SEQ ID NO: 1123420 - RNA, 18 nt, Human
agacagugugugcacaug

SEQ ID NO: 1123421 - RNA, 19 nt, Human
agagaggagaaggggcugg

SEQ ID NO: 1123422 - RNA, 20 nt, Human
agaguaggacccugagagau

SEQ ID NO: 1123423 - RNA, 24 nt, Human
agcaggguaaggagacagcagaga

SEQ ID NO: 1123424 - RNA, 19 nt, Human
aggaaggaaauacauggug

SEQ ID NO: 1123425 - RNA, 19 nt, Human
aggaaggaaauacauggug

SEQ ID NO: 1123426 - RNA, 22 nt, Human
aggaaggaaauacaugguguaa

SEQ ID NO: 1123427 - RNA, 27 nt, Human
aggagacagcagagaggaccgguaccc

SEQ ID NO: 1123428 - RNA, 24 nt, Human
agggaauggcugggcagcugaggg

SEQ ID NO: 1123429 - RNA, 21 nt, Human
agugaaagauaacaaaagccc

SEQ ID NO: 1123430 - RNA, 22 nt, Human
agugugucuaacaguuuguaua

SEQ ID NO: 1123431 - RNA, 19 nt, Human
auacuagaacuuuccaacc

SEQ ID NO: 1123432 - RNA, 24 nt, Human
auagcugaaaagauaaagagcaga

SEQ ID NO: 1123433 - RNA, 18 nt, Human
aucacagguuucccuagg

SEQ ID NO: 1123434 - RNA, 22 nt, Human
aucuggguggggaggggcaagg

SEQ ID NO: 1123435 - RNA, 26 nt, Human
augaacauaauacagugaaacuccau

SEQ ID NO: 1123436 - RNA, 19 nt, Human
augaagggcugcgcuuaca

SEQ ID NO: 1123437 - RNA, 25 nt, Human
cacacacacauuuacucauacccag

SEQ ID NO: 1123438 - RNA, 23 nt, Human
cacacauuuacucauacccagca

SEQ ID NO: 1123439 - RNA, 21 nt, Human
ccagagaagugaaaugcaaca

SEQ ID NO: 1123440 - RNA, 18 nt, Human
ccaggacaacgaaacaca

SEQ ID NO: 1123441 - RNA, 19 nt, Human
cccaccacuacagccacuc

SEQ ID NO: 1123442 - RNA, 20 nt, Human
cccucuccagggaucugcua

SEQ ID NO: 1123443 - RNA, 19 nt, Human
ccugaaauucccaccacua

SEQ ID NO: 1123444 - RNA, 26 nt, Human
ccugcccccucuccagggaucugcua

SEQ ID NO: 1123445 - RNA, 22 nt, Human
ccugguuucucuuucuucaaag

SEQ ID NO: 1123446 - RNA, 19 nt, Human
ccuguuuuguuuuuguuuu

SEQ ID NO: 1123447 - RNA, 20 nt, Human
cgcuggagagggaauggcug

SEQ ID NO: 1123448 - RNA, 19 nt, Human
cgggaagaggacuccagag

SEQ ID NO: 1123449 - RNA, 22 nt, Human
cucaugccuuaaccugcucuuc

SEQ ID NO: 1123450 - RNA, 22 nt, Human
cucuuuagcacccacugacuga

SEQ ID NO: 1123451 - RNA, 20 nt, Human
cuggcccacuucugggccug

SEQ ID NO: 1123452 - RNA, 24 nt, Human
cuuacccacaucacagguuucccu

SEQ ID NO: 1123453 - RNA, 20 nt, Human
gaaauuacuuagauggagga

SEQ ID NO: 1123454 - RNA, 25 nt, Human
gaaauucccaccacuacagccacuc

SEQ ID NO: 1123455 - RNA, 24 nt, Human
gaacuuacccacaucacagguuuc

SEQ ID NO: 1123456 - RNA, 19 nt, Human
gaauggcugggcagcugag

SEQ ID NO: 1123457 - RNA, 18 nt, Human
gacagguaugacucgggg

SEQ ID NO: 1123458 - RNA, 18 nt, Human
gacagugugugcacaugu

SEQ ID NO: 1123459 - RNA, 24 nt, Human
gaccugcccccucuccagggaucu

SEQ ID NO: 1123460 - RNA, 24 nt, Human
gaggggcaagggagaggugauacu

SEQ ID NO: 1123461 - RNA, 22 nt, Human
gcaagggagaggugauacuaga

SEQ ID NO: 1123462 - RNA, 26 nt, Human
gcacaauuccaaggaggagggaacgc

SEQ ID NO: 1123463 - RNA, 22 nt, Human
gcagagaggagaaggggcugga

SEQ ID NO: 1123464 - RNA, 19 nt, Human
gcauuaucuguagccccua

SEQ ID NO: 1123465 - RNA, 21 nt, Human
ggaaauuacuuagauggagga

SEQ ID NO: 1123466 - RNA, 22 nt, Human
ggaagaggacuccagagaaagc

SEQ ID NO: 1123467 - RNA, 22 nt, Human
ggaggaaaugguaaaggaagga

SEQ ID NO: 1123468 - RNA, 22 nt, Human
ggagugugugaaacaaugcuug

SEQ ID NO: 1123469 - RNA, 19 nt, Human
ggcugggcagcugagggga

SEQ ID NO: 1123470 - RNA, 20 nt, Human
ggcuuugugugugugugugu

SEQ ID NO: 1123471 - RNA, 21 nt, Human
gggaaagaaggcuugguggua

SEQ ID NO: 1123472 - RNA, 18 nt, Human
ggggagcaggguaaggag

SEQ ID NO: 1123473 - RNA, 19 nt, Human
gguaaggagacagcagaga

SEQ ID NO: 1123474 - RNA, 23 nt, Human
gguaaggagacagcagagaggac

SEQ ID NO: 1123475 - RNA, 22 nt, Human
gguaugggacgcuggagaggga

SEQ ID NO: 1123476 - RNA, 24 nt, Human
guaacaucugaagacugacaacuc

SEQ ID NO: 1123477 - RNA, 19 nt, Human
gugaaacaaugcuugcccc

SEQ ID NO: 1123478 - RNA, 20 nt, Human
gugcagagaggagaaggggc

SEQ ID NO: 1123479 - RNA, 19 nt, Human
guggggugggccagauggc

SEQ ID NO: 1123480 - RNA, 25 nt, Human
gugugugcacauguacguguacacg

SEQ ID NO: 1123481 - RNA, 21 nt, Human
gugugugugugugugugugug

SEQ ID NO: 1123482 - RNA, 21 nt, Human
gugugugugugugugugugug

SEQ ID NO: 1123483 - RNA, 19 nt, Human
uaaagucauuuuuaaggca

SEQ ID NO: 1123484 - RNA, 18 nt, Human
uaacuuaaaaaacuccga

SEQ ID NO: 1123485 - RNA, 19 nt, Human
uaacuuaaaaaacuccgau

SEQ ID NO: 1123486 - RNA, 19 nt, Human
uaaggagacagcagagagg

SEQ ID NO: 1123487 - RNA, 27 nt, Human
uacacgcacucacacacacauuuacuc

SEQ ID NO: 1123488 - RNA, 26 nt, Human
uacguguacacgcacucacacacaca

SEQ ID NO: 1123489 - RNA, 27 nt, Human
uaggcuuugugugugugugugugugug

SEQ ID NO: 1123490 - RNA, 22 nt, Human
uauuauacauucuauguauaua

SEQ ID NO: 1123491 - RNA, 20 nt, Human
uccaggacaacgaaacacag

SEQ ID NO: 1123492 - RNA, 18 nt, Human
ucccuguuuuguuuuugu

SEQ ID NO: 1123493 - RNA, 20 nt, Human
ucuccagggaucugcuaugg

SEQ ID NO: 1123494 - RNA, 21 nt, Human
ucuggguaacuuaaaaaacuc

SEQ ID NO: 1123495 - RNA, 20 nt, Human
ugaaagauaacaaaagcccu

SEQ ID NO: 1123496 - RNA, 19 nt, Human
ugaaaugcaacaucuguuu

SEQ ID NO: 1123497 - RNA, 21 nt, Human
ugacaacucagaauuuccuaa

SEQ ID NO: 1123498 - RNA, 18 nt, Human
ugacugaacugucaccua

SEQ ID NO: 1123499 - RNA, 19 nt, Human
ugagagaugggacauaggg

SEQ ID NO: 1123500 - RNA, 19 nt, Human
ugauacacacaugcucaug

SEQ ID NO: 1123501 - RNA, 22 nt, Human
ugcccccucuccagggaucugc

SEQ ID NO: 1123502 - RNA, 22 nt, Human
uggaggaacgggaagaggacuc

SEQ ID NO: 1123503 - RNA, 26 nt, Human
uggaggaacgggaagaggacuccaga

SEQ ID NO: 1123504 - RNA, 19 nt, Human
uggcaucucuauagaucua

SEQ ID NO: 1123505 - RNA, 24 nt, Human
ugggacauagggcagggacauuug

SEQ ID NO: 1123506 - RNA, 21 nt, Human
ugguguaggggagcaggguaa

SEQ ID NO: 1123507 - RNA, 21 nt, Human
uguauguagacagugugugca

SEQ ID NO: 1123508 - RNA, 18 nt, Human
ugugcacauguacgugua

SEQ ID NO: 1123509 - RNA, 20 nt, Human
uguguagugugucuaacagu

SEQ ID NO: 1123510 - RNA, 21 nt, Human
uguguguguguagugugucua

SEQ ID NO: 1123511 - RNA, 20 nt, Human
uguguguguguguagugugu

SEQ ID NO: 1123512 - RNA, 21 nt, Human
uguguguguguguguguagug

SEQ ID NO: 1123513 - RNA, 22 nt, Human
uguguguguguguguguagugu

SEQ ID NO: 1123514 - RNA, 22 nt, Human
uguguguguguguguguagugu

SEQ ID NO: 1123515 - RNA, 24 nt, Human
uguguguguguguguguagugugu

SEQ ID NO: 1123516 - RNA, 18 nt, Human
ugugugugugugugugug

SEQ ID NO: 1123517 - RNA, 18 nt, Human
ugugugugugugugugug

SEQ ID NO: 1123518 - RNA, 18 nt, Human
ugugugugugugugugug

SEQ ID NO: 1123519 - RNA, 18 nt, Human
ugugugugugugugugug

SEQ ID NO: 1123520 - RNA, 18 nt, Human
ugugugugugugugugug

SEQ ID NO: 1123521 - RNA, 18 nt, Human
ugugugugugugugugug

SEQ ID NO: 1123522 - RNA, 18 nt, Human
ugugugugugugugugug

SEQ ID NO: 1123523 - RNA, 18 nt, Human
ugugugugugugugugug

SEQ ID NO: 1123524 - RNA, 18 nt, Human
ugugugugugugugugug

SEQ ID NO: 1123525 - RNA, 18 nt, Human
ugugugugugugugugug

SEQ ID NO: 1123526 - RNA, 21 nt, Human
ugugugugugugugugugugu

SEQ ID NO: 1123527 - RNA, 21 nt, Human
ugugugugugugugugugugu

SEQ ID NO: 1123528 - RNA, 21 nt, Human
ugugugugugugugugugugu

SEQ ID NO: 1123529 - RNA, 21 nt, Human
ugugugugugugugugugugu

SEQ ID NO: 1123530 - RNA, 21 nt, Human
ugugugugugugugugugugu

SEQ ID NO: 1123531 - RNA, 21 nt, Human
ugugugugugugugugugugu

SEQ ID NO: 1123532 - RNA, 21 nt, Human
ugugugugugugugugugugu

SEQ ID NO: 1123533 - RNA, 21 nt, Human
ugugugugugugugugugugu

SEQ ID NO: 1123534 - RNA, 21 nt, Human
ugugugugugugugugugugu

SEQ ID NO: 1123535 - RNA, 21 nt, Human
ugugugugugugugugugugu

SEQ ID NO: 1123536 - RNA, 21 nt, Human
ugugugugugugugugugugu

SEQ ID NO: 1123537 - RNA, 21 nt, Human
ugugugugugugugugugugu

SEQ ID NO: 1123538 - RNA, 21 nt, Human
ugugugugugugugugugugu

SEQ ID NO: 1123539 - RNA, 21 nt, Human
ugugugugugugugugugugu

SEQ ID NO: 1123540 - RNA, 21 nt, Human
ugugugugugugugugugugu

SEQ ID NO: 1123541 - RNA, 21 nt, Human
ugugugugugugugugugugu

SEQ ID NO: 1123542 - RNA, 21 nt, Human
ugugugugugugugugugugu

SEQ ID NO: 1123543 - RNA, 22 nt, Human
ugugugugugugugugugugua

SEQ ID NO: 1123544 - RNA, 22 nt, Human
ugugugugugugugugugugug

SEQ ID NO: 1123545 - RNA, 22 nt, Human
ugugugugugugugugugugug

SEQ ID NO: 1123546 - RNA, 22 nt, Human
ugugugugugugugugugugug

SEQ ID NO: 1123547 - RNA, 22 nt, Human
ugugugugugugugugugugug

SEQ ID NO: 1123548 - RNA, 22 nt, Human
ugugugugugugugugugugug

SEQ ID NO: 1123549 - RNA, 21 nt, Human
uguuuuguuuuuguuuuuuuu

SEQ ID NO: 1123550 - RNA, 18 nt, Human
uguuuuuguuuuuuuugg

SEQ ID NO: 1123551 - RNA, 20 nt, Human
uucacauuagagucaucugg

SEQ ID NO: 1123552 - RNA, 21 nt, Human
uugaacaggguggggugggcc

SEQ ID NO: 1123553 - RNA, 23 nt, Human
uuggcugagcugauggggaaggu

SEQ ID NO: 1123554 - RNA, 25 nt, Human
uuggguuuuuuuuuuucauuuuuaa

SEQ ID NO: 1123555 - RNA, 19 nt, Human
uuguuuuuguuuuuuuugg

SEQ ID NO: 1123556 - RNA, 20 nt, Human
uuuaacuuuuuuuaauccca

SEQ ID NO: 1123557 - RNA, 26 nt, Human
uuuacucauacccagcaguggagauc

SEQ ID NO: 1123558 - RNA, 24 nt, Human
uuugugugugugugugugugugug

SEQ ID NO: 1123559 - RNA, 18 nt, Human
aaaaagaaaagggagagg

SEQ ID NO: 1123560 - RNA, 23 nt, Human
aaaagccaaggcucucccagaca

SEQ ID NO: 1123561 - RNA, 21 nt, Human
aaacagugugucacagacccc

SEQ ID NO: 1123562 - RNA, 18 nt, Human
aacaucucuggcucuucu

SEQ ID NO: 1123563 - RNA, 25 nt, Human
aacccaccuaccuagcuggcugccc

SEQ ID NO: 1123564 - RNA, 24 nt, Human
aagaaacuugggucaguagaaggc

SEQ ID NO: 1123565 - RNA, 18 nt, Human
aagaauuggugaucauuu

SEQ ID NO: 1123566 - RNA, 19 nt, Human
aagcaucuuaaaagggggg

SEQ ID NO: 1123567 - RNA, 22 nt, Human
aagcucugcuggggaccagguu

SEQ ID NO: 1123568 - RNA, 24 nt, Human
aagguagggugguaaaaagaaaag

SEQ ID NO: 1123569 - RNA, 23 nt, Human
aauacuuuguaaaaacugcuuuu

SEQ ID NO: 1123570 - RNA, 19 nt, Human
acaggcucugagagcaaug

SEQ ID NO: 1123571 - RNA, 19 nt, Human
accaaaguuacucuccuca

SEQ ID NO: 1123572 - RNA, 19 nt, Human
accaacaucaccccacucu

SEQ ID NO: 1123573 - RNA, 23 nt, Human
accacagguagaugaggaagcag

SEQ ID NO: 1123574 - RNA, 23 nt, Human
acugaaaagccaaggcucuccca

SEQ ID NO: 1123575 - RNA, 20 nt, Human
acugcaaaccuccaggaagc

SEQ ID NO: 1123576 - RNA, 23 nt, Human
agaaaagguucuccaaaauguuu

SEQ ID NO: 1123577 - RNA, 21 nt, Human
agaacuccuucaggcucacuu

SEQ ID NO: 1123578 - RNA, 18 nt, Human
agagagaaccaagcacca

SEQ ID NO: 1123579 - RNA, 20 nt, Human
agaggaguccaucuuccaag

SEQ ID NO: 1123580 - RNA, 22 nt, Human
agauuuagagucaaacugagcc

SEQ ID NO: 1123581 - RNA, 22 nt, Human
agcuggcugcccgagaaaaaga

SEQ ID NO: 1123582 - RNA, 23 nt, Human
agcuguuuccaagcuaggagugg

SEQ ID NO: 1123583 - RNA, 21 nt, Human
agcuucaaguaaaguugagca

SEQ ID NO: 1123584 - RNA, 22 nt, Human
agggugguaaaaagaaaaggga

SEQ ID NO: 1123585 - RNA, 23 nt, Human
augaaaugaacaucucuggcucu

SEQ ID NO: 1123586 - RNA, 20 nt, Human
augcuucuaugcuuguuucc

SEQ ID NO: 1123587 - RNA, 21 nt, Human
caacaucaccccacucugcuc

SEQ ID NO: 1123588 - RNA, 20 nt, Human
cacauacaaccaacaucacc

SEQ ID NO: 1123589 - RNA, 20 nt, Human
caccaagcagcagcucucag

SEQ ID NO: 1123590 - RNA, 18 nt, Human
cacccugaacagcagagu

SEQ ID NO: 1123591 - RNA, 27 nt, Human
cacucugcucaucugugccuccacccu

SEQ ID NO: 1123592 - RNA, 19 nt, Human
cagagcuccccugccacuc

SEQ ID NO: 1123593 - RNA, 19 nt, Human
cagcagcucucaggaaagg

SEQ ID NO: 1123594 - RNA, 23 nt, Human
caugacgcugcuagugagaaucc

SEQ ID NO: 1123595 - RNA, 20 nt, Human
ccacuaacaauaaagguagg

SEQ ID NO: 1123596 - RNA, 23 nt, Human
ccacuccaugaggcgcugcugcc

SEQ ID NO: 1123597 - RNA, 20 nt, Human
ccacuggauggcucuggagc

SEQ ID NO: 1123598 - RNA, 21 nt, Human
ccacuggauggcucuggagcc

SEQ ID NO: 1123599 - RNA, 22 nt, Human
ccagaggcucuuaaaaaacuaa

SEQ ID NO: 1123600 - RNA, 21 nt, Human
ccauagaaagcucaaguucag

SEQ ID NO: 1123601 - RNA, 22 nt, Human
ccaucccuuccuuguuccagaa

SEQ ID NO: 1123602 - RNA, 21 nt, Human
ccaugaggcgcugcugccggc

SEQ ID NO: 1123603 - RNA, 21 nt, Human
ccauggaaucagagacccaga

SEQ ID NO: 1123604 - RNA, 18 nt, Human
cccaaauauuucaaccuc

SEQ ID NO: 1123605 - RNA, 22 nt, Human
cccaacaccacagguagaugag

SEQ ID NO: 1123606 - RNA, 25 nt, Human
cccacacccagccugcaauggucca

SEQ ID NO: 1123607 - RNA, 22 nt, Human
ccccacucugcucaucugugcc

SEQ ID NO: 1123608 - RNA, 23 nt, Human
ccccugccacuccaugaggcgcu

SEQ ID NO: 1123609 - RNA, 20 nt, Human
cccuccacagacagagcucc

SEQ ID NO: 1123610 - RNA, 21 nt, Human
cccugaccaaaguuacucucc

SEQ ID NO: 1123611 - RNA, 24 nt, Human
cccugaccaaaguuacucuccuca

SEQ ID NO: 1123612 - RNA, 22 nt, Human
ccgaagcccucacccacaccca

SEQ ID NO: 1123613 - RNA, 24 nt, Human
ccgaagcccucacccacacccagc

SEQ ID NO: 1123614 - RNA, 26 nt, Human
ccgaagcccucacccacacccagccu

SEQ ID NO: 1123615 - RNA, 19 nt, Human
ccucacccacacccagccu

SEQ ID NO: 1123616 - RNA, 23 nt, Human
ccucacccacacccagccugcaa

SEQ ID NO: 1123617 - RNA, 22 nt, Human
ccucacugcaaaccuccaggaa

SEQ ID NO: 1123618 - RNA, 30 nt, Human
ccuccacagacagagcuccccugccacucu

SEQ ID NO: 1123619 - RNA, 21 nt, Human
ccugaaagucuccggguggca

SEQ ID NO: 1123620 - RNA, 20 nt, Human
ccuucaggcucacuugggcu

SEQ ID NO: 1123621 - RNA, 22 nt, Human
ccuuccaucccuuccuuguucc

SEQ ID NO: 1123622 - RNA, 24 nt, Human
cuagaaaucuccaccccaaauauu

SEQ ID NO: 1123623 - RNA, 21 nt, Human
cuaugcuuguuuccuaaacac

SEQ ID NO: 1123624 - RNA, 19 nt, Human
cucacccacacccagccug

SEQ ID NO: 1123625 - RNA, 26 nt, Human
cucacugcaaaccuccaggaagcgga

SEQ ID NO: 1123626 - RNA, 20 nt, Human
cuccauggaaucagagaccc

SEQ ID NO: 1123627 - RNA, 21 nt, Human
cucugcucaucugugccucca

SEQ ID NO: 1123628 - RNA, 22 nt, Human
cugcuucaucucagaacugauc

SEQ ID NO: 1123629 - RNA, 19 nt, Human
cugguccacuaauucuacu

SEQ ID NO: 1123630 - RNA, 21 nt, Human
cuuaaaaggggggaaaaaaaa

SEQ ID NO: 1123631 - RNA, 22 nt, Human
cuucagagccugcacggucucc

SEQ ID NO: 1123632 - RNA, 23 nt, Human
cuuggucccaacaccacagguag

SEQ ID NO: 1123633 - RNA, 20 nt, Human
gaaaaucuggugugaccagg

SEQ ID NO: 1123634 - RNA, 24 nt, Human
gaaaugaacaucucuggcucuucu

SEQ ID NO: 1123635 - RNA, 21 nt, Human
gagaggaguccaucuuccaag

SEQ ID NO: 1123636 - RNA, 21 nt, Human
gauggcucuggagccagggga

SEQ ID NO: 1123637 - RNA, 25 nt, Human
gcacauacaaccaacaucaccccac

SEQ ID NO: 1123638 - RNA, 21 nt, Human
gcucacuugggcuccccucca

SEQ ID NO: 1123639 - RNA, 18 nt, Human
gcucauuagugugaagga

SEQ ID NO: 1123640 - RNA, 19 nt, Human
ggauaaacagccaaggcac

SEQ ID NO: 1123641 - RNA, 22 nt, Human
gggauagcuaagggcacagucc

SEQ ID NO: 1123642 - RNA, 19 nt, Human
gggcaggaagagagaacca

SEQ ID NO: 1123643 - RNA, 20 nt, Human
gugccuccacccugaacagc

SEQ ID NO: 1123644 - RNA, 19 nt, Human
uaaaaaacuaagaccauug

SEQ ID NO: 1123645 - RNA, 23 nt, Human
uaaaaagaaaagggagaggagca

SEQ ID NO: 1123646 - RNA, 24 nt, Human
uaaaauagcaaaacagauuuagag

SEQ ID NO: 1123647 - RNA, 25 nt, Human
uaaacagccaaggcacuaaaugguu

SEQ ID NO: 1123648 - RNA, 23 nt, Human
uagaaggcucauuagugugaagg

SEQ ID NO: 1123649 - RNA, 24 nt, Human
uagggugguaaaaagaaaagggag

SEQ ID NO: 1123650 - RNA, 25 nt, Human
ucacugcaaaccuccaggaagcgga

SEQ ID NO: 1123651 - RNA, 20 nt, Human
ucagagaugagaggagucca

SEQ ID NO: 1123652 - RNA, 21 nt, Human
ucaggcuccaacuuagguacc

SEQ ID NO: 1123653 - RNA, 20 nt, Human
uccaagcuaggagugggcua

SEQ ID NO: 1123654 - RNA, 21 nt, Human
uccacacacaauaccugggca

SEQ ID NO: 1123655 - RNA, 25 nt, Human
uccacacacaauaccugggcaggaa

SEQ ID NO: 1123656 - RNA, 18 nt, Human
uccagagaaaacacuacc

SEQ ID NO: 1123657 - RNA, 23 nt, Human
ucccuuccuuguuccagaaacag

SEQ ID NO: 1123658 - RNA, 18 nt, Human
uccuuguuccagaaacag

SEQ ID NO: 1123659 - RNA, 20 nt, Human
ucuacuccugacucuccaug

SEQ ID NO: 1123660 - RNA, 18 nt, Human
ucuccggguggcaagcuc

SEQ ID NO: 1123661 - RNA, 21 nt, Human
ucugcagucagaaacugaggc

SEQ ID NO: 1123662 - RNA, 23 nt, Human
ucuguacuuccagagaaaacacu

SEQ ID NO: 1123663 - RNA, 24 nt, Human
ucugucuuuauuuacagcaaagua

SEQ ID NO: 1123664 - RNA, 20 nt, Human
ucugugccuccacccugaac

SEQ ID NO: 1123665 - RNA, 21 nt, Human
ugaccaaaguuacucuccuca

SEQ ID NO: 1123666 - RNA, 18 nt, Human
ugcauucccugcuucauc

SEQ ID NO: 1123667 - RNA, 24 nt, Human
ugccuccacccugaacagcagagu

SEQ ID NO: 1123668 - RNA, 19 nt, Human
ugcucaucugugccuccac

SEQ ID NO: 1123669 - RNA, 19 nt, Human
ugcugagucugggggaaaa

SEQ ID NO: 1123670 - RNA, 20 nt, Human
uggccaaaugcugggcugcc

SEQ ID NO: 1123671 - RNA, 18 nt, Human
ugggagccuucccuugcu

SEQ ID NO: 1123672 - RNA, 18 nt, Human
ugggauaaacagccaagg

SEQ ID NO: 1123673 - RNA, 20 nt, Human
ugggauagcuaagggcacag

SEQ ID NO: 1123674 - RNA, 18 nt, Human
ugggcugccacggagggg

SEQ ID NO: 1123675 - RNA, 20 nt, Human
uggugaucauuugacaaggg

SEQ ID NO: 1123676 - RNA, 21 nt, Human
uggugaucauuugacaagggg

SEQ ID NO: 1123677 - RNA, 20 nt, Human
ugugaaggagugagaggcca

SEQ ID NO: 1123678 - RNA, 18 nt, Human
uuccuuguuccagaaaca

SEQ ID NO: 1123679 - RNA, 18 nt, Human
uugacaaggggcagggca

SEQ ID NO: 1123680 - RNA, 21 nt, Human
uuggccaaaugcugggcugcc

SEQ ID NO: 1123681 - RNA, 18 nt, Human
uuucuggcaauggcagcc

SEQ ID NO: 1123682 - RNA, 25 nt, Human
aaccacaccuggacgacacggacac

SEQ ID NO: 1123683 - RNA, 22 nt, Human
aagccagugaccccucaaagaa

SEQ ID NO: 1123684 - RNA, 19 nt, Human
aaugaauccccaaaccacc

SEQ ID NO: 1123685 - RNA, 22 nt, Human
acacaggagauggauaacagag

SEQ ID NO: 1123686 - RNA, 23 nt, Human
agugaccccucaaagaauauggu

SEQ ID NO: 1123687 - RNA, 23 nt, Human
augaauccccaaaccaccacacc

SEQ ID NO: 1123688 - RNA, 23 nt, Human
cacaccaaguggaaaaagccaga

SEQ ID NO: 1123689 - RNA, 25 nt, Human
caccuggacgacacggacacucagc

SEQ ID NO: 1123690 - RNA, 24 nt, Human
cacucagcccugucucugcagcca

SEQ ID NO: 1123691 - RNA, 19 nt, Human
ccaccacaccaaguggaaa

SEQ ID NO: 1123692 - RNA, 21 nt, Human
ccacucgccuccaggaauggg

SEQ ID NO: 1123693 - RNA, 20 nt, Human
ccccaaaccaccacaccaag

SEQ ID NO: 1123694 - RNA, 21 nt, Human
ccccaaaccaccacaccaagu

SEQ ID NO: 1123695 - RNA, 22 nt, Human
ccucuggguguucugcugaucu

SEQ ID NO: 1123696 - RNA, 25 nt, Human
ccuggacgacacggacacucagccc

SEQ ID NO: 1123697 - RNA, 25 nt, Human
cugguuuuggaaccacaccuggacg

SEQ ID NO: 1123698 - RNA, 24 nt, Human
gacacggacacucagcccugucuc

SEQ ID NO: 1123699 - RNA, 21 nt, Human
gccuugcucaccucuggacua

SEQ ID NO: 1123700 - RNA, 21 nt, Human
gcugcugcugcugucgccugg

SEQ ID NO: 1123701 - RNA, 19 nt, Human
gcugcugcugucgccuggc

SEQ ID NO: 1123702 - RNA, 20 nt, Human
uagucacagaacucuagggg

SEQ ID NO: 1123703 - RNA, 23 nt, Human
uauacaguggaaugcugaaauag

SEQ ID NO: 1123704 - RNA, 21 nt, Human
ucaccuggugacuggaaacaa

SEQ ID NO: 1123705 - RNA, 23 nt, Human
ucagcccugucucugcagccaga

SEQ ID NO: 1123706 - RNA, 18 nt, Human
uccccaaaccaccacacc

SEQ ID NO: 1123707 - RNA, 19 nt, Human
uccccaaaccaccacacca

SEQ ID NO: 1123708 - RNA, 22 nt, Human
uccccaaaccaccacaccaagu

SEQ ID NO: 1123709 - RNA, 19 nt, Human
ucugcagccagagucucuc

SEQ ID NO: 1123710 - RNA, 21 nt, Human
ucuugcugcugcugcugcugu

SEQ ID NO: 1123711 - RNA, 19 nt, Human
ugaaauaggaaugaaugaa

SEQ ID NO: 1123712 - RNA, 22 nt, Human
ugaaauaggaaugaaugaaucc

SEQ ID NO: 1123713 - RNA, 23 nt, Human
ugaauccccaaaccaccacacca

SEQ ID NO: 1123714 - RNA, 19 nt, Human
ugaaugaauccccaaacca

SEQ ID NO: 1123715 - RNA, 18 nt, Human
ugagaacaccaaucagag

SEQ ID NO: 1123716 - RNA, 25 nt, Human
ugagaacaccaaucagagcucagcc

SEQ ID NO: 1123717 - RNA, 22 nt, Human
ugcagccagagucucucucacc

SEQ ID NO: 1123718 - RNA, 22 nt, Human
ugcugaaauaggaaugaaugaa

SEQ ID NO: 1123719 - RNA, 27 nt, Human
ugcugaucuugcugcugcugcugcugu

SEQ ID NO: 1123720 - RNA, 20 nt, Human
uggugacuggaaacauggug

SEQ ID NO: 1123721 - RNA, 28 nt, Human
uucugcugaucuugcugcugcugcugcc

SEQ ID NO: 1123722 - RNA, 18 nt, Human
cuucuugagagcaggagu

SEQ ID NO: 1123723 - RNA, 19 nt, Human
aagcguuuucugcaagaac

SEQ ID NO: 1123724 - RNA, 20 nt, Human
aaggaucccuccuguguuac

SEQ ID NO: 1123725 - RNA, 21 nt, Human
aaggugucucuaaaagggaca

SEQ ID NO: 1123726 - RNA, 21 nt, Human
aauaauagacacaggcaggga

SEQ ID NO: 1123727 - RNA, 18 nt, Human
aauggugauggacaaacu

SEQ ID NO: 1123728 - RNA, 20 nt, Human
aauugucaagagcaguuggu

SEQ ID NO: 1123729 - RNA, 21 nt, Human
acacugaagacacaaagaaug

SEQ ID NO: 1123730 - RNA, 21 nt, Human
acaggauauuuauacucuuga

SEQ ID NO: 1123731 - RNA, 18 nt, Human
acccagagauacgugguu

SEQ ID NO: 1123732 - RNA, 19 nt, Human
acuguacuuucauucaaau

SEQ ID NO: 1123733 - RNA, 18 nt, Human
agacacuaguaaaaacaa

SEQ ID NO: 1123734 - RNA, 19 nt, Human
agaguccugggugacaugc

SEQ ID NO: 1123735 - RNA, 19 nt, Human
agccaacacugaagacaca

SEQ ID NO: 1123736 - RNA, 23 nt, Human
agcgacuccugacuccugaccuc

SEQ ID NO: 1123737 - RNA, 18 nt, Human
agguugccacuggcaugg

SEQ ID NO: 1123738 - RNA, 23 nt, Human
auagagccaugcccacugaccca

SEQ ID NO: 1123739 - RNA, 25 nt, Human
augacaacaacaaaaagaugaggaa

SEQ ID NO: 1123740 - RNA, 20 nt, Human
augugcugcacaguuaugug

SEQ ID NO: 1123741 - RNA, 22 nt, Human
auugucucugcaguguuccugg

SEQ ID NO: 1123742 - RNA, 18 nt, Human
caaagaugacaaugaccu

SEQ ID NO: 1123743 - RNA, 21 nt, Human
cacaguuaugugaacguguca

SEQ ID NO: 1123744 - RNA, 21 nt, Human
caccggcagaguccuggguga

SEQ ID NO: 1123745 - RNA, 19 nt, Human
cagacaacuucagaaugua

SEQ ID NO: 1123746 - RNA, 18 nt, Human
cagcauugucucugcagg

SEQ ID NO: 1123747 - RNA, 19 nt, Human
cagcauugucucugcagug

SEQ ID NO: 1123748 - RNA, 19 nt, Human
caggauggaauagagagga

SEQ ID NO: 1123749 - RNA, 26 nt, Human
caguaaaaauugagaccccaaauuug

SEQ ID NO: 1123750 - RNA, 26 nt, Human
ccccuccuuaaccaaguaaccagucc

SEQ ID NO: 1123751 - RNA, 23 nt, Human
ccuggcaaaacguuuaggcugaa

SEQ ID NO: 1123752 - RNA, 20 nt, Human
cgacuccugacuccugaccu

SEQ ID NO: 1123753 - RNA, 24 nt, Human
cuauagguccugccugcaggaaug

SEQ ID NO: 1123754 - RNA, 24 nt, Human
cuccugacuccugaccucuacagg

SEQ ID NO: 1123755 - RNA, 23 nt, Human
cuucagacugcgcacagguugcc

SEQ ID NO: 1123756 - RNA, 21 nt, Human
cuugaaaaccgcuuucccaag

SEQ ID NO: 1123757 - RNA, 18 nt, Human
gaagacauuuucagacaa

SEQ ID NO: 1123758 - RNA, 22 nt, Human
gaccuucucugcccgcagaugg

SEQ ID NO: 1123759 - RNA, 24 nt, Human
gagcaguuggugguucugaaauac

SEQ ID NO: 1123760 - RNA, 18 nt, Human
gauuaccuccuaugaaac

SEQ ID NO: 1123761 - RNA, 19 nt, Human
gcagacacuaguaaaaaca

SEQ ID NO: 1123762 - RNA, 22 nt, Human
gccaacacugaagacacaaaga

SEQ ID NO: 1123763 - RNA, 21 nt, Human
ggcacuucuguagggcuggca

SEQ ID NO: 1123764 - RNA, 26 nt, Human
ggcuaaggccucccaaugcuguuugu

SEQ ID NO: 1123765 - RNA, 23 nt, Human
gggguucaaaauaacuaaagaaa

SEQ ID NO: 1123766 - RNA, 25 nt, Human
gugguucugaaauacaauccucagc

SEQ ID NO: 1123767 - RNA, 22 nt, Human
uaaaacaagccaacacugaaga

SEQ ID NO: 1123768 - RNA, 21 nt, Human
uaaccaguccugauaucauaa

SEQ ID NO: 1123769 - RNA, 22 nt, Human
uaacuaaagaaaugcagcuaca

SEQ ID NO: 1123770 - RNA, 23 nt, Human
uaacuaaagaaaugcagcuacau

SEQ ID NO: 1123771 - RNA, 24 nt, Human
uacagauggaucagcuaaaacaag

SEQ ID NO: 1123772 - RNA, 22 nt, Human
uagagccaugcccacugacccc

SEQ ID NO: 1123773 - RNA, 22 nt, Human
uagcuguggucuuccuaaguac

SEQ ID NO: 1123774 - RNA, 24 nt, Human
uaggaauagagccaugcccacuga

SEQ ID NO: 1123775 - RNA, 24 nt, Human
uagguucauugaaaccaggguaac

SEQ ID NO: 1123776 - RNA, 19 nt, Human
uaguaaaaacaaaggcaca

SEQ ID NO: 1123777 - RNA, 23 nt, Human
ucaaaauaacuaaagaaaugcag

SEQ ID NO: 1123778 - RNA, 18 nt, Human
ucagagacaugccugcaa

SEQ ID NO: 1123779 - RNA, 23 nt, Human
ucagucaguucaagacaaccuga

SEQ ID NO: 1123780 - RNA, 19 nt, Human
ucauucaaaucuucacuug

SEQ ID NO: 1123781 - RNA, 21 nt, Human
ucauugaaaccaggguaacac

SEQ ID NO: 1123782 - RNA, 18 nt, Human
ucccggcaugugcugcac

SEQ ID NO: 1123783 - RNA, 24 nt, Human
uccuggcaaaacguuuaggcugaa

SEQ ID NO: 1123784 - RNA, 25 nt, Human
ucuauaaacaaguccaugucaccac

SEQ ID NO: 1123785 - RNA, 22 nt, Human
ucugaaauacaauccucagcca

SEQ ID NO: 1123786 - RNA, 21 nt, Human
ugaaaccaggguaacaccuuu

SEQ ID NO: 1123787 - RNA, 20 nt, Human
ugaaauacaauccucagcca

SEQ ID NO: 1123788 - RNA, 21 nt, Human
ugaauauaauaauagacacag

SEQ ID NO: 1123789 - RNA, 24 nt, Human
ugacaacaacaaaaagaugaggaa

SEQ ID NO: 1123790 - RNA, 18 nt, Human
ugacaugcugucuccugc

SEQ ID NO: 1123791 - RNA, 24 nt, Human
ugacaugcugucuccugccagcga

SEQ ID NO: 1123792 - RNA, 18 nt, Human
ugagccagacagcugacc

SEQ ID NO: 1123793 - RNA, 23 nt, Human
ugcaacagcagacacuaguaaaa

SEQ ID NO: 1123794 - RNA, 22 nt, Human
ugcaguguuccuggcaaaacgu

SEQ ID NO: 1123795 - RNA, 21 nt, Human
ugcugcacaguuaugugaacg

SEQ ID NO: 1123796 - RNA, 22 nt, Human
uggaaacucacagcauugucuc

SEQ ID NO: 1123797 - RNA, 21 nt, Human
uguagagauaugaauauaaua

SEQ ID NO: 1123798 - RNA, 21 nt, Human
ugucaagagcaguuggugguu

SEQ ID NO: 1123799 - RNA, 18 nt, Human
uucaagacaaccugaagg

SEQ ID NO: 1123800 - RNA, 18 nt, Human
uuuugcaacagcagacac

SEQ ID NO: 1123801 - RNA, 20 nt, Human
uuuuguugugugauuugugg

SEQ ID NO: 1123802 - RNA, 22 nt, Human
aggcucaggcgggcagccgagc

SEQ ID NO: 1123803 - RNA, 19 nt, Human
caccagggccuugcgggcu

SEQ ID NO: 1123804 - RNA, 22 nt, Human
cacccuggaggccaccagggcc

SEQ ID NO: 1123805 - RNA, 26 nt, Human
cacugaguccggguagaucaccuggu

SEQ ID NO: 1123806 - RNA, 19 nt, Human
cagagcuccuggaggugcc

SEQ ID NO: 1123807 - RNA, 24 nt, Human
ccagcugcugcuccagccgcugcu

SEQ ID NO: 1123808 - RNA, 19 nt, Human
cccaggauuuggcagagcu

SEQ ID NO: 1123809 - RNA, 19 nt, Human
cgcccaggauuuggcagag

SEQ ID NO: 1123810 - RNA, 20 nt, Human
gcuccagccgcugcuucucc

SEQ ID NO: 1123811 - RNA, 21 nt, Human
ucaggcucaggcgggcagccg

SEQ ID NO: 1123812 - RNA, 18 nt, Human
uggcagagcuccuggagg

SEQ ID NO: 1123813 - RNA, 18 nt, Human
aaagcaacccucaucccu

SEQ ID NO: 1123814 - RNA, 19 nt, Human
aaagugcugggauuacaga

SEQ ID NO: 1123815 - RNA, 24 nt, Human
aaagugcugggauuacagacguga

SEQ ID NO: 1123816 - RNA, 23 nt, Human
aaauccccuuccccaugccucuc

SEQ ID NO: 1123817 - RNA, 21 nt, Human
aacccccacaccugcccacac

SEQ ID NO: 1123818 - RNA, 20 nt, Human
aacuucuucuucauggcucu

SEQ ID NO: 1123819 - RNA, 20 nt, Human
aagaaguccuccuggaucuu

SEQ ID NO: 1123820 - RNA, 19 nt, Human
aagccacagccaagcuccg

SEQ ID NO: 1123821 - RNA, 18 nt, Human
aagcuccaggccccugcu

SEQ ID NO: 1123822 - RNA, 20 nt, Human
aaggcccuccaccccaccug

SEQ ID NO: 1123823 - RNA, 19 nt, Human
aaguagcugggauuacagg

SEQ ID NO: 1123824 - RNA, 27 nt, Human
aaguagcugggauuacaggcacaaccc

SEQ ID NO: 1123825 - RNA, 19 nt, Human
aagugcugggauuacagac

SEQ ID NO: 1123826 - RNA, 26 nt, Human
aagugcugggauuacagacgugagcc

SEQ ID NO: 1123827 - RNA, 22 nt, Human
aauggauagagggagggaggga

SEQ ID NO: 1123828 - RNA, 24 nt, Human
aauuuugcauuuuuaguagagaca

SEQ ID NO: 1123829 - RNA, 24 nt, Human
acaaauccccuuccccaugccucu

SEQ ID NO: 1123830 - RNA, 18 nt, Human
acagacgugagccaccgc

SEQ ID NO: 1123831 - RNA, 26 nt, Human
acagaggccgacaaugaccagcacca

SEQ ID NO: 1123832 - RNA, 23 nt, Human
acagcccuccucccaaucuccga

SEQ ID NO: 1123833 - RNA, 18 nt, Human
acaggguuucaccauguu

SEQ ID NO: 1123834 - RNA, 23 nt, Human
acaggguuucaccauguuggcca

SEQ ID NO: 1123835 - RNA, 24 nt, Human
acaggguuucaccauguuggccag

SEQ ID NO: 1123836 - RNA, 24 nt, Human
accaacccccacaccugcccacac

SEQ ID NO: 1123837 - RNA, 26 nt, Human
accaccuccuccaagaaguccuccug

SEQ ID NO: 1123838 - RNA, 22 nt, Human
accauguuggccaggcuggucu

SEQ ID NO: 1123839 - RNA, 22 nt, Human
accucagccccccagguucuag

SEQ ID NO: 1123840 - RNA, 23 nt, Human
accucggccucccaaagugcugg

SEQ ID NO: 1123841 - RNA, 21 nt, Human
acgugagccaccgcaccuggc

SEQ ID NO: 1123842 - RNA, 23 nt, Human
acucuguggagugcaguggugca

SEQ ID NO: 1123843 - RNA, 21 nt, Human
agaaagccacagccaagcucc

SEQ ID NO: 1123844 - RNA, 23 nt, Human
agaccuuugugcaggccaugccc

SEQ ID NO: 1123845 - RNA, 22 nt, Human
agcacugcuuggcaucugcagc

SEQ ID NO: 1123846 - RNA, 19 nt, Human
agccaccaccuccuccaag

SEQ ID NO: 1123847 - RNA, 23 nt, Human
agcgccugucacggguggguggc

SEQ ID NO: 1123848 - RNA, 23 nt, Human
aggaaucccuuccucucucugcc

SEQ ID NO: 1123849 - RNA, 26 nt, Human
aggaguccucugaaggcccuccaccc

SEQ ID NO: 1123850 - RNA, 24 nt, Human
aggugauccacccaccucggccuc

SEQ ID NO: 1123851 - RNA, 20 nt, Human
agugcaguggugcaaucucg

SEQ ID NO: 1123852 - RNA, 24 nt, Human
agugcaguggugcaaucucggcuc

SEQ ID NO: 1123853 - RNA, 21 nt, Human
aguggccacugggaccccaug

SEQ ID NO: 1123854 - RNA, 23 nt, Human
aguggcugagccuccacugcuua

SEQ ID NO: 1123855 - RNA, 19 nt, Human
auagagggagggagggagg

SEQ ID NO: 1123856 - RNA, 18 nt, Human
augaaacagugacaaaaa

SEQ ID NO: 1123857 - RNA, 27 nt, Human
caaagcaacccucaucccuuguaaccc

SEQ ID NO: 1123858 - RNA, 24 nt, Human
caaagugcugggauuacagacgug

SEQ ID NO: 1123859 - RNA, 18 nt, Human
caacccccacaccugccc

SEQ ID NO: 1123860 - RNA, 24 nt, Human
caaccucagccccccagguucuag

SEQ ID NO: 1123861 - RNA, 24 nt, Human
caagcuccaggccccugcuccaca

SEQ ID NO: 1123862 - RNA, 26 nt, Human
caccacuaacuucuucuucauggcuc

SEQ ID NO: 1123863 - RNA, 20 nt, Human
caccaggaccacggccagcg

SEQ ID NO: 1123864 - RNA, 21 nt, Human
caccauguuggccaggcuggu

SEQ ID NO: 1123865 - RNA, 23 nt, Human
caccauguuggccaggcuggucu

SEQ ID NO: 1123866 - RNA, 24 nt, Human
caccauguuggccaggcuggucuu

SEQ ID NO: 1123867 - RNA, 27 nt, Human
caccauguuggccaggcuggucuugaa

SEQ ID NO: 1123868 - RNA, 22 nt, Human
cacccaccucggccucccaaag

SEQ ID NO: 1123869 - RNA, 23 nt, Human
cacccaccucggccucccaaagu

SEQ ID NO: 1123870 - RNA, 21 nt, Human
caccccacagauucacugcca

SEQ ID NO: 1123871 - RNA, 24 nt, Human
caccugcccacacaggagaccagc

SEQ ID NO: 1123872 - RNA, 23 nt, Human
cacgcuaaucacccuccuccaug

SEQ ID NO: 1123873 - RNA, 19 nt, Human
cacggccagcaggcccagc

SEQ ID NO: 1123874 - RNA, 19 nt, Human
cacucuguggagugcagug

SEQ ID NO: 1123875 - RNA, 21 nt, Human
cacugcaaccucagcccccca

SEQ ID NO: 1123876 - RNA, 22 nt, Human
cacugcuuagggagaagcucca

SEQ ID NO: 1123877 - RNA, 22 nt, Human
cagacauucccuggcaccuccc

SEQ ID NO: 1123878 - RNA, 19 nt, Human
cagcaccaggaccacggcc

SEQ ID NO: 1123879 - RNA, 21 nt, Human
cagcaggugggguggacuuag

SEQ ID NO: 1123880 - RNA, 21 nt, Human
cagccacggcagcccuggugu

SEQ ID NO: 1123881 - RNA, 19 nt, Human
cagcccagccaccaccucc

SEQ ID NO: 1123882 - RNA, 24 nt, Human
cagcccagccaccaccuccuccaa

SEQ ID NO: 1123883 - RNA, 22 nt, Human
cagccccccagguucuagcgau

SEQ ID NO: 1123884 - RNA, 18 nt, Human
cagcccuccucccaaucu

SEQ ID NO: 1123885 - RNA, 19 nt, Human
cagcccuccucccaaucuc

SEQ ID NO: 1123886 - RNA, 21 nt, Human
cagcccuccucccaaucuccg

SEQ ID NO: 1123887 - RNA, 23 nt, Human
caggaguccucugaaggcccucc

SEQ ID NO: 1123888 - RNA, 23 nt, Human
caggcacaacccaccaugccuga

SEQ ID NO: 1123889 - RNA, 24 nt, Human
caggcacugccaccgacagcccuc

SEQ ID NO: 1123890 - RNA, 18 nt, Human
caggccaugcccucugcc

SEQ ID NO: 1123891 - RNA, 21 nt, Human
cagggccuugccuaccuccuc

SEQ ID NO: 1123892 - RNA, 19 nt, Human
caggguccugaaggcagag

SEQ ID NO: 1123893 - RNA, 24 nt, Human
caggguuucaccauguuggccagg

SEQ ID NO: 1123894 - RNA, 19 nt, Human
cagguucuagcgauucucc

SEQ ID NO: 1123895 - RNA, 25 nt, Human
cagugacaaaaauuaccugaagaaa

SEQ ID NO: 1123896 - RNA, 21 nt, Human
caucuccagcagcggcccuuc

SEQ ID NO: 1123897 - RNA, 22 nt, Human
caucuccagcagcggcccuucc

SEQ ID NO: 1123898 - RNA, 18 nt, Human
caucucugcccucccaaa

SEQ ID NO: 1123899 - RNA, 24 nt, Human
cauguuggccaggcuggucuugaa

SEQ ID NO: 1123900 - RNA, 22 nt, Human
ccaaagugcugggauuacagac

SEQ ID NO: 1123901 - RNA, 24 nt, Human
ccaaagugcugggauuacagacgu

SEQ ID NO: 1123902 - RNA, 19 nt, Human
ccaacccccacaccugccc

SEQ ID NO: 1123903 - RNA, 19 nt, Human
ccaagcuccaggccccugc

SEQ ID NO: 1123904 - RNA, 23 nt, Human
ccaaguagcugggauuacaggca

SEQ ID NO: 1123905 - RNA, 19 nt, Human
ccacacaggagaccagcac

SEQ ID NO: 1123906 - RNA, 21 nt, Human
ccacaccccucuuucugcagg

SEQ ID NO: 1123907 - RNA, 26 nt, Human
ccacaccccucuuucugcagggccuu

SEQ ID NO: 1123908 - RNA, 22 nt, Human
ccacaccugcccacacaggaga

SEQ ID NO: 1123909 - RNA, 21 nt, Human
ccagcaccaggaccacggcca

SEQ ID NO: 1123910 - RNA, 24 nt, Human
ccagcagcagacgggggccccaag

SEQ ID NO: 1123911 - RNA, 19 nt, Human
ccagggcugcugccaagcc

SEQ ID NO: 1123912 - RNA, 22 nt, Human
ccaugcccucugccagaagcuc

SEQ ID NO: 1123913 - RNA, 18 nt, Human
ccaugggguaaggagcag

SEQ ID NO: 1123914 - RNA, 23 nt, Human
cccaaguagcugggauuacaggc

SEQ ID NO: 1123915 - RNA, 24 nt, Human
cccaaguagcugggauuacaggca

SEQ ID NO: 1123916 - RNA, 21 nt, Human
cccacaaucagagcaccccac

SEQ ID NO: 1123917 - RNA, 26 nt, Human
cccacaccugcccacacaggagacca

SEQ ID NO: 1123918 - RNA, 21 nt, Human
cccacagacauaccacaagac

SEQ ID NO: 1123919 - RNA, 27 nt, Human
cccacagacauaccacaagacaggcug

SEQ ID NO: 1123920 - RNA, 21 nt, Human
cccacauguggugggaagggu

SEQ ID NO: 1123921 - RNA, 19 nt, Human
cccagccucagacauuccc

SEQ ID NO: 1123922 - RNA, 21 nt, Human
cccaugcugcuggugugccag

SEQ ID NO: 1123923 - RNA, 24 nt, Human
ccccaccucagccuagagccuggc

SEQ ID NO: 1123924 - RNA, 22 nt, Human
ccccagauuuccacaccccucu

SEQ ID NO: 1123925 - RNA, 21 nt, Human
ccccagguucuagcgauucuc

SEQ ID NO: 1123926 - RNA, 24 nt, Human
ccccagguucuagcgauucuccug

SEQ ID NO: 1123927 - RNA, 23 nt, Human
ccccaugcucagaaugugucccc

SEQ ID NO: 1123928 - RNA, 21 nt, Human
cccccaccucagccuagagcc

SEQ ID NO: 1123929 - RNA, 25 nt, Human
cccccagguucuagcgauucuccug

SEQ ID NO: 1123930 - RNA, 24 nt, Human
ccccccagguucuagcgauucucc

SEQ ID NO: 1123931 - RNA, 21 nt, Human
ccccugcuccacaaauccccu

SEQ ID NO: 1123932 - RNA, 21 nt, Human
cccucuacugggccuuagccc

SEQ ID NO: 1123933 - RNA, 22 nt, Human
cccugcuuaucuucagagccca

SEQ ID NO: 1123934 - RNA, 22 nt, Human
cccuuccccaugccucucucaa

SEQ ID NO: 1123935 - RNA, 24 nt, Human
ccgacagcccuccucccaaucucc

SEQ ID NO: 1123936 - RNA, 18 nt, Human
ccucacaguggcugagcc

SEQ ID NO: 1123937 - RNA, 24 nt, Human
ccuccaugaaacagugacaaaaau

SEQ ID NO: 1123938 - RNA, 18 nt, Human
ccucccaaauccucccug

SEQ ID NO: 1123939 - RNA, 23 nt, Human
ccuccuagugucccuugccacuc

SEQ ID NO: 1123940 - RNA, 24 nt, Human
ccugaccucaggugauccacccac

SEQ ID NO: 1123941 - RNA, 19 nt, Human
ccugccacagccucccaag

SEQ ID NO: 1123942 - RNA, 19 nt, Human
ccuggcucagagggccuuu

SEQ ID NO: 1123943 - RNA, 20 nt, Human
ccuuccccaugccucucuca

SEQ ID NO: 1123944 - RNA, 19 nt, Human
ccuugccacucaggacaca

SEQ ID NO: 1123945 - RNA, 19 nt, Human
ccuugccuaccuccucaca

SEQ ID NO: 1123946 - RNA, 22 nt, Human
cggcagcccugguguacacaug

SEQ ID NO: 1123947 - RNA, 20 nt, Human
cggcucacugcaaccucagc

SEQ ID NO: 1123948 - RNA, 19 nt, Human
cuagaccaacccccacacc

SEQ ID NO: 1123949 - RNA, 27 nt, Human
cuagcgauucuccugccacagccuccc

SEQ ID NO: 1123950 - RNA, 25 nt, Human
cuagugucccuuccgggaaccuccu

SEQ ID NO: 1123951 - RNA, 22 nt, Human
cucacaguggcugagccuccac

SEQ ID NO: 1123952 - RNA, 21 nt, Human
cucacgaugaauggauagagg

SEQ ID NO: 1123953 - RNA, 20 nt, Human
cucacugcaaccucagcccc

SEQ ID NO: 1123954 - RNA, 24 nt, Human
cucacugcaaccucagccccccag

SEQ ID NO: 1123955 - RNA, 18 nt, Human
cucaucucugcccuccca

SEQ ID NO: 1123956 - RNA, 23 nt, Human
cucccugcuuaucuucagagccc

SEQ ID NO: 1123957 - RNA, 19 nt, Human
cuccgagcacugcuuggca

SEQ ID NO: 1123958 - RNA, 22 nt, Human
cucggcucacugcaaccucagc

SEQ ID NO: 1123959 - RNA, 20 nt, Human
cucugaaggcccuccacccc

SEQ ID NO: 1123960 - RNA, 24 nt, Human
cugaaggcccuccaccccaccugg

SEQ ID NO: 1123961 - RNA, 23 nt, Human
cugcaaccucagccccccagguu

SEQ ID NO: 1123962 - RNA, 24 nt, Human
cugcaaccucagccccccagguuc

SEQ ID NO: 1123963 - RNA, 20 nt, Human
cugcagccacggcagcccug

SEQ ID NO: 1123964 - RNA, 18 nt, Human
cugggaccccaugcucag

SEQ ID NO: 1123965 - RNA, 22 nt, Human
cuguuccucugcuaggaauccc

SEQ ID NO: 1123966 - RNA, 20 nt, Human
cuuagcccagcuguuccucu

SEQ ID NO: 1123967 - RNA, 19 nt, Human
cuuccauagugcccacaau

SEQ ID NO: 1123968 - RNA, 21 nt, Human
cuuugugcaggccaugcccuc

SEQ ID NO: 1123969 - RNA, 19 nt, Human
gaaggcccuccaccccacc

SEQ ID NO: 1123970 - RNA, 22 nt, Human
gaaucaaagcccccucuacugg

SEQ ID NO: 1123971 - RNA, 21 nt, Human
gacagcccuccucccaaucuc

SEQ ID NO: 1123972 - RNA, 24 nt, Human
gaccucaggugauccacccaccuc

SEQ ID NO: 1123973 - RNA, 18 nt, Human
gagacagaggccgacaau

SEQ ID NO: 1123974 - RNA, 24 nt, Human
gagcccccagauuuccacaccccu

SEQ ID NO: 1123975 - RNA, 18 nt, Human
gagucagcuccagacaga

SEQ ID NO: 1123976 - RNA, 18 nt, Human
gauuacagacgugagcca

SEQ ID NO: 1123977 - RNA, 23 nt, Human
gauuacagacgugagccaccgca

SEQ ID NO: 1123978 - RNA, 24 nt, Human
gauuacaggcacaacccaccaugc

SEQ ID NO: 1123979 - RNA, 18 nt, Human
gcacugccaccgacagcc

SEQ ID NO: 1123980 - RNA, 19 nt, Human
gcaggcuguccggccccca

SEQ ID NO: 1123981 - RNA, 19 nt, Human
gccaauuuccagccucagu

SEQ ID NO: 1123982 - RNA, 21 nt, Human
gccuagagccuggcacugucc

SEQ ID NO: 1123983 - RNA, 23 nt, Human
gcuccacaaauccccuuccccau

SEQ ID NO: 1123984 - RNA, 18 nt, Human
gcuggaugcugggcugga

SEQ ID NO: 1123985 - RNA, 21 nt, Human
gcugggauuacagacgugagc

SEQ ID NO: 1123986 - RNA, 23 nt, Human
gcuggucuugaacuccugaccuc

SEQ ID NO: 1123987 - RNA, 22 nt, Human
gcuguauucuagcgcuucccua

SEQ ID NO: 1123988 - RNA, 18 nt, Human
gcugugccugcccugccu

SEQ ID NO: 1123989 - RNA, 18 nt, Human
ggaagaggcgagcccagg

SEQ ID NO: 1123990 - RNA, 23 nt, Human
ggaaucccuuccucucucugccu

SEQ ID NO: 1123991 - RNA, 23 nt, Human
ggaggcucuuaauucuccuggag

SEQ ID NO: 1123992 - RNA, 19 nt, Human
ggcacugccaccgacagcc

SEQ ID NO: 1123993 - RNA, 24 nt, Human
ggcuggucuugaacuccugaccuc

SEQ ID NO: 1123994 - RNA, 24 nt, Human
gggcagccgcccaugcugcuggug

SEQ ID NO: 1123995 - RNA, 19 nt, Human
ggguggcccugucacucag

SEQ ID NO: 1123996 - RNA, 22 nt, Human
ggguuucaccauguuggccagg

SEQ ID NO: 1123997 - RNA, 23 nt, Human
gguccugaaggcagagggccgcu

SEQ ID NO: 1123998 - RNA, 19 nt, Human
ggucuugaacuccugaccu

SEQ ID NO: 1123999 - RNA, 18 nt, Human
guagcugggauuacaggc

SEQ ID NO: 1124000 - RNA, 24 nt, Human
gugauccacccaccucggccuccc

SEQ ID NO: 1124001 - RNA, 19 nt, Human
guggcugagccuccacugc

SEQ ID NO: 1124002 - RNA, 22 nt, Human
uacagacgugagccaccgcacc

SEQ ID NO: 1124003 - RNA, 21 nt, Human
uaccugaagaaagccacagcc

SEQ ID NO: 1124004 - RNA, 25 nt, Human
uaccugaagaaagccacagccaagc

SEQ ID NO: 1124005 - RNA, 22 nt, Human
uagagacaggguuucaccaugu

SEQ ID NO: 1124006 - RNA, 20 nt, Human
uagcuagaccaacccccaca

SEQ ID NO: 1124007 - RNA, 18 nt, Human
uagcuuccauagugcccu

SEQ ID NO: 1124008 - RNA, 19 nt, Human
uaggaaucccuuccucucu

SEQ ID NO: 1124009 - RNA, 24 nt, Human
uaguagagacaggguuucaccaug

SEQ ID NO: 1124010 - RNA, 26 nt, Human
uaguagagacaggguuucaccauguu

SEQ ID NO: 1124011 - RNA, 18 nt, Human
ucacugcaaccucagccc

SEQ ID NO: 1124012 - RNA, 21 nt, Human
ucacugcaaccucagcccccc

SEQ ID NO: 1124013 - RNA, 24 nt, Human
ucacugcaaccucagccccccagg

SEQ ID NO: 1124014 - RNA, 19 nt, Human
ucagaauguguccccacau

SEQ ID NO: 1124015 - RNA, 20 nt, Human
ucaggugauccacccaccuc

SEQ ID NO: 1124016 - RNA, 21 nt, Human
ucagguuccuuggaggcugag

SEQ ID NO: 1124017 - RNA, 22 nt, Human
uccagggcugcugccaagcccu

SEQ ID NO: 1124018 - RNA, 21 nt, Human
uccaugaaacagugacaaaaa

SEQ ID NO: 1124019 - RNA, 18 nt, Human
ucccaaagugcugggauu

SEQ ID NO: 1124020 - RNA, 24 nt, Human
ucccaaagugcugggauuacagac

SEQ ID NO: 1124021 - RNA, 24 nt, Human
ucccaaguagcugggauuacaggc

SEQ ID NO: 1124022 - RNA, 27 nt, Human
uccccacauguggugggaagggucugu

SEQ ID NO: 1124023 - RNA, 21 nt, Human
ucccccaccucagccuagagc

SEQ ID NO: 1124024 - RNA, 19 nt, Human
ucccugcuuaucuucagag

SEQ ID NO: 1124025 - RNA, 24 nt, Human
uccuccaagaaguccuccuggauc

SEQ ID NO: 1124026 - RNA, 20 nt, Human
uccuuggaggcugagggcag

SEQ ID NO: 1124027 - RNA, 18 nt, Human
ucggccucccaaagugcu

SEQ ID NO: 1124028 - RNA, 19 nt, Human
ucuacugggccuuagccca

SEQ ID NO: 1124029 - RNA, 23 nt, Human
ucuagcgcuucccuagcccuggc

SEQ ID NO: 1124030 - RNA, 26 nt, Human
ucugcagccacggcagcccuggugua

SEQ ID NO: 1124031 - RNA, 27 nt, Human
ucugcagccacggcagcccugguugac

SEQ ID NO: 1124032 - RNA, 19 nt, Human
ucuucauggcucugcugcu

SEQ ID NO: 1124033 - RNA, 20 nt, Human
ucuucuucauggcucugcug

SEQ ID NO: 1124034 - RNA, 23 nt, Human
ucuugaacuccugaccucaggug

SEQ ID NO: 1124035 - RNA, 20 nt, Human
ugaaggcagagggccgcucc

SEQ ID NO: 1124036 - RNA, 21 nt, Human
ugaaggcccuccaccccaccu

SEQ ID NO: 1124037 - RNA, 21 nt, Human
ugaccucaggugauccaccca

SEQ ID NO: 1124038 - RNA, 24 nt, Human
ugaccucaggugauccacccaccu

SEQ ID NO: 1124039 - RNA, 23 nt, Human
ugaggcagcaggugggguggacu

SEQ ID NO: 1124040 - RNA, 24 nt, Human
ugauccacccaccucggccuccca

SEQ ID NO: 1124041 - RNA, 20 nt, Human
ugcaagguccuugggcugug

SEQ ID NO: 1124042 - RNA, 22 nt, Human
ugcaguggugcaaucucggcuc

SEQ ID NO: 1124043 - RNA, 24 nt, Human
ugccacagccucccaaguagcugg

SEQ ID NO: 1124044 - RNA, 20 nt, Human
ugccugcccugccuguguca

SEQ ID NO: 1124045 - RNA, 24 nt, Human
ugcugggauuacagacgugagcca

SEQ ID NO: 1124046 - RNA, 24 nt, Human
ugcuuagggagaagcuccaguagg

SEQ ID NO: 1124047 - RNA, 22 nt, Human
uggacuuagcuagaccaacccc

SEQ ID NO: 1124048 - RNA, 19 nt, Human
uggagcaugggguuuagcu

SEQ ID NO: 1124049 - RNA, 23 nt, Human
uggagugcaguggugcaaucucg

SEQ ID NO: 1124050 - RNA, 24 nt, Human
uggagugcaguggugcaaucucgg

SEQ ID NO: 1124051 - RNA, 25 nt, Human
uggcaucugcagccacggcagcccu

SEQ ID NO: 1124052 - RNA, 24 nt, Human
uggccaggcuggucuugaacuccu

SEQ ID NO: 1124053 - RNA, 19 nt, Human
uggcugagccuccacugcu

SEQ ID NO: 1124054 - RNA, 18 nt, Human
ugggauuacagacgugag

SEQ ID NO: 1124055 - RNA, 19 nt, Human
ugggauuacagacgugagc

SEQ ID NO: 1124056 - RNA, 21 nt, Human
ugggauuacagacgugagcca

SEQ ID NO: 1124057 - RNA, 22 nt, Human
ugggauuacagacgugagccac

SEQ ID NO: 1124058 - RNA, 23 nt, Human
ugggauuacagacgugagccacc

SEQ ID NO: 1124059 - RNA, 24 nt, Human
ugggauuacagacgugagccaccg

SEQ ID NO: 1124060 - RNA, 22 nt, Human
ugggauuacaggcacaacccac

SEQ ID NO: 1124061 - RNA, 24 nt, Human
ugggauuacaggcacaacccacca

SEQ ID NO: 1124062 - RNA, 25 nt, Human
ugggauuacaggcacaacccaccau

SEQ ID NO: 1124063 - RNA, 24 nt, Human
ugggccuuagcccagcuguuccuu

SEQ ID NO: 1124064 - RNA, 21 nt, Human
uggguggcccugucacucagc

SEQ ID NO: 1124065 - RNA, 23 nt, Human
ugguuucuccugugucccccacc

SEQ ID NO: 1124066 - RNA, 24 nt, Human
uuaguagagacaggguuucaccau

SEQ ID NO: 1124067 - RNA, 23 nt, Human
uuccagccucagugguaaagguu

SEQ ID NO: 1124068 - RNA, 18 nt, Human
uucccuggcaccucccca

SEQ ID NO: 1124069 - RNA, 21 nt, Human
uucccuggcaccuccccagca

SEQ ID NO: 1124070 - RNA, 19 nt, Human
uuccuuggaggcugagggc

SEQ ID NO: 1124071 - RNA, 21 nt, Human
uuccuuggaggcugagggcag

SEQ ID NO: 1124072 - RNA, 21 nt, Human
uucuagcgauucuccugccac

SEQ ID NO: 1124073 - RNA, 21 nt, Human
uucuccuggagucagcuccag

SEQ ID NO: 1124074 - RNA, 24 nt, Human
uuucaccauguuggccaggcuggu

SEQ ID NO: 1124075 - RNA, 19 nt, Human
uuuugcauuuuuaguagag

SEQ ID NO: 1124076 - RNA, 20 nt, Human
uuuugcauuuuuaguagaga

SEQ ID NO: 1124077 - RNA, 24 nt, Human
uuuuuaguagagacaggguuucac

SEQ ID NO: 1124078 - RNA, 20 nt, Human
acaggccccccgacacaugc

SEQ ID NO: 1124079 - RNA, 26 nt, Human
accuguccccccacuggaccccucca

SEQ ID NO: 1124080 - RNA, 20 nt, Human
aggaccuguccccccacugg

SEQ ID NO: 1124081 - RNA, 19 nt, Human
aggcugaacaggccccccg

SEQ ID NO: 1124082 - RNA, 21 nt, Human
agggcuuguggacguaccaga

SEQ ID NO: 1124083 - RNA, 21 nt, Human
caccagcagguuggagguccu

SEQ ID NO: 1124084 - RNA, 22 nt, Human
cagaaaccuccucugccagcuu

SEQ ID NO: 1124085 - RNA, 24 nt, Human
caggccccccgacacaugccucuc

SEQ ID NO: 1124086 - RNA, 22 nt, Human
ccacuggaccccuccaucccgg

SEQ ID NO: 1124087 - RNA, 22 nt, Human
ccccuccaucccgggugaaggu

SEQ ID NO: 1124088 - RNA, 19 nt, Human
ccuccacguaaguaccgua

SEQ ID NO: 1124089 - RNA, 21 nt, Human
cgcccagaaaccuccucugcc

SEQ ID NO: 1124090 - RNA, 18 nt, Human
cucagcagccacuacucc

SEQ ID NO: 1124091 - RNA, 22 nt, Human
cucucaggcccuccuccuccac

SEQ ID NO: 1124092 - RNA, 18 nt, Human
cugaugcuuaggcagacg

SEQ ID NO: 1124093 - RNA, 22 nt, Human
cugcagcacccugaucaccagc

SEQ ID NO: 1124094 - RNA, 21 nt, Human
cugcagcuuugucacuggcug

SEQ ID NO: 1124095 - RNA, 23 nt, Human
gaccuguccccccacuggacccc

SEQ ID NO: 1124096 - RNA, 18 nt, Human
gagguccucuccgccagu

SEQ ID NO: 1124097 - RNA, 19 nt, Human
gcagcuuugucacuggcug

SEQ ID NO: 1124098 - RNA, 25 nt, Human
gcccagaaaccuccucugccagcuu

SEQ ID NO: 1124099 - RNA, 22 nt, Human
gcucucaggcccuccuccucca

SEQ ID NO: 1124100 - RNA, 29 nt, Human
guugcaguucuuccgccacagcucugauc

SEQ ID NO: 1124101 - RNA, 23 nt, Human
ucaccaagucauggaacuccacu

SEQ ID NO: 1124102 - RNA, 21 nt, Human
ucacuggcugcagcacccuga

SEQ ID NO: 1124103 - RNA, 19 nt, Human
ucggaagcuggaggaccug

SEQ ID NO: 1124104 - RNA, 21 nt, Human
ucucaaacuggagccuggcuc

SEQ ID NO: 1124105 - RNA, 18 nt, Human
ugaacggugaccugccgc

SEQ ID NO: 1124106 - RNA, 21 nt, Human
uggguggucuucaggauaagu

SEQ ID NO: 1124107 - RNA, 21 nt, Human
uucacagugacuucugugccc

SEQ ID NO: 1124108 - RNA, 21 nt, Human
uucuuccgccacagcucugcc

SEQ ID NO: 1124109 - RNA, 18 nt, Human
uuggagguccucuccgcc

SEQ ID NO: 1124110 - RNA, 22 nt, Human
acaguuuucuucuuggaacugu

SEQ ID NO: 1124111 - RNA, 18 nt, Human
accaaugucugcuacauu

SEQ ID NO: 1124112 - RNA, 23 nt, Human
aggucaaagccagcaacuaagga

SEQ ID NO: 1124113 - RNA, 18 nt, Human
auaagucuuggguggguu

SEQ ID NO: 1124114 - RNA, 24 nt, Human
caacauaaaaggucaaagccagca

SEQ ID NO: 1124115 - RNA, 20 nt, Human
cacaccauccuggguauaag

SEQ ID NO: 1124116 - RNA, 18 nt, Human
caggaagcugccuggguu

SEQ ID NO: 1124117 - RNA, 18 nt, Human
cauaaaaggucaaagcca

SEQ ID NO: 1124118 - RNA, 23 nt, Human
cauccaucuaucacauugucuuc

SEQ ID NO: 1124119 - RNA, 22 nt, Human
ccauccuggguauaagucuugg

SEQ ID NO: 1124120 - RNA, 27 nt, Human
uaaaaggucaaagccagcaacuaagga

SEQ ID NO: 1124121 - RNA, 19 nt, Human
uagacgcaggcauauaggg

SEQ ID NO: 1124122 - RNA, 23 nt, Human
uauggcaguugagaaaauagaug

SEQ ID NO: 1124123 - RNA, 19 nt, Human
ucaaagccagcaacuaagg

SEQ ID NO: 1124124 - RNA, 24 nt, Human
ucuguaacugagucaucccugauu

SEQ ID NO: 1124125 - RNA, 20 nt, Human
ugcagaauaagaucuucuuc

SEQ ID NO: 1124126 - RNA, 18 nt, Human
ugccaggaagcugccugg

SEQ ID NO: 1124127 - RNA, 20 nt, Human
ugccaggaagcugccugggu

SEQ ID NO: 1124128 - RNA, 21 nt, Human
ugcuacauuuuccacuucuuc

SEQ ID NO: 1124129 - RNA, 24 nt, Human
uggcacugccaggaagcugccugg

SEQ ID NO: 1124130 - RNA, 19 nt, Human
ugucuggaggugucugaag

SEQ ID NO: 1124131 - RNA, 21 nt, Human
uuaaaaauuucccgaccuccu

SEQ ID NO: 1124132 - RNA, 23 nt, Human
uuaaaaauuucccgaccuccuga

SEQ ID NO: 1124133 - RNA, 20 nt, Human
uuauaaucuucaauuucagu

SEQ ID NO: 1124134 - RNA, 23 nt, Human
uuauggguacuccaagccuccua

SEQ ID NO: 1124135 - RNA, 19 nt, Human
uucauugcagaauaagauc

SEQ ID NO: 1124136 - RNA, 19 nt, Human
uucuuggaacuguaacugu

SEQ ID NO: 1124137 - RNA, 19 nt, Human
uugugcuacaagugaagau

SEQ ID NO: 1124138 - RNA, 22 nt, Human
uuuaaaaauuucccgaccuccu

SEQ ID NO: 1124139 - RNA, 22 nt, Human
uuugguuuugacaguuuucuuc

SEQ ID NO: 1124140 - RNA, 21 nt, Human
uugguggcggcuccacugcag

SEQ ID NO: 1124141 - RNA, 19 nt, Human
cagggaaaugcuuuuucca

SEQ ID NO: 1124142 - RNA, 20 nt, Human
cuucuuaaauucaucaggga

SEQ ID NO: 1124143 - RNA, 19 nt, Human
aacccuugacccucucccu

SEQ ID NO: 1124144 - RNA, 26 nt, Human
aaccugucacccaaauagugaacaca

SEQ ID NO: 1124145 - RNA, 19 nt, Human
aagaagccugucuguauca

SEQ ID NO: 1124146 - RNA, 21 nt, Human
aagcagagaugaaaagcagag

SEQ ID NO: 1124147 - RNA, 21 nt, Human
aagccagaaauaaaauucagg

SEQ ID NO: 1124148 - RNA, 23 nt, Human
aauaagcagagaugaaaagcaga

SEQ ID NO: 1124149 - RNA, 20 nt, Human
aaucaggaucacccaaauuc

SEQ ID NO: 1124150 - RNA, 19 nt, Human
aaucuauagacaauaaccu

SEQ ID NO: 1124151 - RNA, 19 nt, Human
acagugucucucauaugcc

SEQ ID NO: 1124152 - RNA, 24 nt, Human
acccaaauagugaacacaguaccc

SEQ ID NO: 1124153 - RNA, 21 nt, Human
acccaaauucaaaaugacacc

SEQ ID NO: 1124154 - RNA, 19 nt, Human
acccaacacucucugaccc

SEQ ID NO: 1124155 - RNA, 20 nt, Human
agagaugaaaagcagagaga

SEQ ID NO: 1124156 - RNA, 22 nt, Human
aggaagauuuaaauuuaagcug

SEQ ID NO: 1124157 - RNA, 18 nt, Human
agguacgagccagggacc

SEQ ID NO: 1124158 - RNA, 19 nt, Human
agguagguaggcaaacaag

SEQ ID NO: 1124159 - RNA, 20 nt, Human
agugggaacaugcaguauuu

SEQ ID NO: 1124160 - RNA, 23 nt, Human
auccccucuucauugagaaaggc

SEQ ID NO: 1124161 - RNA, 18 nt, Human
cacaaacagaaauaagca

SEQ ID NO: 1124162 - RNA, 19 nt, Human
caccagaaaaagaggccca

SEQ ID NO: 1124163 - RNA, 22 nt, Human
caccagaaaaagaggcccaaug

SEQ ID NO: 1124164 - RNA, 21 nt, Human
cacugucauacuuugcaaaga

SEQ ID NO: 1124165 - RNA, 22 nt, Human
cagauaucauucaguacuuucc

SEQ ID NO: 1124166 - RNA, 21 nt, Human
caggagggacauguacagguu

SEQ ID NO: 1124167 - RNA, 24 nt, Human
caggaucacccaaauucaaaauga

SEQ ID NO: 1124168 - RNA, 20 nt, Human
ccaaucaaaucacaauucca

SEQ ID NO: 1124169 - RNA, 20 nt, Human
cccaacacucucugacccuu

SEQ ID NO: 1124170 - RNA, 20 nt, Human
cccacaugggccagucagaa

SEQ ID NO: 1124171 - RNA, 19 nt, Human
cccccuuaccucagugucc

SEQ ID NO: 1124172 - RNA, 22 nt, Human
cccuccccucuuuuaguguccc

SEQ ID NO: 1124173 - RNA, 19 nt, Human
cccucucccuccccucuuu

SEQ ID NO: 1124174 - RNA, 18 nt, Human
ccugcauaauugcaaagu

SEQ ID NO: 1124175 - RNA, 24 nt, Human
ccuguacuagguacuugacagaag

SEQ ID NO: 1124176 - RNA, 23 nt, Human
cgucaagauuuacagaaaacuga

SEQ ID NO: 1124177 - RNA, 19 nt, Human
cucauaugccuauauaacc

SEQ ID NO: 1124178 - RNA, 21 nt, Human
cucccccuuaccucagugucc

SEQ ID NO: 1124179 - RNA, 22 nt, Human
cucuuccuccuucauuacacug

SEQ ID NO: 1124180 - RNA, 23 nt, Human
cuuaagaccuucaacugauuaac

SEQ ID NO: 1124181 - RNA, 21 nt, Human
cuucucuuucuuuccuauuuu

SEQ ID NO: 1124182 - RNA, 22 nt, Human
cuucucuuucuuuccuauuuuu

SEQ ID NO: 1124183 - RNA, 23 nt, Human
cuuuccagguagguaggcaaaca

SEQ ID NO: 1124184 - RNA, 25 nt, Human
gaagaagccugucuguaucaccaga

SEQ ID NO: 1124185 - RNA, 28 nt, Human
gaucacccaaauucaaaaugacacccaa

SEQ ID NO: 1124186 - RNA, 18 nt, Human
gcagagaugaaaagcaga

SEQ ID NO: 1124187 - RNA, 19 nt, Human
gcagagaugaaaagcagag

SEQ ID NO: 1124188 - RNA, 23 nt, Human
gucuguaucaccagaaaaagagg

SEQ ID NO: 1124189 - RNA, 23 nt, Human
guguccugucacagguacgagcc

SEQ ID NO: 1124190 - RNA, 23 nt, Human
guuguuucuucucccuagaagcu

SEQ ID NO: 1124191 - RNA, 21 nt, Human
uaaaaucaggaucacccaaau

SEQ ID NO: 1124192 - RNA, 22 nt, Human
uaacaauaauagcaaagauuua

SEQ ID NO: 1124193 - RNA, 19 nt, Human
uaacacaaacagaaauaag

SEQ ID NO: 1124194 - RNA, 23 nt, Human
uaacacaaacagaaauaagcaga

SEQ ID NO: 1124195 - RNA, 22 nt, Human
uaacuucuugugagacaguguc

SEQ ID NO: 1124196 - RNA, 19 nt, Human
uaagaccuucaacugauua

SEQ ID NO: 1124197 - RNA, 18 nt, Human
uaagcagagaugaaaagc

SEQ ID NO: 1124198 - RNA, 21 nt, Human
uaagcugcuuaauagccaucu

SEQ ID NO: 1124199 - RNA, 23 nt, Human
uaagugggaacaugcaguauuug

SEQ ID NO: 1124200 - RNA, 20 nt, Human
uacagaaaacugaaagauua

SEQ ID NO: 1124201 - RNA, 23 nt, Human
uagauaaugcuauauacaaagca

SEQ ID NO: 1124202 - RNA, 18 nt, Human
uagcaaagauuuagauaa

SEQ ID NO: 1124203 - RNA, 22 nt, Human
uauaaaaucaggaucacccaaa

SEQ ID NO: 1124204 - RNA, 20 nt, Human
uauaaccaagguaucuacuc

SEQ ID NO: 1124205 - RNA, 25 nt, Human
uauaguaacaguaugagguagguac

SEQ ID NO: 1124206 - RNA, 23 nt, Human
uaucugccaagcacuaauuuaau

SEQ ID NO: 1124207 - RNA, 23 nt, Human
ucacacauguuguuucuucuccc

SEQ ID NO: 1124208 - RNA, 18 nt, Human
ucacagguacgagccagg

SEQ ID NO: 1124209 - RNA, 18 nt, Human
ucagaauccuccauguga

SEQ ID NO: 1124210 - RNA, 19 nt, Human
ucaggccagaguuguccau

SEQ ID NO: 1124211 - RNA, 21 nt, Human
ucauaugccuauauaaccaag

SEQ ID NO: 1124212 - RNA, 18 nt, Human
ucccaagucguauggaag

SEQ ID NO: 1124213 - RNA, 21 nt, Human
ucccauguuacagauaagggu

SEQ ID NO: 1124214 - RNA, 23 nt, Human
uccccagugucuguuguucccau

SEQ ID NO: 1124215 - RNA, 19 nt, Human
uccuuagaacaugagcaca

SEQ ID NO: 1124216 - RNA, 18 nt, Human
ucucauagcagcugcucu

SEQ ID NO: 1124217 - RNA, 18 nt, Human
ucugucucuuccuccuuc

SEQ ID NO: 1124218 - RNA, 21 nt, Human
ugaaaagcagagagacaucuc

SEQ ID NO: 1124219 - RNA, 22 nt, Human
ugaaaagcagagagacaucucu

SEQ ID NO: 1124220 - RNA, 22 nt, Human
ugaauaaacagcucaaucaaaa

SEQ ID NO: 1124221 - RNA, 22 nt, Human
ugagaaaggccucccccuuacc

SEQ ID NO: 1124222 - RNA, 25 nt, Human
ugagaaugaauaaacagcucaauca

SEQ ID NO: 1124223 - RNA, 22 nt, Human
ugaggagcuaagauugaauaug

SEQ ID NO: 1124224 - RNA, 25 nt, Human
ugccugucuaucugucucuuccucc

SEQ ID NO: 1124225 - RNA, 19 nt, Human
uggaagaagccugucugua

SEQ ID NO: 1124226 - RNA, 19 nt, Human
uguccaugcuucaagcaac

SEQ ID NO: 1124227 - RNA, 23 nt, Human
uuaaauaacaauaauagcaaaga

SEQ ID NO: 1124228 - RNA, 24 nt, Human
uucagguucugccugucuaacucu

SEQ ID NO: 1124229 - RNA, 23 nt, Human
uugguaagaggcaaagccagaaa

SEQ ID NO: 1124230 - RNA, 20 nt, Human
acccaggggagcccccagca

SEQ ID NO: 1124231 - RNA, 23 nt, Human
acuggcugcacugggaugccugg

SEQ ID NO: 1124232 - RNA, 18 nt, Human
acugggggcccagcuggg

SEQ ID NO: 1124233 - RNA, 19 nt, Human
agcaguaccgaugguagca

SEQ ID NO: 1124234 - RNA, 24 nt, Human
agcggcgcggcccggcggagcccc

SEQ ID NO: 1124235 - RNA, 19 nt, Human
aggaacagaggaagcagcc

SEQ ID NO: 1124236 - RNA, 20 nt, Human
caacaaagaggaucacagcu

SEQ ID NO: 1124237 - RNA, 25 nt, Human
caacaggaacagaggaagcagcaga

SEQ ID NO: 1124238 - RNA, 21 nt, Human
cagagcgauugcggugagcgg

SEQ ID NO: 1124239 - RNA, 19 nt, Human
cagcaacaaagaggaucac

SEQ ID NO: 1124240 - RNA, 23 nt, Human
cagcagaaggugaagaacucgca

SEQ ID NO: 1124241 - RNA, 18 nt, Human
cagcuuugggguccuggg

SEQ ID NO: 1124242 - RNA, 25 nt, Human
caggucccgcagcagaaggugaaga

SEQ ID NO: 1124243 - RNA, 19 nt, Human
ccacagcaacaaagaggau

SEQ ID NO: 1124244 - RNA, 20 nt, Human
ccagagaagggaccgcagga

SEQ ID NO: 1124245 - RNA, 24 nt, Human
ccagcaccaacagagcgauugcgg

SEQ ID NO: 1124246 - RNA, 20 nt, Human
ccccagcaccaacagagcga

SEQ ID NO: 1124247 - RNA, 19 nt, Human
ccccauccccuuacccagg

SEQ ID NO: 1124248 - RNA, 19 nt, Human
cccccagcaccaacagagc

SEQ ID NO: 1124249 - RNA, 22 nt, Human
cccgcagcagaaggugaagaac

SEQ ID NO: 1124250 - RNA, 19 nt, Human
cccugcagcaguaccgaug

SEQ ID NO: 1124251 - RNA, 18 nt, Human
ccgaugguagcagguccc

SEQ ID NO: 1124252 - RNA, 19 nt, Human
ccugcagcaguaccgaugg

SEQ ID NO: 1124253 - RNA, 22 nt, Human
cgcagcagaaggugaagaacuc

SEQ ID NO: 1124254 - RNA, 20 nt, Human
cucuccccauccccuuaccc

SEQ ID NO: 1124255 - RNA, 21 nt, Human
gagcggcgcggcccggcggag

SEQ ID NO: 1124256 - RNA, 25 nt, Human
gaggagcugcaggguuguagacugg

SEQ ID NO: 1124257 - RNA, 21 nt, Human
gcagcagaaggugaagaacuc

SEQ ID NO: 1124258 - RNA, 24 nt, Human
gccuucaaaugggcucuggagcug

SEQ ID NO: 1124259 - RNA, 19 nt, Human
ggagcaggaccacuaggug

SEQ ID NO: 1124260 - RNA, 19 nt, Human
ggcccagggcuuggcuugg

SEQ ID NO: 1124261 - RNA, 18 nt, Human
ggcugugggggugcaggg

SEQ ID NO: 1124262 - RNA, 21 nt, Human
ggcuuggcuuggucuggggcc

SEQ ID NO: 1124263 - RNA, 19 nt, Human
ggcuuggucuggggccugg

SEQ ID NO: 1124264 - RNA, 18 nt, Human
gggcccagcuggguagag

SEQ ID NO: 1124265 - RNA, 20 nt, Human
gggcugaaggccaggcagug

SEQ ID NO: 1124266 - RNA, 21 nt, Human
gggcugggcgcggccgggguc

SEQ ID NO: 1124267 - RNA, 22 nt, Human
gggcugggcgcggccggggucg

SEQ ID NO: 1124268 - RNA, 20 nt, Human
ggggcugggcgcggccgggg

SEQ ID NO: 1124269 - RNA, 22 nt, Human
uagacugggggcccagcugggu

SEQ ID NO: 1124270 - RNA, 25 nt, Human
ucuccccauccccuuacccagggga

SEQ ID NO: 1124271 - RNA, 20 nt, Human
ugcggugagcggcgcggccc

SEQ ID NO: 1124272 - RNA, 20 nt, Human
uggcuuggucuggggccugg

SEQ ID NO: 1124273 - RNA, 22 nt, Human
uggggagcaggaccacuaggug

SEQ ID NO: 1124274 - RNA, 21 nt, Human
ugggguccuggggguaugggu

SEQ ID NO: 1124275 - RNA, 23 nt, Human
ugguagcaggucccgcagcagaa

SEQ ID NO: 1124276 - RNA, 23 nt, Human
ugguggcaaccacagcaacaaag

SEQ ID NO: 1124277 - RNA, 22 nt, Human
ugucauuggaaucuccuggccu

SEQ ID NO: 1124278 - RNA, 23 nt, Human
aaccagugccauugcaguuacaa

SEQ ID NO: 1124279 - RNA, 19 nt, Human
aagaaagagaaagaucuga

SEQ ID NO: 1124280 - RNA, 26 nt, Human
aagaaagagaaagaucugaaaaaugc

SEQ ID NO: 1124281 - RNA, 21 nt, Human
aagagaagcaaguagaaucug

SEQ ID NO: 1124282 - RNA, 18 nt, Human
aagcagagauuugaaucc

SEQ ID NO: 1124283 - RNA, 21 nt, Human
aauaauaugaagaguagguac

SEQ ID NO: 1124284 - RNA, 23 nt, Human
acagaaacacgucugccucuuuu

SEQ ID NO: 1124285 - RNA, 24 nt, Human
acaggccaaaggcggcguguguug

SEQ ID NO: 1124286 - RNA, 20 nt, Human
acaguaauuuagugcuugcu

SEQ ID NO: 1124287 - RNA, 21 nt, Human
accugcaaaagacugaaauag

SEQ ID NO: 1124288 - RNA, 19 nt, Human
acucacgcugggcccagcc

SEQ ID NO: 1124289 - RNA, 19 nt, Human
acuccugauaucucaauau

SEQ ID NO: 1124290 - RNA, 21 nt, Human
agaaaaggagauuacaaacgu

SEQ ID NO: 1124291 - RNA, 19 nt, Human
agaaagagaaagaucugaa

SEQ ID NO: 1124292 - RNA, 19 nt, Human
agaagagaagcaaguagaa

SEQ ID NO: 1124293 - RNA, 22 nt, Human
agaagcaaauuuagccacaauc

SEQ ID NO: 1124294 - RNA, 24 nt, Human
agcuagaagcaaauuuagccacaa

SEQ ID NO: 1124295 - RNA, 20 nt, Human
aggccaaaggcggcgugugu

SEQ ID NO: 1124296 - RNA, 20 nt, Human
aggguaguugaaaaccagug

SEQ ID NO: 1124297 - RNA, 21 nt, Human
agugguaauaaugaauauuua

SEQ ID NO: 1124298 - RNA, 18 nt, Human
auaacguggagaagagaa

SEQ ID NO: 1124299 - RNA, 22 nt, Human
auauacauagaaacuauguaug

SEQ ID NO: 1124300 - RNA, 18 nt, Human
augguagcauucuuaggu

SEQ ID NO: 1124301 - RNA, 24 nt, Human
caaauacgcaauucuacaucaaau

SEQ ID NO: 1124302 - RNA, 23 nt, Human
caagaaauaaguacaauagccaa

SEQ ID NO: 1124303 - RNA, 18 nt, Human
cacaaaaccuaaugugcu

SEQ ID NO: 1124304 - RNA, 21 nt, Human
cacagcuucauuguugccccu

SEQ ID NO: 1124305 - RNA, 20 nt, Human
caccaugcugguaccaagcu

SEQ ID NO: 1124306 - RNA, 19 nt, Human
cacugugcuacuccguuua

SEQ ID NO: 1124307 - RNA, 20 nt, Human
cagcagcgccgugggguggu

SEQ ID NO: 1124308 - RNA, 18 nt, Human
caggggaauguaggaagc

SEQ ID NO: 1124309 - RNA, 22 nt, Human
cagugccauugcaguuacaaaa

SEQ ID NO: 1124310 - RNA, 24 nt, Human
caugcauauaaaaauuuauccccu

SEQ ID NO: 1124311 - RNA, 20 nt, Human
ccacgcgcgggcucccgccu

SEQ ID NO: 1124312 - RNA, 19 nt, Human
ccagggggaggacagcggg

SEQ ID NO: 1124313 - RNA, 21 nt, Human
cccagaaugaagacacaaaac

SEQ ID NO: 1124314 - RNA, 18 nt, Human
ccuacauagacauggccu

SEQ ID NO: 1124315 - RNA, 21 nt, Human
cgcgggcucccgccggggagc

SEQ ID NO: 1124316 - RNA, 21 nt, Human
cuaauaacguggagaagagaa

SEQ ID NO: 1124317 - RNA, 20 nt, Human
cucaaauauccucucuuguu

SEQ ID NO: 1124318 - RNA, 18 nt, Human
cucacgcugggcccagcc

SEQ ID NO: 1124319 - RNA, 21 nt, Human
cugguuagaauugcuuccuug

SEQ ID NO: 1124320 - RNA, 26 nt, Human
cuuacugcugaauccaaaagguuuuc

SEQ ID NO: 1124321 - RNA, 19 nt, Human
cuugcucuuucccacacuu

SEQ ID NO: 1124322 - RNA, 23 nt, Human
gaacauuaaauuugucagaaaug

SEQ ID NO: 1124323 - RNA, 21 nt, Human
gcaaaagacugaaauagcuca

SEQ ID NO: 1124324 - RNA, 18 nt, Human
gcuucgcugaaaaagcaa

SEQ ID NO: 1124325 - RNA, 20 nt, Human
ggugacuaauugcccccgua

SEQ ID NO: 1124326 - RNA, 19 nt, Human
gucugcugccgugcugucc

SEQ ID NO: 1124327 - RNA, 23 nt, Human
gugggguggugacuaauugcccc

SEQ ID NO: 1124328 - RNA, 19 nt, Human
gugguaauaaugaauauuu

SEQ ID NO: 1124329 - RNA, 21 nt, Human
uaaauaugugcuuaguuuucc

SEQ ID NO: 1124330 - RNA, 19 nt, Human
uaaaucaagaaaaaaguga

SEQ ID NO: 1124331 - RNA, 19 nt, Human
uaaggauacuaaacuccug

SEQ ID NO: 1124332 - RNA, 18 nt, Human
uacauagacauggccuuu

SEQ ID NO: 1124333 - RNA, 21 nt, Human
uaccaaaauuauaaccauuaa

SEQ ID NO: 1124334 - RNA, 18 nt, Human
uaccaagcucaucaacau

SEQ ID NO: 1124335 - RNA, 19 nt, Human
uaccagguggagaaaacua

SEQ ID NO: 1124336 - RNA, 21 nt, Human
uacuaaacuccugaugaagcu

SEQ ID NO: 1124337 - RNA, 22 nt, Human
uagcaaguuuguuuugcuaugu

SEQ ID NO: 1124338 - RNA, 25 nt, Human
uauuccaacauacaaacauguuuau

SEQ ID NO: 1124339 - RNA, 19 nt, Human
ucaagcaggaacauauaac

SEQ ID NO: 1124340 - RNA, 18 nt, Human
ucaauaucuacuuacaaa

SEQ ID NO: 1124341 - RNA, 23 nt, Human
ucacaaccuuucauucuagguuu

SEQ ID NO: 1124342 - RNA, 24 nt, Human
ucacaaccuuucauucuagguuuc

SEQ ID NO: 1124343 - RNA, 25 nt, Human
ucacaaccuuucauucuagguuucu

SEQ ID NO: 1124344 - RNA, 24 nt, Human
ucacccacagcuucauuguugccc

SEQ ID NO: 1124345 - RNA, 21 nt, Human
uccagggggaggacagcgggc

SEQ ID NO: 1124346 - RNA, 18 nt, Human
uccccgacaaaaaaaguc

SEQ ID NO: 1124347 - RNA, 22 nt, Human
uccuggguucuuucacaaccuu

SEQ ID NO: 1124348 - RNA, 27 nt, Human
ucucuaggacuccaacauacaggccaa

SEQ ID NO: 1124349 - RNA, 19 nt, Human
ucucuguuuucauucaauc

SEQ ID NO: 1124350 - RNA, 21 nt, Human
ugaagaagcacuguuuuucac

SEQ ID NO: 1124351 - RNA, 21 nt, Human
ugaagaguagguacccagaau

SEQ ID NO: 1124352 - RNA, 20 nt, Human
ugcaguuacaaauacgcaau

SEQ ID NO: 1124353 - RNA, 21 nt, Human
ugccgugcuguccucagcagc

SEQ ID NO: 1124354 - RNA, 24 nt, Human
uggcaauuuuuuucuuaaggaaag

SEQ ID NO: 1124355 - RNA, 21 nt, Human
uguaugaacacaaacacaggg

SEQ ID NO: 1124356 - RNA, 22 nt, Human
ugucauuccguguuuuuccuca

SEQ ID NO: 1124357 - RNA, 21 nt, Human
ugucuggagagcagugcaaag

SEQ ID NO: 1124358 - RNA, 23 nt, Human
uucacucuuuacuagcccacacu

SEQ ID NO: 1124359 - RNA, 22 nt, Human
uuccaacauacaaacauguuua

SEQ ID NO: 1124360 - RNA, 25 nt, Human
uuccccgacaaaaaaaguccucugg

SEQ ID NO: 1124361 - RNA, 22 nt, Human
uugaagaagcacuguucugugg

SEQ ID NO: 1124362 - RNA, 25 nt, Human
uugcacagaaacacgucugccucuu

SEQ ID NO: 1124363 - RNA, 22 nt, Human
uugcugguuagaauugcuuccu

SEQ ID NO: 1124364 - RNA, 22 nt, Human
uugcuuccuuguuacaggguag

SEQ ID NO: 1124365 - RNA, 21 nt, Human
uuuaaaaucauuucucucccu

SEQ ID NO: 1124366 - RNA, 18 nt, Human
aaacaagaaaaggcuagg

SEQ ID NO: 1124367 - RNA, 19 nt, Human
aagcucucucucugcauau

SEQ ID NO: 1124368 - RNA, 22 nt, Human
aaggugucuuuuuuccccaaga

SEQ ID NO: 1124369 - RNA, 20 nt, Human
agcucaaguaacaaguuuua

SEQ ID NO: 1124370 - RNA, 19 nt, Human
cacauauaaacagacccaa

SEQ ID NO: 1124371 - RNA, 19 nt, Human
cagccgcugucagugccug

SEQ ID NO: 1124372 - RNA, 22 nt, Human
ccaaagcaagacuuaaugccac

SEQ ID NO: 1124373 - RNA, 18 nt, Human
ccgcugucagugccugca

SEQ ID NO: 1124374 - RNA, 24 nt, Human
gaccacaaaggcagaguagcagcc

SEQ ID NO: 1124375 - RNA, 20 nt, Human
uauauaagcucucucucugc

SEQ ID NO: 1124376 - RNA, 22 nt, Human
ucaaucaagcccaugauuccaa

SEQ ID NO: 1124377 - RNA, 18 nt, Human
uccaagcucaaguaacaa

SEQ ID NO: 1124378 - RNA, 23 nt, Human
ugaagcaaacaagaaaaggcuag

SEQ ID NO: 1124379 - RNA, 18 nt, Human
ugcauauauacacauaua

SEQ ID NO: 1124380 - RNA, 23 nt, Human
ugcauauauacacauauaaacag

SEQ ID NO: 1124381 - RNA, 22 nt, Human
ugugaaauaaggcuuuaaccaa

SEQ ID NO: 1124382 - RNA, 18 nt, Human
aaaaaccaauugagggcc

SEQ ID NO: 1124383 - RNA, 22 nt, Human
aaacaaacaccucucaugcuua

SEQ ID NO: 1124384 - RNA, 20 nt, Human
aaacacagcuaccggcucac

SEQ ID NO: 1124385 - RNA, 21 nt, Human
aaagaacaacugcagaaccac

SEQ ID NO: 1124386 - RNA, 19 nt, Human
aaagaaggcagaggccugg

SEQ ID NO: 1124387 - RNA, 23 nt, Human
aaagaauguggucaacaaacaca

SEQ ID NO: 1124388 - RNA, 18 nt, Human
aaagugacaugaugaccc

SEQ ID NO: 1124389 - RNA, 22 nt, Human
aacaaacacagcuaccggcuca

SEQ ID NO: 1124390 - RNA, 21 nt, Human
aacaaagaaggcagaggccug

SEQ ID NO: 1124391 - RNA, 24 nt, Human
aaccaauugagggccacaaaccca

SEQ ID NO: 1124392 - RNA, 19 nt, Human
aagaaguuccuguugcuuc

SEQ ID NO: 1124393 - RNA, 23 nt, Human
aagaauguggucaacaaacacag

SEQ ID NO: 1124394 - RNA, 20 nt, Human
aagcaggcuuuggggaaaua

SEQ ID NO: 1124395 - RNA, 27 nt, Human
aagcagucaccuucccgaaccugaagc

SEQ ID NO: 1124396 - RNA, 22 nt, Human
aaguuacuccucagccagccca

SEQ ID NO: 1124397 - RNA, 20 nt, Human
aaguuccuucuucacuuuuc

SEQ ID NO: 1124398 - RNA, 20 nt, Human
aauacaaaaauuagaaaaaa

SEQ ID NO: 1124399 - RNA, 19 nt, Human
acaccaaguuacuccucag

SEQ ID NO: 1124400 - RNA, 23 nt, Human
acacuggucagagaacacuggaa

SEQ ID NO: 1124401 - RNA, 22 nt, Human
acagagccugcccaggcucaau

SEQ ID NO: 1124402 - RNA, 21 nt, Human
accacuccccgcuaccccccg

SEQ ID NO: 1124403 - RNA, 21 nt, Human
acugaggcacagaaaggauaa

SEQ ID NO: 1124404 - RNA, 21 nt, Human
acugcugacagguagccuguu

SEQ ID NO: 1124405 - RNA, 18 nt, Human
agaaaacacaguguuugc

SEQ ID NO: 1124406 - RNA, 23 nt, Human
agaacacuggaacgccccccaca

SEQ ID NO: 1124407 - RNA, 20 nt, Human
agaaccacauuacagaggca

SEQ ID NO: 1124408 - RNA, 21 nt, Human
agaaccuaucgcaaaauguca

SEQ ID NO: 1124409 - RNA, 18 nt, Human
agaccagaaaacacagug

SEQ ID NO: 1124410 - RNA, 18 nt, Human
agacccaacagguuggca

SEQ ID NO: 1124411 - RNA, 18 nt, Human
agagaaagggcgcaaaga

SEQ ID NO: 1124412 - RNA, 22 nt, Human
agagaacacuggaacgcccccc

SEQ ID NO: 1124413 - RNA, 20 nt, Human
agaggcuuccccggcugggu

SEQ ID NO: 1124414 - RNA, 20 nt, Human
agcaccacccuccucaaacu

SEQ ID NO: 1124415 - RNA, 18 nt, Human
agcagcagccuccuugac

SEQ ID NO: 1124416 - RNA, 23 nt, Human
agcaggcuuuggggaaauaccuu

SEQ ID NO: 1124417 - RNA, 20 nt, Human
agcagucaccuucccgaacc

SEQ ID NO: 1124418 - RNA, 22 nt, Human
agcaguguucuuuagcauucac

SEQ ID NO: 1124419 - RNA, 21 nt, Human
agccagcagguggccauggga

SEQ ID NO: 1124420 - RNA, 18 nt, Human
aggaaaagcaggcuuugg

SEQ ID NO: 1124421 - RNA, 25 nt, Human
aggaaguggggagcgggcagggggc

SEQ ID NO: 1124422 - RNA, 18 nt, Human
aggagcugggaugcuaug

SEQ ID NO: 1124423 - RNA, 22 nt, Human
aggaggcuuggauggaagacac

SEQ ID NO: 1124424 - RNA, 21 nt, Human
aggcaagaaaauuggacuucu

SEQ ID NO: 1124425 - RNA, 18 nt, Human
aggcagaggccuggguua

SEQ ID NO: 1124426 - RNA, 23 nt, Human
agggagagaaagggcgcaaagag

SEQ ID NO: 1124427 - RNA, 24 nt, Human
aggggagggaggagaaauggggau

SEQ ID NO: 1124428 - RNA, 23 nt, Human
aggggcuucugcucacagaggcc

SEQ ID NO: 1124429 - RNA, 20 nt, Human
agugagacugcugacaggua

SEQ ID NO: 1124430 - RNA, 21 nt, Human
auaggaaaccugucuuaaagg

SEQ ID NO: 1124431 - RNA, 20 nt, Human
aucuugaauauuugccaaua

SEQ ID NO: 1124432 - RNA, 23 nt, Human
augugaugggggaaggggaggga

SEQ ID NO: 1124433 - RNA, 22 nt, Human
auucaaacaggccucgccggga

SEQ ID NO: 1124434 - RNA, 21 nt, Human
auuuacaccaaguuacuccuc

SEQ ID NO: 1124435 - RNA, 26 nt, Human
caaaaaauacaaacgcuuguggauac

SEQ ID NO: 1124436 - RNA, 23 nt, Human
caaaaacacaaguguguggcacg

SEQ ID NO: 1124437 - RNA, 19 nt, Human
caaaacaaggacgcgaagc

SEQ ID NO: 1124438 - RNA, 21 nt, Human
caaaagccucaucuugauauc

SEQ ID NO: 1124439 - RNA, 18 nt, Human
caaagaauguggucaaca

SEQ ID NO: 1124440 - RNA, 26 nt, Human
caaagaccagaaaacacaguguuugc

SEQ ID NO: 1124441 - RNA, 19 nt, Human
caaagaggagggugggccu

SEQ ID NO: 1124442 - RNA, 29 nt, Human
caaaguacauaucaggcugaagaugcagg

SEQ ID NO: 1124443 - RNA, 22 nt, Human
caaauaccaacaacgagugacc

SEQ ID NO: 1124444 - RNA, 23 nt, Human
caacaaacacagcuaccggcuca

SEQ ID NO: 1124445 - RNA, 22 nt, Human
caacguuaaacaaacaccucuc

SEQ ID NO: 1124446 - RNA, 23 nt, Human
caagagcugccaccaaauaccaa

SEQ ID NO: 1124447 - RNA, 24 nt, Human
caauggaacucgacauuuuuaaac

SEQ ID NO: 1124448 - RNA, 19 nt, Human
caccaaauaccaacaacga

SEQ ID NO: 1124449 - RNA, 24 nt, Human
cacuggaacgccccccaaccggag

SEQ ID NO: 1124450 - RNA, 21 nt, Human
cagaaaguucaacuaaccccc

SEQ ID NO: 1124451 - RNA, 22 nt, Human
cagaaccuaucgcaaaauguca

SEQ ID NO: 1124452 - RNA, 18 nt, Human
cagaggagguagguuagu

SEQ ID NO: 1124453 - RNA, 22 nt, Human
cagaggccuggguuaguguccu

SEQ ID NO: 1124454 - RNA, 22 nt, Human
cagcagcagccuccuugacacu

SEQ ID NO: 1124455 - RNA, 21 nt, Human
cagcagguggccaugggacca

SEQ ID NO: 1124456 - RNA, 24 nt, Human
cagcagguggccaugggaccagca

SEQ ID NO: 1124457 - RNA, 23 nt, Human
caggcucaauccggaaagcacca

SEQ ID NO: 1124458 - RNA, 24 nt, Human
caggcucaauccggaaagcaccac

SEQ ID NO: 1124459 - RNA, 19 nt, Human
cagggcuaggaggaguugg

SEQ ID NO: 1124460 - RNA, 24 nt, Human
cauucacacugcagagaccccucc

SEQ ID NO: 1124461 - RNA, 23 nt, Human
cauuucuacucugaaacccggga

SEQ ID NO: 1124462 - RNA, 18 nt, Human
ccaaagaccagaaaacac

SEQ ID NO: 1124463 - RNA, 23 nt, Human
ccaagagggagagaaagggcgca

SEQ ID NO: 1124464 - RNA, 23 nt, Human
ccaaggagaacagagagaggaaa

SEQ ID NO: 1124465 - RNA, 18 nt, Human
ccacagagccugcccagg

SEQ ID NO: 1124466 - RNA, 21 nt, Human
ccacuagcccaaccagccuuc

SEQ ID NO: 1124467 - RNA, 24 nt, Human
ccagaacuuagguaacaaagaagg

SEQ ID NO: 1124468 - RNA, 20 nt, Human
ccagggccucccccaaccug

SEQ ID NO: 1124469 - RNA, 19 nt, Human
cccaaagaccagaaaacac

SEQ ID NO: 1124470 - RNA, 19 nt, Human
cccaccggugccgaaaccc

SEQ ID NO: 1124471 - RNA, 21 nt, Human
cccaggcucaauccggaaagc

SEQ ID NO: 1124472 - RNA, 23 nt, Human
ccccgcuaccccccguguuuuca

SEQ ID NO: 1124473 - RNA, 22 nt, Human
ccccuaaggauugacccucccu

SEQ ID NO: 1124474 - RNA, 23 nt, Human
ccccuaaggauugacccucccuc

SEQ ID NO: 1124475 - RNA, 18 nt, Human
cccgcuccccacuucuuc

SEQ ID NO: 1124476 - RNA, 23 nt, Human
cccucccucacuaccucaaagcc

SEQ ID NO: 1124477 - RNA, 20 nt, Human
ccgaaacccgccuucccagg

SEQ ID NO: 1124478 - RNA, 21 nt, Human
ccgagggcugaacuugguguc

SEQ ID NO: 1124479 - RNA, 22 nt, Human
ccggcccacaggucccuaggcc

SEQ ID NO: 1124480 - RNA, 22 nt, Human
ccuacggcauacagaaccuauc

SEQ ID NO: 1124481 - RNA, 22 nt, Human
ccuccuugacacugaaccaccu

SEQ ID NO: 1124482 - RNA, 24 nt, Human
ccugaaauuuuccagcaucaccau

SEQ ID NO: 1124483 - RNA, 23 nt, Human
ccugguuuuggccucuccucaga

SEQ ID NO: 1124484 - RNA, 20 nt, Human
ccugucguucucuuugaagu

SEQ ID NO: 1124485 - RNA, 22 nt, Human
ccuucuucacuuuucugauccc

SEQ ID NO: 1124486 - RNA, 22 nt, Human
cggcccacaggucccuaggccu

SEQ ID NO: 1124487 - RNA, 19 nt, Human
cggcucacuugcaaaagaa

SEQ ID NO: 1124488 - RNA, 25 nt, Human
cggcugggucucacccaguaagcac

SEQ ID NO: 1124489 - RNA, 18 nt, Human
cgggaccuuccuggccau

SEQ ID NO: 1124490 - RNA, 18 nt, Human
cggucaaaacaaggacgc

SEQ ID NO: 1124491 - RNA, 20 nt, Human
cucacagaggccuugaggcc

SEQ ID NO: 1124492 - RNA, 18 nt, Human
cugaagccugguuuuggc

SEQ ID NO: 1124493 - RNA, 21 nt, Human
cugccaccaaauaccaacaac

SEQ ID NO: 1124494 - RNA, 26 nt, Human
cuucccagggggaccaagccuuucgc

SEQ ID NO: 1124495 - RNA, 22 nt, Human
cuugacacugaaccaccugccc

SEQ ID NO: 1124496 - RNA, 18 nt, Human
gaaauaccuuccccugcu

SEQ ID NO: 1124497 - RNA, 18 nt, Human
gaaguggggagcgggcag

SEQ ID NO: 1124498 - RNA, 19 nt, Human
gaccugucguucucuuuuu

SEQ ID NO: 1124499 - RNA, 18 nt, Human
gaccuuccuggccaugag

SEQ ID NO: 1124500 - RNA, 19 nt, Human
gagaaacccuggcgccacc

SEQ ID NO: 1124501 - RNA, 21 nt, Human
gagaaagccuggggcucuggg

SEQ ID NO: 1124502 - RNA, 20 nt, Human
gagaccccucgaaacaaagg

SEQ ID NO: 1124503 - RNA, 20 nt, Human
gagcugccaccaaauaccaa

SEQ ID NO: 1124504 - RNA, 18 nt, Human
gaggugucugugaaggag

SEQ ID NO: 1124505 - RNA, 24 nt, Human
gcaaagaacaacugcagaaccaca

SEQ ID NO: 1124506 - RNA, 22 nt, Human
gcucugggugucugguuuccag

SEQ ID NO: 1124507 - RNA, 23 nt, Human
ggaaguaaccgagggcugaacuu

SEQ ID NO: 1124508 - RNA, 19 nt, Human
ggauggaagacacugguca

SEQ ID NO: 1124509 - RNA, 20 nt, Human
ggcaagaaaauuggacuucu

SEQ ID NO: 1124510 - RNA, 22 nt, Human
ggccaugaggaauugauaaguu

SEQ ID NO: 1124511 - RNA, 20 nt, Human
gggaauggaaacauaugggg

SEQ ID NO: 1124512 - RNA, 21 nt, Human
gggcugugcagcaguguucuu

SEQ ID NO: 1124513 - RNA, 20 nt, Human
ggggagggaggagaaauggg

SEQ ID NO: 1124514 - RNA, 20 nt, Human
ggggagggaggagaaauggg

SEQ ID NO: 1124515 - RNA, 29 nt, Human
ggguguuacuuucuauggucauaggagac

SEQ ID NO: 1124516 - RNA, 24 nt, Human
gugaagccccagcagucccagcgg

SEQ ID NO: 1124517 - RNA, 21 nt, Human
gugaugggggaaggggaggga

SEQ ID NO: 1124518 - RNA, 20 nt, Human
guguuuugugcugaagacag

SEQ ID NO: 1124519 - RNA, 18 nt, Human
uaacccccaaagaccaga

SEQ ID NO: 1124520 - RNA, 25 nt, Human
uacaccaaguuacuccucagccagc

SEQ ID NO: 1124521 - RNA, 21 nt, Human
uaccacuccccgcuacccccc

SEQ ID NO: 1124522 - RNA, 23 nt, Human
uaccaugaaucacuauuaaagcc

SEQ ID NO: 1124523 - RNA, 19 nt, Human
uaccccccguguuuucagu

SEQ ID NO: 1124524 - RNA, 20 nt, Human
uagcaaagaacaacugcaga

SEQ ID NO: 1124525 - RNA, 18 nt, Human
uaggaccaagagcugcca

SEQ ID NO: 1124526 - RNA, 21 nt, Human
uaggaccaagagcugccacca

SEQ ID NO: 1124527 - RNA, 24 nt, Human
uaggaccaagagcugccaccaaau

SEQ ID NO: 1124528 - RNA, 27 nt, Human
uauacaguuuuauaguguuuaggucag

SEQ ID NO: 1124529 - RNA, 20 nt, Human
uauaguguuuaggucaguuu

SEQ ID NO: 1124530 - RNA, 21 nt, Human
ucaaaacuucggcucaguugc

SEQ ID NO: 1124531 - RNA, 24 nt, Human
ucacaaggaggcuuggauggaaga

SEQ ID NO: 1124532 - RNA, 21 nt, Human
ucaccggcccacaggucccua

SEQ ID NO: 1124533 - RNA, 23 nt, Human
ucagagcuuuacccgagggccug

SEQ ID NO: 1124534 - RNA, 24 nt, Human
ucagucaucugaaagugacaugau

SEQ ID NO: 1124535 - RNA, 18 nt, Human
ucauugaaaaagccaggg

SEQ ID NO: 1124536 - RNA, 24 nt, Human
uccagggcuaggaggaguuggaga

SEQ ID NO: 1124537 - RNA, 20 nt, Human
ucccagggggaccaagccuu

SEQ ID NO: 1124538 - RNA, 22 nt, Human
ucccgaaccugaagccugguuu

SEQ ID NO: 1124539 - RNA, 21 nt, Human
uccggacgagacuucccugga

SEQ ID NO: 1124540 - RNA, 23 nt, Human
uccucagccagcccaacaaaagc

SEQ ID NO: 1124541 - RNA, 18 nt, Human
uccugcuacugcaguugc

SEQ ID NO: 1124542 - RNA, 23 nt, Human
uccuucuucacuuuucugauccc

SEQ ID NO: 1124543 - RNA, 27 nt, Human
ucgacggucaaaacaaggacgcgaagc

SEQ ID NO: 1124544 - RNA, 21 nt, Human
ucgcagugagacugcugacag

SEQ ID NO: 1124545 - RNA, 24 nt, Human
ucuauggucauaggaaaccggggc

SEQ ID NO: 1124546 - RNA, 23 nt, Human
ucuauggucauaggaaaccuguc

SEQ ID NO: 1124547 - RNA, 22 nt, Human
ugaaaaagccagggccuccccc

SEQ ID NO: 1124548 - RNA, 23 nt, Human
ugaaccaccugcccaccggugcc

SEQ ID NO: 1124549 - RNA, 18 nt, Human
ugaagccccagcaguccc

SEQ ID NO: 1124550 - RNA, 20 nt, Human
ugacacugaaccaccugccc

SEQ ID NO: 1124551 - RNA, 18 nt, Human
ugagacugcugacaggua

SEQ ID NO: 1124552 - RNA, 21 nt, Human
ugagagugcugugguggggcg

SEQ ID NO: 1124553 - RNA, 19 nt, Human
ugauaaguuccuucuucac

SEQ ID NO: 1124554 - RNA, 18 nt, Human
ugauccuuuccugagagu

SEQ ID NO: 1124555 - RNA, 23 nt, Human
ugccaaagaauguggucaacaaa

SEQ ID NO: 1124556 - RNA, 23 nt, Human
uggaacauccacagcaauaggac

SEQ ID NO: 1124557 - RNA, 19 nt, Human
uggaagaaauacacaaaga

SEQ ID NO: 1124558 - RNA, 20 nt, Human
uggaugagaauuccaugacc

SEQ ID NO: 1124559 - RNA, 25 nt, Human
ugggaccagcagcagccuccuugac

SEQ ID NO: 1124560 - RNA, 18 nt, Human
ugggaggaacugccaaag

SEQ ID NO: 1124561 - RNA, 18 nt, Human
ugggaugcuauguaugca

SEQ ID NO: 1124562 - RNA, 19 nt, Human
ugggccugcccccagcucu

SEQ ID NO: 1124563 - RNA, 18 nt, Human
uggggagcgggcaggggg

SEQ ID NO: 1124564 - RNA, 18 nt, Human
ugggggaaggggagggag

SEQ ID NO: 1124565 - RNA, 21 nt, Human
ugggggaaggggagggaggag

SEQ ID NO: 1124566 - RNA, 18 nt, Human
ugguggggcggagggcag

SEQ ID NO: 1124567 - RNA, 22 nt, Human
ugugaugggggaaggggaggga

SEQ ID NO: 1124568 - RNA, 24 nt, Human
ugugggucaguauuacuggugucc

SEQ ID NO: 1124569 - RNA, 23 nt, Human
ugugguaaaacucagguuuucca

SEQ ID NO: 1124570 - RNA, 25 nt, Human
ugugguggggcggagggcaggggca

SEQ ID NO: 1124571 - RNA, 21 nt, Human
uguugcuuccaguaaaaugug

SEQ ID NO: 1124572 - RNA, 22 nt, Human
uguuuaggucaguuaccuugug

SEQ ID NO: 1124573 - RNA, 19 nt, Human
uguuuugugcugaagacag

SEQ ID NO: 1124574 - RNA, 21 nt, Human
uuacuccucagccagcccaac

SEQ ID NO: 1124575 - RNA, 22 nt, Human
uuccagggcuaggaggaguugg

SEQ ID NO: 1124576 - RNA, 20 nt, Human
uucugcuuugcccgcucccc

SEQ ID NO: 1124577 - RNA, 19 nt, Human
uucugggugccgagaaagc

SEQ ID NO: 1124578 - RNA, 18 nt, Human
uugacccucccucacuac

SEQ ID NO: 1124579 - RNA, 18 nt, Human
uugcaacuacaaaguaca

SEQ ID NO: 1124580 - RNA, 19 nt, Human
aaaaggaaggaaagucaga

SEQ ID NO: 1124581 - RNA, 22 nt, Human
aaacaacccaaacaaguggaac

SEQ ID NO: 1124582 - RNA, 27 nt, Human
aaacaaguggaacccaggagcucccac

SEQ ID NO: 1124583 - RNA, 20 nt, Human
aacaggacaaaucgggccug

SEQ ID NO: 1124584 - RNA, 24 nt, Human
aagcccagcucuaaggguugcugg

SEQ ID NO: 1124585 - RNA, 18 nt, Human
aaggcacgucugccagaa

SEQ ID NO: 1124586 - RNA, 18 nt, Human
acaaagaugauugaacgg

SEQ ID NO: 1124587 - RNA, 18 nt, Human
accacgggucacauuuca

SEQ ID NO: 1124588 - RNA, 21 nt, Human
acccuccuacacuggagggau

SEQ ID NO: 1124589 - RNA, 20 nt, Human
agaaaggagucuccccucac

SEQ ID NO: 1124590 - RNA, 22 nt, Human
agccagccuguacuccacggcc

SEQ ID NO: 1124591 - RNA, 22 nt, Human
aggaaagucagaagggagaaug

SEQ ID NO: 1124592 - RNA, 22 nt, Human
aggaccagggagugagccggga

SEQ ID NO: 1124593 - RNA, 20 nt, Human
aggguugcuggauaaacacc

SEQ ID NO: 1124594 - RNA, 23 nt, Human
aguugaccacgggucacauuuca

SEQ ID NO: 1124595 - RNA, 19 nt, Human
auaaaacaaaggcacgucu

SEQ ID NO: 1124596 - RNA, 19 nt, Human
aucccuaguaggagacaca

SEQ ID NO: 1124597 - RNA, 18 nt, Human
auggucccugcagcuguc

SEQ ID NO: 1124598 - RNA, 24 nt, Human
caaacaaguggaacccaggagcuc

SEQ ID NO: 1124599 - RNA, 23 nt, Human
caaaggcacgucugccagaacaa

SEQ ID NO: 1124600 - RNA, 22 nt, Human
caaauggcuuucagcgccacuc

SEQ ID NO: 1124601 - RNA, 25 nt, Human
caaguggaacccaggagcucccacc

SEQ ID NO: 1124602 - RNA, 22 nt, Human
cacaggcaugugccuaccccuu

SEQ ID NO: 1124603 - RNA, 21 nt, Human
cacaggcucuguacuagggac

SEQ ID NO: 1124604 - RNA, 19 nt, Human
caccaugaguagagugcca

SEQ ID NO: 1124605 - RNA, 22 nt, Human
cacgaaaucagugaauucagaa

SEQ ID NO: 1124606 - RNA, 20 nt, Human
cacuucggucaccaucugcu

SEQ ID NO: 1124607 - RNA, 18 nt, Human
cagaagacacuguugagu

SEQ ID NO: 1124608 - RNA, 18 nt, Human
cagacccggauagccccu

SEQ ID NO: 1124609 - RNA, 23 nt, Human
cagcucucccucccacccuccua

SEQ ID NO: 1124610 - RNA, 24 nt, Human
caggacaaaucgggccugaccugg

SEQ ID NO: 1124611 - RNA, 24 nt, Human
caggcaugugccuacccccugaag

SEQ ID NO: 1124612 - RNA, 22 nt, Human
caguuugccaacuggggagacu

SEQ ID NO: 1124613 - RNA, 19 nt, Human
cauugcaucugagggaugc

SEQ ID NO: 1124614 - RNA, 18 nt, Human
ccacggcgggacccccag

SEQ ID NO: 1124615 - RNA, 22 nt, Human
ccagcucucccucccacccucc

SEQ ID NO: 1124616 - RNA, 19 nt, Human
cccaacccugaagcccagc

SEQ ID NO: 1124617 - RNA, 19 nt, Human
cccaggaagucuguguucc

SEQ ID NO: 1124618 - RNA, 22 nt, Human
ccccaggaagucuguguuccag

SEQ ID NO: 1124619 - RNA, 20 nt, Human
cccugaagcccagcucuaag

SEQ ID NO: 1124620 - RNA, 21 nt, Human
ccguggaccuccuuuuagucc

SEQ ID NO: 1124621 - RNA, 22 nt, Human
ccuaauuccagcccuaccaggc

SEQ ID NO: 1124622 - RNA, 23 nt, Human
ccuacacuggagggaucugagaa

SEQ ID NO: 1124623 - RNA, 19 nt, Human
ccucaccccuggaccagcu

SEQ ID NO: 1124624 - RNA, 21 nt, Human
ccucccacccuccuacacugg

SEQ ID NO: 1124625 - RNA, 22 nt, Human
ccugcaccuuccacccuucuca

SEQ ID NO: 1124626 - RNA, 20 nt, Human
ccuggaccagcucucccucc

SEQ ID NO: 1124627 - RNA, 23 nt, Human
ccuuccaugcacaccaucauuaa

SEQ ID NO: 1124628 - RNA, 25 nt, Human
ccuugggcugcagcacugggaccuu

SEQ ID NO: 1124629 - RNA, 21 nt, Human
cggcagguuggggagggucag

SEQ ID NO: 1124630 - RNA, 19 nt, Human
cggcgggacccccaggaag

SEQ ID NO: 1124631 - RNA, 22 nt, Human
cuaaggguugcuggauaaacac

SEQ ID NO: 1124632 - RNA, 24 nt, Human
cuaauuccagcccuaccaggcugu

SEQ ID NO: 1124633 - RNA, 19 nt, Human
cucacagagggcaagaaac

SEQ ID NO: 1124634 - RNA, 20 nt, Human
cucccucccacccuccuaca

SEQ ID NO: 1124635 - RNA, 25 nt, Human
cucugggguucucauucccuaaggg

SEQ ID NO: 1124636 - RNA, 24 nt, Human
cugcaguaggcaaauggcuuucag

SEQ ID NO: 1124637 - RNA, 22 nt, Human
cuguguuccagcccccagugca

SEQ ID NO: 1124638 - RNA, 23 nt, Human
cuucggucaccaucugcuggcuc

SEQ ID NO: 1124639 - RNA, 18 nt, Human
gaccagcucucccuccca

SEQ ID NO: 1124640 - RNA, 18 nt, Human
gagaagggcuauccugca

SEQ ID NO: 1124641 - RNA, 23 nt, Human
gaggacacgaagucucacagagg

SEQ ID NO: 1124642 - RNA, 23 nt, Human
gaggauaauggaaggucaacagc

SEQ ID NO: 1124643 - RNA, 20 nt, Human
gcaggccuuuggggugggua

SEQ ID NO: 1124644 - RNA, 18 nt, Human
gccuaggcuaguguggag

SEQ ID NO: 1124645 - RNA, 23 nt, Human
gcuaguguggagcugagcuggug

SEQ ID NO: 1124646 - RNA, 18 nt, Human
ggacacggucaaguagau

SEQ ID NO: 1124647 - RNA, 20 nt, Human
ggcaugugccuaccccuugu

SEQ ID NO: 1124648 - RNA, 21 nt, Human
ggcucaaugggaagugugugu

SEQ ID NO: 1124649 - RNA, 21 nt, Human
ggucacauuucauuggucagg

SEQ ID NO: 1124650 - RNA, 22 nt, Human
gguugcuggauaaacacccagc

SEQ ID NO: 1124651 - RNA, 19 nt, Human
guggaacccaggagcuccc

SEQ ID NO: 1124652 - RNA, 19 nt, Human
guugagugcccguucugca

SEQ ID NO: 1124653 - RNA, 20 nt, Human
uaaaacaaaggcacgucugc

SEQ ID NO: 1124654 - RNA, 19 nt, Human
uaaacacccagcagugcuc

SEQ ID NO: 1124655 - RNA, 19 nt, Human
uaccaggcugugcucagug

SEQ ID NO: 1124656 - RNA, 22 nt, Human
uaucugaaaacucccugugaga

SEQ ID NO: 1124657 - RNA, 19 nt, Human
uauuccaaccagcaguuug

SEQ ID NO: 1124658 - RNA, 22 nt, Human
ucaccccuggaccagcucuccc

SEQ ID NO: 1124659 - RNA, 27 nt, Human
ucagcagcgcauccguggaccuccuuu

SEQ ID NO: 1124660 - RNA, 21 nt, Human
ucaguucugauuugcugaugu

SEQ ID NO: 1124661 - RNA, 22 nt, Human
uccacccuucucaggauuccca

SEQ ID NO: 1124662 - RNA, 26 nt, Human
ucccaccacggcgggacccccaggaa

SEQ ID NO: 1124663 - RNA, 19 nt, Human
ucccacccuccuacacugg

SEQ ID NO: 1124664 - RNA, 18 nt, Human
ucccugaacccagggccu

SEQ ID NO: 1124665 - RNA, 23 nt, Human
uccuaaauccgaguugcuggcuc

SEQ ID NO: 1124666 - RNA, 20 nt, Human
uccugcaccuuccacccuuc

SEQ ID NO: 1124667 - RNA, 21 nt, Human
ucucaggauucccagagccuu

SEQ ID NO: 1124668 - RNA, 21 nt, Human
ucuguacuagggacacaaaga

SEQ ID NO: 1124669 - RNA, 20 nt, Human
ucuguguuccagcccccagu

SEQ ID NO: 1124670 - RNA, 20 nt, Human
ugagaaaggagucuccccuc

SEQ ID NO: 1124671 - RNA, 24 nt, Human
ugagccgggaugaacaggcagcga

SEQ ID NO: 1124672 - RNA, 20 nt, Human
ugaggcaggccuuuggggug

SEQ ID NO: 1124673 - RNA, 21 nt, Human
ugaguagagugccagucccug

SEQ ID NO: 1124674 - RNA, 19 nt, Human
ugcacaccaucauuaaacc

SEQ ID NO: 1124675 - RNA, 20 nt, Human
ugcacaccaucauuaaaccu

SEQ ID NO: 1124676 - RNA, 21 nt, Human
uggaacaggacaaaucgggcc

SEQ ID NO: 1124677 - RNA, 20 nt, Human
uggaacccaggagcucccac

SEQ ID NO: 1124678 - RNA, 22 nt, Human
uggagggaucugagaaaagaaa

SEQ ID NO: 1124679 - RNA, 18 nt, Human
uggcagugugagcaggaa

SEQ ID NO: 1124680 - RNA, 24 nt, Human
uggggagacucagccuucaguaua

SEQ ID NO: 1124681 - RNA, 18 nt, Human
uggguaucaucaccccaa

SEQ ID NO: 1124682 - RNA, 20 nt, Human
uguuuuccucaucugaagug

SEQ ID NO: 1124683 - RNA, 22 nt, Human
uucacacgugaggacacgaagu

SEQ ID NO: 1124684 - RNA, 19 nt, Human
uucccauugcaucugaggg

SEQ ID NO: 1124685 - RNA, 18 nt, Human
aaaacagaggcccucagc

SEQ ID NO: 1124686 - RNA, 23 nt, Human
aaacaucgggauuuugucgaacu

SEQ ID NO: 1124687 - RNA, 23 nt, Human
aaacugccaaacugcuuuccaac

SEQ ID NO: 1124688 - RNA, 25 nt, Human
aaaggguuuuccuuuucuuaggaga

SEQ ID NO: 1124689 - RNA, 20 nt, Human
aaccuagaguuuuuggggcu

SEQ ID NO: 1124690 - RNA, 23 nt, Human
aagagaacagugaccacaaaaau

SEQ ID NO: 1124691 - RNA, 23 nt, Human
aagaguaagaucccuggaccacc

SEQ ID NO: 1124692 - RNA, 19 nt, Human
aagaucaucagcaauguca

SEQ ID NO: 1124693 - RNA, 24 nt, Human
aauagaagaaaaaugugaagagag

SEQ ID NO: 1124694 - RNA, 18 nt, Human
aauugacuuacugacacu

SEQ ID NO: 1124695 - RNA, 18 nt, Human
acacugaugcauaaaugg

SEQ ID NO: 1124696 - RNA, 20 nt, Human
acacugaugcauaaaugguc

SEQ ID NO: 1124697 - RNA, 20 nt, Human
acaguccacacaucgcugcc

SEQ ID NO: 1124698 - RNA, 26 nt, Human
agaaaucccucaugcucaucaauacc

SEQ ID NO: 1124699 - RNA, 18 nt, Human
agaagaaaaaugugaaga

SEQ ID NO: 1124700 - RNA, 19 nt, Human
agaagaaaaaugugaagag

SEQ ID NO: 1124701 - RNA, 18 nt, Human
agaagacuguggauagcc

SEQ ID NO: 1124702 - RNA, 23 nt, Human
agaagagaacagugaccacaaaa

SEQ ID NO: 1124703 - RNA, 21 nt, Human
agacaaccccuaauugacuua

SEQ ID NO: 1124704 - RNA, 30 nt, Human
agacaaccccuaauugacuuacugacacuu

SEQ ID NO: 1124705 - RNA, 22 nt, Human
agacauaucgacauuuagaggu

SEQ ID NO: 1124706 - RNA, 19 nt, Human
agagacauauacuagguag

SEQ ID NO: 1124707 - RNA, 23 nt, Human
agcaaugucaccugcaccacuaa

SEQ ID NO: 1124708 - RNA, 23 nt, Human
agcuagaucccaccaaaaucaaa

SEQ ID NO: 1124709 - RNA, 26 nt, Human
aggaaaaguuucuagacugaauccug

SEQ ID NO: 1124710 - RNA, 19 nt, Human
agggagccccaccuuguug

SEQ ID NO: 1124711 - RNA, 24 nt, Human
agggucaauugauuuucacaaaag

SEQ ID NO: 1124712 - RNA, 24 nt, Human
agguauuugaaguguacuugaaga

SEQ ID NO: 1124713 - RNA, 23 nt, Human
aguugugccaugaagaucucaga

SEQ ID NO: 1124714 - RNA, 21 nt, Human
aucugggaaaaucaacugccc

SEQ ID NO: 1124715 - RNA, 21 nt, Human
auucccacuccccagcuccag

SEQ ID NO: 1124716 - RNA, 21 nt, Human
caaaagggugaucgaccucau

SEQ ID NO: 1124717 - RNA, 19 nt, Human
caacaaccucaagaucauc

SEQ ID NO: 1124718 - RNA, 27 nt, Human
caacaaccucaagaucaucagcaaugu

SEQ ID NO: 1124719 - RNA, 21 nt, Human
caacaaggaaugaaagugcua

SEQ ID NO: 1124720 - RNA, 20 nt, Human
caacugcccagaaccuagag

SEQ ID NO: 1124721 - RNA, 19 nt, Human
caacuggaaaguccaacac

SEQ ID NO: 1124722 - RNA, 20 nt, Human
caauggaggaacacacaggc

SEQ ID NO: 1124723 - RNA, 23 nt, Human
cacaaagauuacuaaucagcaaa

SEQ ID NO: 1124724 - RNA, 19 nt, Human
cacugaugcauaaaugguc

SEQ ID NO: 1124725 - RNA, 19 nt, Human
cauagaguccaccgacauc

SEQ ID NO: 1124726 - RNA, 18 nt, Human
caucacaaucuuguuuug

SEQ ID NO: 1124727 - RNA, 19 nt, Human
caugaugcucggggaaggu

SEQ ID NO: 1124728 - RNA, 20 nt, Human
ccaaaaaugaugacaucaag

SEQ ID NO: 1124729 - RNA, 23 nt, Human
ccaaaagcuagaucccaccaaaa

SEQ ID NO: 1124730 - RNA, 20 nt, Human
ccaaguucauccaugacaac

SEQ ID NO: 1124731 - RNA, 18 nt, Human
ccaccauuuuccaaaagc

SEQ ID NO: 1124732 - RNA, 21 nt, Human
ccaccccuuauucccacuccc

SEQ ID NO: 1124733 - RNA, 18 nt, Human
ccacuccccagcuccaga

SEQ ID NO: 1124734 - RNA, 20 nt, Human
ccacuccccagcuccagaca

SEQ ID NO: 1124735 - RNA, 21 nt, Human
ccacucuuccaccuuugaucc

SEQ ID NO: 1124736 - RNA, 22 nt, Human
cccauacuaaugagagccuggg

SEQ ID NO: 1124737 - RNA, 24 nt, Human
cccauacuaaugagagccugggac

SEQ ID NO: 1124738 - RNA, 21 nt, Human
cccucagcuucuggggagucc

SEQ ID NO: 1124739 - RNA, 23 nt, Human
ccugccacacucagugccccacc

SEQ ID NO: 1124740 - RNA, 24 nt, Human
ccugggacuuuugcccaggccaaa

SEQ ID NO: 1124741 - RNA, 22 nt, Human
cucauacaucuuuuuauuacca

SEQ ID NO: 1124742 - RNA, 20 nt, Human
cucauugcccacagggccuu

SEQ ID NO: 1124743 - RNA, 24 nt, Human
cuccagacaaccccuaauugacuu

SEQ ID NO: 1124744 - RNA, 19 nt, Human
cucgugcaaaggguuuucc

SEQ ID NO: 1124745 - RNA, 21 nt, Human
cugaaaacgggaagcuuguca

SEQ ID NO: 1124746 - RNA, 20 nt, Human
cugccccucugcugacgccc

SEQ ID NO: 1124747 - RNA, 21 nt, Human
cugccccucugcugacgcccc

SEQ ID NO: 1124748 - RNA, 19 nt, Human
cuuuggugucauggaagga

SEQ ID NO: 1124749 - RNA, 19 nt, Human
gaagagaacagugaccaca

SEQ ID NO: 1124750 - RNA, 20 nt, Human
gaauacaaauuuaaccacca

SEQ ID NO: 1124751 - RNA, 20 nt, Human
gaaucuccccuccucacagu

SEQ ID NO: 1124752 - RNA, 21 nt, Human
gagaaucuccccuccucacag

SEQ ID NO: 1124753 - RNA, 24 nt, Human
gaguccaccgacaucuucaccacc

SEQ ID NO: 1124754 - RNA, 23 nt, Human
ggaaaacucacaaagauuacuaa

SEQ ID NO: 1124755 - RNA, 25 nt, Human
ggagucccugccacacucagugccc

SEQ ID NO: 1124756 - RNA, 23 nt, Human
ggagucgguggccggcaggagga

SEQ ID NO: 1124757 - RNA, 19 nt, Human
guggguaagaaguggugug

SEQ ID NO: 1124758 - RNA, 20 nt, Human
guuucuagacugaauccugg

SEQ ID NO: 1124759 - RNA, 20 nt, Human
uaaagaaauggaaguauggg

SEQ ID NO: 1124760 - RNA, 21 nt, Human
uaagaauauucaaggauaaaa

SEQ ID NO: 1124761 - RNA, 22 nt, Human
uaagaucccuggaccaccagcc

SEQ ID NO: 1124762 - RNA, 19 nt, Human
uacuagguagagucccuca

SEQ ID NO: 1124763 - RNA, 18 nt, Human
uacugaguaggagucggu

SEQ ID NO: 1124764 - RNA, 20 nt, Human
uagaagagaacagugaccac

SEQ ID NO: 1124765 - RNA, 21 nt, Human
uagaagagaacagugaccaca

SEQ ID NO: 1124766 - RNA, 26 nt, Human
uagagucauacaacaugugguuuuuu

SEQ ID NO: 1124767 - RNA, 20 nt, Human
uagaguccaccgacaucuuc

SEQ ID NO: 1124768 - RNA, 23 nt, Human
uagcaaaagggugaucgaccuca

SEQ ID NO: 1124769 - RNA, 18 nt, Human
uagcaugaggacacagcu

SEQ ID NO: 1124770 - RNA, 24 nt, Human
uaggaaaacucacaaagauuacua

SEQ ID NO: 1124771 - RNA, 19 nt, Human
uagguuuuuuuccuuugga

SEQ ID NO: 1124772 - RNA, 19 nt, Human
uagguuuuuuuccuuugga

SEQ ID NO: 1124773 - RNA, 22 nt, Human
uaucauagcauucuagugggua

SEQ ID NO: 1124774 - RNA, 19 nt, Human
uaugacaaugaauuuggcu

SEQ ID NO: 1124775 - RNA, 19 nt, Human
uauggauaaagcugcuacu

SEQ ID NO: 1124776 - RNA, 25 nt, Human
uauuuuauauuuuggauacaaaucu

SEQ ID NO: 1124777 - RNA, 23 nt, Human
ucaacugcccagaaccuagaguu

SEQ ID NO: 1124778 - RNA, 26 nt, Human
ucaauggaggaacacacaggcuuuug

SEQ ID NO: 1124779 - RNA, 25 nt, Human
ucacugccaacauguuauuugugga

SEQ ID NO: 1124780 - RNA, 18 nt, Human
ucagaguagaaauguguu

SEQ ID NO: 1124781 - RNA, 20 nt, Human
ucagguauuugaaguguacu

SEQ ID NO: 1124782 - RNA, 26 nt, Human
ucauaaaaauagagucauacaacaug

SEQ ID NO: 1124783 - RNA, 22 nt, Human
ucaugcugggaaaaagaaaauc

SEQ ID NO: 1124784 - RNA, 20 nt, Human
uccaaaagcuagaucccacc

SEQ ID NO: 1124785 - RNA, 24 nt, Human
uccaaaagggucauuaucucugcc

SEQ ID NO: 1124786 - RNA, 20 nt, Human
uccacacaucgcugccaccc

SEQ ID NO: 1124787 - RNA, 21 nt, Human
uccacacaucgcugccaccca

SEQ ID NO: 1124788 - RNA, 24 nt, Human
uccacacaucgcugccacccagaa

SEQ ID NO: 1124789 - RNA, 19 nt, Human
ucccacuccccagcuccag

SEQ ID NO: 1124790 - RNA, 18 nt, Human
ucccacuccccagcuccg

SEQ ID NO: 1124791 - RNA, 21 nt, Human
uccccauccuccugucuuaca

SEQ ID NO: 1124792 - RNA, 18 nt, Human
ucccugaguugaacagga

SEQ ID NO: 1124793 - RNA, 18 nt, Human
ucccuggaccaccagccc

SEQ ID NO: 1124794 - RNA, 24 nt, Human
uccuuuauugauccuuagcaccuu

SEQ ID NO: 1124795 - RNA, 23 nt, Human
ucgcugccacccagaagacugug

SEQ ID NO: 1124796 - RNA, 25 nt, Human
ucgcugccacccagaagacugugga

SEQ ID NO: 1124797 - RNA, 21 nt, Human
ucugaagagggagaggccuag

SEQ ID NO: 1124798 - RNA, 23 nt, Human
ucugcugacgcccccauaucuga

SEQ ID NO: 1124799 - RNA, 19 nt, Human
ucuuucccagaaggccuuc

SEQ ID NO: 1124800 - RNA, 21 nt, Human
ugaaaacgggaagcuugucau

SEQ ID NO: 1124801 - RNA, 23 nt, Human
ugaaaacgggaagcuugucauga

SEQ ID NO: 1124802 - RNA, 21 nt, Human
ugaauuguccacaugaugcuc

SEQ ID NO: 1124803 - RNA, 22 nt, Human
ugacugaugauacugaccaucu

SEQ ID NO: 1124804 - RNA, 21 nt, Human
ugagacgcgcaugaaccauga

SEQ ID NO: 1124805 - RNA, 19 nt, Human
ugaguugaacaggaggcuu

SEQ ID NO: 1124806 - RNA, 19 nt, Human
ugccaugaagaucucagag

SEQ ID NO: 1124807 - RNA, 24 nt, Human
ugccaugaagaucucagaguagaa

SEQ ID NO: 1124808 - RNA, 19 nt, Human
ugccccaccacaaugagaa

SEQ ID NO: 1124809 - RNA, 24 nt, Human
ugcguucagccaaaaaaaaaaaaa

SEQ ID NO: 1124810 - RNA, 20 nt, Human
uggaaaguccaacacacguu

SEQ ID NO: 1124811 - RNA, 29 nt, Human
uggagugaagaguuuguuuuuguuguggu

SEQ ID NO: 1124812 - RNA, 19 nt, Human
uggauagccccuccaggaa

SEQ ID NO: 1124813 - RNA, 24 nt, Human
uggauaugaauagguucucaggua

SEQ ID NO: 1124814 - RNA, 24 nt, Human
uggcaacaucauaaguaauuuggu

SEQ ID NO: 1124815 - RNA, 22 nt, Human
uguauggaucacucccauuugu

SEQ ID NO: 1124816 - RNA, 24 nt, Human
uguggauagccccuccaggaaacu

SEQ ID NO: 1124817 - RNA, 22 nt, Human
ugugguucaccuguguuguagg

SEQ ID NO: 1124818 - RNA, 18 nt, Human
uuaaauuguauggaucac

SEQ ID NO: 1124819 - RNA, 18 nt, Human
uuagaauaauuauacccc

SEQ ID NO: 1124820 - RNA, 19 nt, Human
uucaaaaagaauguggucc

SEQ ID NO: 1124821 - RNA, 21 nt, Human
uucaagaaguugugccaugaa

SEQ ID NO: 1124822 - RNA, 27 nt, Human
uucagccaaaaaaaaaaaaaugcugua

SEQ ID NO: 1124823 - RNA, 21 nt, Human
uuccaaaagcuagaucccacc

SEQ ID NO: 1124824 - RNA, 25 nt, Human
uucccauacuaaugagagccuggga

SEQ ID NO: 1124825 - RNA, 23 nt, Human
uuccuuuucuuaggagagaaagc

SEQ ID NO: 1124826 - RNA, 22 nt, Human
uucuaccaggaaacaucggggg

SEQ ID NO: 1124827 - RNA, 24 nt, Human
uucucagucucuggauuauauuuc

SEQ ID NO: 1124828 - RNA, 19 nt, Human
uuguagcacguaucaauau

SEQ ID NO: 1124829 - RNA, 20 nt, Human
uuuaaacaaguaauacugag

SEQ ID NO: 1124830 - RNA, 20 nt, Human
uuugcccaacuuaaaauugg

SEQ ID NO: 1124831 - RNA, 20 nt, Human
uuugcccaggccaaagaugu

SEQ ID NO: 1124832 - RNA, 20 nt, Human
uuugugguucaccuguguug

SEQ ID NO: 1124833 - RNA, 23 nt, Human
uuuuuggggcucgugcaaagggu

SEQ ID NO: 1124834 - RNA, 20 nt, Human
agagaagggauuccucggau

SEQ ID NO: 1124835 - RNA, 21 nt, Human
agagaagggauuccucggauu

SEQ ID NO: 1124836 - RNA, 23 nt, Human
agggauuccucggauucccaagg

SEQ ID NO: 1124837 - RNA, 23 nt, Human
caaggcacccagcgccccugccu

SEQ ID NO: 1124838 - RNA, 22 nt, Human
cccaaggcacccagcgccccug

SEQ ID NO: 1124839 - RNA, 20 nt, Human
uuccucggauucccaaggca

SEQ ID NO: 1124840 - RNA, 23 nt, Human
uuuaauggggauguguucaaggc

SEQ ID NO: 1124841 - RNA, 22 nt, Human
aaaauacagggacaaauauuac

SEQ ID NO: 1124842 - RNA, 18 nt, Human
aaacaggcagggcauguu

SEQ ID NO: 1124843 - RNA, 22 nt, Human
aaacaucuuauuuaccaaaaua

SEQ ID NO: 1124844 - RNA, 18 nt, Human
aaagcccuccucccgccc

SEQ ID NO: 1124845 - RNA, 20 nt, Human
aacaaugaauaccccucccc

SEQ ID NO: 1124846 - RNA, 24 nt, Human
aacagagggguaaacaugaucuga

SEQ ID NO: 1124847 - RNA, 18 nt, Human
aacugcagaagcuccucu

SEQ ID NO: 1124848 - RNA, 27 nt, Human
aacugcagaagcuccucugucaagaug

SEQ ID NO: 1124849 - RNA, 22 nt, Human
aagaggagaaagggcaggagag

SEQ ID NO: 1124850 - RNA, 24 nt, Human
aagcaaggaauaaaauaagccaaa

SEQ ID NO: 1124851 - RNA, 21 nt, Human
aagcccuccucccgcccacgg

SEQ ID NO: 1124852 - RNA, 22 nt, Human
aauacagaagcagaaaaccgaa

SEQ ID NO: 1124853 - RNA, 23 nt, Human
aauccauuagccaggcccacaug

SEQ ID NO: 1124854 - RNA, 19 nt, Human
acaaaauacagaagcagaa

SEQ ID NO: 1124855 - RNA, 21 nt, Human
acaacuucacauaauacagcu

SEQ ID NO: 1124856 - RNA, 19 nt, Human
acagcuaagaaucugaaca

SEQ ID NO: 1124857 - RNA, 25 nt, Human
acaggcagggcauguuuuuaauaua

SEQ ID NO: 1124858 - RNA, 25 nt, Human
acccauaaacaucuuaucugccuuu

SEQ ID NO: 1124859 - RNA, 21 nt, Human
accccuccccugagugaaucc

SEQ ID NO: 1124860 - RNA, 18 nt, Human
accuggccuagucaauga

SEQ ID NO: 1124861 - RNA, 21 nt, Human
agaaugauuuuuaaaccuuug

SEQ ID NO: 1124862 - RNA, 21 nt, Human
agacagguaguaggagccaga

SEQ ID NO: 1124863 - RNA, 20 nt, Human
agaccgagaccuagacagaa

SEQ ID NO: 1124864 - RNA, 21 nt, Human
agccaugcagacacuauggga

SEQ ID NO: 1124865 - RNA, 18 nt, Human
agcuaagaaucugaacaa

SEQ ID NO: 1124866 - RNA, 27 nt, Human
aggaccaacgaggggaaaccgguaccc

SEQ ID NO: 1124867 - RNA, 24 nt, Human
aggagaguaguaggaaacacagug

SEQ ID NO: 1124868 - RNA, 19 nt, Human
aggcaaauggauucacaag

SEQ ID NO: 1124869 - RNA, 21 nt, Human
aggcaaauggauucacaagaa

SEQ ID NO: 1124870 - RNA, 18 nt, Human
agggauguuaugagucug

SEQ ID NO: 1124871 - RNA, 21 nt, Human
agggcccugagacaggacagg

SEQ ID NO: 1124872 - RNA, 21 nt, Human
auaccccuccccugagugaau

SEQ ID NO: 1124873 - RNA, 22 nt, Human
aucuugacagauacugucagga

SEQ ID NO: 1124874 - RNA, 21 nt, Human
auggcugcauaguauuccaug

SEQ ID NO: 1124875 - RNA, 18 nt, Human
auguggggucggaggcuu

SEQ ID NO: 1124876 - RNA, 21 nt, Human
caaaacaagcacuaaagcccu

SEQ ID NO: 1124877 - RNA, 24 nt, Human
caaaauacagaagcagaaaaccga

SEQ ID NO: 1124878 - RNA, 21 nt, Human
caaaugauuucagcccccucc

SEQ ID NO: 1124879 - RNA, 24 nt, Human
caagaugacccuugagagucccaa

SEQ ID NO: 1124880 - RNA, 23 nt, Human
caaggcaaauggauucacaagaa

SEQ ID NO: 1124881 - RNA, 24 nt, Human
caauacuaaggauuaaaagugaaa

SEQ ID NO: 1124882 - RNA, 19 nt, Human
caaugaauaccccuccccu

SEQ ID NO: 1124883 - RNA, 23 nt, Human
caauugccaccucuauaggugga

SEQ ID NO: 1124884 - RNA, 24 nt, Human
caccaacaaugaauaccccucccc

SEQ ID NO: 1124885 - RNA, 21 nt, Human
cacuaugggaagaauguucca

SEQ ID NO: 1124886 - RNA, 23 nt, Human
cacuuccucugugaagcugagaa

SEQ ID NO: 1124887 - RNA, 21 nt, Human
caggacagggucaagcaugcc

SEQ ID NO: 1124888 - RNA, 21 nt, Human
caggcagagggaacagcaggg

SEQ ID NO: 1124889 - RNA, 22 nt, Human
cagggcccugagacaggacagg

SEQ ID NO: 1124890 - RNA, 19 nt, Human
cauaauacagcuaagaauc

SEQ ID NO: 1124891 - RNA, 22 nt, Human
cauaauacagcuaagaaucuga

SEQ ID NO: 1124892 - RNA, 22 nt, Human
caucaacccauaaucuacauua

SEQ ID NO: 1124893 - RNA, 26 nt, Human
cauggcuucaguucggaugugggguc

SEQ ID NO: 1124894 - RNA, 19 nt, Human
cauucuggcagcaguuucc

SEQ ID NO: 1124895 - RNA, 18 nt, Human
ccauauuuucuuuaucca

SEQ ID NO: 1124896 - RNA, 24 nt, Human
cccacagagacugacaauguacaa

SEQ ID NO: 1124897 - RNA, 19 nt, Human
ccccuguaacuccuugacu

SEQ ID NO: 1124898 - RNA, 23 nt, Human
ccccuguaacuccuugacuggag

SEQ ID NO: 1124899 - RNA, 19 nt, Human
cccugagugaauccauuua

SEQ ID NO: 1124900 - RNA, 18 nt, Human
ccuaguguccaacccagu

SEQ ID NO: 1124901 - RNA, 20 nt, Human
ccucccgcccacgguucugc

SEQ ID NO: 1124902 - RNA, 25 nt, Human
cucacagaagcagcaaaacaagcac

SEQ ID NO: 1124903 - RNA, 19 nt, Human
cucauaaacuccagacaau

SEQ ID NO: 1124904 - RNA, 19 nt, Human
cuccauaccuggccuaguc

SEQ ID NO: 1124905 - RNA, 21 nt, Human
cugaaaagguaugcuuaugaa

SEQ ID NO: 1124906 - RNA, 20 nt, Human
cugcccccaucaacccauaa

SEQ ID NO: 1124907 - RNA, 21 nt, Human
cuggagcagaguaaacaggcu

SEQ ID NO: 1124908 - RNA, 21 nt, Human
gaaaugcugcuggcgcagccc

SEQ ID NO: 1124909 - RNA, 23 nt, Human
gaacugaauauauuacaaagcca

SEQ ID NO: 1124910 - RNA, 18 nt, Human
gacacaaaaaucuugaau

SEQ ID NO: 1124911 - RNA, 26 nt, Human
gacugguuucuaauggacugcuccau

SEQ ID NO: 1124912 - RNA, 20 nt, Human
gagaugguguucaagguaug

SEQ ID NO: 1124913 - RNA, 20 nt, Human
gaggacuauuuaaagcacaa

SEQ ID NO: 1124914 - RNA, 22 nt, Human
gcaaaacaagcacuaaagcccu

SEQ ID NO: 1124915 - RNA, 23 nt, Human
gcacuaaagcccuccucccgccc

SEQ ID NO: 1124916 - RNA, 23 nt, Human
gcacuaaagcccuccucccgccc

SEQ ID NO: 1124917 - RNA, 22 nt, Human
ggaaacaggcagggcauguuuu

SEQ ID NO: 1124918 - RNA, 21 nt, Human
ggacaugaacucauucuuuuu

SEQ ID NO: 1124919 - RNA, 21 nt, Human
gggcuaaauuaaaacccaaca

SEQ ID NO: 1124920 - RNA, 22 nt, Human
gguaacaauucccaacugcaga

SEQ ID NO: 1124921 - RNA, 22 nt, Human
gucuuugggagaccaaaaagca

SEQ ID NO: 1124922 - RNA, 21 nt, Human
guggaaguauaggccuaacaa

SEQ ID NO: 1124923 - RNA, 20 nt, Human
uaacccacagagacugacaa

SEQ ID NO: 1124924 - RNA, 22 nt, Human
uaagcaaugaagcugacaaaca

SEQ ID NO: 1124925 - RNA, 22 nt, Human
uacaaagccaaaagaucugcag

SEQ ID NO: 1124926 - RNA, 18 nt, Human
uacacaugugccauggug

SEQ ID NO: 1124927 - RNA, 24 nt, Human
uacagcuaagaaucugaacaacca

SEQ ID NO: 1124928 - RNA, 21 nt, Human
uaccaaaauagaaaaaggagg

SEQ ID NO: 1124929 - RNA, 23 nt, Human
uacgagaagccaaugggcuaccc

SEQ ID NO: 1124930 - RNA, 20 nt, Human
uacuaaggauuaaaagugaa

SEQ ID NO: 1124931 - RNA, 20 nt, Human
uagaaacacccccacagcau

SEQ ID NO: 1124932 - RNA, 25 nt, Human
uagaacucccaagcacaaggcaaau

SEQ ID NO: 1124933 - RNA, 23 nt, Human
uagaaugauuuuuaaaccuuugg

SEQ ID NO: 1124934 - RNA, 25 nt, Human
uagccaggcccacauggcuucaguu

SEQ ID NO: 1124935 - RNA, 19 nt, Human
uaggaaacacagugagaca

SEQ ID NO: 1124936 - RNA, 18 nt, Human
uagguauuucucuuaaug

SEQ ID NO: 1124937 - RNA, 19 nt, Human
uaguaggagccagaucaug

SEQ ID NO: 1124938 - RNA, 24 nt, Human
uaguuugcugagaauaaugguuuc

SEQ ID NO: 1124939 - RNA, 19 nt, Human
uaucuucacagaaaugacc

SEQ ID NO: 1124940 - RNA, 24 nt, Human
uauugugaauagugcugcaauaaa

SEQ ID NO: 1124941 - RNA, 18 nt, Human
uauuucaccaacaaugaa

SEQ ID NO: 1124942 - RNA, 20 nt, Human
uauuucaccaacaaugaaua

SEQ ID NO: 1124943 - RNA, 21 nt, Human
uccagacaauugggaggagac

SEQ ID NO: 1124944 - RNA, 25 nt, Human
ucccccuguaacuccuugacuggaa

SEQ ID NO: 1124945 - RNA, 21 nt, Human
ucccugagaggccggaugcag

SEQ ID NO: 1124946 - RNA, 20 nt, Human
ucccugcaaaggacaugaac

SEQ ID NO: 1124947 - RNA, 22 nt, Human
ucccuugccucucaccccccga

SEQ ID NO: 1124948 - RNA, 24 nt, Human
ucccuugccucucaccccccgaca

SEQ ID NO: 1124949 - RNA, 20 nt, Human
uccucugugaagcugagaac

SEQ ID NO: 1124950 - RNA, 18 nt, Human
uccuguguuaguuugcug

SEQ ID NO: 1124951 - RNA, 23 nt, Human
uccuugacuggagcagaguaaac

SEQ ID NO: 1124952 - RNA, 22 nt, Human
ucggaggcuuucuauuccggug

SEQ ID NO: 1124953 - RNA, 21 nt, Human
ucuaaaauacagggacaaaua

SEQ ID NO: 1124954 - RNA, 20 nt, Human
ucucaccccccgacaggccc

SEQ ID NO: 1124955 - RNA, 21 nt, Human
ucucuuaaugcuaucacuucc

SEQ ID NO: 1124956 - RNA, 25 nt, Human
ucugcuacaacuugcaaauauagug

SEQ ID NO: 1124957 - RNA, 21 nt, Human
ucuuugggagaccaaaaagca

SEQ ID NO: 1124958 - RNA, 24 nt, Human
ucuuuguuauugugaauagugcug

SEQ ID NO: 1124959 - RNA, 21 nt, Human
ugaaaugcugcuggcgcagcc

SEQ ID NO: 1124960 - RNA, 18 nt, Human
ugaauaaauguggaacug

SEQ ID NO: 1124961 - RNA, 19 nt, Human
ugaaugccaggaucuugag

SEQ ID NO: 1124962 - RNA, 20 nt, Human
ugaaugugcuucacuuccuc

SEQ ID NO: 1124963 - RNA, 20 nt, Human
ugacaaacaacuucacauaa

SEQ ID NO: 1124964 - RNA, 23 nt, Human
ugacagaagcagacccgguccuu

SEQ ID NO: 1124965 - RNA, 20 nt, Human
ugaccauauuguugcccauc

SEQ ID NO: 1124966 - RNA, 24 nt, Human
ugagaauaaugguuuccagcuuca

SEQ ID NO: 1124967 - RNA, 21 nt, Human
ugagacagguaguaggagcca

SEQ ID NO: 1124968 - RNA, 23 nt, Human
ugaggacacaaaaaucuugaaug

SEQ ID NO: 1124969 - RNA, 19 nt, Human
ugagugagaacaugcggug

SEQ ID NO: 1124970 - RNA, 24 nt, Human
ugagugagaacaugcgguguuugg

SEQ ID NO: 1124971 - RNA, 26 nt, Human
ugcccccaucaacccauaaucuacau

SEQ ID NO: 1124972 - RNA, 21 nt, Human
ugccuugauucccccuguaac

SEQ ID NO: 1124973 - RNA, 22 nt, Human
ugcugcaauaaacauauguaug

SEQ ID NO: 1124974 - RNA, 18 nt, Human
uggaaagucacuggagaa

SEQ ID NO: 1124975 - RNA, 21 nt, Human
uggcaguagguguaaaaaaca

SEQ ID NO: 1124976 - RNA, 19 nt, Human
uggcuucaguucggaugug

SEQ ID NO: 1124977 - RNA, 18 nt, Human
ugggaaaggccuuugaua

SEQ ID NO: 1124978 - RNA, 20 nt, Human
ugggaagaauguuccaggca

SEQ ID NO: 1124979 - RNA, 20 nt, Human
ugggcucacagaagcagcaa

SEQ ID NO: 1124980 - RNA, 21 nt, Human
uguaaaaacuggaaagucacu

SEQ ID NO: 1124981 - RNA, 19 nt, Human
uguaugcaugugucuuuau

SEQ ID NO: 1124982 - RNA, 21 nt, Human
uguaugcaugugucuuuauag

SEQ ID NO: 1124983 - RNA, 19 nt, Human
ugugauguuccccccacug

SEQ ID NO: 1124984 - RNA, 22 nt, Human
uguggaacugaauauauuacaa

SEQ ID NO: 1124985 - RNA, 20 nt, Human
uguuaugagucugagaucac

SEQ ID NO: 1124986 - RNA, 24 nt, Human
uguuaugagucugagaucacagag

SEQ ID NO: 1124987 - RNA, 24 nt, Human
uguuugguuuucuguuccuguguu

SEQ ID NO: 1124988 - RNA, 20 nt, Human
uuaaagcacaaggccagaaa

SEQ ID NO: 1124989 - RNA, 18 nt, Human
uuacauagguacacaugu

SEQ ID NO: 1124990 - RNA, 24 nt, Human
uuaugagugagaacaugcgguguu

SEQ ID NO: 1124991 - RNA, 23 nt, Human
uucaucuacuauccacauuaccg

SEQ ID NO: 1124992 - RNA, 23 nt, Human
uugcugagaauaaugguuuccag

SEQ ID NO: 1124993 - RNA, 22 nt, Human
uuucaccaacaaugaauacccc

SEQ ID NO: 1124994 - RNA, 19 nt, Human
uuuccagcuucauccaugu

SEQ ID NO: 1124995 - RNA, 22 nt, Human
uuuggggccagcaucuugacag

SEQ ID NO: 1124996 - RNA, 22 nt, Human
uuuuauggcugcauaguauucc

SEQ ID NO: 1124997 - RNA, 23 nt, Human
acggggagugauugggcgagcug

SEQ ID NO: 1124998 - RNA, 23 nt, Human
agcaggugcgcggagccucccac

SEQ ID NO: 1124999 - RNA, 20 nt, Human
agccgcgggggccccagacg

SEQ ID NO: 1125000 - RNA, 19 nt, Human
auccucaauagucuguucc

SEQ ID NO: 1125001 - RNA, 20 nt, Human
auguagcagggggugaugag

SEQ ID NO: 1125002 - RNA, 21 nt, Human
auguagcagggggugaugagc

SEQ ID NO: 1125003 - RNA, 19 nt, Human
cacccggggcgugcgggcg

SEQ ID NO: 1125004 - RNA, 21 nt, Human
cacccggggcgugcgggcgcc

SEQ ID NO: 1125005 - RNA, 19 nt, Human
cacuccauucucaagcccu

SEQ ID NO: 1125006 - RNA, 22 nt, Human
cagcaggugcgcggagccuccc

SEQ ID NO: 1125007 - RNA, 18 nt, Human
cagccgagcggcucaggc

SEQ ID NO: 1125008 - RNA, 18 nt, Human
cagcgcuggcuaggcgcg

SEQ ID NO: 1125009 - RNA, 21 nt, Human
cagggcaggauacugccucuc

SEQ ID NO: 1125010 - RNA, 23 nt, Human
caucgccugaggcugucacucca

SEQ ID NO: 1125011 - RNA, 19 nt, Human
ccaccgccgcugucacucg

SEQ ID NO: 1125012 - RNA, 25 nt, Human
ccaccgccgcugucacucgccaccc

SEQ ID NO: 1125013 - RNA, 24 nt, Human
ccccaccgccgcugucacucgcca

SEQ ID NO: 1125014 - RNA, 21 nt, Human
cccggugcuucuuggccgggg

SEQ ID NO: 1125015 - RNA, 22 nt, Human
cccucggcucagggaggguucc

SEQ ID NO: 1125016 - RNA, 24 nt, Human
ccgcugucacucgccaccccgcgc

SEQ ID NO: 1125017 - RNA, 27 nt, Human
cgccaccccgcgcuccagcaggugcgc

SEQ ID NO: 1125018 - RNA, 19 nt, Human
cggcucaggccggccgcaa

SEQ ID NO: 1125019 - RNA, 20 nt, Human
cggcucagggaggguuccgg

SEQ ID NO: 1125020 - RNA, 23 nt, Human
cucggcucagggaggguuccggc

SEQ ID NO: 1125021 - RNA, 20 nt, Human
cucuguguccagggcaggau

SEQ ID NO: 1125022 - RNA, 22 nt, Human
gcccggugcuucuuggccgggg

SEQ ID NO: 1125023 - RNA, 19 nt, Human
gccggggcggcuacggagg

SEQ ID NO: 1125024 - RNA, 18 nt, Human
gcgcuggcuaggcgcggg

SEQ ID NO: 1125025 - RNA, 22 nt, Human
gcuccagcaggugcgcggagcc

SEQ ID NO: 1125026 - RNA, 23 nt, Human
ggccggccgcaaggccgccgucg

SEQ ID NO: 1125027 - RNA, 20 nt, Human
ggcuacggaggccagggcag

SEQ ID NO: 1125028 - RNA, 19 nt, Human
ggcuaggcgcggggcugcc

SEQ ID NO: 1125029 - RNA, 26 nt, Human
gggcaguucuggacccucggcucagg

SEQ ID NO: 1125030 - RNA, 18 nt, Human
ggggacugagacggggag

SEQ ID NO: 1125031 - RNA, 24 nt, Human
guccagggcaggauacugccucuc

SEQ ID NO: 1125032 - RNA, 21 nt, Human
uccagggcaggauacugccuc

SEQ ID NO: 1125033 - RNA, 22 nt, Human
ucgagacagacaucgccugagg

SEQ ID NO: 1125034 - RNA, 22 nt, Human
ucuuggccggggcggcuacgga

SEQ ID NO: 1125035 - RNA, 18 nt, Human
uggccggggcggcuacgg

SEQ ID NO: 1125036 - RNA, 20 nt, Human
uggcuaggcgcggggcugcc

SEQ ID NO: 1125037 - RNA, 22 nt, Human
aaaaaaaaaaaaaacaacuuaa

SEQ ID NO: 1125038 - RNA, 23 nt, Human
aaaaacaacaacaacgaagagaa

SEQ ID NO: 1125039 - RNA, 27 nt, Human
aaaaacaccauaaaucauggcaaaaga

SEQ ID NO: 1125040 - RNA, 20 nt, Human
aaaacaacaacaacgaagag

SEQ ID NO: 1125041 - RNA, 19 nt, Human
aaaacaccauaaaucaugg

SEQ ID NO: 1125042 - RNA, 19 nt, Human
aaacaacaacaacgaagag

SEQ ID NO: 1125043 - RNA, 18 nt, Human
aaacaccauaaaucaugg

SEQ ID NO: 1125044 - RNA, 21 nt, Human
aaauaaaugcucgguuaccua

SEQ ID NO: 1125045 - RNA, 24 nt, Human
aacaaauuguagacaaccauacaa

SEQ ID NO: 1125046 - RNA, 26 nt, Human
aagagaaaacagcaucagugccaaaa

SEQ ID NO: 1125047 - RNA, 23 nt, Human
acaaaaaaaaaaaaaaacaacuu

SEQ ID NO: 1125048 - RNA, 24 nt, Human
acaaaaaaaaaaaaaaacaacuua

SEQ ID NO: 1125049 - RNA, 24 nt, Human
acaaaguaucccuuagcaccaaaa

SEQ ID NO: 1125050 - RNA, 19 nt, Human
acaaagucuucaaaccaaa

SEQ ID NO: 1125051 - RNA, 24 nt, Human
acaaccccauauuuucacuggcca

SEQ ID NO: 1125052 - RNA, 24 nt, Human
acaacgaagagaaaaaacagaccu

SEQ ID NO: 1125053 - RNA, 22 nt, Human
acagcaucagugccaaaaugaa

SEQ ID NO: 1125054 - RNA, 23 nt, Human
acaguagguacuuaauaaauacc

SEQ ID NO: 1125055 - RNA, 23 nt, Human
accaucaucuaugaaucucugcu

SEQ ID NO: 1125056 - RNA, 22 nt, Human
accaucuuuucuuacuccuggc

SEQ ID NO: 1125057 - RNA, 27 nt, Human
acgcugccgcuucucccucucaugggc

SEQ ID NO: 1125058 - RNA, 19 nt, Human
acugaaagaacaaagacaa

SEQ ID NO: 1125059 - RNA, 21 nt, Human
agaaaaaacagaccagcagaa

SEQ ID NO: 1125060 - RNA, 22 nt, Human
agacaaagucuucaaaccaaaa

SEQ ID NO: 1125061 - RNA, 19 nt, Human
agacaagagaaaacagcau

SEQ ID NO: 1125062 - RNA, 19 nt, Human
agacgucccaaugcagugg

SEQ ID NO: 1125063 - RNA, 25 nt, Human
agagaaaaaacagaccagcagaaag

SEQ ID NO: 1125064 - RNA, 23 nt, Human
aggaaaaaaaaaaucccacaaaa

SEQ ID NO: 1125065 - RNA, 24 nt, Human
aggaacuaacuguacaaccccaua

SEQ ID NO: 1125066 - RNA, 20 nt, Human
aguugcuuucauuucuuaag

SEQ ID NO: 1125067 - RNA, 20 nt, Human
aucagggcaggcaaagugag

SEQ ID NO: 1125068 - RNA, 18 nt, Human
aucccuuagcaccaaaaa

SEQ ID NO: 1125069 - RNA, 23 nt, Human
augaaaggaacuccagugacuca

SEQ ID NO: 1125070 - RNA, 23 nt, Human
augaugcuuuuucuuacucccua

SEQ ID NO: 1125071 - RNA, 24 nt, Human
augccuuaaaaaaaaagcuguaua

SEQ ID NO: 1125072 - RNA, 21 nt, Human
augcgcuuaggaaacuguggc

SEQ ID NO: 1125073 - RNA, 20 nt, Human
auguaucaaguauuacaguu

SEQ ID NO: 1125074 - RNA, 21 nt, Human
auuucauuagggggaggggca

SEQ ID NO: 1125075 - RNA, 24 nt, Human
caaaaaacaccauaaaucauggca

SEQ ID NO: 1125076 - RNA, 22 nt, Human
caaaaaaucuacaggaacccca

SEQ ID NO: 1125077 - RNA, 22 nt, Human
caaaaaaucuacaggaacccca

SEQ ID NO: 1125078 - RNA, 23 nt, Human
caaaguaucccuuagcaccaaaa

SEQ ID NO: 1125079 - RNA, 20 nt, Human
caacaacaacgaagagaaaa

SEQ ID NO: 1125080 - RNA, 22 nt, Human
caagaggaauaauggucuguug

SEQ ID NO: 1125081 - RNA, 18 nt, Human
caaggcacuguguacgaa

SEQ ID NO: 1125082 - RNA, 22 nt, Human
caagugcagacgucccaaugca

SEQ ID NO: 1125083 - RNA, 24 nt, Human
cacaguagguacuuaauaaauacc

SEQ ID NO: 1125084 - RNA, 19 nt, Human
caccagcaaaucucaaaaa

SEQ ID NO: 1125085 - RNA, 21 nt, Human
caccucauacccuuaccccca

SEQ ID NO: 1125086 - RNA, 23 nt, Human
cagaagaaacuuccugaucaccu

SEQ ID NO: 1125087 - RNA, 19 nt, Human
cagaccagcagaaagaacu

SEQ ID NO: 1125088 - RNA, 22 nt, Human
cagcaaaucucaaaaacccaaa

SEQ ID NO: 1125089 - RNA, 20 nt, Human
cagcagaaagaacuauucug

SEQ ID NO: 1125090 - RNA, 25 nt, Human
cauacaaagauaaaaucaaacuaac

SEQ ID NO: 1125091 - RNA, 24 nt, Human
cauauacauaaauauauacauaua

SEQ ID NO: 1125092 - RNA, 25 nt, Human
cauuuugucaugcuggugaauuacu

SEQ ID NO: 1125093 - RNA, 21 nt, Human
ccaaaaaaucuacaggaaccc

SEQ ID NO: 1125094 - RNA, 19 nt, Human
ccaguguguuuccaccucu

SEQ ID NO: 1125095 - RNA, 21 nt, Human
cccacaaaaaaucuaaacccu

SEQ ID NO: 1125096 - RNA, 18 nt, Human
ccuuuacaaaguuucaaa

SEQ ID NO: 1125097 - RNA, 24 nt, Human
cuaauacugacgaggaaugucuaa

SEQ ID NO: 1125098 - RNA, 25 nt, Human
cucaaaaacccaaaccuacaucaaa

SEQ ID NO: 1125099 - RNA, 22 nt, Human
cugaucaccucauacccuuacc

SEQ ID NO: 1125100 - RNA, 19 nt, Human
cuguguauguaucuucucc

SEQ ID NO: 1125101 - RNA, 23 nt, Human
cuguguauguaucuucucccacu

SEQ ID NO: 1125102 - RNA, 20 nt, Human
cuucaagaggaauaaugguc

SEQ ID NO: 1125103 - RNA, 24 nt, Human
cuugcagcuauagggcacuggaga

SEQ ID NO: 1125104 - RNA, 20 nt, Human
cuuuugaccaaaaauucuag

SEQ ID NO: 1125105 - RNA, 18 nt, Human
gaaguuuugcuuucauuu

SEQ ID NO: 1125106 - RNA, 23 nt, Human
gacucuaugaggaacaauugcuu

SEQ ID NO: 1125107 - RNA, 21 nt, Human
gagcucauuugguuucuucaa

SEQ ID NO: 1125108 - RNA, 21 nt, Human
gcaaaauaacauucuaggaac

SEQ ID NO: 1125109 - RNA, 20 nt, Human
gcaaaucucaaaaacccaaa

SEQ ID NO: 1125110 - RNA, 19 nt, Human
gcauuuuuuucauauggaa

SEQ ID NO: 1125111 - RNA, 21 nt, Human
gccaaaaugaaaggaacucca

SEQ ID NO: 1125112 - RNA, 28 nt, Human
gccaaaaugaaaggaacuccagugacuc

SEQ ID NO: 1125113 - RNA, 19 nt, Human
gcugccgcuucucccucuc

SEQ ID NO: 1125114 - RNA, 23 nt, Human
ggcaggcaaagugaggguggagc

SEQ ID NO: 1125115 - RNA, 24 nt, Human
ggccuuuggcuaaaugccauuuuu

SEQ ID NO: 1125116 - RNA, 24 nt, Human
guggagcucauuugguuucuucaa

SEQ ID NO: 1125117 - RNA, 22 nt, Human
uaaacagaagcagcauaucauc

SEQ ID NO: 1125118 - RNA, 24 nt, Human
uaaacagaagcagcauaucaucca

SEQ ID NO: 1125119 - RNA, 21 nt, Human
uaaauuacaaucauuuucccc

SEQ ID NO: 1125120 - RNA, 18 nt, Human
uacaaaaaaaaaaaaaaa

SEQ ID NO: 1125121 - RNA, 21 nt, Human
uaccagauaauuuuagacccu

SEQ ID NO: 1125122 - RNA, 24 nt, Human
uacuuuguagcugcuacaauaguu

SEQ ID NO: 1125123 - RNA, 22 nt, Human
uagacaaagucuucaaaccaaa

SEQ ID NO: 1125124 - RNA, 18 nt, Human
uauaugauuuuucauuuu

SEQ ID NO: 1125125 - RNA, 23 nt, Human
uaucugacacuuaacacuuacuu

SEQ ID NO: 1125126 - RNA, 22 nt, Human
uauuaugggcaaggcacugugu

SEQ ID NO: 1125127 - RNA, 24 nt, Human
uauuugaagagcaaaugaugcaug

SEQ ID NO: 1125128 - RNA, 23 nt, Human
ucaaaaaagcugagauuaugaaa

SEQ ID NO: 1125129 - RNA, 24 nt, Human
ucaugaugcuuuuucuuacucccu

SEQ ID NO: 1125130 - RNA, 23 nt, Human
ucaugcuggugaauuacuuugua

SEQ ID NO: 1125131 - RNA, 23 nt, Human
ucaugggcucugcaggccgccau

SEQ ID NO: 1125132 - RNA, 23 nt, Human
uccaagcacauagauauuugaag

SEQ ID NO: 1125133 - RNA, 24 nt, Human
uccagaagaaacuuccugaucacc

SEQ ID NO: 1125134 - RNA, 31 nt, Human
ucuaauacuauuuugacuuuugaccaaaaaa

SEQ ID NO: 1125135 - RNA, 23 nt, Human
ucucaaaaacccaaaccuacauc

SEQ ID NO: 1125136 - RNA, 19 nt, Human
ucucccucucaugggcucu

SEQ ID NO: 1125137 - RNA, 23 nt, Human
ucucccucucaugggcucugcag

SEQ ID NO: 1125138 - RNA, 18 nt, Human
ucugaacacauuugaaac

SEQ ID NO: 1125139 - RNA, 25 nt, Human
ucugacacuuaacacuuacuucauc

SEQ ID NO: 1125140 - RNA, 21 nt, Human
ugaaagaacaaagacaaagaa

SEQ ID NO: 1125141 - RNA, 22 nt, Human
ugaaagaauuucacuucacagg

SEQ ID NO: 1125142 - RNA, 22 nt, Human
ugaaauauuuggucuuuuuuca

SEQ ID NO: 1125143 - RNA, 21 nt, Human
ugaaucaccaaccugcugcca

SEQ ID NO: 1125144 - RNA, 24 nt, Human
ugacauagacuguaucagugauug

SEQ ID NO: 1125145 - RNA, 20 nt, Human
ugaccaaaaauucuagugcu

SEQ ID NO: 1125146 - RNA, 21 nt, Human
ugaccauuuugucaugcuggu

SEQ ID NO: 1125147 - RNA, 24 nt, Human
ugacugcaugacuaauucaacucu

SEQ ID NO: 1125148 - RNA, 19 nt, Human
ugaggaaaaaaaaaauccc

SEQ ID NO: 1125149 - RNA, 23 nt, Human
ugaggcaggaccaaaaacuaugc

SEQ ID NO: 1125150 - RNA, 22 nt, Human
ugaucaccucauacccuuaccc

SEQ ID NO: 1125151 - RNA, 23 nt, Human
ugaucaccucauacccuuacccc

SEQ ID NO: 1125152 - RNA, 22 nt, Human
ugcaucacuguuaaacagaagc

SEQ ID NO: 1125153 - RNA, 21 nt, Human
ugcauuaccagcaugcaaacc

SEQ ID NO: 1125154 - RNA, 22 nt, Human
ugcauuaccagcaugcaaaccu

SEQ ID NO: 1125155 - RNA, 21 nt, Human
ugccaaaaugaaaggaacucc

SEQ ID NO: 1125156 - RNA, 29 nt, Human
ugcgcacauucacauacuuacauauacau

SEQ ID NO: 1125157 - RNA, 19 nt, Human
uggaaguucaaaaaagcug

SEQ ID NO: 1125158 - RNA, 30 nt, Human
uggauuuaagaaaaaugaggaaaaaaaaaa

SEQ ID NO: 1125159 - RNA, 19 nt, Human
uggcuccaagcacauagau

SEQ ID NO: 1125160 - RNA, 21 nt, Human
uguggaaguucaaaaaagcug

SEQ ID NO: 1125161 - RNA, 20 nt, Human
uguuuccuuuacaaaguuuc

SEQ ID NO: 1125162 - RNA, 23 nt, Human
uuacaauuaaaaacaacaacaac

SEQ ID NO: 1125163 - RNA, 23 nt, Human
uucaaaaaagcugagauuaugaa

SEQ ID NO: 1125164 - RNA, 25 nt, Human
uucacacauagcaaaguuuucaaac

SEQ ID NO: 1125165 - RNA, 23 nt, Human
uucaccagcaaaucucaaaaacc

SEQ ID NO: 1125166 - RNA, 24 nt, Human
uucaccagcaaaucucaaaaaccc

SEQ ID NO: 1125167 - RNA, 18 nt, Human
uucacuggccacagcugc

SEQ ID NO: 1125168 - RNA, 19 nt, Human
uuccaaauaucacuaacca

SEQ ID NO: 1125169 - RNA, 20 nt, Human
uuuucagccacauaauguug

SEQ ID NO: 1125170 - RNA, 24 nt, Human
aaacggagacccaggccgggcgca

SEQ ID NO: 1125171 - RNA, 18 nt, Human
acagagugagacucugcc

SEQ ID NO: 1125172 - RNA, 24 nt, Human
accccgucucuacuaaaaauacaa

SEQ ID NO: 1125173 - RNA, 24 nt, Human
acgccacugcccuccagccugggc

SEQ ID NO: 1125174 - RNA, 18 nt, Human
acugcccuccagccuggg

SEQ ID NO: 1125175 - RNA, 24 nt, Human
acugcccuccagccugggcgacag

SEQ ID NO: 1125176 - RNA, 21 nt, Human
agaauccaagucugccugacc

SEQ ID NO: 1125177 - RNA, 24 nt, Human
agcacuuugggaggcugagguggg

SEQ ID NO: 1125178 - RNA, 20 nt, Human
agccgggcgugguggugggc

SEQ ID NO: 1125179 - RNA, 23 nt, Human
agccgggcgugguggugggcgcc

SEQ ID NO: 1125180 - RNA, 24 nt, Human
agccugggcgacagagugagacuc

SEQ ID NO: 1125181 - RNA, 21 nt, Human
agcuagagaaacggagaccca

SEQ ID NO: 1125182 - RNA, 23 nt, Human
aggcaggcauuuucauucuugcu

SEQ ID NO: 1125183 - RNA, 18 nt, Human
aggcccagggcugggcaa

SEQ ID NO: 1125184 - RNA, 24 nt, Human
agguggggcuugcagugagccgag

SEQ ID NO: 1125185 - RNA, 24 nt, Human
aggugggugaaucacgaggucagg

SEQ ID NO: 1125186 - RNA, 23 nt, Human
aguggcucaugccuguaauccca

SEQ ID NO: 1125187 - RNA, 24 nt, Human
aguggcucaugccuguaaucccag

SEQ ID NO: 1125188 - RNA, 24 nt, Human
aucacgccacugcccuccagccug

SEQ ID NO: 1125189 - RNA, 19 nt, Human
augccuguaaucccagcac

SEQ ID NO: 1125190 - RNA, 24 nt, Human
caacaaaccacaaggcaggcauuu

SEQ ID NO: 1125191 - RNA, 24 nt, Human
cacugcccuccagccugggcgaca

SEQ ID NO: 1125192 - RNA, 20 nt, Human
cagaagguggggcuugcagu

SEQ ID NO: 1125193 - RNA, 24 nt, Human
cagcacuuugggaggcugaggugg

SEQ ID NO: 1125194 - RNA, 24 nt, Human
cagcuacucgggaggcugaggcag

SEQ ID NO: 1125195 - RNA, 21 nt, Human
cagggcugggcaaagggcagg

SEQ ID NO: 1125196 - RNA, 24 nt, Human
caguugccuuccuuccuaaggucc

SEQ ID NO: 1125197 - RNA, 20 nt, Human
caugccuguaaucccagcac

SEQ ID NO: 1125198 - RNA, 24 nt, Human
caugccuguaaucccagcacuuug

SEQ ID NO: 1125199 - RNA, 21 nt, Human
cauuucacagcuagagaaacg

SEQ ID NO: 1125200 - RNA, 20 nt, Human
ccacugcccuccagccuggg

SEQ ID NO: 1125201 - RNA, 21 nt, Human
ccacugcccuccagccugggc

SEQ ID NO: 1125202 - RNA, 21 nt, Human
ccacugcccuccagccugggc

SEQ ID NO: 1125203 - RNA, 23 nt, Human
ccacugcccuccagccugggcga

SEQ ID NO: 1125204 - RNA, 24 nt, Human
ccacugcccuccagccugggcgac

SEQ ID NO: 1125205 - RNA, 26 nt, Human
ccacuugccacgcacaaaaauaguuc

SEQ ID NO: 1125206 - RNA, 25 nt, Human
ccaggccgggcgcaguggcucaugc

SEQ ID NO: 1125207 - RNA, 20 nt, Human
cccagcuggagcugagauuc

SEQ ID NO: 1125208 - RNA, 22 nt, Human
ccugggcgacagagugagacuc

SEQ ID NO: 1125209 - RNA, 22 nt, Human
ccuguaaucccagcacuuuggg

SEQ ID NO: 1125210 - RNA, 21 nt, Human
ccuguagucccagcuacucgg

SEQ ID NO: 1125211 - RNA, 22 nt, Human
ccuguagucccagcuacucggg

SEQ ID NO: 1125212 - RNA, 26 nt, Human
cgcacaaaaauaguucccuaccauca

SEQ ID NO: 1125213 - RNA, 23 nt, Human
cgccuguagucccagcuacucgg

SEQ ID NO: 1125214 - RNA, 24 nt, Human
cgccuguagucccagcuacucggg

SEQ ID NO: 1125215 - RNA, 19 nt, Human
cggugaaaccccgucucua

SEQ ID NO: 1125216 - RNA, 24 nt, Human
cucaugccuguaaucccagcacuu

SEQ ID NO: 1125217 - RNA, 20 nt, Human
cuccagccugggcgacagag

SEQ ID NO: 1125218 - RNA, 20 nt, Human
cugaccccaaaggcuuuuuc

SEQ ID NO: 1125219 - RNA, 19 nt, Human
cuugcagugagccgagauc

SEQ ID NO: 1125220 - RNA, 24 nt, Human
cuuggcuaaugcggugaaaccccg

SEQ ID NO: 1125221 - RNA, 23 nt, Human
gagaucacgccacugcccuccag

SEQ ID NO: 1125222 - RNA, 24 nt, Human
gaucugugcugggugggccccagg

SEQ ID NO: 1125223 - RNA, 22 nt, Human
gccacugcccuccagccugggc

SEQ ID NO: 1125224 - RNA, 24 nt, Human
gcuaaugcggugaaaccccgucuc

SEQ ID NO: 1125225 - RNA, 24 nt, Human
gcugagccgcugagccgcugaggg

SEQ ID NO: 1125226 - RNA, 23 nt, Human
ggagacccaggccgggcgcagug

SEQ ID NO: 1125227 - RNA, 23 nt, Human
ggccgggcgcaguggcucaugcc

SEQ ID NO: 1125228 - RNA, 23 nt, Human
ggcgcaguggcucaugccuguaa

SEQ ID NO: 1125229 - RNA, 22 nt, Human
ggcgugguggugggcgccugua

SEQ ID NO: 1125230 - RNA, 21 nt, Human
ggcuugcagugagccgagauc

SEQ ID NO: 1125231 - RNA, 18 nt, Human
ggggcuugcagugagccg

SEQ ID NO: 1125232 - RNA, 24 nt, Human
ggggcuugcagugagccgagauca

SEQ ID NO: 1125233 - RNA, 18 nt, Human
ggugaaucacgaggucag

SEQ ID NO: 1125234 - RNA, 24 nt, Human
gguggugggcgccuguagucccag

SEQ ID NO: 1125235 - RNA, 25 nt, Human
guucccuaccaucaaggcaagagug

SEQ ID NO: 1125236 - RNA, 19 nt, Human
uaaacuuuuauuuucuccc

SEQ ID NO: 1125237 - RNA, 19 nt, Human
uaagccgggcgugguggug

SEQ ID NO: 1125238 - RNA, 22 nt, Human
uaaugcggugaaaccccgucuc

SEQ ID NO: 1125239 - RNA, 19 nt, Human
uacaucucagauuccuucu

SEQ ID NO: 1125240 - RNA, 24 nt, Human
uagaauccaagucugccugacccc

SEQ ID NO: 1125241 - RNA, 18 nt, Human
ucacgaggucaggagauc

SEQ ID NO: 1125242 - RNA, 24 nt, Human
ucacgaggucaggagaucgagacc

SEQ ID NO: 1125243 - RNA, 23 nt, Human
ucacgccacugcccuccagccug

SEQ ID NO: 1125244 - RNA, 24 nt, Human
ucagaagccucacaguugccuucc

SEQ ID NO: 1125245 - RNA, 22 nt, Human
ucaugccuguaaucccagcacu

SEQ ID NO: 1125246 - RNA, 25 nt, Human
ucauucuugcuaccuccucuucaca

SEQ ID NO: 1125247 - RNA, 20 nt, Human
uccacaucaaggauccucuu

SEQ ID NO: 1125248 - RNA, 23 nt, Human
uccagccugggcgacagagugag

SEQ ID NO: 1125249 - RNA, 24 nt, Human
uccagccugggcgacagagugaga

SEQ ID NO: 1125250 - RNA, 24 nt, Human
ucccuaccaucaaggcaagaguug

SEQ ID NO: 1125251 - RNA, 18 nt, Human
uccuucucagaagccuca

SEQ ID NO: 1125252 - RNA, 21 nt, Human
ucucagagcaacuggucugug

SEQ ID NO: 1125253 - RNA, 22 nt, Human
ucucuacuaaaaauacaaaaaa

SEQ ID NO: 1125254 - RNA, 19 nt, Human
ucugugcugggugggcccc

SEQ ID NO: 1125255 - RNA, 19 nt, Human
ugagagagaucagaccagg

SEQ ID NO: 1125256 - RNA, 21 nt, Human
ugagagagaucagaccaggua

SEQ ID NO: 1125257 - RNA, 22 nt, Human
ugagccgagaucacgccacugc

SEQ ID NO: 1125258 - RNA, 23 nt, Human
ugaggcaguagaauggcgugaac

SEQ ID NO: 1125259 - RNA, 24 nt, Human
ugaggcaguagaauggcgugaacu

SEQ ID NO: 1125260 - RNA, 25 nt, Human
ugaggcaguagaauggcgugaacuc

SEQ ID NO: 1125261 - RNA, 24 nt, Human
ugaggugggugaaucacgagguca

SEQ ID NO: 1125262 - RNA, 23 nt, Human
ugaggugggugaaucacgagguu

SEQ ID NO: 1125263 - RNA, 24 nt, Human
ugcagauuggaggcccagggcugg

SEQ ID NO: 1125264 - RNA, 18 nt, Human
ugccaaaguccggcaggg

SEQ ID NO: 1125265 - RNA, 21 nt, Human
ugccacgcacaaaaauaguuc

SEQ ID NO: 1125266 - RNA, 25 nt, Human
ugccacgcacaaaaauaguucccua

SEQ ID NO: 1125267 - RNA, 22 nt, Human
ugccugaccccaaaggccggcg

SEQ ID NO: 1125268 - RNA, 23 nt, Human
ugccuguaaucccagcacuuugg

SEQ ID NO: 1125269 - RNA, 23 nt, Human
ugccuguaaucccagcacuuugg

SEQ ID NO: 1125270 - RNA, 20 nt, Human
ugcugggugggccccaggcc

SEQ ID NO: 1125271 - RNA, 19 nt, Human
uggagacaagauugcucag

SEQ ID NO: 1125272 - RNA, 18 nt, Human
uggaggcccagggcuggg

SEQ ID NO: 1125273 - RNA, 19 nt, Human
uggcgugaacucagaaggu

SEQ ID NO: 1125274 - RNA, 24 nt, Human
uggcgugaacucagaagguggggc

SEQ ID NO: 1125275 - RNA, 21 nt, Human
uggcuaaugcggugaaacccc

SEQ ID NO: 1125276 - RNA, 24 nt, Human
uggcucaugccuguaaucccagca

SEQ ID NO: 1125277 - RNA, 19 nt, Human
ugggaggcugaggugggug

SEQ ID NO: 1125278 - RNA, 24 nt, Human
ugggaggcugaggugggugaauca

SEQ ID NO: 1125279 - RNA, 21 nt, Human
ugggcaaagggcaggaacaga

SEQ ID NO: 1125280 - RNA, 24 nt, Human
ugggccccaggcccgugaguccag

SEQ ID NO: 1125281 - RNA, 21 nt, Human
ugggcgacagagugagacucu

SEQ ID NO: 1125282 - RNA, 24 nt, Human
ugguggugggcgccuguaguccca

SEQ ID NO: 1125283 - RNA, 23 nt, Human
uuagaacagucauuucacagcua

SEQ ID NO: 1125284 - RNA, 20 nt, Human
uucccuaccaucaaggcaag

SEQ ID NO: 1125285 - RNA, 20 nt, Human
uugcagugagccgagaucac

SEQ ID NO: 1125286 - RNA, 21 nt, Human
uugcagugagccgagaucacg

SEQ ID NO: 1125287 - RNA, 22 nt, Human
uuggaacugagagaagaacucc

SEQ ID NO: 1125288 - RNA, 24 nt, Human
uuggcuaaugcggugaaaccccgu

SEQ ID NO: 1125289 - RNA, 25 nt, Human
uugggaggcugaggugggugaauca

SEQ ID NO: 1125290 - RNA, 18 nt, Human
aaagguucuagggaggcg

SEQ ID NO: 1125291 - RNA, 18 nt, Human
aaagugcuggagggcagg

SEQ ID NO: 1125292 - RNA, 25 nt, Human
aaccaagaacugggaagggggccag

SEQ ID NO: 1125293 - RNA, 23 nt, Human
aaugugccauccugggaagaggg

SEQ ID NO: 1125294 - RNA, 18 nt, Human
acacccaggacagacagc

SEQ ID NO: 1125295 - RNA, 21 nt, Human
acagccccgugcaaaaugaaa

SEQ ID NO: 1125296 - RNA, 23 nt, Human
acauaauuugcacagccccgugc

SEQ ID NO: 1125297 - RNA, 18 nt, Human
accaagacagugagggcu

SEQ ID NO: 1125298 - RNA, 20 nt, Human
acugaguccccgaaggguag

SEQ ID NO: 1125299 - RNA, 20 nt, Human
agaaagguucuagggaggcg

SEQ ID NO: 1125300 - RNA, 21 nt, Human
agaaggaaaugugacccagga

SEQ ID NO: 1125301 - RNA, 20 nt, Human
agacagccagcguggacuug

SEQ ID NO: 1125302 - RNA, 24 nt, Human
agacggcaacagcaaaguacuaaa

SEQ ID NO: 1125303 - RNA, 18 nt, Human
agacugggucuacgugcc

SEQ ID NO: 1125304 - RNA, 18 nt, Human
agagagagagagagaggc

SEQ ID NO: 1125305 - RNA, 24 nt, Human
agcagggagacgcgacgaauacca

SEQ ID NO: 1125306 - RNA, 20 nt, Human
agcauauuuuaggggucgag

SEQ ID NO: 1125307 - RNA, 21 nt, Human
agcaucuacacccaggacaga

SEQ ID NO: 1125308 - RNA, 18 nt, Human
aggaggggccgugaggug

SEQ ID NO: 1125309 - RNA, 25 nt, Human
agucaagaggagaaagaggcccauu

SEQ ID NO: 1125310 - RNA, 23 nt, Human
caaaaugaaaacacaagaacccc

SEQ ID NO: 1125311 - RNA, 19 nt, Human
caaacagugaccaagccag

SEQ ID NO: 1125312 - RNA, 27 nt, Human
caacagcaaaguacuaaaccaaguaca

SEQ ID NO: 1125313 - RNA, 21 nt, Human
caagacagugagggcuggagc

SEQ ID NO: 1125314 - RNA, 21 nt, Human
cacaccccugggcuuccagaa

SEQ ID NO: 1125315 - RNA, 21 nt, Human
cacagccccgugcaaaaugaa

SEQ ID NO: 1125316 - RNA, 18 nt, Human
cacauaauuugcacagcc

SEQ ID NO: 1125317 - RNA, 24 nt, Human
caccaaaucagcaucuacacccag

SEQ ID NO: 1125318 - RNA, 20 nt, Human
cagaccaagacagugagggc

SEQ ID NO: 1125319 - RNA, 24 nt, Human
cagagccucuggagucuuguacau

SEQ ID NO: 1125320 - RNA, 23 nt, Human
cagcaaacagugaccaagccaga

SEQ ID NO: 1125321 - RNA, 21 nt, Human
cagcgccucgcccacucgggg

SEQ ID NO: 1125322 - RNA, 18 nt, Human
caggagggaaagguaaug

SEQ ID NO: 1125323 - RNA, 19 nt, Human
caggccgagggaucuccaa

SEQ ID NO: 1125324 - RNA, 19 nt, Human
ccaagaacugggaaggggg

SEQ ID NO: 1125325 - RNA, 24 nt, Human
ccaggcacagcccgaggcugugcu

SEQ ID NO: 1125326 - RNA, 19 nt, Human
ccaucuaauaagcaaacuc

SEQ ID NO: 1125327 - RNA, 22 nt, Human
ccccagcaaacagugaccaagc

SEQ ID NO: 1125328 - RNA, 19 nt, Human
ccgcagcuccuguucccgc

SEQ ID NO: 1125329 - RNA, 22 nt, Human
ccuccugagggugcgcggaggu

SEQ ID NO: 1125330 - RNA, 20 nt, Human
ccugggaagagggccagacc

SEQ ID NO: 1125331 - RNA, 21 nt, Human
cgagggaucuccaaacgcagc

SEQ ID NO: 1125332 - RNA, 25 nt, Human
cgccaccgagcuggacccgccuccu

SEQ ID NO: 1125333 - RNA, 23 nt, Human
cggauggggcuaaacguggagag

SEQ ID NO: 1125334 - RNA, 25 nt, Human
cgguaucggagccuacagccgccag

SEQ ID NO: 1125335 - RNA, 21 nt, Human
cgugugugugugugugugugu

SEQ ID NO: 1125336 - RNA, 21 nt, Human
cuaaaccaaguacaggauucc

SEQ ID NO: 1125337 - RNA, 24 nt, Human
cugggaagggggccagggugagga

SEQ ID NO: 1125338 - RNA, 25 nt, Human
cuuccagaaaaaccaguaaaagaag

SEQ ID NO: 1125339 - RNA, 21 nt, Human
gaacugggaagggggccaggg

SEQ ID NO: 1125340 - RNA, 25 nt, Human
gacggcaacagcaaaguacuaaacc

SEQ ID NO: 1125341 - RNA, 20 nt, Human
gaggcccauucugcgcauuc

SEQ ID NO: 1125342 - RNA, 23 nt, Human
gaggggccgugaggugagagagu

SEQ ID NO: 1125343 - RNA, 21 nt, Human
gcaacagcaaaguacuaaacc

SEQ ID NO: 1125344 - RNA, 19 nt, Human
gcuaaaauagaagaaagcu

SEQ ID NO: 1125345 - RNA, 18 nt, Human
gcuggagagaggcuuugc

SEQ ID NO: 1125346 - RNA, 20 nt, Human
gcugggcggcccaaggugga

SEQ ID NO: 1125347 - RNA, 19 nt, Human
ggaagggggccagggugag

SEQ ID NO: 1125348 - RNA, 21 nt, Human
ggacacagaccccgcgggggc

SEQ ID NO: 1125349 - RNA, 23 nt, Human
ggagagcaacaagcagggagacg

SEQ ID NO: 1125350 - RNA, 23 nt, Human
gggaaagguaaugauuaaaacac

SEQ ID NO: 1125351 - RNA, 22 nt, Human
gggaagagggccagaccuggaa

SEQ ID NO: 1125352 - RNA, 25 nt, Human
gugcaaaaugaaaacacaagaaccc

SEQ ID NO: 1125353 - RNA, 21 nt, Human
gugugugugugugugugugug

SEQ ID NO: 1125354 - RNA, 22 nt, Human
uaaaauagaagaaagcugcaaa

SEQ ID NO: 1125355 - RNA, 20 nt, Human
uagaagaaagcugcaaagug

SEQ ID NO: 1125356 - RNA, 18 nt, Human
uagggaggcgcggaggcg

SEQ ID NO: 1125357 - RNA, 20 nt, Human
uauaccgugugugugugugu

SEQ ID NO: 1125358 - RNA, 20 nt, Human
uauaccgugugugugugugu

SEQ ID NO: 1125359 - RNA, 20 nt, Human
uauaccgugugugugugugu

SEQ ID NO: 1125360 - RNA, 27 nt, Human
uauaccgugugugugugugugugugug

SEQ ID NO: 1125361 - RNA, 23 nt, Human
ucagcaucuacacccaggacaga

SEQ ID NO: 1125362 - RNA, 19 nt, Human
ucagcgcguugaagcgcuc

SEQ ID NO: 1125363 - RNA, 21 nt, Human
uccagccugggagccaggcac

SEQ ID NO: 1125364 - RNA, 24 nt, Human
ucccgcgcgaguucucgcgggagc

SEQ ID NO: 1125365 - RNA, 19 nt, Human
ucugaaguuugcccuaggg

SEQ ID NO: 1125366 - RNA, 24 nt, Human
ucuggcagaggggacugcaggcuu

SEQ ID NO: 1125367 - RNA, 25 nt, Human
ugaaaacacaagaaccccuauuaga

SEQ ID NO: 1125368 - RNA, 18 nt, Human
ugaaaccagcucugucuc

SEQ ID NO: 1125369 - RNA, 22 nt, Human
ugagaaagguucuagggaggcg

SEQ ID NO: 1125370 - RNA, 28 nt, Human
ugagcaugcggcccguuguuguaaugac

SEQ ID NO: 1125371 - RNA, 20 nt, Human
ugaggcugggcggcccaagg

SEQ ID NO: 1125372 - RNA, 18 nt, Human
ugaggugagagaguccgg

SEQ ID NO: 1125373 - RNA, 19 nt, Human
ugaggugagagaguccggg

SEQ ID NO: 1125374 - RNA, 23 nt, Human
ugaggugagagaguccgggagcc

SEQ ID NO: 1125375 - RNA, 20 nt, Human
ugccacagaccaagacagug

SEQ ID NO: 1125376 - RNA, 19 nt, Human
ugcuggagggcaggaguca

SEQ ID NO: 1125377 - RNA, 19 nt, Human
uggaaggaggggccgugag

SEQ ID NO: 1125378 - RNA, 20 nt, Human
uggagagcaacaagcaggga

SEQ ID NO: 1125379 - RNA, 24 nt, Human
uggcagaggggacugcaggcuuug

SEQ ID NO: 1125380 - RNA, 20 nt, Human
uggcucuucccacagagccu

SEQ ID NO: 1125381 - RNA, 25 nt, Human
ugggaagagggccagaccuggaagu

SEQ ID NO: 1125382 - RNA, 25 nt, Human
ugggaagggggccagggugaggauu

SEQ ID NO: 1125383 - RNA, 20 nt, Human
ugggagccaggcacagcccg

SEQ ID NO: 1125384 - RNA, 19 nt, Human
uggggcuaaacguggagag

SEQ ID NO: 1125385 - RNA, 20 nt, Human
ugguggggcugggggggagu

SEQ ID NO: 1125386 - RNA, 18 nt, Human
ugugugugugugugugug

SEQ ID NO: 1125387 - RNA, 18 nt, Human
ugugugugugugugugug

SEQ ID NO: 1125388 - RNA, 18 nt, Human
ugugugugugugugugug

SEQ ID NO: 1125389 - RNA, 18 nt, Human
ugugugugugugugugug

SEQ ID NO: 1125390 - RNA, 18 nt, Human
ugugugugugugugugug

SEQ ID NO: 1125391 - RNA, 18 nt, Human
ugugugugugugugugug

SEQ ID NO: 1125392 - RNA, 18 nt, Human
ugugugugugugugugug

SEQ ID NO: 1125393 - RNA, 18 nt, Human
ugugugugugugugugug

SEQ ID NO: 1125394 - RNA, 18 nt, Human
ugugugugugugugugug

SEQ ID NO: 1125395 - RNA, 18 nt, Human
ugugugugugugugugug

SEQ ID NO: 1125396 - RNA, 18 nt, Human
ugugugugugugugugug

SEQ ID NO: 1125397 - RNA, 18 nt, Human
ugugugugugugugugug

SEQ ID NO: 1125398 - RNA, 21 nt, Human
ugugugugugugugugugugu

SEQ ID NO: 1125399 - RNA, 21 nt, Human
ugugugugugugugugugugu

SEQ ID NO: 1125400 - RNA, 21 nt, Human
ugugugugugugugugugugu

SEQ ID NO: 1125401 - RNA, 21 nt, Human
ugugugugugugugugugugu

SEQ ID NO: 1125402 - RNA, 21 nt, Human
ugugugugugugugugugugu

SEQ ID NO: 1125403 - RNA, 21 nt, Human
ugugugugugugugugugugu

SEQ ID NO: 1125404 - RNA, 21 nt, Human
ugugugugugugugugugugu

SEQ ID NO: 1125405 - RNA, 21 nt, Human
ugugugugugugugugugugu

SEQ ID NO: 1125406 - RNA, 21 nt, Human
ugugugugugugugugugugu

SEQ ID NO: 1125407 - RNA, 21 nt, Human
ugugugugugugugugugugu

SEQ ID NO: 1125408 - RNA, 21 nt, Human
ugugugugugugugugugugu

SEQ ID NO: 1125409 - RNA, 21 nt, Human
ugugugugugugugugugugu

SEQ ID NO: 1125410 - RNA, 21 nt, Human
ugugugugugugugugugugu

SEQ ID NO: 1125411 - RNA, 21 nt, Human
ugugugugugugugugugugu

SEQ ID NO: 1125412 - RNA, 21 nt, Human
ugugugugugugugugugugu

SEQ ID NO: 1125413 - RNA, 21 nt, Human
ugugugugugugugugugugu

SEQ ID NO: 1125414 - RNA, 21 nt, Human
ugugugugugugugugugugu

SEQ ID NO: 1125415 - RNA, 21 nt, Human
ugugugugugugugugugugu

SEQ ID NO: 1125416 - RNA, 21 nt, Human
ugugugugugugugugugugu

SEQ ID NO: 1125417 - RNA, 21 nt, Human
ugugugugugugugugugugu

SEQ ID NO: 1125418 - RNA, 21 nt, Human
ugugugugugugugugugugu

SEQ ID NO: 1125419 - RNA, 21 nt, Human
ugugugugugugugugugugu

SEQ ID NO: 1125420 - RNA, 22 nt, Human
ugugugugugugugugugugug

SEQ ID NO: 1125421 - RNA, 22 nt, Human
ugugugugugugugugugugug

SEQ ID NO: 1125422 - RNA, 22 nt, Human
ugugugugugugugugugugug

SEQ ID NO: 1125423 - RNA, 22 nt, Human
ugugugugugugugugugugug

SEQ ID NO: 1125424 - RNA, 22 nt, Human
ugugugugugugugugugugug

SEQ ID NO: 1125425 - RNA, 22 nt, Human
ugugugugugugugugugugug

SEQ ID NO: 1125426 - RNA, 22 nt, Human
ugugugugugugugugugugug

SEQ ID NO: 1125427 - RNA, 22 nt, Human
ugugugugugugugugugugug

SEQ ID NO: 1125428 - RNA, 22 nt, Human
ugugugugugugugugugugug

SEQ ID NO: 1125429 - RNA, 22 nt, Human
ugugugugugugugugugugug

SEQ ID NO: 1125430 - RNA, 20 nt, Human
uuguuuguuuguuuuguuuu

SEQ ID NO: 1125431 - RNA, 22 nt, Human
uuuuuguuuguuuguuuuguuu

SEQ ID NO: 1125432 - RNA, 20 nt, Human
accaggccacagggcugugg

SEQ ID NO: 1125433 - RNA, 18 nt, Human
agaaacauuuuuaauugu

SEQ ID NO: 1125434 - RNA, 21 nt, Human
agcccauguguuucucagaug

SEQ ID NO: 1125435 - RNA, 21 nt, Human
aggcaggccagagaggccagg

SEQ ID NO: 1125436 - RNA, 19 nt, Human
aucaccaggggagucccgg

SEQ ID NO: 1125437 - RNA, 21 nt, Human
caaggcaggccagagaggcca

SEQ ID NO: 1125438 - RNA, 22 nt, Human
caaggcaggccagagaggccag

SEQ ID NO: 1125439 - RNA, 21 nt, Human
caggccagagaggccaggggc

SEQ ID NO: 1125440 - RNA, 25 nt, Human
ccacagggcuguggggcaugcagcc

SEQ ID NO: 1125441 - RNA, 21 nt, Human
ccugccccaucaccaggggag

SEQ ID NO: 1125442 - RNA, 22 nt, Human
cuguggggcaugcagccgaugg

SEQ ID NO: 1125443 - RNA, 18 nt, Human
gcucuugcuuuccccugg

SEQ ID NO: 1125444 - RNA, 24 nt, Human
gggcaugcagccgauggugcagcu

SEQ ID NO: 1125445 - RNA, 21 nt, Human
uccugccccaucaccagggga

SEQ ID NO: 1125446 - RNA, 23 nt, Human
ugacagaagaaacauuuuuaauu

SEQ ID NO: 1125447 - RNA, 20 nt, Human
ugcaccaggccacagggcuu

SEQ ID NO: 1125448 - RNA, 22 nt, Human
ugccccaucaccaggggagucc

SEQ ID NO: 1125449 - RNA, 18 nt, Human
ugggaugucgaggacacu

SEQ ID NO: 1125450 - RNA, 20 nt, Human
uguucugguccugccccauc

SEQ ID NO: 1125451 - RNA, 22 nt, Human
aaagaacgagaaauagccaaac

SEQ ID NO: 1125452 - RNA, 18 nt, Human
aaaguguuauggucugau

SEQ ID NO: 1125453 - RNA, 18 nt, Human
aaauucuuucagauaacc

SEQ ID NO: 1125454 - RNA, 23 nt, Human
aacaagauugugagaguucagag

SEQ ID NO: 1125455 - RNA, 24 nt, Human
aacccucuguacuugugcuuuacc

SEQ ID NO: 1125456 - RNA, 21 nt, Human
aagaaugcaguguaaauggaa

SEQ ID NO: 1125457 - RNA, 20 nt, Human
aagcaagcacuauuuuagac

SEQ ID NO: 1125458 - RNA, 27 nt, Human
aagcaagggaugaggcaaaagggaccc

SEQ ID NO: 1125459 - RNA, 18 nt, Human
aaguguuaaaaaaacaug

SEQ ID NO: 1125460 - RNA, 23 nt, Human
aauagcuggguuuacaggcaugu

SEQ ID NO: 1125461 - RNA, 19 nt, Human
aaucauagcucacugcagc

SEQ ID NO: 1125462 - RNA, 22 nt, Human
aauucagucucccuggaaguug

SEQ ID NO: 1125463 - RNA, 24 nt, Human
acagcagcagucuagggcuuccaa

SEQ ID NO: 1125464 - RNA, 19 nt, Human
acaggcuggagugcagcug

SEQ ID NO: 1125465 - RNA, 21 nt, Human
accucagccuccugaauagcu

SEQ ID NO: 1125466 - RNA, 25 nt, Human
accucagccuccugaauagcugggu

SEQ ID NO: 1125467 - RNA, 19 nt, Human
accucugauccccuaaucc

SEQ ID NO: 1125468 - RNA, 19 nt, Human
acugcagccucaaacuccu

SEQ ID NO: 1125469 - RNA, 22 nt, Human
agaaaaccaucaugcucccccc

SEQ ID NO: 1125470 - RNA, 21 nt, Human
agaaccuuaaccagggcaggc

SEQ ID NO: 1125471 - RNA, 20 nt, Human
agaagcuggccgcugcaucc

SEQ ID NO: 1125472 - RNA, 21 nt, Human
agacaaccuuuacugagcacc

SEQ ID NO: 1125473 - RNA, 19 nt, Human
agcagguaccuccuucagg

SEQ ID NO: 1125474 - RNA, 20 nt, Human
agccucaaacuccuggccuc

SEQ ID NO: 1125475 - RNA, 18 nt, Human
agccuccugaauagcugg

SEQ ID NO: 1125476 - RNA, 19 nt, Human
aggauugaggcgggggugu

SEQ ID NO: 1125477 - RNA, 19 nt, Human
aggcaugugacacugugcc

SEQ ID NO: 1125478 - RNA, 23 nt, Human
agggaugaggcaaaaggcaucuu

SEQ ID NO: 1125479 - RNA, 24 nt, Human
agguaauuaggucaugaaggugga

SEQ ID NO: 1125480 - RNA, 21 nt, Human
agguggguguagagagggugc

SEQ ID NO: 1125481 - RNA, 23 nt, Human
agugcagcugugcaaucauagcu

SEQ ID NO: 1125482 - RNA, 18 nt, Human
auagcucacugcagccuc

SEQ ID NO: 1125483 - RNA, 25 nt, Human
aucaugcuccccccgccccgaacuc

SEQ ID NO: 1125484 - RNA, 20 nt, Human
aucuuggacuuccagacucc

SEQ ID NO: 1125485 - RNA, 21 nt, Human
auugugagaguucagaguucc

SEQ ID NO: 1125486 - RNA, 22 nt, Human
caaaauagcacccauuucaggc

SEQ ID NO: 1125487 - RNA, 24 nt, Human
caacagcauuugugacucugucua

SEQ ID NO: 1125488 - RNA, 23 nt, Human
caagacaaccuuuacugagcacc

SEQ ID NO: 1125489 - RNA, 19 nt, Human
caccucugauccccuaauc

SEQ ID NO: 1125490 - RNA, 23 nt, Human
cacuuagcuuuggggugguggga

SEQ ID NO: 1125491 - RNA, 24 nt, Human
cagaaagaacgagaaauagccaaa

SEQ ID NO: 1125492 - RNA, 25 nt, Human
cagaacucggccaugauggcaccau

SEQ ID NO: 1125493 - RNA, 23 nt, Human
cagcagcagucuagggcuuccaa

SEQ ID NO: 1125494 - RNA, 25 nt, Human
cagcaggaggauugaggcgggggug

SEQ ID NO: 1125495 - RNA, 23 nt, Human
cagccucaaacuccuggccucaa

SEQ ID NO: 1125496 - RNA, 18 nt, Human
caggagcaggagcuaaga

SEQ ID NO: 1125497 - RNA, 19 nt, Human
caugcuccccccgccccga

SEQ ID NO: 1125498 - RNA, 23 nt, Human
ccaaguguuaaaaaaacauggga

SEQ ID NO: 1125499 - RNA, 23 nt, Human
ccagaagagggcccucaccagaa

SEQ ID NO: 1125500 - RNA, 18 nt, Human
ccagggcaggcguagaga

SEQ ID NO: 1125501 - RNA, 20 nt, Human
ccaucaugcuccccccgccc

SEQ ID NO: 1125502 - RNA, 18 nt, Human
ccccuaaucccauuccgu

SEQ ID NO: 1125503 - RNA, 24 nt, Human
cccugcccucaugaggcuuuacag

SEQ ID NO: 1125504 - RNA, 23 nt, Human
ccgauccucccaccucagccucc

SEQ ID NO: 1125505 - RNA, 19 nt, Human
ccugucccuagaggaucug

SEQ ID NO: 1125506 - RNA, 24 nt, Human
ccuuaaccagggcaggccgggguc

SEQ ID NO: 1125507 - RNA, 21 nt, Human
cgggacgguaaagaaaguauc

SEQ ID NO: 1125508 - RNA, 24 nt, Human
cuagucaaaauagcacccauuuca

SEQ ID NO: 1125509 - RNA, 24 nt, Human
cucaaccgauccucccaccucagc

SEQ ID NO: 1125510 - RNA, 21 nt, Human
cucacugcagccucaaacucc

SEQ ID NO: 1125511 - RNA, 24 nt, Human
cucacugcagccucaaacuccugg

SEQ ID NO: 1125512 - RNA, 25 nt, Human
cuccaaaagucuauaauaauacuua

SEQ ID NO: 1125513 - RNA, 21 nt, Human
cuccccccgccccgaacucau

SEQ ID NO: 1125514 - RNA, 24 nt, Human
cuccugaauagcuggguuuacagg

SEQ ID NO: 1125515 - RNA, 27 nt, Human
cuccuggccucaaccgauccucccacc

SEQ ID NO: 1125516 - RNA, 22 nt, Human
cugcagccucaaacuccuggcc

SEQ ID NO: 1125517 - RNA, 27 nt, Human
cugcagccucaaacuccuggccucaac

SEQ ID NO: 1125518 - RNA, 18 nt, Human
gaaauagccaaaccauga

SEQ ID NO: 1125519 - RNA, 21 nt, Human
gaaauucuuucagauaaccuu

SEQ ID NO: 1125520 - RNA, 23 nt, Human
gaaccaacccggcagccuguguu

SEQ ID NO: 1125521 - RNA, 20 nt, Human
gaacucggccaugauggcac

SEQ ID NO: 1125522 - RNA, 18 nt, Human
gacucugucuaguucuug

SEQ ID NO: 1125523 - RNA, 19 nt, Human
gacuggaggggucaggggc

SEQ ID NO: 1125524 - RNA, 18 nt, Human
gagcaagcuuacccucca

SEQ ID NO: 1125525 - RNA, 18 nt, Human
gagcaccuaucauaaagc

SEQ ID NO: 1125526 - RNA, 18 nt, Human
gagcucaggaagaggcag

SEQ ID NO: 1125527 - RNA, 23 nt, Human
gaucuuggacuuccagacuccug

SEQ ID NO: 1125528 - RNA, 19 nt, Human
gaugugaagguugagaaaa

SEQ ID NO: 1125529 - RNA, 25 nt, Human
gcaaaaggcaucuuugaaaauuaca

SEQ ID NO: 1125530 - RNA, 24 nt, Human
gcagcaggaggauugaggcggggg

SEQ ID NO: 1125531 - RNA, 23 nt, Human
gccaagcuaaucuuuuuaaaagu

SEQ ID NO: 1125532 - RNA, 24 nt, Human
gcuccccccgccccgaacucauuu

SEQ ID NO: 1125533 - RNA, 20 nt, Human
gggaaauguccuuuuucucu

SEQ ID NO: 1125534 - RNA, 18 nt, Human
gggaauguuaagucuaac

SEQ ID NO: 1125535 - RNA, 19 nt, Human
ggugggguuauuccagaca

SEQ ID NO: 1125536 - RNA, 21 nt, Human
guggugggagggagggguugg

SEQ ID NO: 1125537 - RNA, 18 nt, Human
guuuggagauggcaucuu

SEQ ID NO: 1125538 - RNA, 21 nt, Human
uaaaaauuucuguguauccuc

SEQ ID NO: 1125539 - RNA, 21 nt, Human
uaaacaaugucacaugauuaa

SEQ ID NO: 1125540 - RNA, 27 nt, Human
uacagcagcagucuagggcuuccaaga

SEQ ID NO: 1125541 - RNA, 24 nt, Human
uacaggcaugugacacugugccca

SEQ ID NO: 1125542 - RNA, 21 nt, Human
uagagaugaacuuaagaccua

SEQ ID NO: 1125543 - RNA, 23 nt, Human
uagaugaaguuucagcaagggcu

SEQ ID NO: 1125544 - RNA, 23 nt, Human
uagccaaaccaugaguucccuca

SEQ ID NO: 1125545 - RNA, 24 nt, Human
uagcucacugcagccucaaacucc

SEQ ID NO: 1125546 - RNA, 21 nt, Human
uauaauaauacuuaaaagcaa

SEQ ID NO: 1125547 - RNA, 23 nt, Human
uaugcugucuucacgggacggua

SEQ ID NO: 1125548 - RNA, 25 nt, Human
ucaaccgauccucccaccucagccu

SEQ ID NO: 1125549 - RNA, 24 nt, Human
ucacugcagccucaaacuccuggc

SEQ ID NO: 1125550 - RNA, 24 nt, Human
ucacuuagcuuuggggugguggga

SEQ ID NO: 1125551 - RNA, 20 nt, Human
ucagauaaccuggagggaaa

SEQ ID NO: 1125552 - RNA, 19 nt, Human
ucaggaagaggcagggccc

SEQ ID NO: 1125553 - RNA, 21 nt, Human
ucaggggcaacucccagguug

SEQ ID NO: 1125554 - RNA, 21 nt, Human
ucauagaauauacacucucaa

SEQ ID NO: 1125555 - RNA, 20 nt, Human
uccccagaaugaugguguuu

SEQ ID NO: 1125556 - RNA, 23 nt, Human
ucccuagaggaucugcucaauuc

SEQ ID NO: 1125557 - RNA, 23 nt, Human
ucccucaccucugauccccuaau

SEQ ID NO: 1125558 - RNA, 26 nt, Human
uccucccaccucagccuccugaauag

SEQ ID NO: 1125559 - RNA, 18 nt, Human
ucucagcacaggcuggag

SEQ ID NO: 1125560 - RNA, 23 nt, Human
ucucagcacaggcuggagugcag

SEQ ID NO: 1125561 - RNA, 24 nt, Human
ucugugaucaacagcauuugugac

SEQ ID NO: 1125562 - RNA, 22 nt, Human
ugaagaaacaagauugugagag

SEQ ID NO: 1125563 - RNA, 18 nt, Human
ugaauagcuggguuuaca

SEQ ID NO: 1125564 - RNA, 21 nt, Human
ugagcagguaccuccuucagg

SEQ ID NO: 1125565 - RNA, 22 nt, Human
ugaguaagguuccaaaccugcc

SEQ ID NO: 1125566 - RNA, 23 nt, Human
ugaguucccucaccucugauccc

SEQ ID NO: 1125567 - RNA, 21 nt, Human
ugauccccuaaucccauuccg

SEQ ID NO: 1125568 - RNA, 21 nt, Human
ugaugagaaccuuaaccaggg

SEQ ID NO: 1125569 - RNA, 18 nt, Human
uggaaccggggugggguu

SEQ ID NO: 1125570 - RNA, 28 nt, Human
uggagugaacaauuucauggcaggcacu

SEQ ID NO: 1125571 - RNA, 18 nt, Human
uggcagaagaaauucagu

SEQ ID NO: 1125572 - RNA, 21 nt, Human
uggcaucuuugggagguaauu

SEQ ID NO: 1125573 - RNA, 26 nt, Human
ugggagggagggguugggaagcuuuc

SEQ ID NO: 1125574 - RNA, 18 nt, Human
ugggguggugggagggag

SEQ ID NO: 1125575 - RNA, 18 nt, Human
ugggguggugggagggag

SEQ ID NO: 1125576 - RNA, 19 nt, Human
ugggguggugggagggagg

SEQ ID NO: 1125577 - RNA, 25 nt, Human
ugggguggugggagggagggguugg

SEQ ID NO: 1125578 - RNA, 24 nt, Human
uggguuuacaggcaugugacacug

SEQ ID NO: 1125579 - RNA, 23 nt, Human
ugguauuuuguuacaggagcagg

SEQ ID NO: 1125580 - RNA, 21 nt, Human
uggucugauguaucccccaaa

SEQ ID NO: 1125581 - RNA, 24 nt, Human
ugguguuuggagauggcaucuuug

SEQ ID NO: 1125582 - RNA, 21 nt, Human
uguaaagaaucagagagccca

SEQ ID NO: 1125583 - RNA, 22 nt, Human
uguaugaaaugugcauggcggu

SEQ ID NO: 1125584 - RNA, 23 nt, Human
ugugacacugugcccagcucuuc

SEQ ID NO: 1125585 - RNA, 23 nt, Human
ugugcaaucauagcucacugcag

SEQ ID NO: 1125586 - RNA, 23 nt, Human
uguuacagaggcaagaagagggg

SEQ ID NO: 1125587 - RNA, 18 nt, Human
uguuuuguuuuguuuuug

SEQ ID NO: 1125588 - RNA, 20 nt, Human
uguuuuguuuuugcagggcu

SEQ ID NO: 1125589 - RNA, 19 nt, Human
uuacagaggcaagaagagg

SEQ ID NO: 1125590 - RNA, 19 nt, Human
uuacaggcaugugacacug

SEQ ID NO: 1125591 - RNA, 22 nt, Human
uucaagucucucaauucuaacu

SEQ ID NO: 1125592 - RNA, 21 nt, Human
uuccguggagguaaccacuua

SEQ ID NO: 1125593 - RNA, 19 nt, Human
uuccugacuuggguggaac

SEQ ID NO: 1125594 - RNA, 23 nt, Human
uuccuuccucaccugcugcaagu

SEQ ID NO: 1125595 - RNA, 19 nt, Human
uugaagaaugcaguguaaa

SEQ ID NO: 1125596 - RNA, 23 nt, Human
uugaugguguuacugacuggcag

SEQ ID NO: 1125597 - RNA, 18 nt, Human
uuggagauggcaucuuug

SEQ ID NO: 1125598 - RNA, 19 nt, Human
uuuacugagcaccuaucaa

SEQ ID NO: 1125599 - RNA, 21 nt, Human
uuugcaugccucuaaggggcu

SEQ ID NO: 1125600 - RNA, 20 nt, Human
ccuuuuggaaauagcucugg

SEQ ID NO: 1125601 - RNA, 23 nt, Human
ucagcaaauguaaagccccacuu

SEQ ID NO: 1125602 - RNA, 18 nt, Human
ugcucagcaaauguaaag

SEQ ID NO: 1125603 - RNA, 21 nt, Human
uucaccuuuuggaaauagcuc

SEQ ID NO: 1125604 - RNA, 21 nt, Human
aaagcccuucucugaccgcac

SEQ ID NO: 1125605 - RNA, 18 nt, Human
aaagugcugggauuacaa

SEQ ID NO: 1125606 - RNA, 24 nt, Human
aaagugcugggauuacaagcguga

SEQ ID NO: 1125607 - RNA, 18 nt, Human
aagcuccuaacgcccucc

SEQ ID NO: 1125608 - RNA, 18 nt, Human
aagucccuguugugcccc

SEQ ID NO: 1125609 - RNA, 19 nt, Human
aagugcugggauuacaagc

SEQ ID NO: 1125610 - RNA, 19 nt, Human
aagugcugggauuacaagc

SEQ ID NO: 1125611 - RNA, 26 nt, Human
aagugcugggauuacaagcgugagcc

SEQ ID NO: 1125612 - RNA, 24 nt, Human
acacaggccccguccaagccacgc

SEQ ID NO: 1125613 - RNA, 25 nt, Human
acacuacaguccccugaggagcuac

SEQ ID NO: 1125614 - RNA, 20 nt, Human
accauauuggccaggcuagu

SEQ ID NO: 1125615 - RNA, 18 nt, Human
acccuggaccucugucuc

SEQ ID NO: 1125616 - RNA, 21 nt, Human
accgcacugcugagugcagca

SEQ ID NO: 1125617 - RNA, 20 nt, Human
accuccaccucuucccuugg

SEQ ID NO: 1125618 - RNA, 29 nt, Human
accugggcuugaggccucauagaggagcc

SEQ ID NO: 1125619 - RNA, 18 nt, Human
acgggguuuuaccauauu

SEQ ID NO: 1125620 - RNA, 20 nt, Human
acgggguuuuaccauauugg

SEQ ID NO: 1125621 - RNA, 24 nt, Human
acgggguuuuaccauauuggccag

SEQ ID NO: 1125622 - RNA, 21 nt, Human
acuacaguccccugaggagcu

SEQ ID NO: 1125623 - RNA, 20 nt, Human
acugcaaccuccaccucccg

SEQ ID NO: 1125624 - RNA, 20 nt, Human
agagccuggcuggggacugg

SEQ ID NO: 1125625 - RNA, 24 nt, Human
agcgauucuccugccucagccucc

SEQ ID NO: 1125626 - RNA, 26 nt, Human
agcuccacccacagucucugggcagc

SEQ ID NO: 1125627 - RNA, 21 nt, Human
aggaggacuuugugccaaggc

SEQ ID NO: 1125628 - RNA, 21 nt, Human
aggccaaggccaggcuuggga

SEQ ID NO: 1125629 - RNA, 19 nt, Human
aggggacagagccuggcug

SEQ ID NO: 1125630 - RNA, 23 nt, Human
aggggcaggacucuggggaaccu

SEQ ID NO: 1125631 - RNA, 26 nt, Human
aggggcaggacucuggggaaccuauu

SEQ ID NO: 1125632 - RNA, 23 nt, Human
aggggucagcacugaccacucug

SEQ ID NO: 1125633 - RNA, 19 nt, Human
agguauggcaggggacaga

SEQ ID NO: 1125634 - RNA, 18 nt, Human
aguagcugggauuacagg

SEQ ID NO: 1125635 - RNA, 19 nt, Human
agucucgaacuccugacuu

SEQ ID NO: 1125636 - RNA, 24 nt, Human
caaagugcugggauuacaagcgug

SEQ ID NO: 1125637 - RNA, 23 nt, Human
caaccuccaccucccgaguucaa

SEQ ID NO: 1125638 - RNA, 23 nt, Human
caagaccaaaagcccuucucuga

SEQ ID NO: 1125639 - RNA, 20 nt, Human
caagcgauucuccugccuca

SEQ ID NO: 1125640 - RNA, 22 nt, Human
caagcgauucuccugccucagc

SEQ ID NO: 1125641 - RNA, 19 nt, Human
caagcuccuaacgcccucc

SEQ ID NO: 1125642 - RNA, 24 nt, Human
caagcuccuaacgcccuccccaca

SEQ ID NO: 1125643 - RNA, 20 nt, Human
cacaguaacaggggcagggu

SEQ ID NO: 1125644 - RNA, 24 nt, Human
caccacagccagcuaauuuuugua

SEQ ID NO: 1125645 - RNA, 24 nt, Human
caccucggccucccaaagugcugg

SEQ ID NO: 1125646 - RNA, 21 nt, Human
cagagccuggcuggggacugg

SEQ ID NO: 1125647 - RNA, 18 nt, Human
cagcaggcagcuccaccc

SEQ ID NO: 1125648 - RNA, 20 nt, Human
cagcaggcagcuccacccac

SEQ ID NO: 1125649 - RNA, 19 nt, Human
caggagaggaggaauggua

SEQ ID NO: 1125650 - RNA, 22 nt, Human
caggagaggaggaaugguaggu

SEQ ID NO: 1125651 - RNA, 19 nt, Human
caggccccguccaagccac

SEQ ID NO: 1125652 - RNA, 18 nt, Human
caggguuuacuaccuugg

SEQ ID NO: 1125653 - RNA, 22 nt, Human
caggguuuacuaccuuggggcc

SEQ ID NO: 1125654 - RNA, 24 nt, Human
cagguaucuacccaccucggccuc

SEQ ID NO: 1125655 - RNA, 20 nt, Human
caggugcccaccaccacagc

SEQ ID NO: 1125656 - RNA, 24 nt, Human
cagucucugggcagccccaggcug

SEQ ID NO: 1125657 - RNA, 19 nt, Human
caguggcacgaucuuggcu

SEQ ID NO: 1125658 - RNA, 22 nt, Human
cauagaggagcccucagugcug

SEQ ID NO: 1125659 - RNA, 24 nt, Human
cauauuggccaggcuagucucgaa

SEQ ID NO: 1125660 - RNA, 24 nt, Human
cauuagaggggcaggacucugggg

SEQ ID NO: 1125661 - RNA, 28 nt, Human
cauugcacuauagcuucagaacaguggu

SEQ ID NO: 1125662 - RNA, 20 nt, Human
cauugcacuauagcuucagg

SEQ ID NO: 1125663 - RNA, 20 nt, Human
ccaaagugcugggauuacaa

SEQ ID NO: 1125664 - RNA, 22 nt, Human
ccaaagugcugggauuacaagc

SEQ ID NO: 1125665 - RNA, 24 nt, Human
ccaaagugcugggauuacaagcgu

SEQ ID NO: 1125666 - RNA, 18 nt, Human
ccaagccacgcugaggac

SEQ ID NO: 1125667 - RNA, 19 nt, Human
ccaaggccaaggccaggcu

SEQ ID NO: 1125668 - RNA, 24 nt, Human
ccaccucccgaguucaagcgauuc

SEQ ID NO: 1125669 - RNA, 21 nt, Human
ccaggcuguccccuccccacu

SEQ ID NO: 1125670 - RNA, 24 nt, Human
cccaagagccccaggggucagcac

SEQ ID NO: 1125671 - RNA, 21 nt, Human
cccaccaccacagccagcuaa

SEQ ID NO: 1125672 - RNA, 18 nt, Human
ccccaggcuguccccucc

SEQ ID NO: 1125673 - RNA, 22 nt, Human
ccccugaggagcuacaugacuu

SEQ ID NO: 1125674 - RNA, 23 nt, Human
cccgaguagcugggauuacaggu

SEQ ID NO: 1125675 - RNA, 24 nt, Human
cccgaguagcugggauuacaggug

SEQ ID NO: 1125676 - RNA, 23 nt, Human
cccgaguucaagcgauucuccug

SEQ ID NO: 1125677 - RNA, 25 nt, Human
cccuccccacucugauucuaggaca

SEQ ID NO: 1125678 - RNA, 21 nt, Human
ccgaguagcugggauuacagg

SEQ ID NO: 1125679 - RNA, 23 nt, Human
ccucaggggcagccuccaggagu

SEQ ID NO: 1125680 - RNA, 24 nt, Human
ccucccgaguucaagcgauucucc

SEQ ID NO: 1125681 - RNA, 26 nt, Human
ccucugaauuauuucuugcuuagccc

SEQ ID NO: 1125682 - RNA, 23 nt, Human
ccugccucagccucccgaguagc

SEQ ID NO: 1125683 - RNA, 18 nt, Human
ccuggcuggggacuggac

SEQ ID NO: 1125684 - RNA, 25 nt, Human
ccuugggacugaucugggcugguuu

SEQ ID NO: 1125685 - RNA, 24 nt, Human
cucagccucccgaguagcugggau

SEQ ID NO: 1125686 - RNA, 19 nt, Human
cucugaauuauuucuugcu

SEQ ID NO: 1125687 - RNA, 23 nt, Human
cugcaaccuccaccucccgaguu

SEQ ID NO: 1125688 - RNA, 24 nt, Human
cugcaaccuccaccucccgaguuc

SEQ ID NO: 1125689 - RNA, 23 nt, Human
cugccucagccucccgaguagcu

SEQ ID NO: 1125690 - RNA, 23 nt, Human
cuggacuucaagaccaaaagccc

SEQ ID NO: 1125691 - RNA, 19 nt, Human
cuggagcacaguaacaggg

SEQ ID NO: 1125692 - RNA, 25 nt, Human
cuggagggccuuccaggaacugucc

SEQ ID NO: 1125693 - RNA, 20 nt, Human
cugggcagccccaggcuguc

SEQ ID NO: 1125694 - RNA, 18 nt, Human
cugggguuggagccuagg

SEQ ID NO: 1125695 - RNA, 19 nt, Human
cugggguuggagccuaggc

SEQ ID NO: 1125696 - RNA, 21 nt, Human
cuuugugccaaggccaaggcc

SEQ ID NO: 1125697 - RNA, 21 nt, Human
gaccucugucuccucaucuuu

SEQ ID NO: 1125698 - RNA, 22 nt, Human
gaccuugcucaggacaguccua

SEQ ID NO: 1125699 - RNA, 23 nt, Human
gacuucagguaucuacccaccuc

SEQ ID NO: 1125700 - RNA, 19 nt, Human
gagcacaguaacaggggca

SEQ ID NO: 1125701 - RNA, 18 nt, Human
gauuacaagcgugagcca

SEQ ID NO: 1125702 - RNA, 24 nt, Human
gauuacaagcgugagccaccgugc

SEQ ID NO: 1125703 - RNA, 18 nt, Human
gauucuaggacaaagacc

SEQ ID NO: 1125704 - RNA, 18 nt, Human
gcaaccuccaccucccga

SEQ ID NO: 1125705 - RNA, 22 nt, Human
gcaaccuccaccucccgaguuc

SEQ ID NO: 1125706 - RNA, 22 nt, Human
gcagcaggcagcuccacccaca

SEQ ID NO: 1125707 - RNA, 20 nt, Human
gcagccccaggcuguccccu

SEQ ID NO: 1125708 - RNA, 20 nt, Human
gccaaggccaaggccaggcu

SEQ ID NO: 1125709 - RNA, 24 nt, Human
gcgauucuccugccucagccuccc

SEQ ID NO: 1125710 - RNA, 21 nt, Human
gcugggauuacaagcgugagc

SEQ ID NO: 1125711 - RNA, 22 nt, Human
ggaacugucccuucccuuagga

SEQ ID NO: 1125712 - RNA, 23 nt, Human
ggcagggcacacucugguucagg

SEQ ID NO: 1125713 - RNA, 20 nt, Human
ggcaggggacagagccuggc

SEQ ID NO: 1125714 - RNA, 21 nt, Human
gggcugcagaccuugcucagg

SEQ ID NO: 1125715 - RNA, 18 nt, Human
ggggcucccugacccugg

SEQ ID NO: 1125716 - RNA, 23 nt, Human
gggggcccuuggcggaggcgggc

SEQ ID NO: 1125717 - RNA, 22 nt, Human
ggggggucccuagacagagggu

SEQ ID NO: 1125718 - RNA, 18 nt, Human
ggggugagcagagcuggg

SEQ ID NO: 1125719 - RNA, 23 nt, Human
gggguuuuaccauauuggccagg

SEQ ID NO: 1125720 - RNA, 22 nt, Human
ggguuuuaccauauuggccagg

SEQ ID NO: 1125721 - RNA, 19 nt, Human
ggucagguggccacauccu

SEQ ID NO: 1125722 - RNA, 18 nt, Human
guagcugggauuacaggu

SEQ ID NO: 1125723 - RNA, 23 nt, Human
guaggacaaaggacucuggccuu

SEQ ID NO: 1125724 - RNA, 23 nt, Human
guaucuacccaccucggccuccc

SEQ ID NO: 1125725 - RNA, 21 nt, Human
guccccuccccacucugauuc

SEQ ID NO: 1125726 - RNA, 24 nt, Human
uaauagacacgggguuuuaccaua

SEQ ID NO: 1125727 - RNA, 22 nt, Human
uaauuuuuguauuuuuaauaga

SEQ ID NO: 1125728 - RNA, 22 nt, Human
uacaagcgugagccaccgugcc

SEQ ID NO: 1125729 - RNA, 24 nt, Human
uaccauauuggccaggcuagucuc

SEQ ID NO: 1125730 - RNA, 27 nt, Human
uaccauauuggccaggcuagucucgaa

SEQ ID NO: 1125731 - RNA, 22 nt, Human
uacccaccucggccucccaaag

SEQ ID NO: 1125732 - RNA, 23 nt, Human
uacccaccucggccucccaaagu

SEQ ID NO: 1125733 - RNA, 25 nt, Human
uaccuggacuucaagaccaaaagcc

SEQ ID NO: 1125734 - RNA, 23 nt, Human
uaccuuggggccucuuuccacac

SEQ ID NO: 1125735 - RNA, 20 nt, Human
uagacacgggguuuuaccau

SEQ ID NO: 1125736 - RNA, 23 nt, Human
uagguguggaaacaaggggcagg

SEQ ID NO: 1125737 - RNA, 21 nt, Human
ucaagaccaaaagcccuucuc

SEQ ID NO: 1125738 - RNA, 25 nt, Human
ucaagaccaaaagcccuucucugac

SEQ ID NO: 1125739 - RNA, 20 nt, Human
ucagccucccgaguagcugg

SEQ ID NO: 1125740 - RNA, 18 nt, Human
ucaggcacccagaggaga

SEQ ID NO: 1125741 - RNA, 20 nt, Human
uccaaaaaaauaugaaacac

SEQ ID NO: 1125742 - RNA, 22 nt, Human
uccaaaaaaauaugaaacacac

SEQ ID NO: 1125743 - RNA, 21 nt, Human
uccacccacagucucugggca

SEQ ID NO: 1125744 - RNA, 18 nt, Human
ucccaaagugcugggauu

SEQ ID NO: 1125745 - RNA, 24 nt, Human
ucccaaagugcugggauuacaagc

SEQ ID NO: 1125746 - RNA, 25 nt, Human
uccccagcauccagcuggagggccu

SEQ ID NO: 1125747 - RNA, 23 nt, Human
ucccgaguagcugggauuacagg

SEQ ID NO: 1125748 - RNA, 24 nt, Human
ucccgaguagcugggauuacaggu

SEQ ID NO: 1125749 - RNA, 21 nt, Human
ucccgaguucaagcgauucuc

SEQ ID NO: 1125750 - RNA, 24 nt, Human
ucccgaguucaagcgauucuccug

SEQ ID NO: 1125751 - RNA, 26 nt, Human
ucccuagacagaggguaggaccucug

SEQ ID NO: 1125752 - RNA, 20 nt, Human
ucccucugcagaccucacag

SEQ ID NO: 1125753 - RNA, 20 nt, Human
ucccuuuucuacauggggag

SEQ ID NO: 1125754 - RNA, 22 nt, Human
uccuaaugccugcaagcuccua

SEQ ID NO: 1125755 - RNA, 18 nt, Human
uccuagagcugggccaag

SEQ ID NO: 1125756 - RNA, 22 nt, Human
uccuagagcugggccaagccuc

SEQ ID NO: 1125757 - RNA, 18 nt, Human
ucggccucccaaagugcu

SEQ ID NO: 1125758 - RNA, 21 nt, Human
ucuacccaccucggccuccca

SEQ ID NO: 1125759 - RNA, 24 nt, Human
ucuccugccucagccucccgagua

SEQ ID NO: 1125760 - RNA, 23 nt, Human
ucucgaacuccugacuucaggua

SEQ ID NO: 1125761 - RNA, 20 nt, Human
ucucugggcagccccaggcu

SEQ ID NO: 1125762 - RNA, 21 nt, Human
ucugggcagccccaggcuguc

SEQ ID NO: 1125763 - RNA, 19 nt, Human
ucugggguuggagccuagg

SEQ ID NO: 1125764 - RNA, 19 nt, Human
ucuugcucugucauccagg

SEQ ID NO: 1125765 - RNA, 20 nt, Human
ucuugcucugucauccagga

SEQ ID NO: 1125766 - RNA, 23 nt, Human
ucuugcucugucauccaggaugg

SEQ ID NO: 1125767 - RNA, 18 nt, Human
ucuuuucucccucugcag

SEQ ID NO: 1125768 - RNA, 20 nt, Human
ugaccacacacuacaguccc

SEQ ID NO: 1125769 - RNA, 19 nt, Human
ugaccagaggcuggacaag

SEQ ID NO: 1125770 - RNA, 19 nt, Human
ugaccuccaccucuucccu

SEQ ID NO: 1125771 - RNA, 22 nt, Human
ugacugcaaccuccaccucccg

SEQ ID NO: 1125772 - RNA, 24 nt, Human
ugacugcaaccuccaccucccgag

SEQ ID NO: 1125773 - RNA, 19 nt, Human
ugacuucagguaucuaccc

SEQ ID NO: 1125774 - RNA, 20 nt, Human
ugacuucugaugccaggucc

SEQ ID NO: 1125775 - RNA, 23 nt, Human
ugauuggggcuggauguucacuu

SEQ ID NO: 1125776 - RNA, 18 nt, Human
ugcaggguugggaaccau

SEQ ID NO: 1125777 - RNA, 24 nt, Human
ugccucagccucccgaguagcugg

SEQ ID NO: 1125778 - RNA, 19 nt, Human
ugcucaggacaguccuaau

SEQ ID NO: 1125779 - RNA, 24 nt, Human
ugcugggauuacaagcgugagcca

SEQ ID NO: 1125780 - RNA, 22 nt, Human
ugcuggggaucaggagaggagg

SEQ ID NO: 1125781 - RNA, 22 nt, Human
uggagggccuuccaggaacugu

SEQ ID NO: 1125782 - RNA, 19 nt, Human
uggagucuugcucugucau

SEQ ID NO: 1125783 - RNA, 24 nt, Human
uggccaggcuagucucgaacuccu

SEQ ID NO: 1125784 - RNA, 21 nt, Human
ugggauuacaagcgugagcca

SEQ ID NO: 1125785 - RNA, 22 nt, Human
ugggauuacaagcgugagccac

SEQ ID NO: 1125786 - RNA, 23 nt, Human
ugggauuacaagcgugagccacc

SEQ ID NO: 1125787 - RNA, 23 nt, Human
ugggauuacaagcgugagccacc

SEQ ID NO: 1125788 - RNA, 24 nt, Human
ugggauuacaagcgugagccaccg

SEQ ID NO: 1125789 - RNA, 21 nt, Human
ugggauuacaggugcccacca

SEQ ID NO: 1125790 - RNA, 24 nt, Human
ugggauuacaggugcccaccacca

SEQ ID NO: 1125791 - RNA, 23 nt, Human
ugguagguguggaaacaaggggc

SEQ ID NO: 1125792 - RNA, 24 nt, Human
uggugugcaguggcacgaucuugg

SEQ ID NO: 1125793 - RNA, 21 nt, Human
ugucuccucaucuuucugccc

SEQ ID NO: 1125794 - RNA, 24 nt, Human
ugugcaguggcacgaucuuggcug

SEQ ID NO: 1125795 - RNA, 24 nt, Human
uuaauagacacgggguuuuaccau

SEQ ID NO: 1125796 - RNA, 21 nt, Human
uucaagcgauucuccugccuc

SEQ ID NO: 1125797 - RNA, 23 nt, Human
uucaagcgauucuccugccucag

SEQ ID NO: 1125798 - RNA, 24 nt, Human
uucaagcgauucuccugccucagc

SEQ ID NO: 1125799 - RNA, 19 nt, Human
uucagguaucuacccaccu

SEQ ID NO: 1125800 - RNA, 18 nt, Human
uucggggugagcagagcu

SEQ ID NO: 1125801 - RNA, 18 nt, Human
uuucucccucugcagacc

SEQ ID NO: 1125802 - RNA, 18 nt, Human
uuuuguauuuuuaauaga

SEQ ID NO: 1125803 - RNA, 21 nt, Human
uuuuuaauagacacgggguuu

SEQ ID NO: 1125804 - RNA, 18 nt, Human
uuuuuguauuuuuaauag

SEQ ID NO: 1125805 - RNA, 23 nt, Human
agacaagaccgugccuggaccug

SEQ ID NO: 1125806 - RNA, 24 nt, Human
agaccuuggcccucacagcagccc

SEQ ID NO: 1125807 - RNA, 19 nt, Human
agaggaccgagggucccag

SEQ ID NO: 1125808 - RNA, 19 nt, Human
agauugcagggugggugcu

SEQ ID NO: 1125809 - RNA, 20 nt, Human
agcuguggggucgggggcag

SEQ ID NO: 1125810 - RNA, 19 nt, Human
aggggacagagccuggcug

SEQ ID NO: 1125811 - RNA, 19 nt, Human
agguauggcaggggacaga

SEQ ID NO: 1125812 - RNA, 21 nt, Human
cagagccuggcuggggacugg

SEQ ID NO: 1125813 - RNA, 20 nt, Human
cagagcugggccagggugcc

SEQ ID NO: 1125814 - RNA, 20 nt, Human
cagcaggggcuuuggucaug

SEQ ID NO: 1125815 - RNA, 23 nt, Human
cagccgggcuggugccugagggc

SEQ ID NO: 1125816 - RNA, 21 nt, Human
ccagaccuuggcccucacagc

SEQ ID NO: 1125817 - RNA, 19 nt, Human
cccaguggcccugcccagg

SEQ ID NO: 1125818 - RNA, 18 nt, Human
ccucacagcagcccugcc

SEQ ID NO: 1125819 - RNA, 18 nt, Human
ccuggcuggggacuggac

SEQ ID NO: 1125820 - RNA, 19 nt, Human
cgggggcaggggcugugca

SEQ ID NO: 1125821 - RNA, 21 nt, Human
cguggccagaccuuggcccuc

SEQ ID NO: 1125822 - RNA, 21 nt, Human
cuggaccugcaucugugugua

SEQ ID NO: 1125823 - RNA, 24 nt, Human
cugggccagggugccagcaggggc

SEQ ID NO: 1125824 - RNA, 20 nt, Human
cuguguguaugccugggggc

SEQ ID NO: 1125825 - RNA, 18 nt, Human
gagcccaugggacugggg

SEQ ID NO: 1125826 - RNA, 19 nt, Human
gagcugggccagggugcca

SEQ ID NO: 1125827 - RNA, 21 nt, Human
gagcugggccagggugccagc

SEQ ID NO: 1125828 - RNA, 24 nt, Human
gagcuguggggucgggggcagggg

SEQ ID NO: 1125829 - RNA, 25 nt, Human
gcacuggaagaaccugagaccuaaa

SEQ ID NO: 1125830 - RNA, 18 nt, Human
gcccuugugggguugcug

SEQ ID NO: 1125831 - RNA, 19 nt, Human
gcuguggggucgggggcag

SEQ ID NO: 1125832 - RNA, 19 nt, Human
ggacuggggagggugaagg

SEQ ID NO: 1125833 - RNA, 23 nt, Human
ggagugagcuguggggucggggg

SEQ ID NO: 1125834 - RNA, 20 nt, Human
ggcaggggacagagccuggc

SEQ ID NO: 1125835 - RNA, 22 nt, Human
gggccacuggguggggggcugg

SEQ ID NO: 1125836 - RNA, 22 nt, Human
gggccagggugccagcaggggc

SEQ ID NO: 1125837 - RNA, 19 nt, Human
ggggcuggguccugccucu

SEQ ID NO: 1125838 - RNA, 23 nt, Human
gggggcccuuggcggaggcgggc

SEQ ID NO: 1125839 - RNA, 21 nt, Human
guguaugccugggggcugggu

SEQ ID NO: 1125840 - RNA, 20 nt, Human
uaugcccauccuaugcccca

SEQ ID NO: 1125841 - RNA, 18 nt, Human
ucacagcagcccugccug

SEQ ID NO: 1125842 - RNA, 22 nt, Human
ucaggcccggacauggguacug

SEQ ID NO: 1125843 - RNA, 23 nt, Human
ucaggcccggacauggguacugg

SEQ ID NO: 1125844 - RNA, 20 nt, Human
uccaaaaaaauaugaaacac

SEQ ID NO: 1125845 - RNA, 22 nt, Human
uccaaaaaaauaugaaacacac

SEQ ID NO: 1125846 - RNA, 24 nt, Human
ucccaggacucagagcugggccag

SEQ ID NO: 1125847 - RNA, 18 nt, Human
ucuguguguaugccuggg

SEQ ID NO: 1125848 - RNA, 18 nt, Human
ugcccagggugcugcgag

SEQ ID NO: 1125849 - RNA, 20 nt, Human
ugccugagggccugucucca

SEQ ID NO: 1125850 - RNA, 24 nt, Human
ugccuggggcccauucccgggggc

SEQ ID NO: 1125851 - RNA, 22 nt, Human
ugcugugaggagcccaugggaa

SEQ ID NO: 1125852 - RNA, 21 nt, Human
uggaagaaccugagaccuaaa

SEQ ID NO: 1125853 - RNA, 21 nt, Human
uggaccugcaucuguguguau

SEQ ID NO: 1125854 - RNA, 24 nt, Human
uggagugagcuguggggucggggg

SEQ ID NO: 1125855 - RNA, 23 nt, Human
uggcccucacagcagcccugccu

SEQ ID NO: 1125856 - RNA, 19 nt, Human
uggggucgggggcaggggc

SEQ ID NO: 1125857 - RNA, 19 nt, Human
uggggucgggggcaggggc

SEQ ID NO: 1125858 - RNA, 21 nt, Human
uggggucgggggcaggggcug

SEQ ID NO: 1125859 - RNA, 19 nt, Human
uguguugaggacaagcugc

SEQ ID NO: 1125860 - RNA, 21 nt, Human
uugcugugaggagcccauggg

SEQ ID NO: 1125861 - RNA, 19 nt, Human
aaagugcuaagauuacagg

SEQ ID NO: 1125862 - RNA, 24 nt, Human
aaaguggugggaauacaggcauga

SEQ ID NO: 1125863 - RNA, 20 nt, Human
aaauaaggucuggcucuguc

SEQ ID NO: 1125864 - RNA, 21 nt, Human
aaaugcuggugguccagccuc

SEQ ID NO: 1125865 - RNA, 19 nt, Human
aaccagcuggagacccagc

SEQ ID NO: 1125866 - RNA, 22 nt, Human
aaccagcuggagacccagcccc

SEQ ID NO: 1125867 - RNA, 19 nt, Human
aaccucugccuccugggcc

SEQ ID NO: 1125868 - RNA, 25 nt, Human
aacucauagacucaagcaauccacc

SEQ ID NO: 1125869 - RNA, 19 nt, Human
aagagagcccggccggugc

SEQ ID NO: 1125870 - RNA, 24 nt, Human
aagcaauccacccacuuuggccuc

SEQ ID NO: 1125871 - RNA, 18 nt, Human
aagccccccaagaauccc

SEQ ID NO: 1125872 - RNA, 22 nt, Human
aagccccccaagaaucccugga

SEQ ID NO: 1125873 - RNA, 24 nt, Human
aagcugaagugcaguggcacaauc

SEQ ID NO: 1125874 - RNA, 23 nt, Human
aaggcgucccagaggaggugauu

SEQ ID NO: 1125875 - RNA, 20 nt, Human
aaguagcugggacuacaagc

SEQ ID NO: 1125876 - RNA, 26 nt, Human
aagugcuaagauuacaggcaagagcc

SEQ ID NO: 1125877 - RNA, 24 nt, Human
acagaguuuuaccauguugcccag

SEQ ID NO: 1125878 - RNA, 19 nt, Human
acaggcaagagccgccacg

SEQ ID NO: 1125879 - RNA, 20 nt, Human
accauguugcccaggcuggu

SEQ ID NO: 1125880 - RNA, 22 nt, Human
accauguugcccaggcuggucu

SEQ ID NO: 1125881 - RNA, 24 nt, Human
accauguugcccaggcuggucuug

SEQ ID NO: 1125882 - RNA, 25 nt, Human
accauguugcccaggcuggucuuga

SEQ ID NO: 1125883 - RNA, 25 nt, Human
acccacuuuggccucccaaagugcu

SEQ ID NO: 1125884 - RNA, 28 nt, Human
acccauccugccccaccucgaguucccu

SEQ ID NO: 1125885 - RNA, 23 nt, Human
accucugccuccugggccaaggg

SEQ ID NO: 1125886 - RNA, 18 nt, Human
acgggguuucauguuggu

SEQ ID NO: 1125887 - RNA, 21 nt, Human
acgggguuucauguuggucag

SEQ ID NO: 1125888 - RNA, 19 nt, Human
acuugcugggugaucuugg

SEQ ID NO: 1125889 - RNA, 18 nt, Human
agaaucagagcugugaaa

SEQ ID NO: 1125890 - RNA, 24 nt, Human
agacaaggacacugaugcccagag

SEQ ID NO: 1125891 - RNA, 23 nt, Human
agagaaggccgcggaggcucaga

SEQ ID NO: 1125892 - RNA, 18 nt, Human
agauuacaggcaagagcc

SEQ ID NO: 1125893 - RNA, 25 nt, Human
agcaacaaagacucugcaggaaaaa

SEQ ID NO: 1125894 - RNA, 19 nt, Human
agcaauccacccacuuugg

SEQ ID NO: 1125895 - RNA, 18 nt, Human
agccuccaaaguagcugg

SEQ ID NO: 1125896 - RNA, 24 nt, Human
agcucgugcaaccucagcaucccu

SEQ ID NO: 1125897 - RNA, 24 nt, Human
agcugggacuacaagcacacaaca

SEQ ID NO: 1125898 - RNA, 20 nt, Human
agcugggcaacagcaggcuu

SEQ ID NO: 1125899 - RNA, 18 nt, Human
aggcaccuuuucagagaa

SEQ ID NO: 1125900 - RNA, 18 nt, Human
aggcagagauccagcaac

SEQ ID NO: 1125901 - RNA, 24 nt, Human
aggugauccacccaccuuggccuc

SEQ ID NO: 1125902 - RNA, 18 nt, Human
aguagagacgggguuuca

SEQ ID NO: 1125903 - RNA, 21 nt, Human
aguagaggaaggcgucccaga

SEQ ID NO: 1125904 - RNA, 18 nt, Human
aguagcuggaauuacagg

SEQ ID NO: 1125905 - RNA, 23 nt, Human
aguagcugggacuacaagcacac

SEQ ID NO: 1125906 - RNA, 21 nt, Human
agucaaucccugggcaagacc

SEQ ID NO: 1125907 - RNA, 24 nt, Human
agugauucuccugccucagccucc

SEQ ID NO: 1125908 - RNA, 21 nt, Human
agugcaguggcacaaucucag

SEQ ID NO: 1125909 - RNA, 24 nt, Human
agugcaguggcacaaucucagcuc

SEQ ID NO: 1125910 - RNA, 21 nt, Human
aguuugcgugguuccgugcug

SEQ ID NO: 1125911 - RNA, 23 nt, Human
augcauuuccaggcaagagagcc

SEQ ID NO: 1125912 - RNA, 22 nt, Human
augcuggugguccagcccugaa

SEQ ID NO: 1125913 - RNA, 18 nt, Human
auucuccugccucagccu

SEQ ID NO: 1125914 - RNA, 19 nt, Human
caaaagcaaggcuuggcuc

SEQ ID NO: 1125915 - RNA, 21 nt, Human
caaagccuacagaaggaguuu

SEQ ID NO: 1125916 - RNA, 22 nt, Human
caaaguagcugggacuacaagc

SEQ ID NO: 1125917 - RNA, 24 nt, Human
caaaguagcugggacuacaagcac

SEQ ID NO: 1125918 - RNA, 27 nt, Human
caaagugcuaagauuacaggcaagagc

SEQ ID NO: 1125919 - RNA, 19 nt, Human
caagagagcccggccggug

SEQ ID NO: 1125920 - RNA, 19 nt, Human
caagagccgccacguccag

SEQ ID NO: 1125921 - RNA, 20 nt, Human
caagagccgccacguccagc

SEQ ID NO: 1125922 - RNA, 20 nt, Human
caagcacacaacaccacacc

SEQ ID NO: 1125923 - RNA, 22 nt, Human
caagugauucuccugccucagc

SEQ ID NO: 1125924 - RNA, 24 nt, Human
caauccacccacuuuggccuccca

SEQ ID NO: 1125925 - RNA, 23 nt, Human
cacacaacaccacacucagcuaa

SEQ ID NO: 1125926 - RNA, 18 nt, Human
cacacccuucuuccaccc

SEQ ID NO: 1125927 - RNA, 20 nt, Human
caccaugcugacaagguacc

SEQ ID NO: 1125928 - RNA, 23 nt, Human
cacccaagcugaagugcaguggc

SEQ ID NO: 1125929 - RNA, 22 nt, Human
cacccaccuuggccucccaaag

SEQ ID NO: 1125930 - RNA, 23 nt, Human
cacccaccuuggccucccaaagu

SEQ ID NO: 1125931 - RNA, 22 nt, Human
cacccgcuacuccgcgcauccc

SEQ ID NO: 1125932 - RNA, 21 nt, Human
cacccugcccuuacugggguc

SEQ ID NO: 1125933 - RNA, 18 nt, Human
cacccuucuuccacccag

SEQ ID NO: 1125934 - RNA, 27 nt, Human
cacucccuacccauccugccccaccuc

SEQ ID NO: 1125935 - RNA, 21 nt, Human
cacugcaaccucugccuccug

SEQ ID NO: 1125936 - RNA, 23 nt, Human
cacugcaaccucugccuccuggg

SEQ ID NO: 1125937 - RNA, 19 nt, Human
cagaagucuuuucucuuuc

SEQ ID NO: 1125938 - RNA, 24 nt, Human
cagaguuuuaccauguugcccagg

SEQ ID NO: 1125939 - RNA, 20 nt, Human
cagccagacagaagucuuuu

SEQ ID NO: 1125940 - RNA, 22 nt, Human
cagcccugaaugccucacuccu

SEQ ID NO: 1125941 - RNA, 18 nt, Human
cagggaagggagaaguca

SEQ ID NO: 1125942 - RNA, 19 nt, Human
cagggccaggagacagcug

SEQ ID NO: 1125943 - RNA, 21 nt, Human
cagugggcccccaguucagcc

SEQ ID NO: 1125944 - RNA, 25 nt, Human
cauccucaccacagcccugugaggg

SEQ ID NO: 1125945 - RNA, 25 nt, Human
caucugcuuuucucaucaauccuuu

SEQ ID NO: 1125946 - RNA, 20 nt, Human
cauguugcccaggcuggucu

SEQ ID NO: 1125947 - RNA, 23 nt, Human
cauguugcccaggcuggucuuga

SEQ ID NO: 1125948 - RNA, 24 nt, Human
cauguugcccaggcuggucuugaa

SEQ ID NO: 1125949 - RNA, 21 nt, Human
cauguuggucaggguggucuc

SEQ ID NO: 1125950 - RNA, 24 nt, Human
ccaaaguggugggaauacaggcau

SEQ ID NO: 1125951 - RNA, 22 nt, Human
ccacccacuuuggccucccaaa

SEQ ID NO: 1125952 - RNA, 27 nt, Human
ccagcagccuccucuaaaguaacuucu

SEQ ID NO: 1125953 - RNA, 19 nt, Human
ccagcccugcagauauucu

SEQ ID NO: 1125954 - RNA, 23 nt, Human
ccagcucuccacagugggccccc

SEQ ID NO: 1125955 - RNA, 23 nt, Human
ccagcuugccuuacagccgggua

SEQ ID NO: 1125956 - RNA, 18 nt, Human
ccaguccagcuuuccacc

SEQ ID NO: 1125957 - RNA, 21 nt, Human
ccauccugccccaccucgagu

SEQ ID NO: 1125958 - RNA, 23 nt, Human
cccaagcugaagugcaguggcac

SEQ ID NO: 1125959 - RNA, 21 nt, Human
cccauccugccccaccucgag

SEQ ID NO: 1125960 - RNA, 22 nt, Human
cccauccugccccaccucgagu

SEQ ID NO: 1125961 - RNA, 21 nt, Human
ccccagcagccuccucuaaag

SEQ ID NO: 1125962 - RNA, 23 nt, Human
cccccauucuuucuguaaccuca

SEQ ID NO: 1125963 - RNA, 25 nt, Human
ccccccaagaaucccuggagguaga

SEQ ID NO: 1125964 - RNA, 23 nt, Human
ccccuucauccucaccacagccc

SEQ ID NO: 1125965 - RNA, 25 nt, Human
ccccuucauccucaccacagcccug

SEQ ID NO: 1125966 - RNA, 23 nt, Human
cccgaguagcuggaauuacaggu

SEQ ID NO: 1125967 - RNA, 23 nt, Human
cccugguucaagugauucuccuc

SEQ ID NO: 1125968 - RNA, 23 nt, Human
cccugguucaagugauucuccug

SEQ ID NO: 1125969 - RNA, 19 nt, Human
ccucccaaaguggugggaa

SEQ ID NO: 1125970 - RNA, 25 nt, Human
ccucugaucucacucccuacccauc

SEQ ID NO: 1125971 - RNA, 24 nt, Human
ccugaccucaggugauccacccac

SEQ ID NO: 1125972 - RNA, 19 nt, Human
ccugcagauauucuuuacc

SEQ ID NO: 1125973 - RNA, 27 nt, Human
ccugccccaccucgaguucccuggaag

SEQ ID NO: 1125974 - RNA, 23 nt, Human
ccugccucagccucccgaguagc

SEQ ID NO: 1125975 - RNA, 22 nt, Human
ccugguucaagugauucuccug

SEQ ID NO: 1125976 - RNA, 26 nt, Human
ccuuacagccggguaccggcuccacc

SEQ ID NO: 1125977 - RNA, 22 nt, Human
cgccccagcagccuccucuaaa

SEQ ID NO: 1125978 - RNA, 24 nt, Human
cgcucaggccccaagcccccauuc

SEQ ID NO: 1125979 - RNA, 24 nt, Human
cgcuucagccuccaaaguagcugg

SEQ ID NO: 1125980 - RNA, 24 nt, Human
cucaagcaauccacccacuuuggc

SEQ ID NO: 1125981 - RNA, 24 nt, Human
cucacugcaaccucugccuccugg

SEQ ID NO: 1125982 - RNA, 21 nt, Human
cucagcucgugcaaccucagc

SEQ ID NO: 1125983 - RNA, 24 nt, Human
cucaggugauccacccaccuuggc

SEQ ID NO: 1125984 - RNA, 18 nt, Human
cucauagacucaagcaau

SEQ ID NO: 1125985 - RNA, 23 nt, Human
cucauagacucaagcaauccacc

SEQ ID NO: 1125986 - RNA, 23 nt, Human
cuccugggccaagggauccuucc

SEQ ID NO: 1125987 - RNA, 18 nt, Human
cucuuguugcccaggcug

SEQ ID NO: 1125988 - RNA, 18 nt, Human
cucuuguugcccaggcug

SEQ ID NO: 1125989 - RNA, 19 nt, Human
cucuuguugcccaggcugg

SEQ ID NO: 1125990 - RNA, 19 nt, Human
cugcaaccucugccuccug

SEQ ID NO: 1125991 - RNA, 22 nt, Human
cugcaaccucugccuccugggc

SEQ ID NO: 1125992 - RNA, 23 nt, Human
cugcaaccucugccuccugggcc

SEQ ID NO: 1125993 - RNA, 23 nt, Human
cugccucagccucccgaguagcu

SEQ ID NO: 1125994 - RNA, 20 nt, Human
cugccuccugggccaaggga

SEQ ID NO: 1125995 - RNA, 23 nt, Human
cuggaaggaacacccugcccuua

SEQ ID NO: 1125996 - RNA, 24 nt, Human
cugggccucaguuugcuucaucug

SEQ ID NO: 1125997 - RNA, 24 nt, Human
cuuacuugcugggugaucuugggc

SEQ ID NO: 1125998 - RNA, 22 nt, Human
cuuagagacaaggacacugaug

SEQ ID NO: 1125999 - RNA, 20 nt, Human
cuuguugcccaggcuggagg

SEQ ID NO: 1126000 - RNA, 22 nt, Human
gaauacaggcaugagccacugc

SEQ ID NO: 1126001 - RNA, 22 nt, Human
gaauacaggcaugagccacugc

SEQ ID NO: 1126002 - RNA, 24 nt, Human
gaccucaggugauccacccaccuu

SEQ ID NO: 1126003 - RNA, 22 nt, Human
gacgggguuucauguuggucag

SEQ ID NO: 1126004 - RNA, 21 nt, Human
gacuacaagcacacaacacca

SEQ ID NO: 1126005 - RNA, 20 nt, Human
gacucaagcaauccacccac

SEQ ID NO: 1126006 - RNA, 23 nt, Human
gacucaagcaauccacccacuuu

SEQ ID NO: 1126007 - RNA, 22 nt, Human
gagaacuccaguccagcuuucc

SEQ ID NO: 1126008 - RNA, 21 nt, Human
gagacagaguuuuaccauguu

SEQ ID NO: 1126009 - RNA, 21 nt, Human
gagacgggguuucauguuggu

SEQ ID NO: 1126010 - RNA, 20 nt, Human
gaggaugaugaugaugauga

SEQ ID NO: 1126011 - RNA, 22 nt, Human
gaggcaauggagguguuggggg

SEQ ID NO: 1126012 - RNA, 24 nt, Human
gaguagcuggaauuacaggugcgc

SEQ ID NO: 1126013 - RNA, 20 nt, Human
gaugaugauagcaacaaaga

SEQ ID NO: 1126014 - RNA, 20 nt, Human
gcaccuuuucagagaacucc

SEQ ID NO: 1126015 - RNA, 21 nt, Human
gcagcggugcgaucucagcuc

SEQ ID NO: 1126016 - RNA, 23 nt, Human
gcaggaaaaaagccugcucuaag

SEQ ID NO: 1126017 - RNA, 18 nt, Human
gccaucccaccacugaga

SEQ ID NO: 1126018 - RNA, 19 nt, Human
gccauuucugcuauucauc

SEQ ID NO: 1126019 - RNA, 19 nt, Human
gccccaagcccccauucuu

SEQ ID NO: 1126020 - RNA, 21 nt, Human
gcccccauucuuucuguaacc

SEQ ID NO: 1126021 - RNA, 25 nt, Human
gcucugucacccaagcugaagugca

SEQ ID NO: 1126022 - RNA, 20 nt, Human
gcucuguuucuuacuugcug

SEQ ID NO: 1126023 - RNA, 19 nt, Human
gcucuuguugcccaggcug

SEQ ID NO: 1126024 - RNA, 21 nt, Human
gcucuuguugcccaggcugga

SEQ ID NO: 1126025 - RNA, 19 nt, Human
gcugaagugcaguggcaca

SEQ ID NO: 1126026 - RNA, 21 nt, Human
gcugccugccagggccaagaa

SEQ ID NO: 1126027 - RNA, 22 nt, Human
gcugccugccagggccaagaag

SEQ ID NO: 1126028 - RNA, 22 nt, Human
ggaauacaggcaugagccacug

SEQ ID NO: 1126029 - RNA, 24 nt, Human
ggaggguggggucccaaccagcug

SEQ ID NO: 1126030 - RNA, 22 nt, Human
ggauccuuccgcuucagccucc

SEQ ID NO: 1126031 - RNA, 24 nt, Human
ggcagaggcaauggagguguuggg

SEQ ID NO: 1126032 - RNA, 19 nt, Human
ggccccaagcccccauucu

SEQ ID NO: 1126033 - RNA, 22 nt, Human
gggcauuuucugcugugugggg

SEQ ID NO: 1126034 - RNA, 19 nt, Human
gggggguggagacagggaa

SEQ ID NO: 1126035 - RNA, 20 nt, Human
gggguuucauguuggucagg

SEQ ID NO: 1126036 - RNA, 24 nt, Human
ggguggucucaaacuccugaccuc

SEQ ID NO: 1126037 - RNA, 19 nt, Human
ggguuucauguuggucagg

SEQ ID NO: 1126038 - RNA, 21 nt, Human
gguucaagugauucuccugcc

SEQ ID NO: 1126039 - RNA, 25 nt, Human
guaccuacccacccugcgccccagc

SEQ ID NO: 1126040 - RNA, 20 nt, Human
guagagacgggguuucaugu

SEQ ID NO: 1126041 - RNA, 19 nt, Human
guagcuggaauuacaggug

SEQ ID NO: 1126042 - RNA, 22 nt, Human
gucagggccaggagacagcuga

SEQ ID NO: 1126043 - RNA, 21 nt, Human
gugaaccuucagagggcaaag

SEQ ID NO: 1126044 - RNA, 24 nt, Human
gugauccacccaccuuggccuccc

SEQ ID NO: 1126045 - RNA, 24 nt, Human
gugauucuccugccucagccuccc

SEQ ID NO: 1126046 - RNA, 24 nt, Human
guggggucccaaccagcuggagac

SEQ ID NO: 1126047 - RNA, 22 nt, Human
guuggucaggguggucucaaac

SEQ ID NO: 1126048 - RNA, 24 nt, Human
guuuuaccauguugcccaggcugg

SEQ ID NO: 1126049 - RNA, 24 nt, Human
uaagauuacaggcaagagccgcca

SEQ ID NO: 1126050 - RNA, 22 nt, Human
uaagccccccaagaaucccugg

SEQ ID NO: 1126051 - RNA, 24 nt, Human
uaauuuuuuguauuuuuaguagag

SEQ ID NO: 1126052 - RNA, 21 nt, Human
uacacauauaaagggcauccc

SEQ ID NO: 1126053 - RNA, 20 nt, Human
uacagccggguaccggcucc

SEQ ID NO: 1126054 - RNA, 24 nt, Human
uacaggcaagagccgccacgucca

SEQ ID NO: 1126055 - RNA, 20 nt, Human
uacaugugcugccagacccc

SEQ ID NO: 1126056 - RNA, 21 nt, Human
uaccauguugcccaggcuggu

SEQ ID NO: 1126057 - RNA, 24 nt, Human
uaccauguugcccaggcuggucuu

SEQ ID NO: 1126058 - RNA, 27 nt, Human
uaccauguugcccaggcuggucuugaa

SEQ ID NO: 1126059 - RNA, 24 nt, Human
uaccuacccacccugcgccccagc

SEQ ID NO: 1126060 - RNA, 20 nt, Human
uacuccgcgcaucccagcuu

SEQ ID NO: 1126061 - RNA, 23 nt, Human
uagagagacagaguuuuaccaug

SEQ ID NO: 1126062 - RNA, 19 nt, Human
uaguagagacgggguuuca

SEQ ID NO: 1126063 - RNA, 19 nt, Human
uaguagagacgggguuuca

SEQ ID NO: 1126064 - RNA, 21 nt, Human
uaguagagacgggguuucaug

SEQ ID NO: 1126065 - RNA, 24 nt, Human
uaguagagacgggguuucauguug

SEQ ID NO: 1126066 - RNA, 23 nt, Human
uauaagcuucugcaccccauugc

SEQ ID NO: 1126067 - RNA, 18 nt, Human
uaucacagcacccgucac

SEQ ID NO: 1126068 - RNA, 24 nt, Human
uauuucucuauccugcauucugga

SEQ ID NO: 1126069 - RNA, 19 nt, Human
ucaagugauucuccugccu

SEQ ID NO: 1126070 - RNA, 22 nt, Human
ucaauccuuuacaaagccuaca

SEQ ID NO: 1126071 - RNA, 24 nt, Human
ucacagaaguuguagagcucuuuc

SEQ ID NO: 1126072 - RNA, 19 nt, Human
ucacagauauccuuuuuuu

SEQ ID NO: 1126073 - RNA, 20 nt, Human
ucacccagcggccgagugag

SEQ ID NO: 1126074 - RNA, 24 nt, Human
ucacugcaaccucugccuccuggg

SEQ ID NO: 1126075 - RNA, 25 nt, Human
ucacugcaaccucugccuccugggc

SEQ ID NO: 1126076 - RNA, 27 nt, Human
ucacugcaaccucugccuccugggcca

SEQ ID NO: 1126077 - RNA, 22 nt, Human
ucagccucccgaguagcuggaa

SEQ ID NO: 1126078 - RNA, 23 nt, Human
ucagugaaccuucagagggcaaa

SEQ ID NO: 1126079 - RNA, 21 nt, Human
uccauaccuuccacacccuuc

SEQ ID NO: 1126080 - RNA, 24 nt, Human
ucccaaagugcuaagauuacaggc

SEQ ID NO: 1126081 - RNA, 24 nt, Human
ucccaaaguggugggaauacaggc

SEQ ID NO: 1126082 - RNA, 22 nt, Human
ucccagaggaggugauuuuaaa

SEQ ID NO: 1126083 - RNA, 23 nt, Human
ucccgaguagcuggaauuacagg

SEQ ID NO: 1126084 - RNA, 18 nt, Human
ucccucugaucucacucc

SEQ ID NO: 1126085 - RNA, 20 nt, Human
ucccugggcaagaccuccug

SEQ ID NO: 1126086 - RNA, 22 nt, Human
ucccugggcaagaccuccugga

SEQ ID NO: 1126087 - RNA, 21 nt, Human
ucccugguucaagugauucuc

SEQ ID NO: 1126088 - RNA, 22 nt, Human
ucccugguucaagugauucucc

SEQ ID NO: 1126089 - RNA, 24 nt, Human
ucccugguucaagugauucuccug

SEQ ID NO: 1126090 - RNA, 26 nt, Human
ucccuguaucacagcacccgucacuc

SEQ ID NO: 1126091 - RNA, 23 nt, Human
ucuccacagugggcccccaguuc

SEQ ID NO: 1126092 - RNA, 28 nt, Human
ucuccagcucuguuucuuacuugcuggg

SEQ ID NO: 1126093 - RNA, 24 nt, Human
ucuccugccucagccucccgagua

SEQ ID NO: 1126094 - RNA, 21 nt, Human
ucugccuccugggccaaggga

SEQ ID NO: 1126095 - RNA, 18 nt, Human
ucuggcucugucacccaa

SEQ ID NO: 1126096 - RNA, 23 nt, Human
ucuggcucugucacccaagcuga

SEQ ID NO: 1126097 - RNA, 24 nt, Human
ucuggcucugucacccaagcugaa

SEQ ID NO: 1126098 - RNA, 24 nt, Human
ucugucacccaagcugaagugcag

SEQ ID NO: 1126099 - RNA, 26 nt, Human
ugaacucauagacucaagcaauccac

SEQ ID NO: 1126100 - RNA, 19 nt, Human
ugaagugcaguggcacaau

SEQ ID NO: 1126101 - RNA, 22 nt, Human
ugaagugggugggauacucuca

SEQ ID NO: 1126102 - RNA, 21 nt, Human
ugaccucaggugauccaccca

SEQ ID NO: 1126103 - RNA, 24 nt, Human
ugaccucaggugauccacccaccu

SEQ ID NO: 1126104 - RNA, 18 nt, Human
ugagaaguagaggaaggc

SEQ ID NO: 1126105 - RNA, 21 nt, Human
ugaggaugaggaugaugauga

SEQ ID NO: 1126106 - RNA, 18 nt, Human
ugauagcaacaaagacuc

SEQ ID NO: 1126107 - RNA, 24 nt, Human
ugauccacccaccuuggccuccca

SEQ ID NO: 1126108 - RNA, 20 nt, Human
ugaugauagcaacaaagacu

SEQ ID NO: 1126109 - RNA, 23 nt, Human
ugaugaugaggaugaggaugaug

SEQ ID NO: 1126110 - RNA, 22 nt, Human
ugcagcacagacuguacacaua

SEQ ID NO: 1126111 - RNA, 22 nt, Human
ugccagauaauuuguacaaccu

SEQ ID NO: 1126112 - RNA, 23 nt, Human
ugccagggccaagaagauguucu

SEQ ID NO: 1126113 - RNA, 21 nt, Human
ugcccaggcuggucuugaacu

SEQ ID NO: 1126114 - RNA, 18 nt, Human
ugcccugagucacacagc

SEQ ID NO: 1126115 - RNA, 24 nt, Human
ugccucagccucccgaguagcugg

SEQ ID NO: 1126116 - RNA, 23 nt, Human
ugccuccugggccaagggauccu

SEQ ID NO: 1126117 - RNA, 19 nt, Human
ugccuuguuuaagcccccc

SEQ ID NO: 1126118 - RNA, 21 nt, Human
uggaauuacaggugcgcacca

SEQ ID NO: 1126119 - RNA, 24 nt, Human
uggaauuacaggugcgcaccacaa

SEQ ID NO: 1126120 - RNA, 18 nt, Human
uggagacccagccccacc

SEQ ID NO: 1126121 - RNA, 21 nt, Human
uggagacccagccccaccaug

SEQ ID NO: 1126122 - RNA, 18 nt, Human
uggagguagaugaugaug

SEQ ID NO: 1126123 - RNA, 24 nt, Human
uggcacaaucucagcucacugcaa

SEQ ID NO: 1126124 - RNA, 24 nt, Human
uggcaggcagagauccagcaacac

SEQ ID NO: 1126125 - RNA, 18 nt, Human
uggcugccugccagggcc

SEQ ID NO: 1126126 - RNA, 19 nt, Human
ugggaaaccagcucuccac

SEQ ID NO: 1126127 - RNA, 22 nt, Human
ugggaauacaggcaugagccac

SEQ ID NO: 1126128 - RNA, 22 nt, Human
ugggaauacaggcaugagccac

SEQ ID NO: 1126129 - RNA, 24 nt, Human
ugggaauacaggcaugagccacug

SEQ ID NO: 1126130 - RNA, 24 nt, Human
ugggaauacaggcaugagccacug

SEQ ID NO: 1126131 - RNA, 26 nt, Human
ugggaauacaggcaugagccacugcg

SEQ ID NO: 1126132 - RNA, 20 nt, Human
ugggacuacaagcacacaac

SEQ ID NO: 1126133 - RNA, 24 nt, Human
ugggacuacaagcacacaacacca

SEQ ID NO: 1126134 - RNA, 24 nt, Human
ugggauaauggggcaaaagcuuca

SEQ ID NO: 1126135 - RNA, 21 nt, Human
ugggauacucucagccuuuga

SEQ ID NO: 1126136 - RNA, 23 nt, Human
ugggccaagggauccuuccgcuu

SEQ ID NO: 1126137 - RNA, 18 nt, Human
uggggaguaaucaaucac

SEQ ID NO: 1126138 - RNA, 18 nt, Human
ugggggguggagacaggg

SEQ ID NO: 1126139 - RNA, 24 nt, Human
uggucaggguggucucaaacuccu

SEQ ID NO: 1126140 - RNA, 19 nt, Human
uguaaucacagauauccuu

SEQ ID NO: 1126141 - RNA, 21 nt, Human
uguauuuuuaguagagacggg

SEQ ID NO: 1126142 - RNA, 18 nt, Human
ugucaguaagguggagaa

SEQ ID NO: 1126143 - RNA, 24 nt, Human
ugugcgcauuaauaaauuugcaug

SEQ ID NO: 1126144 - RNA, 24 nt, Human
ugugggggguggagacagggaagg

SEQ ID NO: 1126145 - RNA, 21 nt, Human
uguguggggcagaacaggccu

SEQ ID NO: 1126146 - RNA, 22 nt, Human
uguuccuaccagcuccucucau

SEQ ID NO: 1126147 - RNA, 18 nt, Human
uguugggggagcacccuc

SEQ ID NO: 1126148 - RNA, 22 nt, Human
uuacgugaaggguccggccucc

SEQ ID NO: 1126149 - RNA, 20 nt, Human
uuagaaaagucagggccagg

SEQ ID NO: 1126150 - RNA, 23 nt, Human
uuagagagacagaguuuuaccau

SEQ ID NO: 1126151 - RNA, 20 nt, Human
uuaguagagacgggguuuca

SEQ ID NO: 1126152 - RNA, 20 nt, Human
uuaguagagacgggguuuca

SEQ ID NO: 1126153 - RNA, 23 nt, Human
uuaguagagacgggguuucaugu

SEQ ID NO: 1126154 - RNA, 21 nt, Human
uucaagugauucuccugccuc

SEQ ID NO: 1126155 - RNA, 23 nt, Human
uucaagugauucuccugccucag

SEQ ID NO: 1126156 - RNA, 24 nt, Human
uucaagugauucuccugccucagc

SEQ ID NO: 1126157 - RNA, 24 nt, Human
uucagccuccaaaguagcugggac

SEQ ID NO: 1126158 - RNA, 21 nt, Human
uuccacacccuucuuccaccc

SEQ ID NO: 1126159 - RNA, 21 nt, Human
uugaaauggucccaugcagac

SEQ ID NO: 1126160 - RNA, 18 nt, Human
uugcccaggcuggagggc

SEQ ID NO: 1126161 - RNA, 23 nt, Human
uuguauuuuuaguagagacgggg

SEQ ID NO: 1126162 - RNA, 24 nt, Human
uuucauguuggucaggguggucuc

SEQ ID NO: 1126163 - RNA, 19 nt, Human
uuuggccucccaaagugcu

SEQ ID NO: 1126164 - RNA, 23 nt, Human
uuuuaccauguugcccaggcugg

SEQ ID NO: 1126165 - RNA, 21 nt, Human
uuuucagugaaccuucagagg

SEQ ID NO: 1126166 - RNA, 20 nt, Human
uuuuuagagagacagaguuu

SEQ ID NO: 1126167 - RNA, 24 nt, Human
uuuuuaguagagacgggguuucau

SEQ ID NO: 1126168 - RNA, 21 nt, Human
uuuuuguauuuuuaguagaga

SEQ ID NO: 1126169 - RNA, 24 nt, Human
uuuuuuguauuuuuaguagagacg

SEQ ID NO: 1126170 - RNA, 24 nt, Human
uuuuuuuuuuuaaauaaggucugg

SEQ ID NO: 1126171 - RNA, 19 nt, Human
aagaaggagagagaaaaga

SEQ ID NO: 1126172 - RNA, 23 nt, Human
aagcaacccggacacuuucaaac

SEQ ID NO: 1126173 - RNA, 24 nt, Human
acauacauuuuuagguguaucucu

SEQ ID NO: 1126174 - RNA, 24 nt, Human
accaacuacccccauaauccuuuu

SEQ ID NO: 1126175 - RNA, 19 nt, Human
accacgcauguauccagag

SEQ ID NO: 1126176 - RNA, 18 nt, Human
acucuauaccuaugaaac

SEQ ID NO: 1126177 - RNA, 20 nt, Human
agaagaaggagagagaaaag

SEQ ID NO: 1126178 - RNA, 21 nt, Human
agaagaaggagagagaaaaga

SEQ ID NO: 1126179 - RNA, 18 nt, Human
agagagaaaagacauugg

SEQ ID NO: 1126180 - RNA, 26 nt, Human
agagguaggggccaaucucccaaggg

SEQ ID NO: 1126181 - RNA, 22 nt, Human
aggaugcguuuucccgagggcu

SEQ ID NO: 1126182 - RNA, 20 nt, Human
agggaugaacaaggcacgua

SEQ ID NO: 1126183 - RNA, 21 nt, Human
agggcuucugaagccaggccu

SEQ ID NO: 1126184 - RNA, 23 nt, Human
aggugugggacuggguuccuggg

SEQ ID NO: 1126185 - RNA, 24 nt, Human
augaaucccuugucacagacagag

SEQ ID NO: 1126186 - RNA, 24 nt, Human
auggaugaauaaauaagagagaag

SEQ ID NO: 1126187 - RNA, 24 nt, Human
auggaugcuugguugcuuccacau

SEQ ID NO: 1126188 - RNA, 22 nt, Human
caaacaucaugcguccagaaug

SEQ ID NO: 1126189 - RNA, 18 nt, Human
caaccaccacucugucuu

SEQ ID NO: 1126190 - RNA, 19 nt, Human
cacaguuguagcugcaaga

SEQ ID NO: 1126191 - RNA, 19 nt, Human
cagcaaagauaauuuuggc

SEQ ID NO: 1126192 - RNA, 20 nt, Human
caggaugcguuuucccgagg

SEQ ID NO: 1126193 - RNA, 27 nt, Human
caucaaacgccgauaucucucgaaggc

SEQ ID NO: 1126194 - RNA, 23 nt, Human
ccaaaacucuauaccuaugaaac

SEQ ID NO: 1126195 - RNA, 19 nt, Human
cccacaaacaucaugcguc

SEQ ID NO: 1126196 - RNA, 23 nt, Human
cccacaaacaucaugcguccaga

SEQ ID NO: 1126197 - RNA, 21 nt, Human
cccccauaauccuuuugucuu

SEQ ID NO: 1126198 - RNA, 23 nt, Human
ccucaaugucgugcuagaggggc

SEQ ID NO: 1126199 - RNA, 24 nt, Human
ccugcagccccugccaaccaccac

SEQ ID NO: 1126200 - RNA, 22 nt, Human
ccuggaaguaguuuaaacaaag

SEQ ID NO: 1126201 - RNA, 18 nt, Human
ccuugaggguguggucug

SEQ ID NO: 1126202 - RNA, 22 nt, Human
cggaaguaugguuugccgccgg

SEQ ID NO: 1126203 - RNA, 24 nt, Human
cggaaguaugguuugccgccggaa

SEQ ID NO: 1126204 - RNA, 22 nt, Human
cggcgagauggacacuccccuc

SEQ ID NO: 1126205 - RNA, 19 nt, Human
cgugcgugcggcgagaugg

SEQ ID NO: 1126206 - RNA, 18 nt, Human
cuauagcaacgacaaacc

SEQ ID NO: 1126207 - RNA, 20 nt, Human
cugcagccccugccaaccac

SEQ ID NO: 1126208 - RNA, 23 nt, Human
cugcucaccuuggugauaggacc

SEQ ID NO: 1126209 - RNA, 20 nt, Human
cuuccugcagccccugccaa

SEQ ID NO: 1126210 - RNA, 20 nt, Human
gaagaaggccgugaacgacg

SEQ ID NO: 1126211 - RNA, 18 nt, Human
gaaggccgugaacgacgu

SEQ ID NO: 1126212 - RNA, 24 nt, Human
gaaugguucccaccgaggugccca

SEQ ID NO: 1126213 - RNA, 28 nt, Human
gagguaggggccaaucuucagggcuaug

SEQ ID NO: 1126214 - RNA, 20 nt, Human
gcaggugugggacuggguuc

SEQ ID NO: 1126215 - RNA, 20 nt, Human
gcgugcggcgagauggacac

SEQ ID NO: 1126216 - RNA, 21 nt, Human
gcuagaggggccgaagaaggc

SEQ ID NO: 1126217 - RNA, 21 nt, Human
ggauccuaagcaacccggaca

SEQ ID NO: 1126218 - RNA, 21 nt, Human
ggcaggugugggacuggguuc

SEQ ID NO: 1126219 - RNA, 23 nt, Human
ggcuccuuucagucuggggcauu

SEQ ID NO: 1126220 - RNA, 19 nt, Human
gguggccuuuuguacccuc

SEQ ID NO: 1126221 - RNA, 19 nt, Human
guccagaaugcgagaugac

SEQ ID NO: 1126222 - RNA, 18 nt, Human
uaaauaagagagaagaag

SEQ ID NO: 1126223 - RNA, 22 nt, Human
uacacagcaccaucugugccac

SEQ ID NO: 1126224 - RNA, 19 nt, Human
uagcugcaagacuugagca

SEQ ID NO: 1126225 - RNA, 24 nt, Human
uauagauauaccaucuuuugcuua

SEQ ID NO: 1126226 - RNA, 20 nt, Human
ucacagacagagaguugcag

SEQ ID NO: 1126227 - RNA, 22 nt, Human
uccuauagcaacgacaaaccgg

SEQ ID NO: 1126228 - RNA, 22 nt, Human
uccuguggacagauuccauuca

SEQ ID NO: 1126229 - RNA, 23 nt, Human
ucuauaccuaugaaacaaucauu

SEQ ID NO: 1126230 - RNA, 25 nt, Human
ucucucgaaggcaaggaaucugcaa

SEQ ID NO: 1126231 - RNA, 23 nt, Human
ucucuggaggaggaggcagcugu

SEQ ID NO: 1126232 - RNA, 24 nt, Human
ucucuggaggaggaggcagcugug

SEQ ID NO: 1126233 - RNA, 22 nt, Human
ucugcaaucuccuugagggugu

SEQ ID NO: 1126234 - RNA, 18 nt, Human
ugaacaaggcacguagca

SEQ ID NO: 1126235 - RNA, 26 nt, Human
ugaauaaauaagagagaagaaggaga

SEQ ID NO: 1126236 - RNA, 20 nt, Human
ugagaagggugaauggaagg

SEQ ID NO: 1126237 - RNA, 18 nt, Human
ugaggguguggucugauc

SEQ ID NO: 1126238 - RNA, 20 nt, Human
ugcuccaaguaucuccuaaa

SEQ ID NO: 1126239 - RNA, 22 nt, Human
ugcuuccacauuuugacuguug

SEQ ID NO: 1126240 - RNA, 19 nt, Human
uggacacucccccgcucuc

SEQ ID NO: 1126241 - RNA, 23 nt, Human
uggcgguguaggugacaucaaac

SEQ ID NO: 1126242 - RNA, 21 nt, Human
ugggacgugcgugcggcgaga

SEQ ID NO: 1126243 - RNA, 18 nt, Human
ugggagguugaagggaug

SEQ ID NO: 1126244 - RNA, 23 nt, Human
ugggguggccuuuuguacccuca

SEQ ID NO: 1126245 - RNA, 22 nt, Human
ugguagcacauugcagaauucc

SEQ ID NO: 1126246 - RNA, 23 nt, Human
uggucaagugcagcccacacuca

SEQ ID NO: 1126247 - RNA, 22 nt, Human
uggucugauccaacagcaaaga

SEQ ID NO: 1126248 - RNA, 19 nt, Human
ugucacagacagagaguug

SEQ ID NO: 1126249 - RNA, 22 nt, Human
ugucuuguaaaaccaaaacucu

SEQ ID NO: 1126250 - RNA, 21 nt, Human
uucccaccgaggugcccacaa

SEQ ID NO: 1126251 - RNA, 23 nt, Human
uuccuggaaguaguuuaaacaaa

SEQ ID NO: 1126252 - RNA, 19 nt, Human
uugaagggaugaacaaggc

SEQ ID NO: 1126253 - RNA, 18 nt, Human
uugacuguugaacauaga

SEQ ID NO: 1126254 - RNA, 20 nt, Human
uuuccuaggcuaaauuccug

SEQ ID NO: 1126255 - RNA, 23 nt, Human
uuugccgccggaagcggaagucc

SEQ ID NO: 1126256 - RNA, 20 nt, Human
uuugcuaucuuaaccauuuu

SEQ ID NO: 1126257 - RNA, 24 nt, Human
aagaaaccaagaggccgagaggca

SEQ ID NO: 1126258 - RNA, 21 nt, Human
acagagggccuuauguccaca

SEQ ID NO: 1126259 - RNA, 26 nt, Human
acuguccuuaagcugucaggcaugga

SEQ ID NO: 1126260 - RNA, 20 nt, Human
agaaaagaaaccaagaggcc

SEQ ID NO: 1126261 - RNA, 25 nt, Human
agccucaaccagaaagagcccuggc

SEQ ID NO: 1126262 - RNA, 19 nt, Human
aggcaagaaaagaaaccaa

SEQ ID NO: 1126263 - RNA, 20 nt, Human
aggcaugaucacagagggcc

SEQ ID NO: 1126264 - RNA, 21 nt, Human
aggcccccagaugccaggcag

SEQ ID NO: 1126265 - RNA, 21 nt, Human
auccugagaacagcagggaac

SEQ ID NO: 1126266 - RNA, 18 nt, Human
caaccagaaagagcccug

SEQ ID NO: 1126267 - RNA, 23 nt, Human
caaccuuuaagccccagccaccu

SEQ ID NO: 1126268 - RNA, 22 nt, Human
caguaaaguaggggaaggcaag

SEQ ID NO: 1126269 - RNA, 21 nt, Human
ccaggcagccccagggcacaa

SEQ ID NO: 1126270 - RNA, 23 nt, Human
ccagggcacaaguccuucaagaa

SEQ ID NO: 1126271 - RNA, 20 nt, Human
ccccagaugccaggcagccc

SEQ ID NO: 1126272 - RNA, 21 nt, Human
cccccagaugccaggcagccc

SEQ ID NO: 1126273 - RNA, 19 nt, Human
ccucaaccagaaagagccc

SEQ ID NO: 1126274 - RNA, 18 nt, Human
ccugagaacagcagggaa

SEQ ID NO: 1126275 - RNA, 22 nt, Human
ccuggccaaccuuuaagcccca

SEQ ID NO: 1126276 - RNA, 29 nt, Human
cucagccucaaccagaaagagcccuggcc

SEQ ID NO: 1126277 - RNA, 21 nt, Human
cugaugacaccagugagucuc

SEQ ID NO: 1126278 - RNA, 23 nt, Human
cuguccuuaagcugucaggcaug

SEQ ID NO: 1126279 - RNA, 22 nt, Human
cuucaagaacugugcacaaucc

SEQ ID NO: 1126280 - RNA, 22 nt, Human
gagagggucauugucacuuugc

SEQ ID NO: 1126281 - RNA, 20 nt, Human
gagggaguggggagggucua

SEQ ID NO: 1126282 - RNA, 24 nt, Human
gcaagaaaagaaaccaagaggccg

SEQ ID NO: 1126283 - RNA, 19 nt, Human
gccaaccuuuaagccccag

SEQ ID NO: 1126284 - RNA, 20 nt, Human
ggccugaugacaccagugag

SEQ ID NO: 1126285 - RNA, 20 nt, Human
gggagggucuaaagauggga

SEQ ID NO: 1126286 - RNA, 22 nt, Human
ucccugagguucaaggccccca

SEQ ID NO: 1126287 - RNA, 21 nt, Human
ucccuggccaaccuuuaagcc

SEQ ID NO: 1126288 - RNA, 23 nt, Human
ucccuggccaaccuuuaagcccc

SEQ ID NO: 1126289 - RNA, 18 nt, Human
uccgcggaguaagcuucc

SEQ ID NO: 1126290 - RNA, 24 nt, Human
ucucagccucaaccagaaagagcc

SEQ ID NO: 1126291 - RNA, 22 nt, Human
ucugaggaggcccccagaugcc

SEQ ID NO: 1126292 - RNA, 22 nt, Human
ugagaguuauugagcaagagag

SEQ ID NO: 1126293 - RNA, 18 nt, Human
uggcucugaggaggcccc

SEQ ID NO: 1126294 - RNA, 22 nt, Human
uuacuccaucccuggccaaccu

SEQ ID NO: 1126295 - RNA, 23 nt, Human
acaggaacaccugcccagcuucu

SEQ ID NO: 1126296 - RNA, 20 nt, Human
cacucuugaccccugaccuc

SEQ ID NO: 1126297 - RNA, 20 nt, Human
cagcccucccgcgccggccc

SEQ ID NO: 1126298 - RNA, 22 nt, Human
caucacacagcccucccgcgcc

SEQ ID NO: 1126299 - RNA, 19 nt, Human
ccucccgcgccggcccggg

SEQ ID NO: 1126300 - RNA, 27 nt, Human
cuugaccccugaccucgcuaccucggc

SEQ ID NO: 1126301 - RNA, 21 nt, Human
gcgcuccgaggccaucacaca

SEQ ID NO: 1126302 - RNA, 18 nt, Human
ucgaugcaagauccaggc

SEQ ID NO: 1126303 - RNA, 24 nt, Human
ucgggagauucgauaauccuuuuu

SEQ ID NO: 1126304 - RNA, 21 nt, Human
ugaccccugaccucgcuaccu

SEQ ID NO: 1126305 - RNA, 22 nt, Human
ugaccccugaccucgcuaccuc

SEQ ID NO: 1126306 - RNA, 19 nt, Human
uucuuccaccuccggcucc

SEQ ID NO: 1126307 - RNA, 18 nt, Human
aagcuggcugggccaaag

SEQ ID NO: 1126308 - RNA, 21 nt, Human
aagggccagacagaccaacag

SEQ ID NO: 1126309 - RNA, 23 nt, Human
acgccgccguccccggcucggac

SEQ ID NO: 1126310 - RNA, 21 nt, Human
caagaccagaucugaagcugg

SEQ ID NO: 1126311 - RNA, 18 nt, Human
cagagccuacucggugac

SEQ ID NO: 1126312 - RNA, 19 nt, Human
cagcugaggcggcagcggc

SEQ ID NO: 1126313 - RNA, 21 nt, Human
cggccacucagcuccagacac

SEQ ID NO: 1126314 - RNA, 26 nt, Human
cugccaggccuuuguggaggccuggg

SEQ ID NO: 1126315 - RNA, 18 nt, Human
cuggaaugagaccucugu

SEQ ID NO: 1126316 - RNA, 23 nt, Human
cuguggcagaagccagagccuac

SEQ ID NO: 1126317 - RNA, 21 nt, Human
gagaaaggccaaaggcuuuga

SEQ ID NO: 1126318 - RNA, 19 nt, Human
gcagcggcagacaggugcg

SEQ ID NO: 1126319 - RNA, 20 nt, Human
gcugugcuuugucugggucc

SEQ ID NO: 1126320 - RNA, 20 nt, Human
ggcaaggggguggggcaagg

SEQ ID NO: 1126321 - RNA, 21 nt, Human
ggccugggaggagaaaggcca

SEQ ID NO: 1126322 - RNA, 22 nt, Human
gggcaagggccagacagaccaa

SEQ ID NO: 1126323 - RNA, 20 nt, Human
gguccuggcgagagcucgcc

SEQ ID NO: 1126324 - RNA, 19 nt, Human
ucugggucccccaggggac

SEQ ID NO: 1126325 - RNA, 26 nt, Human
ugaggcggcagcggcagacaggugcg

SEQ ID NO: 1126326 - RNA, 18 nt, Human
ugccaggccuuuguggag

SEQ ID NO: 1126327 - RNA, 22 nt, Human
ugccaggccuuuguggaggccu

SEQ ID NO: 1126328 - RNA, 21 nt, Human
ugcccggccacucagcuccag

SEQ ID NO: 1126329 - RNA, 22 nt, Human
uggaaugagaccucugucugcc

SEQ ID NO: 1126330 - RNA, 22 nt, Human
uggcagaagccagagccuacuc

SEQ ID NO: 1126331 - RNA, 24 nt, Human
uggcugggccaaagcagcugaggc

SEQ ID NO: 1126332 - RNA, 19 nt, Human
ugggaccgaugcccggcca

SEQ ID NO: 1126333 - RNA, 25 nt, Human
ugggccaaagcagcugaggcggcag

SEQ ID NO: 1126334 - RNA, 20 nt, Human
uguggcagaagccagagccu

SEQ ID NO: 1126335 - RNA, 23 nt, Human
uguggcagaagccagagccuacu

SEQ ID NO: 1126336 - RNA, 19 nt, Human
gcggaaagagaaaaaaaaa

SEQ ID NO: 1126337 - RNA, 23 nt, Human
uccuugaggcauuuuauuuguaa

SEQ ID NO: 1126338 - RNA, 22 nt, Human
uggcggaaagagaaaaaaaaaa

SEQ ID NO: 1126339 - RNA, 22 nt, Human
ugugacggcguggaaagauggc

SEQ ID NO: 1126340 - RNA, 22 nt, Human
aaaaaaaaaaaaaaaggccgag

SEQ ID NO: 1126341 - RNA, 18 nt, Human
aaagaaggagcugaggcc

SEQ ID NO: 1126342 - RNA, 20 nt, Human
aacauggugaaacccccguc

SEQ ID NO: 1126343 - RNA, 21 nt, Human
aacauggugaaacccccgucu

SEQ ID NO: 1126344 - RNA, 22 nt, Human
aacauggugaaacccccgucuc

SEQ ID NO: 1126345 - RNA, 24 nt, Human
aaccuggccaacauggugaaaccc

SEQ ID NO: 1126346 - RNA, 22 nt, Human
aaggagcugaggccgggcaugg

SEQ ID NO: 1126347 - RNA, 18 nt, Human
aaggggcugcgcguggca

SEQ ID NO: 1126348 - RNA, 24 nt, Human
aaucgcuugaacccgggaggcgga

SEQ ID NO: 1126349 - RNA, 24 nt, Human
acagagcaagacucugucucaaaa

SEQ ID NO: 1126350 - RNA, 24 nt, Human
acaugaagucaggaguucgagacc

SEQ ID NO: 1126351 - RNA, 24 nt, Human
accucagccaccggccgcuccagc

SEQ ID NO: 1126352 - RNA, 21 nt, Human
acggaaaugagaaacacgaug

SEQ ID NO: 1126353 - RNA, 24 nt, Human
acuacacuccagccucgacgacag

SEQ ID NO: 1126354 - RNA, 21 nt, Human
agacaggacagguugaaccug

SEQ ID NO: 1126355 - RNA, 22 nt, Human
agacaggacagguugaaccugg

SEQ ID NO: 1126356 - RNA, 21 nt, Human
agacgacaaugcccaggggca

SEQ ID NO: 1126357 - RNA, 21 nt, Human
agaggccagaggcucggggac

SEQ ID NO: 1126358 - RNA, 18 nt, Human
agaggcucggggacagga

SEQ ID NO: 1126359 - RNA, 18 nt, Human
agagggagaagcagggac

SEQ ID NO: 1126360 - RNA, 19 nt, Human
agagggagaagcagggacu

SEQ ID NO: 1126361 - RNA, 24 nt, Human
agcacuuugggaggccgaggcugg

SEQ ID NO: 1126362 - RNA, 18 nt, Human
aggcacgagaaucgcuug

SEQ ID NO: 1126363 - RNA, 24 nt, Human
aggcacgagaaucgcuugaacccg

SEQ ID NO: 1126364 - RNA, 21 nt, Human
aggcaucagaggccagaggcu

SEQ ID NO: 1126365 - RNA, 21 nt, Human
aggccgaggcuggcggaucac

SEQ ID NO: 1126366 - RNA, 24 nt, Human
aggcugaggcacgagaaucgcuug

SEQ ID NO: 1126367 - RNA, 26 nt, Human
aggcuggcggaucacaugaagucagg

SEQ ID NO: 1126368 - RNA, 25 nt, Human
caacauggugaaacccccgucucua

SEQ ID NO: 1126369 - RNA, 20 nt, Human
caaggaugagauccagguuu

SEQ ID NO: 1126370 - RNA, 22 nt, Human
cacaccuguaaucccagcacuu

SEQ ID NO: 1126371 - RNA, 24 nt, Human
cacaccuguaaucccagcacuuug

SEQ ID NO: 1126372 - RNA, 23 nt, Human
cacaugaagucaggaguucgaga

SEQ ID NO: 1126373 - RNA, 26 nt, Human
caccacuacacuccagccucgacgac

SEQ ID NO: 1126374 - RNA, 24 nt, Human
caccgccgcgcccacgcgcgccca

SEQ ID NO: 1126375 - RNA, 19 nt, Human
caccuguaaucccagcacu

SEQ ID NO: 1126376 - RNA, 24 nt, Human
caccuguaaucccagcacuuuggg

SEQ ID NO: 1126377 - RNA, 25 nt, Human
cacgccuccacaaucugcuccaccg

SEQ ID NO: 1126378 - RNA, 24 nt, Human
cacuacacuccagccucgacgaca

SEQ ID NO: 1126379 - RNA, 23 nt, Human
cacuccagccucgacgacagagc

SEQ ID NO: 1126380 - RNA, 22 nt, Human
cagcacuuugggaggccgaggc

SEQ ID NO: 1126381 - RNA, 25 nt, Human
cagcacuuugggaggccgaggcugg

SEQ ID NO: 1126382 - RNA, 19 nt, Human
cagcagcgcggccgccgac

SEQ ID NO: 1126383 - RNA, 20 nt, Human
cagcgcuccugcagcugccc

SEQ ID NO: 1126384 - RNA, 20 nt, Human
cagcucuuucaccaccgggg

SEQ ID NO: 1126385 - RNA, 20 nt, Human
cagcugccccaggccaaagg

SEQ ID NO: 1126386 - RNA, 22 nt, Human
cagcugccccaggccaaagguu

SEQ ID NO: 1126387 - RNA, 24 nt, Human
caggaggcugaggcacgagaaucg

SEQ ID NO: 1126388 - RNA, 20 nt, Human
cauggcauuuccacgccucc

SEQ ID NO: 1126389 - RNA, 21 nt, Human
ccacgcagcgcuccugcagcu

SEQ ID NO: 1126390 - RNA, 19 nt, Human
ccacuacacuccagccucg

SEQ ID NO: 1126391 - RNA, 20 nt, Human
ccacuacacuccagccucga

SEQ ID NO: 1126392 - RNA, 21 nt, Human
ccacuacacuccagccucgac

SEQ ID NO: 1126393 - RNA, 20 nt, Human
cccacgcgcgcccagcuucg

SEQ ID NO: 1126394 - RNA, 18 nt, Human
cccaugcacgaccagucc

SEQ ID NO: 1126395 - RNA, 19 nt, Human
cccaugcacgaccaguccc

SEQ ID NO: 1126396 - RNA, 24 nt, Human
cccaugcacgaccagucccaaggg

SEQ ID NO: 1126397 - RNA, 23 nt, Human
ccccgucucuacuaaaaauacaa

SEQ ID NO: 1126398 - RNA, 22 nt, Human
cccgaccccaccucgcccacac

SEQ ID NO: 1126399 - RNA, 19 nt, Human
cccugcccggcccgacccc

SEQ ID NO: 1126400 - RNA, 21 nt, Human
ccgagccuguggugucugagg

SEQ ID NO: 1126401 - RNA, 21 nt, Human
ccgccaccucagccaccggcc

SEQ ID NO: 1126402 - RNA, 21 nt, Human
ccgccgcgcccacgcgcgccc

SEQ ID NO: 1126403 - RNA, 19 nt, Human
ccgccggggccagcaaggc

SEQ ID NO: 1126404 - RNA, 21 nt, Human
ccuccacaaucugcuccaccg

SEQ ID NO: 1126405 - RNA, 20 nt, Human
ccuccugcgagccggcaaau

SEQ ID NO: 1126406 - RNA, 22 nt, Human
ccucgacgacagagcaagacuc

SEQ ID NO: 1126407 - RNA, 21 nt, Human
ccucggguccggagggccucc

SEQ ID NO: 1126408 - RNA, 23 nt, Human
ccuggccaacauggugaaacccc

SEQ ID NO: 1126409 - RNA, 25 nt, Human
ccuggccaacauggugaaacccccg

SEQ ID NO: 1126410 - RNA, 22 nt, Human
ccuguggugucugaggggcauu

SEQ ID NO: 1126411 - RNA, 24 nt, Human
cgagaccaaccuggccaacauggu

SEQ ID NO: 1126412 - RNA, 26 nt, Human
cgaggcuggcggaucacaugaaguca

SEQ ID NO: 1126413 - RNA, 21 nt, Human
cgaugggggcagagcugggga

SEQ ID NO: 1126414 - RNA, 21 nt, Human
cgcacaccuguaaucccagca

SEQ ID NO: 1126415 - RNA, 18 nt, Human
cgcccggcucacugggca

SEQ ID NO: 1126416 - RNA, 22 nt, Human
cggagggccuccugcgagccgg

SEQ ID NO: 1126417 - RNA, 21 nt, Human
cggaucacaugaagucaggag

SEQ ID NO: 1126418 - RNA, 24 nt, Human
cggaucacaugaagucaggaguuc

SEQ ID NO: 1126419 - RNA, 20 nt, Human
cguuguggugcaugucugua

SEQ ID NO: 1126420 - RNA, 21 nt, Human
cuaguagacgacaaugcccag

SEQ ID NO: 1126421 - RNA, 18 nt, Human
cucaaaaaaaaaaaaaaa

SEQ ID NO: 1126422 - RNA, 22 nt, Human
cucagccaccggccgcuccagc

SEQ ID NO: 1126423 - RNA, 19 nt, Human
cucccggggcagggugccu

SEQ ID NO: 1126424 - RNA, 19 nt, Human
cucugucucaaaaaaaaaa

SEQ ID NO: 1126425 - RNA, 24 nt, Human
gacagagcaagacucugucucaaa

SEQ ID NO: 1126426 - RNA, 18 nt, Human
gacagguugaaccugggg

SEQ ID NO: 1126427 - RNA, 18 nt, Human
gaccccaccucgcccaca

SEQ ID NO: 1126428 - RNA, 18 nt, Human
gagaaacacgaugggggc

SEQ ID NO: 1126429 - RNA, 19 nt, Human
gagaagcagggacuuggga

SEQ ID NO: 1126430 - RNA, 18 nt, Human
gagcaggagaggcccaag

SEQ ID NO: 1126431 - RNA, 21 nt, Human
gagcuugucgcugcggagcag

SEQ ID NO: 1126432 - RNA, 21 nt, Human
gaggucaaugggauguuccag

SEQ ID NO: 1126433 - RNA, 22 nt, Human
gagugcugcggaaaaagguuca

SEQ ID NO: 1126434 - RNA, 24 nt, Human
gaucacaugaagucaggaguucga

SEQ ID NO: 1126435 - RNA, 23 nt, Human
gaucuccaggggggcaggucugg

SEQ ID NO: 1126436 - RNA, 26 nt, Human
gaugagugguuccugccgguucugcu

SEQ ID NO: 1126437 - RNA, 19 nt, Human
gcagggcguagagucaggg

SEQ ID NO: 1126438 - RNA, 19 nt, Human
gcaugucuguaaucccagc

SEQ ID NO: 1126439 - RNA, 25 nt, Human
gccaacauggugaaacccccgucuc

SEQ ID NO: 1126440 - RNA, 21 nt, Human
gccaggcccuagagcugguga

SEQ ID NO: 1126441 - RNA, 20 nt, Human
gccgaaaucgcaccacuaca

SEQ ID NO: 1126442 - RNA, 21 nt, Human
gccugggaggccuggccaggc

SEQ ID NO: 1126443 - RNA, 19 nt, Human
gcgcucagcuccgccgggg

SEQ ID NO: 1126444 - RNA, 24 nt, Human
gcuguaguuuggggcaggcucagc

SEQ ID NO: 1126445 - RNA, 18 nt, Human
ggaaauggauugaggggg

SEQ ID NO: 1126446 - RNA, 18 nt, Human
ggagaagcagggacuugg

SEQ ID NO: 1126447 - RNA, 22 nt, Human
ggagccugggaggccuggccag

SEQ ID NO: 1126448 - RNA, 21 nt, Human
ggaggccuguuugcugagaag

SEQ ID NO: 1126449 - RNA, 21 nt, Human
ggaguucgagaccaaccuggc

SEQ ID NO: 1126450 - RNA, 23 nt, Human
ggaucacaugaagucaggaguuc

SEQ ID NO: 1126451 - RNA, 21 nt, Human
ggcaggcucagcugggcgggu

SEQ ID NO: 1126452 - RNA, 20 nt, Human
ggcagggcguagagucaggg

SEQ ID NO: 1126453 - RNA, 19 nt, Human
ggccagaggcucggggaca

SEQ ID NO: 1126454 - RNA, 18 nt, Human
ggcccaagcuccugaagg

SEQ ID NO: 1126455 - RNA, 19 nt, Human
ggcucggggacaggaacag

SEQ ID NO: 1126456 - RNA, 22 nt, Human
gggacaggaacagacacaggga

SEQ ID NO: 1126457 - RNA, 20 nt, Human
gggaggagcagaaugcggug

SEQ ID NO: 1126458 - RNA, 19 nt, Human
gggaggcccagcccaagcc

SEQ ID NO: 1126459 - RNA, 25 nt, Human
gggcagagcuggggaaaagcugggg

SEQ ID NO: 1126460 - RNA, 22 nt, Human
gggcaggcucagcugggcgggu

SEQ ID NO: 1126461 - RNA, 20 nt, Human
gggcagggugccucuccggc

SEQ ID NO: 1126462 - RNA, 24 nt, Human
gggcaugguggcgcacaccuguaa

SEQ ID NO: 1126463 - RNA, 23 nt, Human
gggcgccccgggccucauccccu

SEQ ID NO: 1126464 - RNA, 19 nt, Human
gggcguagagucagggugu

SEQ ID NO: 1126465 - RNA, 21 nt, Human
ggggcagagcuggggaaaagc

SEQ ID NO: 1126466 - RNA, 19 nt, Human
ggugaggaguaugaaggga

SEQ ID NO: 1126467 - RNA, 24 nt, Human
gguggcgcacaccuguaaucccag

SEQ ID NO: 1126468 - RNA, 24 nt, Human
gguucugcucuuccagggcgcuca

SEQ ID NO: 1126469 - RNA, 22 nt, Human
guggugcaugucuguaauccca

SEQ ID NO: 1126470 - RNA, 23 nt, Human
guggugcaugucuguaaucccag

SEQ ID NO: 1126471 - RNA, 21 nt, Human
gugguuccugccgguucugcu

SEQ ID NO: 1126472 - RNA, 18 nt, Human
guuuggggcaggcucagc

SEQ ID NO: 1126473 - RNA, 28 nt, Human
uaagccccauaggacugacaaucaaaaa

SEQ ID NO: 1126474 - RNA, 20 nt, Human
uaccuggcugugggccucua

SEQ ID NO: 1126475 - RNA, 21 nt, Human
uaggacugacaaucaaaaaca

SEQ ID NO: 1126476 - RNA, 19 nt, Human
ucaaaaacaggucuggcug

SEQ ID NO: 1126477 - RNA, 23 nt, Human
ucacaugaagucaggaguucgag

SEQ ID NO: 1126478 - RNA, 19 nt, Human
ucacugggcacgcugggaa

SEQ ID NO: 1126479 - RNA, 18 nt, Human
uccagguuucuggcgugg

SEQ ID NO: 1126480 - RNA, 22 nt, Human
ucccggggcagggugccucucc

SEQ ID NO: 1126481 - RNA, 19 nt, Human
uccucguuuucgaguuuca

SEQ ID NO: 1126482 - RNA, 18 nt, Human
uccugcagcugccccagg

SEQ ID NO: 1126483 - RNA, 24 nt, Human
ucgagggcucccugcgagucccgg

SEQ ID NO: 1126484 - RNA, 18 nt, Human
ucgcuugaacccgggagg

SEQ ID NO: 1126485 - RNA, 19 nt, Human
ucggagugcugcggaaaaa

SEQ ID NO: 1126486 - RNA, 19 nt, Human
ucggagugcugcggaaaaa

SEQ ID NO: 1126487 - RNA, 25 nt, Human
ucggagugcugcggaaaaagguuca

SEQ ID NO: 1126488 - RNA, 23 nt, Human
ucucuacuaaaaauacaacaauu

SEQ ID NO: 1126489 - RNA, 21 nt, Human
ucuguaaucccagcuacucag

SEQ ID NO: 1126490 - RNA, 23 nt, Human
ucugucucaaaaaaaaaaaaaaa

SEQ ID NO: 1126491 - RNA, 25 nt, Human
ucugucucaaaaaaaaaaaaaaaaa

SEQ ID NO: 1126492 - RNA, 18 nt, Human
ugaaagaaggagcugagg

SEQ ID NO: 1126493 - RNA, 23 nt, Human
ugaaagaaggagcugaggccggg

SEQ ID NO: 1126494 - RNA, 23 nt, Human
ugaaggcaucagaggccagaggc

SEQ ID NO: 1126495 - RNA, 18 nt, Human
ugagaagggguuggggug

SEQ ID NO: 1126496 - RNA, 24 nt, Human
ugagagaacugaaccaacuggaaa

SEQ ID NO: 1126497 - RNA, 20 nt, Human
ugagagggagaagcagggac

SEQ ID NO: 1126498 - RNA, 24 nt, Human
ugaggcacgagaaucgcuugaacc

SEQ ID NO: 1126499 - RNA, 24 nt, Human
ugaggccgggcaugguggcgcaca

SEQ ID NO: 1126500 - RNA, 18 nt, Human
ugaugcucccggggcagg

SEQ ID NO: 1126501 - RNA, 21 nt, Human
ugcacgaccagucccaagggc

SEQ ID NO: 1126502 - RNA, 20 nt, Human
ugcggagcaggggcagcagc

SEQ ID NO: 1126503 - RNA, 21 nt, Human
uggaaugaaagaaggagcuga

SEQ ID NO: 1126504 - RNA, 21 nt, Human
uggcauuuccacgccuccaca

SEQ ID NO: 1126505 - RNA, 25 nt, Human
uggccaacauggugaaacccccguc

SEQ ID NO: 1126506 - RNA, 24 nt, Human
uggcgcacaccuguaaucccagca

SEQ ID NO: 1126507 - RNA, 23 nt, Human
uggcggaucacaugaagucagga

SEQ ID NO: 1126508 - RNA, 24 nt, Human
ugggaggccgaggcuggcggauca

SEQ ID NO: 1126509 - RNA, 18 nt, Human
ugggaggccuggccaggc

SEQ ID NO: 1126510 - RNA, 18 nt, Human
ugggguggaggagggagc

SEQ ID NO: 1126511 - RNA, 21 nt, Human
uggugcaugucuguaauccca

SEQ ID NO: 1126512 - RNA, 22 nt, Human
uggugcaugucuguaaucccag

SEQ ID NO: 1126513 - RNA, 24 nt, Human
ugguggcgcacaccuguaauccca

SEQ ID NO: 1126514 - RNA, 21 nt, Human
ugucgcugcggagcaggggca

SEQ ID NO: 1126515 - RNA, 24 nt, Human
ugucuguaaucccagcuacucagg

SEQ ID NO: 1126516 - RNA, 21 nt, Human
ugugggaaauggauugaggaa

SEQ ID NO: 1126517 - RNA, 19 nt, Human
ugugggccucuaugaaagc

SEQ ID NO: 1126518 - RNA, 21 nt, Human
uguggugcaugucuguaaucc

SEQ ID NO: 1126519 - RNA, 24 nt, Human
uguggugcaugucuguaaucccag

SEQ ID NO: 1126520 - RNA, 21 nt, Human
uuagccgggcguuguggugca

SEQ ID NO: 1126521 - RNA, 22 nt, Human
uuccaggacuuaagccccauag

SEQ ID NO: 1126522 - RNA, 25 nt, Human
uugaaccuggggcugagagaacuga

SEQ ID NO: 1126523 - RNA, 22 nt, Human
uugaagugagccgaaaucgcac

SEQ ID NO: 1126524 - RNA, 18 nt, Human
uugagggggcgcuggagu

SEQ ID NO: 1126525 - RNA, 25 nt, Human
uugggaggccgaggcuggcggauca

SEQ ID NO: 1126526 - RNA, 21 nt, Human
uuugaagugagccgaaaucgc

SEQ ID NO: 1126527 - RNA, 26 nt, Human
aaacagaagagguacagaagggaccc

SEQ ID NO: 1126528 - RNA, 21 nt, Human
aaagagcucagccugaccugc

SEQ ID NO: 1126529 - RNA, 19 nt, Human
aaaggcagaggaggaugaa

SEQ ID NO: 1126530 - RNA, 18 nt, Human
aaccagccaagaccugca

SEQ ID NO: 1126531 - RNA, 21 nt, Human
aagaccugcagaagggaucaa

SEQ ID NO: 1126532 - RNA, 19 nt, Human
aagccagaggcagagagga

SEQ ID NO: 1126533 - RNA, 19 nt, Human
aagccuuuggcuguggugc

SEQ ID NO: 1126534 - RNA, 18 nt, Human
aaggauggcacaguugcc

SEQ ID NO: 1126535 - RNA, 18 nt, Human
agaggaagggcccgaagu

SEQ ID NO: 1126536 - RNA, 22 nt, Human
agaugugcuggacaccggaggu

SEQ ID NO: 1126537 - RNA, 19 nt, Human
agcaggaggugggggcagg

SEQ ID NO: 1126538 - RNA, 18 nt, Human
agcugugguuggaacugg

SEQ ID NO: 1126539 - RNA, 22 nt, Human
aggcgccagcggccacuuagca

SEQ ID NO: 1126540 - RNA, 20 nt, Human
aggggaaaggcagaggagga

SEQ ID NO: 1126541 - RNA, 18 nt, Human
aucagcaaagccaacugc

SEQ ID NO: 1126542 - RNA, 22 nt, Human
augaaagagacauaaagccaga

SEQ ID NO: 1126543 - RNA, 18 nt, Human
auguucagaugcucaucu

SEQ ID NO: 1126544 - RNA, 24 nt, Human
caagccuuuggcuguggugcccua

SEQ ID NO: 1126545 - RNA, 18 nt, Human
cacccaaauccaggaagc

SEQ ID NO: 1126546 - RNA, 21 nt, Human
cacccaaauccaggaagccuc

SEQ ID NO: 1126547 - RNA, 23 nt, Human
cagaagagguacagaaaaguuaa

SEQ ID NO: 1126548 - RNA, 27 nt, Human
caucucuauccuugacuccacugaggg

SEQ ID NO: 1126549 - RNA, 21 nt, Human
cauguucagaugcucaucucc

SEQ ID NO: 1126550 - RNA, 19 nt, Human
ccaaggcuaaggcuggggu

SEQ ID NO: 1126551 - RNA, 19 nt, Human
ccaucgcgugccaagccag

SEQ ID NO: 1126552 - RNA, 21 nt, Human
ccccugccagaccugcagcuc

SEQ ID NO: 1126553 - RNA, 20 nt, Human
ccgcaggaaaucauagaaaa

SEQ ID NO: 1126554 - RNA, 21 nt, Human
ccuagcccaugcuagccccug

SEQ ID NO: 1126555 - RNA, 20 nt, Human
ccuguaggucuggaaauagg

SEQ ID NO: 1126556 - RNA, 24 nt, Human
ccuguaggucuggaaauaggcccc

SEQ ID NO: 1126557 - RNA, 19 nt, Human
cgggagcaggagguggggg

SEQ ID NO: 1126558 - RNA, 21 nt, Human
cgggagcaggaggugggggca

SEQ ID NO: 1126559 - RNA, 22 nt, Human
cuagcccaugcuagccccugcc

SEQ ID NO: 1126560 - RNA, 21 nt, Human
cucuugcauucaccagccgca

SEQ ID NO: 1126561 - RNA, 25 nt, Human
cugaaaccagccaagaccugcagaa

SEQ ID NO: 1126562 - RNA, 24 nt, Human
cugccagugucuguacagcugcau

SEQ ID NO: 1126563 - RNA, 26 nt, Human
cugcgggggugaggaagcuggcuucc

SEQ ID NO: 1126564 - RNA, 21 nt, Human
cugugguccuuccuguauccc

SEQ ID NO: 1126565 - RNA, 25 nt, Human
cuuccagugaagaugugcuggacac

SEQ ID NO: 1126566 - RNA, 23 nt, Human
cuuccuguaucccguccaucgcg

SEQ ID NO: 1126567 - RNA, 18 nt, Human
cuugacuccacugagggg

SEQ ID NO: 1126568 - RNA, 20 nt, Human
gaaagagacauaaagccaga

SEQ ID NO: 1126569 - RNA, 20 nt, Human
gagcaggaggugggggcagg

SEQ ID NO: 1126570 - RNA, 18 nt, Human
gaggaagggcccgaagug

SEQ ID NO: 1126571 - RNA, 23 nt, Human
gagggugguagucugggcacagg

SEQ ID NO: 1126572 - RNA, 23 nt, Human
gaggugggggaucagcaaagcca

SEQ ID NO: 1126573 - RNA, 21 nt, Human
gaugugcuggacaccggaggu

SEQ ID NO: 1126574 - RNA, 21 nt, Human
ggaaaucauagaaaaugacca

SEQ ID NO: 1126575 - RNA, 22 nt, Human
ggaaucccauucagcugcccuu

SEQ ID NO: 1126576 - RNA, 19 nt, Human
ggaggugguaaagcugugg

SEQ ID NO: 1126577 - RNA, 20 nt, Human
ggaggugguaaagcuguggu

SEQ ID NO: 1126578 - RNA, 21 nt, Human
gggcaggggaaaggcagagga

SEQ ID NO: 1126579 - RNA, 18 nt, Human
ggggaucagcaaagccaa

SEQ ID NO: 1126580 - RNA, 18 nt, Human
ggugguagucugggcaca

SEQ ID NO: 1126581 - RNA, 18 nt, Human
guagucugggcacaggcu

SEQ ID NO: 1126582 - RNA, 21 nt, Human
uaacgggaggugguaaagcug

SEQ ID NO: 1126583 - RNA, 20 nt, Human
uacaaaaacagaagagguac

SEQ ID NO: 1126584 - RNA, 20 nt, Human
uagcacccgcugaucuuggu

SEQ ID NO: 1126585 - RNA, 24 nt, Human
uaggucuggaaauaggccccaguc

SEQ ID NO: 1126586 - RNA, 25 nt, Human
ucaagggcaggggaaaggcagagga

SEQ ID NO: 1126587 - RNA, 21 nt, Human
ucagcaaagccaacugcgggg

SEQ ID NO: 1126588 - RNA, 21 nt, Human
uccaggaagccucaaggcccc

SEQ ID NO: 1126589 - RNA, 19 nt, Human
ucccauucagcugcccaag

SEQ ID NO: 1126590 - RNA, 20 nt, Human
ucucuugcauucaccagccg

SEQ ID NO: 1126591 - RNA, 24 nt, Human
ugaaagagacauaaagccagaggc

SEQ ID NO: 1126592 - RNA, 20 nt, Human
ugaugagggugguagucugg

SEQ ID NO: 1126593 - RNA, 22 nt, Human
ugccaagccaguccuuaguugc

SEQ ID NO: 1126594 - RNA, 19 nt, Human
ugcccuagcccaugcuagc

SEQ ID NO: 1126595 - RNA, 21 nt, Human
ugcccuagcccaugcuagccc

SEQ ID NO: 1126596 - RNA, 20 nt, Human
ugccugaggaaucccauuca

SEQ ID NO: 1126597 - RNA, 20 nt, Human
uggaaauaggccccaguccu

SEQ ID NO: 1126598 - RNA, 21 nt, Human
uggcaaggauggcacaguugc

SEQ ID NO: 1126599 - RNA, 23 nt, Human
ugggacccguuuccugaaaccag

SEQ ID NO: 1126600 - RNA, 20 nt, Human
ugggggcaggcaaagggcug

SEQ ID NO: 1126601 - RNA, 22 nt, Human
ugggggcaggcaaagggcuggg

SEQ ID NO: 1126602 - RNA, 24 nt, Human
uuacaaaaacagaagagguacaga

SEQ ID NO: 1126603 - RNA, 25 nt, Human
uugcuggauugaucucugccagugu

SEQ ID NO: 1126604 - RNA, 20 nt, Human
accccaccgucucccuccca

SEQ ID NO: 1126605 - RNA, 24 nt, Human
accccaccgucucccucccaccuu

SEQ ID NO: 1126606 - RNA, 26 nt, Human
accgucucccucccaccuucccacug

SEQ ID NO: 1126607 - RNA, 22 nt, Human
agucacagcgacuggcacaacc

SEQ ID NO: 1126608 - RNA, 24 nt, Human
caccgucucccucccaccuuccca

SEQ ID NO: 1126609 - RNA, 18 nt, Human
cccaccgucucccuccca

SEQ ID NO: 1126610 - RNA, 22 nt, Human
ccucccaccuucccacugcagu

SEQ ID NO: 1126611 - RNA, 19 nt, Human
cucccucccaccuucccac

SEQ ID NO: 1126612 - RNA, 20 nt, Human
gcacaaccuucuccaaacug

SEQ ID NO: 1126613 - RNA, 26 nt, Human
ucacagcgacuggcacaaccuucucc

SEQ ID NO: 1126614 - RNA, 29 nt, Human
ucagcccuuaccccaccgucucccuccca

SEQ ID NO: 1126615 - RNA, 19 nt, Human
uccaugaacagggucacag

SEQ ID NO: 1126616 - RNA, 22 nt, Human
uccaugaacagggucacagcca

SEQ ID NO: 1126617 - RNA, 22 nt, Human
aaggagcuggagcccgcgccag

SEQ ID NO: 1126618 - RNA, 24 nt, Human
aaggggcaggcugggaggggcugc

SEQ ID NO: 1126619 - RNA, 18 nt, Human
acgcagcugccgcaacau

SEQ ID NO: 1126620 - RNA, 18 nt, Human
acucauguucugcauccc

SEQ ID NO: 1126621 - RNA, 18 nt, Human
agccgcugguggucuucg

SEQ ID NO: 1126622 - RNA, 21 nt, Human
agccggcucuccucgcccucc

SEQ ID NO: 1126623 - RNA, 19 nt, Human
agccuggagccggcugaug

SEQ ID NO: 1126624 - RNA, 23 nt, Human
aggagucggaggacucggacacc

SEQ ID NO: 1126625 - RNA, 20 nt, Human
aggcuggggcuugugaggcc

SEQ ID NO: 1126626 - RNA, 19 nt, Human
cacuugggcaggagucgga

SEQ ID NO: 1126627 - RNA, 23 nt, Human
cagcugccgcaacauguccugcu

SEQ ID NO: 1126628 - RNA, 21 nt, Human
cagcuuccuaucacgugucuc

SEQ ID NO: 1126629 - RNA, 21 nt, Human
ccaggcucuugcagcuccuca

SEQ ID NO: 1126630 - RNA, 20 nt, Human
ccccauaggccgagcucaga

SEQ ID NO: 1126631 - RNA, 25 nt, Human
cccgcgccagagccaaagcuggagc

SEQ ID NO: 1126632 - RNA, 23 nt, Human
cccucccaggcucuggggcagcg

SEQ ID NO: 1126633 - RNA, 24 nt, Human
ccuccagcucggacaacuuggcgu

SEQ ID NO: 1126634 - RNA, 24 nt, Human
ccucccucccaggcucuggggcag

SEQ ID NO: 1126635 - RNA, 20 nt, Human
cgcccuccaguagcuuccug

SEQ ID NO: 1126636 - RNA, 23 nt, Human
cgcugcagggcggccuccagcuc

SEQ ID NO: 1126637 - RNA, 23 nt, Human
cucaaucucagccuggagccggc

SEQ ID NO: 1126638 - RNA, 18 nt, Human
cuccagggaagcccucug

SEQ ID NO: 1126639 - RNA, 19 nt, Human
cuccucgcccuccaguagc

SEQ ID NO: 1126640 - RNA, 20 nt, Human
cucuccgcgcugcugugcau

SEQ ID NO: 1126641 - RNA, 18 nt, Human
cugcuuggcccgcugcag

SEQ ID NO: 1126642 - RNA, 25 nt, Human
cuuggcccgcugcagggcggccucc

SEQ ID NO: 1126643 - RNA, 21 nt, Human
cuugugaggcccccauaggcc

SEQ ID NO: 1126644 - RNA, 23 nt, Human
gagcuggugcggcugaaggagcu

SEQ ID NO: 1126645 - RNA, 19 nt, Human
gccagagccaaagcuggag

SEQ ID NO: 1126646 - RNA, 18 nt, Human
gcccuccaguagcuuccu

SEQ ID NO: 1126647 - RNA, 25 nt, Human
gccgcaacauguccugcuuggcccg

SEQ ID NO: 1126648 - RNA, 23 nt, Human
ggaggggcugccucagcuguuca

SEQ ID NO: 1126649 - RNA, 20 nt, Human
ggcccccauaggccgagcuc

SEQ ID NO: 1126650 - RNA, 21 nt, Human
ggcuggggcuugugaggcccc

SEQ ID NO: 1126651 - RNA, 19 nt, Human
gggcagcgcagaaggggca

SEQ ID NO: 1126652 - RNA, 24 nt, Human
guucacuugggcaggagucggagg

SEQ ID NO: 1126653 - RNA, 22 nt, Human
uaguggccucccucccaggcuc

SEQ ID NO: 1126654 - RNA, 24 nt, Human
ucacaaccacggcccucgaggagc

SEQ ID NO: 1126655 - RNA, 24 nt, Human
ucacgugucucgaucuucuucaca

SEQ ID NO: 1126656 - RNA, 23 nt, Human
uccagcucggacaacuuggcguu

SEQ ID NO: 1126657 - RNA, 23 nt, Human
uccgcgcugcugugcaucugcaa

SEQ ID NO: 1126658 - RNA, 23 nt, Human
ucgcccuccaguagcuuccugua

SEQ ID NO: 1126659 - RNA, 19 nt, Human
ucugcaucccagacuccag

SEQ ID NO: 1126660 - RNA, 21 nt, Human
ugaggcuggggcuugugaggc

SEQ ID NO: 1126661 - RNA, 24 nt, Human
ugccucagcuguucacuugggcag

SEQ ID NO: 1126662 - RNA, 24 nt, Human
ugcuucccagccaggcucuugcag

SEQ ID NO: 1126663 - RNA, 27 nt, Human
uggagcccaggccauagcugaggcugg

SEQ ID NO: 1126664 - RNA, 18 nt, Human
uggagccggcugauguuc

SEQ ID NO: 1126665 - RNA, 21 nt, Human
ugggcaggagucggaggacuc

SEQ ID NO: 1126666 - RNA, 23 nt, Human
uggggcccucaaucucagccugg

SEQ ID NO: 1126667 - RNA, 21 nt, Human
uggugcggcugaaggagcugg

SEQ ID NO: 1126668 - RNA, 20 nt, Human
uucccagccaggcucuugca

SEQ ID NO: 1126669 - RNA, 21 nt, Human
uucccagccaggcucuugcag

SEQ ID NO: 1126670 - RNA, 20 nt, Human
uugacguucaucagcugcug

SEQ ID NO: 1126671 - RNA, 20 nt, Human
aaaaaaaaaagaggaaccag

SEQ ID NO: 1126672 - RNA, 23 nt, Human
aaaaaacaaacaaacaaacaaaa

SEQ ID NO: 1126673 - RNA, 18 nt, Human
aaaauuagcugggcgugg

SEQ ID NO: 1126674 - RNA, 25 nt, Human
aaacaaacaaaaaaagaaggaucca

SEQ ID NO: 1126675 - RNA, 22 nt, Human
aaacagaauaguauaaugagac

SEQ ID NO: 1126676 - RNA, 19 nt, Human
aaagaccaagggaggcgcc

SEQ ID NO: 1126677 - RNA, 22 nt, Human
aaaugaaccccaagaccucuga

SEQ ID NO: 1126678 - RNA, 24 nt, Human
aaauggggcuaaugcccucauccc

SEQ ID NO: 1126679 - RNA, 18 nt, Human
aacacuuugagaggcuga

SEQ ID NO: 1126680 - RNA, 27 nt, Human
aaccggccugcacaaaugaacccccuc

SEQ ID NO: 1126681 - RNA, 21 nt, Human
aagcaggugugugggggaggu

SEQ ID NO: 1126682 - RNA, 22 nt, Human
aagcccccagcuggggcacucc

SEQ ID NO: 1126683 - RNA, 19 nt, Human
aagggacgcgugugcucug

SEQ ID NO: 1126684 - RNA, 20 nt, Human
aaguucaggaguucgagacc

SEQ ID NO: 1126685 - RNA, 23 nt, Human
aaguugggguggagaaaaauggg

SEQ ID NO: 1126686 - RNA, 24 nt, Human
aaucaccuaaguucaggaguucga

SEQ ID NO: 1126687 - RNA, 25 nt, Human
aaucuuguuucaucugcacucccac

SEQ ID NO: 1126688 - RNA, 18 nt, Human
aauuagccaggcauggug

SEQ ID NO: 1126689 - RNA, 24 nt, Human
acaaaugaaccccaagaccucuga

SEQ ID NO: 1126690 - RNA, 20 nt, Human
acaagagcaaaacuccaucu

SEQ ID NO: 1126691 - RNA, 19 nt, Human
acacagugaaggggaucuc

SEQ ID NO: 1126692 - RNA, 24 nt, Human
acagcgccacugcacucuagccug

SEQ ID NO: 1126693 - RNA, 22 nt, Human
acccacccuccaccacccaacc

SEQ ID NO: 1126694 - RNA, 22 nt, Human
acgcagcggcuguggauggggc

SEQ ID NO: 1126695 - RNA, 23 nt, Human
acuaaagucuugguggauucuuc

SEQ ID NO: 1126696 - RNA, 23 nt, Human
acucccaccuccuuuucccccac

SEQ ID NO: 1126697 - RNA, 24 nt, Human
acugcacuacagccugggcaacag

SEQ ID NO: 1126698 - RNA, 27 nt, Human
acugcacucuagccuggccgacaagag

SEQ ID NO: 1126699 - RNA, 24 nt, Human
acugcagcugggggauaggaguga

SEQ ID NO: 1126700 - RNA, 19 nt, Human
agaacccagacagcagccc

SEQ ID NO: 1126701 - RNA, 18 nt, Human
agaacugagagcuuccac

SEQ ID NO: 1126702 - RNA, 24 nt, Human
agaaucaccuaaguucaggaguuc

SEQ ID NO: 1126703 - RNA, 22 nt, Human
agacaagagaggggcuggaggc

SEQ ID NO: 1126704 - RNA, 23 nt, Human
agagaaacucagugucucagggg

SEQ ID NO: 1126705 - RNA, 19 nt, Human
agagaggccuuuccugggg

SEQ ID NO: 1126706 - RNA, 18 nt, Human
agaggagaggggugggga

SEQ ID NO: 1126707 - RNA, 22 nt, Human
agagguugcagugagcugagau

SEQ ID NO: 1126708 - RNA, 24 nt, Human
agagguugcagugagcugagaucg

SEQ ID NO: 1126709 - RNA, 21 nt, Human
agaugcuguugggacaaaaug

SEQ ID NO: 1126710 - RNA, 22 nt, Human
agcaggugugugggggagguuc

SEQ ID NO: 1126711 - RNA, 23 nt, Human
agccaggcaugguggcaggcgcc

SEQ ID NO: 1126712 - RNA, 23 nt, Human
agccuggccaacguggugaaccc

SEQ ID NO: 1126713 - RNA, 22 nt, Human
agccugggcaacagcgagacuc

SEQ ID NO: 1126714 - RNA, 24 nt, Human
agcucuggggccugccuaaagcaa

SEQ ID NO: 1126715 - RNA, 18 nt, Human
agcugggcccacucaugg

SEQ ID NO: 1126716 - RNA, 20 nt, Human
agcugggcgugguggugggc

SEQ ID NO: 1126717 - RNA, 20 nt, Human
aggagaggacucauaaaugg

SEQ ID NO: 1126718 - RNA, 22 nt, Human
aggagagggguggggaugcugg

SEQ ID NO: 1126719 - RNA, 24 nt, Human
aggaugugauucaagcaaagacca

SEQ ID NO: 1126720 - RNA, 20 nt, Human
aggcagagguugcagugagc

SEQ ID NO: 1126721 - RNA, 24 nt, Human
aggcagagguugcagugagcugag

SEQ ID NO: 1126722 - RNA, 19 nt, Human
aggcaggagaaucaccuaa

SEQ ID NO: 1126723 - RNA, 21 nt, Human
aggcaggaucgcuugaacccg

SEQ ID NO: 1126724 - RNA, 24 nt, Human
aggcaugguggcaggcgccuguaa

SEQ ID NO: 1126725 - RNA, 22 nt, Human
aggcccaaaacacaacugacag

SEQ ID NO: 1126726 - RNA, 19 nt, Human
aggcugaggcaggagaauc

SEQ ID NO: 1126727 - RNA, 18 nt, Human
aggcugugcagccccagg

SEQ ID NO: 1126728 - RNA, 22 nt, Human
agggacagccuguacaaaagcc

SEQ ID NO: 1126729 - RNA, 20 nt, Human
agggagacggagauggaugg

SEQ ID NO: 1126730 - RNA, 21 nt, Human
aggugcuuagggaaaaccagg

SEQ ID NO: 1126731 - RNA, 21 nt, Human
agguggaaguugcagugagcc

SEQ ID NO: 1126732 - RNA, 24 nt, Human
agguggaaguugcagugagccgag

SEQ ID NO: 1126733 - RNA, 23 nt, Human
agguggcuuuuggggucucugga

SEQ ID NO: 1126734 - RNA, 26 nt, Human
agguggcuuuuggggucucuggagga

SEQ ID NO: 1126735 - RNA, 24 nt, Human
aguaagucacugaagcaccugccc

SEQ ID NO: 1126736 - RNA, 24 nt, Human
agucacuugaacccaggaggcaga

SEQ ID NO: 1126737 - RNA, 24 nt, Human
aucgcaccacugcacuacagccug

SEQ ID NO: 1126738 - RNA, 23 nt, Human
aucgcuugaacccgggaggugga

SEQ ID NO: 1126739 - RNA, 21 nt, Human
auggggggaagcaggugugug

SEQ ID NO: 1126740 - RNA, 22 nt, Human
caaaacacaacugacaggccgg

SEQ ID NO: 1126741 - RNA, 21 nt, Human
caaaugaaccccaagaccucu

SEQ ID NO: 1126742 - RNA, 24 nt, Human
caacacuuugagaggcugaggcag

SEQ ID NO: 1126743 - RNA, 24 nt, Human
caacccccaucgccucccacacca

SEQ ID NO: 1126744 - RNA, 24 nt, Human
caacguggugaacccucgucucua

SEQ ID NO: 1126745 - RNA, 22 nt, Human
caagccccacaguguccuggag

SEQ ID NO: 1126746 - RNA, 24 nt, Human
caagcccccagcuggggcacuccu

SEQ ID NO: 1126747 - RNA, 20 nt, Human
cacaaaugaaccccaagacc

SEQ ID NO: 1126748 - RNA, 23 nt, Human
cacaaaugaaccccaagaccucu

SEQ ID NO: 1126749 - RNA, 22 nt, Human
cacaacugacaggccgucccuu

SEQ ID NO: 1126750 - RNA, 18 nt, Human
cacagaccagcccagaga

SEQ ID NO: 1126751 - RNA, 22 nt, Human
cacaggaucaaaggcaucccgg

SEQ ID NO: 1126752 - RNA, 21 nt, Human
caccacccaacccccaucgcc

SEQ ID NO: 1126753 - RNA, 24 nt, Human
caccacccaacccccaucgccucc

SEQ ID NO: 1126754 - RNA, 20 nt, Human
caccaccuccaccgcccucu

SEQ ID NO: 1126755 - RNA, 24 nt, Human
caccacugcacuacagccugggca

SEQ ID NO: 1126756 - RNA, 25 nt, Human
caccgcgucacccagaccuugacuc

SEQ ID NO: 1126757 - RNA, 23 nt, Human
caccugcaaucccagcuacucgg

SEQ ID NO: 1126758 - RNA, 24 nt, Human
caccugcaaucccagcuacucggg

SEQ ID NO: 1126759 - RNA, 23 nt, Human
cacucaugguggcccacacucag

SEQ ID NO: 1126760 - RNA, 24 nt, Human
cacucuagccuggccgacaagagc

SEQ ID NO: 1126761 - RNA, 23 nt, Human
cacugcacuacagccugggcaac

SEQ ID NO: 1126762 - RNA, 24 nt, Human
cacugcacuacagccugggcaaca

SEQ ID NO: 1126763 - RNA, 18 nt, Human
cacugcacucuagccugg

SEQ ID NO: 1126764 - RNA, 21 nt, Human
cacugcacucuagccuggccg

SEQ ID NO: 1126765 - RNA, 24 nt, Human
cacugcacucuagccuggccgaca

SEQ ID NO: 1126766 - RNA, 25 nt, Human
cacugcacucuagccuggccgacaa

SEQ ID NO: 1126767 - RNA, 26 nt, Human
cagaacccagacagcagcccauggga

SEQ ID NO: 1126768 - RNA, 25 nt, Human
cagagccagaacccagacagcagcc

SEQ ID NO: 1126769 - RNA, 18 nt, Human
cagagggacagccuguac

SEQ ID NO: 1126770 - RNA, 23 nt, Human
cagcccagagaucccuggaaauc

SEQ ID NO: 1126771 - RNA, 21 nt, Human
cagcccagcgcuugccagcgg

SEQ ID NO: 1126772 - RNA, 18 nt, Human
cagccccacaccuggccc

SEQ ID NO: 1126773 - RNA, 20 nt, Human
cagccccacaccuggcccuc

SEQ ID NO: 1126774 - RNA, 18 nt, Human
cagccucauccuucagga

SEQ ID NO: 1126775 - RNA, 18 nt, Human
cagccugggcaacagcga

SEQ ID NO: 1126776 - RNA, 24 nt, Human
cagcuacucaggaggcugaggcag

SEQ ID NO: 1126777 - RNA, 21 nt, Human
cagcugagggcucuccugcca

SEQ ID NO: 1126778 - RNA, 20 nt, Human
caggcacaacaaagcccacc

SEQ ID NO: 1126779 - RNA, 21 nt, Human
caggcacacauccuggccucg

SEQ ID NO: 1126780 - RNA, 20 nt, Human
caggcccaaaacacaacuga

SEQ ID NO: 1126781 - RNA, 18 nt, Human
caggcgcccacccacgcu

SEQ ID NO: 1126782 - RNA, 18 nt, Human
cagguuuuguuccacuuu

SEQ ID NO: 1126783 - RNA, 18 nt, Human
cagugauggccacucccc

SEQ ID NO: 1126784 - RNA, 20 nt, Human
cauccuggccucggccugcc

SEQ ID NO: 1126785 - RNA, 23 nt, Human
caucugaaaaauggggauacaaa

SEQ ID NO: 1126786 - RNA, 24 nt, Human
caugccuguuaucccaacacuuug

SEQ ID NO: 1126787 - RNA, 21 nt, Human
ccaaccgccccauugucccag

SEQ ID NO: 1126788 - RNA, 20 nt, Human
ccaacguggugaacccucgu

SEQ ID NO: 1126789 - RNA, 24 nt, Human
ccaagaccucugaccccaugaccu

SEQ ID NO: 1126790 - RNA, 23 nt, Human
ccaauaaucgaggcuuguggggc

SEQ ID NO: 1126791 - RNA, 18 nt, Human
ccacacugauggggaggg

SEQ ID NO: 1126792 - RNA, 21 nt, Human
ccacccuccaccacccaaccc

SEQ ID NO: 1126793 - RNA, 19 nt, Human
ccaccucuccagccgccug

SEQ ID NO: 1126794 - RNA, 18 nt, Human
ccacucaugguggcccac

SEQ ID NO: 1126795 - RNA, 20 nt, Human
ccacugcacuacagccuggg

SEQ ID NO: 1126796 - RNA, 20 nt, Human
ccacugcacuacagccuggg

SEQ ID NO: 1126797 - RNA, 21 nt, Human
ccacugcacuacagccugggc

SEQ ID NO: 1126798 - RNA, 24 nt, Human
ccacugcacuacagccugggcaac

SEQ ID NO: 1126799 - RNA, 19 nt, Human
ccacugcacucuagccugg

SEQ ID NO: 1126800 - RNA, 20 nt, Human
ccacugcacucuagccuggc

SEQ ID NO: 1126801 - RNA, 24 nt, Human
ccacugcacucuagccuggccgac

SEQ ID NO: 1126802 - RNA, 24 nt, Human
ccagaacccagacagcagcccaug

SEQ ID NO: 1126803 - RNA, 20 nt, Human
ccagagagcagggcugcugg

SEQ ID NO: 1126804 - RNA, 21 nt, Human
ccagagccuucgcacucacca

SEQ ID NO: 1126805 - RNA, 23 nt, Human
ccagccgccuggacucugggucc

SEQ ID NO: 1126806 - RNA, 22 nt, Human
ccaggaggcagagguugcagug

SEQ ID NO: 1126807 - RNA, 22 nt, Human
ccaggcaaaagggaaagggaca

SEQ ID NO: 1126808 - RNA, 19 nt, Human
ccaggcccgcccugcacac

SEQ ID NO: 1126809 - RNA, 21 nt, Human
ccaggcgcugcucuucuugcu

SEQ ID NO: 1126810 - RNA, 22 nt, Human
ccagguuuuguuccacuuuuuc

SEQ ID NO: 1126811 - RNA, 22 nt, Human
cccaagaccucugaccccauga

SEQ ID NO: 1126812 - RNA, 22 nt, Human
cccacaguguccuggagcacau

SEQ ID NO: 1126813 - RNA, 22 nt, Human
cccacaguguccuggagcacau

SEQ ID NO: 1126814 - RNA, 18 nt, Human
cccacccacgcucucuca

SEQ ID NO: 1126815 - RNA, 20 nt, Human
cccaccccccauagaugggc

SEQ ID NO: 1126816 - RNA, 19 nt, Human
cccacccuccaccacccaa

SEQ ID NO: 1126817 - RNA, 21 nt, Human
cccacccuccaccacccaacc

SEQ ID NO: 1126818 - RNA, 22 nt, Human
cccacccuccaccacccaaccc

SEQ ID NO: 1126819 - RNA, 25 nt, Human
cccacccuccaccacccaaccccca

SEQ ID NO: 1126820 - RNA, 21 nt, Human
cccagacagcagcccauggga

SEQ ID NO: 1126821 - RNA, 22 nt, Human
cccagagaaacucagugucuca

SEQ ID NO: 1126822 - RNA, 26 nt, Human
ccccaaccgccccauugucccaggcc

SEQ ID NO: 1126823 - RNA, 22 nt, Human
ccccaaccgccccauugucccu

SEQ ID NO: 1126824 - RNA, 19 nt, Human
ccccacaccuggcccucuc

SEQ ID NO: 1126825 - RNA, 19 nt, Human
ccccacagaccagcccaga

SEQ ID NO: 1126826 - RNA, 19 nt, Human
ccccaccucuccagccgcc

SEQ ID NO: 1126827 - RNA, 21 nt, Human
ccccagccccacaccuggccc

SEQ ID NO: 1126828 - RNA, 22 nt, Human
ccccaggccacguccccucucc

SEQ ID NO: 1126829 - RNA, 18 nt, Human
ccccaucgccucccacac

SEQ ID NO: 1126830 - RNA, 20 nt, Human
ccccauugucccaggcccgg

SEQ ID NO: 1126831 - RNA, 23 nt, Human
ccccuacugcagcugggggauag

SEQ ID NO: 1126832 - RNA, 22 nt, Human
ccccuggcagggccugagguga

SEQ ID NO: 1126833 - RNA, 23 nt, Human
ccccugggcucagucuggcaggg

SEQ ID NO: 1126834 - RNA, 23 nt, Human
cccggugccaggcgcugcucuuc

SEQ ID NO: 1126835 - RNA, 20 nt, Human
cccucaacucccauccucaa

SEQ ID NO: 1126836 - RNA, 24 nt, Human
cccucgucucuacuaaaaauacaa

SEQ ID NO: 1126837 - RNA, 24 nt, Human
cccugggcucagucuggcaggcca

SEQ ID NO: 1126838 - RNA, 31 nt, Human
ccgacaggcccaaaacacaacugacaggccu

SEQ ID NO: 1126839 - RNA, 22 nt, Human
ccggccugcacaaaugaacccc

SEQ ID NO: 1126840 - RNA, 20 nt, Human
ccggcuguggcuccaggugc

SEQ ID NO: 1126841 - RNA, 21 nt, Human
ccucaaggcaggauaaugggc

SEQ ID NO: 1126842 - RNA, 26 nt, Human
ccuccaccacccaacccccaucgccu

SEQ ID NO: 1126843 - RNA, 21 nt, Human
ccucgccccaccccccauaga

SEQ ID NO: 1126844 - RNA, 21 nt, Human
ccucgcccucccaggccccuc

SEQ ID NO: 1126845 - RNA, 20 nt, Human
ccucggccugcccaguuugg

SEQ ID NO: 1126846 - RNA, 21 nt, Human
ccugcaaucccagcuacucgg

SEQ ID NO: 1126847 - RNA, 22 nt, Human
ccugcacaaaugaaccccaaga

SEQ ID NO: 1126848 - RNA, 20 nt, Human
ccugcugggccagcugggcc

SEQ ID NO: 1126849 - RNA, 22 nt, Human
ccuggagaagccaccccugggc

SEQ ID NO: 1126850 - RNA, 21 nt, Human
ccuggccaacguggugaaccc

SEQ ID NO: 1126851 - RNA, 22 nt, Human
ccuggccaacguggugaacccu

SEQ ID NO: 1126852 - RNA, 24 nt, Human
ccuggccaacguggugaacccucg

SEQ ID NO: 1126853 - RNA, 20 nt, Human
ccugggcaacagcgagacuc

SEQ ID NO: 1126854 - RNA, 22 nt, Human
ccugguuugcagggcggcgggc

SEQ ID NO: 1126855 - RNA, 21 nt, Human
ccuguaaucccagcuacucag

SEQ ID NO: 1126856 - RNA, 22 nt, Human
ccuguaaucccagcuacucagg

SEQ ID NO: 1126857 - RNA, 21 nt, Human
ccuugugguaauagccccucg

SEQ ID NO: 1126858 - RNA, 24 nt, Human
ccuuuccuuggcaacugggccaag

SEQ ID NO: 1126859 - RNA, 21 nt, Human
cgacaagagcaaaacuccauc

SEQ ID NO: 1126860 - RNA, 23 nt, Human
cgacaggcccaaaacacaacuga

SEQ ID NO: 1126861 - RNA, 22 nt, Human
cgagacagcgccacugcacucu

SEQ ID NO: 1126862 - RNA, 24 nt, Human
cgagacagcgccacugcacucuag

SEQ ID NO: 1126863 - RNA, 24 nt, Human
cgagaccagccuggccaacguggu

SEQ ID NO: 1126864 - RNA, 19 nt, Human
cgaggcaaggcugggcugg

SEQ ID NO: 1126865 - RNA, 24 nt, Human
cgccuguaaucccagcuacucagg

SEQ ID NO: 1126866 - RNA, 24 nt, Human
cgggaggcugaggcacaagaguca

SEQ ID NO: 1126867 - RNA, 24 nt, Human
cgggagguggaaguugcagugagc

SEQ ID NO: 1126868 - RNA, 21 nt, Human
cuaaagcaagggugaccaucc

SEQ ID NO: 1126869 - RNA, 19 nt, Human
cuacugggacauuguugug

SEQ ID NO: 1126870 - RNA, 20 nt, Human
cuagcccucgccccaccccc

SEQ ID NO: 1126871 - RNA, 22 nt, Human
cuagucuggggaagggacuccu

SEQ ID NO: 1126872 - RNA, 19 nt, Human
cucacagagagcaccucac

SEQ ID NO: 1126873 - RNA, 23 nt, Human
cucagccucagagccaagauggg

SEQ ID NO: 1126874 - RNA, 24 nt, Human
cucaugccuguuaucccaacacuu

SEQ ID NO: 1126875 - RNA, 22 nt, Human
cucaugguggcccacacucagc

SEQ ID NO: 1126876 - RNA, 23 nt, Human
cuccagaggucagaggagcagcu

SEQ ID NO: 1126877 - RNA, 20 nt, Human
cuccaggugcugaaggaccc

SEQ ID NO: 1126878 - RNA, 19 nt, Human
cuccaucucaaaaaaaaaa

SEQ ID NO: 1126879 - RNA, 23 nt, Human
cuccccacagugcagccuccuca

SEQ ID NO: 1126880 - RNA, 22 nt, Human
cugaggcaggaucgcuugaacc

SEQ ID NO: 1126881 - RNA, 20 nt, Human
cugagggcucuccugccaag

SEQ ID NO: 1126882 - RNA, 21 nt, Human
cugcaaucccagcuacucggg

SEQ ID NO: 1126883 - RNA, 24 nt, Human
cugcagugugcucuuccccaggcc

SEQ ID NO: 1126884 - RNA, 21 nt, Human
cugcugccugcuacagcauua

SEQ ID NO: 1126885 - RNA, 23 nt, Human
cugcuggagacaagagaggggcc

SEQ ID NO: 1126886 - RNA, 20 nt, Human
cuggagcacauuccuugcuc

SEQ ID NO: 1126887 - RNA, 22 nt, Human
cuggagcacauuccuugcucua

SEQ ID NO: 1126888 - RNA, 20 nt, Human
cuggcccucucaggcagccc

SEQ ID NO: 1126889 - RNA, 24 nt, Human
cuggccgacaagagcaaaacucca

SEQ ID NO: 1126890 - RNA, 23 nt, Human
cuggggccugccuaaagcaaggg

SEQ ID NO: 1126891 - RNA, 18 nt, Human
cuugcuggggcacuggcc

SEQ ID NO: 1126892 - RNA, 20 nt, Human
cuuuaaagauccuccucacc

SEQ ID NO: 1126893 - RNA, 21 nt, Human
cuuugucuccacccacccucc

SEQ ID NO: 1126894 - RNA, 22 nt, Human
gaaccccaagaccucugacccc

SEQ ID NO: 1126895 - RNA, 19 nt, Human
gaagcaccugcccgugagg

SEQ ID NO: 1126896 - RNA, 19 nt, Human
gaagcagguguguggggga

SEQ ID NO: 1126897 - RNA, 25 nt, Human
gaaggggauugggaacaagcccccu

SEQ ID NO: 1126898 - RNA, 20 nt, Human
gacagugauggccacucccc

SEQ ID NO: 1126899 - RNA, 18 nt, Human
gaccaucugcuaaugccu

SEQ ID NO: 1126900 - RNA, 22 nt, Human
gacccgacaggcccaaaacaca

SEQ ID NO: 1126901 - RNA, 23 nt, Human
gacccgacaggcccaaaacacaa

SEQ ID NO: 1126902 - RNA, 21 nt, Human
gagaagcccaagcccccagcu

SEQ ID NO: 1126903 - RNA, 19 nt, Human
gagagggaggcuggggugg

SEQ ID NO: 1126904 - RNA, 31 nt, Human
gagccagaacccagacagcagcccaugggaa

SEQ ID NO: 1126905 - RNA, 21 nt, Human
gagcugggaaggaggggacgc

SEQ ID NO: 1126906 - RNA, 21 nt, Human
gagcugucgggggaauuaaau

SEQ ID NO: 1126907 - RNA, 21 nt, Human
gaggcagagguugcagugagc

SEQ ID NO: 1126908 - RNA, 20 nt, Human
gaggcuggggugguuuccug

SEQ ID NO: 1126909 - RNA, 19 nt, Human
gaggcugugcagccccagg

SEQ ID NO: 1126910 - RNA, 22 nt, Human
gauccagcucuaaucuaauuug

SEQ ID NO: 1126911 - RNA, 24 nt, Human
gaucgcuugaacccgggaggugga

SEQ ID NO: 1126912 - RNA, 23 nt, Human
gcacaacaaagcccacuuccucu

SEQ ID NO: 1126913 - RNA, 25 nt, Human
gcagccccaggucagaaugcugugc

SEQ ID NO: 1126914 - RNA, 20 nt, Human
gcagccgcugugggcagugc

SEQ ID NO: 1126915 - RNA, 20 nt, Human
gcagcggcuguggauggggc

SEQ ID NO: 1126916 - RNA, 18 nt, Human
gccacuccccuacugcag

SEQ ID NO: 1126917 - RNA, 20 nt, Human
gccacugcacucuagccugg

SEQ ID NO: 1126918 - RNA, 19 nt, Human
gccagaacccagacagcag

SEQ ID NO: 1126919 - RNA, 23 nt, Human
gccagagcauaagagaaccucug

SEQ ID NO: 1126920 - RNA, 22 nt, Human
gcccaaaacacaacugacaggc

SEQ ID NO: 1126921 - RNA, 18 nt, Human
gccccaggucagaaugcu

SEQ ID NO: 1126922 - RNA, 20 nt, Human
gcccucgccccaccccccau

SEQ ID NO: 1126923 - RNA, 19 nt, Human
gccuaaagcaagggugacc

SEQ ID NO: 1126924 - RNA, 21 nt, Human
gccuagcccucgccccacccc

SEQ ID NO: 1126925 - RNA, 21 nt, Human
gccuccugcugggccagcugg

SEQ ID NO: 1126926 - RNA, 24 nt, Human
gccuggggccccacagaccagccc

SEQ ID NO: 1126927 - RNA, 21 nt, Human
gcgggcaaagggggacucagg

SEQ ID NO: 1126928 - RNA, 20 nt, Human
gcgggugaggggauggaugg

SEQ ID NO: 1126929 - RNA, 20 nt, Human
gcugagaucgcaccacugca

SEQ ID NO: 1126930 - RNA, 24 nt, Human
ggaaggggacccacccuccaccac

SEQ ID NO: 1126931 - RNA, 18 nt, Human
ggaaguugcagugagccg

SEQ ID NO: 1126932 - RNA, 22 nt, Human
ggaaguugcagugagccgagac

SEQ ID NO: 1126933 - RNA, 27 nt, Human
ggacaggaagggcgggugaggggaugg

SEQ ID NO: 1126934 - RNA, 20 nt, Human
ggaccccagccccacaccug

SEQ ID NO: 1126935 - RNA, 18 nt, Human
ggagaagccaccccuggg

SEQ ID NO: 1126936 - RNA, 19 nt, Human
ggagagggguggggaugcu

SEQ ID NO: 1126937 - RNA, 24 nt, Human
ggagauggagggcaauggaaggga

SEQ ID NO: 1126938 - RNA, 20 nt, Human
ggagcacauuccuugcucua

SEQ ID NO: 1126939 - RNA, 21 nt, Human
ggaggcgcagaaucagcccuc

SEQ ID NO: 1126940 - RNA, 21 nt, Human
ggcacaguggcucaugccugu

SEQ ID NO: 1126941 - RNA, 21 nt, Human
ggccuacuuggugccugccug

SEQ ID NO: 1126942 - RNA, 23 nt, Human
ggcgggcaaagggggacucagga

SEQ ID NO: 1126943 - RNA, 19 nt, Human
ggcuggaggccugaauggc

SEQ ID NO: 1126944 - RNA, 21 nt, Human
ggcugggcacaguggcucaug

SEQ ID NO: 1126945 - RNA, 18 nt, Human
gggaaggaggggacgcug

SEQ ID NO: 1126946 - RNA, 20 nt, Human
gggacagccuguacaaaagc

SEQ ID NO: 1126947 - RNA, 21 nt, Human
gggaggggcccugcaaaaugu

SEQ ID NO: 1126948 - RNA, 20 nt, Human
gggagguuuggcccccuuua

SEQ ID NO: 1126949 - RNA, 20 nt, Human
gggauuaaaagccuuccaac

SEQ ID NO: 1126950 - RNA, 18 nt, Human
gggcacaguggcucaugc

SEQ ID NO: 1126951 - RNA, 19 nt, Human
gggcacuccuggcccuucc

SEQ ID NO: 1126952 - RNA, 18 nt, Human
ggggaucucgcugcccug

SEQ ID NO: 1126953 - RNA, 18 nt, Human
ggggcaguucccaggagg

SEQ ID NO: 1126954 - RNA, 20 nt, Human
ggggcuggaaagauggggaa

SEQ ID NO: 1126955 - RNA, 22 nt, Human
gggggcucccuggagugcaggu

SEQ ID NO: 1126956 - RNA, 19 nt, Human
ggggggaagcaggugugug

SEQ ID NO: 1126957 - RNA, 18 nt, Human
ggggguugagagggaggc

SEQ ID NO: 1126958 - RNA, 19 nt, Human
ggugaccaucugcuaaugc

SEQ ID NO: 1126959 - RNA, 24 nt, Human
gguggcaggcgccuguaaucccag

SEQ ID NO: 1126960 - RNA, 24 nt, Human
gguucggagugccggguccuccag

SEQ ID NO: 1126961 - RNA, 23 nt, Human
gguugagagggaggcuggggugg

SEQ ID NO: 1126962 - RNA, 26 nt, Human
gguugagagggaggcuggggugguuu

SEQ ID NO: 1126963 - RNA, 23 nt, Human
gucccuccuuuucucugcaaggc

SEQ ID NO: 1126964 - RNA, 25 nt, Human
gugaggaauugcagggaggaggggg

SEQ ID NO: 1126965 - RNA, 20 nt, Human
gugaucuggagaaaaacaag

SEQ ID NO: 1126966 - RNA, 24 nt, Human
gugccaggcgcugcucuucuugcu

SEQ ID NO: 1126967 - RNA, 20 nt, Human
gugccggguccuccagaggu

SEQ ID NO: 1126968 - RNA, 18 nt, Human
gugccuuugucuccaccc

SEQ ID NO: 1126969 - RNA, 18 nt, Human
guggauggcagaaggggg

SEQ ID NO: 1126970 - RNA, 23 nt, Human
guggcaggcgccuguaaucccag

SEQ ID NO: 1126971 - RNA, 24 nt, Human
guggcauuucagucccuucucuuu

SEQ ID NO: 1126972 - RNA, 19 nt, Human
gugggcagaggagaggggu

SEQ ID NO: 1126973 - RNA, 23 nt, Human
gugguaauagccccucgcccucc

SEQ ID NO: 1126974 - RNA, 24 nt, Human
guugcagugagccgagacagcgcc

SEQ ID NO: 1126975 - RNA, 19 nt, Human
guugcagugagcugagauc

SEQ ID NO: 1126976 - RNA, 21 nt, Human
uaaaaauacaaaaauuagcca

SEQ ID NO: 1126977 - RNA, 23 nt, Human
uaaagcaagggugaccaucugcu

SEQ ID NO: 1126978 - RNA, 19 nt, Human
uaaccacugugaaaccccc

SEQ ID NO: 1126979 - RNA, 20 nt, Human
uaaguucaggaguucgagac

SEQ ID NO: 1126980 - RNA, 23 nt, Human
uaaucugcagugugcucuucccc

SEQ ID NO: 1126981 - RNA, 25 nt, Human
uacaguaucagggcuuucaaaaaac

SEQ ID NO: 1126982 - RNA, 28 nt, Human
uaccccugccuccugcugggccagcugg

SEQ ID NO: 1126983 - RNA, 20 nt, Human
uagcccucgccccacccccc

SEQ ID NO: 1126984 - RNA, 24 nt, Human
uaucagggcuuucaaaaaacaaac

SEQ ID NO: 1126985 - RNA, 21 nt, Human
ucaaaaaacaaacaaacaaac

SEQ ID NO: 1126986 - RNA, 23 nt, Human
ucaaaagcuguaggaaaaaguca

SEQ ID NO: 1126987 - RNA, 18 nt, Human
ucaacaucugccaaucuu

SEQ ID NO: 1126988 - RNA, 24 nt, Human
ucaccaccuccaccgcccucucag

SEQ ID NO: 1126989 - RNA, 23 nt, Human
ucaccuaaguucaggaguucgag

SEQ ID NO: 1126990 - RNA, 21 nt, Human
ucagcugccguggaucacuuc

SEQ ID NO: 1126991 - RNA, 20 nt, Human
ucagucccuucucuuugccu

SEQ ID NO: 1126992 - RNA, 23 nt, Human
ucauaggccucuuacaggcacac

SEQ ID NO: 1126993 - RNA, 19 nt, Human
uccaaccaaucucuccuac

SEQ ID NO: 1126994 - RNA, 22 nt, Human
uccacagccugguuugcagggc

SEQ ID NO: 1126995 - RNA, 23 nt, Human
uccaucucaaaaaaaaaaaaaaa

SEQ ID NO: 1126996 - RNA, 25 nt, Human
uccaucucaaaaaaaaaaaaaaaaa

SEQ ID NO: 1126997 - RNA, 19 nt, Human
ucccacaccagggugccuu

SEQ ID NO: 1126998 - RNA, 24 nt, Human
ucccaccuccuuuucccccacuuc

SEQ ID NO: 1126999 - RNA, 20 nt, Human
ucccaggaggagacugccuu

SEQ ID NO: 1127000 - RNA, 25 nt, Human
ucccaggaggagacugccuuuuguu

SEQ ID NO: 1127001 - RNA, 18 nt, Human
ucccaggcagaucuggcc

SEQ ID NO: 1127002 - RNA, 21 nt, Human
ucccccaccucuccagccgcc

SEQ ID NO: 1127003 - RNA, 20 nt, Human
ucccccacuucccguguuau

SEQ ID NO: 1127004 - RNA, 19 nt, Human
uccccuggcagggccugag

SEQ ID NO: 1127005 - RNA, 19 nt, Human
ucccucgucuagcuucaac

SEQ ID NO: 1127006 - RNA, 19 nt, Human
ucccuggagugcagguugu

SEQ ID NO: 1127007 - RNA, 25 nt, Human
uccucaccaccuccaccgcccucuc

SEQ ID NO: 1127008 - RNA, 22 nt, Human
uccuccucaccaccuccaccgc

SEQ ID NO: 1127009 - RNA, 24 nt, Human
uccuccucaccaccuccaccgccc

SEQ ID NO: 1127010 - RNA, 24 nt, Human
uccuugcucuagggagacggagau

SEQ ID NO: 1127011 - RNA, 18 nt, Human
ucgcuugaacccgggagg

SEQ ID NO: 1127012 - RNA, 25 nt, Human
ucgggaggcugaggcacaagaguca

SEQ ID NO: 1127013 - RNA, 22 nt, Human
ucuaaucuaauuugccccuaac

SEQ ID NO: 1127014 - RNA, 21 nt, Human
ucucuacuaaaaauacaaaaa

SEQ ID NO: 1127015 - RNA, 26 nt, Human
ucucugcaaggcucagugaacccccc

SEQ ID NO: 1127016 - RNA, 23 nt, Human
ucucuucuuauucccuggguugg

SEQ ID NO: 1127017 - RNA, 19 nt, Human
ucugcaaggcucagugaac

SEQ ID NO: 1127018 - RNA, 26 nt, Human
ugaaacccccgcaggaggggccacac

SEQ ID NO: 1127019 - RNA, 21 nt, Human
ugaaauggggcuaaugcccuc

SEQ ID NO: 1127020 - RNA, 18 nt, Human
ugaaccccccguggugcc

SEQ ID NO: 1127021 - RNA, 22 nt, Human
ugacaguacccucuggccugac

SEQ ID NO: 1127022 - RNA, 21 nt, Human
ugagacaaagccccagggcac

SEQ ID NO: 1127023 - RNA, 19 nt, Human
ugagacgucaccuggagaa

SEQ ID NO: 1127024 - RNA, 24 nt, Human
ugagaggcugaggcaggagaauca

SEQ ID NO: 1127025 - RNA, 22 nt, Human
ugagcugagaucgcaccacugc

SEQ ID NO: 1127026 - RNA, 19 nt, Human
ugagcuggccggggaaagg

SEQ ID NO: 1127027 - RNA, 19 nt, Human
ugagcugugggcugccaga

SEQ ID NO: 1127028 - RNA, 24 nt, Human
ugaggcacaagagucacuugaacc

SEQ ID NO: 1127029 - RNA, 19 nt, Human
ugaggcaggagaaucaccu

SEQ ID NO: 1127030 - RNA, 25 nt, Human
ugaggcaggagaaucaccuaaguuc

SEQ ID NO: 1127031 - RNA, 22 nt, Human
ugaggcaggaucgcuugaaccc

SEQ ID NO: 1127032 - RNA, 22 nt, Human
ugaggcagggagcucuggggcc

SEQ ID NO: 1127033 - RNA, 23 nt, Human
ugaggcagggagcucuggggccu

SEQ ID NO: 1127034 - RNA, 22 nt, Human
ugagggaaacauucuggucaga

SEQ ID NO: 1127035 - RNA, 22 nt, Human
ugaguaagucacugaagcaccu

SEQ ID NO: 1127036 - RNA, 24 nt, Human
ugaguaagucacugaagcaccugc

SEQ ID NO: 1127037 - RNA, 22 nt, Human
ugauggggcaguucccaggagg

SEQ ID NO: 1127038 - RNA, 18 nt, Human
ugauucaagcaaagacca

SEQ ID NO: 1127039 - RNA, 23 nt, Human
ugcagccgcugugggcagugcca

SEQ ID NO: 1127040 - RNA, 22 nt, Human
ugcaggcgcccacccacgcucu

SEQ ID NO: 1127041 - RNA, 19 nt, Human
ugcagggauuccagguugg

SEQ ID NO: 1127042 - RNA, 20 nt, Human
ugccaagaagagcagggugg

SEQ ID NO: 1127043 - RNA, 24 nt, Human
ugccagagcugaggccagcagggc

SEQ ID NO: 1127044 - RNA, 22 nt, Human
ugccggguccuccagaggucag

SEQ ID NO: 1127045 - RNA, 21 nt, Human
ugccugccuggggccccacag

SEQ ID NO: 1127046 - RNA, 23 nt, Human
ugccuguuaucccaacacuuuga

SEQ ID NO: 1127047 - RNA, 22 nt, Human
ugccuugacuccccacagugca

SEQ ID NO: 1127048 - RNA, 19 nt, Human
uggacaccgcgucacccag

SEQ ID NO: 1127049 - RNA, 19 nt, Human
uggagaaaaacaaggaaag

SEQ ID NO: 1127050 - RNA, 22 nt, Human
uggagacaagagaggggcugga

SEQ ID NO: 1127051 - RNA, 25 nt, Human
uggagauggagggcaauggaaggga

SEQ ID NO: 1127052 - RNA, 20 nt, Human
uggauggugcugagcuggga

SEQ ID NO: 1127053 - RNA, 19 nt, Human
uggcagaagggggugcaga

SEQ ID NO: 1127054 - RNA, 24 nt, Human
uggcagaagggggugcagaggcca

SEQ ID NO: 1127055 - RNA, 22 nt, Human
uggcaggccacacugaugggga

SEQ ID NO: 1127056 - RNA, 23 nt, Human
uggcagggccugaggugagcugg

SEQ ID NO: 1127057 - RNA, 18 nt, Human
uggcagggucaaagguca

SEQ ID NO: 1127058 - RNA, 21 nt, Human
uggccaacguggugaacccuc

SEQ ID NO: 1127059 - RNA, 22 nt, Human
uggccacuccccuacugcagcu

SEQ ID NO: 1127060 - RNA, 21 nt, Human
uggcccuucccccaccucucc

SEQ ID NO: 1127061 - RNA, 21 nt, Human
uggccucggccugcccaguuu

SEQ ID NO: 1127062 - RNA, 21 nt, Human
uggcucaugccuguuauccca

SEQ ID NO: 1127063 - RNA, 24 nt, Human
uggcugggcacaguggcucaugcc

SEQ ID NO: 1127064 - RNA, 19 nt, Human
ugggaaaauccagacgaug

SEQ ID NO: 1127065 - RNA, 20 nt, Human
ugggaacaagccccacagug

SEQ ID NO: 1127066 - RNA, 24 nt, Human
ugggaaggaacccuccggcugugg

SEQ ID NO: 1127067 - RNA, 21 nt, Human
ugggcacccaguaacugaggg

SEQ ID NO: 1127068 - RNA, 27 nt, Human
ugggcagaggagaggggucgaacguuu

SEQ ID NO: 1127069 - RNA, 20 nt, Human
uggggagggggccuaagccc

SEQ ID NO: 1127070 - RNA, 18 nt, Human
uggggaugcuggaucacc

SEQ ID NO: 1127071 - RNA, 23 nt, Human
uggggaugcuggaucaccuucuu

SEQ ID NO: 1127072 - RNA, 21 nt, Human
uggggggaagcaggugugugg

SEQ ID NO: 1127073 - RNA, 23 nt, Human
uggggguugagagggaggcuggg

SEQ ID NO: 1127074 - RNA, 23 nt, Human
uggguugggagagacuaaagucu

SEQ ID NO: 1127075 - RNA, 24 nt, Human
ugguggcaggcgccuguaauccca

SEQ ID NO: 1127076 - RNA, 18 nt, Human
ugguguggggcggaggca

SEQ ID NO: 1127077 - RNA, 22 nt, Human
uguaggaaaaagucaagacauu

SEQ ID NO: 1127078 - RNA, 22 nt, Human
ugucccugcccuacccuugccu

SEQ ID NO: 1127079 - RNA, 25 nt, Human
ugucuccacccacccuccccuggca

SEQ ID NO: 1127080 - RNA, 21 nt, Human
ugugaaacccccgcaggaggg

SEQ ID NO: 1127081 - RNA, 27 nt, Human
ugugaaauggggcuaaugcccucaucc

SEQ ID NO: 1127082 - RNA, 19 nt, Human
ugugggcagugccagagcu

SEQ ID NO: 1127083 - RNA, 21 nt, Human
uguggggcguggacaggaagg

SEQ ID NO: 1127084 - RNA, 24 nt, Human
uguggugauuagaugccugggcug

SEQ ID NO: 1127085 - RNA, 23 nt, Human
uguuucaucugcacucccaccuc

SEQ ID NO: 1127086 - RNA, 22 nt, Human
uuaaaauaaggugccuccagcc

SEQ ID NO: 1127087 - RNA, 18 nt, Human
uuagcugggcgugguggu

SEQ ID NO: 1127088 - RNA, 24 nt, Human
uuagcugggcgugguggugggcac

SEQ ID NO: 1127089 - RNA, 18 nt, Human
uucaagcaaagaccaagg

SEQ ID NO: 1127090 - RNA, 25 nt, Human
uucccaggaggagacugccuuuugu

SEQ ID NO: 1127091 - RNA, 18 nt, Human
uucccaggcugcgcgggg

SEQ ID NO: 1127092 - RNA, 22 nt, Human
uugaccccaaaggccagagcau

SEQ ID NO: 1127093 - RNA, 23 nt, Human
uugaccccaaaggccagagcaua

SEQ ID NO: 1127094 - RNA, 25 nt, Human
uugagaggcugaggcaggagaauca

SEQ ID NO: 1127095 - RNA, 19 nt, Human
uugcagugagccgagacag

SEQ ID NO: 1127096 - RNA, 22 nt, Human
uugcagugagccgagacagcgc

SEQ ID NO: 1127097 - RNA, 18 nt, Human
uugcagugagcugagauc

SEQ ID NO: 1127098 - RNA, 19 nt, Human
uugcagugagcugagaucg

SEQ ID NO: 1127099 - RNA, 20 nt, Human
uugcagugagcugagaucgc

SEQ ID NO: 1127100 - RNA, 22 nt, Human
uugcagugagcugagaucgcac

SEQ ID NO: 1127101 - RNA, 23 nt, Human
uuguaggaguggaaugagaaucc

SEQ ID NO: 1127102 - RNA, 19 nt, Human
uuucucacagagagcaccu

SEQ ID NO: 1127103 - RNA, 19 nt, Human
uuucucaucugaaaaaugg

SEQ ID NO: 1127104 - RNA, 27 nt, Human
uuuuucucuucuuauucccuggguugg

SEQ ID NO: 1127105 - RNA, 22 nt, Human
aaccagcccacccagaaccagc

SEQ ID NO: 1127106 - RNA, 19 nt, Human
cagaaccagcccacagcac

SEQ ID NO: 1127107 - RNA, 22 nt, Human
cagcccacccagaaccagccca

SEQ ID NO: 1127108 - RNA, 21 nt, Human
cagguugguguugaccaggcu

SEQ ID NO: 1127109 - RNA, 22 nt, Human
ccacacuucucgugacuccaau

SEQ ID NO: 1127110 - RNA, 22 nt, Human
ccacagcacuuuccuccacucu

SEQ ID NO: 1127111 - RNA, 24 nt, Human
ccacagcacuuuccuccacucuga

SEQ ID NO: 1127112 - RNA, 22 nt, Human
ccacccagaaccagcccacagc

SEQ ID NO: 1127113 - RNA, 21 nt, Human
ccacccagaaccagcccaccc

SEQ ID NO: 1127114 - RNA, 21 nt, Human
cccacacuucucgugacucca

SEQ ID NO: 1127115 - RNA, 22 nt, Human
cccacagcacuuuccuccacuc

SEQ ID NO: 1127116 - RNA, 21 nt, Human
cccacaguugcuguccacacc

SEQ ID NO: 1127117 - RNA, 20 nt, Human
cccagaaccagcccacagca

SEQ ID NO: 1127118 - RNA, 20 nt, Human
cccagaaccagcccacccag

SEQ ID NO: 1127119 - RNA, 21 nt, Human
ccccugcugcggcccccacag

SEQ ID NO: 1127120 - RNA, 23 nt, Human
ccugccagcuccccacccagaac

SEQ ID NO: 1127121 - RNA, 23 nt, Human
cuccccacccagaaccagcccac

SEQ ID NO: 1127122 - RNA, 18 nt, Human
cuccccugcugcggcccc

SEQ ID NO: 1127123 - RNA, 21 nt, Human
cuccucugcccugccagcucc

SEQ ID NO: 1127124 - RNA, 22 nt, Human
cuccucugcccugccagcuccc

SEQ ID NO: 1127125 - RNA, 28 nt, Human
cucucccaccuacagguguguucaggau

SEQ ID NO: 1127126 - RNA, 20 nt, Human
cucuccucucccaccuacag

SEQ ID NO: 1127127 - RNA, 19 nt, Human
gaaccagcccacccagaac

SEQ ID NO: 1127128 - RNA, 21 nt, Human
gccagcuccccacccagaacc

SEQ ID NO: 1127129 - RNA, 25 nt, Human
gugcugcaaacuuuugccuuuuggg

SEQ ID NO: 1127130 - RNA, 21 nt, Human
ugaccaggcucagcuuguauc

SEQ ID NO: 1127131 - RNA, 20 nt, Human
ugcugcaaacuuuugccuuu

SEQ ID NO: 1127132 - RNA, 22 nt, Human
ugcuguccacaccucucccaca

SEQ ID NO: 1127133 - RNA, 23 nt, Human
ugcuguccacaccucucccacac

SEQ ID NO: 1127134 - RNA, 18 nt, Human
aacacacagacccacaca

SEQ ID NO: 1127135 - RNA, 24 nt, Human
aacacaggggcauucagagaaaga

SEQ ID NO: 1127136 - RNA, 23 nt, Human
aagaagauacagguucagaugga

SEQ ID NO: 1127137 - RNA, 23 nt, Human
aagcagucggcaagagaugcagc

SEQ ID NO: 1127138 - RNA, 19 nt, Human
acaguggggcugugcgugg

SEQ ID NO: 1127139 - RNA, 25 nt, Human
accuucugccugucagucguagucg

SEQ ID NO: 1127140 - RNA, 22 nt, Human
agacccacacagagacucagga

SEQ ID NO: 1127141 - RNA, 21 nt, Human
agaggaguggggaggccuagg

SEQ ID NO: 1127142 - RNA, 22 nt, Human
agagggcugggccagcauguuu

SEQ ID NO: 1127143 - RNA, 24 nt, Human
agccccaaggaugcuggccaggaa

SEQ ID NO: 1127144 - RNA, 22 nt, Human
agcuggggcuggggcuggggcu

SEQ ID NO: 1127145 - RNA, 22 nt, Human
aggaagggccugaagagcugug

SEQ ID NO: 1127146 - RNA, 21 nt, Human
aggacgaggaagagcuggaga

SEQ ID NO: 1127147 - RNA, 19 nt, Human
aggagacuggaagacagca

SEQ ID NO: 1127148 - RNA, 24 nt, Human
agggagaggagcacaggcugaagg

SEQ ID NO: 1127149 - RNA, 18 nt, Human
auggagcagcuggagcug

SEQ ID NO: 1127150 - RNA, 25 nt, Human
caauagucugguggcagagacacac

SEQ ID NO: 1127151 - RNA, 18 nt, Human
cacacaaugucacuguga

SEQ ID NO: 1127152 - RNA, 24 nt, Human
cacacaaugucacugugauguauu

SEQ ID NO: 1127153 - RNA, 22 nt, Human
cacagacccacacagagacuca

SEQ ID NO: 1127154 - RNA, 20 nt, Human
cacagugucagaagugggac

SEQ ID NO: 1127155 - RNA, 18 nt, Human
cagcucagcaaggggcag

SEQ ID NO: 1127156 - RNA, 23 nt, Human
caggaagggccugaagagcugug

SEQ ID NO: 1127157 - RNA, 18 nt, Human
caggggcauucagagaaa

SEQ ID NO: 1127158 - RNA, 19 nt, Human
cauggaggucagaagccca

SEQ ID NO: 1127159 - RNA, 21 nt, Human
cauuacuagaggaguggggag

SEQ ID NO: 1127160 - RNA, 22 nt, Human
ccagagcaucaaggagcaauag

SEQ ID NO: 1127161 - RNA, 18 nt, Human
ccagcauccauggccagc

SEQ ID NO: 1127162 - RNA, 22 nt, Human
ccagcauccauggccagccggg

SEQ ID NO: 1127163 - RNA, 22 nt, Human
cccacacagagacucaggagag

SEQ ID NO: 1127164 - RNA, 25 nt, Human
ccccuacagcuguaccgagaggcuc

SEQ ID NO: 1127165 - RNA, 22 nt, Human
cccuuuccccucaacuucuucc

SEQ ID NO: 1127166 - RNA, 22 nt, Human
ccuagccugcaucugagcuccg

SEQ ID NO: 1127167 - RNA, 21 nt, Human
ccucucagggcugugcacucc

SEQ ID NO: 1127168 - RNA, 20 nt, Human
ccuggugacaguggggcugu

SEQ ID NO: 1127169 - RNA, 22 nt, Human
ccuucugccugucagucaggga

SEQ ID NO: 1127170 - RNA, 21 nt, Human
cgcaugcagcggcaguacaug

SEQ ID NO: 1127171 - RNA, 20 nt, Human
cugagacagauacuggcccu

SEQ ID NO: 1127172 - RNA, 23 nt, Human
cuggggcuggggcuggcucaggc

SEQ ID NO: 1127173 - RNA, 20 nt, Human
gaaggagacuggaagacagc

SEQ ID NO: 1127174 - RNA, 23 nt, Human
gaagggccugaagagcugugggg

SEQ ID NO: 1127175 - RNA, 18 nt, Human
gacaccaagaacuacgua

SEQ ID NO: 1127176 - RNA, 23 nt, Human
gaccugccuguuucuuccugccc

SEQ ID NO: 1127177 - RNA, 23 nt, Human
gacgaggaagagcuggagaagga

SEQ ID NO: 1127178 - RNA, 25 nt, Human
gagaaggagguagcucugagaccgg

SEQ ID NO: 1127179 - RNA, 19 nt, Human
gagacagauacuggcccug

SEQ ID NO: 1127180 - RNA, 18 nt, Human
gagcacaggcugaaggag

SEQ ID NO: 1127181 - RNA, 21 nt, Human
gagggcagccaggcacaggaa

SEQ ID NO: 1127182 - RNA, 21 nt, Human
gauagugggacuggagagaga

SEQ ID NO: 1127183 - RNA, 19 nt, Human
gcacuguucccgcagcugc

SEQ ID NO: 1127184 - RNA, 21 nt, Human
gcaggcugagaccugggggua

SEQ ID NO: 1127185 - RNA, 22 nt, Human
gcccuggugacaguggggcugu

SEQ ID NO: 1127186 - RNA, 19 nt, Human
gcgauggaaugaagugaaa

SEQ ID NO: 1127187 - RNA, 23 nt, Human
gcucagaccugccuguuucuucc

SEQ ID NO: 1127188 - RNA, 20 nt, Human
gcugggccagcauguuuucc

SEQ ID NO: 1127189 - RNA, 22 nt, Human
ggaacagggacuggagccuggg

SEQ ID NO: 1127190 - RNA, 21 nt, Human
ggaagaagauacagguucaga

SEQ ID NO: 1127191 - RNA, 21 nt, Human
ggacuggagccugggaaggua

SEQ ID NO: 1127192 - RNA, 21 nt, Human
ggcacugagggaacaagcugg

SEQ ID NO: 1127193 - RNA, 24 nt, Human
ggcgauggaaugaagugaaagaaa

SEQ ID NO: 1127194 - RNA, 19 nt, Human
ggcucuggauaggaggucc

SEQ ID NO: 1127195 - RNA, 23 nt, Human
ggcuggggcuggggcuggcucag

SEQ ID NO: 1127196 - RNA, 24 nt, Human
gggaacacagugucagaaguggga

SEQ ID NO: 1127197 - RNA, 21 nt, Human
gggagcacaggccugaggacg

SEQ ID NO: 1127198 - RNA, 21 nt, Human
gggcagacacccuggccuuca

SEQ ID NO: 1127199 - RNA, 20 nt, Human
gggcagccaggcacaggaag

SEQ ID NO: 1127200 - RNA, 19 nt, Human
gggcuggggcuggcucagg

SEQ ID NO: 1127201 - RNA, 20 nt, Human
ggggaugcugaggaacaggg

SEQ ID NO: 1127202 - RNA, 22 nt, Human
gguaauggguggcuuggaagaa

SEQ ID NO: 1127203 - RNA, 18 nt, Human
ggugggagggcagccagg

SEQ ID NO: 1127204 - RNA, 24 nt, Human
gguucagauggagcagcuggagcu

SEQ ID NO: 1127205 - RNA, 24 nt, Human
guaauggguggcuuggaagaagau

SEQ ID NO: 1127206 - RNA, 20 nt, Human
guagcucugagaccgggggc

SEQ ID NO: 1127207 - RNA, 20 nt, Human
guagggcaggcugagaccug

SEQ ID NO: 1127208 - RNA, 24 nt, Human
guagggcaggcugagaccuggggg

SEQ ID NO: 1127209 - RNA, 20 nt, Human
gucagggagggagaggagca

SEQ ID NO: 1127210 - RNA, 25 nt, Human
guggcagagacacacacaaugucac

SEQ ID NO: 1127211 - RNA, 22 nt, Human
uaaaagccuaaguuccuggccg

SEQ ID NO: 1127212 - RNA, 25 nt, Human
uaaccucucagggcugugcacuccc

SEQ ID NO: 1127213 - RNA, 22 nt, Human
uagaagugacccggaaguggua

SEQ ID NO: 1127214 - RNA, 18 nt, Human
uagaugcaggugacccag

SEQ ID NO: 1127215 - RNA, 20 nt, Human
uaggaggucccugagacaga

SEQ ID NO: 1127216 - RNA, 20 nt, Human
uagggugggagggcagccag

SEQ ID NO: 1127217 - RNA, 22 nt, Human
uagggugggagggcagccaggc

SEQ ID NO: 1127218 - RNA, 20 nt, Human
ucagagguacaaaaggguag

SEQ ID NO: 1127219 - RNA, 21 nt, Human
ucaggagagcauggaggucag

SEQ ID NO: 1127220 - RNA, 23 nt, Human
ucaggcucuggauaggagguccc

SEQ ID NO: 1127221 - RNA, 18 nt, Human
ucccaaagguuaaggacc

SEQ ID NO: 1127222 - RNA, 18 nt, Human
ucccugagacagauacug

SEQ ID NO: 1127223 - RNA, 20 nt, Human
uccguugugcuagcuuugug

SEQ ID NO: 1127224 - RNA, 19 nt, Human
ucucagggcugugcacucc

SEQ ID NO: 1127225 - RNA, 22 nt, Human
ucuuacccccauuccacagggg

SEQ ID NO: 1127226 - RNA, 21 nt, Human
ucuuguuuucagggacuaggu

SEQ ID NO: 1127227 - RNA, 22 nt, Human
ugaaggagacuggaagacagca

SEQ ID NO: 1127228 - RNA, 19 nt, Human
ugaagugaaagaaauagcc

SEQ ID NO: 1127229 - RNA, 23 nt, Human
ugacccagagcaucaaggagcaa

SEQ ID NO: 1127230 - RNA, 22 nt, Human
ugagaugagccccaaggaugcu

SEQ ID NO: 1127231 - RNA, 21 nt, Human
ugaggaacagggacuggagcc

SEQ ID NO: 1127232 - RNA, 19 nt, Human
ugaggacgaggaagagcug

SEQ ID NO: 1127233 - RNA, 20 nt, Human
ugaggacgaggaagagcugg

SEQ ID NO: 1127234 - RNA, 24 nt, Human
ugcuuaggugugaacagagcuuuu

SEQ ID NO: 1127235 - RNA, 23 nt, Human
uggaaagaggauccagauaaaag

SEQ ID NO: 1127236 - RNA, 20 nt, Human
uggaagaagauacagguuca

SEQ ID NO: 1127237 - RNA, 22 nt, Human
uggaagaagauacagguucaga

SEQ ID NO: 1127238 - RNA, 19 nt, Human
uggaaugaagugaaagaaa

SEQ ID NO: 1127239 - RNA, 20 nt, Human
uggagcagcuggagcugggg

SEQ ID NO: 1127240 - RNA, 18 nt, Human
uggagcuggggcuggggc

SEQ ID NO: 1127241 - RNA, 18 nt, Human
uggauggaauguguaugu

SEQ ID NO: 1127242 - RNA, 20 nt, Human
uggcagagacacacacaaug

SEQ ID NO: 1127243 - RNA, 18 nt, Human
uggccaggaaugggagug

SEQ ID NO: 1127244 - RNA, 22 nt, Human
uggcccuggugacaguggggcu

SEQ ID NO: 1127245 - RNA, 19 nt, Human
uggccgcaugcagcggcag

SEQ ID NO: 1127246 - RNA, 21 nt, Human
ugggagggcagccaggcacag

SEQ ID NO: 1127247 - RNA, 19 nt, Human
uggggagcacaggccugag

SEQ ID NO: 1127248 - RNA, 19 nt, Human
uggggcuggcucaggcucu

SEQ ID NO: 1127249 - RNA, 19 nt, Human
uggggcuggggcuggggcu

SEQ ID NO: 1127250 - RNA, 20 nt, Human
uggggcugugcguggggcca

SEQ ID NO: 1127251 - RNA, 22 nt, Human
uggggcugugcguggggccaga

SEQ ID NO: 1127252 - RNA, 18 nt, Human
ugggggaugcugaggaac

SEQ ID NO: 1127253 - RNA, 22 nt, Human
uggggguauggauggaaugugu

SEQ ID NO: 1127254 - RNA, 24 nt, Human
uguaugagaugagccccaaggaug

SEQ ID NO: 1127255 - RNA, 19 nt, Human
ugucugacccugcucucuc

SEQ ID NO: 1127256 - RNA, 18 nt, Human
uguguaugugguaauggu

SEQ ID NO: 1127257 - RNA, 18 nt, Human
uuccuccacagaaguaca

SEQ ID NO: 1127258 - RNA, 20 nt, Human
uuccugaggcauggaccgag

SEQ ID NO: 1127259 - RNA, 18 nt, Human
aacugcuguuucuucucu

SEQ ID NO: 1127260 - RNA, 22 nt, Human
cagcuugcuucagcugcucugc

SEQ ID NO: 1127261 - RNA, 18 nt, Human
ccagcugggggcgcaauu

SEQ ID NO: 1127262 - RNA, 21 nt, Human
ccugacauucaucaugagagg

SEQ ID NO: 1127263 - RNA, 22 nt, Human
ccugagagugaaccaggacuuu

SEQ ID NO: 1127264 - RNA, 22 nt, Human
cggcugauaccaccaugcugac

SEQ ID NO: 1127265 - RNA, 22 nt, Human
cggcugauaccaccaugcugac

SEQ ID NO: 1127266 - RNA, 19 nt, Human
cugcgucagcucucguucc

SEQ ID NO: 1127267 - RNA, 23 nt, Human
cuguuucuucucugccagcuggg

SEQ ID NO: 1127268 - RNA, 22 nt, Human
cuucucgcuggaccaagggccc

SEQ ID NO: 1127269 - RNA, 21 nt, Human
gcucucguuccugagagugaa

SEQ ID NO: 1127270 - RNA, 20 nt, Human
gcucugcaagcuucuccucc

SEQ ID NO: 1127271 - RNA, 20 nt, Human
ucagcauaaauuuuaugagg

SEQ ID NO: 1127272 - RNA, 23 nt, Human
ucucugccuucucgcuggacaaa

SEQ ID NO: 1127273 - RNA, 24 nt, Human
ucugccuucucgcuggacaaaggg

SEQ ID NO: 1127274 - RNA, 24 nt, Human
ucugccuucucgcuggaccaaggg

SEQ ID NO: 1127275 - RNA, 25 nt, Human
ugccugagcuccucagcuugcuuca

SEQ ID NO: 1127276 - RNA, 24 nt, Human
ugcuucagcugcucugcaagcuuc

SEQ ID NO: 1127277 - RNA, 18 nt, Human
uggcagaagagguggggc

SEQ ID NO: 1127278 - RNA, 20 nt, Human
uggcagaagagguggggcca

SEQ ID NO: 1127279 - RNA, 23 nt, Human
uggcagaagagguggggccaggg

SEQ ID NO: 1127280 - RNA, 28 nt, Human
accccaaaaauaccagcuccaggaaaac

SEQ ID NO: 1127281 - RNA, 20 nt, Human
agcuggggaagcagggccag

SEQ ID NO: 1127282 - RNA, 19 nt, Human
aggcccugggaauugcagc

SEQ ID NO: 1127283 - RNA, 22 nt, Human
caccccaaaaauaccagcucca

SEQ ID NO: 1127284 - RNA, 24 nt, Human
caccccaaaaauaccagcuccagg

SEQ ID NO: 1127285 - RNA, 22 nt, Human
cagccucugggcaucagagccc

SEQ ID NO: 1127286 - RNA, 24 nt, Human
caggaaaaccaugguaucucccca

SEQ ID NO: 1127287 - RNA, 18 nt, Human
cagggccaggcccuggga

SEQ ID NO: 1127288 - RNA, 23 nt, Human
caugguaucuccccagcacuuug

SEQ ID NO: 1127289 - RNA, 20 nt, Human
ccaugguaucuccccagcac

SEQ ID NO: 1127290 - RNA, 20 nt, Human
ccccagcacuuugcagggcc

SEQ ID NO: 1127291 - RNA, 24 nt, Human
ccucugggcaucagagcccggccc

SEQ ID NO: 1127292 - RNA, 23 nt, Human
gaagcagggccaggcccugggaa

SEQ ID NO: 1127293 - RNA, 22 nt, Human
gcucaagcacaaaagacuccug

SEQ ID NO: 1127294 - RNA, 20 nt, Human
gcuguaugaaugaaugaguu

SEQ ID NO: 1127295 - RNA, 20 nt, Human
ugcagggccuggcaugugga

SEQ ID NO: 1127296 - RNA, 24 nt, Human
uuagcggaucuaaugauguuuccu

SEQ ID NO: 1127297 - RNA, 22 nt, Human
uuugcagggccuggcaugugga

SEQ ID NO: 1127298 - RNA, 25 nt, Human
aaaccagcuccaaaugcucaccugg

SEQ ID NO: 1127299 - RNA, 23 nt, Human
aaacugcaucuuuguucagagcc

SEQ ID NO: 1127300 - RNA, 23 nt, Human
aaagaaagguccggcucagccaa

SEQ ID NO: 1127301 - RNA, 22 nt, Human
aacaaccaacccauccucaugu

SEQ ID NO: 1127302 - RNA, 21 nt, Human
aacccauuuccucugcagcca

SEQ ID NO: 1127303 - RNA, 23 nt, Human
aagaucgaaccauguaagugcca

SEQ ID NO: 1127304 - RNA, 21 nt, Human
aagcgauuuggggccacggcc

SEQ ID NO: 1127305 - RNA, 21 nt, Human
aagcuacaacagcuuuccaag

SEQ ID NO: 1127306 - RNA, 28 nt, Human
aagugugcccuuaggaggccaaacaucc

SEQ ID NO: 1127307 - RNA, 20 nt, Human
aaguguuaauccucacgaug

SEQ ID NO: 1127308 - RNA, 22 nt, Human
acaagcuacaacagcuuuccaa

SEQ ID NO: 1127309 - RNA, 20 nt, Human
acaucguccccagguccaga

SEQ ID NO: 1127310 - RNA, 24 nt, Human
accacacucgggcugcuuggacag

SEQ ID NO: 1127311 - RNA, 19 nt, Human
acccagcccuguucaguga

SEQ ID NO: 1127312 - RNA, 18 nt, Human
accucuggccaaaucuuc

SEQ ID NO: 1127313 - RNA, 20 nt, Human
accuggcugucagggauggg

SEQ ID NO: 1127314 - RNA, 23 nt, Human
acucucggggaagcgauuugggg

SEQ ID NO: 1127315 - RNA, 18 nt, Human
acuguggagguuguuaau

SEQ ID NO: 1127316 - RNA, 19 nt, Human
agacgcccuucucuccacu

SEQ ID NO: 1127317 - RNA, 18 nt, Human
agagcccuccggagccuc

SEQ ID NO: 1127318 - RNA, 19 nt, Human
agcaagaucgaaccaugua

SEQ ID NO: 1127319 - RNA, 19 nt, Human
agccucgaaaagcagagug

SEQ ID NO: 1127320 - RNA, 22 nt, Human
agcuguggacugcagcuucagg

SEQ ID NO: 1127321 - RNA, 23 nt, Human
aggaagagcccuccggagccucg

SEQ ID NO: 1127322 - RNA, 19 nt, Human
aggcacaagcuacaacagc

SEQ ID NO: 1127323 - RNA, 21 nt, Human
aggcacaagcuacaacagcuu

SEQ ID NO: 1127324 - RNA, 19 nt, Human
aggcccgaaggcuugaguc

SEQ ID NO: 1127325 - RNA, 23 nt, Human
aggcuggauguggcuugggagag

SEQ ID NO: 1127326 - RNA, 19 nt, Human
cacacagcauaacaguggc

SEQ ID NO: 1127327 - RNA, 19 nt, Human
cacagcauaacaguggcag

SEQ ID NO: 1127328 - RNA, 21 nt, Human
caccuggcugucagggauggg

SEQ ID NO: 1127329 - RNA, 22 nt, Human
cacgcuggccgggcuguguaga

SEQ ID NO: 1127330 - RNA, 19 nt, Human
cacuugucuccagcaagau

SEQ ID NO: 1127331 - RNA, 20 nt, Human
cagagccaacccauuuccuc

SEQ ID NO: 1127332 - RNA, 24 nt, Human
cagaugcccacauugcccugcagg

SEQ ID NO: 1127333 - RNA, 21 nt, Human
cagcagacaaagcucacucaa

SEQ ID NO: 1127334 - RNA, 18 nt, Human
cagcaggaagagcccucc

SEQ ID NO: 1127335 - RNA, 25 nt, Human
cagggaccaagaccacacucgggcu

SEQ ID NO: 1127336 - RNA, 18 nt, Human
cagggauggggagccuca

SEQ ID NO: 1127337 - RNA, 21 nt, Human
caguacccagcccuguucagu

SEQ ID NO: 1127338 - RNA, 20 nt, Human
caugggccuucuucucccca

SEQ ID NO: 1127339 - RNA, 24 nt, Human
ccaaacauccaccugucuaccaac

SEQ ID NO: 1127340 - RNA, 22 nt, Human
ccacaggcacaagcuacaacag

SEQ ID NO: 1127341 - RNA, 18 nt, Human
ccacccacaggcacaagc

SEQ ID NO: 1127342 - RNA, 27 nt, Human
ccagaccccaaacucauugccacacuc

SEQ ID NO: 1127343 - RNA, 20 nt, Human
ccagaugcccacauugcccu

SEQ ID NO: 1127344 - RNA, 19 nt, Human
ccaggcuggauguggcuug

SEQ ID NO: 1127345 - RNA, 23 nt, Human
cccacauugcccugcagggacca

SEQ ID NO: 1127346 - RNA, 19 nt, Human
ccccagaccccaaacucau

SEQ ID NO: 1127347 - RNA, 18 nt, Human
ccccagguccagaugccc

SEQ ID NO: 1127348 - RNA, 21 nt, Human
ccccucuguagccugugacaa

SEQ ID NO: 1127349 - RNA, 22 nt, Human
cccugccccagaccccaaacuc

SEQ ID NO: 1127350 - RNA, 19 nt, Human
cccuguuggaggcucuugg

SEQ ID NO: 1127351 - RNA, 19 nt, Human
ccggagccucgaaaagcag

SEQ ID NO: 1127352 - RNA, 19 nt, Human
ccucaugggugaaagaggg

SEQ ID NO: 1127353 - RNA, 22 nt, Human
ccucugcagccacaaaaugccu

SEQ ID NO: 1127354 - RNA, 20 nt, Human
ccugcuggccuccugcugug

SEQ ID NO: 1127355 - RNA, 22 nt, Human
ccuggcugucagggauggggga

SEQ ID NO: 1127356 - RNA, 22 nt, Human
ccuggggcccuccacgcuggcc

SEQ ID NO: 1127357 - RNA, 22 nt, Human
ccuucuguucuucuugccgacc

SEQ ID NO: 1127358 - RNA, 22 nt, Human
cgauuuggggccacggcccuag

SEQ ID NO: 1127359 - RNA, 24 nt, Human
cucauugccacacuccauaccacu

SEQ ID NO: 1127360 - RNA, 18 nt, Human
cucugcauucaagugccc

SEQ ID NO: 1127361 - RNA, 18 nt, Human
cugcagggaccaagacca

SEQ ID NO: 1127362 - RNA, 23 nt, Human
cugcaucuuuguucagagccaac

SEQ ID NO: 1127363 - RNA, 23 nt, Human
cugccaguacccagcccuguuca

SEQ ID NO: 1127364 - RNA, 31 nt, Human
cugcuuggacaggauguagcuggucacuguu

SEQ ID NO: 1127365 - RNA, 20 nt, Human
cuggccaaaucuuccuguuc

SEQ ID NO: 1127366 - RNA, 18 nt, Human
cuggggcccuccacgcug

SEQ ID NO: 1127367 - RNA, 21 nt, Human
cuggucaaugaacugaggccc

SEQ ID NO: 1127368 - RNA, 23 nt, Human
gaaaagcagaguggaaguggugg

SEQ ID NO: 1127369 - RNA, 20 nt, Human
gacaggauguagcuggucac

SEQ ID NO: 1127370 - RNA, 24 nt, Human
gacccccaauuguccacuugucuc

SEQ ID NO: 1127371 - RNA, 21 nt, Human
gaggucaccucuggccaaauc

SEQ ID NO: 1127372 - RNA, 19 nt, Human
gaguuggagcgaacuagcu

SEQ ID NO: 1127373 - RNA, 24 nt, Human
gcacaagcuacaacagcuuuccaa

SEQ ID NO: 1127374 - RNA, 18 nt, Human
gcaggaagagcccuccgg

SEQ ID NO: 1127375 - RNA, 25 nt, Human
gccacacuccauaccacugucacgg

SEQ ID NO: 1127376 - RNA, 18 nt, Human
gccauuggcaagaaugcc

SEQ ID NO: 1127377 - RNA, 18 nt, Human
ggaagagggaggugggcc

SEQ ID NO: 1127378 - RNA, 21 nt, Human
ggacaggauguagcuggucac

SEQ ID NO: 1127379 - RNA, 18 nt, Human
ggagguuguuaauuuaac

SEQ ID NO: 1127380 - RNA, 19 nt, Human
ggccuggaugccccuggag

SEQ ID NO: 1127381 - RNA, 21 nt, Human
gguuaggacauuggugagcua

SEQ ID NO: 1127382 - RNA, 25 nt, Human
guggaagugguggugccccccacug

SEQ ID NO: 1127383 - RNA, 18 nt, Human
guugcuguugcugccucc

SEQ ID NO: 1127384 - RNA, 24 nt, Human
guuucuggggucccaggucaucca

SEQ ID NO: 1127385 - RNA, 24 nt, Human
uaacugccugccugggcacguugc

SEQ ID NO: 1127386 - RNA, 18 nt, Human
uaccaaaugauuuugcuc

SEQ ID NO: 1127387 - RNA, 27 nt, Human
uaugucaccuauguuucaggugaaacg

SEQ ID NO: 1127388 - RNA, 23 nt, Human
ucacucaaucugauacuguggag

SEQ ID NO: 1127389 - RNA, 20 nt, Human
ucagccaaggacaaaggggc

SEQ ID NO: 1127390 - RNA, 22 nt, Human
uccaggcuggauguggcuuggg

SEQ ID NO: 1127391 - RNA, 19 nt, Human
ucccaaacggcaguuucug

SEQ ID NO: 1127392 - RNA, 22 nt, Human
ucccugccccagaccccaaacu

SEQ ID NO: 1127393 - RNA, 21 nt, Human
ucccugggagggaaccagaag

SEQ ID NO: 1127394 - RNA, 19 nt, Human
uccgccuucuguucuucuu

SEQ ID NO: 1127395 - RNA, 21 nt, Human
ucgcagaggcuccuggggguc

SEQ ID NO: 1127396 - RNA, 22 nt, Human
ucgcagaggcuccuggggguca

SEQ ID NO: 1127397 - RNA, 21 nt, Human
ucgcgguugcccguguugccu

SEQ ID NO: 1127398 - RNA, 21 nt, Human
ucuaccaacuagacauuuggu

SEQ ID NO: 1127399 - RNA, 27 nt, Human
ucuaccaggcaggugccuucuccaccc

SEQ ID NO: 1127400 - RNA, 26 nt, Human
ucuccacccacaggcacaagcuacaa

SEQ ID NO: 1127401 - RNA, 23 nt, Human
ucucgguuaggacauuggugagc

SEQ ID NO: 1127402 - RNA, 25 nt, Human
ucugccagugacccccaauugucca

SEQ ID NO: 1127403 - RNA, 19 nt, Human
ucuggagcuggccccucug

SEQ ID NO: 1127404 - RNA, 24 nt, Human
ucuguagccugugacaaucagcuu

SEQ ID NO: 1127405 - RNA, 19 nt, Human
ugacaaucagcuugagucc

SEQ ID NO: 1127406 - RNA, 18 nt, Human
ugcagccuggggucugaa

SEQ ID NO: 1127407 - RNA, 20 nt, Human
ugccaagucuccgccuucug

SEQ ID NO: 1127408 - RNA, 24 nt, Human
ugccaagucuccgccuucuguucu

SEQ ID NO: 1127409 - RNA, 23 nt, Human
ugccagagauucaccaccugggg

SEQ ID NO: 1127410 - RNA, 24 nt, Human
ugccagagauucaccaccugggga

SEQ ID NO: 1127411 - RNA, 25 nt, Human
ugccccagaccccaaacucauugcc

SEQ ID NO: 1127412 - RNA, 20 nt, Human
ugcccguguugccucaggcc

SEQ ID NO: 1127413 - RNA, 21 nt, Human
ugcccugcagggaccaagaca

SEQ ID NO: 1127414 - RNA, 24 nt, Human
ugccuuugugugucagggcucggg

SEQ ID NO: 1127415 - RNA, 20 nt, Human
ugcugccucccaaacggcag

SEQ ID NO: 1127416 - RNA, 21 nt, Human
uggaagugguggugcccagga

SEQ ID NO: 1127417 - RNA, 22 nt, Human
uggaagugguggugcccaggac

SEQ ID NO: 1127418 - RNA, 23 nt, Human
uggaagugguggugcccaggacg

SEQ ID NO: 1127419 - RNA, 24 nt, Human
uggaagugguggugcccaggacgg

SEQ ID NO: 1127420 - RNA, 24 nt, Human
uggaugaggccgaaugucaugaag

SEQ ID NO: 1127421 - RNA, 23 nt, Human
uggcauaauuuaaaccaaaagag

SEQ ID NO: 1127422 - RNA, 19 nt, Human
uggccgggcuguguagaga

SEQ ID NO: 1127423 - RNA, 20 nt, Human
ugggaagaagccacacagca

SEQ ID NO: 1127424 - RNA, 19 nt, Human
ugggagggaaccagaagua

SEQ ID NO: 1127425 - RNA, 18 nt, Human
ugggggucagaaagcugg

SEQ ID NO: 1127426 - RNA, 18 nt, Human
ugucacggagugcagaua

SEQ ID NO: 1127427 - RNA, 18 nt, Human
ugucaugaagauaaugga

SEQ ID NO: 1127428 - RNA, 19 nt, Human
ugucucugccagugacccc

SEQ ID NO: 1127429 - RNA, 21 nt, Human
ugugcucaugggauuuauaug

SEQ ID NO: 1127430 - RNA, 20 nt, Human
uguuggaggcucuuggcagg

SEQ ID NO: 1127431 - RNA, 24 nt, Human
uguuucuugagcccuguuggaggc

SEQ ID NO: 1127432 - RNA, 20 nt, Human
uuaaacauuucuuuucuucc

SEQ ID NO: 1127433 - RNA, 18 nt, Human
uuccaaaagaaagguccg

SEQ ID NO: 1127434 - RNA, 20 nt, Human
uugagcccuguuggaggcuc

SEQ ID NO: 1127435 - RNA, 23 nt, Human
uugcugccucccaaacggcaguu

SEQ ID NO: 1127436 - RNA, 20 nt, Human
uuggucucagacagcaagaa

SEQ ID NO: 1127437 - RNA, 20 nt, Human
aaaggccccaaggagcccuc

SEQ ID NO: 1127438 - RNA, 21 nt, Human
aaggccccaaggagcccucag

SEQ ID NO: 1127439 - RNA, 23 nt, Human
accccauaaaggccccaaggagc

SEQ ID NO: 1127440 - RNA, 24 nt, Human
accccauaaaggccccaaggagcc

SEQ ID NO: 1127441 - RNA, 22 nt, Human
cacuguguggccuugguggagc

SEQ ID NO: 1127442 - RNA, 19 nt, Human
ccacugcagcagacaaggc

SEQ ID NO: 1127443 - RNA, 22 nt, Human
ccauaaaggccccaaggagccc

SEQ ID NO: 1127444 - RNA, 19 nt, Human
cccacuguguggccuuggu

SEQ ID NO: 1127445 - RNA, 24 nt, Human
uaauggagauggaauuaccccaua

SEQ ID NO: 1127446 - RNA, 20 nt, Human
ucagcccuaauggagaugga

SEQ ID NO: 1127447 - RNA, 19 nt, Human
aaagaauucccccuccccu

SEQ ID NO: 1127448 - RNA, 21 nt, Human
aaagaauucccccuccccuca

SEQ ID NO: 1127449 - RNA, 19 nt, Human
aacgucguucuccccgccc

SEQ ID NO: 1127450 - RNA, 22 nt, Human
aggcacugcguagaauguuugc

SEQ ID NO: 1127451 - RNA, 25 nt, Human
agggaagggggaggggucgucccga

SEQ ID NO: 1127452 - RNA, 21 nt, Human
aggggcaacaggguccggagc

SEQ ID NO: 1127453 - RNA, 22 nt, Human
auguuugcucacuaagcccaaa

SEQ ID NO: 1127454 - RNA, 26 nt, Human
cacacgggccccucuccggggggcuu

SEQ ID NO: 1127455 - RNA, 18 nt, Human
ccacacgggccccucucc

SEQ ID NO: 1127456 - RNA, 19 nt, Human
ccaccccuucccgcgccau

SEQ ID NO: 1127457 - RNA, 22 nt, Human
cccacgccgccccgcccagggg

SEQ ID NO: 1127458 - RNA, 19 nt, Human
cccaggcgccccggucuuc

SEQ ID NO: 1127459 - RNA, 22 nt, Human
cccccugcccugccccgcuagc

SEQ ID NO: 1127460 - RNA, 22 nt, Human
cccgggguuacuacgguuuccc

SEQ ID NO: 1127461 - RNA, 22 nt, Human
cccuuugugccccggggaugag

SEQ ID NO: 1127462 - RNA, 27 nt, Human
ccuggccgaaggcuuggggagcucauu

SEQ ID NO: 1127463 - RNA, 22 nt, Human
cggccgcguuagcccgccgccc

SEQ ID NO: 1127464 - RNA, 25 nt, Human
cgggccccucuccggggggcuuuuu

SEQ ID NO: 1127465 - RNA, 23 nt, Human
cuagcgccaacgucguucucccc

SEQ ID NO: 1127466 - RNA, 21 nt, Human
cucccccugcccugccccgcu

SEQ ID NO: 1127467 - RNA, 20 nt, Human
cuggcuugucuuccaccccu

SEQ ID NO: 1127468 - RNA, 24 nt, Human
cuggcuugucuuccaccccuuccc

SEQ ID NO: 1127469 - RNA, 21 nt, Human
cuuccaccccuucccgcgcca

SEQ ID NO: 1127470 - RNA, 19 nt, Human
gagcgcgcgcgcgcucgcc

SEQ ID NO: 1127471 - RNA, 19 nt, Human
gcccacucgcggaaacuag

SEQ ID NO: 1127472 - RNA, 21 nt, Human
gccccucuccggggggcuuuu

SEQ ID NO: 1127473 - RNA, 19 nt, Human
gccgcguuagcccgccgcc

SEQ ID NO: 1127474 - RNA, 18 nt, Human
gcuagucguguuuccgcg

SEQ ID NO: 1127475 - RNA, 25 nt, Human
gcuggcuugucuuccaccccuuccc

SEQ ID NO: 1127476 - RNA, 18 nt, Human
ggaaacuaguuucuugug

SEQ ID NO: 1127477 - RNA, 24 nt, Human
ggcccgggguuacuacgguuuccc

SEQ ID NO: 1127478 - RNA, 18 nt, Human
gggcuuuuucuuaaaggg

SEQ ID NO: 1127479 - RNA, 18 nt, Human
ggggcaacaggguccgga

SEQ ID NO: 1127480 - RNA, 20 nt, Human
ggguggugccugggccggcc

SEQ ID NO: 1127481 - RNA, 18 nt, Human
gguccggagcccgccaac

SEQ ID NO: 1127482 - RNA, 22 nt, Human
ggugucuuuuuuuuuuuuuuuu

SEQ ID NO: 1127483 - RNA, 21 nt, Human
gucuuugcugugaagugcguc

SEQ ID NO: 1127484 - RNA, 18 nt, Human
guggagugugauggagcc

SEQ ID NO: 1127485 - RNA, 18 nt, Human
guggagugugauggagcc

SEQ ID NO: 1127486 - RNA, 21 nt, Human
guggugccugggccggcuuau

SEQ ID NO: 1127487 - RNA, 23 nt, Human
gugucuuuuuuuuuuuuuuuuuu

SEQ ID NO: 1127488 - RNA, 20 nt, Human
uagucguguuuccgcgcgcc

SEQ ID NO: 1127489 - RNA, 21 nt, Human
ucccgugacucccucccccug

SEQ ID NO: 1127490 - RNA, 23 nt, Human
ucccgugacucccucccccugcc

SEQ ID NO: 1127491 - RNA, 18 nt, Human
uccgcgcgccugcgcacg

SEQ ID NO: 1127492 - RNA, 24 nt, Human
uccgcgcgccugcgcacggggccg

SEQ ID NO: 1127493 - RNA, 18 nt, Human
ucgcgcuggcuugucuuc

SEQ ID NO: 1127494 - RNA, 23 nt, Human
ucgucccgaagcgcgcuagucgu

SEQ ID NO: 1127495 - RNA, 20 nt, Human
ucucgcuguguuguccgcga

SEQ ID NO: 1127496 - RNA, 20 nt, Human
ucucuugucauccaggcugu

SEQ ID NO: 1127497 - RNA, 23 nt, Human
ucuuuuuuuuuuuuuuuuugaga

SEQ ID NO: 1127498 - RNA, 19 nt, Human
ugacucccucccccugccc

SEQ ID NO: 1127499 - RNA, 25 nt, Human
ugagggaagggggaggggucguccc

SEQ ID NO: 1127500 - RNA, 21 nt, Human
ugcccugccccgcuagcgcca

SEQ ID NO: 1127501 - RNA, 23 nt, Human
ugcccugccccgcuagcgccaac

SEQ ID NO: 1127502 - RNA, 18 nt, Human
ugcuaaaucccgugacuc

SEQ ID NO: 1127503 - RNA, 21 nt, Human
uggugcgugagcgcgcgcgcg

SEQ ID NO: 1127504 - RNA, 18 nt, Human
ugucuuccaccccuuccc

SEQ ID NO: 1127505 - RNA, 26 nt, Human
ugugauggagccuucucgaaacggga

SEQ ID NO: 1127506 - RNA, 21 nt, Human
uuagcccgccgcccgcggccg

SEQ ID NO: 1127507 - RNA, 21 nt, Human
uuggccuuugagggaaggggg

SEQ ID NO: 1127508 - RNA, 21 nt, Human
uuggguggugccugggccggc

SEQ ID NO: 1127509 - RNA, 23 nt, Human
uugucauccaggcuguagugcag

SEQ ID NO: 1127510 - RNA, 21 nt, Human
uuuacucagccacacgggccc

SEQ ID NO: 1127511 - RNA, 22 nt, Human
uuuuuuuuuuuuuugagacggg

SEQ ID NO: 1127512 - RNA, 24 nt, Human
uuuuuuuuuuuuuuuugagacggg

SEQ ID NO: 1127513 - RNA, 18 nt, Human
uuuuuuuuuuuuuuuuug

SEQ ID NO: 1127514 - RNA, 20 nt, Human
aacaaagcgagacuccaucu

SEQ ID NO: 1127515 - RNA, 21 nt, Human
aacacagcgaaagccugucuc

SEQ ID NO: 1127516 - RNA, 19 nt, Human
aacauggcaaaaccccauc

SEQ ID NO: 1127517 - RNA, 21 nt, Human
aacauggcaaaaccccaucuc

SEQ ID NO: 1127518 - RNA, 21 nt, Human
aacauggcaaaaccccaucuc

SEQ ID NO: 1127519 - RNA, 23 nt, Human
aagcccaccacucuaggccuugg

SEQ ID NO: 1127520 - RNA, 22 nt, Human
aagcuccaguccuggcucugcc

SEQ ID NO: 1127521 - RNA, 24 nt, Human
aagugagguggcucaugccuguaa

SEQ ID NO: 1127522 - RNA, 25 nt, Human
aagugccugccucgugcugcugucu

SEQ ID NO: 1127523 - RNA, 24 nt, Human
aaucacuugaaccugggaggugga

SEQ ID NO: 1127524 - RNA, 21 nt, Human
aaugcccacagggcgggcagc

SEQ ID NO: 1127525 - RNA, 20 nt, Human
aauugcuugaaccuaggagg

SEQ ID NO: 1127526 - RNA, 24 nt, Human
acaaagcgagacuccaucucaaaa

SEQ ID NO: 1127527 - RNA, 24 nt, Human
accccaucucuacuaaagauacaa

SEQ ID NO: 1127528 - RNA, 20 nt, Human
accgagaucgugccacugca

SEQ ID NO: 1127529 - RNA, 18 nt, Human
accgcacuccagccuggg

SEQ ID NO: 1127530 - RNA, 24 nt, Human
accuaggaggccaagguugcagug

SEQ ID NO: 1127531 - RNA, 24 nt, Human
acuccagcuuggguggcagaguga

SEQ ID NO: 1127532 - RNA, 24 nt, Human
acugcacuccagcuuggguggcag

SEQ ID NO: 1127533 - RNA, 26 nt, Human
acugcacuccagcuuggguggcagag

SEQ ID NO: 1127534 - RNA, 22 nt, Human
acugggccuaugccaugugcac

SEQ ID NO: 1127535 - RNA, 24 nt, Human
acuugaggucaggaguucgagacc

SEQ ID NO: 1127536 - RNA, 21 nt, Human
agaaggaagagaacugucugg

SEQ ID NO: 1127537 - RNA, 24 nt, Human
agaaggaagagaacugucuggaaa

SEQ ID NO: 1127538 - RNA, 22 nt, Human
agaaucacuugaaccugggagg

SEQ ID NO: 1127539 - RNA, 22 nt, Human
agaauugcuugaaccuaggagg

SEQ ID NO: 1127540 - RNA, 21 nt, Human
agcauuuugggaggccgaggc

SEQ ID NO: 1127541 - RNA, 24 nt, Human
agcauuuugggaggccgaggcggg

SEQ ID NO: 1127542 - RNA, 24 nt, Human
agccuggccaacacagcgaaagcc

SEQ ID NO: 1127543 - RNA, 24 nt, Human
agccugggcaacaaagcgagacuc

SEQ ID NO: 1127544 - RNA, 24 nt, Human
agcuuggguggcagagugagacuu

SEQ ID NO: 1127545 - RNA, 23 nt, Human
aggaguucgagaccagucuggcc

SEQ ID NO: 1127546 - RNA, 22 nt, Human
aggcaggagaaucacuugaacc

SEQ ID NO: 1127547 - RNA, 24 nt, Human
aggcaggagaaucacuugaaccug

SEQ ID NO: 1127548 - RNA, 24 nt, Human
aggccaagguugcagugaaccgag

SEQ ID NO: 1127549 - RNA, 22 nt, Human
aggccaggcgcgguggcucacg

SEQ ID NO: 1127550 - RNA, 22 nt, Human
aggccaguggaucacuugaggu

SEQ ID NO: 1127551 - RNA, 26 nt, Human
aggccaguggaucacuugaggucagg

SEQ ID NO: 1127552 - RNA, 22 nt, Human
aggccgaggcgggcggcaaggu

SEQ ID NO: 1127553 - RNA, 25 nt, Human
aggccgaggcgggcggcaaggucag

SEQ ID NO: 1127554 - RNA, 24 nt, Human
aggcgcgguggcucacgccuguaa

SEQ ID NO: 1127555 - RNA, 24 nt, Human
aggcugaggcaggagaaucacuug

SEQ ID NO: 1127556 - RNA, 24 nt, Human
aggcuggggcaggagaauugcuug

SEQ ID NO: 1127557 - RNA, 20 nt, Human
aggucggugcggcgcugaga

SEQ ID NO: 1127558 - RNA, 21 nt, Human
agguggagguuguggugagcc

SEQ ID NO: 1127559 - RNA, 24 nt, Human
agguggagguuguggugagccgag

SEQ ID NO: 1127560 - RNA, 18 nt, Human
aguacagagaaggaagag

SEQ ID NO: 1127561 - RNA, 24 nt, Human
agucuggccaacauggcaaaaccc

SEQ ID NO: 1127562 - RNA, 24 nt, Human
aucacuugaggucaggaguucgag

SEQ ID NO: 1127563 - RNA, 24 nt, Human
aucgugccacugcacuccagcuug

SEQ ID NO: 1127564 - RNA, 19 nt, Human
augccuguaaucccagcac

SEQ ID NO: 1127565 - RNA, 22 nt, Human
auucaagaccagccuggccaac

SEQ ID NO: 1127566 - RNA, 24 nt, Human
auugcaccaccgcacuccagccug

SEQ ID NO: 1127567 - RNA, 28 nt, Human
auugcaccaccgcacuccagccugggca

SEQ ID NO: 1127568 - RNA, 19 nt, Human
caaaauuagcugggcaugg

SEQ ID NO: 1127569 - RNA, 22 nt, Human
caaagcccaccacucuaggccu

SEQ ID NO: 1127570 - RNA, 26 nt, Human
caaaugcccacagggcgggcagcugg

SEQ ID NO: 1127571 - RNA, 21 nt, Human
caacucgggaggcugaggcag

SEQ ID NO: 1127572 - RNA, 24 nt, Human
caaggccaguggaucacuugaggu

SEQ ID NO: 1127573 - RNA, 26 nt, Human
caaggccaguggaucacuugagguca

SEQ ID NO: 1127574 - RNA, 22 nt, Human
caaggucaggcauucaagacca

SEQ ID NO: 1127575 - RNA, 19 nt, Human
cacaccuauagucccagca

SEQ ID NO: 1127576 - RNA, 24 nt, Human
cacaccuauagucccagcaacucg

SEQ ID NO: 1127577 - RNA, 19 nt, Human
cacaccuguaaucccagcu

SEQ ID NO: 1127578 - RNA, 25 nt, Human
caccgcacuccagccugggcaacaa

SEQ ID NO: 1127579 - RNA, 21 nt, Human
caccuauagucccagcaacuc

SEQ ID NO: 1127580 - RNA, 24 nt, Human
caccuauagucccagcaacucggg

SEQ ID NO: 1127581 - RNA, 18 nt, Human
caccuggacugaacaaug

SEQ ID NO: 1127582 - RNA, 21 nt, Human
caccuggacugaacaaugggc

SEQ ID NO: 1127583 - RNA, 22 nt, Human
caccuggacugaacaaugggca

SEQ ID NO: 1127584 - RNA, 24 nt, Human
caccuguaaucccagcuacucagg

SEQ ID NO: 1127585 - RNA, 24 nt, Human
cacgccuguaaucccagcauuuug

SEQ ID NO: 1127586 - RNA, 22 nt, Human
cacuccagcuuggguggcagag

SEQ ID NO: 1127587 - RNA, 23 nt, Human
cacuccagcuuggguggcagagu

SEQ ID NO: 1127588 - RNA, 24 nt, Human
cacuccagcuuggguggcagagug

SEQ ID NO: 1127589 - RNA, 19 nt, Human
cacugcacuccagcuuggg

SEQ ID NO: 1127590 - RNA, 21 nt, Human
cacugcacuccagcuugggug

SEQ ID NO: 1127591 - RNA, 23 nt, Human
cacugcacuccagcuuggguggc

SEQ ID NO: 1127592 - RNA, 24 nt, Human
cacugcacuccagcuuggguggca

SEQ ID NO: 1127593 - RNA, 25 nt, Human
cacugcacuccagcuuggguggcag

SEQ ID NO: 1127594 - RNA, 21 nt, Human
cacuugaaccugggaggugga

SEQ ID NO: 1127595 - RNA, 23 nt, Human
cacuugaggucaggaguucgaga

SEQ ID NO: 1127596 - RNA, 23 nt, Human
cagagugagacuucaucucaaaa

SEQ ID NO: 1127597 - RNA, 24 nt, Human
cagcaacucgggaggcugaggcag

SEQ ID NO: 1127598 - RNA, 20 nt, Human
cagcacuuugggaggccaag

SEQ ID NO: 1127599 - RNA, 23 nt, Human
cagcacuuugggaggccaaggcc

SEQ ID NO: 1127600 - RNA, 23 nt, Human
cagcaguccugccccugccaggg

SEQ ID NO: 1127601 - RNA, 24 nt, Human
cagcauuuugggaggccgaggcgg

SEQ ID NO: 1127602 - RNA, 20 nt, Human
cagcuacucaggaggcuggg

SEQ ID NO: 1127603 - RNA, 24 nt, Human
cagcuacucaggaggcuggggcag

SEQ ID NO: 1127604 - RNA, 23 nt, Human
cagggaguuggcauccaucucug

SEQ ID NO: 1127605 - RNA, 23 nt, Human
cagggcgggcagcugggaggccc

SEQ ID NO: 1127606 - RNA, 19 nt, Human
cagggucugcugcuggccc

SEQ ID NO: 1127607 - RNA, 21 nt, Human
caguccugccccugccaggga

SEQ ID NO: 1127608 - RNA, 20 nt, Human
cagucuagagaaaggcccag

SEQ ID NO: 1127609 - RNA, 19 nt, Human
caucucaaaaaaaaagaug

SEQ ID NO: 1127610 - RNA, 20 nt, Human
caugccuguaaucccagcac

SEQ ID NO: 1127611 - RNA, 24 nt, Human
caugccuguaaucccagcacuuug

SEQ ID NO: 1127612 - RNA, 20 nt, Human
ccaccgcacuccagccuggg

SEQ ID NO: 1127613 - RNA, 21 nt, Human
ccaccgcacuccagccugggc

SEQ ID NO: 1127614 - RNA, 24 nt, Human
ccaccgcacuccagccugggcaac

SEQ ID NO: 1127615 - RNA, 18 nt, Human
ccacugcacuccagcuug

SEQ ID NO: 1127616 - RNA, 20 nt, Human
ccacugcacuccagcuuggg

SEQ ID NO: 1127617 - RNA, 20 nt, Human
ccacugcacuccagcuuggg

SEQ ID NO: 1127618 - RNA, 20 nt, Human
ccacugcacuccagcuuggg

SEQ ID NO: 1127619 - RNA, 21 nt, Human
ccacugcacuccagcuugggu

SEQ ID NO: 1127620 - RNA, 22 nt, Human
ccacugcacuccagcuugggug

SEQ ID NO: 1127621 - RNA, 23 nt, Human
ccacugcacuccagcuugggugg

SEQ ID NO: 1127622 - RNA, 24 nt, Human
ccacugcacuccagcuuggguggc

SEQ ID NO: 1127623 - RNA, 24 nt, Human
ccaguggaucacuugaggucagga

SEQ ID NO: 1127624 - RNA, 19 nt, Human
ccccuaugggcaguccggg

SEQ ID NO: 1127625 - RNA, 21 nt, Human
cccgggccucagucccgggaa

SEQ ID NO: 1127626 - RNA, 18 nt, Human
ccugggagguggagguug

SEQ ID NO: 1127627 - RNA, 22 nt, Human
ccuguaaucccagcauuuuggg

SEQ ID NO: 1127628 - RNA, 21 nt, Human
ccuguaaucccagcuacucag

SEQ ID NO: 1127629 - RNA, 22 nt, Human
ccugucucuacuaaaaauacaa

SEQ ID NO: 1127630 - RNA, 21 nt, Human
cgagaccagucuggccaacau

SEQ ID NO: 1127631 - RNA, 23 nt, Human
cgagacuccaucucaaaaaaaaa

SEQ ID NO: 1127632 - RNA, 21 nt, Human
cgcacaccuauagucccagca

SEQ ID NO: 1127633 - RNA, 21 nt, Human
cgggaacaaugggcaccugga

SEQ ID NO: 1127634 - RNA, 24 nt, Human
cgggaggcugaggcaggagaauca

SEQ ID NO: 1127635 - RNA, 18 nt, Human
cucaaaaaaaaaaaaaaa

SEQ ID NO: 1127636 - RNA, 18 nt, Human
cucaaaaaaaaaaaaaaa

SEQ ID NO: 1127637 - RNA, 21 nt, Human
cucacgccuguaaucccagca

SEQ ID NO: 1127638 - RNA, 21 nt, Human
cucacgccuguaaucccagca

SEQ ID NO: 1127639 - RNA, 24 nt, Human
cucaugccuguaaucccagcacuu

SEQ ID NO: 1127640 - RNA, 18 nt, Human
cugccucgugcugcuguc

SEQ ID NO: 1127641 - RNA, 20 nt, Human
cuggccaacacagcgaaagc

SEQ ID NO: 1127642 - RNA, 23 nt, Human
cuggccaacauggcaaaacccca

SEQ ID NO: 1127643 - RNA, 24 nt, Human
cugggaggcccuccgugagagccc

SEQ ID NO: 1127644 - RNA, 21 nt, Human
cuguaaucccagcuacucagg

SEQ ID NO: 1127645 - RNA, 21 nt, Human
cuugaaccugggagguggagg

SEQ ID NO: 1127646 - RNA, 21 nt, Human
gaacugucuggaagacagaau

SEQ ID NO: 1127647 - RNA, 23 nt, Human
gagaucgugccacugcacuccag

SEQ ID NO: 1127648 - RNA, 18 nt, Human
gaggcuggggcaggagaa

SEQ ID NO: 1127649 - RNA, 18 nt, Human
gaucacuugaggucagga

SEQ ID NO: 1127650 - RNA, 24 nt, Human
gaucacuugaggucaggaguucga

SEQ ID NO: 1127651 - RNA, 23 nt, Human
gcacuccagcuuggguggcagag

SEQ ID NO: 1127652 - RNA, 19 nt, Human
gcagcugggaggcccuccg

SEQ ID NO: 1127653 - RNA, 23 nt, Human
gcaggagaaucacuugaaccugg

SEQ ID NO: 1127654 - RNA, 19 nt, Human
gccacugcacuccagcuug

SEQ ID NO: 1127655 - RNA, 24 nt, Human
gccacugcacuccagcuugggugg

SEQ ID NO: 1127656 - RNA, 19 nt, Human
gcccagggucugcugcugg

SEQ ID NO: 1127657 - RNA, 22 nt, Human
gcccagggucugcugcuggccc

SEQ ID NO: 1127658 - RNA, 22 nt, Human
gccgggugugguggcacacacc

SEQ ID NO: 1127659 - RNA, 19 nt, Human
gcucugggauguggugacc

SEQ ID NO: 1127660 - RNA, 19 nt, Human
gcucugggauguggugacc

SEQ ID NO: 1127661 - RNA, 22 nt, Human
ggagguuguggugagccgagau

SEQ ID NO: 1127662 - RNA, 24 nt, Human
ggagguuguggugagccgagauug

SEQ ID NO: 1127663 - RNA, 20 nt, Human
ggaucacuugaggucaggaa

SEQ ID NO: 1127664 - RNA, 22 nt, Human
ggaucacuugaggucaggaguu

SEQ ID NO: 1127665 - RNA, 21 nt, Human
ggcacacaccuguaaucccag

SEQ ID NO: 1127666 - RNA, 24 nt, Human
ggcagagugagacuucaucucaaa

SEQ ID NO: 1127667 - RNA, 21 nt, Human
ggcaggagaauugcuugaacc

SEQ ID NO: 1127668 - RNA, 21 nt, Human
ggcagguggggcugcucggca

SEQ ID NO: 1127669 - RNA, 19 nt, Human
ggccuuggcuuucuaaugg

SEQ ID NO: 1127670 - RNA, 23 nt, Human
gggcaggagaauugcuugaaccu

SEQ ID NO: 1127671 - RNA, 24 nt, Human
gggccaagugagguggcucaugcc

SEQ ID NO: 1127672 - RNA, 24 nt, Human
ggggcaggagaauugcuugaaccu

SEQ ID NO: 1127673 - RNA, 24 nt, Human
ggugacccaguacgcaguacagag

SEQ ID NO: 1127674 - RNA, 24 nt, Human
gguggcacacaccuguaaucccag

SEQ ID NO: 1127675 - RNA, 24 nt, Human
gguggcgcacaccuauagucccag

SEQ ID NO: 1127676 - RNA, 23 nt, Human
gguggcucacgccuguaauccca

SEQ ID NO: 1127677 - RNA, 24 nt, Human
gguggcucacgccuguaaucccag

SEQ ID NO: 1127678 - RNA, 23 nt, Human
gguggcucaugccuguaauccca

SEQ ID NO: 1127679 - RNA, 24 nt, Human
gguggcucaugccuguaaucccag

SEQ ID NO: 1127680 - RNA, 23 nt, Human
ggugugguggcacacaccuguaa

SEQ ID NO: 1127681 - RNA, 20 nt, Human
guaaaagaaguaaaagugcu

SEQ ID NO: 1127682 - RNA, 18 nt, Human
gucugcugcuggcccugc

SEQ ID NO: 1127683 - RNA, 23 nt, Human
guggaucacuugaggucaggagu

SEQ ID NO: 1127684 - RNA, 18 nt, Human
guguggcugggagggcag

SEQ ID NO: 1127685 - RNA, 18 nt, Human
uaaaaauacaaaauuagc

SEQ ID NO: 1127686 - RNA, 19 nt, Human
uaaaaauacaaaauuagcu

SEQ ID NO: 1127687 - RNA, 22 nt, Human
uaaaagaaguaaaagugccugc

SEQ ID NO: 1127688 - RNA, 23 nt, Human
uagagaaaggcccagggucugcu

SEQ ID NO: 1127689 - RNA, 21 nt, Human
ucacgccuguaaucccagcau

SEQ ID NO: 1127690 - RNA, 19 nt, Human
ucacuugaaccugggaggu

SEQ ID NO: 1127691 - RNA, 24 nt, Human
ucacuugaaccugggagguggagg

SEQ ID NO: 1127692 - RNA, 18 nt, Human
ucagucccgggaacaaug

SEQ ID NO: 1127693 - RNA, 22 nt, Human
ucagucuagagaaaggcccagg

SEQ ID NO: 1127694 - RNA, 22 nt, Human
ucaucucaaaaaaaaaaaaaaa

SEQ ID NO: 1127695 - RNA, 24 nt, Human
ucaucucaaaaaaaaaaaaaaaaa

SEQ ID NO: 1127696 - RNA, 22 nt, Human
ucaugccuguaaucccagcacu

SEQ ID NO: 1127697 - RNA, 24 nt, Human
uccagccugggcaacaaagcgaga

SEQ ID NO: 1127698 - RNA, 24 nt, Human
uccagcuuggguggcagagugaga

SEQ ID NO: 1127699 - RNA, 19 nt, Human
ucccgggccucagucccgg

SEQ ID NO: 1127700 - RNA, 25 nt, Human
ucgggaggcugaggcaggagaauca

SEQ ID NO: 1127701 - RNA, 23 nt, Human
ucgugccacugcacuccagcuug

SEQ ID NO: 1127702 - RNA, 20 nt, Human
ucucuacuaaaaauacaaaa

SEQ ID NO: 1127703 - RNA, 21 nt, Human
ucucuacuaaagauacaaaaa

SEQ ID NO: 1127704 - RNA, 26 nt, Human
ucucuacuaaagauacaagacaucgg

SEQ ID NO: 1127705 - RNA, 18 nt, Human
ucugaggccuaagugagc

SEQ ID NO: 1127706 - RNA, 22 nt, Human
ugaaccgagaucgugccacugc

SEQ ID NO: 1127707 - RNA, 27 nt, Human
ugaaccugggagguggagguugugacg

SEQ ID NO: 1127708 - RNA, 21 nt, Human
ugacuguauauggagauaggc

SEQ ID NO: 1127709 - RNA, 26 nt, Human
ugagagcacacccacggggaauggug

SEQ ID NO: 1127710 - RNA, 22 nt, Human
ugagccgagauugcaccaccgc

SEQ ID NO: 1127711 - RNA, 20 nt, Human
ugaggcaggagaaucacuug

SEQ ID NO: 1127712 - RNA, 24 nt, Human
ugaggcaggagaaucacuugaacc

SEQ ID NO: 1127713 - RNA, 25 nt, Human
ugaggcaggagaaucacuugaaccu

SEQ ID NO: 1127714 - RNA, 21 nt, Human
ugcaccaccgcacuccagccu

SEQ ID NO: 1127715 - RNA, 18 nt, Human
ugcagugugaaggucggu

SEQ ID NO: 1127716 - RNA, 24 nt, Human
ugccacugcacuccagcuugggug

SEQ ID NO: 1127717 - RNA, 20 nt, Human
ugccugccucgugcugcugu

SEQ ID NO: 1127718 - RNA, 23 nt, Human
ugccuguaaucccagcacuuugg

SEQ ID NO: 1127719 - RNA, 23 nt, Human
ugccuguaaucccagcacuuugg

SEQ ID NO: 1127720 - RNA, 24 nt, Human
ugccuguaaucccagcacuuuggg

SEQ ID NO: 1127721 - RNA, 18 nt, Human
ugcuauaacugagcaagg

SEQ ID NO: 1127722 - RNA, 24 nt, Human
uggacugaacaaugggcacccgga

SEQ ID NO: 1127723 - RNA, 22 nt, Human
uggaucacuugaggucaggagu

SEQ ID NO: 1127724 - RNA, 24 nt, Human
uggaucacuugaggucaggaguuc

SEQ ID NO: 1127725 - RNA, 26 nt, Human
uggaucacuugaggucaggaguucga

SEQ ID NO: 1127726 - RNA, 18 nt, Human
uggcagagugagacuuca

SEQ ID NO: 1127727 - RNA, 24 nt, Human
uggcucacgccuguaaucccagca

SEQ ID NO: 1127728 - RNA, 22 nt, Human
uggcucaugccuguaaucccag

SEQ ID NO: 1127729 - RNA, 24 nt, Human
uggcucaugccuguaaucccagca

SEQ ID NO: 1127730 - RNA, 19 nt, Human
uggcugaacugcggccccu

SEQ ID NO: 1127731 - RNA, 24 nt, Human
uggcugggagggcaggugggggga

SEQ ID NO: 1127732 - RNA, 24 nt, Human
ugggaggccaaggccaguggauca

SEQ ID NO: 1127733 - RNA, 18 nt, Human
ugggaggccgaggcgggc

SEQ ID NO: 1127734 - RNA, 19 nt, Human
ugggaggccgaggcgggcg

SEQ ID NO: 1127735 - RNA, 21 nt, Human
ugggaggccgaggcgggcggc

SEQ ID NO: 1127736 - RNA, 20 nt, Human
ugggagguggagguuguggu

SEQ ID NO: 1127737 - RNA, 24 nt, Human
ugggagguggagguuguggugagc

SEQ ID NO: 1127738 - RNA, 18 nt, Human
ugggauguggugacccag

SEQ ID NO: 1127739 - RNA, 20 nt, Human
ugggccuaugccaugugcac

SEQ ID NO: 1127740 - RNA, 24 nt, Human
uggggcaggagaauugcuugaacc

SEQ ID NO: 1127741 - RNA, 20 nt, Human
ugggguguggcugggagggc

SEQ ID NO: 1127742 - RNA, 23 nt, Human
ugguggcacacaccuguaauccc

SEQ ID NO: 1127743 - RNA, 24 nt, Human
ugguggcacacaccuguaauccca

SEQ ID NO: 1127744 - RNA, 19 nt, Human
uguggucaaagcccaccac

SEQ ID NO: 1127745 - RNA, 21 nt, Human
uguggucaaagcccaccacuc

SEQ ID NO: 1127746 - RNA, 19 nt, Human
uuacugggccuaugccaug

SEQ ID NO: 1127747 - RNA, 18 nt, Human
uuagcugggcaugguggc

SEQ ID NO: 1127748 - RNA, 20 nt, Human
uuagcugggcaugguggcgc

SEQ ID NO: 1127749 - RNA, 18 nt, Human
uucaagaccagccuggcc

SEQ ID NO: 1127750 - RNA, 24 nt, Human
uucccgggccucagucccgggaac

SEQ ID NO: 1127751 - RNA, 24 nt, Human
uugaaccugggagguggagguugu

SEQ ID NO: 1127752 - RNA, 22 nt, Human
uugcagugaaccgagaucgugc

SEQ ID NO: 1127753 - RNA, 18 nt, Human
uugcuugaaccuaggagg

SEQ ID NO: 1127754 - RNA, 24 nt, Human
uugcuugaaccuaggaggccaagg

SEQ ID NO: 1127755 - RNA, 18 nt, Human
uuguggugagccgagauu

SEQ ID NO: 1127756 - RNA, 22 nt, Human
uuguggugagccgagauugcac

SEQ ID NO: 1127757 - RNA, 20 nt, Human
cagagcuguccacacucucc

SEQ ID NO: 1127758 - RNA, 18 nt, Human
caggcccugugguggugg

SEQ ID NO: 1127759 - RNA, 21 nt, Human
ccaguggccuucugugcccgg

SEQ ID NO: 1127760 - RNA, 19 nt, Human
cccauggcccgccccggga

SEQ ID NO: 1127761 - RNA, 22 nt, Human
ccccgggacagccaguuguccu

SEQ ID NO: 1127762 - RNA, 22 nt, Human
cuguccacacucucccgggacc

SEQ ID NO: 1127763 - RNA, 21 nt, Human
gacagccaguuguccuggagc

SEQ ID NO: 1127764 - RNA, 18 nt, Human
gagcaggcucucacuucc

SEQ ID NO: 1127765 - RNA, 21 nt, Human
gcagggccugggcccauggcc

SEQ ID NO: 1127766 - RNA, 18 nt, Human
ggcacggcacaggcccug

SEQ ID NO: 1127767 - RNA, 20 nt, Human
ggcacggcacaggcccugug

SEQ ID NO: 1127768 - RNA, 21 nt, Human
ggcccgccccgggacagccag

SEQ ID NO: 1127769 - RNA, 20 nt, Human
ggccuccgggccaguggccu

SEQ ID NO: 1127770 - RNA, 20 nt, Human
gggcacggcacaggcccugu

SEQ ID NO: 1127771 - RNA, 21 nt, Human
ggggcugggguuugcagggga

SEQ ID NO: 1127772 - RNA, 19 nt, Human
uccacacucucccgggacc

SEQ ID NO: 1127773 - RNA, 20 nt, Human
uggcagggccugggcccaug

SEQ ID NO: 1127774 - RNA, 24 nt, Human
aaagugcugggauuacaggcguga

SEQ ID NO: 1127775 - RNA, 21 nt, Human
aacaagaauaacaugcuccac

SEQ ID NO: 1127776 - RNA, 23 nt, Human
aaccaagcccacuaccgcuuagc

SEQ ID NO: 1127777 - RNA, 22 nt, Human
aaggaccuucagaaacaagaau

SEQ ID NO: 1127778 - RNA, 19 nt, Human
aagugcugggauuacaggc

SEQ ID NO: 1127779 - RNA, 19 nt, Human
aagugcugggauuacaggc

SEQ ID NO: 1127780 - RNA, 26 nt, Human
aagugcugggauuacaggcgugagcc

SEQ ID NO: 1127781 - RNA, 23 nt, Human
acaagacggccugugccaggucc

SEQ ID NO: 1127782 - RNA, 25 nt, Human
acaggugcucaccaccacgccugac

SEQ ID NO: 1127783 - RNA, 24 nt, Human
accacagucuacuaaacaucauca

SEQ ID NO: 1127784 - RNA, 19 nt, Human
accugcagcuggcgcuugu

SEQ ID NO: 1127785 - RNA, 22 nt, Human
acugcaaccucugccucccagg

SEQ ID NO: 1127786 - RNA, 23 nt, Human
agagaaacagccugagccacagg

SEQ ID NO: 1127787 - RNA, 24 nt, Human
agcaggccggggaggagccucggc

SEQ ID NO: 1127788 - RNA, 21 nt, Human
agcuccaugacccugggccuc

SEQ ID NO: 1127789 - RNA, 18 nt, Human
agcuccuccugggcagcc

SEQ ID NO: 1127790 - RNA, 18 nt, Human
aggagcgccgcggugggg

SEQ ID NO: 1127791 - RNA, 20 nt, Human
aggagcgccgcgguggggaa

SEQ ID NO: 1127792 - RNA, 24 nt, Human
aggcgaucugccugccuuggccuc

SEQ ID NO: 1127793 - RNA, 24 nt, Human
aguacaguggugcgauccuggcug

SEQ ID NO: 1127794 - RNA, 18 nt, Human
aguagcugggauuacagg

SEQ ID NO: 1127795 - RNA, 18 nt, Human
agugcugggauuacaggc

SEQ ID NO: 1127796 - RNA, 18 nt, Human
aucagggcgagcguggag

SEQ ID NO: 1127797 - RNA, 21 nt, Human
aucugaaggguccuggcaggg

SEQ ID NO: 1127798 - RNA, 22 nt, Human
augacccugggccuccguuuuc

SEQ ID NO: 1127799 - RNA, 21 nt, Human
augcugggcuggggaccaggc

SEQ ID NO: 1127800 - RNA, 18 nt, Human
augggucugguuagaaaa

SEQ ID NO: 1127801 - RNA, 21 nt, Human
auucuccugccucagccuccc

SEQ ID NO: 1127802 - RNA, 24 nt, Human
auuuuuguaguuuuaguagagacg

SEQ ID NO: 1127803 - RNA, 21 nt, Human
caaagugcugggauuacaggc

SEQ ID NO: 1127804 - RNA, 24 nt, Human
caaagugcugggauuacaggcgug

SEQ ID NO: 1127805 - RNA, 25 nt, Human
caaccaagcccacuaccgcuuagcu

SEQ ID NO: 1127806 - RNA, 24 nt, Human
caagacggccugugccaggucccu

SEQ ID NO: 1127807 - RNA, 22 nt, Human
caagcaauucuccugccucagc

SEQ ID NO: 1127808 - RNA, 22 nt, Human
cagcgagaugcugggcugggga

SEQ ID NO: 1127809 - RNA, 18 nt, Human
cagcgccucccucaccuc

SEQ ID NO: 1127810 - RNA, 18 nt, Human
cagcuccucggccugcug

SEQ ID NO: 1127811 - RNA, 20 nt, Human
caggacccagugggugucac

SEQ ID NO: 1127812 - RNA, 19 nt, Human
caggugcucaccaccacgc

SEQ ID NO: 1127813 - RNA, 21 nt, Human
cauguccuggaccugcagcug

SEQ ID NO: 1127814 - RNA, 19 nt, Human
ccacguuggucaggcuggu

SEQ ID NO: 1127815 - RNA, 21 nt, Human
ccagcgagaugcugggcuggg

SEQ ID NO: 1127816 - RNA, 23 nt, Human
cccagguucaagcaauucuccug

SEQ ID NO: 1127817 - RNA, 23 nt, Human
cccgaguagcugggauuacaggu

SEQ ID NO: 1127818 - RNA, 24 nt, Human
cccgaguagcugggauuacaggug

SEQ ID NO: 1127819 - RNA, 21 nt, Human
ccgaguagcugggauuacagg

SEQ ID NO: 1127820 - RNA, 20 nt, Human
ccgcagcuccuccugggcag

SEQ ID NO: 1127821 - RNA, 18 nt, Human
ccucacucagcuguuccu

SEQ ID NO: 1127822 - RNA, 22 nt, Human
ccucacucagcuguuccuucuc

SEQ ID NO: 1127823 - RNA, 24 nt, Human
ccucccagguucaagcaauucucc

SEQ ID NO: 1127824 - RNA, 24 nt, Human
ccucgcgcugggcgugcucguggg

SEQ ID NO: 1127825 - RNA, 22 nt, Human
ccucuagggcccgccgcucgcu

SEQ ID NO: 1127826 - RNA, 21 nt, Human
ccugaccucaggcgaucugcc

SEQ ID NO: 1127827 - RNA, 25 nt, Human
ccugcacugcguccuccugcucuuc

SEQ ID NO: 1127828 - RNA, 25 nt, Human
ccugcagcuggcgcuugugcagggc

SEQ ID NO: 1127829 - RNA, 20 nt, Human
ccugcagcuucucccgcucc

SEQ ID NO: 1127830 - RNA, 19 nt, Human
ccugccgcagcuccucggc

SEQ ID NO: 1127831 - RNA, 23 nt, Human
ccugccucagccucccgaguagc

SEQ ID NO: 1127832 - RNA, 24 nt, Human
ccugccucagccucccgaguagcu

SEQ ID NO: 1127833 - RNA, 22 nt, Human
ccugccuuggccucucaaagug

SEQ ID NO: 1127834 - RNA, 21 nt, Human
ccuguagccagcgagaugcug

SEQ ID NO: 1127835 - RNA, 25 nt, Human
ccuguagccgcagggauuccagggc

SEQ ID NO: 1127836 - RNA, 20 nt, Human
ccuuagggucugcuguagcc

SEQ ID NO: 1127837 - RNA, 25 nt, Human
ccuucugccgggccagcagcuccuc

SEQ ID NO: 1127838 - RNA, 23 nt, Human
cuaaccccacggggggcacuguc

SEQ ID NO: 1127839 - RNA, 24 nt, Human
cucagccucccgaguagcugggau

SEQ ID NO: 1127840 - RNA, 19 nt, Human
cuccagggccaccugcucc

SEQ ID NO: 1127841 - RNA, 19 nt, Human
cuccaugacccugggccuc

SEQ ID NO: 1127842 - RNA, 26 nt, Human
cuccugaccucaggcgaucugccugc

SEQ ID NO: 1127843 - RNA, 22 nt, Human
cuccugccucagccucccgagu

SEQ ID NO: 1127844 - RNA, 18 nt, Human
cuccugcugcaggguagc

SEQ ID NO: 1127845 - RNA, 21 nt, Human
cucggccgggcgaggagcgcc

SEQ ID NO: 1127846 - RNA, 23 nt, Human
cucuaguugucuauggcuguggg

SEQ ID NO: 1127847 - RNA, 20 nt, Human
cucugcagcugggcccgcuc

SEQ ID NO: 1127848 - RNA, 19 nt, Human
cucuucugcuaacugugug

SEQ ID NO: 1127849 - RNA, 19 nt, Human
cugacagcgccaucuucuc

SEQ ID NO: 1127850 - RNA, 23 nt, Human
cugcaaccucugccucccagguu

SEQ ID NO: 1127851 - RNA, 24 nt, Human
cugcaaccucugccucccagguuc

SEQ ID NO: 1127852 - RNA, 21 nt, Human
cugcaccucgcgcugggcgug

SEQ ID NO: 1127853 - RNA, 21 nt, Human
cugcagcugggcccgcucggc

SEQ ID NO: 1127854 - RNA, 23 nt, Human
cugccgggccagcagcuccuccu

SEQ ID NO: 1127855 - RNA, 18 nt, Human
cugcuccugccggcucug

SEQ ID NO: 1127856 - RNA, 24 nt, Human
cuggaccugcagcuggcgcuugug

SEQ ID NO: 1127857 - RNA, 22 nt, Human
cuggacgccgcucucagagucu

SEQ ID NO: 1127858 - RNA, 18 nt, Human
cuggcgccgcagcuccuc

SEQ ID NO: 1127859 - RNA, 20 nt, Human
cugggccaccugcaggcugu

SEQ ID NO: 1127860 - RNA, 23 nt, Human
cugggcccgcucggccuccagcu

SEQ ID NO: 1127861 - RNA, 22 nt, Human
cuguagccccucuccguccucu

SEQ ID NO: 1127862 - RNA, 18 nt, Human
cugucacacaggcuggag

SEQ ID NO: 1127863 - RNA, 22 nt, Human
cugugccucaguuuaccaucca

SEQ ID NO: 1127864 - RNA, 20 nt, Human
cuuaaaaugguaucuggcac

SEQ ID NO: 1127865 - RNA, 21 nt, Human
cuucucgcucucggccaggag

SEQ ID NO: 1127866 - RNA, 24 nt, Human
cuuggccucucaaagugcugggau

SEQ ID NO: 1127867 - RNA, 20 nt, Human
gacaagacggccugugccag

SEQ ID NO: 1127868 - RNA, 23 nt, Human
gaccucaggcgaucugccugccu

SEQ ID NO: 1127869 - RNA, 20 nt, Human
gagacgggauuucuccacgu

SEQ ID NO: 1127870 - RNA, 18 nt, Human
gauuacaggcgugagcca

SEQ ID NO: 1127871 - RNA, 22 nt, Human
gauuacaggcgugagccacugc

SEQ ID NO: 1127872 - RNA, 22 nt, Human
gauuacaggcgugagccacugc

SEQ ID NO: 1127873 - RNA, 22 nt, Human
gcaaccucugccucccagguuc

SEQ ID NO: 1127874 - RNA, 19 nt, Human
gcagcugggcccgcucggc

SEQ ID NO: 1127875 - RNA, 19 nt, Human
gccccaguuuccugaaaug

SEQ ID NO: 1127876 - RNA, 22 nt, Human
gccgcugcaccucgcgcugggc

SEQ ID NO: 1127877 - RNA, 18 nt, Human
gccucaguuuaccaucca

SEQ ID NO: 1127878 - RNA, 18 nt, Human
gccucccucaccuccacc

SEQ ID NO: 1127879 - RNA, 22 nt, Human
gccuuggccucucaaagugcug

SEQ ID NO: 1127880 - RNA, 19 nt, Human
gcucaccaccacgccugac

SEQ ID NO: 1127881 - RNA, 29 nt, Human
gcuccuuggccaggacugagcgcuucccc

SEQ ID NO: 1127882 - RNA, 23 nt, Human
gcuggucuggaacuccugaccuc

SEQ ID NO: 1127883 - RNA, 20 nt, Human
ggagaugguggccaggcugu

SEQ ID NO: 1127884 - RNA, 20 nt, Human
ggccugaggcaggaguuugg

SEQ ID NO: 1127885 - RNA, 24 nt, Human
ggccugcugcugggccaccugcag

SEQ ID NO: 1127886 - RNA, 21 nt, Human
ggcucuucugcuaacugugug

SEQ ID NO: 1127887 - RNA, 24 nt, Human
ggcuggucuggaacuccugaccuc

SEQ ID NO: 1127888 - RNA, 21 nt, Human
gguccagacgguaggaggccc

SEQ ID NO: 1127889 - RNA, 19 nt, Human
guuagaaaacccgacauca

SEQ ID NO: 1127890 - RNA, 23 nt, Human
uaacugugugaccuggggcaagu

SEQ ID NO: 1127891 - RNA, 25 nt, Human
uaagugacuauaccucccugagccc

SEQ ID NO: 1127892 - RNA, 24 nt, Human
uaauuuuuguaguuuuaguagaga

SEQ ID NO: 1127893 - RNA, 19 nt, Human
uacaggcgugagccacugc

SEQ ID NO: 1127894 - RNA, 23 nt, Human
uacaggcgugagccacugcgccc

SEQ ID NO: 1127895 - RNA, 22 nt, Human
uacaggugcucaccaccacgcc

SEQ ID NO: 1127896 - RNA, 21 nt, Human
uagcaaucuccucacucagcu

SEQ ID NO: 1127897 - RNA, 22 nt, Human
uagccagcgagaugcugggcug

SEQ ID NO: 1127898 - RNA, 19 nt, Human
uaguagagacgggauuucu

SEQ ID NO: 1127899 - RNA, 24 nt, Human
uaguagagacgggauuucuccacg

SEQ ID NO: 1127900 - RNA, 20 nt, Human
uaucauggaguuaaaugaga

SEQ ID NO: 1127901 - RNA, 25 nt, Human
uaucauggaguuaaaugagagaacu

SEQ ID NO: 1127902 - RNA, 22 nt, Human
ucaaagugcugggauuacaggc

SEQ ID NO: 1127903 - RNA, 24 nt, Human
ucaaagugcugggauuacaggcgu

SEQ ID NO: 1127904 - RNA, 20 nt, Human
ucacaucugcaaaaugaggu

SEQ ID NO: 1127905 - RNA, 23 nt, Human
ucacucagcuguuccuuccucgg

SEQ ID NO: 1127906 - RNA, 20 nt, Human
ucagccucccgaguagcugg

SEQ ID NO: 1127907 - RNA, 20 nt, Human
ucaugcuccugcugcagggu

SEQ ID NO: 1127908 - RNA, 23 nt, Human
uccaccacagucuacuaaacauc

SEQ ID NO: 1127909 - RNA, 22 nt, Human
uccagccggucccgcuggcgcc

SEQ ID NO: 1127910 - RNA, 21 nt, Human
ucccagguucaagcaauucuc

SEQ ID NO: 1127911 - RNA, 24 nt, Human
ucccagguucaagcaauucuccug

SEQ ID NO: 1127912 - RNA, 23 nt, Human
ucccgaguagcugggauuacagg

SEQ ID NO: 1127913 - RNA, 24 nt, Human
ucccgaguagcugggauuacaggu

SEQ ID NO: 1127914 - RNA, 19 nt, Human
ucccgccaugcugccuccu

SEQ ID NO: 1127915 - RNA, 21 nt, Human
ucccgcuggcgccgcagcucc

SEQ ID NO: 1127916 - RNA, 24 nt, Human
uccuccugggcagccugcagcuuc

SEQ ID NO: 1127917 - RNA, 25 nt, Human
ucgcuaagcugcuuccgcagggugc

SEQ ID NO: 1127918 - RNA, 20 nt, Human
ucggcggggugaacggccuc

SEQ ID NO: 1127919 - RNA, 24 nt, Human
ucucaaagugcugggauuacaggc

SEQ ID NO: 1127920 - RNA, 18 nt, Human
ucucugacagcgccaucu

SEQ ID NO: 1127921 - RNA, 23 nt, Human
ucugcagcugggcccgcucggcc

SEQ ID NO: 1127922 - RNA, 24 nt, Human
ucugcuaacugugugaccuggggc

SEQ ID NO: 1127923 - RNA, 19 nt, Human
ucuugcucugucacacagg

SEQ ID NO: 1127924 - RNA, 23 nt, Human
ucuugcucugucacacaggcugg

SEQ ID NO: 1127925 - RNA, 24 nt, Human
ucuugcucugucacacaggcugga

SEQ ID NO: 1127926 - RNA, 18 nt, Human
ugacaagacggccugugc

SEQ ID NO: 1127927 - RNA, 18 nt, Human
ugaccucaggcgaucugc

SEQ ID NO: 1127928 - RNA, 20 nt, Human
ugaccucaggcgaucugccu

SEQ ID NO: 1127929 - RNA, 21 nt, Human
ugaccucaggcgaucugccug

SEQ ID NO: 1127930 - RNA, 24 nt, Human
ugaccucaggcgaucugccugccu

SEQ ID NO: 1127931 - RNA, 19 nt, Human
ugacugcaaccucugccuc

SEQ ID NO: 1127932 - RNA, 24 nt, Human
ugacugcaaccucugccucccagg

SEQ ID NO: 1127933 - RNA, 21 nt, Human
ugaggcaggaguuuggagaga

SEQ ID NO: 1127934 - RNA, 22 nt, Human
ugaggcaggaguuuggagagaa

SEQ ID NO: 1127935 - RNA, 21 nt, Human
ugcacugcguccuccugcucu

SEQ ID NO: 1127936 - RNA, 18 nt, Human
ugcagcuucucccgcucc

SEQ ID NO: 1127937 - RNA, 20 nt, Human
ugccccgaaccuccuguagc

SEQ ID NO: 1127938 - RNA, 23 nt, Human
ugccccgaaccuccuguagccag

SEQ ID NO: 1127939 - RNA, 18 nt, Human
ugccgcuccaucuccagg

SEQ ID NO: 1127940 - RNA, 24 nt, Human
ugccucagccucccgaguagcugg

SEQ ID NO: 1127941 - RNA, 24 nt, Human
ugccugacacaucuccccaaggac

SEQ ID NO: 1127942 - RNA, 21 nt, Human
ugccuuggccucucaaagugc

SEQ ID NO: 1127943 - RNA, 24 nt, Human
ugcugggauuacaggcgugagcca

SEQ ID NO: 1127944 - RNA, 24 nt, Human
uggaguacaguggugcgauccugg

SEQ ID NO: 1127945 - RNA, 20 nt, Human
uggcccgagagcccccgcag

SEQ ID NO: 1127946 - RNA, 23 nt, Human
uggcgccgcagcuccuccugggc

SEQ ID NO: 1127947 - RNA, 18 nt, Human
ugggauuacaggcgugag

SEQ ID NO: 1127948 - RNA, 19 nt, Human
ugggauuacaggcgugagc

SEQ ID NO: 1127949 - RNA, 21 nt, Human
ugggauuacaggcgugagcca

SEQ ID NO: 1127950 - RNA, 22 nt, Human
ugggauuacaggcgugagccac

SEQ ID NO: 1127951 - RNA, 22 nt, Human
ugggauuacaggcgugagccac

SEQ ID NO: 1127952 - RNA, 24 nt, Human
ugggauuacaggcgugagccacug

SEQ ID NO: 1127953 - RNA, 26 nt, Human
ugggauuacaggcgugagccacugcg

SEQ ID NO: 1127954 - RNA, 19 nt, Human
ugggauuacaggugcucac

SEQ ID NO: 1127955 - RNA, 21 nt, Human
ugggauuacaggugcucacca

SEQ ID NO: 1127956 - RNA, 24 nt, Human
ugggauuacaggugcucaccacca

SEQ ID NO: 1127957 - RNA, 19 nt, Human
ugggccugcauggcgccgu

SEQ ID NO: 1127958 - RNA, 21 nt, Human
uggguggguggcccaugucac

SEQ ID NO: 1127959 - RNA, 26 nt, Human
uggguggguggcccauguuguaauga

SEQ ID NO: 1127960 - RNA, 24 nt, Human
uggucaggcuggucuggaacuccu

SEQ ID NO: 1127961 - RNA, 23 nt, Human
uggucuggaacuccugaccucag

SEQ ID NO: 1127962 - RNA, 21 nt, Human
ugguuucugccgcuccaucuc

SEQ ID NO: 1127963 - RNA, 21 nt, Human
ugucacagaguuaucauggag

SEQ ID NO: 1127964 - RNA, 18 nt, Human
uuaguagagacgggauuu

SEQ ID NO: 1127965 - RNA, 21 nt, Human
uucaagcaauucuccugccuc

SEQ ID NO: 1127966 - RNA, 24 nt, Human
uucaagcaauucuccugccucagc

SEQ ID NO: 1127967 - RNA, 22 nt, Human
uuccagggccucaagcuucuca

SEQ ID NO: 1127968 - RNA, 27 nt, Human
uuccugaaaugggucugguuagaaaaa

SEQ ID NO: 1127969 - RNA, 24 nt, Human
uuguuuguuuuuuugagacacagu

SEQ ID NO: 1127970 - RNA, 18 nt, Human
uuuuguaguuuuaguaga

SEQ ID NO: 1127971 - RNA, 20 nt, Human
uuuuuguaguuuuaguagag

SEQ ID NO: 1127972 - RNA, 21 nt, Human
cacugauuaggggugcggagg

SEQ ID NO: 1127973 - RNA, 22 nt, Human
ccucugugaguucagcaaggau

SEQ ID NO: 1127974 - RNA, 18 nt, Human
ugauuugaagcugugauu

SEQ ID NO: 1127975 - RNA, 24 nt, Human
ugugucucaucaugucacacugau

SEQ ID NO: 1127976 - RNA, 19 nt, Human
aaaauucaacuacuaaagg

SEQ ID NO: 1127977 - RNA, 19 nt, Human
aaacgagcugacacaaacc

SEQ ID NO: 1127978 - RNA, 21 nt, Human
aaacgagcugacacaaaccca

SEQ ID NO: 1127979 - RNA, 25 nt, Human
aaacgagcugacacaaaccggaccc

SEQ ID NO: 1127980 - RNA, 21 nt, Human
aaacucacagacaucgcacca

SEQ ID NO: 1127981 - RNA, 21 nt, Human
aaaguccuccucaccaugcuu

SEQ ID NO: 1127982 - RNA, 22 nt, Human
acaagcccggcuauccccaaau

SEQ ID NO: 1127983 - RNA, 24 nt, Human
acccuauacugcuccucgcuccuc

SEQ ID NO: 1127984 - RNA, 24 nt, Human
acugcagcagcaugcugaggccca

SEQ ID NO: 1127985 - RNA, 25 nt, Human
agagcccccucagcccugaugucuc

SEQ ID NO: 1127986 - RNA, 19 nt, Human
agauaacagcaagaugaga

SEQ ID NO: 1127987 - RNA, 21 nt, Human
agauaacagcaagaugagaca

SEQ ID NO: 1127988 - RNA, 20 nt, Human
agcacgugucacgaggaagu

SEQ ID NO: 1127989 - RNA, 21 nt, Human
agcacgugucacgaggaaguu

SEQ ID NO: 1127990 - RNA, 21 nt, Human
agccagagcccccucagcccu

SEQ ID NO: 1127991 - RNA, 19 nt, Human
aggauccauccuccugccu

SEQ ID NO: 1127992 - RNA, 20 nt, Human
aggcagguggagcacaggga

SEQ ID NO: 1127993 - RNA, 21 nt, Human
aggcagguggagcacagggag

SEQ ID NO: 1127994 - RNA, 22 nt, Human
aggcagguggagcacagggagg

SEQ ID NO: 1127995 - RNA, 18 nt, Human
aggccaggcgccugccac

SEQ ID NO: 1127996 - RNA, 19 nt, Human
auccauccuccugccucca

SEQ ID NO: 1127997 - RNA, 19 nt, Human
caaggaugcugcaggcaac

SEQ ID NO: 1127998 - RNA, 24 nt, Human
caaggccaggcgccugccacgcuu

SEQ ID NO: 1127999 - RNA, 23 nt, Human
caaucaaaguccuccucaccaug

SEQ ID NO: 1128000 - RNA, 21 nt, Human
caccaugcuuuagcacguguc

SEQ ID NO: 1128001 - RNA, 22 nt, Human
cacccagggaaacagagaaaga

SEQ ID NO: 1128002 - RNA, 19 nt, Human
caccgcucacaagcccggc

SEQ ID NO: 1128003 - RNA, 21 nt, Human
caccugcaagguccuggcagc

SEQ ID NO: 1128004 - RNA, 22 nt, Human
cacugcagcugcugacucugcc

SEQ ID NO: 1128005 - RNA, 20 nt, Human
cagagaaagaggcuuccuuc

SEQ ID NO: 1128006 - RNA, 19 nt, Human
cagcaagaugagacacgau

SEQ ID NO: 1128007 - RNA, 19 nt, Human
cagcagugaccugaaccgc

SEQ ID NO: 1128008 - RNA, 24 nt, Human
cagcccacacgcugggcaggucaa

SEQ ID NO: 1128009 - RNA, 22 nt, Human
caggaaaugcuccuccuccucc

SEQ ID NO: 1128010 - RNA, 22 nt, Human
cagggccuggagaugcuaaaug

SEQ ID NO: 1128011 - RNA, 20 nt, Human
cauggacccuauacugcucc

SEQ ID NO: 1128012 - RNA, 19 nt, Human
ccacaaagaaggcccgcag

SEQ ID NO: 1128013 - RNA, 21 nt, Human
ccaccugccagcccccucacc

SEQ ID NO: 1128014 - RNA, 24 nt, Human
cccaaucaaaguccuccucaccau

SEQ ID NO: 1128015 - RNA, 22 nt, Human
cccaucuccccccaggccccaa

SEQ ID NO: 1128016 - RNA, 25 nt, Human
ccccaggccccaaggaaaggguccc

SEQ ID NO: 1128017 - RNA, 23 nt, Human
ccccaucuccccccaggccccaa

SEQ ID NO: 1128018 - RNA, 20 nt, Human
cccccaaaacacgccucggg

SEQ ID NO: 1128019 - RNA, 25 nt, Human
cccccaaaacacgccucggggugaa

SEQ ID NO: 1128020 - RNA, 24 nt, Human
cccccaggccccaaggaaaggguc

SEQ ID NO: 1128021 - RNA, 22 nt, Human
ccccuccuccuucucagccucc

SEQ ID NO: 1128022 - RNA, 18 nt, Human
cccuccuccuucucagcc

SEQ ID NO: 1128023 - RNA, 19 nt, Human
ccgacuuugcaauccuguc

SEQ ID NO: 1128024 - RNA, 24 nt, Human
ccgcgcaaguccuggcagcugcgc

SEQ ID NO: 1128025 - RNA, 22 nt, Human
ccuagcggcggugcgcuccucc

SEQ ID NO: 1128026 - RNA, 19 nt, Human
ccucagggagccccuccuc

SEQ ID NO: 1128027 - RNA, 18 nt, Human
ccuccaaccccugcccug

SEQ ID NO: 1128028 - RNA, 22 nt, Human
ccuccagcucugggacugccac

SEQ ID NO: 1128029 - RNA, 20 nt, Human
ccuccuucucagccuccugc

SEQ ID NO: 1128030 - RNA, 22 nt, Human
ccuccuucucagccuccugcag

SEQ ID NO: 1128031 - RNA, 25 nt, Human
ccugcagcagugaccugaaccgcuc

SEQ ID NO: 1128032 - RNA, 18 nt, Human
ccugccagcccccucacc

SEQ ID NO: 1128033 - RNA, 26 nt, Human
cgaagcaaacgagcugacacaaaccc

SEQ ID NO: 1128034 - RNA, 19 nt, Human
cgacuuugcaauccugucc

SEQ ID NO: 1128035 - RNA, 21 nt, Human
cgcaaguccuggcagcugcgc

SEQ ID NO: 1128036 - RNA, 19 nt, Human
cgcccugccugccugcagc

SEQ ID NO: 1128037 - RNA, 19 nt, Human
cgggguggagccccaucuc

SEQ ID NO: 1128038 - RNA, 23 nt, Human
cuaaaugggguuagccaccugcc

SEQ ID NO: 1128039 - RNA, 20 nt, Human
cuauacugcuccucgcuccu

SEQ ID NO: 1128040 - RNA, 22 nt, Human
cucacaagcccggcuaucccca

SEQ ID NO: 1128041 - RNA, 19 nt, Human
cuccaaccccugcccugcu

SEQ ID NO: 1128042 - RNA, 21 nt, Human
cuccuccgccuugauuuuggc

SEQ ID NO: 1128043 - RNA, 20 nt, Human
cugacucugccuggccaugc

SEQ ID NO: 1128044 - RNA, 19 nt, Human
cugcuacaagcuuugcaaa

SEQ ID NO: 1128045 - RNA, 23 nt, Human
cugcuccucgcuccuccaacccc

SEQ ID NO: 1128046 - RNA, 19 nt, Human
cuucccauggagaugagga

SEQ ID NO: 1128047 - RNA, 24 nt, Human
gacacuggaggguggccagggcag

SEQ ID NO: 1128048 - RNA, 19 nt, Human
gaccugaaccgcucagugg

SEQ ID NO: 1128049 - RNA, 18 nt, Human
gagaaagaggcuuccuuc

SEQ ID NO: 1128050 - RNA, 20 nt, Human
gaggagggaaagagcuagag

SEQ ID NO: 1128051 - RNA, 19 nt, Human
gccagggcagggggaagag

SEQ ID NO: 1128052 - RNA, 24 nt, Human
gccccaucuccccccaggccccaa

SEQ ID NO: 1128053 - RNA, 19 nt, Human
gcccccucacccagggaaa

SEQ ID NO: 1128054 - RNA, 24 nt, Human
gcccugccugccugcagcaaggac

SEQ ID NO: 1128055 - RNA, 21 nt, Human
gcgaugcuucuucuccagcuc

SEQ ID NO: 1128056 - RNA, 21 nt, Human
gcuccucgcuccuccaacccc

SEQ ID NO: 1128057 - RNA, 20 nt, Human
gcugaaaggcuucaucugga

SEQ ID NO: 1128058 - RNA, 19 nt, Human
gcuucacucuacugccugc

SEQ ID NO: 1128059 - RNA, 21 nt, Human
ggaaaugggaggagggaaaga

SEQ ID NO: 1128060 - RNA, 20 nt, Human
ggacucugugagguggguuu

SEQ ID NO: 1128061 - RNA, 19 nt, Human
ggcagcggcgcacgucacc

SEQ ID NO: 1128062 - RNA, 21 nt, Human
ggcagggggaagaggccaggu

SEQ ID NO: 1128063 - RNA, 20 nt, Human
ggccaggcgccugccacgcu

SEQ ID NO: 1128064 - RNA, 19 nt, Human
ggccagguggacacacgga

SEQ ID NO: 1128065 - RNA, 19 nt, Human
gucaccgcgcaaguccugg

SEQ ID NO: 1128066 - RNA, 21 nt, Human
gucauucccacccauggaccc

SEQ ID NO: 1128067 - RNA, 21 nt, Human
guccaucacgugucccuucca

SEQ ID NO: 1128068 - RNA, 21 nt, Human
guccccagugcugaguuucug

SEQ ID NO: 1128069 - RNA, 19 nt, Human
guccccgacuuugcaaucc

SEQ ID NO: 1128070 - RNA, 19 nt, Human
gucccuuccacacugcagc

SEQ ID NO: 1128071 - RNA, 19 nt, Human
guggagccccaucuccccc

SEQ ID NO: 1128072 - RNA, 25 nt, Human
uagguccuggccgcggugggcuucu

SEQ ID NO: 1128073 - RNA, 20 nt, Human
uauccccaaaucucaacaac

SEQ ID NO: 1128074 - RNA, 20 nt, Human
ucaauggucccaaucaaagu

SEQ ID NO: 1128075 - RNA, 19 nt, Human
ucacugcagcagcaugcug

SEQ ID NO: 1128076 - RNA, 21 nt, Human
ucagggagccccuccuccuuc

SEQ ID NO: 1128077 - RNA, 19 nt, Human
uccacaaagaaggcccgca

SEQ ID NO: 1128078 - RNA, 21 nt, Human
ucccaaucaaaguccuccuca

SEQ ID NO: 1128079 - RNA, 18 nt, Human
uccccaaaucucaacaac

SEQ ID NO: 1128080 - RNA, 24 nt, Human
ucccuggcagccacacgcugacac

SEQ ID NO: 1128081 - RNA, 20 nt, Human
uccgagaccgccugcagcag

SEQ ID NO: 1128082 - RNA, 21 nt, Human
ugagccagcccacacgcuggg

SEQ ID NO: 1128083 - RNA, 18 nt, Human
ugcccugcuacgucgggg

SEQ ID NO: 1128084 - RNA, 22 nt, Human
ugccuccagcucugggacugcc

SEQ ID NO: 1128085 - RNA, 19 nt, Human
ugcuacaagcuuugcaaaa

SEQ ID NO: 1128086 - RNA, 23 nt, Human
uggcagggccuggagaugcuaaa

SEQ ID NO: 1128087 - RNA, 23 nt, Human
uggggucagccagcucguccucc

SEQ ID NO: 1128088 - RNA, 19 nt, Human
uguagauggacccaaggcc

SEQ ID NO: 1128089 - RNA, 20 nt, Human
uguagauggacccaaggcca

SEQ ID NO: 1128090 - RNA, 20 nt, Human
uguccccgacuuugcaaucc

SEQ ID NO: 1128091 - RNA, 20 nt, Human
uucuccagcuccgagaccgc

SEQ ID NO: 1128092 - RNA, 21 nt, Human
uuugcagcccccaaaacacgc

SEQ ID NO: 1128093 - RNA, 22 nt, Human
aaacaucccggaaaaagaaccc

SEQ ID NO: 1128094 - RNA, 18 nt, Human
aagcauggucaaaaucgc

SEQ ID NO: 1128095 - RNA, 22 nt, Human
aaugacaggggugaagggcaga

SEQ ID NO: 1128096 - RNA, 19 nt, Human
acagaacaccacuaaugaa

SEQ ID NO: 1128097 - RNA, 18 nt, Human
acagacgugugccaccgc

SEQ ID NO: 1128098 - RNA, 20 nt, Human
accucaagcccagcaacagc

SEQ ID NO: 1128099 - RNA, 20 nt, Human
acuccacaaguugagagaag

SEQ ID NO: 1128100 - RNA, 18 nt, Human
acugcuccucucucugcc

SEQ ID NO: 1128101 - RNA, 19 nt, Human
agaaaaugaagagagcagg

SEQ ID NO: 1128102 - RNA, 18 nt, Human
agacagagucucgcuaug

SEQ ID NO: 1128103 - RNA, 18 nt, Human
agagaaggucaacagucc

SEQ ID NO: 1128104 - RNA, 18 nt, Human
agccauccucccaucuca

SEQ ID NO: 1128105 - RNA, 22 nt, Human
agcugugugggucuccgucugg

SEQ ID NO: 1128106 - RNA, 18 nt, Human
aggcagggucugucagug

SEQ ID NO: 1128107 - RNA, 20 nt, Human
aggccccgcagccucugccc

SEQ ID NO: 1128108 - RNA, 20 nt, Human
agggggcuugggcuggucgu

SEQ ID NO: 1128109 - RNA, 23 nt, Human
aguagcugggacuacagacgugu

SEQ ID NO: 1128110 - RNA, 20 nt, Human
agugauaaaaagagcccuua

SEQ ID NO: 1128111 - RNA, 22 nt, Human
agugguggugcuggugccaagg

SEQ ID NO: 1128112 - RNA, 19 nt, Human
auaaaauauacauggaccc

SEQ ID NO: 1128113 - RNA, 18 nt, Human
auaccuuccagaggcacc

SEQ ID NO: 1128114 - RNA, 18 nt, Human
auagugcacugcaaccuc

SEQ ID NO: 1128115 - RNA, 24 nt, Human
aucccaccuccauuuacuccucug

SEQ ID NO: 1128116 - RNA, 22 nt, Human
aucccgccaccaagccagccug

SEQ ID NO: 1128117 - RNA, 21 nt, Human
aucuaucugugagaucuccau

SEQ ID NO: 1128118 - RNA, 23 nt, Human
aucuuacaacccaaccauggacu

SEQ ID NO: 1128119 - RNA, 24 nt, Human
aucuuacaacccaaccauggacua

SEQ ID NO: 1128120 - RNA, 21 nt, Human
auguagcaggaguuucaucca

SEQ ID NO: 1128121 - RNA, 19 nt, Human
auuacacagcuuagauucc

SEQ ID NO: 1128122 - RNA, 19 nt, Human
auuucuuccucuccuaauc

SEQ ID NO: 1128123 - RNA, 21 nt, Human
caaaccugagcaccuaacuag

SEQ ID NO: 1128124 - RNA, 20 nt, Human
caaaguaacccaaaccuucc

SEQ ID NO: 1128125 - RNA, 24 nt, Human
caaccucaaacuccugggcucaag

SEQ ID NO: 1128126 - RNA, 19 nt, Human
caagagcacaaaccugagc

SEQ ID NO: 1128127 - RNA, 21 nt, Human
caagcacacaggugucaccac

SEQ ID NO: 1128128 - RNA, 19 nt, Human
cacaaaccugagcaccuaa

SEQ ID NO: 1128129 - RNA, 22 nt, Human
cacagcuuagauuccuaaaccu

SEQ ID NO: 1128130 - RNA, 19 nt, Human
cacaugguggugggauggc

SEQ ID NO: 1128131 - RNA, 21 nt, Human
cacugcaaccucaaacuccug

SEQ ID NO: 1128132 - RNA, 23 nt, Human
cacugcaaccucaaacuccuggg

SEQ ID NO: 1128133 - RNA, 24 nt, Human
cagagucucgcuauguugcccagg

SEQ ID NO: 1128134 - RNA, 21 nt, Human
cagccucuuuuucuauguccc

SEQ ID NO: 1128135 - RNA, 22 nt, Human
cagcucacaaguggcaaagcca

SEQ ID NO: 1128136 - RNA, 23 nt, Human
cagcuccuggccccagcaggucc

SEQ ID NO: 1128137 - RNA, 21 nt, Human
caggauauagccccccccgcu

SEQ ID NO: 1128138 - RNA, 23 nt, Human
caguggugcuucaggaguuccaa

SEQ ID NO: 1128139 - RNA, 19 nt, Human
ccaagccagccugugaaaa

SEQ ID NO: 1128140 - RNA, 22 nt, Human
ccacagagccaguguagaagca

SEQ ID NO: 1128141 - RNA, 24 nt, Human
ccacuucugggucgcuaaggcgga

SEQ ID NO: 1128142 - RNA, 22 nt, Human
ccaggauauagccccccccgcu

SEQ ID NO: 1128143 - RNA, 21 nt, Human
cccaaaccuuccaccugccaa

SEQ ID NO: 1128144 - RNA, 21 nt, Human
cccacacaggaaguuuuggau

SEQ ID NO: 1128145 - RNA, 27 nt, Human
cccacagccgggugcaggccggggucc

SEQ ID NO: 1128146 - RNA, 19 nt, Human
cccacgugcagggagcagc

SEQ ID NO: 1128147 - RNA, 22 nt, Human
cccgcagccucugcccacagcc

SEQ ID NO: 1128148 - RNA, 24 nt, Human
cccuaccugcuuuuucucucccug

SEQ ID NO: 1128149 - RNA, 20 nt, Human
cccucuuccuccucuucauc

SEQ ID NO: 1128150 - RNA, 24 nt, Human
ccucccaucucagccugcugagua

SEQ ID NO: 1128151 - RNA, 20 nt, Human
ccucccugccuccuuuaauc

SEQ ID NO: 1128152 - RNA, 19 nt, Human
ccuccuccuuccccuccuc

SEQ ID NO: 1128153 - RNA, 19 nt, Human
ccuccucuucaucuuccuc

SEQ ID NO: 1128154 - RNA, 25 nt, Human
ccucucaccucccugccuccuuuaa

SEQ ID NO: 1128155 - RNA, 20 nt, Human
ccucugggcaaaaucuggag

SEQ ID NO: 1128156 - RNA, 20 nt, Human
ccugggcucaagccauccuc

SEQ ID NO: 1128157 - RNA, 25 nt, Human
cgcuauguugcccaggcugcagugc

SEQ ID NO: 1128158 - RNA, 21 nt, Human
cgugugccaccgcacccgagu

SEQ ID NO: 1128159 - RNA, 20 nt, Human
cuauguugcccaggcugcag

SEQ ID NO: 1128160 - RNA, 25 nt, Human
cucaagccauccucccaucucagcc

SEQ ID NO: 1128161 - RNA, 24 nt, Human
cucagccugcugaguagcugggac

SEQ ID NO: 1128162 - RNA, 21 nt, Human
cuccgcgggcuacugcuccuc

SEQ ID NO: 1128163 - RNA, 23 nt, Human
cuccugggcucaagccauccucc

SEQ ID NO: 1128164 - RNA, 20 nt, Human
cucucaccucccugccuccu

SEQ ID NO: 1128165 - RNA, 20 nt, Human
cucucccuucucccucuucc

SEQ ID NO: 1128166 - RNA, 21 nt, Human
cugaagccuggagaguugagg

SEQ ID NO: 1128167 - RNA, 23 nt, Human
cugcaaccucaaacuccugggcu

SEQ ID NO: 1128168 - RNA, 19 nt, Human
cuggccccuaauuugaccc

SEQ ID NO: 1128169 - RNA, 24 nt, Human
gaagcaagcacacaggugucacca

SEQ ID NO: 1128170 - RNA, 24 nt, Human
gagcagccuuuagagccagcagcu

SEQ ID NO: 1128171 - RNA, 25 nt, Human
gaguagcugggacuacagacgugug

SEQ ID NO: 1128172 - RNA, 22 nt, Human
gaguuggggugggugggaggcu

SEQ ID NO: 1128173 - RNA, 21 nt, Human
gaucugcuuucagucuucccc

SEQ ID NO: 1128174 - RNA, 28 nt, Human
gauggugaggguggcgugggggaagucc

SEQ ID NO: 1128175 - RNA, 24 nt, Human
gcacugcaaccucaaacuccuggg

SEQ ID NO: 1128176 - RNA, 19 nt, Human
gcagacacccaaacaaagc

SEQ ID NO: 1128177 - RNA, 18 nt, Human
gccaccgcacccgaguua

SEQ ID NO: 1128178 - RNA, 20 nt, Human
gccacucucccuucucccuc

SEQ ID NO: 1128179 - RNA, 21 nt, Human
gccacucucccuucucccucu

SEQ ID NO: 1128180 - RNA, 22 nt, Human
gcguuugggguuugcccagcug

SEQ ID NO: 1128181 - RNA, 24 nt, Human
gcuacugcuccucucucugccacu

SEQ ID NO: 1128182 - RNA, 19 nt, Human
ggaaauggggaacuuugga

SEQ ID NO: 1128183 - RNA, 22 nt, Human
ggaggaacacccaaguccucgg

SEQ ID NO: 1128184 - RNA, 20 nt, Human
ggaguuucauccaagagcac

SEQ ID NO: 1128185 - RNA, 20 nt, Human
ggcccuccuccuuccccucc

SEQ ID NO: 1128186 - RNA, 24 nt, Human
ggcugaagccuggagaguugaggg

SEQ ID NO: 1128187 - RNA, 19 nt, Human
gggcugaggugcccacgug

SEQ ID NO: 1128188 - RNA, 24 nt, Human
ggggaaauggggaacuuuggaagg

SEQ ID NO: 1128189 - RNA, 24 nt, Human
ggggugggugggaggcucacagaa

SEQ ID NO: 1128190 - RNA, 21 nt, Human
ggugcuucaggaguuccaaag

SEQ ID NO: 1128191 - RNA, 19 nt, Human
guaaagaaaacaucccgga

SEQ ID NO: 1128192 - RNA, 18 nt, Human
guggcauccacaguuaga

SEQ ID NO: 1128193 - RNA, 20 nt, Human
guggcgugggugagaggaga

SEQ ID NO: 1128194 - RNA, 21 nt, Human
gugggugagaggagacuuggc

SEQ ID NO: 1128195 - RNA, 19 nt, Human
gugguggugcuggugccaa

SEQ ID NO: 1128196 - RNA, 20 nt, Human
gugugccaccgcacccgagu

SEQ ID NO: 1128197 - RNA, 22 nt, Human
guucgguucauuuuaggccccg

SEQ ID NO: 1128198 - RNA, 26 nt, Human
guuuuggauuucuuccucuccuaauc

SEQ ID NO: 1128199 - RNA, 23 nt, Human
uagaaugacaggggugaagggca

SEQ ID NO: 1128200 - RNA, 26 nt, Human
uagagagaggaauggaagguggggcc

SEQ ID NO: 1128201 - RNA, 22 nt, Human
uagcaaggaauuucuggaaaag

SEQ ID NO: 1128202 - RNA, 18 nt, Human
uagccccccccgcuguuc

SEQ ID NO: 1128203 - RNA, 21 nt, Human
uaggccccgcagccucugccc

SEQ ID NO: 1128204 - RNA, 23 nt, Human
uauagccccccccgcuguuccaa

SEQ ID NO: 1128205 - RNA, 19 nt, Human
uauguugcccaggcugcag

SEQ ID NO: 1128206 - RNA, 25 nt, Human
ucaagccauccucccaucucagccu

SEQ ID NO: 1128207 - RNA, 19 nt, Human
ucaagcccagcaacagcgg

SEQ ID NO: 1128208 - RNA, 18 nt, Human
ucacaaguggcaaagcca

SEQ ID NO: 1128209 - RNA, 23 nt, Human
ucacaaguggcaaagccagugga

SEQ ID NO: 1128210 - RNA, 21 nt, Human
ucacuccuuacucauucacuc

SEQ ID NO: 1128211 - RNA, 19 nt, Human
ucagaaaaugaagagagca

SEQ ID NO: 1128212 - RNA, 20 nt, Human
ucagccugcugaguagcugg

SEQ ID NO: 1128213 - RNA, 23 nt, Human
ucagccugcugaguagcugggac

SEQ ID NO: 1128214 - RNA, 18 nt, Human
ucaggaaagaaaggccca

SEQ ID NO: 1128215 - RNA, 19 nt, Human
ucaggaaagaaaggcccag

SEQ ID NO: 1128216 - RNA, 24 nt, Human
ucaggccugccaggcagggucugu

SEQ ID NO: 1128217 - RNA, 20 nt, Human
ucaguccacagugagaggcc

SEQ ID NO: 1128218 - RNA, 22 nt, Human
ucauccaagagcacaaaccuga

SEQ ID NO: 1128219 - RNA, 21 nt, Human
uccaaaggacccauccaucca

SEQ ID NO: 1128220 - RNA, 24 nt, Human
uccaagagcacaaaccugagcacc

SEQ ID NO: 1128221 - RNA, 28 nt, Human
uccacaguuagaauaagaaccggggucc

SEQ ID NO: 1128222 - RNA, 30 nt, Human
uccagaggcaccugcccucugacucuggaa

SEQ ID NO: 1128223 - RNA, 18 nt, Human
uccauccucucaguccac

SEQ ID NO: 1128224 - RNA, 19 nt, Human
uccauuuacuccucugggc

SEQ ID NO: 1128225 - RNA, 20 nt, Human
ucccaccuccauuuacuccc

SEQ ID NO: 1128226 - RNA, 20 nt, Human
ucccggauaauuauucugga

SEQ ID NO: 1128227 - RNA, 18 nt, Human
uccuccuuccccuccucu

SEQ ID NO: 1128228 - RNA, 18 nt, Human
uccucucaguccacagug

SEQ ID NO: 1128229 - RNA, 18 nt, Human
uccucugccccucccccu

SEQ ID NO: 1128230 - RNA, 19 nt, Human
uccucugggcaaaaucugg

SEQ ID NO: 1128231 - RNA, 18 nt, Human
uccugggcucaagccauc

SEQ ID NO: 1128232 - RNA, 24 nt, Human
uccugggcucaagccauccuccca

SEQ ID NO: 1128233 - RNA, 20 nt, Human
ucucaaaguaacccaaaccu

SEQ ID NO: 1128234 - RNA, 20 nt, Human
ucucccucuuccuccucuuc

SEQ ID NO: 1128235 - RNA, 19 nt, Human
ucucgcuauguugcccagg

SEQ ID NO: 1128236 - RNA, 23 nt, Human
ucucgcuauguugcccaggcugc

SEQ ID NO: 1128237 - RNA, 24 nt, Human
ucucgcuauguugcccaggcugca

SEQ ID NO: 1128238 - RNA, 18 nt, Human
ucugugagaucuccauca

SEQ ID NO: 1128239 - RNA, 21 nt, Human
ucuuccuccucuucaucuucc

SEQ ID NO: 1128240 - RNA, 24 nt, Human
ugaaaucuaucugugagaucucca

SEQ ID NO: 1128241 - RNA, 19 nt, Human
ugaaaugagccacuucugc

SEQ ID NO: 1128242 - RNA, 18 nt, Human
ugcaggcccuccuccuuc

SEQ ID NO: 1128243 - RNA, 22 nt, Human
ugccaaggggcuggccacagag

SEQ ID NO: 1128244 - RNA, 25 nt, Human
ugcuuggagcucucuggugcuagga

SEQ ID NO: 1128245 - RNA, 19 nt, Human
uggaaaggacuuggggcag

SEQ ID NO: 1128246 - RNA, 23 nt, Human
uggaaaggacuuggggcagcucc

SEQ ID NO: 1128247 - RNA, 21 nt, Human
ugggacuacagacgugugcca

SEQ ID NO: 1128248 - RNA, 23 nt, Human
ugggacuacagacgugugccacc

SEQ ID NO: 1128249 - RNA, 24 nt, Human
ugggacuacagacgugugccaccg

SEQ ID NO: 1128250 - RNA, 19 nt, Human
ugggcuggucguaaacacu

SEQ ID NO: 1128251 - RNA, 19 nt, Human
uggggugggugggaggcuc

SEQ ID NO: 1128252 - RNA, 19 nt, Human
uggugccaaggggcuggcc

SEQ ID NO: 1128253 - RNA, 18 nt, Human
uggugcuggugccaaggg

SEQ ID NO: 1128254 - RNA, 24 nt, Human
uucacagauguggaaccucaagcc

SEQ ID NO: 1128255 - RNA, 19 nt, Human
uuccuuguagagcucuggc

SEQ ID NO: 1128256 - RNA, 19 nt, Human
uuggagcucucuggugcua

SEQ ID NO: 1128257 - RNA, 18 nt, Human
uuugacccacacaggaag

SEQ ID NO: 1128258 - RNA, 21 nt, Human
uuugcccaaggucacgcagcu

SEQ ID NO: 1128259 - RNA, 23 nt, Human
uuuggauuucuuccucuccuaau

SEQ ID NO: 1128260 - RNA, 21 nt, Human
ccugcacaucucaucuaugug

SEQ ID NO: 1128261 - RNA, 21 nt, Human
uguguguuuggucacauugag

SEQ ID NO: 1128262 - RNA, 21 nt, Human
aaggacuagugcaaacugaaa

SEQ ID NO: 1128263 - RNA, 25 nt, Human
agccaaagacacauauaaaaauaag

SEQ ID NO: 1128264 - RNA, 22 nt, Human
aggcugagccuuucgaccacaa

SEQ ID NO: 1128265 - RNA, 22 nt, Human
agggauccaaaucucagacacc

SEQ ID NO: 1128266 - RNA, 23 nt, Human
agguaucaagggagcucaaaggg

SEQ ID NO: 1128267 - RNA, 27 nt, Human
agugauggggaaacagaagggagggcc

SEQ ID NO: 1128268 - RNA, 18 nt, Human
auggagcucugagcccag

SEQ ID NO: 1128269 - RNA, 23 nt, Human
caagacugaagguaaaggacuag

SEQ ID NO: 1128270 - RNA, 21 nt, Human
cauguccacagacuucaugua

SEQ ID NO: 1128271 - RNA, 23 nt, Human
ccuccaaaguccugagaaaucaa

SEQ ID NO: 1128272 - RNA, 20 nt, Human
gacacauauaaaaauaagau

SEQ ID NO: 1128273 - RNA, 18 nt, Human
gcagcagcuucuaaccaa

SEQ ID NO: 1128274 - RNA, 25 nt, Human
guagagguaucaagggagcucaaag

SEQ ID NO: 1128275 - RNA, 24 nt, Human
gucagagcccuccaaaguccugag

SEQ ID NO: 1128276 - RNA, 18 nt, Human
gugauggggaaacagacc

SEQ ID NO: 1128277 - RNA, 18 nt, Human
guugcagcagcuucuaac

SEQ ID NO: 1128278 - RNA, 21 nt, Human
guuuccuaccugugucaccuc

SEQ ID NO: 1128279 - RNA, 19 nt, Human
uaaaaaagcuucccaaugc

SEQ ID NO: 1128280 - RNA, 25 nt, Human
uauaaugaugggagagggcaguugc

SEQ ID NO: 1128281 - RNA, 18 nt, Human
ucaaaauaaagaucaguu

SEQ ID NO: 1128282 - RNA, 19 nt, Human
ucagugcagcgaucccuuc

SEQ ID NO: 1128283 - RNA, 18 nt, Human
uccaaaucucagacacca

SEQ ID NO: 1128284 - RNA, 21 nt, Human
uccaagacugaagguaaagga

SEQ ID NO: 1128285 - RNA, 21 nt, Human
ugaugggagagggcaguugca

SEQ ID NO: 1128286 - RNA, 20 nt, Human
ugggagagggcaguugcagc

SEQ ID NO: 1128287 - RNA, 21 nt, Human
ugggagagggcaguugcagca

SEQ ID NO: 1128288 - RNA, 24 nt, Human
uggugucagagcccuccaaagucc

SEQ ID NO: 1128289 - RNA, 21 nt, Human
uguucuucacaggcugcuguu

SEQ ID NO: 1128290 - RNA, 22 nt, Human
uguuuccuaccugugucaccuc

SEQ ID NO: 1128291 - RNA, 24 nt, Human
uugcagcagcuucuaaccaagugu

SEQ ID NO: 1128292 - RNA, 18 nt, Human
uuggagguaggaugucca

SEQ ID NO: 1128293 - RNA, 22 nt, Human
ccaagccacucauuuccuuugu

SEQ ID NO: 1128294 - RNA, 21 nt, Human
ccuugauuuggaaacucuugg

SEQ ID NO: 1128295 - RNA, 20 nt, Human
gccucccauacuucaguagc

SEQ ID NO: 1128296 - RNA, 24 nt, Human
gccucccauacuucaguagcucca

SEQ ID NO: 1128297 - RNA, 22 nt, Human
gccuugauuuggaaacucuugg

SEQ ID NO: 1128298 - RNA, 25 nt, Human
gccuugauuuggaaacucuuggugu

SEQ ID NO: 1128299 - RNA, 23 nt, Human
guaggcguugcugccggugucag

SEQ ID NO: 1128300 - RNA, 21 nt, Human
uacagaucacauugagguagg

SEQ ID NO: 1128301 - RNA, 22 nt, Human
ucagaagccucccauacuucag

SEQ ID NO: 1128302 - RNA, 23 nt, Human
ucagaagccucccauacuucagu

SEQ ID NO: 1128303 - RNA, 19 nt, Human
uccuuuguaggcauaggga

SEQ ID NO: 1128304 - RNA, 18 nt, Human
ugauuuggaaacucuugg

SEQ ID NO: 1128305 - RNA, 28 nt, Human
aaaagaaagaaguuccuaggaaacagaa

SEQ ID NO: 1128306 - RNA, 23 nt, Human
aaacuccugaccucaggcaaucc

SEQ ID NO: 1128307 - RNA, 26 nt, Human
aaacugaaauacaggauguuauaauc

SEQ ID NO: 1128308 - RNA, 22 nt, Human
aaagaaauauggugugugaaaa

SEQ ID NO: 1128309 - RNA, 22 nt, Human
aaagacaacaagggaaaauggc

SEQ ID NO: 1128310 - RNA, 24 nt, Human
aaagugcugggauuacaggcguga

SEQ ID NO: 1128311 - RNA, 20 nt, Human
aaccuccaccucccugguuc

SEQ ID NO: 1128312 - RNA, 23 nt, Human
aaggagcaugguguaugucagag

SEQ ID NO: 1128313 - RNA, 19 nt, Human
aagugcugggauuacaggc

SEQ ID NO: 1128314 - RNA, 19 nt, Human
aagugcugggauuacaggc

SEQ ID NO: 1128315 - RNA, 26 nt, Human
aagugcugggauuacaggcgugagcc

SEQ ID NO: 1128316 - RNA, 24 nt, Human
acccagcuaauuuuuuuguauuuu

SEQ ID NO: 1128317 - RNA, 23 nt, Human
acccaggcuggagugcaguggug

SEQ ID NO: 1128318 - RNA, 23 nt, Human
acuagucucaaacuccugaccuc

SEQ ID NO: 1128319 - RNA, 21 nt, Human
acuuugaguaggugggaaaga

SEQ ID NO: 1128320 - RNA, 21 nt, Human
agaaaagaaagaaguuccuag

SEQ ID NO: 1128321 - RNA, 20 nt, Human
agaauuacaaacuagcccua

SEQ ID NO: 1128322 - RNA, 18 nt, Human
agcaugguguaugucaga

SEQ ID NO: 1128323 - RNA, 24 nt, Human
aggaaaaaggagcaugguguaugu

SEQ ID NO: 1128324 - RNA, 22 nt, Human
aggauguuauaaucuccugaaa

SEQ ID NO: 1128325 - RNA, 22 nt, Human
aggcaauccaccugccucggcc

SEQ ID NO: 1128326 - RNA, 24 nt, Human
aggcaauccaccugccucggccuc

SEQ ID NO: 1128327 - RNA, 21 nt, Human
aggcguaagccaccauaccca

SEQ ID NO: 1128328 - RNA, 25 nt, Human
aggcuggagugcaguggugcgaucu

SEQ ID NO: 1128329 - RNA, 22 nt, Human
aguagagauaguguuucaccau

SEQ ID NO: 1128330 - RNA, 19 nt, Human
aguagcugggauuauaggc

SEQ ID NO: 1128331 - RNA, 21 nt, Human
agugcaguggugcgaucucag

SEQ ID NO: 1128332 - RNA, 23 nt, Human
agugcaguggugcgaucucagcu

SEQ ID NO: 1128333 - RNA, 24 nt, Human
agugcaguggugcgaucucagcuc

SEQ ID NO: 1128334 - RNA, 18 nt, Human
agugcugggauuacaggc

SEQ ID NO: 1128335 - RNA, 24 nt, Human
aguggugcgaucucagcucacugc

SEQ ID NO: 1128336 - RNA, 22 nt, Human
aguguuucaccauguuggccag

SEQ ID NO: 1128337 - RNA, 24 nt, Human
auaguguuucaccauguuggccag

SEQ ID NO: 1128338 - RNA, 24 nt, Human
auguuauaaucuccugaaaugcua

SEQ ID NO: 1128339 - RNA, 24 nt, Human
caaagugcugggauuacaggcgug

SEQ ID NO: 1128340 - RNA, 21 nt, Human
caacaguaguccagaucuuga

SEQ ID NO: 1128341 - RNA, 21 nt, Human
caccauguuggccagacuagu

SEQ ID NO: 1128342 - RNA, 24 nt, Human
caccauguuggccagacuagucuc

SEQ ID NO: 1128343 - RNA, 27 nt, Human
caccauguuggccagacuagucucaaa

SEQ ID NO: 1128344 - RNA, 21 nt, Human
cacccaggcuggagugcagug

SEQ ID NO: 1128345 - RNA, 23 nt, Human
caccugccucggccucccaaagu

SEQ ID NO: 1128346 - RNA, 20 nt, Human
cagccuccugaguagcuggg

SEQ ID NO: 1128347 - RNA, 24 nt, Human
cauguuggccagacuagucucaaa

SEQ ID NO: 1128348 - RNA, 20 nt, Human
ccaaagugcugggauuacag

SEQ ID NO: 1128349 - RNA, 22 nt, Human
ccaaagugcugggauuacaggc

SEQ ID NO: 1128350 - RNA, 22 nt, Human
ccaaagugcugggauuacaggc

SEQ ID NO: 1128351 - RNA, 24 nt, Human
ccaaagugcugggauuacaggcgu

SEQ ID NO: 1128352 - RNA, 18 nt, Human
ccaugaggcagacacuga

SEQ ID NO: 1128353 - RNA, 20 nt, Human
cccugguucaagcaauuccc

SEQ ID NO: 1128354 - RNA, 23 nt, Human
cccugguucaagcaauuccccug

SEQ ID NO: 1128355 - RNA, 26 nt, Human
ccuaggaaacagaacaccaugaagau

SEQ ID NO: 1128356 - RNA, 21 nt, Human
ccugaccucaggcaauccacc

SEQ ID NO: 1128357 - RNA, 23 nt, Human
ccugaccucaggcaauccaccug

SEQ ID NO: 1128358 - RNA, 23 nt, Human
ccugaguagcugggauuauaggc

SEQ ID NO: 1128359 - RNA, 23 nt, Human
ccugaguagcugggauuauaggc

SEQ ID NO: 1128360 - RNA, 24 nt, Human
ccugccucagccuccugaguagcu

SEQ ID NO: 1128361 - RNA, 24 nt, Human
cgcucugucacccaggcuggagug

SEQ ID NO: 1128362 - RNA, 19 nt, Human
cuaaaggaaaaaggagcau

SEQ ID NO: 1128363 - RNA, 25 nt, Human
cucacugcaaccuccaccucccugg

SEQ ID NO: 1128364 - RNA, 24 nt, Human
cucagccuccugaguagcugggau

SEQ ID NO: 1128365 - RNA, 20 nt, Human
cuccugaaaugcuaagaaaa

SEQ ID NO: 1128366 - RNA, 24 nt, Human
cuccugaaaugcuaagaaaaugaa

SEQ ID NO: 1128367 - RNA, 24 nt, Human
cucgcucugucacccaggcuggag

SEQ ID NO: 1128368 - RNA, 24 nt, Human
cugaguagcugggauuauaggcgu

SEQ ID NO: 1128369 - RNA, 24 nt, Human
cugcaaccuccaccucccugguuc

SEQ ID NO: 1128370 - RNA, 23 nt, Human
cugccucggccucccaaagugcu

SEQ ID NO: 1128371 - RNA, 19 nt, Human
cugucacccaggcuggagu

SEQ ID NO: 1128372 - RNA, 20 nt, Human
cuuagagucacuugacuagu

SEQ ID NO: 1128373 - RNA, 24 nt, Human
gaccucaggcaauccaccugccuc

SEQ ID NO: 1128374 - RNA, 21 nt, Human
gagccacuggguuuucauuuu

SEQ ID NO: 1128375 - RNA, 20 nt, Human
gaguagcugggauuauaggc

SEQ ID NO: 1128376 - RNA, 18 nt, Human
gauuacaggcgugagcca

SEQ ID NO: 1128377 - RNA, 21 nt, Human
gauuacaggcgugagccacug

SEQ ID NO: 1128378 - RNA, 24 nt, Human
gauuacaggcgugagccacugggu

SEQ ID NO: 1128379 - RNA, 18 nt, Human
gauuauaggcguaagcca

SEQ ID NO: 1128380 - RNA, 21 nt, Human
gauuauaggcguaagccacca

SEQ ID NO: 1128381 - RNA, 24 nt, Human
gauuauaggcguaagccaccauac

SEQ ID NO: 1128382 - RNA, 22 nt, Human
gcaaccuccaccucccugguuc

SEQ ID NO: 1128383 - RNA, 24 nt, Human
gcaauccaccugccucggccuccc

SEQ ID NO: 1128384 - RNA, 25 nt, Human
gcucugucacccaggcuggagugca

SEQ ID NO: 1128385 - RNA, 27 nt, Human
ggaaaaaggagcaugguguaugucaga

SEQ ID NO: 1128386 - RNA, 19 nt, Human
ggauuauaggcguaagcca

SEQ ID NO: 1128387 - RNA, 23 nt, Human
gggaaagauaaacacuuauuaac

SEQ ID NO: 1128388 - RNA, 18 nt, Human
guagcugggauuauaggc

SEQ ID NO: 1128389 - RNA, 18 nt, Human
guagcugggauuauaggc

SEQ ID NO: 1128390 - RNA, 21 nt, Human
uaagccaccauacccagcuaa

SEQ ID NO: 1128391 - RNA, 26 nt, Human
uaauuuuuuuguauuuuuaguagaga

SEQ ID NO: 1128392 - RNA, 18 nt, Human
uacaggcgugagccacug

SEQ ID NO: 1128393 - RNA, 24 nt, Human
uacaggcgugagccacuggguuuu

SEQ ID NO: 1128394 - RNA, 22 nt, Human
uagagauaguguuucaccaugu

SEQ ID NO: 1128395 - RNA, 22 nt, Human
uaggaaaugaggauuguuuuga

SEQ ID NO: 1128396 - RNA, 24 nt, Human
uaguagagauaguguuucaccaug

SEQ ID NO: 1128397 - RNA, 19 nt, Human
uaguguuucaccauguugg

SEQ ID NO: 1128398 - RNA, 19 nt, Human
ucaaagacaacaagggaaa

SEQ ID NO: 1128399 - RNA, 24 nt, Human
ucacccaggcuggagugcaguggu

SEQ ID NO: 1128400 - RNA, 19 nt, Human
ucacugcaaccuccaccuc

SEQ ID NO: 1128401 - RNA, 24 nt, Human
ucacugcaaccuccaccucccugg

SEQ ID NO: 1128402 - RNA, 24 nt, Human
ucacugcaaccuccaccucccugg

SEQ ID NO: 1128403 - RNA, 25 nt, Human
ucacugcaaccuccaccucccuggu

SEQ ID NO: 1128404 - RNA, 27 nt, Human
ucacugcaaccuccaccucccugguuc

SEQ ID NO: 1128405 - RNA, 20 nt, Human
ucagccuccugaguagcugg

SEQ ID NO: 1128406 - RNA, 19 nt, Human
ucaguugucauaaacagua

SEQ ID NO: 1128407 - RNA, 24 nt, Human
ucccaaagugcugggauuacaggc

SEQ ID NO: 1128408 - RNA, 18 nt, Human
uccccugccucagccucc

SEQ ID NO: 1128409 - RNA, 24 nt, Human
uccccugccucagccuccugagua

SEQ ID NO: 1128410 - RNA, 19 nt, Human
ucccugguucaagcaauuc

SEQ ID NO: 1128411 - RNA, 24 nt, Human
ucccugguucaagcaauuccccug

SEQ ID NO: 1128412 - RNA, 24 nt, Human
uccugaguagcugggauuauaggc

SEQ ID NO: 1128413 - RNA, 18 nt, Human
ucggccucccaaagugcu

SEQ ID NO: 1128414 - RNA, 22 nt, Human
ucuaagugaggauucccugagg

SEQ ID NO: 1128415 - RNA, 19 nt, Human
ucucgcucugucacccagg

SEQ ID NO: 1128416 - RNA, 22 nt, Human
ucucgcucugucacccaggcug

SEQ ID NO: 1128417 - RNA, 23 nt, Human
ucucgcucugucacccaggcugg

SEQ ID NO: 1128418 - RNA, 24 nt, Human
ucucgcucugucacccaggcugga

SEQ ID NO: 1128419 - RNA, 26 nt, Human
ucucgcucugucacccaggcuggagu

SEQ ID NO: 1128420 - RNA, 27 nt, Human
ucucgcucugucacccaggcuggagug

SEQ ID NO: 1128421 - RNA, 24 nt, Human
ucugucacccaggcuggagugcag

SEQ ID NO: 1128422 - RNA, 19 nt, Human
ugaccucaggcaauccacc

SEQ ID NO: 1128423 - RNA, 22 nt, Human
ugagauggagucucgcucuguc

SEQ ID NO: 1128424 - RNA, 24 nt, Human
ugaggcagacacugaacuaggccc

SEQ ID NO: 1128425 - RNA, 24 nt, Human
ugaguaggugggaaagauaaacac

SEQ ID NO: 1128426 - RNA, 24 nt, Human
ugccucagccuccugaguagcugg

SEQ ID NO: 1128427 - RNA, 21 nt, Human
ugccucggccucccaaagugc

SEQ ID NO: 1128428 - RNA, 24 nt, Human
ugccucggccucccaaagugcugg

SEQ ID NO: 1128429 - RNA, 24 nt, Human
ugcugggauuacaggcgugagcca

SEQ ID NO: 1128430 - RNA, 23 nt, Human
uggagugcaguggugcgaucuca

SEQ ID NO: 1128431 - RNA, 24 nt, Human
uggagugcaguggugcgaucucag

SEQ ID NO: 1128432 - RNA, 18 nt, Human
ugggauuacaggcgugag

SEQ ID NO: 1128433 - RNA, 19 nt, Human
ugggauuacaggcgugagc

SEQ ID NO: 1128434 - RNA, 21 nt, Human
ugggauuacaggcgugagcca

SEQ ID NO: 1128435 - RNA, 22 nt, Human
ugggauuacaggcgugagccac

SEQ ID NO: 1128436 - RNA, 22 nt, Human
ugggauuacaggcgugagccac

SEQ ID NO: 1128437 - RNA, 23 nt, Human
ugggauuacaggcgugagccacu

SEQ ID NO: 1128438 - RNA, 24 nt, Human
ugggauuacaggcgugagccacug

SEQ ID NO: 1128439 - RNA, 18 nt, Human
ugggauuauaggcguaag

SEQ ID NO: 1128440 - RNA, 22 nt, Human
ugggauuauaggcguaagccac

SEQ ID NO: 1128441 - RNA, 24 nt, Human
ugggauuauaggcguaagccacca

SEQ ID NO: 1128442 - RNA, 25 nt, Human
ugggauuauaggcguaagccaccau

SEQ ID NO: 1128443 - RNA, 24 nt, Human
uggugcgaucucagcucacugcaa

SEQ ID NO: 1128444 - RNA, 21 nt, Human
ugucauaaacaguagaaaaga

SEQ ID NO: 1128445 - RNA, 24 nt, Human
uuacugggaauuucuucaacagua

SEQ ID NO: 1128446 - RNA, 24 nt, Human
uuaguagagauaguguuucaccau

SEQ ID NO: 1128447 - RNA, 19 nt, Human
uucaaagacaacaagggaa

SEQ ID NO: 1128448 - RNA, 21 nt, Human
uucaagcaauuccccugccuc

SEQ ID NO: 1128449 - RNA, 24 nt, Human
uucaagcaauuccccugccucagc

SEQ ID NO: 1128450 - RNA, 19 nt, Human
uuccccugccucagccucc

SEQ ID NO: 1128451 - RNA, 20 nt, Human
uucuuagagucacuugacua

SEQ ID NO: 1128452 - RNA, 21 nt, Human
uuucaccauguuggccagacu

SEQ ID NO: 1128453 - RNA, 20 nt, Human
uuuuguauuuuuaguagaga

SEQ ID NO: 1128454 - RNA, 24 nt, Human
uuuuuaguagagauaguguuucac

SEQ ID NO: 1128455 - RNA, 21 nt, Human
uuuuuguauuuuuaguagaga

SEQ ID NO: 1128456 - RNA, 23 nt, Human
uuuuuuauuuugagauggagucu

SEQ ID NO: 1128457 - RNA, 21 nt, Human
uuuuuuguauuuuuaguagag

SEQ ID NO: 1128458 - RNA, 25 nt, Human
uuuuuuuuuuuuuuuuuuacuuuuu

SEQ ID NO: 1128459 - RNA, 21 nt, Human
caccauguuguacaucagagc

SEQ ID NO: 1128460 - RNA, 18 nt, Human
cauuuaaagcccacucuu

SEQ ID NO: 1128461 - RNA, 24 nt, Human
aaaagaagacgggguuauggaaaa

SEQ ID NO: 1128462 - RNA, 19 nt, Human
aacaauguggguacuuuuu

SEQ ID NO: 1128463 - RNA, 19 nt, Human
aacguggcuggcaccuccc

SEQ ID NO: 1128464 - RNA, 22 nt, Human
aagcucauccacaccugaggcc

SEQ ID NO: 1128465 - RNA, 23 nt, Human
aaggaaaaacauuguguaaauaa

SEQ ID NO: 1128466 - RNA, 18 nt, Human
acaucuccgggaggggag

SEQ ID NO: 1128467 - RNA, 19 nt, Human
acccucugggagggacccu

SEQ ID NO: 1128468 - RNA, 22 nt, Human
agccuggggccgugaggugguc

SEQ ID NO: 1128469 - RNA, 20 nt, Human
aggaaggaaaaccauuucau

SEQ ID NO: 1128470 - RNA, 23 nt, Human
aguggagggcggccugggacggc

SEQ ID NO: 1128471 - RNA, 24 nt, Human
auccccuuugaggacgcucuguua

SEQ ID NO: 1128472 - RNA, 22 nt, Human
augaaagcagauacccaaaagc

SEQ ID NO: 1128473 - RNA, 24 nt, Human
cacaagccuccuguaacacggagc

SEQ ID NO: 1128474 - RNA, 22 nt, Human
cacacuugacuuucggaaacuu

SEQ ID NO: 1128475 - RNA, 23 nt, Human
cagcaucaucaccagaagauggg

SEQ ID NO: 1128476 - RNA, 22 nt, Human
cagguccugcagcaccgccucc

SEQ ID NO: 1128477 - RNA, 23 nt, Human
ccagcagcggcggcgccccuuuc

SEQ ID NO: 1128478 - RNA, 22 nt, Human
ccccauuuugcaaacgaggaaa

SEQ ID NO: 1128479 - RNA, 22 nt, Human
ccccuguggcagugccucaccc

SEQ ID NO: 1128480 - RNA, 23 nt, Human
cccgcagacuccgcaccugaggc

SEQ ID NO: 1128481 - RNA, 18 nt, Human
cccucugggagggacccu

SEQ ID NO: 1128482 - RNA, 18 nt, Human
ccuccuguaacacggagc

SEQ ID NO: 1128483 - RNA, 29 nt, Human
ccucgcguugcuguugggcuccccugacu

SEQ ID NO: 1128484 - RNA, 21 nt, Human
cgaggaaacugaggcucggag

SEQ ID NO: 1128485 - RNA, 24 nt, Human
cgagugggcaggagccccaagccc

SEQ ID NO: 1128486 - RNA, 20 nt, Human
cguccuggccguggcuuggg

SEQ ID NO: 1128487 - RNA, 20 nt, Human
cucaccaccucucaaaggca

SEQ ID NO: 1128488 - RNA, 24 nt, Human
cucaccaccucucaaaggcaccuu

SEQ ID NO: 1128489 - RNA, 22 nt, Human
cuccacggugaacccgcccgcc

SEQ ID NO: 1128490 - RNA, 21 nt, Human
cugcaugggguugugggccuu

SEQ ID NO: 1128491 - RNA, 23 nt, Human
cuggagauuccccggauucccag

SEQ ID NO: 1128492 - RNA, 24 nt, Human
cugugcucacaagccuccuguaac

SEQ ID NO: 1128493 - RNA, 20 nt, Human
cuuuguggagugugauugug

SEQ ID NO: 1128494 - RNA, 19 nt, Human
gaagcucagcccccuuccu

SEQ ID NO: 1128495 - RNA, 23 nt, Human
gaagcucauccacaccugaggcc

SEQ ID NO: 1128496 - RNA, 18 nt, Human
gacccgggcgcccuccag

SEQ ID NO: 1128497 - RNA, 24 nt, Human
gagcucaccaccucucaaaggcac

SEQ ID NO: 1128498 - RNA, 19 nt, Human
gaggacaccaccggggggg

SEQ ID NO: 1128499 - RNA, 18 nt, Human
gccccaagcccuggagga

SEQ ID NO: 1128500 - RNA, 21 nt, Human
gcccuggaggaaggaaaacca

SEQ ID NO: 1128501 - RNA, 23 nt, Human
gcucggaggccuggagcaaugug

SEQ ID NO: 1128502 - RNA, 22 nt, Human
ggaaacagaguccaguccugcu

SEQ ID NO: 1128503 - RNA, 19 nt, Human
ggaaggaaaaccauuucau

SEQ ID NO: 1128504 - RNA, 18 nt, Human
ggcagggccgugagcccc

SEQ ID NO: 1128505 - RNA, 20 nt, Human
ggcucggaggccuggagcaa

SEQ ID NO: 1128506 - RNA, 18 nt, Human
gggcuaguuuccagcagc

SEQ ID NO: 1128507 - RNA, 24 nt, Human
ggggguagaauccagacgugaguu

SEQ ID NO: 1128508 - RNA, 18 nt, Human
gugucugcuuccagaagu

SEQ ID NO: 1128509 - RNA, 23 nt, Human
uaacacggagcucaccaccucuc

SEQ ID NO: 1128510 - RNA, 22 nt, Human
ucacaagccuccuguaacacgg

SEQ ID NO: 1128511 - RNA, 21 nt, Human
uccaacagggaguucccucug

SEQ ID NO: 1128512 - RNA, 22 nt, Human
uccacggugaacccgcccgcca

SEQ ID NO: 1128513 - RNA, 23 nt, Human
uccaggugcaggcagagggucgg

SEQ ID NO: 1128514 - RNA, 22 nt, Human
uccccugaccagggaggaugga

SEQ ID NO: 1128515 - RNA, 25 nt, Human
uccuguaacacggagcucaccaccu

SEQ ID NO: 1128516 - RNA, 18 nt, Human
ucugggagggacccucuc

SEQ ID NO: 1128517 - RNA, 25 nt, Human
ugaaaaagaagacgggguuauggaa

SEQ ID NO: 1128518 - RNA, 18 nt, Human
ugaaagcagauacccaaa

SEQ ID NO: 1128519 - RNA, 21 nt, Human
ugaaagcagauacccaaaagc

SEQ ID NO: 1128520 - RNA, 23 nt, Human
ugacuuaucucaggauucacaca

SEQ ID NO: 1128521 - RNA, 21 nt, Human
ugaggacaccaccgggggggu

SEQ ID NO: 1128522 - RNA, 24 nt, Human
ugaggacaccaccggggggguccc

SEQ ID NO: 1128523 - RNA, 19 nt, Human
ugcaggcagagggucgggu

SEQ ID NO: 1128524 - RNA, 19 nt, Human
ugcucccgcagacuccgca

SEQ ID NO: 1128525 - RNA, 23 nt, Human
uggaaaaggcaacgggcuggaga

SEQ ID NO: 1128526 - RNA, 23 nt, Human
uggcagggccgugagccccugug

SEQ ID NO: 1128527 - RNA, 24 nt, Human
ugggaacaauguggguacuuuuuu

SEQ ID NO: 1128528 - RNA, 22 nt, Human
ugggcaggagccccaagcccug

SEQ ID NO: 1128529 - RNA, 18 nt, Human
uggggccgugaggugguc

SEQ ID NO: 1128530 - RNA, 27 nt, Human
uguaacacggagcucaccaccucucaa

SEQ ID NO: 1128531 - RNA, 24 nt, Human
ugucaggaaugaaagcagauaccc

SEQ ID NO: 1128532 - RNA, 27 nt, Human
ugucaggaaugaaagcagauacccaaa

SEQ ID NO: 1128533 - RNA, 18 nt, Human
uuccccggauucccaggc

SEQ ID NO: 1128534 - RNA, 19 nt, Human
uucucgggggcggccgggc

SEQ ID NO: 1128535 - RNA, 24 nt, Human
uuuccagcagcggcggcgccccuu

SEQ ID NO: 1128536 - RNA, 23 nt, Human
uuucucacaagccgcagcaccuc

SEQ ID NO: 1128537 - RNA, 21 nt, Human
acccagcaccauccagcucug

SEQ ID NO: 1128538 - RNA, 21 nt, Human
aguuucuuguugcugguuugc

SEQ ID NO: 1128539 - RNA, 30 nt, Human
cacccccuucagacccucuccuggggcugg

SEQ ID NO: 1128540 - RNA, 23 nt, Human
ccggccgggugcggguccccaca

SEQ ID NO: 1128541 - RNA, 18 nt, Human
gagaccacugcaacagcc

SEQ ID NO: 1128542 - RNA, 22 nt, Human
gagcccgagaccacugcaacag

SEQ ID NO: 1128543 - RNA, 21 nt, Human
gcaggaaggucgggaggaggg

SEQ ID NO: 1128544 - RNA, 24 nt, Human
gcccuggccacccaguuucuuguu

SEQ ID NO: 1128545 - RNA, 23 nt, Human
gggcaggaaggucgggaggaggg

SEQ ID NO: 1128546 - RNA, 20 nt, Human
ucagacccucuccuggggcu

SEQ ID NO: 1128547 - RNA, 23 nt, Human
ucgggaggagggacucacccccu

SEQ ID NO: 1128548 - RNA, 22 nt, Human
ucuccuggggcugagugggagc

SEQ ID NO: 1128549 - RNA, 18 nt, Human
ugagcccagggugagacc

SEQ ID NO: 1128550 - RNA, 19 nt, Human
ugccugggcgugggcagga

SEQ ID NO: 1128551 - RNA, 19 nt, Human
ugccugggcgugggcagga

SEQ ID NO: 1128552 - RNA, 26 nt, Human
uggggucgugcacggacgcccuggcc

SEQ ID NO: 1128553 - RNA, 24 nt, Human
ugucucgcucccuguggggaccca

SEQ ID NO: 1128554 - RNA, 20 nt, Human
ugucucgggucuucaucagc

SEQ ID NO: 1128555 - RNA, 22 nt, Human
uuggaccccucccugaacucau

SEQ ID NO: 1128556 - RNA, 18 nt, Human
caccaaagcggccacggc

SEQ ID NO: 1128557 - RNA, 21 nt, Human
uacaacaccaaagcggccacg

SEQ ID NO: 1128558 - RNA, 24 nt, Human
aaagaaaggcagauuuauuagaga

SEQ ID NO: 1128559 - RNA, 18 nt, Human
aagaagggcagacuuaaa

SEQ ID NO: 1128560 - RNA, 19 nt, Human
aaggagcagggccggugug

SEQ ID NO: 1128561 - RNA, 19 nt, Human
aaggagcagggccggugug

SEQ ID NO: 1128562 - RNA, 19 nt, Human
aaggagcagggccggugug

SEQ ID NO: 1128563 - RNA, 19 nt, Human
aaggagcagggccggugug

SEQ ID NO: 1128564 - RNA, 20 nt, Human
aagggaggagccacugcaaa

SEQ ID NO: 1128565 - RNA, 19 nt, Human
aaugauggaggagccaggu

SEQ ID NO: 1128566 - RNA, 24 nt, Human
acccgcucugcugggcccucacug

SEQ ID NO: 1128567 - RNA, 20 nt, Human
agaggaagcagcgcuugggc

SEQ ID NO: 1128568 - RNA, 20 nt, Human
agcacagaagcaacgggcag

SEQ ID NO: 1128569 - RNA, 26 nt, Human
agcuacacagcaccaagucugcgccu

SEQ ID NO: 1128570 - RNA, 19 nt, Human
aggacggaaggguggaugg

SEQ ID NO: 1128571 - RNA, 22 nt, Human
aggcagguggcccauccgggga

SEQ ID NO: 1128572 - RNA, 20 nt, Human
aggcaguacugauaacgcca

SEQ ID NO: 1128573 - RNA, 18 nt, Human
aggcgggcgccugggccu

SEQ ID NO: 1128574 - RNA, 22 nt, Human
agggaggagccgaagcaagggg

SEQ ID NO: 1128575 - RNA, 22 nt, Human
agggaggagccgaagcaagggg

SEQ ID NO: 1128576 - RNA, 22 nt, Human
agggaggagccgaagcaagggg

SEQ ID NO: 1128577 - RNA, 22 nt, Human
agggaggagccgaagcaagggg

SEQ ID NO: 1128578 - RNA, 18 nt, Human
agggcagacuuaaagcuu

SEQ ID NO: 1128579 - RNA, 19 nt, Human
agggcucggugggagcaga

SEQ ID NO: 1128580 - RNA, 20 nt, Human
auaggacggcgccugugcug

SEQ ID NO: 1128581 - RNA, 24 nt, Human
caaaccaaccgugcgcaggaaaac

SEQ ID NO: 1128582 - RNA, 24 nt, Human
caagggaggagccacugcaaagaa

SEQ ID NO: 1128583 - RNA, 28 nt, Human
caagggaggagccgaagcaaggggcagg

SEQ ID NO: 1128584 - RNA, 28 nt, Human
caagggaggagccgaagcaaggggcagg

SEQ ID NO: 1128585 - RNA, 28 nt, Human
caagggaggagccgaagcaaggggcagg

SEQ ID NO: 1128586 - RNA, 28 nt, Human
caagggaggagccgaagcaaggggcagg

SEQ ID NO: 1128587 - RNA, 24 nt, Human
cacaccccccacccccacauguca

SEQ ID NO: 1128588 - RNA, 20 nt, Human
cacugccugagcaaccagca

SEQ ID NO: 1128589 - RNA, 24 nt, Human
cagcaagggaggagccgaagcaag

SEQ ID NO: 1128590 - RNA, 24 nt, Human
cagcaagggaggagccgaagcaag

SEQ ID NO: 1128591 - RNA, 24 nt, Human
cagcaagggaggagccgaagcaag

SEQ ID NO: 1128592 - RNA, 24 nt, Human
cagcaagggaggagccgaagcaag

SEQ ID NO: 1128593 - RNA, 20 nt, Human
cagcuccacccgcucugcug

SEQ ID NO: 1128594 - RNA, 18 nt, Human
cagcuccuggggccuggg

SEQ ID NO: 1128595 - RNA, 20 nt, Human
caggcaaggugaacauggug

SEQ ID NO: 1128596 - RNA, 22 nt, Human
caggcugggccuggcuccuggg

SEQ ID NO: 1128597 - RNA, 22 nt, Human
caggcugggccuggcuccuggg

SEQ ID NO: 1128598 - RNA, 21 nt, Human
caugugugacacaggcaaggu

SEQ ID NO: 1128599 - RNA, 20 nt, Human
ccagagccucccucuggcag

SEQ ID NO: 1128600 - RNA, 22 nt, Human
ccauggaguuagcgagcaccca

SEQ ID NO: 1128601 - RNA, 21 nt, Human
ccauggcccccuaggcucucu

SEQ ID NO: 1128602 - RNA, 28 nt, Human
cccacccccacaugucagggcacagccg

SEQ ID NO: 1128603 - RNA, 24 nt, Human
cccacccccacaugucagggcacc

SEQ ID NO: 1128604 - RNA, 20 nt, Human
cccauucugcaccugcugug

SEQ ID NO: 1128605 - RNA, 20 nt, Human
ccccccacccccacauguca

SEQ ID NO: 1128606 - RNA, 22 nt, Human
ccucccucuggcagggcaggca

SEQ ID NO: 1128607 - RNA, 21 nt, Human
ccugagcaaccagcaggauuu

SEQ ID NO: 1128608 - RNA, 19 nt, Human
cucccggcugcagggagca

SEQ ID NO: 1128609 - RNA, 21 nt, Human
cuccuggggccugggcccagc

SEQ ID NO: 1128610 - RNA, 18 nt, Human
cucugugcacagcccccc

SEQ ID NO: 1128611 - RNA, 19 nt, Human
cugcaccugcuguguacgc

SEQ ID NO: 1128612 - RNA, 21 nt, Human
cugcugggcccucacugaguc

SEQ ID NO: 1128613 - RNA, 19 nt, Human
cuggagggcucggugggag

SEQ ID NO: 1128614 - RNA, 21 nt, Human
cuggcuccuggggccugggcc

SEQ ID NO: 1128615 - RNA, 21 nt, Human
cuggcuccuggggccugggcc

SEQ ID NO: 1128616 - RNA, 25 nt, Human
cugugugcuggagagggccacaggc

SEQ ID NO: 1128617 - RNA, 22 nt, Human
cuugcuggggauguuauaggac

SEQ ID NO: 1128618 - RNA, 26 nt, Human
cuuugcuucuucuuuuugaggacggc

SEQ ID NO: 1128619 - RNA, 20 nt, Human
gaagaagggcagacuuaaag

SEQ ID NO: 1128620 - RNA, 21 nt, Human
gaaggguggauggaugcgugg

SEQ ID NO: 1128621 - RNA, 24 nt, Human
gagaaaguagaaaaugugcauagc

SEQ ID NO: 1128622 - RNA, 22 nt, Human
gcaagggaggagccacugcaaa

SEQ ID NO: 1128623 - RNA, 18 nt, Human
gcagggccgguguggggg

SEQ ID NO: 1128624 - RNA, 18 nt, Human
gcagggccgguguggggg

SEQ ID NO: 1128625 - RNA, 18 nt, Human
gcagggccgguguggggg

SEQ ID NO: 1128626 - RNA, 21 nt, Human
gccgaagcaaggggcagguca

SEQ ID NO: 1128627 - RNA, 21 nt, Human
gccgaagcaaggggcagguca

SEQ ID NO: 1128628 - RNA, 21 nt, Human
gccgaagcaaggggcagguca

SEQ ID NO: 1128629 - RNA, 21 nt, Human
gccgaagcaaggggcagguca

SEQ ID NO: 1128630 - RNA, 20 nt, Human
gccugagcaaccagcaggau

SEQ ID NO: 1128631 - RNA, 19 nt, Human
gccugggcccagcuccugg

SEQ ID NO: 1128632 - RNA, 25 nt, Human
gccugggccuagaggaggaaggagc

SEQ ID NO: 1128633 - RNA, 19 nt, Human
gcuccuggggccugggccc

SEQ ID NO: 1128634 - RNA, 19 nt, Human
gcuccuggggccugggccc

SEQ ID NO: 1128635 - RNA, 19 nt, Human
gcuccuggggccugggccc

SEQ ID NO: 1128636 - RNA, 18 nt, Human
ggcgcaggcugggccugg

SEQ ID NO: 1128637 - RNA, 18 nt, Human
ggcgcaggcugggccugg

SEQ ID NO: 1128638 - RNA, 18 nt, Human
ggcgcaggcugggccugg

SEQ ID NO: 1128639 - RNA, 18 nt, Human
ggcgcaggcugggccugg

SEQ ID NO: 1128640 - RNA, 20 nt, Human
ggcugggccuggcuccuggg

SEQ ID NO: 1128641 - RNA, 20 nt, Human
ggcugggccuggcuccuggg

SEQ ID NO: 1128642 - RNA, 20 nt, Human
ggcugggccuggcuccuggg

SEQ ID NO: 1128643 - RNA, 18 nt, Human
gggauguuauaggacggc

SEQ ID NO: 1128644 - RNA, 19 nt, Human
gggcgcaggcugggccugg

SEQ ID NO: 1128645 - RNA, 19 nt, Human
gggcgcaggcugggccugg

SEQ ID NO: 1128646 - RNA, 19 nt, Human
gggcgcaggcugggccugg

SEQ ID NO: 1128647 - RNA, 19 nt, Human
gggcgcaggcugggccugg

SEQ ID NO: 1128648 - RNA, 18 nt, Human
gggcuggagggcucggug

SEQ ID NO: 1128649 - RNA, 26 nt, Human
ggggcaauaauugcugugggcgggga

SEQ ID NO: 1128650 - RNA, 18 nt, Human
ggggcaggucagcaaggg

SEQ ID NO: 1128651 - RNA, 18 nt, Human
ggggcaggucagcaaggg

SEQ ID NO: 1128652 - RNA, 18 nt, Human
ggggcaggucagcaaggg

SEQ ID NO: 1128653 - RNA, 18 nt, Human
ggggcaggucagcaaggg

SEQ ID NO: 1128654 - RNA, 19 nt, Human
ggggccugggcccagcucc

SEQ ID NO: 1128655 - RNA, 21 nt, Human
gucccagagccucccucuggc

SEQ ID NO: 1128656 - RNA, 23 nt, Human
gugggcggggagugccagggcug

SEQ ID NO: 1128657 - RNA, 19 nt, Human
uaaauccauuccaaugcaa

SEQ ID NO: 1128658 - RNA, 23 nt, Human
uacacagcaccaagucugcgccu

SEQ ID NO: 1128659 - RNA, 19 nt, Human
ucagaagcugguggcugca

SEQ ID NO: 1128660 - RNA, 26 nt, Human
ucagcaaaucucccgucagaagcugg

SEQ ID NO: 1128661 - RNA, 21 nt, Human
ucagggaggacggaagggugg

SEQ ID NO: 1128662 - RNA, 20 nt, Human
uccaagacaagggggcugga

SEQ ID NO: 1128663 - RNA, 19 nt, Human
uccacaccccccaccccca

SEQ ID NO: 1128664 - RNA, 18 nt, Human
ucccauggaguuagcgag

SEQ ID NO: 1128665 - RNA, 19 nt, Human
uccggggaucacugccuga

SEQ ID NO: 1128666 - RNA, 20 nt, Human
uccugccagcccgacucccc

SEQ ID NO: 1128667 - RNA, 19 nt, Human
ucucaggucccagagccuc

SEQ ID NO: 1128668 - RNA, 21 nt, Human
ucuuugcuucuucuuuuugcc

SEQ ID NO: 1128669 - RNA, 18 nt, Human
ugaaaugauggaggagcc

SEQ ID NO: 1128670 - RNA, 18 nt, Human
ugagcuacacagcaccaa

SEQ ID NO: 1128671 - RNA, 24 nt, Human
ugaggcagguggcccauccgggga

SEQ ID NO: 1128672 - RNA, 22 nt, Human
ugauggaggagccagguguggu

SEQ ID NO: 1128673 - RNA, 23 nt, Human
ugauggaggagccaggugugguc

SEQ ID NO: 1128674 - RNA, 23 nt, Human
ugcaaagaaaugagggcuugcug

SEQ ID NO: 1128675 - RNA, 19 nt, Human
ugcauagcacagaagcaac

SEQ ID NO: 1128676 - RNA, 24 nt, Human
ugccagggcugggccauggccccc

SEQ ID NO: 1128677 - RNA, 22 nt, Human
uggaggugcaggcugggccugg

SEQ ID NO: 1128678 - RNA, 19 nt, Human
uggcaauagccgggcacag

SEQ ID NO: 1128679 - RNA, 22 nt, Human
uggcaauagccgggcacaggaa

SEQ ID NO: 1128680 - RNA, 21 nt, Human
uggcagggcaggcaaugaggc

SEQ ID NO: 1128681 - RNA, 23 nt, Human
uggcuccuggggcaauaauugcu

SEQ ID NO: 1128682 - RNA, 21 nt, Human
uggcuccuggggccuggaccu

SEQ ID NO: 1128683 - RNA, 21 nt, Human
uggcuccuggggccuggaccu

SEQ ID NO: 1128684 - RNA, 21 nt, Human
uggcuccuggggccugggccc

SEQ ID NO: 1128685 - RNA, 21 nt, Human
uggcuccuggggccugggccc

SEQ ID NO: 1128686 - RNA, 19 nt, Human
ugggagcagaggcggggcc

SEQ ID NO: 1128687 - RNA, 22 nt, Human
ugggcggggagugccagggcug

SEQ ID NO: 1128688 - RNA, 20 nt, Human
uggggcaauaauugcugugg

SEQ ID NO: 1128689 - RNA, 23 nt, Human
uggggccugggcccagcuccugg

SEQ ID NO: 1128690 - RNA, 18 nt, Human
ugggggcgcaggcugggc

SEQ ID NO: 1128691 - RNA, 18 nt, Human
ugggggcgcaggcugggc

SEQ ID NO: 1128692 - RNA, 18 nt, Human
ugggggcgcaggcugggc

SEQ ID NO: 1128693 - RNA, 18 nt, Human
ugggggcgcaggcugggc

SEQ ID NO: 1128694 - RNA, 22 nt, Human
uguggucagaauuugccaggga

SEQ ID NO: 1128695 - RNA, 23 nt, Human
uguggucagaauuugccagggaa

SEQ ID NO: 1128696 - RNA, 21 nt, Human
uugcuucuucuuuuugccuuc

SEQ ID NO: 1128697 - RNA, 22 nt, Human
agaaaggacuacaauguacaau

SEQ ID NO: 1128698 - RNA, 23 nt, Human
acacccuagagaccacgcuaaca

SEQ ID NO: 1128699 - RNA, 26 nt, Human
acagcaggggcuacucgcccucccag

SEQ ID NO: 1128700 - RNA, 20 nt, Human
accacgcuaacaagaggccu

SEQ ID NO: 1128701 - RNA, 18 nt, Human
acgcccggcacagcagcc

SEQ ID NO: 1128702 - RNA, 23 nt, Human
acgcccggcacagcagccacgcc

SEQ ID NO: 1128703 - RNA, 21 nt, Human
agaaggaggggagggagagag

SEQ ID NO: 1128704 - RNA, 21 nt, Human
agaggggggccacgcgguccc

SEQ ID NO: 1128705 - RNA, 22 nt, Human
aggaggggagggagagaggggg

SEQ ID NO: 1128706 - RNA, 24 nt, Human
aggaggggagggagagaggggggc

SEQ ID NO: 1128707 - RNA, 20 nt, Human
agggagagaggggggccacg

SEQ ID NO: 1128708 - RNA, 26 nt, Human
agucagcaccggccacgcccggcaca

SEQ ID NO: 1128709 - RNA, 21 nt, Human
cagcagacggcgucagacccc

SEQ ID NO: 1128710 - RNA, 22 nt, Human
cagcaggggcuacucgcccucc

SEQ ID NO: 1128711 - RNA, 19 nt, Human
ccccggggcucaguucucu

SEQ ID NO: 1128712 - RNA, 20 nt, Human
cccggcaccccguaccgcaa

SEQ ID NO: 1128713 - RNA, 23 nt, Human
cccuccagaaggaggggagggag

SEQ ID NO: 1128714 - RNA, 21 nt, Human
cccuggaaaugcucaucgccu

SEQ ID NO: 1128715 - RNA, 18 nt, Human
ccggggcucaguucucuc

SEQ ID NO: 1128716 - RNA, 22 nt, Human
cgcaagucagcaccggccacgc

SEQ ID NO: 1128717 - RNA, 22 nt, Human
cuccagaaggaggggagggagg

SEQ ID NO: 1128718 - RNA, 18 nt, Human
cucccccgaucagcgucc

SEQ ID NO: 1128719 - RNA, 20 nt, Human
cugcaaccagcacauggaga

SEQ ID NO: 1128720 - RNA, 19 nt, Human
gaaggaggggagggagaga

SEQ ID NO: 1128721 - RNA, 18 nt, Human
gaggcccagcccuggaaa

SEQ ID NO: 1128722 - RNA, 21 nt, Human
gaggcccagcccuggaaaugc

SEQ ID NO: 1128723 - RNA, 23 nt, Human
gaggcccagcccuggaaaugcuc

SEQ ID NO: 1128724 - RNA, 20 nt, Human
gagggagagaggggggccac

SEQ ID NO: 1128725 - RNA, 19 nt, Human
gauccccacccggcacccc

SEQ ID NO: 1128726 - RNA, 19 nt, Human
gcgcucccgcacgguguug

SEQ ID NO: 1128727 - RNA, 21 nt, Human
ggagggagagaggggggccac

SEQ ID NO: 1128728 - RNA, 19 nt, Human
ggcaguggacacacaguga

SEQ ID NO: 1128729 - RNA, 21 nt, Human
gggggccacgcggucccgccg

SEQ ID NO: 1128730 - RNA, 19 nt, Human
ugcagaauugccacggccg

SEQ ID NO: 1128731 - RNA, 24 nt, Human
aaagugcugggauuacaggcauga

SEQ ID NO: 1128732 - RNA, 18 nt, Human
aacacacagcuucaggca

SEQ ID NO: 1128733 - RNA, 20 nt, Human
aacacaugccccacggugca

SEQ ID NO: 1128734 - RNA, 23 nt, Human
aacaccccagaauuugagaacag

SEQ ID NO: 1128735 - RNA, 21 nt, Human
aacccggagcagcccagcccc

SEQ ID NO: 1128736 - RNA, 25 nt, Human
aacugcauccaacaggaacccccac

SEQ ID NO: 1128737 - RNA, 18 nt, Human
aagcagggcccccaggga

SEQ ID NO: 1128738 - RNA, 19 nt, Human
aagccaagcucccacccag

SEQ ID NO: 1128739 - RNA, 22 nt, Human
aagcuugcccccaaacucugcc

SEQ ID NO: 1128740 - RNA, 24 nt, Human
aaggaggcugggccagcccaggac

SEQ ID NO: 1128741 - RNA, 19 nt, Human
aagugcugggauuacaggc

SEQ ID NO: 1128742 - RNA, 21 nt, Human
aagugcugggauuacaggcau

SEQ ID NO: 1128743 - RNA, 20 nt, Human
aaugccaggacaagcaacaa

SEQ ID NO: 1128744 - RNA, 23 nt, Human
acacagaugcacagacacacauc

SEQ ID NO: 1128745 - RNA, 21 nt, Human
acaccauccccucuacagccc

SEQ ID NO: 1128746 - RNA, 23 nt, Human
acacccacaccauccccucuaca

SEQ ID NO: 1128747 - RNA, 20 nt, Human
acaccccaagggccacacaa

SEQ ID NO: 1128748 - RNA, 19 nt, Human
acacugagagccccaucug

SEQ ID NO: 1128749 - RNA, 18 nt, Human
acagacacaggccacaca

SEQ ID NO: 1128750 - RNA, 21 nt, Human
acagaugcacagacacacauc

SEQ ID NO: 1128751 - RNA, 19 nt, Human
acagcccagccaagagggu

SEQ ID NO: 1128752 - RNA, 22 nt, Human
accaaugccaggacaagcaaca

SEQ ID NO: 1128753 - RNA, 21 nt, Human
accaggucacccacagaccca

SEQ ID NO: 1128754 - RNA, 26 nt, Human
acccacaccauccccucuacagcccu

SEQ ID NO: 1128755 - RNA, 21 nt, Human
acccacagacccaagcccaag

SEQ ID NO: 1128756 - RNA, 19 nt, Human
accccacacccaggcagac

SEQ ID NO: 1128757 - RNA, 21 nt, Human
accccacacccaggcagacag

SEQ ID NO: 1128758 - RNA, 27 nt, Human
accccacacccaggcagacagacagac

SEQ ID NO: 1128759 - RNA, 21 nt, Human
accccgaggaccucuuuccca

SEQ ID NO: 1128760 - RNA, 19 nt, Human
acccgaagcccagcaucac

SEQ ID NO: 1128761 - RNA, 21 nt, Human
acccgaagcccagcaucaccc

SEQ ID NO: 1128762 - RNA, 19 nt, Human
accugaguccacagcccag

SEQ ID NO: 1128763 - RNA, 21 nt, Human
accugucuguuuuguucucug

SEQ ID NO: 1128764 - RNA, 23 nt, Human
accuuagccucccaaagugcugg

SEQ ID NO: 1128765 - RNA, 18 nt, Human
acgccacccuggcugugg

SEQ ID NO: 1128766 - RNA, 19 nt, Human
acuaaauacagagcuccug

SEQ ID NO: 1128767 - RNA, 24 nt, Human
acuauauuggccaagcuggucucg

SEQ ID NO: 1128768 - RNA, 18 nt, Human
acugggccagggcugcca

SEQ ID NO: 1128769 - RNA, 22 nt, Human
agaaacccggagcagcccagcc

SEQ ID NO: 1128770 - RNA, 22 nt, Human
agaacacaggccugcccccucc

SEQ ID NO: 1128771 - RNA, 21 nt, Human
agaacagcuuccacaucacca

SEQ ID NO: 1128772 - RNA, 19 nt, Human
agaagccuuggggacccuc

SEQ ID NO: 1128773 - RNA, 19 nt, Human
agaagguaggaucugaacu

SEQ ID NO: 1128774 - RNA, 24 nt, Human
agaaugucuggcgccugcucagcc

SEQ ID NO: 1128775 - RNA, 20 nt, Human
agacagacagacacaggcca

SEQ ID NO: 1128776 - RNA, 26 nt, Human
agacagacagacacaggccacacaca

SEQ ID NO: 1128777 - RNA, 24 nt, Human
agacagacagacacaggccggacc

SEQ ID NO: 1128778 - RNA, 22 nt, Human
agacccugacaccacacgacga

SEQ ID NO: 1128779 - RNA, 22 nt, Human
agagcccccuccaccugaaacu

SEQ ID NO: 1128780 - RNA, 23 nt, Human
agaggaccaagcagggcccccag

SEQ ID NO: 1128781 - RNA, 19 nt, Human
agagucccccucaccccac

SEQ ID NO: 1128782 - RNA, 24 nt, Human
agcacaucugcuacccgaagccca

SEQ ID NO: 1128783 - RNA, 23 nt, Human
agcacucccacccccaccagccc

SEQ ID NO: 1128784 - RNA, 22 nt, Human
agcagacagaaggagaccaaga

SEQ ID NO: 1128785 - RNA, 25 nt, Human
agcaggaccccugguccuggaccua

SEQ ID NO: 1128786 - RNA, 18 nt, Human
agcaggaggguccaggcc

SEQ ID NO: 1128787 - RNA, 21 nt, Human
agcauccuuugcggaccucac

SEQ ID NO: 1128788 - RNA, 22 nt, Human
agccaagcucccacccagagcc

SEQ ID NO: 1128789 - RNA, 18 nt, Human
agccagugggggccgggg

SEQ ID NO: 1128790 - RNA, 26 nt, Human
agccggacaccugaguccacagccca

SEQ ID NO: 1128791 - RNA, 20 nt, Human
agcuccugaggagucagaca

SEQ ID NO: 1128792 - RNA, 21 nt, Human
agcugagggagaggggcaggu

SEQ ID NO: 1128793 - RNA, 24 nt, Human
agcuggucucgaacuccugaccuc

SEQ ID NO: 1128794 - RNA, 20 nt, Human
aggaagagguguucagcugu

SEQ ID NO: 1128795 - RNA, 23 nt, Human
aggacagacugaggugggguucc

SEQ ID NO: 1128796 - RNA, 19 nt, Human
aggcaaggcggcugcuggu

SEQ ID NO: 1128797 - RNA, 24 nt, Human
aggcagacagacagacacaggcca

SEQ ID NO: 1128798 - RNA, 26 nt, Human
aggcagcagacagaaggagaccaaga

SEQ ID NO: 1128799 - RNA, 20 nt, Human
agggagaggagcaccucagg

SEQ ID NO: 1128800 - RNA, 22 nt, Human
agggagaggggcagguggcagg

SEQ ID NO: 1128801 - RNA, 19 nt, Human
agggguuucacuauauugg

SEQ ID NO: 1128802 - RNA, 23 nt, Human
agguacaugcccaccacagcaca

SEQ ID NO: 1128803 - RNA, 24 nt, Human
agguaggaucugaacuggagagag

SEQ ID NO: 1128804 - RNA, 24 nt, Human
aggugauccgcccaccuuagccuc

SEQ ID NO: 1128805 - RNA, 23 nt, Human
agguguucagcugugggcagaag

SEQ ID NO: 1128806 - RNA, 18 nt, Human
aguccaggacagacugag

SEQ ID NO: 1128807 - RNA, 20 nt, Human
aguggccagagaagccuugg

SEQ ID NO: 1128808 - RNA, 20 nt, Human
aguggcugggaggucggggg

SEQ ID NO: 1128809 - RNA, 20 nt, Human
aucuggacacugggccaggg

SEQ ID NO: 1128810 - RNA, 24 nt, Human
caaagugcugggauuacaggcaug

SEQ ID NO: 1128811 - RNA, 21 nt, Human
caacaaaaagaaacacacagc

SEQ ID NO: 1128812 - RNA, 24 nt, Human
caacaaaaagaaacacacagcuuc

SEQ ID NO: 1128813 - RNA, 20 nt, Human
caacaccccagaauuugaga

SEQ ID NO: 1128814 - RNA, 23 nt, Human
caacaggaacccccaccuucacc

SEQ ID NO: 1128815 - RNA, 18 nt, Human
caagcaacaaaaagaaac

SEQ ID NO: 1128816 - RNA, 19 nt, Human
caagcaacaaaaagaaaca

SEQ ID NO: 1128817 - RNA, 18 nt, Human
caagcucccacccagagc

SEQ ID NO: 1128818 - RNA, 21 nt, Human
caagcucccacccagagccac

SEQ ID NO: 1128819 - RNA, 22 nt, Human
caaggcccacuaaauacagagc

SEQ ID NO: 1128820 - RNA, 19 nt, Human
caaggcccugggcagccuc

SEQ ID NO: 1128821 - RNA, 22 nt, Human
caaugccaggacaagcaacaaa

SEQ ID NO: 1128822 - RNA, 20 nt, Human
cacacacacacaaacaucac

SEQ ID NO: 1128823 - RNA, 25 nt, Human
cacacacacacacacaaacaucacu

SEQ ID NO: 1128824 - RNA, 22 nt, Human
cacaccauccccucuacagccc

SEQ ID NO: 1128825 - RNA, 19 nt, Human
cacacccacaccauccccu

SEQ ID NO: 1128826 - RNA, 20 nt, Human
cacacccaggcagacagaca

SEQ ID NO: 1128827 - RNA, 23 nt, Human
cacagacccaagcccaagucacc

SEQ ID NO: 1128828 - RNA, 24 nt, Human
cacagacccaagcccaagucacca

SEQ ID NO: 1128829 - RNA, 21 nt, Human
cacagcacaacaccccagaau

SEQ ID NO: 1128830 - RNA, 21 nt, Human
caccaaugccaggacaagcaa

SEQ ID NO: 1128831 - RNA, 21 nt, Human
caccacacgacgacugacacc

SEQ ID NO: 1128832 - RNA, 18 nt, Human
caccacacgacgacuggc

SEQ ID NO: 1128833 - RNA, 22 nt, Human
caccauaauggaagcuucccaa

SEQ ID NO: 1128834 - RNA, 21 nt, Human
cacccacagacccaagcccaa

SEQ ID NO: 1128835 - RNA, 22 nt, Human
cacccacagacccaagcccaag

SEQ ID NO: 1128836 - RNA, 20 nt, Human
caccccaggacaaggcccac

SEQ ID NO: 1128837 - RNA, 28 nt, Human
cacccugugcauucagcacucccacccc

SEQ ID NO: 1128838 - RNA, 22 nt, Human
caccgaguagaagagacccuga

SEQ ID NO: 1128839 - RNA, 22 nt, Human
cacuagagucccccucaccccc

SEQ ID NO: 1128840 - RNA, 21 nt, Human
cacuauauuggccaagcuggu

SEQ ID NO: 1128841 - RNA, 24 nt, Human
cacuauauuggccaagcuggucuc

SEQ ID NO: 1128842 - RNA, 19 nt, Human
cacucccacccccaccagc

SEQ ID NO: 1128843 - RNA, 20 nt, Human
cagaacacaggccugccccc

SEQ ID NO: 1128844 - RNA, 20 nt, Human
cagacacacaucggaugccc

SEQ ID NO: 1128845 - RNA, 20 nt, Human
cagagaagccccuaccccuc

SEQ ID NO: 1128846 - RNA, 18 nt, Human
cagauaggcuccuuccca

SEQ ID NO: 1128847 - RNA, 18 nt, Human
cagcaacacccagggaca

SEQ ID NO: 1128848 - RNA, 24 nt, Human
cagcacagcuggccacacccacac

SEQ ID NO: 1128849 - RNA, 22 nt, Human
cagcagacagaaggagaccaag

SEQ ID NO: 1128850 - RNA, 23 nt, Human
cagcaggcagcaacacccaggga

SEQ ID NO: 1128851 - RNA, 21 nt, Human
cagcaucacccugugcauuca

SEQ ID NO: 1128852 - RNA, 23 nt, Human
cagcaucacccugugcauucagc

SEQ ID NO: 1128853 - RNA, 27 nt, Human
cagcauccuuugcggaccucacucaga

SEQ ID NO: 1128854 - RNA, 19 nt, Human
cagcccaggacaggguagu

SEQ ID NO: 1128855 - RNA, 21 nt, Human
cagccccccagccugcuuccc

SEQ ID NO: 1128856 - RNA, 21 nt, Human
cagcccccuguggcccucgac

SEQ ID NO: 1128857 - RNA, 20 nt, Human
cagccgcaggggcugggcug

SEQ ID NO: 1128858 - RNA, 25 nt, Human
cagccggacaccugaguccacagcc

SEQ ID NO: 1128859 - RNA, 19 nt, Human
caggacagacugagguggg

SEQ ID NO: 1128860 - RNA, 24 nt, Human
caggaccaggucacccacagaccc

SEQ ID NO: 1128861 - RNA, 28 nt, Human
caggaccaggucacccacagacccaagc

SEQ ID NO: 1128862 - RNA, 21 nt, Human
caggaccccugguccuggacc

SEQ ID NO: 1128863 - RNA, 18 nt, Human
caggagcucccagccagu

SEQ ID NO: 1128864 - RNA, 24 nt, Human
cagggaacugcaaauccuucccca

SEQ ID NO: 1128865 - RNA, 25 nt, Human
caggguagucagaguggacacugcc

SEQ ID NO: 1128866 - RNA, 21 nt, Human
cauaauggaagcuucccacag

SEQ ID NO: 1128867 - RNA, 19 nt, Human
caugccuccacggguccca

SEQ ID NO: 1128868 - RNA, 21 nt, Human
caugccuccacgggucccaaa

SEQ ID NO: 1128869 - RNA, 23 nt, Human
ccaaagugcugggauuacaggca

SEQ ID NO: 1128870 - RNA, 24 nt, Human
ccaaagugcugggauuacaggcau

SEQ ID NO: 1128871 - RNA, 24 nt, Human
ccaacacacacacacacacaaaca

SEQ ID NO: 1128872 - RNA, 22 nt, Human
ccaaugccaggacaagcaacaa

SEQ ID NO: 1128873 - RNA, 25 nt, Human
ccacaccauccccucuacagcccug

SEQ ID NO: 1128874 - RNA, 27 nt, Human
ccacaccauccccucuacagcccuggc

SEQ ID NO: 1128875 - RNA, 20 nt, Human
ccacacccacaccauccccu

SEQ ID NO: 1128876 - RNA, 21 nt, Human
ccacacccacaccauccccuc

SEQ ID NO: 1128877 - RNA, 21 nt, Human
ccacacccaggcagacagaca

SEQ ID NO: 1128878 - RNA, 23 nt, Human
ccacacgacgacuggcacaucac

SEQ ID NO: 1128879 - RNA, 26 nt, Human
ccacagacccaagcccaagucaccac

SEQ ID NO: 1128880 - RNA, 20 nt, Human
ccacagcacaucugcuaccc

SEQ ID NO: 1128881 - RNA, 18 nt, Human
ccacccccaccagccccc

SEQ ID NO: 1128882 - RNA, 22 nt, Human
ccagagccgcgccaagccaagc

SEQ ID NO: 1128883 - RNA, 19 nt, Human
ccagaucacgccacccugg

SEQ ID NO: 1128884 - RNA, 24 nt, Human
ccagcccccuguggcccucgaccc

SEQ ID NO: 1128885 - RNA, 22 nt, Human
ccaggcccuggugaccccugac

SEQ ID NO: 1128886 - RNA, 21 nt, Human
ccagggacccuggggaccgga

SEQ ID NO: 1128887 - RNA, 19 nt, Human
ccagggcaggacaccccaa

SEQ ID NO: 1128888 - RNA, 24 nt, Human
cccaaagugcugggauuacaggca

SEQ ID NO: 1128889 - RNA, 21 nt, Human
cccaacacacacacacacaca

SEQ ID NO: 1128890 - RNA, 21 nt, Human
cccacacccaggcagacagac

SEQ ID NO: 1128891 - RNA, 18 nt, Human
cccacagacccaagccca

SEQ ID NO: 1128892 - RNA, 22 nt, Human
cccacuaaauacagagcuccug

SEQ ID NO: 1128893 - RNA, 20 nt, Human
cccagagaagccccuacccc

SEQ ID NO: 1128894 - RNA, 23 nt, Human
cccagagccgcgccaagccaagc

SEQ ID NO: 1128895 - RNA, 21 nt, Human
cccagccaagaggguggguca

SEQ ID NO: 1128896 - RNA, 22 nt, Human
cccagccagugggggccggggc

SEQ ID NO: 1128897 - RNA, 18 nt, Human
cccaggcagacagacaga

SEQ ID NO: 1128898 - RNA, 22 nt, Human
cccaggcagacagacagacaca

SEQ ID NO: 1128899 - RNA, 25 nt, Human
ccccaagggccacacaauggccccc

SEQ ID NO: 1128900 - RNA, 18 nt, Human
ccccacacccaggcagac

SEQ ID NO: 1128901 - RNA, 24 nt, Human
ccccagaacacaggccugcccccu

SEQ ID NO: 1128902 - RNA, 20 nt, Human
ccccagcuggcugucaccaa

SEQ ID NO: 1128903 - RNA, 22 nt, Human
ccccagcuucacauucucccug

SEQ ID NO: 1128904 - RNA, 24 nt, Human
ccccaggcccccuccugcaaggcc

SEQ ID NO: 1128905 - RNA, 25 nt, Human
cccccaacacacacacacacacaaa

SEQ ID NO: 1128906 - RNA, 19 nt, Human
cccccagaacacaggccug

SEQ ID NO: 1128907 - RNA, 26 nt, Human
ccccccaacacacacacacacacaaa

SEQ ID NO: 1128908 - RNA, 24 nt, Human
ccccgacuguccacagcacaucug

SEQ ID NO: 1128909 - RNA, 23 nt, Human
ccccgcccagccccgacucacag

SEQ ID NO: 1128910 - RNA, 24 nt, Human
ccccuccaccugaaacugcaucca

SEQ ID NO: 1128911 - RNA, 19 nt, Human
ccccucuacagcccuggca

SEQ ID NO: 1128912 - RNA, 21 nt, Human
ccccugaggauguucucccuc

SEQ ID NO: 1128913 - RNA, 19 nt, Human
cccuccagccuauguggca

SEQ ID NO: 1128914 - RNA, 26 nt, Human
cccuccagccuauguggcagcccccc

SEQ ID NO: 1128915 - RNA, 21 nt, Human
ccgaagcccagcaucacccug

SEQ ID NO: 1128916 - RNA, 24 nt, Human
ccgaagcccagcaucacccugugc

SEQ ID NO: 1128917 - RNA, 19 nt, Human
ccgcagaugacccgacccc

SEQ ID NO: 1128918 - RNA, 26 nt, Human
ccgcccaccuuagccucccaaagugc

SEQ ID NO: 1128919 - RNA, 25 nt, Human
ccggagugugcuaacacaugccccc

SEQ ID NO: 1128920 - RNA, 21 nt, Human
ccggcccugcagugccccucc

SEQ ID NO: 1128921 - RNA, 21 nt, Human
ccggcccugcagugccccucc

SEQ ID NO: 1128922 - RNA, 19 nt, Human
ccuaaccccuaaaacaggg

SEQ ID NO: 1128923 - RNA, 23 nt, Human
ccucaccccacacccaggcagac

SEQ ID NO: 1128924 - RNA, 24 nt, Human
ccucaccccacacccaggcagaca

SEQ ID NO: 1128925 - RNA, 24 nt, Human
ccuccaaacuucacggagcaggac

SEQ ID NO: 1128926 - RNA, 18 nt, Human
ccucccucagcacagcug

SEQ ID NO: 1128927 - RNA, 23 nt, Human
ccucccugcuguugccucagaaa

SEQ ID NO: 1128928 - RNA, 18 nt, Human
ccugaaacugcauccaac

SEQ ID NO: 1128929 - RNA, 24 nt, Human
ccugaccucaggugauccgcccac

SEQ ID NO: 1128930 - RNA, 19 nt, Human
ccugagcugcaguuuccug

SEQ ID NO: 1128931 - RNA, 20 nt, Human
ccugcagccgcccccagggc

SEQ ID NO: 1128932 - RNA, 20 nt, Human
ccugcagccgcccccagggc

SEQ ID NO: 1128933 - RNA, 24 nt, Human
ccugcagugccccuccguggcugg

SEQ ID NO: 1128934 - RNA, 21 nt, Human
ccugccaucccggcccagagc

SEQ ID NO: 1128935 - RNA, 24 nt, Human
ccugcuucccauggaaccccccca

SEQ ID NO: 1128936 - RNA, 22 nt, Human
ccuggagccgccaccccaggac

SEQ ID NO: 1128937 - RNA, 24 nt, Human
ccuggccccucccugguccccugg

SEQ ID NO: 1128938 - RNA, 22 nt, Human
ccugugcauucagcacucccac

SEQ ID NO: 1128939 - RNA, 23 nt, Human
cgacccagagaagccccuacccc

SEQ ID NO: 1128940 - RNA, 23 nt, Human
cgcagcacagaaugucuggcgcc

SEQ ID NO: 1128941 - RNA, 24 nt, Human
cgccaggcaaggcggcugcuggug

SEQ ID NO: 1128942 - RNA, 21 nt, Human
cgcccagccccgacucacagg

SEQ ID NO: 1128943 - RNA, 21 nt, Human
cggaacuugggcaggagcucc

SEQ ID NO: 1128944 - RNA, 21 nt, Human
cggcuccagaucacgccaccc

SEQ ID NO: 1128945 - RNA, 19 nt, Human
cuccagugacucugggcuc

SEQ ID NO: 1128946 - RNA, 21 nt, Human
cucgcugcucuugcagccgca

SEQ ID NO: 1128947 - RNA, 18 nt, Human
cucugccuuucugacugg

SEQ ID NO: 1128948 - RNA, 25 nt, Human
cucugccuuucugacuggggcuugg

SEQ ID NO: 1128949 - RNA, 19 nt, Human
cucuugcagccgcaggggc

SEQ ID NO: 1128950 - RNA, 28 nt, Human
cugaaacugcauccaacaggaaccccca

SEQ ID NO: 1128951 - RNA, 20 nt, Human
cugcagugccccuccguggc

SEQ ID NO: 1128952 - RNA, 19 nt, Human
cuggacacugggccagggc

SEQ ID NO: 1128953 - RNA, 23 nt, Human
cuggcccuuagcaccgaguagaa

SEQ ID NO: 1128954 - RNA, 23 nt, Human
cugggcucucggggguggcagag

SEQ ID NO: 1128955 - RNA, 20 nt, Human
cuugcagccgcaggggcugg

SEQ ID NO: 1128956 - RNA, 22 nt, Human
gaagccuuggggacccuccaaa

SEQ ID NO: 1128957 - RNA, 19 nt, Human
gacaagcaacaaaaagaaa

SEQ ID NO: 1128958 - RNA, 24 nt, Human
gacaccugaguccacagcccagcc

SEQ ID NO: 1128959 - RNA, 22 nt, Human
gaccaggucacccacagaccca

SEQ ID NO: 1128960 - RNA, 24 nt, Human
gaccucaggugauccgcccaccuu

SEQ ID NO: 1128961 - RNA, 22 nt, Human
gagcaggaccccugguccugga

SEQ ID NO: 1128962 - RNA, 19 nt, Human
gagcccccuccaccugaaa

SEQ ID NO: 1128963 - RNA, 18 nt, Human
gagcucaagcagcugcuc

SEQ ID NO: 1128964 - RNA, 21 nt, Human
gaggcagcagacagaaggaga

SEQ ID NO: 1128965 - RNA, 18 nt, Human
gauuacaggcaugaguca

SEQ ID NO: 1128966 - RNA, 21 nt, Human
gauuacaggcaugagucacca

SEQ ID NO: 1128967 - RNA, 22 nt, Human
gauuacaggcaugagucaccac

SEQ ID NO: 1128968 - RNA, 22 nt, Human
gcaaggcggcugcuggugggug

SEQ ID NO: 1128969 - RNA, 25 nt, Human
gcacagacacacaucggaugccccu

SEQ ID NO: 1128970 - RNA, 22 nt, Human
gcacaggaccaggucacccaca

SEQ ID NO: 1128971 - RNA, 22 nt, Human
gcagcacagaaugucuggcgcc

SEQ ID NO: 1128972 - RNA, 22 nt, Human
gcauccuuugcggaccucacuc

SEQ ID NO: 1128973 - RNA, 22 nt, Human
gccacacacagaugcacagaca

SEQ ID NO: 1128974 - RNA, 21 nt, Human
gccacacccacaccauccccu

SEQ ID NO: 1128975 - RNA, 19 nt, Human
gccagccuccucccugcca

SEQ ID NO: 1128976 - RNA, 22 nt, Human
gcccaagcuggccccaggcccc

SEQ ID NO: 1128977 - RNA, 23 nt, Human
gccccaggcccccuccugcaagg

SEQ ID NO: 1128978 - RNA, 20 nt, Human
gcccccaaacucugccuuuc

SEQ ID NO: 1128979 - RNA, 19 nt, Human
gcccccagaacacaggccu

SEQ ID NO: 1128980 - RNA, 19 nt, Human
gccccucccugcuguugcc

SEQ ID NO: 1128981 - RNA, 24 nt, Human
gcccuggcaaguccccccagcccu

SEQ ID NO: 1128982 - RNA, 22 nt, Human
gcccuggccucugccaugucuc

SEQ ID NO: 1128983 - RNA, 23 nt, Human
gcccuggccucugccaugucuca

SEQ ID NO: 1128984 - RNA, 20 nt, Human
gcccuggugaccccugacug

SEQ ID NO: 1128985 - RNA, 18 nt, Human
gccggggccgcagcacag

SEQ ID NO: 1128986 - RNA, 21 nt, Human
gcugcugguggguguuguggg

SEQ ID NO: 1128987 - RNA, 20 nt, Human
gcuggccccaggcccccucc

SEQ ID NO: 1128988 - RNA, 24 nt, Human
ggagacagaugaccccugaggaug

SEQ ID NO: 1128989 - RNA, 18 nt, Human
ggagaggggcagguggca

SEQ ID NO: 1128990 - RNA, 19 nt, Human
ggagcagcccagcccccca

SEQ ID NO: 1128991 - RNA, 23 nt, Human
ggaggcuccccgcccagccccga

SEQ ID NO: 1128992 - RNA, 23 nt, Human
ggagguggagacaaggguggggc

SEQ ID NO: 1128993 - RNA, 19 nt, Human
ggauuacaggcaugaguca

SEQ ID NO: 1128994 - RNA, 22 nt, Human
ggcaggcaggaggacagugucc

SEQ ID NO: 1128995 - RNA, 18 nt, Human
ggcccagagccgcgccaa

SEQ ID NO: 1128996 - RNA, 20 nt, Human
ggccccaggcccccuccugc

SEQ ID NO: 1128997 - RNA, 19 nt, Human
ggcucucggggguggcaga

SEQ ID NO: 1128998 - RNA, 21 nt, Human
ggcugggcuggugggauccug

SEQ ID NO: 1128999 - RNA, 23 nt, Human
ggcuggugggauccugggagguc

SEQ ID NO: 1129000 - RNA, 21 nt, Human
gggcaggacaccccaagggcc

SEQ ID NO: 1129001 - RNA, 22 nt, Human
gggccggggccgcagcacagaa

SEQ ID NO: 1129002 - RNA, 19 nt, Human
gggggacguggaggcgaug

SEQ ID NO: 1129003 - RNA, 18 nt, Human
gggguuucacuauauugg

SEQ ID NO: 1129004 - RNA, 18 nt, Human
gguagucagaguggacac

SEQ ID NO: 1129005 - RNA, 19 nt, Human
ggucucgaacuccugaccu

SEQ ID NO: 1129006 - RNA, 20 nt, Human
gguggagacaaggguggggc

SEQ ID NO: 1129007 - RNA, 18 nt, Human
guagagagagcuuccgcc

SEQ ID NO: 1129008 - RNA, 24 nt, Human
gugauccgcccaccuuagccuccc

SEQ ID NO: 1129009 - RNA, 25 nt, Human
guggagacaaggguggggccagcgg

SEQ ID NO: 1129010 - RNA, 25 nt, Human
uaacacccuagguacaugcccacca

SEQ ID NO: 1129011 - RNA, 21 nt, Human
uacagcccuggcaaguccccc

SEQ ID NO: 1129012 - RNA, 22 nt, Human
uacaggcaugagucaccacacc

SEQ ID NO: 1129013 - RNA, 24 nt, Human
uauauuggccaagcuggucucgaa

SEQ ID NO: 1129014 - RNA, 22 nt, Human
ucacucagaggccgggguuccu

SEQ ID NO: 1129015 - RNA, 19 nt, Human
ucacuggcuggcgccaggc

SEQ ID NO: 1129016 - RNA, 18 nt, Human
ucagcacagcuggccaca

SEQ ID NO: 1129017 - RNA, 24 nt, Human
ucagcacucccacccccaccagcc

SEQ ID NO: 1129018 - RNA, 22 nt, Human
ucaggaggcuccccgcccagcc

SEQ ID NO: 1129019 - RNA, 21 nt, Human
uccaagcugagggagaggggc

SEQ ID NO: 1129020 - RNA, 21 nt, Human
uccacagcacaucugcuaccc

SEQ ID NO: 1129021 - RNA, 26 nt, Human
uccacagcacaucugcuacccgaagc

SEQ ID NO: 1129022 - RNA, 24 nt, Human
ucccaaagugcugggauuacaggc

SEQ ID NO: 1129023 - RNA, 19 nt, Human
ucccacaggcagggaccug

SEQ ID NO: 1129024 - RNA, 22 nt, Human
ucccaggccgcagugaccagcc

SEQ ID NO: 1129025 - RNA, 21 nt, Human
ucccauggaacccccccaaca

SEQ ID NO: 1129026 - RNA, 19 nt, Human
uccccacgugugagggcua

SEQ ID NO: 1129027 - RNA, 21 nt, Human
uccccccagcccugcggcucc

SEQ ID NO: 1129028 - RNA, 22 nt, Human
ucccuacccccacuuugucccc

SEQ ID NO: 1129029 - RNA, 23 nt, Human
uccguggcugggagacagaugac

SEQ ID NO: 1129030 - RNA, 25 nt, Human
uccuuugcggaccucacucagaggc

SEQ ID NO: 1129031 - RNA, 18 nt, Human
ucucaaggcccugggcag

SEQ ID NO: 1129032 - RNA, 25 nt, Human
ucucccugcccuggccucugccaug

SEQ ID NO: 1129033 - RNA, 23 nt, Human
ucucgaacuccugaccucaggug

SEQ ID NO: 1129034 - RNA, 23 nt, Human
ucugaacuggagagagccggggc

SEQ ID NO: 1129035 - RNA, 21 nt, Human
ugaacuggagagagccgaggu

SEQ ID NO: 1129036 - RNA, 20 nt, Human
ugaccccugacugcaacccu

SEQ ID NO: 1129037 - RNA, 22 nt, Human
ugaccccugaggauguucuccc

SEQ ID NO: 1129038 - RNA, 18 nt, Human
ugaccucaggugauccgc

SEQ ID NO: 1129039 - RNA, 21 nt, Human
ugaccucaggugauccgccca

SEQ ID NO: 1129040 - RNA, 24 nt, Human
ugaccucaggugauccgcccaccu

SEQ ID NO: 1129041 - RNA, 26 nt, Human
ugagcccccagaacacaggccugccc

SEQ ID NO: 1129042 - RNA, 19 nt, Human
ugagcugcaguuuccuggc

SEQ ID NO: 1129043 - RNA, 21 nt, Human
ugaggauguucucccucuccc

SEQ ID NO: 1129044 - RNA, 18 nt, Human
ugaggucaugccggacac

SEQ ID NO: 1129045 - RNA, 19 nt, Human
ugaggucaugccggacacu

SEQ ID NO: 1129046 - RNA, 20 nt, Human
ugaggucaugccggacacug

SEQ ID NO: 1129047 - RNA, 21 nt, Human
ugaggugggguuccagaggca

SEQ ID NO: 1129048 - RNA, 24 nt, Human
ugauccgcccaccuuagccuccca

SEQ ID NO: 1129049 - RNA, 25 nt, Human
ugcacagacacacaucggaugcccc

SEQ ID NO: 1129050 - RNA, 25 nt, Human
ugcagccgcaggggcugggcuggug

SEQ ID NO: 1129051 - RNA, 25 nt, Human
ugccaggacaagcaacaaaaagaaa

SEQ ID NO: 1129052 - RNA, 24 nt, Human
ugccaugucucacuaggccuggag

SEQ ID NO: 1129053 - RNA, 22 nt, Human
ugcccaggccagccccacccuu

SEQ ID NO: 1129054 - RNA, 24 nt, Human
ugcccaggccagccccacccuugu

SEQ ID NO: 1129055 - RNA, 18 nt, Human
ugcccaggcugagccagg

SEQ ID NO: 1129056 - RNA, 22 nt, Human
ugcccaggcugagccaggcccu

SEQ ID NO: 1129057 - RNA, 25 nt, Human
ugcccagugccccuaaaagugggca

SEQ ID NO: 1129058 - RNA, 22 nt, Human
ugccucagaaacccggagcagc

SEQ ID NO: 1129059 - RNA, 26 nt, Human
ugccugcccucuuuuggagaaugcug

SEQ ID NO: 1129060 - RNA, 23 nt, Human
ugcuaacacaugccccacggugc

SEQ ID NO: 1129061 - RNA, 21 nt, Human
ugcuauggccucuggaggaca

SEQ ID NO: 1129062 - RNA, 24 nt, Human
ugcugaggcgucaggcggccucgu

SEQ ID NO: 1129063 - RNA, 24 nt, Human
ugcugggauuacaggcaugaguca

SEQ ID NO: 1129064 - RNA, 18 nt, Human
uggaacccccccaacaca

SEQ ID NO: 1129065 - RNA, 21 nt, Human
uggagaaugcuggggcccaag

SEQ ID NO: 1129066 - RNA, 25 nt, Human
uggagacaaggguggggccagcgga

SEQ ID NO: 1129067 - RNA, 24 nt, Human
uggagagagccgagguucgggagg

SEQ ID NO: 1129068 - RNA, 26 nt, Human
uggcagaggaccaagcagggccccca

SEQ ID NO: 1129069 - RNA, 20 nt, Human
uggcaggggagaaggaggcu

SEQ ID NO: 1129070 - RNA, 23 nt, Human
uggcaggggagaaggaggcuggg

SEQ ID NO: 1129071 - RNA, 24 nt, Human
uggccaagcuggucucgaacuccu

SEQ ID NO: 1129072 - RNA, 22 nt, Human
uggccagagaagccuuggggac

SEQ ID NO: 1129073 - RNA, 19 nt, Human
uggccccaggcccccuccu

SEQ ID NO: 1129074 - RNA, 25 nt, Human
uggcgccaggcaaggcggcugcugg

SEQ ID NO: 1129075 - RNA, 18 nt, Human
ugggaaggccgcacagca

SEQ ID NO: 1129076 - RNA, 24 nt, Human
ugggaaggccgcacagcaggcagc

SEQ ID NO: 1129077 - RNA, 21 nt, Human
ugggaggucugugcccaggca

SEQ ID NO: 1129078 - RNA, 18 nt, Human
ugggauuacaggcaugag

SEQ ID NO: 1129079 - RNA, 18 nt, Human
ugggauuacaggcaugag

SEQ ID NO: 1129080 - RNA, 22 nt, Human
ugggauuacaggcaugagucac

SEQ ID NO: 1129081 - RNA, 23 nt, Human
ugggauuacaggcaugagucacc

SEQ ID NO: 1129082 - RNA, 24 nt, Human
ugggauuacaggcaugagucacca

SEQ ID NO: 1129083 - RNA, 24 nt, Human
ugggcaggagcucccagccagugg

SEQ ID NO: 1129084 - RNA, 19 nt, Human
uggggcuugggggcuacag

SEQ ID NO: 1129085 - RNA, 22 nt, Human
ugggggacguggaggcgaugag

SEQ ID NO: 1129086 - RNA, 27 nt, Human
ugggguuccagaggcagaggaaugccc

SEQ ID NO: 1129087 - RNA, 20 nt, Human
ugguggguguugugggggac

SEQ ID NO: 1129088 - RNA, 21 nt, Human
uguagagaaagcuugccccca

SEQ ID NO: 1129089 - RNA, 23 nt, Human
uguccaagcugagggagaggggc

SEQ ID NO: 1129090 - RNA, 25 nt, Human
ugugcccaggcaguggcugggaggu

SEQ ID NO: 1129091 - RNA, 20 nt, Human
uguggauuuguugauugucu

SEQ ID NO: 1129092 - RNA, 18 nt, Human
ugugggcagaagguagga

SEQ ID NO: 1129093 - RNA, 19 nt, Human
uguugugggggacguggag

SEQ ID NO: 1129094 - RNA, 22 nt, Human
uuagagcagcuccagugacucu

SEQ ID NO: 1129095 - RNA, 25 nt, Human
uuagcaccgaguagaagagacccug

SEQ ID NO: 1129096 - RNA, 18 nt, Human
uuagccucccaaagugcu

SEQ ID NO: 1129097 - RNA, 18 nt, Human
uucagcacucccaccccc

SEQ ID NO: 1129098 - RNA, 19 nt, Human
uuccuguccaagcugaggg

SEQ ID NO: 1129099 - RNA, 22 nt, Human
uugggcaggagcucccagccag

SEQ ID NO: 1129100 - RNA, 21 nt, Human
uuucacuauauuggccaagcu

SEQ ID NO: 1129101 - RNA, 18 nt, Human
uuuccuggccccucccug

SEQ ID NO: 1129102 - RNA, 24 nt, Human
uuuguggauuuguugauugucuga

SEQ ID NO: 1129103 - RNA, 22 nt, Human
aaaccaaaggucccuuccucag

SEQ ID NO: 1129104 - RNA, 19 nt, Human
aaaccaagacaagugagag

SEQ ID NO: 1129105 - RNA, 21 nt, Human
aaaccaggcugagugggaagg

SEQ ID NO: 1129106 - RNA, 23 nt, Human
aaaccccagcuuguagggcccca

SEQ ID NO: 1129107 - RNA, 19 nt, Human
aagcagcagaggaggcucc

SEQ ID NO: 1129108 - RNA, 21 nt, Human
acccucaccaggaaaccaggc

SEQ ID NO: 1129109 - RNA, 18 nt, Human
acugccucagcccuucaa

SEQ ID NO: 1129110 - RNA, 21 nt, Human
agaggaggcuccaaggagggu

SEQ ID NO: 1129111 - RNA, 19 nt, Human
agagguggacaguuggccc

SEQ ID NO: 1129112 - RNA, 18 nt, Human
agcaggagacuugggccc

SEQ ID NO: 1129113 - RNA, 21 nt, Human
aggaagggaggggagcagggc

SEQ ID NO: 1129114 - RNA, 22 nt, Human
aggaagggcagcuucuggcucu

SEQ ID NO: 1129115 - RNA, 21 nt, Human
aggagggugaggaaggagugg

SEQ ID NO: 1129116 - RNA, 18 nt, Human
aggggcagggagagcugg

SEQ ID NO: 1129117 - RNA, 23 nt, Human
agugacaaggcagccagcccuga

SEQ ID NO: 1129118 - RNA, 18 nt, Human
caacuucucuuccucuuc

SEQ ID NO: 1129119 - RNA, 23 nt, Human
caagacaagugagagaggugagc

SEQ ID NO: 1129120 - RNA, 21 nt, Human
cacacagccuuuuguaaaacc

SEQ ID NO: 1129121 - RNA, 23 nt, Human
cacccccucccuggcuggcacca

SEQ ID NO: 1129122 - RNA, 21 nt, Human
cacuccacaagcucuaauuca

SEQ ID NO: 1129123 - RNA, 20 nt, Human
cagccuuuuguaaaaccaag

SEQ ID NO: 1129124 - RNA, 20 nt, Human
cagcuucuggcucucuuccc

SEQ ID NO: 1129125 - RNA, 20 nt, Human
cagggucuucugccuccuga

SEQ ID NO: 1129126 - RNA, 18 nt, Human
caguccccucaggacuug

SEQ ID NO: 1129127 - RNA, 21 nt, Human
ccacuccacaagcucuaauuc

SEQ ID NO: 1129128 - RNA, 21 nt, Human
ccaggaugaggaggaagggca

SEQ ID NO: 1129129 - RNA, 18 nt, Human
ccagucccuccccaggcu

SEQ ID NO: 1129130 - RNA, 23 nt, Human
cccagaccugggccagguuucca

SEQ ID NO: 1129131 - RNA, 20 nt, Human
cccagcuuguagggccccac

SEQ ID NO: 1129132 - RNA, 20 nt, Human
cccagucccuccccaggcuc

SEQ ID NO: 1129133 - RNA, 20 nt, Human
cccaugacugcaggacccuc

SEQ ID NO: 1129134 - RNA, 18 nt, Human
ccccacuccacaagcucu

SEQ ID NO: 1129135 - RNA, 23 nt, Human
ccccaggacucccacccccuccc

SEQ ID NO: 1129136 - RNA, 24 nt, Human
ccccaggcucuacuaauggcuagc

SEQ ID NO: 1129137 - RNA, 26 nt, Human
ccucccaugggccuugcccugggggu

SEQ ID NO: 1129138 - RNA, 22 nt, Human
ccuccugccuccccaggacucc

SEQ ID NO: 1129139 - RNA, 22 nt, Human
ccuuaaaaccccagcuuguagg

SEQ ID NO: 1129140 - RNA, 18 nt, Human
ccuuuugaagacagaagu

SEQ ID NO: 1129141 - RNA, 25 nt, Human
cuagccagucccagucccuccccag

SEQ ID NO: 1129142 - RNA, 24 nt, Human
cuccccaggcucuacuaauggcua

SEQ ID NO: 1129143 - RNA, 18 nt, Human
cucucuucccagcugcug

SEQ ID NO: 1129144 - RNA, 22 nt, Human
cucugagaguggugagguccag

SEQ ID NO: 1129145 - RNA, 22 nt, Human
cugacugccucagcccuucaaa

SEQ ID NO: 1129146 - RNA, 19 nt, Human
gaagacagaaguggaaagg

SEQ ID NO: 1129147 - RNA, 20 nt, Human
gaaguggaaaggagagaaua

SEQ ID NO: 1129148 - RNA, 26 nt, Human
gagaauaguggacaagagagguggac

SEQ ID NO: 1129149 - RNA, 19 nt, Human
gaggaaggaguggcagggc

SEQ ID NO: 1129150 - RNA, 23 nt, Human
gaggaagggcagcuucuggcucu

SEQ ID NO: 1129151 - RNA, 18 nt, Human
gaggaggaggaacugggg

SEQ ID NO: 1129152 - RNA, 20 nt, Human
gaggaggaggaacuggggau

SEQ ID NO: 1129153 - RNA, 22 nt, Human
gagggugaggaaggaguggcag

SEQ ID NO: 1129154 - RNA, 24 nt, Human
gcaauacaagaaccacuggcugag

SEQ ID NO: 1129155 - RNA, 21 nt, Human
gccagcccugacugccucagc

SEQ ID NO: 1129156 - RNA, 18 nt, Human
ggcagcuucuggcucucu

SEQ ID NO: 1129157 - RNA, 20 nt, Human
ggcccagcaucauguccuca

SEQ ID NO: 1129158 - RNA, 20 nt, Human
gggcaugguguccagaaagc

SEQ ID NO: 1129159 - RNA, 21 nt, Human
ggggcagggagagcuggugga

SEQ ID NO: 1129160 - RNA, 19 nt, Human
ggggccaggaugaggagga

SEQ ID NO: 1129161 - RNA, 24 nt, Human
gggggcuggggaggggccaggaug

SEQ ID NO: 1129162 - RNA, 18 nt, Human
gguggggcugcuaaucug

SEQ ID NO: 1129163 - RNA, 19 nt, Human
gugaagggcaggaagggag

SEQ ID NO: 1129164 - RNA, 24 nt, Human
gugaggaaggaguggcagggcugg

SEQ ID NO: 1129165 - RNA, 25 nt, Human
uaaaaccaagacaagugagagaggu

SEQ ID NO: 1129166 - RNA, 29 nt, Human
uagagaaaaccaaaggucccuuccucaau

SEQ ID NO: 1129167 - RNA, 24 nt, Human
ucaacuucucuuccucuuccaaga

SEQ ID NO: 1129168 - RNA, 24 nt, Human
ucagggucuucugccuccugccuc

SEQ ID NO: 1129169 - RNA, 26 nt, Human
ucagggucuucugccuccugccuccc

SEQ ID NO: 1129170 - RNA, 18 nt, Human
ucagugggucuugggugg

SEQ ID NO: 1129171 - RNA, 20 nt, Human
ucccaugggccuugcccugg

SEQ ID NO: 1129172 - RNA, 21 nt, Human
ucccaugggccuugcccuggg

SEQ ID NO: 1129173 - RNA, 22 nt, Human
ucccucuucuugggaaugguuu

SEQ ID NO: 1129174 - RNA, 19 nt, Human
ucccugggguugggaggag

SEQ ID NO: 1129175 - RNA, 23 nt, Human
uccucaguccccucaggacuugg

SEQ ID NO: 1129176 - RNA, 19 nt, Human
ucugaaauaagacacaggg

SEQ ID NO: 1129177 - RNA, 27 nt, Human
ucugccuccugccuccccaggacuccc

SEQ ID NO: 1129178 - RNA, 18 nt, Human
ugacugcaggacccucac

SEQ ID NO: 1129179 - RNA, 19 nt, Human
ugagcaggagacuugggcc

SEQ ID NO: 1129180 - RNA, 20 nt, Human
ugagcaggagacuugggccc

SEQ ID NO: 1129181 - RNA, 18 nt, Human
ugaggaggaagggcagcu

SEQ ID NO: 1129182 - RNA, 23 nt, Human
ugaggaggaagggcagcuucugg

SEQ ID NO: 1129183 - RNA, 18 nt, Human
ugaggucccucuucuugg

SEQ ID NO: 1129184 - RNA, 24 nt, Human
ugcaggacccucaccaggaaacca

SEQ ID NO: 1129185 - RNA, 19 nt, Human
ugccaggacaagcagcucu

SEQ ID NO: 1129186 - RNA, 22 nt, Human
ugcccugggggucccccagggc

SEQ ID NO: 1129187 - RNA, 23 nt, Human
ugcccugggggucccccagggcc

SEQ ID NO: 1129188 - RNA, 23 nt, Human
ugcccuuggucccuucccuccca

SEQ ID NO: 1129189 - RNA, 20 nt, Human
ugcuaaucugcacuucuauc

SEQ ID NO: 1129190 - RNA, 19 nt, Human
uggaaaggagagaauagug

SEQ ID NO: 1129191 - RNA, 20 nt, Human
ugggaggaggaggaacuggg

SEQ ID NO: 1129192 - RNA, 23 nt, Human
ugggaggaggaggaacuggggau

SEQ ID NO: 1129193 - RNA, 18 nt, Human
ugggagggguaaggcaua

SEQ ID NO: 1129194 - RNA, 22 nt, Human
ugggagggguaaggcauagagu

SEQ ID NO: 1129195 - RNA, 21 nt, Human
ugggauagacaagcagcagag

SEQ ID NO: 1129196 - RNA, 20 nt, Human
uggggaggggccaggaugag

SEQ ID NO: 1129197 - RNA, 20 nt, Human
uggguugggagggguaaggc

SEQ ID NO: 1129198 - RNA, 22 nt, Human
ugguguuuuccaccuguucuug

SEQ ID NO: 1129199 - RNA, 20 nt, Human
uguccagaaagcuggugaag

SEQ ID NO: 1129200 - RNA, 21 nt, Human
ugucugaaauaagacacaggg

SEQ ID NO: 1129201 - RNA, 18 nt, Human
uucacaguauuggcgggg

SEQ ID NO: 1129202 - RNA, 22 nt, Human
uugaagacagaaguggaaagga

SEQ ID NO: 1129203 - RNA, 21 nt, Human
uugccagcugaggucccucuu

SEQ ID NO: 1129204 - RNA, 19 nt, Human
uuggccuagccagucccag

SEQ ID NO: 1129205 - RNA, 20 nt, Human
uugggauagacaagcagcag

SEQ ID NO: 1129206 - RNA, 18 nt, Human
uuuuuuggcacugucuac

SEQ ID NO: 1129207 - RNA, 21 nt, Human
aaaagagacuuugcaaauaug

SEQ ID NO: 1129208 - RNA, 20 nt, Human
aaccuccuccucccuacuuc

SEQ ID NO: 1129209 - RNA, 19 nt, Human
aaggaaacugaggcacaga

SEQ ID NO: 1129210 - RNA, 19 nt, Human
aaguaguugggauuacagg

SEQ ID NO: 1129211 - RNA, 20 nt, Human
acagggaaacagaagcagag

SEQ ID NO: 1129212 - RNA, 20 nt, Human
acagggaaacagaagcagag

SEQ ID NO: 1129213 - RNA, 25 nt, Human
acucuguugcccaggcuggagugua

SEQ ID NO: 1129214 - RNA, 21 nt, Human
agaggcuggagugagaugcuu

SEQ ID NO: 1129215 - RNA, 20 nt, Human
aggaaugcagcccugcccaa

SEQ ID NO: 1129216 - RNA, 18 nt, Human
aggcacagagggcugagc

SEQ ID NO: 1129217 - RNA, 25 nt, Human
aggccggaguacuggccacaccuag

SEQ ID NO: 1129218 - RNA, 21 nt, Human
aguguaguggcacaaucucag

SEQ ID NO: 1129219 - RNA, 23 nt, Human
augcuuugauguuggaggaaggg

SEQ ID NO: 1129220 - RNA, 20 nt, Human
caagacagggaaacagaagc

SEQ ID NO: 1129221 - RNA, 21 nt, Human
cacaguagcagcuaggaggcc

SEQ ID NO: 1129222 - RNA, 24 nt, Human
cacaguagcagcuaggaggccgga

SEQ ID NO: 1129223 - RNA, 19 nt, Human
caccuaggacugaaugaag

SEQ ID NO: 1129224 - RNA, 22 nt, Human
cacucuguugcccaggcuggag

SEQ ID NO: 1129225 - RNA, 22 nt, Human
cagaagcagaggcuggagugag

SEQ ID NO: 1129226 - RNA, 22 nt, Human
cagagggcugagccccaugccu

SEQ ID NO: 1129227 - RNA, 23 nt, Human
cagcccugcccaaaccuugauuu

SEQ ID NO: 1129228 - RNA, 22 nt, Human
cagcucacugcaaccuccuccu

SEQ ID NO: 1129229 - RNA, 20 nt, Human
cagcuccucaaucucguccu

SEQ ID NO: 1129230 - RNA, 21 nt, Human
cagggaaacagaagcagaggc

SEQ ID NO: 1129231 - RNA, 18 nt, Human
cauguucacauucccagg

SEQ ID NO: 1129232 - RNA, 19 nt, Human
ccaagacagggaaacagaa

SEQ ID NO: 1129233 - RNA, 26 nt, Human
ccacaugcguuauuccuguugguccu

SEQ ID NO: 1129234 - RNA, 22 nt, Human
cccaaguaguugggauuacagg

SEQ ID NO: 1129235 - RNA, 20 nt, Human
cccuacuucaagcgauucuc

SEQ ID NO: 1129236 - RNA, 21 nt, Human
ccgcagcuccucaaucucguc

SEQ ID NO: 1129237 - RNA, 21 nt, Human
ccucaaucucguccugcggag

SEQ ID NO: 1129238 - RNA, 18 nt, Human
ccuccucccuacuucaag

SEQ ID NO: 1129239 - RNA, 20 nt, Human
ccuccuccucccuacuucaa

SEQ ID NO: 1129240 - RNA, 21 nt, Human
ccucucaaggcaaggaaaagg

SEQ ID NO: 1129241 - RNA, 21 nt, Human
ccucucaaggcaaggaaaagg

SEQ ID NO: 1129242 - RNA, 24 nt, Human
ccuuugaccuccaggaucagaaga

SEQ ID NO: 1129243 - RNA, 24 nt, Human
cggagucucacucuguugcccagg

SEQ ID NO: 1129244 - RNA, 24 nt, Human
cucacucuguugcccaggcuggag

SEQ ID NO: 1129245 - RNA, 24 nt, Human
cucacugcaaccuccuccucccua

SEQ ID NO: 1129246 - RNA, 19 nt, Human
cucccugccuuagccuccc

SEQ ID NO: 1129247 - RNA, 22 nt, Human
cugcaaccuccuccucccuacu

SEQ ID NO: 1129248 - RNA, 24 nt, Human
cugcaaccuccuccucccuacuuc

SEQ ID NO: 1129249 - RNA, 21 nt, Human
cugccuuagccucccaaguag

SEQ ID NO: 1129250 - RNA, 22 nt, Human
cugggcccacaguagcagcuag

SEQ ID NO: 1129251 - RNA, 23 nt, Human
cuuagccucccaaguaguuggga

SEQ ID NO: 1129252 - RNA, 22 nt, Human
gcaaggaaaagguuucuccccu

SEQ ID NO: 1129253 - RNA, 20 nt, Human
gcccaggcuggaguguagug

SEQ ID NO: 1129254 - RNA, 22 nt, Human
gccggaguacuggccacaccua

SEQ ID NO: 1129255 - RNA, 24 nt, Human
gcguuauuccuguugguccucaca

SEQ ID NO: 1129256 - RNA, 22 nt, Human
gcucacugcaaccuccuccucc

SEQ ID NO: 1129257 - RNA, 20 nt, Human
gggaccuggauguggcaggc

SEQ ID NO: 1129258 - RNA, 22 nt, Human
guaaauuaaggaucccaagaca

SEQ ID NO: 1129259 - RNA, 26 nt, Human
uaaggaaacugaggcacagagggcug

SEQ ID NO: 1129260 - RNA, 24 nt, Human
ucacucuguugcccaggcuggagu

SEQ ID NO: 1129261 - RNA, 18 nt, Human
ucacugcaaccuccuccc

SEQ ID NO: 1129262 - RNA, 19 nt, Human
ucacugcaaccuccuccuc

SEQ ID NO: 1129263 - RNA, 27 nt, Human
ucacugcaaccuccuccucccuacuuc

SEQ ID NO: 1129264 - RNA, 23 nt, Human
ucagaagauaauaaucugguguu

SEQ ID NO: 1129265 - RNA, 25 nt, Human
ucagcucacugcaaccuccuccucc

SEQ ID NO: 1129266 - RNA, 18 nt, Human
ucccaggaucugugaaug

SEQ ID NO: 1129267 - RNA, 23 nt, Human
ucccaggaucugugaauguugcc

SEQ ID NO: 1129268 - RNA, 21 nt, Human
ucccuacuucaagcgauucuc

SEQ ID NO: 1129269 - RNA, 20 nt, Human
uccucccacagcggcugugg

SEQ ID NO: 1129270 - RNA, 22 nt, Human
uccugcggagggaaggaaggaa

SEQ ID NO: 1129271 - RNA, 23 nt, Human
ucucacucuguugcccaggcugg

SEQ ID NO: 1129272 - RNA, 24 nt, Human
ucucacucuguugcccaggcugga

SEQ ID NO: 1129273 - RNA, 26 nt, Human
ucucacucuguugcccaggcuggagu

SEQ ID NO: 1129274 - RNA, 27 nt, Human
ucucacucuguugcccaggcuggagug

SEQ ID NO: 1129275 - RNA, 18 nt, Human
ucuguugcccaggcugga

SEQ ID NO: 1129276 - RNA, 24 nt, Human
ucuguugcccaggcuggaguguag

SEQ ID NO: 1129277 - RNA, 18 nt, Human
ugacauuguugcauguuu

SEQ ID NO: 1129278 - RNA, 22 nt, Human
ugagacggagucucacucuguu

SEQ ID NO: 1129279 - RNA, 21 nt, Human
ugcccaggcuggaguguagug

SEQ ID NO: 1129280 - RNA, 22 nt, Human
ugcccaggcuggaguguagugg

SEQ ID NO: 1129281 - RNA, 24 nt, Human
ugcccaggcuggaguguaguggca

SEQ ID NO: 1129282 - RNA, 20 nt, Human
ugccuuagccucccaaguag

SEQ ID NO: 1129283 - RNA, 24 nt, Human
ugcuuugauguuggaggaaggggc

SEQ ID NO: 1129284 - RNA, 18 nt, Human
uggaguguaguggcacaa

SEQ ID NO: 1129285 - RNA, 23 nt, Human
uggaguguaguggcacaaucuca

SEQ ID NO: 1129286 - RNA, 24 nt, Human
uggaguguaguggcacaaucucag

SEQ ID NO: 1129287 - RNA, 25 nt, Human
uggauguggcaggcugaaugacaga

SEQ ID NO: 1129288 - RNA, 24 nt, Human
uggcacaaucucagcucacugcaa

SEQ ID NO: 1129289 - RNA, 20 nt, Human
ugggggaccuggauguggca

SEQ ID NO: 1129290 - RNA, 22 nt, Human
uguaguggcacaaucucagcuc

SEQ ID NO: 1129291 - RNA, 22 nt, Human
uguggcaggcugaaugacagac

SEQ ID NO: 1129292 - RNA, 19 nt, Human
uguucacauucccaggauc

SEQ ID NO: 1129293 - RNA, 24 nt, Human
uucaagcgauucucccugccuuag

SEQ ID NO: 1129294 - RNA, 23 nt, Human
uucauuuuuuuguuguuuuugag

SEQ ID NO: 1129295 - RNA, 19 nt, Human
uugaccuccaggaucagaa

SEQ ID NO: 1129296 - RNA, 21 nt, Human
acucuccccagcucccuccau

SEQ ID NO: 1129297 - RNA, 19 nt, Human
ccaugucaaucccuuggca

SEQ ID NO: 1129298 - RNA, 19 nt, Human
cucuccccagcucccucca

SEQ ID NO: 1129299 - RNA, 22 nt, Human
cuuugagagggaccaaaaggaa

SEQ ID NO: 1129300 - RNA, 27 nt, Human
gaugacagaugcaggcuuugagaggga

SEQ ID NO: 1129301 - RNA, 21 nt, Human
uaaauggaugacagaugcagg

SEQ ID NO: 1129302 - RNA, 25 nt, Human
uccccagcucccuccaugucaaucc

SEQ ID NO: 1129303 - RNA, 19 nt, Human
ucuccacuggggugugggg

SEQ ID NO: 1129304 - RNA, 19 nt, Human
ucugacuccuucacucucc

SEQ ID NO: 1129305 - RNA, 19 nt, Human
ugacuccuucacucucccc

SEQ ID NO: 1129306 - RNA, 18 nt, Human
ugagagggaccaaaagga

SEQ ID NO: 1129307 - RNA, 19 nt, Human
ugggaggggcugacauuag

SEQ ID NO: 1129308 - RNA, 24 nt, Human
ugggaggggcugacauuagagggg

SEQ ID NO: 1129309 - RNA, 18 nt, Human
uggggucagucauccugg

SEQ ID NO: 1129310 - RNA, 18 nt, Human
uucacucuccccagcucc

SEQ ID NO: 1129311 - RNA, 18 nt, Human
aaaacccucacaugccuc

SEQ ID NO: 1129312 - RNA, 21 nt, Human
aaagacauacagggacugugc

SEQ ID NO: 1129313 - RNA, 22 nt, Human
aacaaagccacucuugaugaac

SEQ ID NO: 1129314 - RNA, 20 nt, Human
aacauagggagcccccaucu

SEQ ID NO: 1129315 - RNA, 21 nt, Human
aacauagggagcccccaucuc

SEQ ID NO: 1129316 - RNA, 24 nt, Human
aacauccccacgaggcaagcacug

SEQ ID NO: 1129317 - RNA, 22 nt, Human
aagaaagaggcaggggagagga

SEQ ID NO: 1129318 - RNA, 21 nt, Human
aaggauuuugagcagaggugu

SEQ ID NO: 1129319 - RNA, 25 nt, Human
acaagacaaccacuguacaacaaag

SEQ ID NO: 1129320 - RNA, 23 nt, Human
acagcccagaggccggguuucca

SEQ ID NO: 1129321 - RNA, 20 nt, Human
acugaggugaccaugggugg

SEQ ID NO: 1129322 - RNA, 19 nt, Human
agaaggaacuaggagagcg

SEQ ID NO: 1129323 - RNA, 24 nt, Human
agcacuuugggaggauggcuuggg

SEQ ID NO: 1129324 - RNA, 23 nt, Human
agccugggcaacauagggagccc

SEQ ID NO: 1129325 - RNA, 24 nt, Human
aggaagggcugcagcguuuucuug

SEQ ID NO: 1129326 - RNA, 26 nt, Human
aggaggucuggagaagggggaccucc

SEQ ID NO: 1129327 - RNA, 20 nt, Human
aggaguuugagaccagccug

SEQ ID NO: 1129328 - RNA, 18 nt, Human
aggcaaaagggagaauga

SEQ ID NO: 1129329 - RNA, 21 nt, Human
aggcaaaagggagaaugagca

SEQ ID NO: 1129330 - RNA, 25 nt, Human
aggcaaaagggagaaugaggggacc

SEQ ID NO: 1129331 - RNA, 18 nt, Human
aggcaggggagaggaagg

SEQ ID NO: 1129332 - RNA, 23 nt, Human
aggcaggggagaggaaggccaag

SEQ ID NO: 1129333 - RNA, 18 nt, Human
aggcaguguccugggguc

SEQ ID NO: 1129334 - RNA, 20 nt, Human
aggggccagugagugggagc

SEQ ID NO: 1129335 - RNA, 22 nt, Human
agguggaggcuuucuuccugag

SEQ ID NO: 1129336 - RNA, 20 nt, Human
aguaacugaggugaccaugg

SEQ ID NO: 1129337 - RNA, 18 nt, Human
agucaugguugcuuucug

SEQ ID NO: 1129338 - RNA, 21 nt, Human
aguuggcccagggucacacag

SEQ ID NO: 1129339 - RNA, 23 nt, Human
auggguggcaagagccacaaaag

SEQ ID NO: 1129340 - RNA, 20 nt, Human
auuugauaacguuuggcuag

SEQ ID NO: 1129341 - RNA, 19 nt, Human
caaaacccucacaugccuc

SEQ ID NO: 1129342 - RNA, 20 nt, Human
caaaacccucacaugccucc

SEQ ID NO: 1129343 - RNA, 22 nt, Human
cacaacauccccacgaggcaag

SEQ ID NO: 1129344 - RNA, 24 nt, Human
cacaaguauccacagcccagaggc

SEQ ID NO: 1129345 - RNA, 23 nt, Human
cacacaacauccccacgaggcaa

SEQ ID NO: 1129346 - RNA, 23 nt, Human
cacacacaacauccccacgaggc

SEQ ID NO: 1129347 - RNA, 18 nt, Human
cacacaguuaagugauua

SEQ ID NO: 1129348 - RNA, 24 nt, Human
cacacuuguaaucccagcacuuug

SEQ ID NO: 1129349 - RNA, 18 nt, Human
cacagagcaggugcucaa

SEQ ID NO: 1129350 - RNA, 21 nt, Human
caccaccucucccaucacaag

SEQ ID NO: 1129351 - RNA, 18 nt, Human
cacgaacaugcaugugug

SEQ ID NO: 1129352 - RNA, 23 nt, Human
cacugucuuuauccccauguuca

SEQ ID NO: 1129353 - RNA, 23 nt, Human
cacuuguaaucccagcacuuugg

SEQ ID NO: 1129354 - RNA, 24 nt, Human
cacuuguaaucccagcacuuuggg

SEQ ID NO: 1129355 - RNA, 21 nt, Human
cagaaugccccaaacuugccc

SEQ ID NO: 1129356 - RNA, 19 nt, Human
cagcacuuugggaggaugg

SEQ ID NO: 1129357 - RNA, 22 nt, Human
cagccucugcuggagcccugcc

SEQ ID NO: 1129358 - RNA, 21 nt, Human
caggcuuggcgugguggcuca

SEQ ID NO: 1129359 - RNA, 26 nt, Human
caucucugcuuccaccccagcagggg

SEQ ID NO: 1129360 - RNA, 21 nt, Human
ccacucuugaugaacuccuac

SEQ ID NO: 1129361 - RNA, 20 nt, Human
ccagccaccaagugccuacu

SEQ ID NO: 1129362 - RNA, 25 nt, Human
cccaaccccuagaccugagccugaa

SEQ ID NO: 1129363 - RNA, 22 nt, Human
cccacaugcccugagaugggac

SEQ ID NO: 1129364 - RNA, 20 nt, Human
cccacgaggcaagcacuguc

SEQ ID NO: 1129365 - RNA, 24 nt, Human
ccccagagggcccugccagccacc

SEQ ID NO: 1129366 - RNA, 20 nt, Human
cccccugcccccacucuacc

SEQ ID NO: 1129367 - RNA, 22 nt, Human
cccccugcccccacucuaccug

SEQ ID NO: 1129368 - RNA, 18 nt, Human
ccccuucuuccagucucc

SEQ ID NO: 1129369 - RNA, 22 nt, Human
cccuagaccugagccugaaucu

SEQ ID NO: 1129370 - RNA, 20 nt, Human
cccugugcugcaagcucccc

SEQ ID NO: 1129371 - RNA, 19 nt, Human
ccgaagcugcugccaaucc

SEQ ID NO: 1129372 - RNA, 23 nt, Human
ccgcaccaccucucccaucacaa

SEQ ID NO: 1129373 - RNA, 21 nt, Human
ccgcaggaguccaggcagaga

SEQ ID NO: 1129374 - RNA, 24 nt, Human
ccuccaaagacauacagggacugu

SEQ ID NO: 1129375 - RNA, 19 nt, Human
ccucucuccugcccuccca

SEQ ID NO: 1129376 - RNA, 18 nt, Human
ccucuggagggggcuucu

SEQ ID NO: 1129377 - RNA, 25 nt, Human
ccucuuggccuuccacucauccgca

SEQ ID NO: 1129378 - RNA, 21 nt, Human
ccugaggcugagggcugaaac

SEQ ID NO: 1129379 - RNA, 18 nt, Human
ccugcccccugcccccac

SEQ ID NO: 1129380 - RNA, 24 nt, Human
ccugugcugcaagcuccccaagga

SEQ ID NO: 1129381 - RNA, 23 nt, Human
cgaggcaagcacugucuuuaucc

SEQ ID NO: 1129382 - RNA, 18 nt, Human
cgcaccaccucucccauc

SEQ ID NO: 1129383 - RNA, 23 nt, Human
cguggcucuaagcucuuugcaca

SEQ ID NO: 1129384 - RNA, 24 nt, Human
cguguguaugcauguauacacaca

SEQ ID NO: 1129385 - RNA, 24 nt, Human
cuacuguuuuccaggccagggcug

SEQ ID NO: 1129386 - RNA, 22 nt, Human
cucacacuuguaaucccagcac

SEQ ID NO: 1129387 - RNA, 24 nt, Human
cucacacuuguaaucccagcacuu

SEQ ID NO: 1129388 - RNA, 19 nt, Human
cugcccacuagaaaacaag

SEQ ID NO: 1129389 - RNA, 18 nt, Human
cugcuggagcccugccug

SEQ ID NO: 1129390 - RNA, 21 nt, Human
cuggcuuggccaacucagauc

SEQ ID NO: 1129391 - RNA, 19 nt, Human
cuguugcuugcagcuagga

SEQ ID NO: 1129392 - RNA, 21 nt, Human
cuuacaaaacccucacaugcc

SEQ ID NO: 1129393 - RNA, 25 nt, Human
cuuacaaaacccucacaugccucca

SEQ ID NO: 1129394 - RNA, 18 nt, Human
cuuugcucuggggagacg

SEQ ID NO: 1129395 - RNA, 22 nt, Human
cuuugggaggauggcuuggguc

SEQ ID NO: 1129396 - RNA, 18 nt, Human
gaaggaggucuggagaag

SEQ ID NO: 1129397 - RNA, 20 nt, Human
gaccauggguggcaagagcc

SEQ ID NO: 1129398 - RNA, 21 nt, Human
gagaauuuuucaucuauuugg

SEQ ID NO: 1129399 - RNA, 18 nt, Human
gagagccaggagcauguu

SEQ ID NO: 1129400 - RNA, 21 nt, Human
gaguaacugaggugaccaugg

SEQ ID NO: 1129401 - RNA, 20 nt, Human
gagucgaucuagugggcacc

SEQ ID NO: 1129402 - RNA, 20 nt, Human
gaugcacgaacaugcaugug

SEQ ID NO: 1129403 - RNA, 23 nt, Human
gauuuauucuaagagccuagaac

SEQ ID NO: 1129404 - RNA, 19 nt, Human
gcagaaugaggaagaaaga

SEQ ID NO: 1129405 - RNA, 22 nt, Human
gcagaaugccccaaacuugccc

SEQ ID NO: 1129406 - RNA, 18 nt, Human
gcccugaggcugagggcu

SEQ ID NO: 1129407 - RNA, 20 nt, Human
gccuuguggccucuggaggg

SEQ ID NO: 1129408 - RNA, 18 nt, Human
ggaaacaaaguacugauu

SEQ ID NO: 1129409 - RNA, 21 nt, Human
ggccaagggccugggcuuugc

SEQ ID NO: 1129410 - RNA, 18 nt, Human
ggccccuucuuccagucu

SEQ ID NO: 1129411 - RNA, 23 nt, Human
ggccccuucuuccagucuccugu

SEQ ID NO: 1129412 - RNA, 20 nt, Human
ggccgcguccucuccuggcu

SEQ ID NO: 1129413 - RNA, 23 nt, Human
ggccugggcuuugcucuggggag

SEQ ID NO: 1129414 - RNA, 23 nt, Human
ggcgugguggcucacacuuguaa

SEQ ID NO: 1129415 - RNA, 19 nt, Human
ggguucugggugcagaaug

SEQ ID NO: 1129416 - RNA, 20 nt, Human
gguccaggaguuugagacca

SEQ ID NO: 1129417 - RNA, 18 nt, Human
ggucuguccccaggugcc

SEQ ID NO: 1129418 - RNA, 24 nt, Human
gguggcucacacuuguaaucccag

SEQ ID NO: 1129419 - RNA, 21 nt, Human
gguucugggugcagaaugagg

SEQ ID NO: 1129420 - RNA, 21 nt, Human
guacaagacaaccacuguaca

SEQ ID NO: 1129421 - RNA, 18 nt, Human
gucaggcuuggcguggug

SEQ ID NO: 1129422 - RNA, 21 nt, Human
gugcccagccucugcuggagc

SEQ ID NO: 1129423 - RNA, 22 nt, Human
guguauggauggaguaagauug

SEQ ID NO: 1129424 - RNA, 21 nt, Human
uaagagccuagaacagcagcu

SEQ ID NO: 1129425 - RNA, 25 nt, Human
uaagcucuuugcacacguguguaug

SEQ ID NO: 1129426 - RNA, 19 nt, Human
uacaaaacccucacaugcc

SEQ ID NO: 1129427 - RNA, 18 nt, Human
uacagacaucugaaaugg

SEQ ID NO: 1129428 - RNA, 24 nt, Human
uacucugugcaaggcacaaugcua

SEQ ID NO: 1129429 - RNA, 20 nt, Human
uagaaaacaaggcucaauca

SEQ ID NO: 1129430 - RNA, 22 nt, Human
uaucacaacaauccuccuaaac

SEQ ID NO: 1129431 - RNA, 23 nt, Human
ucagaggaggacccgaggcacag

SEQ ID NO: 1129432 - RNA, 24 nt, Human
ucaggcuuggcgugguggcucaca

SEQ ID NO: 1129433 - RNA, 22 nt, Human
uccacagcccagaggccggguu

SEQ ID NO: 1129434 - RNA, 19 nt, Human
uccaggcagagacaagggg

SEQ ID NO: 1129435 - RNA, 19 nt, Human
ucccaaaauccagccaauc

SEQ ID NO: 1129436 - RNA, 19 nt, Human
ucccaggaagggcugcagc

SEQ ID NO: 1129437 - RNA, 23 nt, Human
uccccaaccccuagaccugagcc

SEQ ID NO: 1129438 - RNA, 21 nt, Human
uccccaggugccugauagucu

SEQ ID NO: 1129439 - RNA, 23 nt, Human
uccuacuguuuuccaggccaggg

SEQ ID NO: 1129440 - RNA, 21 nt, Human
uccucuccuggcuucuccaug

SEQ ID NO: 1129441 - RNA, 23 nt, Human
uccugcccucccaggaagggcug

SEQ ID NO: 1129442 - RNA, 23 nt, Human
uccuggggucuguccccaggugc

SEQ ID NO: 1129443 - RNA, 20 nt, Human
ucuaccuggggaaacaaagu

SEQ ID NO: 1129444 - RNA, 25 nt, Human
ucuacuugugaacaaugagaauuuu

SEQ ID NO: 1129445 - RNA, 30 nt, Human
ucuccugucuuguccacuggauuggcaaaa

SEQ ID NO: 1129446 - RNA, 20 nt, Human
ugaaauggagagccaggagc

SEQ ID NO: 1129447 - RNA, 24 nt, Human
ugaaauggagagccaggagcaugu

SEQ ID NO: 1129448 - RNA, 22 nt, Human
ugaacuccuacuguuuuccagg

SEQ ID NO: 1129449 - RNA, 18 nt, Human
ugaaggugcccagccucu

SEQ ID NO: 1129450 - RNA, 21 nt, Human
ugaggcaaaagggagaaugag

SEQ ID NO: 1129451 - RNA, 24 nt, Human
ugaggcaaaagggagaaugagcac

SEQ ID NO: 1129452 - RNA, 21 nt, Human
ugagugcuggccuacagacaa

SEQ ID NO: 1129453 - RNA, 18 nt, Human
ugaugaacuccuacuguu

SEQ ID NO: 1129454 - RNA, 22 nt, Human
ugauggcugaaggugcccagcc

SEQ ID NO: 1129455 - RNA, 18 nt, Human
ugcagcuaggaacccugg

SEQ ID NO: 1129456 - RNA, 23 nt, Human
ugccccaaacuugcccugcccgu

SEQ ID NO: 1129457 - RNA, 22 nt, Human
ugccccagagggcccugccagc

SEQ ID NO: 1129458 - RNA, 24 nt, Human
ugccccgaagcugcugccaaucca

SEQ ID NO: 1129459 - RNA, 26 nt, Human
ugccuuguggccucuggagggggcuu

SEQ ID NO: 1129460 - RNA, 18 nt, Human
ugcugaggaaguggacag

SEQ ID NO: 1129461 - RNA, 19 nt, Human
uggagcccugccugcugga

SEQ ID NO: 1129462 - RNA, 18 nt, Human
uggcccagggucacacag

SEQ ID NO: 1129463 - RNA, 23 nt, Human
uggccgcguccucuccuggcuuc

SEQ ID NO: 1129464 - RNA, 21 nt, Human
uggcucacacuuguaauccca

SEQ ID NO: 1129465 - RNA, 24 nt, Human
uggcucacacuuguaaucccagca

SEQ ID NO: 1129466 - RNA, 21 nt, Human
uggcuuggccaacucagaucu

SEQ ID NO: 1129467 - RNA, 19 nt, Human
ugggacacaguugcugaug

SEQ ID NO: 1129468 - RNA, 22 nt, Human
uggggagacgucuagaaucuac

SEQ ID NO: 1129469 - RNA, 23 nt, Human
uggggagacgucuagaaucuacu

SEQ ID NO: 1129470 - RNA, 18 nt, Human
uggguuaucacaacaauc

SEQ ID NO: 1129471 - RNA, 24 nt, Human
ugguggcucacacuuguaauccca

SEQ ID NO: 1129472 - RNA, 22 nt, Human
uguacaacaaagccacucuuga

SEQ ID NO: 1129473 - RNA, 19 nt, Human
uguauacacacacaacauc

SEQ ID NO: 1129474 - RNA, 25 nt, Human
uguauacacacacaacauccccacg

SEQ ID NO: 1129475 - RNA, 25 nt, Human
uguaugcauguauacacacacaaca

SEQ ID NO: 1129476 - RNA, 19 nt, Human
uucauggcucugcggguuu

SEQ ID NO: 1129477 - RNA, 18 nt, Human
uuccaccccagcaggggu

SEQ ID NO: 1129478 - RNA, 18 nt, Human
uuggcaaaaaucuuaaag

SEQ ID NO: 1129479 - RNA, 21 nt, Human
uuggcagcugggccaguggcc

SEQ ID NO: 1129480 - RNA, 22 nt, Human
uuggguccaggaguuugagacc

SEQ ID NO: 1129481 - RNA, 26 nt, Human
uuuaauauuccccaaccccuagaccu

SEQ ID NO: 1129482 - RNA, 25 nt, Human
uuuccaggccagggcuggugcuuuc

SEQ ID NO: 1129483 - RNA, 23 nt, Human
uuugagaaauuccuuuucugcuu

SEQ ID NO: 1129484 - RNA, 20 nt, Human
uuugcacacguguguaugca

SEQ ID NO: 1129485 - RNA, 23 nt, Human
uuuguaguccccaguuuacagac

SEQ ID NO: 1129486 - RNA, 22 nt, Human
uuuuccaggccagggcuggugc

SEQ ID NO: 1129487 - RNA, 18 nt, Human
aaaccaggaaagaaaaug

SEQ ID NO: 1129488 - RNA, 26 nt, Human
aaacccacagggaggcagaaccagaa

SEQ ID NO: 1129489 - RNA, 21 nt, Human
aacaacagcaaacccacaggg

SEQ ID NO: 1129490 - RNA, 22 nt, Human
accagaaaaccaggaaagaaaa

SEQ ID NO: 1129491 - RNA, 24 nt, Human
agaugaucaauaacaacagcaaac

SEQ ID NO: 1129492 - RNA, 21 nt, Human
aggcagaaccagaaaaccagg

SEQ ID NO: 1129493 - RNA, 23 nt, Human
agggcugggaccucuggaggcuu

SEQ ID NO: 1129494 - RNA, 23 nt, Human
auggacccacacccuccggccca

SEQ ID NO: 1129495 - RNA, 22 nt, Human
auguguggcuaagcugggccag

SEQ ID NO: 1129496 - RNA, 20 nt, Human
cacacccuccggcccagccc

SEQ ID NO: 1129497 - RNA, 18 nt, Human
cacccuccggcccagccc

SEQ ID NO: 1129498 - RNA, 22 nt, Human
cacccuccggcccagcccugcu

SEQ ID NO: 1129499 - RNA, 19 nt, Human
cacugcucccaugcccucc

SEQ ID NO: 1129500 - RNA, 21 nt, Human
cacugcucccaugcccuccca

SEQ ID NO: 1129501 - RNA, 23 nt, Human
cagcaaacccacagggaggcaga

SEQ ID NO: 1129502 - RNA, 19 nt, Human
ccacacccuccggcccagc

SEQ ID NO: 1129503 - RNA, 22 nt, Human
cccaugggccugcucacugcuc

SEQ ID NO: 1129504 - RNA, 21 nt, Human
cccccggguaugggaagaccc

SEQ ID NO: 1129505 - RNA, 23 nt, Human
ccucugaaucuuggcuaaguaag

SEQ ID NO: 1129506 - RNA, 21 nt, Human
ccugggcugggcuggcagggc

SEQ ID NO: 1129507 - RNA, 25 nt, Human
cucacugcucccaugcccucccaga

SEQ ID NO: 1129508 - RNA, 23 nt, Human
cuggaggucaucugugaugcugg

SEQ ID NO: 1129509 - RNA, 25 nt, Human
gaggcagaaccagaaaaccaggaaa

SEQ ID NO: 1129510 - RNA, 19 nt, Human
gcauguguggcuaagcugg

SEQ ID NO: 1129511 - RNA, 19 nt, Human
gcucccaugcccucccaga

SEQ ID NO: 1129512 - RNA, 18 nt, Human
gggcugggcuggcagggc

SEQ ID NO: 1129513 - RNA, 20 nt, Human
gggcugggcuggcagggcug

SEQ ID NO: 1129514 - RNA, 21 nt, Human
gggcugggcuggcagggcugc

SEQ ID NO: 1129515 - RNA, 24 nt, Human
uaagcugggccagccugggcuggg

SEQ ID NO: 1129516 - RNA, 21 nt, Human
uacuucauggcgcaugugugg

SEQ ID NO: 1129517 - RNA, 24 nt, Human
ucaauaacaacagcaaacccacag

SEQ ID NO: 1129518 - RNA, 24 nt, Human
uccccaugggccugcucacugcuc

SEQ ID NO: 1129519 - RNA, 18 nt, Human
ucccugcagggcuggagg

SEQ ID NO: 1129520 - RNA, 19 nt, Human
ugaugcuggagaagggcug

SEQ ID NO: 1129521 - RNA, 20 nt, Human
ugggccagccugggcugggc

SEQ ID NO: 1129522 - RNA, 18 nt, Human
ugucaggggucccccggg

SEQ ID NO: 1129523 - RNA, 19 nt, Human
ugucaggggucccccgggu

SEQ ID NO: 1129524 - RNA, 19 nt, Human
ugugaugcuggagaagggc

SEQ ID NO: 1129525 - RNA, 22 nt, Human
aaauaaccauuguuuuaaggau

SEQ ID NO: 1129526 - RNA, 20 nt, Human
aacauggugaaacccugucu

SEQ ID NO: 1129527 - RNA, 21 nt, Human
aacauggugaaacccugucuc

SEQ ID NO: 1129528 - RNA, 18 nt, Human
aacugcuugaauccugga

SEQ ID NO: 1129529 - RNA, 19 nt, Human
aaguaugcauugggaacag

SEQ ID NO: 1129530 - RNA, 20 nt, Human
aaguaugcauugggaacagu

SEQ ID NO: 1129531 - RNA, 19 nt, Human
acagagcgagacuccaucu

SEQ ID NO: 1129532 - RNA, 22 nt, Human
acccugucucuacuaaaaauag

SEQ ID NO: 1129533 - RNA, 24 nt, Human
accugaggucaggaguucgagacc

SEQ ID NO: 1129534 - RNA, 24 nt, Human
acugcacuccagccugggugacag

SEQ ID NO: 1129535 - RNA, 26 nt, Human
acugcacuccagccugggugacagag

SEQ ID NO: 1129536 - RNA, 18 nt, Human
agaacagauacugcacau

SEQ ID NO: 1129537 - RNA, 24 nt, Human
agacugaggcaggagaacugcuug

SEQ ID NO: 1129538 - RNA, 20 nt, Human
agagguuacagugagccaag

SEQ ID NO: 1129539 - RNA, 22 nt, Human
agauggcgccacugcacuccag

SEQ ID NO: 1129540 - RNA, 23 nt, Human
agcacuucgggaggccaaggcag

SEQ ID NO: 1129541 - RNA, 20 nt, Human
agcacuuugggaggccgagg

SEQ ID NO: 1129542 - RNA, 24 nt, Human
agccugggugacagagcgagacuc

SEQ ID NO: 1129543 - RNA, 21 nt, Human
agccuggucaacauggugaaa

SEQ ID NO: 1129544 - RNA, 24 nt, Human
aggagcgguggcucaugccuguag

SEQ ID NO: 1129545 - RNA, 21 nt, Human
aggaguucgagaccagccugg

SEQ ID NO: 1129546 - RNA, 24 nt, Human
aggcagagguuacagugagccaag

SEQ ID NO: 1129547 - RNA, 18 nt, Human
aggcaggagaacugcuug

SEQ ID NO: 1129548 - RNA, 26 nt, Human
aggcaggcagaucaccugaggucagg

SEQ ID NO: 1129549 - RNA, 24 nt, Human
aggccgagggcggggguggaucac

SEQ ID NO: 1129550 - RNA, 22 nt, Human
aggccgggcgcaguggcucacg

SEQ ID NO: 1129551 - RNA, 21 nt, Human
aggcuuuuuaaaaaagugauu

SEQ ID NO: 1129552 - RNA, 18 nt, Human
aggucaggacuuugagac

SEQ ID NO: 1129553 - RNA, 22 nt, Human
aggugccuucucagggucuucc

SEQ ID NO: 1129554 - RNA, 24 nt, Human
aguggcucacgccuguaaucuuag

SEQ ID NO: 1129555 - RNA, 24 nt, Human
auggcgccacugcacuccagccug

SEQ ID NO: 1129556 - RNA, 26 nt, Human
caaauacauacauuauuauauuuaca

SEQ ID NO: 1129557 - RNA, 24 nt, Human
caacauggugaaaacucgucucua

SEQ ID NO: 1129558 - RNA, 24 nt, Human
caacauggugaaacccugucucua

SEQ ID NO: 1129559 - RNA, 19 nt, Human
caacucuugcuuuucaggg

SEQ ID NO: 1129560 - RNA, 21 nt, Human
caagaagcaaugagacuugag

SEQ ID NO: 1129561 - RNA, 23 nt, Human
caagauacacaaauacacagaug

SEQ ID NO: 1129562 - RNA, 24 nt, Human
caaggcaggcagaucaccugaggu

SEQ ID NO: 1129563 - RNA, 26 nt, Human
caaggcaggcagaucaccugagguca

SEQ ID NO: 1129564 - RNA, 23 nt, Human
cacaccuguaaucccagcuacuu

SEQ ID NO: 1129565 - RNA, 23 nt, Human
cacagagcggacauauaagacaa

SEQ ID NO: 1129566 - RNA, 26 nt, Human
caccucuagcguugucuaaacaacuc

SEQ ID NO: 1129567 - RNA, 23 nt, Human
caccugaggucaggaguucgaga

SEQ ID NO: 1129568 - RNA, 23 nt, Human
caccuguaaucccagcuacuugg

SEQ ID NO: 1129569 - RNA, 24 nt, Human
caccuguaaucccagcuacuuggg

SEQ ID NO: 1129570 - RNA, 20 nt, Human
cacgccuguaaucuuagcac

SEQ ID NO: 1129571 - RNA, 24 nt, Human
cacgccuguaaucuuagcacuucg

SEQ ID NO: 1129572 - RNA, 22 nt, Human
cacuccagccugggugacagag

SEQ ID NO: 1129573 - RNA, 24 nt, Human
cacuccagccugggugacagagcg

SEQ ID NO: 1129574 - RNA, 19 nt, Human
cacugcacuccagccuggg

SEQ ID NO: 1129575 - RNA, 21 nt, Human
cacugcacuccagccugggug

SEQ ID NO: 1129576 - RNA, 22 nt, Human
cacugcacuccagccuggguga

SEQ ID NO: 1129577 - RNA, 23 nt, Human
cacugcacuccagccugggugac

SEQ ID NO: 1129578 - RNA, 24 nt, Human
cacugcacuccagccugggugaca

SEQ ID NO: 1129579 - RNA, 24 nt, Human
cacugcacuccagccugggugaca

SEQ ID NO: 1129580 - RNA, 22 nt, Human
cacuuuuuuccagacuaccucu

SEQ ID NO: 1129581 - RNA, 22 nt, Human
cagagcaagcuccuauuccauc

SEQ ID NO: 1129582 - RNA, 23 nt, Human
cagaucaccugaggucaggacuu

SEQ ID NO: 1129583 - RNA, 25 nt, Human
cagcacuuugggaggccgagggcgg

SEQ ID NO: 1129584 - RNA, 22 nt, Human
caggagaacugcuugaauccug

SEQ ID NO: 1129585 - RNA, 21 nt, Human
caggugccuucucagggucuu

SEQ ID NO: 1129586 - RNA, 23 nt, Human
caguuaaacagguuuuuucccag

SEQ ID NO: 1129587 - RNA, 24 nt, Human
cauacaaauacauacauuauuaua

SEQ ID NO: 1129588 - RNA, 24 nt, Human
cauauaagacaaacuccaggaagg

SEQ ID NO: 1129589 - RNA, 27 nt, Human
caucccaacccuuauaaaaauaacuag

SEQ ID NO: 1129590 - RNA, 24 nt, Human
caugccuguagugccagcacuuug

SEQ ID NO: 1129591 - RNA, 18 nt, Human
ccaaaaacacuuuuuucc

SEQ ID NO: 1129592 - RNA, 19 nt, Human
ccaacucuugucucccaga

SEQ ID NO: 1129593 - RNA, 23 nt, Human
ccacuaaaagaagagcuccacag

SEQ ID NO: 1129594 - RNA, 20 nt, Human
ccacugcacuccagccuggg

SEQ ID NO: 1129595 - RNA, 20 nt, Human
ccacugcacuccagccuggg

SEQ ID NO: 1129596 - RNA, 20 nt, Human
ccacugcacuccagccuggg

SEQ ID NO: 1129597 - RNA, 21 nt, Human
ccacugcacuccagccugggu

SEQ ID NO: 1129598 - RNA, 21 nt, Human
ccacugcacuccagccugggu

SEQ ID NO: 1129599 - RNA, 23 nt, Human
ccacugcacuccagccuggguga

SEQ ID NO: 1129600 - RNA, 23 nt, Human
ccacugcacuccagccuggguga

SEQ ID NO: 1129601 - RNA, 24 nt, Human
ccacugcacuccagccugggugac

SEQ ID NO: 1129602 - RNA, 19 nt, Human
ccccggacugcaagauuau

SEQ ID NO: 1129603 - RNA, 24 nt, Human
cccggccaggagcgguggcucaug

SEQ ID NO: 1129604 - RNA, 22 nt, Human
ccugaggucaggacuuugagac

SEQ ID NO: 1129605 - RNA, 22 nt, Human
ccugaggucaggaguucgagac

SEQ ID NO: 1129606 - RNA, 22 nt, Human
ccuggccaacauggugaaaccc

SEQ ID NO: 1129607 - RNA, 24 nt, Human
ccuggccaacauggugaaacccug

SEQ ID NO: 1129608 - RNA, 22 nt, Human
ccugggugacagagcgagacuc

SEQ ID NO: 1129609 - RNA, 19 nt, Human
ccuggucaacauggugaaa

SEQ ID NO: 1129610 - RNA, 24 nt, Human
ccuggucaacauggugaaaacucg

SEQ ID NO: 1129611 - RNA, 21 nt, Human
ccuguaaucccagcuacuugg

SEQ ID NO: 1129612 - RNA, 24 nt, Human
cgagaccagccuggucaacauggu

SEQ ID NO: 1129613 - RNA, 25 nt, Human
cgagacuccaucuuggaaaaaaaaa

SEQ ID NO: 1129614 - RNA, 18 nt, Human
cgccuguaaucuuagcac

SEQ ID NO: 1129615 - RNA, 23 nt, Human
cgccuguaaucuuagcacuucgg

SEQ ID NO: 1129616 - RNA, 24 nt, Human
cgccuguaaucuuagcacuucggg

SEQ ID NO: 1129617 - RNA, 24 nt, Human
cggccaggagcgguggcucaugcc

SEQ ID NO: 1129618 - RNA, 24 nt, Human
cgggaggccaaggcaggcagauca

SEQ ID NO: 1129619 - RNA, 20 nt, Human
cgucucuacuaaaauuacaa

SEQ ID NO: 1129620 - RNA, 24 nt, Human
cucacgccuguaaucuuagcacuu

SEQ ID NO: 1129621 - RNA, 24 nt, Human
cucaugccuguagugccagcacuu

SEQ ID NO: 1129622 - RNA, 21 nt, Human
cucccagaacugaacaccucu

SEQ ID NO: 1129623 - RNA, 20 nt, Human
cuccuugcuccaaaaaucua

SEQ ID NO: 1129624 - RNA, 20 nt, Human
cucgucucuacuaaaauuac

SEQ ID NO: 1129625 - RNA, 18 nt, Human
cugcuugaauccuggagg

SEQ ID NO: 1129626 - RNA, 24 nt, Human
cuggccaacauggugaaacccugu

SEQ ID NO: 1129627 - RNA, 21 nt, Human
cuguaaucccagcuacuuggg

SEQ ID NO: 1129628 - RNA, 23 nt, Human
gaaaagagggacauggugugcag

SEQ ID NO: 1129629 - RNA, 19 nt, Human
gaaacccugucucuacuaa

SEQ ID NO: 1129630 - RNA, 23 nt, Human
gagaccugccuggccaacauggu

SEQ ID NO: 1129631 - RNA, 25 nt, Human
gagggugcaccauuccuggagguac

SEQ ID NO: 1129632 - RNA, 24 nt, Human
gaucaccugaggucaggacuuuga

SEQ ID NO: 1129633 - RNA, 21 nt, Human
gaucaccugaggucaggaguu

SEQ ID NO: 1129634 - RNA, 24 nt, Human
gaucaccugaggucaggaguucga

SEQ ID NO: 1129635 - RNA, 24 nt, Human
gcacuccagccugggugacagagc

SEQ ID NO: 1129636 - RNA, 21 nt, Human
gcagaucaccugaggucagga

SEQ ID NO: 1129637 - RNA, 24 nt, Human
gccaacauggugaaacccugucuc

SEQ ID NO: 1129638 - RNA, 19 nt, Human
gccacugcacuccagccug

SEQ ID NO: 1129639 - RNA, 24 nt, Human
gccacugcacuccagccuggguga

SEQ ID NO: 1129640 - RNA, 23 nt, Human
gccuggccaacauggugaaaccc

SEQ ID NO: 1129641 - RNA, 20 nt, Human
gcgcaguggcucacgccugu

SEQ ID NO: 1129642 - RNA, 23 nt, Human
gcugcuacaguuguuuggaccag

SEQ ID NO: 1129643 - RNA, 22 nt, Human
ggagaacugcuugaauccugga

SEQ ID NO: 1129644 - RNA, 21 nt, Human
ggaggcagagguuacagugag

SEQ ID NO: 1129645 - RNA, 23 nt, Human
ggcgcaguggcucacgccuguaa

SEQ ID NO: 1129646 - RNA, 23 nt, Human
ggcggggguggaucaccugaggu

SEQ ID NO: 1129647 - RNA, 23 nt, Human
gggaggccaaggcaggcagauca

SEQ ID NO: 1129648 - RNA, 24 nt, Human
gggcggggguggaucaccugaggu

SEQ ID NO: 1129649 - RNA, 24 nt, Human
gggguggaucaccugaggucagga

SEQ ID NO: 1129650 - RNA, 21 nt, Human
gguggaucaccugaggucagg

SEQ ID NO: 1129651 - RNA, 18 nt, Human
gguggcucaugccuguag

SEQ ID NO: 1129652 - RNA, 24 nt, Human
gguggcucaugccuguagugccag

SEQ ID NO: 1129653 - RNA, 24 nt, Human
gguuacagugagccaagauggcgc

SEQ ID NO: 1129654 - RNA, 19 nt, Human
guaaauccaaaaacacuuu

SEQ ID NO: 1129655 - RNA, 24 nt, Human
guuggcacacaccuguaaucccag

SEQ ID NO: 1129656 - RNA, 19 nt, Human
uaaaaauagaaaaauuagc

SEQ ID NO: 1129657 - RNA, 20 nt, Human
uaaaaauagaaaaauuagcu

SEQ ID NO: 1129658 - RNA, 21 nt, Human
uaaaauuacaaaaauuaggcc

SEQ ID NO: 1129659 - RNA, 23 nt, Human
uaaacugguaagaacagauacug

SEQ ID NO: 1129660 - RNA, 27 nt, Human
uaaaucaagacuguucacucauggacc

SEQ ID NO: 1129661 - RNA, 22 nt, Human
uaagacaaacuccaggaaggcu

SEQ ID NO: 1129662 - RNA, 21 nt, Human
uacacagaugugcugcuacag

SEQ ID NO: 1129663 - RNA, 21 nt, Human
uaccucuugagacuugggcuu

SEQ ID NO: 1129664 - RNA, 20 nt, Human
uacuaaaauuacaaaaauua

SEQ ID NO: 1129665 - RNA, 18 nt, Human
uacugcacaugaucuuag

SEQ ID NO: 1129666 - RNA, 26 nt, Human
uagagagggugcaccauuccuggagg

SEQ ID NO: 1129667 - RNA, 24 nt, Human
uagcacuucgggaggccaaggcag

SEQ ID NO: 1129668 - RNA, 21 nt, Human
uagcaggugaaaacugguagu

SEQ ID NO: 1129669 - RNA, 26 nt, Human
uagcugagcaugguuggcacacaccu

SEQ ID NO: 1129670 - RNA, 18 nt, Human
uauuccaucuccuugcuc

SEQ ID NO: 1129671 - RNA, 18 nt, Human
ucacccaagaucuaguuc

SEQ ID NO: 1129672 - RNA, 20 nt, Human
ucacccaagaucuaguucuu

SEQ ID NO: 1129673 - RNA, 20 nt, Human
ucaccugaggucaggaguuc

SEQ ID NO: 1129674 - RNA, 18 nt, Human
ucagggacccauccaucu

SEQ ID NO: 1129675 - RNA, 22 nt, Human
ucaugccuguagugccagcacu

SEQ ID NO: 1129676 - RNA, 20 nt, Human
uccaaaaacacuuuuuucca

SEQ ID NO: 1129677 - RNA, 23 nt, Human
uccagccugggugacagagcgag

SEQ ID NO: 1129678 - RNA, 24 nt, Human
uccagccugggugacagagcgaga

SEQ ID NO: 1129679 - RNA, 23 nt, Human
uccaucuccuugcuccaaaaauc

SEQ ID NO: 1129680 - RNA, 23 nt, Human
ucccagaacugaacaccucuagc

SEQ ID NO: 1129681 - RNA, 19 nt, Human
ucuagguugucacccaaga

SEQ ID NO: 1129682 - RNA, 21 nt, Human
ucucccagaacugaacaccuc

SEQ ID NO: 1129683 - RNA, 22 nt, Human
ucuccuugcuccaaaaaucuau

SEQ ID NO: 1129684 - RNA, 21 nt, Human
ucucuacuaaaaauagaaaaa

SEQ ID NO: 1129685 - RNA, 21 nt, Human
ucucuacuaaaauuacaaaaa

SEQ ID NO: 1129686 - RNA, 21 nt, Human
ucugauuccgacucucuuagg

SEQ ID NO: 1129687 - RNA, 18 nt, Human
ugaaaugacugaaccuca

SEQ ID NO: 1129688 - RNA, 18 nt, Human
ugacugaaccucaagacu

SEQ ID NO: 1129689 - RNA, 19 nt, Human
ugagaaaaaauaaccauug

SEQ ID NO: 1129690 - RNA, 20 nt, Human
ugagaaaaaauaaccauugu

SEQ ID NO: 1129691 - RNA, 24 nt, Human
ugaggcaggagaacugcuugaauc

SEQ ID NO: 1129692 - RNA, 25 nt, Human
ugaggcaggagaacugcuugaaucc

SEQ ID NO: 1129693 - RNA, 23 nt, Human
ugaggucaggacuuugagaccug

SEQ ID NO: 1129694 - RNA, 19 nt, Human
ugcaagauuauggaggaac

SEQ ID NO: 1129695 - RNA, 23 nt, Human
ugccuguagugccagcacuuugg

SEQ ID NO: 1129696 - RNA, 20 nt, Human
uggacagagcaagcuccuau

SEQ ID NO: 1129697 - RNA, 21 nt, Human
uggaggaacaagauacacaaa

SEQ ID NO: 1129698 - RNA, 25 nt, Human
uggaggaacaagauacacaaauaca

SEQ ID NO: 1129699 - RNA, 24 nt, Human
uggaucaccugaggucaggaguuc

SEQ ID NO: 1129700 - RNA, 27 nt, Human
uggaucaccugaggucaggaguucgag

SEQ ID NO: 1129701 - RNA, 24 nt, Human
uggccaacauggugaaacccuguc

SEQ ID NO: 1129702 - RNA, 18 nt, Human
uggcucacgccuguaauc

SEQ ID NO: 1129703 - RNA, 24 nt, Human
uggcucacgccuguaaucuuagca

SEQ ID NO: 1129704 - RNA, 27 nt, Human
ugggaggccgagggcggggguggauca

SEQ ID NO: 1129705 - RNA, 21 nt, Human
uguuuggaccaggaugggcac

SEQ ID NO: 1129706 - RNA, 22 nt, Human
uuaaaucaagacuguucacuca

SEQ ID NO: 1129707 - RNA, 24 nt, Human
uuugggaggccgagggcgggggug

SEQ ID NO: 1129708 - RNA, 18 nt, Human
uuugggggugguagagag

SEQ ID NO: 1129709 - RNA, 23 nt, Human
aaaagcagcuacacagagaacag

SEQ ID NO: 1129710 - RNA, 21 nt, Human
aagagccaaaaacccacagcc

SEQ ID NO: 1129711 - RNA, 23 nt, Human
aggcgugugcuccuuccucagcu

SEQ ID NO: 1129712 - RNA, 26 nt, Human
auagcagaugcaagagccaaaaaccc

SEQ ID NO: 1129713 - RNA, 22 nt, Human
caaaagcagcuacacagagaac

SEQ ID NO: 1129714 - RNA, 20 nt, Human
caagagccaaaaacccacag

SEQ ID NO: 1129715 - RNA, 22 nt, Human
caagagccaaaaacccacagcc

SEQ ID NO: 1129716 - RNA, 24 nt, Human
gaacagaguuagcaaauggcaccc

SEQ ID NO: 1129717 - RNA, 18 nt, Human
gagacagaacuauagcag

SEQ ID NO: 1129718 - RNA, 20 nt, Human
gagcugccaaaagcagcuac

SEQ ID NO: 1129719 - RNA, 23 nt, Human
gaugcaagagccaaaaacccacu

SEQ ID NO: 1129720 - RNA, 22 nt, Human
gauggaguuguccucugcccag

SEQ ID NO: 1129721 - RNA, 18 nt, Human
ggaguuguccucugccca

SEQ ID NO: 1129722 - RNA, 18 nt, Human
uaagaaggauggaguugu

SEQ ID NO: 1129723 - RNA, 19 nt, Human
ucacugcuagagucuaacg

SEQ ID NO: 1129724 - RNA, 19 nt, Human
uccucugcccaguuuuggc

SEQ ID NO: 1129725 - RNA, 23 nt, Human
ucuguaggugacggucuuaacuu

SEQ ID NO: 1129726 - RNA, 22 nt, Human
ugagugguggauuagaagagag

SEQ ID NO: 1129727 - RNA, 22 nt, Human
uggagaagcccuuuuguaagaa

SEQ ID NO: 1129728 - RNA, 18 nt, Human
ugggauucuguaggugac

SEQ ID NO: 1129729 - RNA, 18 nt, Human
uguccucugcccaguuuu

SEQ ID NO: 1129730 - RNA, 23 nt, Human
uugaugaggcgugugcuccuucc

SEQ ID NO: 1129731 - RNA, 24 nt, Human
aaaaaaaaaaaacaaaacaaaaaa

SEQ ID NO: 1129732 - RNA, 23 nt, Human
aaaaaaaacaaaacaaaacaaaa

SEQ ID NO: 1129733 - RNA, 23 nt, Human
aaaaaaacaaaaaacaaacaaaa

SEQ ID NO: 1129734 - RNA, 25 nt, Human
aaaaaaacaaaaaacaaacaaaaaa

SEQ ID NO: 1129735 - RNA, 31 nt, Human
aaaaaacaaaacaaaacaaaaaaacaaaaaa

SEQ ID NO: 1129736 - RNA, 24 nt, Human
aaaaacaaaacaaaaaacugugug

SEQ ID NO: 1129737 - RNA, 25 nt, Human
aaaaacaaaacaaaaaacugugugg

SEQ ID NO: 1129738 - RNA, 27 nt, Human
aaaacaaaacaaaacaaaaaaacaaaa

SEQ ID NO: 1129739 - RNA, 23 nt, Human
aaacaaaacaaaacaaaaaaaca

SEQ ID NO: 1129740 - RNA, 24 nt, Human
aaacaaaacaaaacaaaaaaacaa

SEQ ID NO: 1129741 - RNA, 25 nt, Human
aaacaaaacaaaacaaaaaaacaaa

SEQ ID NO: 1129742 - RNA, 23 nt, Human
aaacaagugcuccgaggaaacaa

SEQ ID NO: 1129743 - RNA, 26 nt, Human
aaacauucagcaauuauuagaauggu

SEQ ID NO: 1129744 - RNA, 18 nt, Human
aaaugagcuacugaaguc

SEQ ID NO: 1129745 - RNA, 23 nt, Human
aaauggcagaggcugaagaaacc

SEQ ID NO: 1129746 - RNA, 25 nt, Human
aacaaaacaaaaaaacaaaaaacaa

SEQ ID NO: 1129747 - RNA, 25 nt, Human
aacaaaacaaaaaacuguguggucu

SEQ ID NO: 1129748 - RNA, 26 nt, Human
aacaaaacaaaacaaaaaaacaagac

SEQ ID NO: 1129749 - RNA, 20 nt, Human
aacauggcaaaaccccgucu

SEQ ID NO: 1129750 - RNA, 21 nt, Human
aacauggcaaaaccccgucuc

SEQ ID NO: 1129751 - RNA, 22 nt, Human
aagaugacuauaguagaggugc

SEQ ID NO: 1129752 - RNA, 29 nt, Human
acaaaacaaaaaaacaaaaaacaaacaaa

SEQ ID NO: 1129753 - RNA, 18 nt, Human
acaaaacaaaaaacugug

SEQ ID NO: 1129754 - RNA, 26 nt, Human
acaaaacaaaacaaaaaaacaaaaaa

SEQ ID NO: 1129755 - RNA, 19 nt, Human
acaguccuggguccagagc

SEQ ID NO: 1129756 - RNA, 20 nt, Human
acccccaucaaacaggaauu

SEQ ID NO: 1129757 - RNA, 24 nt, Human
accccgucucuacuaaaaauacaa

SEQ ID NO: 1129758 - RNA, 21 nt, Human
acucauuauauagcaaacauu

SEQ ID NO: 1129759 - RNA, 24 nt, Human
acugccacuccagcuugggcagca

SEQ ID NO: 1129760 - RNA, 19 nt, Human
acuugguugaaccuguggc

SEQ ID NO: 1129761 - RNA, 25 nt, Human
agaaaagaaacaagugcuccgagga

SEQ ID NO: 1129762 - RNA, 23 nt, Human
agaccuggaguauagaugccaau

SEQ ID NO: 1129763 - RNA, 19 nt, Human
agaggcugaagaaaccaaa

SEQ ID NO: 1129764 - RNA, 18 nt, Human
agagguugcauuaagcug

SEQ ID NO: 1129765 - RNA, 24 nt, Human
agagguugcauuaagcugagauca

SEQ ID NO: 1129766 - RNA, 24 nt, Human
agcacuuugggaggcugaggcggg

SEQ ID NO: 1129767 - RNA, 20 nt, Human
agcagaccucggggucuagu

SEQ ID NO: 1129768 - RNA, 23 nt, Human
agccggguaugauggcacacgcc

SEQ ID NO: 1129769 - RNA, 18 nt, Human
agccuggccaacauggca

SEQ ID NO: 1129770 - RNA, 24 nt, Human
agccuggccaacauggcaaaaccc

SEQ ID NO: 1129771 - RNA, 24 nt, Human
agcuugggcagcagaacaagacuc

SEQ ID NO: 1129772 - RNA, 22 nt, Human
aggcaugagacucacuugaacc

SEQ ID NO: 1129773 - RNA, 24 nt, Human
aggcaugagacucacuugaaccug

SEQ ID NO: 1129774 - RNA, 24 nt, Human
aggcugaggcaugagacucacuug

SEQ ID NO: 1129775 - RNA, 18 nt, Human
aggcugaggcgggcagau

SEQ ID NO: 1129776 - RNA, 24 nt, Human
aggcugaggcgggcagauaacuug

SEQ ID NO: 1129777 - RNA, 20 nt, Human
aggcugggugcaguggcuca

SEQ ID NO: 1129778 - RNA, 20 nt, Human
agguagagguugcauuaagc

SEQ ID NO: 1129779 - RNA, 24 nt, Human
agguagagguugcauuaagcugag

SEQ ID NO: 1129780 - RNA, 24 nt, Human
aguggcucacgccuguaaucccag

SEQ ID NO: 1129781 - RNA, 19 nt, Human
auagcaaacauucagcaau

SEQ ID NO: 1129782 - RNA, 25 nt, Human
aucaugccacugccacuccagcuug

SEQ ID NO: 1129783 - RNA, 26 nt, Human
aucuucuuugcuuugacccccaucag

SEQ ID NO: 1129784 - RNA, 23 nt, Human
auggcacacgccuguaauuccag

SEQ ID NO: 1129785 - RNA, 21 nt, Human
augugucuuaagaucauggug

SEQ ID NO: 1129786 - RNA, 23 nt, Human
auuguaaucuccaaggacagaag

SEQ ID NO: 1129787 - RNA, 23 nt, Human
caaaaaaaacaaaacaaaacaaa

SEQ ID NO: 1129788 - RNA, 23 nt, Human
caaaaaaacaaaaaacaaacaaa

SEQ ID NO: 1129789 - RNA, 24 nt, Human
caaaaaaacaaaaaacaaacaaaa

SEQ ID NO: 1129790 - RNA, 23 nt, Human
caaaaaaucuucuucugggguuc

SEQ ID NO: 1129791 - RNA, 24 nt, Human
caacauggcaaaaccccgucucua

SEQ ID NO: 1129792 - RNA, 22 nt, Human
caagacucuaucucaaaaaaaa

SEQ ID NO: 1129793 - RNA, 18 nt, Human
cacaauaaaauuggugac

SEQ ID NO: 1129794 - RNA, 24 nt, Human
cacgccuguaaucccagcacuuug

SEQ ID NO: 1129795 - RNA, 23 nt, Human
cacgccuguaauuccagcuacuu

SEQ ID NO: 1129796 - RNA, 24 nt, Human
cacgccuguaauuccagcuacuug

SEQ ID NO: 1129797 - RNA, 18 nt, Human
cacuccagcuugggcagc

SEQ ID NO: 1129798 - RNA, 25 nt, Human
cagaaaaaaaaaaaaaagaaaagaa

SEQ ID NO: 1129799 - RNA, 23 nt, Human
cagaacaagacucuaucucaaaa

SEQ ID NO: 1129800 - RNA, 22 nt, Human
cagaagaaaaaacuaagguuca

SEQ ID NO: 1129801 - RNA, 24 nt, Human
cagauaacuugagauuaggaguuc

SEQ ID NO: 1129802 - RNA, 24 nt, Human
cagcacuuugggaggcugaggcgg

SEQ ID NO: 1129803 - RNA, 23 nt, Human
cauuuuggauuuuuuaaaaguug

SEQ ID NO: 1129804 - RNA, 23 nt, Human
ccagcugugugaccuugggcaag

SEQ ID NO: 1129805 - RNA, 24 nt, Human
ccaggcugggugcaguggcucacg

SEQ ID NO: 1129806 - RNA, 21 nt, Human
ccagggaaugacagaaucagg

SEQ ID NO: 1129807 - RNA, 22 nt, Human
cccaggcugggugcaguggcuc

SEQ ID NO: 1129808 - RNA, 25 nt, Human
ccucggggucuaguugugacucugu

SEQ ID NO: 1129809 - RNA, 23 nt, Human
ccuggccaacauggcaaaacccc

SEQ ID NO: 1129810 - RNA, 24 nt, Human
ccuggccaacauggcaaaaccccg

SEQ ID NO: 1129811 - RNA, 22 nt, Human
ccuguaaucccagcacuuuggg

SEQ ID NO: 1129812 - RNA, 21 nt, Human
ccuguaauuccagcuacuugg

SEQ ID NO: 1129813 - RNA, 27 nt, Human
ccuguggcuaggggaagaccggggucc

SEQ ID NO: 1129814 - RNA, 21 nt, Human
cgagaccagccuggccaacau

SEQ ID NO: 1129815 - RNA, 23 nt, Human
cgccuguaauuccagcuacuugg

SEQ ID NO: 1129816 - RNA, 24 nt, Human
cgccuguaauuccagcuacuuggg

SEQ ID NO: 1129817 - RNA, 18 nt, Human
cucaaaaaaaacaaaaca

SEQ ID NO: 1129818 - RNA, 22 nt, Human
cucacgccuguaaucccagcac

SEQ ID NO: 1129819 - RNA, 24 nt, Human
cucacgccuguaaucccagcacuu

SEQ ID NO: 1129820 - RNA, 23 nt, Human
cucccuggacuuccggugcuucc

SEQ ID NO: 1129821 - RNA, 23 nt, Human
cugaagaaaccaacagccuggga

SEQ ID NO: 1129822 - RNA, 23 nt, Human
cugacagccuuucacugucuccc

SEQ ID NO: 1129823 - RNA, 24 nt, Human
cugccacuccagcuugggcagcag

SEQ ID NO: 1129824 - RNA, 23 nt, Human
cuugagauuaggaguucgagacc

SEQ ID NO: 1129825 - RNA, 20 nt, Human
gaagaaaccaacagccuggg

SEQ ID NO: 1129826 - RNA, 23 nt, Human
gacagccuuucacugucucccac

SEQ ID NO: 1129827 - RNA, 19 nt, Human
gaccuaucucccagagagc

SEQ ID NO: 1129828 - RNA, 24 nt, Human
gagaucaugccacugccacuccag

SEQ ID NO: 1129829 - RNA, 18 nt, Human
gaggacagagggccaggg

SEQ ID NO: 1129830 - RNA, 24 nt, Human
gauggcacacgccuguaauuccag

SEQ ID NO: 1129831 - RNA, 21 nt, Human
gcacauagcagagccucagga

SEQ ID NO: 1129832 - RNA, 18 nt, Human
gcagagccucaguuagag

SEQ ID NO: 1129833 - RNA, 23 nt, Human
gcauagaaaauucguggaaugac

SEQ ID NO: 1129834 - RNA, 21 nt, Human
gccaacauggcaaaaccccgu

SEQ ID NO: 1129835 - RNA, 24 nt, Human
gcuccagaaaaaaaaaaaaaagaa

SEQ ID NO: 1129836 - RNA, 25 nt, Human
gcuccagaaaaaaaaaaaaaagaaa

SEQ ID NO: 1129837 - RNA, 23 nt, Human
gcucuuugguguggugaugcugg

SEQ ID NO: 1129838 - RNA, 21 nt, Human
ggaacccaucccacacaccag

SEQ ID NO: 1129839 - RNA, 22 nt, Human
ggcugucugagauaaauaauau

SEQ ID NO: 1129840 - RNA, 24 nt, Human
ggguaugauggcacacgccuguaa

SEQ ID NO: 1129841 - RNA, 18 nt, Human
ggugaugcuggguggacu

SEQ ID NO: 1129842 - RNA, 23 nt, Human
ggugcaguggcucacgccuguaa

SEQ ID NO: 1129843 - RNA, 18 nt, Human
gguggaugccguggggaa

SEQ ID NO: 1129844 - RNA, 19 nt, Human
guagaggugcauugguggg

SEQ ID NO: 1129845 - RNA, 18 nt, Human
gucugcuggaaggcucca

SEQ ID NO: 1129846 - RNA, 18 nt, Human
guguacauuccacgcaua

SEQ ID NO: 1129847 - RNA, 19 nt, Human
guucucgucaucgcucuga

SEQ ID NO: 1129848 - RNA, 18 nt, Human
guugcauuaagcugagau

SEQ ID NO: 1129849 - RNA, 21 nt, Human
uaaaaauacaaaaacuagccg

SEQ ID NO: 1129850 - RNA, 23 nt, Human
uaacuugagauuaggaguucgag

SEQ ID NO: 1129851 - RNA, 20 nt, Human
uaagaugacuauaguagagg

SEQ ID NO: 1129852 - RNA, 21 nt, Human
uagaacaguccuggguccaga

SEQ ID NO: 1129853 - RNA, 21 nt, Human
uagaaugguugcuucuaucga

SEQ ID NO: 1129854 - RNA, 18 nt, Human
uaggaugugucuuaagau

SEQ ID NO: 1129855 - RNA, 22 nt, Human
ucaaaaaaaacaaaacaaaaca

SEQ ID NO: 1129856 - RNA, 21 nt, Human
ucaaaucacacacccgcacag

SEQ ID NO: 1129857 - RNA, 19 nt, Human
ucacuugaaccugggaggu

SEQ ID NO: 1129858 - RNA, 21 nt, Human
ucaguuagaggcagaggaaga

SEQ ID NO: 1129859 - RNA, 24 nt, Human
ucaugccacugccacuccagcuug

SEQ ID NO: 1129860 - RNA, 23 nt, Human
uccacgcauagaaaauucgugga

SEQ ID NO: 1129861 - RNA, 26 nt, Human
uccacgcauagaaaauucguggaauu

SEQ ID NO: 1129862 - RNA, 23 nt, Human
uccagaaaaaaaaaaaaaagaaa

SEQ ID NO: 1129863 - RNA, 24 nt, Human
uccagaaaaaaaaaaaaaagaaaa

SEQ ID NO: 1129864 - RNA, 25 nt, Human
uccagaaaaaaaaaaaaaagaaaag

SEQ ID NO: 1129865 - RNA, 21 nt, Human
uccagcagaccucggggucua

SEQ ID NO: 1129866 - RNA, 18 nt, Human
uccagcuugggcagcaga

SEQ ID NO: 1129867 - RNA, 21 nt, Human
ucccaggcugggugcaguggc

SEQ ID NO: 1129868 - RNA, 18 nt, Human
ucccuggacuuccggugc

SEQ ID NO: 1129869 - RNA, 19 nt, Human
ucucaaaaaaaacaaaaca

SEQ ID NO: 1129870 - RNA, 21 nt, Human
ucucuacuaaaaauacaaaaa

SEQ ID NO: 1129871 - RNA, 18 nt, Human
ucuucuucugggguucuc

SEQ ID NO: 1129872 - RNA, 23 nt, Human
ugaacagaaggccccacaguguc

SEQ ID NO: 1129873 - RNA, 24 nt, Human
ugaaccugggagguagagguugca

SEQ ID NO: 1129874 - RNA, 24 nt, Human
ugaagaaaccaacagccugggaac

SEQ ID NO: 1129875 - RNA, 23 nt, Human
ugagaaaagaaacaagugcuccg

SEQ ID NO: 1129876 - RNA, 19 nt, Human
ugagaucaugccacugcca

SEQ ID NO: 1129877 - RNA, 24 nt, Human
ugaggcaugagacucacuugaacc

SEQ ID NO: 1129878 - RNA, 24 nt, Human
ugauggcacacgccuguaauucca

SEQ ID NO: 1129879 - RNA, 18 nt, Human
ugccacuccagcuugggc

SEQ ID NO: 1129880 - RNA, 18 nt, Human
uggaaggauccaugagug

SEQ ID NO: 1129881 - RNA, 24 nt, Human
uggaaggcuccagaaaaaaaaaaa

SEQ ID NO: 1129882 - RNA, 20 nt, Human
uggagacaggacuaggaugu

SEQ ID NO: 1129883 - RNA, 21 nt, Human
uggauggaugaauggguuagu

SEQ ID NO: 1129884 - RNA, 19 nt, Human
uggcacacgccuguaauuc

SEQ ID NO: 1129885 - RNA, 21 nt, Human
uggcacacgccuguaauucca

SEQ ID NO: 1129886 - RNA, 18 nt, Human
uggcacauagcagagccu

SEQ ID NO: 1129887 - RNA, 18 nt, Human
uggcacauagcagagccu

SEQ ID NO: 1129888 - RNA, 22 nt, Human
uggcucacgccuguaaucccag

SEQ ID NO: 1129889 - RNA, 24 nt, Human
uggcucacgccuguaaucccagca

SEQ ID NO: 1129890 - RNA, 24 nt, Human
ugggaggcugaggcaugagacuca

SEQ ID NO: 1129891 - RNA, 19 nt, Human
ugggaggcugaggcgggca

SEQ ID NO: 1129892 - RNA, 19 nt, Human
ugggaggcugaggcgggca

SEQ ID NO: 1129893 - RNA, 20 nt, Human
ugggaggcugaggcgggcag

SEQ ID NO: 1129894 - RNA, 22 nt, Human
ugggaggcugaggcgggcagau

SEQ ID NO: 1129895 - RNA, 24 nt, Human
ugggagguagagguugcauuaagc

SEQ ID NO: 1129896 - RNA, 18 nt, Human
ugguguggugaugcuggg

SEQ ID NO: 1129897 - RNA, 23 nt, Human
ugguguggugaugcuggguggac

SEQ ID NO: 1129898 - RNA, 18 nt, Human
uguaaaaugagcuacuga

SEQ ID NO: 1129899 - RNA, 19 nt, Human
ugucacacggcucaacauu

SEQ ID NO: 1129900 - RNA, 25 nt, Human
ugucacacggcucaacauucacgug

SEQ ID NO: 1129901 - RNA, 22 nt, Human
ugugaggaucaaauggaaggau

SEQ ID NO: 1129902 - RNA, 24 nt, Human
ugugaggaucaaauggaaggaucc

SEQ ID NO: 1129903 - RNA, 19 nt, Human
uguucuacuauuaucucuc

SEQ ID NO: 1129904 - RNA, 20 nt, Human
uguugugaggaucaaaugga

SEQ ID NO: 1129905 - RNA, 24 nt, Human
uguugugaggaucaaauggaagga

SEQ ID NO: 1129906 - RNA, 20 nt, Human
uguuuuaucuuuuggggaca

SEQ ID NO: 1129907 - RNA, 23 nt, Human
uguuuuaucuuuuggggacacau

SEQ ID NO: 1129908 - RNA, 21 nt, Human
uucuuugcuuugacccccauc

SEQ ID NO: 1129909 - RNA, 24 nt, Human
uugaaccugggagguagagguugc

SEQ ID NO: 1129910 - RNA, 25 nt, Human
uugggaggcugaggcaugagacuca

SEQ ID NO: 1129911 - RNA, 19 nt, Human
uuugcuuucugagaaaaga

SEQ ID NO: 1129912 - RNA, 21 nt, Human
uuugcuuucugagaaaagaaa

SEQ ID NO: 1129913 - RNA, 19 nt, Human
aaacacaagcucuggagcc

SEQ ID NO: 1129914 - RNA, 22 nt, Human
ccaaagcuuucugggccgggcu

SEQ ID NO: 1129915 - RNA, 22 nt, Human
gauuuccauccuuuauucacuc

SEQ ID NO: 1129916 - RNA, 19 nt, Human
uccaaagcuuucugggccg

SEQ ID NO: 1129917 - RNA, 24 nt, Human
uccaaagcuuucugggccgggcuu

SEQ ID NO: 1129918 - RNA, 26 nt, Human
uucauggaaggccguaucggugcagg

SEQ ID NO: 1129919 - RNA, 24 nt, Human
aaaaagaaaaugcaaggaaaaaaa

SEQ ID NO: 1129920 - RNA, 21 nt, Human
aaacaaaugcgacuggccagg

SEQ ID NO: 1129921 - RNA, 24 nt, Human
aaacugaauuucaguuugaagcaa

SEQ ID NO: 1129922 - RNA, 20 nt, Human
aaacuuuggucaaaacaaac

SEQ ID NO: 1129923 - RNA, 24 nt, Human
aaaguguugggauuacagguguga

SEQ ID NO: 1129924 - RNA, 21 nt, Human
aaauaugaaagaucgaaagcu

SEQ ID NO: 1129925 - RNA, 22 nt, Human
aaccugcugcccagugagauga

SEQ ID NO: 1129926 - RNA, 22 nt, Human
aagaucgaaagcuacuuuugcc

SEQ ID NO: 1129927 - RNA, 19 nt, Human
aagcgaccuuugccaagag

SEQ ID NO: 1129928 - RNA, 25 nt, Human
aaggaaaaaaauuaaaaaauaaagc

SEQ ID NO: 1129929 - RNA, 19 nt, Human
aaguagcugggauuacagg

SEQ ID NO: 1129930 - RNA, 25 nt, Human
aaguagcugggauuacaggcaccca

SEQ ID NO: 1129931 - RNA, 19 nt, Human
aaguaguugggauuacagg

SEQ ID NO: 1129932 - RNA, 24 nt, Human
aaguaguugggauuacaggcacgc

SEQ ID NO: 1129933 - RNA, 21 nt, Human
aagugauucuccugcuucagc

SEQ ID NO: 1129934 - RNA, 21 nt, Human
aaguguugggauuacaggugu

SEQ ID NO: 1129935 - RNA, 26 nt, Human
aaguguugggauuacaggugugagcc

SEQ ID NO: 1129936 - RNA, 22 nt, Human
acagaauauugcuuugucaccc

SEQ ID NO: 1129937 - RNA, 21 nt, Human
acaggcacccaccaccaugcc

SEQ ID NO: 1129938 - RNA, 23 nt, Human
acaugaauccaccauguaucccu

SEQ ID NO: 1129939 - RNA, 23 nt, Human
accaggaauaaaguuuggaguau

SEQ ID NO: 1129940 - RNA, 20 nt, Human
accauguaucccuauacuca

SEQ ID NO: 1129941 - RNA, 18 nt, Human
accauguuggccaggcug

SEQ ID NO: 1129942 - RNA, 18 nt, Human
accauguuggccaggcug

SEQ ID NO: 1129943 - RNA, 19 nt, Human
acccaggcuggagugcaau

SEQ ID NO: 1129944 - RNA, 18 nt, Human
acgggguuucaccauguu

SEQ ID NO: 1129945 - RNA, 23 nt, Human
acgggguuucaccauguuggcca

SEQ ID NO: 1129946 - RNA, 24 nt, Human
acgggguuucaccauguuggccag

SEQ ID NO: 1129947 - RNA, 23 nt, Human
acuaucaucuccauccacaaauc

SEQ ID NO: 1129948 - RNA, 25 nt, Human
acucgucacccaggcuggagugcaa

SEQ ID NO: 1129949 - RNA, 18 nt, Human
acucuagcuuuugcuacc

SEQ ID NO: 1129950 - RNA, 19 nt, Human
acugaaguacaugaaucca

SEQ ID NO: 1129951 - RNA, 22 nt, Human
acugcaaccgcugccucccagg

SEQ ID NO: 1129952 - RNA, 18 nt, Human
acugcaccuggccaagag

SEQ ID NO: 1129953 - RNA, 19 nt, Human
acugcaccuggccaagagc

SEQ ID NO: 1129954 - RNA, 21 nt, Human
acugcaccuggccaagagcag

SEQ ID NO: 1129955 - RNA, 22 nt, Human
agaaaaacagccccaugaaaca

SEQ ID NO: 1129956 - RNA, 21 nt, Human
agaaauucaagacaugaagcc

SEQ ID NO: 1129957 - RNA, 21 nt, Human
agaccuccuaagauaagugac

SEQ ID NO: 1129958 - RNA, 21 nt, Human
aggaaaaaaacuucuaaaaag

SEQ ID NO: 1129959 - RNA, 22 nt, Human
aggaaaaaaacuucuaaaaaga

SEQ ID NO: 1129960 - RNA, 20 nt, Human
aggcacgcaccaccacaccc

SEQ ID NO: 1129961 - RNA, 19 nt, Human
aggcgggagugcaguggca

SEQ ID NO: 1129962 - RNA, 20 nt, Human
agggggaaaaaaaaggaaaa

SEQ ID NO: 1129963 - RNA, 22 nt, Human
aguagagacgggguuucaccau

SEQ ID NO: 1129964 - RNA, 22 nt, Human
aguagagaugggguuucaccau

SEQ ID NO: 1129965 - RNA, 24 nt, Human
agugcaauggcgcgaugucggcuc

SEQ ID NO: 1129966 - RNA, 20 nt, Human
agugcaguggcauagucuug

SEQ ID NO: 1129967 - RNA, 23 nt, Human
agugcaguggcauagucuuggcu

SEQ ID NO: 1129968 - RNA, 24 nt, Human
agugcaguggcauagucuuggcuu

SEQ ID NO: 1129969 - RNA, 18 nt, Human
augaaaagaaaaacagcc

SEQ ID NO: 1129970 - RNA, 19 nt, Human
augaaaagaaaaacagccc

SEQ ID NO: 1129971 - RNA, 22 nt, Human
augggguuucaccauguuggcc

SEQ ID NO: 1129972 - RNA, 24 nt, Human
augggguuucaccauguuggccag

SEQ ID NO: 1129973 - RNA, 18 nt, Human
auugcuuugucacccagg

SEQ ID NO: 1129974 - RNA, 24 nt, Human
auuuacaaaauuaacagaucccaa

SEQ ID NO: 1129975 - RNA, 22 nt, Human
auuucauccagucucuccccca

SEQ ID NO: 1129976 - RNA, 25 nt, Human
auuuuuguacuuuuuaguagagaug

SEQ ID NO: 1129977 - RNA, 20 nt, Human
caaaacaaacacugaaguac

SEQ ID NO: 1129978 - RNA, 19 nt, Human
caaaguguugggauuacag

SEQ ID NO: 1129979 - RNA, 20 nt, Human
caaaguguugggauuacagg

SEQ ID NO: 1129980 - RNA, 20 nt, Human
caaaguguugggauuacagg

SEQ ID NO: 1129981 - RNA, 24 nt, Human
caaaguguugggauuacaggugug

SEQ ID NO: 1129982 - RNA, 25 nt, Human
caaaguucuaggauuacagggcaug

SEQ ID NO: 1129983 - RNA, 22 nt, Human
caagcgauucuccugccucagc

SEQ ID NO: 1129984 - RNA, 27 nt, Human
caagcgauucuccugccucagccuccc

SEQ ID NO: 1129985 - RNA, 24 nt, Human
caauuuuuuguauuuuuaguagag

SEQ ID NO: 1129986 - RNA, 25 nt, Human
caauuuuuuguauuuuuaguagaga

SEQ ID NO: 1129987 - RNA, 24 nt, Human
caccacacccagcuaauuuuugua

SEQ ID NO: 1129988 - RNA, 21 nt, Human
caccauguuggccaggcuggu

SEQ ID NO: 1129989 - RNA, 21 nt, Human
caccauguuggccaggcuggu

SEQ ID NO: 1129990 - RNA, 24 nt, Human
caccauguuggccaggcuggucuc

SEQ ID NO: 1129991 - RNA, 24 nt, Human
caccauguuggccaggcuggucuc

SEQ ID NO: 1129992 - RNA, 27 nt, Human
caccauguuggccaggcuggucucaaa

SEQ ID NO: 1129993 - RNA, 27 nt, Human
caccauguuggccaggcuggucucaaa

SEQ ID NO: 1129994 - RNA, 23 nt, Human
cacccaccucagccgcucaaagu

SEQ ID NO: 1129995 - RNA, 23 nt, Human
caccucccacuccaucagaggcu

SEQ ID NO: 1129996 - RNA, 18 nt, Human
cacgcaccaccacaccca

SEQ ID NO: 1129997 - RNA, 20 nt, Human
cacuaaaccugcugcccagu

SEQ ID NO: 1129998 - RNA, 21 nt, Human
cacuaucaucuccauccacaa

SEQ ID NO: 1129999 - RNA, 21 nt, Human
cacucgucacccaggcuggag

SEQ ID NO: 1130000 - RNA, 24 nt, Human
cagaccuccuaagauaagugacuc

SEQ ID NO: 1130001 - RNA, 20 nt, Human
cagaucccaauacagagagg

SEQ ID NO: 1130002 - RNA, 22 nt, Human
cagcagcagcaucucacugccu

SEQ ID NO: 1130003 - RNA, 21 nt, Human
caggcacccaccaccaugccc

SEQ ID NO: 1130004 - RNA, 21 nt, Human
caggcacgcaccaccacaccc

SEQ ID NO: 1130005 - RNA, 24 nt, Human
caggugauacacccaccccugaag

SEQ ID NO: 1130006 - RNA, 23 nt, Human
cagugccccaagcuggucagaga

SEQ ID NO: 1130007 - RNA, 20 nt, Human
caucacuaucaucuccaucc

SEQ ID NO: 1130008 - RNA, 24 nt, Human
cauguuggccaggcuggucucaaa

SEQ ID NO: 1130009 - RNA, 24 nt, Human
cauguuggccaggcuggucucaaa

SEQ ID NO: 1130010 - RNA, 23 nt, Human
ccaaguagcugggauuacaggca

SEQ ID NO: 1130011 - RNA, 24 nt, Human
ccaccuggguuuaagugauucucc

SEQ ID NO: 1130012 - RNA, 23 nt, Human
cccaaguagcugggauuacaggc

SEQ ID NO: 1130013 - RNA, 24 nt, Human
cccaaguagcugggauuacaggca

SEQ ID NO: 1130014 - RNA, 23 nt, Human
cccaaguaguugggauuacaggc

SEQ ID NO: 1130015 - RNA, 24 nt, Human
cccaaguaguugggauuacaggca

SEQ ID NO: 1130016 - RNA, 20 nt, Human
cccagguucaagcgauucuc

SEQ ID NO: 1130017 - RNA, 23 nt, Human
cccagguucaagcgauucuccug

SEQ ID NO: 1130018 - RNA, 22 nt, Human
cccaugaaggcagaacagggga

SEQ ID NO: 1130019 - RNA, 19 nt, Human
cccccccuucagccuccca

SEQ ID NO: 1130020 - RNA, 21 nt, Human
ccucaaaugauccgccccccc

SEQ ID NO: 1130021 - RNA, 19 nt, Human
ccucacuaaaccugcugcc

SEQ ID NO: 1130022 - RNA, 24 nt, Human
ccucccagguucaagcgauucucc

SEQ ID NO: 1130023 - RNA, 18 nt, Human
ccugaccucaaaugaucc

SEQ ID NO: 1130024 - RNA, 22 nt, Human
ccugcauuaaaacaaaugcgac

SEQ ID NO: 1130025 - RNA, 23 nt, Human
ccuggguuuaagugauucuccug

SEQ ID NO: 1130026 - RNA, 24 nt, Human
cgggguuucaccauguuggccagg

SEQ ID NO: 1130027 - RNA, 20 nt, Human
cgucacccaggcuggagugc

SEQ ID NO: 1130028 - RNA, 22 nt, Human
cuaaaaagagagaguacagugu

SEQ ID NO: 1130029 - RNA, 22 nt, Human
cucaaaguguugggauuacagg

SEQ ID NO: 1130030 - RNA, 21 nt, Human
cucacugcaaccuccgccacc

SEQ ID NO: 1130031 - RNA, 24 nt, Human
cucagccucccaaguaguugggau

SEQ ID NO: 1130032 - RNA, 24 nt, Human
cuccuguugacugugauguuuguu

SEQ ID NO: 1130033 - RNA, 24 nt, Human
cucgucacccaggcuggagugcaa

SEQ ID NO: 1130034 - RNA, 23 nt, Human
cugcaaccgcugccucccagguu

SEQ ID NO: 1130035 - RNA, 24 nt, Human
cugcaaccgcugccucccagguuc

SEQ ID NO: 1130036 - RNA, 24 nt, Human
cugcaaccuccgccaccuggguuu

SEQ ID NO: 1130037 - RNA, 21 nt, Human
cugccucagccucccaaguag

SEQ ID NO: 1130038 - RNA, 23 nt, Human
cugcuucagcuucccaaguagcu

SEQ ID NO: 1130039 - RNA, 23 nt, Human
cuucagccucccaaaguucuagg

SEQ ID NO: 1130040 - RNA, 21 nt, Human
gaaaaacagccccaugaaaca

SEQ ID NO: 1130041 - RNA, 18 nt, Human
gaacaguaggcauguuuc

SEQ ID NO: 1130042 - RNA, 22 nt, Human
gaagccaacuagauaccaggaa

SEQ ID NO: 1130043 - RNA, 21 nt, Human
gaagccaggguggcacuuuug

SEQ ID NO: 1130044 - RNA, 19 nt, Human
gacuccuugugaaaccagg

SEQ ID NO: 1130045 - RNA, 24 nt, Human
gacuucaggugauacacccaccuc

SEQ ID NO: 1130046 - RNA, 24 nt, Human
gagacgggguuucaccauguuggc

SEQ ID NO: 1130047 - RNA, 18 nt, Human
gagaugggguuucaccau

SEQ ID NO: 1130048 - RNA, 24 nt, Human
gagaugggguuucaccauguuggc

SEQ ID NO: 1130049 - RNA, 21 nt, Human
gauaugggggaagaagaggaa

SEQ ID NO: 1130050 - RNA, 24 nt, Human
gauuacaggcacccaccaccaugc

SEQ ID NO: 1130051 - RNA, 24 nt, Human
gauuacagggcaugaacuacugca

SEQ ID NO: 1130052 - RNA, 18 nt, Human
gauuacaggugugagcca

SEQ ID NO: 1130053 - RNA, 21 nt, Human
gauuacaggugugagccaccg

SEQ ID NO: 1130054 - RNA, 22 nt, Human
gauuacaggugugagccaccgc

SEQ ID NO: 1130055 - RNA, 21 nt, Human
gauucuccugccucagccucc

SEQ ID NO: 1130056 - RNA, 24 nt, Human
gauuucauccagucucucccccau

SEQ ID NO: 1130057 - RNA, 20 nt, Human
gcaccaccacacccagcuaa

SEQ ID NO: 1130058 - RNA, 19 nt, Human
gcacgcaccaccacaccca

SEQ ID NO: 1130059 - RNA, 22 nt, Human
gcagaacaggggaagaggcaca

SEQ ID NO: 1130060 - RNA, 20 nt, Human
gccacaccucucauggccac

SEQ ID NO: 1130061 - RNA, 23 nt, Human
gcccagccaauuuuuuguauuuu

SEQ ID NO: 1130062 - RNA, 24 nt, Human
gcgauucuccugccucagccuccc

SEQ ID NO: 1130063 - RNA, 19 nt, Human
gcuggagugcaauggcgcg

SEQ ID NO: 1130064 - RNA, 23 nt, Human
gcuggucucaaacuccugaccuc

SEQ ID NO: 1130065 - RNA, 21 nt, Human
gcuuacugcaaccgcugccuc

SEQ ID NO: 1130066 - RNA, 24 nt, Human
gcuucagcuucccaaguagcuggg

SEQ ID NO: 1130067 - RNA, 24 nt, Human
ggaaaaguuaauuuccaaguguuu

SEQ ID NO: 1130068 - RNA, 22 nt, Human
ggaagaggcacaguuuuccaga

SEQ ID NO: 1130069 - RNA, 23 nt, Human
ggagugcaguggcauagucuugg

SEQ ID NO: 1130070 - RNA, 21 nt, Human
ggaguuucacucgucacccag

SEQ ID NO: 1130071 - RNA, 18 nt, Human
ggcucuuggucagagagg

SEQ ID NO: 1130072 - RNA, 24 nt, Human
ggcuggucucaaacuccugaccuc

SEQ ID NO: 1130073 - RNA, 19 nt, Human
gggaaaaaaaaggaaaaaa

SEQ ID NO: 1130074 - RNA, 24 nt, Human
gggagugcaguggcauagucuugg

SEQ ID NO: 1130075 - RNA, 22 nt, Human
gggguuucaccauguuggccag

SEQ ID NO: 1130076 - RNA, 23 nt, Human
gggguuucaccauguuggccagg

SEQ ID NO: 1130077 - RNA, 18 nt, Human
ggguuucaccauguuggc

SEQ ID NO: 1130078 - RNA, 23 nt, Human
guagagacgggguuucaccaugu

SEQ ID NO: 1130079 - RNA, 23 nt, Human
guagagaugggguuucaccaugu

SEQ ID NO: 1130080 - RNA, 18 nt, Human
guagcugggauuacaggc

SEQ ID NO: 1130081 - RNA, 18 nt, Human
guaguugggauuacaggc

SEQ ID NO: 1130082 - RNA, 24 nt, Human
guuucacucgucacccaggcugga

SEQ ID NO: 1130083 - RNA, 25 nt, Human
uaaaaaauaaagcgaccuuugccaa

SEQ ID NO: 1130084 - RNA, 21 nt, Human
uaaaacaaaugcgacuggcca

SEQ ID NO: 1130085 - RNA, 25 nt, Human
uaaccugacuuacagaccuccuaag

SEQ ID NO: 1130086 - RNA, 27 nt, Human
uaagcaaaccauuucucuaagucagga

SEQ ID NO: 1130087 - RNA, 21 nt, Human
uaagugacuccuugugaaacc

SEQ ID NO: 1130088 - RNA, 20 nt, Human
uaagugauucuccugcuuca

SEQ ID NO: 1130089 - RNA, 22 nt, Human
uaagugauucuccugcuucagc

SEQ ID NO: 1130090 - RNA, 25 nt, Human
uaauuuuuguacuuuuuaguagaga

SEQ ID NO: 1130091 - RNA, 26 nt, Human
uacaaaauuaacagaucccaauacag

SEQ ID NO: 1130092 - RNA, 19 nt, Human
uacagaccuccuaagauaa

SEQ ID NO: 1130093 - RNA, 19 nt, Human
uacaggugugagccaccgc

SEQ ID NO: 1130094 - RNA, 20 nt, Human
uacaggugugagccaccgcu

SEQ ID NO: 1130095 - RNA, 23 nt, Human
uacaggugugagccaccgcuccc

SEQ ID NO: 1130096 - RNA, 18 nt, Human
uacugcaaccgcugccuc

SEQ ID NO: 1130097 - RNA, 21 nt, Human
uacugcaaccgcugccuccca

SEQ ID NO: 1130098 - RNA, 25 nt, Human
uagaauaaaaaagaaaaugcaagga

SEQ ID NO: 1130099 - RNA, 22 nt, Human
uagagacgggguuucaccaugu

SEQ ID NO: 1130100 - RNA, 22 nt, Human
uagagaugggguuucaccaugu

SEQ ID NO: 1130101 - RNA, 25 nt, Human
uagccacaccucucauggccacagg

SEQ ID NO: 1130102 - RNA, 18 nt, Human
uagcuacaagaauccaca

SEQ ID NO: 1130103 - RNA, 22 nt, Human
uagcuacaagaauccacagcag

SEQ ID NO: 1130104 - RNA, 24 nt, Human
uaggauuacagggcaugaacuacu

SEQ ID NO: 1130105 - RNA, 26 nt, Human
uaggauuacagggcaugaacuacugc

SEQ ID NO: 1130106 - RNA, 24 nt, Human
uaguagagacgggguuucaccaug

SEQ ID NO: 1130107 - RNA, 26 nt, Human
uaguagagacgggguuucaccauguu

SEQ ID NO: 1130108 - RNA, 24 nt, Human
uaguagagaugggguuucaccaug

SEQ ID NO: 1130109 - RNA, 26 nt, Human
uaguagagaugggguuucaccauguu

SEQ ID NO: 1130110 - RNA, 19 nt, Human
uaugccaagaagccgaggc

SEQ ID NO: 1130111 - RNA, 19 nt, Human
uauugcuuugucacccagg

SEQ ID NO: 1130112 - RNA, 20 nt, Human
uauugcuuugucacccaggc

SEQ ID NO: 1130113 - RNA, 21 nt, Human
ucaaaguguugggauuacagg

SEQ ID NO: 1130114 - RNA, 24 nt, Human
ucaaaguguugggauuacaggugu

SEQ ID NO: 1130115 - RNA, 21 nt, Human
ucaauuuuuauuuuugagaug

SEQ ID NO: 1130116 - RNA, 22 nt, Human
ucaccagugcgcuccccagugc

SEQ ID NO: 1130117 - RNA, 18 nt, Human
ucacccaggcuggagugc

SEQ ID NO: 1130118 - RNA, 21 nt, Human
ucacucgucacccaggcugga

SEQ ID NO: 1130119 - RNA, 19 nt, Human
ucacugcaaccuccgccac

SEQ ID NO: 1130120 - RNA, 23 nt, Human
ucacugcaaccuccgccaccugg

SEQ ID NO: 1130121 - RNA, 23 nt, Human
ucacugcaaccuccgccaccugg

SEQ ID NO: 1130122 - RNA, 24 nt, Human
ucacugcaaccuccgccaccuggg

SEQ ID NO: 1130123 - RNA, 20 nt, Human
ucagccucccaaaguucuag

SEQ ID NO: 1130124 - RNA, 24 nt, Human
ucccaaguagcugggauuacaggc

SEQ ID NO: 1130125 - RNA, 24 nt, Human
ucccaaguaguugggauuacaggc

SEQ ID NO: 1130126 - RNA, 21 nt, Human
ucccagguucaagcgauucuc

SEQ ID NO: 1130127 - RNA, 24 nt, Human
ucccagguucaagcgauucuccug

SEQ ID NO: 1130128 - RNA, 21 nt, Human
ucccugaaggaacauacuccc

SEQ ID NO: 1130129 - RNA, 23 nt, Human
uccgacaccacacuaucuugaau

SEQ ID NO: 1130130 - RNA, 18 nt, Human
uccugaccucaaaugauc

SEQ ID NO: 1130131 - RNA, 18 nt, Human
ucgcaugaagcaagcucc

SEQ ID NO: 1130132 - RNA, 23 nt, Human
ucgccacagcaauacucuagcuu

SEQ ID NO: 1130133 - RNA, 19 nt, Human
ucuccugccucagccuccc

SEQ ID NO: 1130134 - RNA, 18 nt, Human
ucucuaagucaggagagc

SEQ ID NO: 1130135 - RNA, 21 nt, Human
ugaaaagaaaaacagccccau

SEQ ID NO: 1130136 - RNA, 25 nt, Human
ugaaaagaaaaacagccccaugaaa

SEQ ID NO: 1130137 - RNA, 19 nt, Human
ugaaaggcucaauauaaag

SEQ ID NO: 1130138 - RNA, 20 nt, Human
ugaagcaaggaaugugaccc

SEQ ID NO: 1130139 - RNA, 20 nt, Human
ugaagccaacuagauaccag

SEQ ID NO: 1130140 - RNA, 19 nt, Human
ugaaggaacauacucccag

SEQ ID NO: 1130141 - RNA, 20 nt, Human
ugaaggaacauacucccagu

SEQ ID NO: 1130142 - RNA, 20 nt, Human
ugaaguacaugaauccacca

SEQ ID NO: 1130143 - RNA, 19 nt, Human
ugaccaguggcugaaacag

SEQ ID NO: 1130144 - RNA, 18 nt, Human
ugaccucaaaugauccgc

SEQ ID NO: 1130145 - RNA, 22 nt, Human
ugaccucaaaugauccgccccc

SEQ ID NO: 1130146 - RNA, 18 nt, Human
ugacuuagaaaaugcacu

SEQ ID NO: 1130147 - RNA, 19 nt, Human
ugagggggaaaaaaaagga

SEQ ID NO: 1130148 - RNA, 20 nt, Human
ugcaauggcgcgaugucggc

SEQ ID NO: 1130149 - RNA, 22 nt, Human
ugcaaugggccagaacuucucc

SEQ ID NO: 1130150 - RNA, 21 nt, Human
ugcaguggcauagucuuggcu

SEQ ID NO: 1130151 - RNA, 24 nt, Human
ugccucagccucccaaguaguugg

SEQ ID NO: 1130152 - RNA, 21 nt, Human
ugccuuaauuuuugcagcagc

SEQ ID NO: 1130153 - RNA, 19 nt, Human
ugcugaguaaggcucacug

SEQ ID NO: 1130154 - RNA, 24 nt, Human
ugcuucagcuucccaaguagcugg

SEQ ID NO: 1130155 - RNA, 24 nt, Human
uggagugcaauggcgcgaugucgg

SEQ ID NO: 1130156 - RNA, 23 nt, Human
uggaguuucacucgucacccagg

SEQ ID NO: 1130157 - RNA, 23 nt, Human
uggccaagagcagaagaauuuag

SEQ ID NO: 1130158 - RNA, 21 nt, Human
uggccaggcuggucucaaacu

SEQ ID NO: 1130159 - RNA, 24 nt, Human
uggccaggcuggucucaaacuccu

SEQ ID NO: 1130160 - RNA, 20 nt, Human
uggcgcgaugucggcucacu

SEQ ID NO: 1130161 - RNA, 19 nt, Human
ugggauuacaggcacccac

SEQ ID NO: 1130162 - RNA, 21 nt, Human
ugggauuacaggcacccacca

SEQ ID NO: 1130163 - RNA, 22 nt, Human
ugggauuacaggcacccaccac

SEQ ID NO: 1130164 - RNA, 24 nt, Human
ugggauuacaggcacccaccacca

SEQ ID NO: 1130165 - RNA, 21 nt, Human
ugggauuacaggcacgcacca

SEQ ID NO: 1130166 - RNA, 24 nt, Human
ugggauuacaggcacgcaccacca

SEQ ID NO: 1130167 - RNA, 18 nt, Human
ugggauuacaggugugag

SEQ ID NO: 1130168 - RNA, 19 nt, Human
ugggauuacaggugugagc

SEQ ID NO: 1130169 - RNA, 21 nt, Human
ugggauuacaggugugagcca

SEQ ID NO: 1130170 - RNA, 22 nt, Human
ugggauuacaggugugagccac

SEQ ID NO: 1130171 - RNA, 23 nt, Human
ugggauuacaggugugagccacc

SEQ ID NO: 1130172 - RNA, 24 nt, Human
ugggauuacaggugugagccaccg

SEQ ID NO: 1130173 - RNA, 24 nt, Human
ugggguuucaccauguuggccagg

SEQ ID NO: 1130174 - RNA, 19 nt, Human
uggucaaaacaaacacuga

SEQ ID NO: 1130175 - RNA, 21 nt, Human
uguauuuuuaguagagacggg

SEQ ID NO: 1130176 - RNA, 23 nt, Human
ugugaaaccaggaugaaauauga

SEQ ID NO: 1130177 - RNA, 23 nt, Human
uguggcagugaagccaacuagau

SEQ ID NO: 1130178 - RNA, 22 nt, Human
uguuggcaacuuuaaaauggua

SEQ ID NO: 1130179 - RNA, 23 nt, Human
uuaaaacaaaugcgacuggcccu

SEQ ID NO: 1130180 - RNA, 20 nt, Human
uuaacagaucccaauacaga

SEQ ID NO: 1130181 - RNA, 23 nt, Human
uuacuaaauaagccaauugaggg

SEQ ID NO: 1130182 - RNA, 19 nt, Human
uuacugcaaccgcugccuc

SEQ ID NO: 1130183 - RNA, 24 nt, Human
uuacugcaaccgcugccucccagg

SEQ ID NO: 1130184 - RNA, 19 nt, Human
uuagcucaccucccacucc

SEQ ID NO: 1130185 - RNA, 18 nt, Human
uuaguagagacgggguuu

SEQ ID NO: 1130186 - RNA, 22 nt, Human
uuaguagagacgggguuucacc

SEQ ID NO: 1130187 - RNA, 24 nt, Human
uuaguagagacgggguuucaccau

SEQ ID NO: 1130188 - RNA, 18 nt, Human
uuaguagagaugggguuu

SEQ ID NO: 1130189 - RNA, 22 nt, Human
uuaguagagaugggguuucacc

SEQ ID NO: 1130190 - RNA, 24 nt, Human
uuaguagagaugggguuucaccau

SEQ ID NO: 1130191 - RNA, 21 nt, Human
uucaagcgauucuccugccuc

SEQ ID NO: 1130192 - RNA, 23 nt, Human
uucaagcgauucuccugccucag

SEQ ID NO: 1130193 - RNA, 24 nt, Human
uucaagcgauucuccugccucagc

SEQ ID NO: 1130194 - RNA, 24 nt, Human
uucacucgucacccaggcuggagu

SEQ ID NO: 1130195 - RNA, 24 nt, Human
uucagcuucccaaguagcugggau

SEQ ID NO: 1130196 - RNA, 23 nt, Human
uucaggugauacacccaccucag

SEQ ID NO: 1130197 - RNA, 22 nt, Human
uucaucacuaucaucuccaucc

SEQ ID NO: 1130198 - RNA, 24 nt, Human
uuggaagcuuuuagguaccaauuc

SEQ ID NO: 1130199 - RNA, 21 nt, Human
uugggauuacaggugugagcc

SEQ ID NO: 1130200 - RNA, 23 nt, Human
uuguauuuuuaguagagacgggg

SEQ ID NO: 1130201 - RNA, 23 nt, Human
uuuaagugauucuccugcuucag

SEQ ID NO: 1130202 - RNA, 24 nt, Human
uuucaccauguuggccaggcuggu

SEQ ID NO: 1130203 - RNA, 24 nt, Human
uuucaccauguuggccaggcuggu

SEQ ID NO: 1130204 - RNA, 21 nt, Human
uuucacucgucacccaggcug

SEQ ID NO: 1130205 - RNA, 23 nt, Human
uuucacucgucacccaggcugga

SEQ ID NO: 1130206 - RNA, 23 nt, Human
uuucaucacuaucaucuccaucc

SEQ ID NO: 1130207 - RNA, 24 nt, Human
uuugucacccaggcgggagugcag

SEQ ID NO: 1130208 - RNA, 24 nt, Human
uuuuuaguagagacgggguuucac

SEQ ID NO: 1130209 - RNA, 24 nt, Human
uuuuuaguagagaugggguuucac

SEQ ID NO: 1130210 - RNA, 23 nt, Human
uuuuuauuuuugagauggaguuu

SEQ ID NO: 1130211 - RNA, 21 nt, Human
uuuuuguacuuuuuaguagag

SEQ ID NO: 1130212 - RNA, 21 nt, Human
uuuuuguauuuuuaguagaga

SEQ ID NO: 1130213 - RNA, 24 nt, Human
uuuuuuguauuuuuaguagagacg

SEQ ID NO: 1130214 - RNA, 21 nt, Human
aaaacaaacaggcaaggggcc

SEQ ID NO: 1130215 - RNA, 20 nt, Human
aaacaaacaggcaaggggcc

SEQ ID NO: 1130216 - RNA, 21 nt, Human
aaacccucccucccuaaaggc

SEQ ID NO: 1130217 - RNA, 20 nt, Human
aaacgaacagcagagaaauc

SEQ ID NO: 1130218 - RNA, 24 nt, Human
aaagaaacagggcuccagccccca

SEQ ID NO: 1130219 - RNA, 18 nt, Human
aacacagugggaccucag

SEQ ID NO: 1130220 - RNA, 20 nt, Human
aacccucucccccagaccca

SEQ ID NO: 1130221 - RNA, 22 nt, Human
aagcacaacaggaaggccaggu

SEQ ID NO: 1130222 - RNA, 20 nt, Human
aagccaaaaacuuuaauuuc

SEQ ID NO: 1130223 - RNA, 18 nt, Human
aagggcucaggcugucag

SEQ ID NO: 1130224 - RNA, 28 nt, Human
aauggucccaaaggcccuucaagggggu

SEQ ID NO: 1130225 - RNA, 24 nt, Human
acagcagagaaaucacacugguua

SEQ ID NO: 1130226 - RNA, 22 nt, Human
acaugcucacgaugacacaaag

SEQ ID NO: 1130227 - RNA, 18 nt, Human
accuacuccccaggggcu

SEQ ID NO: 1130228 - RNA, 22 nt, Human
acucuccuccccaaacccccau

SEQ ID NO: 1130229 - RNA, 19 nt, Human
agaaaaacaaacaggcaag

SEQ ID NO: 1130230 - RNA, 21 nt, Human
agaaacagggcuccagccccc

SEQ ID NO: 1130231 - RNA, 18 nt, Human
agaaagaagggaggagga

SEQ ID NO: 1130232 - RNA, 24 nt, Human
agaacaaacaagaaaaucauugag

SEQ ID NO: 1130233 - RNA, 20 nt, Human
agagcccugcuccuuccacc

SEQ ID NO: 1130234 - RNA, 22 nt, Human
agagcccugcuccuuccacccc

SEQ ID NO: 1130235 - RNA, 20 nt, Human
agagggaaugagggaaaggu

SEQ ID NO: 1130236 - RNA, 20 nt, Human
agccuggguguccucaggag

SEQ ID NO: 1130237 - RNA, 19 nt, Human
agcggggacaggaugggcu

SEQ ID NO: 1130238 - RNA, 18 nt, Human
aggcaguagcggggacag

SEQ ID NO: 1130239 - RNA, 21 nt, Human
aggccaccaccuacuccccag

SEQ ID NO: 1130240 - RNA, 23 nt, Human
aggcccccagccuaaggacccag

SEQ ID NO: 1130241 - RNA, 24 nt, Human
aguaauaaacgaacagcagagaaa

SEQ ID NO: 1130242 - RNA, 21 nt, Human
aguucuucccccuuugcaccc

SEQ ID NO: 1130243 - RNA, 21 nt, Human
auaaaggcugugcagacacca

SEQ ID NO: 1130244 - RNA, 23 nt, Human
aucaaggucuagacccaauccug

SEQ ID NO: 1130245 - RNA, 24 nt, Human
augaacacaaugcaacgcgacccc

SEQ ID NO: 1130246 - RNA, 29 nt, Human
auuaggcuucaaagaaagaagggaggagg

SEQ ID NO: 1130247 - RNA, 25 nt, Human
caaagaaacagggcuccagccccca

SEQ ID NO: 1130248 - RNA, 18 nt, Human
caaagaaagaagggagga

SEQ ID NO: 1130249 - RNA, 19 nt, Human
caacaggaaggccaggucu

SEQ ID NO: 1130250 - RNA, 20 nt, Human
caacccucucccccagaccc

SEQ ID NO: 1130251 - RNA, 21 nt, Human
caacccucucccccagaccca

SEQ ID NO: 1130252 - RNA, 20 nt, Human
caacgcgaccccacuccaac

SEQ ID NO: 1130253 - RNA, 18 nt, Human
caagggccccagaaaccc

SEQ ID NO: 1130254 - RNA, 19 nt, Human
caagggccccagaaacccu

SEQ ID NO: 1130255 - RNA, 23 nt, Human
caagggcccuccacccaggcauc

SEQ ID NO: 1130256 - RNA, 22 nt, Human
caaggggccaauucugugccuu

SEQ ID NO: 1130257 - RNA, 22 nt, Human
cacagccccugggaaggggcac

SEQ ID NO: 1130258 - RNA, 22 nt, Human
cacaggccaccaccuacucccc

SEQ ID NO: 1130259 - RNA, 18 nt, Human
caccaccuacuccccagg

SEQ ID NO: 1130260 - RNA, 20 nt, Human
caccaggggaagggcucagg

SEQ ID NO: 1130261 - RNA, 24 nt, Human
caccgcggucccaggaaacucuga

SEQ ID NO: 1130262 - RNA, 22 nt, Human
cacucuccuccccaaaccccca

SEQ ID NO: 1130263 - RNA, 23 nt, Human
cagaaacccucccucccuaaagg

SEQ ID NO: 1130264 - RNA, 26 nt, Human
cagaaacccucccucccuaaaggccu

SEQ ID NO: 1130265 - RNA, 20 nt, Human
cagagcccugcuccuuccac

SEQ ID NO: 1130266 - RNA, 21 nt, Human
cagcccagggcuucgaggcca

SEQ ID NO: 1130267 - RNA, 19 nt, Human
cagccccccaguggccccu

SEQ ID NO: 1130268 - RNA, 22 nt, Human
cagcugcuccaccccuccagga

SEQ ID NO: 1130269 - RNA, 23 nt, Human
caggcaggagcugguguuuccua

SEQ ID NO: 1130270 - RNA, 19 nt, Human
cagggugggaccaaaggca

SEQ ID NO: 1130271 - RNA, 24 nt, Human
ccacccccuaagccaccugcucca

SEQ ID NO: 1130272 - RNA, 22 nt, Human
ccagagcccugcuccuuccacc

SEQ ID NO: 1130273 - RNA, 24 nt, Human
ccagcccccagcugcuccaccccu

SEQ ID NO: 1130274 - RNA, 20 nt, Human
ccagccccccaguggccccu

SEQ ID NO: 1130275 - RNA, 22 nt, Human
ccagccccccaguggccccuag

SEQ ID NO: 1130276 - RNA, 24 nt, Human
ccagggcuucgaggccaggaaucc

SEQ ID NO: 1130277 - RNA, 18 nt, Human
ccauucccucacugcccc

SEQ ID NO: 1130278 - RNA, 20 nt, Human
cccacagcugcucccauucc

SEQ ID NO: 1130279 - RNA, 18 nt, Human
cccagagaagucacuggu

SEQ ID NO: 1130280 - RNA, 19 nt, Human
ccccagaaacccucccucc

SEQ ID NO: 1130281 - RNA, 20 nt, Human
ccccagaaacccucccuccc

SEQ ID NO: 1130282 - RNA, 21 nt, Human
ccccagaaacccucccucccu

SEQ ID NO: 1130283 - RNA, 20 nt, Human
ccccagccccccaguggccc

SEQ ID NO: 1130284 - RNA, 22 nt, Human
ccccagccuaaggacccaggcu

SEQ ID NO: 1130285 - RNA, 25 nt, Human
ccccagccuugggauuccacccacc

SEQ ID NO: 1130286 - RNA, 20 nt, Human
ccccagcugcuccaccccuc

SEQ ID NO: 1130287 - RNA, 21 nt, Human
ccccaggggcucuugugaggg

SEQ ID NO: 1130288 - RNA, 24 nt, Human
ccccagguguuguuauugcuucgg

SEQ ID NO: 1130289 - RNA, 22 nt, Human
cccccaagcugggucuugauuu

SEQ ID NO: 1130290 - RNA, 18 nt, Human
cccccagacccaggccca

SEQ ID NO: 1130291 - RNA, 18 nt, Human
cccccagccuaaggaccc

SEQ ID NO: 1130292 - RNA, 22 nt, Human
cccccagcugcuccaccccucc

SEQ ID NO: 1130293 - RNA, 22 nt, Human
cccccagguguuguuauugcuu

SEQ ID NO: 1130294 - RNA, 20 nt, Human
cccccaguggccccuagugc

SEQ ID NO: 1130295 - RNA, 26 nt, Human
cccccucugccaagguccuacaaccc

SEQ ID NO: 1130296 - RNA, 20 nt, Human
ccccuaagccaccugcucca

SEQ ID NO: 1130297 - RNA, 19 nt, Human
ccccuaguucuucccccuu

SEQ ID NO: 1130298 - RNA, 19 nt, Human
ccccugaacaaccacagcg

SEQ ID NO: 1130299 - RNA, 21 nt, Human
ccccugaacaaccacagcggu

SEQ ID NO: 1130300 - RNA, 19 nt, Human
ccccuggagaccccagccc

SEQ ID NO: 1130301 - RNA, 19 nt, Human
ccccuggagaccccagccc

SEQ ID NO: 1130302 - RNA, 28 nt, Human
cccuccacccaggcaucaaggucuagac

SEQ ID NO: 1130303 - RNA, 18 nt, Human
cccucugccaagguccua

SEQ ID NO: 1130304 - RNA, 21 nt, Human
cccuggcaacccucuccccca

SEQ ID NO: 1130305 - RNA, 23 nt, Human
ccuacaacccuuaggagucccuc

SEQ ID NO: 1130306 - RNA, 18 nt, Human
ccucccuaaaggccuggg

SEQ ID NO: 1130307 - RNA, 23 nt, Human
ccucccucccuaaaggccugggc

SEQ ID NO: 1130308 - RNA, 24 nt, Human
ccuccuggguaaagggggcgucuc

SEQ ID NO: 1130309 - RNA, 21 nt, Human
ccuggcaacccucucccccag

SEQ ID NO: 1130310 - RNA, 20 nt, Human
ccuggcuccggcucagccuc

SEQ ID NO: 1130311 - RNA, 23 nt, Human
ccuggcuccggcucagccucuau

SEQ ID NO: 1130312 - RNA, 21 nt, Human
ccuggugggacugggaccggg

SEQ ID NO: 1130313 - RNA, 23 nt, Human
ccuucccaccacccguccaggaa

SEQ ID NO: 1130314 - RNA, 21 nt, Human
cgcgaccccacuccaacccaa

SEQ ID NO: 1130315 - RNA, 24 nt, Human
cggcacaggccaccaccuacuccc

SEQ ID NO: 1130316 - RNA, 23 nt, Human
cgggaccaggaacagggugggac

SEQ ID NO: 1130317 - RNA, 20 nt, Human
cuaauggagaccaggccccc

SEQ ID NO: 1130318 - RNA, 25 nt, Human
cuauggccccuuacaagggcccucc

SEQ ID NO: 1130319 - RNA, 23 nt, Human
cucauacugcccuggcuccggcu

SEQ ID NO: 1130320 - RNA, 19 nt, Human
cuccaagagagggaaugag

SEQ ID NO: 1130321 - RNA, 23 nt, Human
cucccauucccucacugccccag

SEQ ID NO: 1130322 - RNA, 24 nt, Human
cucccuggcaacccucucccccag

SEQ ID NO: 1130323 - RNA, 21 nt, Human
cuccugccuucccaccacccg

SEQ ID NO: 1130324 - RNA, 19 nt, Human
cucuccuccccaaaccccc

SEQ ID NO: 1130325 - RNA, 18 nt, Human
cucugccaagguccuaca

SEQ ID NO: 1130326 - RNA, 23 nt, Human
cugcugcuccaagagagggaaug

SEQ ID NO: 1130327 - RNA, 27 nt, Human
cuuccacccccagccuugggauuccac

SEQ ID NO: 1130328 - RNA, 19 nt, Human
cuugaagcuucuccgaagc

SEQ ID NO: 1130329 - RNA, 25 nt, Human
gaaaaugucacucuccuccccaaac

SEQ ID NO: 1130330 - RNA, 18 nt, Human
gaaagaagggaggaggag

SEQ ID NO: 1130331 - RNA, 20 nt, Human
gaagcuucuccgaagcuaau

SEQ ID NO: 1130332 - RNA, 25 nt, Human
gaagggcacacucgagauaaaagca

SEQ ID NO: 1130333 - RNA, 22 nt, Human
gagaccaggcccccucugccaa

SEQ ID NO: 1130334 - RNA, 23 nt, Human
gagggaaagguggguggauggag

SEQ ID NO: 1130335 - RNA, 19 nt, Human
gaugaaaaugucacucucc

SEQ ID NO: 1130336 - RNA, 21 nt, Human
gauuucacagaacaaacaaga

SEQ ID NO: 1130337 - RNA, 19 nt, Human
gcaacgcgaccccacucca

SEQ ID NO: 1130338 - RNA, 22 nt, Human
gccccagaaacccucccucccu

SEQ ID NO: 1130339 - RNA, 19 nt, Human
gcccccagccuaaggaccc

SEQ ID NO: 1130340 - RNA, 24 nt, Human
gcccuccacccaggcaucaagguc

SEQ ID NO: 1130341 - RNA, 24 nt, Human
gcgaaucccuccagagcccugcuc

SEQ ID NO: 1130342 - RNA, 19 nt, Human
gcgaccccacuccaaccca

SEQ ID NO: 1130343 - RNA, 18 nt, Human
gcuccugccuucccacca

SEQ ID NO: 1130344 - RNA, 19 nt, Human
gcuccugccuucccaccac

SEQ ID NO: 1130345 - RNA, 18 nt, Human
gcucugcccuguuuuuga

SEQ ID NO: 1130346 - RNA, 21 nt, Human
gcucugggcuguuggagaacc

SEQ ID NO: 1130347 - RNA, 24 nt, Human
gcugggucuugauuuccuugucug

SEQ ID NO: 1130348 - RNA, 20 nt, Human
gcuuuucccccaagcugggu

SEQ ID NO: 1130349 - RNA, 20 nt, Human
ggaccaggaacaggguggga

SEQ ID NO: 1130350 - RNA, 24 nt, Human
ggaccgggaccaggaacagggugg

SEQ ID NO: 1130351 - RNA, 22 nt, Human
ggaccgggaccgggaccaggaa

SEQ ID NO: 1130352 - RNA, 21 nt, Human
ggacugggaccgggaccggga

SEQ ID NO: 1130353 - RNA, 21 nt, Human
gggacccaggcugggggugcc

SEQ ID NO: 1130354 - RNA, 19 nt, Human
gggcaguggcagccccacc

SEQ ID NO: 1130355 - RNA, 24 nt, Human
ggggaggacuugccugaaaugagg

SEQ ID NO: 1130356 - RNA, 22 nt, Human
ggguaagcagcucuguggaggu

SEQ ID NO: 1130357 - RNA, 20 nt, Human
ggguucuggagaaggagagu

SEQ ID NO: 1130358 - RNA, 21 nt, Human
gucacuuccuguuucugggcc

SEQ ID NO: 1130359 - RNA, 23 nt, Human
gucccaggaaacucugaagaccc

SEQ ID NO: 1130360 - RNA, 24 nt, Human
guccucaggagaaaacaacacccu

SEQ ID NO: 1130361 - RNA, 20 nt, Human
gugccuugaaugcgaauccc

SEQ ID NO: 1130362 - RNA, 25 nt, Human
guggauggagagaggcccccagccu

SEQ ID NO: 1130363 - RNA, 22 nt, Human
guuccaguccugcccacccacu

SEQ ID NO: 1130364 - RNA, 21 nt, Human
guuuuugaaaagcuaccccug

SEQ ID NO: 1130365 - RNA, 23 nt, Human
uaaguaauaaacgaacagcagag

SEQ ID NO: 1130366 - RNA, 20 nt, Human
uacccaggguuuccacaggc

SEQ ID NO: 1130367 - RNA, 18 nt, Human
uagaaaaacaaacaggca

SEQ ID NO: 1130368 - RNA, 24 nt, Human
ucaaagaaagaagggaggaggagg

SEQ ID NO: 1130369 - RNA, 19 nt, Human
ucaaggggguucuggagaa

SEQ ID NO: 1130370 - RNA, 20 nt, Human
ucaaggggguucuggagaag

SEQ ID NO: 1130371 - RNA, 21 nt, Human
ucacacugguuagaaaaacaa

SEQ ID NO: 1130372 - RNA, 20 nt, Human
ucacagaacaaacaagaaaa

SEQ ID NO: 1130373 - RNA, 22 nt, Human
ucacucuccuccccaaaccccc

SEQ ID NO: 1130374 - RNA, 21 nt, Human
ucacugaccacccccaggugu

SEQ ID NO: 1130375 - RNA, 23 nt, Human
ucacugaccacccccagguguug

SEQ ID NO: 1130376 - RNA, 22 nt, Human
ucacugcaucugaagguuuggg

SEQ ID NO: 1130377 - RNA, 20 nt, Human
ucacuuccuguuucugggcc

SEQ ID NO: 1130378 - RNA, 18 nt, Human
uccaagagagggaaugag

SEQ ID NO: 1130379 - RNA, 19 nt, Human
uccaagagagggaaugagg

SEQ ID NO: 1130380 - RNA, 25 nt, Human
uccagagcccugcuccuuccacccc

SEQ ID NO: 1130381 - RNA, 22 nt, Human
uccaggaggugagcgggauuuc

SEQ ID NO: 1130382 - RNA, 20 nt, Human
ucccagcagacaugcacugg

SEQ ID NO: 1130383 - RNA, 19 nt, Human
ucccaggaccucagcuccc

SEQ ID NO: 1130384 - RNA, 20 nt, Human
ucccaggaccucagcucccu

SEQ ID NO: 1130385 - RNA, 19 nt, Human
uccccaaacccccaucccu

SEQ ID NO: 1130386 - RNA, 21 nt, Human
ucccccagacccaggcccaga

SEQ ID NO: 1130387 - RNA, 24 nt, Human
uccucaggagaaaacaacacccuc

SEQ ID NO: 1130388 - RNA, 22 nt, Human
uccugcccacccacuaacacag

SEQ ID NO: 1130389 - RNA, 20 nt, Human
ucucccuccaguugguccug

SEQ ID NO: 1130390 - RNA, 22 nt, Human
ucuccuggcucaaaauauucca

SEQ ID NO: 1130391 - RNA, 21 nt, Human
ucugaccucccugaagcgcug

SEQ ID NO: 1130392 - RNA, 23 nt, Human
ucuggagaaggagaguggagaug

SEQ ID NO: 1130393 - RNA, 21 nt, Human
ucuuuuggggggccauuaggc

SEQ ID NO: 1130394 - RNA, 22 nt, Human
ugaaaacaaagucugaaaagca

SEQ ID NO: 1130395 - RNA, 26 nt, Human
ugaaaagcacaacaggaaggccaggu

SEQ ID NO: 1130396 - RNA, 20 nt, Human
ugaaaagcuaccccugaaca

SEQ ID NO: 1130397 - RNA, 21 nt, Human
ugaaaagcuaccccugaacaa

SEQ ID NO: 1130398 - RNA, 21 nt, Human
ugaaaaugucacucuccuccc

SEQ ID NO: 1130399 - RNA, 23 nt, Human
ugaaaaugucacucuccucccca

SEQ ID NO: 1130400 - RNA, 22 nt, Human
ugaaagggcuccagaggugaug

SEQ ID NO: 1130401 - RNA, 22 nt, Human
ugaaauggggaugacggcacag

SEQ ID NO: 1130402 - RNA, 28 nt, Human
ugaacacaaugcaacgcgaccccacucc

SEQ ID NO: 1130403 - RNA, 23 nt, Human
ugaccagaacuuuaaagaauacc

SEQ ID NO: 1130404 - RNA, 20 nt, Human
ugaggggucuugugugaguc

SEQ ID NO: 1130405 - RNA, 20 nt, Human
ugcaggguaagcagcucugu

SEQ ID NO: 1130406 - RNA, 20 nt, Human
ugcccuggcuccggcucagc

SEQ ID NO: 1130407 - RNA, 18 nt, Human
ugcucacagcccuggguu

SEQ ID NO: 1130408 - RNA, 22 nt, Human
ugcugaggggucuugugugagu

SEQ ID NO: 1130409 - RNA, 22 nt, Human
uggaaauggacuaaugguccca

SEQ ID NO: 1130410 - RNA, 19 nt, Human
uggaaggaguugccuggug

SEQ ID NO: 1130411 - RNA, 19 nt, Human
uggaaggaguugccuggug

SEQ ID NO: 1130412 - RNA, 27 nt, Human
uggagaccccagccccccaguggcccc

SEQ ID NO: 1130413 - RNA, 19 nt, Human
uggagcaacggucuccugu

SEQ ID NO: 1130414 - RNA, 19 nt, Human
uggccccuagugccagccu

SEQ ID NO: 1130415 - RNA, 20 nt, Human
uggccccuagugccagccuc

SEQ ID NO: 1130416 - RNA, 25 nt, Human
ugggaaggggcacaugcucacgaug

SEQ ID NO: 1130417 - RNA, 18 nt, Human
ugggccucaguuucccaa

SEQ ID NO: 1130418 - RNA, 23 nt, Human
uggucccaaaggcccuucaaggg

SEQ ID NO: 1130419 - RNA, 19 nt, Human
ugguuuauagagguggagc

SEQ ID NO: 1130420 - RNA, 21 nt, Human
uucacagaacaaacaagaaaa

SEQ ID NO: 1130421 - RNA, 20 nt, Human
uuccacccccagccuuggga

SEQ ID NO: 1130422 - RNA, 20 nt, Human
uuccuugucuguaaaaugga

SEQ ID NO: 1130423 - RNA, 28 nt, Human
uugaaaacagucauccccuggagacccc

SEQ ID NO: 1130424 - RNA, 19 nt, Human
uuuccuaacucucccucca

SEQ ID NO: 1130425 - RNA, 24 nt, Human
aaacaaaacaaacuccagaucaaa

SEQ ID NO: 1130426 - RNA, 24 nt, Human
aaacaaacuccagaucaaaguuca

SEQ ID NO: 1130427 - RNA, 18 nt, Human
aaagcccucugaucugcu

SEQ ID NO: 1130428 - RNA, 19 nt, Human
aaauggagauaaaguaguu

SEQ ID NO: 1130429 - RNA, 20 nt, Human
aacuuauuucuucaacuaca

SEQ ID NO: 1130430 - RNA, 18 nt, Human
aagagccaaggcaagagc

SEQ ID NO: 1130431 - RNA, 21 nt, Human
aagcccugaagacuaacaacu

SEQ ID NO: 1130432 - RNA, 19 nt, Human
acaaaacaaacuccagauc

SEQ ID NO: 1130433 - RNA, 24 nt, Human
acaaaauggagauaaaguaguuaa

SEQ ID NO: 1130434 - RNA, 19 nt, Human
aggcacauucccugccuuu

SEQ ID NO: 1130435 - RNA, 18 nt, Human
agguaaaguugcaggaag

SEQ ID NO: 1130436 - RNA, 22 nt, Human
agucauggcuccccaucugagg

SEQ ID NO: 1130437 - RNA, 18 nt, Human
auccugaggugcaaccca

SEQ ID NO: 1130438 - RNA, 20 nt, Human
augcuuugguuuuuaaaacu

SEQ ID NO: 1130439 - RNA, 26 nt, Human
auucugucacccaggcuagacuggua

SEQ ID NO: 1130440 - RNA, 21 nt, Human
caaagcccucugaucugcuuc

SEQ ID NO: 1130441 - RNA, 22 nt, Human
cacccaggcuagacugguaagc

SEQ ID NO: 1130442 - RNA, 18 nt, Human
cagcugucuuuccaaccu

SEQ ID NO: 1130443 - RNA, 19 nt, Human
cauagcuauuucaguugcc

SEQ ID NO: 1130444 - RNA, 24 nt, Human
cauucugucacccaggcuagacug

SEQ ID NO: 1130445 - RNA, 22 nt, Human
ccaucugagggaaagagguaaa

SEQ ID NO: 1130446 - RNA, 21 nt, Human
cccugaagacuaacaacugcc

SEQ ID NO: 1130447 - RNA, 23 nt, Human
ccugaaacaaaacaaacuccaga

SEQ ID NO: 1130448 - RNA, 24 nt, Human
cuggccacagaagaggcacauucc

SEQ ID NO: 1130449 - RNA, 22 nt, Human
gaagaggcacauucccugccuu

SEQ ID NO: 1130450 - RNA, 25 nt, Human
gagcaaguuucuguuagcaagguuc

SEQ ID NO: 1130451 - RNA, 18 nt, Human
guuguggagcucaaggac

SEQ ID NO: 1130452 - RNA, 27 nt, Human
uacagccaggucaucuacugaagagcc

SEQ ID NO: 1130453 - RNA, 19 nt, Human
uagauguuguggagcucaa

SEQ ID NO: 1130454 - RNA, 21 nt, Human
uauccgccacauagcuauuuc

SEQ ID NO: 1130455 - RNA, 19 nt, Human
ucagcugucuuuccaaccu

SEQ ID NO: 1130456 - RNA, 22 nt, Human
ucagugccugauauauaauagg

SEQ ID NO: 1130457 - RNA, 26 nt, Human
uccguauccgccacauagcuauuuca

SEQ ID NO: 1130458 - RNA, 19 nt, Human
ucucauucugucacccagg

SEQ ID NO: 1130459 - RNA, 23 nt, Human
ucucauucugucacccaggcuag

SEQ ID NO: 1130460 - RNA, 24 nt, Human
ucucauucugucacccaggcuaga

SEQ ID NO: 1130461 - RNA, 24 nt, Human
ucugucacccaggcuagacuggua

SEQ ID NO: 1130462 - RNA, 25 nt, Human
ucugucacccaggcuagacugguaa

SEQ ID NO: 1130463 - RNA, 22 nt, Human
ucuuuuuuuuugagacgggguc

SEQ ID NO: 1130464 - RNA, 23 nt, Human
ucuuuuuuuuugagacggggucu

SEQ ID NO: 1130465 - RNA, 21 nt, Human
ugaaacaaaacaaacuccaga

SEQ ID NO: 1130466 - RNA, 24 nt, Human
ugaaacaaaacaaacuccagauca

SEQ ID NO: 1130467 - RNA, 22 nt, Human
ugagacggggucucauucuguc

SEQ ID NO: 1130468 - RNA, 18 nt, Human
ugcaagaaaaggugguca

SEQ ID NO: 1130469 - RNA, 22 nt, Human
ugccucuugcauuuuuuaaaaa

SEQ ID NO: 1130470 - RNA, 21 nt, Human
ugucacccaggcuagacuggu

SEQ ID NO: 1130471 - RNA, 24 nt, Human
uuaagucacaggguuauugugaag

SEQ ID NO: 1130472 - RNA, 25 nt, Human
uucaggcccgaaaccugccuccaug

SEQ ID NO: 1130473 - RNA, 18 nt, Human
uucccagguuucaggagc

SEQ ID NO: 1130474 - RNA, 24 nt, Human
uucccagguuucaggagcaaaagc

SEQ ID NO: 1130475 - RNA, 20 nt, Human
uuccugaaacaaaacaaacu

SEQ ID NO: 1130476 - RNA, 21 nt, Human
uucuuuuuuuuugagacgggg

SEQ ID NO: 1130477 - RNA, 26 nt, Human
uucuuuuuuuuugagacggggucuca

SEQ ID NO: 1130478 - RNA, 22 nt, Human
uuugcaaagcccucugaucugc

SEQ ID NO: 1130479 - RNA, 20 nt, Human
aguguuagaagagcucagag

SEQ ID NO: 1130480 - RNA, 21 nt, Human
gaagaagagcuuuauuuagug

SEQ ID NO: 1130481 - RNA, 19 nt, Human
ucagaggagaccuguagug

SEQ ID NO: 1130482 - RNA, 19 nt, Human
agacagggccuguggcugc

SEQ ID NO: 1130483 - RNA, 18 nt, Human
aggcaggguuucuccaug

SEQ ID NO: 1130484 - RNA, 18 nt, Human
aggcaggguuucuccaug

SEQ ID NO: 1130485 - RNA, 18 nt, Human
agggaagaucugaggcaa

SEQ ID NO: 1130486 - RNA, 24 nt, Human
aggugauccacccaccucggccuc

SEQ ID NO: 1130487 - RNA, 19 nt, Human
caaagagagagccugucac

SEQ ID NO: 1130488 - RNA, 22 nt, Human
cacccaccucggccucccaaag

SEQ ID NO: 1130489 - RNA, 23 nt, Human
cacccaccucggccucccaaagu

SEQ ID NO: 1130490 - RNA, 24 nt, Human
caggguuucuccauguuggucagg

SEQ ID NO: 1130491 - RNA, 19 nt, Human
ccauguuggucaggcuggu

SEQ ID NO: 1130492 - RNA, 24 nt, Human
ccugaccucaggugauccacccac

SEQ ID NO: 1130493 - RNA, 24 nt, Human
cuccauguuggucaggcuggucuc

SEQ ID NO: 1130494 - RNA, 24 nt, Human
cugaaauagugcagcaccuucucu

SEQ ID NO: 1130495 - RNA, 19 nt, Human
gaagaucugaggcaaagag

SEQ ID NO: 1130496 - RNA, 24 nt, Human
gaccucaggugauccacccaccuc

SEQ ID NO: 1130497 - RNA, 24 nt, Human
gagagccugucaccugugcugccu

SEQ ID NO: 1130498 - RNA, 20 nt, Human
gaggcaggguuucuccaugu

SEQ ID NO: 1130499 - RNA, 23 nt, Human
gagggaagaucugaggcaaagag

SEQ ID NO: 1130500 - RNA, 24 nt, Human
gcaggguuucuccauguuggucag

SEQ ID NO: 1130501 - RNA, 23 nt, Human
gcuggucucgaacuccugaccuc

SEQ ID NO: 1130502 - RNA, 24 nt, Human
ggcuggucucgaacuccugaccuc

SEQ ID NO: 1130503 - RNA, 21 nt, Human
ggguuucuccauguuggucag

SEQ ID NO: 1130504 - RNA, 19 nt, Human
ggucucgaacuccugaccu

SEQ ID NO: 1130505 - RNA, 24 nt, Human
gugauccacccaccucggccuccc

SEQ ID NO: 1130506 - RNA, 18 nt, Human
uaaggcgaggagcagguc

SEQ ID NO: 1130507 - RNA, 24 nt, Human
uccauguuggucaggcuggucucg

SEQ ID NO: 1130508 - RNA, 19 nt, Human
ucucgaacuccugaccuca

SEQ ID NO: 1130509 - RNA, 21 nt, Human
ugaccucaggugauccaccca

SEQ ID NO: 1130510 - RNA, 24 nt, Human
ugaccucaggugauccacccaccu

SEQ ID NO: 1130511 - RNA, 20 nt, Human
ugaggcaaagagagagccuc

SEQ ID NO: 1130512 - RNA, 24 nt, Human
ugauccacccaccucggccuccca

SEQ ID NO: 1130513 - RNA, 24 nt, Human
uggucaggcuggucucgaacuccu

SEQ ID NO: 1130514 - RNA, 21 nt, Human
uuucuccauguuggucaggcu

SEQ ID NO: 1130515 - RNA, 22 nt, Human
aaaaaaaaaaaaaaagaaagaa

SEQ ID NO: 1130516 - RNA, 25 nt, Human
aaaaaaaaaagaaagaaagaaagaa

SEQ ID NO: 1130517 - RNA, 22 nt, Human
aaaaagccaaauauaucaucac

SEQ ID NO: 1130518 - RNA, 19 nt, Human
aaaaaugcugaauugcuau

SEQ ID NO: 1130519 - RNA, 19 nt, Human
aaaaccccacccccauccc

SEQ ID NO: 1130520 - RNA, 18 nt, Human
aaaccagcccaagcccau

SEQ ID NO: 1130521 - RNA, 19 nt, Human
aaacuccgucucacaaaaa

SEQ ID NO: 1130522 - RNA, 20 nt, Human
aaagaaccugaucuagaugc

SEQ ID NO: 1130523 - RNA, 18 nt, Human
aaagagaggcaucaacug

SEQ ID NO: 1130524 - RNA, 24 nt, Human
aaagcgcuaggauuauagguguga

SEQ ID NO: 1130525 - RNA, 23 nt, Human
aaaguagcuagguuucccaauua

SEQ ID NO: 1130526 - RNA, 21 nt, Human
aaauauaccacuagaaagaac

SEQ ID NO: 1130527 - RNA, 19 nt, Human
aaauucaaagaaaugaaga

SEQ ID NO: 1130528 - RNA, 19 nt, Human
aacaugguaaaaccccauc

SEQ ID NO: 1130529 - RNA, 20 nt, Human
aacaugguaaaaccccaucu

SEQ ID NO: 1130530 - RNA, 21 nt, Human
aacaugguaaaaccccaucuc

SEQ ID NO: 1130531 - RNA, 21 nt, Human
aacaugguaaaaccccaucuc

SEQ ID NO: 1130532 - RNA, 22 nt, Human
aaccuaaauuucccacaaacca

SEQ ID NO: 1130533 - RNA, 19 nt, Human
aagaaagaaaaggaaaaag

SEQ ID NO: 1130534 - RNA, 19 nt, Human
aagaaccaauaauauauug

SEQ ID NO: 1130535 - RNA, 21 nt, Human
aagcagagguugcagugagcc

SEQ ID NO: 1130536 - RNA, 24 nt, Human
aagcagagguugcagugagccgag

SEQ ID NO: 1130537 - RNA, 24 nt, Human
aagcagcaagugggaaaagucaga

SEQ ID NO: 1130538 - RNA, 26 nt, Human
aagcgcuaggauuauaggugugagcu

SEQ ID NO: 1130539 - RNA, 20 nt, Human
aaguuuuucaaccaagauga

SEQ ID NO: 1130540 - RNA, 23 nt, Human
aauaccuccucaagugaucuucc

SEQ ID NO: 1130541 - RNA, 24 nt, Human
aaucacuugaacccgggaagcaga

SEQ ID NO: 1130542 - RNA, 24 nt, Human
aaugguacccaggguccccaauua

SEQ ID NO: 1130543 - RNA, 21 nt, Human
acaugagauguuugugagguc

SEQ ID NO: 1130544 - RNA, 25 nt, Human
accaaaauacaaaagaccaaaauuu

SEQ ID NO: 1130545 - RNA, 19 nt, Human
acccaggcuggagugcagu

SEQ ID NO: 1130546 - RNA, 25 nt, Human
accccacccuacucuccaccuccag

SEQ ID NO: 1130547 - RNA, 24 nt, Human
accccaucucuacuaaaaauacaa

SEQ ID NO: 1130548 - RNA, 20 nt, Human
accuuagaaccuuaaagcca

SEQ ID NO: 1130549 - RNA, 25 nt, Human
accuucaccccacccuacucuccac

SEQ ID NO: 1130550 - RNA, 18 nt, Human
acucugucacccaggcug

SEQ ID NO: 1130551 - RNA, 25 nt, Human
acucugucacccaggcuggagugca

SEQ ID NO: 1130552 - RNA, 18 nt, Human
acugcaaauucuacaagg

SEQ ID NO: 1130553 - RNA, 21 nt, Human
acuuuuccaccaaugggcacu

SEQ ID NO: 1130554 - RNA, 20 nt, Human
agaaaaaguagcuagguuuc

SEQ ID NO: 1130555 - RNA, 18 nt, Human
agaaaaccugcagacuau

SEQ ID NO: 1130556 - RNA, 21 nt, Human
agaaagcagcaagugggaaaa

SEQ ID NO: 1130557 - RNA, 19 nt, Human
agaaccaacaagaucagcc

SEQ ID NO: 1130558 - RNA, 22 nt, Human
agaaucacuugaacccgggaag

SEQ ID NO: 1130559 - RNA, 22 nt, Human
agagaaagggggaagagagagg

SEQ ID NO: 1130560 - RNA, 19 nt, Human
agagcauagaaaaaguagc

SEQ ID NO: 1130561 - RNA, 18 nt, Human
agagcuggccugucuaca

SEQ ID NO: 1130562 - RNA, 22 nt, Human
agagguugcagugagccgagau

SEQ ID NO: 1130563 - RNA, 24 nt, Human
agagguugcagugagccgagauug

SEQ ID NO: 1130564 - RNA, 22 nt, Human
agauggcucuucagaucagggu

SEQ ID NO: 1130565 - RNA, 24 nt, Human
agcacuuucggaggcugagguggg

SEQ ID NO: 1130566 - RNA, 19 nt, Human
agcagggagagggauuagu

SEQ ID NO: 1130567 - RNA, 20 nt, Human
agcaugcugggcuuggugcc

SEQ ID NO: 1130568 - RNA, 20 nt, Human
agcugggcaugauggugggc

SEQ ID NO: 1130569 - RNA, 22 nt, Human
agcuuggccaacaugguaaaac

SEQ ID NO: 1130570 - RNA, 24 nt, Human
agcuuggccaacaugguaaaaccc

SEQ ID NO: 1130571 - RNA, 21 nt, Human
aggacauaggugguauuuaaa

SEQ ID NO: 1130572 - RNA, 18 nt, Human
aggauuccugucugcucc

SEQ ID NO: 1130573 - RNA, 19 nt, Human
aggauuccugucugcuccu

SEQ ID NO: 1130574 - RNA, 24 nt, Human
aggcacaguggcucccaccuguga

SEQ ID NO: 1130575 - RNA, 18 nt, Human
aggcaggagaaucacuug

SEQ ID NO: 1130576 - RNA, 24 nt, Human
aggcaggagaaucacuugaacccg

SEQ ID NO: 1130577 - RNA, 21 nt, Human
aggcucuuguccacagcacca

SEQ ID NO: 1130578 - RNA, 24 nt, Human
aggcugaggcaggagaaucacuug

SEQ ID NO: 1130579 - RNA, 24 nt, Human
aggcugagguggguggaucaccug

SEQ ID NO: 1130580 - RNA, 18 nt, Human
aggcuggagugcaguggc

SEQ ID NO: 1130581 - RNA, 23 nt, Human
aggcuguggaagaaugaaauguc

SEQ ID NO: 1130582 - RNA, 24 nt, Human
agggauuagugaggaaagcaugga

SEQ ID NO: 1130583 - RNA, 22 nt, Human
agggggauggagggaguuaggu

SEQ ID NO: 1130584 - RNA, 22 nt, Human
agguggguggaucaccugaggu

SEQ ID NO: 1130585 - RNA, 23 nt, Human
aggugugagcuacugugccuggc

SEQ ID NO: 1130586 - RNA, 19 nt, Human
aguaaauagguggguggaa

SEQ ID NO: 1130587 - RNA, 20 nt, Human
agugaugggauaugugggcc

SEQ ID NO: 1130588 - RNA, 20 nt, Human
agugcaguggcgcaaacuug

SEQ ID NO: 1130589 - RNA, 24 nt, Human
agugcaguggcgcaaacuuggcuc

SEQ ID NO: 1130590 - RNA, 22 nt, Human
aguggauagacauauggaguag

SEQ ID NO: 1130591 - RNA, 24 nt, Human
aguggcucccaccugugaucccag

SEQ ID NO: 1130592 - RNA, 18 nt, Human
aguguggacacuuacucc

SEQ ID NO: 1130593 - RNA, 20 nt, Human
auagaaagccaguagaaaag

SEQ ID NO: 1130594 - RNA, 20 nt, Human
auagagaacaauuuaugcua

SEQ ID NO: 1130595 - RNA, 24 nt, Human
aucuucccagccuccugaguagcu

SEQ ID NO: 1130596 - RNA, 23 nt, Human
augaagaaagcagcaagugggaa

SEQ ID NO: 1130597 - RNA, 22 nt, Human
augcugaauugcuauauuaugu

SEQ ID NO: 1130598 - RNA, 20 nt, Human
auggauggguggaugauugg

SEQ ID NO: 1130599 - RNA, 19 nt, Human
auggauuauggaugggugg

SEQ ID NO: 1130600 - RNA, 23 nt, Human
auggugggcaccuguaaucccag

SEQ ID NO: 1130601 - RNA, 25 nt, Human
caaacuccugggcucaagugauccu

SEQ ID NO: 1130602 - RNA, 24 nt, Human
caaagcgcuaggauuauaggugug

SEQ ID NO: 1130603 - RNA, 20 nt, Human
caacaagaucagccucuacc

SEQ ID NO: 1130604 - RNA, 21 nt, Human
caacaagaucagccucuaccu

SEQ ID NO: 1130605 - RNA, 23 nt, Human
caagucaggucccaggguugccu

SEQ ID NO: 1130606 - RNA, 22 nt, Human
caagugauccucuugccucagc

SEQ ID NO: 1130607 - RNA, 27 nt, Human
caagugauccucuugccucagccuccc

SEQ ID NO: 1130608 - RNA, 27 nt, Human
caagugauccucuugccucagccuccc

SEQ ID NO: 1130609 - RNA, 20 nt, Human
cacaauacaagaagacaaga

SEQ ID NO: 1130610 - RNA, 25 nt, Human
cacaauacaagaagacaagaaaaua

SEQ ID NO: 1130611 - RNA, 22 nt, Human
cacagcaccaugauuccuuaga

SEQ ID NO: 1130612 - RNA, 19 nt, Human
caccacgggaccaccacuc

SEQ ID NO: 1130613 - RNA, 24 nt, Human
cacccaggcuggagugcaguggcg

SEQ ID NO: 1130614 - RNA, 20 nt, Human
caccccacccuacucuccac

SEQ ID NO: 1130615 - RNA, 25 nt, Human
caccccacccuacucuccaccucca

SEQ ID NO: 1130616 - RNA, 19 nt, Human
cacccccaucccaccaccc

SEQ ID NO: 1130617 - RNA, 20 nt, Human
cacccuacccuauccaucuc

SEQ ID NO: 1130618 - RNA, 22 nt, Human
cacccuacccuauccaucucca

SEQ ID NO: 1130619 - RNA, 21 nt, Human
caccuguaaucccagcuacuu

SEQ ID NO: 1130620 - RNA, 23 nt, Human
caccuguaaucccagcuacuugg

SEQ ID NO: 1130621 - RNA, 24 nt, Human
caccuguaaucccagcuacuuggg

SEQ ID NO: 1130622 - RNA, 18 nt, Human
caccugugaucccagcac

SEQ ID NO: 1130623 - RNA, 24 nt, Human
caccugugaucccagcacuuucgg

SEQ ID NO: 1130624 - RNA, 24 nt, Human
cacuaugcugccuaggcuggucuc

SEQ ID NO: 1130625 - RNA, 23 nt, Human
cacuccucauccugcaggcacuu

SEQ ID NO: 1130626 - RNA, 23 nt, Human
cacucugucacccaggcuggagu

SEQ ID NO: 1130627 - RNA, 24 nt, Human
cacucugucacccaggcuggagug

SEQ ID NO: 1130628 - RNA, 21 nt, Human
cagaguaccacagguggcagg

SEQ ID NO: 1130629 - RNA, 24 nt, Human
cagcacuuucggaggcugaggugg

SEQ ID NO: 1130630 - RNA, 20 nt, Human
cagccuccugaguagcuggg

SEQ ID NO: 1130631 - RNA, 24 nt, Human
cagcuacuugggaggcugaggcag

SEQ ID NO: 1130632 - RNA, 24 nt, Human
cagcuuggccaacaugguaaaacc

SEQ ID NO: 1130633 - RNA, 22 nt, Human
caguccacaaugugagcagcac

SEQ ID NO: 1130634 - RNA, 18 nt, Human
caucacuuucagaugaug

SEQ ID NO: 1130635 - RNA, 23 nt, Human
caucccaccacccuucaaagagc

SEQ ID NO: 1130636 - RNA, 23 nt, Human
caugguaaagucccaguccugcu

SEQ ID NO: 1130637 - RNA, 21 nt, Human
cauuaaacaggucugugucuu

SEQ ID NO: 1130638 - RNA, 26 nt, Human
cauucugucuugccuaauuuucaggc

SEQ ID NO: 1130639 - RNA, 21 nt, Human
ccaaagcgcuaggauuauagg

SEQ ID NO: 1130640 - RNA, 24 nt, Human
ccaaagcgcuaggauuauaggugu

SEQ ID NO: 1130641 - RNA, 20 nt, Human
ccaacuguggguccucaggc

SEQ ID NO: 1130642 - RNA, 22 nt, Human
ccaagaucuauuaacauuuucu

SEQ ID NO: 1130643 - RNA, 21 nt, Human
ccaauucucucccaggaacaa

SEQ ID NO: 1130644 - RNA, 18 nt, Human
ccagcccaagcccauuuc

SEQ ID NO: 1130645 - RNA, 20 nt, Human
ccagcccaucuuacaggaua

SEQ ID NO: 1130646 - RNA, 19 nt, Human
ccaggaacaauccugugcu

SEQ ID NO: 1130647 - RNA, 19 nt, Human
ccaggcacaguggcuccca

SEQ ID NO: 1130648 - RNA, 19 nt, Human
ccaggguugccuuggccgu

SEQ ID NO: 1130649 - RNA, 21 nt, Human
ccaggguugccuuggccguuc

SEQ ID NO: 1130650 - RNA, 19 nt, Human
ccaguccugcuacuuggug

SEQ ID NO: 1130651 - RNA, 19 nt, Human
cccacaaaccagcccaagc

SEQ ID NO: 1130652 - RNA, 21 nt, Human
cccacaaaccagcccaagccc

SEQ ID NO: 1130653 - RNA, 23 nt, Human
cccacaaaccagcccaagcccau

SEQ ID NO: 1130654 - RNA, 23 nt, Human
cccacaccacgggaccaccacuc

SEQ ID NO: 1130655 - RNA, 23 nt, Human
cccaccugugaucccagcacuuu

SEQ ID NO: 1130656 - RNA, 23 nt, Human
cccaguccugcuacuuggugagu

SEQ ID NO: 1130657 - RNA, 19 nt, Human
ccccaaauaaacacucagu

SEQ ID NO: 1130658 - RNA, 22 nt, Human
ccccaaauaaacacucaguaca

SEQ ID NO: 1130659 - RNA, 22 nt, Human
ccccaaguaagcucugaacucc

SEQ ID NO: 1130660 - RNA, 22 nt, Human
cccuggccuccucuuccuuguc

SEQ ID NO: 1130661 - RNA, 18 nt, Human
ccuacaguaacaauagac

SEQ ID NO: 1130662 - RNA, 22 nt, Human
ccucaagugaucuucccagccu

SEQ ID NO: 1130663 - RNA, 23 nt, Human
ccucaggcaacuaacuucaccuc

SEQ ID NO: 1130664 - RNA, 24 nt, Human
ccucuugccucagccucccaaagc

SEQ ID NO: 1130665 - RNA, 22 nt, Human
ccugccaacaacucaacgagcu

SEQ ID NO: 1130666 - RNA, 24 nt, Human
ccuggacaaucccugggacuacau

SEQ ID NO: 1130667 - RNA, 21 nt, Human
ccuggcaccuccugcuuuuuc

SEQ ID NO: 1130668 - RNA, 18 nt, Human
ccuggccuccucuuccuu

SEQ ID NO: 1130669 - RNA, 19 nt, Human
ccugggcucaagugauccu

SEQ ID NO: 1130670 - RNA, 20 nt, Human
ccugggcucaagugauccuc

SEQ ID NO: 1130671 - RNA, 22 nt, Human
ccugggcucaagugauccucuu

SEQ ID NO: 1130672 - RNA, 21 nt, Human
ccuguaaucccagcuacuugg

SEQ ID NO: 1130673 - RNA, 19 nt, Human
ccuucaccccacccuacuc

SEQ ID NO: 1130674 - RNA, 22 nt, Human
ccuucaccccacccuacucucc

SEQ ID NO: 1130675 - RNA, 24 nt, Human
cgggaagcagagguugcagugagc

SEQ ID NO: 1130676 - RNA, 27 nt, Human
cucaagugaucuucccagccuccugag

SEQ ID NO: 1130677 - RNA, 24 nt, Human
cucacucugucacccaggcuggag

SEQ ID NO: 1130678 - RNA, 24 nt, Human
cucccaccugugaucccagcacuu

SEQ ID NO: 1130679 - RNA, 23 nt, Human
cuccugggcucaagugauccucu

SEQ ID NO: 1130680 - RNA, 21 nt, Human
cucuccuuucuucauccuuuu

SEQ ID NO: 1130681 - RNA, 19 nt, Human
cucuucaaagcuaguaucc

SEQ ID NO: 1130682 - RNA, 21 nt, Human
cugacugcaaauucuacaagg

SEQ ID NO: 1130683 - RNA, 21 nt, Human
cuguaaucccagcuacuuggg

SEQ ID NO: 1130684 - RNA, 19 nt, Human
cuguuucccaacauugcug

SEQ ID NO: 1130685 - RNA, 20 nt, Human
cuguuugaaugaaaggugga

SEQ ID NO: 1130686 - RNA, 19 nt, Human
cuuaaaacaugaauaggcc

SEQ ID NO: 1130687 - RNA, 26 nt, Human
cuuaaaaccccacccccaucccacca

SEQ ID NO: 1130688 - RNA, 19 nt, Human
cuuagaacaggggacucca

SEQ ID NO: 1130689 - RNA, 20 nt, Human
cuuccaagggggcacaccug

SEQ ID NO: 1130690 - RNA, 19 nt, Human
cuuccuugucuuccuggga

SEQ ID NO: 1130691 - RNA, 23 nt, Human
cuuccuugucuuccugggagagg

SEQ ID NO: 1130692 - RNA, 21 nt, Human
cuuucugcaacuugguucacc

SEQ ID NO: 1130693 - RNA, 19 nt, Human
gaaggaaaggagggauagg

SEQ ID NO: 1130694 - RNA, 18 nt, Human
gaauauaaagauggauag

SEQ ID NO: 1130695 - RNA, 22 nt, Human
gacacuguuucccaacauugcu

SEQ ID NO: 1130696 - RNA, 21 nt, Human
gacaugagggcuuauuaggaa

SEQ ID NO: 1130697 - RNA, 22 nt, Human
gaccaccacucuaucaagucuu

SEQ ID NO: 1130698 - RNA, 18 nt, Human
gacugauucucugucacu

SEQ ID NO: 1130699 - RNA, 19 nt, Human
gagcagauaguggauuuua

SEQ ID NO: 1130700 - RNA, 25 nt, Human
gagcuuauuuuucuguuuuugagac

SEQ ID NO: 1130701 - RNA, 20 nt, Human
gagguucuguuuaagcaagu

SEQ ID NO: 1130702 - RNA, 24 nt, Human
gagucagauuagggcuggagacac

SEQ ID NO: 1130703 - RNA, 19 nt, Human
gauaugguagagagcaugc

SEQ ID NO: 1130704 - RNA, 21 nt, Human
gaucaccugaggucaggaguu

SEQ ID NO: 1130705 - RNA, 23 nt, Human
gaucaccugaggucaggaguuug

SEQ ID NO: 1130706 - RNA, 24 nt, Human
gaucaccugaggucaggaguuugu

SEQ ID NO: 1130707 - RNA, 24 nt, Human
gauggugggcaccuguaaucccag

SEQ ID NO: 1130708 - RNA, 21 nt, Human
gcagagaaagggggaagagag

SEQ ID NO: 1130709 - RNA, 23 nt, Human
gcaggagaaucacuugaacccgg

SEQ ID NO: 1130710 - RNA, 24 nt, Human
gccaacaugguaaaaccccaucuc

SEQ ID NO: 1130711 - RNA, 20 nt, Human
gcccacaccacgggaccacc

SEQ ID NO: 1130712 - RNA, 22 nt, Human
gcccacaccacgggaccaccac

SEQ ID NO: 1130713 - RNA, 19 nt, Human
gccuucaccuucaccccac

SEQ ID NO: 1130714 - RNA, 22 nt, Human
gcgcaaacuuggcucaccaaag

SEQ ID NO: 1130715 - RNA, 22 nt, Human
gcuacuaauguuuuccccagcc

SEQ ID NO: 1130716 - RNA, 19 nt, Human
gcuggagugcaguggcgca

SEQ ID NO: 1130717 - RNA, 20 nt, Human
ggaaagcauggauguuuggg

SEQ ID NO: 1130718 - RNA, 20 nt, Human
ggaagcagagguugcaguga

SEQ ID NO: 1130719 - RNA, 21 nt, Human
ggaggcugagguggguggauc

SEQ ID NO: 1130720 - RNA, 22 nt, Human
ggaggcugagguggguggauca

SEQ ID NO: 1130721 - RNA, 22 nt, Human
ggaucaccugaggucaggaguu

SEQ ID NO: 1130722 - RNA, 18 nt, Human
ggcauggugcccuaccuc

SEQ ID NO: 1130723 - RNA, 21 nt, Human
gggcacuccucauccugcagg

SEQ ID NO: 1130724 - RNA, 24 nt, Human
gggcaugauggugggcaccuguaa

SEQ ID NO: 1130725 - RNA, 22 nt, Human
gggcucaagugauccucuugcc

SEQ ID NO: 1130726 - RNA, 20 nt, Human
gguagaaaaccugcagacua

SEQ ID NO: 1130727 - RNA, 20 nt, Human
ggucuguagaagaaagauga

SEQ ID NO: 1130728 - RNA, 21 nt, Human
gguggaucaccugaggucagg

SEQ ID NO: 1130729 - RNA, 24 nt, Human
guacaugaaugcauggauuaugga

SEQ ID NO: 1130730 - RNA, 24 nt, Human
gugauccucuugccucagccuccc

SEQ ID NO: 1130731 - RNA, 18 nt, Human
gugaucuucccagccucc

SEQ ID NO: 1130732 - RNA, 24 nt, Human
gugaucuucccagccuccugagua

SEQ ID NO: 1130733 - RNA, 23 nt, Human
guggaaacaugaauguacaaaug

SEQ ID NO: 1130734 - RNA, 20 nt, Human
gugugugcaugugugugugu

SEQ ID NO: 1130735 - RNA, 20 nt, Human
gugugugcaugugugugugu

SEQ ID NO: 1130736 - RNA, 19 nt, Human
guugcagugagccgagauu

SEQ ID NO: 1130737 - RNA, 20 nt, Human
guugcuucauuccauucugu

SEQ ID NO: 1130738 - RNA, 24 nt, Human
guuguguuuuuguuuuuguuuuug

SEQ ID NO: 1130739 - RNA, 19 nt, Human
uaaaauauuucagagcaua

SEQ ID NO: 1130740 - RNA, 24 nt, Human
uaacaauagacuggaggaggcaga

SEQ ID NO: 1130741 - RNA, 18 nt, Human
uaacuaacuuaauggaug

SEQ ID NO: 1130742 - RNA, 20 nt, Human
uaagcaaauccucaguauga

SEQ ID NO: 1130743 - RNA, 21 nt, Human
uaagccauuuuaggguauuug

SEQ ID NO: 1130744 - RNA, 23 nt, Human
uaagccccaugguaaagucccag

SEQ ID NO: 1130745 - RNA, 22 nt, Human
uacaaaagaccaaaauuugcag

SEQ ID NO: 1130746 - RNA, 18 nt, Human
uacaagggcuuccccagg

SEQ ID NO: 1130747 - RNA, 25 nt, Human
uaccacagguggcaggaguauuagc

SEQ ID NO: 1130748 - RNA, 21 nt, Human
uaccagauuuaggaucuacuu

SEQ ID NO: 1130749 - RNA, 24 nt, Human
uaccguuuagugagcccacaccac

SEQ ID NO: 1130750 - RNA, 22 nt, Human
uagaaagccaguagaaaaguug

SEQ ID NO: 1130751 - RNA, 19 nt, Human
uagaacgcagugcuuaaaa

SEQ ID NO: 1130752 - RNA, 23 nt, Human
uagagugugauaagugggaagau

SEQ ID NO: 1130753 - RNA, 23 nt, Human
uagcuaaaaagaaccaauaauau

SEQ ID NO: 1130754 - RNA, 22 nt, Human
uaggacauaggugguauuuaaa

SEQ ID NO: 1130755 - RNA, 19 nt, Human
uaggauuauaggugugagc

SEQ ID NO: 1130756 - RNA, 21 nt, Human
uaggauuauaggugugagcua

SEQ ID NO: 1130757 - RNA, 22 nt, Human
uaggauuauaggugugagcuac

SEQ ID NO: 1130758 - RNA, 22 nt, Human
uaggauuauaggugugagcuac

SEQ ID NO: 1130759 - RNA, 24 nt, Human
uaggauuauaggugugagcuacug

SEQ ID NO: 1130760 - RNA, 19 nt, Human
uaggccccaaauaaacacu

SEQ ID NO: 1130761 - RNA, 22 nt, Human
uaggccccaaauaaacacucag

SEQ ID NO: 1130762 - RNA, 22 nt, Human
uagggcuggagacacaacuuug

SEQ ID NO: 1130763 - RNA, 19 nt, Human
uaggugggggggauuggua

SEQ ID NO: 1130764 - RNA, 24 nt, Human
uagguggguggaaacaugaaugua

SEQ ID NO: 1130765 - RNA, 19 nt, Human
uaguagcuauaaauggaua

SEQ ID NO: 1130766 - RNA, 21 nt, Human
uaguaucccuuucugcaacuu

SEQ ID NO: 1130767 - RNA, 22 nt, Human
uaguggauuuuaggagucagau

SEQ ID NO: 1130768 - RNA, 22 nt, Human
uauaaccccagaguaccacagg

SEQ ID NO: 1130769 - RNA, 24 nt, Human
uaugacccaaauagaaaaaacaaa

SEQ ID NO: 1130770 - RNA, 24 nt, Human
uaugcugccuaggcuggucucaaa

SEQ ID NO: 1130771 - RNA, 20 nt, Human
uaugugggccuauugaugga

SEQ ID NO: 1130772 - RNA, 21 nt, Human
uauuuagagggaaaugaguug

SEQ ID NO: 1130773 - RNA, 21 nt, Human
ucaacgaagccucaauuuccc

SEQ ID NO: 1130774 - RNA, 21 nt, Human
ucaagguagaacuaaaauuau

SEQ ID NO: 1130775 - RNA, 24 nt, Human
ucacccaggcuggagugcaguggc

SEQ ID NO: 1130776 - RNA, 20 nt, Human
ucacccuacccuauccaucu

SEQ ID NO: 1130777 - RNA, 20 nt, Human
ucaccuucaccccacccuac

SEQ ID NO: 1130778 - RNA, 24 nt, Human
ucacucugucacccaggcuggagu

SEQ ID NO: 1130779 - RNA, 18 nt, Human
ucaugguuuuggccccuu

SEQ ID NO: 1130780 - RNA, 24 nt, Human
uccaagcaucucacuuuccaagca

SEQ ID NO: 1130781 - RNA, 19 nt, Human
uccaaguaagaagauggcu

SEQ ID NO: 1130782 - RNA, 23 nt, Human
uccacagccuucaccuucacccc

SEQ ID NO: 1130783 - RNA, 24 nt, Human
uccauggaauuaaaauuccaccuc

SEQ ID NO: 1130784 - RNA, 23 nt, Human
ucccaaagcgcuaggauuauagg

SEQ ID NO: 1130785 - RNA, 19 nt, Human
ucccacaaaccagcccaag

SEQ ID NO: 1130786 - RNA, 22 nt, Human
ucccacaaaccagcccaagccc

SEQ ID NO: 1130787 - RNA, 24 nt, Human
ucccacaaaccagcccaagcccau

SEQ ID NO: 1130788 - RNA, 19 nt, Human
ucccaggguugccuuggcc

SEQ ID NO: 1130789 - RNA, 20 nt, Human
ucccaggguugccuuggccg

SEQ ID NO: 1130790 - RNA, 22 nt, Human
uccccagcucaagugaucuuug

SEQ ID NO: 1130791 - RNA, 22 nt, Human
uccccaggucaggcucaggcua

SEQ ID NO: 1130792 - RNA, 24 nt, Human
uccugaguagcugggaccauaggc

SEQ ID NO: 1130793 - RNA, 21 nt, Human
uccugggcucaagugauccuc

SEQ ID NO: 1130794 - RNA, 21 nt, Human
uccugggcucaagugauccuc

SEQ ID NO: 1130795 - RNA, 24 nt, Human
uccugggcucaagugauccucuug

SEQ ID NO: 1130796 - RNA, 24 nt, Human
ucggaggcugagguggguggauca

SEQ ID NO: 1130797 - RNA, 21 nt, Human
ucucaaacuccugggcucaag

SEQ ID NO: 1130798 - RNA, 21 nt, Human
ucucacaaaaaaaaaaaaaaa

SEQ ID NO: 1130799 - RNA, 23 nt, Human
ucucacucugucacccaggcugg

SEQ ID NO: 1130800 - RNA, 24 nt, Human
ucucacucugucacccaggcugga

SEQ ID NO: 1130801 - RNA, 26 nt, Human
ucucacucugucacccaggcuggagu

SEQ ID NO: 1130802 - RNA, 27 nt, Human
ucucacucugucacccaggcuggagug

SEQ ID NO: 1130803 - RNA, 21 nt, Human
ucuccaguaggcuguggaaga

SEQ ID NO: 1130804 - RNA, 22 nt, Human
ucucuacuaaaaauacaaaaaa

SEQ ID NO: 1130805 - RNA, 22 nt, Human
ucucugucacuggcuuccuaug

SEQ ID NO: 1130806 - RNA, 20 nt, Human
ucugacuguguucucccauc

SEQ ID NO: 1130807 - RNA, 24 nt, Human
ucugucacccaggcuggagugcag

SEQ ID NO: 1130808 - RNA, 23 nt, Human
ucuuaaaaccccacccccauccc

SEQ ID NO: 1130809 - RNA, 22 nt, Human
ucuugguacauagcaagggcuu

SEQ ID NO: 1130810 - RNA, 25 nt, Human
ugaaauggggauccaucacacuguu

SEQ ID NO: 1130811 - RNA, 24 nt, Human
ugaauagguagguagcuaugugga

SEQ ID NO: 1130812 - RNA, 22 nt, Human
ugaauggauaggugaguaaagg

SEQ ID NO: 1130813 - RNA, 23 nt, Human
ugaauguacaaaugaaagcauua

SEQ ID NO: 1130814 - RNA, 23 nt, Human
ugagacaaauuugaggaaucuug

SEQ ID NO: 1130815 - RNA, 21 nt, Human
ugagauguuugugagguccag

SEQ ID NO: 1130816 - RNA, 22 nt, Human
ugagccgagauugcgccugggc

SEQ ID NO: 1130817 - RNA, 18 nt, Human
ugaggaaugagucucaga

SEQ ID NO: 1130818 - RNA, 20 nt, Human
ugaggcaggagaaucacuug

SEQ ID NO: 1130819 - RNA, 24 nt, Human
ugaggcaggagaaucacuugaacc

SEQ ID NO: 1130820 - RNA, 25 nt, Human
ugaggcaggagaaucacuugaaccc

SEQ ID NO: 1130821 - RNA, 21 nt, Human
ugaggucaggaguuugugacc

SEQ ID NO: 1130822 - RNA, 18 nt, Human
ugagguccagguggagau

SEQ ID NO: 1130823 - RNA, 20 nt, Human
ugagguggguggaucaccug

SEQ ID NO: 1130824 - RNA, 24 nt, Human
ugagguggguggaucaccugaggu

SEQ ID NO: 1130825 - RNA, 26 nt, Human
ugagguggguggaucaccugagguca

SEQ ID NO: 1130826 - RNA, 19 nt, Human
ugaguugcccaaugccaca

SEQ ID NO: 1130827 - RNA, 23 nt, Human
ugcauggauuauggaugggugga

SEQ ID NO: 1130828 - RNA, 24 nt, Human
ugccuaggcuggucucaaacuccu

SEQ ID NO: 1130829 - RNA, 22 nt, Human
ugccucagccucccaaagcgcu

SEQ ID NO: 1130830 - RNA, 24 nt, Human
ugccucagccucccaaagcgcuag

SEQ ID NO: 1130831 - RNA, 25 nt, Human
ugccuuuauuuucauuauuauuuug

SEQ ID NO: 1130832 - RNA, 18 nt, Human
ugcugccuaggcuggucu

SEQ ID NO: 1130833 - RNA, 24 nt, Human
ugcuggaagagcaagguagguggg

SEQ ID NO: 1130834 - RNA, 20 nt, Human
ugcuggugaugaucauuaua

SEQ ID NO: 1130835 - RNA, 21 nt, Human
uggaagaaugaaaugucucau

SEQ ID NO: 1130836 - RNA, 18 nt, Human
uggaggaggcagaguauc

SEQ ID NO: 1130837 - RNA, 23 nt, Human
uggagugcaguggcgcaaacuug

SEQ ID NO: 1130838 - RNA, 24 nt, Human
uggagugcaguggcgcaaacuugg

SEQ ID NO: 1130839 - RNA, 23 nt, Human
uggaucaccugaggucaggaguu

SEQ ID NO: 1130840 - RNA, 27 nt, Human
uggaucaccugaggucaggaguuugug

SEQ ID NO: 1130841 - RNA, 22 nt, Human
uggccaacaugguaaaacccca

SEQ ID NO: 1130842 - RNA, 22 nt, Human
uggcgcaaacuuggcucaccaa

SEQ ID NO: 1130843 - RNA, 24 nt, Human
uggcucccaccugugaucccagca

SEQ ID NO: 1130844 - RNA, 22 nt, Human
uggcucuucagaucaggguggc

SEQ ID NO: 1130845 - RNA, 24 nt, Human
ugggaccauaggcacgugacacca

SEQ ID NO: 1130846 - RNA, 19 nt, Human
ugggaggcugaggcaggag

SEQ ID NO: 1130847 - RNA, 24 nt, Human
ugggaggcugaggcaggagaauca

SEQ ID NO: 1130848 - RNA, 23 nt, Human
ugggauaaaucaugguuuuggcc

SEQ ID NO: 1130849 - RNA, 20 nt, Human
ugggauaugguagagagcau

SEQ ID NO: 1130850 - RNA, 25 nt, Human
ugggauaugugggccuauugaugga

SEQ ID NO: 1130851 - RNA, 19 nt, Human
ugggcucaagugauccucu

SEQ ID NO: 1130852 - RNA, 24 nt, Human
ugggcucaagugauccucuugccu

SEQ ID NO: 1130853 - RNA, 21 nt, Human
uggggaagaauagagagcaau

SEQ ID NO: 1130854 - RNA, 24 nt, Human
uggguggaucaccugaggucagga

SEQ ID NO: 1130855 - RNA, 24 nt, Human
ugguacauagcaagggcuugcgug

SEQ ID NO: 1130856 - RNA, 20 nt, Human
ugguagagagcaugcugggc

SEQ ID NO: 1130857 - RNA, 18 nt, Human
uggugcccuaccucugcc

SEQ ID NO: 1130858 - RNA, 19 nt, Human
uggugcccuaccucugccu

SEQ ID NO: 1130859 - RNA, 21 nt, Human
uggugggcaccuguaauccca

SEQ ID NO: 1130860 - RNA, 21 nt, Human
ugguugagcagggagagggau

SEQ ID NO: 1130861 - RNA, 21 nt, Human
ugucacccaggcuggagugca

SEQ ID NO: 1130862 - RNA, 20 nt, Human
ugugaaaauauaggaaaaau

SEQ ID NO: 1130863 - RNA, 24 nt, Human
ugugaccagcuuggccaacauggu

SEQ ID NO: 1130864 - RNA, 19 nt, Human
ugugauaagugggaagaug

SEQ ID NO: 1130865 - RNA, 22 nt, Human
uguggacacuuacuccauggga

SEQ ID NO: 1130866 - RNA, 19 nt, Human
ugugugcaugugugugugu

SEQ ID NO: 1130867 - RNA, 20 nt, Human
ugugugcaugugugugugug

SEQ ID NO: 1130868 - RNA, 23 nt, Human
uguuguguuuuuguuuuuguuuu

SEQ ID NO: 1130869 - RNA, 21 nt, Human
uguuguuguguuuuuguuuuu

SEQ ID NO: 1130870 - RNA, 24 nt, Human
uguuuaagcaaguucaacaugaga

SEQ ID NO: 1130871 - RNA, 26 nt, Human
uuaaaaccccacccccaucccaccac

SEQ ID NO: 1130872 - RNA, 21 nt, Human
uuaccaaaauacaaaagacca

SEQ ID NO: 1130873 - RNA, 22 nt, Human
uuagaggaggcaggaaaguugg

SEQ ID NO: 1130874 - RNA, 18 nt, Human
uuagcugggcaugauggu

SEQ ID NO: 1130875 - RNA, 24 nt, Human
uuagcugggcaugauggugggcac

SEQ ID NO: 1130876 - RNA, 23 nt, Human
uucccuggccuccucuuccuugg

SEQ ID NO: 1130877 - RNA, 18 nt, Human
uucuaaaugguacccagg

SEQ ID NO: 1130878 - RNA, 18 nt, Human
uucuuaaaaccccacccc

SEQ ID NO: 1130879 - RNA, 20 nt, Human
uucuuaccuuucccccuaca

SEQ ID NO: 1130880 - RNA, 24 nt, Human
uugaaaaaaagccaaauauaucau

SEQ ID NO: 1130881 - RNA, 24 nt, Human
uugaggaaugagucucagaaaaaa

SEQ ID NO: 1130882 - RNA, 18 nt, Human
uugcagugagccgagauu

SEQ ID NO: 1130883 - RNA, 20 nt, Human
uugcagugagccgagauugc

SEQ ID NO: 1130884 - RNA, 22 nt, Human
uugcagugagccgagauugcgc

SEQ ID NO: 1130885 - RNA, 23 nt, Human
uuggccaacaugguaaaacccca

SEQ ID NO: 1130886 - RNA, 25 nt, Human
uugggaggcugaggcaggagaauca

SEQ ID NO: 1130887 - RNA, 24 nt, Human
uugggucucacuaugcugccuagg

SEQ ID NO: 1130888 - RNA, 18 nt, Human
uugugaaguuuuucaacc

SEQ ID NO: 1130889 - RNA, 22 nt, Human
uuguuguuguguuuuuguuuuu

SEQ ID NO: 1130890 - RNA, 21 nt, Human
uuucggaggcugaggugggug

SEQ ID NO: 1130891 - RNA, 28 nt, Human
uuucugguugcuucauuccauucugucu

SEQ ID NO: 1130892 - RNA, 18 nt, Human
uuucuuggagaaggcugg

SEQ ID NO: 1130893 - RNA, 22 nt, Human
uuucuuuugacuauagauguga

SEQ ID NO: 1130894 - RNA, 20 nt, Human
uuugauaaaauucaguaguc

SEQ ID NO: 1130895 - RNA, 19 nt, Human
uuugccucuccuuucuuca

SEQ ID NO: 1130896 - RNA, 24 nt, Human
uuuucaggcccauccaagcaucuc

SEQ ID NO: 1130897 - RNA, 22 nt, Human
uuuugagacaggguuucccacu

SEQ ID NO: 1130898 - RNA, 22 nt, Human
uuuuuguuguuguguuuuuguu

SEQ ID NO: 1130899 - RNA, 20 nt, Human
uuuuuguuuuugguuuuguu

SEQ ID NO: 1130900 - RNA, 21 nt, Human
uuuuuguuuuuguuuuugguu

SEQ ID NO: 1130901 - RNA, 25 nt, Human
aaagcaccuuuuccuccacacccca

SEQ ID NO: 1130902 - RNA, 22 nt, Human
aacaugcuucucuguucuccca

SEQ ID NO: 1130903 - RNA, 22 nt, Human
aagcaccuuuuccuccacaccc

SEQ ID NO: 1130904 - RNA, 18 nt, Human
aaucauuucaggccuuua

SEQ ID NO: 1130905 - RNA, 22 nt, Human
acacacacacacaccagagaca

SEQ ID NO: 1130906 - RNA, 21 nt, Human
acacagacccaggcuuggaca

SEQ ID NO: 1130907 - RNA, 23 nt, Human
agacacagacccaggcuuggaca

SEQ ID NO: 1130908 - RNA, 21 nt, Human
agccagcucucugagcugccu

SEQ ID NO: 1130909 - RNA, 22 nt, Human
aggaaccuacauggagacaggc

SEQ ID NO: 1130910 - RNA, 22 nt, Human
aggacacacacacacacaccag

SEQ ID NO: 1130911 - RNA, 28 nt, Human
aguggagcugcugauuugugaccugggg

SEQ ID NO: 1130912 - RNA, 19 nt, Human
agugucagcuguugcuauu

SEQ ID NO: 1130913 - RNA, 20 nt, Human
caccuuuuccuccacacccc

SEQ ID NO: 1130914 - RNA, 18 nt, Human
cagcuaggccccucuguc

SEQ ID NO: 1130915 - RNA, 20 nt, Human
cagcuaggccccucugucca

SEQ ID NO: 1130916 - RNA, 20 nt, Human
caggaggugaguggagcugc

SEQ ID NO: 1130917 - RNA, 21 nt, Human
caucauucuugcuguccccag

SEQ ID NO: 1130918 - RNA, 26 nt, Human
caugcucaugcacacgcuggaacgug

SEQ ID NO: 1130919 - RNA, 22 nt, Human
ccaaaagcucagcgaccaguga

SEQ ID NO: 1130920 - RNA, 19 nt, Human
cccagcucugccauccccu

SEQ ID NO: 1130921 - RNA, 22 nt, Human
cccagcucugccauccccugaa

SEQ ID NO: 1130922 - RNA, 22 nt, Human
ccugaagugccuccccuucuca

SEQ ID NO: 1130923 - RNA, 23 nt, Human
ccugaagugccuccccuucucac

SEQ ID NO: 1130924 - RNA, 19 nt, Human
ccugugcagagccguggcg

SEQ ID NO: 1130925 - RNA, 24 nt, Human
cguuuuauccuuauugcaacccua

SEQ ID NO: 1130926 - RNA, 19 nt, Human
cucuguccaucuugcuccc

SEQ ID NO: 1130927 - RNA, 22 nt, Human
cucuguucucccagaaacuuca

SEQ ID NO: 1130928 - RNA, 27 nt, Human
cugaagugccuccccuucucaccaaca

SEQ ID NO: 1130929 - RNA, 23 nt, Human
cugaaucaggaggugggaguuua

SEQ ID NO: 1130930 - RNA, 24 nt, Human
cugggggugggcugugaugacggc

SEQ ID NO: 1130931 - RNA, 21 nt, Human
cuguauguacugcugacgggg

SEQ ID NO: 1130932 - RNA, 23 nt, Human
cuuggacaguggcuagccagcua

SEQ ID NO: 1130933 - RNA, 22 nt, Human
gaccagugacagagcuggccug

SEQ ID NO: 1130934 - RNA, 22 nt, Human
gaucguguauauuauguucaua

SEQ ID NO: 1130935 - RNA, 28 nt, Human
gaugcacauauaccauugcaugugugug

SEQ ID NO: 1130936 - RNA, 18 nt, Human
gcacagcagaugagaagu

SEQ ID NO: 1130937 - RNA, 21 nt, Human
gcaccuuuuccuccacacccc

SEQ ID NO: 1130938 - RNA, 19 nt, Human
gcagagccguggcgugugg

SEQ ID NO: 1130939 - RNA, 22 nt, Human
gccacaugaggacacacacaca

SEQ ID NO: 1130940 - RNA, 22 nt, Human
ggcgcuugaggacuucuacagg

SEQ ID NO: 1130941 - RNA, 20 nt, Human
ggcuagccagcuaggccccu

SEQ ID NO: 1130942 - RNA, 22 nt, Human
ggguagguucugggggucagag

SEQ ID NO: 1130943 - RNA, 20 nt, Human
gguugaguuaggcacauggg

SEQ ID NO: 1130944 - RNA, 20 nt, Human
gugcagagccguggcgugug

SEQ ID NO: 1130945 - RNA, 22 nt, Human
gugcugggccugccuaaagguc

SEQ ID NO: 1130946 - RNA, 20 nt, Human
gugugaaaucauuucaggcc

SEQ ID NO: 1130947 - RNA, 26 nt, Human
gugugcuggacacuguauguacugcu

SEQ ID NO: 1130948 - RNA, 19 nt, Human
guugggcaggcugugcccc

SEQ ID NO: 1130949 - RNA, 23 nt, Human
guugucuggaaguugaggaaccu

SEQ ID NO: 1130950 - RNA, 21 nt, Human
uaaaacaggccuaaugaaagc

SEQ ID NO: 1130951 - RNA, 22 nt, Human
uaaaacaggccuaaugaaagca

SEQ ID NO: 1130952 - RNA, 20 nt, Human
uaaaaugcucaguaaguguc

SEQ ID NO: 1130953 - RNA, 21 nt, Human
uaaaaugcucaguaaguguca

SEQ ID NO: 1130954 - RNA, 22 nt, Human
uagaggaaugagcucucccaga

SEQ ID NO: 1130955 - RNA, 18 nt, Human
uagguucugggggucaga

SEQ ID NO: 1130956 - RNA, 24 nt, Human
uauguucauacacacagaccuaug

SEQ ID NO: 1130957 - RNA, 18 nt, Human
uccaaaagcucagcgacc

SEQ ID NO: 1130958 - RNA, 23 nt, Human
uccaucuugcucccagcucugcc

SEQ ID NO: 1130959 - RNA, 24 nt, Human
ucccaccucccuggugcuugucca

SEQ ID NO: 1130960 - RNA, 23 nt, Human
ucccuggugcuuguccacagcca

SEQ ID NO: 1130961 - RNA, 25 nt, Human
uccucacauguacaaaugcaucuau

SEQ ID NO: 1130962 - RNA, 19 nt, Human
uccugugugcuggacacug

SEQ ID NO: 1130963 - RNA, 18 nt, Human
ucuaggcccugugcagag

SEQ ID NO: 1130964 - RNA, 21 nt, Human
ucuaugggagcaugcguuuga

SEQ ID NO: 1130965 - RNA, 22 nt, Human
ucucccagagcacagacaggga

SEQ ID NO: 1130966 - RNA, 20 nt, Human
ucucgccucagagugagggc

SEQ ID NO: 1130967 - RNA, 21 nt, Human
ucugcgugugggcaucauucu

SEQ ID NO: 1130968 - RNA, 19 nt, Human
ucugugggguugaguuagg

SEQ ID NO: 1130969 - RNA, 25 nt, Human
ugaaagcaccuuuuccuccacaccc

SEQ ID NO: 1130970 - RNA, 18 nt, Human
ugaccugggggugggcug

SEQ ID NO: 1130971 - RNA, 21 nt, Human
ugagaaugagagcaugggguu

SEQ ID NO: 1130972 - RNA, 23 nt, Human
ugagaaugagagcaugggguugu

SEQ ID NO: 1130973 - RNA, 18 nt, Human
ugagcauuuguuggagga

SEQ ID NO: 1130974 - RNA, 18 nt, Human
ugaguuaggcacaugggg

SEQ ID NO: 1130975 - RNA, 19 nt, Human
ugcaggcgcuuagacaccc

SEQ ID NO: 1130976 - RNA, 22 nt, Human
ugcauccacaugauagggaucu

SEQ ID NO: 1130977 - RNA, 25 nt, Human
ugcgugcauacaaaugggcauaugg

SEQ ID NO: 1130978 - RNA, 19 nt, Human
ugcuuguccacagccacau

SEQ ID NO: 1130979 - RNA, 21 nt, Human
uggaggauggcuguuuguuua

SEQ ID NO: 1130980 - RNA, 24 nt, Human
uggcaggaggugaguggagcugcu

SEQ ID NO: 1130981 - RNA, 23 nt, Human
uggcaugcucaugcacacgcugg

SEQ ID NO: 1130982 - RNA, 19 nt, Human
uggcuagccagcuaggccc

SEQ ID NO: 1130983 - RNA, 23 nt, Human
ugggagcaugcguuugaauuugg

SEQ ID NO: 1130984 - RNA, 24 nt, Human
ugggcaggcugugccccagagagg

SEQ ID NO: 1130985 - RNA, 18 nt, Human
ugggcauaugacugagaa

SEQ ID NO: 1130986 - RNA, 18 nt, Human
uguaaaacgagggcugcc

SEQ ID NO: 1130987 - RNA, 22 nt, Human
uguaauggacuguuccugaggu

SEQ ID NO: 1130988 - RNA, 19 nt, Human
uguccacagccacaugagg

SEQ ID NO: 1130989 - RNA, 22 nt, Human
uguccacagccacaugaggaca

SEQ ID NO: 1130990 - RNA, 21 nt, Human
ugugagcccuggguuccucau

SEQ ID NO: 1130991 - RNA, 21 nt, Human
ugugaugacggcuggcugaug

SEQ ID NO: 1130992 - RNA, 20 nt, Human
ugugugcauccacaugauag

SEQ ID NO: 1130993 - RNA, 22 nt, Human
ugugugcuggacacuguaugua

SEQ ID NO: 1130994 - RNA, 21 nt, Human
uuacuuaaccuccuugugccu

SEQ ID NO: 1130995 - RNA, 19 nt, Human
uuauuugucauuugaucuu

SEQ ID NO: 1130996 - RNA, 21 nt, Human
uuggggcuuccugugugcugg

SEQ ID NO: 1130997 - RNA, 19 nt, Human
uuuaaaggcuucaugcccu

SEQ ID NO: 1130998 - RNA, 22 nt, Human
uuucaggccuuuaaaggcuuca

SEQ ID NO: 1130999 - RNA, 20 nt, Human
uuuguuggaggauggcuguu

SEQ ID NO: 1131000 - RNA, 18 nt, Human
uuuuggauacacccaagc

SEQ ID NO: 1131001 - RNA, 24 nt, Human
aaaaaaaaaagauaguacaaaaaa

SEQ ID NO: 1131002 - RNA, 23 nt, Human
aaaaaacaaaagacuaauaucau

SEQ ID NO: 1131003 - RNA, 21 nt, Human
aaaaaacagaaacuccuagag

SEQ ID NO: 1131004 - RNA, 26 nt, Human
aaaacaaaaaacagaaacuccuagag

SEQ ID NO: 1131005 - RNA, 20 nt, Human
aaaacagaaacuccuagagc

SEQ ID NO: 1131006 - RNA, 18 nt, Human
aaaacuugggcaaaggca

SEQ ID NO: 1131007 - RNA, 23 nt, Human
aaacaaaaaacagaaacuccuag

SEQ ID NO: 1131008 - RNA, 24 nt, Human
aaacaaaaaacagaaacuccuaga

SEQ ID NO: 1131009 - RNA, 23 nt, Human
aaacagaaaauauuugggaucua

SEQ ID NO: 1131010 - RNA, 24 nt, Human
aaacagaaaauauuugggaucuag

SEQ ID NO: 1131011 - RNA, 23 nt, Human
aaacaggguugaaacaugccccu

SEQ ID NO: 1131012 - RNA, 19 nt, Human
aaagagcuguaacacaaac

SEQ ID NO: 1131013 - RNA, 28 nt, Human
aacacaaacaggguugaaacaugccccu

SEQ ID NO: 1131014 - RNA, 21 nt, Human
aacaugcuuaucaaaguagga

SEQ ID NO: 1131015 - RNA, 25 nt, Human
aacuuucagaaaaaaaaaacagaaa

SEQ ID NO: 1131016 - RNA, 22 nt, Human
aagaggaaaagggcaaggauga

SEQ ID NO: 1131017 - RNA, 21 nt, Human
aagcaacaccccaaagaucuu

SEQ ID NO: 1131018 - RNA, 22 nt, Human
aagcaacaccccaaagaucuug

SEQ ID NO: 1131019 - RNA, 21 nt, Human
aagcauuucacaaaauaccca

SEQ ID NO: 1131020 - RNA, 18 nt, Human
aagccuccaggcaccacu

SEQ ID NO: 1131021 - RNA, 21 nt, Human
aauaaaacaaaaaacagaaac

SEQ ID NO: 1131022 - RNA, 23 nt, Human
acaaaaaacagaaacuccuagag

SEQ ID NO: 1131023 - RNA, 25 nt, Human
acaaaaugcugaugaaagaaauuuc

SEQ ID NO: 1131024 - RNA, 25 nt, Human
acaccccaaagaucuuguaacacag

SEQ ID NO: 1131025 - RNA, 19 nt, Human
acagaaaaagcauuucaca

SEQ ID NO: 1131026 - RNA, 26 nt, Human
acagugaaagacugaaaggucuacac

SEQ ID NO: 1131027 - RNA, 19 nt, Human
acaguggccagaccccacg

SEQ ID NO: 1131028 - RNA, 24 nt, Human
acuaaaucugauacucaaaccaaa

SEQ ID NO: 1131029 - RNA, 21 nt, Human
acuacauugagggugaagaga

SEQ ID NO: 1131030 - RNA, 19 nt, Human
agaaaaaaaaaacagaaaa

SEQ ID NO: 1131031 - RNA, 19 nt, Human
agaaaaagagaaauagagg

SEQ ID NO: 1131032 - RNA, 22 nt, Human
agaaaaagagaaauagagggaa

SEQ ID NO: 1131033 - RNA, 23 nt, Human
agaaaaagagaaauagagggaau

SEQ ID NO: 1131034 - RNA, 19 nt, Human
agaaaagcaacaccccaaa

SEQ ID NO: 1131035 - RNA, 22 nt, Human
agcccagugagcccaaacaaaa

SEQ ID NO: 1131036 - RNA, 21 nt, Human
aggacaagaacuugggaccca

SEQ ID NO: 1131037 - RNA, 21 nt, Human
aggacacccuggcuguggaaa

SEQ ID NO: 1131038 - RNA, 21 nt, Human
aggaggcagaugggcuccugg

SEQ ID NO: 1131039 - RNA, 22 nt, Human
aggcagaugggcuccugggcag

SEQ ID NO: 1131040 - RNA, 18 nt, Human
aggcugagaagucccaca

SEQ ID NO: 1131041 - RNA, 24 nt, Human
agggggcagguccccagugaggcc

SEQ ID NO: 1131042 - RNA, 18 nt, Human
aguacuaaaucugauacu

SEQ ID NO: 1131043 - RNA, 22 nt, Human
aguccagagacugcuguuaagu

SEQ ID NO: 1131044 - RNA, 23 nt, Human
auaaaacaaaaaacagaaacucc

SEQ ID NO: 1131045 - RNA, 24 nt, Human
auaaaacuuucagaaaaaaaaaac

SEQ ID NO: 1131046 - RNA, 18 nt, Human
auauucagaaaauggcag

SEQ ID NO: 1131047 - RNA, 19 nt, Human
aucuaaagguaacacgggg

SEQ ID NO: 1131048 - RNA, 20 nt, Human
aucuugcucacccuccacuu

SEQ ID NO: 1131049 - RNA, 26 nt, Human
caaaaaacagaaacuccuagagcuga

SEQ ID NO: 1131050 - RNA, 24 nt, Human
caacauaauccaacauacuaacug

SEQ ID NO: 1131051 - RNA, 23 nt, Human
caaguagaauucaacaauguaaa

SEQ ID NO: 1131052 - RNA, 20 nt, Human
cacacaccccuugccacucc

SEQ ID NO: 1131053 - RNA, 21 nt, Human
cacacaggccuuaucuuccuc

SEQ ID NO: 1131054 - RNA, 18 nt, Human
caccacuuuguuccccag

SEQ ID NO: 1131055 - RNA, 19 nt, Human
cacuuuguuccccaguacc

SEQ ID NO: 1131056 - RNA, 19 nt, Human
cagaaaaaaaaaacagaaa

SEQ ID NO: 1131057 - RNA, 20 nt, Human
caggacacccuggcugugga

SEQ ID NO: 1131058 - RNA, 20 nt, Human
caucuugcucacccuccacu

SEQ ID NO: 1131059 - RNA, 20 nt, Human
ccaaacaaaacuugggcaaa

SEQ ID NO: 1131060 - RNA, 19 nt, Human
ccacugcagcagcugacau

SEQ ID NO: 1131061 - RNA, 23 nt, Human
ccagaccccacgcucacucacac

SEQ ID NO: 1131062 - RNA, 21 nt, Human
ccaggcaccacuuuguucccc

SEQ ID NO: 1131063 - RNA, 24 nt, Human
ccaugccugacuugccuuuggcag

SEQ ID NO: 1131064 - RNA, 22 nt, Human
cccacgcucacucacacacccc

SEQ ID NO: 1131065 - RNA, 19 nt, Human
cccacugcggguuuccucc

SEQ ID NO: 1131066 - RNA, 24 nt, Human
cccuugccacuccaugccugacuu

SEQ ID NO: 1131067 - RNA, 21 nt, Human
ccuccaggcaccacuuuguuc

SEQ ID NO: 1131068 - RNA, 19 nt, Human
ccuguaggugccccuugcu

SEQ ID NO: 1131069 - RNA, 19 nt, Human
ccugugccagcaccuggag

SEQ ID NO: 1131070 - RNA, 20 nt, Human
ccuugcugugagcagccugg

SEQ ID NO: 1131071 - RNA, 24 nt, Human
cgaagcuuacugcaggaaugcagg

SEQ ID NO: 1131072 - RNA, 20 nt, Human
cggaaugagcccagugagcc

SEQ ID NO: 1131073 - RNA, 23 nt, Human
cuaguacuaaaucugauacucaa

SEQ ID NO: 1131074 - RNA, 24 nt, Human
cucaaaccaaaaaaaaaagauagu

SEQ ID NO: 1131075 - RNA, 22 nt, Human
cucacacaccccuugccacucc

SEQ ID NO: 1131076 - RNA, 21 nt, Human
cugaaacuuaaaauacaguag

SEQ ID NO: 1131077 - RNA, 19 nt, Human
cugcagcagcugacauguc

SEQ ID NO: 1131078 - RNA, 21 nt, Human
cugcuggguugcuaguagcau

SEQ ID NO: 1131079 - RNA, 23 nt, Human
cuggccagaaaagcaacacccca

SEQ ID NO: 1131080 - RNA, 18 nt, Human
cugggcagaagggggcag

SEQ ID NO: 1131081 - RNA, 18 nt, Human
gaagggggcaggucccca

SEQ ID NO: 1131082 - RNA, 23 nt, Human
gacaugggguccaggcugguagc

SEQ ID NO: 1131083 - RNA, 22 nt, Human
gacucuuucuugggagcccugu

SEQ ID NO: 1131084 - RNA, 21 nt, Human
gagcacagccugccaggccga

SEQ ID NO: 1131085 - RNA, 18 nt, Human
gagcuguaacacaaacag

SEQ ID NO: 1131086 - RNA, 18 nt, Human
gcaguggcaggaggcaga

SEQ ID NO: 1131087 - RNA, 24 nt, Human
gcccuucgggaagcccagaccugg

SEQ ID NO: 1131088 - RNA, 19 nt, Human
gccuuuggcagacaugggg

SEQ ID NO: 1131089 - RNA, 21 nt, Human
ggaaagccuggagagccugga

SEQ ID NO: 1131090 - RNA, 22 nt, Human
ggagcuccccaagccagggcua

SEQ ID NO: 1131091 - RNA, 19 nt, Human
ggaucuagauagugaggca

SEQ ID NO: 1131092 - RNA, 19 nt, Human
gggaagcccagaccugggg

SEQ ID NO: 1131093 - RNA, 20 nt, Human
ggggaggaacuccagaugug

SEQ ID NO: 1131094 - RNA, 19 nt, Human
uaaaacaaaaaacagaaac

SEQ ID NO: 1131095 - RNA, 24 nt, Human
uaaaacaaaaaacagaaacuccua

SEQ ID NO: 1131096 - RNA, 19 nt, Human
uaaaagagcuguaacacaa

SEQ ID NO: 1131097 - RNA, 21 nt, Human
uaaaagagcuguaacacaaac

SEQ ID NO: 1131098 - RNA, 23 nt, Human
uaaaucugauacucaaaccaaaa

SEQ ID NO: 1131099 - RNA, 18 nt, Human
uaacacaaacaggguuga

SEQ ID NO: 1131100 - RNA, 24 nt, Human
uaacacaaacaggguugaaacaug

SEQ ID NO: 1131101 - RNA, 18 nt, Human
uaaguccagagacugcug

SEQ ID NO: 1131102 - RNA, 23 nt, Human
uacagaaaaagcauuucacaaaa

SEQ ID NO: 1131103 - RNA, 24 nt, Human
uaccaaaaauaaaacaaaaaacag

SEQ ID NO: 1131104 - RNA, 25 nt, Human
uaccaaaaauaaaacaaaaaacaga

SEQ ID NO: 1131105 - RNA, 23 nt, Human
uagagcugauaagugacuucagc

SEQ ID NO: 1131106 - RNA, 21 nt, Human
uaggugccccuugcugugagc

SEQ ID NO: 1131107 - RNA, 22 nt, Human
uauggggcuugcaugcugagaa

SEQ ID NO: 1131108 - RNA, 22 nt, Human
ucaauucuucccaaguugauau

SEQ ID NO: 1131109 - RNA, 19 nt, Human
ucagaaccaggaaguugcu

SEQ ID NO: 1131110 - RNA, 27 nt, Human
uccaacauacuaacuggauacaaaaga

SEQ ID NO: 1131111 - RNA, 23 nt, Human
uccagagacugcuguuaaguccu

SEQ ID NO: 1131112 - RNA, 22 nt, Human
uccccaagccagggcuaugacu

SEQ ID NO: 1131113 - RNA, 22 nt, Human
ucuccaagccuccaggcaccac

SEQ ID NO: 1131114 - RNA, 26 nt, Human
ucugauacucaaaccaaaaaaaaaag

SEQ ID NO: 1131115 - RNA, 22 nt, Human
ugaagcuaguacuaaaucugau

SEQ ID NO: 1131116 - RNA, 20 nt, Human
ugagcccaaacaaaacuugg

SEQ ID NO: 1131117 - RNA, 23 nt, Human
ugagcccaaacaaaacuugggca

SEQ ID NO: 1131118 - RNA, 18 nt, Human
ugagcccagugagcccaa

SEQ ID NO: 1131119 - RNA, 25 nt, Human
ugaggauccagggggcugcuguugu

SEQ ID NO: 1131120 - RNA, 21 nt, Human
ugagggugaagagaaagaaag

SEQ ID NO: 1131121 - RNA, 19 nt, Human
ugcccaaaagccucagaac

SEQ ID NO: 1131122 - RNA, 19 nt, Human
ugcucauggaggcugagaa

SEQ ID NO: 1131123 - RNA, 21 nt, Human
uggaaaggagcuacccacugc

SEQ ID NO: 1131124 - RNA, 19 nt, Human
uggaggcugagaaguccca

SEQ ID NO: 1131125 - RNA, 24 nt, Human
uggcaaaggguccugcagcucccg

SEQ ID NO: 1131126 - RNA, 26 nt, Human
uggcaggaggcagaugggaggucgac

SEQ ID NO: 1131127 - RNA, 25 nt, Human
uggcaggaggcagaugggcuccugg

SEQ ID NO: 1131128 - RNA, 23 nt, Human
uggccagaaaagcaacaccccaa

SEQ ID NO: 1131129 - RNA, 23 nt, Human
ugggagcuccccaagccagggcu

SEQ ID NO: 1131130 - RNA, 21 nt, Human
uguauauucagaaaauggcag

SEQ ID NO: 1131131 - RNA, 23 nt, Human
ugugccagcaccuggagcugccc

SEQ ID NO: 1131132 - RNA, 18 nt, Human
uguuagaaguucuaccca

SEQ ID NO: 1131133 - RNA, 19 nt, Human
uuaaagagcaucuauaaca

SEQ ID NO: 1131134 - RNA, 21 nt, Human
uuagcaaguagaauucaacaa

SEQ ID NO: 1131135 - RNA, 24 nt, Human
uuagcaaguagaauucaacaaugu

SEQ ID NO: 1131136 - RNA, 22 nt, Human
uuauuguuaaacaguguuagaa

SEQ ID NO: 1131137 - RNA, 20 nt, Human
uuccuggccaggaauggagg

SEQ ID NO: 1131138 - RNA, 24 nt, Human
uucugcuggaacugcuggguugcu

SEQ ID NO: 1131139 - RNA, 21 nt, Human
uuucagaaaaaaaaaacagaa

SEQ ID NO: 1131140 - RNA, 21 nt, Human
ucagagcccaaugucaccagc

SEQ ID NO: 1131141 - RNA, 18 nt, Human
ucgggucuacacccaaga

SEQ ID NO: 1131142 - RNA, 23 nt, Human
uggggcaaaugccaccaccuguc

SEQ ID NO: 1131143 - RNA, 24 nt, Human
ugucaccagcgacuccugugaaau

SEQ ID NO: 1131144 - RNA, 20 nt, Human
aaaaacccagaaugaggaca

SEQ ID NO: 1131145 - RNA, 24 nt, Human
aaaaacccagaaugaggacacuac

SEQ ID NO: 1131146 - RNA, 20 nt, Human
aacucuacaaaauaugaaaa

SEQ ID NO: 1131147 - RNA, 21 nt, Human
aagcugccauguuaacaggcc

SEQ ID NO: 1131148 - RNA, 19 nt, Human
aaggacaccaggcaaacug

SEQ ID NO: 1131149 - RNA, 23 nt, Human
aaggagcugaggauggcucaugg

SEQ ID NO: 1131150 - RNA, 21 nt, Human
acaaaaacccagaaugaggac

SEQ ID NO: 1131151 - RNA, 26 nt, Human
acacagaagacaaaaacccagaauga

SEQ ID NO: 1131152 - RNA, 27 nt, Human
acagagcaagaccccauucucuuaaaa

SEQ ID NO: 1131153 - RNA, 24 nt, Human
acaucuaugauggcaaaaacacua

SEQ ID NO: 1131154 - RNA, 19 nt, Human
accacugcacuccagccug

SEQ ID NO: 1131155 - RNA, 22 nt, Human
accacugcacuccagccugggu

SEQ ID NO: 1131156 - RNA, 23 nt, Human
accacugcacuccagccugggug

SEQ ID NO: 1131157 - RNA, 25 nt, Human
accacugcacuccagccugggugac

SEQ ID NO: 1131158 - RNA, 20 nt, Human
acggagcugggaaacuuccc

SEQ ID NO: 1131159 - RNA, 21 nt, Human
acuaagaccuggucacuccaa

SEQ ID NO: 1131160 - RNA, 18 nt, Human
acuacacuccagccuggg

SEQ ID NO: 1131161 - RNA, 22 nt, Human
acuacacuccagccugggucac

SEQ ID NO: 1131162 - RNA, 24 nt, Human
acugcacuccagccugggugacag

SEQ ID NO: 1131163 - RNA, 26 nt, Human
acugcacuccagccugggugacagag

SEQ ID NO: 1131164 - RNA, 19 nt, Human
acuugggaggcugaggcag

SEQ ID NO: 1131165 - RNA, 21 nt, Human
acuuucucuuuaaagggggug

SEQ ID NO: 1131166 - RNA, 22 nt, Human
agaaagaagguggauuacaauc

SEQ ID NO: 1131167 - RNA, 22 nt, Human
agccagggauggcagugugugc

SEQ ID NO: 1131168 - RNA, 18 nt, Human
aggaggaucauggaugca

SEQ ID NO: 1131169 - RNA, 20 nt, Human
aggcugaggcaggaggauca

SEQ ID NO: 1131170 - RNA, 22 nt, Human
aggcugaggcaggaggaucaug

SEQ ID NO: 1131171 - RNA, 21 nt, Human
agugggcacagccuuuuaaac

SEQ ID NO: 1131172 - RNA, 21 nt, Human
aucacuuugucauccuuucuu

SEQ ID NO: 1131173 - RNA, 26 nt, Human
auucucuuaaaaacagaaauugggaa

SEQ ID NO: 1131174 - RNA, 21 nt, Human
caaaaacaaaauacuucuaag

SEQ ID NO: 1131175 - RNA, 21 nt, Human
caaaaacccagaaugaggaca

SEQ ID NO: 1131176 - RNA, 21 nt, Human
caaaauaugaaaacauuagcc

SEQ ID NO: 1131177 - RNA, 21 nt, Human
cacagaagacaaaaacccaga

SEQ ID NO: 1131178 - RNA, 26 nt, Human
caccacugcacuccagccugggugac

SEQ ID NO: 1131179 - RNA, 20 nt, Human
cacuccagccugggucacgu

SEQ ID NO: 1131180 - RNA, 22 nt, Human
cacuccagccugggugacagag

SEQ ID NO: 1131181 - RNA, 23 nt, Human
cacuccagccugggugacagagc

SEQ ID NO: 1131182 - RNA, 19 nt, Human
cacugcacuccagccuggg

SEQ ID NO: 1131183 - RNA, 19 nt, Human
cacugcacuccagccuggg

SEQ ID NO: 1131184 - RNA, 20 nt, Human
cacugcacuccagccugggg

SEQ ID NO: 1131185 - RNA, 22 nt, Human
cacugcacuccagccuggguga

SEQ ID NO: 1131186 - RNA, 23 nt, Human
cacugcacuccagccugggugac

SEQ ID NO: 1131187 - RNA, 24 nt, Human
cacugcacuccagccugggugaca

SEQ ID NO: 1131188 - RNA, 25 nt, Human
cacugcacuccagccugggugacag

SEQ ID NO: 1131189 - RNA, 22 nt, Human
cagaaggaaagcauacaaucau

SEQ ID NO: 1131190 - RNA, 24 nt, Human
cagaaugaggacacuaccaguaaa

SEQ ID NO: 1131191 - RNA, 21 nt, Human
cauccaucucugcuaugucuu

SEQ ID NO: 1131192 - RNA, 22 nt, Human
cauccccuuuaucgguacggcc

SEQ ID NO: 1131193 - RNA, 19 nt, Human
ccaaggaaaauuagcucca

SEQ ID NO: 1131194 - RNA, 20 nt, Human
ccacugcacuccagccuggg

SEQ ID NO: 1131195 - RNA, 20 nt, Human
ccacugcacuccagccuggg

SEQ ID NO: 1131196 - RNA, 21 nt, Human
ccacugcacuccagccugggu

SEQ ID NO: 1131197 - RNA, 24 nt, Human
ccacugcacuccagccugggugac

SEQ ID NO: 1131198 - RNA, 25 nt, Human
ccacugcacuccagccugggugaca

SEQ ID NO: 1131199 - RNA, 25 nt, Human
ccacugcacuccagccugggugacc

SEQ ID NO: 1131200 - RNA, 20 nt, Human
ccagaaugaggacacuacca

SEQ ID NO: 1131201 - RNA, 22 nt, Human
ccucauaccuucccacuccuaa

SEQ ID NO: 1131202 - RNA, 20 nt, Human
ccugggugacagagcaagac

SEQ ID NO: 1131203 - RNA, 21 nt, Human
cuacuacacuccagccugggu

SEQ ID NO: 1131204 - RNA, 24 nt, Human
cuacuacacuccagccugggucac

SEQ ID NO: 1131205 - RNA, 19 nt, Human
cucauaccuucccacuccu

SEQ ID NO: 1131206 - RNA, 19 nt, Human
cuccauucuggucuauacc

SEQ ID NO: 1131207 - RNA, 19 nt, Human
cugacugacaugaacuaca

SEQ ID NO: 1131208 - RNA, 21 nt, Human
cugccauguuaacaggcccau

SEQ ID NO: 1131209 - RNA, 22 nt, Human
cugcuguaaaguccagccaugu

SEQ ID NO: 1131210 - RNA, 24 nt, Human
cuucaaacauccaucucugcuaug

SEQ ID NO: 1131211 - RNA, 22 nt, Human
cuuuuaaaggaugagaagcuga

SEQ ID NO: 1131212 - RNA, 19 nt, Human
gacaugaacuacaauuuuu

SEQ ID NO: 1131213 - RNA, 18 nt, Human
gagcaagaccccauucuc

SEQ ID NO: 1131214 - RNA, 25 nt, Human
gauaaacggagcugggaaacuuccc

SEQ ID NO: 1131215 - RNA, 21 nt, Human
gaugaaucuuauaacugaacc

SEQ ID NO: 1131216 - RNA, 20 nt, Human
gaugcaacacaguuauuugg

SEQ ID NO: 1131217 - RNA, 24 nt, Human
gcacuccagccugggugacagagc

SEQ ID NO: 1131218 - RNA, 19 nt, Human
gccagaucuucacuuucau

SEQ ID NO: 1131219 - RNA, 19 nt, Human
gcuacuacacuccagccug

SEQ ID NO: 1131220 - RNA, 25 nt, Human
ggaugagaagcugagcagugggggg

SEQ ID NO: 1131221 - RNA, 25 nt, Human
ggguuugcuuauagacaaagcugcc

SEQ ID NO: 1131222 - RNA, 24 nt, Human
guaagggucauuguuauaugcaag

SEQ ID NO: 1131223 - RNA, 18 nt, Human
guguccccaagggacaca

SEQ ID NO: 1131224 - RNA, 23 nt, Human
uaaaaaagcuucccuguguuagc

SEQ ID NO: 1131225 - RNA, 24 nt, Human
uaacaaggagcugaggauggcuca

SEQ ID NO: 1131226 - RNA, 23 nt, Human
uaacaucuuagacguaaggguca

SEQ ID NO: 1131227 - RNA, 23 nt, Human
uaaccuucaucuaaaaaugacuu

SEQ ID NO: 1131228 - RNA, 21 nt, Human
uaacugaaccucacaagaauu

SEQ ID NO: 1131229 - RNA, 23 nt, Human
uaagaugagucaucacugacuga

SEQ ID NO: 1131230 - RNA, 25 nt, Human
uaaggacaccaggcaaacuggagac

SEQ ID NO: 1131231 - RNA, 22 nt, Human
uaaguaaaaucaauugacuccc

SEQ ID NO: 1131232 - RNA, 20 nt, Human
uacaaaauaugaaaacauua

SEQ ID NO: 1131233 - RNA, 22 nt, Human
uacuacacuccagccuggguca

SEQ ID NO: 1131234 - RNA, 23 nt, Human
uagccagggauggcagugugugc

SEQ ID NO: 1131235 - RNA, 25 nt, Human
ucaucuaaaaaugacuucaugucac

SEQ ID NO: 1131236 - RNA, 21 nt, Human
uccaaaaacaaaauacuucua

SEQ ID NO: 1131237 - RNA, 18 nt, Human
uccagagggcuccucuca

SEQ ID NO: 1131238 - RNA, 24 nt, Human
uccagccugggugacagagcaaga

SEQ ID NO: 1131239 - RNA, 23 nt, Human
uccucauaccuucccacuccuaa

SEQ ID NO: 1131240 - RNA, 22 nt, Human
ucuguccuuuucuuuccagagg

SEQ ID NO: 1131241 - RNA, 21 nt, Human
ucuuauaacugaaccucacaa

SEQ ID NO: 1131242 - RNA, 20 nt, Human
ugaauagcuacuacacucca

SEQ ID NO: 1131243 - RNA, 19 nt, Human
ugacagagcaagaccccau

SEQ ID NO: 1131244 - RNA, 23 nt, Human
ugacaugaacuacaauuuuugag

SEQ ID NO: 1131245 - RNA, 23 nt, Human
ugacugcaccacugcacuccagc

SEQ ID NO: 1131246 - RNA, 18 nt, Human
ugagaagcugagcagugg

SEQ ID NO: 1131247 - RNA, 21 nt, Human
ugaggauauugagggugggag

SEQ ID NO: 1131248 - RNA, 18 nt, Human
ugaggcaggaggaucaug

SEQ ID NO: 1131249 - RNA, 22 nt, Human
ugagucaucacugacugacaug

SEQ ID NO: 1131250 - RNA, 21 nt, Human
ugcaccacugcacuccagccu

SEQ ID NO: 1131251 - RNA, 27 nt, Human
ugcaccacugcacuccagccuggguga

SEQ ID NO: 1131252 - RNA, 31 nt, Human
ugcaccacugcacuccagccugggugacagg

SEQ ID NO: 1131253 - RNA, 22 nt, Human
ugcaguaagccaugacugcacc

SEQ ID NO: 1131254 - RNA, 23 nt, Human
uggcaaaaacacuauacucaaaa

SEQ ID NO: 1131255 - RNA, 20 nt, Human
ugggaggcugaggcaggagg

SEQ ID NO: 1131256 - RNA, 24 nt, Human
ugggaggcugaggcaggaggauca

SEQ ID NO: 1131257 - RNA, 18 nt, Human
ugucacaguaaacacaga

SEQ ID NO: 1131258 - RNA, 21 nt, Human
uguccuuuucuuuccagaggg

SEQ ID NO: 1131259 - RNA, 25 nt, Human
uguccuuuucuuuccagagggcucc

SEQ ID NO: 1131260 - RNA, 18 nt, Human
uucaaacauccaucucug

SEQ ID NO: 1131261 - RNA, 20 nt, Human
uucaaucacuuugucauccu

SEQ ID NO: 1131262 - RNA, 22 nt, Human
uucaugucacaguaaacacaga

SEQ ID NO: 1131263 - RNA, 21 nt, Human
uucccuugaagccaugaguuu

SEQ ID NO: 1131264 - RNA, 19 nt, Human
uucuaagaaagaaggugga

SEQ ID NO: 1131265 - RNA, 25 nt, Human
uugggaggcugaggcaggaggauca

SEQ ID NO: 1131266 - RNA, 20 nt, Human
uuucuaagaaagaaggugga

SEQ ID NO: 1131267 - RNA, 19 nt, Human
caucuucuccgucucugcc

SEQ ID NO: 1131268 - RNA, 21 nt, Human
uucaucuucuccgucucugcc

SEQ ID NO: 1131269 - RNA, 25 nt, Human
uucuuuagcacugguucccuucuga

SEQ ID NO: 1131270 - RNA, 23 nt, Human
ggugagcagagauggggaaggga

SEQ ID NO: 1131271 - RNA, 20 nt, Human
uacaguuugucaacacucaa

SEQ ID NO: 1131272 - RNA, 20 nt, Human
ucuccugacacacaaaucca

SEQ ID NO: 1131273 - RNA, 20 nt, Human
uggaagacugggcaccuggu

SEQ ID NO: 1131274 - RNA, 21 nt, Human
ugggcaccuggugccaggccc

SEQ ID NO: 1131275 - RNA, 18 nt, Human
uggggaagggaguugcuc

SEQ ID NO: 1131276 - RNA, 22 nt, Human
aaaacaaaucuuacacagccuu

SEQ ID NO: 1131277 - RNA, 27 nt, Human
aagaaccugcuuuaaauuuccaugcca

SEQ ID NO: 1131278 - RNA, 18 nt, Human
aagcugcaucagagacaa

SEQ ID NO: 1131279 - RNA, 20 nt, Human
acacuguacaguuuaaaaac

SEQ ID NO: 1131280 - RNA, 18 nt, Human
accaccaggacagggcca

SEQ ID NO: 1131281 - RNA, 23 nt, Human
accaggcaagguuagugacuauu

SEQ ID NO: 1131282 - RNA, 25 nt, Human
acuaccauccccauauauaacuaau

SEQ ID NO: 1131283 - RNA, 23 nt, Human
agacaagaaaaaaaacugcgcua

SEQ ID NO: 1131284 - RNA, 24 nt, Human
agacaagaaaaaaaacugcgcuag

SEQ ID NO: 1131285 - RNA, 26 nt, Human
agacaagaaaaaaaacugcgcuagag

SEQ ID NO: 1131286 - RNA, 26 nt, Human
aucagagacaacugaagaugaaaaaa

SEQ ID NO: 1131287 - RNA, 18 nt, Human
cacuguacaguuuaaaaa

SEQ ID NO: 1131288 - RNA, 21 nt, Human
caugccaauuuacaaccccca

SEQ ID NO: 1131289 - RNA, 21 nt, Human
ccaacaagaaccugcuuuaaa

SEQ ID NO: 1131290 - RNA, 22 nt, Human
ccaggacagggccaucuaaaga

SEQ ID NO: 1131291 - RNA, 19 nt, Human
ccauccccauauauaacua

SEQ ID NO: 1131292 - RNA, 24 nt, Human
ccaucuaaagacacauuugguagu

SEQ ID NO: 1131293 - RNA, 23 nt, Human
ccuuacauuucaauuuuuuucuu

SEQ ID NO: 1131294 - RNA, 23 nt, Human
cugcgcaccaacaagaaccugcu

SEQ ID NO: 1131295 - RNA, 26 nt, Human
gaaccugcuuuaaauuuccaugccaa

SEQ ID NO: 1131296 - RNA, 18 nt, Human
gacacauuugguagugua

SEQ ID NO: 1131297 - RNA, 22 nt, Human
gacacuguacaguuuaaaaacc

SEQ ID NO: 1131298 - RNA, 23 nt, Human
gcauucagaaugucaacaaaaca

SEQ ID NO: 1131299 - RNA, 22 nt, Human
gcugcgcaccaacaagaaccug

SEQ ID NO: 1131300 - RNA, 18 nt, Human
uaaaaggagugaguugug

SEQ ID NO: 1131301 - RNA, 23 nt, Human
uccccauauauaacuaauuugug

SEQ ID NO: 1131302 - RNA, 21 nt, Human
agcacacagggacccuuggag

SEQ ID NO: 1131303 - RNA, 21 nt, Human
agggcucaaagcaccuugaaa

SEQ ID NO: 1131304 - RNA, 19 nt, Human
auugaaggaucugcggggg

SEQ ID NO: 1131305 - RNA, 19 nt, Human
caagucaagacaaugguga

SEQ ID NO: 1131306 - RNA, 22 nt, Human
cccaagucaagacaauggugac

SEQ ID NO: 1131307 - RNA, 27 nt, Human
ccucucaucauugcuucuccuaagggc

SEQ ID NO: 1131308 - RNA, 18 nt, Human
uaggaaaggcagcccagg

SEQ ID NO: 1131309 - RNA, 23 nt, Human
uccuaagggccauugaaucucua

SEQ ID NO: 1131310 - RNA, 23 nt, Human
ugaaucucuagcacacagggacc

SEQ ID NO: 1131311 - RNA, 18 nt, Human
ugaucucuucaucaguag

SEQ ID NO: 1131312 - RNA, 19 nt, Human
uucacuguuucuacugugc

SEQ ID NO: 1131313 - RNA, 20 nt, Human
uucagcaucaugccagacag

SEQ ID NO: 1131314 - RNA, 21 nt, Human
uucagcaucaugccagacagg

SEQ ID NO: 1131315 - RNA, 24 nt, Human
uuccuacagggcucaaagcaccuu

SEQ ID NO: 1131316 - RNA, 21 nt, Human
uugcuucuccuaagggccauu

SEQ ID NO: 1131317 - RNA, 23 nt, Human
aacugugcaaaagucucuugccg

SEQ ID NO: 1131318 - RNA, 19 nt, Human
aagcagcuguccagaccuc

SEQ ID NO: 1131319 - RNA, 22 nt, Human
aagcgcacuauggugacccaug

SEQ ID NO: 1131320 - RNA, 21 nt, Human
accaagcaauccagaaaccga

SEQ ID NO: 1131321 - RNA, 22 nt, Human
acccuuugggaucccccagccu

SEQ ID NO: 1131322 - RNA, 22 nt, Human
accuggccccugcagugcuccg

SEQ ID NO: 1131323 - RNA, 20 nt, Human
agaaaucaauaaauaucgaa

SEQ ID NO: 1131324 - RNA, 22 nt, Human
agacagucgguagacuccaagc

SEQ ID NO: 1131325 - RNA, 21 nt, Human
aggaacacaggcaccuuggcc

SEQ ID NO: 1131326 - RNA, 21 nt, Human
aggagcggggacagacucuga

SEQ ID NO: 1131327 - RNA, 19 nt, Human
agggauggggcuguuggag

SEQ ID NO: 1131328 - RNA, 23 nt, Human
agggauggggcuguuggaggagc

SEQ ID NO: 1131329 - RNA, 22 nt, Human
aggggggcaggaggaggaguug

SEQ ID NO: 1131330 - RNA, 21 nt, Human
agggugccaccagagucccag

SEQ ID NO: 1131331 - RNA, 18 nt, Human
agucccagugccuggguu

SEQ ID NO: 1131332 - RNA, 18 nt, Human
auaaugagugagccaggc

SEQ ID NO: 1131333 - RNA, 22 nt, Human
auccugcacccagugcucaauu

SEQ ID NO: 1131334 - RNA, 22 nt, Human
augcaggugggaacaauccagu

SEQ ID NO: 1131335 - RNA, 22 nt, Human
cacaggcaccuuggccugaaga

SEQ ID NO: 1131336 - RNA, 23 nt, Human
cacccagggugccaccagagucc

SEQ ID NO: 1131337 - RNA, 19 nt, Human
caggagacgaugcgcuuuc

SEQ ID NO: 1131338 - RNA, 20 nt, Human
ccagaaaccgagcaggaaca

SEQ ID NO: 1131339 - RNA, 21 nt, Human
ccagaccucugagacagacag

SEQ ID NO: 1131340 - RNA, 21 nt, Human
cccuguacagccccagcgagu

SEQ ID NO: 1131341 - RNA, 21 nt, Human
cccuuugggaucccccagccu

SEQ ID NO: 1131342 - RNA, 21 nt, Human
ccugccgcguuucuccuccca

SEQ ID NO: 1131343 - RNA, 19 nt, Human
ccuggguugggggcuggag

SEQ ID NO: 1131344 - RNA, 24 nt, Human
ccuuugggaucccccagccugucc

SEQ ID NO: 1131345 - RNA, 21 nt, Human
cgagaaggaggaaaacccgcc

SEQ ID NO: 1131346 - RNA, 23 nt, Human
cucaagaccuccugcaacggucu

SEQ ID NO: 1131347 - RNA, 21 nt, Human
cuccaagcagaaacugugcaa

SEQ ID NO: 1131348 - RNA, 28 nt, Human
cucccaaugccucuggagccagcucugu

SEQ ID NO: 1131349 - RNA, 20 nt, Human
cugagacagacagucgguag

SEQ ID NO: 1131350 - RNA, 21 nt, Human
cuggcccaccgcugaccgcac

SEQ ID NO: 1131351 - RNA, 23 nt, Human
cuggcccaccgcugguccccugg

SEQ ID NO: 1131352 - RNA, 18 nt, Human
cuuccucuaccagacugu

SEQ ID NO: 1131353 - RNA, 25 nt, Human
gagaggcucuggcccaccgcugacc

SEQ ID NO: 1131354 - RNA, 20 nt, Human
gagugauucucuuucucuuc

SEQ ID NO: 1131355 - RNA, 27 nt, Human
gcacagcuucaucccggugauccaugc

SEQ ID NO: 1131356 - RNA, 20 nt, Human
gccccgagggggugggggcu

SEQ ID NO: 1131357 - RNA, 20 nt, Human
gccugccgcguuucuccucc

SEQ ID NO: 1131358 - RNA, 18 nt, Human
gccuggguugggggcugg

SEQ ID NO: 1131359 - RNA, 19 nt, Human
gcucagggcccuguacagc

SEQ ID NO: 1131360 - RNA, 19 nt, Human
gcuccggaaauugccaggg

SEQ ID NO: 1131361 - RNA, 19 nt, Human
gcugccucgcuucugagcu

SEQ ID NO: 1131362 - RNA, 18 nt, Human
ggcccaccgcugaccgcc

SEQ ID NO: 1131363 - RNA, 18 nt, Human
gggagggaggggggcagg

SEQ ID NO: 1131364 - RNA, 26 nt, Human
gggaucccccagccuguccuccgccu

SEQ ID NO: 1131365 - RNA, 19 nt, Human
gucgccaaccacuuugucu

SEQ ID NO: 1131366 - RNA, 24 nt, Human
gugauucucuuucucuucuucauu

SEQ ID NO: 1131367 - RNA, 21 nt, Human
guggcugucgccaaccacuuu

SEQ ID NO: 1131368 - RNA, 21 nt, Human
guucuuuuuuuuuccuucaug

SEQ ID NO: 1131369 - RNA, 23 nt, Human
guuucauuuaaguaccaagcaau

SEQ ID NO: 1131370 - RNA, 30 nt, Human
uaauaagauguuucauuuaaguaccaagcc

SEQ ID NO: 1131371 - RNA, 24 nt, Human
uagaaaucaauaaauaucgaauga

SEQ ID NO: 1131372 - RNA, 20 nt, Human
ucauuuaaguaccaagcaau

SEQ ID NO: 1131373 - RNA, 22 nt, Human
ucccccagccuguccuccgccu

SEQ ID NO: 1131374 - RNA, 21 nt, Human
uccggccugcaggagcgggga

SEQ ID NO: 1131375 - RNA, 26 nt, Human
uccuccguccuccuguccgagcuuca

SEQ ID NO: 1131376 - RNA, 19 nt, Human
uccuccuguccgagcuuca

SEQ ID NO: 1131377 - RNA, 21 nt, Human
ucgcuucugagcugccacccu

SEQ ID NO: 1131378 - RNA, 23 nt, Human
ucucuugccggugcuccggaaau

SEQ ID NO: 1131379 - RNA, 21 nt, Human
ugaccccagaaggcaguugcu

SEQ ID NO: 1131380 - RNA, 21 nt, Human
ugacucacucagaugagauuu

SEQ ID NO: 1131381 - RNA, 24 nt, Human
ugagccaaauguaacaagcagcug

SEQ ID NO: 1131382 - RNA, 19 nt, Human
ugagccaggccugccgcgu

SEQ ID NO: 1131383 - RNA, 21 nt, Human
ugccaccagagucccagugcc

SEQ ID NO: 1131384 - RNA, 20 nt, Human
ugccugccacccagggugcc

SEQ ID NO: 1131385 - RNA, 18 nt, Human
ugccuggguugggggcug

SEQ ID NO: 1131386 - RNA, 19 nt, Human
uggaggagccgagagcuac

SEQ ID NO: 1131387 - RNA, 19 nt, Human
uggauccugcacccagugc

SEQ ID NO: 1131388 - RNA, 23 nt, Human
uggcucaagaccuccugcaacgg

SEQ ID NO: 1131389 - RNA, 23 nt, Human
ugggaucccccagccuguccucc

SEQ ID NO: 1131390 - RNA, 18 nt, Human
ugggggcuggagcgcacc

SEQ ID NO: 1131391 - RNA, 23 nt, Human
uguaaugagauauuuacaugugc

SEQ ID NO: 1131392 - RNA, 18 nt, Human
ugugguuucagggccuca

SEQ ID NO: 1131393 - RNA, 21 nt, Human
uguuuuucuuugcugacuugu

SEQ ID NO: 1131394 - RNA, 25 nt, Human
uuaaguaccaagcaauccagaaacc

SEQ ID NO: 1131395 - RNA, 18 nt, Human
uucauggggaaaguuggg

SEQ ID NO: 1131396 - RNA, 18 nt, Human
uuccaaggcucgugcacu

SEQ ID NO: 1131397 - RNA, 18 nt, Human
uuggccugaagaauuggg

SEQ ID NO: 1131398 - RNA, 30 nt, Human
uuuaggucuuggcaaaaauguggcugucgg

SEQ ID NO: 1131399 - RNA, 26 nt, Human
uuugggagggaggggggcaggaggag

SEQ ID NO: 1131400 - RNA, 22 nt, Human
cuguaugaaacauucuccaccu

SEQ ID NO: 1131401 - RNA, 25 nt, Human
cuuuuuauuccccacuugucaggag

SEQ ID NO: 1131402 - RNA, 18 nt, Human
ggcuuuuuauuccccacu

SEQ ID NO: 1131403 - RNA, 19 nt, Human
acuuguacguuccuucccu

SEQ ID NO: 1131404 - RNA, 20 nt, Human
uuacuuguacguuccuuccc

SEQ ID NO: 1131405 - RNA, 23 nt, Human
aaagaaccgugaaccagcauuuu

SEQ ID NO: 1131406 - RNA, 20 nt, Human
aaagacacacccagggccag

SEQ ID NO: 1131407 - RNA, 22 nt, Human
aaagacacacccagggccagag

SEQ ID NO: 1131408 - RNA, 22 nt, Human
aaagacgucuaugaaaccugag

SEQ ID NO: 1131409 - RNA, 22 nt, Human
aaaugccagaagaguggaugug

SEQ ID NO: 1131410 - RNA, 19 nt, Human
aacacggugaaacuccguc

SEQ ID NO: 1131411 - RNA, 20 nt, Human
aacacggugaaacuccgucu

SEQ ID NO: 1131412 - RNA, 21 nt, Human
aagaaaucugcuuaagaaauc

SEQ ID NO: 1131413 - RNA, 23 nt, Human
aagacacacccagggccagagau

SEQ ID NO: 1131414 - RNA, 24 nt, Human
aauggcgugaaccugggaggcgga

SEQ ID NO: 1131415 - RNA, 19 nt, Human
acacggugaaacuccgucu

SEQ ID NO: 1131416 - RNA, 25 nt, Human
acaggaaaagacacacccagggcca

SEQ ID NO: 1131417 - RNA, 20 nt, Human
acuccccagcacauggggau

SEQ ID NO: 1131418 - RNA, 24 nt, Human
acuccgucuguacuaaaaauacaa

SEQ ID NO: 1131419 - RNA, 23 nt, Human
acucugcauuccaggauucucug

SEQ ID NO: 1131420 - RNA, 24 nt, Human
acuuugggaggucaaggcagguua

SEQ ID NO: 1131421 - RNA, 26 nt, Human
agacacacccagggccagagauucua

SEQ ID NO: 1131422 - RNA, 20 nt, Human
agcacuuugggaggucaagg

SEQ ID NO: 1131423 - RNA, 19 nt, Human
aggaaaagacacacccagg

SEQ ID NO: 1131424 - RNA, 21 nt, Human
aggaaaagacacacccagggc

SEQ ID NO: 1131425 - RNA, 23 nt, Human
aggaaaagacacacccagggcca

SEQ ID NO: 1131426 - RNA, 24 nt, Human
aggcaggugcaucacgaggucagg

SEQ ID NO: 1131427 - RNA, 19 nt, Human
aggcggagcuugcaguggg

SEQ ID NO: 1131428 - RNA, 23 nt, Human
aggcggagcuugcagugggccaa

SEQ ID NO: 1131429 - RNA, 21 nt, Human
aggcgggagaauggcgugaac

SEQ ID NO: 1131430 - RNA, 24 nt, Human
aggcgggagaauggcgugaaccug

SEQ ID NO: 1131431 - RNA, 21 nt, Human
agggagguggguguggacaga

SEQ ID NO: 1131432 - RNA, 19 nt, Human
aggugcaucacgaggucag

SEQ ID NO: 1131433 - RNA, 22 nt, Human
agucuugcugaaggugcuugcg

SEQ ID NO: 1131434 - RNA, 24 nt, Human
aguggcucacgccuguaaucccag

SEQ ID NO: 1131435 - RNA, 20 nt, Human
aucacgaggucaggagaucc

SEQ ID NO: 1131436 - RNA, 19 nt, Human
caagccccucuuuuucuuc

SEQ ID NO: 1131437 - RNA, 24 nt, Human
caaggcaggugcaucacgagguca

SEQ ID NO: 1131438 - RNA, 27 nt, Human
cacacucuucaccacugaccccacccc

SEQ ID NO: 1131439 - RNA, 21 nt, Human
cacaggaagggcaggggcuuc

SEQ ID NO: 1131440 - RNA, 23 nt, Human
cacccccgcuugcacacuaugcc

SEQ ID NO: 1131441 - RNA, 21 nt, Human
caccuguugucccagcucccg

SEQ ID NO: 1131442 - RNA, 24 nt, Human
cacgccuguaaucccagcacuuug

SEQ ID NO: 1131443 - RNA, 20 nt, Human
cacuaugccacaggaagggc

SEQ ID NO: 1131444 - RNA, 19 nt, Human
cacuccccagcacaugggg

SEQ ID NO: 1131445 - RNA, 24 nt, Human
cacugaccccacccccgcuugcac

SEQ ID NO: 1131446 - RNA, 24 nt, Human
cagcacuuugggaggucaaggcag

SEQ ID NO: 1131447 - RNA, 25 nt, Human
cagcacuuugggaggucaaggcagg

SEQ ID NO: 1131448 - RNA, 24 nt, Human
ccacaggaagggcaggggcuucca

SEQ ID NO: 1131449 - RNA, 20 nt, Human
ccagaagaguggaugugaua

SEQ ID NO: 1131450 - RNA, 21 nt, Human
ccaggauucucuguucucugg

SEQ ID NO: 1131451 - RNA, 21 nt, Human
ccaggggaggaucugggcugc

SEQ ID NO: 1131452 - RNA, 20 nt, Human
ccccacccccgcuugcacac

SEQ ID NO: 1131453 - RNA, 24 nt, Human
ccccucuuuuucuucugauauccc

SEQ ID NO: 1131454 - RNA, 19 nt, Human
cccgaggcgggagaauggc

SEQ ID NO: 1131455 - RNA, 23 nt, Human
cccucuuuuucuucugauauccc

SEQ ID NO: 1131456 - RNA, 23 nt, Human
ccuggaggaagcagcucuaacuu

SEQ ID NO: 1131457 - RNA, 23 nt, Human
ccuggcuaacacggugaaacucc

SEQ ID NO: 1131458 - RNA, 24 nt, Human
ccuggcuaacacggugaaacuccg

SEQ ID NO: 1131459 - RNA, 22 nt, Human
ccuguaaucccagcacuuuggg

SEQ ID NO: 1131460 - RNA, 25 nt, Human
ccuguugucccagcucccgaggcgg

SEQ ID NO: 1131461 - RNA, 24 nt, Human
cgagaccauccuggcuaacacggu

SEQ ID NO: 1131462 - RNA, 19 nt, Human
cgaggcacaagucugugcc

SEQ ID NO: 1131463 - RNA, 21 nt, Human
cucaaguuuuggguuagggca

SEQ ID NO: 1131464 - RNA, 22 nt, Human
cucacgccuguaaucccagcac

SEQ ID NO: 1131465 - RNA, 24 nt, Human
cucacgccuguaaucccagcacuu

SEQ ID NO: 1131466 - RNA, 25 nt, Human
cugaccccacccccgcuugcacacu

SEQ ID NO: 1131467 - RNA, 18 nt, Human
cuggcuaacacggugaaa

SEQ ID NO: 1131468 - RNA, 21 nt, Human
gacaaaaaugaacuuaaacua

SEQ ID NO: 1131469 - RNA, 22 nt, Human
gaccccacccccgcuugcacac

SEQ ID NO: 1131470 - RNA, 21 nt, Human
gacgucuaugaaaccugaggu

SEQ ID NO: 1131471 - RNA, 21 nt, Human
gagcucagggaggccaggggg

SEQ ID NO: 1131472 - RNA, 18 nt, Human
gagcuugcagugggccaa

SEQ ID NO: 1131473 - RNA, 22 nt, Human
gcaccaguugcaauuuuaaucc

SEQ ID NO: 1131474 - RNA, 20 nt, Human
gcgcaguggcucacgccugu

SEQ ID NO: 1131475 - RNA, 18 nt, Human
gcuaacacggugaaacuc

SEQ ID NO: 1131476 - RNA, 23 nt, Human
gcugggaagcgaggcacaagucu

SEQ ID NO: 1131477 - RNA, 20 nt, Human
gcuuccaucacaaucacuca

SEQ ID NO: 1131478 - RNA, 18 nt, Human
ggagcuugcagugggcca

SEQ ID NO: 1131479 - RNA, 19 nt, Human
ggaggucaaggcaggugca

SEQ ID NO: 1131480 - RNA, 21 nt, Human
ggccgggcgcaguggcucacg

SEQ ID NO: 1131481 - RNA, 23 nt, Human
ggcgcaguggcucacgccuguaa

SEQ ID NO: 1131482 - RNA, 23 nt, Human
gggcaccuguugucccagcuccc

SEQ ID NO: 1131483 - RNA, 19 nt, Human
gguggguguggacagaggc

SEQ ID NO: 1131484 - RNA, 20 nt, Human
uaaagaaccgugaaccagca

SEQ ID NO: 1131485 - RNA, 21 nt, Human
uaacacggugaaacuccgucu

SEQ ID NO: 1131486 - RNA, 24 nt, Human
uaacagcuacaggaaaagacacac

SEQ ID NO: 1131487 - RNA, 25 nt, Human
uaaucuuuacuaaagaaccgugaac

SEQ ID NO: 1131488 - RNA, 22 nt, Human
uagagaauuuuuucucaaguuu

SEQ ID NO: 1131489 - RNA, 18 nt, Human
uagcuuacaaaaaacugc

SEQ ID NO: 1131490 - RNA, 20 nt, Human
uagcuuacaaaaaacugcga

SEQ ID NO: 1131491 - RNA, 20 nt, Human
ucaccacugaccccaccccc

SEQ ID NO: 1131492 - RNA, 23 nt, Human
ucaccacugaccccacccccgcu

SEQ ID NO: 1131493 - RNA, 18 nt, Human
ucacgaggucaggagauc

SEQ ID NO: 1131494 - RNA, 24 nt, Human
ucacgaggucaggagaucgagacc

SEQ ID NO: 1131495 - RNA, 22 nt, Human
ucagggaggccagggggcuuca

SEQ ID NO: 1131496 - RNA, 21 nt, Human
ucugcauuccaggauucucug

SEQ ID NO: 1131497 - RNA, 24 nt, Human
ucuguacuaaaaauacaaaaaauu

SEQ ID NO: 1131498 - RNA, 18 nt, Human
ugaccccacccccgcuug

SEQ ID NO: 1131499 - RNA, 24 nt, Human
uggcucacgccuguaaucccagca

SEQ ID NO: 1131500 - RNA, 19 nt, Human
ugggaagcgaggcacaagu

SEQ ID NO: 1131501 - RNA, 23 nt, Human
ugggaagcgaggcacaagucugu

SEQ ID NO: 1131502 - RNA, 19 nt, Human
ugggaggcggagcuugcag

SEQ ID NO: 1131503 - RNA, 29 nt, Human
ugggaggcggagcuugcagugacaacggu

SEQ ID NO: 1131504 - RNA, 24 nt, Human
ugggaggcggagcuugcagugggc

SEQ ID NO: 1131505 - RNA, 21 nt, Human
uggguguggacagaggcacug

SEQ ID NO: 1131506 - RNA, 21 nt, Human
ugucccagcucccgaggcggg

SEQ ID NO: 1131507 - RNA, 25 nt, Human
uguggacagaggcacugggcagcug

SEQ ID NO: 1131508 - RNA, 23 nt, Human
uucucuguucucuggcugugggg

SEQ ID NO: 1131509 - RNA, 20 nt, Human
aaccaguggacaagccagaa

SEQ ID NO: 1131510 - RNA, 21 nt, Human
aacuggucucccugcucccuc

SEQ ID NO: 1131511 - RNA, 20 nt, Human
acgaguccucuugucucaaa

SEQ ID NO: 1131512 - RNA, 21 nt, Human
acgaguccucuugucucaaag

SEQ ID NO: 1131513 - RNA, 22 nt, Human
aucagucuuuguucucuguagg

SEQ ID NO: 1131514 - RNA, 20 nt, Human
augcaaucuaucucuaagac

SEQ ID NO: 1131515 - RNA, 19 nt, Human
caaccaguggacaagccag

SEQ ID NO: 1131516 - RNA, 18 nt, Human
caacugaacuguuaacug

SEQ ID NO: 1131517 - RNA, 24 nt, Human
cccaaccaccuaauagagggucau

SEQ ID NO: 1131518 - RNA, 21 nt, Human
cccucucuuacuauccuccca

SEQ ID NO: 1131519 - RNA, 24 nt, Human
cccucucuuacuauccucccagcc

SEQ ID NO: 1131520 - RNA, 21 nt, Human
ccuccauccucaucuccucca

SEQ ID NO: 1131521 - RNA, 18 nt, Human
ccucuugucucaaagcuc

SEQ ID NO: 1131522 - RNA, 24 nt, Human
cgaguccucuugucucaaagcucu

SEQ ID NO: 1131523 - RNA, 22 nt, Human
cuauccucccagcccuccaucc

SEQ ID NO: 1131524 - RNA, 24 nt, Human
cucauggcccucaugcaaucuauc

SEQ ID NO: 1131525 - RNA, 24 nt, Human
cugacaccuugacuacuucagugg

SEQ ID NO: 1131526 - RNA, 19 nt, Human
gaguccucuugucucaaag

SEQ ID NO: 1131527 - RNA, 24 nt, Human
ucaguggcccguaacuggucuccc

SEQ ID NO: 1131528 - RNA, 21 nt, Human
ucccucucuuacuauccuccc

SEQ ID NO: 1131529 - RNA, 22 nt, Human
uccucaucuccuccaguccgca

SEQ ID NO: 1131530 - RNA, 19 nt, Human
uggaagaggcccaaccacc

SEQ ID NO: 1131531 - RNA, 21 nt, Human
ugucugacaccuugacuacuu

SEQ ID NO: 1131532 - RNA, 23 nt, Human
uuacccucauggcccucaugcaa

SEQ ID NO: 1131533 - RNA, 21 nt, Human
uuccuucuugcuggggggaga

SEQ ID NO: 1131534 - RNA, 21 nt, Human
aaaguuaacgggcuuucuagg

SEQ ID NO: 1131535 - RNA, 20 nt, Human
aacaguggaagccuccaccc

SEQ ID NO: 1131536 - RNA, 18 nt, Human
aagcaggaagcaaagggc

SEQ ID NO: 1131537 - RNA, 19 nt, Human
aagccccagguaggcacag

SEQ ID NO: 1131538 - RNA, 22 nt, Human
acaguggaagccuccacccaaa

SEQ ID NO: 1131539 - RNA, 18 nt, Human
acaguggggaugugggca

SEQ ID NO: 1131540 - RNA, 22 nt, Human
agaaguuucuucuggaauuuca

SEQ ID NO: 1131541 - RNA, 21 nt, Human
agaggaagcaggaagcaaagg

SEQ ID NO: 1131542 - RNA, 19 nt, Human
agaugacucuaggugcugg

SEQ ID NO: 1131543 - RNA, 22 nt, Human
agcucuuccaaaucagagcuga

SEQ ID NO: 1131544 - RNA, 24 nt, Human
aggaagguggauuccacgaucagg

SEQ ID NO: 1131545 - RNA, 18 nt, Human
aggccagagcggaagaga

SEQ ID NO: 1131546 - RNA, 24 nt, Human
aggccucccccaucugucugugga

SEQ ID NO: 1131547 - RNA, 22 nt, Human
aguaaggguguaacgaagagga

SEQ ID NO: 1131548 - RNA, 19 nt, Human
auaaacaauaucauagcuc

SEQ ID NO: 1131549 - RNA, 21 nt, Human
augacucuaggugcugggggc

SEQ ID NO: 1131550 - RNA, 26 nt, Human
augcagcuucugcuucgucagguuug

SEQ ID NO: 1131551 - RNA, 18 nt, Human
auuacagaacauuuuucc

SEQ ID NO: 1131552 - RNA, 26 nt, Human
caaacaaauagaggaagcaggaagca

SEQ ID NO: 1131553 - RNA, 22 nt, Human
caagaaguuucuucuggaauuu

SEQ ID NO: 1131554 - RNA, 20 nt, Human
caagaugaggccagagaaug

SEQ ID NO: 1131555 - RNA, 21 nt, Human
caagccccagguaggcacagg

SEQ ID NO: 1131556 - RNA, 23 nt, Human
caagccccagguaggcacaggaa

SEQ ID NO: 1131557 - RNA, 23 nt, Human
caaggagcugcaagcgguccagu

SEQ ID NO: 1131558 - RNA, 22 nt, Human
cacagccugcguuuggucgccu

SEQ ID NO: 1131559 - RNA, 23 nt, Human
cagcauccugccuuagagauggg

SEQ ID NO: 1131560 - RNA, 18 nt, Human
caggaagagccgaggcca

SEQ ID NO: 1131561 - RNA, 18 nt, Human
caggaugggcugcaggca

SEQ ID NO: 1131562 - RNA, 21 nt, Human
caggcagccacagccugcguu

SEQ ID NO: 1131563 - RNA, 23 nt, Human
cauaagcagcauccugccuuaga

SEQ ID NO: 1131564 - RNA, 24 nt, Human
ccagagcggaagagaaauggcaca

SEQ ID NO: 1131565 - RNA, 23 nt, Human
cccgaguaggggugagggagccc

SEQ ID NO: 1131566 - RNA, 22 nt, Human
ccucugggcauuaucucagcuc

SEQ ID NO: 1131567 - RNA, 20 nt, Human
ccugucgugcccaagccaaa

SEQ ID NO: 1131568 - RNA, 18 nt, Human
ccuuccaugcagacaccu

SEQ ID NO: 1131569 - RNA, 18 nt, Human
cuaggugaaagccaagcc

SEQ ID NO: 1131570 - RNA, 24 nt, Human
cucauaagcagcauccugccuuag

SEQ ID NO: 1131571 - RNA, 25 nt, Human
cucauaagcagcauccugccuuaga

SEQ ID NO: 1131572 - RNA, 24 nt, Human
cucccugguuauguugaugcugcu

SEQ ID NO: 1131573 - RNA, 20 nt, Human
cucuaggugcugggggcagg

SEQ ID NO: 1131574 - RNA, 21 nt, Human
gaaaggagcaagaucugcaaa

SEQ ID NO: 1131575 - RNA, 24 nt, Human
gagccgaggccagagcggaagaga

SEQ ID NO: 1131576 - RNA, 24 nt, Human
gaucccucuggcuugccguauguu

SEQ ID NO: 1131577 - RNA, 20 nt, Human
gcagauggcuguuuccagaa

SEQ ID NO: 1131578 - RNA, 22 nt, Human
gccuugcucuccucucugcagc

SEQ ID NO: 1131579 - RNA, 18 nt, Human
ggcaggaugggcugcagg

SEQ ID NO: 1131580 - RNA, 19 nt, Human
ggcugcaggcagccacagc

SEQ ID NO: 1131581 - RNA, 20 nt, Human
gggaggcuauugauggauug

SEQ ID NO: 1131582 - RNA, 20 nt, Human
ggggaugugggcacggaugg

SEQ ID NO: 1131583 - RNA, 23 nt, Human
guucucuugggaagcacuucgca

SEQ ID NO: 1131584 - RNA, 22 nt, Human
uaagcagcauccugccuuagag

SEQ ID NO: 1131585 - RNA, 18 nt, Human
uaggcacaggaagagccg

SEQ ID NO: 1131586 - RNA, 21 nt, Human
ucagcuccuaacuuauguuua

SEQ ID NO: 1131587 - RNA, 21 nt, Human
uccugucgugcccaagccaaa

SEQ ID NO: 1131588 - RNA, 19 nt, Human
uccuuagcuuugggcccac

SEQ ID NO: 1131589 - RNA, 22 nt, Human
ucgccuugcucuccucucugca

SEQ ID NO: 1131590 - RNA, 21 nt, Human
ucgcucucccuuccaugcaga

SEQ ID NO: 1131591 - RNA, 22 nt, Human
ucuaugauguaaauggugaccc

SEQ ID NO: 1131592 - RNA, 23 nt, Human
ucucugcagcuggcacccaaucu

SEQ ID NO: 1131593 - RNA, 20 nt, Human
ucuguggagcccucauaagc

SEQ ID NO: 1131594 - RNA, 24 nt, Human
ugaaaggagcaagaucugcaaaga

SEQ ID NO: 1131595 - RNA, 21 nt, Human
ugaccugcuccagcacaauua

SEQ ID NO: 1131596 - RNA, 23 nt, Human
ugcaaagaucccucuggcuugcc

SEQ ID NO: 1131597 - RNA, 18 nt, Human
ugcccgaguaggggugag

SEQ ID NO: 1131598 - RNA, 26 nt, Human
uggaauuucaaaugugauguggucug

SEQ ID NO: 1131599 - RNA, 24 nt, Human
uggcacacgcaugcauguauaacc

SEQ ID NO: 1131600 - RNA, 24 nt, Human
ugggaucuuggcaaaaugcagcuu

SEQ ID NO: 1131601 - RNA, 22 nt, Human
ugggggcaggaugggcugcagg

SEQ ID NO: 1131602 - RNA, 23 nt, Human
ugggggcaggaugggcugcaggc

SEQ ID NO: 1131603 - RNA, 21 nt, Human
ugguggguuuuccuuagcuuu

SEQ ID NO: 1131604 - RNA, 21 nt, Human
ugucuguggagcccucauaag

SEQ ID NO: 1131605 - RNA, 24 nt, Human
uucaugcuuccacucgacaaacau

SEQ ID NO: 1131606 - RNA, 27 nt, Human
uuccucugggcauuaucucagcucccc

SEQ ID NO: 1131607 - RNA, 20 nt, Human
aaaaacaguuuacuaaaggc

SEQ ID NO: 1131608 - RNA, 23 nt, Human
aaacauguaugcacauucugccu

SEQ ID NO: 1131609 - RNA, 21 nt, Human
aaagccagcauacaagaaccu

SEQ ID NO: 1131610 - RNA, 22 nt, Human
aaaggcauccaaacugcgagga

SEQ ID NO: 1131611 - RNA, 20 nt, Human
aacccagaaggacaggaggg

SEQ ID NO: 1131612 - RNA, 21 nt, Human
aaccgcugucuccuaaucccu

SEQ ID NO: 1131613 - RNA, 21 nt, Human
aauaauccacagucaaaccag

SEQ ID NO: 1131614 - RNA, 22 nt, Human
acacacacgugccccaacuccc

SEQ ID NO: 1131615 - RNA, 21 nt, Human
acagaagacagcccuuggcca

SEQ ID NO: 1131616 - RNA, 24 nt, Human
acagcagcugcuuccuagaaaccc

SEQ ID NO: 1131617 - RNA, 24 nt, Human
accacaacccccuccccggcccag

SEQ ID NO: 1131618 - RNA, 22 nt, Human
acccagaaggacaggagggcuc

SEQ ID NO: 1131619 - RNA, 23 nt, Human
accuagaauccggcagaaauacc

SEQ ID NO: 1131620 - RNA, 21 nt, Human
agaaaaacaguuuacuaaagg

SEQ ID NO: 1131621 - RNA, 19 nt, Human
agaaaagccagcauacaag

SEQ ID NO: 1131622 - RNA, 24 nt, Human
agaaggacaggagggcucgggggc

SEQ ID NO: 1131623 - RNA, 25 nt, Human
agcuaugugcacagaagacagcccu

SEQ ID NO: 1131624 - RNA, 23 nt, Human
agcugcuuccuagaaacccccac

SEQ ID NO: 1131625 - RNA, 22 nt, Human
aggaaauaauccacagucaaac

SEQ ID NO: 1131626 - RNA, 21 nt, Human
aggcaaggcaaacacaaaccc

SEQ ID NO: 1131627 - RNA, 20 nt, Human
aggcauccaaacugcgagga

SEQ ID NO: 1131628 - RNA, 25 nt, Human
aggccagagcccugugcacagagga

SEQ ID NO: 1131629 - RNA, 18 nt, Human
aggcuaggcccugcccaa

SEQ ID NO: 1131630 - RNA, 26 nt, Human
aggugucaaaaaaaggcauccaaacu

SEQ ID NO: 1131631 - RNA, 19 nt, Human
caaacccagaaggacagga

SEQ ID NO: 1131632 - RNA, 27 nt, Human
caaacccagaaggacaggagggcucgg

SEQ ID NO: 1131633 - RNA, 21 nt, Human
caacaacacaaugagggagga

SEQ ID NO: 1131634 - RNA, 23 nt, Human
caacaccauuccuucaaagugag

SEQ ID NO: 1131635 - RNA, 18 nt, Human
caacccccuccccggccc

SEQ ID NO: 1131636 - RNA, 19 nt, Human
cacaaacccagaaggacag

SEQ ID NO: 1131637 - RNA, 19 nt, Human
cacaacccccuccccggcc

SEQ ID NO: 1131638 - RNA, 23 nt, Human
cacagcagcugcuuccuagaaac

SEQ ID NO: 1131639 - RNA, 21 nt, Human
cacaguuucacuagagacaaa

SEQ ID NO: 1131640 - RNA, 24 nt, Human
caccaggcaaggcaaacacaaacc

SEQ ID NO: 1131641 - RNA, 25 nt, Human
cacgugccccaacuccccaccccca

SEQ ID NO: 1131642 - RNA, 18 nt, Human
cacuagagacaaaaucac

SEQ ID NO: 1131643 - RNA, 20 nt, Human
cacuagagacaaaaucacca

SEQ ID NO: 1131644 - RNA, 30 nt, Human
cagcacccaaaggacacucaugaaaacauu

SEQ ID NO: 1131645 - RNA, 22 nt, Human
cagcaguagcgcacaggcacac

SEQ ID NO: 1131646 - RNA, 22 nt, Human
cagugugguggcugacaauccc

SEQ ID NO: 1131647 - RNA, 22 nt, Human
cauucagaaaacuaaguucaag

SEQ ID NO: 1131648 - RNA, 22 nt, Human
ccaaaggacacucaugaaaaca

SEQ ID NO: 1131649 - RNA, 24 nt, Human
ccacccauacagggaacugcugca

SEQ ID NO: 1131650 - RNA, 21 nt, Human
ccacugugagacuccuggccc

SEQ ID NO: 1131651 - RNA, 21 nt, Human
ccaggcaaggcaaacacaaac

SEQ ID NO: 1131652 - RNA, 21 nt, Human
ccccacaaccaucuucuccug

SEQ ID NO: 1131653 - RNA, 26 nt, Human
ccccuccguggcccugguauuccucc

SEQ ID NO: 1131654 - RNA, 18 nt, Human
ccuaaauggugugugaag

SEQ ID NO: 1131655 - RNA, 22 nt, Human
ccucacaucauguguccucaau

SEQ ID NO: 1131656 - RNA, 25 nt, Human
ccuccugcugcugccccuaggaguc

SEQ ID NO: 1131657 - RNA, 19 nt, Human
ccuggacggguucucugag

SEQ ID NO: 1131658 - RNA, 19 nt, Human
ccuggccccuccguggccc

SEQ ID NO: 1131659 - RNA, 21 nt, Human
ccuguuagccaacaccauucc

SEQ ID NO: 1131660 - RNA, 22 nt, Human
ccuuaccacaacccccuccccg

SEQ ID NO: 1131661 - RNA, 18 nt, Human
cgcacaggcacacagcua

SEQ ID NO: 1131662 - RNA, 18 nt, Human
cggaggucaaacuaccag

SEQ ID NO: 1131663 - RNA, 18 nt, Human
cggcccagcaguggaggc

SEQ ID NO: 1131664 - RNA, 22 nt, Human
cuagcgcaggugucaaaaaaag

SEQ ID NO: 1131665 - RNA, 18 nt, Human
cucaggccagccauucuc

SEQ ID NO: 1131666 - RNA, 27 nt, Human
cucccugcccagaguggagguaccacc

SEQ ID NO: 1131667 - RNA, 18 nt, Human
cuccuggccccuccgugg

SEQ ID NO: 1131668 - RNA, 19 nt, Human
cucuucuuggccccugagg

SEQ ID NO: 1131669 - RNA, 21 nt, Human
cugcaggcuccugagcuaugu

SEQ ID NO: 1131670 - RNA, 24 nt, Human
cuuaccacaacccccuccccggcc

SEQ ID NO: 1131671 - RNA, 20 nt, Human
cuuccuagaaacccccacaa

SEQ ID NO: 1131672 - RNA, 20 nt, Human
cuuggccagagcgggaagug

SEQ ID NO: 1131673 - RNA, 21 nt, Human
cuuuaugcaggcaagguccuc

SEQ ID NO: 1131674 - RNA, 18 nt, Human
gaacuucugcacaccccc

SEQ ID NO: 1131675 - RNA, 22 nt, Human
gacuuguucuccugacuccuuu

SEQ ID NO: 1131676 - RNA, 18 nt, Human
gagggaccauuauuucca

SEQ ID NO: 1131677 - RNA, 20 nt, Human
gagggcccuuaccacaaccc

SEQ ID NO: 1131678 - RNA, 22 nt, Human
gagucacagacaggcccucccu

SEQ ID NO: 1131679 - RNA, 18 nt, Human
gauuucugguccccaacu

SEQ ID NO: 1131680 - RNA, 22 nt, Human
gcaaacacaaacccagaaggac

SEQ ID NO: 1131681 - RNA, 22 nt, Human
gcaggcaagguccucugggggc

SEQ ID NO: 1131682 - RNA, 20 nt, Human
gccagagcgggaaguggggu

SEQ ID NO: 1131683 - RNA, 20 nt, Human
gccuccuaaaugguguguga

SEQ ID NO: 1131684 - RNA, 23 nt, Human
ggaagugggguccagagcgaguc

SEQ ID NO: 1131685 - RNA, 24 nt, Human
ggcagaacuucuaggcuuuuaguc

SEQ ID NO: 1131686 - RNA, 19 nt, Human
gggcucgggggcaagccug

SEQ ID NO: 1131687 - RNA, 18 nt, Human
gggcugcaaaaggcuagg

SEQ ID NO: 1131688 - RNA, 21 nt, Human
gggugguggcagugugguggc

SEQ ID NO: 1131689 - RNA, 21 nt, Human
ggugguggcagugugguggcu

SEQ ID NO: 1131690 - RNA, 20 nt, Human
gugguggcagugugguggcu

SEQ ID NO: 1131691 - RNA, 24 nt, Human
uaacccauggcuucaaaucucccu

SEQ ID NO: 1131692 - RNA, 19 nt, Human
uaagaaaagccagcauaca

SEQ ID NO: 1131693 - RNA, 22 nt, Human
uaagaaaagccagcauacaaga

SEQ ID NO: 1131694 - RNA, 26 nt, Human
uaagaacagaacuucugcacaccccc

SEQ ID NO: 1131695 - RNA, 21 nt, Human
uaagacagaaaaacaguuuac

SEQ ID NO: 1131696 - RNA, 22 nt, Human
uacaagaaccuagcgcaggugu

SEQ ID NO: 1131697 - RNA, 19 nt, Human
uaccacaacccccuccccg

SEQ ID NO: 1131698 - RNA, 19 nt, Human
uagagucugcccuccacug

SEQ ID NO: 1131699 - RNA, 22 nt, Human
uagcaaugugcuguuggguccc

SEQ ID NO: 1131700 - RNA, 20 nt, Human
uaggaguccuccagcuggau

SEQ ID NO: 1131701 - RNA, 23 nt, Human
uaggguggccuccuaaauggugu

SEQ ID NO: 1131702 - RNA, 23 nt, Human
uauaaauaagguaaaugcuuucc

SEQ ID NO: 1131703 - RNA, 20 nt, Human
uauuccuccugcugcugccc

SEQ ID NO: 1131704 - RNA, 20 nt, Human
ucaaaaaaaggcauccaaaa

SEQ ID NO: 1131705 - RNA, 20 nt, Human
ucaaaaaaaggcauccaaac

SEQ ID NO: 1131706 - RNA, 23 nt, Human
ucaccagguggcuaacccuucug

SEQ ID NO: 1131707 - RNA, 21 nt, Human
ucacuaagaacagaacuucug

SEQ ID NO: 1131708 - RNA, 22 nt, Human
ucagccccuagcacccagucag

SEQ ID NO: 1131709 - RNA, 21 nt, Human
uccaaacugcgaggacagagg

SEQ ID NO: 1131710 - RNA, 20 nt, Human
uccacugugagacuccuggc

SEQ ID NO: 1131711 - RNA, 23 nt, Human
uccccacccccauucagaaaacu

SEQ ID NO: 1131712 - RNA, 24 nt, Human
uccccacccccauucagaaaacua

SEQ ID NO: 1131713 - RNA, 21 nt, Human
uccccggcccagcaguggagg

SEQ ID NO: 1131714 - RNA, 22 nt, Human
uccccuacaaagcagguuucug

SEQ ID NO: 1131715 - RNA, 19 nt, Human
ucccugcccagaguggagg

SEQ ID NO: 1131716 - RNA, 20 nt, Human
uccuguuagccaacaccauu

SEQ ID NO: 1131717 - RNA, 18 nt, Human
uccuucaaagugaggcag

SEQ ID NO: 1131718 - RNA, 18 nt, Human
ucgggggcaagccuggga

SEQ ID NO: 1131719 - RNA, 21 nt, Human
ucucaggccagccauucucac

SEQ ID NO: 1131720 - RNA, 20 nt, Human
ucucugagcccagauuucug

SEQ ID NO: 1131721 - RNA, 19 nt, Human
ucugcacacccccaugucc

SEQ ID NO: 1131722 - RNA, 20 nt, Human
ucugcacacccccauguccu

SEQ ID NO: 1131723 - RNA, 18 nt, Human
ucuucucuucuuggcccc

SEQ ID NO: 1131724 - RNA, 23 nt, Human
ugaaacagagggaccauuauuuc

SEQ ID NO: 1131725 - RNA, 25 nt, Human
ugaaacagagggaccauuauuucca

SEQ ID NO: 1131726 - RNA, 21 nt, Human
ugacguaagacagaaaaacag

SEQ ID NO: 1131727 - RNA, 19 nt, Human
ugcccagaguggagguacc

SEQ ID NO: 1131728 - RNA, 20 nt, Human
ugccccaacuccccaccccc

SEQ ID NO: 1131729 - RNA, 19 nt, Human
ugcccgggagaccacugca

SEQ ID NO: 1131730 - RNA, 21 nt, Human
ugccuaggucuauucaacaac

SEQ ID NO: 1131731 - RNA, 18 nt, Human
uggaaaaagaaccuacau

SEQ ID NO: 1131732 - RNA, 21 nt, Human
uggcauuaucauuacuucagc

SEQ ID NO: 1131733 - RNA, 26 nt, Human
ugggauuggccugucacagcagcugc

SEQ ID NO: 1131734 - RNA, 23 nt, Human
ugggcagaggaggugagcuggau

SEQ ID NO: 1131735 - RNA, 19 nt, Human
uguaaucagccccuagcac

SEQ ID NO: 1131736 - RNA, 24 nt, Human
uguccucuugccucguuagggugg

SEQ ID NO: 1131737 - RNA, 20 nt, Human
ugucuguucaacucuucccc

SEQ ID NO: 1131738 - RNA, 24 nt, Human
ugugcagggugguggcaguguggu

SEQ ID NO: 1131739 - RNA, 20 nt, Human
uuaaaagaaacagcacccaa

SEQ ID NO: 1131740 - RNA, 24 nt, Human
uuacacacacgugccccaacuccc

SEQ ID NO: 1131741 - RNA, 22 nt, Human
uucaaagugaggcagccucccc

SEQ ID NO: 1131742 - RNA, 26 nt, Human
uucagcuggcaucuguuagagucugc

SEQ ID NO: 1131743 - RNA, 21 nt, Human
uucaugagucacccauuugag

SEQ ID NO: 1131744 - RNA, 21 nt, Human
uuccuagaaacccccacaacc

SEQ ID NO: 1131745 - RNA, 21 nt, Human
uucuauggauacaaggcugcc

SEQ ID NO: 1131746 - RNA, 25 nt, Human
uucuuggccccugaggacauccacc

SEQ ID NO: 1131747 - RNA, 22 nt, Human
uuuaaaagaaacagcacccaaa

SEQ ID NO: 1131748 - RNA, 19 nt, Human
aacuguccccgagugacca

SEQ ID NO: 1131749 - RNA, 18 nt, Human
accccgggacuggggcuu

SEQ ID NO: 1131750 - RNA, 23 nt, Human
agcacccuuugucccuggguggc

SEQ ID NO: 1131751 - RNA, 19 nt, Human
aggaccccgggacuggggc

SEQ ID NO: 1131752 - RNA, 22 nt, Human
aggcagcucagucuagagucua

SEQ ID NO: 1131753 - RNA, 18 nt, Human
cacccuggaauggcugaa

SEQ ID NO: 1131754 - RNA, 19 nt, Human
cagcacccuggaauggcug

SEQ ID NO: 1131755 - RNA, 19 nt, Human
ccagggccuggcgcagaag

SEQ ID NO: 1131756 - RNA, 19 nt, Human
ccccgaguccccaccgcuc

SEQ ID NO: 1131757 - RNA, 23 nt, Human
ccgaccccgaguccccaccgcuc

SEQ ID NO: 1131758 - RNA, 21 nt, Human
ccggcagguggugacuccccu

SEQ ID NO: 1131759 - RNA, 22 nt, Human
cgcucuguccuucuccagggcc

SEQ ID NO: 1131760 - RNA, 21 nt, Human
cggcagguggugacuccccuc

SEQ ID NO: 1131761 - RNA, 21 nt, Human
cgggacuggggcuuugucagu

SEQ ID NO: 1131762 - RNA, 20 nt, Human
cuacagcacccuggaauggc

SEQ ID NO: 1131763 - RNA, 26 nt, Human
cucccugaccacgaauacucugccaa

SEQ ID NO: 1131764 - RNA, 18 nt, Human
gcuggaguucaggugggc

SEQ ID NO: 1131765 - RNA, 24 nt, Human
ggccugauccugcugaccacgggu

SEQ ID NO: 1131766 - RNA, 18 nt, Human
ggcuuugucaguuuaaug

SEQ ID NO: 1131767 - RNA, 23 nt, Human
uaauggauuccaccucuaggaau

SEQ ID NO: 1131768 - RNA, 23 nt, Human
uccagggccuggcgcagaagcac

SEQ ID NO: 1131769 - RNA, 18 nt, Human
uccccgagugaccaaggc

SEQ ID NO: 1131770 - RNA, 28 nt, Human
uccccgagugaccaaggcagcucagucu

SEQ ID NO: 1131771 - RNA, 21 nt, Human
ucccuggguggccugauccug

SEQ ID NO: 1131772 - RNA, 21 nt, Human
ucuggccuccuaaggggcagg

SEQ ID NO: 1131773 - RNA, 22 nt, Human
ugaguacccaggaugaccuaau

SEQ ID NO: 1131774 - RNA, 18 nt, Human
uggaauggcugaaauuaa

SEQ ID NO: 1131775 - RNA, 21 nt, Human
uggccugauccugcugaccac

SEQ ID NO: 1131776 - RNA, 22 nt, Human
ugggaagcugugcauccuacag

SEQ ID NO: 1131777 - RNA, 23 nt, Human
uggguggccugauccugcugacc

SEQ ID NO: 1131778 - RNA, 26 nt, Human
aaaaaugugguauuugcagugcccuc

SEQ ID NO: 1131779 - RNA, 18 nt, Human
aaacaagaaaaaaaugug

SEQ ID NO: 1131780 - RNA, 22 nt, Human
aaacacugaaauuggcugaacc

SEQ ID NO: 1131781 - RNA, 29 nt, Human
aaacagaaguguaaaucagaagggacccc

SEQ ID NO: 1131782 - RNA, 21 nt, Human
aaauggccuugcagagugggc

SEQ ID NO: 1131783 - RNA, 22 nt, Human
aaauucacuucuuggggccaaa

SEQ ID NO: 1131784 - RNA, 24 nt, Human
aacucagagguaagugagauuugg

SEQ ID NO: 1131785 - RNA, 18 nt, Human
aacucccugaauagccaa

SEQ ID NO: 1131786 - RNA, 23 nt, Human
aagaaaccagaauaccaucugug

SEQ ID NO: 1131787 - RNA, 20 nt, Human
aagaagcuaaaauacuauca

SEQ ID NO: 1131788 - RNA, 22 nt, Human
aagcaaaaccccacaccaauaa

SEQ ID NO: 1131789 - RNA, 19 nt, Human
aagcagaaguugcacccca

SEQ ID NO: 1131790 - RNA, 19 nt, Human
aagcaucugauccuccauu

SEQ ID NO: 1131791 - RNA, 21 nt, Human
aagccaggacgagcaggugaa

SEQ ID NO: 1131792 - RNA, 20 nt, Human
aagggcucaagagcgcugau

SEQ ID NO: 1131793 - RNA, 25 nt, Human
aagugagauuugggaagacaguuac

SEQ ID NO: 1131794 - RNA, 22 nt, Human
aaguggaaacuucuguuuuguu

SEQ ID NO: 1131795 - RNA, 20 nt, Human
acacaaucaaucagaaaacu

SEQ ID NO: 1131796 - RNA, 21 nt, Human
accacuguaaagaagacugaa

SEQ ID NO: 1131797 - RNA, 19 nt, Human
accaguaaggccacacgcc

SEQ ID NO: 1131798 - RNA, 25 nt, Human
acccagaaccuccugcaagaaacca

SEQ ID NO: 1131799 - RNA, 18 nt, Human
acccugagguuccugggc

SEQ ID NO: 1131800 - RNA, 18 nt, Human
accugaacuucuagcacc

SEQ ID NO: 1131801 - RNA, 19 nt, Human
accugaacuucuagcacca

SEQ ID NO: 1131802 - RNA, 20 nt, Human
acgccaagagcagauuaaac

SEQ ID NO: 1131803 - RNA, 18 nt, Human
acucgcugcucaggaaca

SEQ ID NO: 1131804 - RNA, 23 nt, Human
acuugcccuucaccucauuccac

SEQ ID NO: 1131805 - RNA, 21 nt, Human
agaaaacagaaguguaaauca

SEQ ID NO: 1131806 - RNA, 19 nt, Human
agaaaagaggcacaaagaa

SEQ ID NO: 1131807 - RNA, 26 nt, Human
agaaaagguaacauucacacuucaca

SEQ ID NO: 1131808 - RNA, 22 nt, Human
agaaagacaggaauacagcaga

SEQ ID NO: 1131809 - RNA, 23 nt, Human
agaacacuuucuagccccugccu

SEQ ID NO: 1131810 - RNA, 21 nt, Human
agaaggcaguagagggagggg

SEQ ID NO: 1131811 - RNA, 23 nt, Human
agaaggcaguagagggagggggc

SEQ ID NO: 1131812 - RNA, 18 nt, Human
agaauaggaugagagggg

SEQ ID NO: 1131813 - RNA, 25 nt, Human
agacaggaauacagcagaagggacc

SEQ ID NO: 1131814 - RNA, 21 nt, Human
agagaaaagaggcacaaagaa

SEQ ID NO: 1131815 - RNA, 19 nt, Human
agagaccuagggccugccu

SEQ ID NO: 1131816 - RNA, 24 nt, Human
agagagaaagacaggaauacagca

SEQ ID NO: 1131817 - RNA, 19 nt, Human
agaggggaagaggaugggc

SEQ ID NO: 1131818 - RNA, 23 nt, Human
agcaaguuggccuuagcaccccc

SEQ ID NO: 1131819 - RNA, 22 nt, Human
agcaccauucucuccucuggcg

SEQ ID NO: 1131820 - RNA, 25 nt, Human
aggaacauaggcuuccacagacaga

SEQ ID NO: 1131821 - RNA, 25 nt, Human
aggaagcuucaccgguguaaacugu

SEQ ID NO: 1131822 - RNA, 26 nt, Human
aggaaggaacauaacauugugaaaaa

SEQ ID NO: 1131823 - RNA, 24 nt, Human
aggaaucccugggagguagcggug

SEQ ID NO: 1131824 - RNA, 18 nt, Human
aggagaggccuaaaaaua

SEQ ID NO: 1131825 - RNA, 23 nt, Human
aggaggucaggcacacagagucc

SEQ ID NO: 1131826 - RNA, 19 nt, Human
aggcaaagcucuccaggca

SEQ ID NO: 1131827 - RNA, 20 nt, Human
aggcacugagguugggcacc

SEQ ID NO: 1131828 - RNA, 22 nt, Human
aggcacugagguugggcaccac

SEQ ID NO: 1131829 - RNA, 22 nt, Human
aggcaguagagggagggggccu

SEQ ID NO: 1131830 - RNA, 19 nt, Human
aggcgggugggacccagaa

SEQ ID NO: 1131831 - RNA, 22 nt, Human
aggcuggaggguggccccagaa

SEQ ID NO: 1131832 - RNA, 22 nt, Human
aggcuuccacagacagagguaa

SEQ ID NO: 1131833 - RNA, 21 nt, Human
aggggcagcaggaacugagag

SEQ ID NO: 1131834 - RNA, 26 nt, Human
aggugcccuuuagaggccuccaauug

SEQ ID NO: 1131835 - RNA, 19 nt, Human
aucuauucagcaucccuca

SEQ ID NO: 1131836 - RNA, 21 nt, Human
augaagcagaaguugcacccc

SEQ ID NO: 1131837 - RNA, 20 nt, Human
auggaggcaaagcucuccag

SEQ ID NO: 1131838 - RNA, 19 nt, Human
auucugaggccucucuccc

SEQ ID NO: 1131839 - RNA, 21 nt, Human
auugguaccaaugauggugcc

SEQ ID NO: 1131840 - RNA, 19 nt, Human
caaaacauagcccuuagca

SEQ ID NO: 1131841 - RNA, 18 nt, Human
caaacagagagaucccac

SEQ ID NO: 1131842 - RNA, 24 nt, Human
caaagcaaaaccccacaccaauaa

SEQ ID NO: 1131843 - RNA, 18 nt, Human
caaagcucuccaggcagc

SEQ ID NO: 1131844 - RNA, 24 nt, Human
caaagcucuccaggcagcagaaga

SEQ ID NO: 1131845 - RNA, 21 nt, Human
caagccaggacgagcagguga

SEQ ID NO: 1131846 - RNA, 24 nt, Human
cacacagaguccuaggcacugagg

SEQ ID NO: 1131847 - RNA, 22 nt, Human
cacacagccagcccaaggccca

SEQ ID NO: 1131848 - RNA, 23 nt, Human
cacacagccagcccaaggcccag

SEQ ID NO: 1131849 - RNA, 21 nt, Human
caccacacucggucaucagag

SEQ ID NO: 1131850 - RNA, 19 nt, Human
caccauggacgccucaggc

SEQ ID NO: 1131851 - RNA, 24 nt, Human
cacccccaccacacucggucauca

SEQ ID NO: 1131852 - RNA, 19 nt, Human
caccucauuccacccucaa

SEQ ID NO: 1131853 - RNA, 19 nt, Human
caccugcuguucuuuugcu

SEQ ID NO: 1131854 - RNA, 21 nt, Human
caccuugucuacuccugccau

SEQ ID NO: 1131855 - RNA, 21 nt, Human
cacucaaaaccuaccacugua

SEQ ID NO: 1131856 - RNA, 18 nt, Human
cacucuguuaccugagcu

SEQ ID NO: 1131857 - RNA, 18 nt, Human
cacuggguggggcuuugg

SEQ ID NO: 1131858 - RNA, 24 nt, Human
cagaaaacagcaacugucccccuu

SEQ ID NO: 1131859 - RNA, 19 nt, Human
cagagccgggaugccuucc

SEQ ID NO: 1131860 - RNA, 18 nt, Human
cagagugauggccaccca

SEQ ID NO: 1131861 - RNA, 22 nt, Human
cagcaaauuguaaggaggagua

SEQ ID NO: 1131862 - RNA, 23 nt, Human
cagcacagcagagucccaggugg

SEQ ID NO: 1131863 - RNA, 20 nt, Human
cagcaggaacugagagaaga

SEQ ID NO: 1131864 - RNA, 22 nt, Human
cagccugguccuguccuguucc

SEQ ID NO: 1131865 - RNA, 24 nt, Human
caggaacgugugcaaaacauagcc

SEQ ID NO: 1131866 - RNA, 23 nt, Human
caggcacacagaguccuaggcac

SEQ ID NO: 1131867 - RNA, 19 nt, Human
caggggacagccugguccu

SEQ ID NO: 1131868 - RNA, 23 nt, Human
caguaaggccacacgccgggcac

SEQ ID NO: 1131869 - RNA, 20 nt, Human
caguagagggagggggccug

SEQ ID NO: 1131870 - RNA, 19 nt, Human
caucaccauggacgccuca

SEQ ID NO: 1131871 - RNA, 24 nt, Human
caucagaccuuaaagcaaguauca

SEQ ID NO: 1131872 - RNA, 19 nt, Human
caucaggagucuccaaauc

SEQ ID NO: 1131873 - RNA, 27 nt, Human
ccaaagcaaaaccccacaccaauaacu

SEQ ID NO: 1131874 - RNA, 24 nt, Human
ccacagaggcgagcucggcugggu

SEQ ID NO: 1131875 - RNA, 20 nt, Human
ccagaauaccaucugugggg

SEQ ID NO: 1131876 - RNA, 21 nt, Human
ccagcaugcaucauccaaagu

SEQ ID NO: 1131877 - RNA, 25 nt, Human
ccagccaggcuggcaaggacugaau

SEQ ID NO: 1131878 - RNA, 21 nt, Human
ccagcccugcauuuacuccuc

SEQ ID NO: 1131879 - RNA, 22 nt, Human
ccaggacgagcaggugaacaca

SEQ ID NO: 1131880 - RNA, 20 nt, Human
ccaggcuggcaaggacugaa

SEQ ID NO: 1131881 - RNA, 22 nt, Human
ccagugccacuugcccacgcag

SEQ ID NO: 1131882 - RNA, 19 nt, Human
ccauuugcucucuuugauc

SEQ ID NO: 1131883 - RNA, 26 nt, Human
cccagagccgggaugccuuccagagc

SEQ ID NO: 1131884 - RNA, 21 nt, Human
cccaggaugaaacaaaaggcu

SEQ ID NO: 1131885 - RNA, 21 nt, Human
ccccacaccaauaacuucauc

SEQ ID NO: 1131886 - RNA, 19 nt, Human
ccccauccacccccaucua

SEQ ID NO: 1131887 - RNA, 23 nt, Human
ccccauccacccccaucuauuca

SEQ ID NO: 1131888 - RNA, 24 nt, Human
cccccauccacccccaucuauuca

SEQ ID NO: 1131889 - RNA, 24 nt, Human
cccccuccccucaggccucaauuu

SEQ ID NO: 1131890 - RNA, 24 nt, Human
ccccuccucauccaucagaugccc

SEQ ID NO: 1131891 - RNA, 18 nt, Human
ccccucugacucgcugcu

SEQ ID NO: 1131892 - RNA, 20 nt, Human
ccccugccucccucccccca

SEQ ID NO: 1131893 - RNA, 28 nt, Human
ccccugccucccuccccccauccacccc

SEQ ID NO: 1131894 - RNA, 20 nt, Human
cccucaggccucaauuuucc

SEQ ID NO: 1131895 - RNA, 23 nt, Human
cccugcauuuacuccucucucca

SEQ ID NO: 1131896 - RNA, 25 nt, Human
cccugucuacccccaccauguuuca

SEQ ID NO: 1131897 - RNA, 25 nt, Human
ccucaaaacagaggguccaggagga

SEQ ID NO: 1131898 - RNA, 21 nt, Human
ccugaacuucuagcaccauuc

SEQ ID NO: 1131899 - RNA, 18 nt, Human
ccuggggcccaagccagg

SEQ ID NO: 1131900 - RNA, 22 nt, Human
ccuguccuguuccggguaggag

SEQ ID NO: 1131901 - RNA, 20 nt, Human
ccuuccagagccggcugcuc

SEQ ID NO: 1131902 - RNA, 19 nt, Human
ccuucuuugccauuugcuc

SEQ ID NO: 1131903 - RNA, 23 nt, Human
ccuuucuacuuauuuuaaaaauc

SEQ ID NO: 1131904 - RNA, 23 nt, Human
cgggugggacccagaaccuccug

SEQ ID NO: 1131905 - RNA, 23 nt, Human
cuagagcuggcugcaccugcugu

SEQ ID NO: 1131906 - RNA, 18 nt, Human
cuagcaccauucucuccu

SEQ ID NO: 1131907 - RNA, 21 nt, Human
cucaaagauucuccccuccuc

SEQ ID NO: 1131908 - RNA, 20 nt, Human
cucaggaacauaggcuucca

SEQ ID NO: 1131909 - RNA, 19 nt, Human
cucauuauccaaacggcau

SEQ ID NO: 1131910 - RNA, 19 nt, Human
cucccaacacuugaaggcc

SEQ ID NO: 1131911 - RNA, 25 nt, Human
cucccaaccugguaaaacuucucca

SEQ ID NO: 1131912 - RNA, 18 nt, Human
cuccccccauccaccccc

SEQ ID NO: 1131913 - RNA, 19 nt, Human
cuccccccauccaccccca

SEQ ID NO: 1131914 - RNA, 24 nt, Human
cuccccccauccacccccaucuau

SEQ ID NO: 1131915 - RNA, 20 nt, Human
cucccuccccccauccaccc

SEQ ID NO: 1131916 - RNA, 19 nt, Human
cuccucuggcgaccccuag

SEQ ID NO: 1131917 - RNA, 18 nt, Human
cuccuucaggcucccuca

SEQ ID NO: 1131918 - RNA, 18 nt, Human
cuccuugcugaacagccc

SEQ ID NO: 1131919 - RNA, 20 nt, Human
cucugcgauucugaccacag

SEQ ID NO: 1131920 - RNA, 22 nt, Human
cucuguuccucagcuccucuga

SEQ ID NO: 1131921 - RNA, 24 nt, Human
cucuuggucugugugauccucauu

SEQ ID NO: 1131922 - RNA, 23 nt, Human
cugaaccccugucuacccccacc

SEQ ID NO: 1131923 - RNA, 22 nt, Human
cugauggccccucugcgauucu

SEQ ID NO: 1131924 - RNA, 22 nt, Human
cugcucauguguccaccuccuu

SEQ ID NO: 1131925 - RNA, 21 nt, Human
cuggcaaggacugaauccaaa

SEQ ID NO: 1131926 - RNA, 19 nt, Human
cuggcccccuccccucagg

SEQ ID NO: 1131927 - RNA, 22 nt, Human
cugucccccuucuuugccauuu

SEQ ID NO: 1131928 - RNA, 21 nt, Human
cuucaucaagagauucucacu

SEQ ID NO: 1131929 - RNA, 23 nt, Human
cuuccagagccggcugcugccaa

SEQ ID NO: 1131930 - RNA, 18 nt, Human
cuuuguaugauugcuuca

SEQ ID NO: 1131931 - RNA, 26 nt, Human
gaacacacacagaaggaacuaaaaga

SEQ ID NO: 1131932 - RNA, 22 nt, Human
gaaggacugggugagccaucag

SEQ ID NO: 1131933 - RNA, 24 nt, Human
gaaugaagcagaaguugcaccccc

SEQ ID NO: 1131934 - RNA, 24 nt, Human
gacccauuggccacaucaaacucu

SEQ ID NO: 1131935 - RNA, 20 nt, Human
gacugaagacaagacugcca

SEQ ID NO: 1131936 - RNA, 24 nt, Human
gagaaagacaggaauacagcagaa

SEQ ID NO: 1131937 - RNA, 20 nt, Human
gaggauggagccaggccugu

SEQ ID NO: 1131938 - RNA, 23 nt, Human
gauccucauuuucaaauuagagg

SEQ ID NO: 1131939 - RNA, 22 nt, Human
gaugguacuucaucuucacuug

SEQ ID NO: 1131940 - RNA, 22 nt, Human
gcaaggguuuuaggaaggaaca

SEQ ID NO: 1131941 - RNA, 24 nt, Human
gcacacagaguccuaggcacugag

SEQ ID NO: 1131942 - RNA, 20 nt, Human
gcacuguaagggaacaaaau

SEQ ID NO: 1131943 - RNA, 18 nt, Human
gcagagugggcguccgag

SEQ ID NO: 1131944 - RNA, 21 nt, Human
gccacacgccgggcacggggc

SEQ ID NO: 1131945 - RNA, 18 nt, Human
gccaccuccucucaaugc

SEQ ID NO: 1131946 - RNA, 26 nt, Human
gccccagaagaacacuuucuagcccc

SEQ ID NO: 1131947 - RNA, 26 nt, Human
gccccugccucccuccccccauccac

SEQ ID NO: 1131948 - RNA, 21 nt, Human
gcucaggaacauaggcuucca

SEQ ID NO: 1131949 - RNA, 20 nt, Human
gcugaacagcccuagucuga

SEQ ID NO: 1131950 - RNA, 19 nt, Human
gcugcugccaagacccuga

SEQ ID NO: 1131951 - RNA, 24 nt, Human
ggacccagaaccuccugcaagaaa

SEQ ID NO: 1131952 - RNA, 18 nt, Human
ggagggagcagccccgcc

SEQ ID NO: 1131953 - RNA, 20 nt, Human
gggaagaggaugggcgggac

SEQ ID NO: 1131954 - RNA, 20 nt, Human
gggacagccugguccugucc

SEQ ID NO: 1131955 - RNA, 18 nt, Human
gggcaaggccaggcuggc

SEQ ID NO: 1131956 - RNA, 22 nt, Human
gggcuuuggaggugaggagguc

SEQ ID NO: 1131957 - RNA, 22 nt, Human
ggguggaaacucccugaauagc

SEQ ID NO: 1131958 - RNA, 20 nt, Human
gguggaaacucccugaauag

SEQ ID NO: 1131959 - RNA, 20 nt, Human
ggugggguuguccuagaagg

SEQ ID NO: 1131960 - RNA, 23 nt, Human
guauucuaaggaaaauccauggu

SEQ ID NO: 1131961 - RNA, 18 nt, Human
gucagagaguucuucuua

SEQ ID NO: 1131962 - RNA, 21 nt, Human
gugugauccucauuuucaaau

SEQ ID NO: 1131963 - RNA, 21 nt, Human
uaaaaaccaaagcaaaacccc

SEQ ID NO: 1131964 - RNA, 19 nt, Human
uaaaaauaugccacaaaau

SEQ ID NO: 1131965 - RNA, 23 nt, Human
uaaacaggaucucaaagauucuc

SEQ ID NO: 1131966 - RNA, 23 nt, Human
uaaagcaaguaucagcccuagug

SEQ ID NO: 1131967 - RNA, 19 nt, Human
uaaauauuuggugagaaaa

SEQ ID NO: 1131968 - RNA, 23 nt, Human
uaaaucagaaaagguaacauuca

SEQ ID NO: 1131969 - RNA, 19 nt, Human
uaacaggagugaggaugug

SEQ ID NO: 1131970 - RNA, 22 nt, Human
uaagaauggaacccguguuuga

SEQ ID NO: 1131971 - RNA, 20 nt, Human
uaaggaaaauccauggugcc

SEQ ID NO: 1131972 - RNA, 21 nt, Human
uaagucuuaggugucagugcc

SEQ ID NO: 1131973 - RNA, 26 nt, Human
uaauuaaaaaccaaagcaaaacccca

SEQ ID NO: 1131974 - RNA, 22 nt, Human
uacaauguucuuuaggguuuua

SEQ ID NO: 1131975 - RNA, 19 nt, Human
uaccagguggacaccugga

SEQ ID NO: 1131976 - RNA, 22 nt, Human
uacccaggaugaaacaaaaggc

SEQ ID NO: 1131977 - RNA, 20 nt, Human
uacuuucaauacuuuugcuc

SEQ ID NO: 1131978 - RNA, 20 nt, Human
uagcagagugugcaggucgc

SEQ ID NO: 1131979 - RNA, 22 nt, Human
uagcaggaacgugugcaaaaca

SEQ ID NO: 1131980 - RNA, 22 nt, Human
uagccccugccucccucccccc

SEQ ID NO: 1131981 - RNA, 23 nt, Human
uaucagcccuagugggaaacaga

SEQ ID NO: 1131982 - RNA, 21 nt, Human
uaugaaggacugggugagcca

SEQ ID NO: 1131983 - RNA, 20 nt, Human
ucaaaaugauuucagaggca

SEQ ID NO: 1131984 - RNA, 19 nt, Human
ucaaacagagagaucccac

SEQ ID NO: 1131985 - RNA, 20 nt, Human
ucaaauaacaccuaagaggc

SEQ ID NO: 1131986 - RNA, 24 nt, Human
ucaaauuagaggcuaaagauggac

SEQ ID NO: 1131987 - RNA, 19 nt, Human
ucaauccacucuccacucc

SEQ ID NO: 1131988 - RNA, 19 nt, Human
ucaauguaauguugccauc

SEQ ID NO: 1131989 - RNA, 22 nt, Human
ucaccucauuccacccucaaaa

SEQ ID NO: 1131990 - RNA, 26 nt, Human
ucagaaaacaucccaaguuuguagga

SEQ ID NO: 1131991 - RNA, 24 nt, Human
ucagaggauggagccaggccuguc

SEQ ID NO: 1131992 - RNA, 23 nt, Human
ucaggccaugugcacuggguggg

SEQ ID NO: 1131993 - RNA, 24 nt, Human
ucauguaugcucugggcaaggcca

SEQ ID NO: 1131994 - RNA, 19 nt, Human
uccacacaugggaauuugc

SEQ ID NO: 1131995 - RNA, 19 nt, Human
uccacacaugggaauuugc

SEQ ID NO: 1131996 - RNA, 22 nt, Human
uccacccccauuccccuuggca

SEQ ID NO: 1131997 - RNA, 20 nt, Human
uccaccuccuucaggcuccc

SEQ ID NO: 1131998 - RNA, 21 nt, Human
uccaccuccuucaggcucccu

SEQ ID NO: 1131999 - RNA, 20 nt, Human
uccacucccagagucuggcc

SEQ ID NO: 1132000 - RNA, 18 nt, Human
uccacucuccacucccag

SEQ ID NO: 1132001 - RNA, 21 nt, Human
uccaggaggacaaggacugcc

SEQ ID NO: 1132002 - RNA, 21 nt, Human
ucccagagucuggcccccucc

SEQ ID NO: 1132003 - RNA, 19 nt, Human
ucccucagaaaacauccca

SEQ ID NO: 1132004 - RNA, 21 nt, Human
ucccucagaaaacaucccaag

SEQ ID NO: 1132005 - RNA, 25 nt, Human
ucccucagaaaacaucccaaguucc

SEQ ID NO: 1132006 - RNA, 19 nt, Human
ucccuccccccauccaccc

SEQ ID NO: 1132007 - RNA, 18 nt, Human
ucccugauggccccucug

SEQ ID NO: 1132008 - RNA, 23 nt, Human
ucccugauggccccucugcgauu

SEQ ID NO: 1132009 - RNA, 20 nt, Human
ucccugccacgguguuuggg

SEQ ID NO: 1132010 - RNA, 18 nt, Human
uccgaggacuuucugcug

SEQ ID NO: 1132011 - RNA, 20 nt, Human
uccugggcucccuggggccc

SEQ ID NO: 1132012 - RNA, 20 nt, Human
ucuagccccugccucccucc

SEQ ID NO: 1132013 - RNA, 19 nt, Human
ucucaaugccauugguacc

SEQ ID NO: 1132014 - RNA, 21 nt, Human
ucuccaggcagcagaagacca

SEQ ID NO: 1132015 - RNA, 25 nt, Human
ucuccagugcuaucucccucuccca

SEQ ID NO: 1132016 - RNA, 28 nt, Human
ucuccagugcuaucucccuucccaaggg

SEQ ID NO: 1132017 - RNA, 20 nt, Human
ucugaagcucccugcucugc

SEQ ID NO: 1132018 - RNA, 22 nt, Human
ucugaggccucucucccaaccu

SEQ ID NO: 1132019 - RNA, 21 nt, Human
ucugcuugaugggggcauaug

SEQ ID NO: 1132020 - RNA, 22 nt, Human
ucuggcccccuccccucaggcc

SEQ ID NO: 1132021 - RNA, 20 nt, Human
ucuuccagguguauggcauc

SEQ ID NO: 1132022 - RNA, 23 nt, Human
ugaaacagccagcaaauaaguuc

SEQ ID NO: 1132023 - RNA, 20 nt, Human
ugaacacacacagaaggaac

SEQ ID NO: 1132024 - RNA, 19 nt, Human
ugaaccccugucuaccccc

SEQ ID NO: 1132025 - RNA, 18 nt, Human
ugaaguggaaacuucugu

SEQ ID NO: 1132026 - RNA, 24 nt, Human
ugaccacaggaugcccgcagcaca

SEQ ID NO: 1132027 - RNA, 21 nt, Human
ugaccauaacuugcuuacacc

SEQ ID NO: 1132028 - RNA, 19 nt, Human
ugacuucaauccacucucc

SEQ ID NO: 1132029 - RNA, 19 nt, Human
ugagagaagaaggguugaa

SEQ ID NO: 1132030 - RNA, 22 nt, Human
ugagcaaccugcacuucagucc

SEQ ID NO: 1132031 - RNA, 24 nt, Human
ugaggaggucagagaguucuucuu

SEQ ID NO: 1132032 - RNA, 24 nt, Human
ugauucaaacagagagaucccaca

SEQ ID NO: 1132033 - RNA, 23 nt, Human
ugcaaacaagaaaaaaauguggu

SEQ ID NO: 1132034 - RNA, 23 nt, Human
ugcaacugucagccucacuacag

SEQ ID NO: 1132035 - RNA, 18 nt, Human
ugcccucauaaacaggau

SEQ ID NO: 1132036 - RNA, 25 nt, Human
ugccuuggaucccugcacauagaac

SEQ ID NO: 1132037 - RNA, 22 nt, Human
ugcugucuagagcuggcugcac

SEQ ID NO: 1132038 - RNA, 19 nt, Human
uggacccaaauccaccccc

SEQ ID NO: 1132039 - RNA, 25 nt, Human
uggcaaggacugaauccaaauccca

SEQ ID NO: 1132040 - RNA, 21 nt, Human
uggcaggagacagggacuuaa

SEQ ID NO: 1132041 - RNA, 18 nt, Human
uggcaguaaugggagaga

SEQ ID NO: 1132042 - RNA, 20 nt, Human
uggccacaucaaacucugau

SEQ ID NO: 1132043 - RNA, 24 nt, Human
uggccagugccacuugcccaccag

SEQ ID NO: 1132044 - RNA, 25 nt, Human
uggcugaaccccugucuacccccac

SEQ ID NO: 1132045 - RNA, 20 nt, Human
ugggaagguccucccugaug

SEQ ID NO: 1132046 - RNA, 22 nt, Human
ugggaauucccaaggugggcac

SEQ ID NO: 1132047 - RNA, 22 nt, Human
ugggaguuuaugcucggccagg

SEQ ID NO: 1132048 - RNA, 18 nt, Human
ugguauuugcagugcccu

SEQ ID NO: 1132049 - RNA, 19 nt, Human
ugguauuugcagugcccuc

SEQ ID NO: 1132050 - RNA, 23 nt, Human
ugguugguuuuaagaaagaggcu

SEQ ID NO: 1132051 - RNA, 18 nt, Human
uguaauguugccauccaa

SEQ ID NO: 1132052 - RNA, 23 nt, Human
uguauggcaucucauaacagagu

SEQ ID NO: 1132053 - RNA, 18 nt, Human
ugucggggcugcucaugu

SEQ ID NO: 1132054 - RNA, 24 nt, Human
uguuccggguaggaggcacugggc

SEQ ID NO: 1132055 - RNA, 21 nt, Human
uguuccucagcuccucugaga

SEQ ID NO: 1132056 - RNA, 18 nt, Human
uuaaagcaaguaucagcc

SEQ ID NO: 1132057 - RNA, 18 nt, Human
uuaauggcagcccucagu

SEQ ID NO: 1132058 - RNA, 23 nt, Human
uuagcacccccaccacacucggu

SEQ ID NO: 1132059 - RNA, 25 nt, Human
uucaagaagcuaaaauacuaucaga

SEQ ID NO: 1132060 - RNA, 19 nt, Human
uucacagguaacaaauggu

SEQ ID NO: 1132061 - RNA, 24 nt, Human
uucagaggauggagccaggccugu

SEQ ID NO: 1132062 - RNA, 24 nt, Human
uucauuggcaauuuuuugcaacaa

SEQ ID NO: 1132063 - RNA, 21 nt, Human
uuccagagccggcugcugcca

SEQ ID NO: 1132064 - RNA, 20 nt, Human
uucccuauucuccucucuca

SEQ ID NO: 1132065 - RNA, 19 nt, Human
uuccuugggagugucccug

SEQ ID NO: 1132066 - RNA, 20 nt, Human
uuccuugggagugucccuga

SEQ ID NO: 1132067 - RNA, 18 nt, Human
uucuuggggccaaacacu

SEQ ID NO: 1132068 - RNA, 22 nt, Human
uugaaggcuguuuguacuccac

SEQ ID NO: 1132069 - RNA, 19 nt, Human
uugaagucucuguuccuca

SEQ ID NO: 1132070 - RNA, 22 nt, Human
uugaccauaacuugcuuacacc

SEQ ID NO: 1132071 - RNA, 19 nt, Human
uugcagagugggcguccga

SEQ ID NO: 1132072 - RNA, 19 nt, Human
uugcccuucaccucauucc

SEQ ID NO: 1132073 - RNA, 18 nt, Human
uugcugccaagcucccaa

SEQ ID NO: 1132074 - RNA, 19 nt, Human
uugcuggugggguuguccu

SEQ ID NO: 1132075 - RNA, 23 nt, Human
uugguugguuuuaagaaagaggc

SEQ ID NO: 1132076 - RNA, 20 nt, Human
uuguuuacccuaauucccua

SEQ ID NO: 1132077 - RNA, 23 nt, Human
agcacccuuugucccuggguggc

SEQ ID NO: 1132078 - RNA, 21 nt, Human
agguggugacuccccauccgc

SEQ ID NO: 1132079 - RNA, 23 nt, Human
auagucccgacuccccgagacag

SEQ ID NO: 1132080 - RNA, 18 nt, Human
auccgcggaggcuccccc

SEQ ID NO: 1132081 - RNA, 19 nt, Human
caacugccgggagauucug

SEQ ID NO: 1132082 - RNA, 24 nt, Human
caacugccuccugagugaccgaga

SEQ ID NO: 1132083 - RNA, 19 nt, Human
cacccuggaauggcugaag

SEQ ID NO: 1132084 - RNA, 26 nt, Human
caccgcucuguccuucuccaaggccc

SEQ ID NO: 1132085 - RNA, 20 nt, Human
cagguggugacuccccaucc

SEQ ID NO: 1132086 - RNA, 22 nt, Human
cagucuagagucucgacuaccc

SEQ ID NO: 1132087 - RNA, 24 nt, Human
ccaacugccuccugagugaccgag

SEQ ID NO: 1132088 - RNA, 19 nt, Human
ccccgcugaccccaagucc

SEQ ID NO: 1132089 - RNA, 21 nt, Human
ccccgcugaccccaagucccc

SEQ ID NO: 1132090 - RNA, 19 nt, Human
cccggugcaggagcacccu

SEQ ID NO: 1132091 - RNA, 20 nt, Human
ccggcagguggugacucccc

SEQ ID NO: 1132092 - RNA, 18 nt, Human
ccgggaaccaacugccgg

SEQ ID NO: 1132093 - RNA, 21 nt, Human
ccuccgggaaccaacugccgg

SEQ ID NO: 1132094 - RNA, 24 nt, Human
ccuccgggaaccaacugccgggag

SEQ ID NO: 1132095 - RNA, 20 nt, Human
cgacuacccggggugaccca

SEQ ID NO: 1132096 - RNA, 23 nt, Human
cgcucuguccuucuccaaggccc

SEQ ID NO: 1132097 - RNA, 21 nt, Human
cggcagguggugacuccccuc

SEQ ID NO: 1132098 - RNA, 26 nt, Human
cucccugaccacgaauacucugccaa

SEQ ID NO: 1132099 - RNA, 20 nt, Human
cuccgggaaccaacugccgg

SEQ ID NO: 1132100 - RNA, 18 nt, Human
cugaccccaaguccccac

SEQ ID NO: 1132101 - RNA, 21 nt, Human
gaggcucccccgcugacccca

SEQ ID NO: 1132102 - RNA, 20 nt, Human
gcccggugcaggagcacccu

SEQ ID NO: 1132103 - RNA, 18 nt, Human
gcuggaguucaggugggc

SEQ ID NO: 1132104 - RNA, 18 nt, Human
ggcuuugucaguuuaaca

SEQ ID NO: 1132105 - RNA, 20 nt, Human
gucuagagucucgacuaccc

SEQ ID NO: 1132106 - RNA, 23 nt, Human
uaacagauucugccuccgggaac

SEQ ID NO: 1132107 - RNA, 19 nt, Human
ucccuggguggccugaccc

SEQ ID NO: 1132108 - RNA, 21 nt, Human
ucccuggguggccugacccug

SEQ ID NO: 1132109 - RNA, 26 nt, Human
uccgcggaggcucccccgcugacccc

SEQ ID NO: 1132110 - RNA, 21 nt, Human
uccggccuccuaaggggcagg

SEQ ID NO: 1132111 - RNA, 22 nt, Human
uccugagugaccgagacagcuc

SEQ ID NO: 1132112 - RNA, 27 nt, Human
uccugagugaccgagacagcucagucu

SEQ ID NO: 1132113 - RNA, 19 nt, Human
ucugccaacugccuccuga

SEQ ID NO: 1132114 - RNA, 18 nt, Human
uggaauggcugaaauuaa

SEQ ID NO: 1132115 - RNA, 21 nt, Human
ugggaagcugugcauccuaua

SEQ ID NO: 1132116 - RNA, 23 nt, Human
uggguggccugacccugcugacc

SEQ ID NO: 1132117 - RNA, 23 nt, Human
uuuucauauaauugcauuuuuca

SEQ ID NO: 1132118 - RNA, 18 nt, Human
auaaaguggcugugcucc

SEQ ID NO: 1132119 - RNA, 22 nt, Human
ccacacagcugacuacgcugcu

SEQ ID NO: 1132120 - RNA, 21 nt, Human
cugagcaaaucucauuacuaa

SEQ ID NO: 1132121 - RNA, 20 nt, Human
cuggaugucugcaucagggc

SEQ ID NO: 1132122 - RNA, 22 nt, Human
ucugcaucagggcugcugaggc

SEQ ID NO: 1132123 - RNA, 18 nt, Human
ugacuacgcugcugagca

SEQ ID NO: 1132124 - RNA, 23 nt, Human
ugagaaugcaccacacagcugac

SEQ ID NO: 1132125 - RNA, 28 nt, Human
aagcacuccagaaaacugaggagaaaag

SEQ ID NO: 1132126 - RNA, 18 nt, Human
aagccccccgacacacuc

SEQ ID NO: 1132127 - RNA, 19 nt, Human
aagccgccaagccccccga

SEQ ID NO: 1132128 - RNA, 19 nt, Human
acucaccauccgcaaccgg

SEQ ID NO: 1132129 - RNA, 20 nt, Human
acuccagaaaacugaggaga

SEQ ID NO: 1132130 - RNA, 24 nt, Human
acuccagaaaacugaggagaaaag

SEQ ID NO: 1132131 - RNA, 21 nt, Human
agaggaaagggagugcuagag

SEQ ID NO: 1132132 - RNA, 20 nt, Human
aggcucccagagacaccagu

SEQ ID NO: 1132133 - RNA, 20 nt, Human
auaaauuacuccucagagaa

SEQ ID NO: 1132134 - RNA, 18 nt, Human
caaagcacuccagaaaac

SEQ ID NO: 1132135 - RNA, 20 nt, Human
caaccggaacgcggaagcaa

SEQ ID NO: 1132136 - RNA, 22 nt, Human
ccaacacugcuggucauggcac

SEQ ID NO: 1132137 - RNA, 18 nt, Human
cccugcacacugcccggc

SEQ ID NO: 1132138 - RNA, 19 nt, Human
cccugcacacugcccggca

SEQ ID NO: 1132139 - RNA, 19 nt, Human
cccugcacacugcccggca

SEQ ID NO: 1132140 - RNA, 22 nt, Human
cccugcuggcucuccauauggg

SEQ ID NO: 1132141 - RNA, 18 nt, Human
cggagaacucccagaccc

SEQ ID NO: 1132142 - RNA, 21 nt, Human
cuccaaagcacuccagaaaac

SEQ ID NO: 1132143 - RNA, 22 nt, Human
gacaccaguaaauaaaugggag

SEQ ID NO: 1132144 - RNA, 18 nt, Human
gacccuaggggaucuggg

SEQ ID NO: 1132145 - RNA, 21 nt, Human
gcaaccggaacgcggaagcaa

SEQ ID NO: 1132146 - RNA, 19 nt, Human
ggaggguagggaaagggau

SEQ ID NO: 1132147 - RNA, 21 nt, Human
ggaucuggguggccaccaaca

SEQ ID NO: 1132148 - RNA, 19 nt, Human
uaaggaaaggcucccagag

SEQ ID NO: 1132149 - RNA, 19 nt, Human
uagcccagucagucagcgg

SEQ ID NO: 1132150 - RNA, 26 nt, Human
uccaaagcacuccagaaaacugagga

SEQ ID NO: 1132151 - RNA, 22 nt, Human
uccgcaaccggaacgcggaagc

SEQ ID NO: 1132152 - RNA, 23 nt, Human
ugaggagaaaagccgccaagccc

SEQ ID NO: 1132153 - RNA, 19 nt, Human
ugaggcaagggagcugggc

SEQ ID NO: 1132154 - RNA, 21 nt, Human
ugaggcaagggagcugggcuc

SEQ ID NO: 1132155 - RNA, 23 nt, Human
ugccagccuuuaaccucaaagca

SEQ ID NO: 1132156 - RNA, 18 nt, Human
uggccaagaggacggaga

SEQ ID NO: 1132157 - RNA, 21 nt, Human
uggcucuccauaugggcugac

SEQ ID NO: 1132158 - RNA, 19 nt, Human
ugggcuuuugacucguagc

SEQ ID NO: 1132159 - RNA, 18 nt, Human
uggucauggcacagcacc

SEQ ID NO: 1132160 - RNA, 18 nt, Human
aaaaagagaggacuugaa

SEQ ID NO: 1132161 - RNA, 21 nt, Human
acaaagcacuaggaaauguca

SEQ ID NO: 1132162 - RNA, 23 nt, Human
agaagaagacaguccagugguga

SEQ ID NO: 1132163 - RNA, 18 nt, Human
agagaucaauuauuguca

SEQ ID NO: 1132164 - RNA, 21 nt, Human
agauagucgagauaggagaac

SEQ ID NO: 1132165 - RNA, 18 nt, Human
agauuauccauucucagc

SEQ ID NO: 1132166 - RNA, 23 nt, Human
agcuguauauuuuucaaagguuu

SEQ ID NO: 1132167 - RNA, 26 nt, Human
caauguuuguuugauauuggaaccug

SEQ ID NO: 1132168 - RNA, 23 nt, Human
cucacaaagcacuaggaaauguc

SEQ ID NO: 1132169 - RNA, 22 nt, Human
gaaaaugguccaagucuccuca

SEQ ID NO: 1132170 - RNA, 20 nt, Human
gaagaagacaguccaguggg

SEQ ID NO: 1132171 - RNA, 22 nt, Human
gaaguagcuaugcgaaaauuua

SEQ ID NO: 1132172 - RNA, 22 nt, Human
ggaauaaaagagcuggaaaaaa

SEQ ID NO: 1132173 - RNA, 20 nt, Human
gguaacaaagauagucgaga

SEQ ID NO: 1132174 - RNA, 18 nt, Human
gucucaaucuggcucugg

SEQ ID NO: 1132175 - RNA, 18 nt, Human
guuucugacauagcaaug

SEQ ID NO: 1132176 - RNA, 23 nt, Human
uaaaagagauuaaaaaugcggua

SEQ ID NO: 1132177 - RNA, 21 nt, Human
uaccuucaacucagguuguuc

SEQ ID NO: 1132178 - RNA, 18 nt, Human
uaggagaaugugggauau

SEQ ID NO: 1132179 - RNA, 19 nt, Human
uaguccagagcaugggcag

SEQ ID NO: 1132180 - RNA, 23 nt, Human
uauuauggaauacugcagugaga

SEQ ID NO: 1132181 - RNA, 22 nt, Human
ucauguuuaggagaauguggga

SEQ ID NO: 1132182 - RNA, 21 nt, Human
ucauuugggauaaugaaagug

SEQ ID NO: 1132183 - RNA, 20 nt, Human
ugaggauaacagguaacaaa

SEQ ID NO: 1132184 - RNA, 19 nt, Human
ugggcaauacauuuuuguu

SEQ ID NO: 1132185 - RNA, 23 nt, Human
uguauacauuaacaguucaugua

SEQ ID NO: 1132186 - RNA, 20 nt, Human
ugugggauauggggaagggg

SEQ ID NO: 1132187 - RNA, 19 nt, Human
uguuuaggagaauguggga

SEQ ID NO: 1132188 - RNA, 18 nt, Human
uuaauccaagccuauuau

SEQ ID NO: 1132189 - RNA, 29 nt, Human
uucucugcuguuacguaaguuuuccgauu

SEQ ID NO: 1132190 - RNA, 19 nt, Human
uugcugcccauugucccug

SEQ ID NO: 1132191 - RNA, 20 nt, Human
uuuuguuugauuuuuagguc

SEQ ID NO: 1132192 - RNA, 24 nt, Human
aaagcaaaagccuguuuuuuuucu

SEQ ID NO: 1132193 - RNA, 26 nt, Human
aaagcaaaagccuguuuuuuuucuug

SEQ ID NO: 1132194 - RNA, 22 nt, Human
accacccccaccaccaccaccc

SEQ ID NO: 1132195 - RNA, 19 nt, Human
acccccaccaccaccccca

SEQ ID NO: 1132196 - RNA, 23 nt, Human
accucuaccuccucgcccuccau

SEQ ID NO: 1132197 - RNA, 18 nt, Human
acugcagaaguaguaucc

SEQ ID NO: 1132198 - RNA, 22 nt, Human
agcagccccacgaccucuggau

SEQ ID NO: 1132199 - RNA, 20 nt, Human
agcagccgccuuuccccuuc

SEQ ID NO: 1132200 - RNA, 19 nt, Human
agccccuaaccuccuccag

SEQ ID NO: 1132201 - RNA, 21 nt, Human
agccccuaaccuccuccagcu

SEQ ID NO: 1132202 - RNA, 18 nt, Human
aggaucagcccauucaac

SEQ ID NO: 1132203 - RNA, 20 nt, Human
auagagcccacaaaaagccu

SEQ ID NO: 1132204 - RNA, 20 nt, Human
aucccccccuuuccuuuccc

SEQ ID NO: 1132205 - RNA, 21 nt, Human
aucccccccuuuccuuucccu

SEQ ID NO: 1132206 - RNA, 23 nt, Human
aucucacucaccaaaaugaauga

SEQ ID NO: 1132207 - RNA, 18 nt, Human
caagaaagcaaaagccug

SEQ ID NO: 1132208 - RNA, 21 nt, Human
caccaccaccacccucugucu

SEQ ID NO: 1132209 - RNA, 26 nt, Human
caccaccacccccaccaccaccaccc

SEQ ID NO: 1132210 - RNA, 20 nt, Human
caccacccccaccaccaccc

SEQ ID NO: 1132211 - RNA, 23 nt, Human
caccacccccaccaccaccccca

SEQ ID NO: 1132212 - RNA, 20 nt, Human
cacccccaccaccaccaccc

SEQ ID NO: 1132213 - RNA, 22 nt, Human
cacccccaccaccacccccacc

SEQ ID NO: 1132214 - RNA, 20 nt, Human
caccccuucucuagcuccaa

SEQ ID NO: 1132215 - RNA, 24 nt, Human
cacucacucacucccucagccccu

SEQ ID NO: 1132216 - RNA, 21 nt, Human
cacucacucccucagccccua

SEQ ID NO: 1132217 - RNA, 23 nt, Human
cacucauuaaccuacgccuugcc

SEQ ID NO: 1132218 - RNA, 21 nt, Human
cacucauuccaguuucccaac

SEQ ID NO: 1132219 - RNA, 22 nt, Human
cacuccccucugcgguagcuca

SEQ ID NO: 1132220 - RNA, 19 nt, Human
cacucccucagccccuaac

SEQ ID NO: 1132221 - RNA, 23 nt, Human
cacuuuuguucugaacacgagag

SEQ ID NO: 1132222 - RNA, 23 nt, Human
cagccccuaaccuccuccagcuc

SEQ ID NO: 1132223 - RNA, 25 nt, Human
cagccccuaaccuccuccagcuccu

SEQ ID NO: 1132224 - RNA, 21 nt, Human
cagcuccuccuucuccccccc

SEQ ID NO: 1132225 - RNA, 21 nt, Human
cagcuccuccuucucccccua

SEQ ID NO: 1132226 - RNA, 19 nt, Human
cauaaccaccucuaccucc

SEQ ID NO: 1132227 - RNA, 21 nt, Human
cauaggaucagcccauucaac

SEQ ID NO: 1132228 - RNA, 20 nt, Human
cauauccauaauaaucugga

SEQ ID NO: 1132229 - RNA, 24 nt, Human
ccaaagaucuccccguuggacuga

SEQ ID NO: 1132230 - RNA, 23 nt, Human
ccaccacccccaccaccaccacc

SEQ ID NO: 1132231 - RNA, 22 nt, Human
ccaccacccccaccaccacccc

SEQ ID NO: 1132232 - RNA, 26 nt, Human
ccaccacccccaccaccacccccacc

SEQ ID NO: 1132233 - RNA, 21 nt, Human
ccacucgucuccgagcgcgcu

SEQ ID NO: 1132234 - RNA, 23 nt, Human
ccagcaucaagcaaugucugaaa

SEQ ID NO: 1132235 - RNA, 21 nt, Human
ccaguuucccaaacugacuaa

SEQ ID NO: 1132236 - RNA, 18 nt, Human
cccaccaccaccacccuc

SEQ ID NO: 1132237 - RNA, 23 nt, Human
cccaccaccaccacccucugucu

SEQ ID NO: 1132238 - RNA, 18 nt, Human
cccaccaccacccccacc

SEQ ID NO: 1132239 - RNA, 26 nt, Human
cccagaccuugacuuuaccacucauu

SEQ ID NO: 1132240 - RNA, 25 nt, Human
ccccaccaccaccacccucugucug

SEQ ID NO: 1132241 - RNA, 20 nt, Human
ccccacuguucccacucccc

SEQ ID NO: 1132242 - RNA, 23 nt, Human
ccccacuguucccacuccccucu

SEQ ID NO: 1132243 - RNA, 18 nt, Human
cccccccccccuuuaccc

SEQ ID NO: 1132244 - RNA, 21 nt, Human
cccccccccccuuuaccccac

SEQ ID NO: 1132245 - RNA, 19 nt, Human
ccccccccccuuuacccca

SEQ ID NO: 1132246 - RNA, 19 nt, Human
cccccccccuuuaccccac

SEQ ID NO: 1132247 - RNA, 22 nt, Human
ccccccuuuaccccacuguucc

SEQ ID NO: 1132248 - RNA, 21 nt, Human
ccccccuuuccuuucccuucc

SEQ ID NO: 1132249 - RNA, 21 nt, Human
ccccuucucuagcuccaacuu

SEQ ID NO: 1132250 - RNA, 18 nt, Human
ccccuugcuccucuacca

SEQ ID NO: 1132251 - RNA, 23 nt, Human
cccuccaagucuuuaccauucau

SEQ ID NO: 1132252 - RNA, 20 nt, Human
ccgaagcucacgccgcugac

SEQ ID NO: 1132253 - RNA, 22 nt, Human
ccgcccccccccccuuuacccc

SEQ ID NO: 1132254 - RNA, 27 nt, Human
ccuccagcuccuccuucucgggccgcc

SEQ ID NO: 1132255 - RNA, 20 nt, Human
ccuccaucucuuguuggagg

SEQ ID NO: 1132256 - RNA, 21 nt, Human
ccuuucuuauucccgcccccc

SEQ ID NO: 1132257 - RNA, 23 nt, Human
cgcuucacucacucacucccuca

SEQ ID NO: 1132258 - RNA, 27 nt, Human
cgugaucccccccuuuccuuucccuuc

SEQ ID NO: 1132259 - RNA, 19 nt, Human
cgugcucgcugcucccugu

SEQ ID NO: 1132260 - RNA, 22 nt, Human
cuaaaugccuuuucuaaaaucu

SEQ ID NO: 1132261 - RNA, 21 nt, Human
cuaccaccccuucucuagcuc

SEQ ID NO: 1132262 - RNA, 23 nt, Human
cucagccccuaaccuccuccagc

SEQ ID NO: 1132263 - RNA, 22 nt, Human
cuccaagucuuuaccauucauu

SEQ ID NO: 1132264 - RNA, 20 nt, Human
cucccccuaccaccaccccc

SEQ ID NO: 1132265 - RNA, 20 nt, Human
cucccccuaccaccaccccc

SEQ ID NO: 1132266 - RNA, 21 nt, Human
cucccccuaccaccaccccca

SEQ ID NO: 1132267 - RNA, 23 nt, Human
cucccccuaccaccacccccacc

SEQ ID NO: 1132268 - RNA, 25 nt, Human
cucccccuaccaccacccccaccac

SEQ ID NO: 1132269 - RNA, 19 nt, Human
cucuaccuccucgcccucc

SEQ ID NO: 1132270 - RNA, 19 nt, Human
cucucggccuuucuuauuc

SEQ ID NO: 1132271 - RNA, 24 nt, Human
cucucugugaauaaccggcucuac

SEQ ID NO: 1132272 - RNA, 19 nt, Human
cugucugccuucucucggc

SEQ ID NO: 1132273 - RNA, 25 nt, Human
cuugcgcgcgccccugcgugauccc

SEQ ID NO: 1132274 - RNA, 20 nt, Human
cuuuaccacucauuaaccua

SEQ ID NO: 1132275 - RNA, 20 nt, Human
cuuuccuuuucugauuuggu

SEQ ID NO: 1132276 - RNA, 23 nt, Human
gaacugccaaugcaccgucuuca

SEQ ID NO: 1132277 - RNA, 18 nt, Human
gagcagcaccccuugcuc

SEQ ID NO: 1132278 - RNA, 21 nt, Human
gagcagccgccuuuccccuuc

SEQ ID NO: 1132279 - RNA, 22 nt, Human
gcccccccccccuuuaccccac

SEQ ID NO: 1132280 - RNA, 24 nt, Human
gcuucacucacucacucccucagc

SEQ ID NO: 1132281 - RNA, 19 nt, Human
gggaagagcagccccacga

SEQ ID NO: 1132282 - RNA, 18 nt, Human
guugggcaccuccucucg

SEQ ID NO: 1132283 - RNA, 19 nt, Human
uaaccuccuccagcuccuc

SEQ ID NO: 1132284 - RNA, 22 nt, Human
uaauaguaguaaucgucauaca

SEQ ID NO: 1132285 - RNA, 23 nt, Human
uaccaccacccccaccaccaccc

SEQ ID NO: 1132286 - RNA, 23 nt, Human
uaccacggggaagagcagcccca

SEQ ID NO: 1132287 - RNA, 21 nt, Human
uagcucaggcacgagcagccg

SEQ ID NO: 1132288 - RNA, 21 nt, Human
uaggaucagcccauucaacag

SEQ ID NO: 1132289 - RNA, 22 nt, Human
uauuuucucccuccaagucuuu

SEQ ID NO: 1132290 - RNA, 19 nt, Human
ucacucacucccucagccc

SEQ ID NO: 1132291 - RNA, 23 nt, Human
ucacucauuccaguuucccaaac

SEQ ID NO: 1132292 - RNA, 20 nt, Human
ucagcaacuuucugugauaa

SEQ ID NO: 1132293 - RNA, 20 nt, Human
ucagcccauucaacaguucc

SEQ ID NO: 1132294 - RNA, 19 nt, Human
ucaggcacgagcagccgcc

SEQ ID NO: 1132295 - RNA, 24 nt, Human
ucauaaccauaguauggaucuuca

SEQ ID NO: 1132296 - RNA, 20 nt, Human
uccaacauucccccagaccu

SEQ ID NO: 1132297 - RNA, 18 nt, Human
uccagcuccuccuucucc

SEQ ID NO: 1132298 - RNA, 23 nt, Human
uccauagccuugacagcaccauc

SEQ ID NO: 1132299 - RNA, 22 nt, Human
ucccaaacugacuaaaugccuu

SEQ ID NO: 1132300 - RNA, 23 nt, Human
ucccccagaccuugacuuuacca

SEQ ID NO: 1132301 - RNA, 19 nt, Human
ucccuccaagucuuuacca

SEQ ID NO: 1132302 - RNA, 25 nt, Human
ucccuccaagucuuuaccauucauu

SEQ ID NO: 1132303 - RNA, 21 nt, Human
uccgaugguaccagguugcaa

SEQ ID NO: 1132304 - RNA, 18 nt, Human
uccuugguuuuaacucuu

SEQ ID NO: 1132305 - RNA, 23 nt, Human
ucuccccguuggacugaggggga

SEQ ID NO: 1132306 - RNA, 19 nt, Human
ucuguaagacccucuguua

SEQ ID NO: 1132307 - RNA, 18 nt, Human
ucugugaauaaccggcuc

SEQ ID NO: 1132308 - RNA, 20 nt, Human
ucuucaguaucauuuccauu

SEQ ID NO: 1132309 - RNA, 24 nt, Human
ucuucauauccaccacgauaguua

SEQ ID NO: 1132310 - RNA, 21 nt, Human
ucuuguuggagggggcauaua

SEQ ID NO: 1132311 - RNA, 19 nt, Human
ugaauggauaacugcagaa

SEQ ID NO: 1132312 - RNA, 24 nt, Human
ugacagcaaacccuauccaguucc

SEQ ID NO: 1132313 - RNA, 23 nt, Human
ugaucuucauauucaagaaagca

SEQ ID NO: 1132314 - RNA, 23 nt, Human
ugccugggcagcuguuuugugau

SEQ ID NO: 1132315 - RNA, 19 nt, Human
ugcuugcgcgcgccccugc

SEQ ID NO: 1132316 - RNA, 18 nt, Human
uggaggauauccauaacc

SEQ ID NO: 1132317 - RNA, 18 nt, Human
ugucuggcgcgaguggag

SEQ ID NO: 1132318 - RNA, 21 nt, Human
uuaaagcuucaauagcucuuu

SEQ ID NO: 1132319 - RNA, 18 nt, Human
uuaacauguucuguagcc

SEQ ID NO: 1132320 - RNA, 22 nt, Human
uuaccccacuguucccacuccc

SEQ ID NO: 1132321 - RNA, 21 nt, Human
uucagcaacuuucugugauaa

SEQ ID NO: 1132322 - RNA, 19 nt, Human
uucauaaccauaguaugga

SEQ ID NO: 1132323 - RNA, 25 nt, Human
uucccgcccccccccccuuuacccc

SEQ ID NO: 1132324 - RNA, 20 nt, Human
uugaaaaucuucauaaccau

SEQ ID NO: 1132325 - RNA, 22 nt, Human
uugcuccucuaccaccccuucu

SEQ ID NO: 1132326 - RNA, 21 nt, Human
uuuuucuugucauccgguugg

SEQ ID NO: 1132327 - RNA, 22 nt, Human
cacaaccugguaucacuauacc

SEQ ID NO: 1132328 - RNA, 22 nt, Human
cacuauaccacacgcuagcucu

SEQ ID NO: 1132329 - RNA, 18 nt, Human
ccacacgcuagcucuugg

SEQ ID NO: 1132330 - RNA, 19 nt, Human
uccccagugcagaagggau

SEQ ID NO: 1132331 - RNA, 21 nt, Human
ucuuucuuucuuuuuuuugaa

SEQ ID NO: 1132332 - RNA, 19 nt, Human
ucuuuuuuuugagacagag

SEQ ID NO: 1132333 - RNA, 22 nt, Human
ugagaaugccucauuuuuucuu

SEQ ID NO: 1132334 - RNA, 23 nt, Human
uucuuucuuucuuuuuuuugaga

SEQ ID NO: 1132335 - RNA, 21 nt, Human
uucuuuuuuuugagacagagg

SEQ ID NO: 1132336 - RNA, 23 nt, Human
uucuuuuuuuugagacagaggug

SEQ ID NO: 1132337 - RNA, 18 nt, Human
uugagacagaggugaauu

SEQ ID NO: 1132338 - RNA, 19 nt, Human
agaagacacugaacucucc

SEQ ID NO: 1132339 - RNA, 19 nt, Human
agggugguggggggcagca

SEQ ID NO: 1132340 - RNA, 23 nt, Human
agggugguggggggcagcaauga

SEQ ID NO: 1132341 - RNA, 19 nt, Human
agucagggggcuccuaaga

SEQ ID NO: 1132342 - RNA, 22 nt, Human
cacugaacucucccggaagaga

SEQ ID NO: 1132343 - RNA, 20 nt, Human
cagaagacacugaacucucc

SEQ ID NO: 1132344 - RNA, 20 nt, Human
ccccagaggguggugggggg

SEQ ID NO: 1132345 - RNA, 23 nt, Human
cggaagagaugaauccaaaggca

SEQ ID NO: 1132346 - RNA, 24 nt, Human
gacacugaacucucccggaagaga

SEQ ID NO: 1132347 - RNA, 23 nt, Human
ggcacugauuuuggaagucaggg

SEQ ID NO: 1132348 - RNA, 21 nt, Human
gugguggggggcagcaaugag

SEQ ID NO: 1132349 - RNA, 23 nt, Human
acagugcugcacauggggguugg

SEQ ID NO: 1132350 - RNA, 18 nt, Human
cagacagugcugcacaug

SEQ ID NO: 1132351 - RNA, 20 nt, Human
ccaagaaugccucagccacc

SEQ ID NO: 1132352 - RNA, 21 nt, Human
cccaagaaugccucagccacc

SEQ ID NO: 1132353 - RNA, 18 nt, Human
gaaaagaugguggagagg

SEQ ID NO: 1132354 - RNA, 25 nt, Human
guccagacagugcugcacauggggg

SEQ ID NO: 1132355 - RNA, 20 nt, Human
gugaaaagaugguggagagg

SEQ ID NO: 1132356 - RNA, 22 nt, Human
gugaaaagaugguggagagggc

SEQ ID NO: 1132357 - RNA, 24 nt, Human
uauugggauuaacacuugugaaaa

SEQ ID NO: 1132358 - RNA, 22 nt, Human
ugcuauguggcccaagaaugcc

SEQ ID NO: 1132359 - RNA, 19 nt, Human
uggcccaagaaugccucag

SEQ ID NO: 1132360 - RNA, 18 nt, Human
aaaauagcauuagaaggc

SEQ ID NO: 1132361 - RNA, 20 nt, Human
aaaguucuagggguaggaug

SEQ ID NO: 1132362 - RNA, 20 nt, Human
aaauaucgauggucaacacu

SEQ ID NO: 1132363 - RNA, 18 nt, Human
aaauuauaaaacauggca

SEQ ID NO: 1132364 - RNA, 24 nt, Human
aacagaacacaagaugguacacca

SEQ ID NO: 1132365 - RNA, 19 nt, Human
aacauuuguugaaccccuu

SEQ ID NO: 1132366 - RNA, 22 nt, Human
acaacauaaaacaaaacauagg

SEQ ID NO: 1132367 - RNA, 21 nt, Human
acaccgaagauaaccagacau

SEQ ID NO: 1132368 - RNA, 25 nt, Human
acacucggcucugugacucugcuuc

SEQ ID NO: 1132369 - RNA, 23 nt, Human
acagaacacaagaugguacacca

SEQ ID NO: 1132370 - RNA, 24 nt, Human
acagaacacaagaugguacaccau

SEQ ID NO: 1132371 - RNA, 24 nt, Human
agaaggcagaacuaauguuuauau

SEQ ID NO: 1132372 - RNA, 25 nt, Human
agacagaaacagaagccacaugugg

SEQ ID NO: 1132373 - RNA, 19 nt, Human
agcucauccucuuccuuca

SEQ ID NO: 1132374 - RNA, 20 nt, Human
aggcacacggugcaggucau

SEQ ID NO: 1132375 - RNA, 22 nt, Human
agggaagaggggucuacgguuc

SEQ ID NO: 1132376 - RNA, 23 nt, Human
auaaaacaaaacauaggcguauu

SEQ ID NO: 1132377 - RNA, 24 nt, Human
auacgacauauaagcauguauaca

SEQ ID NO: 1132378 - RNA, 19 nt, Human
caaaauagcauuagaaggc

SEQ ID NO: 1132379 - RNA, 22 nt, Human
caccaggccaggagacuuggac

SEQ ID NO: 1132380 - RNA, 18 nt, Human
cacggugcaggucauccu

SEQ ID NO: 1132381 - RNA, 25 nt, Human
cagaacuaauguuuauauguacaaa

SEQ ID NO: 1132382 - RNA, 18 nt, Human
cagaagccacauguggga

SEQ ID NO: 1132383 - RNA, 23 nt, Human
caggggaggcugggacgcagaca

SEQ ID NO: 1132384 - RNA, 19 nt, Human
cagguuagaauaaaucugc

SEQ ID NO: 1132385 - RNA, 23 nt, Human
caugugaacaugagggcagagac

SEQ ID NO: 1132386 - RNA, 18 nt, Human
ccacaugugggaggaaau

SEQ ID NO: 1132387 - RNA, 19 nt, Human
ccaggaagugaaugcaaua

SEQ ID NO: 1132388 - RNA, 22 nt, Human
cccacaccuugaucucagacuu

SEQ ID NO: 1132389 - RNA, 19 nt, Human
cccuuaggcugcuggagcu

SEQ ID NO: 1132390 - RNA, 22 nt, Human
ccuacagugguuauauauucuu

SEQ ID NO: 1132391 - RNA, 24 nt, Human
ccuaccucccuccucuccugauuu

SEQ ID NO: 1132392 - RNA, 20 nt, Human
ccuccuaccucccuccucuc

SEQ ID NO: 1132393 - RNA, 24 nt, Human
ccuccuaccucccuccucuccuga

SEQ ID NO: 1132394 - RNA, 18 nt, Human
ccugcaaaccacccggag

SEQ ID NO: 1132395 - RNA, 21 nt, Human
cgacauauaagcauguauaca

SEQ ID NO: 1132396 - RNA, 18 nt, Human
cuaccucccuccucuccu

SEQ ID NO: 1132397 - RNA, 21 nt, Human
cucugcuucagaggauagccc

SEQ ID NO: 1132398 - RNA, 26 nt, Human
cucugcuucagaggauagcccuuagg

SEQ ID NO: 1132399 - RNA, 21 nt, Human
cugcaaaccacccggagcugc

SEQ ID NO: 1132400 - RNA, 20 nt, Human
cugcccagagacagaaacag

SEQ ID NO: 1132401 - RNA, 19 nt, Human
cuuucauccuacagugguu

SEQ ID NO: 1132402 - RNA, 18 nt, Human
gaaauaacuuacaccgaa

SEQ ID NO: 1132403 - RNA, 22 nt, Human
gaaggaaccagcccugcccaca

SEQ ID NO: 1132404 - RNA, 24 nt, Human
gagagccaugugaacaugagggca

SEQ ID NO: 1132405 - RNA, 25 nt, Human
gagagccaugugaacaugagggcag

SEQ ID NO: 1132406 - RNA, 19 nt, Human
gauucugucucccuuuugc

SEQ ID NO: 1132407 - RNA, 19 nt, Human
gcagugagcguuuacugag

SEQ ID NO: 1132408 - RNA, 22 nt, Human
ggagagccugggcagaggcccu

SEQ ID NO: 1132409 - RNA, 21 nt, Human
gggacgcagacacacacacac

SEQ ID NO: 1132410 - RNA, 20 nt, Human
gguacuuuguugcagcagcc

SEQ ID NO: 1132411 - RNA, 22 nt, Human
gugcauuaaaggcacacggugc

SEQ ID NO: 1132412 - RNA, 25 nt, Human
uaaaacaacauuuguugaacccccc

SEQ ID NO: 1132413 - RNA, 20 nt, Human
uaaaacuagaagucaaaacc

SEQ ID NO: 1132414 - RNA, 21 nt, Human
uaacuaaagauucugucuccc

SEQ ID NO: 1132415 - RNA, 23 nt, Human
uaacuuacaccgaagauaaccag

SEQ ID NO: 1132416 - RNA, 23 nt, Human
uacaaaaugucacauacgacaua

SEQ ID NO: 1132417 - RNA, 19 nt, Human
uacaccaucugaauguaag

SEQ ID NO: 1132418 - RNA, 22 nt, Human
uacaccgaagauaaccagacau

SEQ ID NO: 1132419 - RNA, 20 nt, Human
uacacucggcucugugacuc

SEQ ID NO: 1132420 - RNA, 20 nt, Human
uacgguucaguucucaagac

SEQ ID NO: 1132421 - RNA, 19 nt, Human
uaguuaagaugaggcccua

SEQ ID NO: 1132422 - RNA, 18 nt, Human
uauaagcauguauacaua

SEQ ID NO: 1132423 - RNA, 18 nt, Human
uaucagaguaauaguagu

SEQ ID NO: 1132424 - RNA, 26 nt, Human
uauguacaaaaugucacauacggugu

SEQ ID NO: 1132425 - RNA, 26 nt, Human
ucauuuaugcaugguugugcuauuuc

SEQ ID NO: 1132426 - RNA, 25 nt, Human
ucccugcaaaccuaugaguaggauu

SEQ ID NO: 1132427 - RNA, 19 nt, Human
ucuaagugcauuaaaggca

SEQ ID NO: 1132428 - RNA, 22 nt, Human
ucuacgguucaguucucaagac

SEQ ID NO: 1132429 - RNA, 19 nt, Human
ucuagggguaggauggcag

SEQ ID NO: 1132430 - RNA, 21 nt, Human
ucuagggguaggauggcaggg

SEQ ID NO: 1132431 - RNA, 21 nt, Human
ucuagggguaggauggcaggg

SEQ ID NO: 1132432 - RNA, 23 nt, Human
ucuagggguaggauggcaggguc

SEQ ID NO: 1132433 - RNA, 23 nt, Human
ucuccagacagcugcagaggcuu

SEQ ID NO: 1132434 - RNA, 25 nt, Human
ucugucucccuuuugcugacucucc

SEQ ID NO: 1132435 - RNA, 22 nt, Human
ugaacaugagggcagagacugg

SEQ ID NO: 1132436 - RNA, 18 nt, Human
ugaaguaagcaccaggcc

SEQ ID NO: 1132437 - RNA, 19 nt, Human
ugacagggaagaggggucu

SEQ ID NO: 1132438 - RNA, 23 nt, Human
ugaggaaguaaaacaacauuugu

SEQ ID NO: 1132439 - RNA, 19 nt, Human
uggcaaguaaauuguagca

SEQ ID NO: 1132440 - RNA, 22 nt, Human
uggcaaguaaauuguagcauuu

SEQ ID NO: 1132441 - RNA, 22 nt, Human
uggcagugagcguuuacugagg

SEQ ID NO: 1132442 - RNA, 18 nt, Human
ugggaggaaauaucgaug

SEQ ID NO: 1132443 - RNA, 19 nt, Human
uggucaacacugacaggga

SEQ ID NO: 1132444 - RNA, 21 nt, Human
uguauacauaaagcugguaua

SEQ ID NO: 1132445 - RNA, 24 nt, Human
ugucacauacgacauauaagcaug

SEQ ID NO: 1132446 - RNA, 20 nt, Human
ugucagacaauuuuccagug

SEQ ID NO: 1132447 - RNA, 20 nt, Human
uguggaacucaggucugggg

SEQ ID NO: 1132448 - RNA, 26 nt, Human
uguuacauaagaaauaaacaacauaa

SEQ ID NO: 1132449 - RNA, 23 nt, Human
uuacaccgaagauaaccagacau

SEQ ID NO: 1132450 - RNA, 19 nt, Human
uuccccuccaacgugcagc

SEQ ID NO: 1132451 - RNA, 23 nt, Human
uuuaugcaugguugugcuauuuc

SEQ ID NO: 1132452 - RNA, 26 nt, Human
aaacucacaacuaccauccucaucug

SEQ ID NO: 1132453 - RNA, 22 nt, Human
aaagagaccauugacccaggac

SEQ ID NO: 1132454 - RNA, 22 nt, Human
aacccuggcuggccaagugacg

SEQ ID NO: 1132455 - RNA, 23 nt, Human
aagacuucaucccaaacucacaa

SEQ ID NO: 1132456 - RNA, 20 nt, Human
acaggguguguuucugggcc

SEQ ID NO: 1132457 - RNA, 19 nt, Human
accucugucuucgcccucg

SEQ ID NO: 1132458 - RNA, 20 nt, Human
acgggccugcaccuccacac

SEQ ID NO: 1132459 - RNA, 21 nt, Human
acucuucacucacuuagcaaa

SEQ ID NO: 1132460 - RNA, 22 nt, Human
acugccaaacccuggcuggcca

SEQ ID NO: 1132461 - RNA, 21 nt, Human
agacagggaggaggcaacaca

SEQ ID NO: 1132462 - RNA, 22 nt, Human
agacagggaggaggcaacacag

SEQ ID NO: 1132463 - RNA, 25 nt, Human
agacagggaggaggcaacacagggu

SEQ ID NO: 1132464 - RNA, 26 nt, Human
agacagggaggaggcaacacagggug

SEQ ID NO: 1132465 - RNA, 19 nt, Human
agauuccccacggaaccac

SEQ ID NO: 1132466 - RNA, 19 nt, Human
agccccaggucccuguggc

SEQ ID NO: 1132467 - RNA, 19 nt, Human
aggaggggaaagagaccau

SEQ ID NO: 1132468 - RNA, 18 nt, Human
aggcugaggaggaggaug

SEQ ID NO: 1132469 - RNA, 24 nt, Human
agucaugaaaauguggaagcacug

SEQ ID NO: 1132470 - RNA, 24 nt, Human
agugacaggcgacaggaauagaaa

SEQ ID NO: 1132471 - RNA, 22 nt, Human
augaagcccugagugagggcug

SEQ ID NO: 1132472 - RNA, 22 nt, Human
augcugugggcccagacacugc

SEQ ID NO: 1132473 - RNA, 23 nt, Human
augcugugggcccagacacugcu

SEQ ID NO: 1132474 - RNA, 19 nt, Human
caaaguugcagugccuuuc

SEQ ID NO: 1132475 - RNA, 27 nt, Human
caacaucauuuauuugacucuucacuc

SEQ ID NO: 1132476 - RNA, 19 nt, Human
caagagaaggaguaaccau

SEQ ID NO: 1132477 - RNA, 18 nt, Human
cagcuguguccaccacag

SEQ ID NO: 1132478 - RNA, 20 nt, Human
cagguacagaguucaacuga

SEQ ID NO: 1132479 - RNA, 24 nt, Human
caguacugggcacuguucacaguc

SEQ ID NO: 1132480 - RNA, 24 nt, Human
cauccucaucugaaccuuuggaag

SEQ ID NO: 1132481 - RNA, 24 nt, Human
ccaaacccuggcuggccaagugac

SEQ ID NO: 1132482 - RNA, 19 nt, Human
ccacacagguguuggcugc

SEQ ID NO: 1132483 - RNA, 19 nt, Human
ccccacggaaccaccaccu

SEQ ID NO: 1132484 - RNA, 23 nt, Human
ccccacggaaccaccaccuuccu

SEQ ID NO: 1132485 - RNA, 26 nt, Human
ccccuggagauccugcaucccagggg

SEQ ID NO: 1132486 - RNA, 18 nt, Human
ccguucuugccugcuccg

SEQ ID NO: 1132487 - RNA, 20 nt, Human
ccucaugagguggugagugc

SEQ ID NO: 1132488 - RNA, 19 nt, Human
ccugagugagggcuguggc

SEQ ID NO: 1132489 - RNA, 21 nt, Human
cgacaggaauagaaauccaca

SEQ ID NO: 1132490 - RNA, 25 nt, Human
cgacaggaauagaaauccacagaag

SEQ ID NO: 1132491 - RNA, 29 nt, Human
cucagcccuggccuacaguuccgguuccg

SEQ ID NO: 1132492 - RNA, 30 nt, Human
cuccagccccaggucccuguggcugggccu

SEQ ID NO: 1132493 - RNA, 20 nt, Human
cucucuccagccccaggucc

SEQ ID NO: 1132494 - RNA, 19 nt, Human
cugcccaucuugagcagag

SEQ ID NO: 1132495 - RNA, 19 nt, Human
cuggagauccugcauccca

SEQ ID NO: 1132496 - RNA, 20 nt, Human
cuggcuuauuuguuuuguaa

SEQ ID NO: 1132497 - RNA, 21 nt, Human
cugucuucgcccucgcugugg

SEQ ID NO: 1132498 - RNA, 21 nt, Human
cugugggcccagacacugcuc

SEQ ID NO: 1132499 - RNA, 21 nt, Human
cuuacaacauacuccagucac

SEQ ID NO: 1132500 - RNA, 25 nt, Human
cuuauuuguuuuguaaaaaaucugc

SEQ ID NO: 1132501 - RNA, 19 nt, Human
gacccaggacugcccuggc

SEQ ID NO: 1132502 - RNA, 19 nt, Human
gaccucugucuucgcccuc

SEQ ID NO: 1132503 - RNA, 19 nt, Human
gacucuucacucacuuagc

SEQ ID NO: 1132504 - RNA, 18 nt, Human
gagcagguuuaaauucgc

SEQ ID NO: 1132505 - RNA, 27 nt, Human
gaggaagaggaagagucagacagggag

SEQ ID NO: 1132506 - RNA, 19 nt, Human
gaggaggaggaugucacgg

SEQ ID NO: 1132507 - RNA, 21 nt, Human
gaggaggaggaugucacggug

SEQ ID NO: 1132508 - RNA, 18 nt, Human
gaguuuguuugggagcug

SEQ ID NO: 1132509 - RNA, 19 nt, Human
gcagauugccucucagaau

SEQ ID NO: 1132510 - RNA, 21 nt, Human
gcccuggccuacaguucuccu

SEQ ID NO: 1132511 - RNA, 22 nt, Human
gcccuggccuacaguucuccua

SEQ ID NO: 1132512 - RNA, 24 nt, Human
gcuccuaccuuggggacacuggug

SEQ ID NO: 1132513 - RNA, 21 nt, Human
ggaaaagaucuuucuaacaga

SEQ ID NO: 1132514 - RNA, 19 nt, Human
ggacauucacacaucagag

SEQ ID NO: 1132515 - RNA, 20 nt, Human
ggcugggccauaggagucgc

SEQ ID NO: 1132516 - RNA, 21 nt, Human
gggaacuuguuagaaagggaa

SEQ ID NO: 1132517 - RNA, 21 nt, Human
gggagcaggaggaagaggaag

SEQ ID NO: 1132518 - RNA, 18 nt, Human
guccucucucuccagccc

SEQ ID NO: 1132519 - RNA, 23 nt, Human
guugcagugccuuuccucaugaa

SEQ ID NO: 1132520 - RNA, 23 nt, Human
uaccuuggggacacuggugcccu

SEQ ID NO: 1132521 - RNA, 18 nt, Human
uacugggcacuguucaca

SEQ ID NO: 1132522 - RNA, 22 nt, Human
uagaaauccacagaagcucccc

SEQ ID NO: 1132523 - RNA, 19 nt, Human
uagcaaacauuuacugacc

SEQ ID NO: 1132524 - RNA, 22 nt, Human
uaucauugaccaaaguugcagu

SEQ ID NO: 1132525 - RNA, 24 nt, Human
uauuugacucuucacucacuuagc

SEQ ID NO: 1132526 - RNA, 22 nt, Human
ucaugaaaauguggaagcacug

SEQ ID NO: 1132527 - RNA, 23 nt, Human
uccccacggaaccaccaccuucc

SEQ ID NO: 1132528 - RNA, 18 nt, Human
uccucucucuccagcccc

SEQ ID NO: 1132529 - RNA, 19 nt, Human
uccucucucuccagcccca

SEQ ID NO: 1132530 - RNA, 21 nt, Human
uccugcaucccaggugcacuc

SEQ ID NO: 1132531 - RNA, 18 nt, Human
uccugcucaggccucuuc

SEQ ID NO: 1132532 - RNA, 23 nt, Human
ucugucuucgcccucgcuguggg

SEQ ID NO: 1132533 - RNA, 21 nt, Human
ucuugagcagagccgggcccu

SEQ ID NO: 1132534 - RNA, 18 nt, Human
ugagggcuguggcaacuu

SEQ ID NO: 1132535 - RNA, 23 nt, Human
ugauagguccccccuggagaucc

SEQ ID NO: 1132536 - RNA, 24 nt, Human
ugcacuagcuccuaccuuggggac

SEQ ID NO: 1132537 - RNA, 25 nt, Human
ugcacucagcccuggccuacaguuc

SEQ ID NO: 1132538 - RNA, 21 nt, Human
ugcaugaagcccugagugagg

SEQ ID NO: 1132539 - RNA, 19 nt, Human
ugcccuggcgugcaugaag

SEQ ID NO: 1132540 - RNA, 21 nt, Human
ugcuaucaggaagcacagcug

SEQ ID NO: 1132541 - RNA, 21 nt, Human
uggaagcacuggcuggaaguu

SEQ ID NO: 1132542 - RNA, 19 nt, Human
uggaagcauucaagagaag

SEQ ID NO: 1132543 - RNA, 22 nt, Human
uggaagcauucaagagaaggag

SEQ ID NO: 1132544 - RNA, 18 nt, Human
uggcuuauuuguuuugua

SEQ ID NO: 1132545 - RNA, 24 nt, Human
uggcuuauuuguuuuguaaaaaau

SEQ ID NO: 1132546 - RNA, 20 nt, Human
ugggagcuggucccagggag

SEQ ID NO: 1132547 - RNA, 21 nt, Human
ugucacgguguaggugcaggg

SEQ ID NO: 1132548 - RNA, 19 nt, Human
uucaagagaaggaguaacc

SEQ ID NO: 1132549 - RNA, 22 nt, Human
uucagguggugccugcacucag

SEQ ID NO: 1132550 - RNA, 20 nt, Human
uuccuugguugcucaguauu

SEQ ID NO: 1132551 - RNA, 18 nt, Human
uuugacucuucacucacu

SEQ ID NO: 1132552 - RNA, 24 nt, Human
aaaaagaagagggagugagcacag

SEQ ID NO: 1132553 - RNA, 18 nt, Human
aaaacaccaagaaccugg

SEQ ID NO: 1132554 - RNA, 22 nt, Human
aaaacaccaagaaccuggacaa

SEQ ID NO: 1132555 - RNA, 22 nt, Human
aaccuggacaacuugcagucaa

SEQ ID NO: 1132556 - RNA, 18 nt, Human
aagagggagugagcacag

SEQ ID NO: 1132557 - RNA, 18 nt, Human
aagcaggccgccacuuca

SEQ ID NO: 1132558 - RNA, 24 nt, Human
acugucgcccaggcuggagugcag

SEQ ID NO: 1132559 - RNA, 22 nt, Human
agaccaagaccgucuacugaua

SEQ ID NO: 1132560 - RNA, 21 nt, Human
agagacagagguauggggagu

SEQ ID NO: 1132561 - RNA, 25 nt, Human
agagagagacagagguauggggagu

SEQ ID NO: 1132562 - RNA, 18 nt, Human
agaggaaaaaaaagaaga

SEQ ID NO: 1132563 - RNA, 22 nt, Human
agaggaaaaaaaagaagaggga

SEQ ID NO: 1132564 - RNA, 20 nt, Human
agagggagugagcacaggug

SEQ ID NO: 1132565 - RNA, 18 nt, Human
aggaaaaaaaagaagagg

SEQ ID NO: 1132566 - RNA, 21 nt, Human
aggcucauccauugcacaucu

SEQ ID NO: 1132567 - RNA, 18 nt, Human
agggcacagcagagccug

SEQ ID NO: 1132568 - RNA, 20 nt, Human
caaaacaccaagaaccugga

SEQ ID NO: 1132569 - RNA, 22 nt, Human
caagaccaagaccgucuacuga

SEQ ID NO: 1132570 - RNA, 20 nt, Human
caccaaguggccaaugggaa

SEQ ID NO: 1132571 - RNA, 24 nt, Human
cacucaguaccuaccugaagucag

SEQ ID NO: 1132572 - RNA, 20 nt, Human
cacuggggccucacucagcu

SEQ ID NO: 1132573 - RNA, 20 nt, Human
cagcuccuccccaaauaggc

SEQ ID NO: 1132574 - RNA, 21 nt, Human
caggucagauacuucacagcc

SEQ ID NO: 1132575 - RNA, 21 nt, Human
caucaccuucuaugaccuagc

SEQ ID NO: 1132576 - RNA, 22 nt, Human
ccacagagcacuuuccagcaca

SEQ ID NO: 1132577 - RNA, 20 nt, Human
ccagagguuucuauggacuu

SEQ ID NO: 1132578 - RNA, 19 nt, Human
cccaggcuggagugcagca

SEQ ID NO: 1132579 - RNA, 20 nt, Human
cccccugggguagcuugggu

SEQ ID NO: 1132580 - RNA, 19 nt, Human
ccucacucagcuccucccc

SEQ ID NO: 1132581 - RNA, 19 nt, Human
cucacucagcuccucccca

SEQ ID NO: 1132582 - RNA, 18 nt, Human
cucuaaggggcauuugga

SEQ ID NO: 1132583 - RNA, 21 nt, Human
cugaaggcucauccauugcac

SEQ ID NO: 1132584 - RNA, 23 nt, Human
cugagaagacacccauuuuuaca

SEQ ID NO: 1132585 - RNA, 22 nt, Human
cuucauuuacaccgggugaaca

SEQ ID NO: 1132586 - RNA, 22 nt, Human
cuugcugccaacucuggcugca

SEQ ID NO: 1132587 - RNA, 21 nt, Human
cuuugggcaaugcaaucugcc

SEQ ID NO: 1132588 - RNA, 18 nt, Human
gacuugaguuuguucuca

SEQ ID NO: 1132589 - RNA, 29 nt, Human
gagagagaggaaaaaaaagaagagggagu

SEQ ID NO: 1132590 - RNA, 18 nt, Human
gagauagagugucacugu

SEQ ID NO: 1132591 - RNA, 18 nt, Human
gagccagcauuugaacug

SEQ ID NO: 1132592 - RNA, 24 nt, Human
gguauggggaguuggagggagaga

SEQ ID NO: 1132593 - RNA, 24 nt, Human
gucacugucgcccaggcuggagug

SEQ ID NO: 1132594 - RNA, 23 nt, Human
guccauguccucuuuccagcugg

SEQ ID NO: 1132595 - RNA, 23 nt, Human
gucugggacaucuuuaauuguuc

SEQ ID NO: 1132596 - RNA, 23 nt, Human
gugucacugucgcccaggcugga

SEQ ID NO: 1132597 - RNA, 23 nt, Human
uaccuaccugaagucagguacca

SEQ ID NO: 1132598 - RNA, 20 nt, Human
uagagugucacugucgccca

SEQ ID NO: 1132599 - RNA, 22 nt, Human
uagauccugagaagacacccau

SEQ ID NO: 1132600 - RNA, 23 nt, Human
uagauccugagaagacacccauu

SEQ ID NO: 1132601 - RNA, 22 nt, Human
uaggagcguaacuuuguaacuu

SEQ ID NO: 1132602 - RNA, 22 nt, Human
ucacuggggccucacucagcuc

SEQ ID NO: 1132603 - RNA, 20 nt, Human
ucacugucgcccaggcugga

SEQ ID NO: 1132604 - RNA, 18 nt, Human
ucagguaccaugugugca

SEQ ID NO: 1132605 - RNA, 24 nt, Human
ucccagauuaaacgggaggaacau

SEQ ID NO: 1132606 - RNA, 21 nt, Human
uccccaaauaggccuguccau

SEQ ID NO: 1132607 - RNA, 18 nt, Human
uccucugagcccccuggg

SEQ ID NO: 1132608 - RNA, 18 nt, Human
ucgcccaggcuggagugc

SEQ ID NO: 1132609 - RNA, 25 nt, Human
ucugccaccagugacaugcacucag

SEQ ID NO: 1132610 - RNA, 20 nt, Human
ucugggacaucuuuaauugu

SEQ ID NO: 1132611 - RNA, 24 nt, Human
ucuuugcuuucucucauuuggcac

SEQ ID NO: 1132612 - RNA, 18 nt, Human
ugaccuagccugggaacu

SEQ ID NO: 1132613 - RNA, 19 nt, Human
ugagcagagagagacagag

SEQ ID NO: 1132614 - RNA, 21 nt, Human
ugagcagagagagacagaggu

SEQ ID NO: 1132615 - RNA, 21 nt, Human
ugaggcagauuaacuugccca

SEQ ID NO: 1132616 - RNA, 27 nt, Human
ugaggcagauuaacuugcccaagauca

SEQ ID NO: 1132617 - RNA, 19 nt, Human
ugcacucaguaccuaccug

SEQ ID NO: 1132618 - RNA, 19 nt, Human
ugcaucaggucauagcaac

SEQ ID NO: 1132619 - RNA, 23 nt, Human
ugcgaaacugaaaauaccucuga

SEQ ID NO: 1132620 - RNA, 24 nt, Human
uggagugcagcagaugcgaaacug

SEQ ID NO: 1132621 - RNA, 20 nt, Human
uggcagagccagcauuugaa

SEQ ID NO: 1132622 - RNA, 22 nt, Human
uggccuaguccagguuuccuca

SEQ ID NO: 1132623 - RNA, 23 nt, Human
ugucacagcuuagugcuugcugc

SEQ ID NO: 1132624 - RNA, 22 nt, Human
ugucacugucgcccaggcugga

SEQ ID NO: 1132625 - RNA, 24 nt, Human
ugucacugucgcccaggcuggagu

SEQ ID NO: 1132626 - RNA, 19 nt, Human
uguucagacgccuuugggc

SEQ ID NO: 1132627 - RNA, 22 nt, Human
uucaagggugagcagagagaga

SEQ ID NO: 1132628 - RNA, 23 nt, Human
uucauuuucaauaaauaucuguu

SEQ ID NO: 1132629 - RNA, 22 nt, Human
uuccucugagcccccuggggua

SEQ ID NO: 1132630 - RNA, 20 nt, Human
uuccuugcuuugcugugcau

SEQ ID NO: 1132631 - RNA, 21 nt, Human
uugcagucaagaccaagaccg

SEQ ID NO: 1132632 - RNA, 22 nt, Human
uuuuugcucuuucauugcuuca

SEQ ID NO: 1132633 - RNA, 21 nt, Human
cguucugcuuucuguguuuca

SEQ ID NO: 1132634 - RNA, 18 nt, Human
gaacagaaggcguucugc

SEQ ID NO: 1132635 - RNA, 22 nt, Human
uccacaaacccuguguugugga

SEQ ID NO: 1132636 - RNA, 19 nt, Human
uguggaagaacagaaggcg

SEQ ID NO: 1132637 - RNA, 18 nt, Human
uucugcuuucuguguuuc

SEQ ID NO: 1132638 - RNA, 19 nt, Human
aaaauauggaaaacucaaa

SEQ ID NO: 1132639 - RNA, 19 nt, Human
uauggaaaacucaaaaaua

SEQ ID NO: 1132640 - RNA, 24 nt, Human
uauggaaaacucaaaaauaucuuc

SEQ ID NO: 1132641 - RNA, 19 nt, Human
uucaaaauauggaaaacuc

SEQ ID NO: 1132642 - RNA, 23 nt, Human
uucaaaauauggaaaacucaaaa

SEQ ID NO: 1132643 - RNA, 18 nt, Human
aacuagaaggagaagcug

SEQ ID NO: 1132644 - RNA, 22 nt, Human
aagggccccaaaacaucagccc

SEQ ID NO: 1132645 - RNA, 20 nt, Human
acaucugccuucucacucaa

SEQ ID NO: 1132646 - RNA, 20 nt, Human
accacugugaucugcaaagc

SEQ ID NO: 1132647 - RNA, 19 nt, Human
accucuuggagaugucagc

SEQ ID NO: 1132648 - RNA, 22 nt, Human
acucugccauuucaggcugcag

SEQ ID NO: 1132649 - RNA, 24 nt, Human
acugugaagaguaucagccaaaaa

SEQ ID NO: 1132650 - RNA, 19 nt, Human
agcaccagacucugccauu

SEQ ID NO: 1132651 - RNA, 18 nt, Human
agccagcuggaacuggcu

SEQ ID NO: 1132652 - RNA, 18 nt, Human
agcuggaacuggcucaca

SEQ ID NO: 1132653 - RNA, 22 nt, Human
agcuggaacuggcucacagaca

SEQ ID NO: 1132654 - RNA, 22 nt, Human
agcuucaaucagcuucugcagc

SEQ ID NO: 1132655 - RNA, 22 nt, Human
aggccagguucauaaacaggug

SEQ ID NO: 1132656 - RNA, 23 nt, Human
aggccagguucauaaacaggugu

SEQ ID NO: 1132657 - RNA, 28 nt, Human
agggugucacagagagguucccaucagg

SEQ ID NO: 1132658 - RNA, 24 nt, Human
agguguugcaguugaagacuggua

SEQ ID NO: 1132659 - RNA, 24 nt, Human
auuccugcuuccaccacugugauc

SEQ ID NO: 1132660 - RNA, 22 nt, Human
caagaucaccaucaggugccgc

SEQ ID NO: 1132661 - RNA, 18 nt, Human
caccacagcuucuuguag

SEQ ID NO: 1132662 - RNA, 19 nt, Human
cagcagcugggacugcuuc

SEQ ID NO: 1132663 - RNA, 22 nt, Human
cagcagcugggacugcuucagg

SEQ ID NO: 1132664 - RNA, 20 nt, Human
cagcagguccagcuuaggcu

SEQ ID NO: 1132665 - RNA, 23 nt, Human
caggccacagggccaaucaccac

SEQ ID NO: 1132666 - RNA, 24 nt, Human
caucagguucacagggcgcccgcu

SEQ ID NO: 1132667 - RNA, 24 nt, Human
caucuucaucccaauugcugagaa

SEQ ID NO: 1132668 - RNA, 24 nt, Human
ccacaagccaaucgagcagcuugc

SEQ ID NO: 1132669 - RNA, 20 nt, Human
ccacugcucucugggcuaag

SEQ ID NO: 1132670 - RNA, 21 nt, Human
ccagagccuccugcuccucaa

SEQ ID NO: 1132671 - RNA, 19 nt, Human
ccaugauaaccaucuucuc

SEQ ID NO: 1132672 - RNA, 18 nt, Human
ccccuggcaacaccuucu

SEQ ID NO: 1132673 - RNA, 21 nt, Human
ccccuggcaacaccuucugga

SEQ ID NO: 1132674 - RNA, 20 nt, Human
ccuccugcugcuucugcacc

SEQ ID NO: 1132675 - RNA, 21 nt, Human
ccuggauggcagcacugaucu

SEQ ID NO: 1132676 - RNA, 21 nt, Human
cgaugggcaugugcugauggu

SEQ ID NO: 1132677 - RNA, 18 nt, Human
cucaagugccuccugcug

SEQ ID NO: 1132678 - RNA, 18 nt, Human
cucaaguuccaugagcuc

SEQ ID NO: 1132679 - RNA, 21 nt, Human
cucacagacaggacaucugcc

SEQ ID NO: 1132680 - RNA, 21 nt, Human
cuccagagccuccugcuccuc

SEQ ID NO: 1132681 - RNA, 19 nt, Human
cuccagcagcagguccagc

SEQ ID NO: 1132682 - RNA, 22 nt, Human
cuccuuggucuucuccagcagc

SEQ ID NO: 1132683 - RNA, 20 nt, Human
cuggagccuggauuccugcc

SEQ ID NO: 1132684 - RNA, 25 nt, Human
cuggauggcagcacugaucuucucu

SEQ ID NO: 1132685 - RNA, 30 nt, Human
cuuccaacacugacaccaugauaaccaucu

SEQ ID NO: 1132686 - RNA, 22 nt, Human
gaucgucagcaccagacucugc

SEQ ID NO: 1132687 - RNA, 24 nt, Human
gcaugugcugaugguccuccaucu

SEQ ID NO: 1132688 - RNA, 27 nt, Human
gccaaucaccacagcuucuuguagaga

SEQ ID NO: 1132689 - RNA, 18 nt, Human
gccccaaaacaucagccc

SEQ ID NO: 1132690 - RNA, 21 nt, Human
gccccuggcaacaccuucugg

SEQ ID NO: 1132691 - RNA, 18 nt, Human
gcuucaaucagcuucugc

SEQ ID NO: 1132692 - RNA, 21 nt, Human
gcuucaaucagcuucugcagc

SEQ ID NO: 1132693 - RNA, 20 nt, Human
ggagaugucagcuucaauca

SEQ ID NO: 1132694 - RNA, 19 nt, Human
ggcagcacugaucuucucu

SEQ ID NO: 1132695 - RNA, 21 nt, Human
uaacuagaaggagaagcugug

SEQ ID NO: 1132696 - RNA, 19 nt, Human
uagaaggagaagcuguggu

SEQ ID NO: 1132697 - RNA, 25 nt, Human
uagaaggagaagcugugguuuucac

SEQ ID NO: 1132698 - RNA, 21 nt, Human
ucagccaaaaauauuuuucgu

SEQ ID NO: 1132699 - RNA, 20 nt, Human
uccaacacugacaccaugau

SEQ ID NO: 1132700 - RNA, 20 nt, Human
uccacauaccuuggugaggc

SEQ ID NO: 1132701 - RNA, 22 nt, Human
uccugcuuccaccacugugauc

SEQ ID NO: 1132702 - RNA, 24 nt, Human
uccuuggucuucuccagcagcagg

SEQ ID NO: 1132703 - RNA, 18 nt, Human
ucuccagcagcaggucca

SEQ ID NO: 1132704 - RNA, 23 nt, Human
ucugcaccaucagcucuuucuuc

SEQ ID NO: 1132705 - RNA, 20 nt, Human
ucugccauuucaggcugcag

SEQ ID NO: 1132706 - RNA, 19 nt, Human
ucugccuucucacucaacu

SEQ ID NO: 1132707 - RNA, 19 nt, Human
ugacaccaugauaaccauc

SEQ ID NO: 1132708 - RNA, 21 nt, Human
ugagaagaugggcagacaaga

SEQ ID NO: 1132709 - RNA, 18 nt, Human
ugauucugggucucagug

SEQ ID NO: 1132710 - RNA, 24 nt, Human
ugccgcuuccuuccuguggcuuuc

SEQ ID NO: 1132711 - RNA, 22 nt, Human
ugcuuccaccacugugaucugc

SEQ ID NO: 1132712 - RNA, 23 nt, Human
ugggacugcuucagguuuugcug

SEQ ID NO: 1132713 - RNA, 19 nt, Human
ugggccccuggcaacaccu

SEQ ID NO: 1132714 - RNA, 23 nt, Human
ugucagagcaucugggccccugg

SEQ ID NO: 1132715 - RNA, 25 nt, Human
uucaagaagugucagagcaucuggg

SEQ ID NO: 1132716 - RNA, 24 nt, Human
uucaggcugcaguaccuucugucc

SEQ ID NO: 1132717 - RNA, 20 nt, Human
uuccaacacugacaccauga

SEQ ID NO: 1132718 - RNA, 20 nt, Human
uuccagucggccuggucuuu

SEQ ID NO: 1132719 - RNA, 20 nt, Human
uucguggaggccucugugcc

SEQ ID NO: 1132720 - RNA, 20 nt, Human
uugcugagaagaugggcaga

SEQ ID NO: 1132721 - RNA, 22 nt, Human
uugcuggaggaauucagucacu

SEQ ID NO: 1132722 - RNA, 20 nt, Human
uuucaccugacaggccacag

SEQ ID NO: 1132723 - RNA, 18 nt, Human
uuuugcuggaggaauuca

SEQ ID NO: 1132724 - RNA, 22 nt, Human
aaagacgaguuccuuagccucc

SEQ ID NO: 1132725 - RNA, 26 nt, Human
aagacgaguuccuuagccuccaaacc

SEQ ID NO: 1132726 - RNA, 18 nt, Human
aagcuguccugcccauga

SEQ ID NO: 1132727 - RNA, 20 nt, Human
acuuccccaggcccccaaua

SEQ ID NO: 1132728 - RNA, 21 nt, Human
agccccgagucuuguugcaac

SEQ ID NO: 1132729 - RNA, 24 nt, Human
aggcccccaauaaacacacaaucu

SEQ ID NO: 1132730 - RNA, 19 nt, Human
agggcucaguacuucccca

SEQ ID NO: 1132731 - RNA, 24 nt, Human
caacaugcagggugucuuccagga

SEQ ID NO: 1132732 - RNA, 19 nt, Human
caacucccgaagcuguccu

SEQ ID NO: 1132733 - RNA, 21 nt, Human
ccaggguuuuccgguuucugg

SEQ ID NO: 1132734 - RNA, 19 nt, Human
cuuaagucacccaucugac

SEQ ID NO: 1132735 - RNA, 26 nt, Human
gcacagcuuaaagacgaggggaacgc

SEQ ID NO: 1132736 - RNA, 18 nt, Human
uaagaugugaaaaggcag

SEQ ID NO: 1132737 - RNA, 21 nt, Human
uaagcacagcuuaaagacgag

SEQ ID NO: 1132738 - RNA, 22 nt, Human
uagccuccaaacucuugcuccu

SEQ ID NO: 1132739 - RNA, 23 nt, Human
uagccuccaaacucuugcuccug

SEQ ID NO: 1132740 - RNA, 21 nt, Human
ugacaugcaaggagaagagga

SEQ ID NO: 1132741 - RNA, 22 nt, Human
ugcccugucccacugguuuuca

SEQ ID NO: 1132742 - RNA, 18 nt, Human
uggucagggagccccaug

SEQ ID NO: 1132743 - RNA, 21 nt, Human
uguaagcacagcuuaaagacg

SEQ ID NO: 1132744 - RNA, 20 nt, Human
uuccccaggcccccaauaaa

SEQ ID NO: 1132745 - RNA, 22 nt, Human
uuccccaggcccccaauaaaca

SEQ ID NO: 1132746 - RNA, 21 nt, Human
uuuuccgguuucuggcucagc

SEQ ID NO: 1132747 - RNA, 25 nt, Human
aagaagccgcccuucuccgcccuuc

SEQ ID NO: 1132748 - RNA, 25 nt, Human
aagaagccgcccuucuccgcccuuu

SEQ ID NO: 1132749 - RNA, 22 nt, Human
acaaagaaagcagggagagggg

SEQ ID NO: 1132750 - RNA, 18 nt, Human
acuuccggcuggaaaagg

SEQ ID NO: 1132751 - RNA, 19 nt, Human
agggcaaggaacagaauag

SEQ ID NO: 1132752 - RNA, 22 nt, Human
cacagcucaggcacucucaucc

SEQ ID NO: 1132753 - RNA, 25 nt, Human
cagaauagccagcuccugccugccc

SEQ ID NO: 1132754 - RNA, 22 nt, Human
cagcuccugccugcccuuccca

SEQ ID NO: 1132755 - RNA, 21 nt, Human
cagguacuuccggcuggaaaa

SEQ ID NO: 1132756 - RNA, 20 nt, Human
ccagcuccugccugcccuuc

SEQ ID NO: 1132757 - RNA, 18 nt, Human
ccucauggaugagacaga

SEQ ID NO: 1132758 - RNA, 21 nt, Human
ccugccugcccuucccagagg

SEQ ID NO: 1132759 - RNA, 22 nt, Human
ccugccugcccuucccagaggg

SEQ ID NO: 1132760 - RNA, 22 nt, Human
cuccaugccuggcacuguccuc

SEQ ID NO: 1132761 - RNA, 18 nt, Human
cucucagguacuuccggc

SEQ ID NO: 1132762 - RNA, 19 nt, Human
gacaaagaaagcagggaga

SEQ ID NO: 1132763 - RNA, 19 nt, Human
gagacagacaaagaaagca

SEQ ID NO: 1132764 - RNA, 18 nt, Human
gcuggggacagggcaagg

SEQ ID NO: 1132765 - RNA, 22 nt, Human
ggagauauguguuccugagauc

SEQ ID NO: 1132766 - RNA, 22 nt, Human
ggugcuggggacagggcaagga

SEQ ID NO: 1132767 - RNA, 30 nt, Human
gucuuauccaccuucuggggucucucucaa

SEQ ID NO: 1132768 - RNA, 20 nt, Human
uauccaccuucuggggucuc

SEQ ID NO: 1132769 - RNA, 18 nt, Human
ucuccgcccuucucuugc

SEQ ID NO: 1132770 - RNA, 20 nt, Human
ucugcagucuuauccaccuu

SEQ ID NO: 1132771 - RNA, 21 nt, Human
ucugcagucuuauccaccuuc

SEQ ID NO: 1132772 - RNA, 20 nt, Human
ugagacagacaaagaaagca

SEQ ID NO: 1132773 - RNA, 18 nt, Human
ugccuggcacuguccucg

SEQ ID NO: 1132774 - RNA, 21 nt, Human
ugccuggugagaccuugggca

SEQ ID NO: 1132775 - RNA, 18 nt, Human
aacgcagagaccggcaca

SEQ ID NO: 1132776 - RNA, 22 nt, Human
aagcaggccagagugucucucg

SEQ ID NO: 1132777 - RNA, 20 nt, Human
accccagcaucaccugguau

SEQ ID NO: 1132778 - RNA, 24 nt, Human
agcaucaccccagcaucaccuggu

SEQ ID NO: 1132779 - RNA, 20 nt, Human
auggcgcgcgccccagcccc

SEQ ID NO: 1132780 - RNA, 22 nt, Human
caccccagcaucaccugguauu

SEQ ID NO: 1132781 - RNA, 21 nt, Human
caccucugucagggcugagaa

SEQ ID NO: 1132782 - RNA, 18 nt, Human
cagaaggaggcuuuucac

SEQ ID NO: 1132783 - RNA, 22 nt, Human
cagaaggaggcuuuucacgaug

SEQ ID NO: 1132784 - RNA, 22 nt, Human
cagaguagagacuaggucucaa

SEQ ID NO: 1132785 - RNA, 24 nt, Human
cagccuacucgaugccagacacug

SEQ ID NO: 1132786 - RNA, 18 nt, Human
ccacggccuccggcaccg

SEQ ID NO: 1132787 - RNA, 25 nt, Human
ccagaaaucuuuccaccucuuuugg

SEQ ID NO: 1132788 - RNA, 19 nt, Human
ccagaaauguuuaacgcag

SEQ ID NO: 1132789 - RNA, 19 nt, Human
cgccccagccccgcagguu

SEQ ID NO: 1132790 - RNA, 21 nt, Human
cggccuccggcaccggguccu

SEQ ID NO: 1132791 - RNA, 21 nt, Human
cugagccagaaaucuuuccac

SEQ ID NO: 1132792 - RNA, 21 nt, Human
gaacaaagcaggccagagugu

SEQ ID NO: 1132793 - RNA, 19 nt, Human
gcccauggcgcgcgcccca

SEQ ID NO: 1132794 - RNA, 22 nt, Human
gggacagggaagggaacaaagc

SEQ ID NO: 1132795 - RNA, 22 nt, Human
ucagugcagugcaggcggccca

SEQ ID NO: 1132796 - RNA, 20 nt, Human
uccaccucuuuuggcucagu

SEQ ID NO: 1132797 - RNA, 23 nt, Human
ugagaaaaugauggcugggguag

SEQ ID NO: 1132798 - RNA, 26 nt, Human
ugcuauuaucaucaucacuguuacuu

SEQ ID NO: 1132799 - RNA, 20 nt, Human
ugcuauuaucaucaucacuu

SEQ ID NO: 1132800 - RNA, 24 nt, Human
ugcugcgcgcccagcugguucagc

SEQ ID NO: 1132801 - RNA, 18 nt, Human
uggaaccagaaggaggcu

SEQ ID NO: 1132802 - RNA, 18 nt, Human
uggcgcgcgccccagccc

SEQ ID NO: 1132803 - RNA, 23 nt, Human
uuccaccgccgccgccgcccugc

SEQ ID NO: 1132804 - RNA, 18 nt, Human
uuuccaccucuuuuggcu

SEQ ID NO: 1132805 - RNA, 23 nt, Human
aagcagcacuacugugugggaag

SEQ ID NO: 1132806 - RNA, 25 nt, Human
acucuauugcccaggcuggaaugca

SEQ ID NO: 1132807 - RNA, 19 nt, Human
acugugugggaaguugugg

SEQ ID NO: 1132808 - RNA, 18 nt, Human
agacggcagcccaggcca

SEQ ID NO: 1132809 - RNA, 19 nt, Human
agacggcagcccaggccaa

SEQ ID NO: 1132810 - RNA, 19 nt, Human
cacucuauugcccaggcug

SEQ ID NO: 1132811 - RNA, 20 nt, Human
cagcccaggccaagcuuccc

SEQ ID NO: 1132812 - RNA, 23 nt, Human
cagcccaggccaagcuuccccgg

SEQ ID NO: 1132813 - RNA, 18 nt, Human
caggcccacagagcccca

SEQ ID NO: 1132814 - RNA, 26 nt, Human
caggcuggaaugcaaaguuagaaaug

SEQ ID NO: 1132815 - RNA, 18 nt, Human
ccacagagccccaguggg

SEQ ID NO: 1132816 - RNA, 24 nt, Human
cccgggcccccucagauucucggg

SEQ ID NO: 1132817 - RNA, 20 nt, Human
cccucaggcccacagagccc

SEQ ID NO: 1132818 - RNA, 22 nt, Human
cccucaggcccacagagcccca

SEQ ID NO: 1132819 - RNA, 19 nt, Human
ccucaggcccacagagccc

SEQ ID NO: 1132820 - RNA, 19 nt, Human
cggcagcccaggccaagcu

SEQ ID NO: 1132821 - RNA, 20 nt, Human
cucacucuauugcccaggcc

SEQ ID NO: 1132822 - RNA, 20 nt, Human
cucgggcccucccacucccc

SEQ ID NO: 1132823 - RNA, 25 nt, Human
cucgggcccucccacuccccucagg

SEQ ID NO: 1132824 - RNA, 26 nt, Human
gccaagcuuccccgggcccccucaga

SEQ ID NO: 1132825 - RNA, 18 nt, Human
ggggguauggagaugaaa

SEQ ID NO: 1132826 - RNA, 23 nt, Human
uaagacggcagcccaggccaagc

SEQ ID NO: 1132827 - RNA, 24 nt, Human
uaagacggcagcccaggccaagcu

SEQ ID NO: 1132828 - RNA, 21 nt, Human
uauugcccaggcuggaaugca

SEQ ID NO: 1132829 - RNA, 26 nt, Human
ucccagaucgagccccucaggcccac

SEQ ID NO: 1132830 - RNA, 23 nt, Human
ucucacucuauugcccaggcugg

SEQ ID NO: 1132831 - RNA, 24 nt, Human
ucucacucuauugcccaggcugga

SEQ ID NO: 1132832 - RNA, 26 nt, Human
ucucacucuauugcccaggcuggaau

SEQ ID NO: 1132833 - RNA, 21 nt, Human
ugggaaguugugggggguaug

SEQ ID NO: 1132834 - RNA, 21 nt, Human
ugugggaaguuguggggggua

SEQ ID NO: 1132835 - RNA, 21 nt, Human
uuacugacacucaugucacac

SEQ ID NO: 1132836 - RNA, 22 nt, Human
uuccccgggcccccucagauuc

SEQ ID NO: 1132837 - RNA, 19 nt, Human
uugcauagcucaagcuuag

SEQ ID NO: 1132838 - RNA, 24 nt, Human
uugcccaggcuggaaugcaaaguu

SEQ ID NO: 1132839 - RNA, 25 nt, Human
caaaagguccuccaacacgucaaug

SEQ ID NO: 1132840 - RNA, 21 nt, Human
ccuccaacacgucaaugucug

SEQ ID NO: 1132841 - RNA, 21 nt, Human
cucagaauuauggcaggaggc

SEQ ID NO: 1132842 - RNA, 21 nt, Human
aagcuuuuggacacuccagcc

SEQ ID NO: 1132843 - RNA, 22 nt, Human
aagcuuuuggacacuccagccu

SEQ ID NO: 1132844 - RNA, 22 nt, Human
aauuugcucacuucuuuuccuu

SEQ ID NO: 1132845 - RNA, 24 nt, Human
acucauuguacuuaaucuuccccc

SEQ ID NO: 1132846 - RNA, 19 nt, Human
agcugacugaaggggcuug

SEQ ID NO: 1132847 - RNA, 23 nt, Human
agcuuuuggacacuccagccucu

SEQ ID NO: 1132848 - RNA, 21 nt, Human
auugcagagccuucaucagag

SEQ ID NO: 1132849 - RNA, 19 nt, Human
auuugcacaagccucccuc

SEQ ID NO: 1132850 - RNA, 18 nt, Human
cacaggcccaguguagag

SEQ ID NO: 1132851 - RNA, 23 nt, Human
cagagccuucaucagaguugucc

SEQ ID NO: 1132852 - RNA, 24 nt, Human
cagcaccagaaucuaugagaauau

SEQ ID NO: 1132853 - RNA, 24 nt, Human
cagccucuccagggagaaaauggc

SEQ ID NO: 1132854 - RNA, 24 nt, Human
cagcuuccaggcuuggcccgggag

SEQ ID NO: 1132855 - RNA, 22 nt, Human
caguccccgccgcucgcccucg

SEQ ID NO: 1132856 - RNA, 22 nt, Human
cauauuuguucuuugaugagga

SEQ ID NO: 1132857 - RNA, 21 nt, Human
caucauccucuccagcuucca

SEQ ID NO: 1132858 - RNA, 23 nt, Human
ccacaggacagcaauuuugccac

SEQ ID NO: 1132859 - RNA, 24 nt, Human
cccgcacccgcccugacacgacua

SEQ ID NO: 1132860 - RNA, 19 nt, Human
cccgccgcucgcccucgcc

SEQ ID NO: 1132861 - RNA, 19 nt, Human
cccgcugcucgcccuuccc

SEQ ID NO: 1132862 - RNA, 20 nt, Human
ccgccgcucgcccucgcccu

SEQ ID NO: 1132863 - RNA, 20 nt, Human
ccucccgcugcucgcccuuc

SEQ ID NO: 1132864 - RNA, 25 nt, Human
cgcccugacacgacuagcaaucuca

SEQ ID NO: 1132865 - RNA, 24 nt, Human
cgcugcucgcccuuccccaguccc

SEQ ID NO: 1132866 - RNA, 22 nt, Human
cggccaagcuuuuggacacucc

SEQ ID NO: 1132867 - RNA, 22 nt, Human
cuccagggagaaaauggcugcg

SEQ ID NO: 1132868 - RNA, 22 nt, Human
cuuaaucuuccccccucuugaa

SEQ ID NO: 1132869 - RNA, 18 nt, Human
gcagagccuucaucagag

SEQ ID NO: 1132870 - RNA, 27 nt, Human
ggcacuuucuaucuaccagaaguguua

SEQ ID NO: 1132871 - RNA, 22 nt, Human
uaccacaggacagcaauuuugc

SEQ ID NO: 1132872 - RNA, 27 nt, Human
ucagguccauugucgucuucuucauca

SEQ ID NO: 1132873 - RNA, 21 nt, Human
uccaggcuuggcccgggaggc

SEQ ID NO: 1132874 - RNA, 21 nt, Human
uccagggagaaaauggcugcg

SEQ ID NO: 1132875 - RNA, 18 nt, Human
uccccaguccccgccgcu

SEQ ID NO: 1132876 - RNA, 18 nt, Human
ucccucuggcauugcaga

SEQ ID NO: 1132877 - RNA, 22 nt, Human
ucccucuggcauugcagagccu

SEQ ID NO: 1132878 - RNA, 18 nt, Human
ucuaucuaccagaagugu

SEQ ID NO: 1132879 - RNA, 21 nt, Human
ucuccauggcugcagccaccu

SEQ ID NO: 1132880 - RNA, 20 nt, Human
ucuucagucccgcacccgcc

SEQ ID NO: 1132881 - RNA, 24 nt, Human
ugacagcggcggcacagagccucu

SEQ ID NO: 1132882 - RNA, 23 nt, Human
ugagaauauuugcacaagccucc

SEQ ID NO: 1132883 - RNA, 21 nt, Human
uguccuguuuucgccaucaag

SEQ ID NO: 1132884 - RNA, 22 nt, Human
uucacuuuaaugucuguaccac

SEQ ID NO: 1132885 - RNA, 21 nt, Human
uuccuuauggccaauaaaagu

SEQ ID NO: 1132886 - RNA, 24 nt, Human
uuugcacaagccucccucuggcau

SEQ ID NO: 1132887 - RNA, 24 nt, Human
aaaaaccuaguguuuucaacccuc

SEQ ID NO: 1132888 - RNA, 18 nt, Human
aaaacccaggaaagaagc

SEQ ID NO: 1132889 - RNA, 18 nt, Human
aaacaaugcugccacuca

SEQ ID NO: 1132890 - RNA, 20 nt, Human
aaagaagccuuuugucccuu

SEQ ID NO: 1132891 - RNA, 20 nt, Human
aaaggaaccagcgcugcugu

SEQ ID NO: 1132892 - RNA, 19 nt, Human
aaaggagaaugcuggaagg

SEQ ID NO: 1132893 - RNA, 18 nt, Human
aacaccaaaacccaggaa

SEQ ID NO: 1132894 - RNA, 21 nt, Human
aacaccaaaacccaggaaaga

SEQ ID NO: 1132895 - RNA, 24 nt, Human
aaccaaaaacaaaaagauacacaa

SEQ ID NO: 1132896 - RNA, 24 nt, Human
aacccugagcgcccccaaaccacc

SEQ ID NO: 1132897 - RNA, 18 nt, Human
aagaagugggaaggucaa

SEQ ID NO: 1132898 - RNA, 24 nt, Human
aagaggagaagggccccuuccuca

SEQ ID NO: 1132899 - RNA, 21 nt, Human
aagauacacaaauaguaagcc

SEQ ID NO: 1132900 - RNA, 23 nt, Human
aagcagcacagccccagauagca

SEQ ID NO: 1132901 - RNA, 24 nt, Human
aauaguaagccccuaaauucuguu

SEQ ID NO: 1132902 - RNA, 23 nt, Human
acaacacggaggcagcagaacac

SEQ ID NO: 1132903 - RNA, 24 nt, Human
acacacagcuugccaaaaaagcac

SEQ ID NO: 1132904 - RNA, 25 nt, Human
acaccacacaaacuagccaggaaac

SEQ ID NO: 1132905 - RNA, 21 nt, Human
acaccauccauguuuccuuuu

SEQ ID NO: 1132906 - RNA, 26 nt, Human
acagaaccagcagcuucuuacacacc

SEQ ID NO: 1132907 - RNA, 18 nt, Human
acaggggacaccuccuuc

SEQ ID NO: 1132908 - RNA, 21 nt, Human
accacaccacacaaacuagcc

SEQ ID NO: 1132909 - RNA, 22 nt, Human
accaccccuaaccugccccccc

SEQ ID NO: 1132910 - RNA, 24 nt, Human
accaccccuaaccugcccccccca

SEQ ID NO: 1132911 - RNA, 27 nt, Human
accaccccuaaccugccccccccacca

SEQ ID NO: 1132912 - RNA, 22 nt, Human
accccaggcugggccgggcccc

SEQ ID NO: 1132913 - RNA, 23 nt, Human
accccuaaccugccccccccacc

SEQ ID NO: 1132914 - RNA, 18 nt, Human
acccggaccaaaagcagc

SEQ ID NO: 1132915 - RNA, 21 nt, Human
accuggcucagaugccagcag

SEQ ID NO: 1132916 - RNA, 24 nt, Human
acuggaaaaggagacaaaaaccua

SEQ ID NO: 1132917 - RNA, 18 nt, Human
agaacaccaacagaagag

SEQ ID NO: 1132918 - RNA, 20 nt, Human
agaauuauuucauauuucuu

SEQ ID NO: 1132919 - RNA, 25 nt, Human
agaggagaagggccccuuccucaga

SEQ ID NO: 1132920 - RNA, 26 nt, Human
agcaaaagugaucccaaccacaccac

SEQ ID NO: 1132921 - RNA, 26 nt, Human
agcagaacaccaacagaagaguccca

SEQ ID NO: 1132922 - RNA, 26 nt, Human
agcagcacagccccagauagcacccc

SEQ ID NO: 1132923 - RNA, 21 nt, Human
agccaacauagacacauucuc

SEQ ID NO: 1132924 - RNA, 19 nt, Human
agccuggcuuggagcagcu

SEQ ID NO: 1132925 - RNA, 22 nt, Human
agcgcugcugucacccuccaug

SEQ ID NO: 1132926 - RNA, 22 nt, Human
aggcagcagaacaccaacagaa

SEQ ID NO: 1132927 - RNA, 19 nt, Human
aggcaguguaacccugagc

SEQ ID NO: 1132928 - RNA, 25 nt, Human
agugcagccuccccccauaccaccc

SEQ ID NO: 1132929 - RNA, 22 nt, Human
auacuggucuaagccuccccuc

SEQ ID NO: 1132930 - RNA, 19 nt, Human
auggccaccuccacaaccu

SEQ ID NO: 1132931 - RNA, 25 nt, Human
caaaaaagcacccugugucuuacau

SEQ ID NO: 1132932 - RNA, 27 nt, Human
caaacccgcccccaacccggaccaaaa

SEQ ID NO: 1132933 - RNA, 18 nt, Human
caaagcccuccuacuccc

SEQ ID NO: 1132934 - RNA, 18 nt, Human
caaagggugcccagaggc

SEQ ID NO: 1132935 - RNA, 19 nt, Human
caacauagacacauucucc

SEQ ID NO: 1132936 - RNA, 19 nt, Human
caacccggaccaaaagcag

SEQ ID NO: 1132937 - RNA, 18 nt, Human
caagcagccaacauagac

SEQ ID NO: 1132938 - RNA, 24 nt, Human
caagcuagcaagaaaacacagccc

SEQ ID NO: 1132939 - RNA, 24 nt, Human
caagggcucugugguggucagagg

SEQ ID NO: 1132940 - RNA, 19 nt, Human
cacaacaccaaaacccagg

SEQ ID NO: 1132941 - RNA, 19 nt, Human
cacaacaccaaaacccagg

SEQ ID NO: 1132942 - RNA, 22 nt, Human
cacaacaccaaaacccaggaaa

SEQ ID NO: 1132943 - RNA, 22 nt, Human
cacaaccaaaaacaaaaagaua

SEQ ID NO: 1132944 - RNA, 23 nt, Human
cacaaccaaaaacaaaaagauac

SEQ ID NO: 1132945 - RNA, 25 nt, Human
cacaagcagaaguuguucacccucu

SEQ ID NO: 1132946 - RNA, 21 nt, Human
cacaagcuuagcccccggauu

SEQ ID NO: 1132947 - RNA, 24 nt, Human
cacaccacacaaacuagccaggaa

SEQ ID NO: 1132948 - RNA, 22 nt, Human
cacagcagccaccuuccugaga

SEQ ID NO: 1132949 - RNA, 22 nt, Human
cacagcccagguaagcucaucu

SEQ ID NO: 1132950 - RNA, 18 nt, Human
cacagccccagauagcac

SEQ ID NO: 1132951 - RNA, 23 nt, Human
cacagguacccuccuacugcucc

SEQ ID NO: 1132952 - RNA, 21 nt, Human
caccacugucauggccaccuc

SEQ ID NO: 1132953 - RNA, 20 nt, Human
cacccaaccaaccccccgag

SEQ ID NO: 1132954 - RNA, 19 nt, Human
caccccuaaccugcccccc

SEQ ID NO: 1132955 - RNA, 18 nt, Human
cacccuccaugcaccugc

SEQ ID NO: 1132956 - RNA, 27 nt, Human
cacccucuagagccuugaguccaggaa

SEQ ID NO: 1132957 - RNA, 18 nt, Human
cagaacagaaucugcuac

SEQ ID NO: 1132958 - RNA, 22 nt, Human
cagacaaugccagaaaaaccua

SEQ ID NO: 1132959 - RNA, 21 nt, Human
cagcagaacaccaacagaaga

SEQ ID NO: 1132960 - RNA, 24 nt, Human
cagcagaaggagggcacccuccag

SEQ ID NO: 1132961 - RNA, 24 nt, Human
cagcagcuucuuacacaccccagg

SEQ ID NO: 1132962 - RNA, 20 nt, Human
cagcagugcagccucccccc

SEQ ID NO: 1132963 - RNA, 23 nt, Human
cagcccagguaagcucaucucuu

SEQ ID NO: 1132964 - RNA, 23 nt, Human
cagccuccccccauaccaccccu

SEQ ID NO: 1132965 - RNA, 22 nt, Human
cagcuugccaaaaaagcacccu

SEQ ID NO: 1132966 - RNA, 23 nt, Human
caggaggaugccucuuugaugau

SEQ ID NO: 1132967 - RNA, 23 nt, Human
caggggaccugccacagcagcca

SEQ ID NO: 1132968 - RNA, 21 nt, Human
cagguacccuccuacugcucc

SEQ ID NO: 1132969 - RNA, 24 nt, Human
cagugcagccuccccccauaccac

SEQ ID NO: 1132970 - RNA, 20 nt, Human
cauuuagaauagaauuguuc

SEQ ID NO: 1132971 - RNA, 24 nt, Human
ccaacacacagcuugccaaaaaag

SEQ ID NO: 1132972 - RNA, 18 nt, Human
ccaaccaaccccccgacc

SEQ ID NO: 1132973 - RNA, 20 nt, Human
ccaaccaaccccccgacccc

SEQ ID NO: 1132974 - RNA, 24 nt, Human
ccaacccggaccaaaagcagcaca

SEQ ID NO: 1132975 - RNA, 19 nt, Human
ccacagcagccaccuuccu

SEQ ID NO: 1132976 - RNA, 23 nt, Human
ccaccacaagcuuagcccccgga

SEQ ID NO: 1132977 - RNA, 20 nt, Human
ccagagacaacacggaggca

SEQ ID NO: 1132978 - RNA, 19 nt, Human
cccaaagcccuccuacucc

SEQ ID NO: 1132979 - RNA, 23 nt, Human
cccaaccaaccccccgaccccac

SEQ ID NO: 1132980 - RNA, 18 nt, Human
cccacaacaccaaaaccc

SEQ ID NO: 1132981 - RNA, 18 nt, Human
cccauaccaccccuaacc

SEQ ID NO: 1132982 - RNA, 21 nt, Human
cccaucaaacccgcccccaac

SEQ ID NO: 1132983 - RNA, 21 nt, Human
ccccaaagcccuccuacuccc

SEQ ID NO: 1132984 - RNA, 22 nt, Human
ccccaaagcccuccuacucccc

SEQ ID NO: 1132985 - RNA, 23 nt, Human
ccccaccacaagcuuagcccccg

SEQ ID NO: 1132986 - RNA, 20 nt, Human
ccccagauagcaccccaaau

SEQ ID NO: 1132987 - RNA, 21 nt, Human
ccccaggcugggccgggcccc

SEQ ID NO: 1132988 - RNA, 19 nt, Human
ccccaucaaacccgccccc

SEQ ID NO: 1132989 - RNA, 20 nt, Human
ccccaucaaacccgccccca

SEQ ID NO: 1132990 - RNA, 22 nt, Human
ccccaucaaacccgcccccaac

SEQ ID NO: 1132991 - RNA, 21 nt, Human
cccccaccacaagcuuagccc

SEQ ID NO: 1132992 - RNA, 29 nt, Human
cccccauaccaccccuaaccugccccccc

SEQ ID NO: 1132993 - RNA, 21 nt, Human
cccccuuccuggccccuagac

SEQ ID NO: 1132994 - RNA, 19 nt, Human
ccccuaaccugcccccccc

SEQ ID NO: 1132995 - RNA, 19 nt, Human
ccccuaaccugcccccccc

SEQ ID NO: 1132996 - RNA, 22 nt, Human
ccccuaaccugccccccccacc

SEQ ID NO: 1132997 - RNA, 23 nt, Human
ccccuagacuugcugcugcugcc

SEQ ID NO: 1132998 - RNA, 20 nt, Human
cccgcaacacacccagagac

SEQ ID NO: 1132999 - RNA, 21 nt, Human
cccgcaacacacccagagacu

SEQ ID NO: 1133000 - RNA, 22 nt, Human
cccggaccaaaagcagcacagc

SEQ ID NO: 1133001 - RNA, 23 nt, Human
cccuccaacacacagcuugccaa

SEQ ID NO: 1133002 - RNA, 21 nt, Human
cccuccaugcaccugcccacc

SEQ ID NO: 1133003 - RNA, 21 nt, Human
cccuccuacucccccuuccug

SEQ ID NO: 1133004 - RNA, 20 nt, Human
cccucugcacuccaacacaa

SEQ ID NO: 1133005 - RNA, 18 nt, Human
cccuuuucccccacuagg

SEQ ID NO: 1133006 - RNA, 22 nt, Human
ccgcaacacacccagagacugc

SEQ ID NO: 1133007 - RNA, 21 nt, Human
ccuaaccugccccccccacca

SEQ ID NO: 1133008 - RNA, 22 nt, Human
ccuacucccccuuccuggcccc

SEQ ID NO: 1133009 - RNA, 18 nt, Human
ccucaagcuagcaagaaa

SEQ ID NO: 1133010 - RNA, 19 nt, Human
ccucaagcuagcaagaaaa

SEQ ID NO: 1133011 - RNA, 22 nt, Human
ccucagaggccaccacugucau

SEQ ID NO: 1133012 - RNA, 21 nt, Human
ccuccaaggcuccuaccacuu

SEQ ID NO: 1133013 - RNA, 25 nt, Human
ccuccaaggcuccuaccacuuggcc

SEQ ID NO: 1133014 - RNA, 26 nt, Human
ccuccaaggcuccuaccacuuggccu

SEQ ID NO: 1133015 - RNA, 23 nt, Human
ccugccacggguguugcagcacc

SEQ ID NO: 1133016 - RNA, 20 nt, Human
ccugucgcgggcagugaacu

SEQ ID NO: 1133017 - RNA, 19 nt, Human
ccugugguacagaaccagc

SEQ ID NO: 1133018 - RNA, 19 nt, Human
ccuucacacaucugagagu

SEQ ID NO: 1133019 - RNA, 18 nt, Human
ccuuccucagaggccacc

SEQ ID NO: 1133020 - RNA, 18 nt, Human
ccuugaguccaggaagag

SEQ ID NO: 1133021 - RNA, 25 nt, Human
cggaggcagcagaacaccaacagaa

SEQ ID NO: 1133022 - RNA, 18 nt, Human
cucagaugccagcagaag

SEQ ID NO: 1133023 - RNA, 19 nt, Human
cuccagagacugcaggaga

SEQ ID NO: 1133024 - RNA, 23 nt, Human
cuccaugcaccugcccacccucc

SEQ ID NO: 1133025 - RNA, 19 nt, Human
cuccccccauaccaccccu

SEQ ID NO: 1133026 - RNA, 28 nt, Human
cuccccccauaccaccccuaaccugccc

SEQ ID NO: 1133027 - RNA, 18 nt, Human
cucccccuuccuggcccc

SEQ ID NO: 1133028 - RNA, 27 nt, Human
cuggcagcagcagugcagccucccccu

SEQ ID NO: 1133029 - RNA, 20 nt, Human
cugggcagacaaugccagaa

SEQ ID NO: 1133030 - RNA, 21 nt, Human
cuucaggcuccaaccuccagc

SEQ ID NO: 1133031 - RNA, 18 nt, Human
gaacucccuccaacacac

SEQ ID NO: 1133032 - RNA, 19 nt, Human
gaagggggaggacuccucc

SEQ ID NO: 1133033 - RNA, 22 nt, Human
gagacugcaggagaagggggag

SEQ ID NO: 1133034 - RNA, 24 nt, Human
gaggccaccacugucauggccacc

SEQ ID NO: 1133035 - RNA, 25 nt, Human
gcacagccccagauagcaccccaaa

SEQ ID NO: 1133036 - RNA, 22 nt, Human
gcagugcagccuccccccauac

SEQ ID NO: 1133037 - RNA, 22 nt, Human
gccccaaagcccuccuacuccc

SEQ ID NO: 1133038 - RNA, 20 nt, Human
gcccccaacccggaccaaaa

SEQ ID NO: 1133039 - RNA, 21 nt, Human
gccccccccaccacaagcuua

SEQ ID NO: 1133040 - RNA, 25 nt, Human
gccccccccaccacaagcuuagccc

SEQ ID NO: 1133041 - RNA, 21 nt, Human
gcccuccuacucccccuuccu

SEQ ID NO: 1133042 - RNA, 22 nt, Human
gcuccaaccuccagcucaccac

SEQ ID NO: 1133043 - RNA, 24 nt, Human
gcuucuuacacaccccaggcuggg

SEQ ID NO: 1133044 - RNA, 24 nt, Human
ggaggcagcagaacaccaacagaa

SEQ ID NO: 1133045 - RNA, 18 nt, Human
ggcaggugggcugaagaa

SEQ ID NO: 1133046 - RNA, 23 nt, Human
ggccccaaagcccuccuacuccc

SEQ ID NO: 1133047 - RNA, 21 nt, Human
ggccccuagacuugcugcugc

SEQ ID NO: 1133048 - RNA, 19 nt, Human
ggccugagguuccacuuuc

SEQ ID NO: 1133049 - RNA, 25 nt, Human
gucauggccaccuccacaaccugcu

SEQ ID NO: 1133050 - RNA, 22 nt, Human
gugaucccaaccacaccacaca

SEQ ID NO: 1133051 - RNA, 24 nt, Human
gugcccgcaacacacccagagacu

SEQ ID NO: 1133052 - RNA, 18 nt, Human
guggcccaaagggugccc

SEQ ID NO: 1133053 - RNA, 20 nt, Human
uaaaagaagaaugacuaaau

SEQ ID NO: 1133054 - RNA, 23 nt, Human
uaaccugccccccccaccacaag

SEQ ID NO: 1133055 - RNA, 25 nt, Human
uaacucaacuggaaaaggagacaaa

SEQ ID NO: 1133056 - RNA, 27 nt, Human
uaagaacaccauccauguugucguaga

SEQ ID NO: 1133057 - RNA, 18 nt, Human
uaagaugacugucuaagg

SEQ ID NO: 1133058 - RNA, 18 nt, Human
uacacaaauaguaagccc

SEQ ID NO: 1133059 - RNA, 21 nt, Human
uacagaaccagcagcuucuua

SEQ ID NO: 1133060 - RNA, 21 nt, Human
uacugcacccaaccaaccccc

SEQ ID NO: 1133061 - RNA, 21 nt, Human
uagcaccccaaaucugcuccu

SEQ ID NO: 1133062 - RNA, 19 nt, Human
uagcccccggauugugccc

SEQ ID NO: 1133063 - RNA, 20 nt, Human
uagggugccugaggggcaug

SEQ ID NO: 1133064 - RNA, 20 nt, Human
uaucucacugaaaggagaau

SEQ ID NO: 1133065 - RNA, 22 nt, Human
ucauggccaccuccacaaccug

SEQ ID NO: 1133066 - RNA, 19 nt, Human
uccaacacaagcagaaguu

SEQ ID NO: 1133067 - RNA, 18 nt, Human
uccaaggcuccuaccacu

SEQ ID NO: 1133068 - RNA, 22 nt, Human
uccaggaagaggagaagggccc

SEQ ID NO: 1133069 - RNA, 23 nt, Human
uccaggaagaggagaagggcccc

SEQ ID NO: 1133070 - RNA, 22 nt, Human
uccauaacccaucccugccacg

SEQ ID NO: 1133071 - RNA, 25 nt, Human
uccaucaccauggcugccacaacca

SEQ ID NO: 1133072 - RNA, 27 nt, Human
uccaucaccauggcugccacaaccaua

SEQ ID NO: 1133073 - RNA, 20 nt, Human
uccaugcaccugcccacccu

SEQ ID NO: 1133074 - RNA, 21 nt, Human
ucccacaacaccaaaacccag

SEQ ID NO: 1133075 - RNA, 22 nt, Human
ucccacaacaccaaaacccagg

SEQ ID NO: 1133076 - RNA, 23 nt, Human
ucccacaacaccaaaacccagga

SEQ ID NO: 1133077 - RNA, 20 nt, Human
uccccaggugacaccauggg

SEQ ID NO: 1133078 - RNA, 19 nt, Human
uccccccauaccaccccua

SEQ ID NO: 1133079 - RNA, 21 nt, Human
ucccuccaacacacagcuugc

SEQ ID NO: 1133080 - RNA, 19 nt, Human
ucccuuuucccccacuagg

SEQ ID NO: 1133081 - RNA, 21 nt, Human
uccuccuugcccuggcugcac

SEQ ID NO: 1133082 - RNA, 19 nt, Human
uccuggccccuagacuugc

SEQ ID NO: 1133083 - RNA, 26 nt, Human
ucuaaauuuaaaagaagaaugacuaa

SEQ ID NO: 1133084 - RNA, 24 nt, Human
ucugcacuccaacacaagcagaag

SEQ ID NO: 1133085 - RNA, 25 nt, Human
ucuuacacaccccaggcugggccgg

SEQ ID NO: 1133086 - RNA, 20 nt, Human
ugaaaggagaaugcuggaag

SEQ ID NO: 1133087 - RNA, 21 nt, Human
ugaaaggagaaugcuggaagg

SEQ ID NO: 1133088 - RNA, 18 nt, Human
ugaacucccuccaacaca

SEQ ID NO: 1133089 - RNA, 23 nt, Human
ugaaucacagagcugugccaucu

SEQ ID NO: 1133090 - RNA, 18 nt, Human
ugacaccaugggcaggug

SEQ ID NO: 1133091 - RNA, 19 nt, Human
ugagagguucccuuucuuc

SEQ ID NO: 1133092 - RNA, 20 nt, Human
ugagcgcccccaaaccaccc

SEQ ID NO: 1133093 - RNA, 24 nt, Human
ugagcgcccccaaaccaccccugg

SEQ ID NO: 1133094 - RNA, 20 nt, Human
ugcaccugcccacccuccaa

SEQ ID NO: 1133095 - RNA, 22 nt, Human
ugccaccauuagcaccgacgcc

SEQ ID NO: 1133096 - RNA, 19 nt, Human
ugcccacccuccaaggcuc

SEQ ID NO: 1133097 - RNA, 22 nt, Human
ugcccgcaacacacccagagac

SEQ ID NO: 1133098 - RNA, 20 nt, Human
ugccugaggggcauguagca

SEQ ID NO: 1133099 - RNA, 22 nt, Human
ugcuaacaacaagcagccaaca

SEQ ID NO: 1133100 - RNA, 19 nt, Human
uggaaggugcuaguaagau

SEQ ID NO: 1133101 - RNA, 20 nt, Human
uggaaggugcuaguaagaug

SEQ ID NO: 1133102 - RNA, 24 nt, Human
uggccaccuccacaaccugcugcu

SEQ ID NO: 1133103 - RNA, 22 nt, Human
uggccuccacagguacccuccu

SEQ ID NO: 1133104 - RNA, 18 nt, Human
uggcucagaugccagcag

SEQ ID NO: 1133105 - RNA, 19 nt, Human
ugggcagacaaugccagaa

SEQ ID NO: 1133106 - RNA, 22 nt, Human
ugguacagaaccagcagcuucu

SEQ ID NO: 1133107 - RNA, 18 nt, Human
uguaacccugagcgcccc

SEQ ID NO: 1133108 - RNA, 21 nt, Human
ugucuaaggacuccagaacug

SEQ ID NO: 1133109 - RNA, 23 nt, Human
ugugcccgcaacacacccagaga

SEQ ID NO: 1133110 - RNA, 19 nt, Human
uguucagaaauuugcuaac

SEQ ID NO: 1133111 - RNA, 21 nt, Human
uuagcaccgacgccaaaggaa

SEQ ID NO: 1133112 - RNA, 24 nt, Human
uuaucacaaccaaaaacaaaaaga

SEQ ID NO: 1133113 - RNA, 18 nt, Human
uuccuggccauagaagcc

SEQ ID NO: 1133114 - RNA, 22 nt, Human
uuccuggccauagaagcccucc

SEQ ID NO: 1133115 - RNA, 20 nt, Human
uugccaaaaaagcacccugu

SEQ ID NO: 1133116 - RNA, 20 nt, Human
uugcugcugcugccaccauu

SEQ ID NO: 1133117 - RNA, 19 nt, Human
uuguucacccucuagagcc

SEQ ID NO: 1133118 - RNA, 22 nt, Human
uuuuguggcaaugcaugucacu

SEQ ID NO: 1133119 - RNA, 25 nt, Human
uuuuucagaauuauuucauauuucu

SEQ ID NO: 1133120 - RNA, 20 nt, Human
agccaguuuuauggcuucga

SEQ ID NO: 1133121 - RNA, 23 nt, Human
aggggcuggugcugucuacuugg

SEQ ID NO: 1133122 - RNA, 23 nt, Human
cccacacaugugucccgaggagu

SEQ ID NO: 1133123 - RNA, 19 nt, Human
cccucuaccuccgcuccuc

SEQ ID NO: 1133124 - RNA, 18 nt, Human
ggccaugguccuugaggg

SEQ ID NO: 1133125 - RNA, 28 nt, Human
ggccaugguccuugaggggcuggugcug

SEQ ID NO: 1133126 - RNA, 23 nt, Human
ggggaaguucacagagccauuua

SEQ ID NO: 1133127 - RNA, 18 nt, Human
uaccuccgcuccucccug

SEQ ID NO: 1133128 - RNA, 23 nt, Human
uacuuggcccacacauguguccc

SEQ ID NO: 1133129 - RNA, 19 nt, Human
ucagccaguuuuauggcuu

SEQ ID NO: 1133130 - RNA, 18 nt, Human
ucuaccuccgcuccuccc

SEQ ID NO: 1133131 - RNA, 19 nt, Human
ucuccuugggcaaaacggu

SEQ ID NO: 1133132 - RNA, 22 nt, Human
ucuuggccucugcaccucuccu

SEQ ID NO: 1133133 - RNA, 20 nt, Human
ugagccccacaaccgaccag

SEQ ID NO: 1133134 - RNA, 18 nt, Human
ugaggggcuggugcuguc

SEQ ID NO: 1133135 - RNA, 19 nt, Human
uggccucugcaccucuccu

SEQ ID NO: 1133136 - RNA, 18 nt, Human
ugggcaaaacggucuugg

SEQ ID NO: 1133137 - RNA, 19 nt, Human
uggugcugucuacuuggcc

SEQ ID NO: 1133138 - RNA, 21 nt, Human
uuuucugcaaccauugcucac

SEQ ID NO: 1133139 - RNA, 22 nt, Human
aaacagacacaggauauuuuca

SEQ ID NO: 1133140 - RNA, 21 nt, Human
aaagaaaggugaagccaugca

SEQ ID NO: 1133141 - RNA, 24 nt, Human
aacuaauccaaucaccugacacca

SEQ ID NO: 1133142 - RNA, 20 nt, Human
aacugcagcaaccuuggcac

SEQ ID NO: 1133143 - RNA, 19 nt, Human
aagacaggacaccuuugca

SEQ ID NO: 1133144 - RNA, 23 nt, Human
aagugaugggaauuauggaaagc

SEQ ID NO: 1133145 - RNA, 22 nt, Human
aaucaccugacaccaccacaga

SEQ ID NO: 1133146 - RNA, 24 nt, Human
acuggagaacaggagagccacaaa

SEQ ID NO: 1133147 - RNA, 19 nt, Human
agagagcacaacggaauuc

SEQ ID NO: 1133148 - RNA, 22 nt, Human
agagcccagcccccagaggccu

SEQ ID NO: 1133149 - RNA, 18 nt, Human
agagcucccugaaccccc

SEQ ID NO: 1133150 - RNA, 23 nt, Human
agcucccucagucacucccguca

SEQ ID NO: 1133151 - RNA, 22 nt, Human
aggagggagugggaagacagga

SEQ ID NO: 1133152 - RNA, 18 nt, Human
aggagggaguggggaggg

SEQ ID NO: 1133153 - RNA, 20 nt, Human
aggagggaguggggagggag

SEQ ID NO: 1133154 - RNA, 18 nt, Human
aggccccacagcuguuag

SEQ ID NO: 1133155 - RNA, 25 nt, Human
agggaguggggagggaguggggagg

SEQ ID NO: 1133156 - RNA, 23 nt, Human
auagaaacaauuucuuuuuuuau

SEQ ID NO: 1133157 - RNA, 24 nt, Human
augcagccugcugagcugggauug

SEQ ID NO: 1133158 - RNA, 22 nt, Human
caaccccuggggccccacuccc

SEQ ID NO: 1133159 - RNA, 24 nt, Human
caacugccaccaccacugccaggc

SEQ ID NO: 1133160 - RNA, 23 nt, Human
cacaccucagugguggauaccac

SEQ ID NO: 1133161 - RNA, 19 nt, Human
cacagggaacuugcccgga

SEQ ID NO: 1133162 - RNA, 18 nt, Human
caccacagaggacuccca

SEQ ID NO: 1133163 - RNA, 19 nt, Human
caccacugccaggccaagg

SEQ ID NO: 1133164 - RNA, 21 nt, Human
cagaaagagacuguguuccug

SEQ ID NO: 1133165 - RNA, 18 nt, Human
cagaaccauucccccucu

SEQ ID NO: 1133166 - RNA, 23 nt, Human
cagcugcuguugcagugccagga

SEQ ID NO: 1133167 - RNA, 21 nt, Human
cauucccccucucucuaugaa

SEQ ID NO: 1133168 - RNA, 22 nt, Human
cauuuugcuguugccuagcacc

SEQ ID NO: 1133169 - RNA, 20 nt, Human
ccacauggaauuccacaggc

SEQ ID NO: 1133170 - RNA, 19 nt, Human
ccaccaccacugccaggcc

SEQ ID NO: 1133171 - RNA, 26 nt, Human
ccagugauggcaccuguucauucccu

SEQ ID NO: 1133172 - RNA, 21 nt, Human
cccacauggaauuccacaggc

SEQ ID NO: 1133173 - RNA, 26 nt, Human
ccccacagcuguuagcuuucacugcu

SEQ ID NO: 1133174 - RNA, 22 nt, Human
ccccagaggccugcagucugcc

SEQ ID NO: 1133175 - RNA, 23 nt, Human
ccccggggccuccagucuaacac

SEQ ID NO: 1133176 - RNA, 26 nt, Human
ccccggggccuccagucuaacacagg

SEQ ID NO: 1133177 - RNA, 18 nt, Human
ccccuggggccccacucc

SEQ ID NO: 1133178 - RNA, 21 nt, Human
cccugaaccccccggggccuc

SEQ ID NO: 1133179 - RNA, 20 nt, Human
ccuagcccucagaggccugc

SEQ ID NO: 1133180 - RNA, 22 nt, Human
ccucagaggccugcauucugcc

SEQ ID NO: 1133181 - RNA, 18 nt, Human
cgcuaagggggaccugcc

SEQ ID NO: 1133182 - RNA, 24 nt, Human
cucccugaaccccccggggccucc

SEQ ID NO: 1133183 - RNA, 22 nt, Human
cugagcagggcuaccccugccu

SEQ ID NO: 1133184 - RNA, 23 nt, Human
cugcagccugguaccagcugcug

SEQ ID NO: 1133185 - RNA, 24 nt, Human
cugcaggguagaggagcaagcaca

SEQ ID NO: 1133186 - RNA, 22 nt, Human
cugcccuggggcuccugcuuuc

SEQ ID NO: 1133187 - RNA, 21 nt, Human
cuggugccugugcuccucauu

SEQ ID NO: 1133188 - RNA, 22 nt, Human
cuguggccuggcacccuucuga

SEQ ID NO: 1133189 - RNA, 21 nt, Human
gaaaauccauuauagaaacaa

SEQ ID NO: 1133190 - RNA, 22 nt, Human
gaccugccuucccuaggcucac

SEQ ID NO: 1133191 - RNA, 18 nt, Human
gagugggaagacaggaca

SEQ ID NO: 1133192 - RNA, 18 nt, Human
gauacagaaagagacugu

SEQ ID NO: 1133193 - RNA, 19 nt, Human
gcagaaccauucccccucu

SEQ ID NO: 1133194 - RNA, 22 nt, Human
gccaaguacuuuugcacacccc

SEQ ID NO: 1133195 - RNA, 23 nt, Human
gccaugcagccugcugagcuggg

SEQ ID NO: 1133196 - RNA, 21 nt, Human
gcccagcccccagaggccugc

SEQ ID NO: 1133197 - RNA, 23 nt, Human
gcccaggauguggagcuggugga

SEQ ID NO: 1133198 - RNA, 22 nt, Human
gcugagugagcaaccccugggg

SEQ ID NO: 1133199 - RNA, 19 nt, Human
ggaaccugaggauuagggg

SEQ ID NO: 1133200 - RNA, 19 nt, Human
ggagcucccucagucacuc

SEQ ID NO: 1133201 - RNA, 21 nt, Human
ggagggaguggggagggagug

SEQ ID NO: 1133202 - RNA, 23 nt, Human
ggcacugcuucggcccacaugga

SEQ ID NO: 1133203 - RNA, 18 nt, Human
ggccuccagucuaacaca

SEQ ID NO: 1133204 - RNA, 19 nt, Human
ggccuggcacccuucugag

SEQ ID NO: 1133205 - RNA, 19 nt, Human
gggaguggggagggagugg

SEQ ID NO: 1133206 - RNA, 20 nt, Human
gggaguggggagggaguggg

SEQ ID NO: 1133207 - RNA, 20 nt, Human
gggccuccagucuaacacag

SEQ ID NO: 1133208 - RNA, 19 nt, Human
ggggagggaguggggaggc

SEQ ID NO: 1133209 - RNA, 24 nt, Human
guaaggcagaaccauucccccucu

SEQ ID NO: 1133210 - RNA, 22 nt, Human
guggagcugguggagcccccuc

SEQ ID NO: 1133211 - RNA, 21 nt, Human
uacagaaagagacuguguucc

SEQ ID NO: 1133212 - RNA, 23 nt, Human
uagaggagcaagcacauugagca

SEQ ID NO: 1133213 - RNA, 20 nt, Human
uauugagcugagggaagaga

SEQ ID NO: 1133214 - RNA, 20 nt, Human
ucccucuggggucugagguu

SEQ ID NO: 1133215 - RNA, 24 nt, Human
ucccugaaccccccggggccucca

SEQ ID NO: 1133216 - RNA, 20 nt, Human
uccuagcgaugggagagcuc

SEQ ID NO: 1133217 - RNA, 21 nt, Human
uccugcugcuguugcugcaac

SEQ ID NO: 1133218 - RNA, 23 nt, Human
ucuaaacuagauuucacuuaaac

SEQ ID NO: 1133219 - RNA, 21 nt, Human
ucucuaugaagcagcaguguu

SEQ ID NO: 1133220 - RNA, 22 nt, Human
ucugccugagcauuuuggcugu

SEQ ID NO: 1133221 - RNA, 23 nt, Human
ugaaacgcugcagccugguacca

SEQ ID NO: 1133222 - RNA, 24 nt, Human
ugaaagccuagcccucagaggccu

SEQ ID NO: 1133223 - RNA, 22 nt, Human
ugaaauaaacauauauugcaga

SEQ ID NO: 1133224 - RNA, 20 nt, Human
ugaagccaugcagccugcug

SEQ ID NO: 1133225 - RNA, 18 nt, Human
ugaauagaucaucuaaaa

SEQ ID NO: 1133226 - RNA, 19 nt, Human
ugacauggggaagggcuga

SEQ ID NO: 1133227 - RNA, 22 nt, Human
ugagagcccagcccccagaggc

SEQ ID NO: 1133228 - RNA, 20 nt, Human
ugagggaagagauuccaugc

SEQ ID NO: 1133229 - RNA, 19 nt, Human
ugagugagcaaccccuggg

SEQ ID NO: 1133230 - RNA, 19 nt, Human
ugcagaaacagacacagga

SEQ ID NO: 1133231 - RNA, 21 nt, Human
ugcauucugcccuggggcucc

SEQ ID NO: 1133232 - RNA, 20 nt, Human
ugccaccaccacugccaggc

SEQ ID NO: 1133233 - RNA, 20 nt, Human
ugcccuggggauccugcugc

SEQ ID NO: 1133234 - RNA, 22 nt, Human
ugccuagcacccuuuugaaagc

SEQ ID NO: 1133235 - RNA, 23 nt, Human
ugccugaacugagagucaucagc

SEQ ID NO: 1133236 - RNA, 19 nt, Human
ugccugagcauuuuggcug

SEQ ID NO: 1133237 - RNA, 21 nt, Human
ugccugugcuccucauugaag

SEQ ID NO: 1133238 - RNA, 24 nt, Human
ugcugcugcugcaggguagaggag

SEQ ID NO: 1133239 - RNA, 19 nt, Human
ugcuguugcagugccagga

SEQ ID NO: 1133240 - RNA, 19 nt, Human
ugcuguugccuagcacccu

SEQ ID NO: 1133241 - RNA, 18 nt, Human
ugcuguugcugcaacugc

SEQ ID NO: 1133242 - RNA, 19 nt, Human
uggaaagcaaagaaaggug

SEQ ID NO: 1133243 - RNA, 20 nt, Human
uggagaacaggagagccaca

SEQ ID NO: 1133244 - RNA, 25 nt, Human
uggagcugguggagcccccucucca

SEQ ID NO: 1133245 - RNA, 18 nt, Human
uggcacccuucugagagc

SEQ ID NO: 1133246 - RNA, 21 nt, Human
uggggaagggcugagugagca

SEQ ID NO: 1133247 - RNA, 18 nt, Human
uggggagggaguggggag

SEQ ID NO: 1133248 - RNA, 18 nt, Human
uggggagggaguggggag

SEQ ID NO: 1133249 - RNA, 18 nt, Human
uuccagugaagaaucacg

SEQ ID NO: 1133250 - RNA, 18 nt, Human
uucccuaggcucacagua

SEQ ID NO: 1133251 - RNA, 24 nt, Human
uuucaugaugugaauaucaucacu

SEQ ID NO: 1133252 - RNA, 21 nt, Human
aaaaggaaagcucuccacaaa

SEQ ID NO: 1133253 - RNA, 25 nt, Human
aaacaaccagaucucgcuaagaacu

SEQ ID NO: 1133254 - RNA, 28 nt, Human
aaacaaugaggcaggaaaaaaaaggggg

SEQ ID NO: 1133255 - RNA, 26 nt, Human
aaacaucucuuuaaaccauacuuaac

SEQ ID NO: 1133256 - RNA, 18 nt, Human
aaaggcuugagaaccagg

SEQ ID NO: 1133257 - RNA, 23 nt, Human
aacacacucaagacacuucagaa

SEQ ID NO: 1133258 - RNA, 18 nt, Human
aagaaguuuaauuggcuc

SEQ ID NO: 1133259 - RNA, 23 nt, Human
aagaggaaggaggcacguccaca

SEQ ID NO: 1133260 - RNA, 22 nt, Human
acaaggugaagaggaaggaggc

SEQ ID NO: 1133261 - RNA, 23 nt, Human
acuuggcacccauaaacaucucu

SEQ ID NO: 1133262 - RNA, 22 nt, Human
agaggcuguccaggaacccuuc

SEQ ID NO: 1133263 - RNA, 20 nt, Human
agaucucgcuaagaacucac

SEQ ID NO: 1133264 - RNA, 19 nt, Human
agcucaaacaaugaggcag

SEQ ID NO: 1133265 - RNA, 21 nt, Human
aggaacccuucucuauuugcc

SEQ ID NO: 1133266 - RNA, 18 nt, Human
aggcaaaaggaaagcucu

SEQ ID NO: 1133267 - RNA, 21 nt, Human
aggcaggaaaaaaaagggggg

SEQ ID NO: 1133268 - RNA, 24 nt, Human
aucacaugaccagaaaaaauuagg

SEQ ID NO: 1133269 - RNA, 21 nt, Human
augaccagaaaaaauuaggca

SEQ ID NO: 1133270 - RNA, 24 nt, Human
auguccacccaccuuggggauggc

SEQ ID NO: 1133271 - RNA, 19 nt, Human
caaaaggaaagcucuccac

SEQ ID NO: 1133272 - RNA, 23 nt, Human
caauacuaggggauuaaaauuca

SEQ ID NO: 1133273 - RNA, 22 nt, Human
cacacacgagcugaagaggcac

SEQ ID NO: 1133274 - RNA, 21 nt, Human
caccuccuccaauacuagggg

SEQ ID NO: 1133275 - RNA, 22 nt, Human
cacgacaacagcaaggagcaag

SEQ ID NO: 1133276 - RNA, 19 nt, Human
caguguccaugucuauucc

SEQ ID NO: 1133277 - RNA, 18 nt, Human
caucugaggacagaagau

SEQ ID NO: 1133278 - RNA, 24 nt, Human
caucugcaaagucccuaauuccaa

SEQ ID NO: 1133279 - RNA, 22 nt, Human
ccaucugaggacagaagaugag

SEQ ID NO: 1133280 - RNA, 20 nt, Human
ccccaugauccaaucaccuc

SEQ ID NO: 1133281 - RNA, 20 nt, Human
ccccugcauaaggagcaaac

SEQ ID NO: 1133282 - RNA, 22 nt, Human
ccuaggcuugugccugucaccu

SEQ ID NO: 1133283 - RNA, 19 nt, Human
cgacaacagcaaggagcaa

SEQ ID NO: 1133284 - RNA, 22 nt, Human
cgacaacagcaaggagcaaguc

SEQ ID NO: 1133285 - RNA, 19 nt, Human
cgcuaagaacucacuauca

SEQ ID NO: 1133286 - RNA, 26 nt, Human
cuaggcaagucagaggcuguccagga

SEQ ID NO: 1133287 - RNA, 19 nt, Human
cuaucacgacaacagcaag

SEQ ID NO: 1133288 - RNA, 21 nt, Human
cucgcuaagaacucacuauca

SEQ ID NO: 1133289 - RNA, 18 nt, Human
cuuuuaaacaaccagauc

SEQ ID NO: 1133290 - RNA, 22 nt, Human
gaacucacuaucacgacaacag

SEQ ID NO: 1133291 - RNA, 19 nt, Human
gaaucuuucacagugggca

SEQ ID NO: 1133292 - RNA, 21 nt, Human
gagggguccuucaugcagguu

SEQ ID NO: 1133293 - RNA, 18 nt, Human
gcaagccacgugugcaca

SEQ ID NO: 1133294 - RNA, 19 nt, Human
gcaggaaaaaaaagggggg

SEQ ID NO: 1133295 - RNA, 19 nt, Human
ggaaggaggcacguccaca

SEQ ID NO: 1133296 - RNA, 18 nt, Human
ggacagaagaugagaugu

SEQ ID NO: 1133297 - RNA, 19 nt, Human
ggagacccaggaaggccug

SEQ ID NO: 1133298 - RNA, 22 nt, Human
gggaauucuuccuuccucugcc

SEQ ID NO: 1133299 - RNA, 23 nt, Human
gggaauucuuccuuccucugccu

SEQ ID NO: 1133300 - RNA, 19 nt, Human
gggcacaaggugaagagga

SEQ ID NO: 1133301 - RNA, 20 nt, Human
uaacuugauuacaucugcaa

SEQ ID NO: 1133302 - RNA, 21 nt, Human
uacaaccuugucuuaacuuga

SEQ ID NO: 1133303 - RNA, 22 nt, Human
uacacacugaaaggcgaggagg

SEQ ID NO: 1133304 - RNA, 19 nt, Human
uaucacgacaacagcaagg

SEQ ID NO: 1133305 - RNA, 18 nt, Human
ucacagugggcauguuca

SEQ ID NO: 1133306 - RNA, 18 nt, Human
uccacaaaaagagggguc

SEQ ID NO: 1133307 - RNA, 21 nt, Human
uccacccaccuuggggauggc

SEQ ID NO: 1133308 - RNA, 22 nt, Human
uccuuguggcuccaccccaugu

SEQ ID NO: 1133309 - RNA, 24 nt, Human
ugaauccaaaggcuugagaaccag

SEQ ID NO: 1133310 - RNA, 21 nt, Human
ugaccagaaaaaauuaggcac

SEQ ID NO: 1133311 - RNA, 20 nt, Human
ugagaugucacagcucaaac

SEQ ID NO: 1133312 - RNA, 18 nt, Human
ugaggacagaagaugaga

SEQ ID NO: 1133313 - RNA, 23 nt, Human
ugaggacagaagaugagauguca

SEQ ID NO: 1133314 - RNA, 24 nt, Human
ugcacauguguugagaaauggaau

SEQ ID NO: 1133315 - RNA, 19 nt, Human
ugcaccuccuccaauacua

SEQ ID NO: 1133316 - RNA, 18 nt, Human
uggaaucuuucacagugg

SEQ ID NO: 1133317 - RNA, 24 nt, Human
ugugccugucaccuuucucuuuca

SEQ ID NO: 1133318 - RNA, 27 nt, Human
uuaaacaaccagaucucgcuaagaacc

SEQ ID NO: 1133319 - RNA, 19 nt, Human
uucaugcagguuuuacacc

SEQ ID NO: 1133320 - RNA, 21 nt, Human
uuccaaauaggagcauauuca

SEQ ID NO: 1133321 - RNA, 22 nt, Human
uuuaaacagauauuuggcaccc

SEQ ID NO: 1133322 - RNA, 21 nt, Human
uuuaaaccauacuuaacugcc

SEQ ID NO: 1133323 - RNA, 20 nt, Human
uuuacugagucccccaguuc

SEQ ID NO: 1133324 - RNA, 22 nt, Human
agacaggaugggaggaaugggu

SEQ ID NO: 1133325 - RNA, 18 nt, Human
aggaaucagggaugacuu

SEQ ID NO: 1133326 - RNA, 23 nt, Human
cuucccagcucccggggcgaaca

SEQ ID NO: 1133327 - RNA, 18 nt, Human
ggaacauacaucccagcc

SEQ ID NO: 1133328 - RNA, 21 nt, Human
ggguuugggagguuaacaaaa

SEQ ID NO: 1133329 - RNA, 21 nt, Human
gguuuagguuuaucuuccaca

SEQ ID NO: 1133330 - RNA, 22 nt, Human
guuuucaacaagaucaccccgg

SEQ ID NO: 1133331 - RNA, 24 nt, Human
uccacagcgugggcaauucuuuuu

SEQ ID NO: 1133332 - RNA, 21 nt, Human
uggaaucaagguguaaggaac

SEQ ID NO: 1133333 - RNA, 25 nt, Human
ugggagaggguuaagaagaaggagg

SEQ ID NO: 1133334 - RNA, 27 nt, Human
ugggagaggguuaagaagaaggaggaa

SEQ ID NO: 1133335 - RNA, 20 nt, Human
uguaaggaacauacauccca

SEQ ID NO: 1133336 - RNA, 22 nt, Human
uguauggaaucaagguguaagg

SEQ ID NO: 1133337 - RNA, 21 nt, Human
uuaacaaaaauggaugggaga

SEQ ID NO: 1133338 - RNA, 23 nt, Human
uuuuuguuuucaacaagaucacc

SEQ ID NO: 1133339 - RNA, 19 nt, Human
aaaagcccagaguugaagu

SEQ ID NO: 1133340 - RNA, 23 nt, Human
aaacagaugcucgaugcagcaac

SEQ ID NO: 1133341 - RNA, 20 nt, Human
aaaccccaggccccauggca

SEQ ID NO: 1133342 - RNA, 21 nt, Human
aaagcccagaguugaaguguu

SEQ ID NO: 1133343 - RNA, 23 nt, Human
aaauaagagagcaguucagcgag

SEQ ID NO: 1133344 - RNA, 18 nt, Human
aacaugggaaaccccauc

SEQ ID NO: 1133345 - RNA, 20 nt, Human
aagaagaaaauguuaaaggg

SEQ ID NO: 1133346 - RNA, 19 nt, Human
aaggcaggaggaucaccug

SEQ ID NO: 1133347 - RNA, 22 nt, Human
aaucacuugaacccagaggcga

SEQ ID NO: 1133348 - RNA, 21 nt, Human
aaugaacccccacccgugccc

SEQ ID NO: 1133349 - RNA, 25 nt, Human
acagacaguaacacuuuguaggaac

SEQ ID NO: 1133350 - RNA, 24 nt, Human
acaggccaggugcaguggcucaug

SEQ ID NO: 1133351 - RNA, 23 nt, Human
accacaaaccccaggccccaugg

SEQ ID NO: 1133352 - RNA, 22 nt, Human
accacugcacuccagccugggc

SEQ ID NO: 1133353 - RNA, 18 nt, Human
acuagaauacaaaaucua

SEQ ID NO: 1133354 - RNA, 24 nt, Human
acuccagccugggcgacagaguga

SEQ ID NO: 1133355 - RNA, 24 nt, Human
acugcacuccagccugggcgacag

SEQ ID NO: 1133356 - RNA, 26 nt, Human
acugcacuccagccugggcgacagag

SEQ ID NO: 1133357 - RNA, 24 nt, Human
acuuugguggaaccauuuuucuca

SEQ ID NO: 1133358 - RNA, 26 nt, Human
agacaguaacacuuuguaggaacuca

SEQ ID NO: 1133359 - RNA, 22 nt, Human
agaggcgaagguugcagugagc

SEQ ID NO: 1133360 - RNA, 19 nt, Human
agagugagacgaccuaaaa

SEQ ID NO: 1133361 - RNA, 24 nt, Human
agcaagaugccuggaggaccaaaa

SEQ ID NO: 1133362 - RNA, 23 nt, Human
agcccagaguugaaguguugagu

SEQ ID NO: 1133363 - RNA, 23 nt, Human
agccgggcgugguggcauaugcu

SEQ ID NO: 1133364 - RNA, 23 nt, Human
agccuggccaacaugggaaaccc

SEQ ID NO: 1133365 - RNA, 22 nt, Human
agccugggcgacagagugagac

SEQ ID NO: 1133366 - RNA, 24 nt, Human
aggaucaccugaggucauaaguuc

SEQ ID NO: 1133367 - RNA, 18 nt, Human
aggcaggagaaucacuug

SEQ ID NO: 1133368 - RNA, 23 nt, Human
aggcaggagaaucacuugaaccc

SEQ ID NO: 1133369 - RNA, 24 nt, Human
aggcaggagaaucacuugaaccca

SEQ ID NO: 1133370 - RNA, 18 nt, Human
aggcaggaggaucaccug

SEQ ID NO: 1133371 - RNA, 18 nt, Human
aggcaggaggaucaccug

SEQ ID NO: 1133372 - RNA, 19 nt, Human
aggccccauggcauccagc

SEQ ID NO: 1133373 - RNA, 21 nt, Human
aggcgaagguugcagugagcc

SEQ ID NO: 1133374 - RNA, 24 nt, Human
aggcgaagguugcagugagccgag

SEQ ID NO: 1133375 - RNA, 24 nt, Human
aggcugaggcaggagaaucacuug

SEQ ID NO: 1133376 - RNA, 24 nt, Human
aggugcaguggcucaugccuauaa

SEQ ID NO: 1133377 - RNA, 24 nt, Human
aguggcucaugccuauaaucccag

SEQ ID NO: 1133378 - RNA, 22 nt, Human
aguuccuauuuaccugauuaac

SEQ ID NO: 1133379 - RNA, 19 nt, Human
augccuauaaucccagcac

SEQ ID NO: 1133380 - RNA, 24 nt, Human
auggcaccacugcacuccagccug

SEQ ID NO: 1133381 - RNA, 21 nt, Human
auggcauccagccccugcaua

SEQ ID NO: 1133382 - RNA, 24 nt, Human
caaaccccaggccccauggcaucc

SEQ ID NO: 1133383 - RNA, 27 nt, Human
caaaccccaggccccauggcauccagg

SEQ ID NO: 1133384 - RNA, 19 nt, Human
caacaugggaaaccccauc

SEQ ID NO: 1133385 - RNA, 19 nt, Human
caagaagaaaauguuaaag

SEQ ID NO: 1133386 - RNA, 24 nt, Human
caaggcaggaggaucaccugaggu

SEQ ID NO: 1133387 - RNA, 25 nt, Human
caaggcaggaggaucaccugagguc

SEQ ID NO: 1133388 - RNA, 26 nt, Human
caaggcaggaggaucaccugagguca

SEQ ID NO: 1133389 - RNA, 26 nt, Human
caccacugcacuccagccugggcgac

SEQ ID NO: 1133390 - RNA, 22 nt, Human
cacuccagccugggcgacagag

SEQ ID NO: 1133391 - RNA, 22 nt, Human
cacuccagccugggcgacagag

SEQ ID NO: 1133392 - RNA, 24 nt, Human
cacuccagccugggcgacagagug

SEQ ID NO: 1133393 - RNA, 19 nt, Human
cacugcacuccagccuggg

SEQ ID NO: 1133394 - RNA, 21 nt, Human
cacugcacuccagccugggcg

SEQ ID NO: 1133395 - RNA, 22 nt, Human
cacugcacuccagccugggcga

SEQ ID NO: 1133396 - RNA, 23 nt, Human
cacugcacuccagccugggcgac

SEQ ID NO: 1133397 - RNA, 24 nt, Human
cacugcacuccagccugggcgaca

SEQ ID NO: 1133398 - RNA, 24 nt, Human
cagaauaaauagaacaguagaaug

SEQ ID NO: 1133399 - RNA, 22 nt, Human
cagcaagaugccuggaggacca

SEQ ID NO: 1133400 - RNA, 24 nt, Human
cagcacuuugggaggccaaggcag

SEQ ID NO: 1133401 - RNA, 25 nt, Human
cagcacuuugggaggccaaggcagg

SEQ ID NO: 1133402 - RNA, 26 nt, Human
cagcagagauuaagaugagggccaua

SEQ ID NO: 1133403 - RNA, 23 nt, Human
cagcgaggugccugggccacggg

SEQ ID NO: 1133404 - RNA, 24 nt, Human
cagcuacuuggaaggcugaggcag

SEQ ID NO: 1133405 - RNA, 24 nt, Human
caggaacaguucccacaaaacuag

SEQ ID NO: 1133406 - RNA, 24 nt, Human
caugccuauaaucccagcacuuug

SEQ ID NO: 1133407 - RNA, 18 nt, Human
ccaaaagcccagaguuga

SEQ ID NO: 1133408 - RNA, 20 nt, Human
ccacugcacuccagccuggg

SEQ ID NO: 1133409 - RNA, 21 nt, Human
ccacugcacuccagccugggc

SEQ ID NO: 1133410 - RNA, 21 nt, Human
ccacugcacuccagccugggc

SEQ ID NO: 1133411 - RNA, 23 nt, Human
ccacugcacuccagccugggcga

SEQ ID NO: 1133412 - RNA, 24 nt, Human
ccacugcacuccagccugggcgac

SEQ ID NO: 1133413 - RNA, 21 nt, Human
ccaggaacaguucccacaaaa

SEQ ID NO: 1133414 - RNA, 22 nt, Human
ccauacuaucccuuuugcugug

SEQ ID NO: 1133415 - RNA, 21 nt, Human
ccauggcauccagccccugcc

SEQ ID NO: 1133416 - RNA, 19 nt, Human
cccacagcaccacugcagu

SEQ ID NO: 1133417 - RNA, 25 nt, Human
ccccaggccccauggcauccagccc

SEQ ID NO: 1133418 - RNA, 22 nt, Human
cccuaguauuccaggaacaguu

SEQ ID NO: 1133419 - RNA, 23 nt, Human
ccuggccaacaugggaaacccca

SEQ ID NO: 1133420 - RNA, 20 nt, Human
ccugggccacgggagggcuc

SEQ ID NO: 1133421 - RNA, 20 nt, Human
ccugggccacgggagggcuc

SEQ ID NO: 1133422 - RNA, 21 nt, Human
cgagaccagccuggccaacau

SEQ ID NO: 1133423 - RNA, 19 nt, Human
cgguuaaaaauaagagagc

SEQ ID NO: 1133424 - RNA, 24 nt, Human
cucaugccuauaaucccagcacuu

SEQ ID NO: 1133425 - RNA, 21 nt, Human
cuccaguguacaaggucccac

SEQ ID NO: 1133426 - RNA, 23 nt, Human
cuccaguguacaaggucccacaa

SEQ ID NO: 1133427 - RNA, 25 nt, Human
cuggaaaacacaacccuaguauucc

SEQ ID NO: 1133428 - RNA, 21 nt, Human
cugggccacgggagggcucuu

SEQ ID NO: 1133429 - RNA, 20 nt, Human
gaacaauuuuaaauuguugg

SEQ ID NO: 1133430 - RNA, 21 nt, Human
gaacaguucccacaaaacuag

SEQ ID NO: 1133431 - RNA, 18 nt, Human
gaagguugcagugagccg

SEQ ID NO: 1133432 - RNA, 22 nt, Human
gaagguugcagugagccgagau

SEQ ID NO: 1133433 - RNA, 24 nt, Human
gaagguugcagugagccgagaugg

SEQ ID NO: 1133434 - RNA, 22 nt, Human
gagaccagccuggccaacaugg

SEQ ID NO: 1133435 - RNA, 23 nt, Human
gagauggcaccacugcacuccag

SEQ ID NO: 1133436 - RNA, 24 nt, Human
gaucaccugaggucauaaguucga

SEQ ID NO: 1133437 - RNA, 23 nt, Human
gcacuccagccugggcgacagag

SEQ ID NO: 1133438 - RNA, 22 nt, Human
gcaggagaaucacuugaaccca

SEQ ID NO: 1133439 - RNA, 21 nt, Human
gccaacaugggaaaccccauc

SEQ ID NO: 1133440 - RNA, 23 nt, Human
gccacgggagggcucuuugucac

SEQ ID NO: 1133441 - RNA, 18 nt, Human
gcccaaggaugaaagcaa

SEQ ID NO: 1133442 - RNA, 21 nt, Human
gccugggccacgggagggcuc

SEQ ID NO: 1133443 - RNA, 23 nt, Human
ggaucaccugaggucauaaguuc

SEQ ID NO: 1133444 - RNA, 21 nt, Human
gggaaaccccaucccuacuaa

SEQ ID NO: 1133445 - RNA, 23 nt, Human
gugcagauauaaugaacccccac

SEQ ID NO: 1133446 - RNA, 23 nt, Human
guggaaccauuuuucucagcuuu

SEQ ID NO: 1133447 - RNA, 24 nt, Human
guuaaaggggagaacaauuuuaaa

SEQ ID NO: 1133448 - RNA, 18 nt, Human
guugcagugagccgagau

SEQ ID NO: 1133449 - RNA, 26 nt, Human
uaaacagaugcucgaugcagcaacau

SEQ ID NO: 1133450 - RNA, 23 nt, Human
uaacauuuuaugcuagccccaca

SEQ ID NO: 1133451 - RNA, 21 nt, Human
uaagaugagggccauacuauc

SEQ ID NO: 1133452 - RNA, 22 nt, Human
uacaaaguaugaauugccucca

SEQ ID NO: 1133453 - RNA, 22 nt, Human
uacaaggucccacaacauguug

SEQ ID NO: 1133454 - RNA, 26 nt, Human
uacuuucuuuuuacucuuauauguca

SEQ ID NO: 1133455 - RNA, 22 nt, Human
uagccgggcgugguggcauaug

SEQ ID NO: 1133456 - RNA, 21 nt, Human
uauaugucaauucugaaauau

SEQ ID NO: 1133457 - RNA, 18 nt, Human
uaugucaauucugaaaua

SEQ ID NO: 1133458 - RNA, 18 nt, Human
uaugucaauucugaaaua

SEQ ID NO: 1133459 - RNA, 24 nt, Human
ucacuugaacccagaggcgaaggu

SEQ ID NO: 1133460 - RNA, 19 nt, Human
ucagcagagauuaagauga

SEQ ID NO: 1133461 - RNA, 23 nt, Human
ucagcagagauuaagaugagggc

SEQ ID NO: 1133462 - RNA, 24 nt, Human
ucagcagagauuaagaugagggcc

SEQ ID NO: 1133463 - RNA, 22 nt, Human
ucaugccuauaaucccagcacu

SEQ ID NO: 1133464 - RNA, 23 nt, Human
uccagccugggcgacagagugag

SEQ ID NO: 1133465 - RNA, 24 nt, Human
uccagccugggcgacagagugaga

SEQ ID NO: 1133466 - RNA, 18 nt, Human
uccaguguacaagguccc

SEQ ID NO: 1133467 - RNA, 23 nt, Human
uccauuuaccaucauaacugguc

SEQ ID NO: 1133468 - RNA, 23 nt, Human
ucccacaacauguuggaucucug

SEQ ID NO: 1133469 - RNA, 21 nt, Human
ucgaugcagcaacauucauuu

SEQ ID NO: 1133470 - RNA, 20 nt, Human
ucgcucagaaaugcgggcaa

SEQ ID NO: 1133471 - RNA, 19 nt, Human
ucucuggaaaacacaaccc

SEQ ID NO: 1133472 - RNA, 18 nt, Human
ugaacccagaggcgaagg

SEQ ID NO: 1133473 - RNA, 20 nt, Human
ugaggcaggagaaucacuug

SEQ ID NO: 1133474 - RNA, 24 nt, Human
ugaggcaggagaaucacuugaacc

SEQ ID NO: 1133475 - RNA, 25 nt, Human
ugaggcaggagaaucacuugaaccc

SEQ ID NO: 1133476 - RNA, 23 nt, Human
ugccuauaaucccagcacuuugg

SEQ ID NO: 1133477 - RNA, 24 nt, Human
ugccuauaaucccagcacuuuggg

SEQ ID NO: 1133478 - RNA, 21 nt, Human
ugccuggaggaccaaaagccc

SEQ ID NO: 1133479 - RNA, 19 nt, Human
ugccugggccacgggaggg

SEQ ID NO: 1133480 - RNA, 20 nt, Human
ugcuugcgggucaagauaaa

SEQ ID NO: 1133481 - RNA, 23 nt, Human
ugcuuguacucccagcuacuugg

SEQ ID NO: 1133482 - RNA, 20 nt, Human
uggaaggcugaggcaggaga

SEQ ID NO: 1133483 - RNA, 24 nt, Human
uggaaggcugaggcaggagaauca

SEQ ID NO: 1133484 - RNA, 22 nt, Human
uggaggaccaaaagcccagagu

SEQ ID NO: 1133485 - RNA, 23 nt, Human
uggaucucuggaaaacacaaccc

SEQ ID NO: 1133486 - RNA, 20 nt, Human
uggcaccacugcacuccagc

SEQ ID NO: 1133487 - RNA, 21 nt, Human
uggcucaugccuauaauccca

SEQ ID NO: 1133488 - RNA, 24 nt, Human
uggcucaugccuauaaucccagca

SEQ ID NO: 1133489 - RNA, 23 nt, Human
ugggaaaccccaucccuacuaaa

SEQ ID NO: 1133490 - RNA, 19 nt, Human
ugggaggagaaagacagaa

SEQ ID NO: 1133491 - RNA, 24 nt, Human
ugggaggccaaggcaggaggauca

SEQ ID NO: 1133492 - RNA, 25 nt, Human
uuaccacaaaccccaggccccaugg

SEQ ID NO: 1133493 - RNA, 18 nt, Human
uuagccgggcgugguggc

SEQ ID NO: 1133494 - RNA, 20 nt, Human
uuagccgggcgugguggcau

SEQ ID NO: 1133495 - RNA, 24 nt, Human
uuagccgggcgugguggcauaugc

SEQ ID NO: 1133496 - RNA, 18 nt, Human
uugcagugagccgagaug

SEQ ID NO: 1133497 - RNA, 22 nt, Human
uugcagugagccgagauggcac

SEQ ID NO: 1133498 - RNA, 25 nt, Human
uuggaaggcugaggcaggagaauca

SEQ ID NO: 1133499 - RNA, 19 nt, Human
uugguggaaccauuuuucu

SEQ ID NO: 1133500 - RNA, 23 nt, Human
uuuaccacaaaccccaggcccca

SEQ ID NO: 1133501 - RNA, 21 nt, Human
uuuggguuacuuucuuuuuac

SEQ ID NO: 1133502 - RNA, 22 nt, Human
aacaaucaccacaaacuccggc

SEQ ID NO: 1133503 - RNA, 24 nt, Human
aaugugcagguggcaucccugagg

SEQ ID NO: 1133504 - RNA, 21 nt, Human
accacaaacuccggcgaccgc

SEQ ID NO: 1133505 - RNA, 20 nt, Human
acuaaaauagaagguaucug

SEQ ID NO: 1133506 - RNA, 23 nt, Human
acuacaccuacuagaaaaaaaga

SEQ ID NO: 1133507 - RNA, 22 nt, Human
agaauccccccaaaccaggacc

SEQ ID NO: 1133508 - RNA, 27 nt, Human
agaauccccccaaaccaggaccaguau

SEQ ID NO: 1133509 - RNA, 20 nt, Human
agccggggggguggcggcga

SEQ ID NO: 1133510 - RNA, 20 nt, Human
aggaggagauggcagccggg

SEQ ID NO: 1133511 - RNA, 18 nt, Human
aggaggaggaggaagagg

SEQ ID NO: 1133512 - RNA, 19 nt, Human
aggaggaggaggaagagga

SEQ ID NO: 1133513 - RNA, 21 nt, Human
aggaggaggcggcggcccagg

SEQ ID NO: 1133514 - RNA, 22 nt, Human
aggaggaggcggcggcccagga

SEQ ID NO: 1133515 - RNA, 21 nt, Human
aggaggcggcggcccaggagg

SEQ ID NO: 1133516 - RNA, 21 nt, Human
aggaggcggcggcggcggcgg

SEQ ID NO: 1133517 - RNA, 19 nt, Human
aucgugguaaaggcuaggc

SEQ ID NO: 1133518 - RNA, 27 nt, Human
augaggaggcggcggcggcggcggcaa

SEQ ID NO: 1133519 - RNA, 23 nt, Human
augcaauuucuuuauuaaaaagc

SEQ ID NO: 1133520 - RNA, 19 nt, Human
caacauggguaguaauuga

SEQ ID NO: 1133521 - RNA, 20 nt, Human
caccuaagcccggaaagccc

SEQ ID NO: 1133522 - RNA, 21 nt, Human
cagaauccccccaaaccagga

SEQ ID NO: 1133523 - RNA, 21 nt, Human
cagcccaggaggaggcggcag

SEQ ID NO: 1133524 - RNA, 19 nt, Human
ccacggcggccucaccuaa

SEQ ID NO: 1133525 - RNA, 19 nt, Human
ccaggaggaggagauggca

SEQ ID NO: 1133526 - RNA, 18 nt, Human
ccccacggcccccucccc

SEQ ID NO: 1133527 - RNA, 21 nt, Human
cccccacggcccccuccccuc

SEQ ID NO: 1133528 - RNA, 24 nt, Human
ccccggcguccccgcugcugccca

SEQ ID NO: 1133529 - RNA, 18 nt, Human
cccggaaagcccuggccc

SEQ ID NO: 1133530 - RNA, 19 nt, Human
cccggaaagcccuggcccc

SEQ ID NO: 1133531 - RNA, 19 nt, Human
cccuggccccggcccccgg

SEQ ID NO: 1133532 - RNA, 23 nt, Human
ccgccggaagauggggcccacgg

SEQ ID NO: 1133533 - RNA, 21 nt, Human
ccgccuauggugcacgaggau

SEQ ID NO: 1133534 - RNA, 22 nt, Human
ccggcgaccgccggaagauggg

SEQ ID NO: 1133535 - RNA, 24 nt, Human
ccucaccuaagcccggaaagcccc

SEQ ID NO: 1133536 - RNA, 18 nt, Human
ccucccagcuggccuccc

SEQ ID NO: 1133537 - RNA, 19 nt, Human
ccugugccgccuauggugc

SEQ ID NO: 1133538 - RNA, 19 nt, Human
cgcugcugcccagccgggg

SEQ ID NO: 1133539 - RNA, 24 nt, Human
cggcccaggaggaggagauggcag

SEQ ID NO: 1133540 - RNA, 25 nt, Human
cggcggcagcaacaaucaccacaaa

SEQ ID NO: 1133541 - RNA, 22 nt, Human
cguccccgcugcugcccagccg

SEQ ID NO: 1133542 - RNA, 27 nt, Human
cuaagcccggaaagcccuggccccggc

SEQ ID NO: 1133543 - RNA, 22 nt, Human
cugcugcccagccggggcugga

SEQ ID NO: 1133544 - RNA, 24 nt, Human
cuuuacauugucaucuuuuuugau

SEQ ID NO: 1133545 - RNA, 25 nt, Human
cuuuauuagcaacuaaaauagaagg

SEQ ID NO: 1133546 - RNA, 24 nt, Human
gaagaggaggaggcggcggcccag

SEQ ID NO: 1133547 - RNA, 21 nt, Human
gagauggcagccgggggggug

SEQ ID NO: 1133548 - RNA, 26 nt, Human
gaggaggagauggcagccgggggggu

SEQ ID NO: 1133549 - RNA, 19 nt, Human
gcccggacagaguaugaga

SEQ ID NO: 1133550 - RNA, 21 nt, Human
gcccuggccccggcccccggc

SEQ ID NO: 1133551 - RNA, 18 nt, Human
gcggcagcggggagggga

SEQ ID NO: 1133552 - RNA, 21 nt, Human
gcggcagcggggaggggauca

SEQ ID NO: 1133553 - RNA, 18 nt, Human
gcggcggcccaggaggag

SEQ ID NO: 1133554 - RNA, 20 nt, Human
gcggcggcggcggcaggagc

SEQ ID NO: 1133555 - RNA, 23 nt, Human
gcggcggcggcggcggcaggagc

SEQ ID NO: 1133556 - RNA, 19 nt, Human
ggaaagcccuggccccggc

SEQ ID NO: 1133557 - RNA, 23 nt, Human
ggaaagcccuggccccggccccc

SEQ ID NO: 1133558 - RNA, 18 nt, Human
ggaagauggggcccacgg

SEQ ID NO: 1133559 - RNA, 19 nt, Human
ggagauggcagccgggggg

SEQ ID NO: 1133560 - RNA, 23 nt, Human
ggaggagauggcagccggggggg

SEQ ID NO: 1133561 - RNA, 18 nt, Human
ggaggaggaagaggagga

SEQ ID NO: 1133562 - RNA, 18 nt, Human
ggaggaggaggaagagga

SEQ ID NO: 1133563 - RNA, 18 nt, Human
ggaggcggcggcggcggc

SEQ ID NO: 1133564 - RNA, 20 nt, Human
gggggguggcggcggcagca

SEQ ID NO: 1133565 - RNA, 18 nt, Human
ucgugguaaaggcuaggc

SEQ ID NO: 1133566 - RNA, 27 nt, Human
ugcccagccggggcugggagguccucc

SEQ ID NO: 1133567 - RNA, 28 nt, Human
ugcccagccggggcugguuucgaggccg

SEQ ID NO: 1133568 - RNA, 19 nt, Human
uggcagccggggggguggc

SEQ ID NO: 1133569 - RNA, 23 nt, Human
ugggagcccggacagaguaugag

SEQ ID NO: 1133570 - RNA, 18 nt, Human
uguuguacaacaugggua

SEQ ID NO: 1133571 - RNA, 20 nt, Human
uucagccgagccgcccccac

SEQ ID NO: 1133572 - RNA, 23 nt, Human
aaacaaccucaaaagcagauuga

SEQ ID NO: 1133573 - RNA, 21 nt, Human
aaacugaagauaagcacaggg

SEQ ID NO: 1133574 - RNA, 23 nt, Human
aagaaagaauauauuuuaaaaaa

SEQ ID NO: 1133575 - RNA, 22 nt, Human
aagcaaaagagaauuuaacugg

SEQ ID NO: 1133576 - RNA, 19 nt, Human
aagcacaggguucuucaca

SEQ ID NO: 1133577 - RNA, 21 nt, Human
aggcaguccacaaucuccuca

SEQ ID NO: 1133578 - RNA, 24 nt, Human
aucaagaaagcaaaagagaauuua

SEQ ID NO: 1133579 - RNA, 18 nt, Human
auccaucuucugaggucu

SEQ ID NO: 1133580 - RNA, 25 nt, Human
caaacagauccaucuucugaggucu

SEQ ID NO: 1133581 - RNA, 21 nt, Human
ccgcgcuguucccacgacugc

SEQ ID NO: 1133582 - RNA, 22 nt, Human
cuuuuugcugcaucugcuuaau

SEQ ID NO: 1133583 - RNA, 23 nt, Human
gccaacgccgcagcgccggcgcg

SEQ ID NO: 1133584 - RNA, 18 nt, Human
ggcaguccacaaucuccu

SEQ ID NO: 1133585 - RNA, 24 nt, Human
ggucuuuaaaaggauuuaccuuuu

SEQ ID NO: 1133586 - RNA, 22 nt, Human
uaaacugaagauaagcacaggg

SEQ ID NO: 1133587 - RNA, 23 nt, Human
uaauucuccagccuucucuucug

SEQ ID NO: 1133588 - RNA, 23 nt, Human
uagauccuuugcaauaggaaucu

SEQ ID NO: 1133589 - RNA, 23 nt, Human
ucaaaagcagauugaaacaaaca

SEQ ID NO: 1133590 - RNA, 24 nt, Human
uccacaaucuccucacugguguuc

SEQ ID NO: 1133591 - RNA, 21 nt, Human
ucccacgacugcgccaacgcc

SEQ ID NO: 1133592 - RNA, 24 nt, Human
ugaugauaaacugaagauaagcac

SEQ ID NO: 1133593 - RNA, 19 nt, Human
ugucugaugauaaacugaa

SEQ ID NO: 1133594 - RNA, 23 nt, Human
uuugacagguuuuggucucuuuu

SEQ ID NO: 1133595 - RNA, 19 nt, Human
aagagucagcaagcuauga

SEQ ID NO: 1133596 - RNA, 24 nt, Human
caacucucagaaaccauucaccaa

SEQ ID NO: 1133597 - RNA, 18 nt, Human
cacgccugccuacucaca

SEQ ID NO: 1133598 - RNA, 23 nt, Human
cccacaggccaaaucugacccac

SEQ ID NO: 1133599 - RNA, 24 nt, Human
cccauuauggggagagaugaaagu

SEQ ID NO: 1133600 - RNA, 20 nt, Human
cuccccaguuguuacucaac

SEQ ID NO: 1133601 - RNA, 24 nt, Human
cugacccacuccuugguccccugg

SEQ ID NO: 1133602 - RNA, 19 nt, Human
cugguccauggacucuacu

SEQ ID NO: 1133603 - RNA, 21 nt, Human
gcucaguggagcuuggggaag

SEQ ID NO: 1133604 - RNA, 20 nt, Human
uaaaacaagagucagcaagc

SEQ ID NO: 1133605 - RNA, 18 nt, Human
ucaguggagcuuggggaa

SEQ ID NO: 1133606 - RNA, 21 nt, Human
uggaacacgguuacaucuauc

SEQ ID NO: 1133607 - RNA, 22 nt, Human
ugguccauggacucuacucccc

SEQ ID NO: 1133608 - RNA, 24 nt, Human
uugccgcugcguugcagguaugca

SEQ ID NO: 1133609 - RNA, 18 nt, Human
aagcggcccuccagcacc

SEQ ID NO: 1133610 - RNA, 23 nt, Human
aagcuucaucagcugaaccucac

SEQ ID NO: 1133611 - RNA, 21 nt, Human
agaccaggacguacagcacca

SEQ ID NO: 1133612 - RNA, 18 nt, Human
aggcuccagauguccagc

SEQ ID NO: 1133613 - RNA, 19 nt, Human
auagauuuucuccaaauug

SEQ ID NO: 1133614 - RNA, 21 nt, Human
cagauguccagcugggggccu

SEQ ID NO: 1133615 - RNA, 18 nt, Human
cagcaggagguucucggu

SEQ ID NO: 1133616 - RNA, 25 nt, Human
caggagguucucggucuugaggucc

SEQ ID NO: 1133617 - RNA, 24 nt, Human
caggcuccagauguccagcugggg

SEQ ID NO: 1133618 - RNA, 22 nt, Human
ccaaauccaaaaucugccagcu

SEQ ID NO: 1133619 - RNA, 21 nt, Human
cccacaccacguggacagagg

SEQ ID NO: 1133620 - RNA, 20 nt, Human
cgcagaccaggacguacagc

SEQ ID NO: 1133621 - RNA, 20 nt, Human
cgcccaggcuccagaugucc

SEQ ID NO: 1133622 - RNA, 23 nt, Human
cgcccaggcuccagauguccagc

SEQ ID NO: 1133623 - RNA, 23 nt, Human
cuccacggccgacaggauuugcc

SEQ ID NO: 1133624 - RNA, 19 nt, Human
cuccagcacccgcugucuc

SEQ ID NO: 1133625 - RNA, 21 nt, Human
cucccacaccacguggacaga

SEQ ID NO: 1133626 - RNA, 19 nt, Human
cugccagcuugauguccau

SEQ ID NO: 1133627 - RNA, 22 nt, Human
cuuccggggcggcauacggggg

SEQ ID NO: 1133628 - RNA, 18 nt, Human
gccauccagcaggagguu

SEQ ID NO: 1133629 - RNA, 19 nt, Human
gcucccacaccacguggac

SEQ ID NO: 1133630 - RNA, 29 nt, Human
gcucccacaccacguggacagaggcuggg

SEQ ID NO: 1133631 - RNA, 20 nt, Human
uacuccacggccgacaggau

SEQ ID NO: 1133632 - RNA, 18 nt, Human
uaggcccaucgaagggga

SEQ ID NO: 1133633 - RNA, 27 nt, Human
uccacggccgacaggauuugccagaac

SEQ ID NO: 1133634 - RNA, 19 nt, Human
ugacuuguagaaauuccca

SEQ ID NO: 1133635 - RNA, 22 nt, Human
ugaggucccgguggacgaugug

SEQ ID NO: 1133636 - RNA, 18 nt, Human
uggacagaggcucuccug

SEQ ID NO: 1133637 - RNA, 19 nt, Human
uguccagcugggggccuuc

SEQ ID NO: 1133638 - RNA, 24 nt, Human
uucauacuccuuccccucaaagac

SEQ ID NO: 1133639 - RNA, 25 nt, Human
uucauacuccuuccccucaaagacu

SEQ ID NO: 1133640 - RNA, 19 nt, Human
uuccccucaaagacuuccg

SEQ ID NO: 1133641 - RNA, 18 nt, Human
uucucggucuugaggucc

SEQ ID NO: 1133642 - RNA, 24 nt, Human
aaccucugccucccggguucacuc

SEQ ID NO: 1133643 - RNA, 25 nt, Human
aaccucugccucccggguucacucc

SEQ ID NO: 1133644 - RNA, 19 nt, Human
aagagaaggcccggcagug

SEQ ID NO: 1133645 - RNA, 23 nt, Human
acaggcgcccgccaccacgcccg

SEQ ID NO: 1133646 - RNA, 23 nt, Human
accucuucucucuccuggagcag

SEQ ID NO: 1133647 - RNA, 22 nt, Human
acuuacuuucuugauuuucuau

SEQ ID NO: 1133648 - RNA, 18 nt, Human
agccucccgaguagcuag

SEQ ID NO: 1133649 - RNA, 24 nt, Human
aggcaggcgcugggcagcagguug

SEQ ID NO: 1133650 - RNA, 24 nt, Human
aggcuggagugcagugggcaaucu

SEQ ID NO: 1133651 - RNA, 21 nt, Human
agggccucucgagccuuugug

SEQ ID NO: 1133652 - RNA, 24 nt, Human
augggguuucaccguaugagccag

SEQ ID NO: 1133653 - RNA, 19 nt, Human
auucuuuucuuacucauca

SEQ ID NO: 1133654 - RNA, 23 nt, Human
cacaggcgcccgccaccacgccc

SEQ ID NO: 1133655 - RNA, 22 nt, Human
cacagucuggccaugcucaccu

SEQ ID NO: 1133656 - RNA, 18 nt, Human
caccguaugagccaggau

SEQ ID NO: 1133657 - RNA, 24 nt, Human
caccguaugagccaggauggucuc

SEQ ID NO: 1133658 - RNA, 22 nt, Human
cacgcagugccugacacacagc

SEQ ID NO: 1133659 - RNA, 20 nt, Human
cacgcuccuuccugccaccc

SEQ ID NO: 1133660 - RNA, 21 nt, Human
cacuccauucuccugccucag

SEQ ID NO: 1133661 - RNA, 22 nt, Human
cacuccauucuccugccucagc

SEQ ID NO: 1133662 - RNA, 21 nt, Human
cacugcaaccucugccucccg

SEQ ID NO: 1133663 - RNA, 23 nt, Human
cacugcaaccucugccucccggg

SEQ ID NO: 1133664 - RNA, 25 nt, Human
cagagaccuuccacccacaggccuc

SEQ ID NO: 1133665 - RNA, 22 nt, Human
cagccccaagucccugccuccc

SEQ ID NO: 1133666 - RNA, 20 nt, Human
caggacgccucauccuguuu

SEQ ID NO: 1133667 - RNA, 21 nt, Human
caggcgcccgccaccacgccc

SEQ ID NO: 1133668 - RNA, 19 nt, Human
ccacacugcucugugcaca

SEQ ID NO: 1133669 - RNA, 20 nt, Human
ccacugggucugucuuccca

SEQ ID NO: 1133670 - RNA, 21 nt, Human
ccacugggucugucuucccaa

SEQ ID NO: 1133671 - RNA, 24 nt, Human
cccaaucguggccucugcucuucu

SEQ ID NO: 1133672 - RNA, 19 nt, Human
ccccacugggucugucuuc

SEQ ID NO: 1133673 - RNA, 21 nt, Human
ccccacugggucugucuuccc

SEQ ID NO: 1133674 - RNA, 23 nt, Human
cccccaugguccgggcuuggcuu

SEQ ID NO: 1133675 - RNA, 18 nt, Human
ccccucugcugagagccu

SEQ ID NO: 1133676 - RNA, 23 nt, Human
ccccucugcugagagccucugcu

SEQ ID NO: 1133677 - RNA, 23 nt, Human
cccuccauggccacuuuccugcc

SEQ ID NO: 1133678 - RNA, 23 nt, Human
cccugagacggggguccuccucu

SEQ ID NO: 1133679 - RNA, 18 nt, Human
cccugccucccuuucccu

SEQ ID NO: 1133680 - RNA, 20 nt, Human
ccucccuuucccugucaucc

SEQ ID NO: 1133681 - RNA, 19 nt, Human
ccuccucucucccccaugg

SEQ ID NO: 1133682 - RNA, 20 nt, Human
ccuccugccccaugcccccc

SEQ ID NO: 1133683 - RNA, 28 nt, Human
ccuccugccccaugccccccgccggggc

SEQ ID NO: 1133684 - RNA, 23 nt, Human
ccucugccucccggguucacucc

SEQ ID NO: 1133685 - RNA, 19 nt, Human
ccugaccucgugauccuug

SEQ ID NO: 1133686 - RNA, 21 nt, Human
ccugaccucgugauccuuggc

SEQ ID NO: 1133687 - RNA, 23 nt, Human
ccugccucagccucccgaguagc

SEQ ID NO: 1133688 - RNA, 24 nt, Human
ccugccucagccucccgaguagcu

SEQ ID NO: 1133689 - RNA, 20 nt, Human
ccuuuguggacaucuggagg

SEQ ID NO: 1133690 - RNA, 24 nt, Human
cgcucuguugcccaggcuggagug

SEQ ID NO: 1133691 - RNA, 24 nt, Human
cggagucucgcucuguugcccagg

SEQ ID NO: 1133692 - RNA, 22 nt, Human
cucacgcuccuuccugccaccc

SEQ ID NO: 1133693 - RNA, 21 nt, Human
cuccauggccacuuuccugcc

SEQ ID NO: 1133694 - RNA, 24 nt, Human
cucccgaguagcuaggaccacagg

SEQ ID NO: 1133695 - RNA, 18 nt, Human
cuccugaccucgugaucc

SEQ ID NO: 1133696 - RNA, 22 nt, Human
cuccugccucagccucccgagu

SEQ ID NO: 1133697 - RNA, 22 nt, Human
cuccuuccugccacccgcuucc

SEQ ID NO: 1133698 - RNA, 24 nt, Human
cucgcucuguugcccaggcuggag

SEQ ID NO: 1133699 - RNA, 21 nt, Human
cugagauggagggagacccau

SEQ ID NO: 1133700 - RNA, 19 nt, Human
cugcaaccucugccucccg

SEQ ID NO: 1133701 - RNA, 23 nt, Human
cugcaaccucugccucccggguu

SEQ ID NO: 1133702 - RNA, 24 nt, Human
cugcaaccucugccucccggguuc

SEQ ID NO: 1133703 - RNA, 21 nt, Human
cuuccccucugcugagagccu

SEQ ID NO: 1133704 - RNA, 18 nt, Human
cuuggcuucucugggcug

SEQ ID NO: 1133705 - RNA, 22 nt, Human
gaagaaaccugcuuuauaagag

SEQ ID NO: 1133706 - RNA, 21 nt, Human
gaccucgugauccuuggccuc

SEQ ID NO: 1133707 - RNA, 27 nt, Human
gaccugucccuucccacagugaacuuc

SEQ ID NO: 1133708 - RNA, 21 nt, Human
gagacggagucucgcucuguu

SEQ ID NO: 1133709 - RNA, 25 nt, Human
gaguagcuaggaccacaggcgcccg

SEQ ID NO: 1133710 - RNA, 24 nt, Human
gcaaaucccacggagaggcccgga

SEQ ID NO: 1133711 - RNA, 19 nt, Human
gcccaggcuggagugcagu

SEQ ID NO: 1133712 - RNA, 23 nt, Human
gcccggcuaauuuuuuguauuuu

SEQ ID NO: 1133713 - RNA, 25 nt, Human
gcucuguugcccaggcuggagugca

SEQ ID NO: 1133714 - RNA, 23 nt, Human
gcuggagugcagugggcaaucug

SEQ ID NO: 1133715 - RNA, 19 nt, Human
ggaccacaggcgcccgcca

SEQ ID NO: 1133716 - RNA, 22 nt, Human
ggaccacaggcgcccgccacca

SEQ ID NO: 1133717 - RNA, 19 nt, Human
ggagaugggguuucaccgu

SEQ ID NO: 1133718 - RNA, 23 nt, Human
ggagucucgcucuguugcccagg

SEQ ID NO: 1133719 - RNA, 24 nt, Human
ggauggucucgaucuccugaccuc

SEQ ID NO: 1133720 - RNA, 22 nt, Human
gggguuucaccguaugagccag

SEQ ID NO: 1133721 - RNA, 21 nt, Human
gguccgggcuuggcuucucug

SEQ ID NO: 1133722 - RNA, 22 nt, Human
guugcaccgucucaccucucuc

SEQ ID NO: 1133723 - RNA, 19 nt, Human
uaaaaagugaauaagaaaa

SEQ ID NO: 1133724 - RNA, 20 nt, Human
uaagaaaacgucagcuauga

SEQ ID NO: 1133725 - RNA, 22 nt, Human
uaagagaaggcccggcagugga

SEQ ID NO: 1133726 - RNA, 24 nt, Human
uaauuuuuuguauuuuuaguggag

SEQ ID NO: 1133727 - RNA, 23 nt, Human
uagauaaggcuggaaaaggcagg

SEQ ID NO: 1133728 - RNA, 19 nt, Human
uagaugcagcugagaugga

SEQ ID NO: 1133729 - RNA, 21 nt, Human
uaggaccacaggcgcccgcca

SEQ ID NO: 1133730 - RNA, 24 nt, Human
uaggaccacaggcgcccgccacca

SEQ ID NO: 1133731 - RNA, 21 nt, Human
uaguggagaugggguuucacc

SEQ ID NO: 1133732 - RNA, 25 nt, Human
uaguggagaugggguuucaccguau

SEQ ID NO: 1133733 - RNA, 24 nt, Human
ucaccguaugagccaggauggucu

SEQ ID NO: 1133734 - RNA, 25 nt, Human
ucacuccauucuccugccucagccu

SEQ ID NO: 1133735 - RNA, 19 nt, Human
ucacugcaaccucugccuc

SEQ ID NO: 1133736 - RNA, 23 nt, Human
ucacugcaaccucugccucccgg

SEQ ID NO: 1133737 - RNA, 24 nt, Human
ucacugcaaccucugccucccggg

SEQ ID NO: 1133738 - RNA, 25 nt, Human
ucacugcaaccucugccucccgggu

SEQ ID NO: 1133739 - RNA, 24 nt, Human
uccaacagccccaagucccugccu

SEQ ID NO: 1133740 - RNA, 19 nt, Human
ucccacggagaggcccgga

SEQ ID NO: 1133741 - RNA, 19 nt, Human
ucccgaguagcuaggacca

SEQ ID NO: 1133742 - RNA, 21 nt, Human
ucccggguucacuccauucuc

SEQ ID NO: 1133743 - RNA, 24 nt, Human
ucccggguucacuccauucuccug

SEQ ID NO: 1133744 - RNA, 18 nt, Human
ucccugccucccuuuccc

SEQ ID NO: 1133745 - RNA, 20 nt, Human
uccgcaacuggaaccaacgg

SEQ ID NO: 1133746 - RNA, 18 nt, Human
uccuccucucucccccau

SEQ ID NO: 1133747 - RNA, 21 nt, Human
uccuuggccucccaaagugcu

SEQ ID NO: 1133748 - RNA, 24 nt, Human
ucgcucuguugcccaggcuggagu

SEQ ID NO: 1133749 - RNA, 24 nt, Human
ucucaccucucucuggggaccugu

SEQ ID NO: 1133750 - RNA, 18 nt, Human
ucuccuggagcaguuggu

SEQ ID NO: 1133751 - RNA, 19 nt, Human
ucucgcucuguugcccagg

SEQ ID NO: 1133752 - RNA, 22 nt, Human
ucucgcucuguugcccaggcug

SEQ ID NO: 1133753 - RNA, 23 nt, Human
ucucgcucuguugcccaggcugg

SEQ ID NO: 1133754 - RNA, 24 nt, Human
ucucgcucuguugcccaggcugga

SEQ ID NO: 1133755 - RNA, 26 nt, Human
ucucgcucuguugcccaggcuggagu

SEQ ID NO: 1133756 - RNA, 27 nt, Human
ucucgcucuguugcccaggcuggagug

SEQ ID NO: 1133757 - RNA, 18 nt, Human
ucucucuggggaccuguc

SEQ ID NO: 1133758 - RNA, 21 nt, Human
ucugcugagagccucugcuca

SEQ ID NO: 1133759 - RNA, 18 nt, Human
ucuguugcccaggcugga

SEQ ID NO: 1133760 - RNA, 24 nt, Human
ucuguugcccaggcuggagugcag

SEQ ID NO: 1133761 - RNA, 19 nt, Human
ugaccuggcaagacacuuc

SEQ ID NO: 1133762 - RNA, 18 nt, Human
ugacuccgaacucacccu

SEQ ID NO: 1133763 - RNA, 19 nt, Human
ugagacggggguccuccuc

SEQ ID NO: 1133764 - RNA, 18 nt, Human
ugagaugcacaagugaaa

SEQ ID NO: 1133765 - RNA, 22 nt, Human
ugccacaguggaauucuaggca

SEQ ID NO: 1133766 - RNA, 18 nt, Human
ugccagcauucuuuucuu

SEQ ID NO: 1133767 - RNA, 18 nt, Human
ugcccaggcuggagugca

SEQ ID NO: 1133768 - RNA, 21 nt, Human
ugcccaggcuggagugcagug

SEQ ID NO: 1133769 - RNA, 22 nt, Human
ugcccaggcuggagugcagugg

SEQ ID NO: 1133770 - RNA, 24 nt, Human
ugcccaggcuggagugcagugggc

SEQ ID NO: 1133771 - RNA, 23 nt, Human
ugccucagccucccgaguagcua

SEQ ID NO: 1133772 - RNA, 24 nt, Human
ugccucagccucccgaguagcuag

SEQ ID NO: 1133773 - RNA, 20 nt, Human
ugccuccugccccaugcccc

SEQ ID NO: 1133774 - RNA, 21 nt, Human
ugcucaccuguguccacccgc

SEQ ID NO: 1133775 - RNA, 22 nt, Human
uggaaaaggcaggacgccucau

SEQ ID NO: 1133776 - RNA, 23 nt, Human
uggaauucuaggcagacaacuuc

SEQ ID NO: 1133777 - RNA, 19 nt, Human
uggagugcagugggcaauc

SEQ ID NO: 1133778 - RNA, 22 nt, Human
uggagugcagugggcaaucugg

SEQ ID NO: 1133779 - RNA, 24 nt, Human
uggauguggacggcgccaaggacc

SEQ ID NO: 1133780 - RNA, 21 nt, Human
uggcaaaucccacggagaggc

SEQ ID NO: 1133781 - RNA, 27 nt, Human
ugggcagcagguugcagauggauguug

SEQ ID NO: 1133782 - RNA, 24 nt, Human
ugggguuucaccguaugagccagg

SEQ ID NO: 1133783 - RNA, 23 nt, Human
uggguggcugccuccugccccau

SEQ ID NO: 1133784 - RNA, 21 nt, Human
uguauuuuuaguggagauggg

SEQ ID NO: 1133785 - RNA, 18 nt, Human
uuaguggagaugggguuu

SEQ ID NO: 1133786 - RNA, 22 nt, Human
uuaguggagaugggguuucacc

SEQ ID NO: 1133787 - RNA, 24 nt, Human
uuaguggagaugggguuucaccgu

SEQ ID NO: 1133788 - RNA, 21 nt, Human
uuccuagauaaggcuggaaaa

SEQ ID NO: 1133789 - RNA, 24 nt, Human
uucuugauuuucuauggaaccuuu

SEQ ID NO: 1133790 - RNA, 23 nt, Human
uugcccaggcuggagugcagugg

SEQ ID NO: 1133791 - RNA, 24 nt, Human
uuuuuaguggagaugggguuucac

SEQ ID NO: 1133792 - RNA, 21 nt, Human
uuuuuguauuuuuaguggaga

SEQ ID NO: 1133793 - RNA, 24 nt, Human
uuuuuuguauuuuuaguggagaug

SEQ ID NO: 1133794 - RNA, 20 nt, Human
aaaagccuggugagaugcca

SEQ ID NO: 1133795 - RNA, 21 nt, Human
aggacaacccuugccacaggc

SEQ ID NO: 1133796 - RNA, 22 nt, Human
cacucuaguccauugaaaagcc

SEQ ID NO: 1133797 - RNA, 19 nt, Human
cagcaggacaacccuugcc

SEQ ID NO: 1133798 - RNA, 19 nt, Human
cagccccgcacucuagucc

SEQ ID NO: 1133799 - RNA, 22 nt, Human
ccacaggcagagcagccccgca

SEQ ID NO: 1133800 - RNA, 19 nt, Human
ccugugcccagcagcagga

SEQ ID NO: 1133801 - RNA, 20 nt, Human
ccugugcccagcagcaggac

SEQ ID NO: 1133802 - RNA, 18 nt, Human
cuggggcaaucgccgcug

SEQ ID NO: 1133803 - RNA, 23 nt, Human
cuuagcagcgccaaguucuuucu

SEQ ID NO: 1133804 - RNA, 18 nt, Human
gccccgcacucuagucca

SEQ ID NO: 1133805 - RNA, 23 nt, Human
gcgcggagccugguggcgcgugu

SEQ ID NO: 1133806 - RNA, 23 nt, Human
ugagaugccaggccaggccauga

SEQ ID NO: 1133807 - RNA, 23 nt, Human
uuucgggccgccauugccuuagc

SEQ ID NO: 1133808 - RNA, 21 nt, Human
aaaaaccaacccccaaauccc

SEQ ID NO: 1133809 - RNA, 21 nt, Human
acaugggccagcgaggcccug

SEQ ID NO: 1133810 - RNA, 18 nt, Human
accaacccccaaauccca

SEQ ID NO: 1133811 - RNA, 23 nt, Human
acccccaaaucccagggcuucca

SEQ ID NO: 1133812 - RNA, 20 nt, Human
acccgccccacacccgcccc

SEQ ID NO: 1133813 - RNA, 20 nt, Human
acccgccccacacccgcccc

SEQ ID NO: 1133814 - RNA, 19 nt, Human
agcugggccucaggggccu

SEQ ID NO: 1133815 - RNA, 20 nt, Human
auucacaguccaaaaaccaa

SEQ ID NO: 1133816 - RNA, 19 nt, Human
caaaaaccaacccccaaau

SEQ ID NO: 1133817 - RNA, 19 nt, Human
caaaucccagggcuuccag

SEQ ID NO: 1133818 - RNA, 27 nt, Human
caacccccaaaucccagggcuuccagc

SEQ ID NO: 1133819 - RNA, 25 nt, Human
cacaguccaaaaaccaacccccaaa

SEQ ID NO: 1133820 - RNA, 21 nt, Human
cacgcgccccacacccgcccc

SEQ ID NO: 1133821 - RNA, 21 nt, Human
cacgcgccccacacccgcccc

SEQ ID NO: 1133822 - RNA, 21 nt, Human
cacgcgccccacacccgcccc

SEQ ID NO: 1133823 - RNA, 21 nt, Human
cacgcgccccacacccgcucc

SEQ ID NO: 1133824 - RNA, 21 nt, Human
cacgcgccccacacgcgcccc

SEQ ID NO: 1133825 - RNA, 21 nt, Human
cacgcgccccacacgcgcccc

SEQ ID NO: 1133826 - RNA, 22 nt, Human
ccaaaaaccaacccccaaaucc

SEQ ID NO: 1133827 - RNA, 23 nt, Human
ccaaaaaccaacccccaaauccc

SEQ ID NO: 1133828 - RNA, 22 nt, Human
ccaacccccaaaucccagggcu

SEQ ID NO: 1133829 - RNA, 22 nt, Human
ccacacccgccccacacccgcc

SEQ ID NO: 1133830 - RNA, 22 nt, Human
ccacacccgccccacacccgcc

SEQ ID NO: 1133831 - RNA, 22 nt, Human
ccacacgcgccccacacccgcc

SEQ ID NO: 1133832 - RNA, 22 nt, Human
ccacacgcgccccacacccgcc

SEQ ID NO: 1133833 - RNA, 22 nt, Human
ccacacgcgccccacacccgcc

SEQ ID NO: 1133834 - RNA, 26 nt, Human
cccacacacguuccacacgcgcccca

SEQ ID NO: 1133835 - RNA, 28 nt, Human
cccacacacguuccacacgcgccccaca

SEQ ID NO: 1133836 - RNA, 22 nt, Human
cccacacccgccccacacccgc

SEQ ID NO: 1133837 - RNA, 22 nt, Human
cccacacccgccccacacccgc

SEQ ID NO: 1133838 - RNA, 26 nt, Human
cccacacccgcuccacacgcgcccca

SEQ ID NO: 1133839 - RNA, 21 nt, Human
cccacacgcgccccacacccg

SEQ ID NO: 1133840 - RNA, 21 nt, Human
cccacacgcgccccacacccg

SEQ ID NO: 1133841 - RNA, 21 nt, Human
cccacacgcgccccacacccg

SEQ ID NO: 1133842 - RNA, 25 nt, Human
cccacacgcgccccacacccgcccc

SEQ ID NO: 1133843 - RNA, 25 nt, Human
cccacacgcgccccacacccgcccc

SEQ ID NO: 1133844 - RNA, 25 nt, Human
cccacacgcgccccacacccgcccc

SEQ ID NO: 1133845 - RNA, 21 nt, Human
cccacacgcgccccacacgcg

SEQ ID NO: 1133846 - RNA, 26 nt, Human
cccacacgcgccccacacgcgcccca

SEQ ID NO: 1133847 - RNA, 28 nt, Human
cccacacgcgccccacacgcgccccaca

SEQ ID NO: 1133848 - RNA, 26 nt, Human
cccacacgcgccccacacgcgcucca

SEQ ID NO: 1133849 - RNA, 20 nt, Human
ccccacacccgccccacacc

SEQ ID NO: 1133850 - RNA, 20 nt, Human
ccccacacccgccccacacc

SEQ ID NO: 1133851 - RNA, 24 nt, Human
ccccacacccgccccacacccggu

SEQ ID NO: 1133852 - RNA, 24 nt, Human
ccccacacccgccccacacccggu

SEQ ID NO: 1133853 - RNA, 20 nt, Human
ccccacacgcgccccacacc

SEQ ID NO: 1133854 - RNA, 20 nt, Human
ccccacacgcgccccacacc

SEQ ID NO: 1133855 - RNA, 20 nt, Human
ccccacacgcgccccacacc

SEQ ID NO: 1133856 - RNA, 28 nt, Human
cccccaaaucccagggcuuccagcaacc

SEQ ID NO: 1133857 - RNA, 24 nt, Human
cccgccccacacacguuccacacg

SEQ ID NO: 1133858 - RNA, 21 nt, Human
cccgccccacacccgccccac

SEQ ID NO: 1133859 - RNA, 21 nt, Human
cccgccccacacccgccccac

SEQ ID NO: 1133860 - RNA, 20 nt, Human
cccgccccacacccgccccc

SEQ ID NO: 1133861 - RNA, 20 nt, Human
cccgccccacacccgccccc

SEQ ID NO: 1133862 - RNA, 24 nt, Human
cccgcuccacacgcgccccacacg

SEQ ID NO: 1133863 - RNA, 23 nt, Human
cuuuccacaaccugaaaacaagg

SEQ ID NO: 1133864 - RNA, 18 nt, Human
gccccacacgcgcuccac

SEQ ID NO: 1133865 - RNA, 20 nt, Human
gccucaggggccuggggacg

SEQ ID NO: 1133866 - RNA, 22 nt, Human
gggcagggggagccaagcuggg

SEQ ID NO: 1133867 - RNA, 18 nt, Human
gggccucaggggccuggg

SEQ ID NO: 1133868 - RNA, 21 nt, Human
uccacacgcgccccacacccg

SEQ ID NO: 1133869 - RNA, 25 nt, Human
uccacacgcgccccacacccgcucc

SEQ ID NO: 1133870 - RNA, 26 nt, Human
uccacacgcgccccacacccgcucca

SEQ ID NO: 1133871 - RNA, 26 nt, Human
uccacacgcgccccacacgcgcccca

SEQ ID NO: 1133872 - RNA, 28 nt, Human
uccacacgcgccccacacgcgccccaca

SEQ ID NO: 1133873 - RNA, 21 nt, Human
ugggccagcgaggcccugcag

SEQ ID NO: 1133874 - RNA, 19 nt, Human
uucacaguccaaaaaccaa

SEQ ID NO: 1133875 - RNA, 20 nt, Human
uuccacacgcgccccacacc

SEQ ID NO: 1133876 - RNA, 19 nt, Human
aaacucagccugcugcaga

SEQ ID NO: 1133877 - RNA, 21 nt, Human
aagcaggauuccgcagcaagu

SEQ ID NO: 1133878 - RNA, 18 nt, Human
aggcagcuggaggucgug

SEQ ID NO: 1133879 - RNA, 27 nt, Human
caugaaacagagcuuucuuguucuuga

SEQ ID NO: 1133880 - RNA, 20 nt, Human
ccugcggcgcuuugccgccc

SEQ ID NO: 1133881 - RNA, 22 nt, Human
cguguguguguguugugugugu

SEQ ID NO: 1133882 - RNA, 19 nt, Human
gcucugugccugcggcgcu

SEQ ID NO: 1133883 - RNA, 18 nt, Human
ggaauuuuccauguucuu

SEQ ID NO: 1133884 - RNA, 19 nt, Human
ggcucugugccugcggcgc

SEQ ID NO: 1133885 - RNA, 19 nt, Human
ggggggaagccucccagag

SEQ ID NO: 1133886 - RNA, 18 nt, Human
gguugugugagugugcgu

SEQ ID NO: 1133887 - RNA, 23 nt, Human
gugcaugugugagcaugugugca

SEQ ID NO: 1133888 - RNA, 19 nt, Human
gugugcguguguguguguu

SEQ ID NO: 1133889 - RNA, 24 nt, Human
uaaacucagccugcugcagagaug

SEQ ID NO: 1133890 - RNA, 21 nt, Human
ucccagaggaagaugcaggcu

SEQ ID NO: 1133891 - RNA, 19 nt, Human
ucuggggcccgaggcgucc

SEQ ID NO: 1133892 - RNA, 20 nt, Human
ugagugugcgugugugugug

SEQ ID NO: 1133893 - RNA, 20 nt, Human
ugcaugaaacagagcuuucu

SEQ ID NO: 1133894 - RNA, 18 nt, Human
ugcguguguguguguugu

SEQ ID NO: 1133895 - RNA, 22 nt, Human
ugcguguguguguguugugugu

SEQ ID NO: 1133896 - RNA, 25 nt, Human
ugcguguguguguguugugugugug

SEQ ID NO: 1133897 - RNA, 21 nt, Human
uggccaugguugugugagugu

SEQ ID NO: 1133898 - RNA, 22 nt, Human
uggugcccgcggaagcugagca

SEQ ID NO: 1133899 - RNA, 20 nt, Human
ugugagcaugugugcaugcg

SEQ ID NO: 1133900 - RNA, 21 nt, Human
ugugagugugcgugugugugu

SEQ ID NO: 1133901 - RNA, 20 nt, Human
ugugugagugugcgugugug

SEQ ID NO: 1133902 - RNA, 24 nt, Human
ugugugcacguauaagugcaugug

SEQ ID NO: 1133903 - RNA, 20 nt, Human
ugugugcaugcgugagcgug

SEQ ID NO: 1133904 - RNA, 23 nt, Human
ugugugugugugcacguauaagu

SEQ ID NO: 1133905 - RNA, 23 nt, Human
ugugugugugugugcacguauaa

SEQ ID NO: 1133906 - RNA, 21 nt, Human
ugugugugugugugugcacgu

SEQ ID NO: 1133907 - RNA, 22 nt, Human
ugugugugugugugugcacgua

SEQ ID NO: 1133908 - RNA, 22 nt, Human
uguguguguguugugugugugu

SEQ ID NO: 1133909 - RNA, 24 nt, Human
uguguguguguugugugugugugu

SEQ ID NO: 1133910 - RNA, 20 nt, Human
uguguguguugugugugugu

SEQ ID NO: 1133911 - RNA, 20 nt, Human
uguguguguugugugugugu

SEQ ID NO: 1133912 - RNA, 20 nt, Human
uguguguguugugugugugu

SEQ ID NO: 1133913 - RNA, 24 nt, Human
uguguguguugugugugugugugu

SEQ ID NO: 1133914 - RNA, 22 nt, Human
uguguguugugugugugugugu

SEQ ID NO: 1133915 - RNA, 18 nt, Human
uguguugugugugugugu

SEQ ID NO: 1133916 - RNA, 23 nt, Human
uugugugagugugcgugugugug

SEQ ID NO: 1133917 - RNA, 20 nt, Human
uuugcucuuagggaauuuuc

SEQ ID NO: 1133918 - RNA, 19 nt, Human
uuuuccauguucuuccauc

SEQ ID NO: 1133919 - RNA, 24 nt, Human
aaaugcaggaagcugcauugagcc

SEQ ID NO: 1133920 - RNA, 20 nt, Human
aaccugccucccagacuccu

SEQ ID NO: 1133921 - RNA, 18 nt, Human
aaguccucagggccucuc

SEQ ID NO: 1133922 - RNA, 25 nt, Human
aaugcccggcuccuguuccacucac

SEQ ID NO: 1133923 - RNA, 20 nt, Human
accugcguuuguggccaccu

SEQ ID NO: 1133924 - RNA, 20 nt, Human
acgcgucucuucccucuuuu

SEQ ID NO: 1133925 - RNA, 20 nt, Human
acggcgggaaugccuguggc

SEQ ID NO: 1133926 - RNA, 23 nt, Human
agaaggcacugacggcgggaaug

SEQ ID NO: 1133927 - RNA, 19 nt, Human
agagagaggacgaacugau

SEQ ID NO: 1133928 - RNA, 18 nt, Human
agcaaagacccuuagaag

SEQ ID NO: 1133929 - RNA, 22 nt, Human
agcaagggcagcagcuugggga

SEQ ID NO: 1133930 - RNA, 19 nt, Human
agccaagggccacgguugc

SEQ ID NO: 1133931 - RNA, 24 nt, Human
agcugcaggaagcugcacugagcc

SEQ ID NO: 1133932 - RNA, 19 nt, Human
aggaaggagccaagcgcuc

SEQ ID NO: 1133933 - RNA, 24 nt, Human
aggacacuguccuugccaaccauu

SEQ ID NO: 1133934 - RNA, 23 nt, Human
aggaucgugaccgggagggcccc

SEQ ID NO: 1133935 - RNA, 18 nt, Human
aggcuccggucuguuccu

SEQ ID NO: 1133936 - RNA, 21 nt, Human
aggggguuggguauugaugcc

SEQ ID NO: 1133937 - RNA, 21 nt, Human
aggucccccaagccagccucc

SEQ ID NO: 1133938 - RNA, 21 nt, Human
agguggagcugcuggggcagg

SEQ ID NO: 1133939 - RNA, 20 nt, Human
agucccugcuggccacagga

SEQ ID NO: 1133940 - RNA, 20 nt, Human
auugaugccgccugggggcc

SEQ ID NO: 1133941 - RNA, 24 nt, Human
caaaccccuccaggucaccugccu

SEQ ID NO: 1133942 - RNA, 19 nt, Human
caagccagccucccccacc

SEQ ID NO: 1133943 - RNA, 23 nt, Human
caagcugcaggaagcugcacuga

SEQ ID NO: 1133944 - RNA, 23 nt, Human
caagggcagcagcuuggggaggc

SEQ ID NO: 1133945 - RNA, 21 nt, Human
caaguagucccugcuggccaa

SEQ ID NO: 1133946 - RNA, 23 nt, Human
cacagcaagggcagcagcuuggg

SEQ ID NO: 1133947 - RNA, 24 nt, Human
cacagguaaauucuccuucccaca

SEQ ID NO: 1133948 - RNA, 25 nt, Human
caccguccagggcaggaacagaggc

SEQ ID NO: 1133949 - RNA, 22 nt, Human
cacuggaguuccuggacacagc

SEQ ID NO: 1133950 - RNA, 22 nt, Human
cagaggcgugacagucagugcg

SEQ ID NO: 1133951 - RNA, 20 nt, Human
cagccucccccaccaccuug

SEQ ID NO: 1133952 - RNA, 20 nt, Human
caggucccccaagccagccu

SEQ ID NO: 1133953 - RNA, 23 nt, Human
caggucccccaagccagccuccc

SEQ ID NO: 1133954 - RNA, 22 nt, Human
cauggaacagcaaaccccucca

SEQ ID NO: 1133955 - RNA, 19 nt, Human
cauguucugagacaccguc

SEQ ID NO: 1133956 - RNA, 19 nt, Human
ccacgcuucccucccagca

SEQ ID NO: 1133957 - RNA, 18 nt, Human
ccacucuguagcccccaa

SEQ ID NO: 1133958 - RNA, 19 nt, Human
ccagccagccucacaggca

SEQ ID NO: 1133959 - RNA, 18 nt, Human
cccaagccagccuccccc

SEQ ID NO: 1133960 - RNA, 19 nt, Human
cccaagccagccuccccca

SEQ ID NO: 1133961 - RNA, 23 nt, Human
cccacagauccuccuguagccca

SEQ ID NO: 1133962 - RNA, 18 nt, Human
cccacagguuguccccac

SEQ ID NO: 1133963 - RNA, 21 nt, Human
cccacgaugaggaucgugacc

SEQ ID NO: 1133964 - RNA, 20 nt, Human
cccacucuguagcccccaaa

SEQ ID NO: 1133965 - RNA, 19 nt, Human
ccccgcacacccagggcag

SEQ ID NO: 1133966 - RNA, 18 nt, Human
ccccgccgccagcaucug

SEQ ID NO: 1133967 - RNA, 18 nt, Human
ccccugaggacccugugg

SEQ ID NO: 1133968 - RNA, 21 nt, Human
cccuccaugcucucuuucccc

SEQ ID NO: 1133969 - RNA, 24 nt, Human
cccucuuuucuugggugcuggccc

SEQ ID NO: 1133970 - RNA, 24 nt, Human
cccugucuccacgcuucccuccca

SEQ ID NO: 1133971 - RNA, 18 nt, Human
cccuugggcagccucggg

SEQ ID NO: 1133972 - RNA, 23 nt, Human
ccguggagauuggugauggagcu

SEQ ID NO: 1133973 - RNA, 19 nt, Human
ccucccagcauggaugccc

SEQ ID NO: 1133974 - RNA, 24 nt, Human
ccucccccaccaccuugaagggac

SEQ ID NO: 1133975 - RNA, 21 nt, Human
ccucgccaucuccgggccucc

SEQ ID NO: 1133976 - RNA, 22 nt, Human
ccucgccaucuccgggccuccg

SEQ ID NO: 1133977 - RNA, 18 nt, Human
cgagccccgcacacccag

SEQ ID NO: 1133978 - RNA, 26 nt, Human
cgcccuugaacuucagaugcaugcuc

SEQ ID NO: 1133979 - RNA, 26 nt, Human
cgcucagauggcucuggcugcugugg

SEQ ID NO: 1133980 - RNA, 23 nt, Human
cuccuccaggcugcccuugggca

SEQ ID NO: 1133981 - RNA, 21 nt, Human
cucuggaggguccaauuuucc

SEQ ID NO: 1133982 - RNA, 21 nt, Human
cugaaguccauguugucccug

SEQ ID NO: 1133983 - RNA, 23 nt, Human
cugucugagccuguucgcucagg

SEQ ID NO: 1133984 - RNA, 22 nt, Human
cugugugcacgcgucucuuccc

SEQ ID NO: 1133985 - RNA, 23 nt, Human
cuucaggcuccggucuguuccug

SEQ ID NO: 1133986 - RNA, 20 nt, Human
cuuccccgccgccagcaucu

SEQ ID NO: 1133987 - RNA, 19 nt, Human
cuuugcuucagggcguuca

SEQ ID NO: 1133988 - RNA, 20 nt, Human
gaagaugucccacggccccu

SEQ ID NO: 1133989 - RNA, 21 nt, Human
gaccugcguuuguggccaccu

SEQ ID NO: 1133990 - RNA, 27 nt, Human
gaggacccugugguugaguugaccccu

SEQ ID NO: 1133991 - RNA, 21 nt, Human
gaguacucagaggcccauggc

SEQ ID NO: 1133992 - RNA, 28 nt, Human
gauggcucuggcugcugugguugggagg

SEQ ID NO: 1133993 - RNA, 23 nt, Human
gcacgcgucucuucccucuuuuc

SEQ ID NO: 1133994 - RNA, 19 nt, Human
gcacuggaguuccuggaca

SEQ ID NO: 1133995 - RNA, 24 nt, Human
gcagcaaagacccuuagaaggcca

SEQ ID NO: 1133996 - RNA, 23 nt, Human
gcaggaagcugcacugagccuug

SEQ ID NO: 1133997 - RNA, 23 nt, Human
gcauaggucaacacguggccagg

SEQ ID NO: 1133998 - RNA, 19 nt, Human
gccagccucccccaccacc

SEQ ID NO: 1133999 - RNA, 19 nt, Human
gccagcugacucagccaag

SEQ ID NO: 1134000 - RNA, 18 nt, Human
gccaggaagaugucuuug

SEQ ID NO: 1134001 - RNA, 24 nt, Human
gcccugggcauuuggcgguuucca

SEQ ID NO: 1134002 - RNA, 25 nt, Human
ggccccugucuccacgcuucccucc

SEQ ID NO: 1134003 - RNA, 26 nt, Human
ggccugaaggcgcgggggcucagaaa

SEQ ID NO: 1134004 - RNA, 22 nt, Human
ggcugcagggccaagcuggcgu

SEQ ID NO: 1134005 - RNA, 20 nt, Human
ggcugcugugguugggaggg

SEQ ID NO: 1134006 - RNA, 24 nt, Human
ggggccgcuggacuuugcugaagu

SEQ ID NO: 1134007 - RNA, 23 nt, Human
gggugggccugaaggcgcggggg

SEQ ID NO: 1134008 - RNA, 23 nt, Human
ggugggcucugcagcaaagaccc

SEQ ID NO: 1134009 - RNA, 24 nt, Human
ggugguggccaaguccucagggcc

SEQ ID NO: 1134010 - RNA, 21 nt, Human
guaggcagugucacgugcaua

SEQ ID NO: 1134011 - RNA, 24 nt, Human
gucccccaagccagccucccccac

SEQ ID NO: 1134012 - RNA, 24 nt, Human
uagagugguggcccagggcacccc

SEQ ID NO: 1134013 - RNA, 27 nt, Human
uagagugguggcccagggcaccccguu

SEQ ID NO: 1134014 - RNA, 21 nt, Human
ucaacacguggccaggaagau

SEQ ID NO: 1134015 - RNA, 23 nt, Human
ucacaaguagucccugcuggcca

SEQ ID NO: 1134016 - RNA, 19 nt, Human
uccagggcaggaacagagg

SEQ ID NO: 1134017 - RNA, 20 nt, Human
ucccacggccccugucucca

SEQ ID NO: 1134018 - RNA, 21 nt, Human
uccccagcagcacaugggccu

SEQ ID NO: 1134019 - RNA, 18 nt, Human
ucccccaagccagccucc

SEQ ID NO: 1134020 - RNA, 20 nt, Human
ucccccaagccagccucccc

SEQ ID NO: 1134021 - RNA, 21 nt, Human
ucccugcucuuggaaaccugc

SEQ ID NO: 1134022 - RNA, 18 nt, Human
uccugugcuggcugcagg

SEQ ID NO: 1134023 - RNA, 18 nt, Human
uccuucccacagcaaggg

SEQ ID NO: 1134024 - RNA, 18 nt, Human
ucuccacgcuucccuccc

SEQ ID NO: 1134025 - RNA, 18 nt, Human
ucucugaaugcccggcuc

SEQ ID NO: 1134026 - RNA, 21 nt, Human
ucucugaaugcccggcuccug

SEQ ID NO: 1134027 - RNA, 19 nt, Human
ucucuuuccccuuucccaa

SEQ ID NO: 1134028 - RNA, 25 nt, Human
ucugcagcaaagacccuuagaaggc

SEQ ID NO: 1134029 - RNA, 22 nt, Human
ucuggugggcucugcagcaaag

SEQ ID NO: 1134030 - RNA, 21 nt, Human
ucuguagcccccaacauauac

SEQ ID NO: 1134031 - RNA, 23 nt, Human
ucuucgggcggccguccugguuu

SEQ ID NO: 1134032 - RNA, 18 nt, Human
ugaccccuccaugcucuc

SEQ ID NO: 1134033 - RNA, 23 nt, Human
ugaccccuccaugcucucuuucc

SEQ ID NO: 1134034 - RNA, 21 nt, Human
ugacucagccaagggccacgg

SEQ ID NO: 1134035 - RNA, 23 nt, Human
ugaguugaccccuccaugcucuc

SEQ ID NO: 1134036 - RNA, 21 nt, Human
ugcacuggaguuccuggacac

SEQ ID NO: 1134037 - RNA, 21 nt, Human
ugcaugcucagcacccagggg

SEQ ID NO: 1134038 - RNA, 23 nt, Human
ugccguggagauuggugauggag

SEQ ID NO: 1134039 - RNA, 26 nt, Human
ugcuggcugcagggccaagcuggcgu

SEQ ID NO: 1134040 - RNA, 19 nt, Human
ugcuucaggcuccggucug

SEQ ID NO: 1134041 - RNA, 21 nt, Human
uggccaguccaaaguguucug

SEQ ID NO: 1134042 - RNA, 18 nt, Human
uggcugugccaugcagca

SEQ ID NO: 1134043 - RNA, 19 nt, Human
ugggcagccucggggagca

SEQ ID NO: 1134044 - RNA, 23 nt, Human
uggugguggccaaguccucaggg

SEQ ID NO: 1134045 - RNA, 21 nt, Human
ugguugaguugaccccuccau

SEQ ID NO: 1134046 - RNA, 19 nt, Human
ugucugagccuguucgcuc

SEQ ID NO: 1134047 - RNA, 26 nt, Human
ugugcacgcgucucuucccucuuuuc

SEQ ID NO: 1134048 - RNA, 22 nt, Human
uguggaggguggggcagggcug

SEQ ID NO: 1134049 - RNA, 18 nt, Human
uguggcagaggaaaaaug

SEQ ID NO: 1134050 - RNA, 19 nt, Human
uucccucuuuucuugggug

SEQ ID NO: 1134051 - RNA, 18 nt, Human
uugguuuucugaccauug

SEQ ID NO: 1134052 - RNA, 23 nt, Human
aagcggaagaugguuguugagac

SEQ ID NO: 1134053 - RNA, 23 nt, Human
agcagacgcugaccaacucuccc

SEQ ID NO: 1134054 - RNA, 22 nt, Human
cacaacacaagaguuccacaug

SEQ ID NO: 1134055 - RNA, 24 nt, Human
caggacauaguagcuucugcucaa

SEQ ID NO: 1134056 - RNA, 19 nt, Human
cgagggcucuuccuggccc

SEQ ID NO: 1134057 - RNA, 21 nt, Human
gagcacucccagaauuggaau

SEQ ID NO: 1134058 - RNA, 22 nt, Human
ggaaauacacaguguguccuug

SEQ ID NO: 1134059 - RNA, 24 nt, Human
uaaaaacacaacacaagaguucca

SEQ ID NO: 1134060 - RNA, 26 nt, Human
uaaaaacacaacacaagaguuccaca

SEQ ID NO: 1134061 - RNA, 24 nt, Human
uauuucauggguccuucuccccca

SEQ ID NO: 1134062 - RNA, 20 nt, Human
ucaaagggcaggacauagua

SEQ ID NO: 1134063 - RNA, 20 nt, Human
ucacuuauguuuugaauauu

SEQ ID NO: 1134064 - RNA, 27 nt, Human
ucauggguccuucucccccagaggccu

SEQ ID NO: 1134065 - RNA, 19 nt, Human
uccacauggcuggggaggc

SEQ ID NO: 1134066 - RNA, 20 nt, Human
uccuggcccauaucuagcac

SEQ ID NO: 1134067 - RNA, 18 nt, Human
uugcaauaaagcacgaac

SEQ ID NO: 1134068 - RNA, 21 nt, Human
uugcaauaaagcacgaacaag

SEQ ID NO: 1134069 - RNA, 18 nt, Human
aagauaccacagacuggg

SEQ ID NO: 1134070 - RNA, 21 nt, Human
aagcgggccucuggccccagg

SEQ ID NO: 1134071 - RNA, 22 nt, Human
aagcgggccucuggccccaggu

SEQ ID NO: 1134072 - RNA, 22 nt, Human
aaggacaccagucaugcugcac

SEQ ID NO: 1134073 - RNA, 23 nt, Human
accccaccucccuuugucucucc

SEQ ID NO: 1134074 - RNA, 25 nt, Human
accccaccucccuuugucucuccag

SEQ ID NO: 1134075 - RNA, 26 nt, Human
accccaccucccuuugucucuccagc

SEQ ID NO: 1134076 - RNA, 23 nt, Human
acgcauuccugcucugcguuccc

SEQ ID NO: 1134077 - RNA, 21 nt, Human
agaggagaggggagggaagga

SEQ ID NO: 1134078 - RNA, 21 nt, Human
agaggggagggaaggagggaa

SEQ ID NO: 1134079 - RNA, 25 nt, Human
agaggggagggaaggagggaagggg

SEQ ID NO: 1134080 - RNA, 22 nt, Human
agauaccacagacuggguggcu

SEQ ID NO: 1134081 - RNA, 21 nt, Human
agcaagcgggccucuggcccc

SEQ ID NO: 1134082 - RNA, 21 nt, Human
aggaccccaacauaccuguuu

SEQ ID NO: 1134083 - RNA, 18 nt, Human
aggugugucccggauguc

SEQ ID NO: 1134084 - RNA, 18 nt, Human
augaauuaacuccuuguu

SEQ ID NO: 1134085 - RNA, 21 nt, Human
augaucggguguacuauuacc

SEQ ID NO: 1134086 - RNA, 21 nt, Human
auuguuuuucaaaauuccgag

SEQ ID NO: 1134087 - RNA, 18 nt, Human
auuuucagacagccugac

SEQ ID NO: 1134088 - RNA, 22 nt, Human
cacaauucaacccuaacacucc

SEQ ID NO: 1134089 - RNA, 22 nt, Human
caccggcuguguuucugugcgu

SEQ ID NO: 1134090 - RNA, 23 nt, Human
caccucccuuugucucuccagcc

SEQ ID NO: 1134091 - RNA, 18 nt, Human
cacgccuccaucuguggu

SEQ ID NO: 1134092 - RNA, 18 nt, Human
cagcuggcacugccaggc

SEQ ID NO: 1134093 - RNA, 24 nt, Human
caggcucacccagaggggaggggg

SEQ ID NO: 1134094 - RNA, 22 nt, Human
caugaucggguguacuauuacc

SEQ ID NO: 1134095 - RNA, 19 nt, Human
ccaggccucucccugcucc

SEQ ID NO: 1134096 - RNA, 19 nt, Human
ccccacggauugauuuagg

SEQ ID NO: 1134097 - RNA, 20 nt, Human
ccccacggauugauuuaggg

SEQ ID NO: 1134098 - RNA, 23 nt, Human
ccccagcccccagcaagcgggcc

SEQ ID NO: 1134099 - RNA, 24 nt, Human
cccccacccuucaugaauuaacuc

SEQ ID NO: 1134100 - RNA, 19 nt, Human
cccucugagccccagcccc

SEQ ID NO: 1134101 - RNA, 21 nt, Human
cccucugagccccagccccca

SEQ ID NO: 1134102 - RNA, 22 nt, Human
cccugcuccuggugucagcugg

SEQ ID NO: 1134103 - RNA, 22 nt, Human
cccugcuccuggugucagcugg

SEQ ID NO: 1134104 - RNA, 23 nt, Human
ccgcacagcauuuucagacagcc

SEQ ID NO: 1134105 - RNA, 22 nt, Human
ccuccccggcagcaccccaccu

SEQ ID NO: 1134106 - RNA, 19 nt, Human
ccuccuaaauucugugugg

SEQ ID NO: 1134107 - RNA, 25 nt, Human
ccucugagccccagcccccagcaag

SEQ ID NO: 1134108 - RNA, 21 nt, Human
ccugcucugcguucccaggga

SEQ ID NO: 1134109 - RNA, 21 nt, Human
ccuuugucucuccagccagag

SEQ ID NO: 1134110 - RNA, 22 nt, Human
ccuuugucucuccagccagagg

SEQ ID NO: 1134111 - RNA, 19 nt, Human
cgcccugcgcgcaccggcu

SEQ ID NO: 1134112 - RNA, 21 nt, Human
cggcagcaccccaccucccuu

SEQ ID NO: 1134113 - RNA, 20 nt, Human
cuccccggcagcaccccacc

SEQ ID NO: 1134114 - RNA, 22 nt, Human
cuccugaggggcaaggcugagc

SEQ ID NO: 1134115 - RNA, 21 nt, Human
cucugagccccagcccccagc

SEQ ID NO: 1134116 - RNA, 20 nt, Human
cuggcacugccaggcguccc

SEQ ID NO: 1134117 - RNA, 21 nt, Human
cugugaaucccugggagauuc

SEQ ID NO: 1134118 - RNA, 22 nt, Human
cuuugccccucgggccccacgg

SEQ ID NO: 1134119 - RNA, 22 nt, Human
gagggaaggagggaagggggaa

SEQ ID NO: 1134120 - RNA, 19 nt, Human
gaucaggggaggagagugu

SEQ ID NO: 1134121 - RNA, 19 nt, Human
gcagcaccccaccucccuu

SEQ ID NO: 1134122 - RNA, 26 nt, Human
gcauuccugcucugcguucccaggga

SEQ ID NO: 1134123 - RNA, 22 nt, Human
gccaccucuccaucuaagguug

SEQ ID NO: 1134124 - RNA, 21 nt, Human
gccccaggucugggagcggcg

SEQ ID NO: 1134125 - RNA, 22 nt, Human
gcccccagcaagcgggccucug

SEQ ID NO: 1134126 - RNA, 23 nt, Human
gcccccagcaagcgggccucugg

SEQ ID NO: 1134127 - RNA, 24 nt, Human
gcucgcuccccucugagccccagc

SEQ ID NO: 1134128 - RNA, 25 nt, Human
gcuguguuucugugcguugugcuuu

SEQ ID NO: 1134129 - RNA, 18 nt, Human
ggagaccucggcaggagg

SEQ ID NO: 1134130 - RNA, 22 nt, Human
ggagaggggagggaaggaggga

SEQ ID NO: 1134131 - RNA, 19 nt, Human
ggagggaaggagggaaggg

SEQ ID NO: 1134132 - RNA, 19 nt, Human
ggcaggagggagggagaag

SEQ ID NO: 1134133 - RNA, 20 nt, Human
gggccucuggccccaggucu

SEQ ID NO: 1134134 - RNA, 19 nt, Human
gucugggagcggcguggaa

SEQ ID NO: 1134135 - RNA, 22 nt, Human
guuccaggccucucccugcucc

SEQ ID NO: 1134136 - RNA, 20 nt, Human
uacuucaccuucccucagug

SEQ ID NO: 1134137 - RNA, 20 nt, Human
uagaagaggagaggggaggg

SEQ ID NO: 1134138 - RNA, 18 nt, Human
uagcauuugcauuucacu

SEQ ID NO: 1134139 - RNA, 24 nt, Human
uaucauggaauccugaaaucaagg

SEQ ID NO: 1134140 - RNA, 23 nt, Human
uauuguuuuucaaaauuccgagu

SEQ ID NO: 1134141 - RNA, 23 nt, Human
ucacccagaggggagggggaccu

SEQ ID NO: 1134142 - RNA, 21 nt, Human
ucagacagccugacagcagcc

SEQ ID NO: 1134143 - RNA, 18 nt, Human
uccaggccucucccugcu

SEQ ID NO: 1134144 - RNA, 21 nt, Human
uccaggccucucccugcuccu

SEQ ID NO: 1134145 - RNA, 21 nt, Human
ucccagggauccacaaucuuc

SEQ ID NO: 1134146 - RNA, 22 nt, Human
ucccguugcaggccgucuucuc

SEQ ID NO: 1134147 - RNA, 21 nt, Human
ucccuuugucucuccagccag

SEQ ID NO: 1134148 - RNA, 25 nt, Human
ucccuuugucucuccagccagaggu

SEQ ID NO: 1134149 - RNA, 21 nt, Human
uccugaggggcaaggcugagc

SEQ ID NO: 1134150 - RNA, 20 nt, Human
uccuggccucucccugcucc

SEQ ID NO: 1134151 - RNA, 20 nt, Human
uccuggugucagcuggcacu

SEQ ID NO: 1134152 - RNA, 20 nt, Human
uccuggugucagcuggcacu

SEQ ID NO: 1134153 - RNA, 22 nt, Human
ucggcaggagggagggagaagc

SEQ ID NO: 1134154 - RNA, 18 nt, Human
ucuccagggagaaccguu

SEQ ID NO: 1134155 - RNA, 19 nt, Human
ucuccuugccccuuuacuu

SEQ ID NO: 1134156 - RNA, 19 nt, Human
ucucugcaguggacagucu

SEQ ID NO: 1134157 - RNA, 18 nt, Human
ucugcaguggacagucug

SEQ ID NO: 1134158 - RNA, 27 nt, Human
ugaaaacacagaaaugcggcaggaacu

SEQ ID NO: 1134159 - RNA, 19 nt, Human
ugaaaucaagguguguccc

SEQ ID NO: 1134160 - RNA, 22 nt, Human
ugacagcagccgcucgcucccc

SEQ ID NO: 1134161 - RNA, 21 nt, Human
ugcguugugcuuuuguucugc

SEQ ID NO: 1134162 - RNA, 19 nt, Human
ugcuagaaauucggcaaac

SEQ ID NO: 1134163 - RNA, 24 nt, Human
ugcuccuggugucagcuggcacug

SEQ ID NO: 1134164 - RNA, 24 nt, Human
ugcuccuggugucagcuggcacug

SEQ ID NO: 1134165 - RNA, 23 nt, Human
ugcugggcgggcggaacagggug

SEQ ID NO: 1134166 - RNA, 22 nt, Human
uggaaguagaccuuggcucucc

SEQ ID NO: 1134167 - RNA, 23 nt, Human
uggaauccugaaaucaaggugug

SEQ ID NO: 1134168 - RNA, 20 nt, Human
uggcacugccaggcuuccug

SEQ ID NO: 1134169 - RNA, 18 nt, Human
uggcauccaggcucaccc

SEQ ID NO: 1134170 - RNA, 20 nt, Human
ugggagcggcguggaaguag

SEQ ID NO: 1134171 - RNA, 29 nt, Human
ugggauaugcuuauaucaaaaacuuacgu

SEQ ID NO: 1134172 - RNA, 20 nt, Human
ugggcgggcggaacagggug

SEQ ID NO: 1134173 - RNA, 18 nt, Human
ugucccggaugucuccag

SEQ ID NO: 1134174 - RNA, 23 nt, Human
uguuuuacuuuccuagggcggca

SEQ ID NO: 1134175 - RNA, 19 nt, Human
uuccaggccucucccugcu

SEQ ID NO: 1134176 - RNA, 18 nt, Human
uucugugugguaaccgac

SEQ ID NO: 1134177 - RNA, 24 nt, Human
acccugggccuggugucuaguccu

SEQ ID NO: 1134178 - RNA, 21 nt, Human
caaagccaggcccugccccuu

SEQ ID NO: 1134179 - RNA, 20 nt, Human
cuuguagcaaagccaggccc

SEQ ID NO: 1134180 - RNA, 21 nt, Human
gcagacucacacccugggccu

SEQ ID NO: 1134181 - RNA, 19 nt, Human
ucuaucuuguagcaaagcc

SEQ ID NO: 1134182 - RNA, 22 nt, Human
uguagcaaagccaggcccugcc

SEQ ID NO: 1134183 - RNA, 24 nt, Human
aaacagcugggauuacaggcauga

SEQ ID NO: 1134184 - RNA, 25 nt, Human
aaacagcugggauuacaggcaugag

SEQ ID NO: 1134185 - RNA, 19 nt, Human
aacuguuuugguuuagugu

SEQ ID NO: 1134186 - RNA, 25 nt, Human
aagcaauccuccugcgucagccucc

SEQ ID NO: 1134187 - RNA, 24 nt, Human
aauuuuuuaaaacuuuuaguagag

SEQ ID NO: 1134188 - RNA, 19 nt, Human
acacaggcccauaacccgg

SEQ ID NO: 1134189 - RNA, 24 nt, Human
acacggccguggacacacaggccc

SEQ ID NO: 1134190 - RNA, 22 nt, Human
acagaccaccaccuaugcaaac

SEQ ID NO: 1134191 - RNA, 21 nt, Human
acagcucacugaagccucgcu

SEQ ID NO: 1134192 - RNA, 19 nt, Human
accccacgauggcucccuc

SEQ ID NO: 1134193 - RNA, 24 nt, Human
acuccugggcucaagcgauucucc

SEQ ID NO: 1134194 - RNA, 21 nt, Human
agcacccaaggcaggcgucuc

SEQ ID NO: 1134195 - RNA, 19 nt, Human
agccuaaacggugcugcag

SEQ ID NO: 1134196 - RNA, 22 nt, Human
agcugggauuacaggcaugagc

SEQ ID NO: 1134197 - RNA, 19 nt, Human
aggagaaaacugacucuaa

SEQ ID NO: 1134198 - RNA, 21 nt, Human
aggcucccucccuuuucaccc

SEQ ID NO: 1134199 - RNA, 22 nt, Human
aggucucgcuauguugcucagg

SEQ ID NO: 1134200 - RNA, 19 nt, Human
auguugcucaggcuggucu

SEQ ID NO: 1134201 - RNA, 24 nt, Human
caaaacccauguuugaccuaaagc

SEQ ID NO: 1134202 - RNA, 20 nt, Human
caaacagcgcuuaucuggaa

SEQ ID NO: 1134203 - RNA, 22 nt, Human
caaacagcugggauuacaggca

SEQ ID NO: 1134204 - RNA, 27 nt, Human
caagcaauccuccugcgucagccuccc

SEQ ID NO: 1134205 - RNA, 22 nt, Human
caaggcaggcgucucgcugacc

SEQ ID NO: 1134206 - RNA, 21 nt, Human
cacaaucacagcucacugaag

SEQ ID NO: 1134207 - RNA, 24 nt, Human
cacacaggcccauaacccggccag

SEQ ID NO: 1134208 - RNA, 19 nt, Human
caccacgugacagaccacc

SEQ ID NO: 1134209 - RNA, 19 nt, Human
cacccagcgccuuuuucua

SEQ ID NO: 1134210 - RNA, 21 nt, Human
cagccggcauccagcacccaa

SEQ ID NO: 1134211 - RNA, 22 nt, Human
ccaaacagcugggauuacaggc

SEQ ID NO: 1134212 - RNA, 24 nt, Human
ccaaacagcugggauuacaggcau

SEQ ID NO: 1134213 - RNA, 25 nt, Human
ccaccacgugacagaccaccaccua

SEQ ID NO: 1134214 - RNA, 18 nt, Human
ccacgugacagaccacca

SEQ ID NO: 1134215 - RNA, 22 nt, Human
ccagcgccuuuuucuauuuucu

SEQ ID NO: 1134216 - RNA, 23 nt, Human
cccaaacagcugggauuacaggc

SEQ ID NO: 1134217 - RNA, 24 nt, Human
cccaaacagcugggauuacaggca

SEQ ID NO: 1134218 - RNA, 19 nt, Human
cccaccacgugacagacca

SEQ ID NO: 1134219 - RNA, 18 nt, Human
cccauguuugaccuaaag

SEQ ID NO: 1134220 - RNA, 20 nt, Human
cccucccuuuucacccugga

SEQ ID NO: 1134221 - RNA, 26 nt, Human
ccuccugcgucagccucccaaauagc

SEQ ID NO: 1134222 - RNA, 20 nt, Human
ccugggcucaagcgauucuc

SEQ ID NO: 1134223 - RNA, 24 nt, Human
ccuuuguuuagacuuggggccaaa

SEQ ID NO: 1134224 - RNA, 24 nt, Human
cguggacacacaggcccauaaccc

SEQ ID NO: 1134225 - RNA, 24 nt, Human
cucaagcaauccuccugcgucagc

SEQ ID NO: 1134226 - RNA, 24 nt, Human
cucaagcgauucucccgucucugc

SEQ ID NO: 1134227 - RNA, 23 nt, Human
cucacugaagccucgcucuccca

SEQ ID NO: 1134228 - RNA, 18 nt, Human
cucccucccuuuucaccc

SEQ ID NO: 1134229 - RNA, 21 nt, Human
cuccugggcucaagcgauucu

SEQ ID NO: 1134230 - RNA, 25 nt, Human
cuccugggcucaagcgauucucccg

SEQ ID NO: 1134231 - RNA, 21 nt, Human
cucugccacccaaacagcugg

SEQ ID NO: 1134232 - RNA, 23 nt, Human
cucugucacccaggcuggaauac

SEQ ID NO: 1134233 - RNA, 23 nt, Human
gaggucucgcuauguugcucagg

SEQ ID NO: 1134234 - RNA, 22 nt, Human
gauuacaggcaugagccucugc

SEQ ID NO: 1134235 - RNA, 23 nt, Human
gauuacaggcaugagccucugca

SEQ ID NO: 1134236 - RNA, 23 nt, Human
gcccgguuaaauuuuuuaaaacu

SEQ ID NO: 1134237 - RNA, 20 nt, Human
gccuaaacggugcugcagaa

SEQ ID NO: 1134238 - RNA, 20 nt, Human
gcgucagccucccaaauagc

SEQ ID NO: 1134239 - RNA, 19 nt, Human
gcuggaauacaguggcaca

SEQ ID NO: 1134240 - RNA, 19 nt, Human
gcugggauuacaggcauga

SEQ ID NO: 1134241 - RNA, 22 nt, Human
ggauuacaggcaugagccucug

SEQ ID NO: 1134242 - RNA, 19 nt, Human
ggccaaaaaauuccaggca

SEQ ID NO: 1134243 - RNA, 27 nt, Human
ggccguggacacacaggcccauaaccc

SEQ ID NO: 1134244 - RNA, 21 nt, Human
gggccaaaaaauuccaggcac

SEQ ID NO: 1134245 - RNA, 20 nt, Human
gguucuggauucagucagag

SEQ ID NO: 1134246 - RNA, 22 nt, Human
gucguacagccggcauccagca

SEQ ID NO: 1134247 - RNA, 28 nt, Human
uacaggcaaggcaagggccaccaugccc

SEQ ID NO: 1134248 - RNA, 24 nt, Human
uacaggcaugagccucugcaccca

SEQ ID NO: 1134249 - RNA, 24 nt, Human
uaguagagaagaggucucgcuaug

SEQ ID NO: 1134250 - RNA, 24 nt, Human
uaucucucugucacccaggcugga

SEQ ID NO: 1134251 - RNA, 24 nt, Human
uauguugcucaggcuggucuuaaa

SEQ ID NO: 1134252 - RNA, 19 nt, Human
ucacccaggcuggaauaca

SEQ ID NO: 1134253 - RNA, 18 nt, Human
ucagccucccaaauagcu

SEQ ID NO: 1134254 - RNA, 21 nt, Human
uccugggcucaagcgauucuc

SEQ ID NO: 1134255 - RNA, 22 nt, Human
uccugggcucaagcgauucucc

SEQ ID NO: 1134256 - RNA, 24 nt, Human
uccugggcucaagcgauucucccg

SEQ ID NO: 1134257 - RNA, 22 nt, Human
ucucccgucucugccacccaaa

SEQ ID NO: 1134258 - RNA, 19 nt, Human
ucucgcuauguugcucagg

SEQ ID NO: 1134259 - RNA, 23 nt, Human
ucucgcuauguugcucaggcugg

SEQ ID NO: 1134260 - RNA, 24 nt, Human
ucucgcuauguugcucaggcuggu

SEQ ID NO: 1134261 - RNA, 22 nt, Human
ucucucugucacccaggcugga

SEQ ID NO: 1134262 - RNA, 24 nt, Human
ucucucugucacccaggcuggaau

SEQ ID NO: 1134263 - RNA, 24 nt, Human
ucugucacccaggcuggaauacag

SEQ ID NO: 1134264 - RNA, 23 nt, Human
ucuuaaacuccugggcucaagcg

SEQ ID NO: 1134265 - RNA, 23 nt, Human
ugacagaccaccaccuaugcaaa

SEQ ID NO: 1134266 - RNA, 24 nt, Human
ugacagaccaccaccuaugcaaac

SEQ ID NO: 1134267 - RNA, 21 nt, Human
ugaccaagaacugaauagccu

SEQ ID NO: 1134268 - RNA, 23 nt, Human
ugaccaagaacugaauagccugg

SEQ ID NO: 1134269 - RNA, 20 nt, Human
ugauuucaggauuuggcgcu

SEQ ID NO: 1134270 - RNA, 24 nt, Human
ugcccgguuaaauuuuuuaaaacu

SEQ ID NO: 1134271 - RNA, 24 nt, Human
ugcgucagccucccaaauagcuag

SEQ ID NO: 1134272 - RNA, 24 nt, Human
ugcucaggcuggucuuaaacuccu

SEQ ID NO: 1134273 - RNA, 20 nt, Human
uggcacaaucacagcucacu

SEQ ID NO: 1134274 - RNA, 22 nt, Human
uggcacaaucacagcucacuga

SEQ ID NO: 1134275 - RNA, 18 nt, Human
ugggauuacaggcaugag

SEQ ID NO: 1134276 - RNA, 19 nt, Human
ugggauuacaggcaugagc

SEQ ID NO: 1134277 - RNA, 19 nt, Human
ugggauuacaggcaugagc

SEQ ID NO: 1134278 - RNA, 21 nt, Human
ugggauuacaggcaugagccu

SEQ ID NO: 1134279 - RNA, 24 nt, Human
ugggauuacaggcaugagccucug

SEQ ID NO: 1134280 - RNA, 24 nt, Human
ugggauuacaggcaugagccucug

SEQ ID NO: 1134281 - RNA, 25 nt, Human
ugggauuacaggcaugagccucugc

SEQ ID NO: 1134282 - RNA, 24 nt, Human
ugggcucaagcgauucucccgucu

SEQ ID NO: 1134283 - RNA, 22 nt, Human
uuuagacuuggggccaaaaaau

SEQ ID NO: 1134284 - RNA, 18 nt, Human
uuuuuuuuuugagacagg

SEQ ID NO: 1134285 - RNA, 18 nt, Human
ugagaggcggaagcacau

SEQ ID NO: 1134286 - RNA, 21 nt, Human
aaaaagauauguugaagaaaa

SEQ ID NO: 1134287 - RNA, 21 nt, Human
aaaccagguggcugaaaacca

SEQ ID NO: 1134288 - RNA, 18 nt, Human
aaacuaacagagacccca

SEQ ID NO: 1134289 - RNA, 20 nt, Human
aaaggaagggaaacaagggg

SEQ ID NO: 1134290 - RNA, 19 nt, Human
aaagugcugggauucuagg

SEQ ID NO: 1134291 - RNA, 20 nt, Human
aaagugcugggauucuaggc

SEQ ID NO: 1134292 - RNA, 20 nt, Human
aaagugcugggauucuaggc

SEQ ID NO: 1134293 - RNA, 24 nt, Human
aaagugcugggauucuaggcguga

SEQ ID NO: 1134294 - RNA, 22 nt, Human
aaaguucuugaaaaugccuccc

SEQ ID NO: 1134295 - RNA, 19 nt, Human
aaaugaaaggaagaagccc

SEQ ID NO: 1134296 - RNA, 18 nt, Human
aaaugccuccccagccgu

SEQ ID NO: 1134297 - RNA, 23 nt, Human
aacacacucuucaguggcugccc

SEQ ID NO: 1134298 - RNA, 21 nt, Human
aagcagagccggccuccaggg

SEQ ID NO: 1134299 - RNA, 19 nt, Human
aagugcugggauucuaggc

SEQ ID NO: 1134300 - RNA, 19 nt, Human
aauccaggaugaccucauc

SEQ ID NO: 1134301 - RNA, 18 nt, Human
acaaaagaaggcaauaca

SEQ ID NO: 1134302 - RNA, 23 nt, Human
acaaaccagguggcugaaaacca

SEQ ID NO: 1134303 - RNA, 19 nt, Human
acaaaugaaaggaagaagc

SEQ ID NO: 1134304 - RNA, 25 nt, Human
accggagagagcccagcgggaggac

SEQ ID NO: 1134305 - RNA, 20 nt, Human
accgugggaacagcucacac

SEQ ID NO: 1134306 - RNA, 21 nt, Human
accuugcccagcgccccgcgg

SEQ ID NO: 1134307 - RNA, 18 nt, Human
acucugucacccaagcug

SEQ ID NO: 1134308 - RNA, 25 nt, Human
acucugucacccaagcuggagugca

SEQ ID NO: 1134309 - RNA, 19 nt, Human
acugcagccuugacuuccu

SEQ ID NO: 1134310 - RNA, 23 nt, Human
acuuuguugcccaggcuggucuc

SEQ ID NO: 1134311 - RNA, 25 nt, Human
acuuuguugcccaggcuggucucaa

SEQ ID NO: 1134312 - RNA, 21 nt, Human
agaaacacaagaagaugacca

SEQ ID NO: 1134313 - RNA, 19 nt, Human
agacaggcagugauuggag

SEQ ID NO: 1134314 - RNA, 25 nt, Human
agagaccccaaagaaaaggaaggga

SEQ ID NO: 1134315 - RNA, 19 nt, Human
agcagagccggccuccagg

SEQ ID NO: 1134316 - RNA, 22 nt, Human
agcgggaggacaguuggaacag

SEQ ID NO: 1134317 - RNA, 23 nt, Human
aggcuggaagggggcaggaagca

SEQ ID NO: 1134318 - RNA, 22 nt, Human
agggacccuacccuggugccuu

SEQ ID NO: 1134319 - RNA, 19 nt, Human
agggggcaggaagcagagc

SEQ ID NO: 1134320 - RNA, 21 nt, Human
agguggcugaaaaccacagaa

SEQ ID NO: 1134321 - RNA, 21 nt, Human
agugcagcgguuucccugcca

SEQ ID NO: 1134322 - RNA, 26 nt, Human
aguuugggcuucaaucuaccuuucug

SEQ ID NO: 1134323 - RNA, 18 nt, Human
auaaggucacagcauugg

SEQ ID NO: 1134324 - RNA, 24 nt, Human
aucuuacuuuguugcccaggcugg

SEQ ID NO: 1134325 - RNA, 23 nt, Human
augaccucaucugaaccugaaca

SEQ ID NO: 1134326 - RNA, 24 nt, Human
caaaguuccggagaguagaagucc

SEQ ID NO: 1134327 - RNA, 19 nt, Human
caacucaacccuuccacaa

SEQ ID NO: 1134328 - RNA, 19 nt, Human
caagcgauccucccgccuc

SEQ ID NO: 1134329 - RNA, 20 nt, Human
caagcgauccuccugccuca

SEQ ID NO: 1134330 - RNA, 22 nt, Human
caagcgauccuccugccucagc

SEQ ID NO: 1134331 - RNA, 18 nt, Human
caaggagugccgagccuu

SEQ ID NO: 1134332 - RNA, 18 nt, Human
cacaacagccagugcucu

SEQ ID NO: 1134333 - RNA, 19 nt, Human
cacacaccucugugccgcc

SEQ ID NO: 1134334 - RNA, 21 nt, Human
cacacucuucaguggcugccc

SEQ ID NO: 1134335 - RNA, 18 nt, Human
cacaggcucuuucuuaag

SEQ ID NO: 1134336 - RNA, 19 nt, Human
caccacgcccagcuaauuu

SEQ ID NO: 1134337 - RNA, 21 nt, Human
cacccaagcuggagugcagug

SEQ ID NO: 1134338 - RNA, 23 nt, Human
cacuccagcccaugcacugggga

SEQ ID NO: 1134339 - RNA, 23 nt, Human
cacucugucacccaagcuggagu

SEQ ID NO: 1134340 - RNA, 24 nt, Human
cacucugucacccaagcuggagug

SEQ ID NO: 1134341 - RNA, 18 nt, Human
cagcgggaggacaguugg

SEQ ID NO: 1134342 - RNA, 24 nt, Human
caggaaacuaacagagaccccaaa

SEQ ID NO: 1134343 - RNA, 24 nt, Human
caggaucuuacuuuguugcccagg

SEQ ID NO: 1134344 - RNA, 23 nt, Human
caggaugaccucaucugaaccug

SEQ ID NO: 1134345 - RNA, 21 nt, Human
caggcgcgcaucaccacgccc

SEQ ID NO: 1134346 - RNA, 19 nt, Human
caggcucccggguuauucc

SEQ ID NO: 1134347 - RNA, 20 nt, Human
caggcucccggguuauuccc

SEQ ID NO: 1134348 - RNA, 21 nt, Human
caucaacucaacccuuccaca

SEQ ID NO: 1134349 - RNA, 21 nt, Human
caugacauuggcucuuuuucc

SEQ ID NO: 1134350 - RNA, 20 nt, Human
ccacagacuuuuuuuuuuuu

SEQ ID NO: 1134351 - RNA, 22 nt, Human
ccacaugacauuggcucuuuuu

SEQ ID NO: 1134352 - RNA, 21 nt, Human
cccaaagaaaaggaagggaaa

SEQ ID NO: 1134353 - RNA, 25 nt, Human
cccacaaaccagguggcugaaaacc

SEQ ID NO: 1134354 - RNA, 21 nt, Human
cccacagacuuuuuuuuuuuu

SEQ ID NO: 1134355 - RNA, 20 nt, Human
cccaggaagaaucccucugc

SEQ ID NO: 1134356 - RNA, 22 nt, Human
ccccaggaaugcugcgcccucg

SEQ ID NO: 1134357 - RNA, 19 nt, Human
cccccaggaagaaucccuc

SEQ ID NO: 1134358 - RNA, 26 nt, Human
ccucccgccucugccucucauguagc

SEQ ID NO: 1134359 - RNA, 25 nt, Human
ccuccugccucagccucuaaagugc

SEQ ID NO: 1134360 - RNA, 22 nt, Human
ccucugccucucauguagcugg

SEQ ID NO: 1134361 - RNA, 25 nt, Human
ccucugccucucauguagcuggaaa

SEQ ID NO: 1134362 - RNA, 18 nt, Human
ccugggcucaagcgaucc

SEQ ID NO: 1134363 - RNA, 20 nt, Human
ccugggcucaagcgauccuc

SEQ ID NO: 1134364 - RNA, 23 nt, Human
ccugggcucaagcgauccuccug

SEQ ID NO: 1134365 - RNA, 19 nt, Human
ccuugacuuccugggcuca

SEQ ID NO: 1134366 - RNA, 20 nt, Human
ccuugacuuccugggcucaa

SEQ ID NO: 1134367 - RNA, 23 nt, Human
cgcgcaucaccacgcccagcuaa

SEQ ID NO: 1134368 - RNA, 19 nt, Human
cggccuccagggcucugcc

SEQ ID NO: 1134369 - RNA, 21 nt, Human
cggccuccagggcucugccag

SEQ ID NO: 1134370 - RNA, 24 nt, Human
cuaaagugcugggauucuaggcgu

SEQ ID NO: 1134371 - RNA, 25 nt, Human
cuaacagagaccccaaagaaaagga

SEQ ID NO: 1134372 - RNA, 24 nt, Human
cucaagcgauccucccgccucugc

SEQ ID NO: 1134373 - RNA, 24 nt, Human
cucaagcgauccuccugccucagc

SEQ ID NO: 1134374 - RNA, 24 nt, Human
cucacucugucacccaagcuggag

SEQ ID NO: 1134375 - RNA, 22 nt, Human
cuccgcgcccgggcacaggcuc

SEQ ID NO: 1134376 - RNA, 19 nt, Human
cuccucugaagcccccagg

SEQ ID NO: 1134377 - RNA, 21 nt, Human
cucggcccuaauuccuucacu

SEQ ID NO: 1134378 - RNA, 21 nt, Human
cugaacacaucugcaaagacu

SEQ ID NO: 1134379 - RNA, 22 nt, Human
cugccucagccucuaaagugcu

SEQ ID NO: 1134380 - RNA, 22 nt, Human
cugcgcccucgggcugcuccag

SEQ ID NO: 1134381 - RNA, 24 nt, Human
cuguaaaauccugcaccuggauuu

SEQ ID NO: 1134382 - RNA, 24 nt, Human
cuuccugggcucaagcgauccucc

SEQ ID NO: 1134383 - RNA, 23 nt, Human
cuuuuuuuuuuuucagggucuca

SEQ ID NO: 1134384 - RNA, 19 nt, Human
gaaacuaacagagacccca

SEQ ID NO: 1134385 - RNA, 24 nt, Human
gaaacuaacagagaccccaaagaa

SEQ ID NO: 1134386 - RNA, 21 nt, Human
gagagcccagcgggaggacag

SEQ ID NO: 1134387 - RNA, 18 nt, Human
gcaggaagcagagccggc

SEQ ID NO: 1134388 - RNA, 19 nt, Human
gcaggaccacccuccucug

SEQ ID NO: 1134389 - RNA, 21 nt, Human
gccauuaaggaaacgucaccc

SEQ ID NO: 1134390 - RNA, 19 nt, Human
gccguuuucgugagaggug

SEQ ID NO: 1134391 - RNA, 18 nt, Human
gccugccaaggagugccg

SEQ ID NO: 1134392 - RNA, 21 nt, Human
gcuccaggcuggaagggggca

SEQ ID NO: 1134393 - RNA, 21 nt, Human
gcuggagugcaguggugccag

SEQ ID NO: 1134394 - RNA, 23 nt, Human
ggaagggaaacaagggguuugaa

SEQ ID NO: 1134395 - RNA, 22 nt, Human
ggaagggggcaggaagcagagc

SEQ ID NO: 1134396 - RNA, 18 nt, Human
ggacucaacucagcccac

SEQ ID NO: 1134397 - RNA, 18 nt, Human
ggcaggaagcagagccgg

SEQ ID NO: 1134398 - RNA, 22 nt, Human
ggcugccauaacaaauucccac

SEQ ID NO: 1134399 - RNA, 21 nt, Human
gggaggacaguuggaacagag

SEQ ID NO: 1134400 - RNA, 20 nt, Human
gggcaggaccacccuccucu

SEQ ID NO: 1134401 - RNA, 22 nt, Human
gggcucaagcgauccuccugcc

SEQ ID NO: 1134402 - RNA, 19 nt, Human
gggcugccauaacaaauuc

SEQ ID NO: 1134403 - RNA, 19 nt, Human
ggggagaccgaggcacaga

SEQ ID NO: 1134404 - RNA, 24 nt, Human
uaaagugcugggauucuaggcgug

SEQ ID NO: 1134405 - RNA, 24 nt, Human
uaacagagaccccaaagaaaagga

SEQ ID NO: 1134406 - RNA, 20 nt, Human
uaaguaacucacucaagguc

SEQ ID NO: 1134407 - RNA, 24 nt, Human
uaauuuuuuuuauuuuuuguagag

SEQ ID NO: 1134408 - RNA, 23 nt, Human
uacacucaucaacucaacccuuc

SEQ ID NO: 1134409 - RNA, 19 nt, Human
uacgaggagagauacagag

SEQ ID NO: 1134410 - RNA, 21 nt, Human
uacuuuguugcccaggcuggu

SEQ ID NO: 1134411 - RNA, 22 nt, Human
uagagaacccugacaaacaagg

SEQ ID NO: 1134412 - RNA, 22 nt, Human
uagagacaggaucuuacuuugu

SEQ ID NO: 1134413 - RNA, 19 nt, Human
uagccguuuucgugagagg

SEQ ID NO: 1134414 - RNA, 21 nt, Human
uaguggccgacacucagcagc

SEQ ID NO: 1134415 - RNA, 18 nt, Human
uauuuugagauuuuucag

SEQ ID NO: 1134416 - RNA, 23 nt, Human
ucaacucaacccuuccacaaccc

SEQ ID NO: 1134417 - RNA, 22 nt, Human
ucacucaaggucacacaguuga

SEQ ID NO: 1134418 - RNA, 19 nt, Human
ucacugcagccuugacuuc

SEQ ID NO: 1134419 - RNA, 23 nt, Human
ucacugcagccuugacuuccugg

SEQ ID NO: 1134420 - RNA, 24 nt, Human
ucacugcagccuugacuuccuggg

SEQ ID NO: 1134421 - RNA, 19 nt, Human
uccagggcucugccagggg

SEQ ID NO: 1134422 - RNA, 21 nt, Human
ucccugccaggcucccggguu

SEQ ID NO: 1134423 - RNA, 22 nt, Human
uccucugaagcccccaggaaga

SEQ ID NO: 1134424 - RNA, 23 nt, Human
uccucugaagcccccaggaagaa

SEQ ID NO: 1134425 - RNA, 21 nt, Human
uccugggcucaagcgauccuc

SEQ ID NO: 1134426 - RNA, 21 nt, Human
uccugggcucaagcgauccuc

SEQ ID NO: 1134427 - RNA, 22 nt, Human
uccugggcucaagcgauccucc

SEQ ID NO: 1134428 - RNA, 23 nt, Human
uccugggcucaagcgauccuccc

SEQ ID NO: 1134429 - RNA, 24 nt, Human
uccugggcucaagcgauccuccug

SEQ ID NO: 1134430 - RNA, 23 nt, Human
uccuuggcuuggagcagcagugc

SEQ ID NO: 1134431 - RNA, 23 nt, Human
ucucaaauuccugggcucaagcg

SEQ ID NO: 1134432 - RNA, 24 nt, Human
ucucacucugucacccaagcugga

SEQ ID NO: 1134433 - RNA, 26 nt, Human
ucucacucugucacccaagcuggagu

SEQ ID NO: 1134434 - RNA, 27 nt, Human
ucucacucugucacccaagcuggagug

SEQ ID NO: 1134435 - RNA, 24 nt, Human
ucucauguagcuggaaacacaggc

SEQ ID NO: 1134436 - RNA, 24 nt, Human
ucugucacccaagcuggagugcag

SEQ ID NO: 1134437 - RNA, 22 nt, Human
ucuuacuuuguugcccaggcug

SEQ ID NO: 1134438 - RNA, 23 nt, Human
ucuuacuuuguugcccaggcugg

SEQ ID NO: 1134439 - RNA, 22 nt, Human
ucuucaguccuuggugcuccuu

SEQ ID NO: 1134440 - RNA, 19 nt, Human
ugaaaaugccuccccagcc

SEQ ID NO: 1134441 - RNA, 21 nt, Human
ugaaaaugccuccccagccgu

SEQ ID NO: 1134442 - RNA, 18 nt, Human
ugaaaggaagaagcccau

SEQ ID NO: 1134443 - RNA, 22 nt, Human
ugaaauggauacagguaaaaug

SEQ ID NO: 1134444 - RNA, 23 nt, Human
ugaagcccccaggaagaagggag

SEQ ID NO: 1134445 - RNA, 21 nt, Human
ugacauuggcucuuuuuccuu

SEQ ID NO: 1134446 - RNA, 25 nt, Human
ugacuuccugggcucaagcgauccu

SEQ ID NO: 1134447 - RNA, 19 nt, Human
ugagaggugguguucuggg

SEQ ID NO: 1134448 - RNA, 23 nt, Human
ugagccuccgcgcccgggcacag

SEQ ID NO: 1134449 - RNA, 19 nt, Human
ugccauaacaaauucccac

SEQ ID NO: 1134450 - RNA, 24 nt, Human
ugccauaacaaauucccacaaacc

SEQ ID NO: 1134451 - RNA, 23 nt, Human
ugcccagcgccccgcgggcgucu

SEQ ID NO: 1134452 - RNA, 24 nt, Human
ugcccaggcuggucucaaauuccu

SEQ ID NO: 1134453 - RNA, 28 nt, Human
ugcccaggcuggucucaaauuccugggc

SEQ ID NO: 1134454 - RNA, 23 nt, Human
ugccucagccucuaaagugcugg

SEQ ID NO: 1134455 - RNA, 19 nt, Human
ugcugggcaccuggcuguu

SEQ ID NO: 1134456 - RNA, 24 nt, Human
uggaaacacaggcgcgcaucacca

SEQ ID NO: 1134457 - RNA, 23 nt, Human
uggagcacggcuggugccugcca

SEQ ID NO: 1134458 - RNA, 24 nt, Human
uggagugcaguggugccaacaugg

SEQ ID NO: 1134459 - RNA, 22 nt, Human
uggcacagaacaagucugugcc

SEQ ID NO: 1134460 - RNA, 19 nt, Human
ugggauucuaggcgugagc

SEQ ID NO: 1134461 - RNA, 24 nt, Human
ugggauucuaggcgugagccuccg

SEQ ID NO: 1134462 - RNA, 23 nt, Human
ugggcaggaccacccuccucuga

SEQ ID NO: 1134463 - RNA, 24 nt, Human
ugggcucaagcgauccucccgccu

SEQ ID NO: 1134464 - RNA, 24 nt, Human
ugggcucaagcgauccuccugccu

SEQ ID NO: 1134465 - RNA, 21 nt, Human
uggguagcuugugaaccacca

SEQ ID NO: 1134466 - RNA, 21 nt, Human
uggguccugaauccaaugacc

SEQ ID NO: 1134467 - RNA, 24 nt, Human
uggugccaacaugguucacugcag

SEQ ID NO: 1134468 - RNA, 19 nt, Human
uggugccuucagaggcagc

SEQ ID NO: 1134469 - RNA, 24 nt, Human
ugguucacugcagccuugacuucc

SEQ ID NO: 1134470 - RNA, 18 nt, Human
ugugaaagaugcauucug

SEQ ID NO: 1134471 - RNA, 18 nt, Human
uguuccgucccuucacuu

SEQ ID NO: 1134472 - RNA, 22 nt, Human
uguugcccaggcuggucucaaa

SEQ ID NO: 1134473 - RNA, 23 nt, Human
uguugccuguauucguuuucugg

SEQ ID NO: 1134474 - RNA, 18 nt, Human
uuacuuuguugcccaggc

SEQ ID NO: 1134475 - RNA, 24 nt, Human
uuccaacacacucuucaguggcug

SEQ ID NO: 1134476 - RNA, 23 nt, Human
uuccugggcucaagcgauccucc

SEQ ID NO: 1134477 - RNA, 24 nt, Human
uucgugagaggugguguucugggu

SEQ ID NO: 1134478 - RNA, 19 nt, Human
uugcagauguaauuaagug

SEQ ID NO: 1134479 - RNA, 18 nt, Human
uugcccagcgccccgcgg

SEQ ID NO: 1134480 - RNA, 22 nt, Human
uugugcauacacgcucggcccu

SEQ ID NO: 1134481 - RNA, 27 nt, Human
uuuacacucaucaacucaacccuucca

SEQ ID NO: 1134482 - RNA, 21 nt, Human
uuucacaacagccagugcucu

SEQ ID NO: 1134483 - RNA, 24 nt, Human
uuucuggggcugccauaacaaauu

SEQ ID NO: 1134484 - RNA, 23 nt, Human
uuuguugcccaggcuggucucaa

SEQ ID NO: 1134485 - RNA, 24 nt, Human
uuuguugcccaggcuggucucaaa

SEQ ID NO: 1134486 - RNA, 20 nt, Human
uuuucaguggcugacacuuc

SEQ ID NO: 1134487 - RNA, 22 nt, Human
aaaugccagagacccacagagu

SEQ ID NO: 1134488 - RNA, 23 nt, Human
acagcuccaaauagccauaggca

SEQ ID NO: 1134489 - RNA, 21 nt, Human
augaccuucgcaccaguuuuc

SEQ ID NO: 1134490 - RNA, 20 nt, Human
ccacaacugggagcuugauu

SEQ ID NO: 1134491 - RNA, 25 nt, Human
cuccaaauagccauaggcauuguuc

SEQ ID NO: 1134492 - RNA, 18 nt, Human
cuugguggggccucucca

SEQ ID NO: 1134493 - RNA, 24 nt, Human
gacagcuccaaauagccauaggca

SEQ ID NO: 1134494 - RNA, 21 nt, Human
gcauuguuccuugguggggcc

SEQ ID NO: 1134495 - RNA, 22 nt, Human
guguagaaaugccagagaccca

SEQ ID NO: 1134496 - RNA, 27 nt, Human
ucacacaaaugaccuucgcaccaguuu

SEQ ID NO: 1134497 - RNA, 24 nt, Human
ucuacuugcaagauguguagaaau

SEQ ID NO: 1134498 - RNA, 20 nt, Human
ugccuggaggaggaaucugg

SEQ ID NO: 1134499 - RNA, 20 nt, Human
uggaacaaaagggcaguuag

SEQ ID NO: 1134500 - RNA, 23 nt, Human
uguuguggcagcugacgagcuug

SEQ ID NO: 1134501 - RNA, 19 nt, Human
aaaaggccccagcaguuuc

SEQ ID NO: 1134502 - RNA, 19 nt, Human
aacagaaggaaucacugaa

SEQ ID NO: 1134503 - RNA, 18 nt, Human
aagaaacucaaccagaga

SEQ ID NO: 1134504 - RNA, 21 nt, Human
aaucacugaacgaacagccac

SEQ ID NO: 1134505 - RNA, 19 nt, Human
acacuggagggcaagccca

SEQ ID NO: 1134506 - RNA, 20 nt, Human
acacuggagggcaagcccac

SEQ ID NO: 1134507 - RNA, 22 nt, Human
acccccagggccugggacagca

SEQ ID NO: 1134508 - RNA, 18 nt, Human
acuaaggccuuaaugggu

SEQ ID NO: 1134509 - RNA, 21 nt, Human
acucaaccagagaugaaagga

SEQ ID NO: 1134510 - RNA, 18 nt, Human
acugcaacaaccaagccc

SEQ ID NO: 1134511 - RNA, 25 nt, Human
acuucacccacacagggaguuucgg

SEQ ID NO: 1134512 - RNA, 20 nt, Human
acuuugcacaguuacucccc

SEQ ID NO: 1134513 - RNA, 23 nt, Human
agaaagagaggcacaaaaugcuu

SEQ ID NO: 1134514 - RNA, 18 nt, Human
agaggagaagaaagagag

SEQ ID NO: 1134515 - RNA, 24 nt, Human
aggagaagaaagagaggcacaaaa

SEQ ID NO: 1134516 - RNA, 19 nt, Human
aggcaguaaacaaaacagg

SEQ ID NO: 1134517 - RNA, 20 nt, Human
augagcacggcuaagccaag

SEQ ID NO: 1134518 - RNA, 18 nt, Human
auggaagaaacucaacca

SEQ ID NO: 1134519 - RNA, 22 nt, Human
auugcacuuuaugccuuacaaa

SEQ ID NO: 1134520 - RNA, 18 nt, Human
caaaacagggacuucagc

SEQ ID NO: 1134521 - RNA, 24 nt, Human
cacugacugcauaaaacuuugcac

SEQ ID NO: 1134522 - RNA, 20 nt, Human
cagaaggaaucacugaacgg

SEQ ID NO: 1134523 - RNA, 22 nt, Human
cagccagaggagaagaaagaga

SEQ ID NO: 1134524 - RNA, 21 nt, Human
cagcccagugccuggaaacag

SEQ ID NO: 1134525 - RNA, 22 nt, Human
cagcccagugccuggaaacagg

SEQ ID NO: 1134526 - RNA, 21 nt, Human
caggaggcaguaaacaaaaca

SEQ ID NO: 1134527 - RNA, 23 nt, Human
caggaggcaguaaacaaaacagg

SEQ ID NO: 1134528 - RNA, 18 nt, Human
cagugccuggaaacagcc

SEQ ID NO: 1134529 - RNA, 24 nt, Human
cauguaccauuuccugguccugaa

SEQ ID NO: 1134530 - RNA, 19 nt, Human
ccagcaguuucccugaaac

SEQ ID NO: 1134531 - RNA, 21 nt, Human
cccaccacacuggagggcaag

SEQ ID NO: 1134532 - RNA, 20 nt, Human
cccaggugauguaauccaau

SEQ ID NO: 1134533 - RNA, 21 nt, Human
cccccucacccccagggccug

SEQ ID NO: 1134534 - RNA, 21 nt, Human
ccucacccccagggccuggga

SEQ ID NO: 1134535 - RNA, 22 nt, Human
ccuuccuucuaauggaagaaac

SEQ ID NO: 1134536 - RNA, 24 nt, Human
cguccaacaugugaaagauagcac

SEQ ID NO: 1134537 - RNA, 25 nt, Human
cuauacucuucccaucugcaccaca

SEQ ID NO: 1134538 - RNA, 23 nt, Human
cucaaagcuccauguaccauuuc

SEQ ID NO: 1134539 - RNA, 21 nt, Human
cucccccucacccccagggcc

SEQ ID NO: 1134540 - RNA, 23 nt, Human
cuggaaugagagagguuuuucuu

SEQ ID NO: 1134541 - RNA, 18 nt, Human
cugggggaaugacuuuuu

SEQ ID NO: 1134542 - RNA, 27 nt, Human
cuucccacuucacccacacagggaguu

SEQ ID NO: 1134543 - RNA, 29 nt, Human
gaacaggaggcaguaaacaaaagggaccc

SEQ ID NO: 1134544 - RNA, 19 nt, Human
gaccuggaaugagagaggu

SEQ ID NO: 1134545 - RNA, 19 nt, Human
gagaagaaagagaggcaca

SEQ ID NO: 1134546 - RNA, 21 nt, Human
gaggagugggcaggggacagg

SEQ ID NO: 1134547 - RNA, 23 nt, Human
gagugggcaggggacaggggguu

SEQ ID NO: 1134548 - RNA, 19 nt, Human
gccugggacagcaccaggc

SEQ ID NO: 1134549 - RNA, 21 nt, Human
ggacaaaggcaaaaggcccca

SEQ ID NO: 1134550 - RNA, 27 nt, Human
ggacauccagcccagugccuggaaaca

SEQ ID NO: 1134551 - RNA, 25 nt, Human
guccaacugggcuggaaucccaacu

SEQ ID NO: 1134552 - RNA, 20 nt, Human
gugggcaggggacagggggu

SEQ ID NO: 1134553 - RNA, 23 nt, Human
gugggucaguaaggguuugagga

SEQ ID NO: 1134554 - RNA, 23 nt, Human
uccgcuccuuccucguucugggg

SEQ ID NO: 1134555 - RNA, 26 nt, Human
ucuccaguggauauucagccagagga

SEQ ID NO: 1134556 - RNA, 18 nt, Human
ugcaccacagaccuggaa

SEQ ID NO: 1134557 - RNA, 19 nt, Human
ugcaccacagaccuggaau

SEQ ID NO: 1134558 - RNA, 20 nt, Human
ugcaguaaaggcugauugag

SEQ ID NO: 1134559 - RNA, 23 nt, Human
ugccccauggguguggucugucc

SEQ ID NO: 1134560 - RNA, 21 nt, Human
ugccuggaaacagccacgagg

SEQ ID NO: 1134561 - RNA, 21 nt, Human
uggaagaaacucaaccagaga

SEQ ID NO: 1134562 - RNA, 23 nt, Human
uggaagaaacucaaccagagaug

SEQ ID NO: 1134563 - RNA, 18 nt, Human
ugggcaggggacaggggg

SEQ ID NO: 1134564 - RNA, 19 nt, Human
uggguuucuaagaugaguu

SEQ ID NO: 1134565 - RNA, 18 nt, Human
uuaauccuuccuucuaau

SEQ ID NO: 1134566 - RNA, 25 nt, Human
uucaccucuacuaaccaaccccuag

SEQ ID NO: 1134567 - RNA, 23 nt, Human
uucagaagcugguauucuaugga

SEQ ID NO: 1134568 - RNA, 22 nt, Human
uuuuguggguuucuaagaugag

SEQ ID NO: 1134569 - RNA, 24 nt, Human
aacuugauuuauaccgaggaggug

SEQ ID NO: 1134570 - RNA, 26 nt, Human
aaggccccaagggccagcgucagggg

SEQ ID NO: 1134571 - RNA, 19 nt, Human
accccugaggggggaggga

SEQ ID NO: 1134572 - RNA, 20 nt, Human
acccgggauggggaagcucc

SEQ ID NO: 1134573 - RNA, 25 nt, Human
acuccuaggggugccggcgcccagg

SEQ ID NO: 1134574 - RNA, 22 nt, Human
acuggcuuugugguaguauguu

SEQ ID NO: 1134575 - RNA, 21 nt, Human
agccgauggugaguccaaagc

SEQ ID NO: 1134576 - RNA, 21 nt, Human
aggagguuggccuugggcagg

SEQ ID NO: 1134577 - RNA, 22 nt, Human
aggcggagguggaaucggaagg

SEQ ID NO: 1134578 - RNA, 23 nt, Human
aggcggagguggaaucggaaggg

SEQ ID NO: 1134579 - RNA, 22 nt, Human
agggaagggaggggggucaggu

SEQ ID NO: 1134580 - RNA, 19 nt, Human
aggggcaggagcuggagcu

SEQ ID NO: 1134581 - RNA, 20 nt, Human
augggaaacagcuccuuaca

SEQ ID NO: 1134582 - RNA, 24 nt, Human
cacacugccccugguacucagaau

SEQ ID NO: 1134583 - RNA, 19 nt, Human
cagaaucccgaagcaccau

SEQ ID NO: 1134584 - RNA, 20 nt, Human
cagaauccugcgugccccuc

SEQ ID NO: 1134585 - RNA, 18 nt, Human
cagggggagguggaggcg

SEQ ID NO: 1134586 - RNA, 19 nt, Human
caugcccacugggcacacu

SEQ ID NO: 1134587 - RNA, 28 nt, Human
ccccucuguggcagggggagguggaggc

SEQ ID NO: 1134588 - RNA, 23 nt, Human
ccccugaggggggagggaaggga

SEQ ID NO: 1134589 - RNA, 24 nt, Human
cccuccugggaccccaugcccacu

SEQ ID NO: 1134590 - RNA, 22 nt, Human
ccggguugggcaggcagccgca

SEQ ID NO: 1134591 - RNA, 26 nt, Human
ccucagcugcugggguggcggggucc

SEQ ID NO: 1134592 - RNA, 21 nt, Human
ccuccugggaccccaugccca

SEQ ID NO: 1134593 - RNA, 22 nt, Human
ccucggggcgggccuaggcccu

SEQ ID NO: 1134594 - RNA, 18 nt, Human
ccucugccccuagugcuc

SEQ ID NO: 1134595 - RNA, 18 nt, Human
ccugcauccuugugcugg

SEQ ID NO: 1134596 - RNA, 23 nt, Human
ccugggaccccaugcccacuggg

SEQ ID NO: 1134597 - RNA, 21 nt, Human
ccuugugcuggccugaaaauc

SEQ ID NO: 1134598 - RNA, 21 nt, Human
cucaacguuaacguugccaac

SEQ ID NO: 1134599 - RNA, 20 nt, Human
cuccagcguggcacccacga

SEQ ID NO: 1134600 - RNA, 23 nt, Human
cuccugggaccccaugcccacuu

SEQ ID NO: 1134601 - RNA, 23 nt, Human
cugaggggggagggaagggaggg

SEQ ID NO: 1134602 - RNA, 21 nt, Human
cugcauccuugugcuggccug

SEQ ID NO: 1134603 - RNA, 20 nt, Human
cugcccccucggggcgggcc

SEQ ID NO: 1134604 - RNA, 21 nt, Human
cugcccccucggggcgggccu

SEQ ID NO: 1134605 - RNA, 19 nt, Human
cuggccgccucugccccua

SEQ ID NO: 1134606 - RNA, 21 nt, Human
cugguacucagaaucccgaag

SEQ ID NO: 1134607 - RNA, 27 nt, Human
cuuugaagaggagguuggccuugggca

SEQ ID NO: 1134608 - RNA, 19 nt, Human
gaccccaugcccacugggc

SEQ ID NO: 1134609 - RNA, 18 nt, Human
gagcuggagcuucuucuc

SEQ ID NO: 1134610 - RNA, 19 nt, Human
gaggauggggacgccagga

SEQ ID NO: 1134611 - RNA, 18 nt, Human
gauggugaguccaaagcc

SEQ ID NO: 1134612 - RNA, 25 nt, Human
gccccaagggccagcgucaggggca

SEQ ID NO: 1134613 - RNA, 22 nt, Human
gcgggccuaggcccuuuggagg

SEQ ID NO: 1134614 - RNA, 20 nt, Human
gcucagaauccugcgugccc

SEQ ID NO: 1134615 - RNA, 22 nt, Human
gcuggagcuucuucuccagcgu

SEQ ID NO: 1134616 - RNA, 19 nt, Human
ggaaagugggcggggcagg

SEQ ID NO: 1134617 - RNA, 18 nt, Human
ggaagggaggggggucag

SEQ ID NO: 1134618 - RNA, 19 nt, Human
ggaaucccuccugggaccc

SEQ ID NO: 1134619 - RNA, 23 nt, Human
ggaggugggaaagugggcggggc

SEQ ID NO: 1134620 - RNA, 21 nt, Human
ggcgagggcggagguggcggc

SEQ ID NO: 1134621 - RNA, 22 nt, Human
ggcgguugcagccccggggguc

SEQ ID NO: 1134622 - RNA, 20 nt, Human
gggaaagugggcggggcagg

SEQ ID NO: 1134623 - RNA, 20 nt, Human
gggaaagugggcggggcagg

SEQ ID NO: 1134624 - RNA, 22 nt, Human
gggcaggagcuggagcuucuuc

SEQ ID NO: 1134625 - RNA, 21 nt, Human
gggcaggcagccgcaggcccc

SEQ ID NO: 1134626 - RNA, 21 nt, Human
ggggagggaagggaggggggu

SEQ ID NO: 1134627 - RNA, 18 nt, Human
gggggagggaagggaggg

SEQ ID NO: 1134628 - RNA, 23 nt, Human
gguugggcaggcagccgcaggcc

SEQ ID NO: 1134629 - RNA, 20 nt, Human
guggaaggcgggggccagga

SEQ ID NO: 1134630 - RNA, 21 nt, Human
uacaccuccgguggcacuccu

SEQ ID NO: 1134631 - RNA, 19 nt, Human
uacucagaaucccgaagca

SEQ ID NO: 1134632 - RNA, 24 nt, Human
uauccugcauccuugugcuggccu

SEQ ID NO: 1134633 - RNA, 18 nt, Human
ucagaaucccgaagcacc

SEQ ID NO: 1134634 - RNA, 24 nt, Human
uccacacccaccugcaacugguca

SEQ ID NO: 1134635 - RNA, 18 nt, Human
ucgcugcccccucggggc

SEQ ID NO: 1134636 - RNA, 18 nt, Human
ucuggccgccucugcccc

SEQ ID NO: 1134637 - RNA, 19 nt, Human
ucuucuccagcguggcacc

SEQ ID NO: 1134638 - RNA, 21 nt, Human
ugaaugggaaacagcuccuua

SEQ ID NO: 1134639 - RNA, 20 nt, Human
ugcccacugggcacacugcc

SEQ ID NO: 1134640 - RNA, 21 nt, Human
uggaaggcgggggccaggagg

SEQ ID NO: 1134641 - RNA, 24 nt, Human
uggaaugugcccggguugggcagg

SEQ ID NO: 1134642 - RNA, 24 nt, Human
uggaggcggagguggaaucggaag

SEQ ID NO: 1134643 - RNA, 21 nt, Human
uggccugaaaauccacaccca

SEQ ID NO: 1134644 - RNA, 22 nt, Human
uggggaagcuccucucgcugcc

SEQ ID NO: 1134645 - RNA, 20 nt, Human
ugguacucagaaucccgaag

SEQ ID NO: 1134646 - RNA, 22 nt, Human
uuccgaugucccccccaacccc

SEQ ID NO: 1134647 - RNA, 22 nt, Human
uugcgugcaugcccgccuggcu

SEQ ID NO: 1134648 - RNA, 21 nt, Human
uuguuuuuuuuuuuuucuguu

SEQ ID NO: 1134649 - RNA, 24 nt, Human
aaaaaacacaugaagggcauucau

SEQ ID NO: 1134650 - RNA, 18 nt, Human
aaaaaaccagcuccugga

SEQ ID NO: 1134651 - RNA, 21 nt, Human
aaaaauguauauucuguugau

SEQ ID NO: 1134652 - RNA, 20 nt, Human
aaagcagcacccagagcuug

SEQ ID NO: 1134653 - RNA, 20 nt, Human
aacaaagcagcacccagagc

SEQ ID NO: 1134654 - RNA, 21 nt, Human
aagaaaaaaacacaugaaggg

SEQ ID NO: 1134655 - RNA, 22 nt, Human
aagaaaaaaacacaugaagggc

SEQ ID NO: 1134656 - RNA, 20 nt, Human
aagguugggggacacugggc

SEQ ID NO: 1134657 - RNA, 18 nt, Human
acaaagcagcacccagag

SEQ ID NO: 1134658 - RNA, 19 nt, Human
acuguggucugagagacag

SEQ ID NO: 1134659 - RNA, 19 nt, Human
agagaaccuggcucugucc

SEQ ID NO: 1134660 - RNA, 21 nt, Human
agcagucugaaggggccaugg

SEQ ID NO: 1134661 - RNA, 19 nt, Human
agcuguggaaaccaggacc

SEQ ID NO: 1134662 - RNA, 20 nt, Human
aggagcagguuguucgguuu

SEQ ID NO: 1134663 - RNA, 22 nt, Human
aggcagggccuggcucucugug

SEQ ID NO: 1134664 - RNA, 22 nt, Human
aggccuccagcccugccgguuu

SEQ ID NO: 1134665 - RNA, 21 nt, Human
agggcaggugagcccuggggc

SEQ ID NO: 1134666 - RNA, 19 nt, Human
agguccugggugugaggug

SEQ ID NO: 1134667 - RNA, 23 nt, Human
auggcaugugccgucuuccuccc

SEQ ID NO: 1134668 - RNA, 22 nt, Human
auucugggccuuuuccugggca

SEQ ID NO: 1134669 - RNA, 19 nt, Human
caaaaaaccagcuccugga

SEQ ID NO: 1134670 - RNA, 18 nt, Human
caaagcagcacccagagc

SEQ ID NO: 1134671 - RNA, 23 nt, Human
caaagcagcacccagagcuuguu

SEQ ID NO: 1134672 - RNA, 19 nt, Human
caauacugaaaaucaagca

SEQ ID NO: 1134673 - RNA, 21 nt, Human
caccccauccaacacugcacu

SEQ ID NO: 1134674 - RNA, 18 nt, Human
cacugcacugccaggggc

SEQ ID NO: 1134675 - RNA, 21 nt, Human
cacugcuuuaaauguguccca

SEQ ID NO: 1134676 - RNA, 18 nt, Human
cagagcucagguccaugc

SEQ ID NO: 1134677 - RNA, 21 nt, Human
cagcggaccuauggcaugugc

SEQ ID NO: 1134678 - RNA, 18 nt, Human
cagggccuggcucucugu

SEQ ID NO: 1134679 - RNA, 20 nt, Human
cagguccaugcucaggcucu

SEQ ID NO: 1134680 - RNA, 18 nt, Human
cagugcuugcucacauuc

SEQ ID NO: 1134681 - RNA, 21 nt, Human
caucugugcuccugaugcagg

SEQ ID NO: 1134682 - RNA, 20 nt, Human
caugguaucaguuccucuga

SEQ ID NO: 1134683 - RNA, 21 nt, Human
ccaacacugcacugccagggg

SEQ ID NO: 1134684 - RNA, 25 nt, Human
ccagagcucagguccaugcucaggc

SEQ ID NO: 1134685 - RNA, 25 nt, Human
ccagcccugccgguuucccccaucu

SEQ ID NO: 1134686 - RNA, 27 nt, Human
ccagcccugccgguuucccccaucugu

SEQ ID NO: 1134687 - RNA, 18 nt, Human
ccaugcucaggcucuggg

SEQ ID NO: 1134688 - RNA, 20 nt, Human
cccaaguaaaugaauccaau

SEQ ID NO: 1134689 - RNA, 20 nt, Human
cccugggggagggucagggg

SEQ ID NO: 1134690 - RNA, 20 nt, Human
ccuagcucaugacccuggcc

SEQ ID NO: 1134691 - RNA, 26 nt, Human
ccucagagguccugggugugaggugg

SEQ ID NO: 1134692 - RNA, 24 nt, Human
ccugccgguuucccccaucugugc

SEQ ID NO: 1134693 - RNA, 27 nt, Human
cggggcccggggaaggcguaggugcug

SEQ ID NO: 1134694 - RNA, 23 nt, Human
cgugcagccucuugauggccccg

SEQ ID NO: 1134695 - RNA, 18 nt, Human
cuaccuggugggaccagg

SEQ ID NO: 1134696 - RNA, 24 nt, Human
cuagucaaagaaaaaaacacauga

SEQ ID NO: 1134697 - RNA, 18 nt, Human
cuggagcucacgugcagc

SEQ ID NO: 1134698 - RNA, 21 nt, Human
cugucuagaagccccacagcu

SEQ ID NO: 1134699 - RNA, 18 nt, Human
cuugcuucucuaguucuu

SEQ ID NO: 1134700 - RNA, 23 nt, Human
cuuuauuuguuucuuuguucagu

SEQ ID NO: 1134701 - RNA, 22 nt, Human
cuuucuauaaaccgucccggag

SEQ ID NO: 1134702 - RNA, 21 nt, Human
gaaaaaaacacaugaagggca

SEQ ID NO: 1134703 - RNA, 24 nt, Human
gaaaggcaagcucaucccugcagg

SEQ ID NO: 1134704 - RNA, 24 nt, Human
gaagguugggggacacugggcuuc

SEQ ID NO: 1134705 - RNA, 28 nt, Human
gaauaggugugguguggugacgaccucg

SEQ ID NO: 1134706 - RNA, 22 nt, Human
gagcagucugaaggggccaugg

SEQ ID NO: 1134707 - RNA, 22 nt, Human
gagcgugugugugcugugacca

SEQ ID NO: 1134708 - RNA, 21 nt, Human
gagcuguugcggggcccgggg

SEQ ID NO: 1134709 - RNA, 24 nt, Human
gagcuuguuuuuuuuagagaaccu

SEQ ID NO: 1134710 - RNA, 19 nt, Human
gagugaguuucuuaauccu

SEQ ID NO: 1134711 - RNA, 22 nt, Human
gaugcagggggaggacuguauu

SEQ ID NO: 1134712 - RNA, 20 nt, Human
gcaauacugaaaaucaagcc

SEQ ID NO: 1134713 - RNA, 20 nt, Human
gcagaacuuucuauaaaccg

SEQ ID NO: 1134714 - RNA, 21 nt, Human
gccugaagcugccaguguuug

SEQ ID NO: 1134715 - RNA, 19 nt, Human
gcugugcagcucuggagcu

SEQ ID NO: 1134716 - RNA, 19 nt, Human
ggaacagaagcauccuguc

SEQ ID NO: 1134717 - RNA, 22 nt, Human
ggaccuauggcaugugccgucu

SEQ ID NO: 1134718 - RNA, 24 nt, Human
ggcaggugagcccuggggcugacc

SEQ ID NO: 1134719 - RNA, 18 nt, Human
ggcccugggggaggguca

SEQ ID NO: 1134720 - RNA, 21 nt, Human
ggccuccagcccugccgguuu

SEQ ID NO: 1134721 - RNA, 21 nt, Human
gggagcagcugugcagcucug

SEQ ID NO: 1134722 - RNA, 18 nt, Human
ggggaaggcguaggugcu

SEQ ID NO: 1134723 - RNA, 24 nt, Human
ggugucaugugaggucucguccug

SEQ ID NO: 1134724 - RNA, 20 nt, Human
ggugugagguggaagguugg

SEQ ID NO: 1134725 - RNA, 21 nt, Human
gugcaguugucccagccuggc

SEQ ID NO: 1134726 - RNA, 21 nt, Human
guggagcgcgcagccugggcc

SEQ ID NO: 1134727 - RNA, 25 nt, Human
guucuuuuccauuugcugaggagug

SEQ ID NO: 1134728 - RNA, 21 nt, Human
uaaaccacauguggagagcuu

SEQ ID NO: 1134729 - RNA, 20 nt, Human
uaaaccgucccguggccccu

SEQ ID NO: 1134730 - RNA, 23 nt, Human
uaaaugcaacccuguucuuccca

SEQ ID NO: 1134731 - RNA, 24 nt, Human
uagugcuauaaauuucccucuaca

SEQ ID NO: 1134732 - RNA, 19 nt, Human
uauaaucaaagcucagagc

SEQ ID NO: 1134733 - RNA, 23 nt, Human
uauaaucaaagcucagagccaag

SEQ ID NO: 1134734 - RNA, 18 nt, Human
ucaaagaaaaaaacacau

SEQ ID NO: 1134735 - RNA, 21 nt, Human
ucaaagcucagagccaaggcc

SEQ ID NO: 1134736 - RNA, 24 nt, Human
ucacccagacacuguguccuccca

SEQ ID NO: 1134737 - RNA, 25 nt, Human
ucacgugcagccucuugauggcccc

SEQ ID NO: 1134738 - RNA, 19 nt, Human
ucagggccuggugcaguug

SEQ ID NO: 1134739 - RNA, 23 nt, Human
ucaugacccuggcaaagggcagg

SEQ ID NO: 1134740 - RNA, 19 nt, Human
ucauugaggagcagguugu

SEQ ID NO: 1134741 - RNA, 21 nt, Human
uccaagcaccugugacuccca

SEQ ID NO: 1134742 - RNA, 24 nt, Human
uccacaguaaaccacauguggaga

SEQ ID NO: 1134743 - RNA, 24 nt, Human
ucccagagauucugguauguugug

SEQ ID NO: 1134744 - RNA, 19 nt, Human
ucccagccuggcaggcagu

SEQ ID NO: 1134745 - RNA, 19 nt, Human
ucccauugccacaucuucu

SEQ ID NO: 1134746 - RNA, 21 nt, Human
ucccucuacacacugcuuuaa

SEQ ID NO: 1134747 - RNA, 27 nt, Human
ucccugcagguuuaguuguuucuguua

SEQ ID NO: 1134748 - RNA, 20 nt, Human
ucuguucuuuuccauuugcu

SEQ ID NO: 1134749 - RNA, 20 nt, Human
ucuugcuucucuaguucuuu

SEQ ID NO: 1134750 - RNA, 21 nt, Human
ucuuuguucucauugguuuca

SEQ ID NO: 1134751 - RNA, 18 nt, Human
ugaagggagcagucugaa

SEQ ID NO: 1134752 - RNA, 18 nt, Human
ugaaggguuuuuuguguc

SEQ ID NO: 1134753 - RNA, 19 nt, Human
ugaccagcggaccuauggc

SEQ ID NO: 1134754 - RNA, 22 nt, Human
ugacucccaggccuccagcccu

SEQ ID NO: 1134755 - RNA, 21 nt, Human
ugagauccaugagccagagcu

SEQ ID NO: 1134756 - RNA, 21 nt, Human
ugagugaguuucuuaauccug

SEQ ID NO: 1134757 - RNA, 20 nt, Human
ugaugcagggggaggacugu

SEQ ID NO: 1134758 - RNA, 23 nt, Human
ugaugcagggggaggacuguauu

SEQ ID NO: 1134759 - RNA, 23 nt, Human
ugauggugucaugugaggucucg

SEQ ID NO: 1134760 - RNA, 21 nt, Human
ugauuuggagcaggggcgggg

SEQ ID NO: 1134761 - RNA, 20 nt, Human
ugcacagaccacuagacccc

SEQ ID NO: 1134762 - RNA, 18 nt, Human
ugcaccccauccaacacu

SEQ ID NO: 1134763 - RNA, 24 nt, Human
ugcucacuguguuaaaggcuuuau

SEQ ID NO: 1134764 - RNA, 18 nt, Human
ugcuuuucucuccccucc

SEQ ID NO: 1134765 - RNA, 20 nt, Human
uggaaaccaggaccuccugc

SEQ ID NO: 1134766 - RNA, 22 nt, Human
uggaaaccaggaccuccugcuu

SEQ ID NO: 1134767 - RNA, 18 nt, Human
uggcaccugagccacacu

SEQ ID NO: 1134768 - RNA, 20 nt, Human
uggcaggcagucguccccuu

SEQ ID NO: 1134769 - RNA, 18 nt, Human
ugggaccaggcagcuagc

SEQ ID NO: 1134770 - RNA, 23 nt, Human
ugggauuuguaggcagggccugg

SEQ ID NO: 1134771 - RNA, 25 nt, Human
ugggcagaacuuucuauaaaccguc

SEQ ID NO: 1134772 - RNA, 23 nt, Human
ugggccuagcucaugacccuggc

SEQ ID NO: 1134773 - RNA, 20 nt, Human
uggguggaaauggaaaauag

SEQ ID NO: 1134774 - RNA, 23 nt, Human
ugguauguugugucuuuguucuc

SEQ ID NO: 1134775 - RNA, 18 nt, Human
uguaggcagggccuggcu

SEQ ID NO: 1134776 - RNA, 21 nt, Human
ugucuagaagccccacagcug

SEQ ID NO: 1134777 - RNA, 25 nt, Human
ugucugguuuuucaaaggugaaggg

SEQ ID NO: 1134778 - RNA, 22 nt, Human
uguggagcgcgcagccugggcc

SEQ ID NO: 1134779 - RNA, 24 nt, Human
uguggugcugaaaaaaauguauau

SEQ ID NO: 1134780 - RNA, 23 nt, Human
uguguccucccacauccugaccu

SEQ ID NO: 1134781 - RNA, 19 nt, Human
uguugauuuugguggagag

SEQ ID NO: 1134782 - RNA, 23 nt, Human
uuacacaguucugggacaaaacu

SEQ ID NO: 1134783 - RNA, 21 nt, Human
uuagagaaccuggcucugucc

SEQ ID NO: 1134784 - RNA, 21 nt, Human
uucaaaaaaccagcuccugga

SEQ ID NO: 1134785 - RNA, 20 nt, Human
uuccaggaacagaagcaucc

SEQ ID NO: 1134786 - RNA, 21 nt, Human
uucccaggagcgugugugugc

SEQ ID NO: 1134787 - RNA, 19 nt, Human
uuccccagggggugcaccc

SEQ ID NO: 1134788 - RNA, 19 nt, Human
uugauuuggagcaggggcg

SEQ ID NO: 1134789 - RNA, 24 nt, Human
uugcacuguggucugagagacagu

SEQ ID NO: 1134790 - RNA, 21 nt, Human
uugcuagcggucuaucaauau

SEQ ID NO: 1134791 - RNA, 24 nt, Human
uugcugaggagugcuuuacuucca

SEQ ID NO: 1134792 - RNA, 18 nt, Human
uugcuucucuaguucuuu

SEQ ID NO: 1134793 - RNA, 19 nt, Human
uuuccaggaacagaagcau

SEQ ID NO: 1134794 - RNA, 23 nt, Human
uuucuguucuuuuccauuugcuc

SEQ ID NO: 1134795 - RNA, 23 nt, Human
aaaaauaucccauacagucguaa

SEQ ID NO: 1134796 - RNA, 18 nt, Human
aaaaugcuacugucauca

SEQ ID NO: 1134797 - RNA, 18 nt, Human
aacuaaaaccagcaaagc

SEQ ID NO: 1134798 - RNA, 18 nt, Human
acaaggaauccucucuuc

SEQ ID NO: 1134799 - RNA, 20 nt, Human
acacagccuguacuguagcu

SEQ ID NO: 1134800 - RNA, 22 nt, Human
agaaacacacauagucaaaaca

SEQ ID NO: 1134801 - RNA, 19 nt, Human
agacuaauacauacguucc

SEQ ID NO: 1134802 - RNA, 20 nt, Human
agccagaggaccuaacacag

SEQ ID NO: 1134803 - RNA, 19 nt, Human
agccuguacuguagcuuug

SEQ ID NO: 1134804 - RNA, 22 nt, Human
agcuccauuuggagcugugauc

SEQ ID NO: 1134805 - RNA, 19 nt, Human
aggaaaagacuaugcucaa

SEQ ID NO: 1134806 - RNA, 19 nt, Human
aggaauccucucuucaaug

SEQ ID NO: 1134807 - RNA, 22 nt, Human
agggacaacaacagcaggagag

SEQ ID NO: 1134808 - RNA, 23 nt, Human
caaaaaaucccaaaacauuccug

SEQ ID NO: 1134809 - RNA, 21 nt, Human
caacagauaugccaacaauau

SEQ ID NO: 1134810 - RNA, 23 nt, Human
cacaucaauagauaugugguuaa

SEQ ID NO: 1134811 - RNA, 22 nt, Human
cacuuggaaaauaucgaacaaa

SEQ ID NO: 1134812 - RNA, 23 nt, Human
cagaaugcccauaaguagagcuc

SEQ ID NO: 1134813 - RNA, 24 nt, Human
cagcaccaucauguaagggacaac

SEQ ID NO: 1134814 - RNA, 25 nt, Human
cauuccugccagcagacuaauacau

SEQ ID NO: 1134815 - RNA, 22 nt, Human
cauuuuaggccccagaaugccc

SEQ ID NO: 1134816 - RNA, 18 nt, Human
ccaaaacauuccugccag

SEQ ID NO: 1134817 - RNA, 21 nt, Human
ccacccaggugggcagggugg

SEQ ID NO: 1134818 - RNA, 25 nt, Human
ccucaacaccauauccauuuucuug

SEQ ID NO: 1134819 - RNA, 23 nt, Human
cgggagcggcccaggagcccagu

SEQ ID NO: 1134820 - RNA, 19 nt, Human
cuaaaaccagcaaagcaca

SEQ ID NO: 1134821 - RNA, 21 nt, Human
cuaaaaccagcaaagcacauc

SEQ ID NO: 1134822 - RNA, 20 nt, Human
cuccauuuggagcugugauc

SEQ ID NO: 1134823 - RNA, 21 nt, Human
cugcaaugaaacucaacaccc

SEQ ID NO: 1134824 - RNA, 19 nt, Human
gaacaaaaaaucccaaaac

SEQ ID NO: 1134825 - RNA, 23 nt, Human
gaacaaaaaaucccaaaacauuc

SEQ ID NO: 1134826 - RNA, 18 nt, Human
gagacucuugcuguuucu

SEQ ID NO: 1134827 - RNA, 21 nt, Human
gaggaaaagacuaugcucaag

SEQ ID NO: 1134828 - RNA, 22 nt, Human
gaucaagauggcuaaaaaugcu

SEQ ID NO: 1134829 - RNA, 24 nt, Human
ggaaugccuuccucaacaccauau

SEQ ID NO: 1134830 - RNA, 19 nt, Human
gggacaacaacagcaggag

SEQ ID NO: 1134831 - RNA, 24 nt, Human
uaaauauuuucuccuuaaaacuaa

SEQ ID NO: 1134832 - RNA, 24 nt, Human
uaaguauaccaccugaggaaaaga

SEQ ID NO: 1134833 - RNA, 26 nt, Human
uaaugccaaacuuagaguggcaacag

SEQ ID NO: 1134834 - RNA, 18 nt, Human
uagccagaaugucauccu

SEQ ID NO: 1134835 - RNA, 25 nt, Human
ucacauccuucgcauaugguuccaa

SEQ ID NO: 1134836 - RNA, 18 nt, Human
ucccaaaacauuccugcc

SEQ ID NO: 1134837 - RNA, 19 nt, Human
ucuugcagcaccaucaugu

SEQ ID NO: 1134838 - RNA, 18 nt, Human
uuccaaguggggugcgga

SEQ ID NO: 1134839 - RNA, 18 nt, Human
uuccugccagcagacuaa

SEQ ID NO: 1134840 - RNA, 18 nt, Human
uuucuggucuucacuugg

SEQ ID NO: 1134841 - RNA, 22 nt, Human
agacaggcauaauuagguccuc

SEQ ID NO: 1134842 - RNA, 19 nt, Human
ucccacaugaaaauaugau

SEQ ID NO: 1134843 - RNA, 28 nt, Human
uggauggcagugcagguugauucuucuc

SEQ ID NO: 1134844 - RNA, 18 nt, Human
uguggauggcagugcagg

SEQ ID NO: 1134845 - RNA, 21 nt, Human
aaaaaaccaaaacacaacaaa

SEQ ID NO: 1134846 - RNA, 24 nt, Human
aaaaaaccaaaacacaacaaaagc

SEQ ID NO: 1134847 - RNA, 18 nt, Human
aaacaaaaaaccaaaaca

SEQ ID NO: 1134848 - RNA, 18 nt, Human
aaacacaacaaaagcaag

SEQ ID NO: 1134849 - RNA, 23 nt, Human
aaaccaaaacacaacaaaagcaa

SEQ ID NO: 1134850 - RNA, 27 nt, Human
aaaccaaaacacaacaaaagcaagaaa

SEQ ID NO: 1134851 - RNA, 20 nt, Human
aaagcaagaaagaaguauag

SEQ ID NO: 1134852 - RNA, 19 nt, Human
aacauggugaaaccccauu

SEQ ID NO: 1134853 - RNA, 20 nt, Human
aacauggugaaaccccauuu

SEQ ID NO: 1134854 - RNA, 20 nt, Human
aacauggugaaaccccauuu

SEQ ID NO: 1134855 - RNA, 21 nt, Human
aacauggugaaaccccauuuc

SEQ ID NO: 1134856 - RNA, 24 nt, Human
aagaaagaaguauauccaucauac

SEQ ID NO: 1134857 - RNA, 22 nt, Human
aagcaagaaagaaguauaucca

SEQ ID NO: 1134858 - RNA, 24 nt, Human
aagcaagaaagaaguauauccauc

SEQ ID NO: 1134859 - RNA, 20 nt, Human
aagcaggcguuucacucagg

SEQ ID NO: 1134860 - RNA, 19 nt, Human
aagcaggcuggugccacuc

SEQ ID NO: 1134861 - RNA, 20 nt, Human
aaggacuccagggggaggug

SEQ ID NO: 1134862 - RNA, 18 nt, Human
aaguacuuccugagcucc

SEQ ID NO: 1134863 - RNA, 18 nt, Human
acaaaagcaagaaagaag

SEQ ID NO: 1134864 - RNA, 19 nt, Human
acaaaagcaagaaagaagu

SEQ ID NO: 1134865 - RNA, 18 nt, Human
acacagccccucucugug

SEQ ID NO: 1134866 - RNA, 28 nt, Human
acacagccccucucuguguugugacccu

SEQ ID NO: 1134867 - RNA, 22 nt, Human
acagccuggugacagagagacc

SEQ ID NO: 1134868 - RNA, 24 nt, Human
acccuaaacaccuucaaggaccuu

SEQ ID NO: 1134869 - RNA, 18 nt, Human
agaacaacguaggaccau

SEQ ID NO: 1134870 - RNA, 22 nt, Human
agacaggagacugcauguuccu

SEQ ID NO: 1134871 - RNA, 22 nt, Human
agcaagaaagaaguauauccau

SEQ ID NO: 1134872 - RNA, 19 nt, Human
agcacagaggcagccagua

SEQ ID NO: 1134873 - RNA, 20 nt, Human
agcacuuugggaggaugagg

SEQ ID NO: 1134874 - RNA, 22 nt, Human
agccaaguacuuccugagcucc

SEQ ID NO: 1134875 - RNA, 22 nt, Human
agccuggacaacauggugaaac

SEQ ID NO: 1134876 - RNA, 24 nt, Human
agccuggacaacauggugaaaccc

SEQ ID NO: 1134877 - RNA, 21 nt, Human
agccuggugacagagagaccc

SEQ ID NO: 1134878 - RNA, 21 nt, Human
agccuggugacagagagaccc

SEQ ID NO: 1134879 - RNA, 20 nt, Human
agcuugugcaauggguuuag

SEQ ID NO: 1134880 - RNA, 18 nt, Human
aggaugaggcgggcagau

SEQ ID NO: 1134881 - RNA, 24 nt, Human
aggcagaagagggcccugcauaca

SEQ ID NO: 1134882 - RNA, 20 nt, Human
aggcguuucacucagggcag

SEQ ID NO: 1134883 - RNA, 21 nt, Human
aggcguuucacucagggcagc

SEQ ID NO: 1134884 - RNA, 24 nt, Human
aggcugagguggaaagauggcuug

SEQ ID NO: 1134885 - RNA, 20 nt, Human
agggcagcccgggaggcaag

SEQ ID NO: 1134886 - RNA, 19 nt, Human
agggggaggugggcugggc

SEQ ID NO: 1134887 - RNA, 24 nt, Human
aggucgaggcugcagugagccaug

SEQ ID NO: 1134888 - RNA, 24 nt, Human
aggugccccgggccuugcuggagu

SEQ ID NO: 1134889 - RNA, 24 nt, Human
aguggugcacgccuguaguucuag

SEQ ID NO: 1134890 - RNA, 19 nt, Human
augcagaaaagagaaacug

SEQ ID NO: 1134891 - RNA, 24 nt, Human
auugcaccacuguaauacagccug

SEQ ID NO: 1134892 - RNA, 25 nt, Human
caaaaaaccaaaacacaacaaaagc

SEQ ID NO: 1134893 - RNA, 21 nt, Human
caaaacacaacaaaagcaaga

SEQ ID NO: 1134894 - RNA, 24 nt, Human
caaacaccggaggaagagagcaau

SEQ ID NO: 1134895 - RNA, 19 nt, Human
caacauggugaaaccccau

SEQ ID NO: 1134896 - RNA, 24 nt, Human
caacauggugaaaccccauuucua

SEQ ID NO: 1134897 - RNA, 20 nt, Human
cacaacaaaagcaagaaaga

SEQ ID NO: 1134898 - RNA, 21 nt, Human
caccuaggccuugccugaguc

SEQ ID NO: 1134899 - RNA, 21 nt, Human
cacucuguccucaggugcccc

SEQ ID NO: 1134900 - RNA, 23 nt, Human
cacuguaauacagccuggugaca

SEQ ID NO: 1134901 - RNA, 19 nt, Human
cagagaccgaacaccaccc

SEQ ID NO: 1134902 - RNA, 23 nt, Human
cagagcccaaaggcuauagaguu

SEQ ID NO: 1134903 - RNA, 24 nt, Human
cagcacuuugggaggaugaggcgg

SEQ ID NO: 1134904 - RNA, 21 nt, Human
cagcccccaacccugcugccu

SEQ ID NO: 1134905 - RNA, 21 nt, Human
caggaaaggccaggcacggug

SEQ ID NO: 1134906 - RNA, 18 nt, Human
caggagcaaucacagggc

SEQ ID NO: 1134907 - RNA, 18 nt, Human
caugagacaggagacugc

SEQ ID NO: 1134908 - RNA, 19 nt, Human
ccagcccccaacccugcug

SEQ ID NO: 1134909 - RNA, 22 nt, Human
ccagggggaggugggcugggcc

SEQ ID NO: 1134910 - RNA, 24 nt, Human
ccccagaagcaggcuggugccucg

SEQ ID NO: 1134911 - RNA, 22 nt, Human
ccccaugaggugggaacuccug

SEQ ID NO: 1134912 - RNA, 23 nt, Human
cccuaaacaccuucaaggaccuu

SEQ ID NO: 1134913 - RNA, 20 nt, Human
ccuaccuggucacuguguac

SEQ ID NO: 1134914 - RNA, 20 nt, Human
ccuauaaucccagcacuuug

SEQ ID NO: 1134915 - RNA, 19 nt, Human
ccucaggugccccgggccu

SEQ ID NO: 1134916 - RNA, 24 nt, Human
ccucccacaggcaagacuggccca

SEQ ID NO: 1134917 - RNA, 19 nt, Human
ccuccuccuaccuggucac

SEQ ID NO: 1134918 - RNA, 23 nt, Human
ccucuccuccuccuaccugguca

SEQ ID NO: 1134919 - RNA, 24 nt, Human
ccuggacaacauggugaaacccca

SEQ ID NO: 1134920 - RNA, 18 nt, Human
ccuggagcggauguaaaa

SEQ ID NO: 1134921 - RNA, 22 nt, Human
cgccuguaguucuagccacugg

SEQ ID NO: 1134922 - RNA, 21 nt, Human
cgcuaaggcagaagagggccc

SEQ ID NO: 1134923 - RNA, 18 nt, Human
cggcugcuggagcagcgg

SEQ ID NO: 1134924 - RNA, 22 nt, Human
cguguaggcaaugcccagccca

SEQ ID NO: 1134925 - RNA, 22 nt, Human
cuaaauggacagggcgagagug

SEQ ID NO: 1134926 - RNA, 21 nt, Human
cuacucccucuccuccuccua

SEQ ID NO: 1134927 - RNA, 23 nt, Human
cucacucuguccucaggugcccc

SEQ ID NO: 1134928 - RNA, 24 nt, Human
cucaggccuauaaucccagcacuu

SEQ ID NO: 1134929 - RNA, 20 nt, Human
cuccuccuccuaccugguca

SEQ ID NO: 1134930 - RNA, 24 nt, Human
cugacuuaaaaacaaacaaaaaac

SEQ ID NO: 1134931 - RNA, 22 nt, Human
cugcagugagccaugauugcac

SEQ ID NO: 1134932 - RNA, 18 nt, Human
cugcauguuccucccaca

SEQ ID NO: 1134933 - RNA, 21 nt, Human
cuggagcagcggcccuccauc

SEQ ID NO: 1134934 - RNA, 24 nt, Human
cuucauauucuucuauaaaauaua

SEQ ID NO: 1134935 - RNA, 25 nt, Human
cuuccugagcuccugagagacgcca

SEQ ID NO: 1134936 - RNA, 19 nt, Human
cuucuucucucuuaugccc

SEQ ID NO: 1134937 - RNA, 26 nt, Human
gaaaggccaggcacggugggcucagg

SEQ ID NO: 1134938 - RNA, 24 nt, Human
gaacaaaauuuacauagaaaauaa

SEQ ID NO: 1134939 - RNA, 19 nt, Human
gagagacccugacuuaaaa

SEQ ID NO: 1134940 - RNA, 18 nt, Human
gagcucucucugccucuc

SEQ ID NO: 1134941 - RNA, 24 nt, Human
gauggcuugagccugggaggucga

SEQ ID NO: 1134942 - RNA, 18 nt, Human
gcaauaccuaauagcagg

SEQ ID NO: 1134943 - RNA, 22 nt, Human
gccaggcauaucagaaggcacu

SEQ ID NO: 1134944 - RNA, 22 nt, Human
gcccaggaguucgugaccagcc

SEQ ID NO: 1134945 - RNA, 23 nt, Human
gcccgggaggcaaggucugagag

SEQ ID NO: 1134946 - RNA, 24 nt, Human
gccugggaggucgaggcugcagug

SEQ ID NO: 1134947 - RNA, 22 nt, Human
ggaacuccugccccacccacuu

SEQ ID NO: 1134948 - RNA, 20 nt, Human
ggaaggacuccagggggagg

SEQ ID NO: 1134949 - RNA, 22 nt, Human
ggcacaguggugcacgccugua

SEQ ID NO: 1134950 - RNA, 22 nt, Human
gggaaggacuccagggggaggu

SEQ ID NO: 1134951 - RNA, 21 nt, Human
gggcggacgagcagcuggcca

SEQ ID NO: 1134952 - RNA, 20 nt, Human
gguggagggcaagauggacc

SEQ ID NO: 1134953 - RNA, 18 nt, Human
guggugcacgccuguagu

SEQ ID NO: 1134954 - RNA, 26 nt, Human
uaaaaacaaacaaaaaaccaaaacac

SEQ ID NO: 1134955 - RNA, 23 nt, Human
uaaaacaggagcaaucacagggc

SEQ ID NO: 1134956 - RNA, 23 nt, Human
uacacacaaauuagccgggcacc

SEQ ID NO: 1134957 - RNA, 24 nt, Human
uacauagaaaauaauuacagaaca

SEQ ID NO: 1134958 - RNA, 19 nt, Human
uagaguuaaaaccacccac

SEQ ID NO: 1134959 - RNA, 25 nt, Human
uaggcaaugcccagcccccugaaag

SEQ ID NO: 1134960 - RNA, 24 nt, Human
uauauaauuguaacaaggaacaaa

SEQ ID NO: 1134961 - RNA, 21 nt, Human
uaugcagaaaagagaaacugg

SEQ ID NO: 1134962 - RNA, 23 nt, Human
uaugcagaaaagagaaacugguu

SEQ ID NO: 1134963 - RNA, 18 nt, Human
ucacucagggcagcccgg

SEQ ID NO: 1134964 - RNA, 18 nt, Human
ucagagaccgaacaccac

SEQ ID NO: 1134965 - RNA, 22 nt, Human
uccacaauggacauguucacuc

SEQ ID NO: 1134966 - RNA, 21 nt, Human
uccagggggaggugggcuggg

SEQ ID NO: 1134967 - RNA, 26 nt, Human
uccucaggugccccgggccuugcugg

SEQ ID NO: 1134968 - RNA, 22 nt, Human
uccucccacaggcaagacuggc

SEQ ID NO: 1134969 - RNA, 22 nt, Human
uccugccccacccacuuuacag

SEQ ID NO: 1134970 - RNA, 20 nt, Human
uccugggaaggacuccaggg

SEQ ID NO: 1134971 - RNA, 24 nt, Human
ucuauaaucugaaaaggccggggc

SEQ ID NO: 1134972 - RNA, 20 nt, Human
ucucuguguugugacccuag

SEQ ID NO: 1134973 - RNA, 19 nt, Human
ugacagagagacccugacu

SEQ ID NO: 1134974 - RNA, 20 nt, Human
ugacagagagacccugacuu

SEQ ID NO: 1134975 - RNA, 20 nt, Human
ugacuuaaaaacaaacaaaa

SEQ ID NO: 1134976 - RNA, 21 nt, Human
ugacuugugggaugcaggccc

SEQ ID NO: 1134977 - RNA, 21 nt, Human
ugagacaggagacugcauguu

SEQ ID NO: 1134978 - RNA, 21 nt, Human
ugagagacgccaaauauggga

SEQ ID NO: 1134979 - RNA, 23 nt, Human
ugagagacgccaaauaugggaac

SEQ ID NO: 1134980 - RNA, 24 nt, Human
ugagagacgccaaauaugggaaca

SEQ ID NO: 1134981 - RNA, 18 nt, Human
ugagaguggaagcuccug

SEQ ID NO: 1134982 - RNA, 20 nt, Human
ugagaguggaagcuccuggg

SEQ ID NO: 1134983 - RNA, 24 nt, Human
ugagaguggaagcuccugggagcc

SEQ ID NO: 1134984 - RNA, 23 nt, Human
ugagcccaggaguucgugaccag

SEQ ID NO: 1134985 - RNA, 18 nt, Human
ugagccugggaggucgag

SEQ ID NO: 1134986 - RNA, 24 nt, Human
ugagccugggaggucgaggcugca

SEQ ID NO: 1134987 - RNA, 25 nt, Human
ugaggcgggcagauggcuugagccc

SEQ ID NO: 1134988 - RNA, 19 nt, Human
ugaggggaggccccguggg

SEQ ID NO: 1134989 - RNA, 22 nt, Human
ugcaccacuguaauacagccug

SEQ ID NO: 1134990 - RNA, 23 nt, Human
ugcaggcccggcugcuggagcag

SEQ ID NO: 1134991 - RNA, 22 nt, Human
ugcagugagccaugauugcacc

SEQ ID NO: 1134992 - RNA, 22 nt, Human
ugccugagucuggccaugcagu

SEQ ID NO: 1134993 - RNA, 22 nt, Human
uggacaacauggugaaacccca

SEQ ID NO: 1134994 - RNA, 20 nt, Human
uggcugugccaaaugcuaag

SEQ ID NO: 1134995 - RNA, 22 nt, Human
uggcugugccaaaugcuaagca

SEQ ID NO: 1134996 - RNA, 21 nt, Human
uggcuugagcccaggaguucg

SEQ ID NO: 1134997 - RNA, 23 nt, Human
uggcuugagccugggaggucgag

SEQ ID NO: 1134998 - RNA, 24 nt, Human
ugggaacuccugccccacccacuu

SEQ ID NO: 1134999 - RNA, 19 nt, Human
ugggagaggcgauggggca

SEQ ID NO: 1135000 - RNA, 19 nt, Human
ugggaggaugaggcgggca

SEQ ID NO: 1135001 - RNA, 24 nt, Human
ugggaggucgaggcugcagugagc

SEQ ID NO: 1135002 - RNA, 18 nt, Human
ugggccaggcuuccuggc

SEQ ID NO: 1135003 - RNA, 23 nt, Human
uggguuuagggguagcugcuuuu

SEQ ID NO: 1135004 - RNA, 18 nt, Human
uggugcacgccuguaguu

SEQ ID NO: 1135005 - RNA, 20 nt, Human
uggugcacgccuguaguucu

SEQ ID NO: 1135006 - RNA, 24 nt, Human
uguaaaauaaggugauugauuuga

SEQ ID NO: 1135007 - RNA, 19 nt, Human
uguggugagaaucacauga

SEQ ID NO: 1135008 - RNA, 24 nt, Human
uuagccgggcacaguggugcacgc

SEQ ID NO: 1135009 - RNA, 20 nt, Human
uucaaaccaugagacaggag

SEQ ID NO: 1135010 - RNA, 19 nt, Human
uucaaagauaaacaggaaa

SEQ ID NO: 1135011 - RNA, 19 nt, Human
uuguugccauuuuuccaca

SEQ ID NO: 1135012 - RNA, 25 nt, Human
uuucuacaaaauauauacacacaaa

SEQ ID NO: 1135013 - RNA, 20 nt, Human
aaaagacucuagacauggga

SEQ ID NO: 1135014 - RNA, 21 nt, Human
aaaaggacccaaacaaugcug

SEQ ID NO: 1135015 - RNA, 21 nt, Human
aaauauccggaacacacagga

SEQ ID NO: 1135016 - RNA, 23 nt, Human
aaccccgcauggaugggcugaag

SEQ ID NO: 1135017 - RNA, 21 nt, Human
acaaugcugaugacaaugauc

SEQ ID NO: 1135018 - RNA, 23 nt, Human
acagcaaaacagcauauccugaa

SEQ ID NO: 1135019 - RNA, 22 nt, Human
acauauuucuccuaauugugga

SEQ ID NO: 1135020 - RNA, 22 nt, Human
agcauauccugaagugcucagc

SEQ ID NO: 1135021 - RNA, 19 nt, Human
agggugugaugggagaaca

SEQ ID NO: 1135022 - RNA, 21 nt, Human
augaaaaucaaauguaaacca

SEQ ID NO: 1135023 - RNA, 24 nt, Human
cacauguaaaaucacuaaggcgga

SEQ ID NO: 1135024 - RNA, 20 nt, Human
cacuccagccacugccucca

SEQ ID NO: 1135025 - RNA, 18 nt, Human
cagcaaaacagcauaucc

SEQ ID NO: 1135026 - RNA, 23 nt, Human
cagcagugaccugcuucaacacc

SEQ ID NO: 1135027 - RNA, 22 nt, Human
cagcucgacagcgggcacucag

SEQ ID NO: 1135028 - RNA, 18 nt, Human
ccacugccuccaucugca

SEQ ID NO: 1135029 - RNA, 18 nt, Human
ccaucugcacacagcaaa

SEQ ID NO: 1135030 - RNA, 21 nt, Human
cccaugcacauauuucuccua

SEQ ID NO: 1135031 - RNA, 20 nt, Human
cccguguggacagacagaau

SEQ ID NO: 1135032 - RNA, 24 nt, Human
ccuccaucugcacacagcaaaaca

SEQ ID NO: 1135033 - RNA, 22 nt, Human
cggacuuccagaguucccacau

SEQ ID NO: 1135034 - RNA, 20 nt, Human
cuaaaaggacccaaacaaug

SEQ ID NO: 1135035 - RNA, 23 nt, Human
cucuugguuguugacaagauacu

SEQ ID NO: 1135036 - RNA, 21 nt, Human
gaagucagaaguugaacucuu

SEQ ID NO: 1135037 - RNA, 25 nt, Human
gagaacagugagaaguaccgguacc

SEQ ID NO: 1135038 - RNA, 22 nt, Human
gcacauauuucuccuaauugug

SEQ ID NO: 1135039 - RNA, 18 nt, Human
gcuugucagcucgacagc

SEQ ID NO: 1135040 - RNA, 19 nt, Human
ggaaaagcaaaggaacccc

SEQ ID NO: 1135041 - RNA, 22 nt, Human
gggaaaagcaaaggaaccccgc

SEQ ID NO: 1135042 - RNA, 24 nt, Human
uaaaaggacccaaacaaugcugau

SEQ ID NO: 1135043 - RNA, 18 nt, Human
uaaaauagauagguacuu

SEQ ID NO: 1135044 - RNA, 22 nt, Human
uaaaauagauagguacuuccaa

SEQ ID NO: 1135045 - RNA, 24 nt, Human
uaaaauagauagguacuuccaaau

SEQ ID NO: 1135046 - RNA, 21 nt, Human
uaaaauauccggaacacacag

SEQ ID NO: 1135047 - RNA, 25 nt, Human
uaggugucuccacuguuucaguucu

SEQ ID NO: 1135048 - RNA, 23 nt, Human
uaguagcuaagcuuaaucaccgu

SEQ ID NO: 1135049 - RNA, 19 nt, Human
uauuuuacauaaaagacuc

SEQ ID NO: 1135050 - RNA, 18 nt, Human
ucacuaaggcggacuucc

SEQ ID NO: 1135051 - RNA, 23 nt, Human
ucaucggaagucagaaguugaac

SEQ ID NO: 1135052 - RNA, 19 nt, Human
ucccacaugaaaaucaaau

SEQ ID NO: 1135053 - RNA, 23 nt, Human
ucugcacacagcaaaacagcaua

SEQ ID NO: 1135054 - RNA, 22 nt, Human
ugaagggugugaugggagaaca

SEQ ID NO: 1135055 - RNA, 21 nt, Human
ugcuaaaaggacccaaacaau

SEQ ID NO: 1135056 - RNA, 22 nt, Human
uggacagacagaaugauggaca

SEQ ID NO: 1135057 - RNA, 22 nt, Human
ugggaaaagcaaaggaaccccg

SEQ ID NO: 1135058 - RNA, 24 nt, Human
ugggaagacaacaaaaugauuuag

SEQ ID NO: 1135059 - RNA, 25 nt, Human
ugggaagacaacaaaaugauuuaga

SEQ ID NO: 1135060 - RNA, 20 nt, Human
ugggaguaaaaauagggagu

SEQ ID NO: 1135061 - RNA, 25 nt, Human
uguaaggugggaaaagcaaaggaac

SEQ ID NO: 1135062 - RNA, 22 nt, Human
uguuauggaguuacccauuuug

SEQ ID NO: 1135063 - RNA, 24 nt, Human
uguuauggaguuacccauuuugag

SEQ ID NO: 1135064 - RNA, 25 nt, Human
uguuauggaguuacccauuuugaga

SEQ ID NO: 1135065 - RNA, 24 nt, Human
uuaaucacaaucuaucaaaaggga

SEQ ID NO: 1135066 - RNA, 23 nt, Human
uucccacaugaaaaucaaaugua

SEQ ID NO: 1135067 - RNA, 18 nt, Human
uucguaagcuuccaacug

SEQ ID NO: 1135068 - RNA, 22 nt, Human
uucuauucuaucaaaacaccgc

SEQ ID NO: 1135069 - RNA, 27 nt, Human
uugagaaaucugugcuaaaaggaccca

SEQ ID NO: 1135070 - RNA, 18 nt, Human
uuuuguuuguuuugucuu

SEQ ID NO: 1135071 - RNA, 23 nt, Human
aaaaagcaggggaccaaaacuga

SEQ ID NO: 1135072 - RNA, 22 nt, Human
aaacagcacccucugcuucggu

SEQ ID NO: 1135073 - RNA, 25 nt, Human
aaaucacauccuacucaucagcaag

SEQ ID NO: 1135074 - RNA, 22 nt, Human
aaccugagcugugcuuccucug

SEQ ID NO: 1135075 - RNA, 19 nt, Human
aagcaugguuucaaacaug

SEQ ID NO: 1135076 - RNA, 20 nt, Human
aaggaggccgcugcauuucc

SEQ ID NO: 1135077 - RNA, 22 nt, Human
acaccgggucugaccucccagc

SEQ ID NO: 1135078 - RNA, 21 nt, Human
acagagucucacucuguugac

SEQ ID NO: 1135079 - RNA, 20 nt, Human
acaggcugcucaccccaggc

SEQ ID NO: 1135080 - RNA, 20 nt, Human
acaugcaaugaggacagagc

SEQ ID NO: 1135081 - RNA, 25 nt, Human
accucaaaaagcaggggaccaaaac

SEQ ID NO: 1135082 - RNA, 20 nt, Human
acgagccccucagucuuggg

SEQ ID NO: 1135083 - RNA, 25 nt, Human
acucuguugaccaggcuggagugua

SEQ ID NO: 1135084 - RNA, 18 nt, Human
agaacucaaguuaaggcc

SEQ ID NO: 1135085 - RNA, 21 nt, Human
agaaggcucugugugcagccc

SEQ ID NO: 1135086 - RNA, 18 nt, Human
agagagguccaaggugcc

SEQ ID NO: 1135087 - RNA, 22 nt, Human
agcacucugggagggcuguggg

SEQ ID NO: 1135088 - RNA, 23 nt, Human
agcacucugggagggcugugggc

SEQ ID NO: 1135089 - RNA, 18 nt, Human
agcagcugcucuagcggc

SEQ ID NO: 1135090 - RNA, 18 nt, Human
agccuuuccaccaccucc

SEQ ID NO: 1135091 - RNA, 19 nt, Human
agcugcccugggcuggaga

SEQ ID NO: 1135092 - RNA, 19 nt, Human
agcugccucccgccuuggc

SEQ ID NO: 1135093 - RNA, 22 nt, Human
agcugccucccgccuuggcuuc

SEQ ID NO: 1135094 - RNA, 18 nt, Human
agcugugcuuccucugcc

SEQ ID NO: 1135095 - RNA, 23 nt, Human
aggaaggaaggcagggcuugcag

SEQ ID NO: 1135096 - RNA, 18 nt, Human
aggaaggcagggcuugca

SEQ ID NO: 1135097 - RNA, 19 nt, Human
aggcauggaggaggugggc

SEQ ID NO: 1135098 - RNA, 22 nt, Human
agggcuaaacacuggugcccag

SEQ ID NO: 1135099 - RNA, 22 nt, Human
agggcugugggcaugagcagcg

SEQ ID NO: 1135100 - RNA, 20 nt, Human
agggggugguggcaggaguu

SEQ ID NO: 1135101 - RNA, 19 nt, Human
aggucugccucccgggccc

SEQ ID NO: 1135102 - RNA, 19 nt, Human
agugcuccacggcccaggc

SEQ ID NO: 1135103 - RNA, 19 nt, Human
aguggcugagcuggaggau

SEQ ID NO: 1135104 - RNA, 19 nt, Human
augagcagcgaggacucca

SEQ ID NO: 1135105 - RNA, 19 nt, Human
auuugcuuccucaggaugg

SEQ ID NO: 1135106 - RNA, 21 nt, Human
caaauugaaggcaggauccca

SEQ ID NO: 1135107 - RNA, 22 nt, Human
caaccucaaaaagcaggggacc

SEQ ID NO: 1135108 - RNA, 21 nt, Human
caaucuugaacccuuugucac

SEQ ID NO: 1135109 - RNA, 22 nt, Human
cacagcacguggguggcaggac

SEQ ID NO: 1135110 - RNA, 27 nt, Human
cacagcacguggguggcaggaccaaca

SEQ ID NO: 1135111 - RNA, 19 nt, Human
cacagccccucugccucuc

SEQ ID NO: 1135112 - RNA, 21 nt, Human
cacaugcaaugaggacagagc

SEQ ID NO: 1135113 - RNA, 19 nt, Human
caccacgccccacccccaa

SEQ ID NO: 1135114 - RNA, 22 nt, Human
caccauuguaaaaaaaaauaaa

SEQ ID NO: 1135115 - RNA, 19 nt, Human
caccccaggccuggaaucu

SEQ ID NO: 1135116 - RNA, 28 nt, Human
cacccccaacugcacggcagccacucgc

SEQ ID NO: 1135117 - RNA, 20 nt, Human
cacccucugcuucgguccuc

SEQ ID NO: 1135118 - RNA, 18 nt, Human
cacggcagccacucgcau

SEQ ID NO: 1135119 - RNA, 24 nt, Human
cacucuguugaccaggcuggagug

SEQ ID NO: 1135120 - RNA, 21 nt, Human
cagaggagaaaagcacuuagc

SEQ ID NO: 1135121 - RNA, 20 nt, Human
cagagggcaucggugagcac

SEQ ID NO: 1135122 - RNA, 18 nt, Human
cagcagcucccccacaug

SEQ ID NO: 1135123 - RNA, 20 nt, Human
cagugcguggaggagaucgg

SEQ ID NO: 1135124 - RNA, 24 nt, Human
caucagcaaggcggguagacauca

SEQ ID NO: 1135125 - RNA, 22 nt, Human
ccaaaacaaaacaaaaaaaauc

SEQ ID NO: 1135126 - RNA, 24 nt, Human
ccaaaacaaaacaaaaaaaaucug

SEQ ID NO: 1135127 - RNA, 19 nt, Human
ccaaaacugagccuauccu

SEQ ID NO: 1135128 - RNA, 21 nt, Human
ccaaaacugagccuauccugg

SEQ ID NO: 1135129 - RNA, 20 nt, Human
ccaacuucgcagagggcauc

SEQ ID NO: 1135130 - RNA, 19 nt, Human
ccaagugggugaaaugguc

SEQ ID NO: 1135131 - RNA, 24 nt, Human
ccaccgcucuggcacgagccccuc

SEQ ID NO: 1135132 - RNA, 18 nt, Human
ccacgugcacugcugccc

SEQ ID NO: 1135133 - RNA, 23 nt, Human
ccaggugcucuugccaugggucc

SEQ ID NO: 1135134 - RNA, 19 nt, Human
ccagucaaucagaagcaaa

SEQ ID NO: 1135135 - RNA, 22 nt, Human
ccaugcugagccuccccugccu

SEQ ID NO: 1135136 - RNA, 20 nt, Human
ccccaaggcuggagucagcu

SEQ ID NO: 1135137 - RNA, 26 nt, Human
cccuguccccccccccccuuuuuuuu

SEQ ID NO: 1135138 - RNA, 18 nt, Human
ccucccacuucccaccuc

SEQ ID NO: 1135139 - RNA, 19 nt, Human
ccuccugcugcuguuugcc

SEQ ID NO: 1135140 - RNA, 21 nt, Human
ccuccugcugcuguuugccgg

SEQ ID NO: 1135141 - RNA, 25 nt, Human
ccugcagaccagggcuaaacacugg

SEQ ID NO: 1135142 - RNA, 23 nt, Human
ccuggaaggccuugcccaucccc

SEQ ID NO: 1135143 - RNA, 24 nt, Human
ccuggcagcauuuggucuuccucu

SEQ ID NO: 1135144 - RNA, 20 nt, Human
ccuuccugcagaccagggcu

SEQ ID NO: 1135145 - RNA, 20 nt, Human
ccuugggcucccuggggagg

SEQ ID NO: 1135146 - RNA, 20 nt, Human
ccuugugucccucacucccc

SEQ ID NO: 1135147 - RNA, 22 nt, Human
cggcagccacucgcauagcacu

SEQ ID NO: 1135148 - RNA, 19 nt, Human
cuaaacaccacgccccacc

SEQ ID NO: 1135149 - RNA, 23 nt, Human
cuaaacaccacgccccaccccca

SEQ ID NO: 1135150 - RNA, 24 nt, Human
cucacucuguugaccaggcuggag

SEQ ID NO: 1135151 - RNA, 20 nt, Human
cucacugcaaccuccacccc

SEQ ID NO: 1135152 - RNA, 21 nt, Human
cuccaaaacaaaacaaaaaaa

SEQ ID NO: 1135153 - RNA, 19 nt, Human
cuccccugccuugggcucc

SEQ ID NO: 1135154 - RNA, 23 nt, Human
cuccgcaugggcuguggguguug

SEQ ID NO: 1135155 - RNA, 25 nt, Human
cuccuccacgugcacugcugcccuc

SEQ ID NO: 1135156 - RNA, 24 nt, Human
cucuaucugggcccggugggcucc

SEQ ID NO: 1135157 - RNA, 19 nt, Human
cugcuguccuccuuccugc

SEQ ID NO: 1135158 - RNA, 23 nt, Human
cuggaggaugcccuggaacucgg

SEQ ID NO: 1135159 - RNA, 21 nt, Human
cugggguggccgcagacaucc

SEQ ID NO: 1135160 - RNA, 22 nt, Human
cuggugguggcguugaaacagc

SEQ ID NO: 1135161 - RNA, 20 nt, Human
cuguccccccccccccuuuu

SEQ ID NO: 1135162 - RNA, 18 nt, Human
cuguugaccaggcuggag

SEQ ID NO: 1135163 - RNA, 19 nt, Human
cuucuuagaguugucuuga

SEQ ID NO: 1135164 - RNA, 19 nt, Human
cuugguggggcugggaccc

SEQ ID NO: 1135165 - RNA, 19 nt, Human
gaacaucccugauuaagaa

SEQ ID NO: 1135166 - RNA, 20 nt, Human
gaaccugagcugugcuuccu

SEQ ID NO: 1135167 - RNA, 19 nt, Human
gaacucggagcacgcagca

SEQ ID NO: 1135168 - RNA, 18 nt, Human
gacgggauggaggugugg

SEQ ID NO: 1135169 - RNA, 24 nt, Human
gaggacucuagcacggcacagccc

SEQ ID NO: 1135170 - RNA, 19 nt, Human
gagggggugguggcaggag

SEQ ID NO: 1135171 - RNA, 19 nt, Human
gagggggugguggcaggag

SEQ ID NO: 1135172 - RNA, 24 nt, Human
gaguccagccuuuccaccaccucc

SEQ ID NO: 1135173 - RNA, 22 nt, Human
gaucuccgcucacugcaaccuc

SEQ ID NO: 1135174 - RNA, 27 nt, Human
gcaaaacagaacucaaguuaaggccuc

SEQ ID NO: 1135175 - RNA, 19 nt, Human
gcacagccagggucgaggu

SEQ ID NO: 1135176 - RNA, 22 nt, Human
gcagcucccccacaugagcccu

SEQ ID NO: 1135177 - RNA, 18 nt, Human
gcccgagggcagcucugc

SEQ ID NO: 1135178 - RNA, 20 nt, Human
gccuccccugccuugggcuc

SEQ ID NO: 1135179 - RNA, 19 nt, Human
gcgccagugcguggaggag

SEQ ID NO: 1135180 - RNA, 24 nt, Human
gcuuccucugccauggucggaauu

SEQ ID NO: 1135181 - RNA, 22 nt, Human
gcuugcaggaucacggaaaacc

SEQ ID NO: 1135182 - RNA, 21 nt, Human
ggacaggcaugcagaaggcuc

SEQ ID NO: 1135183 - RNA, 20 nt, Human
ggacugggucaauggccaug

SEQ ID NO: 1135184 - RNA, 24 nt, Human
ggaggacaggcaugcagaaggcuc

SEQ ID NO: 1135185 - RNA, 22 nt, Human
ggaggaugcccuggaacucgga

SEQ ID NO: 1135186 - RNA, 22 nt, Human
ggcaacccuucauucauucguc

SEQ ID NO: 1135187 - RNA, 23 nt, Human
ggcacaggcugcucaccccaggc

SEQ ID NO: 1135188 - RNA, 21 nt, Human
ggcccccuucuccgcuuucgu

SEQ ID NO: 1135189 - RNA, 26 nt, Human
ggcucuccaaaacaaaacaaaaaaaa

SEQ ID NO: 1135190 - RNA, 21 nt, Human
ggcugugggcaugagcagcga

SEQ ID NO: 1135191 - RNA, 18 nt, Human
gggaaccugagcugugcu

SEQ ID NO: 1135192 - RNA, 22 nt, Human
gggaaccugagcugugcuuccu

SEQ ID NO: 1135193 - RNA, 22 nt, Human
gggacccucccacuucccaccu

SEQ ID NO: 1135194 - RNA, 19 nt, Human
gggcagugguguccgcgau

SEQ ID NO: 1135195 - RNA, 23 nt, Human
ggucuguguuucaggaacugagg

SEQ ID NO: 1135196 - RNA, 22 nt, Human
ggugugcacauagggagcaggu

SEQ ID NO: 1135197 - RNA, 22 nt, Human
guccccauccauauuucucaag

SEQ ID NO: 1135198 - RNA, 23 nt, Human
gugcagcaccuguagccugugca

SEQ ID NO: 1135199 - RNA, 25 nt, Human
gugcagccccagaccuggguaccuu

SEQ ID NO: 1135200 - RNA, 20 nt, Human
gugcugcugaccccaaggcu

SEQ ID NO: 1135201 - RNA, 19 nt, Human
gugguggcguugaaacagc

SEQ ID NO: 1135202 - RNA, 18 nt, Human
guugaccaggcuggagug

SEQ ID NO: 1135203 - RNA, 22 nt, Human
uaaacaccacgccccaccccca

SEQ ID NO: 1135204 - RNA, 23 nt, Human
uaaagaauuuacuuuuccaggac

SEQ ID NO: 1135205 - RNA, 20 nt, Human
uaagcgccuggcuccgcugu

SEQ ID NO: 1135206 - RNA, 19 nt, Human
uacugccucccuguccccc

SEQ ID NO: 1135207 - RNA, 25 nt, Human
uagaggcucuccaaaacaaaacaaa

SEQ ID NO: 1135208 - RNA, 23 nt, Human
uagcacggcacagccccucugcc

SEQ ID NO: 1135209 - RNA, 27 nt, Human
uagcacggcacagccccucugccucuc

SEQ ID NO: 1135210 - RNA, 19 nt, Human
uagcacucugggagggcug

SEQ ID NO: 1135211 - RNA, 22 nt, Human
uagcacucugggagggcugugg

SEQ ID NO: 1135212 - RNA, 24 nt, Human
uagcacucugggagggcugugggc

SEQ ID NO: 1135213 - RNA, 25 nt, Human
ucaaaaagcaggggaccaaaacuga

SEQ ID NO: 1135214 - RNA, 18 nt, Human
ucacugcaaccuccaccc

SEQ ID NO: 1135215 - RNA, 21 nt, Human
ucacugcaaccuccaccccaa

SEQ ID NO: 1135216 - RNA, 20 nt, Human
ucagaugcccuucccgugcu

SEQ ID NO: 1135217 - RNA, 19 nt, Human
ucagugcaguggcugagcu

SEQ ID NO: 1135218 - RNA, 21 nt, Human
ucauucauucgucggaugugu

SEQ ID NO: 1135219 - RNA, 23 nt, Human
uccaaaacaaaacaaaaaaaauc

SEQ ID NO: 1135220 - RNA, 24 nt, Human
uccaccauuguaaaaaaaaauaaa

SEQ ID NO: 1135221 - RNA, 23 nt, Human
uccagcauuuuaaugaacauccc

SEQ ID NO: 1135222 - RNA, 26 nt, Human
uccagccaagcaugguuucaaacaug

SEQ ID NO: 1135223 - RNA, 24 nt, Human
uccaucagcagcucccccacauga

SEQ ID NO: 1135224 - RNA, 18 nt, Human
uccaugcugagccucccc

SEQ ID NO: 1135225 - RNA, 18 nt, Human
ucccaccuccuugugucc

SEQ ID NO: 1135226 - RNA, 19 nt, Human
ucccagccgggggcacagg

SEQ ID NO: 1135227 - RNA, 24 nt, Human
ucccucacuccccuguuucauucc

SEQ ID NO: 1135228 - RNA, 22 nt, Human
ucccuccucccgcaggagagag

SEQ ID NO: 1135229 - RNA, 21 nt, Human
ucccugggcaauccguguccu

SEQ ID NO: 1135230 - RNA, 21 nt, Human
ucccuggggaggggguggugg

SEQ ID NO: 1135231 - RNA, 19 nt, Human
ucccugucccccccccccc

SEQ ID NO: 1135232 - RNA, 26 nt, Human
uccgcuguucucaggaguggguucug

SEQ ID NO: 1135233 - RNA, 19 nt, Human
uccuccugcugcuguuugc

SEQ ID NO: 1135234 - RNA, 20 nt, Human
uccucuaagcgccuggcucc

SEQ ID NO: 1135235 - RNA, 24 nt, Human
ucucacucuguugaccaggcugga

SEQ ID NO: 1135236 - RNA, 22 nt, Human
ucucccagccugcaggugcccc

SEQ ID NO: 1135237 - RNA, 24 nt, Human
ucucccagccugcaggugccccug

SEQ ID NO: 1135238 - RNA, 18 nt, Human
ucugggcccggugggcuc

SEQ ID NO: 1135239 - RNA, 24 nt, Human
ucuguugaccaggcuggaguguag

SEQ ID NO: 1135240 - RNA, 24 nt, Human
ucuugggugguuuuugccuggucc

SEQ ID NO: 1135241 - RNA, 22 nt, Human
ugaaacagcacccucugcuucg

SEQ ID NO: 1135242 - RNA, 21 nt, Human
ugaccugacccuuagucaacc

SEQ ID NO: 1135243 - RNA, 25 nt, Human
ugagaaagcacaugcaaugaggaca

SEQ ID NO: 1135244 - RNA, 18 nt, Human
ugagaacauucccuccuc

SEQ ID NO: 1135245 - RNA, 21 nt, Human
ugagaacauucccuccucccg

SEQ ID NO: 1135246 - RNA, 22 nt, Human
ugagacagagucucacucuguu

SEQ ID NO: 1135247 - RNA, 20 nt, Human
ugaugaugagcgagauggac

SEQ ID NO: 1135248 - RNA, 22 nt, Human
ugcaaaacagaacucaaguuaa

SEQ ID NO: 1135249 - RNA, 20 nt, Human
ugcccuggaacucggagcac

SEQ ID NO: 1135250 - RNA, 19 nt, Human
ugcugagccuccccugccu

SEQ ID NO: 1135251 - RNA, 18 nt, Human
ugcugcugaccccaaggc

SEQ ID NO: 1135252 - RNA, 22 nt, Human
ugcuggaauguaaucccugggc

SEQ ID NO: 1135253 - RNA, 22 nt, Human
uggaggugugggcagugguguc

SEQ ID NO: 1135254 - RNA, 19 nt, Human
uggcagcauuuggucuucc

SEQ ID NO: 1135255 - RNA, 23 nt, Human
uggcaggaccaacaccgggucug

SEQ ID NO: 1135256 - RNA, 20 nt, Human
uggcagugggaugaggcugg

SEQ ID NO: 1135257 - RNA, 22 nt, Human
uggcagugggaugaggcuggga

SEQ ID NO: 1135258 - RNA, 27 nt, Human
uggcauccagauuugcauaagauggac

SEQ ID NO: 1135259 - RNA, 21 nt, Human
uggccaggccacuagccaguc

SEQ ID NO: 1135260 - RNA, 21 nt, Human
uggccgcagacauccaggcac

SEQ ID NO: 1135261 - RNA, 23 nt, Human
uggcugggccucugaccuugcug

SEQ ID NO: 1135262 - RNA, 19 nt, Human
uggcuuccaucucugucuc

SEQ ID NO: 1135263 - RNA, 24 nt, Human
ugggaaugacuucuucuuuuuuuu

SEQ ID NO: 1135264 - RNA, 20 nt, Human
ugggcagugguguccgcgau

SEQ ID NO: 1135265 - RNA, 22 nt, Human
ugggcaugagcagcgaggacuc

SEQ ID NO: 1135266 - RNA, 19 nt, Human
uggggagggggugguggca

SEQ ID NO: 1135267 - RNA, 24 nt, Human
ugggguccuaaagucugcuguccu

SEQ ID NO: 1135268 - RNA, 23 nt, Human
uggugucugguuuuucaccuuua

SEQ ID NO: 1135269 - RNA, 18 nt, Human
ugucugguuuuucaccuu

SEQ ID NO: 1135270 - RNA, 20 nt, Human
uguugcugcugaguccagcc

SEQ ID NO: 1135271 - RNA, 19 nt, Human
uuccagauaacaaggacgu

SEQ ID NO: 1135272 - RNA, 21 nt, Human
uuccaggaccuacugccuccc

SEQ ID NO: 1135273 - RNA, 21 nt, Human
uuccucaggauggaaucuggc

SEQ ID NO: 1135274 - RNA, 23 nt, Human
uucucaaggaggccaagugggug

SEQ ID NO: 1135275 - RNA, 18 nt, Human
uugcagagggaggacagg

SEQ ID NO: 1135276 - RNA, 25 nt, Human
uugggcucccuggggaggggguggu

SEQ ID NO: 1135277 - RNA, 20 nt, Human
uugguuugagagcaguucau

SEQ ID NO: 1135278 - RNA, 24 nt, Human
uuuaacccaaccucaaaaagcagg

SEQ ID NO: 1135279 - RNA, 21 nt, Human
uuugcauaagauggacugggu

SEQ ID NO: 1135280 - RNA, 22 nt, Human
uuuguugguuugagagcaguuc

SEQ ID NO: 1135281 - RNA, 20 nt, Human
aaaagacucuagacauggga

SEQ ID NO: 1135282 - RNA, 21 nt, Human
aaaaggacccaaacaaugcug

SEQ ID NO: 1135283 - RNA, 21 nt, Human
aaauauccggaacacacagga

SEQ ID NO: 1135284 - RNA, 23 nt, Human
aaccccgcauggaugggcugaag

SEQ ID NO: 1135285 - RNA, 21 nt, Human
acaaugcugaugacaaugauc

SEQ ID NO: 1135286 - RNA, 23 nt, Human
acagcaaaacagcguauccugaa

SEQ ID NO: 1135287 - RNA, 22 nt, Human
acauauuucuccuaauugugga

SEQ ID NO: 1135288 - RNA, 19 nt, Human
agggugugaugggagaaca

SEQ ID NO: 1135289 - RNA, 21 nt, Human
augaaaaucaaauguaaacca

SEQ ID NO: 1135290 - RNA, 24 nt, Human
cacauguaaaaucacuaaggcgga

SEQ ID NO: 1135291 - RNA, 20 nt, Human
cacuccagccacugccucca

SEQ ID NO: 1135292 - RNA, 18 nt, Human
cagcaaaacagcguaucc

SEQ ID NO: 1135293 - RNA, 23 nt, Human
cagcagugaccugcuucaacacc

SEQ ID NO: 1135294 - RNA, 23 nt, Human
cagcguauccugaagugcucaac

SEQ ID NO: 1135295 - RNA, 22 nt, Human
cagcucgacagcgggcacucag

SEQ ID NO: 1135296 - RNA, 18 nt, Human
ccacugccuccaucugca

SEQ ID NO: 1135297 - RNA, 18 nt, Human
ccaucugcacacagcaaa

SEQ ID NO: 1135298 - RNA, 21 nt, Human
cccaugcacauauuucuccua

SEQ ID NO: 1135299 - RNA, 20 nt, Human
cccguguggacagacagaau

SEQ ID NO: 1135300 - RNA, 24 nt, Human
ccuccaucugcacacagcaaaaca

SEQ ID NO: 1135301 - RNA, 18 nt, Human
cgaaugaugcccgugugg

SEQ ID NO: 1135302 - RNA, 20 nt, Human
cuaaaaggacccaaacaaug

SEQ ID NO: 1135303 - RNA, 23 nt, Human
cucuugguuguugacaagauacu

SEQ ID NO: 1135304 - RNA, 19 nt, Human
cugugcuaaaaggacccaa

SEQ ID NO: 1135305 - RNA, 21 nt, Human
gaagucagaaguugaacucuu

SEQ ID NO: 1135306 - RNA, 25 nt, Human
gagaacagugagaaguaccgguacc

SEQ ID NO: 1135307 - RNA, 22 nt, Human
gcacauauuucuccuaauugug

SEQ ID NO: 1135308 - RNA, 18 nt, Human
gcuugucagcucgacagc

SEQ ID NO: 1135309 - RNA, 19 nt, Human
ggaaaagcaaaggaacccc

SEQ ID NO: 1135310 - RNA, 21 nt, Human
ggacuuccagaguucccacau

SEQ ID NO: 1135311 - RNA, 22 nt, Human
gggaaaagcaaaggaaccccgc

SEQ ID NO: 1135312 - RNA, 24 nt, Human
uaaaaggacccaaacaaugcugau

SEQ ID NO: 1135313 - RNA, 21 nt, Human
uaaaauagauagguacuucca

SEQ ID NO: 1135314 - RNA, 22 nt, Human
uaaaauagauagguacuuccaa

SEQ ID NO: 1135315 - RNA, 24 nt, Human
uaaaauagauagguacuuccaaau

SEQ ID NO: 1135316 - RNA, 21 nt, Human
uaaaauauccggaacacacag

SEQ ID NO: 1135317 - RNA, 25 nt, Human
uaggugucuccacuguuucaguucu

SEQ ID NO: 1135318 - RNA, 23 nt, Human
uaguagcuaagcuuaaucaccgu

SEQ ID NO: 1135319 - RNA, 19 nt, Human
uauuuuacauaaaagacuc

SEQ ID NO: 1135320 - RNA, 18 nt, Human
ucacuaaggcggacuucc

SEQ ID NO: 1135321 - RNA, 23 nt, Human
ucaucggaagucagaaguugaac

SEQ ID NO: 1135322 - RNA, 19 nt, Human
ucccacaugaaaaucaaau

SEQ ID NO: 1135323 - RNA, 23 nt, Human
ucugcacacagcaaaacagcgua

SEQ ID NO: 1135324 - RNA, 22 nt, Human
ugaagggugugaugggagaaca

SEQ ID NO: 1135325 - RNA, 23 nt, Human
ugccuccaucugcacacagcaaa

SEQ ID NO: 1135326 - RNA, 21 nt, Human
ugcuaaaaggacccaaacaau

SEQ ID NO: 1135327 - RNA, 22 nt, Human
uggacagacagaaugauggaca

SEQ ID NO: 1135328 - RNA, 22 nt, Human
ugggaaaagcaaaggaaccccg

SEQ ID NO: 1135329 - RNA, 24 nt, Human
ugggaagacaacaaaaugauuuag

SEQ ID NO: 1135330 - RNA, 25 nt, Human
ugggaagacaacaaaaugauuuaga

SEQ ID NO: 1135331 - RNA, 20 nt, Human
ugggaguaaaaauagggagu

SEQ ID NO: 1135332 - RNA, 25 nt, Human
uguaaggugggaaaagcaaaggaac

SEQ ID NO: 1135333 - RNA, 22 nt, Human
uguuauggaguuacccauuuug

SEQ ID NO: 1135334 - RNA, 24 nt, Human
uguuauggaguuacccauuuugag

SEQ ID NO: 1135335 - RNA, 25 nt, Human
uguuauggaguuacccauuuugaga

SEQ ID NO: 1135336 - RNA, 24 nt, Human
uuaaucacaaucuaucaaaaggga

SEQ ID NO: 1135337 - RNA, 23 nt, Human
uucccacaugaaaaucaaaugua

SEQ ID NO: 1135338 - RNA, 18 nt, Human
uucguaagcuuccaacug

SEQ ID NO: 1135339 - RNA, 22 nt, Human
uucuauucuaucaaaacaccgc

SEQ ID NO: 1135340 - RNA, 27 nt, Human
uugagaaaucugugcuaaaaggaccca

SEQ ID NO: 1135341 - RNA, 18 nt, Human
uuuuguuuguuuugucuu

SEQ ID NO: 1135342 - RNA, 27 nt, Human
aaggcaccugcagguuugguguccagu

SEQ ID NO: 1135343 - RNA, 20 nt, Human
acccacggggcagaaaagac

SEQ ID NO: 1135344 - RNA, 22 nt, Human
acggggcagaaaagacgggggc

SEQ ID NO: 1135345 - RNA, 22 nt, Human
aggggagucccgcauccugacc

SEQ ID NO: 1135346 - RNA, 18 nt, Human
auggcgguggaggggagu

SEQ ID NO: 1135347 - RNA, 18 nt, Human
caaccucuggguuacuug

SEQ ID NO: 1135348 - RNA, 19 nt, Human
cagccaggacgcuuggcag

SEQ ID NO: 1135349 - RNA, 19 nt, Human
ccaagaucaaggcaccugc

SEQ ID NO: 1135350 - RNA, 28 nt, Human
ccacccacggggcagaaaagacgggggc

SEQ ID NO: 1135351 - RNA, 22 nt, Human
ccgcauccugacccccggccgc

SEQ ID NO: 1135352 - RNA, 20 nt, Human
ccgcgcacuggggggcccuc

SEQ ID NO: 1135353 - RNA, 18 nt, Human
cgagaucauggcggugga

SEQ ID NO: 1135354 - RNA, 20 nt, Human
gaaaagacgggggcggucaa

SEQ ID NO: 1135355 - RNA, 21 nt, Human
ggggcggucaacuuucuccac

SEQ ID NO: 1135356 - RNA, 18 nt, Human
gggggcccucaaccucug

SEQ ID NO: 1135357 - RNA, 19 nt, Human
ugcuugccaggcaccaguc

SEQ ID NO: 1135358 - RNA, 19 nt, Human
ugggaaguccaagaucaag

SEQ ID NO: 1135359 - RNA, 24 nt, Human
ugggaaguccaagaucaaggcacc

SEQ ID NO: 1135360 - RNA, 19 nt, Human
uguccagugauggcucgcu

SEQ ID NO: 1135361 - RNA, 22 nt, Human
uugccaggcaccagucucuuuc

SEQ ID NO: 1135362 - RNA, 20 nt, Human
uuucuccacuccagccgccu

SEQ ID NO: 1135363 - RNA, 20 nt, Human
acccacggggcagaaaagac

SEQ ID NO: 1135364 - RNA, 22 nt, Human
acggggcagaaaagacgggggc

SEQ ID NO: 1135365 - RNA, 20 nt, Human
agcaauaauaacaucaaaac

SEQ ID NO: 1135366 - RNA, 22 nt, Human
aggggagucccgcauccugacc

SEQ ID NO: 1135367 - RNA, 18 nt, Human
auggcgguggaggggagu

SEQ ID NO: 1135368 - RNA, 18 nt, Human
caaccucuggguuacuug

SEQ ID NO: 1135369 - RNA, 19 nt, Human
cagccaggacgcuuggcag

SEQ ID NO: 1135370 - RNA, 22 nt, Human
cagcucuaauaaaaacagcaau

SEQ ID NO: 1135371 - RNA, 19 nt, Human
cauccugacccccggccgc

SEQ ID NO: 1135372 - RNA, 28 nt, Human
ccacccacggggcagaaaagacgggggc

SEQ ID NO: 1135373 - RNA, 20 nt, Human
ccgcgcacuggggggcccuc

SEQ ID NO: 1135374 - RNA, 18 nt, Human
cgagaucauggcggugga

SEQ ID NO: 1135375 - RNA, 20 nt, Human
gaaaagacgggggcggucaa

SEQ ID NO: 1135376 - RNA, 20 nt, Human
gccaggcaccagucucuuuc

SEQ ID NO: 1135377 - RNA, 21 nt, Human
ggggcggucaacuuucuccac

SEQ ID NO: 1135378 - RNA, 18 nt, Human
gggggcccucaaccucug

SEQ ID NO: 1135379 - RNA, 26 nt, Human
uaaaaacagcaauaauaacaucaaaa

SEQ ID NO: 1135380 - RNA, 23 nt, Human
uacacacagcucuaauaaaaaca

SEQ ID NO: 1135381 - RNA, 20 nt, Human
uccaggguaacaggaaaagg

SEQ ID NO: 1135382 - RNA, 23 nt, Human
uccaggguaacaggaaaaggcuc

SEQ ID NO: 1135383 - RNA, 18 nt, Human
ugcccugacucacuaauu

SEQ ID NO: 1135384 - RNA, 19 nt, Human
ugcuugccaggcaccaguc

SEQ ID NO: 1135385 - RNA, 20 nt, Human
uuucuccacuccagccgccu

SEQ ID NO: 1135386 - RNA, 19 nt, Human
aacuccaacuagcuuugcc

SEQ ID NO: 1135387 - RNA, 21 nt, Human
aagcagacauccaaucaggga

SEQ ID NO: 1135388 - RNA, 21 nt, Human
aaguguugggauuacaggcau

SEQ ID NO: 1135389 - RNA, 23 nt, Human
aaguguugggauuacaggcauga

SEQ ID NO: 1135390 - RNA, 26 nt, Human
aaguguugggauuacaggcaugagcc

SEQ ID NO: 1135391 - RNA, 20 nt, Human
aaucugcccgccuuggccuc

SEQ ID NO: 1135392 - RNA, 24 nt, Human
aaugacagggaagcccccugaaga

SEQ ID NO: 1135393 - RNA, 19 nt, Human
acaagcaaugacagggaag

SEQ ID NO: 1135394 - RNA, 22 nt, Human
acagcaauaauaacaucaaaac

SEQ ID NO: 1135395 - RNA, 23 nt, Human
accauguuggucaggcuggucuc

SEQ ID NO: 1135396 - RNA, 24 nt, Human
accauguuggucaggcuggucucg

SEQ ID NO: 1135397 - RNA, 20 nt, Human
acccacggggcagaaaagac

SEQ ID NO: 1135398 - RNA, 23 nt, Human
acccaggcuggagugcaguggug

SEQ ID NO: 1135399 - RNA, 24 nt, Human
acccaggcuggagugcaguggugu

SEQ ID NO: 1135400 - RNA, 18 nt, Human
acccuguuggcuuuagua

SEQ ID NO: 1135401 - RNA, 24 nt, Human
accucguaaucugcccgccuuggc

SEQ ID NO: 1135402 - RNA, 22 nt, Human
acggggcagaaaagacgggggc

SEQ ID NO: 1135403 - RNA, 21 nt, Human
acgggguucuaccauguuggu

SEQ ID NO: 1135404 - RNA, 24 nt, Human
acgggguucuaccauguuggucag

SEQ ID NO: 1135405 - RNA, 19 nt, Human
agauuucuucaaagccagg

SEQ ID NO: 1135406 - RNA, 21 nt, Human
agcaagcucacacuguccaag

SEQ ID NO: 1135407 - RNA, 24 nt, Human
agccugaggguagggugguggugg

SEQ ID NO: 1135408 - RNA, 21 nt, Human
aggcaucugaagucauuaugg

SEQ ID NO: 1135409 - RNA, 25 nt, Human
aggcuggagugcaguggugugaucu

SEQ ID NO: 1135410 - RNA, 22 nt, Human
aggggagucccgcauccugacc

SEQ ID NO: 1135411 - RNA, 22 nt, Human
aguagagacgggguucuaccau

SEQ ID NO: 1135412 - RNA, 23 nt, Human
aguagaugggauuacaggcaagu

SEQ ID NO: 1135413 - RNA, 19 nt, Human
agugcaguggugugaucuc

SEQ ID NO: 1135414 - RNA, 20 nt, Human
agugcaguggugugaucucg

SEQ ID NO: 1135415 - RNA, 23 nt, Human
agugcaguggugugaucucggcu

SEQ ID NO: 1135416 - RNA, 24 nt, Human
agugcaguggugugaucucggcuc

SEQ ID NO: 1135417 - RNA, 18 nt, Human
auggcgguggaggggagu

SEQ ID NO: 1135418 - RNA, 24 nt, Human
auuuuuguauuuuuaguagagacg

SEQ ID NO: 1135419 - RNA, 22 nt, Human
caaccuccuucacucccaacuc

SEQ ID NO: 1135420 - RNA, 18 nt, Human
caaccucuggguuacuug

SEQ ID NO: 1135421 - RNA, 22 nt, Human
caagcaauucuccugccucagc

SEQ ID NO: 1135422 - RNA, 22 nt, Human
caagcagacauccaaucaggga

SEQ ID NO: 1135423 - RNA, 24 nt, Human
caccacgccuggcuaauuuuugua

SEQ ID NO: 1135424 - RNA, 21 nt, Human
cacccaggcuggagugcagug

SEQ ID NO: 1135425 - RNA, 24 nt, Human
caccgcacccucccuauuucugcc

SEQ ID NO: 1135426 - RNA, 27 nt, Human
caccuuugugcccugacucacuaauuc

SEQ ID NO: 1135427 - RNA, 21 nt, Human
cacugcaaccucugccuccug

SEQ ID NO: 1135428 - RNA, 23 nt, Human
cacugcaaccucugccuccuggg

SEQ ID NO: 1135429 - RNA, 22 nt, Human
cagcacaagcaaugacagggaa

SEQ ID NO: 1135430 - RNA, 19 nt, Human
cagccaggacgcuuggcag

SEQ ID NO: 1135431 - RNA, 22 nt, Human
cagcucuaauaaaaacagcaau

SEQ ID NO: 1135432 - RNA, 23 nt, Human
cauguaaguuuuuccaaaggcuc

SEQ ID NO: 1135433 - RNA, 20 nt, Human
ccaccacgccuggcuaauuu

SEQ ID NO: 1135434 - RNA, 28 nt, Human
ccacccacggggcagaaaagacgggggc

SEQ ID NO: 1135435 - RNA, 19 nt, Human
ccaccgcgcccagccccac

SEQ ID NO: 1135436 - RNA, 24 nt, Human
cccacugaccuucuuucaugggga

SEQ ID NO: 1135437 - RNA, 19 nt, Human
cccgccccaucccuccccc

SEQ ID NO: 1135438 - RNA, 22 nt, Human
cccgccuuggccuccugaagug

SEQ ID NO: 1135439 - RNA, 18 nt, Human
cccugaagacccuugccc

SEQ ID NO: 1135440 - RNA, 18 nt, Human
ccgcacccucccuauuuc

SEQ ID NO: 1135441 - RNA, 22 nt, Human
ccgcauccugacccccggccgc

SEQ ID NO: 1135442 - RNA, 20 nt, Human
ccgcgcacuggggggcccuc

SEQ ID NO: 1135443 - RNA, 18 nt, Human
ccuaguggauguggucug

SEQ ID NO: 1135444 - RNA, 18 nt, Human
ccucccgccccaucccuc

SEQ ID NO: 1135445 - RNA, 21 nt, Human
ccucccgccccaucccucccc

SEQ ID NO: 1135446 - RNA, 24 nt, Human
ccuccuggguucaagcaauucucc

SEQ ID NO: 1135447 - RNA, 19 nt, Human
ccucugccuccuggguuca

SEQ ID NO: 1135448 - RNA, 23 nt, Human
ccugaaguguugggauuacaggc

SEQ ID NO: 1135449 - RNA, 24 nt, Human
ccugaaguguugggauuacaggca

SEQ ID NO: 1135450 - RNA, 23 nt, Human
ccugaguagaugggauuacaggc

SEQ ID NO: 1135451 - RNA, 24 nt, Human
ccugaguagaugggauuacaggca

SEQ ID NO: 1135452 - RNA, 24 nt, Human
ccugccucagccuccugaguagau

SEQ ID NO: 1135453 - RNA, 23 nt, Human
ccuggguucaagcaauucuccug

SEQ ID NO: 1135454 - RNA, 18 nt, Human
cgagaucauggcggugga

SEQ ID NO: 1135455 - RNA, 25 nt, Human
cgccccaucccucccccguugucca

SEQ ID NO: 1135456 - RNA, 23 nt, Human
cgccuuggccuccugaaguguug

SEQ ID NO: 1135457 - RNA, 24 nt, Human
cgcucugucacccaggcuggagug

SEQ ID NO: 1135458 - RNA, 24 nt, Human
cuagauuucuucaaagccagguau

SEQ ID NO: 1135459 - RNA, 22 nt, Human
cuagcucaaccuccuucacucc

SEQ ID NO: 1135460 - RNA, 23 nt, Human
cuagcucaaccuccuucacuccc

SEQ ID NO: 1135461 - RNA, 23 nt, Human
cucaaccuccuucacucccaacu

SEQ ID NO: 1135462 - RNA, 24 nt, Human
cucacugcaaccucugccuccugg

SEQ ID NO: 1135463 - RNA, 23 nt, Human
cucccuauugcuguuugcuccac

SEQ ID NO: 1135464 - RNA, 24 nt, Human
cuccugaaguguugggauuacagg

SEQ ID NO: 1135465 - RNA, 24 nt, Human
cuccugaccucguaaucugcccgc

SEQ ID NO: 1135466 - RNA, 21 nt, Human
cuccuggguucaagcaauucu

SEQ ID NO: 1135467 - RNA, 24 nt, Human
cucgcucugucacccaggcuggag

SEQ ID NO: 1135468 - RNA, 23 nt, Human
cucugucacccaggcuggagugc

SEQ ID NO: 1135469 - RNA, 20 nt, Human
cugaagucauuaugguaacu

SEQ ID NO: 1135470 - RNA, 23 nt, Human
cugaaguguugggauuacaggca

SEQ ID NO: 1135471 - RNA, 24 nt, Human
cugaaguguugggauuacaggcau

SEQ ID NO: 1135472 - RNA, 19 nt, Human
cugcaaccucugccuccug

SEQ ID NO: 1135473 - RNA, 23 nt, Human
cugcaaccucugccuccuggguu

SEQ ID NO: 1135474 - RNA, 24 nt, Human
cugcaaccucugccuccuggguuc

SEQ ID NO: 1135475 - RNA, 20 nt, Human
gaaaagacgggggcggucaa

SEQ ID NO: 1135476 - RNA, 21 nt, Human
gagacggagucucgcucuguc

SEQ ID NO: 1135477 - RNA, 24 nt, Human
gagacgggguucuaccauguuggu

SEQ ID NO: 1135478 - RNA, 22 nt, Human
gagcuacacccuguuggcuuua

SEQ ID NO: 1135479 - RNA, 18 nt, Human
gauuacaggcaugagcca

SEQ ID NO: 1135480 - RNA, 22 nt, Human
gauuacaggcaugagccaccgc

SEQ ID NO: 1135481 - RNA, 22 nt, Human
gauuacaggcaugagccaccgc

SEQ ID NO: 1135482 - RNA, 19 nt, Human
gcaucugaagucauuaugg

SEQ ID NO: 1135483 - RNA, 25 nt, Human
gccccaucccucccccguuguccag

SEQ ID NO: 1135484 - RNA, 22 nt, Human
gcccucuaacaauaagcucugg

SEQ ID NO: 1135485 - RNA, 23 nt, Human
gcuggucucgaacuccugaccuc

SEQ ID NO: 1135486 - RNA, 22 nt, Human
ggauuacaggcaugagccaccg

SEQ ID NO: 1135487 - RNA, 22 nt, Human
ggcagggcuggcucuucagccc

SEQ ID NO: 1135488 - RNA, 22 nt, Human
ggcuggagugcaguggugugau

SEQ ID NO: 1135489 - RNA, 24 nt, Human
ggcuggucucgaacuccugaccuc

SEQ ID NO: 1135490 - RNA, 21 nt, Human
ggggcggucaacuuucuccac

SEQ ID NO: 1135491 - RNA, 18 nt, Human
gggggcccucaaccucug

SEQ ID NO: 1135492 - RNA, 23 nt, Human
gggguucuaccauguuggucagg

SEQ ID NO: 1135493 - RNA, 22 nt, Human
ggguucuaccauguuggucagg

SEQ ID NO: 1135494 - RNA, 19 nt, Human
ggucucgaacuccugaccu

SEQ ID NO: 1135495 - RNA, 23 nt, Human
ggugcugccauguugugcugccu

SEQ ID NO: 1135496 - RNA, 23 nt, Human
guagagacgggguucuaccaugu

SEQ ID NO: 1135497 - RNA, 24 nt, Human
gucucgcucugucacccaggcugg

SEQ ID NO: 1135498 - RNA, 19 nt, Human
guguugggauuacaggcau

SEQ ID NO: 1135499 - RNA, 26 nt, Human
uaaaaacagcaauaauaacaucaaaa

SEQ ID NO: 1135500 - RNA, 24 nt, Human
uaauuuuuguauuuuuaguagaga

SEQ ID NO: 1135501 - RNA, 23 nt, Human
uacacacagcucuaauaaaaaca

SEQ ID NO: 1135502 - RNA, 22 nt, Human
uacaggcaagugccaccacgcc

SEQ ID NO: 1135503 - RNA, 24 nt, Human
uacaggcaugagccaccgcgccca

SEQ ID NO: 1135504 - RNA, 19 nt, Human
uacagugugggauacugaa

SEQ ID NO: 1135505 - RNA, 21 nt, Human
uaccauguuggucaggcuggu

SEQ ID NO: 1135506 - RNA, 24 nt, Human
uaccauguuggucaggcuggucuc

SEQ ID NO: 1135507 - RNA, 22 nt, Human
uagagacgggguucuaccaugu

SEQ ID NO: 1135508 - RNA, 18 nt, Human
uagcaccgcacccucccu

SEQ ID NO: 1135509 - RNA, 24 nt, Human
uaguagagacgggguucuaccaug

SEQ ID NO: 1135510 - RNA, 24 nt, Human
ucaaccuccuucacucccaacucc

SEQ ID NO: 1135511 - RNA, 19 nt, Human
ucaagcaauucuccugccu

SEQ ID NO: 1135512 - RNA, 22 nt, Human
ucacccaggcuggagugcagug

SEQ ID NO: 1135513 - RNA, 23 nt, Human
ucacugcaaccucugccuccugg

SEQ ID NO: 1135514 - RNA, 24 nt, Human
ucacugcaaccucugccuccuggg

SEQ ID NO: 1135515 - RNA, 26 nt, Human
ucacugcaaccucugccuccuggguu

SEQ ID NO: 1135516 - RNA, 18 nt, Human
uccaagcagacauccaau

SEQ ID NO: 1135517 - RNA, 20 nt, Human
uccaggguaacaggaaaagg

SEQ ID NO: 1135518 - RNA, 23 nt, Human
uccaggguaacaggaaaaggcuc

SEQ ID NO: 1135519 - RNA, 24 nt, Human
uccugaaguguugggauuacaggc

SEQ ID NO: 1135520 - RNA, 24 nt, Human
uccugaguagaugggauuacaggc

SEQ ID NO: 1135521 - RNA, 21 nt, Human
uccuggguucaagcaauucuc

SEQ ID NO: 1135522 - RNA, 24 nt, Human
uccuggguucaagcaauucuccug

SEQ ID NO: 1135523 - RNA, 24 nt, Human
ucgcucugucacccaggcuggagu

SEQ ID NO: 1135524 - RNA, 22 nt, Human
ucuaccauguuggucaggcugg

SEQ ID NO: 1135525 - RNA, 18 nt, Human
ucuccugccucagccucc

SEQ ID NO: 1135526 - RNA, 19 nt, Human
ucucgaacuccugaccucg

SEQ ID NO: 1135527 - RNA, 19 nt, Human
ucucgcucugucacccagg

SEQ ID NO: 1135528 - RNA, 23 nt, Human
ucucgcucugucacccaggcugg

SEQ ID NO: 1135529 - RNA, 24 nt, Human
ucucgcucugucacccaggcugga

SEQ ID NO: 1135530 - RNA, 26 nt, Human
ucucgcucugucacccaggcuggagu

SEQ ID NO: 1135531 - RNA, 27 nt, Human
ucucgcucugucacccaggcuggagug

SEQ ID NO: 1135532 - RNA, 21 nt, Human
ucugauaugggaaacgagcuc

SEQ ID NO: 1135533 - RNA, 24 nt, Human
ucugauaugggaaacgagcucuag

SEQ ID NO: 1135534 - RNA, 24 nt, Human
ucugccuccuggguucaagcaauu

SEQ ID NO: 1135535 - RNA, 24 nt, Human
ucugucacccaggcuggagugcag

SEQ ID NO: 1135536 - RNA, 23 nt, Human
ucuucaguauagaguguucugau

SEQ ID NO: 1135537 - RNA, 21 nt, Human
ugaagacccuugcccagaggu

SEQ ID NO: 1135538 - RNA, 21 nt, Human
ugagcuacacccuguuggcuu

SEQ ID NO: 1135539 - RNA, 22 nt, Human
ugcaguggugugaucucggcuc

SEQ ID NO: 1135540 - RNA, 24 nt, Human
ugccucagccuccugaguagaugg

SEQ ID NO: 1135541 - RNA, 18 nt, Human
ugccuuuacaguguggga

SEQ ID NO: 1135542 - RNA, 19 nt, Human
ugcuugccaggcaccaguc

SEQ ID NO: 1135543 - RNA, 19 nt, Human
uggagugcaguggugugau

SEQ ID NO: 1135544 - RNA, 23 nt, Human
uggagugcaguggugugaucucg

SEQ ID NO: 1135545 - RNA, 24 nt, Human
uggagugcaguggugugaucucgg

SEQ ID NO: 1135546 - RNA, 21 nt, Human
ugggauuacaggcaagugcca

SEQ ID NO: 1135547 - RNA, 22 nt, Human
ugggauuacaggcaagugccac

SEQ ID NO: 1135548 - RNA, 24 nt, Human
ugggauuacaggcaagugccacca

SEQ ID NO: 1135549 - RNA, 18 nt, Human
ugggauuacaggcaugag

SEQ ID NO: 1135550 - RNA, 19 nt, Human
ugggauuacaggcaugagc

SEQ ID NO: 1135551 - RNA, 21 nt, Human
ugggauuacaggcaugagcca

SEQ ID NO: 1135552 - RNA, 22 nt, Human
ugggauuacaggcaugagccac

SEQ ID NO: 1135553 - RNA, 23 nt, Human
ugggauuacaggcaugagccacc

SEQ ID NO: 1135554 - RNA, 24 nt, Human
ugggauuacaggcaugagccaccg

SEQ ID NO: 1135555 - RNA, 24 nt, Human
ugggauuacaggcaugagccaccg

SEQ ID NO: 1135556 - RNA, 26 nt, Human
ugggauuacaggcaugagccaccgcg

SEQ ID NO: 1135557 - RNA, 21 nt, Human
uggguucaagcaauucuccug

SEQ ID NO: 1135558 - RNA, 23 nt, Human
uggguucaagcaauucuccugcc

SEQ ID NO: 1135559 - RNA, 24 nt, Human
uggguucaagcaauucuccugccu

SEQ ID NO: 1135560 - RNA, 24 nt, Human
uggucaggcuggucucgaacuccu

SEQ ID NO: 1135561 - RNA, 21 nt, Human
uguauuuuuaguagagacggg

SEQ ID NO: 1135562 - RNA, 18 nt, Human
uuaguagagacgggguuc

SEQ ID NO: 1135563 - RNA, 24 nt, Human
uuaguagagacgggguucuaccau

SEQ ID NO: 1135564 - RNA, 21 nt, Human
uucaagcaauucuccugccuc

SEQ ID NO: 1135565 - RNA, 24 nt, Human
uucaagcaauucuccugccucagc

SEQ ID NO: 1135566 - RNA, 21 nt, Human
uucuaccauguuggucaggcu

SEQ ID NO: 1135567 - RNA, 23 nt, Human
uuguauuuuuaguagagacgggg

SEQ ID NO: 1135568 - RNA, 20 nt, Human
uuucuccacuccagccgccu

SEQ ID NO: 1135569 - RNA, 24 nt, Human
uuuuuaguagagacgggguucuac

SEQ ID NO: 1135570 - RNA, 20 nt, Human
uuuuuguauuuuuaguagag

SEQ ID NO: 1135571 - RNA, 19 nt, Human
aacaaguguucauugaaaa

SEQ ID NO: 1135572 - RNA, 24 nt, Human
aagcaggaguggacgggaggucgc

SEQ ID NO: 1135573 - RNA, 21 nt, Human
aaucccaaauuggauuaguug

SEQ ID NO: 1135574 - RNA, 18 nt, Human
acccccagcuccugggac

SEQ ID NO: 1135575 - RNA, 26 nt, Human
accuucuccagcaugggcuccugcug

SEQ ID NO: 1135576 - RNA, 22 nt, Human
agaagccaggucagggcuggcc

SEQ ID NO: 1135577 - RNA, 23 nt, Human
agagaacuuuuauuucagaagag

SEQ ID NO: 1135578 - RNA, 23 nt, Human
agagcccacccauggggcccucc

SEQ ID NO: 1135579 - RNA, 23 nt, Human
aggaaaacccaacacgaugacug

SEQ ID NO: 1135580 - RNA, 27 nt, Human
aggccccacagccaggccccacccccu

SEQ ID NO: 1135581 - RNA, 28 nt, Human
aggcucagcagauuacccugggccaaga

SEQ ID NO: 1135582 - RNA, 23 nt, Human
agggagguccccgagugcuggcc

SEQ ID NO: 1135583 - RNA, 18 nt, Human
agggggauuugaggagga

SEQ ID NO: 1135584 - RNA, 19 nt, Human
agugcuggccaggggagga

SEQ ID NO: 1135585 - RNA, 18 nt, Human
augggggcucucugccuc

SEQ ID NO: 1135586 - RNA, 21 nt, Human
augggucuggggugauggggg

SEQ ID NO: 1135587 - RNA, 22 nt, Human
caaauaaacaaauccuuccuuc

SEQ ID NO: 1135588 - RNA, 20 nt, Human
caaaucccaaauuggauuag

SEQ ID NO: 1135589 - RNA, 18 nt, Human
caacacgaugacugcccc

SEQ ID NO: 1135590 - RNA, 24 nt, Human
caacuugccgugacuccccacccc

SEQ ID NO: 1135591 - RNA, 19 nt, Human
caccauguagccgcagugc

SEQ ID NO: 1135592 - RNA, 20 nt, Human
caccauguagccgcagugcc

SEQ ID NO: 1135593 - RNA, 23 nt, Human
caccauguagccgcagugccccg

SEQ ID NO: 1135594 - RNA, 24 nt, Human
cacccccagcuccugggaccugcu

SEQ ID NO: 1135595 - RNA, 23 nt, Human
cacgaugacugccccucgcaggc

SEQ ID NO: 1135596 - RNA, 23 nt, Human
cagaagagugcaaauaaacaaau

SEQ ID NO: 1135597 - RNA, 24 nt, Human
cagagcccacccauggggcccucc

SEQ ID NO: 1135598 - RNA, 23 nt, Human
cagccagucccuggccuccuguu

SEQ ID NO: 1135599 - RNA, 21 nt, Human
cagccgggcccuccaccugcc

SEQ ID NO: 1135600 - RNA, 24 nt, Human
cagccgggcccuccaccugcccca

SEQ ID NO: 1135601 - RNA, 23 nt, Human
cagcuccugggaccugcuggccu

SEQ ID NO: 1135602 - RNA, 22 nt, Human
cagcucugggcagucaggucug

SEQ ID NO: 1135603 - RNA, 23 nt, Human
caggaaugagcuggcacuggagg

SEQ ID NO: 1135604 - RNA, 23 nt, Human
cauaaagagcccggcuggcuuua

SEQ ID NO: 1135605 - RNA, 21 nt, Human
caucugaggcccagugcugcc

SEQ ID NO: 1135606 - RNA, 22 nt, Human
caucugaggcccagugcugccc

SEQ ID NO: 1135607 - RNA, 22 nt, Human
ccaccagguggccccagggccc

SEQ ID NO: 1135608 - RNA, 22 nt, Human
ccacccauggggcccucccaac

SEQ ID NO: 1135609 - RNA, 22 nt, Human
ccacuuuaauccaucaguucca

SEQ ID NO: 1135610 - RNA, 23 nt, Human
ccaguggagguguuugcccuggg

SEQ ID NO: 1135611 - RNA, 19 nt, Human
ccauaacaccuucuccagc

SEQ ID NO: 1135612 - RNA, 19 nt, Human
cccacagccaggccccacc

SEQ ID NO: 1135613 - RNA, 23 nt, Human
cccacagccaggccccaccccca

SEQ ID NO: 1135614 - RNA, 23 nt, Human
cccacccugccuggcucuuccug

SEQ ID NO: 1135615 - RNA, 21 nt, Human
cccagcucccaagcugcgagc

SEQ ID NO: 1135616 - RNA, 23 nt, Human
cccagugcugcccaccucgaauc

SEQ ID NO: 1135617 - RNA, 21 nt, Human
ccccacccccagcuccuggga

SEQ ID NO: 1135618 - RNA, 21 nt, Human
ccccacccugccuggcucuuc

SEQ ID NO: 1135619 - RNA, 21 nt, Human
ccccaccugccagggccugga

SEQ ID NO: 1135620 - RNA, 19 nt, Human
ccccagggccccacccugc

SEQ ID NO: 1135621 - RNA, 21 nt, Human
cccccagcuccugggaccugc

SEQ ID NO: 1135622 - RNA, 21 nt, Human
cccguagugugaaggaugggg

SEQ ID NO: 1135623 - RNA, 22 nt, Human
cccguagugugaaggaugggga

SEQ ID NO: 1135624 - RNA, 20 nt, Human
cccugagcccaccagguggc

SEQ ID NO: 1135625 - RNA, 22 nt, Human
cccugagcccaccagguggccc

SEQ ID NO: 1135626 - RNA, 23 nt, Human
cccugagcccaccagguggcccc

SEQ ID NO: 1135627 - RNA, 25 nt, Human
ccuggcccugagcccaccagguggc

SEQ ID NO: 1135628 - RNA, 26 nt, Human
ccuggcuccuagggguccagccaguc

SEQ ID NO: 1135629 - RNA, 19 nt, Human
cuccagcaugggcuccugc

SEQ ID NO: 1135630 - RNA, 19 nt, Human
cuccugcugcugcugggac

SEQ ID NO: 1135631 - RNA, 19 nt, Human
cuccugggaccugcuggcc

SEQ ID NO: 1135632 - RNA, 19 nt, Human
cuccugggaccugcuggcc

SEQ ID NO: 1135633 - RNA, 23 nt, Human
cugcccaccucgaauccccaaau

SEQ ID NO: 1135634 - RNA, 18 nt, Human
cugcggcugccaggcugg

SEQ ID NO: 1135635 - RNA, 18 nt, Human
cuggccccaccugccagg

SEQ ID NO: 1135636 - RNA, 18 nt, Human
cuuccugcaugggucugg

SEQ ID NO: 1135637 - RNA, 22 nt, Human
cuugguuccacuuuaauccauc

SEQ ID NO: 1135638 - RNA, 23 nt, Human
gaagggcagaaggggacacuggg

SEQ ID NO: 1135639 - RNA, 21 nt, Human
gaaggggacacugggccaccc

SEQ ID NO: 1135640 - RNA, 18 nt, Human
gagagagacccguggagc

SEQ ID NO: 1135641 - RNA, 20 nt, Human
gcaaauaaacaaauccuucc

SEQ ID NO: 1135642 - RNA, 21 nt, Human
gcaggaaaacccaacacgaug

SEQ ID NO: 1135643 - RNA, 23 nt, Human
gccaggccccacccccagcuccu

SEQ ID NO: 1135644 - RNA, 18 nt, Human
gcccugagcccaccaggu

SEQ ID NO: 1135645 - RNA, 22 nt, Human
gcccuggcccugagcccaccuu

SEQ ID NO: 1135646 - RNA, 18 nt, Human
gcccuggggggccggcuc

SEQ ID NO: 1135647 - RNA, 19 nt, Human
gcggcugccaggcugggcu

SEQ ID NO: 1135648 - RNA, 22 nt, Human
ggaaaacccaacacgaugacug

SEQ ID NO: 1135649 - RNA, 21 nt, Human
ggaagccccguagugugaagg

SEQ ID NO: 1135650 - RNA, 18 nt, Human
ggagguguuugcccuggg

SEQ ID NO: 1135651 - RNA, 23 nt, Human
ggccaggggaggaaucugcagug

SEQ ID NO: 1135652 - RNA, 19 nt, Human
ggggaagggcagaagggga

SEQ ID NO: 1135653 - RNA, 24 nt, Human
gggugaugggggcucaucugaggc

SEQ ID NO: 1135654 - RNA, 18 nt, Human
uacaaguaaagaauccag

SEQ ID NO: 1135655 - RNA, 23 nt, Human
uagaaagcagcaaagcugcuaua

SEQ ID NO: 1135656 - RNA, 22 nt, Human
uaggucagggcagccagggcga

SEQ ID NO: 1135657 - RNA, 23 nt, Human
uagugugaaggauggggacaucg

SEQ ID NO: 1135658 - RNA, 18 nt, Human
ucacuuggggcguguaaa

SEQ ID NO: 1135659 - RNA, 24 nt, Human
ucagagcccacccauggggcccuc

SEQ ID NO: 1135660 - RNA, 23 nt, Human
ucagagcccagcucuggccccac

SEQ ID NO: 1135661 - RNA, 22 nt, Human
ucauugaaaagaaacuuggggg

SEQ ID NO: 1135662 - RNA, 24 nt, Human
uccagguaauuuugugguuucugc

SEQ ID NO: 1135663 - RNA, 22 nt, Human
ucccaaauuggauuaguugugu

SEQ ID NO: 1135664 - RNA, 22 nt, Human
ucccaaauuggauuaguugugu

SEQ ID NO: 1135665 - RNA, 18 nt, Human
ucccagcacuuuacaugg

SEQ ID NO: 1135666 - RNA, 18 nt, Human
uccccaccccucuuccca

SEQ ID NO: 1135667 - RNA, 19 nt, Human
uccccaccccucuucccag

SEQ ID NO: 1135668 - RNA, 18 nt, Human
uccugggaccugcuggcc

SEQ ID NO: 1135669 - RNA, 22 nt, Human
ucucagcaggcaagguaggggg

SEQ ID NO: 1135670 - RNA, 22 nt, Human
ucucaggaaugagcuggcacug

SEQ ID NO: 1135671 - RNA, 21 nt, Human
ugacuccccaccccucuuccc

SEQ ID NO: 1135672 - RNA, 23 nt, Human
ugagcccaccagguggccccagg

SEQ ID NO: 1135673 - RNA, 25 nt, Human
ugaggcccagugcugcccaccucga

SEQ ID NO: 1135674 - RNA, 21 nt, Human
ugcaaauaaacaaauccuucc

SEQ ID NO: 1135675 - RNA, 28 nt, Human
ugcaaauaaacaaauccuuccuuccccc

SEQ ID NO: 1135676 - RNA, 21 nt, Human
ugccagggccuggaugagccc

SEQ ID NO: 1135677 - RNA, 24 nt, Human
ugccccauaacaccuucuccagca

SEQ ID NO: 1135678 - RNA, 18 nt, Human
ugcccuggggggccggcu

SEQ ID NO: 1135679 - RNA, 21 nt, Human
ugcuggagucaccauguagcc

SEQ ID NO: 1135680 - RNA, 22 nt, Human
ugcugggacaaccaagcaggag

SEQ ID NO: 1135681 - RNA, 21 nt, Human
uggaauugaauugaaucuguc

SEQ ID NO: 1135682 - RNA, 18 nt, Human
uggccaggggaggaaucu

SEQ ID NO: 1135683 - RNA, 21 nt, Human
uggccaggggaggaaucugca

SEQ ID NO: 1135684 - RNA, 21 nt, Human
uggccccagggccccacccug

SEQ ID NO: 1135685 - RNA, 23 nt, Human
ugggcagucaggucugcccagug

SEQ ID NO: 1135686 - RNA, 23 nt, Human
uggggcaagccuggacccucaac

SEQ ID NO: 1135687 - RNA, 20 nt, Human
uggguacagaggucagagcc

SEQ ID NO: 1135688 - RNA, 20 nt, Human
ugguugccggcuaaggaggg

SEQ ID NO: 1135689 - RNA, 21 nt, Human
ugugugagggggauuugagga

SEQ ID NO: 1135690 - RNA, 22 nt, Human
uuccauuucugauaaauguccc

SEQ ID NO: 1135691 - RNA, 25 nt, Human
uugccgugacuccccaccccucuuc

SEQ ID NO: 1135692 - RNA, 22 nt, Human
accugaaucaaggaguuaaggc

SEQ ID NO: 1135693 - RNA, 21 nt, Human
ccugaaucaaggaguuaaggc

SEQ ID NO: 1135694 - RNA, 25 nt, Human
ccugaaucaaggaguuaaggcagcc

SEQ ID NO: 1135695 - RNA, 21 nt, Human
aacucugcuucugaucccaca

SEQ ID NO: 1135696 - RNA, 23 nt, Human
aauagguccuuggauucugcaac

SEQ ID NO: 1135697 - RNA, 20 nt, Human
aauugcauagagucuccccc

SEQ ID NO: 1135698 - RNA, 20 nt, Human
acaaaaauagguccuuggau

SEQ ID NO: 1135699 - RNA, 21 nt, Human
accaucaaaucuccccaccac

SEQ ID NO: 1135700 - RNA, 20 nt, Human
aggcagucaaaccuuggaug

SEQ ID NO: 1135701 - RNA, 20 nt, Human
aguacaaucaucacugcacu

SEQ ID NO: 1135702 - RNA, 19 nt, Human
auagagucucccccgaagc

SEQ ID NO: 1135703 - RNA, 20 nt, Human
auagagucucccccgaagca

SEQ ID NO: 1135704 - RNA, 23 nt, Human
aucaaaucuccccaccacauaaa

SEQ ID NO: 1135705 - RNA, 18 nt, Human
augauaggguuguaacau

SEQ ID NO: 1135706 - RNA, 20 nt, Human
augcuccucuggucaauguu

SEQ ID NO: 1135707 - RNA, 22 nt, Human
auguacuguuuccguguacaca

SEQ ID NO: 1135708 - RNA, 24 nt, Human
auucaaugcuacuuagcagggacu

SEQ ID NO: 1135709 - RNA, 20 nt, Human
caaagccuccagagacauag

SEQ ID NO: 1135710 - RNA, 23 nt, Human
caccagcaucacagcgcuggguu

SEQ ID NO: 1135711 - RNA, 18 nt, Human
cagcacaaucucaugggc

SEQ ID NO: 1135712 - RNA, 20 nt, Human
caggaggagccgaagcgucg

SEQ ID NO: 1135713 - RNA, 25 nt, Human
cauaaagcagugcggagaaagaaca

SEQ ID NO: 1135714 - RNA, 23 nt, Human
caucaaaucuccccaccacauaa

SEQ ID NO: 1135715 - RNA, 24 nt, Human
caucaaaucuccccaccacauaaa

SEQ ID NO: 1135716 - RNA, 18 nt, Human
caucacagcgcuggguuc

SEQ ID NO: 1135717 - RNA, 18 nt, Human
cauguacuguuuccgugu

SEQ ID NO: 1135718 - RNA, 20 nt, Human
ccagcacaaucucaugggca

SEQ ID NO: 1135719 - RNA, 21 nt, Human
ccagggccuguccccagccug

SEQ ID NO: 1135720 - RNA, 20 nt, Human
ccaguguccuguaugagggu

SEQ ID NO: 1135721 - RNA, 21 nt, Human
cccacacagccgcgccagggc

SEQ ID NO: 1135722 - RNA, 20 nt, Human
cccagccuguggggauggag

SEQ ID NO: 1135723 - RNA, 23 nt, Human
cccccgaagcacuguggccccua

SEQ ID NO: 1135724 - RNA, 26 nt, Human
cccuacauagcaucguggagugguca

SEQ ID NO: 1135725 - RNA, 24 nt, Human
cugcuucugaucccacacagccgc

SEQ ID NO: 1135726 - RNA, 24 nt, Human
cugucugcauaucucccagcaugc

SEQ ID NO: 1135727 - RNA, 18 nt, Human
cuguggggauggaguggg

SEQ ID NO: 1135728 - RNA, 24 nt, Human
gcaacucugcuucugaucccacac

SEQ ID NO: 1135729 - RNA, 22 nt, Human
gcaccagaacgcuugguggcca

SEQ ID NO: 1135730 - RNA, 20 nt, Human
gccuguaaucacccugugca

SEQ ID NO: 1135731 - RNA, 20 nt, Human
ggcaggaaagucuuucugcu

SEQ ID NO: 1135732 - RNA, 20 nt, Human
guccuuggauucugcaacuc

SEQ ID NO: 1135733 - RNA, 19 nt, Human
gugcuccaacaauggucac

SEQ ID NO: 1135734 - RNA, 20 nt, Human
uaaaauuuccaugguagagg

SEQ ID NO: 1135735 - RNA, 22 nt, Human
uaaagcagugcggagaaagaac

SEQ ID NO: 1135736 - RNA, 24 nt, Human
uaaagcagugcggagaaagaacaa

SEQ ID NO: 1135737 - RNA, 24 nt, Human
uagaaaggauucuugauucuccca

SEQ ID NO: 1135738 - RNA, 19 nt, Human
uagcucuggauggugcucc

SEQ ID NO: 1135739 - RNA, 23 nt, Human
uagguccuuggauucugcaacuc

SEQ ID NO: 1135740 - RNA, 18 nt, Human
ucacuucuuguggagaac

SEQ ID NO: 1135741 - RNA, 21 nt, Human
uccaucaaagccuccagagac

SEQ ID NO: 1135742 - RNA, 22 nt, Human
ucccagggugguggcuccagca

SEQ ID NO: 1135743 - RNA, 21 nt, Human
ucucccagcaugcuccucugg

SEQ ID NO: 1135744 - RNA, 23 nt, Human
ucucccagcaugcuccucugguc

SEQ ID NO: 1135745 - RNA, 18 nt, Human
ucucccagggugguggcu

SEQ ID NO: 1135746 - RNA, 21 nt, Human
ucuggucaauguuuggaucau

SEQ ID NO: 1135747 - RNA, 21 nt, Human
ugcauagagucucccccgaag

SEQ ID NO: 1135748 - RNA, 19 nt, Human
uggggugcggguccagcag

SEQ ID NO: 1135749 - RNA, 23 nt, Human
uguggggauggaguggggugcgg

SEQ ID NO: 1135750 - RNA, 22 nt, Human
uucugaucccacacagccgcgc

SEQ ID NO: 1135751 - RNA, 21 nt, Human
uucugcaacucugcuucugau

SEQ ID NO: 1135752 - RNA, 21 nt, Human
uuguaugcuucaacggaagaa

SEQ ID NO: 1135753 - RNA, 21 nt, Human
uuugggggccauaaugccucc

SEQ ID NO: 1135754 - RNA, 20 nt, Human
agcucugggccuagguuccu

SEQ ID NO: 1135755 - RNA, 19 nt, Human
aggaacgggacacaucccc

SEQ ID NO: 1135756 - RNA, 19 nt, Human
aggccgcccggggguccac

SEQ ID NO: 1135757 - RNA, 19 nt, Human
aggcggcgucgaugucggc

SEQ ID NO: 1135758 - RNA, 21 nt, Human
agguuccuggugcgcagggcc

SEQ ID NO: 1135759 - RNA, 18 nt, Human
auccccaguggaggcccu

SEQ ID NO: 1135760 - RNA, 23 nt, Human
cacagccccugggucggggcagg

SEQ ID NO: 1135761 - RNA, 21 nt, Human
cacaugcagccccuggggggc

SEQ ID NO: 1135762 - RNA, 23 nt, Human
cagcccagcccuaccaccugcua

SEQ ID NO: 1135763 - RNA, 18 nt, Human
ccacaugcagccccuggg

SEQ ID NO: 1135764 - RNA, 24 nt, Human
ccagcccagcccuaccaccugcua

SEQ ID NO: 1135765 - RNA, 18 nt, Human
ccaguggaggcccugggc

SEQ ID NO: 1135766 - RNA, 23 nt, Human
cccccagcugccaccuggauguc

SEQ ID NO: 1135767 - RNA, 22 nt, Human
ccccuaggccgcccgggggucc

SEQ ID NO: 1135768 - RNA, 19 nt, Human
ccccuggggggccggcgcg

SEQ ID NO: 1135769 - RNA, 21 nt, Human
cccugggcaugcucuggccuc

SEQ ID NO: 1135770 - RNA, 19 nt, Human
cccugggucggggcagggu

SEQ ID NO: 1135771 - RNA, 22 nt, Human
ccuaggccgcccggggguccac

SEQ ID NO: 1135772 - RNA, 20 nt, Human
cgggggccgccuuauugcug

SEQ ID NO: 1135773 - RNA, 23 nt, Human
cgggggccgccuuauugcugagg

SEQ ID NO: 1135774 - RNA, 23 nt, Human
cggggugagguccgggggccgcc

SEQ ID NO: 1135775 - RNA, 22 nt, Human
cugagguccggccgguuggggc

SEQ ID NO: 1135776 - RNA, 24 nt, Human
cugccaccuggaugucaccacuca

SEQ ID NO: 1135777 - RNA, 18 nt, Human
gagguccggccgguuggg

SEQ ID NO: 1135778 - RNA, 20 nt, Human
gcagccccuggggggccggc

SEQ ID NO: 1135779 - RNA, 23 nt, Human
gcugagguccggccgguuggggc

SEQ ID NO: 1135780 - RNA, 18 nt, Human
ggucggggcagggucccc

SEQ ID NO: 1135781 - RNA, 18 nt, Human
guugcaguggaggcggga

SEQ ID NO: 1135782 - RNA, 24 nt, Human
uacagucaggagcccccagcugcc

SEQ ID NO: 1135783 - RNA, 24 nt, Human
uccccaguggaggcccugggcaug

SEQ ID NO: 1135784 - RNA, 18 nt, Human
uccccuaggccgcccggg

SEQ ID NO: 1135785 - RNA, 25 nt, Human
uccccuaggccgcccggggguccac

SEQ ID NO: 1135786 - RNA, 21 nt, Human
ucggggcaggguccccuaggc

SEQ ID NO: 1135787 - RNA, 21 nt, Human
ucuguuuucacauauuuucuu

SEQ ID NO: 1135788 - RNA, 18 nt, Human
ugagguccgggggccgcc

SEQ ID NO: 1135789 - RNA, 25 nt, Human
ugcucuggccucccccucacagcuc

SEQ ID NO: 1135790 - RNA, 22 nt, Human
uggggggccggcgcggggugag

SEQ ID NO: 1135791 - RNA, 20 nt, Human
aaaaacccaaccugcuacuu

SEQ ID NO: 1135792 - RNA, 19 nt, Human
aaaauaaaacaagcuauga

SEQ ID NO: 1135793 - RNA, 18 nt, Human
aagacaucaaauacauua

SEQ ID NO: 1135794 - RNA, 23 nt, Human
aagcuagcacagcgccagggaca

SEQ ID NO: 1135795 - RNA, 21 nt, Human
aaggccacuguuccuccugua

SEQ ID NO: 1135796 - RNA, 21 nt, Human
aaggcuuuuagaggaaaacca

SEQ ID NO: 1135797 - RNA, 20 nt, Human
aaggggcugugcacauagca

SEQ ID NO: 1135798 - RNA, 21 nt, Human
acaaaauaaaacaagcuauga

SEQ ID NO: 1135799 - RNA, 18 nt, Human
acacagcacagacauggc

SEQ ID NO: 1135800 - RNA, 22 nt, Human
acagaguaucccugccucauua

SEQ ID NO: 1135801 - RNA, 19 nt, Human
acagcacagacauggcuga

SEQ ID NO: 1135802 - RNA, 18 nt, Human
acaggguucccagaauuc

SEQ ID NO: 1135803 - RNA, 23 nt, Human
accaaaguccucaaacggcagcc

SEQ ID NO: 1135804 - RNA, 20 nt, Human
accaggguccacaagggaga

SEQ ID NO: 1135805 - RNA, 22 nt, Human
acccaaaauaagccaaccugac

SEQ ID NO: 1135806 - RNA, 18 nt, Human
accuaaccagaagcggca

SEQ ID NO: 1135807 - RNA, 20 nt, Human
acuaaaacacuaagacauca

SEQ ID NO: 1135808 - RNA, 21 nt, Human
agagcucagugguguccacag

SEQ ID NO: 1135809 - RNA, 21 nt, Human
agaugaucaguaaaugaaagc

SEQ ID NO: 1135810 - RNA, 24 nt, Human
agauuccuuuaguuacagcagcuu

SEQ ID NO: 1135811 - RNA, 21 nt, Human
auaaaacaagcuaugaucccc

SEQ ID NO: 1135812 - RNA, 24 nt, Human
augaccauuaauucugucucagga

SEQ ID NO: 1135813 - RNA, 18 nt, Human
caaaguaauccaaggggc

SEQ ID NO: 1135814 - RNA, 21 nt, Human
caaaguccucaaacggcagcc

SEQ ID NO: 1135815 - RNA, 26 nt, Human
caaaguccucaaacggcagccgguca

SEQ ID NO: 1135816 - RNA, 25 nt, Human
caagugcccuccaacccacugcucu

SEQ ID NO: 1135817 - RNA, 18 nt, Human
caaguuuuuaaccaguca

SEQ ID NO: 1135818 - RNA, 25 nt, Human
cacacagcacagacauggcugacuc

SEQ ID NO: 1135819 - RNA, 25 nt, Human
cacagcagaugaucaguaaaugaaa

SEQ ID NO: 1135820 - RNA, 21 nt, Human
cacgaagcugagcugaggcag

SEQ ID NO: 1135821 - RNA, 23 nt, Human
cacuaucauaaaaacccaaccug

SEQ ID NO: 1135822 - RNA, 19 nt, Human
cacuggccaaagggcaaac

SEQ ID NO: 1135823 - RNA, 21 nt, Human
cagaaccagcacagcguccac

SEQ ID NO: 1135824 - RNA, 25 nt, Human
cagcacagacauggcugacuccugu

SEQ ID NO: 1135825 - RNA, 21 nt, Human
cagcguccacaccgacagcag

SEQ ID NO: 1135826 - RNA, 18 nt, Human
cagggacacaugagcucc

SEQ ID NO: 1135827 - RNA, 21 nt, Human
caggugaaaaaccauagugag

SEQ ID NO: 1135828 - RNA, 20 nt, Human
cauaaaaacccaaccugcua

SEQ ID NO: 1135829 - RNA, 23 nt, Human
cauaaaaacccaaccugcuacuu

SEQ ID NO: 1135830 - RNA, 23 nt, Human
ccacaacugcauuauuuugugug

SEQ ID NO: 1135831 - RNA, 22 nt, Human
ccauggcgauaguuuucccaaa

SEQ ID NO: 1135832 - RNA, 19 nt, Human
cccaggugaaaaaccauag

SEQ ID NO: 1135833 - RNA, 22 nt, Human
ccccaaaaauaauuuuaaaagc

SEQ ID NO: 1135834 - RNA, 22 nt, Human
ccuaaaguacccccaacucuga

SEQ ID NO: 1135835 - RNA, 21 nt, Human
ccugaacccaaaauaagccaa

SEQ ID NO: 1135836 - RNA, 22 nt, Human
ccuguaccgcagguccuucccg

SEQ ID NO: 1135837 - RNA, 24 nt, Human
ccuguccuucugcuccuuuagaaa

SEQ ID NO: 1135838 - RNA, 20 nt, Human
ccuucccaggugaaaaacca

SEQ ID NO: 1135839 - RNA, 23 nt, Human
cucccuagucacuaaaacacuaa

SEQ ID NO: 1135840 - RNA, 18 nt, Human
cugaggcuuuucuuuacc

SEQ ID NO: 1135841 - RNA, 22 nt, Human
cugccucauuaaaaaaacugac

SEQ ID NO: 1135842 - RNA, 19 nt, Human
cugcuacauggcaaaacaa

SEQ ID NO: 1135843 - RNA, 21 nt, Human
cugcuacauggcaaaacaagg

SEQ ID NO: 1135844 - RNA, 21 nt, Human
cuggccaagugcccuccaacc

SEQ ID NO: 1135845 - RNA, 21 nt, Human
cugggcuucagugaguggagg

SEQ ID NO: 1135846 - RNA, 22 nt, Human
gaaaacuggccaagugcccucc

SEQ ID NO: 1135847 - RNA, 21 nt, Human
gaacccaaaauaagccaaccu

SEQ ID NO: 1135848 - RNA, 20 nt, Human
gacacaugagcucccaggag

SEQ ID NO: 1135849 - RNA, 18 nt, Human
gaccaguggggaacccag

SEQ ID NO: 1135850 - RNA, 20 nt, Human
gaccuguccuucugcuccuu

SEQ ID NO: 1135851 - RNA, 19 nt, Human
gaggcagcagugcugcauu

SEQ ID NO: 1135852 - RNA, 23 nt, Human
gcacagcgccagggacacaugag

SEQ ID NO: 1135853 - RNA, 24 nt, Human
gcacgaagcugagcugaggcagca

SEQ ID NO: 1135854 - RNA, 19 nt, Human
gccugaacccaaaauaagc

SEQ ID NO: 1135855 - RNA, 22 nt, Human
gccugaacccaaaauaagccaa

SEQ ID NO: 1135856 - RNA, 23 nt, Human
ggaguugaggcagagcucagugg

SEQ ID NO: 1135857 - RNA, 25 nt, Human
ggcaaaacaagguaagcaaagguuu

SEQ ID NO: 1135858 - RNA, 18 nt, Human
ggucucccuagucacuaa

SEQ ID NO: 1135859 - RNA, 22 nt, Human
guacauucacugaaaagcugaa

SEQ ID NO: 1135860 - RNA, 20 nt, Human
gugcagagcaggaggcgguc

SEQ ID NO: 1135861 - RNA, 19 nt, Human
guucuuuucagauuccuuu

SEQ ID NO: 1135862 - RNA, 18 nt, Human
uaaaacaaaguaauccaa

SEQ ID NO: 1135863 - RNA, 19 nt, Human
uaaaacacuaagacaucaa

SEQ ID NO: 1135864 - RNA, 19 nt, Human
uaaaauguucauauuccuc

SEQ ID NO: 1135865 - RNA, 22 nt, Human
uaaacaccuggcaaaaaaccac

SEQ ID NO: 1135866 - RNA, 23 nt, Human
uaaacaccuggcaaaaaaccaca

SEQ ID NO: 1135867 - RNA, 19 nt, Human
uaaacagcuguaaaggaaa

SEQ ID NO: 1135868 - RNA, 23 nt, Human
uaaacuaguuaauggucucccua

SEQ ID NO: 1135869 - RNA, 24 nt, Human
uaaagaaaaauugaaaaauggcug

SEQ ID NO: 1135870 - RNA, 21 nt, Human
uaaaggauuaauuauaaacac

SEQ ID NO: 1135871 - RNA, 23 nt, Human
uaaaucucaaaaccuaggaaccu

SEQ ID NO: 1135872 - RNA, 24 nt, Human
uaaaucucaaaaccuaggaaccuc

SEQ ID NO: 1135873 - RNA, 23 nt, Human
uaaccagucaaugcccucuagua

SEQ ID NO: 1135874 - RNA, 20 nt, Human
uaagacaucaaauacauuaa

SEQ ID NO: 1135875 - RNA, 18 nt, Human
uaagagguuaauaaccau

SEQ ID NO: 1135876 - RNA, 21 nt, Human
uaagccaaccugacacaccua

SEQ ID NO: 1135877 - RNA, 18 nt, Human
uacagcaguuaucugccu

SEQ ID NO: 1135878 - RNA, 23 nt, Human
uacuaggggcauaguccuccggu

SEQ ID NO: 1135879 - RNA, 19 nt, Human
uagcacagcgccagggaca

SEQ ID NO: 1135880 - RNA, 24 nt, Human
uagcauggcacaccacaacugcau

SEQ ID NO: 1135881 - RNA, 21 nt, Human
uaggaaccuccagacagggcc

SEQ ID NO: 1135882 - RNA, 23 nt, Human
uauaaacaccuggcaaaaaacca

SEQ ID NO: 1135883 - RNA, 22 nt, Human
uauauaccaguuggcuuguaug

SEQ ID NO: 1135884 - RNA, 23 nt, Human
ucacuggccaaagggcaaacacu

SEQ ID NO: 1135885 - RNA, 18 nt, Human
ucagugaguggaguugaa

SEQ ID NO: 1135886 - RNA, 22 nt, Human
uccaaacaugagcacagaaggu

SEQ ID NO: 1135887 - RNA, 19 nt, Human
uccacaccgacagcaguua

SEQ ID NO: 1135888 - RNA, 19 nt, Human
uccacagaaagcauuaguc

SEQ ID NO: 1135889 - RNA, 21 nt, Human
uccagacagggccacagucac

SEQ ID NO: 1135890 - RNA, 23 nt, Human
ucccaaaugaccauuaauucugu

SEQ ID NO: 1135891 - RNA, 21 nt, Human
ucccaggagggcacagcuguc

SEQ ID NO: 1135892 - RNA, 23 nt, Human
ucccaggagggcacagcuguccu

SEQ ID NO: 1135893 - RNA, 21 nt, Human
ucccuaaaguacccccaacuc

SEQ ID NO: 1135894 - RNA, 23 nt, Human
ucccugccucauuaaaaaaacug

SEQ ID NO: 1135895 - RNA, 21 nt, Human
uccuguaccgcagguccuucc

SEQ ID NO: 1135896 - RNA, 19 nt, Human
ucuaggucugcuguguucc

SEQ ID NO: 1135897 - RNA, 24 nt, Human
ucugcuccuuuagaaaacagaacc

SEQ ID NO: 1135898 - RNA, 18 nt, Human
ugaacgauucauuaauga

SEQ ID NO: 1135899 - RNA, 22 nt, Human
ugacuccuguaccgcagguccu

SEQ ID NO: 1135900 - RNA, 18 nt, Human
ugagcaaacaucacaaga

SEQ ID NO: 1135901 - RNA, 24 nt, Human
ugagcucccaggagggcacagcug

SEQ ID NO: 1135902 - RNA, 22 nt, Human
ugaggcagagcucagugguguc

SEQ ID NO: 1135903 - RNA, 23 nt, Human
ugaguuaauuuaacauccaaaua

SEQ ID NO: 1135904 - RNA, 24 nt, Human
ugcacuaucauaaaaacccaaccu

SEQ ID NO: 1135905 - RNA, 19 nt, Human
ugccgcagaccgugcagag

SEQ ID NO: 1135906 - RNA, 22 nt, Human
ugcuacauggcaaaacaaggua

SEQ ID NO: 1135907 - RNA, 21 nt, Human
ugcuacgccaggccugaaccc

SEQ ID NO: 1135908 - RNA, 23 nt, Human
ugcucuaaaucucaaaaccuagg

SEQ ID NO: 1135909 - RNA, 21 nt, Human
uggaugaaccacacguauaua

SEQ ID NO: 1135910 - RNA, 20 nt, Human
ugguguccacagaaagcauu

SEQ ID NO: 1135911 - RNA, 20 nt, Human
ugugcacauagcauggcaca

SEQ ID NO: 1135912 - RNA, 21 nt, Human
uuaauggucucccuagucacu

SEQ ID NO: 1135913 - RNA, 21 nt, Human
uuaauucugucucaggaacac

SEQ ID NO: 1135914 - RNA, 24 nt, Human
uuagucuuagguacuguguuaaaa

SEQ ID NO: 1135915 - RNA, 19 nt, Human
uuaugaacacccacccucu

SEQ ID NO: 1135916 - RNA, 19 nt, Human
uucagugaguggaguugaa

SEQ ID NO: 1135917 - RNA, 20 nt, Human
uuccucugagcaaacaucac

SEQ ID NO: 1135918 - RNA, 18 nt, Human
uucucuggcagccugacg

SEQ ID NO: 1135919 - RNA, 23 nt, Human
uuuccuucccaggugaaaaacca

SEQ ID NO: 1135920 - RNA, 22 nt, Human
uuuguguguugucugcuacaug

SEQ ID NO: 1135921 - RNA, 21 nt, Human
agggaagcccugugacuguga

SEQ ID NO: 1135922 - RNA, 20 nt, Human
gaaccggggucuagggaagc

SEQ ID NO: 1135923 - RNA, 27 nt, Human
ggaagcccugugacuguggugaccuca

SEQ ID NO: 1135924 - RNA, 19 nt, Human
gucuagggaagcccuguga

SEQ ID NO: 1135925 - RNA, 21 nt, Human
ucaguucggggagguuaaggg

SEQ ID NO: 1135926 - RNA, 23 nt, Human
ugacugugacucagucacagaug

SEQ ID NO: 1135927 - RNA, 21 nt, Human
acacagccacuauggccacac

SEQ ID NO: 1135928 - RNA, 20 nt, Human
acacagccacuauggccacc

SEQ ID NO: 1135929 - RNA, 19 nt, Human
acaugcaccaggcucugcc

SEQ ID NO: 1135930 - RNA, 21 nt, Human
agacagaaugcucuggugagg

SEQ ID NO: 1135931 - RNA, 24 nt, Human
agcacuuugggaggcugaggcagg

SEQ ID NO: 1135932 - RNA, 20 nt, Human
aggcugaggcaggaagacug

SEQ ID NO: 1135933 - RNA, 22 nt, Human
cacaggucucuauguaacaacg

SEQ ID NO: 1135934 - RNA, 24 nt, Human
cagcacuuugggaggcugaggcag

SEQ ID NO: 1135935 - RNA, 24 nt, Human
cagcacuuugggaggcugaggcag

SEQ ID NO: 1135936 - RNA, 19 nt, Human
cagccacuauggccacacu

SEQ ID NO: 1135937 - RNA, 18 nt, Human
cagcgucugguugacccg

SEQ ID NO: 1135938 - RNA, 18 nt, Human
cauugcauuuauccacug

SEQ ID NO: 1135939 - RNA, 21 nt, Human
cccaagaguucaaggccagca

SEQ ID NO: 1135940 - RNA, 18 nt, Human
cccaggcucagggcuccc

SEQ ID NO: 1135941 - RNA, 24 nt, Human
cccaugacuguaauuccagcacuu

SEQ ID NO: 1135942 - RNA, 22 nt, Human
cccggaggcccaggcccaggcu

SEQ ID NO: 1135943 - RNA, 19 nt, Human
ccuggaggucaaagcagcu

SEQ ID NO: 1135944 - RNA, 19 nt, Human
cuguaauuccagcacuuug

SEQ ID NO: 1135945 - RNA, 20 nt, Human
gacccggaggcccaggccca

SEQ ID NO: 1135946 - RNA, 19 nt, Human
gaguucaaggccagcagga

SEQ ID NO: 1135947 - RNA, 23 nt, Human
gcccaggcccaggcucagggcuc

SEQ ID NO: 1135948 - RNA, 24 nt, Human
gcucagaaggugucuccaucagau

SEQ ID NO: 1135949 - RNA, 19 nt, Human
ggagacugucucucauguu

SEQ ID NO: 1135950 - RNA, 21 nt, Human
uacccuggaggucaaagcagc

SEQ ID NO: 1135951 - RNA, 24 nt, Human
uauaggaaucacaggucucuaugu

SEQ ID NO: 1135952 - RNA, 22 nt, Human
uauauacccuggaggucaaagc

SEQ ID NO: 1135953 - RNA, 24 nt, Human
uauccacuggugggcauuuucacu

SEQ ID NO: 1135954 - RNA, 22 nt, Human
ucuauguaacaacgaugaacuc

SEQ ID NO: 1135955 - RNA, 18 nt, Human
ucugccggagaugcuuua

SEQ ID NO: 1135956 - RNA, 20 nt, Human
ucugccggagaugcuuuauu

SEQ ID NO: 1135957 - RNA, 25 nt, Human
ucuuucaaguauauacccuggaggu

SEQ ID NO: 1135958 - RNA, 21 nt, Human
ugauuggagaugaggaagcca

SEQ ID NO: 1135959 - RNA, 18 nt, Human
ugggaggcugaggcagga

SEQ ID NO: 1135960 - RNA, 20 nt, Human
ugggaggcugaggcaggaag

SEQ ID NO: 1135961 - RNA, 22 nt, Human
uucagcccaagaguucaaggcc

SEQ ID NO: 1135962 - RNA, 24 nt, Human
uuccagcacuuugggaggcugagg

SEQ ID NO: 1135963 - RNA, 24 nt, Human
uugccaaauaauauuccacuguau

SEQ ID NO: 1135964 - RNA, 23 nt, Human
aaaaagcaggggaccaaaacuga

SEQ ID NO: 1135965 - RNA, 25 nt, Human
aaaucacauccuacucaucagcaag

SEQ ID NO: 1135966 - RNA, 23 nt, Human
aacaaucuugaacccuuugucac

SEQ ID NO: 1135967 - RNA, 21 nt, Human
aacagcacccucugcuucggu

SEQ ID NO: 1135968 - RNA, 26 nt, Human
aaccucaaaaagcaggggaccaaaac

SEQ ID NO: 1135969 - RNA, 19 nt, Human
aagcaugguuucaaacaug

SEQ ID NO: 1135970 - RNA, 20 nt, Human
aaggaggccgcugcauuucc

SEQ ID NO: 1135971 - RNA, 19 nt, Human
aaucugucagaugcccuuc

SEQ ID NO: 1135972 - RNA, 22 nt, Human
acaccgggucugaccucccagc

SEQ ID NO: 1135973 - RNA, 21 nt, Human
acagagucucacucuguugac

SEQ ID NO: 1135974 - RNA, 20 nt, Human
acaggcugcuaaccccaggc

SEQ ID NO: 1135975 - RNA, 20 nt, Human
acgagccccucagucuuggg

SEQ ID NO: 1135976 - RNA, 25 nt, Human
acucuguugaccaggcuggagugua

SEQ ID NO: 1135977 - RNA, 18 nt, Human
agaacucaaguuaaggcc

SEQ ID NO: 1135978 - RNA, 21 nt, Human
agaaggcucugugugcagccc

SEQ ID NO: 1135979 - RNA, 18 nt, Human
agagagguccaaggugcc

SEQ ID NO: 1135980 - RNA, 22 nt, Human
agcacucugggagggcuguggg

SEQ ID NO: 1135981 - RNA, 23 nt, Human
agcacucugggagggcugugggc

SEQ ID NO: 1135982 - RNA, 18 nt, Human
agcagcugcucuagcggc

SEQ ID NO: 1135983 - RNA, 18 nt, Human
agccuuuccaccaccucc

SEQ ID NO: 1135984 - RNA, 19 nt, Human
agcugcccugggcuggaga

SEQ ID NO: 1135985 - RNA, 19 nt, Human
agcugccucccgccuuggc

SEQ ID NO: 1135986 - RNA, 22 nt, Human
agcugccucccgccuuggcuuc

SEQ ID NO: 1135987 - RNA, 23 nt, Human
aggaaggaaggcagggcuugcag

SEQ ID NO: 1135988 - RNA, 18 nt, Human
aggaaggcagggcuugca

SEQ ID NO: 1135989 - RNA, 19 nt, Human
aggcauggaggaggugggc

SEQ ID NO: 1135990 - RNA, 22 nt, Human
agggcuaaacacuggugcccag

SEQ ID NO: 1135991 - RNA, 22 nt, Human
agggcugugggcaugagcagcg

SEQ ID NO: 1135992 - RNA, 20 nt, Human
agggggugguggcaggaguu

SEQ ID NO: 1135993 - RNA, 19 nt, Human
aggucugccucccgggccc

SEQ ID NO: 1135994 - RNA, 19 nt, Human
agugcuccauggcccaggc

SEQ ID NO: 1135995 - RNA, 19 nt, Human
augagcagcgaggacucca

SEQ ID NO: 1135996 - RNA, 21 nt, Human
caaauugaaggcaggauccca

SEQ ID NO: 1135997 - RNA, 22 nt, Human
caaccucaaaaagcaggggacc

SEQ ID NO: 1135998 - RNA, 22 nt, Human
cacagcacguggguggcaggac

SEQ ID NO: 1135999 - RNA, 27 nt, Human
cacagcacguggguggcaggaccaaca

SEQ ID NO: 1136000 - RNA, 19 nt, Human
cacagccccucugccucuc

SEQ ID NO: 1136001 - RNA, 19 nt, Human
caccacgccccacccccaa

SEQ ID NO: 1136002 - RNA, 21 nt, Human
caccauuguaaaaaaaauaaa

SEQ ID NO: 1136003 - RNA, 28 nt, Human
cacccccaacugcacggcagccacucgc

SEQ ID NO: 1136004 - RNA, 20 nt, Human
cacccucugcuucgguccuc

SEQ ID NO: 1136005 - RNA, 18 nt, Human
cacggcagccacucgcau

SEQ ID NO: 1136006 - RNA, 24 nt, Human
cacucuguugaccaggcuggagug

SEQ ID NO: 1136007 - RNA, 21 nt, Human
cagaggagaaaagcacuuagc

SEQ ID NO: 1136008 - RNA, 20 nt, Human
cagagggcaucggugagcac

SEQ ID NO: 1136009 - RNA, 18 nt, Human
cagcagcucccccacaua

SEQ ID NO: 1136010 - RNA, 20 nt, Human
cagugcguggaggagaucgg

SEQ ID NO: 1136011 - RNA, 24 nt, Human
caucagcaaggcggguagacauca

SEQ ID NO: 1136012 - RNA, 22 nt, Human
ccaaaacaaaacaaaaaaaauc

SEQ ID NO: 1136013 - RNA, 24 nt, Human
ccaaaacaaaacaaaaaaaaucug

SEQ ID NO: 1136014 - RNA, 19 nt, Human
ccaaaacugagccuauccu

SEQ ID NO: 1136015 - RNA, 21 nt, Human
ccaaaacugagccuauccugg

SEQ ID NO: 1136016 - RNA, 20 nt, Human
ccaacuucgcagagggcauc

SEQ ID NO: 1136017 - RNA, 19 nt, Human
ccaagugggugaaaugguc

SEQ ID NO: 1136018 - RNA, 24 nt, Human
ccaccgcucuggcacgagccccuc

SEQ ID NO: 1136019 - RNA, 18 nt, Human
ccacgugcacugcugccc

SEQ ID NO: 1136020 - RNA, 23 nt, Human
ccaggugcucuugccaugggucc

SEQ ID NO: 1136021 - RNA, 19 nt, Human
ccagucaaucagaagcaaa

SEQ ID NO: 1136022 - RNA, 22 nt, Human
ccaugcugagccuccccugccu

SEQ ID NO: 1136023 - RNA, 19 nt, Human
cccaggauggaaucuggcu

SEQ ID NO: 1136024 - RNA, 20 nt, Human
cccagggcaggggucaggga

SEQ ID NO: 1136025 - RNA, 20 nt, Human
ccccaaggcuggagucagcu

SEQ ID NO: 1136026 - RNA, 18 nt, Human
ccccaauacuuucauuuu

SEQ ID NO: 1136027 - RNA, 21 nt, Human
cccugggcuggagaugggcau

SEQ ID NO: 1136028 - RNA, 18 nt, Human
ccucccacuucccaccuc

SEQ ID NO: 1136029 - RNA, 21 nt, Human
ccuccugcugcuguuugccgg

SEQ ID NO: 1136030 - RNA, 25 nt, Human
ccugcagaccagggcuaaacacugg

SEQ ID NO: 1136031 - RNA, 23 nt, Human
ccuggaaggccuugcccaucccc

SEQ ID NO: 1136032 - RNA, 24 nt, Human
ccuggcagcauuuggucuuccucu

SEQ ID NO: 1136033 - RNA, 20 nt, Human
ccuuccugcagaccagggcu

SEQ ID NO: 1136034 - RNA, 20 nt, Human
ccuugggcucccuggggagg

SEQ ID NO: 1136035 - RNA, 20 nt, Human
ccuugugucccucacucccc

SEQ ID NO: 1136036 - RNA, 22 nt, Human
cggcagccacucgcauagcacu

SEQ ID NO: 1136037 - RNA, 24 nt, Human
cgugcagcaccuguagccugugca

SEQ ID NO: 1136038 - RNA, 23 nt, Human
cuaaacaccacgccccaccccca

SEQ ID NO: 1136039 - RNA, 20 nt, Human
cuaaacaccacgccccaccu

SEQ ID NO: 1136040 - RNA, 24 nt, Human
cucacucuguugaccaggcuggag

SEQ ID NO: 1136041 - RNA, 20 nt, Human
cucacugcaaccuccacccc

SEQ ID NO: 1136042 - RNA, 21 nt, Human
cuccaaaacaaaacaaaaaaa

SEQ ID NO: 1136043 - RNA, 19 nt, Human
cuccccugccuugggcucc

SEQ ID NO: 1136044 - RNA, 23 nt, Human
cuccgcaugggcuguggguguug

SEQ ID NO: 1136045 - RNA, 27 nt, Human
cuccuccacgugcacugcugcccucag

SEQ ID NO: 1136046 - RNA, 24 nt, Human
cucuaucugggcccggugggcucc

SEQ ID NO: 1136047 - RNA, 19 nt, Human
cugcuguccuccuuccugc

SEQ ID NO: 1136048 - RNA, 23 nt, Human
cuggaggacgcccuggaacucgg

SEQ ID NO: 1136049 - RNA, 21 nt, Human
cugggguggccgcagacaucc

SEQ ID NO: 1136050 - RNA, 22 nt, Human
cuggugguggcguugaaacagc

SEQ ID NO: 1136051 - RNA, 19 nt, Human
cuucuuagaguugucuuga

SEQ ID NO: 1136052 - RNA, 19 nt, Human
cuugguggggcugggaccc

SEQ ID NO: 1136053 - RNA, 19 nt, Human
gaacaucccugauuaagaa

SEQ ID NO: 1136054 - RNA, 19 nt, Human
gaacccgagcugugcuucc

SEQ ID NO: 1136055 - RNA, 20 nt, Human
gaacccgagcugugcuuccu

SEQ ID NO: 1136056 - RNA, 19 nt, Human
gaacucggagcacacagca

SEQ ID NO: 1136057 - RNA, 18 nt, Human
gacgggauggaggugugg

SEQ ID NO: 1136058 - RNA, 24 nt, Human
gaggacucuagcacggcacagccc

SEQ ID NO: 1136059 - RNA, 19 nt, Human
gagggggugguggcaggag

SEQ ID NO: 1136060 - RNA, 19 nt, Human
gagggggugguggcaggag

SEQ ID NO: 1136061 - RNA, 24 nt, Human
gaguccagccuuuccaccaccucc

SEQ ID NO: 1136062 - RNA, 22 nt, Human
gaucuccgcucacugcaaccuc

SEQ ID NO: 1136063 - RNA, 27 nt, Human
gcaaaacagaacucaaguuaaggccuc

SEQ ID NO: 1136064 - RNA, 19 nt, Human
gcacagccagggucgaggu

SEQ ID NO: 1136065 - RNA, 21 nt, Human
gcacaggcugcuaaccccagg

SEQ ID NO: 1136066 - RNA, 22 nt, Human
gcagccccagaccuggguaccu

SEQ ID NO: 1136067 - RNA, 22 nt, Human
gcagcucccccacauaagcccu

SEQ ID NO: 1136068 - RNA, 21 nt, Human
gcaggcuucaacgucagugag

SEQ ID NO: 1136069 - RNA, 21 nt, Human
gcaggucugccucccgggccc

SEQ ID NO: 1136070 - RNA, 18 nt, Human
gcccgagggcagcucugc

SEQ ID NO: 1136071 - RNA, 21 nt, Human
gcccuggaacucggagcacac

SEQ ID NO: 1136072 - RNA, 20 nt, Human
gccuccccugccuugggcuc

SEQ ID NO: 1136073 - RNA, 23 nt, Human
gcuccccauccauauuucucaag

SEQ ID NO: 1136074 - RNA, 24 nt, Human
gcuuccucugccauggucggaauu

SEQ ID NO: 1136075 - RNA, 22 nt, Human
gcuugcaggaucacggaaaacc

SEQ ID NO: 1136076 - RNA, 21 nt, Human
ggacaggcaugcagaaggcuc

SEQ ID NO: 1136077 - RNA, 21 nt, Human
ggacccucccacuucccaccu

SEQ ID NO: 1136078 - RNA, 20 nt, Human
ggacugggucaauggccaug

SEQ ID NO: 1136079 - RNA, 24 nt, Human
ggaggacaggcaugcagaaggcuc

SEQ ID NO: 1136080 - RNA, 22 nt, Human
ggaggacgcccuggaacucgga

SEQ ID NO: 1136081 - RNA, 21 nt, Human
ggaugggaccuggaagucuuu

SEQ ID NO: 1136082 - RNA, 22 nt, Human
ggcaacccuucauucauucguc

SEQ ID NO: 1136083 - RNA, 23 nt, Human
ggcacaggcugcuaaccccaggc

SEQ ID NO: 1136084 - RNA, 21 nt, Human
ggcccccuucuccgcuuucgu

SEQ ID NO: 1136085 - RNA, 21 nt, Human
ggcugugggcaugagcagcga

SEQ ID NO: 1136086 - RNA, 18 nt, Human
gggaacccgagcugugcu

SEQ ID NO: 1136087 - RNA, 22 nt, Human
gggaacccgagcugugcuuccu

SEQ ID NO: 1136088 - RNA, 23 nt, Human
ggucuguguuucaggaacugagg

SEQ ID NO: 1136089 - RNA, 21 nt, Human
gugcgucagugcguggaggag

SEQ ID NO: 1136090 - RNA, 19 nt, Human
gugguggcguugaaacagc

SEQ ID NO: 1136091 - RNA, 24 nt, Human
gugguguccaggaugucgaggggg

SEQ ID NO: 1136092 - RNA, 18 nt, Human
guugaccaggcuggagug

SEQ ID NO: 1136093 - RNA, 22 nt, Human
uaaacaccacgccccaccccca

SEQ ID NO: 1136094 - RNA, 23 nt, Human
uaaagaauuuacuuuuccaggac

SEQ ID NO: 1136095 - RNA, 20 nt, Human
uaagcgccuggcuccgcugu

SEQ ID NO: 1136096 - RNA, 20 nt, Human
uaaguucugcaaauucaguu

SEQ ID NO: 1136097 - RNA, 21 nt, Human
uacaugcaaugaggacagagc

SEQ ID NO: 1136098 - RNA, 25 nt, Human
uagaggcucuccaaaacaaaacaaa

SEQ ID NO: 1136099 - RNA, 23 nt, Human
uagcacggcacagccccucugcc

SEQ ID NO: 1136100 - RNA, 27 nt, Human
uagcacggcacagccccucugccucuc

SEQ ID NO: 1136101 - RNA, 19 nt, Human
uagcacucugggagggcug

SEQ ID NO: 1136102 - RNA, 22 nt, Human
uagcacucugggagggcugugg

SEQ ID NO: 1136103 - RNA, 24 nt, Human
uagcacucugggagggcugugggc

SEQ ID NO: 1136104 - RNA, 18 nt, Human
uagggcaggucugccucc

SEQ ID NO: 1136105 - RNA, 25 nt, Human
ucaaaaagcaggggaccaaaacuga

SEQ ID NO: 1136106 - RNA, 18 nt, Human
ucacugcaaccuccaccc

SEQ ID NO: 1136107 - RNA, 21 nt, Human
ucacugcaaccuccaccccaa

SEQ ID NO: 1136108 - RNA, 20 nt, Human
ucagaugcccuucccgugcu

SEQ ID NO: 1136109 - RNA, 19 nt, Human
ucagugcaguggcugagcu

SEQ ID NO: 1136110 - RNA, 21 nt, Human
ucauucauucgucggaugugu

SEQ ID NO: 1136111 - RNA, 23 nt, Human
uccaaaacaaaacaaaaaaaauc

SEQ ID NO: 1136112 - RNA, 23 nt, Human
uccaccauuguaaaaaaaauaaa

SEQ ID NO: 1136113 - RNA, 21 nt, Human
uccacgugcacugcugcccuc

SEQ ID NO: 1136114 - RNA, 23 nt, Human
uccagcauuuuaaugaacauccc

SEQ ID NO: 1136115 - RNA, 26 nt, Human
uccagccaagcaugguuucaaacaug

SEQ ID NO: 1136116 - RNA, 24 nt, Human
uccaucagcagcucccccacauaa

SEQ ID NO: 1136117 - RNA, 18 nt, Human
ucccaccuccuugugucc

SEQ ID NO: 1136118 - RNA, 19 nt, Human
ucccagccgggggcacagg

SEQ ID NO: 1136119 - RNA, 24 nt, Human
ucccucacuccccuguuucauucc

SEQ ID NO: 1136120 - RNA, 22 nt, Human
ucccuccucccgcaggagagag

SEQ ID NO: 1136121 - RNA, 21 nt, Human
ucccuggacaauccguguccu

SEQ ID NO: 1136122 - RNA, 21 nt, Human
ucccuggggaggggguggugg

SEQ ID NO: 1136123 - RNA, 26 nt, Human
uccgcuguucucaggaguggguucug

SEQ ID NO: 1136124 - RNA, 19 nt, Human
uccuccugcugcuguuugc

SEQ ID NO: 1136125 - RNA, 20 nt, Human
uccucuaagcgccuggcucc

SEQ ID NO: 1136126 - RNA, 24 nt, Human
ucucacucuguugaccaggcugga

SEQ ID NO: 1136127 - RNA, 23 nt, Human
ucuccaaaacaaaacaaaaaaaa

SEQ ID NO: 1136128 - RNA, 22 nt, Human
ucucccagccugcaggugcccc

SEQ ID NO: 1136129 - RNA, 24 nt, Human
ucucccagccugcaggugccccug

SEQ ID NO: 1136130 - RNA, 19 nt, Human
ucuguugaccaggcuggag

SEQ ID NO: 1136131 - RNA, 24 nt, Human
ucuguugaccaggcuggaguguag

SEQ ID NO: 1136132 - RNA, 24 nt, Human
ucuugggugguuucugccuggucc

SEQ ID NO: 1136133 - RNA, 22 nt, Human
ugaaacagcacccucugcuucg

SEQ ID NO: 1136134 - RNA, 21 nt, Human
ugaccugacccuuagucaacc

SEQ ID NO: 1136135 - RNA, 18 nt, Human
ugacuucuuccuuuuuuu

SEQ ID NO: 1136136 - RNA, 18 nt, Human
ugagaacauucccuccuc

SEQ ID NO: 1136137 - RNA, 21 nt, Human
ugagaacauucccuccucccg

SEQ ID NO: 1136138 - RNA, 22 nt, Human
ugagacagagucucacucuguu

SEQ ID NO: 1136139 - RNA, 20 nt, Human
ugaugaugagcgagauggac

SEQ ID NO: 1136140 - RNA, 22 nt, Human
ugcaaaacagaacucaaguuaa

SEQ ID NO: 1136141 - RNA, 18 nt, Human
ugcugcugaccccaaggc

SEQ ID NO: 1136142 - RNA, 22 nt, Human
uggaggugugggcagugguguc

SEQ ID NO: 1136143 - RNA, 19 nt, Human
uggcagcauuuggucuucc

SEQ ID NO: 1136144 - RNA, 23 nt, Human
uggcaggaccaacaccgggucug

SEQ ID NO: 1136145 - RNA, 20 nt, Human
uggcagugggaugaggcugg

SEQ ID NO: 1136146 - RNA, 22 nt, Human
uggcagugggaugaggcuggga

SEQ ID NO: 1136147 - RNA, 27 nt, Human
uggcauccagauuugcauaagauggac

SEQ ID NO: 1136148 - RNA, 21 nt, Human
uggccaggccacuagccaguc

SEQ ID NO: 1136149 - RNA, 21 nt, Human
uggccgcagacauccaggcac

SEQ ID NO: 1136150 - RNA, 23 nt, Human
uggcugggccucugaccuugcug

SEQ ID NO: 1136151 - RNA, 19 nt, Human
uggcuuccaucucugucuc

SEQ ID NO: 1136152 - RNA, 18 nt, Human
ugggaaugacuucuuccu

SEQ ID NO: 1136153 - RNA, 25 nt, Human
ugggaaugacuucuuccuuuuuuuu

SEQ ID NO: 1136154 - RNA, 20 nt, Human
ugggcagugguguccacgau

SEQ ID NO: 1136155 - RNA, 22 nt, Human
ugggcaugagcagcgaggacuc

SEQ ID NO: 1136156 - RNA, 24 nt, Human
ugggguccuaaagucugcuguccu

SEQ ID NO: 1136157 - RNA, 23 nt, Human
uggugucugguuuuucaccuuua

SEQ ID NO: 1136158 - RNA, 18 nt, Human
ugucugguuuuucaccuu

SEQ ID NO: 1136159 - RNA, 20 nt, Human
uguugcugcugaguccagcc

SEQ ID NO: 1136160 - RNA, 19 nt, Human
uuccagauaacaaggacgu

SEQ ID NO: 1136161 - RNA, 21 nt, Human
uuccaggaccuacugccuccc

SEQ ID NO: 1136162 - RNA, 19 nt, Human
uuccaugcugagccucccc

SEQ ID NO: 1136163 - RNA, 23 nt, Human
uucucaaggaggccaagugggug

SEQ ID NO: 1136164 - RNA, 18 nt, Human
uugcagagggaggacagg

SEQ ID NO: 1136165 - RNA, 25 nt, Human
uugggcucccuggggaggggguggu

SEQ ID NO: 1136166 - RNA, 20 nt, Human
uugguuugagagcaguucau

SEQ ID NO: 1136167 - RNA, 24 nt, Human
uuuaacccaaccucaaaaagcagg

SEQ ID NO: 1136168 - RNA, 21 nt, Human
uuugcauaagauggacugggu

SEQ ID NO: 1136169 - RNA, 22 nt, Human
uuuguugguuugagagcaguuc

SEQ ID NO: 1136170 - RNA, 20 nt, Human
aaaagacucuagacauggga

SEQ ID NO: 1136171 - RNA, 21 nt, Human
aaaaggacccaaacaaugcug

SEQ ID NO: 1136172 - RNA, 21 nt, Human
aaauauccggaacacacagga

SEQ ID NO: 1136173 - RNA, 23 nt, Human
aaccccgcauggaugggcugaag

SEQ ID NO: 1136174 - RNA, 21 nt, Human
acaaugcugaugacaaugauc

SEQ ID NO: 1136175 - RNA, 23 nt, Human
acagcaaaacagcguauccugaa

SEQ ID NO: 1136176 - RNA, 22 nt, Human
acauauuucuccuaauugugga

SEQ ID NO: 1136177 - RNA, 22 nt, Human
agcguauccugaagugcucaac

SEQ ID NO: 1136178 - RNA, 21 nt, Human
agcucgacagcgggcacucag

SEQ ID NO: 1136179 - RNA, 19 nt, Human
agggugugaugggagaaca

SEQ ID NO: 1136180 - RNA, 24 nt, Human
cacauguaaaaucacuaaggcgga

SEQ ID NO: 1136181 - RNA, 20 nt, Human
cacuccagccacugccucca

SEQ ID NO: 1136182 - RNA, 18 nt, Human
cagcaaaacagcguaucc

SEQ ID NO: 1136183 - RNA, 23 nt, Human
cagcagugaccugcuucaacacc

SEQ ID NO: 1136184 - RNA, 18 nt, Human
ccacugccuccaucugca

SEQ ID NO: 1136185 - RNA, 22 nt, Human
ccauacugcaaacagcuuguca

SEQ ID NO: 1136186 - RNA, 18 nt, Human
ccaucugcacacagcaaa

SEQ ID NO: 1136187 - RNA, 21 nt, Human
cccaugcacauauuucuccua

SEQ ID NO: 1136188 - RNA, 19 nt, Human
ccguguggacagacagaau

SEQ ID NO: 1136189 - RNA, 24 nt, Human
ccuccaucugcacacagcaaaaca

SEQ ID NO: 1136190 - RNA, 18 nt, Human
cgaaugaugcccgugugg

SEQ ID NO: 1136191 - RNA, 20 nt, Human
cuaaaaggacccaaacaaug

SEQ ID NO: 1136192 - RNA, 23 nt, Human
cucuugguuguugacaagauacu

SEQ ID NO: 1136193 - RNA, 19 nt, Human
cugugcuaaaaggacccaa

SEQ ID NO: 1136194 - RNA, 21 nt, Human
gaagucagaaguugaacucuu

SEQ ID NO: 1136195 - RNA, 25 nt, Human
gagaacagugagaaguaccgguacc

SEQ ID NO: 1136196 - RNA, 22 nt, Human
gcacauauuucuccuaauugug

SEQ ID NO: 1136197 - RNA, 18 nt, Human
gcuugucagcucgacagc

SEQ ID NO: 1136198 - RNA, 19 nt, Human
ggaaaagcaaaggaacccc

SEQ ID NO: 1136199 - RNA, 21 nt, Human
ggacuuccagaguucccacau

SEQ ID NO: 1136200 - RNA, 22 nt, Human
gggaaaagcaaaggaaccccgc

SEQ ID NO: 1136201 - RNA, 24 nt, Human
uaaaaggacccaaacaaugcugau

SEQ ID NO: 1136202 - RNA, 21 nt, Human
uaaaauagauagguacuccca

SEQ ID NO: 1136203 - RNA, 24 nt, Human
uaaaauagauagguacucccaaau

SEQ ID NO: 1136204 - RNA, 21 nt, Human
uaaaauauccggaacacacag

SEQ ID NO: 1136205 - RNA, 25 nt, Human
uaggugucuccacuguuucaguucu

SEQ ID NO: 1136206 - RNA, 20 nt, Human
uaguagcuaagcuuaaucac

SEQ ID NO: 1136207 - RNA, 19 nt, Human
uauuuuacauaaaagacuc

SEQ ID NO: 1136208 - RNA, 18 nt, Human
ucacuaaggcggacuucc

SEQ ID NO: 1136209 - RNA, 23 nt, Human
ucaucggaagucagaaguugaac

SEQ ID NO: 1136210 - RNA, 19 nt, Human
ucccacaugaaaaucaaau

SEQ ID NO: 1136211 - RNA, 23 nt, Human
ucugcacacagcaaaacagcgua

SEQ ID NO: 1136212 - RNA, 22 nt, Human
ugaagggugugaugggagaaca

SEQ ID NO: 1136213 - RNA, 21 nt, Human
ugcuaaaaggacccaaacaau

SEQ ID NO: 1136214 - RNA, 22 nt, Human
uggacagacagaaugauggaca

SEQ ID NO: 1136215 - RNA, 22 nt, Human
ugggaaaagcaaaggaaccccg

SEQ ID NO: 1136216 - RNA, 24 nt, Human
ugggaagacaacaaaaugauuuag

SEQ ID NO: 1136217 - RNA, 25 nt, Human
ugggaagacaacaaaaugauuuaga

SEQ ID NO: 1136218 - RNA, 20 nt, Human
ugggaguaaaaauagggagu

SEQ ID NO: 1136219 - RNA, 25 nt, Human
uguaaggugggaaaagcaaaggaac

SEQ ID NO: 1136220 - RNA, 22 nt, Human
uguuauggaguuacccauuuug

SEQ ID NO: 1136221 - RNA, 24 nt, Human
uguuauggaguuacccauuuugag

SEQ ID NO: 1136222 - RNA, 25 nt, Human
uguuauggaguuacccauuuugaga

SEQ ID NO: 1136223 - RNA, 24 nt, Human
uuaaucacaaucuaucaaaaggga

SEQ ID NO: 1136224 - RNA, 23 nt, Human
uucccacaugaaaaucaaaugua

SEQ ID NO: 1136225 - RNA, 18 nt, Human
uucguaagcuuccaacug

SEQ ID NO: 1136226 - RNA, 22 nt, Human
uucuauucuaucaaaacaccgc

SEQ ID NO: 1136227 - RNA, 27 nt, Human
uugagaaaucugugcuaaaaggaccca

SEQ ID NO: 1136228 - RNA, 24 nt, Human
uuuaaaauagauagguacucccaa

SEQ ID NO: 1136229 - RNA, 20 nt, Human
aaaagacucuagacauggga

SEQ ID NO: 1136230 - RNA, 18 nt, Human
aaaaggacccaaacaaug

SEQ ID NO: 1136231 - RNA, 21 nt, Human
aaaaggacccaaacaaugcug

SEQ ID NO: 1136232 - RNA, 21 nt, Human
aaauauccggaacacacagga

SEQ ID NO: 1136233 - RNA, 23 nt, Human
aaccccgcauggaugggcugaag

SEQ ID NO: 1136234 - RNA, 21 nt, Human
acaaugcugaugacaaugauc

SEQ ID NO: 1136235 - RNA, 23 nt, Human
acagcaaaacagcguauccugaa

SEQ ID NO: 1136236 - RNA, 22 nt, Human
acauauuucuccuaauugugga

SEQ ID NO: 1136237 - RNA, 19 nt, Human
agggugugaugggagaaca

SEQ ID NO: 1136238 - RNA, 21 nt, Human
augaaaaucaaauguaaacca

SEQ ID NO: 1136239 - RNA, 24 nt, Human
cacauguaaaaucacuaaggcgga

SEQ ID NO: 1136240 - RNA, 20 nt, Human
cacuccagccacugccucca

SEQ ID NO: 1136241 - RNA, 18 nt, Human
cagcaaaacagcguaucc

SEQ ID NO: 1136242 - RNA, 23 nt, Human
cagcagugaccugcuucaacacc

SEQ ID NO: 1136243 - RNA, 23 nt, Human
cagcguauccugaagugcucaac

SEQ ID NO: 1136244 - RNA, 22 nt, Human
cagcucgacagcgggcacucag

SEQ ID NO: 1136245 - RNA, 18 nt, Human
ccacugccuccaucugca

SEQ ID NO: 1136246 - RNA, 18 nt, Human
ccaucugcacacagcaaa

SEQ ID NO: 1136247 - RNA, 21 nt, Human
cccaugcacauauuucuccua

SEQ ID NO: 1136248 - RNA, 20 nt, Human
cccguguggacagacagaau

SEQ ID NO: 1136249 - RNA, 24 nt, Human
ccuccaucugcacacagcaaaaca

SEQ ID NO: 1136250 - RNA, 18 nt, Human
cgaaugaugcccgugugg

SEQ ID NO: 1136251 - RNA, 23 nt, Human
cucuugguuguugacaagauacu

SEQ ID NO: 1136252 - RNA, 21 nt, Human
gaagucagaaguugaacucuu

SEQ ID NO: 1136253 - RNA, 25 nt, Human
gagaacagugagaaguaccgguacc

SEQ ID NO: 1136254 - RNA, 22 nt, Human
gcacauauuucuccuaauugug

SEQ ID NO: 1136255 - RNA, 18 nt, Human
gcuugucagcucgacagc

SEQ ID NO: 1136256 - RNA, 19 nt, Human
ggaaaagcaaaggaacccc

SEQ ID NO: 1136257 - RNA, 21 nt, Human
ggacuuccagaguucccacau

SEQ ID NO: 1136258 - RNA, 22 nt, Human
gggaaaagcaaaggaaccccgc

SEQ ID NO: 1136259 - RNA, 24 nt, Human
uaaaaggacccaaacaaugcugau

SEQ ID NO: 1136260 - RNA, 18 nt, Human
uaaaauagauagguacuc

SEQ ID NO: 1136261 - RNA, 24 nt, Human
uaaaauagauagguacucccaaau

SEQ ID NO: 1136262 - RNA, 20 nt, Human
uaaaauauccggaacacaca

SEQ ID NO: 1136263 - RNA, 25 nt, Human
uaggugucuccacuguuucaguucu

SEQ ID NO: 1136264 - RNA, 20 nt, Human
uaguagcuaagcuuaaucac

SEQ ID NO: 1136265 - RNA, 19 nt, Human
uauuuuacauaaaagacuc

SEQ ID NO: 1136266 - RNA, 18 nt, Human
ucacuaaggcggacuucc

SEQ ID NO: 1136267 - RNA, 23 nt, Human
ucaucggaagucagaaguugaac

SEQ ID NO: 1136268 - RNA, 19 nt, Human
ucccacaugaaaaucaaau

SEQ ID NO: 1136269 - RNA, 23 nt, Human
ucugcacacagcaaaacagcgua

SEQ ID NO: 1136270 - RNA, 22 nt, Human
ugaagggugugaugggagaaca

SEQ ID NO: 1136271 - RNA, 23 nt, Human
ugccuccaucugcacacagcaaa

SEQ ID NO: 1136272 - RNA, 21 nt, Human
ugcuaaaaggacccaaacaau

SEQ ID NO: 1136273 - RNA, 22 nt, Human
uggacagacagaaugauggaca

SEQ ID NO: 1136274 - RNA, 22 nt, Human
ugggaaaagcaaaggaaccccg

SEQ ID NO: 1136275 - RNA, 24 nt, Human
ugggaagacaacaaaaugauuuag

SEQ ID NO: 1136276 - RNA, 25 nt, Human
ugggaagacaacaaaaugauuuaga

SEQ ID NO: 1136277 - RNA, 20 nt, Human
ugggaguaaaaauagggagu

SEQ ID NO: 1136278 - RNA, 25 nt, Human
uguaaggugggaaaagcaaaggaac

SEQ ID NO: 1136279 - RNA, 21 nt, Human
ugucugggagaggagguaaaa

SEQ ID NO: 1136280 - RNA, 22 nt, Human
uguuauggaguuacccauuuug

SEQ ID NO: 1136281 - RNA, 24 nt, Human
uguuauggaguuacccauuuugag

SEQ ID NO: 1136282 - RNA, 25 nt, Human
uguuauggaguuacccauuuugaga

SEQ ID NO: 1136283 - RNA, 24 nt, Human
uuaaucacaaucuaucaaaaggga

SEQ ID NO: 1136284 - RNA, 23 nt, Human
uucccacaugaaaaucaaaugua

SEQ ID NO: 1136285 - RNA, 18 nt, Human
uucguaagcuuccaacug

SEQ ID NO: 1136286 - RNA, 22 nt, Human
uucuauuccaucaaaacaccgc

SEQ ID NO: 1136287 - RNA, 27 nt, Human
uugagaaaucugugcuaaaaggaccca

SEQ ID NO: 1136288 - RNA, 24 nt, Human
uuuaaaauagauagguacucccaa

SEQ ID NO: 1136289 - RNA, 23 nt, Human
aaacacacauuggccacagaaaa

SEQ ID NO: 1136290 - RNA, 23 nt, Human
acagaaaaaggcgcuucuccgua

SEQ ID NO: 1136291 - RNA, 22 nt, Human
acagauaaccuuaaccucccag

SEQ ID NO: 1136292 - RNA, 22 nt, Human
agacagaaaaauaacauucuga

SEQ ID NO: 1136293 - RNA, 23 nt, Human
agagaaaacacacauuggccaca

SEQ ID NO: 1136294 - RNA, 25 nt, Human
agcgcagcuacucuuaaccccuugg

SEQ ID NO: 1136295 - RNA, 23 nt, Human
augguggugaggaggggugcugg

SEQ ID NO: 1136296 - RNA, 23 nt, Human
caaggcaauggacagauaaccuu

SEQ ID NO: 1136297 - RNA, 22 nt, Human
cagagccuaggggacacuuaag

SEQ ID NO: 1136298 - RNA, 18 nt, Human
cagcugccgccgcucccc

SEQ ID NO: 1136299 - RNA, 22 nt, Human
ccacagaaaaaggcgcuucucc

SEQ ID NO: 1136300 - RNA, 21 nt, Human
ccagaucagccgaaucaaccc

SEQ ID NO: 1136301 - RNA, 25 nt, Human
cccagagaaaacacacauuggccac

SEQ ID NO: 1136302 - RNA, 21 nt, Human
ccucacaucccaaaaauaaca

SEQ ID NO: 1136303 - RNA, 20 nt, Human
ccucuugcagcugccgcaac

SEQ ID NO: 1136304 - RNA, 18 nt, Human
cgcagccagaucacccuc

SEQ ID NO: 1136305 - RNA, 22 nt, Human
cggcugcgcugugccucccacu

SEQ ID NO: 1136306 - RNA, 23 nt, Human
cggcugcgcugugccucccacuu

SEQ ID NO: 1136307 - RNA, 24 nt, Human
cugccgccgcucccgcucggccuc

SEQ ID NO: 1136308 - RNA, 20 nt, Human
cuugcuucuccucuggcagg

SEQ ID NO: 1136309 - RNA, 21 nt, Human
gaaaaauaacauucugagagc

SEQ ID NO: 1136310 - RNA, 19 nt, Human
gacagauaaccuuaaccuc

SEQ ID NO: 1136311 - RNA, 23 nt, Human
gacagauaaccuuaaccucccag

SEQ ID NO: 1136312 - RNA, 26 nt, Human
gcacagcuucuggagggagggaacgc

SEQ ID NO: 1136313 - RNA, 26 nt, Human
gccagaucacccucacaucccaaaaa

SEQ ID NO: 1136314 - RNA, 20 nt, Human
gccgccgcucccgcucggcc

SEQ ID NO: 1136315 - RNA, 20 nt, Human
guagacuuuucuugagacuu

SEQ ID NO: 1136316 - RNA, 25 nt, Human
gucgcagccagaucacccucacauc

SEQ ID NO: 1136317 - RNA, 19 nt, Human
uaacacaguggcacuugga

SEQ ID NO: 1136318 - RNA, 22 nt, Human
uaaccucccagagaaaacacac

SEQ ID NO: 1136319 - RNA, 22 nt, Human
uaaccuuaaccucccagagaaa

SEQ ID NO: 1136320 - RNA, 21 nt, Human
uaagacagaaaaauaacauuc

SEQ ID NO: 1136321 - RNA, 23 nt, Human
uaucagcaacuuugaaauggcuu

SEQ ID NO: 1136322 - RNA, 20 nt, Human
uaugguggugaggaggggug

SEQ ID NO: 1136323 - RNA, 22 nt, Human
ucacgcagcuggcgcucccggg

SEQ ID NO: 1136324 - RNA, 18 nt, Human
ucagccgaaucaacccug

SEQ ID NO: 1136325 - RNA, 19 nt, Human
uccucuugcagcugccgca

SEQ ID NO: 1136326 - RNA, 23 nt, Human
ugaggaggggugcuggugugagg

SEQ ID NO: 1136327 - RNA, 19 nt, Human
ugccauaguuaucagcaac

SEQ ID NO: 1136328 - RNA, 21 nt, Human
ugccgcaacucccggcugcgc

SEQ ID NO: 1136329 - RNA, 20 nt, Human
uggcagggugugagcagcca

SEQ ID NO: 1136330 - RNA, 19 nt, Human
uggugaggaggggugcugg

SEQ ID NO: 1136331 - RNA, 20 nt, Human
ugguggugaggaggggugcu

SEQ ID NO: 1136332 - RNA, 18 nt, Human
aggcuaggccugccugca

SEQ ID NO: 1136333 - RNA, 22 nt, Human
agguguuugcauugcaacaugg

SEQ ID NO: 1136334 - RNA, 22 nt, Human
augaggaccugagcccagaggu

SEQ ID NO: 1136335 - RNA, 22 nt, Human
caggucccagcucugggcuggg

SEQ ID NO: 1136336 - RNA, 21 nt, Human
cccagggaagucaacagaucg

SEQ ID NO: 1136337 - RNA, 21 nt, Human
ccugcagccaagaaggcugcu

SEQ ID NO: 1136338 - RNA, 18 nt, Human
ccuggcuccccuuucuug

SEQ ID NO: 1136339 - RNA, 20 nt, Human
cgccuggguccaccgcucgc

SEQ ID NO: 1136340 - RNA, 25 nt, Human
cgugcuccaggucccagcucugggc

SEQ ID NO: 1136341 - RNA, 20 nt, Human
cuacccagggaagucaacag

SEQ ID NO: 1136342 - RNA, 19 nt, Human
cugccugcagccaagaagg

SEQ ID NO: 1136343 - RNA, 19 nt, Human
gacuaaauccuggcucccc

SEQ ID NO: 1136344 - RNA, 19 nt, Human
guggcaguguccuacccag

SEQ ID NO: 1136345 - RNA, 18 nt, Human
guuugcauugcaacaugg

SEQ ID NO: 1136346 - RNA, 25 nt, Human
uccaggucccagcucugggcugggc

SEQ ID NO: 1136347 - RNA, 21 nt, Human
ugccccaguggugaagguguu

SEQ ID NO: 1136348 - RNA, 24 nt, Human
aaaaauauaaaaaaaaucacaaag

SEQ ID NO: 1136349 - RNA, 21 nt, Human
aaaaguauuauggaaggaccc

SEQ ID NO: 1136350 - RNA, 27 nt, Human
aaacagcacaagaaaaggcaacaagcu

SEQ ID NO: 1136351 - RNA, 24 nt, Human
aaagugcugcaauuacagguguga

SEQ ID NO: 1136352 - RNA, 22 nt, Human
aacacagcgaacuggccagccu

SEQ ID NO: 1136353 - RNA, 21 nt, Human
aacagcacaagaaaaggcaac

SEQ ID NO: 1136354 - RNA, 23 nt, Human
aagaaggcaccaacaguacaaag

SEQ ID NO: 1136355 - RNA, 19 nt, Human
aagcaaauaaagagaaaac

SEQ ID NO: 1136356 - RNA, 24 nt, Human
aagcaauccaccugccucagccuc

SEQ ID NO: 1136357 - RNA, 20 nt, Human
aagccccccugcagcuccuc

SEQ ID NO: 1136358 - RNA, 21 nt, Human
aaggcaaguaauauugcuucc

SEQ ID NO: 1136359 - RNA, 20 nt, Human
aaguagcugggacuacaggc

SEQ ID NO: 1136360 - RNA, 20 nt, Human
aaguagcugggacuacaggc

SEQ ID NO: 1136361 - RNA, 24 nt, Human
aaguauuauggaaggacccaaagc

SEQ ID NO: 1136362 - RNA, 24 nt, Human
aaucaucugaggucaggaguuuga

SEQ ID NO: 1136363 - RNA, 22 nt, Human
aaucuuuaccauauacaaggca

SEQ ID NO: 1136364 - RNA, 23 nt, Human
aauuacaggugugaaccacugca

SEQ ID NO: 1136365 - RNA, 18 nt, Human
acaaagcagauacaaagc

SEQ ID NO: 1136366 - RNA, 22 nt, Human
acaaauauaaaaguauuaugga

SEQ ID NO: 1136367 - RNA, 22 nt, Human
acacaaccuuaucucacaaggg

SEQ ID NO: 1136368 - RNA, 20 nt, Human
acacagcccagcacaucacg

SEQ ID NO: 1136369 - RNA, 19 nt, Human
acaccacaugcucagccac

SEQ ID NO: 1136370 - RNA, 26 nt, Human
acacccccgcaccccuucuucacaca

SEQ ID NO: 1136371 - RNA, 24 nt, Human
acagagcaagacucuaucucaaaa

SEQ ID NO: 1136372 - RNA, 20 nt, Human
acaggaggguuucuucucug

SEQ ID NO: 1136373 - RNA, 18 nt, Human
acaguucugcaggcugca

SEQ ID NO: 1136374 - RNA, 24 nt, Human
acaugcagagcaaaucuggaagac

SEQ ID NO: 1136375 - RNA, 18 nt, Human
acauggugaaaccgucuc

SEQ ID NO: 1136376 - RNA, 20 nt, Human
acauggugaaaccgucucua

SEQ ID NO: 1136377 - RNA, 18 nt, Human
accaaaucacaaauaccc

SEQ ID NO: 1136378 - RNA, 18 nt, Human
accccacagaaacaucac

SEQ ID NO: 1136379 - RNA, 22 nt, Human
accccacuaucacccaccaacc

SEQ ID NO: 1136380 - RNA, 21 nt, Human
accgcacacccccgcaccccu

SEQ ID NO: 1136381 - RNA, 19 nt, Human
accggugucauguuuccag

SEQ ID NO: 1136382 - RNA, 22 nt, Human
acgccacugcacuccagccuga

SEQ ID NO: 1136383 - RNA, 24 nt, Human
acgccacugcacuccagccugagc

SEQ ID NO: 1136384 - RNA, 24 nt, Human
acgcccaggcuggagugcaguggc

SEQ ID NO: 1136385 - RNA, 18 nt, Human
acugcacuccagccugag

SEQ ID NO: 1136386 - RNA, 24 nt, Human
acugcacuccagccugagcgacag

SEQ ID NO: 1136387 - RNA, 18 nt, Human
acuggccccucugcgcac

SEQ ID NO: 1136388 - RNA, 19 nt, Human
acuugcuuccacagccuag

SEQ ID NO: 1136389 - RNA, 23 nt, Human
agaaggcaccaacaguacaaagc

SEQ ID NO: 1136390 - RNA, 20 nt, Human
agaauuuugggguacaauac

SEQ ID NO: 1136391 - RNA, 21 nt, Human
agagaagagccggacacacug

SEQ ID NO: 1136392 - RNA, 21 nt, Human
agagaccuugucucccaccuu

SEQ ID NO: 1136393 - RNA, 21 nt, Human
agcaauccaccugccucagcc

SEQ ID NO: 1136394 - RNA, 19 nt, Human
agcacuuugggaggcugaa

SEQ ID NO: 1136395 - RNA, 19 nt, Human
agcaugugugcguauguau

SEQ ID NO: 1136396 - RNA, 23 nt, Human
agccucagccuccugaguaguug

SEQ ID NO: 1136397 - RNA, 24 nt, Human
agccugagcgacagagcaagacuc

SEQ ID NO: 1136398 - RNA, 22 nt, Human
agccuggccgacauggugaaac

SEQ ID NO: 1136399 - RNA, 23 nt, Human
agccuggccgacauggugaaacc

SEQ ID NO: 1136400 - RNA, 21 nt, Human
agcuggccucacaguucccca

SEQ ID NO: 1136401 - RNA, 23 nt, Human
agcugggugugguggcgugugcc

SEQ ID NO: 1136402 - RNA, 20 nt, Human
aggaguuugagaccagccug

SEQ ID NO: 1136403 - RNA, 19 nt, Human
aggccagcucugaacgugu

SEQ ID NO: 1136404 - RNA, 19 nt, Human
aggcggaaguugcagugag

SEQ ID NO: 1136405 - RNA, 19 nt, Human
aggcggaaguugcagugag

SEQ ID NO: 1136406 - RNA, 20 nt, Human
aggcguuaacagucaucugu

SEQ ID NO: 1136407 - RNA, 22 nt, Human
aggcuccucugcugaacaagga

SEQ ID NO: 1136408 - RNA, 21 nt, Human
aggcugaggcagaacugcuug

SEQ ID NO: 1136409 - RNA, 23 nt, Human
aggcugcagaggaagcauggcac

SEQ ID NO: 1136410 - RNA, 27 nt, Human
aggcugcagaggaagcauggcacuagc

SEQ ID NO: 1136411 - RNA, 25 nt, Human
aggcuggagugcaguggcgccaucu

SEQ ID NO: 1136412 - RNA, 20 nt, Human
aggcugggugcaguggcuca

SEQ ID NO: 1136413 - RNA, 19 nt, Human
aggucaggaguuugagacc

SEQ ID NO: 1136414 - RNA, 19 nt, Human
aggugugaaccacugcacc

SEQ ID NO: 1136415 - RNA, 20 nt, Human
agugcaguggcacaauuaug

SEQ ID NO: 1136416 - RNA, 20 nt, Human
agugcaguggcgccaucucg

SEQ ID NO: 1136417 - RNA, 24 nt, Human
agugcaguggcgccaucucggcuc

SEQ ID NO: 1136418 - RNA, 18 nt, Human
agugccuuccuccuccuu

SEQ ID NO: 1136419 - RNA, 24 nt, Human
aguggcucacaccuguaaucccag

SEQ ID NO: 1136420 - RNA, 19 nt, Human
auaaaaucuuccuuuaaca

SEQ ID NO: 1136421 - RNA, 23 nt, Human
auauguugcccaggcuggucucg

SEQ ID NO: 1136422 - RNA, 24 nt, Human
aucacgccacugcacuccagccug

SEQ ID NO: 1136423 - RNA, 22 nt, Human
aucagccauugccugccccucc

SEQ ID NO: 1136424 - RNA, 20 nt, Human
aucaucugaggucaggaguu

SEQ ID NO: 1136425 - RNA, 24 nt, Human
aucugaggucaggaguuugagacc

SEQ ID NO: 1136426 - RNA, 23 nt, Human
auuagcugggugugguggcgugu

SEQ ID NO: 1136427 - RNA, 26 nt, Human
auugcaaacucccaguuuagguguga

SEQ ID NO: 1136428 - RNA, 18 nt, Human
auuugcucuccucucagu

SEQ ID NO: 1136429 - RNA, 18 nt, Human
caacagggaagacuguua

SEQ ID NO: 1136430 - RNA, 24 nt, Human
caacaucaaaagaauuaagaugaa

SEQ ID NO: 1136431 - RNA, 25 nt, Human
caacaucaaaagaauuaagaugaaa

SEQ ID NO: 1136432 - RNA, 20 nt, Human
caauaccaagaaggcaccaa

SEQ ID NO: 1136433 - RNA, 23 nt, Human
cacacacacauuuguggaacccc

SEQ ID NO: 1136434 - RNA, 24 nt, Human
cacaccuguaaucccagcacuuug

SEQ ID NO: 1136435 - RNA, 21 nt, Human
cacagaugaaacugcaauuaa

SEQ ID NO: 1136436 - RNA, 21 nt, Human
cacaguuccccaggcagcccc

SEQ ID NO: 1136437 - RNA, 18 nt, Human
caccaaccaaacagugac

SEQ ID NO: 1136438 - RNA, 25 nt, Human
cacccucuuuuccacuuucaucgcu

SEQ ID NO: 1136439 - RNA, 21 nt, Human
caccgcacacccccgcacccc

SEQ ID NO: 1136440 - RNA, 22 nt, Human
caccugcucacccucuuuucca

SEQ ID NO: 1136441 - RNA, 23 nt, Human
caccuguaaucccagcacuuugg

SEQ ID NO: 1136442 - RNA, 24 nt, Human
caccuguaaucccagcacuuuggg

SEQ ID NO: 1136443 - RNA, 22 nt, Human
cacucugacgcccaggcuggag

SEQ ID NO: 1136444 - RNA, 21 nt, Human
cacugcaaccuccgccucccg

SEQ ID NO: 1136445 - RNA, 23 nt, Human
cacugcaaccuccgccucccggg

SEQ ID NO: 1136446 - RNA, 19 nt, Human
cacugcacuccagccugag

SEQ ID NO: 1136447 - RNA, 20 nt, Human
cacugcacuccagccugagc

SEQ ID NO: 1136448 - RNA, 22 nt, Human
cacugcacuccagccugagcga

SEQ ID NO: 1136449 - RNA, 27 nt, Human
cacugcacuccagccugagcgacagag

SEQ ID NO: 1136450 - RNA, 22 nt, Human
cacuggagccuugaccucccag

SEQ ID NO: 1136451 - RNA, 23 nt, Human
cacugugaccccacuaucaccca

SEQ ID NO: 1136452 - RNA, 18 nt, Human
cagagcaaaucuggaaga

SEQ ID NO: 1136453 - RNA, 19 nt, Human
cagagcagagaaaguucua

SEQ ID NO: 1136454 - RNA, 21 nt, Human
cagcacaagaaaaggcaacaa

SEQ ID NO: 1136455 - RNA, 18 nt, Human
cagcacuuugggaggcug

SEQ ID NO: 1136456 - RNA, 19 nt, Human
cagccaagccccccugcag

SEQ ID NO: 1136457 - RNA, 21 nt, Human
cagccaagccccccugcagcu

SEQ ID NO: 1136458 - RNA, 19 nt, Human
cagccauugccugccccuc

SEQ ID NO: 1136459 - RNA, 18 nt, Human
cagccucagccuccugag

SEQ ID NO: 1136460 - RNA, 20 nt, Human
cagccuccugaguaguugag

SEQ ID NO: 1136461 - RNA, 24 nt, Human
cagcuacucgggaggcugaggcag

SEQ ID NO: 1136462 - RNA, 19 nt, Human
caggcugaaggaauuauga

SEQ ID NO: 1136463 - RNA, 23 nt, Human
cagggaccagcagcuccaggcau

SEQ ID NO: 1136464 - RNA, 19 nt, Human
cagggcaugaucucccucc

SEQ ID NO: 1136465 - RNA, 22 nt, Human
caggugccauaaacauucaaau

SEQ ID NO: 1136466 - RNA, 23 nt, Human
cauauguugcccaggcuggucuc

SEQ ID NO: 1136467 - RNA, 26 nt, Human
cauauguugcccaggcuggucucgaa

SEQ ID NO: 1136468 - RNA, 20 nt, Human
caucacagggcaugaucucc

SEQ ID NO: 1136469 - RNA, 22 nt, Human
caucccaccuggucuccccacu

SEQ ID NO: 1136470 - RNA, 23 nt, Human
caucugaggucaggaguuugaga

SEQ ID NO: 1136471 - RNA, 20 nt, Human
caugacaccacgccuggcua

SEQ ID NO: 1136472 - RNA, 24 nt, Human
caugacaccacgccuggcuaauuu

SEQ ID NO: 1136473 - RNA, 19 nt, Human
caugcccagccacucaguc

SEQ ID NO: 1136474 - RNA, 22 nt, Human
caugcugccagcucucuguccu

SEQ ID NO: 1136475 - RNA, 24 nt, Human
caugcugccagcucucuguccuuu

SEQ ID NO: 1136476 - RNA, 21 nt, Human
ccaaagugcugcaauuacagg

SEQ ID NO: 1136477 - RNA, 24 nt, Human
ccaaagugcugcaauuacaggugu

SEQ ID NO: 1136478 - RNA, 18 nt, Human
ccaacacuggggacuaca

SEQ ID NO: 1136479 - RNA, 23 nt, Human
ccaacaguacaaagcagauacaa

SEQ ID NO: 1136480 - RNA, 18 nt, Human
ccacucccaaacccugcc

SEQ ID NO: 1136481 - RNA, 20 nt, Human
ccacugcacuccagccugag

SEQ ID NO: 1136482 - RNA, 20 nt, Human
ccacugcacuccagccugag

SEQ ID NO: 1136483 - RNA, 21 nt, Human
ccacugcacuccagccugagc

SEQ ID NO: 1136484 - RNA, 24 nt, Human
ccacugcacuccagccugagcgac

SEQ ID NO: 1136485 - RNA, 26 nt, Human
ccacugcccacaccacaugcucagcc

SEQ ID NO: 1136486 - RNA, 24 nt, Human
ccagaggguccuucugauacccag

SEQ ID NO: 1136487 - RNA, 19 nt, Human
ccagccucagccuccugag

SEQ ID NO: 1136488 - RNA, 22 nt, Human
ccagccucagccuccugaguag

SEQ ID NO: 1136489 - RNA, 20 nt, Human
ccaucaggccccaccuccaa

SEQ ID NO: 1136490 - RNA, 21 nt, Human
ccaucaggccccaccuccaac

SEQ ID NO: 1136491 - RNA, 19 nt, Human
ccauccccuccacuguuuc

SEQ ID NO: 1136492 - RNA, 23 nt, Human
cccacaccacaugcucagccaca

SEQ ID NO: 1136493 - RNA, 28 nt, Human
cccacaccacaugcucagccacaacaca

SEQ ID NO: 1136494 - RNA, 20 nt, Human
cccacagaaacaucacaggc

SEQ ID NO: 1136495 - RNA, 24 nt, Human
cccacuaucacccaccaaccaaac

SEQ ID NO: 1136496 - RNA, 20 nt, Human
cccagguucaagcgauccuc

SEQ ID NO: 1136497 - RNA, 19 nt, Human
cccauauguugcccaggcu

SEQ ID NO: 1136498 - RNA, 19 nt, Human
cccccugcagcuccuccuu

SEQ ID NO: 1136499 - RNA, 19 nt, Human
ccccgcuccuggcuucugg

SEQ ID NO: 1136500 - RNA, 18 nt, Human
ccccuauuuguaugaccu

SEQ ID NO: 1136501 - RNA, 20 nt, Human
cccggguucaagcgauucuc

SEQ ID NO: 1136502 - RNA, 19 nt, Human
cccuaacacaaguuaccac

SEQ ID NO: 1136503 - RNA, 19 nt, Human
cccuaguguccuagggcac

SEQ ID NO: 1136504 - RNA, 20 nt, Human
cccuggaggacuugcucugg

SEQ ID NO: 1136505 - RNA, 22 nt, Human
cccuguuucccagcaacacuga

SEQ ID NO: 1136506 - RNA, 19 nt, Human
ccgcacacccccgcacccc

SEQ ID NO: 1136507 - RNA, 20 nt, Human
ccgccaccacaccgggccaa

SEQ ID NO: 1136508 - RNA, 22 nt, Human
ccgccaccacaccgggccaaau

SEQ ID NO: 1136509 - RNA, 24 nt, Human
ccucccagguucaagcgauccucc

SEQ ID NO: 1136510 - RNA, 22 nt, Human
ccucccggguucaagcgauucu

SEQ ID NO: 1136511 - RNA, 18 nt, Human
ccuccuauuacaacuuuc

SEQ ID NO: 1136512 - RNA, 22 nt, Human
ccugagcgacagagcaagacuc

SEQ ID NO: 1136513 - RNA, 24 nt, Human
ccugaguaguugagaccacaggcu

SEQ ID NO: 1136514 - RNA, 19 nt, Human
ccugcagcuccuccuugcc

SEQ ID NO: 1136515 - RNA, 20 nt, Human
ccugccugcugauuccacuu

SEQ ID NO: 1136516 - RNA, 21 nt, Human
ccuggccgacauggugaaacc

SEQ ID NO: 1136517 - RNA, 22 nt, Human
ccuggccgacauggugaaaccg

SEQ ID NO: 1136518 - RNA, 21 nt, Human
ccuggguucaagcaauccacc

SEQ ID NO: 1136519 - RNA, 23 nt, Human
ccuggguucaagcaauccaccug

SEQ ID NO: 1136520 - RNA, 21 nt, Human
ccuguaaucccagcuacucgg

SEQ ID NO: 1136521 - RNA, 18 nt, Human
ccuugaccucccagguuc

SEQ ID NO: 1136522 - RNA, 21 nt, Human
ccuuggcuucagggccggggg

SEQ ID NO: 1136523 - RNA, 19 nt, Human
cgaccagacagugaugccc

SEQ ID NO: 1136524 - RNA, 26 nt, Human
cgccacugcacuccagccugagcgac

SEQ ID NO: 1136525 - RNA, 24 nt, Human
cgcccaggcuggagugcaguggcg

SEQ ID NO: 1136526 - RNA, 19 nt, Human
cgggggcuuuuacuccugg

SEQ ID NO: 1136527 - RNA, 20 nt, Human
cuacugaauggaucuggagc

SEQ ID NO: 1136528 - RNA, 22 nt, Human
cucacaccuguaaucccagcac

SEQ ID NO: 1136529 - RNA, 24 nt, Human
cucacaccuguaaucccagcacuu

SEQ ID NO: 1136530 - RNA, 19 nt, Human
cucacucugacgcccaggc

SEQ ID NO: 1136531 - RNA, 24 nt, Human
cucacugcaaccuccgccucccgg

SEQ ID NO: 1136532 - RNA, 23 nt, Human
cucagccuccaaguagcugggac

SEQ ID NO: 1136533 - RNA, 19 nt, Human
cucagggagagggccagug

SEQ ID NO: 1136534 - RNA, 24 nt, Human
cuccaaguagcugggacuacaggc

SEQ ID NO: 1136535 - RNA, 24 nt, Human
cuccagccucagccuccugaguag

SEQ ID NO: 1136536 - RNA, 23 nt, Human
cucccacagugcuucaaauaccc

SEQ ID NO: 1136537 - RNA, 20 nt, Human
cucccaucaggccccaccuc

SEQ ID NO: 1136538 - RNA, 23 nt, Human
cucccuccacucucuccucucca

SEQ ID NO: 1136539 - RNA, 21 nt, Human
cuccucagaauucacuuuggc

SEQ ID NO: 1136540 - RNA, 24 nt, Human
cuccugaguaguugagaccacagg

SEQ ID NO: 1136541 - RNA, 23 nt, Human
cuccugccugcugauuccacuug

SEQ ID NO: 1136542 - RNA, 20 nt, Human
cucuccucuccaccugaaaa

SEQ ID NO: 1136543 - RNA, 23 nt, Human
cucugcgcacggacugcuaacuc

SEQ ID NO: 1136544 - RNA, 23 nt, Human
cugcaaccuccgccucccggguu

SEQ ID NO: 1136545 - RNA, 24 nt, Human
cugcaaccuccgccucccggguuc

SEQ ID NO: 1136546 - RNA, 20 nt, Human
cugcagcuccuccuugcccu

SEQ ID NO: 1136547 - RNA, 23 nt, Human
cugccucagccucccaaagugcu

SEQ ID NO: 1136548 - RNA, 24 nt, Human
cugccucagccucccaaagugcug

SEQ ID NO: 1136549 - RNA, 19 nt, Human
cuucagcuguccuuggcac

SEQ ID NO: 1136550 - RNA, 20 nt, Human
cuucccucucuccuugcucc

SEQ ID NO: 1136551 - RNA, 19 nt, Human
cuugcucuggauuuccauu

SEQ ID NO: 1136552 - RNA, 20 nt, Human
cuuuaaacacugugcuccca

SEQ ID NO: 1136553 - RNA, 18 nt, Human
gaaaaacucagacucuaa

SEQ ID NO: 1136554 - RNA, 20 nt, Human
gaaaagcaaccaggguuggc

SEQ ID NO: 1136555 - RNA, 25 nt, Human
gaaccccacagaaacaucacaggcu

SEQ ID NO: 1136556 - RNA, 23 nt, Human
gaaggacccaaagcaugugugcg

SEQ ID NO: 1136557 - RNA, 23 nt, Human
gacaguuccagagcauggaaccg

SEQ ID NO: 1136558 - RNA, 19 nt, Human
gagcagucucguuuguuuu

SEQ ID NO: 1136559 - RNA, 21 nt, Human
gauucucacgccucagccucc

SEQ ID NO: 1136560 - RNA, 20 nt, Human
gcaagcuguuuggcgggauc

SEQ ID NO: 1136561 - RNA, 18 nt, Human
gcaauccaccugccucag

SEQ ID NO: 1136562 - RNA, 24 nt, Human
gcaauccaccugccucagccuccc

SEQ ID NO: 1136563 - RNA, 19 nt, Human
gcacaagaaaaggcaacaa

SEQ ID NO: 1136564 - RNA, 20 nt, Human
gcacaugugugggccaccug

SEQ ID NO: 1136565 - RNA, 24 nt, Human
gcacuccagccugagcgacagagc

SEQ ID NO: 1136566 - RNA, 21 nt, Human
gcagcacuggaggcacaugug

SEQ ID NO: 1136567 - RNA, 22 nt, Human
gccacugcacuccagccugagc

SEQ ID NO: 1136568 - RNA, 19 nt, Human
gcccagcacaucacaggug

SEQ ID NO: 1136569 - RNA, 19 nt, Human
gcccaggcuggagugcagu

SEQ ID NO: 1136570 - RNA, 20 nt, Human
gcccaggcuggagugcagug

SEQ ID NO: 1136571 - RNA, 21 nt, Human
gcccugugcucccuucuuggg

SEQ ID NO: 1136572 - RNA, 18 nt, Human
gcccuguuucccagcaac

SEQ ID NO: 1136573 - RNA, 19 nt, Human
gccgacauggugaaaccgu

SEQ ID NO: 1136574 - RNA, 22 nt, Human
gccucagccuccaaguagcugg

SEQ ID NO: 1136575 - RNA, 19 nt, Human
gccucagccuccugaguag

SEQ ID NO: 1136576 - RNA, 23 nt, Human
gcgauccuccagccucagccucc

SEQ ID NO: 1136577 - RNA, 22 nt, Human
gcgugugccuguaaucccagcu

SEQ ID NO: 1136578 - RNA, 20 nt, Human
gcucacaguucugcaggcuu

SEQ ID NO: 1136579 - RNA, 18 nt, Human
gcucucuguccuuucuug

SEQ ID NO: 1136580 - RNA, 20 nt, Human
gcuggagugcaguggcgcca

SEQ ID NO: 1136581 - RNA, 23 nt, Human
ggaaguugcagugaguggagauc

SEQ ID NO: 1136582 - RNA, 24 nt, Human
ggaaguugcagugaguggagauca

SEQ ID NO: 1136583 - RNA, 24 nt, Human
ggagaucacgccacugcacuccag

SEQ ID NO: 1136584 - RNA, 19 nt, Human
ggaucauccaaacuuguca

SEQ ID NO: 1136585 - RNA, 21 nt, Human
ggccgggggugggggucugca

SEQ ID NO: 1136586 - RNA, 24 nt, Human
gggaggcugaaucaucugagguca

SEQ ID NO: 1136587 - RNA, 20 nt, Human
gggccgggggugggggucug

SEQ ID NO: 1136588 - RNA, 24 nt, Human
ggggugucccauauguugcccagg

SEQ ID NO: 1136589 - RNA, 24 nt, Human
gggugcaguggcucacaccuguaa

SEQ ID NO: 1136590 - RNA, 24 nt, Human
gggugugguggcgugugccuguaa

SEQ ID NO: 1136591 - RNA, 24 nt, Human
ggguucaagcaauccaccugccuc

SEQ ID NO: 1136592 - RNA, 19 nt, Human
ggucaggaguuugagacca

SEQ ID NO: 1136593 - RNA, 24 nt, Human
gguggcgugugccuguaaucccag

SEQ ID NO: 1136594 - RNA, 19 nt, Human
ggugggggucugcacuugc

SEQ ID NO: 1136595 - RNA, 18 nt, Human
guccuuggcaccagacuc

SEQ ID NO: 1136596 - RNA, 21 nt, Human
gugaaauaaagcagcauuuaa

SEQ ID NO: 1136597 - RNA, 24 nt, Human
gugacaccucacaacaaaauuuag

SEQ ID NO: 1136598 - RNA, 18 nt, Human
gugcaguggcucacaccu

SEQ ID NO: 1136599 - RNA, 23 nt, Human
guggcgugugccuguaaucccag

SEQ ID NO: 1136600 - RNA, 24 nt, Human
guucaagcaauccaccugccucag

SEQ ID NO: 1136601 - RNA, 21 nt, Human
uaaagcagcauuuaaaaagac

SEQ ID NO: 1136602 - RNA, 21 nt, Human
uaacauacuguuaccauacua

SEQ ID NO: 1136603 - RNA, 24 nt, Human
uaacauauaagcaaauaaagagaa

SEQ ID NO: 1136604 - RNA, 18 nt, Human
uaaccaaaucacaaauac

SEQ ID NO: 1136605 - RNA, 20 nt, Human
uaagagaaaccacauauuca

SEQ ID NO: 1136606 - RNA, 21 nt, Human
uaagcaaauaaagagaaaaca

SEQ ID NO: 1136607 - RNA, 24 nt, Human
uaaguaaacacagcgaacuggcca

SEQ ID NO: 1136608 - RNA, 22 nt, Human
uacaaaaauauuucccuuaaac

SEQ ID NO: 1136609 - RNA, 21 nt, Human
uacaaagcagauacaaagcag

SEQ ID NO: 1136610 - RNA, 26 nt, Human
uacaacaucaaaagaauuaagaugaa

SEQ ID NO: 1136611 - RNA, 19 nt, Human
uacagaaucuggacaacag

SEQ ID NO: 1136612 - RNA, 24 nt, Human
uacagaguucucacucugacgccc

SEQ ID NO: 1136613 - RNA, 24 nt, Human
uacaggugugaaccacugcaccca

SEQ ID NO: 1136614 - RNA, 25 nt, Human
uaccccauugcaaacucccaguuua

SEQ ID NO: 1136615 - RNA, 19 nt, Human
uagaugcccuuuaaacacu

SEQ ID NO: 1136616 - RNA, 21 nt, Human
uagcacagucacgcucacccu

SEQ ID NO: 1136617 - RNA, 22 nt, Human
uagcugggugugguggcgugug

SEQ ID NO: 1136618 - RNA, 18 nt, Human
uaguauuuuaaaggaagu

SEQ ID NO: 1136619 - RNA, 19 nt, Human
uagugccuuccuccuccuu

SEQ ID NO: 1136620 - RNA, 24 nt, Human
uauaaaaguauuauggaaggaccc

SEQ ID NO: 1136621 - RNA, 20 nt, Human
uaucugaaaaaaaaaaccuu

SEQ ID NO: 1136622 - RNA, 19 nt, Human
uauggaaggacccaaagca

SEQ ID NO: 1136623 - RNA, 23 nt, Human
uauguguugggagagcagucucg

SEQ ID NO: 1136624 - RNA, 24 nt, Human
uauguugcccaggcuggucucgaa

SEQ ID NO: 1136625 - RNA, 24 nt, Human
uauuauacgaaaaacucagacucu

SEQ ID NO: 1136626 - RNA, 22 nt, Human
ucaccauuuuuuggcuccucua

SEQ ID NO: 1136627 - RNA, 18 nt, Human
ucacccaccaaccaaaca

SEQ ID NO: 1136628 - RNA, 23 nt, Human
ucacgccacugcacuccagccug

SEQ ID NO: 1136629 - RNA, 21 nt, Human
ucacgccucagccuccaagua

SEQ ID NO: 1136630 - RNA, 24 nt, Human
ucacucugacgcccaggcuggagu

SEQ ID NO: 1136631 - RNA, 23 nt, Human
ucacugcaaccuccgccucccgg

SEQ ID NO: 1136632 - RNA, 24 nt, Human
ucacugcaaccuccgccucccggg

SEQ ID NO: 1136633 - RNA, 25 nt, Human
ucacugcaaccuccgccucccgggu

SEQ ID NO: 1136634 - RNA, 26 nt, Human
ucacugcaaccuccgccucccggguu

SEQ ID NO: 1136635 - RNA, 24 nt, Human
ucacuggagccuugaccucccagg

SEQ ID NO: 1136636 - RNA, 18 nt, Human
ucagaacuggccccucug

SEQ ID NO: 1136637 - RNA, 19 nt, Human
ucagcuguccuuggcacca

SEQ ID NO: 1136638 - RNA, 24 nt, Human
ucagggaccagcagcuccaggcau

SEQ ID NO: 1136639 - RNA, 19 nt, Human
ucaucugaggucaggaguu

SEQ ID NO: 1136640 - RNA, 21 nt, Human
uccaaaacauugauuuacaaa

SEQ ID NO: 1136641 - RNA, 23 nt, Human
uccaaguagcugggacuacaggc

SEQ ID NO: 1136642 - RNA, 24 nt, Human
uccaaguagcugggacuacaggcg

SEQ ID NO: 1136643 - RNA, 20 nt, Human
uccaggccagcucugaacgu

SEQ ID NO: 1136644 - RNA, 21 nt, Human
uccaugcugcucucauuccug

SEQ ID NO: 1136645 - RNA, 23 nt, Human
ucccaaagugcugcaauuacagg

SEQ ID NO: 1136646 - RNA, 21 nt, Human
ucccagguucaagcgauccuc

SEQ ID NO: 1136647 - RNA, 18 nt, Human
ucccauauguugcccagg

SEQ ID NO: 1136648 - RNA, 21 nt, Human
uccccggggccuggcugaugg

SEQ ID NO: 1136649 - RNA, 24 nt, Human
uccccugcuucacccaccacuuuc

SEQ ID NO: 1136650 - RNA, 21 nt, Human
ucccggguucaagcgauucuc

SEQ ID NO: 1136651 - RNA, 21 nt, Human
ucccggguucaagcgauucuc

SEQ ID NO: 1136652 - RNA, 21 nt, Human
ucccuaggaaaacccaucccu

SEQ ID NO: 1136653 - RNA, 18 nt, Human
ucccuccacucucuccuc

SEQ ID NO: 1136654 - RNA, 24 nt, Human
ucccugcugaguuauguguuggga

SEQ ID NO: 1136655 - RNA, 22 nt, Human
ucccuuaaacuugggauugcuc

SEQ ID NO: 1136656 - RNA, 19 nt, Human
uccuccagccucagccucc

SEQ ID NO: 1136657 - RNA, 23 nt, Human
uccuccuccuuguguagaugguu

SEQ ID NO: 1136658 - RNA, 24 nt, Human
uccugaguaguugagaccacaggc

SEQ ID NO: 1136659 - RNA, 18 nt, Human
uccuggguucaagcaauc

SEQ ID NO: 1136660 - RNA, 19 nt, Human
uccuggguucaagcaaucc

SEQ ID NO: 1136661 - RNA, 24 nt, Human
uccuggguucaagcaauccaccug

SEQ ID NO: 1136662 - RNA, 22 nt, Human
uccuguuccccucagauggucc

SEQ ID NO: 1136663 - RNA, 22 nt, Human
ucgcccaggcugcagugcagug

SEQ ID NO: 1136664 - RNA, 19 nt, Human
ucucaaaaauaaauaaaua

SEQ ID NO: 1136665 - RNA, 22 nt, Human
ucucacucugacgcccaggcug

SEQ ID NO: 1136666 - RNA, 23 nt, Human
ucucacucugacgcccaggcugg

SEQ ID NO: 1136667 - RNA, 24 nt, Human
ucucacucugacgcccaggcugga

SEQ ID NO: 1136668 - RNA, 19 nt, Human
ucucgaacuccuggguuca

SEQ ID NO: 1136669 - RNA, 23 nt, Human
ucucgaacuccuggguucaagca

SEQ ID NO: 1136670 - RNA, 23 nt, Human
ucucuacuaaaaacacaaaaauu

SEQ ID NO: 1136671 - RNA, 24 nt, Human
ucucucagggagagggccagugga

SEQ ID NO: 1136672 - RNA, 20 nt, Human
ucucugggauuaaagaggag

SEQ ID NO: 1136673 - RNA, 22 nt, Human
ucucuuuggccacucccaaacc

SEQ ID NO: 1136674 - RNA, 24 nt, Human
ucugacgcccaggcuggagugcag

SEQ ID NO: 1136675 - RNA, 21 nt, Human
ucugcaucgagcugaaacugc

SEQ ID NO: 1136676 - RNA, 20 nt, Human
ucuguagucuuagugccuuc

SEQ ID NO: 1136677 - RNA, 23 nt, Human
ucuguccuuucuugguccacugu

SEQ ID NO: 1136678 - RNA, 21 nt, Human
ucugugcagccugcauaucgu

SEQ ID NO: 1136679 - RNA, 24 nt, Human
ucuguggucuuguuuuguuuucuc

SEQ ID NO: 1136680 - RNA, 23 nt, Human
ugaagguuucugacaggaggguu

SEQ ID NO: 1136681 - RNA, 23 nt, Human
ugaaucaucugaggucaggaguu

SEQ ID NO: 1136682 - RNA, 24 nt, Human
ugaaucaucugaggucaggaguuu

SEQ ID NO: 1136683 - RNA, 20 nt, Human
ugaccccaggaggcggaagu

SEQ ID NO: 1136684 - RNA, 20 nt, Human
ugacgugucuuucccaagcc

SEQ ID NO: 1136685 - RNA, 23 nt, Human
ugagaaaacagaaauaagaaacg

SEQ ID NO: 1136686 - RNA, 24 nt, Human
ugagaccacaggcucaugacacca

SEQ ID NO: 1136687 - RNA, 19 nt, Human
ugagagcgucagugugggg

SEQ ID NO: 1136688 - RNA, 18 nt, Human
ugaggucaggaguuugag

SEQ ID NO: 1136689 - RNA, 22 nt, Human
ugaguaguugagaccacaggcu

SEQ ID NO: 1136690 - RNA, 18 nt, Human
ugaucucccuccacucuc

SEQ ID NO: 1136691 - RNA, 24 nt, Human
ugcaauuacaggugugaaccacug

SEQ ID NO: 1136692 - RNA, 23 nt, Human
ugcacugcuucucuuuggccacu

SEQ ID NO: 1136693 - RNA, 21 nt, Human
ugcagugcaguggcacaauua

SEQ ID NO: 1136694 - RNA, 24 nt, Human
ugcagugcaguggcacaauuaugg

SEQ ID NO: 1136695 - RNA, 24 nt, Human
ugcccaggcuggucucgaacuccu

SEQ ID NO: 1136696 - RNA, 25 nt, Human
ugcccaggcuggucucgaacuccug

SEQ ID NO: 1136697 - RNA, 26 nt, Human
ugcccaugcugccagcucucuguccu

SEQ ID NO: 1136698 - RNA, 19 nt, Human
ugcccugugcucccuucuu

SEQ ID NO: 1136699 - RNA, 24 nt, Human
ugccucagccucccaaagugcugc

SEQ ID NO: 1136700 - RNA, 23 nt, Human
ugccuguaaucccagcuacucgg

SEQ ID NO: 1136701 - RNA, 24 nt, Human
ugccuguaaucccagcuacucggg

SEQ ID NO: 1136702 - RNA, 23 nt, Human
ugcguacggcugaaagauguuuu

SEQ ID NO: 1136703 - RNA, 21 nt, Human
ugcuuuaaaaauguauaagca

SEQ ID NO: 1136704 - RNA, 21 nt, Human
uggagcagauaagaaagccag

SEQ ID NO: 1136705 - RNA, 20 nt, Human
uggaggcacaugugugggcc

SEQ ID NO: 1136706 - RNA, 28 nt, Human
uggagugcaguggcgccauccuagcacg

SEQ ID NO: 1136707 - RNA, 23 nt, Human
uggagugcaguggcgccaucucg

SEQ ID NO: 1136708 - RNA, 24 nt, Human
uggagugcaguggcgccaucucgg

SEQ ID NO: 1136709 - RNA, 20 nt, Human
uggaucuggagcagauaaga

SEQ ID NO: 1136710 - RNA, 21 nt, Human
uggaugacguaagagaaacca

SEQ ID NO: 1136711 - RNA, 20 nt, Human
uggauuuccauuuguuucug

SEQ ID NO: 1136712 - RNA, 19 nt, Human
uggcagaaggggaaguggg

SEQ ID NO: 1136713 - RNA, 21 nt, Human
uggcagcagaucuuccuccag

SEQ ID NO: 1136714 - RNA, 27 nt, Human
uggcagccaagccccccugcagcuccu

SEQ ID NO: 1136715 - RNA, 18 nt, Human
uggccaaugggucacugc

SEQ ID NO: 1136716 - RNA, 20 nt, Human
uggccagagcaggggugaga

SEQ ID NO: 1136717 - RNA, 19 nt, Human
uggcggggucuaggaccac

SEQ ID NO: 1136718 - RNA, 21 nt, Human
uggcgugugccuguaauccca

SEQ ID NO: 1136719 - RNA, 21 nt, Human
uggcucacaccuguaauccca

SEQ ID NO: 1136720 - RNA, 22 nt, Human
uggcucacaccuguaaucccag

SEQ ID NO: 1136721 - RNA, 24 nt, Human
uggcucacaccuguaaucccagca

SEQ ID NO: 1136722 - RNA, 24 nt, Human
uggcucccuccccggggccuggcu

SEQ ID NO: 1136723 - RNA, 21 nt, Human
uggcuucagggccgggggugg

SEQ ID NO: 1136724 - RNA, 18 nt, Human
ugggacuacaggcguccg

SEQ ID NO: 1136725 - RNA, 19 nt, Human
ugggacuacaggcguccgc

SEQ ID NO: 1136726 - RNA, 21 nt, Human
ugggacuacaggcguccgcca

SEQ ID NO: 1136727 - RNA, 24 nt, Human
ugggacuacaggcguccgccacca

SEQ ID NO: 1136728 - RNA, 27 nt, Human
ugggaggcugaaucaucugaggucaac

SEQ ID NO: 1136729 - RNA, 18 nt, Human
ugggugugguggcgugug

SEQ ID NO: 1136730 - RNA, 21 nt, Human
uggguucaagcaauccaccug

SEQ ID NO: 1136731 - RNA, 19 nt, Human
uggugcaacccuggaggac

SEQ ID NO: 1136732 - RNA, 24 nt, Human
ugguggcgugugccuguaauccca

SEQ ID NO: 1136733 - RNA, 18 nt, Human
ugguuaaaccaaugccug

SEQ ID NO: 1136734 - RNA, 24 nt, Human
ugguucacuggagccuugaccucc

SEQ ID NO: 1136735 - RNA, 19 nt, Human
ugugaucagcucacuuccc

SEQ ID NO: 1136736 - RNA, 19 nt, Human
ugugcguauguaugugugu

SEQ ID NO: 1136737 - RNA, 20 nt, Human
ugugcguauguaugugugua

SEQ ID NO: 1136738 - RNA, 20 nt, Human
ugugcguauguaugugugua

SEQ ID NO: 1136739 - RNA, 20 nt, Human
ugugugcguauguaugugug

SEQ ID NO: 1136740 - RNA, 21 nt, Human
ugugugcguauguaugugugu

SEQ ID NO: 1136741 - RNA, 22 nt, Human
uguucugugcagccugcauauc

SEQ ID NO: 1136742 - RNA, 22 nt, Human
uuaaaugguuaaaccaaugccu

SEQ ID NO: 1136743 - RNA, 24 nt, Human
uuaacauacuguuaccauacuaua

SEQ ID NO: 1136744 - RNA, 23 nt, Human
uuagaaaacaaauugucgcccag

SEQ ID NO: 1136745 - RNA, 22 nt, Human
uuagcaguuacguuuguuugca

SEQ ID NO: 1136746 - RNA, 19 nt, Human
uuagcugggugugguggcg

SEQ ID NO: 1136747 - RNA, 24 nt, Human
uuagcugggugugguggcgugugc

SEQ ID NO: 1136748 - RNA, 21 nt, Human
uucaagcaauccaccugccuc

SEQ ID NO: 1136749 - RNA, 18 nt, Human
uucaagcgauccuccagc

SEQ ID NO: 1136750 - RNA, 23 nt, Human
uucaagcgauucucacgccucag

SEQ ID NO: 1136751 - RNA, 19 nt, Human
uucacagaugaaacugcaa

SEQ ID NO: 1136752 - RNA, 23 nt, Human
uucacuggagccuugaccuccca

SEQ ID NO: 1136753 - RNA, 24 nt, Human
uucacuggagccuugaccucccag

SEQ ID NO: 1136754 - RNA, 19 nt, Human
uuccauuuguuucugaccc

SEQ ID NO: 1136755 - RNA, 22 nt, Human
uugauuuacaaauauaaaagua

SEQ ID NO: 1136756 - RNA, 28 nt, Human
uugcagagccgggggcgguggggugucc

SEQ ID NO: 1136757 - RNA, 20 nt, Human
uugcagugaguggagaucac

SEQ ID NO: 1136758 - RNA, 21 nt, Human
uugcagugaguggagaucacg

SEQ ID NO: 1136759 - RNA, 20 nt, Human
uugucaucagcgagcaacaa

SEQ ID NO: 1136760 - RNA, 22 nt, Human
uugucaucagcgagcaacaaag

SEQ ID NO: 1136761 - RNA, 23 nt, Human
uugucgcccaggcugcagugcag

SEQ ID NO: 1136762 - RNA, 20 nt, Human
uuuccauuuguuucugaccc

SEQ ID NO: 1136763 - RNA, 25 nt, Human
uuuugugacuaaagcuggacggggu

SEQ ID NO: 1136764 - RNA, 22 nt, Human
uuuuuccaggcauuggugauua

SEQ ID NO: 1136765 - RNA, 20 nt, Human
uuuuuuuuacaagucaggug

SEQ ID NO: 1136766 - RNA, 22 nt, Human
uuuuuuuuuuuuacaagucagg

SEQ ID NO: 1136767 - RNA, 25 nt, Human
aaaucacauccuacucaucagcaag

SEQ ID NO: 1136768 - RNA, 21 nt, Human
aacagcacccucugcuucggu

SEQ ID NO: 1136769 - RNA, 26 nt, Human
aaccucaaaaagcaggggaccaaaac

SEQ ID NO: 1136770 - RNA, 18 nt, Human
aacucucgagagcugggc

SEQ ID NO: 1136771 - RNA, 23 nt, Human
aagcacuuagcaucgcaggacuu

SEQ ID NO: 1136772 - RNA, 20 nt, Human
aagcaggggaccaaaacuga

SEQ ID NO: 1136773 - RNA, 19 nt, Human
aagcaugguuucaaacaug

SEQ ID NO: 1136774 - RNA, 20 nt, Human
aaggaggccgcugcauuucc

SEQ ID NO: 1136775 - RNA, 19 nt, Human
aaucugucagaugcccuuc

SEQ ID NO: 1136776 - RNA, 22 nt, Human
acaccgggucugaccucccagc

SEQ ID NO: 1136777 - RNA, 21 nt, Human
acagagucucacucuguugac

SEQ ID NO: 1136778 - RNA, 20 nt, Human
acaggcugcuaaccccaggc

SEQ ID NO: 1136779 - RNA, 25 nt, Human
acucuguugaccaggcuggagugua

SEQ ID NO: 1136780 - RNA, 18 nt, Human
agaacucaaguuaaggcc

SEQ ID NO: 1136781 - RNA, 21 nt, Human
agaaggcucugugugcagccc

SEQ ID NO: 1136782 - RNA, 22 nt, Human
agcacucugggagggcuguggg

SEQ ID NO: 1136783 - RNA, 23 nt, Human
agcacucugggagggcugugggc

SEQ ID NO: 1136784 - RNA, 18 nt, Human
agcagcugcucuagcggc

SEQ ID NO: 1136785 - RNA, 24 nt, Human
agcaggggaccaaaacugagccua

SEQ ID NO: 1136786 - RNA, 23 nt, Human
aggaaggaaggcagggcuugcag

SEQ ID NO: 1136787 - RNA, 19 nt, Human
aggaaggaggggcacagag

SEQ ID NO: 1136788 - RNA, 21 nt, Human
aggaaggaggggcacagagug

SEQ ID NO: 1136789 - RNA, 18 nt, Human
aggaaggcagggcuugca

SEQ ID NO: 1136790 - RNA, 18 nt, Human
aggcaacugagcccuacu

SEQ ID NO: 1136791 - RNA, 22 nt, Human
agggcuaaacacuggugcccag

SEQ ID NO: 1136792 - RNA, 22 nt, Human
agggcugugggcaugagcagcg

SEQ ID NO: 1136793 - RNA, 20 nt, Human
agggggugguggcaggaguu

SEQ ID NO: 1136794 - RNA, 19 nt, Human
aggucugccucccgggccc

SEQ ID NO: 1136795 - RNA, 19 nt, Human
augagcagcgaggacucca

SEQ ID NO: 1136796 - RNA, 21 nt, Human
caaauugaaggcaggauccca

SEQ ID NO: 1136797 - RNA, 22 nt, Human
caaccucaaaaagcaggggacc

SEQ ID NO: 1136798 - RNA, 21 nt, Human
caaucuugaacccuuugucac

SEQ ID NO: 1136799 - RNA, 18 nt, Human
cacacgccccacccccaa

SEQ ID NO: 1136800 - RNA, 22 nt, Human
cacagcacguggguggcaggac

SEQ ID NO: 1136801 - RNA, 27 nt, Human
cacagcacguggguggcaggaccaaca

SEQ ID NO: 1136802 - RNA, 19 nt, Human
cacagccccucugccucuc

SEQ ID NO: 1136803 - RNA, 21 nt, Human
caccauuguaaaaaaaauaaa

SEQ ID NO: 1136804 - RNA, 28 nt, Human
cacccccaacugcacggcagccacucgc

SEQ ID NO: 1136805 - RNA, 20 nt, Human
cacccucugcuucgguccuc

SEQ ID NO: 1136806 - RNA, 18 nt, Human
cacggcagccacucgcau

SEQ ID NO: 1136807 - RNA, 24 nt, Human
cacucuguugaccaggcuggagug

SEQ ID NO: 1136808 - RNA, 21 nt, Human
cagaggagaaaagcacuuagc

SEQ ID NO: 1136809 - RNA, 20 nt, Human
cagagggcaucggugagcac

SEQ ID NO: 1136810 - RNA, 18 nt, Human
cagcagcucccccacaua

SEQ ID NO: 1136811 - RNA, 18 nt, Human
caggcaacugagcccuac

SEQ ID NO: 1136812 - RNA, 24 nt, Human
caucagcaaggcggguagacauca

SEQ ID NO: 1136813 - RNA, 19 nt, Human
ccaaaacugagccuauccu

SEQ ID NO: 1136814 - RNA, 21 nt, Human
ccaaaacugagccuauccugg

SEQ ID NO: 1136815 - RNA, 20 nt, Human
ccaacuucgcagagggcauc

SEQ ID NO: 1136816 - RNA, 19 nt, Human
ccaagugggugaaaugguc

SEQ ID NO: 1136817 - RNA, 18 nt, Human
ccacgugcacugcugccc

SEQ ID NO: 1136818 - RNA, 23 nt, Human
ccaggugcucuugccaugggucc

SEQ ID NO: 1136819 - RNA, 22 nt, Human
ccaugcugagccuccccugccu

SEQ ID NO: 1136820 - RNA, 18 nt, Human
cccaggauggaaucuggc

SEQ ID NO: 1136821 - RNA, 20 nt, Human
ccccaaggcuggagucagcu

SEQ ID NO: 1136822 - RNA, 18 nt, Human
ccccaauacuuucauuuu

SEQ ID NO: 1136823 - RNA, 19 nt, Human
ccccagagggcuccccauc

SEQ ID NO: 1136824 - RNA, 18 nt, Human
cccuguuccccccccccu

SEQ ID NO: 1136825 - RNA, 18 nt, Human
cccuuuuuuuuuuuucaa

SEQ ID NO: 1136826 - RNA, 21 nt, Human
ccuccacgugcacugcugccc

SEQ ID NO: 1136827 - RNA, 20 nt, Human
ccuccgcacagcacugcguu

SEQ ID NO: 1136828 - RNA, 25 nt, Human
ccugcagaccagggcuaaacacugg

SEQ ID NO: 1136829 - RNA, 23 nt, Human
ccuggaaggccuugcccaucccc

SEQ ID NO: 1136830 - RNA, 21 nt, Human
ccuguagccugugcaucaccc

SEQ ID NO: 1136831 - RNA, 20 nt, Human
ccuuccugcagaccagggcu

SEQ ID NO: 1136832 - RNA, 20 nt, Human
ccuugggcucccuggggagg

SEQ ID NO: 1136833 - RNA, 20 nt, Human
ccuugugucccucacucccc

SEQ ID NO: 1136834 - RNA, 24 nt, Human
cuaaacacacgccccacccccaac

SEQ ID NO: 1136835 - RNA, 24 nt, Human
cucacucuguugaccaggcuggag

SEQ ID NO: 1136836 - RNA, 22 nt, Human
cucacugcaaccuccaccccaa

SEQ ID NO: 1136837 - RNA, 19 nt, Human
cuccccugccuugggcucc

SEQ ID NO: 1136838 - RNA, 27 nt, Human
cuccuccacgugcacugcugcccucag

SEQ ID NO: 1136839 - RNA, 23 nt, Human
cugaacgggcuccaggcaacuga

SEQ ID NO: 1136840 - RNA, 23 nt, Human
cugagcccuacuggcagguccuc

SEQ ID NO: 1136841 - RNA, 19 nt, Human
cugcuguccuccuuccugc

SEQ ID NO: 1136842 - RNA, 23 nt, Human
cuggcagguccucggccugggcc

SEQ ID NO: 1136843 - RNA, 22 nt, Human
cuggugguggcguugaaacagc

SEQ ID NO: 1136844 - RNA, 22 nt, Human
cuguucgccgggugcugcugac

SEQ ID NO: 1136845 - RNA, 19 nt, Human
cuucuuagaguugucuuga

SEQ ID NO: 1136846 - RNA, 19 nt, Human
cuugguggggcugggaccc

SEQ ID NO: 1136847 - RNA, 19 nt, Human
gaacccgagcugugcuucc

SEQ ID NO: 1136848 - RNA, 20 nt, Human
gaacccgagcugugcuuccu

SEQ ID NO: 1136849 - RNA, 23 nt, Human
gaccuacugccucccuguucccc

SEQ ID NO: 1136850 - RNA, 19 nt, Human
gagcaguggggaaccgucg

SEQ ID NO: 1136851 - RNA, 24 nt, Human
gaggacucuagcacggcacagccc

SEQ ID NO: 1136852 - RNA, 19 nt, Human
gagggggugguggcaggag

SEQ ID NO: 1136853 - RNA, 19 nt, Human
gagggggugguggcaggag

SEQ ID NO: 1136854 - RNA, 23 nt, Human
gagucagcuugcagcacagccag

SEQ ID NO: 1136855 - RNA, 22 nt, Human
gaucuccgcucacugcaaccuc

SEQ ID NO: 1136856 - RNA, 27 nt, Human
gcaaaacagaacucaaguuaaggccuc

SEQ ID NO: 1136857 - RNA, 19 nt, Human
gcacagccagggucgaggu

SEQ ID NO: 1136858 - RNA, 21 nt, Human
gcacaggcugcuaaccccagg

SEQ ID NO: 1136859 - RNA, 20 nt, Human
gcagccacucgcauagcacu

SEQ ID NO: 1136860 - RNA, 22 nt, Human
gcagcucccccacauaagcccu

SEQ ID NO: 1136861 - RNA, 21 nt, Human
gcagguccucggccugggccc

SEQ ID NO: 1136862 - RNA, 18 nt, Human
gcccgagggcagcucugc

SEQ ID NO: 1136863 - RNA, 20 nt, Human
gccuccccugccuugggcuc

SEQ ID NO: 1136864 - RNA, 23 nt, Human
gcuccccauccauauuucucaag

SEQ ID NO: 1136865 - RNA, 24 nt, Human
gcuuccucugccauggucggaauu

SEQ ID NO: 1136866 - RNA, 22 nt, Human
gcuugcaggaucacggaaaacc

SEQ ID NO: 1136867 - RNA, 26 nt, Human
ggaaggaggggcacagagugcccagg

SEQ ID NO: 1136868 - RNA, 21 nt, Human
ggacaggcaugcagaaggcuc

SEQ ID NO: 1136869 - RNA, 20 nt, Human
ggacugggucaauggccaug

SEQ ID NO: 1136870 - RNA, 24 nt, Human
ggaggacaggcaugcagaaggcuc

SEQ ID NO: 1136871 - RNA, 22 nt, Human
ggcaacccuucauucauucguc

SEQ ID NO: 1136872 - RNA, 23 nt, Human
ggcacaggcugcuaaccccaggc

SEQ ID NO: 1136873 - RNA, 27 nt, Human
ggcagguccucggccugggcccgaaca

SEQ ID NO: 1136874 - RNA, 21 nt, Human
ggcugugggcaugagcagcga

SEQ ID NO: 1136875 - RNA, 18 nt, Human
gggaacccgagcugugcu

SEQ ID NO: 1136876 - RNA, 22 nt, Human
gggaacccgagcugugcuuccu

SEQ ID NO: 1136877 - RNA, 22 nt, Human
gggacccucccacuucccaccu

SEQ ID NO: 1136878 - RNA, 18 nt, Human
gggaugggcugaacgggc

SEQ ID NO: 1136879 - RNA, 18 nt, Human
gggcaggggucaggguuu

SEQ ID NO: 1136880 - RNA, 19 nt, Human
gggcuccaggcaacugagc

SEQ ID NO: 1136881 - RNA, 23 nt, Human
gugcagcaccuguagccugugca

SEQ ID NO: 1136882 - RNA, 25 nt, Human
gugcagccccagaccuggguaccuu

SEQ ID NO: 1136883 - RNA, 19 nt, Human
gugguggcguugaaacagc

SEQ ID NO: 1136884 - RNA, 18 nt, Human
guugaccaggcuggagug

SEQ ID NO: 1136885 - RNA, 21 nt, Human
uaaacacacgccccaccccca

SEQ ID NO: 1136886 - RNA, 23 nt, Human
uaaagaauuuacuuuuccaggac

SEQ ID NO: 1136887 - RNA, 20 nt, Human
uaaguucugcaaauucaguu

SEQ ID NO: 1136888 - RNA, 21 nt, Human
uacaugcaaugaggacagagc

SEQ ID NO: 1136889 - RNA, 23 nt, Human
uagcacggcacagccccucugcc

SEQ ID NO: 1136890 - RNA, 27 nt, Human
uagcacggcacagccccucugccucuc

SEQ ID NO: 1136891 - RNA, 19 nt, Human
uagcacucugggagggcug

SEQ ID NO: 1136892 - RNA, 22 nt, Human
uagcacucugggagggcugugg

SEQ ID NO: 1136893 - RNA, 24 nt, Human
uagcacucugggagggcugugggc

SEQ ID NO: 1136894 - RNA, 18 nt, Human
uagggcaggucugccucc

SEQ ID NO: 1136895 - RNA, 25 nt, Human
ucaaaaagcaggggaccaaaacuga

SEQ ID NO: 1136896 - RNA, 18 nt, Human
ucacugcaaccuccaccc

SEQ ID NO: 1136897 - RNA, 21 nt, Human
ucacugcaaccuccaccccaa

SEQ ID NO: 1136898 - RNA, 20 nt, Human
ucagaugcccuucccgugcu

SEQ ID NO: 1136899 - RNA, 21 nt, Human
ucauucauucgucggaugugu

SEQ ID NO: 1136900 - RNA, 23 nt, Human
uccaccauuguaaaaaaaauaaa

SEQ ID NO: 1136901 - RNA, 20 nt, Human
uccacgggcaggagcaacgg

SEQ ID NO: 1136902 - RNA, 26 nt, Human
uccagccaagcaugguuucaaacaug

SEQ ID NO: 1136903 - RNA, 18 nt, Human
uccaggaugucgaggggg

SEQ ID NO: 1136904 - RNA, 24 nt, Human
uccaucagcagcucccccacauaa

SEQ ID NO: 1136905 - RNA, 18 nt, Human
uccaugcugagccucccc

SEQ ID NO: 1136906 - RNA, 18 nt, Human
ucccaccuccuugugucc

SEQ ID NO: 1136907 - RNA, 19 nt, Human
ucccagccgggggcacagg

SEQ ID NO: 1136908 - RNA, 24 nt, Human
ucccucacuccccuguuucauucc

SEQ ID NO: 1136909 - RNA, 21 nt, Human
ucccuggggaggggguggugg

SEQ ID NO: 1136910 - RNA, 18 nt, Human
ucccuguucccccccccc

SEQ ID NO: 1136911 - RNA, 24 nt, Human
ucucacucuguugaccaggcugga

SEQ ID NO: 1136912 - RNA, 22 nt, Human
ucucccagccugcaggugcccc

SEQ ID NO: 1136913 - RNA, 24 nt, Human
ucucccagccugcaggugccccug

SEQ ID NO: 1136914 - RNA, 23 nt, Human
ucugugcaaucaaauugaaggca

SEQ ID NO: 1136915 - RNA, 19 nt, Human
ucuguugaccaggcuggag

SEQ ID NO: 1136916 - RNA, 24 nt, Human
ucuguugaccaggcuggaguguag

SEQ ID NO: 1136917 - RNA, 22 nt, Human
ugaaacagcacccucugcuucg

SEQ ID NO: 1136918 - RNA, 18 nt, Human
ugaacugggggaugggcu

SEQ ID NO: 1136919 - RNA, 21 nt, Human
ugaccugacccuuagucaacc

SEQ ID NO: 1136920 - RNA, 18 nt, Human
ugagacagagucucacuc

SEQ ID NO: 1136921 - RNA, 22 nt, Human
ugagacagagucucacucuguu

SEQ ID NO: 1136922 - RNA, 20 nt, Human
ugaugaugagcgagauggac

SEQ ID NO: 1136923 - RNA, 22 nt, Human
ugcaaaacagaacucaaguuaa

SEQ ID NO: 1136924 - RNA, 25 nt, Human
ugcccagguaaccgcuccugggagc

SEQ ID NO: 1136925 - RNA, 18 nt, Human
ugcugcugaccccaaggc

SEQ ID NO: 1136926 - RNA, 23 nt, Human
ugcuucgguccucugugcaauca

SEQ ID NO: 1136927 - RNA, 23 nt, Human
uggcaggaccaacaccgggucug

SEQ ID NO: 1136928 - RNA, 27 nt, Human
uggcauccagauuugcauaagauggac

SEQ ID NO: 1136929 - RNA, 23 nt, Human
uggcugggccucugaccuugcug

SEQ ID NO: 1136930 - RNA, 22 nt, Human
ugggcaugagcagcgaggacuc

SEQ ID NO: 1136931 - RNA, 24 nt, Human
ugggguccuaaagucugcuguccu

SEQ ID NO: 1136932 - RNA, 19 nt, Human
uuccagauaacaaggacgu

SEQ ID NO: 1136933 - RNA, 21 nt, Human
uuccaggaccuacugccuccc

SEQ ID NO: 1136934 - RNA, 23 nt, Human
uucucaaggaggccaagugggug

SEQ ID NO: 1136935 - RNA, 18 nt, Human
uugaacucucgagagcug

SEQ ID NO: 1136936 - RNA, 18 nt, Human
uugcagagggaggacagg

SEQ ID NO: 1136937 - RNA, 25 nt, Human
uugggcucccuggggaggggguggu

SEQ ID NO: 1136938 - RNA, 20 nt, Human
uugguuugagagcaguucau

SEQ ID NO: 1136939 - RNA, 24 nt, Human
uuuaacccaaccucaaaaagcagg

SEQ ID NO: 1136940 - RNA, 21 nt, Human
uuugcauaagauggacugggu

SEQ ID NO: 1136941 - RNA, 22 nt, Human
uuuguugguuugagagcaguuc

SEQ ID NO: 1136942 - RNA, 22 nt, Human
uuuuuuuuuuuucaaacaaucu

SEQ ID NO: 1136943 - RNA, 23 nt, Human
aagggcuuccugccucagcuucc

SEQ ID NO: 1136944 - RNA, 24 nt, Human
acaaagcaaugagaaggcaucaga

SEQ ID NO: 1136945 - RNA, 25 nt, Human
acaaagcaaugagaaggcaucagag

SEQ ID NO: 1136946 - RNA, 25 nt, Human
acaaagcaaugagaaggcaucagag

SEQ ID NO: 1136947 - RNA, 26 nt, Human
acaaagcaaugagaaggcaucagagg

SEQ ID NO: 1136948 - RNA, 19 nt, Human
acacaaaguccaggcuaug

SEQ ID NO: 1136949 - RNA, 19 nt, Human
acagggcacucucuccagc

SEQ ID NO: 1136950 - RNA, 22 nt, Human
agaaggaggacacgggcacagg

SEQ ID NO: 1136951 - RNA, 19 nt, Human
agagagcaggagggaacgg

SEQ ID NO: 1136952 - RNA, 19 nt, Human
agcaggagggaacgggccu

SEQ ID NO: 1136953 - RNA, 20 nt, Human
agcaggagggaacgggccug

SEQ ID NO: 1136954 - RNA, 23 nt, Human
aggaccgaaagucgcuuuggggc

SEQ ID NO: 1136955 - RNA, 25 nt, Human
aggagggaacgggccuggggcguga

SEQ ID NO: 1136956 - RNA, 18 nt, Human
aggcgcugagcggugggg

SEQ ID NO: 1136957 - RNA, 24 nt, Human
aggcgcugagcgguggggauggca

SEQ ID NO: 1136958 - RNA, 23 nt, Human
aggcgugcagggcgagggcggcg

SEQ ID NO: 1136959 - RNA, 19 nt, Human
agggagcacaaagcaauga

SEQ ID NO: 1136960 - RNA, 24 nt, Human
augagugcucuucggccgcccaaa

SEQ ID NO: 1136961 - RNA, 21 nt, Human
caccagagagcaggagggaac

SEQ ID NO: 1136962 - RNA, 22 nt, Human
cacggcaaacucugccucccag

SEQ ID NO: 1136963 - RNA, 20 nt, Human
cacucucuccagcagacgcc

SEQ ID NO: 1136964 - RNA, 23 nt, Human
cccauagucagggaaguccaggc

SEQ ID NO: 1136965 - RNA, 22 nt, Human
cccauggguaacagcguggccu

SEQ ID NO: 1136966 - RNA, 18 nt, Human
ccccaggauaagggaauc

SEQ ID NO: 1136967 - RNA, 24 nt, Human
ccccgcagccagguccacauccag

SEQ ID NO: 1136968 - RNA, 19 nt, Human
ccggcgcccgucuccccgc

SEQ ID NO: 1136969 - RNA, 25 nt, Human
cgcuuuggggccggcgcccgucucc

SEQ ID NO: 1136970 - RNA, 24 nt, Human
cggcaagugacuaaagggcuuccu

SEQ ID NO: 1136971 - RNA, 20 nt, Human
cggcucgacacaaaguccag

SEQ ID NO: 1136972 - RNA, 23 nt, Human
cgugcagggcgagggcggcgcgg

SEQ ID NO: 1136973 - RNA, 18 nt, Human
cuccggccgggccuggcc

SEQ ID NO: 1136974 - RNA, 24 nt, Human
cucgcucugucgcccaggcuggag

SEQ ID NO: 1136975 - RNA, 19 nt, Human
cucugucgcccaggcugga

SEQ ID NO: 1136976 - RNA, 20 nt, Human
cucugucgcccaggcuggag

SEQ ID NO: 1136977 - RNA, 20 nt, Human
cuuaggacccgugagccggg

SEQ ID NO: 1136978 - RNA, 23 nt, Human
gagcaggagggaacgggccuggu

SEQ ID NO: 1136979 - RNA, 24 nt, Human
gauggcagguaggcugcgugcagg

SEQ ID NO: 1136980 - RNA, 18 nt, Human
gcccugccggcuugaggc

SEQ ID NO: 1136981 - RNA, 21 nt, Human
ggaugcugucgucccccagga

SEQ ID NO: 1136982 - RNA, 20 nt, Human
ggccuggggcgugaauccgg

SEQ ID NO: 1136983 - RNA, 21 nt, Human
ggccuggggcgugaauccggc

SEQ ID NO: 1136984 - RNA, 21 nt, Human
ggccuugaggcucagggagca

SEQ ID NO: 1136985 - RNA, 20 nt, Human
gggccggcgcccgucucccc

SEQ ID NO: 1136986 - RNA, 21 nt, Human
gggccuggggcgugaauccgg

SEQ ID NO: 1136987 - RNA, 18 nt, Human
gggcggcgcgggccuccg

SEQ ID NO: 1136988 - RNA, 20 nt, Human
ggggcaaagaugcuacggug

SEQ ID NO: 1136989 - RNA, 23 nt, Human
gugcaguggcacaaucucggcuc

SEQ ID NO: 1136990 - RNA, 19 nt, Human
uacauggcaggcgucgggg

SEQ ID NO: 1136991 - RNA, 23 nt, Human
uaggacccgugagccggccuaaa

SEQ ID NO: 1136992 - RNA, 21 nt, Human
uccugccucagcuuccccacc

SEQ ID NO: 1136993 - RNA, 18 nt, Human
ucgcccaggcuggagugc

SEQ ID NO: 1136994 - RNA, 24 nt, Human
ucgcucugucgcccaggcuggagu

SEQ ID NO: 1136995 - RNA, 22 nt, Human
ucuccagcagacgcccucuuca

SEQ ID NO: 1136996 - RNA, 26 nt, Human
ucuccagcagacgcccucuucaucgg

SEQ ID NO: 1136997 - RNA, 19 nt, Human
ucucgcucugucgcccagg

SEQ ID NO: 1136998 - RNA, 23 nt, Human
ucucgcucugucgcccaggcugg

SEQ ID NO: 1136999 - RNA, 24 nt, Human
ucucgcucugucgcccaggcugga

SEQ ID NO: 1137000 - RNA, 23 nt, Human
ucugucgcccaggcuggagugcg

SEQ ID NO: 1137001 - RNA, 22 nt, Human
ugagauggggucucgcucuguc

SEQ ID NO: 1137002 - RNA, 24 nt, Human
ugcagggcgagggcggcgcgggcc

SEQ ID NO: 1137003 - RNA, 22 nt, Human
ugcaguggcacaaucucggcuc

SEQ ID NO: 1137004 - RNA, 21 nt, Human
ugccucagcuuccccaccuga

SEQ ID NO: 1137005 - RNA, 19 nt, Human
ugccuuaggacccgugagc

SEQ ID NO: 1137006 - RNA, 24 nt, Human
uggcacaaucucggcucacggcaa

SEQ ID NO: 1137007 - RNA, 20 nt, Human
uggggcaugggaggcccacc

SEQ ID NO: 1137008 - RNA, 24 nt, Human
uggggucucgcucugucgcccagg

SEQ ID NO: 1137009 - RNA, 22 nt, Human
uuugagauggggucucgcucug

SEQ ID NO: 1137010 - RNA, 24 nt, Human
uuuuugagauggggucucgcucug

SEQ ID NO: 1137011 - RNA, 22 nt, Human
aaagucacaaaaaagucacaaa

SEQ ID NO: 1137012 - RNA, 22 nt, Human
aaagucacaaaaaagucacaaa

SEQ ID NO: 1137013 - RNA, 21 nt, Human
aacagaggaacucgaaagaga

SEQ ID NO: 1137014 - RNA, 28 nt, Human
aagaagaguaggggaauugccgguaccc

SEQ ID NO: 1137015 - RNA, 23 nt, Human
aagaguaggggaauugcccuucc

SEQ ID NO: 1137016 - RNA, 18 nt, Human
aagcagacacaaggacaa

SEQ ID NO: 1137017 - RNA, 24 nt, Human
aagcgauccuuuugccuuggcuuc

SEQ ID NO: 1137018 - RNA, 21 nt, Human
aaguguugggauuaccggugu

SEQ ID NO: 1137019 - RNA, 23 nt, Human
aaguguugggauuaccgguguga

SEQ ID NO: 1137020 - RNA, 26 nt, Human
aaguguugggauuaccggugugagcc

SEQ ID NO: 1137021 - RNA, 21 nt, Human
aauuauuuuaaaaaagaaauc

SEQ ID NO: 1137022 - RNA, 22 nt, Human
acaccgacacaccucucugagc

SEQ ID NO: 1137023 - RNA, 24 nt, Human
acaggcuaaagaauaaacaacaua

SEQ ID NO: 1137024 - RNA, 20 nt, Human
accaccucccagccaccacc

SEQ ID NO: 1137025 - RNA, 19 nt, Human
accaggcuggagaguggcc

SEQ ID NO: 1137026 - RNA, 19 nt, Human
acccacagacguguccagg

SEQ ID NO: 1137027 - RNA, 23 nt, Human
acccaggcuggagugcaguggug

SEQ ID NO: 1137028 - RNA, 24 nt, Human
acccaggcuggagugcaguggugu

SEQ ID NO: 1137029 - RNA, 22 nt, Human
accccgggccaugaggacggca

SEQ ID NO: 1137030 - RNA, 21 nt, Human
accucccagccaccaccacac

SEQ ID NO: 1137031 - RNA, 19 nt, Human
accuccccucuuacaccac

SEQ ID NO: 1137032 - RNA, 18 nt, Human
agaacgccacggccacag

SEQ ID NO: 1137033 - RNA, 19 nt, Human
agaagacuaacaaagucag

SEQ ID NO: 1137034 - RNA, 23 nt, Human
agaguggccugggcacagaggcc

SEQ ID NO: 1137035 - RNA, 25 nt, Human
agcaaggugcaugaggauggggugu

SEQ ID NO: 1137036 - RNA, 21 nt, Human
aggaaaacggcagguaguuag

SEQ ID NO: 1137037 - RNA, 19 nt, Human
aggcagagcucugacacuc

SEQ ID NO: 1137038 - RNA, 21 nt, Human
aggcagagcucugacacuccu

SEQ ID NO: 1137039 - RNA, 21 nt, Human
aggcuggucuccaacuccugg

SEQ ID NO: 1137040 - RNA, 22 nt, Human
agggagagcgggaagcaaggga

SEQ ID NO: 1137041 - RNA, 18 nt, Human
aggggccagugcacagaa

SEQ ID NO: 1137042 - RNA, 18 nt, Human
aggugcaugaggaugggg

SEQ ID NO: 1137043 - RNA, 23 nt, Human
agugcagugguguggucuuggcu

SEQ ID NO: 1137044 - RNA, 24 nt, Human
agugcagugguguggucuuggcuc

SEQ ID NO: 1137045 - RNA, 25 nt, Human
aucuuuuuuuuuuuuuuuuuuuugg

SEQ ID NO: 1137046 - RNA, 24 nt, Human
auggcuggggcagcgcuggagggg

SEQ ID NO: 1137047 - RNA, 25 nt, Human
auucuaaaauguauauggaaagcca

SEQ ID NO: 1137048 - RNA, 25 nt, Human
auucugucacccaggcuggagugca

SEQ ID NO: 1137049 - RNA, 18 nt, Human
caaagcacaauccauaga

SEQ ID NO: 1137050 - RNA, 18 nt, Human
caacaccuccccucuuac

SEQ ID NO: 1137051 - RNA, 24 nt, Human
caacuccugggcucaagcgauccu

SEQ ID NO: 1137052 - RNA, 19 nt, Human
caagcgauccuuuugccuu

SEQ ID NO: 1137053 - RNA, 22 nt, Human
caagcgauccuuuugccuuggc

SEQ ID NO: 1137054 - RNA, 27 nt, Human
caagcgauccuuuugccuuggcuuccc

SEQ ID NO: 1137055 - RNA, 21 nt, Human
cacaaaaaagucacaaaggug

SEQ ID NO: 1137056 - RNA, 23 nt, Human
caccaggaagcugcgugacccug

SEQ ID NO: 1137057 - RNA, 21 nt, Human
cacccaggcuggagugcagug

SEQ ID NO: 1137058 - RNA, 22 nt, Human
caccucccagccaccaccacac

SEQ ID NO: 1137059 - RNA, 19 nt, Human
caccucgcugcagcaggac

SEQ ID NO: 1137060 - RNA, 18 nt, Human
cagcaucuuuuuuuuuuu

SEQ ID NO: 1137061 - RNA, 21 nt, Human
cagccaccaccacacacccuc

SEQ ID NO: 1137062 - RNA, 20 nt, Human
cagccucaagcaaucuuccu

SEQ ID NO: 1137063 - RNA, 22 nt, Human
cagggcaaggcccacaucuguc

SEQ ID NO: 1137064 - RNA, 18 nt, Human
cauggcuggggcagcgcu

SEQ ID NO: 1137065 - RNA, 23 nt, Human
ccaacaccuccccucuuacacca

SEQ ID NO: 1137066 - RNA, 23 nt, Human
ccaaguguugggauuaccggugu

SEQ ID NO: 1137067 - RNA, 24 nt, Human
ccaaguguugggauuaccggugug

SEQ ID NO: 1137068 - RNA, 21 nt, Human
ccacagaggaccccagcaccc

SEQ ID NO: 1137069 - RNA, 21 nt, Human
ccaccaugccuggccagcauc

SEQ ID NO: 1137070 - RNA, 19 nt, Human
ccagaacagacuucaccag

SEQ ID NO: 1137071 - RNA, 20 nt, Human
ccaggcuggucuccaacucc

SEQ ID NO: 1137072 - RNA, 19 nt, Human
cccaacaccuccccucuua

SEQ ID NO: 1137073 - RNA, 18 nt, Human
cccaaguguugggauuac

SEQ ID NO: 1137074 - RNA, 18 nt, Human
cccacagggcaaggccca

SEQ ID NO: 1137075 - RNA, 18 nt, Human
ccccaacaccuccccucu

SEQ ID NO: 1137076 - RNA, 24 nt, Human
ccccaacaccuccccucuuacacc

SEQ ID NO: 1137077 - RNA, 26 nt, Human
cccgugcccuggccccacagggccgg

SEQ ID NO: 1137078 - RNA, 23 nt, Human
ccgaaaccucacaucucauauaa

SEQ ID NO: 1137079 - RNA, 23 nt, Human
ccuacaucagacagacauggcug

SEQ ID NO: 1137080 - RNA, 19 nt, Human
ccugcagcuggguccugac

SEQ ID NO: 1137081 - RNA, 19 nt, Human
ccugggcucaagcgauccu

SEQ ID NO: 1137082 - RNA, 18 nt, Human
ccuguguugcccaggcug

SEQ ID NO: 1137083 - RNA, 23 nt, Human
ccuguguugcccaggcuggucuc

SEQ ID NO: 1137084 - RNA, 21 nt, Human
cgaaagagacccacagacgug

SEQ ID NO: 1137085 - RNA, 24 nt, Human
cgacgucgggggcuuucacaccca

SEQ ID NO: 1137086 - RNA, 19 nt, Human
cgagaagacuaacaaaguc

SEQ ID NO: 1137087 - RNA, 21 nt, Human
cggcuuggccaccaggaagcu

SEQ ID NO: 1137088 - RNA, 25 nt, Human
cucaagcaaucuuccugccucaacg

SEQ ID NO: 1137089 - RNA, 25 nt, Human
cucccagccaccaccacacacccuc

SEQ ID NO: 1137090 - RNA, 20 nt, Human
cucccggccuuguccccacc

SEQ ID NO: 1137091 - RNA, 25 nt, Human
cuccuacaucagacagacauggcug

SEQ ID NO: 1137092 - RNA, 18 nt, Human
cuccugggccuaggcacu

SEQ ID NO: 1137093 - RNA, 24 nt, Human
cugcccgugcccuggccccacagg

SEQ ID NO: 1137094 - RNA, 21 nt, Human
cugccggccccaacaccuccc

SEQ ID NO: 1137095 - RNA, 21 nt, Human
cuguacagcuacagcacagcg

SEQ ID NO: 1137096 - RNA, 24 nt, Human
cuuauucugucacccaggcuggag

SEQ ID NO: 1137097 - RNA, 22 nt, Human
cuugagcacugccggccccaac

SEQ ID NO: 1137098 - RNA, 21 nt, Human
gaacgccacggccacagagga

SEQ ID NO: 1137099 - RNA, 23 nt, Human
gagauggggucucccuguguugc

SEQ ID NO: 1137100 - RNA, 18 nt, Human
gauuaccggugugagcca

SEQ ID NO: 1137101 - RNA, 21 nt, Human
gauuaccggugugagccacca

SEQ ID NO: 1137102 - RNA, 22 nt, Human
gauuaccggugugagccaccau

SEQ ID NO: 1137103 - RNA, 24 nt, Human
gccaaguagcuguaacuacaggug

SEQ ID NO: 1137104 - RNA, 18 nt, Human
gccagugcacagaacccg

SEQ ID NO: 1137105 - RNA, 20 nt, Human
gccccaacaccuccccucuu

SEQ ID NO: 1137106 - RNA, 19 nt, Human
gcuggggcagcgcuggagg

SEQ ID NO: 1137107 - RNA, 24 nt, Human
ggauuaccggugugagccaccaug

SEQ ID NO: 1137108 - RNA, 18 nt, Human
ggcagagcucugacacuc

SEQ ID NO: 1137109 - RNA, 18 nt, Human
ggcagcgcuggaggggag

SEQ ID NO: 1137110 - RNA, 19 nt, Human
ggccccaacaccuccccuc

SEQ ID NO: 1137111 - RNA, 20 nt, Human
ggcuaaagaauaaacaacau

SEQ ID NO: 1137112 - RNA, 20 nt, Human
ggcuggagugcaguggugug

SEQ ID NO: 1137113 - RNA, 24 nt, Human
ggcuggggcagcgcuggaggggag

SEQ ID NO: 1137114 - RNA, 22 nt, Human
gggagauguggagaccagcgga

SEQ ID NO: 1137115 - RNA, 23 nt, Human
gggcagcgcuggaggggagaugu

SEQ ID NO: 1137116 - RNA, 21 nt, Human
gggccuaggcacugcaggaaa

SEQ ID NO: 1137117 - RNA, 23 nt, Human
gguguacgaggcuagcuugguau

SEQ ID NO: 1137118 - RNA, 19 nt, Human
guaaaacacagaauuauuu

SEQ ID NO: 1137119 - RNA, 21 nt, Human
guguuuuuuucauagagaugg

SEQ ID NO: 1137120 - RNA, 18 nt, Human
uaaaaaagaaaucuucag

SEQ ID NO: 1137121 - RNA, 22 nt, Human
uaaccccaagugggauuccuuc

SEQ ID NO: 1137122 - RNA, 18 nt, Human
uacaccaccugcuugugu

SEQ ID NO: 1137123 - RNA, 24 nt, Human
uaccggugugagccaccaugccug

SEQ ID NO: 1137124 - RNA, 19 nt, Human
uaugccgugaccaaguggg

SEQ ID NO: 1137125 - RNA, 22 nt, Human
ucacccaggcuggagugcagug

SEQ ID NO: 1137126 - RNA, 18 nt, Human
ucaccgggcucaggggag

SEQ ID NO: 1137127 - RNA, 22 nt, Human
ucauagagauggggucucccug

SEQ ID NO: 1137128 - RNA, 21 nt, Human
uccagauagacggcucgaucc

SEQ ID NO: 1137129 - RNA, 23 nt, Human
uccccaaguguugggauuaccgg

SEQ ID NO: 1137130 - RNA, 18 nt, Human
ucccggccuuguccccac

SEQ ID NO: 1137131 - RNA, 19 nt, Human
ucccggccuuguccccacc

SEQ ID NO: 1137132 - RNA, 21 nt, Human
ucccuguguugcccaggcugg

SEQ ID NO: 1137133 - RNA, 20 nt, Human
uccugggcucaagcgauccu

SEQ ID NO: 1137134 - RNA, 20 nt, Human
uccugggcucaagcgauccu

SEQ ID NO: 1137135 - RNA, 21 nt, Human
uccugggcucaagcgauccuu

SEQ ID NO: 1137136 - RNA, 24 nt, Human
uccugggcucaagcgauccuuuug

SEQ ID NO: 1137137 - RNA, 23 nt, Human
ucuccaacuccugggcucaagcg

SEQ ID NO: 1137138 - RNA, 19 nt, Human
ucucccuguguugcccagg

SEQ ID NO: 1137139 - RNA, 23 nt, Human
ucucccuguguugcccaggcugg

SEQ ID NO: 1137140 - RNA, 24 nt, Human
ucucccuguguugcccaggcuggu

SEQ ID NO: 1137141 - RNA, 19 nt, Human
ucugucacccaggcuggag

SEQ ID NO: 1137142 - RNA, 24 nt, Human
ucugucacccaggcuggagugcag

SEQ ID NO: 1137143 - RNA, 23 nt, Human
ucuuauucugucacccaggcugg

SEQ ID NO: 1137144 - RNA, 24 nt, Human
ucuuauucugucacccaggcugga

SEQ ID NO: 1137145 - RNA, 19 nt, Human
ucuugcuucucucuuuucc

SEQ ID NO: 1137146 - RNA, 26 nt, Human
ucuuuuuuuuuuuuuuuuuuuugggg

SEQ ID NO: 1137147 - RNA, 22 nt, Human
ugaacuuacauguaaaacacag

SEQ ID NO: 1137148 - RNA, 19 nt, Human
ugacuugagcacugccggc

SEQ ID NO: 1137149 - RNA, 21 nt, Human
ugaggaugggguguccugcag

SEQ ID NO: 1137150 - RNA, 24 nt, Human
ugcccaggcuggucuccaacuccu

SEQ ID NO: 1137151 - RNA, 28 nt, Human
ugcccaggcuggucuccaacuccugggc

SEQ ID NO: 1137152 - RNA, 21 nt, Human
ugcccuggugccaucggaugg

SEQ ID NO: 1137153 - RNA, 24 nt, Human
ugccucaacgugccaaguagcugu

SEQ ID NO: 1137154 - RNA, 19 nt, Human
ugccuuggcuuccccaagu

SEQ ID NO: 1137155 - RNA, 19 nt, Human
ugccuuggcuuccccaagu

SEQ ID NO: 1137156 - RNA, 23 nt, Human
ugcgugacccugggcacaccgac

SEQ ID NO: 1137157 - RNA, 19 nt, Human
ugcucccucuccugggccu

SEQ ID NO: 1137158 - RNA, 22 nt, Human
uggaggggagauguggagacca

SEQ ID NO: 1137159 - RNA, 23 nt, Human
uggaggggagauguggagaccag

SEQ ID NO: 1137160 - RNA, 20 nt, Human
uggagugcaguggugugguc

SEQ ID NO: 1137161 - RNA, 23 nt, Human
uggagugcagugguguggucuug

SEQ ID NO: 1137162 - RNA, 24 nt, Human
uggagugcagugguguggucuugg

SEQ ID NO: 1137163 - RNA, 22 nt, Human
uggcaucagcagccaucgugag

SEQ ID NO: 1137164 - RNA, 27 nt, Human
uggccagcaucuuuuuuuuuuuuuuuu

SEQ ID NO: 1137165 - RNA, 21 nt, Human
uggccugggcacagaggccgg

SEQ ID NO: 1137166 - RNA, 18 nt, Human
ugggauuaccggugugag

SEQ ID NO: 1137167 - RNA, 22 nt, Human
ugggauuaccggugugagccac

SEQ ID NO: 1137168 - RNA, 24 nt, Human
ugggauuaccggugugagccacca

SEQ ID NO: 1137169 - RNA, 25 nt, Human
ugggauuaccggugugagccaccau

SEQ ID NO: 1137170 - RNA, 20 nt, Human
ugggauuccugcccgugccc

SEQ ID NO: 1137171 - RNA, 19 nt, Human
ugggcacaccgacacaccu

SEQ ID NO: 1137172 - RNA, 21 nt, Human
ugggcacagaggccggggcug

SEQ ID NO: 1137173 - RNA, 23 nt, Human
ugggcauugccgagaagacuaac

SEQ ID NO: 1137174 - RNA, 19 nt, Human
ugggcucaagcgauccuuu

SEQ ID NO: 1137175 - RNA, 24 nt, Human
ugggcucaagcgauccuuuugccu

SEQ ID NO: 1137176 - RNA, 24 nt, Human
uggggucucccuguguugcccagg

SEQ ID NO: 1137177 - RNA, 26 nt, Human
uggggucucccuguguugcccaggcc

SEQ ID NO: 1137178 - RNA, 21 nt, Human
ugggguguccugcagcugggu

SEQ ID NO: 1137179 - RNA, 24 nt, Human
ugguguggucuuggcucacugcag

SEQ ID NO: 1137180 - RNA, 24 nt, Human
uguaacuacaggugcgcaccacca

SEQ ID NO: 1137181 - RNA, 21 nt, Human
uguaucaugaacuuacaugua

SEQ ID NO: 1137182 - RNA, 20 nt, Human
uguccaggccacuuucuaac

SEQ ID NO: 1137183 - RNA, 21 nt, Human
ugucuugcuucucucuuuucc

SEQ ID NO: 1137184 - RNA, 20 nt, Human
ugucuuugcuacagcuggag

SEQ ID NO: 1137185 - RNA, 24 nt, Human
uguggggggagggagagcgggaag

SEQ ID NO: 1137186 - RNA, 19 nt, Human
uguugcccaggcuggucuc

SEQ ID NO: 1137187 - RNA, 22 nt, Human
uguugcccaggcuggucuccaa

SEQ ID NO: 1137188 - RNA, 24 nt, Human
uuauucugucacccaggcuggagu

SEQ ID NO: 1137189 - RNA, 23 nt, Human
uucauagagauggggucucccug

SEQ ID NO: 1137190 - RNA, 20 nt, Human
uuguccccaccucgcugcag

SEQ ID NO: 1137191 - RNA, 20 nt, Human
uuuuuuuuuuuuuuuuuggu

SEQ ID NO: 1137192 - RNA, 22 nt, Human
uuuuuuuuuuuuuuuuugguag

SEQ ID NO: 1137193 - RNA, 21 nt, Human
acagaucaggcaaaccaacca

SEQ ID NO: 1137194 - RNA, 22 nt, Human
agauacagaucaggcaaaccaa

SEQ ID NO: 1137195 - RNA, 23 nt, Human
agaucaggcaaaccaaccaaggg

SEQ ID NO: 1137196 - RNA, 19 nt, Human
cagaucaggcaaaccaacc

SEQ ID NO: 1137197 - RNA, 20 nt, Human
cagaucaggcaaaccaacca

SEQ ID NO: 1137198 - RNA, 22 nt, Human
cagcuguagaugaagcccccag

SEQ ID NO: 1137199 - RNA, 18 nt, Human
gagaagaaaucauaagcc

SEQ ID NO: 1137200 - RNA, 19 nt, Human
cagggagcucccuggcuga

SEQ ID NO: 1137201 - RNA, 18 nt, Human
ccuggcugaugagguggg

SEQ ID NO: 1137202 - RNA, 22 nt, Human
uauuuuagaccacagccuguug

SEQ ID NO: 1137203 - RNA, 22 nt, Human
ucagguccuccuccaggcucac

SEQ ID NO: 1137204 - RNA, 19 nt, Human
ucccuggcugaugaggugg

SEQ ID NO: 1137205 - RNA, 20 nt, Human
ucccuggcugaugagguggg

SEQ ID NO: 1137206 - RNA, 19 nt, Human
uccuccaggcucacuaggu

SEQ ID NO: 1137207 - RNA, 19 nt, Human
uccuccaggcucacuaggu

SEQ ID NO: 1137208 - RNA, 18 nt, Human
ucugggcccgggaagccc

SEQ ID NO: 1137209 - RNA, 24 nt, Human
ugagguggggucaggauggauguc

SEQ ID NO: 1137210 - RNA, 22 nt, Human
ugugugccucucucgauggccc

SEQ ID NO: 1137211 - RNA, 26 nt, Human
uguugugugccucucucgauggccug

SEQ ID NO: 1137212 - RNA, 18 nt, Human
aaagaugcuucucagugu

SEQ ID NO: 1137213 - RNA, 24 nt, Human
aaaggacuccagccagcggcaccc

SEQ ID NO: 1137214 - RNA, 22 nt, Human
aaagggcccccagacccagaca

SEQ ID NO: 1137215 - RNA, 18 nt, Human
aaaugcaucuaaagucac

SEQ ID NO: 1137216 - RNA, 26 nt, Human
aacagcagaaugugacccaggagaaa

SEQ ID NO: 1137217 - RNA, 18 nt, Human
aacaggugugaagaggau

SEQ ID NO: 1137218 - RNA, 20 nt, Human
aacccuaagucuauacuccc

SEQ ID NO: 1137219 - RNA, 25 nt, Human
aacugagaagagaagggcugguuca

SEQ ID NO: 1137220 - RNA, 22 nt, Human
aacugggggagccccugcaagc

SEQ ID NO: 1137221 - RNA, 22 nt, Human
aagaccagagaaugaccacuaa

SEQ ID NO: 1137222 - RNA, 25 nt, Human
aagacccucucuuuucaggggaguc

SEQ ID NO: 1137223 - RNA, 18 nt, Human
aagcgccucccaucucaa

SEQ ID NO: 1137224 - RNA, 20 nt, Human
aaggugccaccugcaagcca

SEQ ID NO: 1137225 - RNA, 25 nt, Human
aaugcaucuaaagucacaguguuaa

SEQ ID NO: 1137226 - RNA, 23 nt, Human
acagagaaaaggccaugugagga

SEQ ID NO: 1137227 - RNA, 22 nt, Human
acaggcaagcacauuccuucca

SEQ ID NO: 1137228 - RNA, 20 nt, Human
accaaggaagucccccacaa

SEQ ID NO: 1137229 - RNA, 18 nt, Human
acccauuuccccucccac

SEQ ID NO: 1137230 - RNA, 22 nt, Human
accucucugcuccuccucccca

SEQ ID NO: 1137231 - RNA, 23 nt, Human
acugucuccucuggagggagcug

SEQ ID NO: 1137232 - RNA, 21 nt, Human
agaagaccagagaaugaccac

SEQ ID NO: 1137233 - RNA, 23 nt, Human
agaagaggaggagacaccagagc

SEQ ID NO: 1137234 - RNA, 23 nt, Human
agacacuuacacugagaaaaaug

SEQ ID NO: 1137235 - RNA, 22 nt, Human
agaccagaagagggcaggcugg

SEQ ID NO: 1137236 - RNA, 25 nt, Human
agacccagacaauagggcccagcag

SEQ ID NO: 1137237 - RNA, 18 nt, Human
agauccugacugucuccu

SEQ ID NO: 1137238 - RNA, 22 nt, Human
agccuccuucuaauagcaguuc

SEQ ID NO: 1137239 - RNA, 20 nt, Human
aggcacugugcuaggcacac

SEQ ID NO: 1137240 - RNA, 19 nt, Human
agggagucacccagcgggc

SEQ ID NO: 1137241 - RNA, 19 nt, Human
aggguuguagcccaggccc

SEQ ID NO: 1137242 - RNA, 25 nt, Human
agguucccuucacucacucccuguu

SEQ ID NO: 1137243 - RNA, 21 nt, Human
agucacaguguuaacucuuca

SEQ ID NO: 1137244 - RNA, 18 nt, Human
agugcagagggcucuuug

SEQ ID NO: 1137245 - RNA, 21 nt, Human
agugcugaaacugagaagaga

SEQ ID NO: 1137246 - RNA, 18 nt, Human
aucacccuuucugggacc

SEQ ID NO: 1137247 - RNA, 18 nt, Human
aucccaacaggugugaag

SEQ ID NO: 1137248 - RNA, 20 nt, Human
auggagacaaaggacuccag

SEQ ID NO: 1137249 - RNA, 23 nt, Human
caaaaaaaaaaaaaaauagauaa

SEQ ID NO: 1137250 - RNA, 25 nt, Human
caaagagaaguccaggccaggaguc

SEQ ID NO: 1137251 - RNA, 23 nt, Human
caacaacagcagaaugugaccca

SEQ ID NO: 1137252 - RNA, 23 nt, Human
caacuggcagaccugagucagga

SEQ ID NO: 1137253 - RNA, 26 nt, Human
caccagaaaccaagucuuaacaccuu

SEQ ID NO: 1137254 - RNA, 27 nt, Human
caccagaaaccaagucuuaacaccuuc

SEQ ID NO: 1137255 - RNA, 21 nt, Human
cacccgggagugggggcacga

SEQ ID NO: 1137256 - RNA, 24 nt, Human
caccuugaucuggacuuuccagcc

SEQ ID NO: 1137257 - RNA, 26 nt, Human
cacucuucaccuauauuucccccaaa

SEQ ID NO: 1137258 - RNA, 27 nt, Human
cacuguggccagaauccaaggucaccc

SEQ ID NO: 1137259 - RNA, 21 nt, Human
cagaaaccaagucuuaacacc

SEQ ID NO: 1137260 - RNA, 21 nt, Human
cagcacagggggaaggcucca

SEQ ID NO: 1137261 - RNA, 19 nt, Human
cagcacccgggaguggggg

SEQ ID NO: 1137262 - RNA, 24 nt, Human
cagcagcccucucuggggucucuc

SEQ ID NO: 1137263 - RNA, 23 nt, Human
cagcaggcagggcccgagcaggu

SEQ ID NO: 1137264 - RNA, 23 nt, Human
cagcaugguaccugccacucucc

SEQ ID NO: 1137265 - RNA, 23 nt, Human
cagccuccagaacuggcagaaaa

SEQ ID NO: 1137266 - RNA, 21 nt, Human
cagccucccucccucuggucc

SEQ ID NO: 1137267 - RNA, 21 nt, Human
cagcggcacccgaggagcugc

SEQ ID NO: 1137268 - RNA, 24 nt, Human
cagcuugcuaggaagcuguuccag

SEQ ID NO: 1137269 - RNA, 21 nt, Human
cagggggaaggcuccagcucc

SEQ ID NO: 1137270 - RNA, 28 nt, Human
cagguucccuucacucacucccuguuuc

SEQ ID NO: 1137271 - RNA, 21 nt, Human
cagugcaacuagaagcagcga

SEQ ID NO: 1137272 - RNA, 25 nt, Human
caugaaaugcugccaccuccccaag

SEQ ID NO: 1137273 - RNA, 20 nt, Human
ccacaaaaugacaauuacgc

SEQ ID NO: 1137274 - RNA, 25 nt, Human
ccacaaaaugacaauuacgcacuga

SEQ ID NO: 1137275 - RNA, 20 nt, Human
ccacagagaaaaggccaugu

SEQ ID NO: 1137276 - RNA, 23 nt, Human
ccaccaaggaagucccccacaaa

SEQ ID NO: 1137277 - RNA, 21 nt, Human
ccaccugcaagccaaggagag

SEQ ID NO: 1137278 - RNA, 24 nt, Human
ccaccugcaagccaaggagagagg

SEQ ID NO: 1137279 - RNA, 21 nt, Human
ccagacccagacaauagggcc

SEQ ID NO: 1137280 - RNA, 21 nt, Human
ccagagagccaaaaaaaaaaa

SEQ ID NO: 1137281 - RNA, 22 nt, Human
ccagccagcggcacccgaggag

SEQ ID NO: 1137282 - RNA, 21 nt, Human
ccagcucugcuccugccacac

SEQ ID NO: 1137283 - RNA, 22 nt, Human
ccaggcacucagaacuugugcc

SEQ ID NO: 1137284 - RNA, 23 nt, Human
cccaacaacagcagaaugugacc

SEQ ID NO: 1137285 - RNA, 21 nt, Human
cccaagcugauuaaagaguga

SEQ ID NO: 1137286 - RNA, 21 nt, Human
cccacaaaaugacaauuacgc

SEQ ID NO: 1137287 - RNA, 21 nt, Human
cccagauccugacugucuccu

SEQ ID NO: 1137288 - RNA, 20 nt, Human
ccccacaaaaugacaauuac

SEQ ID NO: 1137289 - RNA, 24 nt, Human
ccccagacccagacaauagggccc

SEQ ID NO: 1137290 - RNA, 23 nt, Human
ccccagcaugguaccugccacuc

SEQ ID NO: 1137291 - RNA, 24 nt, Human
cccccagacccagacaauagggcc

SEQ ID NO: 1137292 - RNA, 24 nt, Human
cccgaggagcugcaucugcccucu

SEQ ID NO: 1137293 - RNA, 19 nt, Human
cccuccuucuccccugccc

SEQ ID NO: 1137294 - RNA, 21 nt, Human
cccucguucuguggaccuugg

SEQ ID NO: 1137295 - RNA, 20 nt, Human
cccucuggcugccccuccca

SEQ ID NO: 1137296 - RNA, 22 nt, Human
cccucuggcugccccucccaga

SEQ ID NO: 1137297 - RNA, 24 nt, Human
cccugcacugagcccugccaguuc

SEQ ID NO: 1137298 - RNA, 21 nt, Human
cccuucugucuccucuguccc

SEQ ID NO: 1137299 - RNA, 22 nt, Human
ccucaccagaaaccaagucuua

SEQ ID NO: 1137300 - RNA, 23 nt, Human
ccuccagaacuggcagaaaauaa

SEQ ID NO: 1137301 - RNA, 25 nt, Human
ccucccaucucaaacuccuccccgc

SEQ ID NO: 1137302 - RNA, 18 nt, Human
ccucccucccucuggucc

SEQ ID NO: 1137303 - RNA, 19 nt, Human
ccucccucccucugguccc

SEQ ID NO: 1137304 - RNA, 23 nt, Human
ccugcaagccaaggagagaggcc

SEQ ID NO: 1137305 - RNA, 21 nt, Human
ccugcaagcgccucccaucuc

SEQ ID NO: 1137306 - RNA, 22 nt, Human
ccugccaccuucuguuccccaa

SEQ ID NO: 1137307 - RNA, 20 nt, Human
ccugcccuuuccugaugccc

SEQ ID NO: 1137308 - RNA, 23 nt, Human
ccuggaaauucccuucugucucc

SEQ ID NO: 1137309 - RNA, 25 nt, Human
ccuguccccauccuguaggguccuu

SEQ ID NO: 1137310 - RNA, 19 nt, Human
ccuuuggguaagacugguu

SEQ ID NO: 1137311 - RNA, 19 nt, Human
cggcucucccagggccucc

SEQ ID NO: 1137312 - RNA, 24 nt, Human
cucagccccucuggcugccccucc

SEQ ID NO: 1137313 - RNA, 22 nt, Human
cucccagggccuccgccucccu

SEQ ID NO: 1137314 - RNA, 23 nt, Human
cucccucauaccccuggagcugu

SEQ ID NO: 1137315 - RNA, 19 nt, Human
cucugccugacagccccuc

SEQ ID NO: 1137316 - RNA, 19 nt, Human
cugcccuuuccugaugccc

SEQ ID NO: 1137317 - RNA, 20 nt, Human
cugcccuuuccugaugcccc

SEQ ID NO: 1137318 - RNA, 24 nt, Human
cuguuccccaagaacagaauccag

SEQ ID NO: 1137319 - RNA, 22 nt, Human
cuuaacaccuugaucuggacuu

SEQ ID NO: 1137320 - RNA, 19 nt, Human
cuucaccuauauuuccccc

SEQ ID NO: 1137321 - RNA, 18 nt, Human
cuucagggagucacccag

SEQ ID NO: 1137322 - RNA, 21 nt, Human
cuuccugccuugacauucacu

SEQ ID NO: 1137323 - RNA, 23 nt, Human
gaaaagccccaccaaggaagucc

SEQ ID NO: 1137324 - RNA, 18 nt, Human
gaaauggaagggacccuu

SEQ ID NO: 1137325 - RNA, 20 nt, Human
gaacuugugccucaguagac

SEQ ID NO: 1137326 - RNA, 19 nt, Human
gaagaggaggagacaccag

SEQ ID NO: 1137327 - RNA, 21 nt, Human
gaauagcagcugaacggagag

SEQ ID NO: 1137328 - RNA, 23 nt, Human
gacagccccuccccgacucccau

SEQ ID NO: 1137329 - RNA, 19 nt, Human
gaccacuaauccugaccua

SEQ ID NO: 1137330 - RNA, 19 nt, Human
gacccagacaauagggccc

SEQ ID NO: 1137331 - RNA, 20 nt, Human
gacuaggacucuuuuaagac

SEQ ID NO: 1137332 - RNA, 18 nt, Human
gaugggaaauggaaggga

SEQ ID NO: 1137333 - RNA, 19 nt, Human
gauuguggggccuguccug

SEQ ID NO: 1137334 - RNA, 19 nt, Human
gcaagcacauuccuuccau

SEQ ID NO: 1137335 - RNA, 21 nt, Human
gcacuccugagccaccccagc

SEQ ID NO: 1137336 - RNA, 26 nt, Human
gcagcagcccucucuggggucucucu

SEQ ID NO: 1137337 - RNA, 25 nt, Human
gcaggaaagggcccccagacccaga

SEQ ID NO: 1137338 - RNA, 23 nt, Human
gcauggugcuguggcagcccaag

SEQ ID NO: 1137339 - RNA, 22 nt, Human
gccagaauccaaggucacccgg

SEQ ID NO: 1137340 - RNA, 23 nt, Human
gccccaugcaccagaggaaauuc

SEQ ID NO: 1137341 - RNA, 19 nt, Human
gccucccugcacugagccc

SEQ ID NO: 1137342 - RNA, 18 nt, Human
gccuuggggaaagugugg

SEQ ID NO: 1137343 - RNA, 20 nt, Human
gcgggcuagaaaaccaccgg

SEQ ID NO: 1137344 - RNA, 19 nt, Human
gcuccagcuccucccagau

SEQ ID NO: 1137345 - RNA, 22 nt, Human
gcugaugaauaguacacaccac

SEQ ID NO: 1137346 - RNA, 22 nt, Human
ggaagggacccuucugcccagc

SEQ ID NO: 1137347 - RNA, 21 nt, Human
ggagcucucucagcauaucuu

SEQ ID NO: 1137348 - RNA, 23 nt, Human
ggagcugcaucugcccucugccu

SEQ ID NO: 1137349 - RNA, 21 nt, Human
ggagcuggaauugcagauugu

SEQ ID NO: 1137350 - RNA, 18 nt, Human
ggcauggugcuguggcag

SEQ ID NO: 1137351 - RNA, 20 nt, Human
ggcccagauggagccacccc

SEQ ID NO: 1137352 - RNA, 19 nt, Human
gggaaaaaggacaucuggc

SEQ ID NO: 1137353 - RNA, 23 nt, Human
gggacugucuccucuggagggag

SEQ ID NO: 1137354 - RNA, 22 nt, Human
gggcaggcugguaggcuauggg

SEQ ID NO: 1137355 - RNA, 24 nt, Human
gggcaggcugguaggcuaugggcu

SEQ ID NO: 1137356 - RNA, 21 nt, Human
guccuggagaugcggcccaga

SEQ ID NO: 1137357 - RNA, 22 nt, Human
gugcugucuucaucaacuggca

SEQ ID NO: 1137358 - RNA, 23 nt, Human
gugugaagaggaugagaucuuca

SEQ ID NO: 1137359 - RNA, 21 nt, Human
uaaacccuaagucuauacucc

SEQ ID NO: 1137360 - RNA, 19 nt, Human
uaacucagccuucaaaagu

SEQ ID NO: 1137361 - RNA, 24 nt, Human
uaacucagccuucaaaaguuccag

SEQ ID NO: 1137362 - RNA, 22 nt, Human
uagaaaagagaaugagcuacau

SEQ ID NO: 1137363 - RNA, 19 nt, Human
uagccuaaaucuuaucucu

SEQ ID NO: 1137364 - RNA, 20 nt, Human
uagcugaauagcagcugaac

SEQ ID NO: 1137365 - RNA, 18 nt, Human
uaggauacuacacuuucc

SEQ ID NO: 1137366 - RNA, 20 nt, Human
uaguacacaccacuccgcau

SEQ ID NO: 1137367 - RNA, 21 nt, Human
uaguacacaccacuccgcauu

SEQ ID NO: 1137368 - RNA, 23 nt, Human
ucacagagcaucggaggcucaga

SEQ ID NO: 1137369 - RNA, 22 nt, Human
ucacagcgcagaacugggggag

SEQ ID NO: 1137370 - RNA, 21 nt, Human
ucaccagucuggagaagacca

SEQ ID NO: 1137371 - RNA, 21 nt, Human
ucaccagucuggagaagacca

SEQ ID NO: 1137372 - RNA, 19 nt, Human
ucacccauuuccccuccca

SEQ ID NO: 1137373 - RNA, 23 nt, Human
ucagccccucuggcugccccucc

SEQ ID NO: 1137374 - RNA, 21 nt, Human
ucagugugguugugaacgucc

SEQ ID NO: 1137375 - RNA, 18 nt, Human
ucaugcucucugucccuc

SEQ ID NO: 1137376 - RNA, 22 nt, Human
uccaaagagaaguccaggccag

SEQ ID NO: 1137377 - RNA, 20 nt, Human
uccaaggucacccgaggucc

SEQ ID NO: 1137378 - RNA, 27 nt, Human
uccagagagccaaaaaaaaaaaaaaaa

SEQ ID NO: 1137379 - RNA, 21 nt, Human
uccaugggaggcuccauccca

SEQ ID NO: 1137380 - RNA, 23 nt, Human
ucccagauccugacugucuccuc

SEQ ID NO: 1137381 - RNA, 22 nt, Human
ucccagguucccuucacucacu

SEQ ID NO: 1137382 - RNA, 20 nt, Human
ucccauaccucucugcuccc

SEQ ID NO: 1137383 - RNA, 21 nt, Human
ucccauaccucucugcuccuc

SEQ ID NO: 1137384 - RNA, 21 nt, Human
ucccauucucugauucuccau

SEQ ID NO: 1137385 - RNA, 19 nt, Human
uccccaagaacagaaucca

SEQ ID NO: 1137386 - RNA, 18 nt, Human
uccgcagccucccucccu

SEQ ID NO: 1137387 - RNA, 22 nt, Human
uccuggagaugcggcccagaug

SEQ ID NO: 1137388 - RNA, 18 nt, Human
ucuaaggccaaggagccc

SEQ ID NO: 1137389 - RNA, 19 nt, Human
ucucuggggucucucuacc

SEQ ID NO: 1137390 - RNA, 18 nt, Human
ucucugucccucuccaca

SEQ ID NO: 1137391 - RNA, 21 nt, Human
ucugccagguuuuguuuuugg

SEQ ID NO: 1137392 - RNA, 21 nt, Human
ucugcuccuccuccccauccc

SEQ ID NO: 1137393 - RNA, 22 nt, Human
ucuguuccccaagaacagaauc

SEQ ID NO: 1137394 - RNA, 24 nt, Human
ugaaacugagaagagaagggcugg

SEQ ID NO: 1137395 - RNA, 24 nt, Human
ugaaauccuaaagguucaaacccc

SEQ ID NO: 1137396 - RNA, 18 nt, Human
ugaaaugcugccaccucc

SEQ ID NO: 1137397 - RNA, 20 nt, Human
ugaaaugcugccaccucccc

SEQ ID NO: 1137398 - RNA, 21 nt, Human
ugaacggagagucaggaaucc

SEQ ID NO: 1137399 - RNA, 21 nt, Human
ugacauucacucaaggugcac

SEQ ID NO: 1137400 - RNA, 23 nt, Human
ugacccaggagaaaguaggacaa

SEQ ID NO: 1137401 - RNA, 19 nt, Human
ugaggagggaguagugggc

SEQ ID NO: 1137402 - RNA, 23 nt, Human
ugaggagggaguagugggcugcc

SEQ ID NO: 1137403 - RNA, 21 nt, Human
ugauccacagugacccuuucc

SEQ ID NO: 1137404 - RNA, 23 nt, Human
ugauccacagugacccuuucccc

SEQ ID NO: 1137405 - RNA, 18 nt, Human
ugcaccagaggaaauucg

SEQ ID NO: 1137406 - RNA, 18 nt, Human
ugcaccagaggaaauucg

SEQ ID NO: 1137407 - RNA, 22 nt, Human
ugccaggccucccucauacccc

SEQ ID NO: 1137408 - RNA, 21 nt, Human
ugcccucugccugacagcccc

SEQ ID NO: 1137409 - RNA, 25 nt, Human
ugccuccaacucggguccgcggucc

SEQ ID NO: 1137410 - RNA, 21 nt, Human
ugcggugaccacccuguuaag

SEQ ID NO: 1137411 - RNA, 18 nt, Human
uggaaaagccccaccaag

SEQ ID NO: 1137412 - RNA, 21 nt, Human
uggaaauucccuucugucucc

SEQ ID NO: 1137413 - RNA, 18 nt, Human
uggaagggacccuucugc

SEQ ID NO: 1137414 - RNA, 23 nt, Human
uggaagggacccuucugcccagc

SEQ ID NO: 1137415 - RNA, 22 nt, Human
uggaccuugguuaccccuguga

SEQ ID NO: 1137416 - RNA, 18 nt, Human
uggagccacccccuugcc

SEQ ID NO: 1137417 - RNA, 24 nt, Human
uggaugggaaauggaagggacccu

SEQ ID NO: 1137418 - RNA, 20 nt, Human
uggcagcccaagcugaugaa

SEQ ID NO: 1137419 - RNA, 21 nt, Human
uggcagcccaagcugaugaau

SEQ ID NO: 1137420 - RNA, 23 nt, Human
uggcagcccaagcugaugaauag

SEQ ID NO: 1137421 - RNA, 21 nt, Human
uggcauggugcuguggcagcc

SEQ ID NO: 1137422 - RNA, 19 nt, Human
uggcugccccucccagagu

SEQ ID NO: 1137423 - RNA, 22 nt, Human
uggcugccccucccagaguuca

SEQ ID NO: 1137424 - RNA, 22 nt, Human
ugguugugaacguccugaagaa

SEQ ID NO: 1137425 - RNA, 18 nt, Human
ugucccaggaacuugcug

SEQ ID NO: 1137426 - RNA, 21 nt, Human
ugucccauucucugauucucc

SEQ ID NO: 1137427 - RNA, 25 nt, Human
uguccccauccuguaggguccuuug

SEQ ID NO: 1137428 - RNA, 19 nt, Human
uguccuccgaagcacuccu

SEQ ID NO: 1137429 - RNA, 21 nt, Human
uguccugccaccuucuguucc

SEQ ID NO: 1137430 - RNA, 23 nt, Human
ugucuggaaccacauggguggac

SEQ ID NO: 1137431 - RNA, 22 nt, Human
ugugccucaguagacuguuuug

SEQ ID NO: 1137432 - RNA, 23 nt, Human
uguggccagaauccaaggucacc

SEQ ID NO: 1137433 - RNA, 21 nt, Human
uguggucaguggggacuuggc

SEQ ID NO: 1137434 - RNA, 18 nt, Human
uucacaucaucagggagu

SEQ ID NO: 1137435 - RNA, 26 nt, Human
uuccugcacagaccagaagagggcag

SEQ ID NO: 1137436 - RNA, 23 nt, Human
uucuccaugugagcugguuuuau

SEQ ID NO: 1137437 - RNA, 20 nt, Human
uucugaaggggagaaggcuc

SEQ ID NO: 1137438 - RNA, 21 nt, Human
uucugcucccccuccuucucc

SEQ ID NO: 1137439 - RNA, 19 nt, Human
uuguagcugcugcagcgcc

SEQ ID NO: 1137440 - RNA, 22 nt, Human
uuuaaacuugccuaagggaggc

SEQ ID NO: 1137441 - RNA, 23 nt, Human
uuuuaagaccacccugugucacc

SEQ ID NO: 1137442 - RNA, 19 nt, Human
acuagaaaacauuuuccuu

SEQ ID NO: 1137443 - RNA, 24 nt, Human
auaaaacagcaauaacuggccgag

SEQ ID NO: 1137444 - RNA, 21 nt, Human
cagcaauaacuggccgaggug

SEQ ID NO: 1137445 - RNA, 23 nt, Human
cagcaauaacuggccgagguggg

SEQ ID NO: 1137446 - RNA, 19 nt, Human
cauggccccuaaaugcaag

SEQ ID NO: 1137447 - RNA, 18 nt, Human
ccagggagacaagugugg

SEQ ID NO: 1137448 - RNA, 18 nt, Human
cccuccuucuucuauccc

SEQ ID NO: 1137449 - RNA, 23 nt, Human
cccugccucccuacuuccuuccc

SEQ ID NO: 1137450 - RNA, 24 nt, Human
ccuacuuccuucccuccuucuucu

SEQ ID NO: 1137451 - RNA, 22 nt, Human
ccuucccuccuucuucuauccc

SEQ ID NO: 1137452 - RNA, 22 nt, Human
cgaggugggcggaucaggaggu

SEQ ID NO: 1137453 - RNA, 24 nt, Human
cuacuuccuucccuccuucuucua

SEQ ID NO: 1137454 - RNA, 23 nt, Human
gaggugggcggaucaggagguca

SEQ ID NO: 1137455 - RNA, 20 nt, Human
gaucaggaggucaggagaga

SEQ ID NO: 1137456 - RNA, 21 nt, Human
ggcggaucaggaggucaggag

SEQ ID NO: 1137457 - RNA, 23 nt, Human
uaaaacagcaauaacuggccgag

SEQ ID NO: 1137458 - RNA, 21 nt, Human
ucccugccucccuacuucccc

SEQ ID NO: 1137459 - RNA, 22 nt, Human
ucucuaaacaucauggccccua

SEQ ID NO: 1137460 - RNA, 18 nt, Human
uggagagggggccagggc

SEQ ID NO: 1137461 - RNA, 19 nt, Human
uggccccuaaaugcaagcc

SEQ ID NO: 1137462 - RNA, 18 nt, Human
uggccgaggugggcggau

SEQ ID NO: 1137463 - RNA, 22 nt, Human
ugggcggaucaggaggucagga

SEQ ID NO: 1137464 - RNA, 25 nt, Human
uuauaaaacagcaauaacuggccga

SEQ ID NO: 1137465 - RNA, 23 nt, Human
agccacagcuacugccaaaaccc

SEQ ID NO: 1137466 - RNA, 24 nt, Human
agccacagcuacugccaaaacccg

SEQ ID NO: 1137467 - RNA, 18 nt, Human
agcuacugccaaaacccg

SEQ ID NO: 1137468 - RNA, 19 nt, Human
ccgcguccccaggcccggc

SEQ ID NO: 1137469 - RNA, 22 nt, Human
ccucggaucccgcucucgaccc

SEQ ID NO: 1137470 - RNA, 18 nt, Human
ccucggccgcccgcgucc

SEQ ID NO: 1137471 - RNA, 25 nt, Human
cgcagccacagcuacugccaaaacc

SEQ ID NO: 1137472 - RNA, 19 nt, Human
cggccgcccgcguccccag

SEQ ID NO: 1137473 - RNA, 20 nt, Human
cggccgcccgcguccccagg

SEQ ID NO: 1137474 - RNA, 25 nt, Human
cugccaaaacccgccagccucggau

SEQ ID NO: 1137475 - RNA, 19 nt, Human
gaucccgcucucgacccca

SEQ ID NO: 1137476 - RNA, 23 nt, Human
gccacagcuacugccaaaacccg

SEQ ID NO: 1137477 - RNA, 22 nt, Human
gcccgcguccccaggcccggca

SEQ ID NO: 1137478 - RNA, 20 nt, Human
ucggaucccgcucucgaccc

SEQ ID NO: 1137479 - RNA, 18 nt, Human
aaaauacaauucaaauac

SEQ ID NO: 1137480 - RNA, 23 nt, Human
aaauccugcaacagcaccuucaa

SEQ ID NO: 1137481 - RNA, 23 nt, Human
aaauggucaccgaggcuacagca

SEQ ID NO: 1137482 - RNA, 20 nt, Human
aacaacuuucuggaaaaugu

SEQ ID NO: 1137483 - RNA, 27 nt, Human
aagaacaacaggcagaagccgguaccc

SEQ ID NO: 1137484 - RNA, 21 nt, Human
aagacgcccuuccccugccca

SEQ ID NO: 1137485 - RNA, 23 nt, Human
aauggcaauguaaaacaaauuuc

SEQ ID NO: 1137486 - RNA, 21 nt, Human
acagagaacugccuuucucca

SEQ ID NO: 1137487 - RNA, 21 nt, Human
acgcccuuccuaggccaugcc

SEQ ID NO: 1137488 - RNA, 25 nt, Human
acuccugccacauuauccaaaaguc

SEQ ID NO: 1137489 - RNA, 19 nt, Human
agaggcuuagaggggucag

SEQ ID NO: 1137490 - RNA, 21 nt, Human
agaggggucagcucugaacua

SEQ ID NO: 1137491 - RNA, 21 nt, Human
agcaagcuggccuugcccaca

SEQ ID NO: 1137492 - RNA, 23 nt, Human
agcucaaagucacaguucaugcc

SEQ ID NO: 1137493 - RNA, 19 nt, Human
agcugcagcccuggggaca

SEQ ID NO: 1137494 - RNA, 22 nt, Human
aggcuacugguaucugcacaca

SEQ ID NO: 1137495 - RNA, 18 nt, Human
auggcaauguaaaacaaa

SEQ ID NO: 1137496 - RNA, 19 nt, Human
auuuaaaaaccugguaacu

SEQ ID NO: 1137497 - RNA, 24 nt, Human
caaauucccucuacagccugaagc

SEQ ID NO: 1137498 - RNA, 21 nt, Human
caacuuucuggaaaaugugac

SEQ ID NO: 1137499 - RNA, 19 nt, Human
caagaacaacaggcagaag

SEQ ID NO: 1137500 - RNA, 19 nt, Human
cacacucaugguuuucaca

SEQ ID NO: 1137501 - RNA, 20 nt, Human
caccgaggcuacagcagaac

SEQ ID NO: 1137502 - RNA, 24 nt, Human
cacucaugguuuucacaacuucau

SEQ ID NO: 1137503 - RNA, 19 nt, Human
cagacugggcugccuggcg

SEQ ID NO: 1137504 - RNA, 22 nt, Human
cagaggcuuagaggggucagcu

SEQ ID NO: 1137505 - RNA, 18 nt, Human
cagcugcagcccugggga

SEQ ID NO: 1137506 - RNA, 22 nt, Human
cagcugcagcccuggggacagg

SEQ ID NO: 1137507 - RNA, 18 nt, Human
cagcugggacuccugcca

SEQ ID NO: 1137508 - RNA, 20 nt, Human
cagcugggacuccugccaca

SEQ ID NO: 1137509 - RNA, 23 nt, Human
cagcuguaacuuguuuuggacug

SEQ ID NO: 1137510 - RNA, 19 nt, Human
cagguccuccagcaccuuc

SEQ ID NO: 1137511 - RNA, 25 nt, Human
caucuuggcucuucaucucccuacc

SEQ ID NO: 1137512 - RNA, 21 nt, Human
caugcagaugagcucuacacc

SEQ ID NO: 1137513 - RNA, 18 nt, Human
cccccagagaagcuuucc

SEQ ID NO: 1137514 - RNA, 19 nt, Human
cccccagagaagcuuucca

SEQ ID NO: 1137515 - RNA, 23 nt, Human
cccugcccagaccuucaugccuc

SEQ ID NO: 1137516 - RNA, 20 nt, Human
ccucugaacaccugccuagc

SEQ ID NO: 1137517 - RNA, 22 nt, Human
ccucugaacaccugccuagccu

SEQ ID NO: 1137518 - RNA, 24 nt, Human
cuacaccagccgagaggaacaagg

SEQ ID NO: 1137519 - RNA, 22 nt, Human
cucacauaucugguccugcccu

SEQ ID NO: 1137520 - RNA, 19 nt, Human
cucacugcaccugcuucac

SEQ ID NO: 1137521 - RNA, 24 nt, Human
cuccagcaccuucuguucauucuc

SEQ ID NO: 1137522 - RNA, 21 nt, Human
cugccacauuauccaaaaguc

SEQ ID NO: 1137523 - RNA, 21 nt, Human
cugguaucugcacacaacaug

SEQ ID NO: 1137524 - RNA, 19 nt, Human
cuguucauucuccuuuaga

SEQ ID NO: 1137525 - RNA, 18 nt, Human
cuucuguucauucuccuu

SEQ ID NO: 1137526 - RNA, 20 nt, Human
gagaagcuuuccauuuagga

SEQ ID NO: 1137527 - RNA, 20 nt, Human
gagaggccuguucaagcagg

SEQ ID NO: 1137528 - RNA, 18 nt, Human
gagcucgcaacgcccuuc

SEQ ID NO: 1137529 - RNA, 21 nt, Human
gcaagcaggcaaguauaucag

SEQ ID NO: 1137530 - RNA, 20 nt, Human
gcaccugcuucaccagcauc

SEQ ID NO: 1137531 - RNA, 18 nt, Human
gggaagcuguuaaaggcc

SEQ ID NO: 1137532 - RNA, 22 nt, Human
gugugcuggggacagcaggacu

SEQ ID NO: 1137533 - RNA, 20 nt, Human
guuuaacagguccuccagca

SEQ ID NO: 1137534 - RNA, 24 nt, Human
uaaaacaaauuucacugaaaauac

SEQ ID NO: 1137535 - RNA, 19 nt, Human
uaagaaaaacugacuaguu

SEQ ID NO: 1137536 - RNA, 20 nt, Human
uacagccugaagcaagcugg

SEQ ID NO: 1137537 - RNA, 23 nt, Human
uaccacaguaacauucuaauuca

SEQ ID NO: 1137538 - RNA, 21 nt, Human
uagaaaagaccuuaaauggua

SEQ ID NO: 1137539 - RNA, 22 nt, Human
uagaagucucucacauaucugg

SEQ ID NO: 1137540 - RNA, 22 nt, Human
uagcagcauuuaaaaaccuggu

SEQ ID NO: 1137541 - RNA, 18 nt, Human
uagcccacaggaacaaua

SEQ ID NO: 1137542 - RNA, 21 nt, Human
uaggagaggccuguucaagca

SEQ ID NO: 1137543 - RNA, 20 nt, Human
uaugcagccaccucccucag

SEQ ID NO: 1137544 - RNA, 19 nt, Human
uauuacaggaaaacuuuuc

SEQ ID NO: 1137545 - RNA, 24 nt, Human
ucacugaaaauacaauucaaauac

SEQ ID NO: 1137546 - RNA, 22 nt, Human
ucacugcaccugcuucaccagc

SEQ ID NO: 1137547 - RNA, 18 nt, Human
ucagugcaguugugugcu

SEQ ID NO: 1137548 - RNA, 21 nt, Human
ucccucuacagccugaagcaa

SEQ ID NO: 1137549 - RNA, 21 nt, Human
uccugccacauuauccaaaag

SEQ ID NO: 1137550 - RNA, 24 nt, Human
ucgcaacgcccuuccuaggccaug

SEQ ID NO: 1137551 - RNA, 19 nt, Human
ucuacagccugaagcaagc

SEQ ID NO: 1137552 - RNA, 23 nt, Human
ucuacagccugaagcaagcuggc

SEQ ID NO: 1137553 - RNA, 23 nt, Human
ucuccauaugcagccaccucccu

SEQ ID NO: 1137554 - RNA, 18 nt, Human
ucuccuuccacuccccga

SEQ ID NO: 1137555 - RNA, 19 nt, Human
ucugcacacaacaugcaga

SEQ ID NO: 1137556 - RNA, 21 nt, Human
ucuggaaaaugugacuagaaa

SEQ ID NO: 1137557 - RNA, 22 nt, Human
ucuguucauucuccuuuagauc

SEQ ID NO: 1137558 - RNA, 23 nt, Human
ucuucaucucccuacccccagag

SEQ ID NO: 1137559 - RNA, 28 nt, Human
ucuuguuuucaaacgccugcuggguggc

SEQ ID NO: 1137560 - RNA, 24 nt, Human
ugagaugaagacaaccuggcagcu

SEQ ID NO: 1137561 - RNA, 19 nt, Human
ugcacacaacaugcagaug

SEQ ID NO: 1137562 - RNA, 19 nt, Human
ugccacauuauccaaaagu

SEQ ID NO: 1137563 - RNA, 20 nt, Human
ugccacauuauccaaaaguc

SEQ ID NO: 1137564 - RNA, 23 nt, Human
ugccuuuaauucucaucuugaug

SEQ ID NO: 1137565 - RNA, 20 nt, Human
ugcuggguggcacuuacggc

SEQ ID NO: 1137566 - RNA, 23 nt, Human
uggcucuucaucucccuaccccc

SEQ ID NO: 1137567 - RNA, 19 nt, Human
ugggaagcuguuaaaggcc

SEQ ID NO: 1137568 - RNA, 21 nt, Human
uguaaaacaaauuucacugaa

SEQ ID NO: 1137569 - RNA, 22 nt, Human
uguaagaaaaacugacuaguua

SEQ ID NO: 1137570 - RNA, 21 nt, Human
ugucagaggcuuagagggguc

SEQ ID NO: 1137571 - RNA, 19 nt, Human
ugucaguaaucucaacuua

SEQ ID NO: 1137572 - RNA, 20 nt, Human
uuaaauggcaauguaaaaca

SEQ ID NO: 1137573 - RNA, 22 nt, Human
uucaagcagggaggcuacuggu

SEQ ID NO: 1137574 - RNA, 20 nt, Human
uucaugcccuguugcuucag

SEQ ID NO: 1137575 - RNA, 23 nt, Human
uucucacccccaccccacaucuc

SEQ ID NO: 1137576 - RNA, 19 nt, Human
uugucaguaaucucaacuu

SEQ ID NO: 1137577 - RNA, 19 nt, Human
uuugcuggagacuagccca

SEQ ID NO: 1137578 - RNA, 24 nt, Human
uuuucuguacauccucauagagaa

SEQ ID NO: 1137579 - RNA, 19 nt, Human
aaaacauuucacaguaguc

SEQ ID NO: 1137580 - RNA, 22 nt, Human
aaauggcguucuccauaagagc

SEQ ID NO: 1137581 - RNA, 21 nt, Human
aagagcucucuggaaacaggc

SEQ ID NO: 1137582 - RNA, 19 nt, Human
aaggagggaacuaauagca

SEQ ID NO: 1137583 - RNA, 21 nt, Human
acaaaaaaaauugagcaaaaa

SEQ ID NO: 1137584 - RNA, 21 nt, Human
agagagccagacuccugaauu

SEQ ID NO: 1137585 - RNA, 22 nt, Human
agcaaaaaauuuagaaaaaggu

SEQ ID NO: 1137586 - RNA, 23 nt, Human
agcaguggccauuguaggaaugu

SEQ ID NO: 1137587 - RNA, 26 nt, Human
agccagacuccugaauugguccgggg

SEQ ID NO: 1137588 - RNA, 23 nt, Human
agcugaagaguuuaauuaugcaa

SEQ ID NO: 1137589 - RNA, 19 nt, Human
auaaaucacaccuggauaa

SEQ ID NO: 1137590 - RNA, 22 nt, Human
auuguaggaauguaucaggauu

SEQ ID NO: 1137591 - RNA, 23 nt, Human
caacugacaaaaaaaauugagca

SEQ ID NO: 1137592 - RNA, 20 nt, Human
cacaccuggauaagcaccuc

SEQ ID NO: 1137593 - RNA, 19 nt, Human
cagguuacaacaagucaaa

SEQ ID NO: 1137594 - RNA, 23 nt, Human
cagguuacagacugauaaacuga

SEQ ID NO: 1137595 - RNA, 22 nt, Human
cccuauugacccgcuuuccuua

SEQ ID NO: 1137596 - RNA, 21 nt, Human
gaaagcugagcaguggccauu

SEQ ID NO: 1137597 - RNA, 22 nt, Human
gaagugcuucuugggaaauauu

SEQ ID NO: 1137598 - RNA, 22 nt, Human
gccagaguugaggcagggcaca

SEQ ID NO: 1137599 - RNA, 19 nt, Human
gggccagaguugaggcagg

SEQ ID NO: 1137600 - RNA, 23 nt, Human
uaacagaacagggccuggggcca

SEQ ID NO: 1137601 - RNA, 18 nt, Human
uaacaggaauguacuuuc

SEQ ID NO: 1137602 - RNA, 22 nt, Human
uaagaagagagccagacuccug

SEQ ID NO: 1137603 - RNA, 24 nt, Human
uaagagcucucuggaaacaggccc

SEQ ID NO: 1137604 - RNA, 20 nt, Human
uauccaaauucuuccagaau

SEQ ID NO: 1137605 - RNA, 18 nt, Human
ucaccauuuucaaugacu

SEQ ID NO: 1137606 - RNA, 20 nt, Human
uccaaaauagcugcuguggu

SEQ ID NO: 1137607 - RNA, 20 nt, Human
ucuuccagaauaaggaggga

SEQ ID NO: 1137608 - RNA, 21 nt, Human
ucuucucggaggauuuuuaaa

SEQ ID NO: 1137609 - RNA, 20 nt, Human
ugacucaugcucauuaguga

SEQ ID NO: 1137610 - RNA, 18 nt, Human
ugagaaagcugagcagug

SEQ ID NO: 1137611 - RNA, 19 nt, Human
ugagaacaacagcuucuuu

SEQ ID NO: 1137612 - RNA, 20 nt, Human
ugcaaaaaaauccuucuuuc

SEQ ID NO: 1137613 - RNA, 23 nt, Human
uggaaguagcaaaaaguuucuuc

SEQ ID NO: 1137614 - RNA, 19 nt, Human
uggcaaaguggacucgcgu

SEQ ID NO: 1137615 - RNA, 23 nt, Human
uggggccagaguugaggcagggc

SEQ ID NO: 1137616 - RNA, 21 nt, Human
uguaucaggauuauuucaaca

SEQ ID NO: 1137617 - RNA, 20 nt, Human
ugugaugcagugagaaagcu

SEQ ID NO: 1137618 - RNA, 19 nt, Human
uuuccaaaauagcugcugu

SEQ ID NO: 1137619 - RNA, 21 nt, Human
aaaagagaaacaaauccggua

SEQ ID NO: 1137620 - RNA, 25 nt, Human
aaacaacccaaauguccuuuaacag

SEQ ID NO: 1137621 - RNA, 18 nt, Human
aaaugacagcccugaucc

SEQ ID NO: 1137622 - RNA, 19 nt, Human
aacauggugaaacgccauc

SEQ ID NO: 1137623 - RNA, 20 nt, Human
aacauggugaaacgccaucu

SEQ ID NO: 1137624 - RNA, 21 nt, Human
aacauggugaaacgccaucuc

SEQ ID NO: 1137625 - RNA, 18 nt, Human
aagaaaaagccacuggug

SEQ ID NO: 1137626 - RNA, 24 nt, Human
aagcggccagggucccaguggggc

SEQ ID NO: 1137627 - RNA, 22 nt, Human
acaaaugacagcccugauccca

SEQ ID NO: 1137628 - RNA, 18 nt, Human
acaacccaaauguccuuu

SEQ ID NO: 1137629 - RNA, 19 nt, Human
acauggugaaacgccaucu

SEQ ID NO: 1137630 - RNA, 19 nt, Human
acucacugcagauuucagc

SEQ ID NO: 1137631 - RNA, 18 nt, Human
agaaggaaaaggcuuccg

SEQ ID NO: 1137632 - RNA, 24 nt, Human
agaaggaaaaggcuuccggucaaa

SEQ ID NO: 1137633 - RNA, 19 nt, Human
agaaggaaggcagaacaau

SEQ ID NO: 1137634 - RNA, 22 nt, Human
agacaaaucacaguggguucuc

SEQ ID NO: 1137635 - RNA, 26 nt, Human
agagaaacaaauccgguaguucugag

SEQ ID NO: 1137636 - RNA, 22 nt, Human
agagacaccaaggaaacucagg

SEQ ID NO: 1137637 - RNA, 24 nt, Human
agcacuuuggggggcugaggcagg

SEQ ID NO: 1137638 - RNA, 23 nt, Human
agccgggcacgguggcucaugcc

SEQ ID NO: 1137639 - RNA, 19 nt, Human
agccuggccaacaugguga

SEQ ID NO: 1137640 - RNA, 20 nt, Human
aggcaggaggcacggaggac

SEQ ID NO: 1137641 - RNA, 18 nt, Human
aggcagguggaucaccug

SEQ ID NO: 1137642 - RNA, 22 nt, Human
aggcagguggaucaccugaggu

SEQ ID NO: 1137643 - RNA, 26 nt, Human
aggcagguggaucaccugaggucagg

SEQ ID NO: 1137644 - RNA, 22 nt, Human
agguggaucaccugaggucagg

SEQ ID NO: 1137645 - RNA, 20 nt, Human
agguggggcucccagggaug

SEQ ID NO: 1137646 - RNA, 28 nt, Human
auaauacagccgggcacgguggcucaug

SEQ ID NO: 1137647 - RNA, 19 nt, Human
augccuguaaucccagcac

SEQ ID NO: 1137648 - RNA, 24 nt, Human
caacauggugaaacgccaucucua

SEQ ID NO: 1137649 - RNA, 21 nt, Human
cacagaacaagcauauacaga

SEQ ID NO: 1137650 - RNA, 22 nt, Human
caccaccuggaggaagugcccu

SEQ ID NO: 1137651 - RNA, 23 nt, Human
caccuggaggaagugcccuggga

SEQ ID NO: 1137652 - RNA, 20 nt, Human
cacgcucacacaugugcaua

SEQ ID NO: 1137653 - RNA, 21 nt, Human
cagaacguucuguuggugcca

SEQ ID NO: 1137654 - RNA, 24 nt, Human
cagcacuuuggggggcugaggcag

SEQ ID NO: 1137655 - RNA, 26 nt, Human
cagcacuuuggggggcugaggcaggu

SEQ ID NO: 1137656 - RNA, 22 nt, Human
caggcuagauguggaggauaaa

SEQ ID NO: 1137657 - RNA, 18 nt, Human
caguggguucucagucuu

SEQ ID NO: 1137658 - RNA, 20 nt, Human
caugccuguaaucccagcac

SEQ ID NO: 1137659 - RNA, 24 nt, Human
caugccuguaaucccagcacuuug

SEQ ID NO: 1137660 - RNA, 19 nt, Human
cccacugugugugcugggc

SEQ ID NO: 1137661 - RNA, 22 nt, Human
ccuccacagucaagaaggcaga

SEQ ID NO: 1137662 - RNA, 21 nt, Human
ccuggccaacauggugaaacg

SEQ ID NO: 1137663 - RNA, 24 nt, Human
ccuggccaacauggugaaacgcca

SEQ ID NO: 1137664 - RNA, 22 nt, Human
ccuguaaucccagcacuuuggg

SEQ ID NO: 1137665 - RNA, 19 nt, Human
ccuguagucccagcuacuc

SEQ ID NO: 1137666 - RNA, 21 nt, Human
ccuguagucccagcuacucag

SEQ ID NO: 1137667 - RNA, 24 nt, Human
cgaaaggugaaaacaacccaaaug

SEQ ID NO: 1137668 - RNA, 24 nt, Human
cgccuguagucccagcuacucagg

SEQ ID NO: 1137669 - RNA, 21 nt, Human
cggccagggucccaguggggc

SEQ ID NO: 1137670 - RNA, 22 nt, Human
cucacugcagauuucagcacuu

SEQ ID NO: 1137671 - RNA, 24 nt, Human
cucaugccuguaaucccagcacuu

SEQ ID NO: 1137672 - RNA, 19 nt, Human
gagaaggaaaaggcuuccg

SEQ ID NO: 1137673 - RNA, 23 nt, Human
gaucaccugaggucaggaguuca

SEQ ID NO: 1137674 - RNA, 24 nt, Human
gaucaccugaggucaggaguucaa

SEQ ID NO: 1137675 - RNA, 26 nt, Human
gcaaaaccucagagucuuugcccaac

SEQ ID NO: 1137676 - RNA, 24 nt, Human
gcaccgaaugucuuuuuauagcca

SEQ ID NO: 1137677 - RNA, 19 nt, Human
gccaacauggugaaacgcc

SEQ ID NO: 1137678 - RNA, 24 nt, Human
gccaacauggugaaacgccaucuc

SEQ ID NO: 1137679 - RNA, 20 nt, Human
gccagggccaggucacucug

SEQ ID NO: 1137680 - RNA, 21 nt, Human
ggacagggaggaaguugguca

SEQ ID NO: 1137681 - RNA, 22 nt, Human
ggaucaccugaggucaggaguu

SEQ ID NO: 1137682 - RNA, 21 nt, Human
ggcacggaggacagggaggaa

SEQ ID NO: 1137683 - RNA, 21 nt, Human
ggccagggucccaguggggcu

SEQ ID NO: 1137684 - RNA, 18 nt, Human
ggcgugguggcgggcgcc

SEQ ID NO: 1137685 - RNA, 22 nt, Human
ggcgugguggcgggcgccugua

SEQ ID NO: 1137686 - RNA, 21 nt, Human
ggcucaugccuguaaucccag

SEQ ID NO: 1137687 - RNA, 20 nt, Human
ggcugaggcagguggaucac

SEQ ID NO: 1137688 - RNA, 24 nt, Human
gggcacgguggcucaugccuguaa

SEQ ID NO: 1137689 - RNA, 18 nt, Human
gggccugcugguggccau

SEQ ID NO: 1137690 - RNA, 24 nt, Human
gggcugaggcagguggaucaccug

SEQ ID NO: 1137691 - RNA, 24 nt, Human
gguggcgggcgccuguagucccag

SEQ ID NO: 1137692 - RNA, 23 nt, Human
gguggcucaugccuguaauccca

SEQ ID NO: 1137693 - RNA, 24 nt, Human
gguggcucaugccuguaaucccag

SEQ ID NO: 1137694 - RNA, 21 nt, Human
gugcugggcgccuccacaguc

SEQ ID NO: 1137695 - RNA, 21 nt, Human
guggaucaccugaggucagga

SEQ ID NO: 1137696 - RNA, 28 nt, Human
uaaacgcacacgcucacacaugugcaua

SEQ ID NO: 1137697 - RNA, 22 nt, Human
uaaagggaaaucaaaaucugcu

SEQ ID NO: 1137698 - RNA, 20 nt, Human
uaaaucagagagaaggaaaa

SEQ ID NO: 1137699 - RNA, 18 nt, Human
uaacagauaauacagccg

SEQ ID NO: 1137700 - RNA, 22 nt, Human
uaaggcaagagaaucucuugaa

SEQ ID NO: 1137701 - RNA, 21 nt, Human
uacagaaggaaggcagaacaa

SEQ ID NO: 1137702 - RNA, 21 nt, Human
uacagaaggaaggcagaacaa

SEQ ID NO: 1137703 - RNA, 22 nt, Human
uagaggcaggaggcacggagga

SEQ ID NO: 1137704 - RNA, 20 nt, Human
uagauguggaggauaaauca

SEQ ID NO: 1137705 - RNA, 23 nt, Human
uauacagaaggaaggcagaacaa

SEQ ID NO: 1137706 - RNA, 21 nt, Human
ucaaaaucagccuggccaaca

SEQ ID NO: 1137707 - RNA, 19 nt, Human
ucaaaugaaucugcaccga

SEQ ID NO: 1137708 - RNA, 18 nt, Human
ucagccuggccaacaugg

SEQ ID NO: 1137709 - RNA, 23 nt, Human
ucagcgcuugcuccauccaaggg

SEQ ID NO: 1137710 - RNA, 22 nt, Human
ucaugccuguaaucccagcacu

SEQ ID NO: 1137711 - RNA, 22 nt, Human
uccaagggccugcugguggcca

SEQ ID NO: 1137712 - RNA, 23 nt, Human
uccaagggccugcugguggccau

SEQ ID NO: 1137713 - RNA, 22 nt, Human
uccacagucaagaaggcagagc

SEQ ID NO: 1137714 - RNA, 21 nt, Human
uccccgucuuauucucggaga

SEQ ID NO: 1137715 - RNA, 23 nt, Human
ucuacaaaugacagcccugaucc

SEQ ID NO: 1137716 - RNA, 18 nt, Human
ucucaacccaggccacag

SEQ ID NO: 1137717 - RNA, 21 nt, Human
ucucuacuaaaaauacaaaaa

SEQ ID NO: 1137718 - RNA, 25 nt, Human
ugaaaacaacccaaauguccuuuaa

SEQ ID NO: 1137719 - RNA, 20 nt, Human
ugaaacgccaucucuacuaa

SEQ ID NO: 1137720 - RNA, 20 nt, Human
ugaggcagguggaucaccug

SEQ ID NO: 1137721 - RNA, 24 nt, Human
ugaggcagguggaucaccugaggu

SEQ ID NO: 1137722 - RNA, 26 nt, Human
ugaggcagguggaucaccugagguca

SEQ ID NO: 1137723 - RNA, 28 nt, Human
ugaggggagagaaggccaucagcgcuug

SEQ ID NO: 1137724 - RNA, 21 nt, Human
ugcaaggguagcuuuccuccc

SEQ ID NO: 1137725 - RNA, 23 nt, Human
ugccuguaaucccagcacuuugg

SEQ ID NO: 1137726 - RNA, 23 nt, Human
ugccuguaaucccagcacuuugg

SEQ ID NO: 1137727 - RNA, 23 nt, Human
uggaagggucuggaaaacccacu

SEQ ID NO: 1137728 - RNA, 23 nt, Human
uggaagggucuggaaaacccacu

SEQ ID NO: 1137729 - RNA, 24 nt, Human
uggaucaccugaggucaggaguuc

SEQ ID NO: 1137730 - RNA, 27 nt, Human
uggaucaccugaggucaggaguucaaa

SEQ ID NO: 1137731 - RNA, 18 nt, Human
uggccaacauggugaaac

SEQ ID NO: 1137732 - RNA, 22 nt, Human
uggcucaugccuguaaucccag

SEQ ID NO: 1137733 - RNA, 24 nt, Human
uggcucaugccuguaaucccagca

SEQ ID NO: 1137734 - RNA, 18 nt, Human
uggggggcugaggcaggu

SEQ ID NO: 1137735 - RNA, 24 nt, Human
uggggggcugaggcagguggauca

SEQ ID NO: 1137736 - RNA, 24 nt, Human
ugguggcgggcgccuguaguccca

SEQ ID NO: 1137737 - RNA, 23 nt, Human
ugugugugcugggcacaggcuag

SEQ ID NO: 1137738 - RNA, 22 nt, Human
uuaaguacccacugugugugcu

SEQ ID NO: 1137739 - RNA, 18 nt, Human
uuagccgggcgugguggc

SEQ ID NO: 1137740 - RNA, 24 nt, Human
uuagccgggcgugguggcgggcgc

SEQ ID NO: 1137741 - RNA, 23 nt, Human
uucccggaaaauugacuaaaaaa

SEQ ID NO: 1137742 - RNA, 25 nt, Human
uuggggggcugaggcagguggauca

SEQ ID NO: 1137743 - RNA, 19 nt, Human
uuucucaacccaggccaca

SEQ ID NO: 1137744 - RNA, 18 nt, Human
uuuggggggcugaggcag

SEQ ID NO: 1137745 - RNA, 23 nt, Human
aaaaagccugggguuuuugcuga

SEQ ID NO: 1137746 - RNA, 18 nt, Human
agcaggucauagugggga

SEQ ID NO: 1137747 - RNA, 20 nt, Human
aggguguggggaccaugagg

SEQ ID NO: 1137748 - RNA, 24 nt, Human
aggguguggggaccaugagguuca

SEQ ID NO: 1137749 - RNA, 19 nt, Human
augcauaggcugugaccug

SEQ ID NO: 1137750 - RNA, 20 nt, Human
cacagcaggucauagugggg

SEQ ID NO: 1137751 - RNA, 22 nt, Human
cagcaggucauaguggggaugg

SEQ ID NO: 1137752 - RNA, 24 nt, Human
caggucauaguggggauggagugu

SEQ ID NO: 1137753 - RNA, 20 nt, Human
caucgggccaccacuaggac

SEQ ID NO: 1137754 - RNA, 19 nt, Human
uccugaggagugggccagc

SEQ ID NO: 1137755 - RNA, 18 nt, Human
ugaacagggucuggccag

SEQ ID NO: 1137756 - RNA, 19 nt, Human
ugaggagugggccagcugu

SEQ ID NO: 1137757 - RNA, 24 nt, Human
ugagguucaccuagaauuucucca

SEQ ID NO: 1137758 - RNA, 26 nt, Human
ugguugauagaaaaaagccugggguu

SEQ ID NO: 1137759 - RNA, 21 nt, Human
uguagaaucccuguuccugag

SEQ ID NO: 1137760 - RNA, 20 nt, Human
uuccugaggagugggccagc

SEQ ID NO: 1137761 - RNA, 21 nt, Human
aaaacucucuccuucaggcgg

SEQ ID NO: 1137762 - RNA, 22 nt, Human
aaaguuaaaagcuacagcaacu

SEQ ID NO: 1137763 - RNA, 20 nt, Human
aacaauaaagugcugugcac

SEQ ID NO: 1137764 - RNA, 28 nt, Human
aacaauaaagugcugugcacagaaagga

SEQ ID NO: 1137765 - RNA, 18 nt, Human
aacacuuugggaggcuga

SEQ ID NO: 1137766 - RNA, 20 nt, Human
aacacuuugggaggcugagg

SEQ ID NO: 1137767 - RNA, 21 nt, Human
aagaggaggugacagggcugg

SEQ ID NO: 1137768 - RNA, 21 nt, Human
aagccaaggccugugagagga

SEQ ID NO: 1137769 - RNA, 27 nt, Human
aaguacaaucuagaaaaccagaacugg

SEQ ID NO: 1137770 - RNA, 22 nt, Human
acagagcaggacaguuucaaaa

SEQ ID NO: 1137771 - RNA, 21 nt, Human
acagcaacucuuuuuugugcu

SEQ ID NO: 1137772 - RNA, 19 nt, Human
acauaguaaaaucucaucu

SEQ ID NO: 1137773 - RNA, 18 nt, Human
acugcacucuaggauggg

SEQ ID NO: 1137774 - RNA, 18 nt, Human
acugcacucuaggauggg

SEQ ID NO: 1137775 - RNA, 22 nt, Human
acugcacucuaggaugggugac

SEQ ID NO: 1137776 - RNA, 24 nt, Human
acugcacucuaggaugggugacag

SEQ ID NO: 1137777 - RNA, 20 nt, Human
agaaaggaauagccugugcc

SEQ ID NO: 1137778 - RNA, 20 nt, Human
agcgaagcacgaaggcugcg

SEQ ID NO: 1137779 - RNA, 20 nt, Human
aggaguuugagaccagucug

SEQ ID NO: 1137780 - RNA, 24 nt, Human
aggauugcuugaggccaggaguuu

SEQ ID NO: 1137781 - RNA, 19 nt, Human
aggccaggaguuugagacc

SEQ ID NO: 1137782 - RNA, 24 nt, Human
aggcgggcaugguggcaaacaucu

SEQ ID NO: 1137783 - RNA, 23 nt, Human
aggcgugaggauugcuugaggcc

SEQ ID NO: 1137784 - RNA, 21 nt, Human
aggcugaggcgugaggauugc

SEQ ID NO: 1137785 - RNA, 24 nt, Human
aggcugaggcgugaggauugcuug

SEQ ID NO: 1137786 - RNA, 23 nt, Human
agggcugcaggauuccaggccug

SEQ ID NO: 1137787 - RNA, 24 nt, Human
agguaagaggaucacuugagccug

SEQ ID NO: 1137788 - RNA, 24 nt, Human
agucugggcgacauaguaaaaucu

SEQ ID NO: 1137789 - RNA, 25 nt, Human
agucugggcgacauaguaaaaucuc

SEQ ID NO: 1137790 - RNA, 19 nt, Human
agugaagguggaagcagag

SEQ ID NO: 1137791 - RNA, 22 nt, Human
aguggucagcagucagcgaagc

SEQ ID NO: 1137792 - RNA, 20 nt, Human
aucacacuacugcacucuag

SEQ ID NO: 1137793 - RNA, 23 nt, Human
caacacuuugggaggcugaggcg

SEQ ID NO: 1137794 - RNA, 19 nt, Human
cacacaccaugugccaggc

SEQ ID NO: 1137795 - RNA, 25 nt, Human
cacagggcagaaaauuuaucuucac

SEQ ID NO: 1137796 - RNA, 23 nt, Human
caccgcaccccacuccauccagc

SEQ ID NO: 1137797 - RNA, 25 nt, Human
caccgcaccccacuccauccagccc

SEQ ID NO: 1137798 - RNA, 21 nt, Human
cacgcaggaggcuaagguaag

SEQ ID NO: 1137799 - RNA, 23 nt, Human
cacgccccugagcagccccaccc

SEQ ID NO: 1137800 - RNA, 22 nt, Human
cacuccauccagcccugcccau

SEQ ID NO: 1137801 - RNA, 25 nt, Human
caggaaguagccgcuuggggaagcc

SEQ ID NO: 1137802 - RNA, 24 nt, Human
caggaggcuaagguaagaggauca

SEQ ID NO: 1137803 - RNA, 18 nt, Human
caggauuccuggagcacu

SEQ ID NO: 1137804 - RNA, 18 nt, Human
cagggcugcagccgagag

SEQ ID NO: 1137805 - RNA, 21 nt, Human
caucuguagucccagccacgc

SEQ ID NO: 1137806 - RNA, 24 nt, Human
caucuguagucccagccacgcagg

SEQ ID NO: 1137807 - RNA, 22 nt, Human
caugaucccgcagccucaaucc

SEQ ID NO: 1137808 - RNA, 20 nt, Human
cauuggacagaugaggacac

SEQ ID NO: 1137809 - RNA, 23 nt, Human
cauuggacagaugaggacacucc

SEQ ID NO: 1137810 - RNA, 23 nt, Human
ccacuuauagugaagguggaagc

SEQ ID NO: 1137811 - RNA, 20 nt, Human
ccccaggauuccuggagcac

SEQ ID NO: 1137812 - RNA, 19 nt, Human
ccccguggcgaagcagggu

SEQ ID NO: 1137813 - RNA, 27 nt, Human
ccccugagcagccccacccuggcucaa

SEQ ID NO: 1137814 - RNA, 22 nt, Human
cccguggcgaagcagggucagc

SEQ ID NO: 1137815 - RNA, 19 nt, Human
cccuggagaaggggacuaa

SEQ ID NO: 1137816 - RNA, 20 nt, Human
ccgcaccccacuccauccag

SEQ ID NO: 1137817 - RNA, 24 nt, Human
ccgcagccucaauccccgcuggcc

SEQ ID NO: 1137818 - RNA, 19 nt, Human
ccugagcagccccacccug

SEQ ID NO: 1137819 - RNA, 21 nt, Human
ccugugccgggucuucagaga

SEQ ID NO: 1137820 - RNA, 20 nt, Human
cgaccugggaccagcagggu

SEQ ID NO: 1137821 - RNA, 19 nt, Human
cgcaccagggcugcagccg

SEQ ID NO: 1137822 - RNA, 19 nt, Human
cgccccugagcagccccac

SEQ ID NO: 1137823 - RNA, 20 nt, Human
cuaagcacacaccaugugcc

SEQ ID NO: 1137824 - RNA, 21 nt, Human
cuacugcacucuaggaugggu

SEQ ID NO: 1137825 - RNA, 23 nt, Human
cuaugccaagaaauuguugaauc

SEQ ID NO: 1137826 - RNA, 19 nt, Human
cucuacggcaacgggccgg

SEQ ID NO: 1137827 - RNA, 23 nt, Human
cugcagccgagagacagucucac

SEQ ID NO: 1137828 - RNA, 19 nt, Human
cuggagcacugccugaagg

SEQ ID NO: 1137829 - RNA, 18 nt, Human
cugggcgacauaguaaaa

SEQ ID NO: 1137830 - RNA, 21 nt, Human
cuguagucccagccacgcagg

SEQ ID NO: 1137831 - RNA, 23 nt, Human
cuucaccaucucacaauuaguuu

SEQ ID NO: 1137832 - RNA, 20 nt, Human
cuuucugcuaggcugugucc

SEQ ID NO: 1137833 - RNA, 20 nt, Human
cuuugguuuccauagcaaug

SEQ ID NO: 1137834 - RNA, 20 nt, Human
gacuaacaccaucuuuugcc

SEQ ID NO: 1137835 - RNA, 18 nt, Human
gagcagccccacccuggc

SEQ ID NO: 1137836 - RNA, 24 nt, Human
gagcaggacaguuucaaaaaaaga

SEQ ID NO: 1137837 - RNA, 21 nt, Human
gaucccgcagccucaaucccc

SEQ ID NO: 1137838 - RNA, 24 nt, Human
gauugcuugaggccaggaguuuga

SEQ ID NO: 1137839 - RNA, 24 nt, Human
gcacucuaggaugggugacagagc

SEQ ID NO: 1137840 - RNA, 24 nt, Human
gccauuauggggaugugugugccg

SEQ ID NO: 1137841 - RNA, 21 nt, Human
gccuguuuuucucaugugccc

SEQ ID NO: 1137842 - RNA, 18 nt, Human
gcucuggcucugggugug

SEQ ID NO: 1137843 - RNA, 22 nt, Human
ggauugcuugaggccaggaguu

SEQ ID NO: 1137844 - RNA, 23 nt, Human
ggauugcuugaggccaggaguuu

SEQ ID NO: 1137845 - RNA, 19 nt, Human
ggccaggaguuugagacca

SEQ ID NO: 1137846 - RNA, 24 nt, Human
ggccuugguccgaagcuccagccu

SEQ ID NO: 1137847 - RNA, 20 nt, Human
ggugcugcccucuuucuucu

SEQ ID NO: 1137848 - RNA, 23 nt, Human
guggcucaucaacacuuugggag

SEQ ID NO: 1137849 - RNA, 20 nt, Human
guguaagaucaacaauagau

SEQ ID NO: 1137850 - RNA, 18 nt, Human
uaaaaggcaucaucuguu

SEQ ID NO: 1137851 - RNA, 19 nt, Human
uaaaaggcaucaucuguuu

SEQ ID NO: 1137852 - RNA, 21 nt, Human
uaaaaggcaucaucuguuuuu

SEQ ID NO: 1137853 - RNA, 21 nt, Human
uaagcacacaccaugugccag

SEQ ID NO: 1137854 - RNA, 20 nt, Human
uacaaucuagaaaaccagaa

SEQ ID NO: 1137855 - RNA, 26 nt, Human
uaccucugacuccaaugcaggggcuc

SEQ ID NO: 1137856 - RNA, 23 nt, Human
uacugcacucuaggaugggugac

SEQ ID NO: 1137857 - RNA, 24 nt, Human
uacugcacucuaggaugggugaca

SEQ ID NO: 1137858 - RNA, 25 nt, Human
uacugcacucuaggaugggugacag

SEQ ID NO: 1137859 - RNA, 23 nt, Human
uacuuuguaacaauaaagugcug

SEQ ID NO: 1137860 - RNA, 23 nt, Human
ucacacuacugcacucuaggaug

SEQ ID NO: 1137861 - RNA, 20 nt, Human
ucacaugaagaggaggugac

SEQ ID NO: 1137862 - RNA, 25 nt, Human
ucacugcaguccccgugggggcccc

SEQ ID NO: 1137863 - RNA, 25 nt, Human
ucacugcaguccccguggggguccc

SEQ ID NO: 1137864 - RNA, 26 nt, Human
ucacugcaguccccguggggguccuc

SEQ ID NO: 1137865 - RNA, 19 nt, Human
ucacuugagccugagaggu

SEQ ID NO: 1137866 - RNA, 26 nt, Human
ucaucucuauaaaaaaagaaaaaaaa

SEQ ID NO: 1137867 - RNA, 19 nt, Human
uccccgcuggccuaacgcu

SEQ ID NO: 1137868 - RNA, 20 nt, Human
uccuucaggcgggugggcgg

SEQ ID NO: 1137869 - RNA, 22 nt, Human
ucucuauaaaaaaagaaaaaaa

SEQ ID NO: 1137870 - RNA, 20 nt, Human
ucugggcaccaucugccuca

SEQ ID NO: 1137871 - RNA, 24 nt, Human
ucugggcgacauaguaaaaucuca

SEQ ID NO: 1137872 - RNA, 20 nt, Human
ucugugagaaaagggcuguc

SEQ ID NO: 1137873 - RNA, 21 nt, Human
ugaaagaaugagguggaauug

SEQ ID NO: 1137874 - RNA, 24 nt, Human
ugaaagagucuaucauucaugaug

SEQ ID NO: 1137875 - RNA, 18 nt, Human
ugagcagccccacccugg

SEQ ID NO: 1137876 - RNA, 22 nt, Human
ugagccugagagguuguggcua

SEQ ID NO: 1137877 - RNA, 20 nt, Human
ugauguuaggccuguuuuuc

SEQ ID NO: 1137878 - RNA, 23 nt, Human
ugcacagaaaggagaaaugcccu

SEQ ID NO: 1137879 - RNA, 19 nt, Human
ugcaggauuccaggccugc

SEQ ID NO: 1137880 - RNA, 18 nt, Human
ugccgggucuucagagaa

SEQ ID NO: 1137881 - RNA, 20 nt, Human
ugcugcccucuuucuucugg

SEQ ID NO: 1137882 - RNA, 18 nt, Human
ugcuugaggccaggaguu

SEQ ID NO: 1137883 - RNA, 20 nt, Human
uggaagaguacuuuguaaca

SEQ ID NO: 1137884 - RNA, 18 nt, Human
uggaagcagagguggccu

SEQ ID NO: 1137885 - RNA, 20 nt, Human
uggaagcagagguggccugg

SEQ ID NO: 1137886 - RNA, 19 nt, Human
uggaaugcuuucuuuaaaa

SEQ ID NO: 1137887 - RNA, 21 nt, Human
uggaaugcuuucuuuaaaaac

SEQ ID NO: 1137888 - RNA, 21 nt, Human
uggagcacugccugaaggcca

SEQ ID NO: 1137889 - RNA, 22 nt, Human
ugggaggcugaggcgugaggau

SEQ ID NO: 1137890 - RNA, 24 nt, Human
ugggaggcugaggcgugaggauug

SEQ ID NO: 1137891 - RNA, 21 nt, Human
ugguccgaagcuccagccuuc

SEQ ID NO: 1137892 - RNA, 23 nt, Human
ugguggcaaacaucuguaguccc

SEQ ID NO: 1137893 - RNA, 24 nt, Human
ugguggcaaacaucuguaguccca

SEQ ID NO: 1137894 - RNA, 23 nt, Human
uguccauggaaaacucucuccuu

SEQ ID NO: 1137895 - RNA, 25 nt, Human
uguccauggaaaacucucuccuuca

SEQ ID NO: 1137896 - RNA, 24 nt, Human
uguuaggccuguuuuucucaugug

SEQ ID NO: 1137897 - RNA, 24 nt, Human
uuaaucuuaaaaaaaauggauuau

SEQ ID NO: 1137898 - RNA, 25 nt, Human
uuaaucuuaaaaaaaauggauuaua

SEQ ID NO: 1137899 - RNA, 22 nt, Human
uuccugggucaaucuguuuuug

SEQ ID NO: 1137900 - RNA, 21 nt, Human
uucuguaucaacaaaaguaga

SEQ ID NO: 1137901 - RNA, 21 nt, Human
uugcuugaggccaggaguuug

SEQ ID NO: 1137902 - RNA, 23 nt, Human
uugcuugaggccaggaguuugag

SEQ ID NO: 1137903 - RNA, 20 nt, Human
uugggaggcugaggcgugag

SEQ ID NO: 1137904 - RNA, 18 nt, Human
uugguuuccauagcaaug

SEQ ID NO: 1137905 - RNA, 18 nt, Human
uuucaaaaaaagacaaaa

SEQ ID NO: 1137906 - RNA, 24 nt, Human
uuucaaaaaaagacaaaaaaaaau

SEQ ID NO: 1137907 - RNA, 22 nt, Human
acccugcuccucugaggucagc

SEQ ID NO: 1137908 - RNA, 20 nt, Human
acgcucgaggcggaagcgac

SEQ ID NO: 1137909 - RNA, 19 nt, Human
agagacccuggccucuucu

SEQ ID NO: 1137910 - RNA, 21 nt, Human
agcuggugauuccucugccau

SEQ ID NO: 1137911 - RNA, 20 nt, Human
aggcggaagcgacaagacgc

SEQ ID NO: 1137912 - RNA, 20 nt, Human
auccugcucucucucuucau

SEQ ID NO: 1137913 - RNA, 20 nt, Human
augaacuguggagggcuucc

SEQ ID NO: 1137914 - RNA, 23 nt, Human
auuccuccucaucaccuccauug

SEQ ID NO: 1137915 - RNA, 18 nt, Human
cacacauguaaucgaaac

SEQ ID NO: 1137916 - RNA, 19 nt, Human
cagcagaagacugggaagc

SEQ ID NO: 1137917 - RNA, 25 nt, Human
cauccugcucucucucuucaucuca

SEQ ID NO: 1137918 - RNA, 22 nt, Human
ccauuggaagagucugguucag

SEQ ID NO: 1137919 - RNA, 21 nt, Human
cccagaucagcaauggccacc

SEQ ID NO: 1137920 - RNA, 23 nt, Human
ccccuuaacauccacagaaacag

SEQ ID NO: 1137921 - RNA, 20 nt, Human
ccuucccagacuacaucucu

SEQ ID NO: 1137922 - RNA, 21 nt, Human
cgcucgaggcggaagcgacaa

SEQ ID NO: 1137923 - RNA, 25 nt, Human
cuaacccagaucagcaauggccacc

SEQ ID NO: 1137924 - RNA, 21 nt, Human
cucaggcagcaugggguccac

SEQ ID NO: 1137925 - RNA, 24 nt, Human
cugguggguuuuggaccuucccag

SEQ ID NO: 1137926 - RNA, 21 nt, Human
gcagaagacugggaagcagag

SEQ ID NO: 1137927 - RNA, 21 nt, Human
gcagaagacugggaagcagag

SEQ ID NO: 1137928 - RNA, 20 nt, Human
ggaagacuguccaagucuug

SEQ ID NO: 1137929 - RNA, 24 nt, Human
gggaagcagaggugagggaugcag

SEQ ID NO: 1137930 - RNA, 22 nt, Human
gggguccacuuuuguccccaaa

SEQ ID NO: 1137931 - RNA, 25 nt, Human
ggguguguuucuggcaucucccuaa

SEQ ID NO: 1137932 - RNA, 24 nt, Human
uaacauccacagaaacagacugga

SEQ ID NO: 1137933 - RNA, 25 nt, Human
uaggagaggccuguuuggaguagua

SEQ ID NO: 1137934 - RNA, 18 nt, Human
uauuccuccucaucaccu

SEQ ID NO: 1137935 - RNA, 19 nt, Human
ucaaguuauuccuccucau

SEQ ID NO: 1137936 - RNA, 20 nt, Human
ucacacacauguaaucgaaa

SEQ ID NO: 1137937 - RNA, 25 nt, Human
ucaguuuuucccaacucucuuccca

SEQ ID NO: 1137938 - RNA, 18 nt, Human
uccacagaaacagacugg

SEQ ID NO: 1137939 - RNA, 21 nt, Human
uccgcaaucccgccacacgcu

SEQ ID NO: 1137940 - RNA, 23 nt, Human
uccuccucaucaccuccauuguu

SEQ ID NO: 1137941 - RNA, 22 nt, Human
uccucugccauccugcucucuc

SEQ ID NO: 1137942 - RNA, 18 nt, Human
ugagagacccuggccucu

SEQ ID NO: 1137943 - RNA, 21 nt, Human
uggaagacuguccaagucuug

SEQ ID NO: 1137944 - RNA, 19 nt, Human
uguggagggcuuccgcaau

SEQ ID NO: 1137945 - RNA, 22 nt, Human
uguggcuuuaaacugucuucaa

SEQ ID NO: 1137946 - RNA, 21 nt, Human
uuaaaauucacacacauguaa

SEQ ID NO: 1137947 - RNA, 21 nt, Human
uucaaguuauuccuccucauc

SEQ ID NO: 1137948 - RNA, 20 nt, Human
uucauucuuuguaucacugu

SEQ ID NO: 1137949 - RNA, 23 nt, Human
uuggaagagucugguucaguuuu

SEQ ID NO: 1137950 - RNA, 21 nt, Human
uuggaguaguacacugagaga

SEQ ID NO: 1137951 - RNA, 24 nt, Human
uuucccaacucucuucccacucgu

SEQ ID NO: 1137952 - RNA, 24 nt, Human
uuuucuuaguaaaauccagcaccu

SEQ ID NO: 1137953 - RNA, 24 nt, Human
aaaacagaacaagggaauuacaga

SEQ ID NO: 1137954 - RNA, 19 nt, Human
aaaaggaacugcaggggca

SEQ ID NO: 1137955 - RNA, 19 nt, Human
aaacagaaaaggaacugca

SEQ ID NO: 1137956 - RNA, 22 nt, Human
aaacagaaaaggaacugcaggg

SEQ ID NO: 1137957 - RNA, 25 nt, Human
aaagcaccaacugcauacucccccc

SEQ ID NO: 1137958 - RNA, 21 nt, Human
aaccagaccuccuguagcucu

SEQ ID NO: 1137959 - RNA, 23 nt, Human
aagaauucaaauccaauucagca

SEQ ID NO: 1137960 - RNA, 23 nt, Human
aagacacacaaucaacaaacaug

SEQ ID NO: 1137961 - RNA, 23 nt, Human
aagggaccuagcuagaggguagg

SEQ ID NO: 1137962 - RNA, 25 nt, Human
aagggaccuagcuagaggguagguc

SEQ ID NO: 1137963 - RNA, 22 nt, Human
aauuccagccuggagacggagc

SEQ ID NO: 1137964 - RNA, 22 nt, Human
acauaacaguggaaaucuuaga

SEQ ID NO: 1137965 - RNA, 25 nt, Human
accaacuccaccccagaaccagacc

SEQ ID NO: 1137966 - RNA, 22 nt, Human
acugcaucuauacuggcaacag

SEQ ID NO: 1137967 - RNA, 20 nt, Human
agacacacaaucaacaaaca

SEQ ID NO: 1137968 - RNA, 20 nt, Human
agacagguguggcugagcga

SEQ ID NO: 1137969 - RNA, 19 nt, Human
agagcuggcaaacagggcu

SEQ ID NO: 1137970 - RNA, 18 nt, Human
aggcaaaauugugacaaa

SEQ ID NO: 1137971 - RNA, 20 nt, Human
aggcagcuauuuuuacuggc

SEQ ID NO: 1137972 - RNA, 20 nt, Human
agugggaucuggaauggacc

SEQ ID NO: 1137973 - RNA, 22 nt, Human
augucaggcagcuauuuuuacu

SEQ ID NO: 1137974 - RNA, 21 nt, Human
caacuccaccccagaaccaga

SEQ ID NO: 1137975 - RNA, 22 nt, Human
caacugcauacuccccccaccc

SEQ ID NO: 1137976 - RNA, 21 nt, Human
cacaacaacuccucuccuaca

SEQ ID NO: 1137977 - RNA, 21 nt, Human
cacacugcacuagauggccag

SEQ ID NO: 1137978 - RNA, 20 nt, Human
caccaagaauucaaauccaa

SEQ ID NO: 1137979 - RNA, 20 nt, Human
caccccagaaccagaccucc

SEQ ID NO: 1137980 - RNA, 24 nt, Human
cagaaacaaaacagaacaagggaa

SEQ ID NO: 1137981 - RNA, 24 nt, Human
cagaaccagaccuccuguagcucu

SEQ ID NO: 1137982 - RNA, 28 nt, Human
cagguaaguaauuucaaguuugcagugg

SEQ ID NO: 1137983 - RNA, 23 nt, Human
caguggggcccccuucucaacuu

SEQ ID NO: 1137984 - RNA, 25 nt, Human
caguggggcccccuucucaacuuug

SEQ ID NO: 1137985 - RNA, 22 nt, Human
caugacaccaggggaaaagcuu

SEQ ID NO: 1137986 - RNA, 22 nt, Human
caugucccaucgugguuaggga

SEQ ID NO: 1137987 - RNA, 20 nt, Human
ccaacugcauacucccccca

SEQ ID NO: 1137988 - RNA, 21 nt, Human
ccaacugcauacuccccccac

SEQ ID NO: 1137989 - RNA, 22 nt, Human
ccaacugcauacuccccccacc

SEQ ID NO: 1137990 - RNA, 23 nt, Human
ccagcagccgauuaccauguccc

SEQ ID NO: 1137991 - RNA, 23 nt, Human
cccagaccagcccaaggagaugc

SEQ ID NO: 1137992 - RNA, 22 nt, Human
ccucacaacaacuccucuccua

SEQ ID NO: 1137993 - RNA, 23 nt, Human
ccuccuguagcucugggcaggug

SEQ ID NO: 1137994 - RNA, 21 nt, Human
ccuguacgcucccugcugcuc

SEQ ID NO: 1137995 - RNA, 18 nt, Human
cuauacuggcaacagagc

SEQ ID NO: 1137996 - RNA, 20 nt, Human
cuccaccccagaaccagacc

SEQ ID NO: 1137997 - RNA, 18 nt, Human
cuccucaggcuccgaaua

SEQ ID NO: 1137998 - RNA, 20 nt, Human
cucugggcagguggugugcc

SEQ ID NO: 1137999 - RNA, 19 nt, Human
cugcugcucuuggcucagu

SEQ ID NO: 1138000 - RNA, 24 nt, Human
cuguaccaacuccaccccagaacc

SEQ ID NO: 1138001 - RNA, 18 nt, Human
cugugcccacuguugucu

SEQ ID NO: 1138002 - RNA, 23 nt, Human
cuuacagaaacaaaacagaacaa

SEQ ID NO: 1138003 - RNA, 23 nt, Human
cuuagagucacaaacuaccaaac

SEQ ID NO: 1138004 - RNA, 19 nt, Human
gaacaagggaauuacagaa

SEQ ID NO: 1138005 - RNA, 23 nt, Human
gaauuccagccuggagacggagc

SEQ ID NO: 1138006 - RNA, 18 nt, Human
gacgggcagggcuggccu

SEQ ID NO: 1138007 - RNA, 20 nt, Human
gcaacagagcuggcaaacag

SEQ ID NO: 1138008 - RNA, 22 nt, Human
gcaaggaaggagccacggggga

SEQ ID NO: 1138009 - RNA, 20 nt, Human
gcaguggggcccccuucuca

SEQ ID NO: 1138010 - RNA, 18 nt, Human
gcauacuccccccacccc

SEQ ID NO: 1138011 - RNA, 19 nt, Human
gcucuguuucuuccagucc

SEQ ID NO: 1138012 - RNA, 20 nt, Human
ggaaggagccacgggggagg

SEQ ID NO: 1138013 - RNA, 19 nt, Human
ggaauuacagaaagcacca

SEQ ID NO: 1138014 - RNA, 22 nt, Human
ggacagggaaggagcccagcuc

SEQ ID NO: 1138015 - RNA, 21 nt, Human
ggcucagugggcaaggaagga

SEQ ID NO: 1138016 - RNA, 18 nt, Human
gggcaaggaaggagccac

SEQ ID NO: 1138017 - RNA, 22 nt, Human
gggcagguggugugccagcagc

SEQ ID NO: 1138018 - RNA, 21 nt, Human
gggcuggccucacaacaacuc

SEQ ID NO: 1138019 - RNA, 19 nt, Human
uaagaaguccuuuccauga

SEQ ID NO: 1138020 - RNA, 20 nt, Human
uaagacagguguggcugagc

SEQ ID NO: 1138021 - RNA, 21 nt, Human
uaaguucaguuguggcaagga

SEQ ID NO: 1138022 - RNA, 22 nt, Human
uaccaaaaauguacaaauuuca

SEQ ID NO: 1138023 - RNA, 24 nt, Human
uaccaaacagaaaaggaacugcag

SEQ ID NO: 1138024 - RNA, 26 nt, Human
uaccaauguuaccaaaaauguacaaa

SEQ ID NO: 1138025 - RNA, 18 nt, Human
uagcuuagaguaagguca

SEQ ID NO: 1138026 - RNA, 19 nt, Human
uagcuuuugcugcuugauu

SEQ ID NO: 1138027 - RNA, 19 nt, Human
ucaacaaacauggaaucug

SEQ ID NO: 1138028 - RNA, 20 nt, Human
ucacagcucuugaggagcgc

SEQ ID NO: 1138029 - RNA, 21 nt, Human
ucaggacagggaaggagccca

SEQ ID NO: 1138030 - RNA, 19 nt, Human
ucaggcagcuauuuuuacu

SEQ ID NO: 1138031 - RNA, 21 nt, Human
ucagugccgaaacugaauguu

SEQ ID NO: 1138032 - RNA, 20 nt, Human
uccagccuggagacggagcg

SEQ ID NO: 1138033 - RNA, 25 nt, Human
uccuucgagugccacaccuguaaca

SEQ ID NO: 1138034 - RNA, 22 nt, Human
ucugccauguuggugacacuau

SEQ ID NO: 1138035 - RNA, 23 nt, Human
ucuggccaauuauuuaaacuuug

SEQ ID NO: 1138036 - RNA, 19 nt, Human
ugacaccaggggaaaagcu

SEQ ID NO: 1138037 - RNA, 22 nt, Human
ugacacgaauccaggaaaggau

SEQ ID NO: 1138038 - RNA, 20 nt, Human
ugacacuauagcugugccca

SEQ ID NO: 1138039 - RNA, 19 nt, Human
ugccaaagacccuuucagg

SEQ ID NO: 1138040 - RNA, 22 nt, Human
ugccgaaacugaauguuaagac

SEQ ID NO: 1138041 - RNA, 23 nt, Human
ugccgaaacugaauguuaagaca

SEQ ID NO: 1138042 - RNA, 20 nt, Human
ugcucccguccuguacgcuc

SEQ ID NO: 1138043 - RNA, 22 nt, Human
uggcaaacagggcucuguugac

SEQ ID NO: 1138044 - RNA, 25 nt, Human
uggcaaacagggcucuguugacuca

SEQ ID NO: 1138045 - RNA, 22 nt, Human
uggcaacagagcuggcaaacag

SEQ ID NO: 1138046 - RNA, 18 nt, Human
uggcaaggagcccuuuuc

SEQ ID NO: 1138047 - RNA, 19 nt, Human
uggcugcaccgcggccuug

SEQ ID NO: 1138048 - RNA, 22 nt, Human
ugucaggacagggaaggagccc

SEQ ID NO: 1138049 - RNA, 22 nt, Human
ugucuucaccguaccucccuca

SEQ ID NO: 1138050 - RNA, 23 nt, Human
ugucuucaccguaccucccucag

SEQ ID NO: 1138051 - RNA, 23 nt, Human
uuaccaugucccaucgugguuag

SEQ ID NO: 1138052 - RNA, 24 nt, Human
uucaccguaccucccucagcuacu

SEQ ID NO: 1138053 - RNA, 20 nt, Human
uucaucaucaaaauagcuuu

SEQ ID NO: 1138054 - RNA, 23 nt, Human
uugggauucacagcauggguuuc

SEQ ID NO: 1138055 - RNA, 23 nt, Human
uuuaagaaguccuuuccaugaca

SEQ ID NO: 1138056 - RNA, 19 nt, Human
uuuucugacacgaauccag

SEQ ID NO: 1138057 - RNA, 23 nt, Human
aaaaaguccaagaggcacaagga

SEQ ID NO: 1138058 - RNA, 18 nt, Human
aaacacacaaaaaagucc

SEQ ID NO: 1138059 - RNA, 19 nt, Human
aaacacacaaaaaagucca

SEQ ID NO: 1138060 - RNA, 21 nt, Human
aagaggcacaaggacagaaug

SEQ ID NO: 1138061 - RNA, 22 nt, Human
acccugugaauauaguaaaaac

SEQ ID NO: 1138062 - RNA, 18 nt, Human
auaaagcuguuuaaaaaa

SEQ ID NO: 1138063 - RNA, 21 nt, Human
cuuugagggggaauaaagagg

SEQ ID NO: 1138064 - RNA, 18 nt, Human
gaauguagucggagcucc

SEQ ID NO: 1138065 - RNA, 19 nt, Human
ggugugggaguugggaaag

SEQ ID NO: 1138066 - RNA, 22 nt, Human
gugugggaguugggaaagacag

SEQ ID NO: 1138067 - RNA, 18 nt, Human
uaaaaacgcugaaucacu

SEQ ID NO: 1138068 - RNA, 23 nt, Human
uaaacacacaaaaaaguccaaga

SEQ ID NO: 1138069 - RNA, 23 nt, Human
uaguaaaaacgcugaaucacuua

SEQ ID NO: 1138070 - RNA, 24 nt, Human
uccaagaggcacaaggacagaagg

SEQ ID NO: 1138071 - RNA, 22 nt, Human
ucuacggccagcuaccgacuga

SEQ ID NO: 1138072 - RNA, 18 nt, Human
ugggaaagacagaggagu

SEQ ID NO: 1138073 - RNA, 19 nt, Human
ugggaaagacagaggagug

SEQ ID NO: 1138074 - RNA, 18 nt, Human
uugagggggaauaaagag

SEQ ID NO: 1138075 - RNA, 24 nt, Human
aaagugcugagguuacaggcauga

SEQ ID NO: 1138076 - RNA, 26 nt, Human
aagugcugagguuacaggcaugagcc

SEQ ID NO: 1138077 - RNA, 26 nt, Human
acagagcuucagagaggagggaacgc

SEQ ID NO: 1138078 - RNA, 22 nt, Human
acaggagcuuucucugccccau

SEQ ID NO: 1138079 - RNA, 24 nt, Human
accauguuggccaggauggucuug

SEQ ID NO: 1138080 - RNA, 18 nt, Human
acuccuggccgggcgcgg

SEQ ID NO: 1138081 - RNA, 19 nt, Human
acugcagcacacccguagc

SEQ ID NO: 1138082 - RNA, 21 nt, Human
agaggagcugggcaggucccg

SEQ ID NO: 1138083 - RNA, 21 nt, Human
agauauccuuuggaugcugag

SEQ ID NO: 1138084 - RNA, 20 nt, Human
agcgauucuccugcuucagc

SEQ ID NO: 1138085 - RNA, 24 nt, Human
agcgauucuccugcuucagccucc

SEQ ID NO: 1138086 - RNA, 22 nt, Human
aggaauaugggagaauuuaggc

SEQ ID NO: 1138087 - RNA, 23 nt, Human
aggaccucaugguuacacccugc

SEQ ID NO: 1138088 - RNA, 26 nt, Human
aggaguggguucguagcugcguugga

SEQ ID NO: 1138089 - RNA, 24 nt, Human
agguuacaggcaugagccgcugcg

SEQ ID NO: 1138090 - RNA, 18 nt, Human
aguagcugggacuacagg

SEQ ID NO: 1138091 - RNA, 19 nt, Human
aguccgacaugaagcuuca

SEQ ID NO: 1138092 - RNA, 20 nt, Human
agugccguggugcgaucucg

SEQ ID NO: 1138093 - RNA, 18 nt, Human
augagguuucaccauguu

SEQ ID NO: 1138094 - RNA, 23 nt, Human
augguuauaaaaaucaggaugcc

SEQ ID NO: 1138095 - RNA, 24 nt, Human
auuuuuguauuuuuaguagagaug

SEQ ID NO: 1138096 - RNA, 24 nt, Human
caaagugcugagguuacaggcaug

SEQ ID NO: 1138097 - RNA, 22 nt, Human
cacauagaacaaagauuugauu

SEQ ID NO: 1138098 - RNA, 24 nt, Human
caccaugcccagcuaauuuuugua

SEQ ID NO: 1138099 - RNA, 18 nt, Human
caccauguuggccaggau

SEQ ID NO: 1138100 - RNA, 22 nt, Human
caccauguuggccaggaugguc

SEQ ID NO: 1138101 - RNA, 24 nt, Human
caccauguuggccaggauggucuu

SEQ ID NO: 1138102 - RNA, 24 nt, Human
caccucagccucccaaagugcuga

SEQ ID NO: 1138103 - RNA, 21 nt, Human
cacugcgaccucugccuccug

SEQ ID NO: 1138104 - RNA, 23 nt, Human
cacugcgaccucugccuccuggg

SEQ ID NO: 1138105 - RNA, 24 nt, Human
cagagaggagcugggcaggucccg

SEQ ID NO: 1138106 - RNA, 21 nt, Human
cagagcccagcucagguuugc

SEQ ID NO: 1138107 - RNA, 19 nt, Human
cagagcuucagagaggagc

SEQ ID NO: 1138108 - RNA, 22 nt, Human
cagagcuucagagaggagcugg

SEQ ID NO: 1138109 - RNA, 20 nt, Human
cagccuccugaguagcuggg

SEQ ID NO: 1138110 - RNA, 26 nt, Human
cagcgauucuccugcuucagccuccu

SEQ ID NO: 1138111 - RNA, 19 nt, Human
caggugcccgccaccaugc

SEQ ID NO: 1138112 - RNA, 21 nt, Human
cagugcuccuuuggguagucu

SEQ ID NO: 1138113 - RNA, 21 nt, Human
caugcaguggcuuucccacag

SEQ ID NO: 1138114 - RNA, 20 nt, Human
ccaaaggacagaauauagga

SEQ ID NO: 1138115 - RNA, 23 nt, Human
ccaaagugcugagguuacaggca

SEQ ID NO: 1138116 - RNA, 24 nt, Human
ccaaagugcugagguuacaggcau

SEQ ID NO: 1138117 - RNA, 24 nt, Human
ccagcucagguuugcuggccaccg

SEQ ID NO: 1138118 - RNA, 25 nt, Human
ccagcucagguuugcuggccaccug

SEQ ID NO: 1138119 - RNA, 26 nt, Human
cccacagagcccagcucagcggaccc

SEQ ID NO: 1138120 - RNA, 21 nt, Human
cccguagcaguacuguuucuc

SEQ ID NO: 1138121 - RNA, 24 nt, Human
ccuccuggguuccagcgauucucc

SEQ ID NO: 1138122 - RNA, 23 nt, Human
ccucugccuccuggguuccagcg

SEQ ID NO: 1138123 - RNA, 21 nt, Human
ccucuuuuauuaacaggagcu

SEQ ID NO: 1138124 - RNA, 23 nt, Human
ccugaguagcugggacuacaggu

SEQ ID NO: 1138125 - RNA, 24 nt, Human
ccugaguagcugggacuacaggug

SEQ ID NO: 1138126 - RNA, 23 nt, Human
ccugauuuggagcuuggaaggag

SEQ ID NO: 1138127 - RNA, 25 nt, Human
ccuggccgggcgcgguggggaaauu

SEQ ID NO: 1138128 - RNA, 21 nt, Human
ccugugaccagaaauucggac

SEQ ID NO: 1138129 - RNA, 24 nt, Human
cucacugcgaccucugccuccugg

SEQ ID NO: 1138130 - RNA, 22 nt, Human
cucaugcaguggcuuucccaca

SEQ ID NO: 1138131 - RNA, 21 nt, Human
cucaugguuacacccugccuu

SEQ ID NO: 1138132 - RNA, 21 nt, Human
cuccuggguuccagcgauucu

SEQ ID NO: 1138133 - RNA, 23 nt, Human
cuccuggguuccagcgauucucc

SEQ ID NO: 1138134 - RNA, 22 nt, Human
cucuugaccucgugaucugccc

SEQ ID NO: 1138135 - RNA, 24 nt, Human
cugcgaccucugccuccuggguuc

SEQ ID NO: 1138136 - RNA, 23 nt, Human
cugcuucagccuccugaguagcu

SEQ ID NO: 1138137 - RNA, 21 nt, Human
cugggcaggucccggugcucu

SEQ ID NO: 1138138 - RNA, 25 nt, Human
cuuuaguccgacaugaagcuucauc

SEQ ID NO: 1138139 - RNA, 21 nt, Human
gaagucugacucuuccuuggu

SEQ ID NO: 1138140 - RNA, 22 nt, Human
gaccucgugaucugcccaccuc

SEQ ID NO: 1138141 - RNA, 24 nt, Human
gaccucgugaucugcccaccucag

SEQ ID NO: 1138142 - RNA, 24 nt, Human
gacuacaggugcccgccaccaugc

SEQ ID NO: 1138143 - RNA, 21 nt, Human
gagauggagucuugcucuguc

SEQ ID NO: 1138144 - RNA, 23 nt, Human
gaggugugucugaggccaaagga

SEQ ID NO: 1138145 - RNA, 18 nt, Human
gagguuucaccauguugg

SEQ ID NO: 1138146 - RNA, 22 nt, Human
gagguuucaccauguuggccag

SEQ ID NO: 1138147 - RNA, 20 nt, Human
gagucuugcucugucgccag

SEQ ID NO: 1138148 - RNA, 18 nt, Human
gcaguacuguuucucaug

SEQ ID NO: 1138149 - RNA, 20 nt, Human
gccauguggucauuguucac

SEQ ID NO: 1138150 - RNA, 22 nt, Human
gcccagcuaauuuuuguauuuu

SEQ ID NO: 1138151 - RNA, 24 nt, Human
gcgauucuccugcuucagccuccu

SEQ ID NO: 1138152 - RNA, 19 nt, Human
gcuucagagaggagcuggg

SEQ ID NO: 1138153 - RNA, 22 nt, Human
gguuacaggcaugagccgcugc

SEQ ID NO: 1138154 - RNA, 24 nt, Human
gguuucaccauguuggccaggaug

SEQ ID NO: 1138155 - RNA, 22 nt, Human
guagaagguguggaguggauaa

SEQ ID NO: 1138156 - RNA, 24 nt, Human
gucuugcucugucgccaggcugga

SEQ ID NO: 1138157 - RNA, 24 nt, Human
gugaucugcccaccucagccuccc

SEQ ID NO: 1138158 - RNA, 20 nt, Human
gugccguggugcgaucucga

SEQ ID NO: 1138159 - RNA, 18 nt, Human
guucacggggccacuagu

SEQ ID NO: 1138160 - RNA, 22 nt, Human
guuucacucacuaaaggagugg

SEQ ID NO: 1138161 - RNA, 23 nt, Human
uaaaaaucaggaugccuggccug

SEQ ID NO: 1138162 - RNA, 24 nt, Human
uaauuuuuguauuuuuaguagaga

SEQ ID NO: 1138163 - RNA, 22 nt, Human
uagagaugagguuucaccaugu

SEQ ID NO: 1138164 - RNA, 24 nt, Human
uagcugccugauuacagagcuuca

SEQ ID NO: 1138165 - RNA, 24 nt, Human
uaguagagaugagguuucaccaug

SEQ ID NO: 1138166 - RNA, 26 nt, Human
uaguagagaugagguuucaccauguu

SEQ ID NO: 1138167 - RNA, 19 nt, Human
ucacaucaaagugcauuca

SEQ ID NO: 1138168 - RNA, 24 nt, Human
ucaccauguuggccaggauggucu

SEQ ID NO: 1138169 - RNA, 24 nt, Human
ucacugcgaccucugccuccuggg

SEQ ID NO: 1138170 - RNA, 25 nt, Human
ucacugcgaccucugccuccugggu

SEQ ID NO: 1138171 - RNA, 18 nt, Human
ucagccucccaaagugcu

SEQ ID NO: 1138172 - RNA, 23 nt, Human
ucagccuccugaguagcugggac

SEQ ID NO: 1138173 - RNA, 24 nt, Human
ucccaaagugcugagguuacaggc

SEQ ID NO: 1138174 - RNA, 18 nt, Human
ucccggugcucugcugug

SEQ ID NO: 1138175 - RNA, 22 nt, Human
uccugaaacuugaggaccucau

SEQ ID NO: 1138176 - RNA, 24 nt, Human
uccugaguagcugggacuacaggu

SEQ ID NO: 1138177 - RNA, 21 nt, Human
uccuggguuccagcgauucuc

SEQ ID NO: 1138178 - RNA, 24 nt, Human
uccuggguuccagcgauucuccug

SEQ ID NO: 1138179 - RNA, 21 nt, Human
ucugcccaccucagccuccca

SEQ ID NO: 1138180 - RNA, 18 nt, Human
ucugccccauucccccca

SEQ ID NO: 1138181 - RNA, 18 nt, Human
ucugucgccaggcuggag

SEQ ID NO: 1138182 - RNA, 21 nt, Human
ucugucgccaggcuggagugc

SEQ ID NO: 1138183 - RNA, 21 nt, Human
ucuugcucugucgccaggcug

SEQ ID NO: 1138184 - RNA, 22 nt, Human
ucuugcucugucgccaggcugg

SEQ ID NO: 1138185 - RNA, 23 nt, Human
ucuugcucugucgccaggcugga

SEQ ID NO: 1138186 - RNA, 18 nt, Human
ugaccagaaauucggacu

SEQ ID NO: 1138187 - RNA, 21 nt, Human
ugaccagaaauucggacuccu

SEQ ID NO: 1138188 - RNA, 19 nt, Human
ugacuguagaaggugugga

SEQ ID NO: 1138189 - RNA, 24 nt, Human
ugaggugugucugaggccaaagga

SEQ ID NO: 1138190 - RNA, 20 nt, Human
ugagguuacaggcaugagcc

SEQ ID NO: 1138191 - RNA, 20 nt, Human
ugagguuacaggcaugagcc

SEQ ID NO: 1138192 - RNA, 22 nt, Human
ugagguuacaggcaugagccgc

SEQ ID NO: 1138193 - RNA, 24 nt, Human
ugagguuacaggcaugagccgcug

SEQ ID NO: 1138194 - RNA, 24 nt, Human
ugagguuacaggcaugagccgcug

SEQ ID NO: 1138195 - RNA, 24 nt, Human
ugagguuucaccauguuggccagg

SEQ ID NO: 1138196 - RNA, 24 nt, Human
ugaucugcccaccucagccuccca

SEQ ID NO: 1138197 - RNA, 23 nt, Human
ugauuuggagcuuggaaggaggu

SEQ ID NO: 1138198 - RNA, 19 nt, Human
ugccccauuccccccauuu

SEQ ID NO: 1138199 - RNA, 21 nt, Human
ugccccauuccccccauuuau

SEQ ID NO: 1138200 - RNA, 18 nt, Human
ugccguggugcgaucucg

SEQ ID NO: 1138201 - RNA, 28 nt, Human
ugccuccuggguuccagcgauucuccuu

SEQ ID NO: 1138202 - RNA, 23 nt, Human
ugcucugucgccaggcuggagug

SEQ ID NO: 1138203 - RNA, 24 nt, Human
ugcuucagccuccugaguagcugg

SEQ ID NO: 1138204 - RNA, 23 nt, Human
uggaagguguccuuccaacuuaa

SEQ ID NO: 1138205 - RNA, 18 nt, Human
uggagucuugcucugucg

SEQ ID NO: 1138206 - RNA, 19 nt, Human
uggagugccguggugcgau

SEQ ID NO: 1138207 - RNA, 24 nt, Human
uggccaggauggucuugaucucuu

SEQ ID NO: 1138208 - RNA, 19 nt, Human
uggccgggcgcggugggga

SEQ ID NO: 1138209 - RNA, 23 nt, Human
uggccgggcgcgguggggaaauu

SEQ ID NO: 1138210 - RNA, 22 nt, Human
uggccugauuuggagcuuggaa

SEQ ID NO: 1138211 - RNA, 21 nt, Human
ugggacuacaggugcccgcca

SEQ ID NO: 1138212 - RNA, 22 nt, Human
ugggacuacaggugcccgccac

SEQ ID NO: 1138213 - RNA, 24 nt, Human
ugggacuacaggugcccgccacca

SEQ ID NO: 1138214 - RNA, 25 nt, Human
ugggacuacaggugcccgccaccau

SEQ ID NO: 1138215 - RNA, 22 nt, Human
uggguccugugaccagaaauuc

SEQ ID NO: 1138216 - RNA, 19 nt, Human
uggguuccagcgauucucc

SEQ ID NO: 1138217 - RNA, 20 nt, Human
uggguuccagcgauucuccu

SEQ ID NO: 1138218 - RNA, 22 nt, Human
ugugaccagaaauucggacucc

SEQ ID NO: 1138219 - RNA, 18 nt, Human
uguugaagucugacucuu

SEQ ID NO: 1138220 - RNA, 18 nt, Human
uuaguagagaugagguuu

SEQ ID NO: 1138221 - RNA, 22 nt, Human
uuaguagagaugagguuucacc

SEQ ID NO: 1138222 - RNA, 24 nt, Human
uuaguagagaugagguuucaccau

SEQ ID NO: 1138223 - RNA, 24 nt, Human
uucagccuccugaguagcugggac

SEQ ID NO: 1138224 - RNA, 18 nt, Human
uuccagcgauucuccugc

SEQ ID NO: 1138225 - RNA, 19 nt, Human
uuucaccauguuggccagg

SEQ ID NO: 1138226 - RNA, 20 nt, Human
uuucaccauguuggccagga

SEQ ID NO: 1138227 - RNA, 18 nt, Human
uuucacucacuaaaggag

SEQ ID NO: 1138228 - RNA, 24 nt, Human
uuucacucacuaaaggaguggguu

SEQ ID NO: 1138229 - RNA, 24 nt, Human
uuuuuaguagagaugagguuucac

SEQ ID NO: 1138230 - RNA, 20 nt, Human
uuuuuguauuuuuaguagag

SEQ ID NO: 1138231 - RNA, 22 nt, Human
aaacaccacgaccccuucccca

SEQ ID NO: 1138232 - RNA, 19 nt, Human
aaacaccaucccuggaaau

SEQ ID NO: 1138233 - RNA, 21 nt, Human
aaagaacucagcuacuacagc

SEQ ID NO: 1138234 - RNA, 24 nt, Human
aaagaucuaacuacuccgaccuuc

SEQ ID NO: 1138235 - RNA, 19 nt, Human
aaagcaaguaugaaggaag

SEQ ID NO: 1138236 - RNA, 23 nt, Human
aaauacaagaaaaugacuaagcu

SEQ ID NO: 1138237 - RNA, 22 nt, Human
aacagagaaucaaguuucacug

SEQ ID NO: 1138238 - RNA, 24 nt, Human
aacucauucuccuauucuccccug

SEQ ID NO: 1138239 - RNA, 22 nt, Human
aacuguaacuggcuacaguuuc

SEQ ID NO: 1138240 - RNA, 22 nt, Human
aagaacucagcuacuacagcca

SEQ ID NO: 1138241 - RNA, 24 nt, Human
aagcagcggagaacuggcugaacu

SEQ ID NO: 1138242 - RNA, 29 nt, Human
aaggaaguacauaggaaaaggaaagggaa

SEQ ID NO: 1138243 - RNA, 18 nt, Human
aaggaugauggugauagu

SEQ ID NO: 1138244 - RNA, 19 nt, Human
aauaauaggaguaacccaa

SEQ ID NO: 1138245 - RNA, 23 nt, Human
aauacagccaaaaugagcugcca

SEQ ID NO: 1138246 - RNA, 19 nt, Human
aaucacaauggcugaucug

SEQ ID NO: 1138247 - RNA, 21 nt, Human
acaagcagugcugcuucgagc

SEQ ID NO: 1138248 - RNA, 25 nt, Human
acagaaaaauacaagaaaaugacua

SEQ ID NO: 1138249 - RNA, 20 nt, Human
accauggcugaauugaucua

SEQ ID NO: 1138250 - RNA, 23 nt, Human
acccaaugaauacuguauggucu

SEQ ID NO: 1138251 - RNA, 20 nt, Human
accguacggagucucaaagu

SEQ ID NO: 1138252 - RNA, 20 nt, Human
acgaccccuuccccaccccc

SEQ ID NO: 1138253 - RNA, 19 nt, Human
acuucaggaacccccucca

SEQ ID NO: 1138254 - RNA, 19 nt, Human
agaaaaaccaaaccaaaaa

SEQ ID NO: 1138255 - RNA, 22 nt, Human
agaaaaaccaaaccaaaaacau

SEQ ID NO: 1138256 - RNA, 20 nt, Human
agaaaggugccagggacucu

SEQ ID NO: 1138257 - RNA, 22 nt, Human
agagcaguuuagccccugagga

SEQ ID NO: 1138258 - RNA, 18 nt, Human
aggaaaaaagaagagaaa

SEQ ID NO: 1138259 - RNA, 22 nt, Human
aggaaagggagggaagaggcuu

SEQ ID NO: 1138260 - RNA, 23 nt, Human
aguacauaggaaaaggaaaggga

SEQ ID NO: 1138261 - RNA, 22 nt, Human
aguccccagaaaaaccaaacca

SEQ ID NO: 1138262 - RNA, 18 nt, Human
auaauucuaagcuaagag

SEQ ID NO: 1138263 - RNA, 20 nt, Human
aucuaccguuuuccugagua

SEQ ID NO: 1138264 - RNA, 24 nt, Human
auggaaaagaacucagcuacuaca

SEQ ID NO: 1138265 - RNA, 21 nt, Human
caaaaaaauaaggaauaaaag

SEQ ID NO: 1138266 - RNA, 25 nt, Human
caaaaaaauaaggaauaaaagcuaa

SEQ ID NO: 1138267 - RNA, 18 nt, Human
caaaaugagcugccaaaa

SEQ ID NO: 1138268 - RNA, 18 nt, Human
caaagaaaggugccaggg

SEQ ID NO: 1138269 - RNA, 19 nt, Human
caaagaaaggugccaggga

SEQ ID NO: 1138270 - RNA, 23 nt, Human
caaccagcacuaccauggcugaa

SEQ ID NO: 1138271 - RNA, 19 nt, Human
caagaaaaugacuaagcug

SEQ ID NO: 1138272 - RNA, 30 nt, Human
caagagcaugacaaaauaaaaacacacaaa

SEQ ID NO: 1138273 - RNA, 27 nt, Human
caagagccccaauucucaguguugacc

SEQ ID NO: 1138274 - RNA, 22 nt, Human
caagcacacacacaaauacugu

SEQ ID NO: 1138275 - RNA, 23 nt, Human
caagcacacacacaaauacugug

SEQ ID NO: 1138276 - RNA, 25 nt, Human
cacaaauacugugaacagaaaaaua

SEQ ID NO: 1138277 - RNA, 19 nt, Human
cacaauuccagcuacuuga

SEQ ID NO: 1138278 - RNA, 22 nt, Human
caccggcauguacacaaguacc

SEQ ID NO: 1138279 - RNA, 19 nt, Human
cacgaccccuuccccaccc

SEQ ID NO: 1138280 - RNA, 22 nt, Human
cacgaccccuuccccacccccc

SEQ ID NO: 1138281 - RNA, 23 nt, Human
cacgaccccuuccccacccccca

SEQ ID NO: 1138282 - RNA, 20 nt, Human
cacuaaaccagagggcacac

SEQ ID NO: 1138283 - RNA, 19 nt, Human
cacugaaaaccaaagaccc

SEQ ID NO: 1138284 - RNA, 19 nt, Human
cacuggaaagcacagagcu

SEQ ID NO: 1138285 - RNA, 23 nt, Human
cagacuccucugacucucuuuuu

SEQ ID NO: 1138286 - RNA, 22 nt, Human
cagccagcauccucuaacaaac

SEQ ID NO: 1138287 - RNA, 33 nt, Human
cagccugucagggacaaguacacuccaccgggg

SEQ ID NO: 1138288 - RNA, 24 nt, Human
caggaugguagugauuaacccacu

SEQ ID NO: 1138289 - RNA, 26 nt, Human
cagguaacuuaugcuuuuaaaacacc

SEQ ID NO: 1138290 - RNA, 26 nt, Human
caguccccagaaaaaccaaaccaaaa

SEQ ID NO: 1138291 - RNA, 18 nt, Human
caucaguaaguuuucugg

SEQ ID NO: 1138292 - RNA, 20 nt, Human
ccacuuaucugcuagaucuc

SEQ ID NO: 1138293 - RNA, 20 nt, Human
ccagaaaaaccaaaccaaaa

SEQ ID NO: 1138294 - RNA, 23 nt, Human
ccagaaaaaccaaaccaaaaaca

SEQ ID NO: 1138295 - RNA, 19 nt, Human
cccaccccccaaagucccu

SEQ ID NO: 1138296 - RNA, 20 nt, Human
ccccagaaaaaccaaaccaa

SEQ ID NO: 1138297 - RNA, 22 nt, Human
ccccagaaaaaccaaaccaaaa

SEQ ID NO: 1138298 - RNA, 18 nt, Human
ccccccaaagucccuuuc

SEQ ID NO: 1138299 - RNA, 21 nt, Human
cccugccaaccagcacuacca

SEQ ID NO: 1138300 - RNA, 21 nt, Human
cccuguuugaugucucccuca

SEQ ID NO: 1138301 - RNA, 19 nt, Human
ccuagugcaucugauugag

SEQ ID NO: 1138302 - RNA, 22 nt, Human
ccucugcugguggccuccuaaa

SEQ ID NO: 1138303 - RNA, 24 nt, Human
ccuuaccucuuucuaggaaaaaag

SEQ ID NO: 1138304 - RNA, 21 nt, Human
ccuuagggaaaaaagaggauc

SEQ ID NO: 1138305 - RNA, 18 nt, Human
ccuucucuaccuuuccca

SEQ ID NO: 1138306 - RNA, 23 nt, Human
cgaccccuuccccaccccccaaa

SEQ ID NO: 1138307 - RNA, 22 nt, Human
cgcuagagguugcaagcagcgg

SEQ ID NO: 1138308 - RNA, 18 nt, Human
cggggagguugauacugu

SEQ ID NO: 1138309 - RNA, 21 nt, Human
cuagagguugcaagcagcgga

SEQ ID NO: 1138310 - RNA, 24 nt, Human
cuauaguaaagcugaaaaagaauc

SEQ ID NO: 1138311 - RNA, 21 nt, Human
cuaugggcagcucucugggcu

SEQ ID NO: 1138312 - RNA, 19 nt, Human
cucauucuccuauucuccc

SEQ ID NO: 1138313 - RNA, 23 nt, Human
cucuucucgcuuugcagcccuag

SEQ ID NO: 1138314 - RNA, 23 nt, Human
cuuaaagcacuuaucagucccca

SEQ ID NO: 1138315 - RNA, 23 nt, Human
cuucaggaacccccuccaucccu

SEQ ID NO: 1138316 - RNA, 25 nt, Human
cuugcauauccuugggguugcuucc

SEQ ID NO: 1138317 - RNA, 19 nt, Human
gaacccccuccaucccugg

SEQ ID NO: 1138318 - RNA, 19 nt, Human
gaccccuuccccacccccc

SEQ ID NO: 1138319 - RNA, 19 nt, Human
gagaaucaaguuucacugu

SEQ ID NO: 1138320 - RNA, 21 nt, Human
gagccccaauucucaguguug

SEQ ID NO: 1138321 - RNA, 27 nt, Human
gaugacuucuauugucuagauuuccac

SEQ ID NO: 1138322 - RNA, 21 nt, Human
gaugcacucaaggugccucaa

SEQ ID NO: 1138323 - RNA, 21 nt, Human
gcaaagaaaggugccagggac

SEQ ID NO: 1138324 - RNA, 18 nt, Human
gccagacuccucugacuc

SEQ ID NO: 1138325 - RNA, 19 nt, Human
gcccagcuuccaagaguac

SEQ ID NO: 1138326 - RNA, 19 nt, Human
gccuaugggcagcucucug

SEQ ID NO: 1138327 - RNA, 18 nt, Human
gccuucucuaccuuuccc

SEQ ID NO: 1138328 - RNA, 20 nt, Human
ggaacccccuccaucccugg

SEQ ID NO: 1138329 - RNA, 24 nt, Human
ggaacccccuccaucccugggcuc

SEQ ID NO: 1138330 - RNA, 21 nt, Human
ggacauggagauaaagguguu

SEQ ID NO: 1138331 - RNA, 18 nt, Human
ggcaggggguggggagag

SEQ ID NO: 1138332 - RNA, 23 nt, Human
gggguugcuuccaucccuguuug

SEQ ID NO: 1138333 - RNA, 22 nt, Human
ggguauggacauugcuuaaagc

SEQ ID NO: 1138334 - RNA, 30 nt, Human
gguaacaaagggcaggggguggggagagaa

SEQ ID NO: 1138335 - RNA, 21 nt, Human
gguggggagagaaaagagaau

SEQ ID NO: 1138336 - RNA, 19 nt, Human
guaacauggaaaagaacuc

SEQ ID NO: 1138337 - RNA, 21 nt, Human
guggggagagaaaagagaauc

SEQ ID NO: 1138338 - RNA, 19 nt, Human
uaaaaagcagaacuccauu

SEQ ID NO: 1138339 - RNA, 20 nt, Human
uaaacaucuaagugcuuucc

SEQ ID NO: 1138340 - RNA, 22 nt, Human
uaaagcugaaaaagaaucaugc

SEQ ID NO: 1138341 - RNA, 20 nt, Human
uaaagguguucacuagaggc

SEQ ID NO: 1138342 - RNA, 24 nt, Human
uaaagguguucacuagaggccucc

SEQ ID NO: 1138343 - RNA, 30 nt, Human
uaacacaagaaaaacaauucauaucccuuu

SEQ ID NO: 1138344 - RNA, 18 nt, Human
uaacuacuccgaccuuca

SEQ ID NO: 1138345 - RNA, 23 nt, Human
uaagagggacauggagauaaagg

SEQ ID NO: 1138346 - RNA, 18 nt, Human
uaagcuaagagcaguuua

SEQ ID NO: 1138347 - RNA, 23 nt, Human
uacauaggaaaaggaaagggagg

SEQ ID NO: 1138348 - RNA, 24 nt, Human
uaccaugugcaaaggcugaggcag

SEQ ID NO: 1138349 - RNA, 18 nt, Human
uacuuggaaagggcccug

SEQ ID NO: 1138350 - RNA, 21 nt, Human
uagagguugcaagcagcggag

SEQ ID NO: 1138351 - RNA, 22 nt, Human
uauacacauggagaguaauaca

SEQ ID NO: 1138352 - RNA, 20 nt, Human
uauggauaaaaccauuuaga

SEQ ID NO: 1138353 - RNA, 22 nt, Human
ucaguaaagcaaguaugaagga

SEQ ID NO: 1138354 - RNA, 20 nt, Human
uccaagaguacagaaagucc

SEQ ID NO: 1138355 - RNA, 21 nt, Human
uccccaccccccaaagucccc

SEQ ID NO: 1138356 - RNA, 25 nt, Human
uccccaccccccaaagucccuuucc

SEQ ID NO: 1138357 - RNA, 18 nt, Human
uccccagaaaaaccaaac

SEQ ID NO: 1138358 - RNA, 24 nt, Human
uccccagaaaaaccaaaccaaaaa

SEQ ID NO: 1138359 - RNA, 27 nt, Human
uccccagaaaaaccaaaccaaaaacau

SEQ ID NO: 1138360 - RNA, 20 nt, Human
ucccugggcuccucacuccu

SEQ ID NO: 1138361 - RNA, 21 nt, Human
ucccuuagggaaaaaagagga

SEQ ID NO: 1138362 - RNA, 21 nt, Human
ucccuuagggaaaaaagagga

SEQ ID NO: 1138363 - RNA, 23 nt, Human
ucgcuuugcagcccuagcuuacg

SEQ ID NO: 1138364 - RNA, 19 nt, Human
ucgguaacauggaaaagaa

SEQ ID NO: 1138365 - RNA, 21 nt, Human
ucuaggaaaaaagaagagaaa

SEQ ID NO: 1138366 - RNA, 23 nt, Human
ucuauuacacucacuaaaccaga

SEQ ID NO: 1138367 - RNA, 22 nt, Human
ucuccuauucuccccugcuaug

SEQ ID NO: 1138368 - RNA, 20 nt, Human
ucucuuaaaaggucuguggg

SEQ ID NO: 1138369 - RNA, 21 nt, Human
ugaaaagcucagagacucagg

SEQ ID NO: 1138370 - RNA, 23 nt, Human
ugaaggaaguacauaggaaaagg

SEQ ID NO: 1138371 - RNA, 22 nt, Human
ugacaaaauaaaaacacacaaa

SEQ ID NO: 1138372 - RNA, 18 nt, Human
ugacaugaggaauucugg

SEQ ID NO: 1138373 - RNA, 21 nt, Human
ugagaaccagagucaggaaca

SEQ ID NO: 1138374 - RNA, 26 nt, Human
ugaggaaaagcugcuaucgaugacuu

SEQ ID NO: 1138375 - RNA, 18 nt, Human
ugaggcagugcuccuccu

SEQ ID NO: 1138376 - RNA, 26 nt, Human
ugcaaacagguaacuuaugcuuuuaa

SEQ ID NO: 1138377 - RNA, 25 nt, Human
ugcaagcagcggagaacuggcugaa

SEQ ID NO: 1138378 - RNA, 19 nt, Human
ugccagacuccucugacuc

SEQ ID NO: 1138379 - RNA, 18 nt, Human
ugccagagggaagggggu

SEQ ID NO: 1138380 - RNA, 19 nt, Human
ugccuuuggaggccucagc

SEQ ID NO: 1138381 - RNA, 18 nt, Human
uggaaaagaacucagcua

SEQ ID NO: 1138382 - RNA, 25 nt, Human
uggaaaagaacucagcuacuacagc

SEQ ID NO: 1138383 - RNA, 21 nt, Human
uggaaauugaacuaggugaca

SEQ ID NO: 1138384 - RNA, 21 nt, Human
uggcaaaaggcaaggacuggu

SEQ ID NO: 1138385 - RNA, 18 nt, Human
uggcugaauugaucuacc

SEQ ID NO: 1138386 - RNA, 21 nt, Human
uucacaagcagaauauaacac

SEQ ID NO: 1138387 - RNA, 23 nt, Human
uuccaaaaaaauauaguguuuua

SEQ ID NO: 1138388 - RNA, 23 nt, Human
uucuuucuuagaaaagggagcug

SEQ ID NO: 1138389 - RNA, 21 nt, Human
uugacacugaaaaccaaagac

SEQ ID NO: 1138390 - RNA, 18 nt, Human
uugaggaaucugauaacu

SEQ ID NO: 1138391 - RNA, 22 nt, Human
uugauaauaauaggaguaaccc

SEQ ID NO: 1138392 - RNA, 21 nt, Human
uugcaaagaaaggugccaggg

SEQ ID NO: 1138393 - RNA, 22 nt, Human
uugcaaagauuuggacugaaaa

SEQ ID NO: 1138394 - RNA, 24 nt, Human
aaagugcugggauuacaggcauga

SEQ ID NO: 1138395 - RNA, 25 nt, Human
aagaagaaaggggugucagccacag

SEQ ID NO: 1138396 - RNA, 19 nt, Human
aagggaggcggaggcagag

SEQ ID NO: 1138397 - RNA, 19 nt, Human
aagugcugggauuacaggc

SEQ ID NO: 1138398 - RNA, 21 nt, Human
aagugcugggauuacaggcau

SEQ ID NO: 1138399 - RNA, 26 nt, Human
aagugcugggauuacaggcaugagcc

SEQ ID NO: 1138400 - RNA, 19 nt, Human
acaucagccugcugaagcc

SEQ ID NO: 1138401 - RNA, 23 nt, Human
agaagaggagacuggggcuuaga

SEQ ID NO: 1138402 - RNA, 21 nt, Human
agaagggaggcggaggcagag

SEQ ID NO: 1138403 - RNA, 18 nt, Human
agacaggguuucuccaug

SEQ ID NO: 1138404 - RNA, 22 nt, Human
agacuccugucucccagcuccc

SEQ ID NO: 1138405 - RNA, 23 nt, Human
agaggcuguuugggcagccuugc

SEQ ID NO: 1138406 - RNA, 23 nt, Human
agcaggcccugugguggcaggag

SEQ ID NO: 1138407 - RNA, 23 nt, Human
agcccagggcaacugccaagcag

SEQ ID NO: 1138408 - RNA, 21 nt, Human
agccuugggcuccaaccaugu

SEQ ID NO: 1138409 - RNA, 24 nt, Human
agcgguucuccugccucagccucc

SEQ ID NO: 1138410 - RNA, 24 nt, Human
agcuggucucaaacucuugaccuc

SEQ ID NO: 1138411 - RNA, 21 nt, Human
aggaggauggagaagugccag

SEQ ID NO: 1138412 - RNA, 19 nt, Human
aggcagaggggcaggugcg

SEQ ID NO: 1138413 - RNA, 21 nt, Human
aggcaugagccaccgugcccg

SEQ ID NO: 1138414 - RNA, 23 nt, Human
aggcaugagccaccgugcccggc

SEQ ID NO: 1138415 - RNA, 19 nt, Human
aggcggaggcagagugggg

SEQ ID NO: 1138416 - RNA, 21 nt, Human
aggcggaggcagagugggggc

SEQ ID NO: 1138417 - RNA, 27 nt, Human
aggggcaggugcgacccuagcaggggu

SEQ ID NO: 1138418 - RNA, 21 nt, Human
agggguaagggugggcagagc

SEQ ID NO: 1138419 - RNA, 22 nt, Human
aggucuaucgcuaccaggugac

SEQ ID NO: 1138420 - RNA, 19 nt, Human
agguggcauagacuccugu

SEQ ID NO: 1138421 - RNA, 24 nt, Human
agguguuccguccgccucagccuc

SEQ ID NO: 1138422 - RNA, 21 nt, Human
aguaacugggauuacaggcau

SEQ ID NO: 1138423 - RNA, 23 nt, Human
aguaacugggauuacaggcaugu

SEQ ID NO: 1138424 - RNA, 21 nt, Human
aguccuuucuccuuucccccu

SEQ ID NO: 1138425 - RNA, 20 nt, Human
agugcaauggcgcgaucucg

SEQ ID NO: 1138426 - RNA, 24 nt, Human
agugcaauggcgcgaucucggcuc

SEQ ID NO: 1138427 - RNA, 20 nt, Human
aguggggaugauccaguggg

SEQ ID NO: 1138428 - RNA, 18 nt, Human
aucucacuucugcccuug

SEQ ID NO: 1138429 - RNA, 20 nt, Human
auggcaggaggauggagaag

SEQ ID NO: 1138430 - RNA, 19 nt, Human
augugccaccacacccagc

SEQ ID NO: 1138431 - RNA, 24 nt, Human
caaagugcugggauuacaggcaug

SEQ ID NO: 1138432 - RNA, 22 nt, Human
caagcgguucuccugccucagc

SEQ ID NO: 1138433 - RNA, 19 nt, Human
caagggcaagaaggaugcc

SEQ ID NO: 1138434 - RNA, 22 nt, Human
cacacccagcccuucugccucc

SEQ ID NO: 1138435 - RNA, 20 nt, Human
cacaggaccugugcagcgag

SEQ ID NO: 1138436 - RNA, 22 nt, Human
cacaugggcuuuggucgggggc

SEQ ID NO: 1138437 - RNA, 18 nt, Human
caccaugaaccccacaga

SEQ ID NO: 1138438 - RNA, 21 nt, Human
cacccagucaauucccaacag

SEQ ID NO: 1138439 - RNA, 18 nt, Human
caccccuacuuuacagaa

SEQ ID NO: 1138440 - RNA, 24 nt, Human
caccccuacuuuacagaagaggag

SEQ ID NO: 1138441 - RNA, 18 nt, Human
cagaagaggagacugggg

SEQ ID NO: 1138442 - RNA, 19 nt, Human
cagaagggaggcggaggca

SEQ ID NO: 1138443 - RNA, 21 nt, Human
cagacaggguuucuccauguu

SEQ ID NO: 1138444 - RNA, 23 nt, Human
cagcccuucugccucccaauucu

SEQ ID NO: 1138445 - RNA, 20 nt, Human
cagccuccugaguaacuggg

SEQ ID NO: 1138446 - RNA, 19 nt, Human
caggguuucuccauguugg

SEQ ID NO: 1138447 - RNA, 21 nt, Human
caggugggaauauccgggaag

SEQ ID NO: 1138448 - RNA, 20 nt, Human
caugugccaccacacccagc

SEQ ID NO: 1138449 - RNA, 23 nt, Human
ccaaagugcugggauuacaggca

SEQ ID NO: 1138450 - RNA, 24 nt, Human
ccaaagugcugggauuacaggcau

SEQ ID NO: 1138451 - RNA, 22 nt, Human
ccaauucucucuccuccguccc

SEQ ID NO: 1138452 - RNA, 27 nt, Human
ccacacccagcccuucugccucccccc

SEQ ID NO: 1138453 - RNA, 20 nt, Human
ccaccacacccagcuaauuu

SEQ ID NO: 1138454 - RNA, 25 nt, Human
ccaggcccacacccagcccuucugc

SEQ ID NO: 1138455 - RNA, 19 nt, Human
ccaucagcaacgcucugca

SEQ ID NO: 1138456 - RNA, 22 nt, Human
ccauguuggucaagcuggucuc

SEQ ID NO: 1138457 - RNA, 24 nt, Human
cccaaagugcugggauuacaggca

SEQ ID NO: 1138458 - RNA, 21 nt, Human
cccaauucucucuccuccguc

SEQ ID NO: 1138459 - RNA, 22 nt, Human
cccaucagcaacgcucugcaga

SEQ ID NO: 1138460 - RNA, 24 nt, Human
cccaucagcaacgcucugcagaaa

SEQ ID NO: 1138461 - RNA, 20 nt, Human
ccccuccucccggguucaag

SEQ ID NO: 1138462 - RNA, 19 nt, Human
ccccugaggacccaggccc

SEQ ID NO: 1138463 - RNA, 19 nt, Human
ccccugcaaagcagggccc

SEQ ID NO: 1138464 - RNA, 23 nt, Human
ccccugcaaagcagggcccaccu

SEQ ID NO: 1138465 - RNA, 23 nt, Human
cccggguucaagcgguucuccug

SEQ ID NO: 1138466 - RNA, 22 nt, Human
cccuugaccacggacaggcccc

SEQ ID NO: 1138467 - RNA, 20 nt, Human
ccgcaucacaggugugauca

SEQ ID NO: 1138468 - RNA, 24 nt, Human
ccgccucagccucccaaagugcug

SEQ ID NO: 1138469 - RNA, 19 nt, Human
ccgggaaggauauuccagg

SEQ ID NO: 1138470 - RNA, 19 nt, Human
ccucccauccucccagcaa

SEQ ID NO: 1138471 - RNA, 21 nt, Human
ccuccucccggguucaagcgg

SEQ ID NO: 1138472 - RNA, 20 nt, Human
ccugaccccaggagcagugg

SEQ ID NO: 1138473 - RNA, 19 nt, Human
ccugaguaacugggauuac

SEQ ID NO: 1138474 - RNA, 23 nt, Human
ccugaguaacugggauuacaggc

SEQ ID NO: 1138475 - RNA, 24 nt, Human
ccugaguaacugggauuacaggca

SEQ ID NO: 1138476 - RNA, 20 nt, Human
ccugcugaagccucccaucc

SEQ ID NO: 1138477 - RNA, 23 nt, Human
ccugcugaagccucccauccucc

SEQ ID NO: 1138478 - RNA, 20 nt, Human
ccugcuucaguccuuucucc

SEQ ID NO: 1138479 - RNA, 22 nt, Human
ccuggcuccugaccccaggagc

SEQ ID NO: 1138480 - RNA, 19 nt, Human
ccugucaggugaguccccc

SEQ ID NO: 1138481 - RNA, 21 nt, Human
ccuuucuccuuucccccuuuc

SEQ ID NO: 1138482 - RNA, 20 nt, Human
cgguucuccugccucagccu

SEQ ID NO: 1138483 - RNA, 23 nt, Human
cuccagugauggcaggaggaugg

SEQ ID NO: 1138484 - RNA, 21 nt, Human
cucccggguucaagcgguucu

SEQ ID NO: 1138485 - RNA, 22 nt, Human
cuccugccucagccuccugagu

SEQ ID NO: 1138486 - RNA, 20 nt, Human
cuccuggacucagagagccc

SEQ ID NO: 1138487 - RNA, 22 nt, Human
cucggaucccccuccucccggg

SEQ ID NO: 1138488 - RNA, 26 nt, Human
cucuugaccucagguguuccguccgc

SEQ ID NO: 1138489 - RNA, 22 nt, Human
cucuuguugcccaggcuggagu

SEQ ID NO: 1138490 - RNA, 24 nt, Human
cugagaucucacuucugcccuuga

SEQ ID NO: 1138491 - RNA, 23 nt, Human
cugaguaacugggauuacaggca

SEQ ID NO: 1138492 - RNA, 24 nt, Human
cugaguaacugggauuacaggcau

SEQ ID NO: 1138493 - RNA, 24 nt, Human
cugccccccugcaaagcagggccc

SEQ ID NO: 1138494 - RNA, 23 nt, Human
cugccucagccuccugaguaacu

SEQ ID NO: 1138495 - RNA, 19 nt, Human
cuggcuugggcucucucca

SEQ ID NO: 1138496 - RNA, 25 nt, Human
cuuccuccacugcugccuaaugcaa

SEQ ID NO: 1138497 - RNA, 24 nt, Human
cuuguugcccaggcuggagugcaa

SEQ ID NO: 1138498 - RNA, 18 nt, Human
gaaaggaugcugcccaca

SEQ ID NO: 1138499 - RNA, 21 nt, Human
gaaccccacagagaaagagcu

SEQ ID NO: 1138500 - RNA, 19 nt, Human
gaagccucccauccucccg

SEQ ID NO: 1138501 - RNA, 21 nt, Human
gaauaaagccuugggcuccaa

SEQ ID NO: 1138502 - RNA, 24 nt, Human
gaccucagguguuccguccgccuc

SEQ ID NO: 1138503 - RNA, 24 nt, Human
gaccuggcuccugaccccaggagc

SEQ ID NO: 1138504 - RNA, 19 nt, Human
gacugaacgugacucuggc

SEQ ID NO: 1138505 - RNA, 20 nt, Human
gagagagcaggcccuguggu

SEQ ID NO: 1138506 - RNA, 19 nt, Human
gagagcaggcccuguggug

SEQ ID NO: 1138507 - RNA, 19 nt, Human
gagccacagaucagaagag

SEQ ID NO: 1138508 - RNA, 22 nt, Human
gaguaacugggauuacaggcau

SEQ ID NO: 1138509 - RNA, 25 nt, Human
gaguaacugggauuacaggcaugug

SEQ ID NO: 1138510 - RNA, 24 nt, Human
gaucucacuucugcccuugaccac

SEQ ID NO: 1138511 - RNA, 18 nt, Human
gauuacaggcaugagcca

SEQ ID NO: 1138512 - RNA, 20 nt, Human
gauuacaggcaugagccacc

SEQ ID NO: 1138513 - RNA, 21 nt, Human
gauuacaggcaugagccaccg

SEQ ID NO: 1138514 - RNA, 18 nt, Human
gauuacaggcaugugcca

SEQ ID NO: 1138515 - RNA, 19 nt, Human
gcaggaggauggagaagug

SEQ ID NO: 1138516 - RNA, 21 nt, Human
gcaggcgaggggaaagcagag

SEQ ID NO: 1138517 - RNA, 26 nt, Human
gccacaguuccaggaggucccaggcu

SEQ ID NO: 1138518 - RNA, 19 nt, Human
gcccaggcuggagugcaau

SEQ ID NO: 1138519 - RNA, 23 nt, Human
gccucagccucccaaagugcugg

SEQ ID NO: 1138520 - RNA, 24 nt, Human
gcucuuguugcccaggcuggagug

SEQ ID NO: 1138521 - RNA, 21 nt, Human
ggagacuggggcuuagaaagg

SEQ ID NO: 1138522 - RNA, 19 nt, Human
ggaggaaacugaggcucag

SEQ ID NO: 1138523 - RNA, 25 nt, Human
ggaggccggggagggcuggcuuggg

SEQ ID NO: 1138524 - RNA, 24 nt, Human
ggauuacaggcaugagccaccgug

SEQ ID NO: 1138525 - RNA, 19 nt, Human
ggauuacaggcaugugcca

SEQ ID NO: 1138526 - RNA, 19 nt, Human
ggccacaggggugaaggac

SEQ ID NO: 1138527 - RNA, 23 nt, Human
gggaaagcagagcuuuaagacug

SEQ ID NO: 1138528 - RNA, 19 nt, Human
gggaugauccagugggaag

SEQ ID NO: 1138529 - RNA, 18 nt, Human
gggcaggugcgacccuag

SEQ ID NO: 1138530 - RNA, 20 nt, Human
gggcaugggagggagagagg

SEQ ID NO: 1138531 - RNA, 24 nt, Human
gggcuggucagcuggggccugggc

SEQ ID NO: 1138532 - RNA, 18 nt, Human
ggggcuggucagcugggg

SEQ ID NO: 1138533 - RNA, 18 nt, Human
gggggagagagcaggccc

SEQ ID NO: 1138534 - RNA, 20 nt, Human
guaacugggauuacaggcau

SEQ ID NO: 1138535 - RNA, 25 nt, Human
guccagugcgacacucccuuccuuu

SEQ ID NO: 1138536 - RNA, 18 nt, Human
gugauggccaccccuacu

SEQ ID NO: 1138537 - RNA, 23 nt, Human
gugggggagagagcaggcccugu

SEQ ID NO: 1138538 - RNA, 20 nt, Human
gugggggcguggggacacag

SEQ ID NO: 1138539 - RNA, 24 nt, Human
guguuccguccgccucagccuccc

SEQ ID NO: 1138540 - RNA, 19 nt, Human
guuaggcucaaacccaguu

SEQ ID NO: 1138541 - RNA, 20 nt, Human
guucuccugccucagccucc

SEQ ID NO: 1138542 - RNA, 23 nt, Human
uaauuuuguauuuuuaguacaga

SEQ ID NO: 1138543 - RNA, 25 nt, Human
uaauuuuguauuuuuaguacagaca

SEQ ID NO: 1138544 - RNA, 23 nt, Human
uacaggcaugagccaccgugccc

SEQ ID NO: 1138545 - RNA, 24 nt, Human
uacaggcaugugccaccacaccca

SEQ ID NO: 1138546 - RNA, 19 nt, Human
uagcaggcgaggggaaagc

SEQ ID NO: 1138547 - RNA, 18 nt, Human
uaggaggaaacugaggcu

SEQ ID NO: 1138548 - RNA, 19 nt, Human
uaggaggaaacugaggcuc

SEQ ID NO: 1138549 - RNA, 24 nt, Human
uaguacagacaggguuucuccaug

SEQ ID NO: 1138550 - RNA, 23 nt, Human
ucaagacguccccugaggaccca

SEQ ID NO: 1138551 - RNA, 18 nt, Human
ucagaggugguccaggug

SEQ ID NO: 1138552 - RNA, 22 nt, Human
ucaggucagagggaugugagga

SEQ ID NO: 1138553 - RNA, 20 nt, Human
ucaguggccgcugguuccug

SEQ ID NO: 1138554 - RNA, 24 nt, Human
ucaguggccgcugguuccuggcgg

SEQ ID NO: 1138555 - RNA, 23 nt, Human
uccagugggaaggggccggaggg

SEQ ID NO: 1138556 - RNA, 19 nt, Human
uccauguuggucaagcugg

SEQ ID NO: 1138557 - RNA, 24 nt, Human
ucccaaagugcugggauuacaggc

SEQ ID NO: 1138558 - RNA, 21 nt, Human
ucccacaggaccugugcagcg

SEQ ID NO: 1138559 - RNA, 22 nt, Human
uccccugaggacccaggcccac

SEQ ID NO: 1138560 - RNA, 19 nt, Human
ucccggguucaagcgguuc

SEQ ID NO: 1138561 - RNA, 21 nt, Human
ucccggguucaagcgguucuc

SEQ ID NO: 1138562 - RNA, 24 nt, Human
ucccggguucaagcgguucuccug

SEQ ID NO: 1138563 - RNA, 21 nt, Human
uccguccgccucagccuccca

SEQ ID NO: 1138564 - RNA, 24 nt, Human
uccugaguaacugggauuacaggc

SEQ ID NO: 1138565 - RNA, 22 nt, Human
ucgcucuuguugcccaggcugg

SEQ ID NO: 1138566 - RNA, 23 nt, Human
ucgcucuuguugcccaggcugga

SEQ ID NO: 1138567 - RNA, 19 nt, Human
ucugccucccaauucucuc

SEQ ID NO: 1138568 - RNA, 18 nt, Human
ucuguacagaggcuguuu

SEQ ID NO: 1138569 - RNA, 22 nt, Human
ucuuguugcccaggcuggagug

SEQ ID NO: 1138570 - RNA, 23 nt, Human
ugaaggaccuggcuccugacccc

SEQ ID NO: 1138571 - RNA, 19 nt, Human
ugaauaaagccuugggcuc

SEQ ID NO: 1138572 - RNA, 19 nt, Human
ugaccucagguguuccguc

SEQ ID NO: 1138573 - RNA, 24 nt, Human
ugaccucagguguuccguccgccu

SEQ ID NO: 1138574 - RNA, 23 nt, Human
ugagacagaguuucgcucuuguu

SEQ ID NO: 1138575 - RNA, 24 nt, Human
ugagaugcaaagggaauaauguua

SEQ ID NO: 1138576 - RNA, 18 nt, Human
ugaggagcuugcccaagg

SEQ ID NO: 1138577 - RNA, 18 nt, Human
ugaggcucagagaggcgg

SEQ ID NO: 1138578 - RNA, 22 nt, Human
ugauggcaggaggauggagaag

SEQ ID NO: 1138579 - RNA, 21 nt, Human
ugaugggcagguguuaggcuc

SEQ ID NO: 1138580 - RNA, 20 nt, Human
ugcauggaagaagaaagggg

SEQ ID NO: 1138581 - RNA, 18 nt, Human
ugcccaggcuggagugca

SEQ ID NO: 1138582 - RNA, 21 nt, Human
ugcccaggcuggagugcaaug

SEQ ID NO: 1138583 - RNA, 21 nt, Human
ugcccaggcuggagugcaaug

SEQ ID NO: 1138584 - RNA, 24 nt, Human
ugcccaggcuggagugcaauggcg

SEQ ID NO: 1138585 - RNA, 23 nt, Human
ugcccuugaccacggacaggccc

SEQ ID NO: 1138586 - RNA, 24 nt, Human
ugccucagccuccugaguaacugg

SEQ ID NO: 1138587 - RNA, 22 nt, Human
uggaaccuuaggaggaaacuga

SEQ ID NO: 1138588 - RNA, 23 nt, Human
uggagugcaauggcgcgaucucg

SEQ ID NO: 1138589 - RNA, 24 nt, Human
uggagugcaauggcgcgaucucgg

SEQ ID NO: 1138590 - RNA, 19 nt, Human
uggcauagacuccugucuc

SEQ ID NO: 1138591 - RNA, 21 nt, Human
uggcauagacuccugucuccc

SEQ ID NO: 1138592 - RNA, 24 nt, Human
uggcggggcuggucagcuggggcc

SEQ ID NO: 1138593 - RNA, 20 nt, Human
uggcuggaggccggggaggg

SEQ ID NO: 1138594 - RNA, 21 nt, Human
uggcuggaggccggggagggc

SEQ ID NO: 1138595 - RNA, 18 nt, Human
ugggagggagagaggagg

SEQ ID NO: 1138596 - RNA, 18 nt, Human
ugggauuacaggcaugag

SEQ ID NO: 1138597 - RNA, 21 nt, Human
ugggauuacaggcaugagcca

SEQ ID NO: 1138598 - RNA, 22 nt, Human
ugggauuacaggcaugagccac

SEQ ID NO: 1138599 - RNA, 23 nt, Human
ugggauuacaggcaugagccacc

SEQ ID NO: 1138600 - RNA, 23 nt, Human
ugggauuacaggcaugagccacc

SEQ ID NO: 1138601 - RNA, 24 nt, Human
ugggauuacaggcaugagccaccg

SEQ ID NO: 1138602 - RNA, 18 nt, Human
ugggauuacaggcaugug

SEQ ID NO: 1138603 - RNA, 21 nt, Human
ugggauuacaggcaugugcca

SEQ ID NO: 1138604 - RNA, 22 nt, Human
ugggauuacaggcaugugccac

SEQ ID NO: 1138605 - RNA, 24 nt, Human
ugggauuacaggcaugugccacca

SEQ ID NO: 1138606 - RNA, 19 nt, Human
ugggcuuuggucgggggcu

SEQ ID NO: 1138607 - RNA, 22 nt, Human
ugggggagagagcaggcccugu

SEQ ID NO: 1138608 - RNA, 24 nt, Human
ugggggcguggggacacagccaca

SEQ ID NO: 1138609 - RNA, 24 nt, Human
uggucaagcuggucucaaacucuu

SEQ ID NO: 1138610 - RNA, 21 nt, Human
uggucagcuggggccugggcu

SEQ ID NO: 1138611 - RNA, 19 nt, Human
ugugguggcaggagguggc

SEQ ID NO: 1138612 - RNA, 19 nt, Human
ugugguggcaggagguggc

SEQ ID NO: 1138613 - RNA, 21 nt, Human
ugugguggcaggagguggcau

SEQ ID NO: 1138614 - RNA, 24 nt, Human
uguuccguccgccucagccuccca

SEQ ID NO: 1138615 - RNA, 20 nt, Human
uguugcccaggcuggagugc

SEQ ID NO: 1138616 - RNA, 24 nt, Human
uuaguacagacaggguuucuccau

SEQ ID NO: 1138617 - RNA, 18 nt, Human
uucaagcgguucuccugc

SEQ ID NO: 1138618 - RNA, 21 nt, Human
uucaagcgguucuccugccuc

SEQ ID NO: 1138619 - RNA, 23 nt, Human
uucaagcgguucuccugccucag

SEQ ID NO: 1138620 - RNA, 23 nt, Human
uucagaggugguccaggugggaa

SEQ ID NO: 1138621 - RNA, 24 nt, Human
uucgcucuuguugcccaggcugga

SEQ ID NO: 1138622 - RNA, 22 nt, Human
uucuuugagccacugaauaaag

SEQ ID NO: 1138623 - RNA, 24 nt, Human
uuucgcucuuguugcccaggcugg

SEQ ID NO: 1138624 - RNA, 21 nt, Human
uuucuccauguuggucaagcu

SEQ ID NO: 1138625 - RNA, 20 nt, Human
uuuguuuuuuugagacagag

SEQ ID NO: 1138626 - RNA, 20 nt, Human
uuuuguauuuuuaguacaga

SEQ ID NO: 1138627 - RNA, 24 nt, Human
uuuuuguuuuuuugagacagaguu

SEQ ID NO: 1138628 - RNA, 22 nt, Human
aaagacagcaaaauuuucccgg

SEQ ID NO: 1138629 - RNA, 19 nt, Human
aagacagcaaaauuuuccc

SEQ ID NO: 1138630 - RNA, 24 nt, Human
acagcaaaauuuucccggcacaag

SEQ ID NO: 1138631 - RNA, 21 nt, Human
caaagacagcaaaauuuuccc

SEQ ID NO: 1138632 - RNA, 22 nt, Human
uaaaauuacaaagacagcaaaa

SEQ ID NO: 1138633 - RNA, 21 nt, Human
aaauacucgaagaagaacauc

SEQ ID NO: 1138634 - RNA, 21 nt, Human
aagaagaacauccaugagaaa

SEQ ID NO: 1138635 - RNA, 22 nt, Human
aauggugauggugaugauggag

SEQ ID NO: 1138636 - RNA, 23 nt, Human
agaagaacauccaugagaaaaaa

SEQ ID NO: 1138637 - RNA, 24 nt, Human
agaggaggaggaaucucuggcucu

SEQ ID NO: 1138638 - RNA, 19 nt, Human
agcagcugcugcgcccucc

SEQ ID NO: 1138639 - RNA, 24 nt, Human
aggaaucucuggcucuccugcuga

SEQ ID NO: 1138640 - RNA, 22 nt, Human
aggaggaggaaucucuggcucu

SEQ ID NO: 1138641 - RNA, 22 nt, Human
auaauggugauggugaugauuu

SEQ ID NO: 1138642 - RNA, 22 nt, Human
cagggagcagcugcugcgcccu

SEQ ID NO: 1138643 - RNA, 26 nt, Human
cgcaggugccuccucgguugcuccuu

SEQ ID NO: 1138644 - RNA, 24 nt, Human
cugucagugaaaauuaggucggcc

SEQ ID NO: 1138645 - RNA, 18 nt, Human
gaggaggaaucucuggcu

SEQ ID NO: 1138646 - RNA, 19 nt, Human
gcaggcgcggggggggucc

SEQ ID NO: 1138647 - RNA, 27 nt, Human
ggaaaacuccaaauagucuuuuacuga

SEQ ID NO: 1138648 - RNA, 19 nt, Human
ggaggaggaaucucuggcu

SEQ ID NO: 1138649 - RNA, 24 nt, Human
ggugaugauggagaggaggaggaa

SEQ ID NO: 1138650 - RNA, 24 nt, Human
gugacggugauggugaugagaauu

SEQ ID NO: 1138651 - RNA, 21 nt, Human
uaagugcaggcgcgggggggg

SEQ ID NO: 1138652 - RNA, 19 nt, Human
uagaacgauacuccaaagg

SEQ ID NO: 1138653 - RNA, 25 nt, Human
uagagaaauagaacgauacuccaaa

SEQ ID NO: 1138654 - RNA, 20 nt, Human
uccaugagaaaaaauaaggc

SEQ ID NO: 1138655 - RNA, 19 nt, Human
ucgaagaagaacauccaug

SEQ ID NO: 1138656 - RNA, 21 nt, Human
ucuccugcugaugucuuucuc

SEQ ID NO: 1138657 - RNA, 25 nt, Human
ucuccugcugaugucuuucucugac

SEQ ID NO: 1138658 - RNA, 21 nt, Human
ugaccaguacagucuccuucu

SEQ ID NO: 1138659 - RNA, 18 nt, Human
ugagaaaaaauaaggcaa

SEQ ID NO: 1138660 - RNA, 18 nt, Human
ugaugauggagaggagga

SEQ ID NO: 1138661 - RNA, 24 nt, Human
ugccuccucgguugcuccuuuaaa

SEQ ID NO: 1138662 - RNA, 22 nt, Human
uggagaggaggaggaaucucug

SEQ ID NO: 1138663 - RNA, 24 nt, Human
uggagaggaggaggaaucucuggc

SEQ ID NO: 1138664 - RNA, 18 nt, Human
uggugaugagaauaaugg

SEQ ID NO: 1138665 - RNA, 19 nt, Human
uggugaugauggagaggag

SEQ ID NO: 1138666 - RNA, 24 nt, Human
ugugggcuuucuuucgcaggugcc

SEQ ID NO: 1138667 - RNA, 24 nt, Human
uguugggucagaaaguguucaggg

SEQ ID NO: 1138668 - RNA, 22 nt, Human
uuaggucggcaaggacgagagu

SEQ ID NO: 1138669 - RNA, 24 nt, Human
uucagggagcagcugcugcgcccu

SEQ ID NO: 1138670 - RNA, 24 nt, Human
ucaggggugcucguggucuuuucc

SEQ ID NO: 1138671 - RNA, 21 nt, Human
ucaguauacguuggggugcag

SEQ ID NO: 1138672 - RNA, 24 nt, Human
ugacaucaguauacguuggggugc

SEQ ID NO: 1138673 - RNA, 19 nt, Human
ugcucguggucuuuucccu

SEQ ID NO: 1138674 - RNA, 24 nt, Human
aaacagauaaaaaucccagcucuc

SEQ ID NO: 1138675 - RNA, 25 nt, Human
aaaccuaccagccgagugacuuugg

SEQ ID NO: 1138676 - RNA, 24 nt, Human
aaagugcugggauuacaggcguga

SEQ ID NO: 1138677 - RNA, 18 nt, Human
aaauaaucuuaucaucag

SEQ ID NO: 1138678 - RNA, 18 nt, Human
aaauuccacggcuugaaa

SEQ ID NO: 1138679 - RNA, 23 nt, Human
aagccaguuugcaaaauuccuga

SEQ ID NO: 1138680 - RNA, 24 nt, Human
aagugauccaccugccucggccuc

SEQ ID NO: 1138681 - RNA, 19 nt, Human
aagugcugggauuacaggc

SEQ ID NO: 1138682 - RNA, 19 nt, Human
aagugcugggauuacaggc

SEQ ID NO: 1138683 - RNA, 26 nt, Human
aagugcugggauuacaggcgugagcc

SEQ ID NO: 1138684 - RNA, 23 nt, Human
acaggcagcagcaggggcggagc

SEQ ID NO: 1138685 - RNA, 24 nt, Human
accauguuggccaggcuggucuug

SEQ ID NO: 1138686 - RNA, 24 nt, Human
acuggguuccaccauguuggccag

SEQ ID NO: 1138687 - RNA, 21 nt, Human
acuuucaccuccaaccccagu

SEQ ID NO: 1138688 - RNA, 22 nt, Human
agaaagcccacgccugcaaaaa

SEQ ID NO: 1138689 - RNA, 22 nt, Human
aggcagcagcaggggcggagcu

SEQ ID NO: 1138690 - RNA, 24 nt, Human
aggcagcagcaggggcggagcuca

SEQ ID NO: 1138691 - RNA, 22 nt, Human
aguagagacuggguuccaccau

SEQ ID NO: 1138692 - RNA, 18 nt, Human
agugcugggauuacaggc

SEQ ID NO: 1138693 - RNA, 24 nt, Human
auacagcaaaacagauaaaaaucc

SEQ ID NO: 1138694 - RNA, 22 nt, Human
caaaacagauaaaaaucccagc

SEQ ID NO: 1138695 - RNA, 24 nt, Human
caaagugcugggauuacaggcgug

SEQ ID NO: 1138696 - RNA, 19 nt, Human
caaauuccacggcuugaaa

SEQ ID NO: 1138697 - RNA, 22 nt, Human
caagugauccaccugccucggc

SEQ ID NO: 1138698 - RNA, 21 nt, Human
caccauguuggccaggcuggu

SEQ ID NO: 1138699 - RNA, 23 nt, Human
caccauguuggccaggcuggucu

SEQ ID NO: 1138700 - RNA, 24 nt, Human
caccauguuggccaggcuggucuu

SEQ ID NO: 1138701 - RNA, 27 nt, Human
caccauguuggccaggcuggucuugaa

SEQ ID NO: 1138702 - RNA, 23 nt, Human
caccugccucggccucccaaagu

SEQ ID NO: 1138703 - RNA, 21 nt, Human
cacugcuggggagacagugac

SEQ ID NO: 1138704 - RNA, 24 nt, Human
cagcaaaacagauaaaaaucccag

SEQ ID NO: 1138705 - RNA, 20 nt, Human
cagcagcaagaaacgauucc

SEQ ID NO: 1138706 - RNA, 28 nt, Human
cagcagcaggggcggagcucaugccgag

SEQ ID NO: 1138707 - RNA, 18 nt, Human
cagcucacccagacccuc

SEQ ID NO: 1138708 - RNA, 21 nt, Human
caggaagguccagaccgggug

SEQ ID NO: 1138709 - RNA, 25 nt, Human
cauacagcaaaacagauaaaaaucc

SEQ ID NO: 1138710 - RNA, 24 nt, Human
cauguuggccaggcuggucuugaa

SEQ ID NO: 1138711 - RNA, 20 nt, Human
ccaaagugcugggauuacag

SEQ ID NO: 1138712 - RNA, 22 nt, Human
ccaaagugcugggauuacaggc

SEQ ID NO: 1138713 - RNA, 22 nt, Human
ccaaagugcugggauuacaggc

SEQ ID NO: 1138714 - RNA, 24 nt, Human
ccaaagugcugggauuacaggcgu

SEQ ID NO: 1138715 - RNA, 23 nt, Human
ccagcugguccgccacaccuccc

SEQ ID NO: 1138716 - RNA, 25 nt, Human
ccagucauucucccuugcuaagccu

SEQ ID NO: 1138717 - RNA, 27 nt, Human
cccaugccaaccuggcacacccagaag

SEQ ID NO: 1138718 - RNA, 22 nt, Human
ccccacugucuaccugcugcuu

SEQ ID NO: 1138719 - RNA, 22 nt, Human
ccccgaacuacccacuuggccc

SEQ ID NO: 1138720 - RNA, 23 nt, Human
ccccgaacuacccacuuggcccc

SEQ ID NO: 1138721 - RNA, 25 nt, Human
cccucaucuacuucauacagcaaaa

SEQ ID NO: 1138722 - RNA, 18 nt, Human
cccugccccaggcuccug

SEQ ID NO: 1138723 - RNA, 23 nt, Human
ccgcagcugucaccagccccacu

SEQ ID NO: 1138724 - RNA, 23 nt, Human
ccucccagaacucuggauccccg

SEQ ID NO: 1138725 - RNA, 21 nt, Human
ccugaccucaagugauccacc

SEQ ID NO: 1138726 - RNA, 23 nt, Human
ccugaccucaagugauccaccug

SEQ ID NO: 1138727 - RNA, 23 nt, Human
ccugaccucaagugauccaccug

SEQ ID NO: 1138728 - RNA, 24 nt, Human
ccugccucggccucccaaagugcu

SEQ ID NO: 1138729 - RNA, 21 nt, Human
ccugcugcuuaagguaaaagc

SEQ ID NO: 1138730 - RNA, 18 nt, Human
ccugggcccagcuggucc

SEQ ID NO: 1138731 - RNA, 25 nt, Human
cggccagcucaauaguacucaaauu

SEQ ID NO: 1138732 - RNA, 23 nt, Human
cgggagagugguuacccuugggg

SEQ ID NO: 1138733 - RNA, 21 nt, Human
cucaagugauccaccugccuc

SEQ ID NO: 1138734 - RNA, 23 nt, Human
cucagcgccaggccugcuuccuc

SEQ ID NO: 1138735 - RNA, 18 nt, Human
cuccugugacucagcgcc

SEQ ID NO: 1138736 - RNA, 19 nt, Human
cucugucuugaucuuggag

SEQ ID NO: 1138737 - RNA, 24 nt, Human
cuggguuccaccauguuggccagg

SEQ ID NO: 1138738 - RNA, 21 nt, Human
cuuggcccccgccucagcuug

SEQ ID NO: 1138739 - RNA, 24 nt, Human
gaccucaagugauccaccugccuc

SEQ ID NO: 1138740 - RNA, 18 nt, Human
gauuacaggcgugagcca

SEQ ID NO: 1138741 - RNA, 21 nt, Human
gauuacaggcgugagccacca

SEQ ID NO: 1138742 - RNA, 24 nt, Human
gauuacaggcgugagccaccaugc

SEQ ID NO: 1138743 - RNA, 21 nt, Human
gcacacccagaaggcagugca

SEQ ID NO: 1138744 - RNA, 19 nt, Human
gccgagugcagaaagccca

SEQ ID NO: 1138745 - RNA, 24 nt, Human
gccucagcuugccugguccuccag

SEQ ID NO: 1138746 - RNA, 25 nt, Human
gccucagcuugccugguccuccagc

SEQ ID NO: 1138747 - RNA, 23 nt, Human
gcuggucuugaacuccugaccuc

SEQ ID NO: 1138748 - RNA, 24 nt, Human
ggagacagugacuucagguggggg

SEQ ID NO: 1138749 - RNA, 24 nt, Human
ggauuacaggcgugagccaccaug

SEQ ID NO: 1138750 - RNA, 19 nt, Human
ggcagcagcaggggcggag

SEQ ID NO: 1138751 - RNA, 19 nt, Human
ggccauuggccgcugaugg

SEQ ID NO: 1138752 - RNA, 24 nt, Human
ggcuggucuugaacuccugaccuc

SEQ ID NO: 1138753 - RNA, 19 nt, Human
gggaggagcguguugggga

SEQ ID NO: 1138754 - RNA, 21 nt, Human
ggguuccaccauguuggccag

SEQ ID NO: 1138755 - RNA, 19 nt, Human
gguccgccacaccucccag

SEQ ID NO: 1138756 - RNA, 19 nt, Human
ggucuugaacuccugaccu

SEQ ID NO: 1138757 - RNA, 24 nt, Human
gugauccaccugccucggccuccc

SEQ ID NO: 1138758 - RNA, 21 nt, Human
gugcucccucccccuccacca

SEQ ID NO: 1138759 - RNA, 25 nt, Human
uaagguaaaagcccacuggucaccu

SEQ ID NO: 1138760 - RNA, 23 nt, Human
uacagcaaaacagauaaaaaucc

SEQ ID NO: 1138761 - RNA, 22 nt, Human
uacaggcgugagccaccaugcc

SEQ ID NO: 1138762 - RNA, 22 nt, Human
uacaggcgugagccaccaugcc

SEQ ID NO: 1138763 - RNA, 23 nt, Human
uacaggcgugagccaccaugccu

SEQ ID NO: 1138764 - RNA, 23 nt, Human
uacccuugggggcaggggugggu

SEQ ID NO: 1138765 - RNA, 20 nt, Human
uacccuugggggcagggguu

SEQ ID NO: 1138766 - RNA, 22 nt, Human
uagagacuggguuccaccaugu

SEQ ID NO: 1138767 - RNA, 20 nt, Human
uagaggccauuggccgcuga

SEQ ID NO: 1138768 - RNA, 24 nt, Human
uaguagagacuggguuccaccaug

SEQ ID NO: 1138769 - RNA, 21 nt, Human
ucaagugauccaccugccucg

SEQ ID NO: 1138770 - RNA, 22 nt, Human
ucacacgcuggucucacugaca

SEQ ID NO: 1138771 - RNA, 25 nt, Human
ucaugccgagugcagaaagcccacg

SEQ ID NO: 1138772 - RNA, 19 nt, Human
uccaaccccaguccugggc

SEQ ID NO: 1138773 - RNA, 19 nt, Human
uccaucaguggcacggcca

SEQ ID NO: 1138774 - RNA, 24 nt, Human
ucccaaagugcugggauuacaggc

SEQ ID NO: 1138775 - RNA, 22 nt, Human
ucccagaacucuggauccccgc

SEQ ID NO: 1138776 - RNA, 23 nt, Human
ucccagcucacccagacccucac

SEQ ID NO: 1138777 - RNA, 21 nt, Human
uccccaugccaaccuggcaca

SEQ ID NO: 1138778 - RNA, 25 nt, Human
ucccucaucuacuucauacagcaaa

SEQ ID NO: 1138779 - RNA, 18 nt, Human
ucggccucccaaagugcu

SEQ ID NO: 1138780 - RNA, 18 nt, Human
ucugaguugugcucccuc

SEQ ID NO: 1138781 - RNA, 21 nt, Human
ucuugaacuccugaccucaag

SEQ ID NO: 1138782 - RNA, 24 nt, Human
ugaccucaagugauccaccugccu

SEQ ID NO: 1138783 - RNA, 18 nt, Human
ugacucagcgccaggccu

SEQ ID NO: 1138784 - RNA, 23 nt, Human
ugacucagcgccaggccugcuuc

SEQ ID NO: 1138785 - RNA, 23 nt, Human
ugacuuugggccagucauucucc

SEQ ID NO: 1138786 - RNA, 19 nt, Human
ugaggagauaggacugugg

SEQ ID NO: 1138787 - RNA, 21 nt, Human
ugaguucugaguugugcuccc

SEQ ID NO: 1138788 - RNA, 19 nt, Human
ugaguugugcucccucccc

SEQ ID NO: 1138789 - RNA, 19 nt, Human
ugccccaggcuccugugac

SEQ ID NO: 1138790 - RNA, 25 nt, Human
ugccccaggcuccugugacucagcc

SEQ ID NO: 1138791 - RNA, 19 nt, Human
ugccgagugcagaaagccc

SEQ ID NO: 1138792 - RNA, 21 nt, Human
ugccucggccucccaaagugc

SEQ ID NO: 1138793 - RNA, 24 nt, Human
ugccucggccucccaaagugcugg

SEQ ID NO: 1138794 - RNA, 22 nt, Human
ugcugaggcgccagcuccuggg

SEQ ID NO: 1138795 - RNA, 24 nt, Human
ugcugggauuacaggcgugagcca

SEQ ID NO: 1138796 - RNA, 24 nt, Human
uggccaggcuggucuugaacuccu

SEQ ID NO: 1138797 - RNA, 18 nt, Human
ugggauuacaggcgugag

SEQ ID NO: 1138798 - RNA, 22 nt, Human
ugggauuacaggcgugagccac

SEQ ID NO: 1138799 - RNA, 23 nt, Human
ugggauuacaggcgugagccacc

SEQ ID NO: 1138800 - RNA, 24 nt, Human
ugggauuacaggcgugagccacca

SEQ ID NO: 1138801 - RNA, 25 nt, Human
ugggauuacaggcgugagccaccau

SEQ ID NO: 1138802 - RNA, 23 nt, Human
uggguuccaccauguuggccagg

SEQ ID NO: 1138803 - RNA, 24 nt, Human
uggugaggagauaggacuguggga

SEQ ID NO: 1138804 - RNA, 19 nt, Human
uguuggggaggaagaugag

SEQ ID NO: 1138805 - RNA, 24 nt, Human
uuaagguaaaagcccacuggucac

SEQ ID NO: 1138806 - RNA, 24 nt, Human
uuaguagagacuggguuccaccau

SEQ ID NO: 1138807 - RNA, 21 nt, Human
uuccaccauguuggccaggcu

SEQ ID NO: 1138808 - RNA, 21 nt, Human
uucucccuugcuaagccucaa

SEQ ID NO: 1138809 - RNA, 19 nt, Human
uucuucccucaucuacuuc

SEQ ID NO: 1138810 - RNA, 19 nt, Human
uugccugguccuccagcug

SEQ ID NO: 1138811 - RNA, 22 nt, Human
uugccugguccuccagcuguau

SEQ ID NO: 1138812 - RNA, 21 nt, Human
uuuccaaaccaguccuucaag

SEQ ID NO: 1138813 - RNA, 19 nt, Human
uuuuuaguagagacugggu

SEQ ID NO: 1138814 - RNA, 18 nt, Human
acaaugcauccaugcccc

SEQ ID NO: 1138815 - RNA, 22 nt, Human
acaaugcauccaugccccaugc

SEQ ID NO: 1138816 - RNA, 20 nt, Human
acaccugauggaagguugga

SEQ ID NO: 1138817 - RNA, 22 nt, Human
acauccgggacccucugaccac

SEQ ID NO: 1138818 - RNA, 23 nt, Human
agaguggagggggggacauccgg

SEQ ID NO: 1138819 - RNA, 23 nt, Human
aggaagcuccgcaggcacagccc

SEQ ID NO: 1138820 - RNA, 19 nt, Human
aggcacagccccugcccag

SEQ ID NO: 1138821 - RNA, 19 nt, Human
caccugauggaagguugga

SEQ ID NO: 1138822 - RNA, 19 nt, Human
cauccaugccccaugcccg

SEQ ID NO: 1138823 - RNA, 18 nt, Human
ccacaucucgggccacac

SEQ ID NO: 1138824 - RNA, 22 nt, Human
ccccagagucacugcagaccaa

SEQ ID NO: 1138825 - RNA, 19 nt, Human
cccuggcggcucggcuggg

SEQ ID NO: 1138826 - RNA, 20 nt, Human
ccgggacccucugaccacac

SEQ ID NO: 1138827 - RNA, 18 nt, Human
cuggaaggaagcuccgca

SEQ ID NO: 1138828 - RNA, 21 nt, Human
gcccagugucacaaacacugc

SEQ ID NO: 1138829 - RNA, 18 nt, Human
gccccgugcagggugcug

SEQ ID NO: 1138830 - RNA, 18 nt, Human
uaaccaggaaccccagag

SEQ ID NO: 1138831 - RNA, 23 nt, Human
uaaccaggaaccccagagucacu

SEQ ID NO: 1138832 - RNA, 19 nt, Human
uccaugccccaugcccagg

SEQ ID NO: 1138833 - RNA, 21 nt, Human
uccaugccccaugcccagggc

SEQ ID NO: 1138834 - RNA, 18 nt, Human
uccgcaggcacagccccu

SEQ ID NO: 1138835 - RNA, 23 nt, Human
ugcauccaugccccaugcccagg

SEQ ID NO: 1138836 - RNA, 18 nt, Human
ugcccagggccacccaca

SEQ ID NO: 1138837 - RNA, 21 nt, Human
uggaaggaagcuccgcaggca

SEQ ID NO: 1138838 - RNA, 21 nt, Human
uguuccuaagcagaugcacug

SEQ ID NO: 1138839 - RNA, 18 nt, Human
aaaagauuucuggcccuu

SEQ ID NO: 1138840 - RNA, 18 nt, Human
aaauguauacccccaaac

SEQ ID NO: 1138841 - RNA, 22 nt, Human
aacucaauccuccuaggucacc

SEQ ID NO: 1138842 - RNA, 26 nt, Human
aaucuccuucacucggucaaauauuu

SEQ ID NO: 1138843 - RNA, 23 nt, Human
acuagcaucuggaagaaagaaaa

SEQ ID NO: 1138844 - RNA, 21 nt, Human
agaaccuaaaacuugcaaaag

SEQ ID NO: 1138845 - RNA, 24 nt, Human
agagagacagaguguuucuacaga

SEQ ID NO: 1138846 - RNA, 18 nt, Human
aucuccuucacucgguca

SEQ ID NO: 1138847 - RNA, 23 nt, Human
aucuggaagaaagaaaagauuuc

SEQ ID NO: 1138848 - RNA, 22 nt, Human
ccccauguccuucuuguuucca

SEQ ID NO: 1138849 - RNA, 23 nt, Human
cccuugguugcagaaccuaaaac

SEQ ID NO: 1138850 - RNA, 21 nt, Human
cuaacguaagucuuggggaag

SEQ ID NO: 1138851 - RNA, 21 nt, Human
cuccuaggucaccucagaggc

SEQ ID NO: 1138852 - RNA, 23 nt, Human
cuccuucacucggucaaauauuu

SEQ ID NO: 1138853 - RNA, 21 nt, Human
cugccuccuuauccaaaagcu

SEQ ID NO: 1138854 - RNA, 18 nt, Human
cuuccugccuccuuaucc

SEQ ID NO: 1138855 - RNA, 23 nt, Human
uaaaacuugcaaaagaaugugug

SEQ ID NO: 1138856 - RNA, 24 nt, Human
uaaaccacccaaaugaaaguauua

SEQ ID NO: 1138857 - RNA, 27 nt, Human
uacccccaaacucaauccuccuagguc

SEQ ID NO: 1138858 - RNA, 23 nt, Human
uaucaaaaauagauauugugaug

SEQ ID NO: 1138859 - RNA, 19 nt, Human
uauccaaaagcucuugaau

SEQ ID NO: 1138860 - RNA, 18 nt, Human
ucaaaaauagauauugug

SEQ ID NO: 1138861 - RNA, 22 nt, Human
uccuaggucaccucagaggcuu

SEQ ID NO: 1138862 - RNA, 19 nt, Human
uccuccuaggucaccucag

SEQ ID NO: 1138863 - RNA, 18 nt, Human
uccugccuccuuauccaa

SEQ ID NO: 1138864 - RNA, 21 nt, Human
uccuucacucggucaaauauu

SEQ ID NO: 1138865 - RNA, 19 nt, Human
ucuuccugccuccuuaucc

SEQ ID NO: 1138866 - RNA, 22 nt, Human
ugaaagauaaagagcuucuucc

SEQ ID NO: 1138867 - RNA, 21 nt, Human
ugaaaguauuaguuugaaaga

SEQ ID NO: 1138868 - RNA, 22 nt, Human
ugaaauguauacccccaaacuc

SEQ ID NO: 1138869 - RNA, 22 nt, Human
ugaaauuaucaaaggugacauc

SEQ ID NO: 1138870 - RNA, 24 nt, Human
ugaauuuauacaaugcuaacguaa

SEQ ID NO: 1138871 - RNA, 22 nt, Human
ugugugaaauguauacccccaa

SEQ ID NO: 1138872 - RNA, 24 nt, Human
uuugccccauguccuucuuguuuc

SEQ ID NO: 1138873 - RNA, 21 nt, Human
aaacagaagcagggacauuga

SEQ ID NO: 1138874 - RNA, 19 nt, Human
aaagaagccuaugacuuga

SEQ ID NO: 1138875 - RNA, 20 nt, Human
aagcagggacauugaggccc

SEQ ID NO: 1138876 - RNA, 21 nt, Human
aagcagggacauugaggccca

SEQ ID NO: 1138877 - RNA, 27 nt, Human
acuucaaggcggcgguauucagagaag

SEQ ID NO: 1138878 - RNA, 20 nt, Human
caaaggccggcgcacggccu

SEQ ID NO: 1138879 - RNA, 26 nt, Human
cagaaggcuuccucucaaauaagucu

SEQ ID NO: 1138880 - RNA, 19 nt, Human
cccgagcgggcugcgaccg

SEQ ID NO: 1138881 - RNA, 21 nt, Human
gaagcagggacauugaggccc

SEQ ID NO: 1138882 - RNA, 24 nt, Human
gacguggccgacaggacgggcgcg

SEQ ID NO: 1138883 - RNA, 19 nt, Human
gcagcgcgcccgccacccc

SEQ ID NO: 1138884 - RNA, 21 nt, Human
ggaauaacaaacagaagcagg

SEQ ID NO: 1138885 - RNA, 30 nt, Human
gggaauaacaaacagaagcagggaccggua

SEQ ID NO: 1138886 - RNA, 22 nt, Human
uaaaacuucaaggcggcgguau

SEQ ID NO: 1138887 - RNA, 20 nt, Human
uaacagugcuuaacaguggc

SEQ ID NO: 1138888 - RNA, 22 nt, Human
uaagugaaugccugaaaguauu

SEQ ID NO: 1138889 - RNA, 21 nt, Human
uaggagaaaccuuuccuagga

SEQ ID NO: 1138890 - RNA, 19 nt, Human
uauucagagaagucaggca

SEQ ID NO: 1138891 - RNA, 21 nt, Human
ucuccugaggugacauaaaga

SEQ ID NO: 1138892 - RNA, 24 nt, Human
ugacauaaagacugaaagaagccu

SEQ ID NO: 1138893 - RNA, 18 nt, Human
uggcagcauaugcgacac

SEQ ID NO: 1138894 - RNA, 20 nt, Human
uugaagacuucguacuaucu

SEQ ID NO: 1138895 - RNA, 24 nt, Human
uugcaaauacaucaucaauucuua

SEQ ID NO: 1138896 - RNA, 25 nt, Human
uuugcaaauacaucaucaauucuua

SEQ ID NO: 1138897 - RNA, 22 nt, Human
aaagacagcagcugcagccuuc

SEQ ID NO: 1138898 - RNA, 18 nt, Human
aagcugguucuucugcag

SEQ ID NO: 1138899 - RNA, 20 nt, Human
acccuucuccuuccccaccu

SEQ ID NO: 1138900 - RNA, 19 nt, Human
acucaccccuccaugccgc

SEQ ID NO: 1138901 - RNA, 19 nt, Human
agacagggguccaagaagc

SEQ ID NO: 1138902 - RNA, 24 nt, Human
agagacgacccuucuccuucccca

SEQ ID NO: 1138903 - RNA, 24 nt, Human
aggcaggaccagccugcuccgugg

SEQ ID NO: 1138904 - RNA, 18 nt, Human
aggccugaaaaggcccca

SEQ ID NO: 1138905 - RNA, 21 nt, Human
agggcaggcagggcccgaagc

SEQ ID NO: 1138906 - RNA, 21 nt, Human
aucugcuccacacugucuucc

SEQ ID NO: 1138907 - RNA, 21 nt, Human
aucugcuccaggccacugcug

SEQ ID NO: 1138908 - RNA, 19 nt, Human
caccuuaucugcuccacac

SEQ ID NO: 1138909 - RNA, 23 nt, Human
cacuaagacgcgaccccucagac

SEQ ID NO: 1138910 - RNA, 24 nt, Human
cagguggcccccacccgcagguuc

SEQ ID NO: 1138911 - RNA, 18 nt, Human
ccaccugugcagcggaag

SEQ ID NO: 1138912 - RNA, 18 nt, Human
ccaggaagaucucgucgg

SEQ ID NO: 1138913 - RNA, 19 nt, Human
cccaaagacucaccccucc

SEQ ID NO: 1138914 - RNA, 25 nt, Human
cccaaagacucaccccuccaugccg

SEQ ID NO: 1138915 - RNA, 19 nt, Human
cccacaggcuggaaggcuc

SEQ ID NO: 1138916 - RNA, 18 nt, Human
ccccacccgcagguucag

SEQ ID NO: 1138917 - RNA, 19 nt, Human
ccccacccgcagguucagc

SEQ ID NO: 1138918 - RNA, 20 nt, Human
cccgaagcugguucuucugc

SEQ ID NO: 1138919 - RNA, 24 nt, Human
cgacccuucuccuuccccaccuua

SEQ ID NO: 1138920 - RNA, 24 nt, Human
cuccgugcucagagacgacccuuc

SEQ ID NO: 1138921 - RNA, 18 nt, Human
cugcccacaggcuggaag

SEQ ID NO: 1138922 - RNA, 24 nt, Human
cugcuccacacugucuuccuuuga

SEQ ID NO: 1138923 - RNA, 21 nt, Human
cugcuccaggccacugcuguu

SEQ ID NO: 1138924 - RNA, 18 nt, Human
cuggaggacgacccucag

SEQ ID NO: 1138925 - RNA, 21 nt, Human
cuuucuggcagcccagcccgg

SEQ ID NO: 1138926 - RNA, 23 nt, Human
gaaaagaaucccgcccacuaaga

SEQ ID NO: 1138927 - RNA, 18 nt, Human
gacugggcagggcaggca

SEQ ID NO: 1138928 - RNA, 20 nt, Human
gagacgacccuucuccuucc

SEQ ID NO: 1138929 - RNA, 20 nt, Human
gaggcugguguccgcuuggc

SEQ ID NO: 1138930 - RNA, 18 nt, Human
gauggggguucuccuggc

SEQ ID NO: 1138931 - RNA, 19 nt, Human
gcacugggccuggaggcug

SEQ ID NO: 1138932 - RNA, 28 nt, Human
gcccgggccccaggccugaaaaggcccc

SEQ ID NO: 1138933 - RNA, 22 nt, Human
gcggaagcagcuggcagucaca

SEQ ID NO: 1138934 - RNA, 22 nt, Human
gcuccaggccacugcuguucag

SEQ ID NO: 1138935 - RNA, 18 nt, Human
ggaagaggugcugcagcg

SEQ ID NO: 1138936 - RNA, 22 nt, Human
ggcacugggccuggaggcuggu

SEQ ID NO: 1138937 - RNA, 24 nt, Human
ggcagggcaggcagggcccgaagc

SEQ ID NO: 1138938 - RNA, 20 nt, Human
ggccccaggccugaaaaggc

SEQ ID NO: 1138939 - RNA, 20 nt, Human
ggcucuggagcccgggcccc

SEQ ID NO: 1138940 - RNA, 25 nt, Human
gggcaggcagggcccgaagcugguu

SEQ ID NO: 1138941 - RNA, 19 nt, Human
gggccuggaggcugguguc

SEQ ID NO: 1138942 - RNA, 23 nt, Human
gugcaggcucuggagcccgggcc

SEQ ID NO: 1138943 - RNA, 20 nt, Human
ucaccccuccaugccgccug

SEQ ID NO: 1138944 - RNA, 18 nt, Human
ucagcccaguaagccacc

SEQ ID NO: 1138945 - RNA, 20 nt, Human
ucuccuggcacugggccugg

SEQ ID NO: 1138946 - RNA, 21 nt, Human
ucugcuccacacugucuuccu

SEQ ID NO: 1138947 - RNA, 20 nt, Human
ucugcuccaggccacugcug

SEQ ID NO: 1138948 - RNA, 21 nt, Human
ugcuccacacugucuuccuuu

SEQ ID NO: 1138949 - RNA, 23 nt, Human
ugcuccgugcucagagacgaccc

SEQ ID NO: 1138950 - RNA, 19 nt, Human
uggcacugggccuggaggc

SEQ ID NO: 1138951 - RNA, 19 nt, Human
uggcagcccagcccgggca

SEQ ID NO: 1138952 - RNA, 20 nt, Human
uggcagcccagcccgggcag

SEQ ID NO: 1138953 - RNA, 19 nt, Human
uggcugagacugggcaggg

SEQ ID NO: 1138954 - RNA, 20 nt, Human
ugggagggguggcgcaggug

SEQ ID NO: 1138955 - RNA, 21 nt, Human
ugggccuggaggcuggugucc

SEQ ID NO: 1138956 - RNA, 18 nt, Human
ugggucaaggcaggacca

SEQ ID NO: 1138957 - RNA, 23 nt, Human
ugguguccgcuuggccuuucugg

SEQ ID NO: 1138958 - RNA, 23 nt, Human
uucaaagggaaaagaaucccgcc

SEQ ID NO: 1138959 - RNA, 19 nt, Human
uuccuggcgagaguaagag

SEQ ID NO: 1138960 - RNA, 24 nt, Human
aaagugcugggauuacaggcauga

SEQ ID NO: 1138961 - RNA, 24 nt, Human
aaagugcugggauuauaggcauga

SEQ ID NO: 1138962 - RNA, 19 nt, Human
aagugcugggauuacaggc

SEQ ID NO: 1138963 - RNA, 21 nt, Human
aagugcugggauuacaggcau

SEQ ID NO: 1138964 - RNA, 26 nt, Human
aagugcugggauuacaggcaugagcc

SEQ ID NO: 1138965 - RNA, 19 nt, Human
aagugcugggauuauaggc

SEQ ID NO: 1138966 - RNA, 21 nt, Human
aagugcugggauuauaggcau

SEQ ID NO: 1138967 - RNA, 20 nt, Human
aaugcaguggcgcgaucucg

SEQ ID NO: 1138968 - RNA, 24 nt, Human
aaugcaguggcgcgaucucggcuc

SEQ ID NO: 1138969 - RNA, 23 nt, Human
acaggugcccaccaccacacccg

SEQ ID NO: 1138970 - RNA, 24 nt, Human
accauguuggccaggcuggucucg

SEQ ID NO: 1138971 - RNA, 24 nt, Human
accuugugauccgcccaacucggc

SEQ ID NO: 1138972 - RNA, 18 nt, Human
acgggguaucaccauguu

SEQ ID NO: 1138973 - RNA, 20 nt, Human
acgggguaucaccauguugg

SEQ ID NO: 1138974 - RNA, 24 nt, Human
acgggguaucaccauguuggccag

SEQ ID NO: 1138975 - RNA, 18 nt, Human
acgggguuucacuguguu

SEQ ID NO: 1138976 - RNA, 19 nt, Human
acgggguuucacuguguua

SEQ ID NO: 1138977 - RNA, 20 nt, Human
acgggguuucacuguguuag

SEQ ID NO: 1138978 - RNA, 24 nt, Human
acgggguuucacuguguuagccag

SEQ ID NO: 1138979 - RNA, 22 nt, Human
acuucacucucugagacuugaa

SEQ ID NO: 1138980 - RNA, 24 nt, Human
agcgauucuccugccucagccucc

SEQ ID NO: 1138981 - RNA, 19 nt, Human
aggcaugagccaccacgcc

SEQ ID NO: 1138982 - RNA, 21 nt, Human
agggagaagacacagggguca

SEQ ID NO: 1138983 - RNA, 18 nt, Human
aguaccugggauuacagg

SEQ ID NO: 1138984 - RNA, 18 nt, Human
aguagcugggacuacagg

SEQ ID NO: 1138985 - RNA, 21 nt, Human
aucuuugauccauccacucug

SEQ ID NO: 1138986 - RNA, 21 nt, Human
augagccaccacgccuggccc

SEQ ID NO: 1138987 - RNA, 19 nt, Human
augcuacuaacacugggga

SEQ ID NO: 1138988 - RNA, 23 nt, Human
auguucuuuuauuauuauuuucu

SEQ ID NO: 1138989 - RNA, 24 nt, Human
caaagugcugggauuacaggcaug

SEQ ID NO: 1138990 - RNA, 24 nt, Human
caaagugcugggauuauaggcaug

SEQ ID NO: 1138991 - RNA, 23 nt, Human
caaccuccaccucccagguucaa

SEQ ID NO: 1138992 - RNA, 20 nt, Human
caagcgauucuccugccuca

SEQ ID NO: 1138993 - RNA, 22 nt, Human
caagcgauucuccugccucagc

SEQ ID NO: 1138994 - RNA, 21 nt, Human
caccauguuggccaggcuggu

SEQ ID NO: 1138995 - RNA, 24 nt, Human
caccauguuggccaggcuggucuc

SEQ ID NO: 1138996 - RNA, 27 nt, Human
caccauguuggccaggcuggucucgaa

SEQ ID NO: 1138997 - RNA, 21 nt, Human
caccgcaaccuccaccuccca

SEQ ID NO: 1138998 - RNA, 21 nt, Human
caccgcaaccuccaccuccca

SEQ ID NO: 1138999 - RNA, 24 nt, Human
caccucggccucccaaagugcugg

SEQ ID NO: 1139000 - RNA, 19 nt, Human
cacgccuggccccucauca

SEQ ID NO: 1139001 - RNA, 24 nt, Human
cacuacacccagcuaauuuuugua

SEQ ID NO: 1139002 - RNA, 23 nt, Human
cacugcaaacucugccucccggg

SEQ ID NO: 1139003 - RNA, 18 nt, Human
cacuguguuagccaggau

SEQ ID NO: 1139004 - RNA, 19 nt, Human
cacuguguuagccaggaug

SEQ ID NO: 1139005 - RNA, 24 nt, Human
cacuguguuagccaggauggucuc

SEQ ID NO: 1139006 - RNA, 20 nt, Human
cagccuccugaguaccuggg

SEQ ID NO: 1139007 - RNA, 21 nt, Human
caggugcccaccaccacaccc

SEQ ID NO: 1139008 - RNA, 24 nt, Human
caggugcccaccaccacacccggc

SEQ ID NO: 1139009 - RNA, 20 nt, Human
caucuuugauccauccacuc

SEQ ID NO: 1139010 - RNA, 26 nt, Human
caucuuugauccauccacucugggag

SEQ ID NO: 1139011 - RNA, 22 nt, Human
caugccauucuucugccucagc

SEQ ID NO: 1139012 - RNA, 24 nt, Human
cauguuggccaggcuggucucgaa

SEQ ID NO: 1139013 - RNA, 23 nt, Human
ccaaagugcugggauuacaggca

SEQ ID NO: 1139014 - RNA, 24 nt, Human
ccaaagugcugggauuacaggcau

SEQ ID NO: 1139015 - RNA, 24 nt, Human
ccaaagugcugggauuauaggcau

SEQ ID NO: 1139016 - RNA, 18 nt, Human
ccaacucuagaacccaca

SEQ ID NO: 1139017 - RNA, 24 nt, Human
ccaccucccagguucaagcgauuc

SEQ ID NO: 1139018 - RNA, 24 nt, Human
cccaaagugcugggauuacaggca

SEQ ID NO: 1139019 - RNA, 21 nt, Human
cccaggcuagagugcaauggc

SEQ ID NO: 1139020 - RNA, 23 nt, Human
cccagguucaagcgauucuccug

SEQ ID NO: 1139021 - RNA, 23 nt, Human
ccgcaaccuccaccucccagguu

SEQ ID NO: 1139022 - RNA, 24 nt, Human
ccgcaaccuccaccucccagguuc

SEQ ID NO: 1139023 - RNA, 24 nt, Human
ccuccaggaagccuccuuuggccc

SEQ ID NO: 1139024 - RNA, 24 nt, Human
ccucccagguucaagcgauucucc

SEQ ID NO: 1139025 - RNA, 19 nt, Human
ccugaguaccugggauuac

SEQ ID NO: 1139026 - RNA, 22 nt, Human
ccugaguaccugggauuacagg

SEQ ID NO: 1139027 - RNA, 24 nt, Human
cgcucugucgcccaggcuggaaug

SEQ ID NO: 1139028 - RNA, 23 nt, Human
cuaauuuuuguauuuuuaauaga

SEQ ID NO: 1139029 - RNA, 23 nt, Human
cuaauuuuuuguauuuuuaguag

SEQ ID NO: 1139030 - RNA, 24 nt, Human
cucaccgcaaccuccaccucccag

SEQ ID NO: 1139031 - RNA, 23 nt, Human
cucacugcaaacucugccucccg

SEQ ID NO: 1139032 - RNA, 24 nt, Human
cucacugcaaacucugccucccgg

SEQ ID NO: 1139033 - RNA, 24 nt, Human
cucagccucgcgaguagcugggac

SEQ ID NO: 1139034 - RNA, 21 nt, Human
cucccggguucaugccauucu

SEQ ID NO: 1139035 - RNA, 19 nt, Human
cuccucugggcagggagaa

SEQ ID NO: 1139036 - RNA, 22 nt, Human
cuccugaccuugugauccgccc

SEQ ID NO: 1139037 - RNA, 20 nt, Human
cuccugaccuugugaucugc

SEQ ID NO: 1139038 - RNA, 21 nt, Human
cucgcucugucgcccaggcug

SEQ ID NO: 1139039 - RNA, 21 nt, Human
cugaguaccugggauuacagg

SEQ ID NO: 1139040 - RNA, 23 nt, Human
cugaguaccugggauuacaggug

SEQ ID NO: 1139041 - RNA, 24 nt, Human
cugaguaccugggauuacaggugu

SEQ ID NO: 1139042 - RNA, 23 nt, Human
cugccucagccuccugaguaccu

SEQ ID NO: 1139043 - RNA, 23 nt, Human
cugccucagccucgcgaguagcu

SEQ ID NO: 1139044 - RNA, 18 nt, Human
cuggagaccagggaugcu

SEQ ID NO: 1139045 - RNA, 18 nt, Human
gaaguccccuccgugccc

SEQ ID NO: 1139046 - RNA, 22 nt, Human
gaccuugugauccgcccaacuc

SEQ ID NO: 1139047 - RNA, 24 nt, Human
gaccuugugauccgcccaacucgg

SEQ ID NO: 1139048 - RNA, 22 nt, Human
gaccuugugaucugcacaccuc

SEQ ID NO: 1139049 - RNA, 24 nt, Human
gaccuugugaucugcacaccucgg

SEQ ID NO: 1139050 - RNA, 19 nt, Human
gaguaccugggauuacagg

SEQ ID NO: 1139051 - RNA, 18 nt, Human
gauuacaggcaugagcca

SEQ ID NO: 1139052 - RNA, 22 nt, Human
gauuacaggcaugagccaccgc

SEQ ID NO: 1139053 - RNA, 22 nt, Human
gauuacaggcaugagccaccgc

SEQ ID NO: 1139054 - RNA, 18 nt, Human
gauuacagguguccgcca

SEQ ID NO: 1139055 - RNA, 21 nt, Human
gauuauaggcaugagccacca

SEQ ID NO: 1139056 - RNA, 22 nt, Human
gauuauaggcaugagccaccac

SEQ ID NO: 1139057 - RNA, 23 nt, Human
gcacgaggugaucaucuuugauc

SEQ ID NO: 1139058 - RNA, 20 nt, Human
gcccaggcuggaaugcagug

SEQ ID NO: 1139059 - RNA, 21 nt, Human
gcccugaggcugagugaaguc

SEQ ID NO: 1139060 - RNA, 25 nt, Human
gccucccggguucaugccauucuuc

SEQ ID NO: 1139061 - RNA, 24 nt, Human
gcgauucuccugccucagccuccu

SEQ ID NO: 1139062 - RNA, 19 nt, Human
gcuagagugcaauggcgug

SEQ ID NO: 1139063 - RNA, 22 nt, Human
gcucucagcucaccgcaaccuc

SEQ ID NO: 1139064 - RNA, 21 nt, Human
gcucuggcucugaggcgugag

SEQ ID NO: 1139065 - RNA, 25 nt, Human
gcucugucgcccaggcuggaaugca

SEQ ID NO: 1139066 - RNA, 21 nt, Human
gcucuuguugcccaggcuaga

SEQ ID NO: 1139067 - RNA, 24 nt, Human
gcucuuguugcccaggcuagagug

SEQ ID NO: 1139068 - RNA, 24 nt, Human
ggauggucucaaucuccugaccuu

SEQ ID NO: 1139069 - RNA, 22 nt, Human
ggauuacaggcaugagccaccg

SEQ ID NO: 1139070 - RNA, 19 nt, Human
ggauuauaggcaugagcca

SEQ ID NO: 1139071 - RNA, 19 nt, Human
ggcagggagaagacacagg

SEQ ID NO: 1139072 - RNA, 23 nt, Human
ggcuggucucgaacuccugaccu

SEQ ID NO: 1139073 - RNA, 21 nt, Human
gggcaguggugcccucugugu

SEQ ID NO: 1139074 - RNA, 22 nt, Human
ggggaaugcagugccuuacccc

SEQ ID NO: 1139075 - RNA, 23 nt, Human
gggguaucaccauguuggccagg

SEQ ID NO: 1139076 - RNA, 23 nt, Human
gggguuucacuguguuagccagg

SEQ ID NO: 1139077 - RNA, 22 nt, Human
ggguaucaccauguuggccagg

SEQ ID NO: 1139078 - RNA, 22 nt, Human
ggguuucacuguguuagccagg

SEQ ID NO: 1139079 - RNA, 20 nt, Human
ggucucgaacuccugaccuu

SEQ ID NO: 1139080 - RNA, 23 nt, Human
guagagacgggguuucacugugu

SEQ ID NO: 1139081 - RNA, 24 nt, Human
uaauagagacgggguaucaccaug

SEQ ID NO: 1139082 - RNA, 24 nt, Human
uaauuuuuguauuuuuaauagaga

SEQ ID NO: 1139083 - RNA, 24 nt, Human
uaauuuuuuguauuuuuaguagag

SEQ ID NO: 1139084 - RNA, 25 nt, Human
uaauuuuuuguauuuuuaguagaga

SEQ ID NO: 1139085 - RNA, 23 nt, Human
uacaggcaugagccaccgcgccc

SEQ ID NO: 1139086 - RNA, 23 nt, Human
uacaggugcccaccaccacaccc

SEQ ID NO: 1139087 - RNA, 22 nt, Human
uagagacgggguaucaccaugu

SEQ ID NO: 1139088 - RNA, 23 nt, Human
uagagugcaauggcgugcucuca

SEQ ID NO: 1139089 - RNA, 20 nt, Human
uaguagagacgggguuucac

SEQ ID NO: 1139090 - RNA, 24 nt, Human
uaguagagacgggguuucacugug

SEQ ID NO: 1139091 - RNA, 19 nt, Human
ucaaucuccugaccuugug

SEQ ID NO: 1139092 - RNA, 20 nt, Human
ucaaucuccugaccuuguga

SEQ ID NO: 1139093 - RNA, 22 nt, Human
ucaccauguuggccaggcuggu

SEQ ID NO: 1139094 - RNA, 24 nt, Human
ucaccgcaaccuccaccucccagg

SEQ ID NO: 1139095 - RNA, 26 nt, Human
ucaccgcaaccuccaccucccagguu

SEQ ID NO: 1139096 - RNA, 18 nt, Human
ucacugcaaacucugccu

SEQ ID NO: 1139097 - RNA, 24 nt, Human
ucacugcaaacucugccucccggg

SEQ ID NO: 1139098 - RNA, 24 nt, Human
ucacuguguuagccaggauggucu

SEQ ID NO: 1139099 - RNA, 26 nt, Human
ucagcucaccgcaaccuccaccuccc

SEQ ID NO: 1139100 - RNA, 18 nt, Human
ucaggaccggacugaguc

SEQ ID NO: 1139101 - RNA, 18 nt, Human
ucaugccauucuucugcc

SEQ ID NO: 1139102 - RNA, 24 nt, Human
ucccaaagugcugggauuacaggc

SEQ ID NO: 1139103 - RNA, 24 nt, Human
ucccaaagugcugggauuauaggc

SEQ ID NO: 1139104 - RNA, 21 nt, Human
ucccagguucaagcgauucuc

SEQ ID NO: 1139105 - RNA, 24 nt, Human
ucccagguucaagcgauucuccug

SEQ ID NO: 1139106 - RNA, 19 nt, Human
uccccaacucuagaaccca

SEQ ID NO: 1139107 - RNA, 20 nt, Human
ucccggguucaugccauucu

SEQ ID NO: 1139108 - RNA, 24 nt, Human
ucccggguucaugccauucuucug

SEQ ID NO: 1139109 - RNA, 24 nt, Human
uccugaguaccugggauuacaggu

SEQ ID NO: 1139110 - RNA, 24 nt, Human
ucgcccaggcuggaaugcaguggc

SEQ ID NO: 1139111 - RNA, 24 nt, Human
ucgcgaguagcugggacuacaggu

SEQ ID NO: 1139112 - RNA, 18 nt, Human
ucggccucccaaagugcu

SEQ ID NO: 1139113 - RNA, 18 nt, Human
ucggccucccaaagugcu

SEQ ID NO: 1139114 - RNA, 23 nt, Human
ucuccucugggcagggagaagac

SEQ ID NO: 1139115 - RNA, 24 nt, Human
ucuccugccucagccuccugagua

SEQ ID NO: 1139116 - RNA, 19 nt, Human
ucucgaacuccugaccuug

SEQ ID NO: 1139117 - RNA, 19 nt, Human
ucucgcucugucgcccagg

SEQ ID NO: 1139118 - RNA, 22 nt, Human
ucucgcucugucgcccaggcug

SEQ ID NO: 1139119 - RNA, 23 nt, Human
ucucgcucugucgcccaggcugg

SEQ ID NO: 1139120 - RNA, 24 nt, Human
ucucgcucugucgcccaggcugga

SEQ ID NO: 1139121 - RNA, 26 nt, Human
ucucgcucugucgcccaggcuggaau

SEQ ID NO: 1139122 - RNA, 24 nt, Human
ucugucgcccaggcuggaaugcag

SEQ ID NO: 1139123 - RNA, 20 nt, Human
ucuuccaucagacaagggcu

SEQ ID NO: 1139124 - RNA, 18 nt, Human
ucuuguugcccaggcuag

SEQ ID NO: 1139125 - RNA, 18 nt, Human
ucuuuuuuuugagacgga

SEQ ID NO: 1139126 - RNA, 23 nt, Human
ugaccuugugaucugcacaccuc

SEQ ID NO: 1139127 - RNA, 22 nt, Human
ugagacggagucucgcucuguc

SEQ ID NO: 1139128 - RNA, 19 nt, Human
ugcagagggcucauucccc

SEQ ID NO: 1139129 - RNA, 22 nt, Human
ugcaguggcgcgaucucggcuc

SEQ ID NO: 1139130 - RNA, 21 nt, Human
ugcccaccaccacacccggcu

SEQ ID NO: 1139131 - RNA, 21 nt, Human
ugcccaggcuagagugcaaug

SEQ ID NO: 1139132 - RNA, 24 nt, Human
ugccucagccuccugaguaccugg

SEQ ID NO: 1139133 - RNA, 24 nt, Human
ugccucagccucgcgaguagcugg

SEQ ID NO: 1139134 - RNA, 19 nt, Human
ugccucccggguucaugcc

SEQ ID NO: 1139135 - RNA, 18 nt, Human
ugccuuaccccaugcaga

SEQ ID NO: 1139136 - RNA, 24 nt, Human
uggaaugcaguggcgcgaucucgg

SEQ ID NO: 1139137 - RNA, 24 nt, Human
uggccaggcuggucucgaacuccu

SEQ ID NO: 1139138 - RNA, 24 nt, Human
uggcgugcucucagcucaccgcaa

SEQ ID NO: 1139139 - RNA, 21 nt, Human
ugggacuacaggugcccacca

SEQ ID NO: 1139140 - RNA, 24 nt, Human
ugggacuacaggugcccaccacca

SEQ ID NO: 1139141 - RNA, 18 nt, Human
ugggauuacaggcaugag

SEQ ID NO: 1139142 - RNA, 19 nt, Human
ugggauuacaggcaugagc

SEQ ID NO: 1139143 - RNA, 21 nt, Human
ugggauuacaggcaugagcca

SEQ ID NO: 1139144 - RNA, 22 nt, Human
ugggauuacaggcaugagccac

SEQ ID NO: 1139145 - RNA, 23 nt, Human
ugggauuacaggcaugagccacc

SEQ ID NO: 1139146 - RNA, 24 nt, Human
ugggauuacaggcaugagccaccg

SEQ ID NO: 1139147 - RNA, 24 nt, Human
ugggauuacaggcaugagccaccg

SEQ ID NO: 1139148 - RNA, 21 nt, Human
ugggauuacagguguccgcca

SEQ ID NO: 1139149 - RNA, 22 nt, Human
ugggauuacagguguccgccac

SEQ ID NO: 1139150 - RNA, 22 nt, Human
ugggauuacagguguccgccac

SEQ ID NO: 1139151 - RNA, 24 nt, Human
ugggauuacagguguccgccacua

SEQ ID NO: 1139152 - RNA, 18 nt, Human
ugggauuauaggcaugag

SEQ ID NO: 1139153 - RNA, 19 nt, Human
ugggauuauaggcaugagc

SEQ ID NO: 1139154 - RNA, 22 nt, Human
ugggauuauaggcaugagccac

SEQ ID NO: 1139155 - RNA, 23 nt, Human
ugggauuauaggcaugagccacc

SEQ ID NO: 1139156 - RNA, 24 nt, Human
ugggauuauaggcaugagccacca

SEQ ID NO: 1139157 - RNA, 26 nt, Human
uggucuccucugggcagggagaagac

SEQ ID NO: 1139158 - RNA, 22 nt, Human
uggugaggaagggcacgaggug

SEQ ID NO: 1139159 - RNA, 21 nt, Human
uguauuuuuaguagagacggg

SEQ ID NO: 1139160 - RNA, 20 nt, Human
uguugcccaggcuagagugc

SEQ ID NO: 1139161 - RNA, 22 nt, Human
uguugcccaggcuagagugcaa

SEQ ID NO: 1139162 - RNA, 24 nt, Human
uuaauagagacgggguaucaccau

SEQ ID NO: 1139163 - RNA, 18 nt, Human
uuaguagagacgggguuu

SEQ ID NO: 1139164 - RNA, 21 nt, Human
uuaguagagacgggguuucac

SEQ ID NO: 1139165 - RNA, 21 nt, Human
uuaguagagacgggguuucac

SEQ ID NO: 1139166 - RNA, 24 nt, Human
uuaguagagacgggguuucacugu

SEQ ID NO: 1139167 - RNA, 21 nt, Human
uucaagcgauucuccugccuc

SEQ ID NO: 1139168 - RNA, 23 nt, Human
uucaagcgauucuccugccucag

SEQ ID NO: 1139169 - RNA, 24 nt, Human
uucaagcgauucuccugccucagc

SEQ ID NO: 1139170 - RNA, 21 nt, Human
uucacuguguuagccaggaug

SEQ ID NO: 1139171 - RNA, 19 nt, Human
uucaugccauucuucugcc

SEQ ID NO: 1139172 - RNA, 18 nt, Human
uugcccaggcuagagugc

SEQ ID NO: 1139173 - RNA, 18 nt, Human
uugcucuuguugcccagg

SEQ ID NO: 1139174 - RNA, 21 nt, Human
uuggcccugaggcugagugaa

SEQ ID NO: 1139175 - RNA, 22 nt, Human
uuggcccugaggcugagugaag

SEQ ID NO: 1139176 - RNA, 23 nt, Human
uuguauuuuuaguagagacgggg

SEQ ID NO: 1139177 - RNA, 19 nt, Human
uuucacuguguuagccagg

SEQ ID NO: 1139178 - RNA, 25 nt, Human
uuucuuuuuuuugagacggagucuc

SEQ ID NO: 1139179 - RNA, 23 nt, Human
uuuugcucuuguugcccaggcua

SEQ ID NO: 1139180 - RNA, 24 nt, Human
uuuuuaguagagacgggguuucac

SEQ ID NO: 1139181 - RNA, 20 nt, Human
uuuuuguauuuuuaauagag

SEQ ID NO: 1139182 - RNA, 23 nt, Human
uuuuuguauuuuuaauagagacg

SEQ ID NO: 1139183 - RNA, 21 nt, Human
uuuuuguauuuuuaguagaga

SEQ ID NO: 1139184 - RNA, 24 nt, Human
uuuuuuguauuuuuaguagagacg

SEQ ID NO: 1139185 - RNA, 24 nt, Human
aaacaaaacaaguaugagucacac

SEQ ID NO: 1139186 - RNA, 23 nt, Human
aaacaaacagaggaucauccuga

SEQ ID NO: 1139187 - RNA, 18 nt, Human
aagaugaaaaaguugaga

SEQ ID NO: 1139188 - RNA, 22 nt, Human
aagcucagguuauuagagccag

SEQ ID NO: 1139189 - RNA, 20 nt, Human
aaggaccuuaugaccaccag

SEQ ID NO: 1139190 - RNA, 19 nt, Human
accaccagccacacacaca

SEQ ID NO: 1139191 - RNA, 19 nt, Human
accuuaugaccaccagcca

SEQ ID NO: 1139192 - RNA, 18 nt, Human
caaaacaaguaugaguca

SEQ ID NO: 1139193 - RNA, 21 nt, Human
cacacaacccuauuuguuuuu

SEQ ID NO: 1139194 - RNA, 25 nt, Human
cacagacugcccagcacucuucacu

SEQ ID NO: 1139195 - RNA, 22 nt, Human
cacuauggugcuuagcaccuga

SEQ ID NO: 1139196 - RNA, 21 nt, Human
cagaggaucauccugaggcuc

SEQ ID NO: 1139197 - RNA, 18 nt, Human
caggagcacugcagcagc

SEQ ID NO: 1139198 - RNA, 25 nt, Human
caggagcacugcagcagcugucggg

SEQ ID NO: 1139199 - RNA, 21 nt, Human
cugaggcucuaagggucccag

SEQ ID NO: 1139200 - RNA, 23 nt, Human
cugcagcagcugucggggguggg

SEQ ID NO: 1139201 - RNA, 22 nt, Human
cugcucaggagcacugcagcag

SEQ ID NO: 1139202 - RNA, 18 nt, Human
gggaauggaaggcuggag

SEQ ID NO: 1139203 - RNA, 18 nt, Human
gggucccagcuucauaac

SEQ ID NO: 1139204 - RNA, 22 nt, Human
uaaaagaauuaaacaaaacaag

SEQ ID NO: 1139205 - RNA, 18 nt, Human
ucaggagcacugcagcag

SEQ ID NO: 1139206 - RNA, 20 nt, Human
ugcagcagcugucgggggug

SEQ ID NO: 1139207 - RNA, 23 nt, Human
ugcccagcacucuucacuguccc

SEQ ID NO: 1139208 - RNA, 25 nt, Human
uggaaggguguugcucccucuaauc

SEQ ID NO: 1139209 - RNA, 22 nt, Human
uggagcaggaggguggaagggu

SEQ ID NO: 1139210 - RNA, 21 nt, Human
aaagggcccuacccagacugc

SEQ ID NO: 1139211 - RNA, 20 nt, Human
aacaggccgggcgcccgccu

SEQ ID NO: 1139212 - RNA, 22 nt, Human
aagaggcucagagccuaccccu

SEQ ID NO: 1139213 - RNA, 25 nt, Human
aagaguagcaaggagagguccuggc

SEQ ID NO: 1139214 - RNA, 20 nt, Human
aaguacacccugggugacaa

SEQ ID NO: 1139215 - RNA, 23 nt, Human
acaauaaauccacuuucucugac

SEQ ID NO: 1139216 - RNA, 24 nt, Human
accccagcacucugagcagaauaa

SEQ ID NO: 1139217 - RNA, 20 nt, Human
acuuugggaagaguagcaag

SEQ ID NO: 1139218 - RNA, 18 nt, Human
agacagaguacaggaggg

SEQ ID NO: 1139219 - RNA, 25 nt, Human
agacuuuucccagggagccacacua

SEQ ID NO: 1139220 - RNA, 19 nt, Human
agaggauggaaggaauggu

SEQ ID NO: 1139221 - RNA, 22 nt, Human
agccacacugccuccccaccuc

SEQ ID NO: 1139222 - RNA, 21 nt, Human
agccgauacugcagccuaccu

SEQ ID NO: 1139223 - RNA, 21 nt, Human
agcucagcccuucgaccaccu

SEQ ID NO: 1139224 - RNA, 19 nt, Human
agggggugucucuucccgg

SEQ ID NO: 1139225 - RNA, 26 nt, Human
aguucccaggugauuucucgagcagc

SEQ ID NO: 1139226 - RNA, 25 nt, Human
aucucucuucacuggccgaagaccc

SEQ ID NO: 1139227 - RNA, 21 nt, Human
caaagcaacagacuuuuccca

SEQ ID NO: 1139228 - RNA, 24 nt, Human
cacagcucagcccuucgaccaccu

SEQ ID NO: 1139229 - RNA, 19 nt, Human
caccaucuguuaacagggc

SEQ ID NO: 1139230 - RNA, 23 nt, Human
caccucuucuuuaaccccucacu

SEQ ID NO: 1139231 - RNA, 22 nt, Human
cagccgcuuugccucccgacuu

SEQ ID NO: 1139232 - RNA, 23 nt, Human
caggccgggcgcccgccuugggc

SEQ ID NO: 1139233 - RNA, 19 nt, Human
cauuucauuaacauccccu

SEQ ID NO: 1139234 - RNA, 23 nt, Human
ccagggagaaaggaugggacccc

SEQ ID NO: 1139235 - RNA, 22 nt, Human
cccaaucuucccaccccucuca

SEQ ID NO: 1139236 - RNA, 23 nt, Human
cccaccccucucaggaagagcug

SEQ ID NO: 1139237 - RNA, 20 nt, Human
cccagaaacuccuaugacac

SEQ ID NO: 1139238 - RNA, 18 nt, Human
cccgcagucccuuccaga

SEQ ID NO: 1139239 - RNA, 20 nt, Human
cccucacuuggcagcuccag

SEQ ID NO: 1139240 - RNA, 23 nt, Human
cccucugccucaaagggcccuac

SEQ ID NO: 1139241 - RNA, 24 nt, Human
cccuucgaccaccugguucccagg

SEQ ID NO: 1139242 - RNA, 23 nt, Human
ccgccgaucgcaccgaagcccaa

SEQ ID NO: 1139243 - RNA, 18 nt, Human
ccggccucugcgucuucc

SEQ ID NO: 1139244 - RNA, 19 nt, Human
ccucccgccgccgaucgca

SEQ ID NO: 1139245 - RNA, 20 nt, Human
ccucccgccgccgaucgcac

SEQ ID NO: 1139246 - RNA, 23 nt, Human
ccucucaggaagagcuggguccc

SEQ ID NO: 1139247 - RNA, 21 nt, Human
ccucugcgucuucccccugga

SEQ ID NO: 1139248 - RNA, 19 nt, Human
ccuggcaaguacacccugg

SEQ ID NO: 1139249 - RNA, 22 nt, Human
cgaagacccucugccucaaagg

SEQ ID NO: 1139250 - RNA, 20 nt, Human
cggccucugcgucuuccccc

SEQ ID NO: 1139251 - RNA, 26 nt, Human
cggggcaagguccagcaccaucuguu

SEQ ID NO: 1139252 - RNA, 21 nt, Human
cggguggaucucgaaccugga

SEQ ID NO: 1139253 - RNA, 19 nt, Human
cucaggaagagcugggucc

SEQ ID NO: 1139254 - RNA, 20 nt, Human
cucccgccgccgaucgcacc

SEQ ID NO: 1139255 - RNA, 19 nt, Human
cuccuagaauacccaggac

SEQ ID NO: 1139256 - RNA, 18 nt, Human
cucuucccggccucugcg

SEQ ID NO: 1139257 - RNA, 24 nt, Human
cugagcagaauaaaucucucuuca

SEQ ID NO: 1139258 - RNA, 21 nt, Human
cugcugaagacagaguacagg

SEQ ID NO: 1139259 - RNA, 18 nt, Human
cuggagaaugccuaaaua

SEQ ID NO: 1139260 - RNA, 20 nt, Human
cugguucccagggaaccucc

SEQ ID NO: 1139261 - RNA, 20 nt, Human
cuguuaacagggcagccagg

SEQ ID NO: 1139262 - RNA, 26 nt, Human
cuuccggggcaagguccagcaccauc

SEQ ID NO: 1139263 - RNA, 19 nt, Human
gaacagcagggcucacugg

SEQ ID NO: 1139264 - RNA, 20 nt, Human
gaacccauguccccucccaa

SEQ ID NO: 1139265 - RNA, 23 nt, Human
gacguaaaaaagcuacaagcccc

SEQ ID NO: 1139266 - RNA, 19 nt, Human
gagcagcuucaguuuaccg

SEQ ID NO: 1139267 - RNA, 19 nt, Human
gaggggagccgaggcuagg

SEQ ID NO: 1139268 - RNA, 22 nt, Human
gcaguggcugcggggcuuccag

SEQ ID NO: 1139269 - RNA, 18 nt, Human
gcccugguuuccugacuc

SEQ ID NO: 1139270 - RNA, 19 nt, Human
gcccugguuuccugacuca

SEQ ID NO: 1139271 - RNA, 20 nt, Human
gccgccgaucgcaccgaagc

SEQ ID NO: 1139272 - RNA, 20 nt, Human
gcuaucuguguuuaaacaaa

SEQ ID NO: 1139273 - RNA, 19 nt, Human
gcugaagacagaguacagg

SEQ ID NO: 1139274 - RNA, 20 nt, Human
ggaaacgcaaucccgugucc

SEQ ID NO: 1139275 - RNA, 23 nt, Human
ggaaauaaagaggauggaaggaa

SEQ ID NO: 1139276 - RNA, 20 nt, Human
ggaaggaauggucccgcagu

SEQ ID NO: 1139277 - RNA, 21 nt, Human
gggagaaaggaugggacccca

SEQ ID NO: 1139278 - RNA, 18 nt, Human
ggucuugcucuguggcug

SEQ ID NO: 1139279 - RNA, 22 nt, Human
gugacauuccccacuuccuuca

SEQ ID NO: 1139280 - RNA, 19 nt, Human
uaaagaggauggaaggaau

SEQ ID NO: 1139281 - RNA, 25 nt, Human
uaacagggcagccagggagaaagga

SEQ ID NO: 1139282 - RNA, 23 nt, Human
uaaccccucacuuggcagcucca

SEQ ID NO: 1139283 - RNA, 19 nt, Human
uacaaaacacuguagcaau

SEQ ID NO: 1139284 - RNA, 23 nt, Human
uacccaggacugagaaccaaagc

SEQ ID NO: 1139285 - RNA, 18 nt, Human
uaccggagcccagccagg

SEQ ID NO: 1139286 - RNA, 19 nt, Human
uaccggagcccagccagga

SEQ ID NO: 1139287 - RNA, 22 nt, Human
uagcaauaagagaaaggcccgu

SEQ ID NO: 1139288 - RNA, 21 nt, Human
uauggucaggcucuggugacc

SEQ ID NO: 1139289 - RNA, 18 nt, Human
ucagagcuucaagccgau

SEQ ID NO: 1139290 - RNA, 20 nt, Human
ucccaaaacgcaaccuugga

SEQ ID NO: 1139291 - RNA, 18 nt, Human
ucccagggaaccucccgc

SEQ ID NO: 1139292 - RNA, 21 nt, Human
ucccauccccaaucuucccac

SEQ ID NO: 1139293 - RNA, 24 nt, Human
ucccauccccaaucuucccacccc

SEQ ID NO: 1139294 - RNA, 24 nt, Human
uccccaaucuucccaccccucuca

SEQ ID NO: 1139295 - RNA, 21 nt, Human
uccccaccucuucuuuaaccc

SEQ ID NO: 1139296 - RNA, 24 nt, Human
uccccaccucuucuuuaaccccuc

SEQ ID NO: 1139297 - RNA, 18 nt, Human
uccccugggagggggcag

SEQ ID NO: 1139298 - RNA, 21 nt, Human
uccuggcaaguacacccuggg

SEQ ID NO: 1139299 - RNA, 19 nt, Human
ucgguccugcccaaggccc

SEQ ID NO: 1139300 - RNA, 21 nt, Human
ucucaggaagagcuggguccc

SEQ ID NO: 1139301 - RNA, 22 nt, Human
ucuggugacccagccgcuuugc

SEQ ID NO: 1139302 - RNA, 23 nt, Human
ucuuuaaccccucacuuggcagc

SEQ ID NO: 1139303 - RNA, 27 nt, Human
ugaaaaagaacuggcccugguuuccug

SEQ ID NO: 1139304 - RNA, 19 nt, Human
ugacacaauaaauccacuu

SEQ ID NO: 1139305 - RNA, 22 nt, Human
ugacguaaaaaagcuacaagcc

SEQ ID NO: 1139306 - RNA, 21 nt, Human
ugcaguggcugcggggcuucc

SEQ ID NO: 1139307 - RNA, 23 nt, Human
ugcaguggcugcggggcuuccag

SEQ ID NO: 1139308 - RNA, 19 nt, Human
uggccgaagacccucugcc

SEQ ID NO: 1139309 - RNA, 18 nt, Human
ugggagggggcagucagg

SEQ ID NO: 1139310 - RNA, 19 nt, Human
ugggagggggcagucaggc

SEQ ID NO: 1139311 - RNA, 21 nt, Human
uucauuucauuaacauccccu

SEQ ID NO: 1139312 - RNA, 19 nt, Human
uuccugacucaaagggccc

SEQ ID NO: 1139313 - RNA, 18 nt, Human
uucuuuaaccccucacuu

SEQ ID NO: 1139314 - RNA, 24 nt, Human
uugggcgcaucuccgccucuuagg

SEQ ID NO: 1139315 - RNA, 18 nt, Human
aacuuccuuuugaaccuu

SEQ ID NO: 1139316 - RNA, 21 nt, Human
aagaagagggauccagcagug

SEQ ID NO: 1139317 - RNA, 19 nt, Human
agaagagggauccagcagu

SEQ ID NO: 1139318 - RNA, 19 nt, Human
agcaggaauggggcuaggu

SEQ ID NO: 1139319 - RNA, 20 nt, Human
agcccccacacuggccugac

SEQ ID NO: 1139320 - RNA, 24 nt, Human
agggcagacugggcagaaaggccu

SEQ ID NO: 1139321 - RNA, 18 nt, Human
aggugcuuccuccccugg

SEQ ID NO: 1139322 - RNA, 21 nt, Human
auggggcuaggugcuuccucc

SEQ ID NO: 1139323 - RNA, 21 nt, Human
cacagccgccccacuccaggg

SEQ ID NO: 1139324 - RNA, 18 nt, Human
caccucauccuccuguuc

SEQ ID NO: 1139325 - RNA, 20 nt, Human
cagcagcaacucuuggauuu

SEQ ID NO: 1139326 - RNA, 19 nt, Human
caggaggaauaagagggca

SEQ ID NO: 1139327 - RNA, 21 nt, Human
caggaggaauaagagggcaga

SEQ ID NO: 1139328 - RNA, 19 nt, Human
cagggccaggcuggcgcug

SEQ ID NO: 1139329 - RNA, 18 nt, Human
ccagcagugagaucaggc

SEQ ID NO: 1139330 - RNA, 20 nt, Human
ccagcagugagaucaggcag

SEQ ID NO: 1139331 - RNA, 18 nt, Human
cccacacuggccugacca

SEQ ID NO: 1139332 - RNA, 18 nt, Human
ccccaaccaagggcaggg

SEQ ID NO: 1139333 - RNA, 22 nt, Human
ccccacacuggccugaccaucu

SEQ ID NO: 1139334 - RNA, 26 nt, Human
ccccacacuggccugaccaucucccc

SEQ ID NO: 1139335 - RNA, 23 nt, Human
ccccugggauggcagcuuggccu

SEQ ID NO: 1139336 - RNA, 24 nt, Human
ccccuugggccccuccagagacaa

SEQ ID NO: 1139337 - RNA, 23 nt, Human
ccuccagcacugccucccugccc

SEQ ID NO: 1139338 - RNA, 21 nt, Human
ccucccagucugggguaccug

SEQ ID NO: 1139339 - RNA, 18 nt, Human
ccucucagcucugcacag

SEQ ID NO: 1139340 - RNA, 21 nt, Human
ccuggcagcaguuccgccagc

SEQ ID NO: 1139341 - RNA, 20 nt, Human
ccuugggccccuccagagac

SEQ ID NO: 1139342 - RNA, 20 nt, Human
ccuuugcucuuugcuguccu

SEQ ID NO: 1139343 - RNA, 19 nt, Human
ccuuuugaaccuuuuuauu

SEQ ID NO: 1139344 - RNA, 19 nt, Human
cgcagcaacuuccuuuuga

SEQ ID NO: 1139345 - RNA, 21 nt, Human
cgguggggccaggaugaggcc

SEQ ID NO: 1139346 - RNA, 18 nt, Human
cucauccuccuguucuca

SEQ ID NO: 1139347 - RNA, 21 nt, Human
cuccagcacugccucccugcc

SEQ ID NO: 1139348 - RNA, 20 nt, Human
cuccauggcugcucaguugg

SEQ ID NO: 1139349 - RNA, 25 nt, Human
cucugcacagacguccucgcucccc

SEQ ID NO: 1139350 - RNA, 19 nt, Human
cugcucucccuccugggau

SEQ ID NO: 1139351 - RNA, 21 nt, Human
cugcugccucccacucugcag

SEQ ID NO: 1139352 - RNA, 19 nt, Human
cugggcugggcacacaggc

SEQ ID NO: 1139353 - RNA, 22 nt, Human
cuuggauuuauuggaaagauuu

SEQ ID NO: 1139354 - RNA, 21 nt, Human
gaagugcuguuccugcagcug

SEQ ID NO: 1139355 - RNA, 19 nt, Human
gacccuacagccucccugg

SEQ ID NO: 1139356 - RNA, 20 nt, Human
gaggagccaccugaggccuc

SEQ ID NO: 1139357 - RNA, 26 nt, Human
gaggcccagucuguuccccgggcccg

SEQ ID NO: 1139358 - RNA, 20 nt, Human
gcagacugggcagaaaggcc

SEQ ID NO: 1139359 - RNA, 24 nt, Human
gcagcaguuccgccagcauuucuu

SEQ ID NO: 1139360 - RNA, 18 nt, Human
gcagugcccaagaguuuc

SEQ ID NO: 1139361 - RNA, 23 nt, Human
gccagcauuucuguaaaugcccu

SEQ ID NO: 1139362 - RNA, 19 nt, Human
gccccgggcuguccuuacc

SEQ ID NO: 1139363 - RNA, 22 nt, Human
gcucuuugcuguccucagaggc

SEQ ID NO: 1139364 - RNA, 21 nt, Human
gcugggcacacaggcagugcc

SEQ ID NO: 1139365 - RNA, 21 nt, Human
gcuguggcccuugcuggccug

SEQ ID NO: 1139366 - RNA, 21 nt, Human
gcuuggccugcuggucuuggg

SEQ ID NO: 1139367 - RNA, 24 nt, Human
ggaagaggagugccagcccuuacc

SEQ ID NO: 1139368 - RNA, 22 nt, Human
ggcaggaagaagagggauccag

SEQ ID NO: 1139369 - RNA, 21 nt, Human
gggaaacaggcucuguccaca

SEQ ID NO: 1139370 - RNA, 19 nt, Human
gggcagaccuucuuaggga

SEQ ID NO: 1139371 - RNA, 23 nt, Human
gggccccuccagagacaauccac

SEQ ID NO: 1139372 - RNA, 20 nt, Human
gggguugagccagccuccag

SEQ ID NO: 1139373 - RNA, 19 nt, Human
guggggccaggaugaggcc

SEQ ID NO: 1139374 - RNA, 18 nt, Human
uaccugaguccugggcag

SEQ ID NO: 1139375 - RNA, 21 nt, Human
uagcccccacacuggccugac

SEQ ID NO: 1139376 - RNA, 21 nt, Human
uccacacaaagucgguggggc

SEQ ID NO: 1139377 - RNA, 19 nt, Human
uccagccagagcucuguca

SEQ ID NO: 1139378 - RNA, 22 nt, Human
ucccccuuacugugucugccaa

SEQ ID NO: 1139379 - RNA, 18 nt, Human
uccuccaggucuccuggg

SEQ ID NO: 1139380 - RNA, 19 nt, Human
uccugcucugccuucuggg

SEQ ID NO: 1139381 - RNA, 19 nt, Human
ucgaagccccgggcugucc

SEQ ID NO: 1139382 - RNA, 21 nt, Human
ucgaagccccgggcuguccuu

SEQ ID NO: 1139383 - RNA, 20 nt, Human
ucuguaaaugcccucaugcc

SEQ ID NO: 1139384 - RNA, 22 nt, Human
ucuguaaaugcccucaugccag

SEQ ID NO: 1139385 - RNA, 22 nt, Human
ucuuccugcucugccuucuggg

SEQ ID NO: 1139386 - RNA, 18 nt, Human
ucuugggguugagccagc

SEQ ID NO: 1139387 - RNA, 19 nt, Human
ugaguccugggcagaccuu

SEQ ID NO: 1139388 - RNA, 24 nt, Human
ugccaagggugccagcacagccgc

SEQ ID NO: 1139389 - RNA, 25 nt, Human
ugccaagggugccagcacagccgcc

SEQ ID NO: 1139390 - RNA, 22 nt, Human
ugcccaagaguuucuaaugagc

SEQ ID NO: 1139391 - RNA, 20 nt, Human
ugccucccugcccugcugcc

SEQ ID NO: 1139392 - RNA, 22 nt, Human
ugccuucuggggcuguggcccu

SEQ ID NO: 1139393 - RNA, 19 nt, Human
ugcucucccuccugggaua

SEQ ID NO: 1139394 - RNA, 23 nt, Human
ugcuuccuccccuggggacuuca

SEQ ID NO: 1139395 - RNA, 19 nt, Human
uggcagccuggccuauagc

SEQ ID NO: 1139396 - RNA, 23 nt, Human
uggcaggaagugcuguuccugca

SEQ ID NO: 1139397 - RNA, 20 nt, Human
ugggauggcagcuuggccug

SEQ ID NO: 1139398 - RNA, 21 nt, Human
uguggaugaagccaggcuggg

SEQ ID NO: 1139399 - RNA, 18 nt, Human
uguggcccuugcuggccu

SEQ ID NO: 1139400 - RNA, 18 nt, Human
uguuagaggcucagaacc

SEQ ID NO: 1139401 - RNA, 22 nt, Human
uuggauuuauuggaaagauuuu

SEQ ID NO: 1139402 - RNA, 23 nt, Human
uugggggcagcagcauucagucc

SEQ ID NO: 1139403 - RNA, 21 nt, Human
uuuugccagaggacccuacag

SEQ ID NO: 1139404 - RNA, 21 nt, Human
aaacaaagcucaaauucuccu

SEQ ID NO: 1139405 - RNA, 18 nt, Human
acaucgauggcgaaagaa

SEQ ID NO: 1139406 - RNA, 21 nt, Human
cacacauuuugcgauaacauc

SEQ ID NO: 1139407 - RNA, 24 nt, Human
cacgccuguuacuacagcuggagg

SEQ ID NO: 1139408 - RNA, 18 nt, Human
cccggccgagaccccgcg

SEQ ID NO: 1139409 - RNA, 18 nt, Human
ccgcacccucacgcuccc

SEQ ID NO: 1139410 - RNA, 19 nt, Human
ccguaugcggcgaaaccgc

SEQ ID NO: 1139411 - RNA, 20 nt, Human
cgccggggcugcuuaccugg

SEQ ID NO: 1139412 - RNA, 22 nt, Human
cggcgaaaccgccggggcugcu

SEQ ID NO: 1139413 - RNA, 23 nt, Human
cggggcugcuuaccuggcccgca

SEQ ID NO: 1139414 - RNA, 26 nt, Human
cuacagcuggagggaaaccggggucc

SEQ ID NO: 1139415 - RNA, 19 nt, Human
cucaaauucuccugacuuc

SEQ ID NO: 1139416 - RNA, 20 nt, Human
gagccgcugcgcguggcugg

SEQ ID NO: 1139417 - RNA, 20 nt, Human
ggccgagaccccgcggagcc

SEQ ID NO: 1139418 - RNA, 24 nt, Human
uaaaauaaaaugauguccaaaagg

SEQ ID NO: 1139419 - RNA, 25 nt, Human
uaaaaugauguccaaaagguuugcu

SEQ ID NO: 1139420 - RNA, 25 nt, Human
uccuucagagcgcggacccggccga

SEQ ID NO: 1139421 - RNA, 21 nt, Human
uguccaaaagguuugcuuguu

SEQ ID NO: 1139422 - RNA, 24 nt, Human
uguccaaaagguuugcuuguuuuu

SEQ ID NO: 1139423 - RNA, 20 nt, Human
uguuguaaauccuccugcgg

SEQ ID NO: 1139424 - RNA, 23 nt, Human
uuaguuucauaaaacucagcauu

SEQ ID NO: 1139425 - RNA, 20 nt, Human
uuauuuauuuauuuauuuuu

SEQ ID NO: 1139426 - RNA, 23 nt, Human
uucucucacacauuuugcgauaa

SEQ ID NO: 1139427 - RNA, 22 nt, Human
uuuauuuauuuauuuauuuauu

SEQ ID NO: 1139428 - RNA, 21 nt, Human
aaaaaagagagagagagagaa

SEQ ID NO: 1139429 - RNA, 22 nt, Human
aaauccagccucugggagcagg

SEQ ID NO: 1139430 - RNA, 19 nt, Human
aacccaggcuccccugucu

SEQ ID NO: 1139431 - RNA, 19 nt, Human
aagaaguccaugggcccuc

SEQ ID NO: 1139432 - RNA, 19 nt, Human
aaggccccaagaugggaaa

SEQ ID NO: 1139433 - RNA, 24 nt, Human
aagugauccacccgccucggccuc

SEQ ID NO: 1139434 - RNA, 19 nt, Human
aaguucccugccaccccuc

SEQ ID NO: 1139435 - RNA, 21 nt, Human
aaucccagaggcaucuuuaga

SEQ ID NO: 1139436 - RNA, 21 nt, Human
acaaaacacacgccaacacca

SEQ ID NO: 1139437 - RNA, 24 nt, Human
acacacacaaaacacacgccaaca

SEQ ID NO: 1139438 - RNA, 23 nt, Human
acacagcacugcuaggcgccccu

SEQ ID NO: 1139439 - RNA, 21 nt, Human
acaccaggcuaauuuuuguau

SEQ ID NO: 1139440 - RNA, 19 nt, Human
acacuggguggccaaagag

SEQ ID NO: 1139441 - RNA, 21 nt, Human
acacuggguggccaaagagca

SEQ ID NO: 1139442 - RNA, 21 nt, Human
acagagcaguaguaggugcca

SEQ ID NO: 1139443 - RNA, 20 nt, Human
acagagcgugcucuguagcc

SEQ ID NO: 1139444 - RNA, 20 nt, Human
acaggacagccaguggccuc

SEQ ID NO: 1139445 - RNA, 19 nt, Human
accagaggggugauggguc

SEQ ID NO: 1139446 - RNA, 19 nt, Human
accagguuaaguucgccau

SEQ ID NO: 1139447 - RNA, 20 nt, Human
acccugaaguucccugccac

SEQ ID NO: 1139448 - RNA, 19 nt, Human
accgaguggcaaggccccu

SEQ ID NO: 1139449 - RNA, 18 nt, Human
accucucugcuuaccuuc

SEQ ID NO: 1139450 - RNA, 18 nt, Human
acgggguuucaccacguu

SEQ ID NO: 1139451 - RNA, 20 nt, Human
acgggguuucaccacguugg

SEQ ID NO: 1139452 - RNA, 24 nt, Human
acgggguuucaccacguuggccag

SEQ ID NO: 1139453 - RNA, 19 nt, Human
acuacaggugcgugccacc

SEQ ID NO: 1139454 - RNA, 21 nt, Human
acucaagccaccccauccccc

SEQ ID NO: 1139455 - RNA, 20 nt, Human
agaccuaggagggcagggca

SEQ ID NO: 1139456 - RNA, 20 nt, Human
agagaaagaaaaaggaaaag

SEQ ID NO: 1139457 - RNA, 21 nt, Human
agagacagggcugcccugcug

SEQ ID NO: 1139458 - RNA, 25 nt, Human
agaggggagguugggaagaccuagg

SEQ ID NO: 1139459 - RNA, 21 nt, Human
agauucuccugccuuagccuc

SEQ ID NO: 1139460 - RNA, 19 nt, Human
agcaagugcugacagagca

SEQ ID NO: 1139461 - RNA, 20 nt, Human
agcacgccaaggaggagccg

SEQ ID NO: 1139462 - RNA, 23 nt, Human
agcaggggaggccaaggccaggu

SEQ ID NO: 1139463 - RNA, 21 nt, Human
agccagggaguccccuucugu

SEQ ID NO: 1139464 - RNA, 21 nt, Human
agccucucgaguagcugggac

SEQ ID NO: 1139465 - RNA, 19 nt, Human
aggaagggccuugaaugug

SEQ ID NO: 1139466 - RNA, 23 nt, Human
aggagauagcuguguuggccagg

SEQ ID NO: 1139467 - RNA, 21 nt, Human
aggaggagccagggggcugcg

SEQ ID NO: 1139468 - RNA, 19 nt, Human
aggcagggaugccuggggg

SEQ ID NO: 1139469 - RNA, 22 nt, Human
aggcagggaugccugggggugc

SEQ ID NO: 1139470 - RNA, 21 nt, Human
aggcagugagcagggcucugg

SEQ ID NO: 1139471 - RNA, 23 nt, Human
aggcugcccuacuggcugaggug

SEQ ID NO: 1139472 - RNA, 18 nt, Human
agggaggccaugaugggc

SEQ ID NO: 1139473 - RNA, 18 nt, Human
agggcgugggaggccugg

SEQ ID NO: 1139474 - RNA, 22 nt, Human
agggcuccucugucccuggaga

SEQ ID NO: 1139475 - RNA, 21 nt, Human
aggggcaggggccugcagggg

SEQ ID NO: 1139476 - RNA, 25 nt, Human
agggggcugcggggagcccaggagg

SEQ ID NO: 1139477 - RNA, 19 nt, Human
aggugccaguggccgaugc

SEQ ID NO: 1139478 - RNA, 18 nt, Human
aguagcugggacuacagg

SEQ ID NO: 1139479 - RNA, 18 nt, Human
aguagcugggacuacagg

SEQ ID NO: 1139480 - RNA, 21 nt, Human
aguaggugccaguggccgaug

SEQ ID NO: 1139481 - RNA, 21 nt, Human
aguccaggguggcaguuuguu

SEQ ID NO: 1139482 - RNA, 25 nt, Human
aucccagaggcaucuuuagaaugga

SEQ ID NO: 1139483 - RNA, 25 nt, Human
aucccccuuagcuuuuccccuccaa

SEQ ID NO: 1139484 - RNA, 21 nt, Human
auggagcauggacuuuacauu

SEQ ID NO: 1139485 - RNA, 22 nt, Human
augggcaggccgguguggguca

SEQ ID NO: 1139486 - RNA, 22 nt, Human
auuuucucaagcaagugcugac

SEQ ID NO: 1139487 - RNA, 24 nt, Human
auuuuuguauuuuuaguagagacg

SEQ ID NO: 1139488 - RNA, 21 nt, Human
caaauccagccucugggagca

SEQ ID NO: 1139489 - RNA, 24 nt, Human
caacaugcugggauuacaggcaua

SEQ ID NO: 1139490 - RNA, 20 nt, Human
caacucagaucaaguccuuu

SEQ ID NO: 1139491 - RNA, 22 nt, Human
caagagauucuccugccuuagc

SEQ ID NO: 1139492 - RNA, 20 nt, Human
caagccaccccaucccccuu

SEQ ID NO: 1139493 - RNA, 19 nt, Human
cacacacaaaacacacgcc

SEQ ID NO: 1139494 - RNA, 20 nt, Human
cacacacaaaacacacgcca

SEQ ID NO: 1139495 - RNA, 24 nt, Human
cacacacaaaacacacgccaacac

SEQ ID NO: 1139496 - RNA, 19 nt, Human
cacaccggguucagcgcag

SEQ ID NO: 1139497 - RNA, 19 nt, Human
cacacguggcaaggagggc

SEQ ID NO: 1139498 - RNA, 20 nt, Human
cacagcacugcuaggcgccc

SEQ ID NO: 1139499 - RNA, 21 nt, Human
cacaggcugguucuccaucug

SEQ ID NO: 1139500 - RNA, 24 nt, Human
caccacaccaggcuaauuuuugua

SEQ ID NO: 1139501 - RNA, 21 nt, Human
caccacguuggccaggcuggu

SEQ ID NO: 1139502 - RNA, 24 nt, Human
caccacguuggccaggcuggucuc

SEQ ID NO: 1139503 - RNA, 27 nt, Human
caccacguuggccaggcuggucucaaa

SEQ ID NO: 1139504 - RNA, 21 nt, Human
cacccacauaugucaccucca

SEQ ID NO: 1139505 - RNA, 18 nt, Human
cacccacugagcuucugc

SEQ ID NO: 1139506 - RNA, 18 nt, Human
cacccacugccucccagc

SEQ ID NO: 1139507 - RNA, 20 nt, Human
cacccuaacuccaguccccg

SEQ ID NO: 1139508 - RNA, 19 nt, Human
caccuccccaaacaggccc

SEQ ID NO: 1139509 - RNA, 24 nt, Human
cacguuggccaggcuggucucaaa

SEQ ID NO: 1139510 - RNA, 18 nt, Human
cacugcaaccucugucuc

SEQ ID NO: 1139511 - RNA, 20 nt, Human
cagaaggaacagccugggca

SEQ ID NO: 1139512 - RNA, 25 nt, Human
cagcacccuccuucccucaccucuc

SEQ ID NO: 1139513 - RNA, 21 nt, Human
cagcagcagcacgccaaggag

SEQ ID NO: 1139514 - RNA, 19 nt, Human
cagccacaccggguucagc

SEQ ID NO: 1139515 - RNA, 21 nt, Human
cagccauguccugggccucca

SEQ ID NO: 1139516 - RNA, 22 nt, Human
cagccauguccugggccuccag

SEQ ID NO: 1139517 - RNA, 20 nt, Human
cagccccugcucccacccug

SEQ ID NO: 1139518 - RNA, 22 nt, Human
cagccccugcucccacccugcc

SEQ ID NO: 1139519 - RNA, 21 nt, Human
cagccugggcaaaggccccaa

SEQ ID NO: 1139520 - RNA, 23 nt, Human
cagccugggugggucucaaaagc

SEQ ID NO: 1139521 - RNA, 19 nt, Human
caggaagggccuugaaugg

SEQ ID NO: 1139522 - RNA, 19 nt, Human
caggagucaagcgggggug

SEQ ID NO: 1139523 - RNA, 20 nt, Human
caggcccagugagguggccc

SEQ ID NO: 1139524 - RNA, 18 nt, Human
caggggaggccaaggcca

SEQ ID NO: 1139525 - RNA, 24 nt, Human
caggggaggccaaggccaggugug

SEQ ID NO: 1139526 - RNA, 22 nt, Human
caggguccucccucagcucaga

SEQ ID NO: 1139527 - RNA, 24 nt, Human
caguaguaggugccaguggccgau

SEQ ID NO: 1139528 - RNA, 22 nt, Human
caugaugggcaggccggugugg

SEQ ID NO: 1139529 - RNA, 25 nt, Human
caugcaccucccacccugaaguucc

SEQ ID NO: 1139530 - RNA, 23 nt, Human
ccaacaugcugggauuacaggca

SEQ ID NO: 1139531 - RNA, 24 nt, Human
ccaacaugcugggauuacaggcau

SEQ ID NO: 1139532 - RNA, 20 nt, Human
ccacccucccuugggccaaa

SEQ ID NO: 1139533 - RNA, 22 nt, Human
ccacugcaaguucuggacuggu

SEQ ID NO: 1139534 - RNA, 18 nt, Human
ccagcacauguucccaug

SEQ ID NO: 1139535 - RNA, 21 nt, Human
ccaggagcucccauucauacc

SEQ ID NO: 1139536 - RNA, 19 nt, Human
ccaggcccauucauucagc

SEQ ID NO: 1139537 - RNA, 23 nt, Human
ccagggaguccccuucuguccuu

SEQ ID NO: 1139538 - RNA, 25 nt, Human
ccaugggcccucugcuaggguggca

SEQ ID NO: 1139539 - RNA, 24 nt, Human
cccaacaugcugggauuacaggca

SEQ ID NO: 1139540 - RNA, 20 nt, Human
cccacacagcacugcuaggc

SEQ ID NO: 1139541 - RNA, 21 nt, Human
cccacacagcacugcuaggcg

SEQ ID NO: 1139542 - RNA, 25 nt, Human
cccacacagcacugcuaggcgcccc

SEQ ID NO: 1139543 - RNA, 23 nt, Human
cccacauaugucaccuccagaca

SEQ ID NO: 1139544 - RNA, 23 nt, Human
cccacccuaacuccaguccccac

SEQ ID NO: 1139545 - RNA, 23 nt, Human
cccagccuugcccugaaccaagc

SEQ ID NO: 1139546 - RNA, 22 nt, Human
cccagcucugggcagcccuggc

SEQ ID NO: 1139547 - RNA, 22 nt, Human
cccaggcuccccugucuacccc

SEQ ID NO: 1139548 - RNA, 21 nt, Human
cccagguucaagagauucucc

SEQ ID NO: 1139549 - RNA, 22 nt, Human
ccccacccucccuugggccaaa

SEQ ID NO: 1139550 - RNA, 27 nt, Human
ccccaggagcucccauucauacccucu

SEQ ID NO: 1139551 - RNA, 22 nt, Human
ccccaucccccuuagcuuuucc

SEQ ID NO: 1139552 - RNA, 18 nt, Human
cccccaccuccuuggcug

SEQ ID NO: 1139553 - RNA, 20 nt, Human
ccccucucuguucuuccucc

SEQ ID NO: 1139554 - RNA, 24 nt, Human
ccccucucuguucuuccuccuccc

SEQ ID NO: 1139555 - RNA, 22 nt, Human
ccccugaaaaagacuggaaaau

SEQ ID NO: 1139556 - RNA, 22 nt, Human
cccgccugcaagcacacguggc

SEQ ID NO: 1139557 - RNA, 20 nt, Human
cccugaaaaagacuggaaaa

SEQ ID NO: 1139558 - RNA, 21 nt, Human
cccugaaaaagacuggaaaau

SEQ ID NO: 1139559 - RNA, 27 nt, Human
cccugaaccaagcacagacgaccacca

SEQ ID NO: 1139560 - RNA, 20 nt, Human
cccugacccuugcccccacc

SEQ ID NO: 1139561 - RNA, 18 nt, Human
cccugaggccacccagcc

SEQ ID NO: 1139562 - RNA, 24 nt, Human
cccugcugcgguagggcccagggg

SEQ ID NO: 1139563 - RNA, 19 nt, Human
cccugugccagcuugucuc

SEQ ID NO: 1139564 - RNA, 25 nt, Human
ccgccugcaagcacacguggcaagg

SEQ ID NO: 1139565 - RNA, 20 nt, Human
ccucacaggcugguucucca

SEQ ID NO: 1139566 - RNA, 20 nt, Human
ccuccagacacacacaaaac

SEQ ID NO: 1139567 - RNA, 23 nt, Human
ccuccagacacacacaaaacaca

SEQ ID NO: 1139568 - RNA, 20 nt, Human
ccucccacgccagccccugc

SEQ ID NO: 1139569 - RNA, 21 nt, Human
ccucccagccuugcccugaac

SEQ ID NO: 1139570 - RNA, 21 nt, Human
ccuccuagcuuaguucugggc

SEQ ID NO: 1139571 - RNA, 20 nt, Human
ccuccuccucccugccucuc

SEQ ID NO: 1139572 - RNA, 18 nt, Human
ccucucacuuagacuccu

SEQ ID NO: 1139573 - RNA, 20 nt, Human
ccucucuguccccucucugu

SEQ ID NO: 1139574 - RNA, 23 nt, Human
ccucucuguccccucucuguucu

SEQ ID NO: 1139575 - RNA, 18 nt, Human
ccugaaccaagcacagac

SEQ ID NO: 1139576 - RNA, 27 nt, Human
ccugacccuugcccccaccuccuuggc

SEQ ID NO: 1139577 - RNA, 18 nt, Human
ccugcaagcacacguggc

SEQ ID NO: 1139578 - RNA, 21 nt, Human
ccugcaccccaggagcuccca

SEQ ID NO: 1139579 - RNA, 21 nt, Human
ccugcagcugaaggagauagc

SEQ ID NO: 1139580 - RNA, 23 nt, Human
ccuggaagguccacagcuccccu

SEQ ID NO: 1139581 - RNA, 20 nt, Human
ccuggcagcuucaccucccc

SEQ ID NO: 1139582 - RNA, 18 nt, Human
ccuggccucaagugaucc

SEQ ID NO: 1139583 - RNA, 22 nt, Human
ccuggccucaagugauccaccc

SEQ ID NO: 1139584 - RNA, 23 nt, Human
ccuggccucaagugauccacccg

SEQ ID NO: 1139585 - RNA, 21 nt, Human
ccuggccugagcugucuugac

SEQ ID NO: 1139586 - RNA, 19 nt, Human
ccuggucuugcuggcuucg

SEQ ID NO: 1139587 - RNA, 21 nt, Human
ccuuccccacccuaacuccag

SEQ ID NO: 1139588 - RNA, 19 nt, Human
ccuugaaugugagggugaa

SEQ ID NO: 1139589 - RNA, 23 nt, Human
ccuugcucacugaagaccucagc

SEQ ID NO: 1139590 - RNA, 19 nt, Human
ccuuucugagacacugagu

SEQ ID NO: 1139591 - RNA, 21 nt, Human
cgcugcagagcuguguagaca

SEQ ID NO: 1139592 - RNA, 24 nt, Human
cgggguuucaccacguuggccagg

SEQ ID NO: 1139593 - RNA, 20 nt, Human
cuagagauuuucauagaccg

SEQ ID NO: 1139594 - RNA, 23 nt, Human
cucacugaagaccucagcaccca

SEQ ID NO: 1139595 - RNA, 24 nt, Human
cucacugcaaccucugucucccag

SEQ ID NO: 1139596 - RNA, 24 nt, Human
cucacugcaaccucugucucccag

SEQ ID NO: 1139597 - RNA, 21 nt, Human
cucagcacccacugccuccca

SEQ ID NO: 1139598 - RNA, 20 nt, Human
cuccacucaagccaccccau

SEQ ID NO: 1139599 - RNA, 21 nt, Human
cuccaggcccauucauucagc

SEQ ID NO: 1139600 - RNA, 19 nt, Human
cucccacgccagccccugc

SEQ ID NO: 1139601 - RNA, 22 nt, Human
cucccagaagcugguuucccag

SEQ ID NO: 1139602 - RNA, 23 nt, Human
cucccagccuugcccugaaccuu

SEQ ID NO: 1139603 - RNA, 21 nt, Human
cucccgccugccccaugcacc

SEQ ID NO: 1139604 - RNA, 23 nt, Human
cucccgccugccccaugcaccuc

SEQ ID NO: 1139605 - RNA, 20 nt, Human
cuccuccauaccucggcucc

SEQ ID NO: 1139606 - RNA, 23 nt, Human
cuccugcauaagcugucugccaa

SEQ ID NO: 1139607 - RNA, 23 nt, Human
cuccugcuaagccagcacccucc

SEQ ID NO: 1139608 - RNA, 23 nt, Human
cucgaguagcugggacuacaggu

SEQ ID NO: 1139609 - RNA, 18 nt, Human
cucucagccauguccugg

SEQ ID NO: 1139610 - RNA, 19 nt, Human
cucugcuuaccuugcuccc

SEQ ID NO: 1139611 - RNA, 18 nt, Human
cucugggcagcccuggcc

SEQ ID NO: 1139612 - RNA, 25 nt, Human
cucuguccccucucuguucuuccuc

SEQ ID NO: 1139613 - RNA, 24 nt, Human
cugacuguccuccugccagucgca

SEQ ID NO: 1139614 - RNA, 19 nt, Human
cugcaaccucugucuccca

SEQ ID NO: 1139615 - RNA, 23 nt, Human
cugcaaccucugucucccagguu

SEQ ID NO: 1139616 - RNA, 24 nt, Human
cugcaaccucugucucccagguuc

SEQ ID NO: 1139617 - RNA, 23 nt, Human
cugccuuagccucucgaguagcu

SEQ ID NO: 1139618 - RNA, 21 nt, Human
cugggggccugcuugucugcg

SEQ ID NO: 1139619 - RNA, 24 nt, Human
cugugaagggaaccccagccacac

SEQ ID NO: 1139620 - RNA, 24 nt, Human
cuuagccucucgaguagcugggac

SEQ ID NO: 1139621 - RNA, 24 nt, Human
cuucaccuaggccucaccuacucc

SEQ ID NO: 1139622 - RNA, 22 nt, Human
cuugccucugagggguccauca

SEQ ID NO: 1139623 - RNA, 20 nt, Human
cuuggggcugcuggcagauc

SEQ ID NO: 1139624 - RNA, 21 nt, Human
gaaaguagcugacugugaaaa

SEQ ID NO: 1139625 - RNA, 23 nt, Human
gaacagccugggcaaaggcccca

SEQ ID NO: 1139626 - RNA, 18 nt, Human
gaacaggugcucaguccu

SEQ ID NO: 1139627 - RNA, 20 nt, Human
gacagagcgugcucuguagc

SEQ ID NO: 1139628 - RNA, 19 nt, Human
gaccccgcauccgcuucuc

SEQ ID NO: 1139629 - RNA, 22 nt, Human
gagaaagaaaaaggaaaagcag

SEQ ID NO: 1139630 - RNA, 24 nt, Human
gagacgggguuucaccacguuggc

SEQ ID NO: 1139631 - RNA, 19 nt, Human
gagacuggggaagcccccu

SEQ ID NO: 1139632 - RNA, 21 nt, Human
gagcaguaguaggugccagug

SEQ ID NO: 1139633 - RNA, 22 nt, Human
gagcuucugccugagccaggga

SEQ ID NO: 1139634 - RNA, 24 nt, Human
gaggcagugagcagggcucugggc

SEQ ID NO: 1139635 - RNA, 23 nt, Human
gaggggcgcuuugcugguugggc

SEQ ID NO: 1139636 - RNA, 18 nt, Human
gauuacaggcauaagcca

SEQ ID NO: 1139637 - RNA, 19 nt, Human
gauuacaggcauaagccac

SEQ ID NO: 1139638 - RNA, 21 nt, Human
gauuacaggcauaagccacua

SEQ ID NO: 1139639 - RNA, 22 nt, Human
gcaaccucugucucccagguuc

SEQ ID NO: 1139640 - RNA, 19 nt, Human
gcaaggccccugcucccag

SEQ ID NO: 1139641 - RNA, 18 nt, Human
gcaccagacuucccuggu

SEQ ID NO: 1139642 - RNA, 21 nt, Human
gccacuacgccuggccugagc

SEQ ID NO: 1139643 - RNA, 18 nt, Human
gcccaggagggcguggga

SEQ ID NO: 1139644 - RNA, 18 nt, Human
gccccugcucccagaagc

SEQ ID NO: 1139645 - RNA, 23 nt, Human
gccucggccucccaacaugcugg

SEQ ID NO: 1139646 - RNA, 20 nt, Human
gccuuagccucucgaguagc

SEQ ID NO: 1139647 - RNA, 19 nt, Human
gcucccacccccagcucuu

SEQ ID NO: 1139648 - RNA, 28 nt, Human
gcucuguagcccaggcuggugugcagug

SEQ ID NO: 1139649 - RNA, 18 nt, Human
gcugcgguagggcccagg

SEQ ID NO: 1139650 - RNA, 18 nt, Human
gcugcucugucagcauga

SEQ ID NO: 1139651 - RNA, 23 nt, Human
gcuggucucaaacuccuggccuc

SEQ ID NO: 1139652 - RNA, 21 nt, Human
gcuucccuuccccacccuaac

SEQ ID NO: 1139653 - RNA, 20 nt, Human
gcuucuuagggcuccucugu

SEQ ID NO: 1139654 - RNA, 19 nt, Human
ggaaagcccuugaagacug

SEQ ID NO: 1139655 - RNA, 18 nt, Human
ggaaaugcacacccacug

SEQ ID NO: 1139656 - RNA, 24 nt, Human
ggaaaugcacacccacugagcuuc

SEQ ID NO: 1139657 - RNA, 22 nt, Human
ggaagaccuaggagggcagggc

SEQ ID NO: 1139658 - RNA, 18 nt, Human
ggaagggccugccuggca

SEQ ID NO: 1139659 - RNA, 21 nt, Human
ggagccugggaggccccugug

SEQ ID NO: 1139660 - RNA, 23 nt, Human
ggagccugggaggccccugugac

SEQ ID NO: 1139661 - RNA, 19 nt, Human
ggauuacaggcauaagcca

SEQ ID NO: 1139662 - RNA, 22 nt, Human
ggcacagugguaaaguuuaacc

SEQ ID NO: 1139663 - RNA, 20 nt, Human
ggcaggggcugccccggucc

SEQ ID NO: 1139664 - RNA, 19 nt, Human
ggcccagcucccagggagg

SEQ ID NO: 1139665 - RNA, 24 nt, Human
ggccucaagugauccacccgccuc

SEQ ID NO: 1139666 - RNA, 19 nt, Human
ggccuccagaucugucccu

SEQ ID NO: 1139667 - RNA, 24 nt, Human
ggcuggucucaaacuccuggccuc

SEQ ID NO: 1139668 - RNA, 21 nt, Human
gggaagaccuaggagggcagg

SEQ ID NO: 1139669 - RNA, 24 nt, Human
gggaagcaucagcugagacccaga

SEQ ID NO: 1139670 - RNA, 18 nt, Human
gggcagcccuggccuguc

SEQ ID NO: 1139671 - RNA, 22 nt, Human
gggcaguggggccggccaagac

SEQ ID NO: 1139672 - RNA, 24 nt, Human
gggccaaagcccuuuagggucccg

SEQ ID NO: 1139673 - RNA, 18 nt, Human
gggcgugggaggccuggc

SEQ ID NO: 1139674 - RNA, 19 nt, Human
gggcucugcuuggcggugg

SEQ ID NO: 1139675 - RNA, 18 nt, Human
ggggcauagaaugggggg

SEQ ID NO: 1139676 - RNA, 19 nt, Human
gggggugggguuggaggcu

SEQ ID NO: 1139677 - RNA, 23 nt, Human
gggguuucaccacguuggccagg

SEQ ID NO: 1139678 - RNA, 22 nt, Human
ggguguggcucugguucucugu

SEQ ID NO: 1139679 - RNA, 25 nt, Human
ggucagagaggcccaggaggugggg

SEQ ID NO: 1139680 - RNA, 20 nt, Human
gguccagggucuaggagcug

SEQ ID NO: 1139681 - RNA, 19 nt, Human
guauagagcaggggaggcc

SEQ ID NO: 1139682 - RNA, 21 nt, Human
gugaagggaaccccagccaca

SEQ ID NO: 1139683 - RNA, 24 nt, Human
gugauccacccgccucggccuccc

SEQ ID NO: 1139684 - RNA, 18 nt, Human
gugcaggcuggugccaag

SEQ ID NO: 1139685 - RNA, 23 nt, Human
gugcaguggugccacuucggcuc

SEQ ID NO: 1139686 - RNA, 23 nt, Human
guggaaagcaagccugcacccca

SEQ ID NO: 1139687 - RNA, 20 nt, Human
guggaguguggccaguggac

SEQ ID NO: 1139688 - RNA, 18 nt, Human
uaacuccaguccccacuc

SEQ ID NO: 1139689 - RNA, 24 nt, Human
uaauuuuuguauuuuuaguagaga

SEQ ID NO: 1139690 - RNA, 22 nt, Human
uacaggcauaagccacuacgcc

SEQ ID NO: 1139691 - RNA, 23 nt, Human
uacauaaaaauccaucccugaaa

SEQ ID NO: 1139692 - RNA, 23 nt, Human
uacccuggccgaggccaccaggc

SEQ ID NO: 1139693 - RNA, 20 nt, Human
uaccucggcuccccacacag

SEQ ID NO: 1139694 - RNA, 21 nt, Human
uaccucggcuccccacacagc

SEQ ID NO: 1139695 - RNA, 21 nt, Human
uaccuugcucccacccccagc

SEQ ID NO: 1139696 - RNA, 22 nt, Human
uacuggcugaggugcaggcugg

SEQ ID NO: 1139697 - RNA, 22 nt, Human
uagagacgggguuucaccacgu

SEQ ID NO: 1139698 - RNA, 26 nt, Human
uagaggcaggcagggaugccuggggg

SEQ ID NO: 1139699 - RNA, 20 nt, Human
uagggcuccucugucccugg

SEQ ID NO: 1139700 - RNA, 22 nt, Human
uagggcuccucugucccuggag

SEQ ID NO: 1139701 - RNA, 18 nt, Human
uaggugccaguggccgau

SEQ ID NO: 1139702 - RNA, 24 nt, Human
uaguagagacgggguuucaccacg

SEQ ID NO: 1139703 - RNA, 19 nt, Human
uaguucugggcccccgccu

SEQ ID NO: 1139704 - RNA, 21 nt, Human
uaguucugggcccccgccugc

SEQ ID NO: 1139705 - RNA, 22 nt, Human
ucacaggcugguucuccaucug

SEQ ID NO: 1139706 - RNA, 18 nt, Human
ucaccuccagacacacac

SEQ ID NO: 1139707 - RNA, 24 nt, Human
ucaccuccagacacacacaaaaca

SEQ ID NO: 1139708 - RNA, 22 nt, Human
ucacugcaaacugaggcucagg

SEQ ID NO: 1139709 - RNA, 19 nt, Human
ucacugcaaccucugucuc

SEQ ID NO: 1139710 - RNA, 24 nt, Human
ucacugcaaccucugucucccagg

SEQ ID NO: 1139711 - RNA, 23 nt, Human
ucagagaggcccaggaggugggg

SEQ ID NO: 1139712 - RNA, 19 nt, Human
ucagaggcugcccuacugg

SEQ ID NO: 1139713 - RNA, 20 nt, Human
ucaguccugggggcuggaga

SEQ ID NO: 1139714 - RNA, 26 nt, Human
ucaguuccugcaauauuggcugugaa

SEQ ID NO: 1139715 - RNA, 19 nt, Human
ucauacccucucugucccc

SEQ ID NO: 1139716 - RNA, 22 nt, Human
ucauagaccagguuaaguucgc

SEQ ID NO: 1139717 - RNA, 22 nt, Human
ucauaguggaaagcaagccugc

SEQ ID NO: 1139718 - RNA, 18 nt, Human
ucauucaaauccagccuc

SEQ ID NO: 1139719 - RNA, 22 nt, Human
ucauucaaauccagccucuggg

SEQ ID NO: 1139720 - RNA, 21 nt, Human
ucauucagcuccugcuuccuc

SEQ ID NO: 1139721 - RNA, 21 nt, Human
uccaccagaggggugauggga

SEQ ID NO: 1139722 - RNA, 24 nt, Human
uccacccgccucggccucccaaca

SEQ ID NO: 1139723 - RNA, 18 nt, Human
uccaggaaagcccuugaa

SEQ ID NO: 1139724 - RNA, 23 nt, Human
uccaucccugaaaucccagaggc

SEQ ID NO: 1139725 - RNA, 24 nt, Human
ucccaacaugcugggauuacaggc

SEQ ID NO: 1139726 - RNA, 24 nt, Human
ucccacgccagccccugcucccac

SEQ ID NO: 1139727 - RNA, 24 nt, Human
ucccagccuugcccugaaccaagc

SEQ ID NO: 1139728 - RNA, 21 nt, Human
ucccagguucaagagauucuc

SEQ ID NO: 1139729 - RNA, 24 nt, Human
ucccagguucaagagauucuccug

SEQ ID NO: 1139730 - RNA, 26 nt, Human
uccccacacagcacugcuaggcgccc

SEQ ID NO: 1139731 - RNA, 25 nt, Human
uccccagcuccuccauaccucggcu

SEQ ID NO: 1139732 - RNA, 19 nt, Human
ucccucaccucucugcuua

SEQ ID NO: 1139733 - RNA, 22 nt, Human
ucccucagcucagaggcugccc

SEQ ID NO: 1139734 - RNA, 25 nt, Human
ucccucagcucagaggcugcccuac

SEQ ID NO: 1139735 - RNA, 22 nt, Human
ucccugauccuagucuugccuc

SEQ ID NO: 1139736 - RNA, 19 nt, Human
ucccugccaccccucgccc

SEQ ID NO: 1139737 - RNA, 25 nt, Human
ucccugccucucuccuugcucacug

SEQ ID NO: 1139738 - RNA, 23 nt, Human
ucccugggggccuuacucccaac

SEQ ID NO: 1139739 - RNA, 24 nt, Human
uccuccuccucccugccucucccc

SEQ ID NO: 1139740 - RNA, 23 nt, Human
uccugggccuccagaucuguccc

SEQ ID NO: 1139741 - RNA, 19 nt, Human
ucucagccauguccugggc

SEQ ID NO: 1139742 - RNA, 18 nt, Human
ucuccaucugggggccug

SEQ ID NO: 1139743 - RNA, 24 nt, Human
ucucccagguucaagagauucucc

SEQ ID NO: 1139744 - RNA, 24 nt, Human
ucuccugccuuagccucucgagua

SEQ ID NO: 1139745 - RNA, 23 nt, Human
ucucgaguagcugggacuacagg

SEQ ID NO: 1139746 - RNA, 24 nt, Human
ucucgaguagcugggacuacaggu

SEQ ID NO: 1139747 - RNA, 19 nt, Human
ucucugaccaggaugaagg

SEQ ID NO: 1139748 - RNA, 19 nt, Human
ucucuguccccucucuguu

SEQ ID NO: 1139749 - RNA, 19 nt, Human
ucugaccacaggucaggga

SEQ ID NO: 1139750 - RNA, 23 nt, Human
ucugccaagaaaacuauugaacu

SEQ ID NO: 1139751 - RNA, 24 nt, Human
ucuguagcccaggcuggugugcag

SEQ ID NO: 1139752 - RNA, 19 nt, Human
ucuguccccucucuguucu

SEQ ID NO: 1139753 - RNA, 20 nt, Human
ucuguccccucucuguucuu

SEQ ID NO: 1139754 - RNA, 22 nt, Human
ucuguccccucucuguucuucc

SEQ ID NO: 1139755 - RNA, 19 nt, Human
ucugucccugauccuaguc

SEQ ID NO: 1139756 - RNA, 22 nt, Human
ucuguucuuccuccucccgccu

SEQ ID NO: 1139757 - RNA, 21 nt, Human
ucuuagggcuccucugucccu

SEQ ID NO: 1139758 - RNA, 21 nt, Human
ucuuagggcuccucugucccu

SEQ ID NO: 1139759 - RNA, 18 nt, Human
ucuucucuucccuccucc

SEQ ID NO: 1139760 - RNA, 21 nt, Human
ucuugcuggcuucgguuuucc

SEQ ID NO: 1139761 - RNA, 21 nt, Human
ugaaaugauggggugucccug

SEQ ID NO: 1139762 - RNA, 19 nt, Human
ugaaggagauagcuguguu

SEQ ID NO: 1139763 - RNA, 28 nt, Human
ugaaugugagggugaaaugauggggugu

SEQ ID NO: 1139764 - RNA, 18 nt, Human
ugaccaggaugaaggugc

SEQ ID NO: 1139765 - RNA, 21 nt, Human
ugacccagggcaagcucuaug

SEQ ID NO: 1139766 - RNA, 27 nt, Human
ugacccagggcaagcucuaugagcggg

SEQ ID NO: 1139767 - RNA, 19 nt, Human
ugacugugaaaaccuugaa

SEQ ID NO: 1139768 - RNA, 22 nt, Human
ugaggcaaaaaccaugcaaggu

SEQ ID NO: 1139769 - RNA, 18 nt, Human
ugaggggcgcuuugcugg

SEQ ID NO: 1139770 - RNA, 21 nt, Human
ugagggguccaucauccuugu

SEQ ID NO: 1139771 - RNA, 19 nt, Human
ugagggugaaaugaugggg

SEQ ID NO: 1139772 - RNA, 18 nt, Human
ugagguggcccucuccug

SEQ ID NO: 1139773 - RNA, 19 nt, Human
ugagguggcccucuccugg

SEQ ID NO: 1139774 - RNA, 23 nt, Human
ugaguucagguuugugacacugg

SEQ ID NO: 1139775 - RNA, 18 nt, Human
ugauggggugucccuggg

SEQ ID NO: 1139776 - RNA, 21 nt, Human
ugcaaggaauggagugacgcc

SEQ ID NO: 1139777 - RNA, 18 nt, Human
ugcacacccacugagcuu

SEQ ID NO: 1139778 - RNA, 22 nt, Human
ugcaguggugccacuucggcuc

SEQ ID NO: 1139779 - RNA, 23 nt, Human
ugccgcugccucucaccguggag

SEQ ID NO: 1139780 - RNA, 20 nt, Human
ugccucgugccucuggccca

SEQ ID NO: 1139781 - RNA, 20 nt, Human
ugcggggagcccaggagggc

SEQ ID NO: 1139782 - RNA, 24 nt, Human
ugcgugccaccacaccaggcuaau

SEQ ID NO: 1139783 - RNA, 18 nt, Human
ugcucccacccccagcuc

SEQ ID NO: 1139784 - RNA, 24 nt, Human
ugcugggauuacaggcauaagcca

SEQ ID NO: 1139785 - RNA, 19 nt, Human
uggaaagcaagccugcacc

SEQ ID NO: 1139786 - RNA, 27 nt, Human
uggacuggugguagaggcugggccgga

SEQ ID NO: 1139787 - RNA, 21 nt, Human
uggagcauggacuuuacauua

SEQ ID NO: 1139788 - RNA, 22 nt, Human
uggaguguggccaguggacaga

SEQ ID NO: 1139789 - RNA, 18 nt, Human
uggauaggugauccugca

SEQ ID NO: 1139790 - RNA, 21 nt, Human
uggcaaggagggcuucagcag

SEQ ID NO: 1139791 - RNA, 23 nt, Human
uggcaaggagggcuucagcaggc

SEQ ID NO: 1139792 - RNA, 26 nt, Human
uggcaaggccccugcucccagaagcu

SEQ ID NO: 1139793 - RNA, 21 nt, Human
uggcagaaggaacagccuggg

SEQ ID NO: 1139794 - RNA, 23 nt, Human
uggcagaaggaacagccugggca

SEQ ID NO: 1139795 - RNA, 22 nt, Human
uggccaaagagcacugccuacu

SEQ ID NO: 1139796 - RNA, 24 nt, Human
uggccaggcuggucucaaacuccu

SEQ ID NO: 1139797 - RNA, 22 nt, Human
uggccgaugcucccggcagcac

SEQ ID NO: 1139798 - RNA, 24 nt, Human
uggccucaagugauccacccgccu

SEQ ID NO: 1139799 - RNA, 19 nt, Human
uggcucugguucucugugc

SEQ ID NO: 1139800 - RNA, 19 nt, Human
uggcugaggugcaggcugg

SEQ ID NO: 1139801 - RNA, 23 nt, Human
uggcuucgguuuucccagggggg

SEQ ID NO: 1139802 - RNA, 19 nt, Human
uggcuucuuagggcuccuu

SEQ ID NO: 1139803 - RNA, 21 nt, Human
ugggacuacaggugcgugcca

SEQ ID NO: 1139804 - RNA, 22 nt, Human
ugggacuacaggugcgugccac

SEQ ID NO: 1139805 - RNA, 24 nt, Human
ugggacuacaggugcgugccacca

SEQ ID NO: 1139806 - RNA, 18 nt, Human
ugggauuacaggcauaag

SEQ ID NO: 1139807 - RNA, 21 nt, Human
ugggauuacaggcauaagcca

SEQ ID NO: 1139808 - RNA, 22 nt, Human
ugggauuacaggcauaagccac

SEQ ID NO: 1139809 - RNA, 22 nt, Human
ugggauuacaggcauaagccac

SEQ ID NO: 1139810 - RNA, 23 nt, Human
ugggauuacaggcauaagccacu

SEQ ID NO: 1139811 - RNA, 24 nt, Human
ugggauuacaggcauaagccacua

SEQ ID NO: 1139812 - RNA, 24 nt, Human
ugggauuacaggcauaagccacua

SEQ ID NO: 1139813 - RNA, 20 nt, Human
ugggcaaaggccccaagaug

SEQ ID NO: 1139814 - RNA, 24 nt, Human
ugggcaaggguggcauccaggaaa

SEQ ID NO: 1139815 - RNA, 19 nt, Human
ugggcaggccggugugggu

SEQ ID NO: 1139816 - RNA, 22 nt, Human
ugggcaggccggugugggucac

SEQ ID NO: 1139817 - RNA, 23 nt, Human
ugggcccucugcuaggguggcac

SEQ ID NO: 1139818 - RNA, 24 nt, Human
ugggguuggaggcugaaacccauu

SEQ ID NO: 1139819 - RNA, 20 nt, Human
ugggugagcugccauccuca

SEQ ID NO: 1139820 - RNA, 22 nt, Human
uggugguagaggcugggcacag

SEQ ID NO: 1139821 - RNA, 26 nt, Human
uggugguuggggcauagaaugggggg

SEQ ID NO: 1139822 - RNA, 24 nt, Human
uggugugcaguggugccacuucgg

SEQ ID NO: 1139823 - RNA, 24 nt, Human
ugguucuccaucugggggccugcu

SEQ ID NO: 1139824 - RNA, 23 nt, Human
ugguugggccaagggaggaaggg

SEQ ID NO: 1139825 - RNA, 20 nt, Human
ugugaagggaaccccagcca

SEQ ID NO: 1139826 - RNA, 18 nt, Human
uuaguagagacgggguuu

SEQ ID NO: 1139827 - RNA, 22 nt, Human
uuaguagagacgggguuucacc

SEQ ID NO: 1139828 - RNA, 24 nt, Human
uuaguagagacgggguuucaccac

SEQ ID NO: 1139829 - RNA, 25 nt, Human
uuaguagagacgggguuucaccacg

SEQ ID NO: 1139830 - RNA, 24 nt, Human
uuaguucugggcccccgccugcaa

SEQ ID NO: 1139831 - RNA, 23 nt, Human
uucagguuugugacacugggugg

SEQ ID NO: 1139832 - RNA, 23 nt, Human
uucucugugcccaguccagggug

SEQ ID NO: 1139833 - RNA, 24 nt, Human
uugcccaaguccacaaggcugugg

SEQ ID NO: 1139834 - RNA, 22 nt, Human
uugcucccacccccagcucugg

SEQ ID NO: 1139835 - RNA, 19 nt, Human
uuggcugguggagccagga

SEQ ID NO: 1139836 - RNA, 23 nt, Human
uuguauuuuuaguagagacgggg

SEQ ID NO: 1139837 - RNA, 21 nt, Human
uuucaccacguuggccaggcu

SEQ ID NO: 1139838 - RNA, 20 nt, Human
uuucuucucuucccuccucc

SEQ ID NO: 1139839 - RNA, 24 nt, Human
uuuuuaguagagacgggguuucac

SEQ ID NO: 1139840 - RNA, 20 nt, Human
uuuuuguauuuuuaguagag

SEQ ID NO: 1139841 - RNA, 30 nt, Human
aaagguccccccacgccugggucccaccuu

SEQ ID NO: 1139842 - RNA, 27 nt, Human
aagguccccccacgccugggucccacc

SEQ ID NO: 1139843 - RNA, 22 nt, Human
acagucgaggaggggcuaugcc

SEQ ID NO: 1139844 - RNA, 21 nt, Human
acagugaguacccuguccgcc

SEQ ID NO: 1139845 - RNA, 25 nt, Human
acccagugggcacugagugagcguc

SEQ ID NO: 1139846 - RNA, 21 nt, Human
acccuuggauuagaugggcuu

SEQ ID NO: 1139847 - RNA, 18 nt, Human
accuuucccuucuuccug

SEQ ID NO: 1139848 - RNA, 18 nt, Human
acgccugggucccaccug

SEQ ID NO: 1139849 - RNA, 22 nt, Human
acguggauccguccuaccuggc

SEQ ID NO: 1139850 - RNA, 22 nt, Human
acuccaaaaauguaaauuaagc

SEQ ID NO: 1139851 - RNA, 19 nt, Human
acuccaccgccagggcuga

SEQ ID NO: 1139852 - RNA, 19 nt, Human
acuuggggggaaugccagg

SEQ ID NO: 1139853 - RNA, 20 nt, Human
agacacccggcaucggucag

SEQ ID NO: 1139854 - RNA, 18 nt, Human
agaggguugagcccagag

SEQ ID NO: 1139855 - RNA, 19 nt, Human
agagguaggggaaauggcu

SEQ ID NO: 1139856 - RNA, 22 nt, Human
agaguuccucugguucccuggg

SEQ ID NO: 1139857 - RNA, 21 nt, Human
agcagaugcugggagggcacg

SEQ ID NO: 1139858 - RNA, 24 nt, Human
agccugggccaccauggagguggg

SEQ ID NO: 1139859 - RNA, 23 nt, Human
agggaucugugggugcugugggg

SEQ ID NO: 1139860 - RNA, 21 nt, Human
aggggggccauucagacagaa

SEQ ID NO: 1139861 - RNA, 26 nt, Human
agguccccccacgccugggucccacc

SEQ ID NO: 1139862 - RNA, 22 nt, Human
auccucacuccaccccucauua

SEQ ID NO: 1139863 - RNA, 23 nt, Human
augaaaaggggggccauucagac

SEQ ID NO: 1139864 - RNA, 20 nt, Human
augggcuugaguuugauucc

SEQ ID NO: 1139865 - RNA, 22 nt, Human
auguuuuggcccguguuucagc

SEQ ID NO: 1139866 - RNA, 22 nt, Human
caaggcaggugggaucaggcca

SEQ ID NO: 1139867 - RNA, 22 nt, Human
cacagugaguacccuguccgcc

SEQ ID NO: 1139868 - RNA, 21 nt, Human
cacauccucacuccaccccuc

SEQ ID NO: 1139869 - RNA, 23 nt, Human
caccccucauuacauccucugcc

SEQ ID NO: 1139870 - RNA, 23 nt, Human
caccuccaucuugaaccaggugg

SEQ ID NO: 1139871 - RNA, 23 nt, Human
cacuccaccccucauuacauccu

SEQ ID NO: 1139872 - RNA, 24 nt, Human
cacuucccuuuucucuacaccucc

SEQ ID NO: 1139873 - RNA, 20 nt, Human
cagacagaaaacuacgcucg

SEQ ID NO: 1139874 - RNA, 22 nt, Human
cagaggagccuggagaccgggc

SEQ ID NO: 1139875 - RNA, 18 nt, Human
cagcgugcggcgcugggg

SEQ ID NO: 1139876 - RNA, 25 nt, Human
cagcucccucuuccuccuccugcuu

SEQ ID NO: 1139877 - RNA, 21 nt, Human
caggcgccuccgucccggcca

SEQ ID NO: 1139878 - RNA, 19 nt, Human
cagggcaccaacucccugu

SEQ ID NO: 1139879 - RNA, 19 nt, Human
caggggacuggagaggccu

SEQ ID NO: 1139880 - RNA, 19 nt, Human
ccaaaaauguaaauuaagc

SEQ ID NO: 1139881 - RNA, 20 nt, Human
ccaccgccagggcugaccug

SEQ ID NO: 1139882 - RNA, 20 nt, Human
ccacuugcaggcagagucgu

SEQ ID NO: 1139883 - RNA, 19 nt, Human
ccaugccuuucuucacaga

SEQ ID NO: 1139884 - RNA, 21 nt, Human
ccccaagagcaguggggacac

SEQ ID NO: 1139885 - RNA, 19 nt, Human
ccccaccuuucccuucuuc

SEQ ID NO: 1139886 - RNA, 20 nt, Human
ccccaccuuucccuucuucc

SEQ ID NO: 1139887 - RNA, 18 nt, Human
ccccacuucccuuuucuc

SEQ ID NO: 1139888 - RNA, 21 nt, Human
ccccccacgccugggucccac

SEQ ID NO: 1139889 - RNA, 18 nt, Human
cccucacaggagccagaa

SEQ ID NO: 1139890 - RNA, 24 nt, Human
cccucacaggagccagaagugaag

SEQ ID NO: 1139891 - RNA, 19 nt, Human
cccugcagccugggccacc

SEQ ID NO: 1139892 - RNA, 22 nt, Human
ccucacaggagccagaagugaa

SEQ ID NO: 1139893 - RNA, 22 nt, Human
ccucagacagcaugggggccuc

SEQ ID NO: 1139894 - RNA, 23 nt, Human
ccuccugcuuucugccacccauc

SEQ ID NO: 1139895 - RNA, 21 nt, Human
ccuccuguucucuccccuccc

SEQ ID NO: 1139896 - RNA, 21 nt, Human
ccugcagccugggccaccauu

SEQ ID NO: 1139897 - RNA, 22 nt, Human
ccugcagccuucucucugucuc

SEQ ID NO: 1139898 - RNA, 25 nt, Human
ccugccguggacaagcccaggggac

SEQ ID NO: 1139899 - RNA, 20 nt, Human
ccuggggugccaugcuccau

SEQ ID NO: 1139900 - RNA, 19 nt, Human
ccugggucccaccugacuc

SEQ ID NO: 1139901 - RNA, 18 nt, Human
ccuguguugucugggcuu

SEQ ID NO: 1139902 - RNA, 20 nt, Human
cgccugggucccaccugacu

SEQ ID NO: 1139903 - RNA, 18 nt, Human
cggcauggacaccuugug

SEQ ID NO: 1139904 - RNA, 23 nt, Human
cgguagaauaggaggcgcucucu

SEQ ID NO: 1139905 - RNA, 20 nt, Human
cuccaaaaauguaaauuaag

SEQ ID NO: 1139906 - RNA, 21 nt, Human
cucccagagccuucauuucca

SEQ ID NO: 1139907 - RNA, 23 nt, Human
cucccugcagccuucucucuguc

SEQ ID NO: 1139908 - RNA, 22 nt, Human
cucuuccuccuccugcuuucug

SEQ ID NO: 1139909 - RNA, 23 nt, Human
cugaggccuccaccgugggccca

SEQ ID NO: 1139910 - RNA, 24 nt, Human
cugcagccugggccaccauggagg

SEQ ID NO: 1139911 - RNA, 18 nt, Human
cuggcccgggauccuccu

SEQ ID NO: 1139912 - RNA, 25 nt, Human
cugggcacucucuuacuuggcacug

SEQ ID NO: 1139913 - RNA, 18 nt, Human
cugggggugguggaggca

SEQ ID NO: 1139914 - RNA, 23 nt, Human
cuucuuccuguuggggcuugggg

SEQ ID NO: 1139915 - RNA, 24 nt, Human
cuugaaccagguggaauagccacc

SEQ ID NO: 1139916 - RNA, 22 nt, Human
gacacucggcaagggcacuuga

SEQ ID NO: 1139917 - RNA, 19 nt, Human
gagcaaggcaggugggauc

SEQ ID NO: 1139918 - RNA, 22 nt, Human
gagcaauguggccugcgucugc

SEQ ID NO: 1139919 - RNA, 24 nt, Human
gaggagccuggagaccgggcaggc

SEQ ID NO: 1139920 - RNA, 18 nt, Human
gauauuagaggguugagc

SEQ ID NO: 1139921 - RNA, 20 nt, Human
gcagcaggugaggccaccug

SEQ ID NO: 1139922 - RNA, 20 nt, Human
gcagccuucucucugucucu

SEQ ID NO: 1139923 - RNA, 19 nt, Human
gcccaccgugagcccugca

SEQ ID NO: 1139924 - RNA, 19 nt, Human
gcccaguccuuguucccca

SEQ ID NO: 1139925 - RNA, 19 nt, Human
gcccgggauccuccuguuc

SEQ ID NO: 1139926 - RNA, 25 nt, Human
gccggggccuccccaagagcagugg

SEQ ID NO: 1139927 - RNA, 20 nt, Human
gccugggucccaccugacuc

SEQ ID NO: 1139928 - RNA, 19 nt, Human
gcugcuugagaggagggag

SEQ ID NO: 1139929 - RNA, 20 nt, Human
gcugcuugagaggagggagg

SEQ ID NO: 1139930 - RNA, 19 nt, Human
gcuggggggauggaaugug

SEQ ID NO: 1139931 - RNA, 19 nt, Human
gcuuggggggugcagacaa

SEQ ID NO: 1139932 - RNA, 21 nt, Human
ggaucaggccaaccccagcuc

SEQ ID NO: 1139933 - RNA, 19 nt, Human
ggcacugagugagcgucag

SEQ ID NO: 1139934 - RNA, 19 nt, Human
ggcauguuggagguucuga

SEQ ID NO: 1139935 - RNA, 24 nt, Human
gggaaagauggggagaggcucugg

SEQ ID NO: 1139936 - RNA, 23 nt, Human
gggcaggcgccuccgucccggcc

SEQ ID NO: 1139937 - RNA, 19 nt, Human
gggggcagaggcagccgcg

SEQ ID NO: 1139938 - RNA, 21 nt, Human
gggugcagacaauuccagggg

SEQ ID NO: 1139939 - RNA, 22 nt, Human
gucagcuuccccaccuuucccu

SEQ ID NO: 1139940 - RNA, 23 nt, Human
guggcuguggcugugaggcucug

SEQ ID NO: 1139941 - RNA, 22 nt, Human
uacagugcccucacaggagcca

SEQ ID NO: 1139942 - RNA, 26 nt, Human
uacccuguccgccugguagggaaggc

SEQ ID NO: 1139943 - RNA, 19 nt, Human
uacccuuggggauccagcg

SEQ ID NO: 1139944 - RNA, 20 nt, Human
uacccuuggggauccagcgu

SEQ ID NO: 1139945 - RNA, 23 nt, Human
uauuugccacuugcaggcagagu

SEQ ID NO: 1139946 - RNA, 20 nt, Human
uauuuuuucugcugggggug

SEQ ID NO: 1139947 - RNA, 18 nt, Human
ucauuacauccucugccc

SEQ ID NO: 1139948 - RNA, 22 nt, Human
ucauuacauccucugcccuugg

SEQ ID NO: 1139949 - RNA, 19 nt, Human
uccagggacuaccaacucu

SEQ ID NO: 1139950 - RNA, 23 nt, Human
ucccaaauccagggacuaccaac

SEQ ID NO: 1139951 - RNA, 18 nt, Human
uccccaagagcagugggg

SEQ ID NO: 1139952 - RNA, 19 nt, Human
uccccacuucccuuuucuc

SEQ ID NO: 1139953 - RNA, 23 nt, Human
uccccacuucccuuuucucuaca

SEQ ID NO: 1139954 - RNA, 22 nt, Human
uccccccacgccugggucccac

SEQ ID NO: 1139955 - RNA, 20 nt, Human
uccccgagcaauguggccug

SEQ ID NO: 1139956 - RNA, 22 nt, Human
uccccucagacagcaugggggc

SEQ ID NO: 1139957 - RNA, 18 nt, Human
ucccuggggugccaugcu

SEQ ID NO: 1139958 - RNA, 25 nt, Human
ucggucagcucccucuuuccucggg

SEQ ID NO: 1139959 - RNA, 19 nt, Human
ucucugcucucucuccaca

SEQ ID NO: 1139960 - RNA, 18 nt, Human
ucuguaagcuucagauug

SEQ ID NO: 1139961 - RNA, 19 nt, Human
ucuuccuccuccugcuuuc

SEQ ID NO: 1139962 - RNA, 24 nt, Human
ucuuccuccuccugcuuucugcca

SEQ ID NO: 1139963 - RNA, 19 nt, Human
ugaaccagguggaauagcc

SEQ ID NO: 1139964 - RNA, 23 nt, Human
ugaaccagguggaauagccaccu

SEQ ID NO: 1139965 - RNA, 19 nt, Human
ugaauauuuguggcaacua

SEQ ID NO: 1139966 - RNA, 21 nt, Human
ugacucaacuuauuucaguau

SEQ ID NO: 1139967 - RNA, 21 nt, Human
ugagcccagagccuggcaccc

SEQ ID NO: 1139968 - RNA, 23 nt, Human
ugagcccagagccuggcacccag

SEQ ID NO: 1139969 - RNA, 24 nt, Human
ugagcccucaaucacggagggccu

SEQ ID NO: 1139970 - RNA, 27 nt, Human
ugaggcuggggagcguaggcugauucu

SEQ ID NO: 1139971 - RNA, 21 nt, Human
ugaguggcauggugcagcagg

SEQ ID NO: 1139972 - RNA, 27 nt, Human
ugcccuuggccugaaugaugucggcuc

SEQ ID NO: 1139973 - RNA, 21 nt, Human
ugccggggccuccccaagagc

SEQ ID NO: 1139974 - RNA, 23 nt, Human
ugccugaggccuccaccgugggc

SEQ ID NO: 1139975 - RNA, 23 nt, Human
ugcgggagacaccccgguuuucc

SEQ ID NO: 1139976 - RNA, 24 nt, Human
ugcugcagguuccuucccuucccg

SEQ ID NO: 1139977 - RNA, 18 nt, Human
ugcugggagggcacgcag

SEQ ID NO: 1139978 - RNA, 23 nt, Human
ugcugggagggcacgcaggccau

SEQ ID NO: 1139979 - RNA, 20 nt, Human
ugcugggggugguggaggcc

SEQ ID NO: 1139980 - RNA, 22 nt, Human
uggaauguguggauauuagagg

SEQ ID NO: 1139981 - RNA, 19 nt, Human
uggacaauacagugcccuc

SEQ ID NO: 1139982 - RNA, 18 nt, Human
uggaggugggggaggacu

SEQ ID NO: 1139983 - RNA, 18 nt, Human
ugggaucaggccaacccc

SEQ ID NO: 1139984 - RNA, 18 nt, Human
uggggagaggcucuggca

SEQ ID NO: 1139985 - RNA, 21 nt, Human
uggggcuggggggauggaaug

SEQ ID NO: 1139986 - RNA, 24 nt, Human
uggggcuggggggauggaaugugu

SEQ ID NO: 1139987 - RNA, 23 nt, Human
ugggggaggacugggccacacug

SEQ ID NO: 1139988 - RNA, 21 nt, Human
ugggggcagaggcagccgcgg

SEQ ID NO: 1139989 - RNA, 24 nt, Human
uggggggaaugccaggaauguggg

SEQ ID NO: 1139990 - RNA, 18 nt, Human
uggggggauggaaugugu

SEQ ID NO: 1139991 - RNA, 20 nt, Human
ugguagggaaggcagaagcu

SEQ ID NO: 1139992 - RNA, 20 nt, Human
ugguagggaaggcagaagcu

SEQ ID NO: 1139993 - RNA, 23 nt, Human
ugguguggcuguggcugugaggc

SEQ ID NO: 1139994 - RNA, 24 nt, Human
ugguguggcuguggcugugaggcu

SEQ ID NO: 1139995 - RNA, 20 nt, Human
ugucacugaagucacccugg

SEQ ID NO: 1139996 - RNA, 21 nt, Human
uguccuguuccccgagcaaug

SEQ ID NO: 1139997 - RNA, 20 nt, Human
ugugggugcugugggggcag

SEQ ID NO: 1139998 - RNA, 18 nt, Human
uguuggggcuuggggggu

SEQ ID NO: 1139999 - RNA, 22 nt, Human
uucccuggggugccaugcucca

SEQ ID NO: 1140000 - RNA, 21 nt, Human
uucucucccaaggccuucaaa

SEQ ID NO: 1140001 - RNA, 21 nt, Human
uucucuccccucccugcagcc

SEQ ID NO: 1140002 - RNA, 21 nt, Human
uugguguggcuguggcugugg

SEQ ID NO: 1140003 - RNA, 18 nt, Human
uuuuucuugggccucguu

SEQ ID NO: 1140004 - RNA, 19 nt, Human
acaagguggggagggcagg

SEQ ID NO: 1140005 - RNA, 20 nt, Human
agucugggucacaagguggg

SEQ ID NO: 1140006 - RNA, 24 nt, Human
agucugggucacaagguggggagg

SEQ ID NO: 1140007 - RNA, 19 nt, Human
cagccugaaccccgcccug

SEQ ID NO: 1140008 - RNA, 22 nt, Human
caggaaagaaucggggguggca

SEQ ID NO: 1140009 - RNA, 22 nt, Human
cugggucacaagguggggaggg

SEQ ID NO: 1140010 - RNA, 21 nt, Human
gcaacuacaucauuaaaaaua

SEQ ID NO: 1140011 - RNA, 20 nt, Human
ggcaggaaagaaucgggggu

SEQ ID NO: 1140012 - RNA, 27 nt, Human
uacuuuuaaccucaaaggcguguacuu

SEQ ID NO: 1140013 - RNA, 24 nt, Human
uggggagggcaggaaagaaucggg

SEQ ID NO: 1140014 - RNA, 25 nt, Human
uuaaaaauaccccagccugaacccc

SEQ ID NO: 1140015 - RNA, 27 nt, Human
uuaucugaaaacauucuuaauucaagc

SEQ ID NO: 1140016 - RNA, 21 nt, Human
aagcagacauuccagagcuca

SEQ ID NO: 1140017 - RNA, 18 nt, Human
aagcucaguucccucauc

SEQ ID NO: 1140018 - RNA, 22 nt, Human
agcaguuccugccucucagaau

SEQ ID NO: 1140019 - RNA, 22 nt, Human
caccagcugcuacccuggaagc

SEQ ID NO: 1140020 - RNA, 21 nt, Human
cccaccagcugcuacccugga

SEQ ID NO: 1140021 - RNA, 19 nt, Human
ccuggcccacccagccucu

SEQ ID NO: 1140022 - RNA, 22 nt, Human
ccuuggguuuacagcuacccag

SEQ ID NO: 1140023 - RNA, 18 nt, Human
cucacagaucaguguccc

SEQ ID NO: 1140024 - RNA, 21 nt, Human
gccucucagaauucuaagcag

SEQ ID NO: 1140025 - RNA, 24 nt, Human
uccugccucucagaauucuaagca

SEQ ID NO: 1140026 - RNA, 23 nt, Human
ucuaagcagacauuccagagcuc

SEQ ID NO: 1140027 - RNA, 19 nt, Human
aaaaacucuuuauucauuc

SEQ ID NO: 1140028 - RNA, 18 nt, Human
aagcaccacauaaggaua

SEQ ID NO: 1140029 - RNA, 21 nt, Human
aagcagacauuccagagcuca

SEQ ID NO: 1140030 - RNA, 22 nt, Human
aagcagugggauggucuugagg

SEQ ID NO: 1140031 - RNA, 22 nt, Human
acagagucugagggaacuggag

SEQ ID NO: 1140032 - RNA, 19 nt, Human
acucagcuucccaggagac

SEQ ID NO: 1140033 - RNA, 19 nt, Human
agaacggaggggcccgagc

SEQ ID NO: 1140034 - RNA, 20 nt, Human
agaaggagcugcugucagug

SEQ ID NO: 1140035 - RNA, 19 nt, Human
agacagaacggaggggccc

SEQ ID NO: 1140036 - RNA, 22 nt, Human
agacagaacggaggggcccgag

SEQ ID NO: 1140037 - RNA, 20 nt, Human
agaggcuagaagccagcacu

SEQ ID NO: 1140038 - RNA, 22 nt, Human
agcaguuccugccucucagaau

SEQ ID NO: 1140039 - RNA, 22 nt, Human
aggcacccagggcugagugcga

SEQ ID NO: 1140040 - RNA, 23 nt, Human
aggggggugcugcaggaaccccc

SEQ ID NO: 1140041 - RNA, 22 nt, Human
cacacgcaccugcacgcagccu

SEQ ID NO: 1140042 - RNA, 22 nt, Human
caccagcugcuacccuggaagc

SEQ ID NO: 1140043 - RNA, 19 nt, Human
cacccagggcugagugcga

SEQ ID NO: 1140044 - RNA, 21 nt, Human
cacccagggcugagugcgaga

SEQ ID NO: 1140045 - RNA, 28 nt, Human
cagcacucagcuucccaggagaccccaa

SEQ ID NO: 1140046 - RNA, 19 nt, Human
cagucacaucugagcagca

SEQ ID NO: 1140047 - RNA, 18 nt, Human
cagugcaccauggccccg

SEQ ID NO: 1140048 - RNA, 19 nt, Human
caucuccccccacacgcac

SEQ ID NO: 1140049 - RNA, 19 nt, Human
ccagaaggagcugcuguca

SEQ ID NO: 1140050 - RNA, 20 nt, Human
cccacacgcaccugcacgca

SEQ ID NO: 1140051 - RNA, 21 nt, Human
cccaccagcugcuacccugga

SEQ ID NO: 1140052 - RNA, 23 nt, Human
ccccaacuauugccgggccaagu

SEQ ID NO: 1140053 - RNA, 19 nt, Human
cccccggcaggcagugggg

SEQ ID NO: 1140054 - RNA, 19 nt, Human
cccucgucccacggcuccg

SEQ ID NO: 1140055 - RNA, 19 nt, Human
cccuggaagcuucagggag

SEQ ID NO: 1140056 - RNA, 24 nt, Human
ccucuagaccuuccagacuggguc

SEQ ID NO: 1140057 - RNA, 26 nt, Human
ccucuagaccuuccagacugggucca

SEQ ID NO: 1140058 - RNA, 18 nt, Human
cgcccucgucccacggcu

SEQ ID NO: 1140059 - RNA, 19 nt, Human
cggaggggcccgagcugaa

SEQ ID NO: 1140060 - RNA, 23 nt, Human
cggcaggcaguggggccaggcuu

SEQ ID NO: 1140061 - RNA, 18 nt, Human
cucacagaucaguguccc

SEQ ID NO: 1140062 - RNA, 21 nt, Human
cuggaguaggggggugcugca

SEQ ID NO: 1140063 - RNA, 21 nt, Human
gagauggcagggggcaagcag

SEQ ID NO: 1140064 - RNA, 23 nt, Human
gagggagacagaacggaggggcc

SEQ ID NO: 1140065 - RNA, 24 nt, Human
gccccgacacaguguggcaucucc

SEQ ID NO: 1140066 - RNA, 21 nt, Human
gccucucagaauucuaagcag

SEQ ID NO: 1140067 - RNA, 24 nt, Human
gcugcaggaacccccggcaggcag

SEQ ID NO: 1140068 - RNA, 21 nt, Human
ggagacagaacggaggggccc

SEQ ID NO: 1140069 - RNA, 22 nt, Human
ggagccuggaguaggggggugc

SEQ ID NO: 1140070 - RNA, 22 nt, Human
ggcaagcaggcaagcaguggga

SEQ ID NO: 1140071 - RNA, 20 nt, Human
ucacaggcacccagggcuga

SEQ ID NO: 1140072 - RNA, 21 nt, Human
ucagggagauggggagccugg

SEQ ID NO: 1140073 - RNA, 20 nt, Human
ucaucccucucagucacauc

SEQ ID NO: 1140074 - RNA, 33 nt, Human
ucccaggagaccccaacuauugccgggccaaga

SEQ ID NO: 1140075 - RNA, 24 nt, Human
uccugccucucagaauucuaagca

SEQ ID NO: 1140076 - RNA, 23 nt, Human
ucuaagcagacauuccagagcuc

SEQ ID NO: 1140077 - RNA, 19 nt, Human
ucuugagguguggggugag

SEQ ID NO: 1140078 - RNA, 19 nt, Human
ugagggaacuggagaggcc

SEQ ID NO: 1140079 - RNA, 19 nt, Human
ugagggaacuggagaggcu

SEQ ID NO: 1140080 - RNA, 21 nt, Human
ugcuacccuggaagcuucagg

SEQ ID NO: 1140081 - RNA, 19 nt, Human
ugcugcaggaacccccggc

SEQ ID NO: 1140082 - RNA, 19 nt, Human
uggaguaggggggugcugc

SEQ ID NO: 1140083 - RNA, 22 nt, Human
uggaguaggggggugcugcagg

SEQ ID NO: 1140084 - RNA, 25 nt, Human
uucuuuggguuuuuaauuauaaaca

SEQ ID NO: 1140085 - RNA, 28 nt, Human
aaacucuuuccaagcuguuugaccacac

SEQ ID NO: 1140086 - RNA, 22 nt, Human
aaguugcugcccacugacccgu

SEQ ID NO: 1140087 - RNA, 23 nt, Human
aauuacuucccaccaggccccac

SEQ ID NO: 1140088 - RNA, 23 nt, Human
acauccccaggaugagcugaggg

SEQ ID NO: 1140089 - RNA, 20 nt, Human
acaugcacuccccaaggcag

SEQ ID NO: 1140090 - RNA, 19 nt, Human
acccaauuacuucccacca

SEQ ID NO: 1140091 - RNA, 18 nt, Human
acucaucaccaaggggau

SEQ ID NO: 1140092 - RNA, 22 nt, Human
aggaguaagagagaaggggagg

SEQ ID NO: 1140093 - RNA, 22 nt, Human
aggcuccaucaccgggccccag

SEQ ID NO: 1140094 - RNA, 22 nt, Human
aggucuuagacucuuaaauaac

SEQ ID NO: 1140095 - RNA, 24 nt, Human
aucccgcuuagugacacuuugccg

SEQ ID NO: 1140096 - RNA, 18 nt, Human
aucgacacccuuagaugg

SEQ ID NO: 1140097 - RNA, 21 nt, Human
caaugagucucccucaggucu

SEQ ID NO: 1140098 - RNA, 19 nt, Human
cacaggcugugcagcuccg

SEQ ID NO: 1140099 - RNA, 21 nt, Human
cacccuuagauggcaguuuua

SEQ ID NO: 1140100 - RNA, 23 nt, Human
caccgggccccagccccuggcuc

SEQ ID NO: 1140101 - RNA, 19 nt, Human
cagccccuggcucucuccu

SEQ ID NO: 1140102 - RNA, 24 nt, Human
caggccccacuuccaacauuggga

SEQ ID NO: 1140103 - RNA, 21 nt, Human
ccaccaggccccacuuccaac

SEQ ID NO: 1140104 - RNA, 24 nt, Human
ccaucaccgggccccagccccugg

SEQ ID NO: 1140105 - RNA, 21 nt, Human
cccaccaggccccacuuccaa

SEQ ID NO: 1140106 - RNA, 20 nt, Human
cccagccccuggcucucucc

SEQ ID NO: 1140107 - RNA, 19 nt, Human
cccucugccauucucccau

SEQ ID NO: 1140108 - RNA, 21 nt, Human
ccgccacgcccucggcggucc

SEQ ID NO: 1140109 - RNA, 21 nt, Human
ccgccacgcccucggcggucc

SEQ ID NO: 1140110 - RNA, 20 nt, Human
ccgggccccagccccuggcc

SEQ ID NO: 1140111 - RNA, 20 nt, Human
cgcagcuccccagccggccu

SEQ ID NO: 1140112 - RNA, 24 nt, Human
cgccccagugcgugccucgggggc

SEQ ID NO: 1140113 - RNA, 18 nt, Human
cuccuccaacgcagcucc

SEQ ID NO: 1140114 - RNA, 18 nt, Human
cuccuccaacgcagcucc

SEQ ID NO: 1140115 - RNA, 24 nt, Human
cucuccaacacaugcacuccccaa

SEQ ID NO: 1140116 - RNA, 18 nt, Human
cucuuaaauaaccagauc

SEQ ID NO: 1140117 - RNA, 21 nt, Human
cuucccaccaggccccacuuc

SEQ ID NO: 1140118 - RNA, 21 nt, Human
gacuguuggggaucccucugc

SEQ ID NO: 1140119 - RNA, 20 nt, Human
gaguaagagagaaggggagg

SEQ ID NO: 1140120 - RNA, 22 nt, Human
gaucccucugccauucucccau

SEQ ID NO: 1140121 - RNA, 20 nt, Human
gccccuggcucucuccucca

SEQ ID NO: 1140122 - RNA, 23 nt, Human
gccccuggcucucuccuccaacg

SEQ ID NO: 1140123 - RNA, 20 nt, Human
gcucacaguucugcaggcuu

SEQ ID NO: 1140124 - RNA, 18 nt, Human
gcugcuucacagcaggug

SEQ ID NO: 1140125 - RNA, 23 nt, Human
ggacaggcucccgccacgcccuc

SEQ ID NO: 1140126 - RNA, 24 nt, Human
ggacaggcucccgccacgcccucg

SEQ ID NO: 1140127 - RNA, 18 nt, Human
ggccuguaaaaccgagga

SEQ ID NO: 1140128 - RNA, 18 nt, Human
gggagccaguauaucaca

SEQ ID NO: 1140129 - RNA, 18 nt, Human
gugacacuuugccguggg

SEQ ID NO: 1140130 - RNA, 24 nt, Human
uaccucguucgcaggcaaaggcug

SEQ ID NO: 1140131 - RNA, 24 nt, Human
uauaucacauagugagagcaggag

SEQ ID NO: 1140132 - RNA, 20 nt, Human
ucaccgggccccagccccug

SEQ ID NO: 1140133 - RNA, 21 nt, Human
ucaccgggccccagccccugg

SEQ ID NO: 1140134 - RNA, 21 nt, Human
uccaaacuacagcaaauccua

SEQ ID NO: 1140135 - RNA, 22 nt, Human
uccaacacaugcacuccccaag

SEQ ID NO: 1140136 - RNA, 19 nt, Human
uccaacgcagcuccccagc

SEQ ID NO: 1140137 - RNA, 18 nt, Human
ucccucaggucucugggu

SEQ ID NO: 1140138 - RNA, 22 nt, Human
ucccucaggucucugggucagc

SEQ ID NO: 1140139 - RNA, 23 nt, Human
uccucaggccuuggcgguugggg

SEQ ID NO: 1140140 - RNA, 27 nt, Human
ucucccaugagcagacauccccaggau

SEQ ID NO: 1140141 - RNA, 22 nt, Human
ucucugggucagccggcgcccc

SEQ ID NO: 1140142 - RNA, 24 nt, Human
ucucugggucagccggcgccccag

SEQ ID NO: 1140143 - RNA, 25 nt, Human
ucucugggucagccggcgccccagu

SEQ ID NO: 1140144 - RNA, 21 nt, Human
ucugcuucccaccucucucca

SEQ ID NO: 1140145 - RNA, 28 nt, Human
ugaaccauucauaagggaucugcccucc

SEQ ID NO: 1140146 - RNA, 22 nt, Human
ugacaugauacagggagaggag

SEQ ID NO: 1140147 - RNA, 21 nt, Human
ugcaaugagcaggccaaacuc

SEQ ID NO: 1140148 - RNA, 22 nt, Human
ugggggcagaaaugaaucugcc

SEQ ID NO: 1140149 - RNA, 20 nt, Human
ugggucagccggcgccccag

SEQ ID NO: 1140150 - RNA, 23 nt, Human
uucagagcggguccucccagacu

SEQ ID NO: 1140151 - RNA, 22 nt, Human
uuccugcauccuccuccauccc

SEQ ID NO: 1140152 - RNA, 21 nt, Human
uuuucaggaaguauggugcug

SEQ ID NO: 1140153 - RNA, 23 nt, Human
aaacagacaaaucauguugcagg

SEQ ID NO: 1140154 - RNA, 20 nt, Human
aacacggugaaacugcgucu

SEQ ID NO: 1140155 - RNA, 21 nt, Human
aacacggugaaacugcgucuc

SEQ ID NO: 1140156 - RNA, 21 nt, Human
aacagugacucccuaccacuc

SEQ ID NO: 1140157 - RNA, 21 nt, Human
aacaugcucugugauacagga

SEQ ID NO: 1140158 - RNA, 22 nt, Human
aaccaauucuucuuucggcacu

SEQ ID NO: 1140159 - RNA, 23 nt, Human
aaccuggacgacagagugggauu

SEQ ID NO: 1140160 - RNA, 24 nt, Human
aaucgcuugaacccgggaggcgga

SEQ ID NO: 1140161 - RNA, 19 nt, Human
acacggugaaacugcgucu

SEQ ID NO: 1140162 - RNA, 21 nt, Human
accucauaucccugaaggcug

SEQ ID NO: 1140163 - RNA, 24 nt, Human
accugaggucagggguucaagacc

SEQ ID NO: 1140164 - RNA, 24 nt, Human
acugcgucucuacuaaaaauauaa

SEQ ID NO: 1140165 - RNA, 22 nt, Human
agaaaucccauggauacaaugc

SEQ ID NO: 1140166 - RNA, 22 nt, Human
agaacagccuggaggaaaagca

SEQ ID NO: 1140167 - RNA, 20 nt, Human
agaacaugcucugugauaca

SEQ ID NO: 1140168 - RNA, 24 nt, Human
agacugaggcaggagaaucgcuug

SEQ ID NO: 1140169 - RNA, 18 nt, Human
agagacacagacccccac

SEQ ID NO: 1140170 - RNA, 23 nt, Human
agcacgguggcucacgccuguaa

SEQ ID NO: 1140171 - RNA, 18 nt, Human
agccagucgugguggcgg

SEQ ID NO: 1140172 - RNA, 19 nt, Human
agccuggucaacacgguga

SEQ ID NO: 1140173 - RNA, 22 nt, Human
aggagucagcgcacaagccacg

SEQ ID NO: 1140174 - RNA, 24 nt, Human
aggcaggagaaucgcuugaacccg

SEQ ID NO: 1140175 - RNA, 18 nt, Human
aggcaggcggaucaccug

SEQ ID NO: 1140176 - RNA, 22 nt, Human
aggcaggcggaucaccugaggu

SEQ ID NO: 1140177 - RNA, 26 nt, Human
aggcaggcggaucaccugaggucagg

SEQ ID NO: 1140178 - RNA, 21 nt, Human
aggcggagguugcaaugagcc

SEQ ID NO: 1140179 - RNA, 24 nt, Human
aggcggagguugcaaugagccgag

SEQ ID NO: 1140180 - RNA, 21 nt, Human
aggucagggguucaagaccag

SEQ ID NO: 1140181 - RNA, 24 nt, Human
aucaccugaggucagggguucaag

SEQ ID NO: 1140182 - RNA, 20 nt, Human
aucuccugcaggcuccugcg

SEQ ID NO: 1140183 - RNA, 24 nt, Human
auugcacucuaaccuggacgacag

SEQ ID NO: 1140184 - RNA, 22 nt, Human
caacacggugaaacugcgucuc

SEQ ID NO: 1140185 - RNA, 23 nt, Human
caccugaggucagggguucaaga

SEQ ID NO: 1140186 - RNA, 20 nt, Human
caccuggugccccagacccu

SEQ ID NO: 1140187 - RNA, 24 nt, Human
cacgccuguaaucccagcacuuug

SEQ ID NO: 1140188 - RNA, 23 nt, Human
cacucuaaccuggacgacagagu

SEQ ID NO: 1140189 - RNA, 24 nt, Human
cagagcccggucccugcagccugu

SEQ ID NO: 1140190 - RNA, 24 nt, Human
cagcacuuugggagaccgaggcag

SEQ ID NO: 1140191 - RNA, 25 nt, Human
cagcacuuugggagaccgaggcagg

SEQ ID NO: 1140192 - RNA, 27 nt, Human
caggcggaucaccugaggucagggguu

SEQ ID NO: 1140193 - RNA, 19 nt, Human
cauugcacucuaaccugga

SEQ ID NO: 1140194 - RNA, 21 nt, Human
cauugcacucuaaccuggacg

SEQ ID NO: 1140195 - RNA, 22 nt, Human
cauugcacucuaaccuggacga

SEQ ID NO: 1140196 - RNA, 24 nt, Human
cauugcacucuaaccuggacgaca

SEQ ID NO: 1140197 - RNA, 21 nt, Human
ccacgguccccuggccccggc

SEQ ID NO: 1140198 - RNA, 23 nt, Human
ccaucuagagcucccugcuggca

SEQ ID NO: 1140199 - RNA, 18 nt, Human
ccauugcacucuaaccug

SEQ ID NO: 1140200 - RNA, 19 nt, Human
ccauugcacucuaaccugg

SEQ ID NO: 1140201 - RNA, 24 nt, Human
ccauugcacucuaaccuggacgac

SEQ ID NO: 1140202 - RNA, 18 nt, Human
cccucccuuuccuuuucc

SEQ ID NO: 1140203 - RNA, 21 nt, Human
cccugaaggcugccauggucu

SEQ ID NO: 1140204 - RNA, 24 nt, Human
ccuaagaaauaaaaccuugcaaau

SEQ ID NO: 1140205 - RNA, 21 nt, Human
ccuauaaucccagcuacucgg

SEQ ID NO: 1140206 - RNA, 22 nt, Human
ccuauaaucccagcuacucggg

SEQ ID NO: 1140207 - RNA, 23 nt, Human
ccucccucccuuuccuuuuccca

SEQ ID NO: 1140208 - RNA, 22 nt, Human
ccugaggucagggguucaagac

SEQ ID NO: 1140209 - RNA, 18 nt, Human
ccugcagccuguggggag

SEQ ID NO: 1140210 - RNA, 20 nt, Human
ccuggucaacacggugaaac

SEQ ID NO: 1140211 - RNA, 22 nt, Human
cgagaucaagccauugcacucc

SEQ ID NO: 1140212 - RNA, 20 nt, Human
cgaggcaggcggaucaccug

SEQ ID NO: 1140213 - RNA, 26 nt, Human
cgaggcaggcggaucaccugagguca

SEQ ID NO: 1140214 - RNA, 23 nt, Human
cgccuauaaucccagcuacucgg

SEQ ID NO: 1140215 - RNA, 24 nt, Human
cgccuauaaucccagcuacucggg

SEQ ID NO: 1140216 - RNA, 23 nt, Human
cgccuguaaucccagcacuuugg

SEQ ID NO: 1140217 - RNA, 24 nt, Human
cgccuguaaucccagcacuuuggg

SEQ ID NO: 1140218 - RNA, 24 nt, Human
cggaucaccugaggucagggguuc

SEQ ID NO: 1140219 - RNA, 23 nt, Human
cgucaacaacggguauuguggaa

SEQ ID NO: 1140220 - RNA, 19 nt, Human
cgugcgguggccucuccuc

SEQ ID NO: 1140221 - RNA, 22 nt, Human
cucacgccuguaaucccagcac

SEQ ID NO: 1140222 - RNA, 24 nt, Human
cucacgccuguaaucccagcacuu

SEQ ID NO: 1140223 - RNA, 22 nt, Human
cuggccacgcggcgcuccaagu

SEQ ID NO: 1140224 - RNA, 21 nt, Human
gaaaagcagccucguucuguu

SEQ ID NO: 1140225 - RNA, 23 nt, Human
gagaaucgcuugaacccgggagg

SEQ ID NO: 1140226 - RNA, 19 nt, Human
gagcacgcccuuaccgagc

SEQ ID NO: 1140227 - RNA, 22 nt, Human
gagguugcaaugagccgagauc

SEQ ID NO: 1140228 - RNA, 23 nt, Human
gaucaccugaggucagggguuca

SEQ ID NO: 1140229 - RNA, 24 nt, Human
gaucaccugaggucagggguucaa

SEQ ID NO: 1140230 - RNA, 23 nt, Human
gaucuguggcuuucauuuuccuc

SEQ ID NO: 1140231 - RNA, 19 nt, Human
gcaaugagccgagaucaag

SEQ ID NO: 1140232 - RNA, 19 nt, Human
gcccagcacgguggcucac

SEQ ID NO: 1140233 - RNA, 22 nt, Human
gcccagcacgguggcucacgcc

SEQ ID NO: 1140234 - RNA, 24 nt, Human
gccggccucccucccuuuccuuuu

SEQ ID NO: 1140235 - RNA, 20 nt, Human
gcgggcgccuauaaucccag

SEQ ID NO: 1140236 - RNA, 25 nt, Human
gcuguguauguuuugaauaugaguu

SEQ ID NO: 1140237 - RNA, 18 nt, Human
ggagguugcaaugagccg

SEQ ID NO: 1140238 - RNA, 24 nt, Human
ggagguugcaaugagccgagauca

SEQ ID NO: 1140239 - RNA, 22 nt, Human
ggaucaccugaggucagggguu

SEQ ID NO: 1140240 - RNA, 23 nt, Human
ggaucaccugaggucagggguuc

SEQ ID NO: 1140241 - RNA, 20 nt, Human
ggggaugggguguucugaga

SEQ ID NO: 1140242 - RNA, 23 nt, Human
gguggcucacgccuguaauccca

SEQ ID NO: 1140243 - RNA, 24 nt, Human
gguggcucacgccuguaaucccag

SEQ ID NO: 1140244 - RNA, 22 nt, Human
gucaacaacggguauuguggaa

SEQ ID NO: 1140245 - RNA, 18 nt, Human
guccuuguccuucacuca

SEQ ID NO: 1140246 - RNA, 23 nt, Human
guggcucacgccuguaaucccag

SEQ ID NO: 1140247 - RNA, 18 nt, Human
guugcaaugagccgagau

SEQ ID NO: 1140248 - RNA, 20 nt, Human
uaaccuggacgacagagugg

SEQ ID NO: 1140249 - RNA, 24 nt, Human
uaccuucugcugguuacccagagc

SEQ ID NO: 1140250 - RNA, 22 nt, Human
ucaggagucagcgcacaagccg

SEQ ID NO: 1140251 - RNA, 18 nt, Human
ucaggcuccuguagagga

SEQ ID NO: 1140252 - RNA, 19 nt, Human
uccaaaauguccuugcaca

SEQ ID NO: 1140253 - RNA, 27 nt, Human
ucccugaaggcugccauggucuccacc

SEQ ID NO: 1140254 - RNA, 18 nt, Human
ucccuuuccuuuucccaa

SEQ ID NO: 1140255 - RNA, 19 nt, Human
uccuucacucaggcuccug

SEQ ID NO: 1140256 - RNA, 19 nt, Human
uccuucacucaggcuccug

SEQ ID NO: 1140257 - RNA, 19 nt, Human
uccuuguccuucacucagg

SEQ ID NO: 1140258 - RNA, 24 nt, Human
ucgcuugaacccgggaggcggagg

SEQ ID NO: 1140259 - RNA, 22 nt, Human
ucgugcgguggccucuccucuc

SEQ ID NO: 1140260 - RNA, 24 nt, Human
ucuaaccuggacgacagaguggga

SEQ ID NO: 1140261 - RNA, 23 nt, Human
ucuccaccacgguccccuggccc

SEQ ID NO: 1140262 - RNA, 23 nt, Human
ucuccaucgcuucuuccguucgu

SEQ ID NO: 1140263 - RNA, 18 nt, Human
ucuccugcaggcuccugc

SEQ ID NO: 1140264 - RNA, 21 nt, Human
ucuccugcaggcuccugcggu

SEQ ID NO: 1140265 - RNA, 23 nt, Human
ucucuacuaaaaauauaaaaauu

SEQ ID NO: 1140266 - RNA, 18 nt, Human
ucugcugguuacccagag

SEQ ID NO: 1140267 - RNA, 18 nt, Human
ucuggguuucuguuuucu

SEQ ID NO: 1140268 - RNA, 20 nt, Human
ugaggcaggagaaucgcuug

SEQ ID NO: 1140269 - RNA, 24 nt, Human
ugaggcaggagaaucgcuugaacc

SEQ ID NO: 1140270 - RNA, 25 nt, Human
ugaggcaggagaaucgcuugaaccc

SEQ ID NO: 1140271 - RNA, 22 nt, Human
ugcaaugagccgagaucaagcc

SEQ ID NO: 1140272 - RNA, 24 nt, Human
ugcacucuaaccuggacgacagag

SEQ ID NO: 1140273 - RNA, 20 nt, Human
ugccccagacccucugagau

SEQ ID NO: 1140274 - RNA, 19 nt, Human
ugcgguuucccugcuccgu

SEQ ID NO: 1140275 - RNA, 22 nt, Human
uggcucacgccuguaaucccag

SEQ ID NO: 1140276 - RNA, 24 nt, Human
uggcucacgccuguaaucccagca

SEQ ID NO: 1140277 - RNA, 24 nt, Human
ugggagaccgaggcaggcggauca

SEQ ID NO: 1140278 - RNA, 22 nt, Human
uggggagagacacagaccccca

SEQ ID NO: 1140279 - RNA, 24 nt, Human
uguccuucacucaggcuccuguag

SEQ ID NO: 1140280 - RNA, 23 nt, Human
uguccuugcacauuuacaaucuc

SEQ ID NO: 1140281 - RNA, 20 nt, Human
uucucuggccacgcggcgcu

SEQ ID NO: 1140282 - RNA, 24 nt, Human
uucucuggccacgcggcgcuccaa

SEQ ID NO: 1140283 - RNA, 21 nt, Human
uucuguuaccuucugcugguu

SEQ ID NO: 1140284 - RNA, 18 nt, Human
uucuguuuucuuuaugac

SEQ ID NO: 1140285 - RNA, 24 nt, Human
uugaacccgggaggcggagguugc

SEQ ID NO: 1140286 - RNA, 25 nt, Human
uugcaaugagccgagaucaagccau

SEQ ID NO: 1140287 - RNA, 18 nt, Human
uuggcccagcacgguggc

SEQ ID NO: 1140288 - RNA, 19 nt, Human
uuuaaaauugauuuuuggc

SEQ ID NO: 1140289 - RNA, 24 nt, Human
aaacaugacgcagccacaaaagau

SEQ ID NO: 1140290 - RNA, 19 nt, Human
aaauggaagaaagaaaucu

SEQ ID NO: 1140291 - RNA, 24 nt, Human
aacacgcccaccuuuaaggaacaa

SEQ ID NO: 1140292 - RNA, 20 nt, Human
aagaaagaaaucucaaaaga

SEQ ID NO: 1140293 - RNA, 19 nt, Human
aauuuguccuccuugucac

SEQ ID NO: 1140294 - RNA, 23 nt, Human
acacacacacacacacacacaca

SEQ ID NO: 1140295 - RNA, 23 nt, Human
acacacacacacacacacacaca

SEQ ID NO: 1140296 - RNA, 23 nt, Human
acacacacacacacacacacaca

SEQ ID NO: 1140297 - RNA, 23 nt, Human
acacacacacacacacacacaca

SEQ ID NO: 1140298 - RNA, 23 nt, Human
acacacacacacacacacacaca

SEQ ID NO: 1140299 - RNA, 23 nt, Human
acacacacacacacacacacaca

SEQ ID NO: 1140300 - RNA, 23 nt, Human
acacacacacacacacacacaca

SEQ ID NO: 1140301 - RNA, 23 nt, Human
acacacacacacacacacacaca

SEQ ID NO: 1140302 - RNA, 23 nt, Human
acacacacacacacacacacaca

SEQ ID NO: 1140303 - RNA, 23 nt, Human
acacacacacacacacacacaca

SEQ ID NO: 1140304 - RNA, 24 nt, Human
acacacacacacacacacacaccc

SEQ ID NO: 1140305 - RNA, 23 nt, Human
acacuggaaccuucuggaagaua

SEQ ID NO: 1140306 - RNA, 25 nt, Human
accacugccccccauuuugcaccag

SEQ ID NO: 1140307 - RNA, 26 nt, Human
agaaagaaaucucaaaagauuacaga

SEQ ID NO: 1140308 - RNA, 20 nt, Human
agacacaaccacugcccccc

SEQ ID NO: 1140309 - RNA, 27 nt, Human
auguacaaacacacacacacacacaca

SEQ ID NO: 1140310 - RNA, 18 nt, Human
caaguaguaagaaggaua

SEQ ID NO: 1140311 - RNA, 20 nt, Human
cacacacacacacacacaca

SEQ ID NO: 1140312 - RNA, 20 nt, Human
cacacacacacacacacaca

SEQ ID NO: 1140313 - RNA, 20 nt, Human
cacacacacacacacacaca

SEQ ID NO: 1140314 - RNA, 20 nt, Human
cacacacacacacacacaca

SEQ ID NO: 1140315 - RNA, 20 nt, Human
cacacacacacacacacaca

SEQ ID NO: 1140316 - RNA, 20 nt, Human
cacacacacacacacacaca

SEQ ID NO: 1140317 - RNA, 20 nt, Human
cacacacacacacacacaca

SEQ ID NO: 1140318 - RNA, 20 nt, Human
cacacacacacacacacaca

SEQ ID NO: 1140319 - RNA, 20 nt, Human
cacacacacacacacacaca

SEQ ID NO: 1140320 - RNA, 20 nt, Human
cacacacacacacacacaca

SEQ ID NO: 1140321 - RNA, 20 nt, Human
cacacacacacacacacaca

SEQ ID NO: 1140322 - RNA, 20 nt, Human
cacacacacacacacacaca

SEQ ID NO: 1140323 - RNA, 20 nt, Human
cacacacacacacacacaca

SEQ ID NO: 1140324 - RNA, 20 nt, Human
cacacacacacacacacaca

SEQ ID NO: 1140325 - RNA, 22 nt, Human
cacacacacacacacacacaca

SEQ ID NO: 1140326 - RNA, 22 nt, Human
cacacacacacacacacacaca

SEQ ID NO: 1140327 - RNA, 22 nt, Human
cacacacacacacacacacaca

SEQ ID NO: 1140328 - RNA, 22 nt, Human
cacacacacacacacacacaca

SEQ ID NO: 1140329 - RNA, 22 nt, Human
cacacacacacacacacacaca

SEQ ID NO: 1140330 - RNA, 26 nt, Human
cacacacacacacacacacacacaca

SEQ ID NO: 1140331 - RNA, 26 nt, Human
cacacacacacacacacacacacaca

SEQ ID NO: 1140332 - RNA, 26 nt, Human
cacacacacacacacacacacacaca

SEQ ID NO: 1140333 - RNA, 26 nt, Human
cacacacacacacacacacacacaca

SEQ ID NO: 1140334 - RNA, 26 nt, Human
cacacacacacacacacacacacaca

SEQ ID NO: 1140335 - RNA, 26 nt, Human
cacacacacacacacacacacacaca

SEQ ID NO: 1140336 - RNA, 26 nt, Human
cacacacacacacacacacacacaca

SEQ ID NO: 1140337 - RNA, 26 nt, Human
cacacacacacacacacacacacaca

SEQ ID NO: 1140338 - RNA, 30 nt, Human; identical to SEQ ID NO: 326474

SEQ ID NO: 1140339 - RNA, 28 nt, Human
cacacacacacacacacacacacaccca

SEQ ID NO: 1140340 - RNA, 27 nt, Human
cacacacacacacacccauaucuuuuc

SEQ ID NO: 1140341 - RNA, 23 nt, Human
cacgcccaccuuuaaggaacaag

SEQ ID NO: 1140342 - RNA, 24 nt, Human
cacgcccaccuuuaaggaacaagg

SEQ ID NO: 1140343 - RNA, 18 nt, Human
cacugcucuccagaaugg

SEQ ID NO: 1140344 - RNA, 19 nt, Human
cagaaacuuggccccagac

SEQ ID NO: 1140345 - RNA, 18 nt, Human
caggacagaaacuuggcc

SEQ ID NO: 1140346 - RNA, 19 nt, Human
cauguuguuucugauauuc

SEQ ID NO: 1140347 - RNA, 20 nt, Human
ccacaacacgcccaccuuua

SEQ ID NO: 1140348 - RNA, 22 nt, Human
ccacugccccccauuuugcacc

SEQ ID NO: 1140349 - RNA, 23 nt, Human
cccaagaaaaggcaaggaggagg

SEQ ID NO: 1140350 - RNA, 21 nt, Human
cccacacaacccucagaccca

SEQ ID NO: 1140351 - RNA, 23 nt, Human
ccccauuuugcaccagccaaaaa

SEQ ID NO: 1140352 - RNA, 24 nt, Human
cccccgcuacauaaccaucucuag

SEQ ID NO: 1140353 - RNA, 20 nt, Human
ccucagacccauacuggccg

SEQ ID NO: 1140354 - RNA, 19 nt, Human
ccuccaguuacaaucuagc

SEQ ID NO: 1140355 - RNA, 20 nt, Human
cucacaaguaguaagaagga

SEQ ID NO: 1140356 - RNA, 18 nt, Human
cucagggaggggaaacgg

SEQ ID NO: 1140357 - RNA, 23 nt, Human
cugaaccaaugcccacacaaccc

SEQ ID NO: 1140358 - RNA, 19 nt, Human
cuuccacaacacgcccacc

SEQ ID NO: 1140359 - RNA, 22 nt, Human
cuugaaaacaugacgcagccac

SEQ ID NO: 1140360 - RNA, 24 nt, Human
cuuuccugugcuuccacaacacgc

SEQ ID NO: 1140361 - RNA, 21 nt, Human
gacacaaccacugccccccau

SEQ ID NO: 1140362 - RNA, 18 nt, Human
gagcuagacccaaaaagu

SEQ ID NO: 1140363 - RNA, 21 nt, Human
gagguggauuugguucggcuu

SEQ ID NO: 1140364 - RNA, 22 nt, Human
gauaccuguaccuccaguuaca

SEQ ID NO: 1140365 - RNA, 24 nt, Human
gcacagcccaagaaaaggcaagga

SEQ ID NO: 1140366 - RNA, 19 nt, Human
ggacagaaacuuggcccca

SEQ ID NO: 1140367 - RNA, 19 nt, Human
ggagguggauuugguucgg

SEQ ID NO: 1140368 - RNA, 24 nt, Human
guauguacaaacacacacacacac

SEQ ID NO: 1140369 - RNA, 29 nt, Human
guauguacaaacacacacacacacacaca

SEQ ID NO: 1140370 - RNA, 28 nt, Human
guggagcccaggccuuacauggguggcg

SEQ ID NO: 1140371 - RNA, 25 nt, Human
guuacaaucuagcauggaguugauu

SEQ ID NO: 1140372 - RNA, 24 nt, Human
guuuuucucacuucagaauucagg

SEQ ID NO: 1140373 - RNA, 21 nt, Human
uaagaaggauacuuccuggca

SEQ ID NO: 1140374 - RNA, 24 nt, Human
uaagacaaaacccuucuucuuuga

SEQ ID NO: 1140375 - RNA, 31 nt, Human
uacaaacacacacacacacacacacacacag

SEQ ID NO: 1140376 - RNA, 19 nt, Human
uaguaagaaggauacuucc

SEQ ID NO: 1140377 - RNA, 26 nt, Human
uauguacaaacacacacacacacaca

SEQ ID NO: 1140378 - RNA, 19 nt, Human
ucagacccauacuggccgg

SEQ ID NO: 1140379 - RNA, 21 nt, Human
ucagacccauacuggccgggc

SEQ ID NO: 1140380 - RNA, 22 nt, Human
uccacaacacgcccaccuuuaa

SEQ ID NO: 1140381 - RNA, 24 nt, Human
uccacaacacgcccaccuuuaagg

SEQ ID NO: 1140382 - RNA, 23 nt, Human
uccguuuacaugaaaugcccaga

SEQ ID NO: 1140383 - RNA, 21 nt, Human
ucuacauaacuaucuaugccu

SEQ ID NO: 1140384 - RNA, 24 nt, Human
ugaaagcacagcccaagaaaaggc

SEQ ID NO: 1140385 - RNA, 19 nt, Human
ugaaaugcccagaauaagc

SEQ ID NO: 1140386 - RNA, 23 nt, Human
ugaaaugcccagaauaagcaaau

SEQ ID NO: 1140387 - RNA, 23 nt, Human
ugacgcagccacaaaagaucaca

SEQ ID NO: 1140388 - RNA, 21 nt, Human
ugcacacacacaggucccgcg

SEQ ID NO: 1140389 - RNA, 21 nt, Human
ugcauuguugcaguagaaauu

SEQ ID NO: 1140390 - RNA, 24 nt, Human
uggagcccaggccuuacaugggug

SEQ ID NO: 1140391 - RNA, 24 nt, Human
uggcaggccaagagccauggcaga

SEQ ID NO: 1140392 - RNA, 23 nt, Human
ugucaccaggauauaaucagagg

SEQ ID NO: 1140393 - RNA, 31 nt, Human
ugugcugaaccaaugcccacacaacccucag

SEQ ID NO: 1140394 - RNA, 20 nt, Human
uugauucuacccuccucugu

SEQ ID NO: 1140395 - RNA, 19 nt, Human
uuugagaauaacuuuccug

SEQ ID NO: 1140396 - RNA, 21 nt, Human
aaacaagccagcacaacuaac

SEQ ID NO: 1140397 - RNA, 18 nt, Human
aaaccgucucugcccucc

SEQ ID NO: 1140398 - RNA, 18 nt, Human
aacaaagucagaaggagc

SEQ ID NO: 1140399 - RNA, 24 nt, Human
aacaaagucagaaggagcaaaauc

SEQ ID NO: 1140400 - RNA, 19 nt, Human
aaccaugucagugcagccu

SEQ ID NO: 1140401 - RNA, 22 nt, Human
aagauacuuuuguaagcuguga

SEQ ID NO: 1140402 - RNA, 21 nt, Human
aagcugcaaccacagacccag

SEQ ID NO: 1140403 - RNA, 22 nt, Human
aagcuucggcugacuuucucaa

SEQ ID NO: 1140404 - RNA, 24 nt, Human
aaugaggaaacaaagucagaagga

SEQ ID NO: 1140405 - RNA, 19 nt, Human
aaugaggggacugugggug

SEQ ID NO: 1140406 - RNA, 21 nt, Human
acaaugacaacaacaaaacaa

SEQ ID NO: 1140407 - RNA, 25 nt, Human
acagagcaagauccucucucuuaaa

SEQ ID NO: 1140408 - RNA, 23 nt, Human
accaacaaugacaacaacaaaac

SEQ ID NO: 1140409 - RNA, 19 nt, Human
acccaguccggcacucugc

SEQ ID NO: 1140410 - RNA, 24 nt, Human
acccgguagcugugcgcuuguucc

SEQ ID NO: 1140411 - RNA, 29 nt, Human
accuugccucuccguucagaaccccagcc

SEQ ID NO: 1140412 - RNA, 24 nt, Human
acugcacucuagccuggacaacag

SEQ ID NO: 1140413 - RNA, 24 nt, Human
acugcacucuagccuggacaacag

SEQ ID NO: 1140414 - RNA, 20 nt, Human
acuugggaggcagagggagg

SEQ ID NO: 1140415 - RNA, 19 nt, Human
acuugggcagcauuugaaa

SEQ ID NO: 1140416 - RNA, 24 nt, Human
acuuguuuaaaauuuccauugaaa

SEQ ID NO: 1140417 - RNA, 18 nt, Human
agaaaacaggcauauucu

SEQ ID NO: 1140418 - RNA, 19 nt, Human
agagcccauacuugggcag

SEQ ID NO: 1140419 - RNA, 24 nt, Human
agaugcgguggcucacgccuguaa

SEQ ID NO: 1140420 - RNA, 24 nt, Human
agcacuuugggaggcugagguggg

SEQ ID NO: 1140421 - RNA, 23 nt, Human
agccagguuugguagugcaugcc

SEQ ID NO: 1140422 - RNA, 19 nt, Human
agccauucccaccuugccu

SEQ ID NO: 1140423 - RNA, 24 nt, Human
aggacugcuugaggccaggaguuc

SEQ ID NO: 1140424 - RNA, 20 nt, Human
aggagccggugggcagcccu

SEQ ID NO: 1140425 - RNA, 24 nt, Human
aggauuacuugagcccaggaguuu

SEQ ID NO: 1140426 - RNA, 19 nt, Human
aggcagagggaggaggauu

SEQ ID NO: 1140427 - RNA, 24 nt, Human
aggcugaggugggaggacugcuug

SEQ ID NO: 1140428 - RNA, 23 nt, Human
aggugggaggacugcuugaggcc

SEQ ID NO: 1140429 - RNA, 24 nt, Human
aguacuuugggaggcugagguggg

SEQ ID NO: 1140430 - RNA, 23 nt, Human
aguggcuuauguuuguaauccca

SEQ ID NO: 1140431 - RNA, 24 nt, Human
aguggcuuauguuuguaaucccag

SEQ ID NO: 1140432 - RNA, 24 nt, Human
aucacaccacugcacucuagccug

SEQ ID NO: 1140433 - RNA, 24 nt, Human
auuacuugagcccaggaguuugag

SEQ ID NO: 1140434 - RNA, 19 nt, Human
caaaacaagccagcacaac

SEQ ID NO: 1140435 - RNA, 18 nt, Human
caaacagggcugaaaaua

SEQ ID NO: 1140436 - RNA, 19 nt, Human
caaaccgucucugcccucc

SEQ ID NO: 1140437 - RNA, 23 nt, Human
caauguaagcuccaucaagauca

SEQ ID NO: 1140438 - RNA, 22 nt, Human
cacacgacucucacuacuugaa

SEQ ID NO: 1140439 - RNA, 24 nt, Human
cacaggcccacugaaagggacaaa

SEQ ID NO: 1140440 - RNA, 24 nt, Human
caccacugcacucuagccuggaca

SEQ ID NO: 1140441 - RNA, 24 nt, Human
cacgccuguaaucccagcacuuug

SEQ ID NO: 1140442 - RNA, 18 nt, Human
cacugcacucuagccugg

SEQ ID NO: 1140443 - RNA, 19 nt, Human
cacugcacucuagccugga

SEQ ID NO: 1140444 - RNA, 21 nt, Human
cacugcacucuagccuggaca

SEQ ID NO: 1140445 - RNA, 24 nt, Human
cacugcacucuagccuggacaaca

SEQ ID NO: 1140446 - RNA, 24 nt, Human
cagcacuuugggaggcugaggugg

SEQ ID NO: 1140447 - RNA, 18 nt, Human
cagcagcccuggccagug

SEQ ID NO: 1140448 - RNA, 21 nt, Human
caggagccggugggcagcccu

SEQ ID NO: 1140449 - RNA, 24 nt, Human
caggagccggugggcagcccugag

SEQ ID NO: 1140450 - RNA, 24 nt, Human
caguacuuugggaggcugaggugg

SEQ ID NO: 1140451 - RNA, 19 nt, Human
ccacugcacucuagccugg

SEQ ID NO: 1140452 - RNA, 19 nt, Human
ccacugcacucuagccugg

SEQ ID NO: 1140453 - RNA, 21 nt, Human
ccacugcacucuagccuggac

SEQ ID NO: 1140454 - RNA, 18 nt, Human
ccauggcccacccaucuc

SEQ ID NO: 1140455 - RNA, 23 nt, Human
cccgugaggcugcagaggaggug

SEQ ID NO: 1140456 - RNA, 19 nt, Human
ccguucagaaccccagcug

SEQ ID NO: 1140457 - RNA, 20 nt, Human
ccucuugguagccauugcuu

SEQ ID NO: 1140458 - RNA, 20 nt, Human
ccugcuuccagagugcccag

SEQ ID NO: 1140459 - RNA, 21 nt, Human
ccuguagucccagcuacuugg

SEQ ID NO: 1140460 - RNA, 18 nt, Human
ccuugacuaggccacuuc

SEQ ID NO: 1140461 - RNA, 23 nt, Human
cgccuguaaucccagcacuuugg

SEQ ID NO: 1140462 - RNA, 24 nt, Human
cgccuguaaucccagcacuuuggg

SEQ ID NO: 1140463 - RNA, 19 nt, Human
cguggacacagucucuagu

SEQ ID NO: 1140464 - RNA, 24 nt, Human
cuaaagcuucggcugacuuucuca

SEQ ID NO: 1140465 - RNA, 23 nt, Human
cuagaaaauauguugauucuuag

SEQ ID NO: 1140466 - RNA, 26 nt, Human
cuagagcccauacuugggcagcauug

SEQ ID NO: 1140467 - RNA, 22 nt, Human
cucacgccuguaaucccagcac

SEQ ID NO: 1140468 - RNA, 24 nt, Human
cucacgccuguaaucccagcacuu

SEQ ID NO: 1140469 - RNA, 20 nt, Human
cucauacauucccuucauuu

SEQ ID NO: 1140470 - RNA, 20 nt, Human
cuccaaaacaagccagcaca

SEQ ID NO: 1140471 - RNA, 18 nt, Human
cugcuguauuuuuaguug

SEQ ID NO: 1140472 - RNA, 19 nt, Human
cugcuuccagagugcccag

SEQ ID NO: 1140473 - RNA, 23 nt, Human
cuuauguuuguaaucccaguacu

SEQ ID NO: 1140474 - RNA, 21 nt, Human
cuucagggucuugaugccacu

SEQ ID NO: 1140475 - RNA, 21 nt, Human
gaaugguaauauccuuagaau

SEQ ID NO: 1140476 - RNA, 24 nt, Human
gacugcuugaggccaggaguucaa

SEQ ID NO: 1140477 - RNA, 20 nt, Human
gagaugucuguggucuuggc

SEQ ID NO: 1140478 - RNA, 18 nt, Human
gagcccaggaguuugagg

SEQ ID NO: 1140479 - RNA, 21 nt, Human
gaggaaacaaagucagaagga

SEQ ID NO: 1140480 - RNA, 18 nt, Human
gaggcagagggaggagga

SEQ ID NO: 1140481 - RNA, 19 nt, Human
gagguugcagugagcuggc

SEQ ID NO: 1140482 - RNA, 23 nt, Human
gagguugcagugagcugugauca

SEQ ID NO: 1140483 - RNA, 21 nt, Human
gaucauggccauggugaugac

SEQ ID NO: 1140484 - RNA, 22 nt, Human
gauuacuugagcccaggaguuu

SEQ ID NO: 1140485 - RNA, 24 nt, Human
gauuacuugagcccaggaguuuga

SEQ ID NO: 1140486 - RNA, 24 nt, Human
gauuuucucuccaaaacaagccag

SEQ ID NO: 1140487 - RNA, 24 nt, Human
gcacucuagccuggacaacagagc

SEQ ID NO: 1140488 - RNA, 18 nt, Human
gccacuucuaccucuugg

SEQ ID NO: 1140489 - RNA, 21 nt, Human
gccagaaugcaggagccggug

SEQ ID NO: 1140490 - RNA, 18 nt, Human
gcucuugucugcagcuga

SEQ ID NO: 1140491 - RNA, 20 nt, Human
gcugugaucacaccacugca

SEQ ID NO: 1140492 - RNA, 25 nt, Human
gcuuauguuuguaaucccaguacuu

SEQ ID NO: 1140493 - RNA, 27 nt, Human
ggaggugggguccauggcccacccauc

SEQ ID NO: 1140494 - RNA, 19 nt, Human
ggaguucaagaaauuagcc

SEQ ID NO: 1140495 - RNA, 22 nt, Human
ggaguuugagguugcagugagc

SEQ ID NO: 1140496 - RNA, 22 nt, Human
ggauuacuugagcccaggaguu

SEQ ID NO: 1140497 - RNA, 23 nt, Human
ggcacaguggcuuauguuuguaa

SEQ ID NO: 1140498 - RNA, 21 nt, Human
ggccagaugcgguggcucacg

SEQ ID NO: 1140499 - RNA, 21 nt, Human
ggcucacgccuguaaucccag

SEQ ID NO: 1140500 - RNA, 24 nt, Human
ggcuuauguuuguaaucccaguac

SEQ ID NO: 1140501 - RNA, 23 nt, Human
gguggcucacgccuguaauccca

SEQ ID NO: 1140502 - RNA, 24 nt, Human
gguggcucacgccuguaaucccag

SEQ ID NO: 1140503 - RNA, 24 nt, Human
guccacgauuggcaagcugcaacc

SEQ ID NO: 1140504 - RNA, 18 nt, Human
uaaaaccaccaacaauga

SEQ ID NO: 1140505 - RNA, 28 nt, Human
uaaaaccaccaacaaugacuggagaccc

SEQ ID NO: 1140506 - RNA, 21 nt, Human
uaagaaaacaggcauauucuu

SEQ ID NO: 1140507 - RNA, 20 nt, Human
uaagauguuauuguggccag

SEQ ID NO: 1140508 - RNA, 19 nt, Human
uaagauuguauuuggaaug

SEQ ID NO: 1140509 - RNA, 18 nt, Human
uaagcugugacaccagcc

SEQ ID NO: 1140510 - RNA, 20 nt, Human
uauguuuguaaucccaguac

SEQ ID NO: 1140511 - RNA, 24 nt, Human
uauguuuguaaucccaguacuuug

SEQ ID NO: 1140512 - RNA, 19 nt, Human
ucaacagaaaauauggccc

SEQ ID NO: 1140513 - RNA, 23 nt, Human
ucaauguaagcuccaucaagauc

SEQ ID NO: 1140514 - RNA, 23 nt, Human
ucacaccacugcacucuagccug

SEQ ID NO: 1140515 - RNA, 23 nt, Human
ucagaaccccagcugcgagcugu

SEQ ID NO: 1140516 - RNA, 25 nt, Human
uccacgauuggcaagcugcaaccac

SEQ ID NO: 1140517 - RNA, 19 nt, Human
uccagaauagcaaguuugc

SEQ ID NO: 1140518 - RNA, 21 nt, Human
uccagggccugggcuaguucc

SEQ ID NO: 1140519 - RNA, 22 nt, Human
uccauuaucuagagcccauacu

SEQ ID NO: 1140520 - RNA, 22 nt, Human
ucccaccuugccucuccguuca

SEQ ID NO: 1140521 - RNA, 24 nt, Human
ucucagauaauaaaaagcucuuug

SEQ ID NO: 1140522 - RNA, 19 nt, Human
ugaaagcucugcucuuguc

SEQ ID NO: 1140523 - RNA, 22 nt, Human
ugaaagggacaaacagggcuga

SEQ ID NO: 1140524 - RNA, 19 nt, Human
ugaaauuuucuuggaauac

SEQ ID NO: 1140525 - RNA, 22 nt, Human
ugaauaguugugacagagacca

SEQ ID NO: 1140526 - RNA, 22 nt, Human
ugagcccaggaguuugagguug

SEQ ID NO: 1140527 - RNA, 19 nt, Human
ugaggaaacaaagucagaa

SEQ ID NO: 1140528 - RNA, 24 nt, Human
ugaggugggaggacugcuugaggc

SEQ ID NO: 1140529 - RNA, 26 nt, Human
ugaggugggaggacugcuugaggcca

SEQ ID NO: 1140530 - RNA, 23 nt, Human
ugagguugcagugagcugugauc

SEQ ID NO: 1140531 - RNA, 25 nt, Human
ugcaaccacagacccaguccggcac

SEQ ID NO: 1140532 - RNA, 19 nt, Human
ugcaacuagaaaauauguu

SEQ ID NO: 1140533 - RNA, 19 nt, Human
ugcagaggagguggggucc

SEQ ID NO: 1140534 - RNA, 18 nt, Human
ugcaggaagauggacaag

SEQ ID NO: 1140535 - RNA, 23 nt, Human
ugcccucccuuuuccagggccug

SEQ ID NO: 1140536 - RNA, 23 nt, Human
ugccuguagucccagcuacuugg

SEQ ID NO: 1140537 - RNA, 24 nt, Human
ugccuguagucccagcuacuuggg

SEQ ID NO: 1140538 - RNA, 18 nt, Human
ugcuuuacucaacagaaa

SEQ ID NO: 1140539 - RNA, 22 nt, Human
uggaaugcaacagagauuuccg

SEQ ID NO: 1140540 - RNA, 26 nt, Human
uggaaugguaauauccuuagaauuuu

SEQ ID NO: 1140541 - RNA, 22 nt, Human
uggacauuuguugaaaccggca

SEQ ID NO: 1140542 - RNA, 24 nt, Human
uggccagaugcgguggcucacgcc

SEQ ID NO: 1140543 - RNA, 25 nt, Human
uggcccacccaucucucccucgcca

SEQ ID NO: 1140544 - RNA, 22 nt, Human
uggcucacgccuguaaucccag

SEQ ID NO: 1140545 - RNA, 24 nt, Human
uggcucacgccuguaaucccagca

SEQ ID NO: 1140546 - RNA, 22 nt, Human
uggcuuauguuuguaaucccag

SEQ ID NO: 1140547 - RNA, 24 nt, Human
uggcuuauguuuguaaucccagua

SEQ ID NO: 1140548 - RNA, 20 nt, Human
ugggaggacugcuugaggcc

SEQ ID NO: 1140549 - RNA, 20 nt, Human
ugggaggcagagggaggagg

SEQ ID NO: 1140550 - RNA, 22 nt, Human
ugggaggcagagggaggaggau

SEQ ID NO: 1140551 - RNA, 19 nt, Human
ugggaggcugaggugggag

SEQ ID NO: 1140552 - RNA, 18 nt, Human
ugggaggcugaggugggc

SEQ ID NO: 1140553 - RNA, 19 nt, Human
ugggaggcugaggugggcg

SEQ ID NO: 1140554 - RNA, 24 nt, Human
uggguguguuuuugcuaaagcuuc

SEQ ID NO: 1140555 - RNA, 24 nt, Human
ugguagugcaugccuguaguccca

SEQ ID NO: 1140556 - RNA, 22 nt, Human
uguaagcugugacaccagccau

SEQ ID NO: 1140557 - RNA, 19 nt, Human
uguaaucccaguacuuugg

SEQ ID NO: 1140558 - RNA, 24 nt, Human
ugugcacgcucuuccugguguccu

SEQ ID NO: 1140559 - RNA, 24 nt, Human
uguuuguaaucccaguacuuuggg

SEQ ID NO: 1140560 - RNA, 24 nt, Human
uuacuugagcccaggaguuugagg

SEQ ID NO: 1140561 - RNA, 20 nt, Human
uuccagaauagcaaguuugc

SEQ ID NO: 1140562 - RNA, 23 nt, Human
uuccagggccugggcuaguuccu

SEQ ID NO: 1140563 - RNA, 18 nt, Human
uuccuggguguguuuuug

SEQ ID NO: 1140564 - RNA, 19 nt, Human
uugaaaccggcacucaaug

SEQ ID NO: 1140565 - RNA, 19 nt, Human
uugcagaaaaaaaugaggg

SEQ ID NO: 1140566 - RNA, 19 nt, Human
uugcagugagcugugauca

SEQ ID NO: 1140567 - RNA, 20 nt, Human
uugcagugagcugugaucac

SEQ ID NO: 1140568 - RNA, 19 nt, Human
uugggaggcagagggagga

SEQ ID NO: 1140569 - RNA, 18 nt, Human
uuuaaaauuuccauugaa

SEQ ID NO: 1140570 - RNA, 25 nt, Human
uuuuccagggccugggcuaguuccu

SEQ ID NO: 1140571 - RNA, 23 nt, Human
uuuuguuuguuuuuuuaagcuuu

SEQ ID NO: 1140572 - RNA, 20 nt, Human
aaaaacuggugaaagcuuga

SEQ ID NO: 1140573 - RNA, 18 nt, Human
aaaacaagcauaaauucc

SEQ ID NO: 1140574 - RNA, 18 nt, Human
aaacaagcauaaauuccu

SEQ ID NO: 1140575 - RNA, 23 nt, Human
aauguuucuuaaguuaacaugau

SEQ ID NO: 1140576 - RNA, 21 nt, Human
acaaaucaggguggugaccuu

SEQ ID NO: 1140577 - RNA, 21 nt, Human
acccacagccaggagccccag

SEQ ID NO: 1140578 - RNA, 21 nt, Human
agccaggagccccagucccgc

SEQ ID NO: 1140579 - RNA, 22 nt, Human
agccucgguaccacacccacag

SEQ ID NO: 1140580 - RNA, 24 nt, Human
agccugucugaucuggugcuuguu

SEQ ID NO: 1140581 - RNA, 18 nt, Human
aggaccggguuccucucc

SEQ ID NO: 1140582 - RNA, 18 nt, Human
aucaggguggugaccuug

SEQ ID NO: 1140583 - RNA, 27 nt, Human
auccacuucucucccuucacuguccag

SEQ ID NO: 1140584 - RNA, 18 nt, Human
caagucgagaaaauugcu

SEQ ID NO: 1140585 - RNA, 19 nt, Human
cacccacagccaggagccc

SEQ ID NO: 1140586 - RNA, 23 nt, Human
cagcaugacuucugcaugugugu

SEQ ID NO: 1140587 - RNA, 23 nt, Human
ccaaauccacuucucucccuuca

SEQ ID NO: 1140588 - RNA, 24 nt, Human
ccaaauccacuucucucccuucac

SEQ ID NO: 1140589 - RNA, 18 nt, Human
ccaccccugacgugcuca

SEQ ID NO: 1140590 - RNA, 21 nt, Human
ccccugacgugcucaccgcuc

SEQ ID NO: 1140591 - RNA, 22 nt, Human
ccucccugcuucgaguuguccc

SEQ ID NO: 1140592 - RNA, 22 nt, Human
ccuccgcgcaggacguaaagau

SEQ ID NO: 1140593 - RNA, 18 nt, Human
ccuggaagcccccucccu

SEQ ID NO: 1140594 - RNA, 20 nt, Human
ccuggaagcccccucccugc

SEQ ID NO: 1140595 - RNA, 21 nt, Human
cuaaaugucucccaaauccac

SEQ ID NO: 1140596 - RNA, 21 nt, Human
cuagucguaggcucucuguga

SEQ ID NO: 1140597 - RNA, 23 nt, Human
cugaagccucgguaccacaccca

SEQ ID NO: 1140598 - RNA, 19 nt, Human
cugcgccccccaccccuga

SEQ ID NO: 1140599 - RNA, 18 nt, Human
gaccugcgccccccaccc

SEQ ID NO: 1140600 - RNA, 25 nt, Human
gacuucugcauguguguagcagccu

SEQ ID NO: 1140601 - RNA, 22 nt, Human
gcaugacuucugcaugugugua

SEQ ID NO: 1140602 - RNA, 20 nt, Human
gccucgguaccacacccaca

SEQ ID NO: 1140603 - RNA, 19 nt, Human
gcgccccccaccccugacg

SEQ ID NO: 1140604 - RNA, 18 nt, Human
gcucaccgcuccacuccc

SEQ ID NO: 1140605 - RNA, 24 nt, Human
gcugaagccucgguaccacaccca

SEQ ID NO: 1140606 - RNA, 23 nt, Human
gggcggcacccgcugaagccucg

SEQ ID NO: 1140607 - RNA, 18 nt, Human
gguggugaccuuggccac

SEQ ID NO: 1140608 - RNA, 22 nt, Human
uaaaacaagcauaaauuccuau

SEQ ID NO: 1140609 - RNA, 18 nt, Human
uaucaggacaaaucaggg

SEQ ID NO: 1140610 - RNA, 19 nt, Human
ucaaauuuaccccaucaaa

SEQ ID NO: 1140611 - RNA, 22 nt, Human
ucauuauugaauauaaaacaag

SEQ ID NO: 1140612 - RNA, 19 nt, Human
uccaggccaccagcaugac

SEQ ID NO: 1140613 - RNA, 21 nt, Human
ucccugcugggcuguguggag

SEQ ID NO: 1140614 - RNA, 18 nt, Human
uccgcgcaggacguaaag

SEQ ID NO: 1140615 - RNA, 21 nt, Human
ucgguaccacacccacagcca

SEQ ID NO: 1140616 - RNA, 22 nt, Human
ucguaggcucucugugaccugg

SEQ ID NO: 1140617 - RNA, 20 nt, Human
ucuaggcgggcggcacccgc

SEQ ID NO: 1140618 - RNA, 19 nt, Human
ugaccugcgccccccaccc

SEQ ID NO: 1140619 - RNA, 21 nt, Human
ugaccugcgccccccaccccu

SEQ ID NO: 1140620 - RNA, 18 nt, Human
ugaccuggaagcccccuc

SEQ ID NO: 1140621 - RNA, 18 nt, Human
ugccuuguucuccuuauc

SEQ ID NO: 1140622 - RNA, 18 nt, Human
uggagaggaccggguucc

SEQ ID NO: 1140623 - RNA, 24 nt, Human
ugucauagagcuucuucacagccu

SEQ ID NO: 1140624 - RNA, 23 nt, Human
uguccaggccaccagcaugacuu

SEQ ID NO: 1140625 - RNA, 25 nt, Human
ugucucccaaauccacuucucuccc

SEQ ID NO: 1140626 - RNA, 21 nt, Human
uuucccgagggaaccaacguu

SEQ ID NO: 1140627 - RNA, 24 nt, Human
uuugauucuaauuaaguugucauu

SEQ ID NO: 1140628 - RNA, 18 nt, Human
aaggaggaugcugggaac

SEQ ID NO: 1140629 - RNA, 20 nt, Human
aauccaaagggagagaauuc

SEQ ID NO: 1140630 - RNA, 24 nt, Human
acacucaagacccuccauacccag

SEQ ID NO: 1140631 - RNA, 20 nt, Human
agagaaaaacugaaguaaau

SEQ ID NO: 1140632 - RNA, 21 nt, Human
agagggaacgguugcuguggg

SEQ ID NO: 1140633 - RNA, 21 nt, Human
aucaggugugcgucaggagcc

SEQ ID NO: 1140634 - RNA, 21 nt, Human
cacccgcagccccaaaggggc

SEQ ID NO: 1140635 - RNA, 20 nt, Human
caccgugccccuggcauccu

SEQ ID NO: 1140636 - RNA, 21 nt, Human
cacgcggaggguccugagggc

SEQ ID NO: 1140637 - RNA, 19 nt, Human
cacucaagacccuccauac

SEQ ID NO: 1140638 - RNA, 22 nt, Human
cagagagaaaaacugaaguaaa

SEQ ID NO: 1140639 - RNA, 18 nt, Human
caggacacagcccgugca

SEQ ID NO: 1140640 - RNA, 20 nt, Human
ccaccgugccccuggcaucc

SEQ ID NO: 1140641 - RNA, 20 nt, Human
ccaccgugccccuggcaucc

SEQ ID NO: 1140642 - RNA, 21 nt, Human
cccgugcuccagugcagcggg

SEQ ID NO: 1140643 - RNA, 21 nt, Human
cccuggcauccuggcccuggc

SEQ ID NO: 1140644 - RNA, 19 nt, Human
ccgcagccccaaaggggca

SEQ ID NO: 1140645 - RNA, 24 nt, Human
ccugcugacacucaagacccucca

SEQ ID NO: 1140646 - RNA, 27 nt, Human
ccuggcccuggccgccaccucccuggc

SEQ ID NO: 1140647 - RNA, 19 nt, Human
ccuggggaauggggagggg

SEQ ID NO: 1140648 - RNA, 22 nt, Human
ccugucccgcucaggcccccug

SEQ ID NO: 1140649 - RNA, 22 nt, Human
ccugugggacccuucucaccca

SEQ ID NO: 1140650 - RNA, 19 nt, Human
ccuguuuugugacguguga

SEQ ID NO: 1140651 - RNA, 21 nt, Human
cucaagacccuccauacccag

SEQ ID NO: 1140652 - RNA, 24 nt, Human
cucaagacccuccauacccagucc

SEQ ID NO: 1140653 - RNA, 26 nt, Human
cuccaugcugaccugugggacccuuc

SEQ ID NO: 1140654 - RNA, 22 nt, Human
cucuggguccaggcguggccuc

SEQ ID NO: 1140655 - RNA, 28 nt, Human
cugacacucaagacccuccauacccagu

SEQ ID NO: 1140656 - RNA, 19 nt, Human
gaccucaccacauuauccc

SEQ ID NO: 1140657 - RNA, 24 nt, Human
gccggggggagggggcugcugaag

SEQ ID NO: 1140658 - RNA, 19 nt, Human
gccuggggcaucuuggccc

SEQ ID NO: 1140659 - RNA, 18 nt, Human
gcggggccucccuccugg

SEQ ID NO: 1140660 - RNA, 21 nt, Human
gcggggccucccuccuggcug

SEQ ID NO: 1140661 - RNA, 21 nt, Human
ggacacagcccgugcagcccc

SEQ ID NO: 1140662 - RNA, 18 nt, Human
ggagggcccagggccugg

SEQ ID NO: 1140663 - RNA, 23 nt, Human
ggccggggggagggggcugcuga

SEQ ID NO: 1140664 - RNA, 26 nt, Human
gggaaggaaccugccugguuuccagc

SEQ ID NO: 1140665 - RNA, 19 nt, Human
ggggagggguaacaccugc

SEQ ID NO: 1140666 - RNA, 19 nt, Human
gggggagggggcugcugaa

SEQ ID NO: 1140667 - RNA, 20 nt, Human
ggguaacaccugccaaggag

SEQ ID NO: 1140668 - RNA, 21 nt, Human
gggucccuccaugcugaccuu

SEQ ID NO: 1140669 - RNA, 18 nt, Human
ggucgaggagacagaucc

SEQ ID NO: 1140670 - RNA, 20 nt, Human
gugcagccccagccuggacc

SEQ ID NO: 1140671 - RNA, 20 nt, Human
ucagagagaaaaacugaagu

SEQ ID NO: 1140672 - RNA, 18 nt, Human
ucaggagggcccagggcc

SEQ ID NO: 1140673 - RNA, 19 nt, Human
ucccugccucuucccccgu

SEQ ID NO: 1140674 - RNA, 21 nt, Human
ucgggucccuccaugcugacc

SEQ ID NO: 1140675 - RNA, 28 nt, Human
ucucugggcagacaaugugacguaaacg

SEQ ID NO: 1140676 - RNA, 20 nt, Human
ucucugguugugucugugcc

SEQ ID NO: 1140677 - RNA, 26 nt, Human
ugcagccaaacaucagcucugggucc

SEQ ID NO: 1140678 - RNA, 25 nt, Human
ugcagcggguacucguggcccugcc

SEQ ID NO: 1140679 - RNA, 18 nt, Human
ugccaaggaggaugcugg

SEQ ID NO: 1140680 - RNA, 19 nt, Human
ugccaaggaggaugcuggg

SEQ ID NO: 1140681 - RNA, 18 nt, Human
ugcccaacgcacgcggag

SEQ ID NO: 1140682 - RNA, 19 nt, Human
ugccccuggcauccuggcc

SEQ ID NO: 1140683 - RNA, 23 nt, Human
uggcauccuggcccuggccgccc

SEQ ID NO: 1140684 - RNA, 21 nt, Human
uggggagggguaacaccugcc

SEQ ID NO: 1140685 - RNA, 21 nt, Human
uggggccccagggggucgagg

SEQ ID NO: 1140686 - RNA, 23 nt, Human
ugggggaaggaaccugccugguu

SEQ ID NO: 1140687 - RNA, 19 nt, Human
uguccugagcccccggagc

SEQ ID NO: 1140688 - RNA, 19 nt, Human
ugugccgacucgguguuga

SEQ ID NO: 1140689 - RNA, 23 nt, Human
ugugcggggccucccuccuggcu

SEQ ID NO: 1140690 - RNA, 22 nt, Human
uguggaaggccaaggacauggg

SEQ ID NO: 1140691 - RNA, 21 nt, Human
uguggccaggccugucccgcu

SEQ ID NO: 1140692 - RNA, 21 nt, Human
uuccagcagaagagacagagu

SEQ ID NO: 1140693 - RNA, 19 nt, Human
aagagccaauaaagagagg

SEQ ID NO: 1140694 - RNA, 20 nt, Human
aagagcuuguccggguuuug

SEQ ID NO: 1140695 - RNA, 21 nt, Human
aggagaugggcugugcguuca

SEQ ID NO: 1140696 - RNA, 22 nt, Human
auuccucagcaucuucuugucg

SEQ ID NO: 1140697 - RNA, 21 nt, Human
cacacacagcgcacacagggu

SEQ ID NO: 1140698 - RNA, 19 nt, Human
cacacaggguuuacagcag

SEQ ID NO: 1140699 - RNA, 18 nt, Human
cacagcgcacacaggguu

SEQ ID NO: 1140700 - RNA, 21 nt, Human
cacaggguuuacagcaggucc

SEQ ID NO: 1140701 - RNA, 19 nt, Human
caccuuguuuuucuugcuc

SEQ ID NO: 1140702 - RNA, 22 nt, Human
cacgaaccccaaggcaucuccu

SEQ ID NO: 1140703 - RNA, 24 nt, Human
cagcagaauuaaacagagcagacu

SEQ ID NO: 1140704 - RNA, 20 nt, Human
cagcauuauuucagaaauau

SEQ ID NO: 1140705 - RNA, 30 nt, Human; identical to SEQ ID NO: 1008247

SEQ ID NO: 1140706 - RNA, 18 nt, Human
ccuacaaagcggacacug

SEQ ID NO: 1140707 - RNA, 20 nt, Human
cgaaccccaaggcaucuccu

SEQ ID NO: 1140708 - RNA, 21 nt, Human
cgggaaagcaaccaaugccug

SEQ ID NO: 1140709 - RNA, 23 nt, Human
cuagcccauuuuugcaaagggag

SEQ ID NO: 1140710 - RNA, 19 nt, Human
cugaaggagagaucuucau

SEQ ID NO: 1140711 - RNA, 23 nt, Human
cugcaaugucuauguaagcaguu

SEQ ID NO: 1140712 - RNA, 21 nt, Human
cugggcucacacacagcgcac

SEQ ID NO: 1140713 - RNA, 18 nt, Human
gaaagugagugugaggug

SEQ ID NO: 1140714 - RNA, 22 nt, Human
gaaugaagccuaaguauuccuc

SEQ ID NO: 1140715 - RNA, 19 nt, Human
gcagacagcagaauuaaac

SEQ ID NO: 1140716 - RNA, 23 nt, Human
gcagacagcagaauuaaacagag

SEQ ID NO: 1140717 - RNA, 18 nt, Human
gcggaaagugagugugag

SEQ ID NO: 1140718 - RNA, 27 nt, Human
guaaauucauucauuagccaaacaaag

SEQ ID NO: 1140719 - RNA, 19 nt, Human
gugacaacuuuauacuccu

SEQ ID NO: 1140720 - RNA, 23 nt, Human
gugguguccuacaaagcggacac

SEQ ID NO: 1140721 - RNA, 23 nt, Human
guuucaaccaaaugauuuugauu

SEQ ID NO: 1140722 - RNA, 19 nt, Human
uaaacagagcagacugaag

SEQ ID NO: 1140723 - RNA, 23 nt, Human
uaaacagagcagacugaaggaga

SEQ ID NO: 1140724 - RNA, 20 nt, Human
uagccaaacaaagcugucua

SEQ ID NO: 1140725 - RNA, 18 nt, Human
uaucucaggaaucagcau

SEQ ID NO: 1140726 - RNA, 22 nt, Human
ucacacacagcgcacacagggu

SEQ ID NO: 1140727 - RNA, 21 nt, Human
ucagcauuauuucagaaauau

SEQ ID NO: 1140728 - RNA, 19 nt, Human
ucccucagcacaauuacua

SEQ ID NO: 1140729 - RNA, 22 nt, Human
ucgcuuccuucaccuuguuuuu

SEQ ID NO: 1140730 - RNA, 20 nt, Human
ucugcaaugucuauguaagc

SEQ ID NO: 1140731 - RNA, 21 nt, Human
ucuucuuugauaacuggcuca

SEQ ID NO: 1140732 - RNA, 23 nt, Human
ucuugcucuucuucauugacugg

SEQ ID NO: 1140733 - RNA, 25 nt, Human
ucuugcucuucuucauugacugguu

SEQ ID NO: 1140734 - RNA, 24 nt, Human
ugaaggagagaucuucauuauuug

SEQ ID NO: 1140735 - RNA, 20 nt, Human
ugacugguuuuuggggccau

SEQ ID NO: 1140736 - RNA, 21 nt, Human
ugagacuggggaucaaaucca

SEQ ID NO: 1140737 - RNA, 23 nt, Human
ugagacuggggaucaaauccacu

SEQ ID NO: 1140738 - RNA, 20 nt, Human
ugaucaccuugacugucugg

SEQ ID NO: 1140739 - RNA, 23 nt, Human
ugcucuucuucauugacugguuu

SEQ ID NO: 1140740 - RNA, 23 nt, Human
uggaauacagaggaaugaacuuc

SEQ ID NO: 1140741 - RNA, 18 nt, Human
uguccauuuuucauuaug

SEQ ID NO: 1140742 - RNA, 23 nt, Human
ugucuauguaagcaguuucccuc

SEQ ID NO: 1140743 - RNA, 18 nt, Human
uguguacacagaagcaug

SEQ ID NO: 1140744 - RNA, 24 nt, Human
uucaccuuguuuuucuugcucuuc

SEQ ID NO: 1140745 - RNA, 24 nt, Human
uuucacaaauuuacaaguguugcu

SEQ ID NO: 1140746 - RNA, 19 nt, Human
auuugcacaagccucccuc

SEQ ID NO: 1140747 - RNA, 24 nt, Human
cagcaccagaaucuaugagaauau

SEQ ID NO: 1140748 - RNA, 21 nt, Human
caucacuucgaugucugcacc

SEQ ID NO: 1140749 - RNA, 21 nt, Human
caucauccucuccagcuucca

SEQ ID NO: 1140750 - RNA, 27 nt, Human
ucagguccauugucgucuucuucauca

SEQ ID NO: 1140751 - RNA, 22 nt, Human
uccaggcuuggccacgggaggc

SEQ ID NO: 1140752 - RNA, 18 nt, Human
ucccucuggcauugcaga

SEQ ID NO: 1140753 - RNA, 22 nt, Human
ucccucuggcauugcagagccu

SEQ ID NO: 1140754 - RNA, 23 nt, Human
ucccucuggcauugcagagccug

SEQ ID NO: 1140755 - RNA, 23 nt, Human
ugagaauauuugcacaagccucc

SEQ ID NO: 1140756 - RNA, 22 nt, Human
uuccaggcuuggccacgggagg

SEQ ID NO: 1140757 - RNA, 24 nt, Human
uuugcacaagccucccucuggcau

SEQ ID NO: 1140758 - RNA, 23 nt, Human
agacccaacaugcucuuggcaga

SEQ ID NO: 1140759 - RNA, 21 nt, Human
augcucuuggcagauacugga

SEQ ID NO: 1140760 - RNA, 20 nt, Human
cuuucuggagcuaaaugggg

SEQ ID NO: 1140761 - RNA, 24 nt, Human
ugaggcagcagucacgggagaccc

SEQ ID NO: 1140762 - RNA, 21 nt, Human
ugcuuggucuugaugauucuu

SEQ ID NO: 1140763 - RNA, 20 nt, Human
aaaaccuuccuuaaagauuc

SEQ ID NO: 1140764 - RNA, 20 nt, Human
aaaagucacccucaaccacc

SEQ ID NO: 1140765 - RNA, 20 nt, Human
aacacugaacuggggaacau

SEQ ID NO: 1140766 - RNA, 20 nt, Human
aacaguucagguccccaagc

SEQ ID NO: 1140767 - RNA, 21 nt, Human
aagcagagcaugcagccggga

SEQ ID NO: 1140768 - RNA, 25 nt, Human
aagggaccagagcgacauacugaug

SEQ ID NO: 1140769 - RNA, 21 nt, Human
accuauuauacaugcaacacu

SEQ ID NO: 1140770 - RNA, 21 nt, Human
agauuaacaauuugaugaccc

SEQ ID NO: 1140771 - RNA, 24 nt, Human
aggcagaggcaaccaaucuuuuuu

SEQ ID NO: 1140772 - RNA, 19 nt, Human
agugacaucaccauaaaac

SEQ ID NO: 1140773 - RNA, 18 nt, Human
auaaaggccaggcagcag

SEQ ID NO: 1140774 - RNA, 23 nt, Human
augaccccaucacaguaccaaaa

SEQ ID NO: 1140775 - RNA, 21 nt, Human
caacacugaacuggggaacau

SEQ ID NO: 1140776 - RNA, 30 nt, Human
cacaguaccaaaauaucccccaaaaugaag

SEQ ID NO: 1140777 - RNA, 23 nt, Human
cacucucccuccugcuucuucca

SEQ ID NO: 1140778 - RNA, 24 nt, Human
cacuguagaccugguuuuuucccc

SEQ ID NO: 1140779 - RNA, 19 nt, Human
cagagcgacauacugaugc

SEQ ID NO: 1140780 - RNA, 26 nt, Human
cagaggcaaccaaucuuuuuuuuuuu

SEQ ID NO: 1140781 - RNA, 20 nt, Human
cagcagcgccacucucccuc

SEQ ID NO: 1140782 - RNA, 19 nt, Human
caggaucacaaaggcagag

SEQ ID NO: 1140783 - RNA, 22 nt, Human
caguaccaaaauaucccccaaa

SEQ ID NO: 1140784 - RNA, 21 nt, Human
caucacaguaccaaaauaucc

SEQ ID NO: 1140785 - RNA, 18 nt, Human
cauggagagcucagcaca

SEQ ID NO: 1140786 - RNA, 23 nt, Human
ccaaaauaucccccaaaaugaag

SEQ ID NO: 1140787 - RNA, 24 nt, Human
cccucaaccaccaucugacugguc

SEQ ID NO: 1140788 - RNA, 21 nt, Human
cggcaacagcgacauggagag

SEQ ID NO: 1140789 - RNA, 23 nt, Human
cgggcggcaacagcgacauggag

SEQ ID NO: 1140790 - RNA, 22 nt, Human
cugaugccuauugaggcaucug

SEQ ID NO: 1140791 - RNA, 19 nt, Human
cuuggggccuccagaacag

SEQ ID NO: 1140792 - RNA, 22 nt, Human
gaucaaaacauaaaucagagug

SEQ ID NO: 1140793 - RNA, 19 nt, Human
gauugcucuuuaaagggac

SEQ ID NO: 1140794 - RNA, 22 nt, Human
gcaacacugaacuggggaacau

SEQ ID NO: 1140795 - RNA, 18 nt, Human
gccagccucugguugucu

SEQ ID NO: 1140796 - RNA, 18 nt, Human
gccuccagaacaguucag

SEQ ID NO: 1140797 - RNA, 19 nt, Human
ggcaggaagaggagaaacc

SEQ ID NO: 1140798 - RNA, 25 nt, Human
ggccaagcagagcaugcagccggga

SEQ ID NO: 1140799 - RNA, 23 nt, Human
ggccaugucccaacaacagcagc

SEQ ID NO: 1140800 - RNA, 21 nt, Human
ggcggcaacagcgacauggag

SEQ ID NO: 1140801 - RNA, 21 nt, Human
ggggaacauggcuuggggccu

SEQ ID NO: 1140802 - RNA, 26 nt, Human
gggggcaggaagaggagaaaccuauu

SEQ ID NO: 1140803 - RNA, 24 nt, Human
ggggggcaggaagaggagaaaccu

SEQ ID NO: 1140804 - RNA, 21 nt, Human
gucacccucaaccaccaucug

SEQ ID NO: 1140805 - RNA, 19 nt, Human
ucaggucucaccugugcca

SEQ ID NO: 1140806 - RNA, 23 nt, Human
ucccaacaacagcagcgccacuc

SEQ ID NO: 1140807 - RNA, 21 nt, Human
ucccaagcugucagcgagcgc

SEQ ID NO: 1140808 - RNA, 20 nt, Human
ucccccaaaaugaaguucaa

SEQ ID NO: 1140809 - RNA, 24 nt, Human
ugagugacaucaccauaaaaacac

SEQ ID NO: 1140810 - RNA, 25 nt, Human
ugagugaguaaaauuauaaaggcca

SEQ ID NO: 1140811 - RNA, 24 nt, Human
uuauaaaggccaggcagcaggaaa

SEQ ID NO: 1140812 - RNA, 23 nt, Human
uucuuccaggauugcucuuuaaa

SEQ ID NO: 1140813 - RNA, 20 nt, Human
uugaugcuuugcucuaucac

SEQ ID NO: 1140814 - RNA, 23 nt, Human
uuuaaaaccuuccuuaaagauuc

SEQ ID NO: 1140815 - RNA, 22 nt, Human
uuucccccuaguuuuuucuuuu

SEQ ID NO: 1140816 - RNA, 25 nt, Human
uuuuacauucuggguugcuauuuuc

SEQ ID NO: 1140817 - RNA, 18 nt, Human
aaagugcugggauuacaa

SEQ ID NO: 1140818 - RNA, 24 nt, Human
aaagugcugggauuacaagcauga

SEQ ID NO: 1140819 - RNA, 19 nt, Human
aagugcugggauuacaagc

SEQ ID NO: 1140820 - RNA, 21 nt, Human
aagugcugggauuacaagcau

SEQ ID NO: 1140821 - RNA, 26 nt, Human
aagugcugggauuacaagcaugagcu

SEQ ID NO: 1140822 - RNA, 23 nt, Human
accugucuuggccucccaaagug

SEQ ID NO: 1140823 - RNA, 24 nt, Human
aggcggccgagaaggcggcucagc

SEQ ID NO: 1140824 - RNA, 24 nt, Human
agugcugggauuacaagcaugagc

SEQ ID NO: 1140825 - RNA, 18 nt, Human
auagaguccucccaaggg

SEQ ID NO: 1140826 - RNA, 24 nt, Human
caaagugcugggauuacaagcaug

SEQ ID NO: 1140827 - RNA, 21 nt, Human
cagccgccgcagggaccaggc

SEQ ID NO: 1140828 - RNA, 20 nt, Human
cagcgcggaccccgcccggg

SEQ ID NO: 1140829 - RNA, 19 nt, Human
ccaaagugcugggauuaca

SEQ ID NO: 1140830 - RNA, 24 nt, Human
ccaaagugcugggauuacaagcau

SEQ ID NO: 1140831 - RNA, 21 nt, Human
ccaagggucuccuaucacugu

SEQ ID NO: 1140832 - RNA, 21 nt, Human
ccaggcugcccaggcuggucu

SEQ ID NO: 1140833 - RNA, 24 nt, Human
ccaggcuggucuugaacuccuggg

SEQ ID NO: 1140834 - RNA, 20 nt, Human
cccacuuguaaaaacacaau

SEQ ID NO: 1140835 - RNA, 21 nt, Human
ccccgccgcccgcgccggcua

SEQ ID NO: 1140836 - RNA, 21 nt, Human
cccgccgcccgcgccggcuac

SEQ ID NO: 1140837 - RNA, 22 nt, Human
cccgccgggugccggagaggaa

SEQ ID NO: 1140838 - RNA, 19 nt, Human
ccgagaaggcggcucagcg

SEQ ID NO: 1140839 - RNA, 20 nt, Human
ccgcccgcgccggcuaccgc

SEQ ID NO: 1140840 - RNA, 19 nt, Human
ccgccgcggcccggccccc

SEQ ID NO: 1140841 - RNA, 26 nt, Human
ccgccgcggcccggcccccgccgccc

SEQ ID NO: 1140842 - RNA, 18 nt, Human
ccgcgcccgggcgcccgc

SEQ ID NO: 1140843 - RNA, 20 nt, Human
ccgcgcgcccgggccgccgg

SEQ ID NO: 1140844 - RNA, 22 nt, Human
cgaagcgccgcgcgcccgggcc

SEQ ID NO: 1140845 - RNA, 22 nt, Human
cgccgcccgcgccggcuaccgc

SEQ ID NO: 1140846 - RNA, 25 nt, Human
cgcgcccgggcgcccgccgggugcc

SEQ ID NO: 1140847 - RNA, 18 nt, Human
cggcccccgccgcccgcg

SEQ ID NO: 1140848 - RNA, 19 nt, Human
cuccugggcucagacaguc

SEQ ID NO: 1140849 - RNA, 19 nt, Human
cuggucuugaacuccuggg

SEQ ID NO: 1140850 - RNA, 23 nt, Human
cugucuuggccucccaaagugcu

SEQ ID NO: 1140851 - RNA, 23 nt, Human
gacagucuaccugucuuggccuc

SEQ ID NO: 1140852 - RNA, 18 nt, Human
gaccaggcggccgagaag

SEQ ID NO: 1140853 - RNA, 20 nt, Human
gagaugggguuuugccaggc

SEQ ID NO: 1140854 - RNA, 19 nt, Human
gauuacaagcaugagcuac

SEQ ID NO: 1140855 - RNA, 18 nt, Human
gcaaagcccccugccaga

SEQ ID NO: 1140856 - RNA, 18 nt, Human
gcaaagcccccugccaga

SEQ ID NO: 1140857 - RNA, 21 nt, Human
gcaaagcccccugccagauag

SEQ ID NO: 1140858 - RNA, 18 nt, Human
gccaggcugcccaggcug

SEQ ID NO: 1140859 - RNA, 18 nt, Human
gccgcagggaccaggcgg

SEQ ID NO: 1140860 - RNA, 21 nt, Human
gcugcccaggcuggucuugaa

SEQ ID NO: 1140861 - RNA, 19 nt, Human
ggauuacaagcaugagcua

SEQ ID NO: 1140862 - RNA, 27 nt, Human
ggcugcccaggcuggucuugaacuccu

SEQ ID NO: 1140863 - RNA, 18 nt, Human
ggcuggucuugaacuccu

SEQ ID NO: 1140864 - RNA, 20 nt, Human
gucuccuaucacuguggcau

SEQ ID NO: 1140865 - RNA, 22 nt, Human
gucuuggccucccaaagugcug

SEQ ID NO: 1140866 - RNA, 24 nt, Human
guuuugccaggcugcccaggcugg

SEQ ID NO: 1140867 - RNA, 23 nt, Human
uaccugucuuggccucccaaagu

SEQ ID NO: 1140868 - RNA, 22 nt, Human
uagaguccucccaagggucucc

SEQ ID NO: 1140869 - RNA, 18 nt, Human
ucccaaagugcugggauu

SEQ ID NO: 1140870 - RNA, 24 nt, Human
ucccaaagugcugggauuacaagc

SEQ ID NO: 1140871 - RNA, 19 nt, Human
ucccucacagcagucaaag

SEQ ID NO: 1140872 - RNA, 19 nt, Human
ucuugaacuccugggcuca

SEQ ID NO: 1140873 - RNA, 24 nt, Human
ucuugaacuccugggcucagacag

SEQ ID NO: 1140874 - RNA, 20 nt, Human
ucuuggccucccaaagugcu

SEQ ID NO: 1140875 - RNA, 24 nt, Human
ugaacuccugggcucagacagucu

SEQ ID NO: 1140876 - RNA, 24 nt, Human
ugccaggcugcccaggcuggucuu

SEQ ID NO: 1140877 - RNA, 27 nt, Human
ugccaggcugcccaggcuggucuugaa

SEQ ID NO: 1140878 - RNA, 28 nt, Human
ugcccaggcuggucuugaacuccugggc

SEQ ID NO: 1140879 - RNA, 27 nt, Human
ugcugggauuacaagcaugagcuacca

SEQ ID NO: 1140880 - RNA, 22 nt, Human
ugggauuacaagcaugagcuac

SEQ ID NO: 1140881 - RNA, 23 nt, Human
ugggauuacaagcaugagcuacc

SEQ ID NO: 1140882 - RNA, 24 nt, Human
ugggauuacaagcaugagcuacca

SEQ ID NO: 1140883 - RNA, 30 nt, Human
ugggauuacaagcaugagcuaccacacugg

SEQ ID NO: 1140884 - RNA, 24 nt, Human
ugggguuuugccaggcugcccagg

SEQ ID NO: 1140885 - RNA, 22 nt, Human
uguaaaaacacaaugacgugca

SEQ ID NO: 1140886 - RNA, 20 nt, Human
uuacaagcaugagcuaccac

SEQ ID NO: 1140887 - RNA, 22 nt, Human
uuugccaggcugcccaggcugg

SEQ ID NO: 1140888 - RNA, 22 nt, Human
uuuugccaggcugcccaggcug

SEQ ID NO: 1140889 - RNA, 21 nt, Human
aacuuggaguccaaagucugu

SEQ ID NO: 1140890 - RNA, 19 nt, Human
aagaaaaagcaaccuacaa

SEQ ID NO: 1140891 - RNA, 19 nt, Human
aagcaaagauuuucccaug

SEQ ID NO: 1140892 - RNA, 19 nt, Human
aaugcaaaacuagguuuga

SEQ ID NO: 1140893 - RNA, 20 nt, Human
acuuggaguccaaagucugu

SEQ ID NO: 1140894 - RNA, 19 nt, Human
agcaaagaacugaagaagc

SEQ ID NO: 1140895 - RNA, 18 nt, Human
agcaaguguccacucccc

SEQ ID NO: 1140896 - RNA, 19 nt, Human
auauuuacauaaugacuaa

SEQ ID NO: 1140897 - RNA, 20 nt, Human
auccucugcuguugccuucu

SEQ ID NO: 1140898 - RNA, 27 nt, Human
auccucugcuguugccuucuuuuuaau

SEQ ID NO: 1140899 - RNA, 26 nt, Human
caaggauacugugaugaaagucaaag

SEQ ID NO: 1140900 - RNA, 24 nt, Human
cacuccccaccccucuccccugcc

SEQ ID NO: 1140901 - RNA, 20 nt, Human
cagccuuuuucaacuuggag

SEQ ID NO: 1140902 - RNA, 18 nt, Human
cagcuauacccuagcuga

SEQ ID NO: 1140903 - RNA, 23 nt, Human
cagcuauacccuagcugagcaaa

SEQ ID NO: 1140904 - RNA, 21 nt, Human
caggaggaagaaaaagcaacc

SEQ ID NO: 1140905 - RNA, 22 nt, Human
ccaccccucuccccugcccccc

SEQ ID NO: 1140906 - RNA, 23 nt, Human
ccacuccccaccccucuccccug

SEQ ID NO: 1140907 - RNA, 20 nt, Human
ccaggaggaagaaaaagcaa

SEQ ID NO: 1140908 - RNA, 18 nt, Human
ccaggucacuuggacaag

SEQ ID NO: 1140909 - RNA, 24 nt, Human
ccccaccccucuccccugcccccc

SEQ ID NO: 1140910 - RNA, 23 nt, Human
cccccuuuuguuacuugaagugu

SEQ ID NO: 1140911 - RNA, 26 nt, Human
cccucuccccugccccccuuuuguua

SEQ ID NO: 1140912 - RNA, 23 nt, Human
cugagguauacaaacuuggcugg

SEQ ID NO: 1140913 - RNA, 18 nt, Human
gaggaagaaaaagcaacc

SEQ ID NO: 1140914 - RNA, 23 nt, Human
gcccaggaggaagaaaaagcaac

SEQ ID NO: 1140915 - RNA, 20 nt, Human
ggagaccuggcauagaaaaa

SEQ ID NO: 1140916 - RNA, 23 nt, Human
guguccacuccccaccccucucc

SEQ ID NO: 1140917 - RNA, 22 nt, Human
uaaaaugagggguuuugacuug

SEQ ID NO: 1140918 - RNA, 25 nt, Human
uaacaaaugcaaaacuagguuugaa

SEQ ID NO: 1140919 - RNA, 22 nt, Human
uaagguaaaaccuuuccacaaa

SEQ ID NO: 1140920 - RNA, 20 nt, Human
uaagguggaugcagaaagaa

SEQ ID NO: 1140921 - RNA, 25 nt, Human
uacacaauuauauuuacauaaugac

SEQ ID NO: 1140922 - RNA, 19 nt, Human
uacauaaugacuaagguaa

SEQ ID NO: 1140923 - RNA, 19 nt, Human
uaggccucuggcuuauggc

SEQ ID NO: 1140924 - RNA, 23 nt, Human
uccccaccccucuccccugcccc

SEQ ID NO: 1140925 - RNA, 22 nt, Human
uccugagcguccauaaucugca

SEQ ID NO: 1140926 - RNA, 19 nt, Human
ucucaggccagcuauaccc

SEQ ID NO: 1140927 - RNA, 23 nt, Human
ucucaggccagcuauacccuagc

SEQ ID NO: 1140928 - RNA, 21 nt, Human
ucucuggggcuugcacugccu

SEQ ID NO: 1140929 - RNA, 22 nt, Human
ucucuggggcuugcacugccuu

SEQ ID NO: 1140930 - RNA, 24 nt, Human
ucugaaacaccuuuuuuaaaaaaa

SEQ ID NO: 1140931 - RNA, 22 nt, Human
ucuucuaguuguuuccuucgau

SEQ ID NO: 1140932 - RNA, 21 nt, Human
ugaaagaacuugcccucugcu

SEQ ID NO: 1140933 - RNA, 22 nt, Human
ugaauauaaaagcuagacgacc

SEQ ID NO: 1140934 - RNA, 24 nt, Human
ugagcaaagaacugaagaagcaag

SEQ ID NO: 1140935 - RNA, 23 nt, Human
ugagcguccauaaucugcaucca

SEQ ID NO: 1140936 - RNA, 21 nt, Human
ugaggagaccuggcauagaaa

SEQ ID NO: 1140937 - RNA, 23 nt, Human
ugcccaggaggaagaaaaagcaa

SEQ ID NO: 1140938 - RNA, 18 nt, Human
uggcauagaaaaaacaag

SEQ ID NO: 1140939 - RNA, 21 nt, Human
ugggaccaaccuucugauaua

SEQ ID NO: 1140940 - RNA, 19 nt, Human
uguaaaaugagggguuuug

SEQ ID NO: 1140941 - RNA, 21 nt, Human
uguuuauuaccacugguucca

SEQ ID NO: 1140942 - RNA, 24 nt, Human
uuaaauauuaagaaagcuaaaauu

SEQ ID NO: 1140943 - RNA, 23 nt, Human
uuauagguuuuucccuuagauuu

SEQ ID NO: 1140944 - RNA, 23 nt, Human
uucugaaacaccuuuuuuaaaaa

SEQ ID NO: 1140945 - RNA, 25 nt, Human
uugaauauaaaagcuagacgaccau

SEQ ID NO: 1140946 - RNA, 18 nt, Human
uugacuuggccaucuguc

SEQ ID NO: 1140947 - RNA, 19 nt, Human
uugcacugccuucucaggc

SEQ ID NO: 1140948 - RNA, 20 nt, Human
uuuuccaggucacuuggaca

SEQ ID NO: 1140949 - RNA, 18 nt, Human
caacacgccguaccgcag

SEQ ID NO: 1140950 - RNA, 20 nt, Human
caauccuuuugauaagaaau

SEQ ID NO: 1140951 - RNA, 23 nt, Human
ccgcugggaccaacacgccguac

SEQ ID NO: 1140952 - RNA, 19 nt, Human
ccuacagcacgucccuacc

SEQ ID NO: 1140953 - RNA, 21 nt, Human
ccucagcugaaccgcugggac

SEQ ID NO: 1140954 - RNA, 19 nt, Human
cugggaccaacacgccgua

SEQ ID NO: 1140955 - RNA, 18 nt, Human
cuguaaaacaaauaccau

SEQ ID NO: 1140956 - RNA, 22 nt, Human
gaaguucuaagaaaaaaugaca

SEQ ID NO: 1140957 - RNA, 21 nt, Human
gcugaaccgcugggaccaaca

SEQ ID NO: 1140958 - RNA, 25 nt, Human
uaaacuccaaagccaauuucaaaag

SEQ ID NO: 1140959 - RNA, 23 nt, Human
uaaauaaaugcuugaaauauacc

SEQ ID NO: 1140960 - RNA, 21 nt, Human
uauccaauccuuuugauaaga

SEQ ID NO: 1140961 - RNA, 20 nt, Human
ucaaaagacauuuuugugaa

SEQ ID NO: 1140962 - RNA, 23 nt, Human
ugaaauauacccaguagaaacuu

SEQ ID NO: 1140963 - RNA, 18 nt, Human
uuucaugucauaaaaugg

SEQ ID NO: 1140964 - RNA, 22 nt, Human
cccuggcucagcuuccaccccc

SEQ ID NO: 1140965 - RNA, 21 nt, Human
ccuguguccccaguccagagc

SEQ ID NO: 1140966 - RNA, 21 nt, Human
cucagccucugccuugggggc

SEQ ID NO: 1140967 - RNA, 22 nt, Human
cugaaaugucuucugauucuca

SEQ ID NO: 1140968 - RNA, 20 nt, Human
cuggcucagcuuccaccccc

SEQ ID NO: 1140969 - RNA, 22 nt, Human
cugucccuggcucagcuuccac

SEQ ID NO: 1140970 - RNA, 22 nt, Human
cuuccacccccagcuggggcuc

SEQ ID NO: 1140971 - RNA, 23 nt, Human
cuucugauucucagccucugccu

SEQ ID NO: 1140972 - RNA, 21 nt, Human
gcuuccacccccagcuggggc

SEQ ID NO: 1140973 - RNA, 20 nt, Human
ucuccugaaaugucuucuga

SEQ ID NO: 1140974 - RNA, 18 nt, Human
ugcuuuauuggggaaggg

SEQ ID NO: 1140975 - RNA, 25 nt, Human
uggcucagcuuccacccccagcugg

SEQ ID NO: 1140976 - RNA, 25 nt, Human
uugcuuuauuggggaagggauggga

SEQ ID NO: 1140977 - RNA, 23 nt, Human
aaaaaggacaccccccaccacaa

SEQ ID NO: 1140978 - RNA, 25 nt, Human
aaaggcagagcccagugcauccacu

SEQ ID NO: 1140979 - RNA, 24 nt, Human
aaagugcugggauuacagguguga

SEQ ID NO: 1140980 - RNA, 24 nt, Human
aaaguggagaauggccgcugcgga

SEQ ID NO: 1140981 - RNA, 24 nt, Human
aaccacaggaggcccccaggaagu

SEQ ID NO: 1140982 - RNA, 24 nt, Human
aaccucaccuuaccauguccccac

SEQ ID NO: 1140983 - RNA, 23 nt, Human
aacucagacucagcacauccaug

SEQ ID NO: 1140984 - RNA, 22 nt, Human
aagaaaaaaaaaaucuagaaga

SEQ ID NO: 1140985 - RNA, 18 nt, Human
aagugcugggauuacagg

SEQ ID NO: 1140986 - RNA, 19 nt, Human
aagugcugggauuacaggu

SEQ ID NO: 1140987 - RNA, 26 nt, Human
aagugcugggauuacaggugugaacc

SEQ ID NO: 1140988 - RNA, 24 nt, Human
aaugcagugaugcgaucuuggcuc

SEQ ID NO: 1140989 - RNA, 21 nt, Human
acaaaugagaagaccaaggcc

SEQ ID NO: 1140990 - RNA, 18 nt, Human
acaggguuucaccauguu

SEQ ID NO: 1140991 - RNA, 21 nt, Human
acaggguuucaccauguuggc

SEQ ID NO: 1140992 - RNA, 24 nt, Human
acaggguuucaccauguuggccag

SEQ ID NO: 1140993 - RNA, 23 nt, Human
accacaauacccugcucugucuc

SEQ ID NO: 1140994 - RNA, 20 nt, Human
accagcgcguguguuccugg

SEQ ID NO: 1140995 - RNA, 24 nt, Human
accauguuggccaggauggucucg

SEQ ID NO: 1140996 - RNA, 19 nt, Human
acccagggcccuggucagc

SEQ ID NO: 1140997 - RNA, 21 nt, Human
acccugcucugucuccuccuc

SEQ ID NO: 1140998 - RNA, 24 nt, Human
accucauucaggaagccccgccag

SEQ ID NO: 1140999 - RNA, 24 nt, Human
accuccagaacgaagcccagccuc

SEQ ID NO: 1141000 - RNA, 24 nt, Human
accucgugauccacccaccuuggc

SEQ ID NO: 1141001 - RNA, 20 nt, Human
accugggccccuccccaagc

SEQ ID NO: 1141002 - RNA, 18 nt, Human
acucacuccugcucccca

SEQ ID NO: 1141003 - RNA, 24 nt, Human
acugauucuuaaaaggggagguga

SEQ ID NO: 1141004 - RNA, 27 nt, Human
agaaaaacucaaaggaaugggccuggg

SEQ ID NO: 1141005 - RNA, 22 nt, Human
agaacucggggaagggaagaac

SEQ ID NO: 1141006 - RNA, 19 nt, Human
agacagggccugcacacag

SEQ ID NO: 1141007 - RNA, 20 nt, Human
agacauagcccuagagcucc

SEQ ID NO: 1141008 - RNA, 22 nt, Human
agacgucucaguacagucucca

SEQ ID NO: 1141009 - RNA, 18 nt, Human
agagggugggggagcucc

SEQ ID NO: 1141010 - RNA, 24 nt, Human
agcaguucucccgccucaaccucc

SEQ ID NO: 1141011 - RNA, 25 nt, Human
agccacaggacaucggcaguggccc

SEQ ID NO: 1141012 - RNA, 21 nt, Human
agcucuuccccauucuccccc

SEQ ID NO: 1141013 - RNA, 23 nt, Human
aggaaacacccccaacccagggc

SEQ ID NO: 1141014 - RNA, 23 nt, Human
aggaagaagaaagaggagcccaa

SEQ ID NO: 1141015 - RNA, 18 nt, Human
agggguggagggcagggg

SEQ ID NO: 1141016 - RNA, 23 nt, Human
agggugggggagcuccaaggcuu

SEQ ID NO: 1141017 - RNA, 19 nt, Human
aggugugaaccaccacgcc

SEQ ID NO: 1141018 - RNA, 24 nt, Human
agugcagcucccagccccaaaaag

SEQ ID NO: 1141019 - RNA, 24 nt, Human
auaaagcacagaacauauacagaa

SEQ ID NO: 1141020 - RNA, 21 nt, Human
aucuauaacaagcauucucaa

SEQ ID NO: 1141021 - RNA, 22 nt, Human
augccaugggacacccugauga

SEQ ID NO: 1141022 - RNA, 26 nt, Human
auuaaacugcagcccucaaaggcaga

SEQ ID NO: 1141023 - RNA, 24 nt, Human
auuauuguauuuuuaguagagaca

SEQ ID NO: 1141024 - RNA, 19 nt, Human
caaaaaugccagcuguagc

SEQ ID NO: 1141025 - RNA, 22 nt, Human
caaagccagccccccaccaguc

SEQ ID NO: 1141026 - RNA, 24 nt, Human
caaagugcugggauuacaggugug

SEQ ID NO: 1141027 - RNA, 19 nt, Human
caaccacaggaggccccca

SEQ ID NO: 1141028 - RNA, 22 nt, Human
caacccagggcccuggucagcc

SEQ ID NO: 1141029 - RNA, 21 nt, Human
caaccucugcagcugcuuccc

SEQ ID NO: 1141030 - RNA, 21 nt, Human
caacuaagccccacugggguc

SEQ ID NO: 1141031 - RNA, 22 nt, Human
caagucccauaggcaacucaga

SEQ ID NO: 1141032 - RNA, 23 nt, Human
cacaauacccugcucugucuccu

SEQ ID NO: 1141033 - RNA, 19 nt, Human
cacaccuuuuuccaccccc

SEQ ID NO: 1141034 - RNA, 21 nt, Human
cacaggacaucggcaguggcc

SEQ ID NO: 1141035 - RNA, 23 nt, Human
cacaggacaucggcaguggccca

SEQ ID NO: 1141036 - RNA, 20 nt, Human
cacaucaccccccaccccuc

SEQ ID NO: 1141037 - RNA, 25 nt, Human
caccaggaagaagaaagaggagccc

SEQ ID NO: 1141038 - RNA, 18 nt, Human
caccauguuggccaggau

SEQ ID NO: 1141039 - RNA, 22 nt, Human
caccauguuggccaggaugguc

SEQ ID NO: 1141040 - RNA, 24 nt, Human
caccauguuggccaggauggucuc

SEQ ID NO: 1141041 - RNA, 22 nt, Human
cacccaccuuggccucccaaag

SEQ ID NO: 1141042 - RNA, 23 nt, Human
cacccaccuuggccucccaaagu

SEQ ID NO: 1141043 - RNA, 19 nt, Human
caccccaagccccacugcc

SEQ ID NO: 1141044 - RNA, 23 nt, Human
caccccaagccccacugccucca

SEQ ID NO: 1141045 - RNA, 19 nt, Human
caccccacccaaccucugc

SEQ ID NO: 1141046 - RNA, 22 nt, Human
caccccaguucccagggcauga

SEQ ID NO: 1141047 - RNA, 24 nt, Human
caccccccaccacaauacccugcu

SEQ ID NO: 1141048 - RNA, 22 nt, Human
caccccccaccccucaacacac

SEQ ID NO: 1141049 - RNA, 23 nt, Human
caccccccaccccucaacacaca

SEQ ID NO: 1141050 - RNA, 18 nt, Human
caccccucaacacacagg

SEQ ID NO: 1141051 - RNA, 22 nt, Human
caccuuaccauguccccaccuc

SEQ ID NO: 1141052 - RNA, 21 nt, Human
cacugcaaccuccgccuccca

SEQ ID NO: 1141053 - RNA, 21 nt, Human
cacugccuccaagccucccac

SEQ ID NO: 1141054 - RNA, 22 nt, Human
cacuuaauauucacagcaacac

SEQ ID NO: 1141055 - RNA, 26 nt, Human
cagaacgaagcccagccuccucugcc

SEQ ID NO: 1141056 - RNA, 22 nt, Human
cagacccaagcccaccagcagg

SEQ ID NO: 1141057 - RNA, 22 nt, Human
cagagcccagugcauccacugc

SEQ ID NO: 1141058 - RNA, 22 nt, Human
cagccccaaaaaggacaccccc

SEQ ID NO: 1141059 - RNA, 21 nt, Human
cagcucaccugggccccuccc

SEQ ID NO: 1141060 - RNA, 24 nt, Human
cagcucaccugggccccuccccaa

SEQ ID NO: 1141061 - RNA, 25 nt, Human
cagcuggagcauccuggucagccaa

SEQ ID NO: 1141062 - RNA, 24 nt, Human
caggguuucaccauguuggccagg

SEQ ID NO: 1141063 - RNA, 26 nt, Human
caguaccugaagaccuguuugcccca

SEQ ID NO: 1141064 - RNA, 19 nt, Human
cagugaugcgaucuuggcu

SEQ ID NO: 1141065 - RNA, 20 nt, Human
caguguauguaucuguuccc

SEQ ID NO: 1141066 - RNA, 25 nt, Human
caugagcaaugacaggaaccauggg

SEQ ID NO: 1141067 - RNA, 23 nt, Human
ccaaaaccgcccuuccuuccccc

SEQ ID NO: 1141068 - RNA, 20 nt, Human
ccaaagugcugggauuacag

SEQ ID NO: 1141069 - RNA, 21 nt, Human
ccaaagugcugggauuacagg

SEQ ID NO: 1141070 - RNA, 21 nt, Human
ccaaagugcugggauuacagg

SEQ ID NO: 1141071 - RNA, 24 nt, Human
ccaaagugcugggauuacaggugu

SEQ ID NO: 1141072 - RNA, 21 nt, Human
ccaagccucccacucugcacu

SEQ ID NO: 1141073 - RNA, 20 nt, Human
ccacaaugucaugugaucag

SEQ ID NO: 1141074 - RNA, 26 nt, Human
ccacccgaaaaguggagaauggccgc

SEQ ID NO: 1141075 - RNA, 23 nt, Human
ccaccuccagaacgaagcccagc

SEQ ID NO: 1141076 - RNA, 24 nt, Human
ccacuggggucccagaaaugaggu

SEQ ID NO: 1141077 - RNA, 20 nt, Human
ccacuucugagcuccagacc

SEQ ID NO: 1141078 - RNA, 24 nt, Human
ccagccccccaccagucagcuacg

SEQ ID NO: 1141079 - RNA, 22 nt, Human
ccaggagggaagcccaaccaca

SEQ ID NO: 1141080 - RNA, 25 nt, Human
ccagugcauccacugcgcaucccca

SEQ ID NO: 1141081 - RNA, 20 nt, Human
cccaaaaaggacacccccca

SEQ ID NO: 1141082 - RNA, 21 nt, Human
cccaaaaaggacaccccccac

SEQ ID NO: 1141083 - RNA, 22 nt, Human
cccaaaaaggacaccccccacc

SEQ ID NO: 1141084 - RNA, 21 nt, Human
cccaagcuggaaacuggaagc

SEQ ID NO: 1141085 - RNA, 19 nt, Human
cccaccacaauacccugcu

SEQ ID NO: 1141086 - RNA, 22 nt, Human
cccaccccacccaaccucugca

SEQ ID NO: 1141087 - RNA, 23 nt, Human
cccaccccacccaaccucugcag

SEQ ID NO: 1141088 - RNA, 19 nt, Human
cccaccuccagaacgaagc

SEQ ID NO: 1141089 - RNA, 20 nt, Human
cccaccuccagaacgaagcc

SEQ ID NO: 1141090 - RNA, 24 nt, Human
cccacuccauccaaauggaaccca

SEQ ID NO: 1141091 - RNA, 19 nt, Human
cccacugccuccaagccuc

SEQ ID NO: 1141092 - RNA, 21 nt, Human
cccagccuccucugcccaucc

SEQ ID NO: 1141093 - RNA, 23 nt, Human
cccaggccaccugggggcucugc

SEQ ID NO: 1141094 - RNA, 21 nt, Human
cccauaggcaacucagacuca

SEQ ID NO: 1141095 - RNA, 25 nt, Human
cccaucuccaccauuuccagcaucc

SEQ ID NO: 1141096 - RNA, 20 nt, Human
ccccaaaaaggacacccccc

SEQ ID NO: 1141097 - RNA, 23 nt, Human
ccccaaaaaggacaccccccacc

SEQ ID NO: 1141098 - RNA, 24 nt, Human
ccccaagccccacugccuccaagg

SEQ ID NO: 1141099 - RNA, 24 nt, Human
ccccaccccacccaaccucugcag

SEQ ID NO: 1141100 - RNA, 22 nt, Human
ccccacugccuccaagccuccc

SEQ ID NO: 1141101 - RNA, 21 nt, Human
ccccaggccaccugggggcuc

SEQ ID NO: 1141102 - RNA, 27 nt, Human
ccccauucucccccuggggcaccccag

SEQ ID NO: 1141103 - RNA, 18 nt, Human
cccccaccccacccaacc

SEQ ID NO: 1141104 - RNA, 27 nt, Human
cccccaccccucaacacacaggagcuc

SEQ ID NO: 1141105 - RNA, 19 nt, Human
ccccuggggcaccccaguu

SEQ ID NO: 1141106 - RNA, 23 nt, Human
ccccuggggcaccccaguuccca

SEQ ID NO: 1141107 - RNA, 23 nt, Human
cccgaauagcugggacuacaguu

SEQ ID NO: 1141108 - RNA, 23 nt, Human
cccuagagcuccuggaagaaccc

SEQ ID NO: 1141109 - RNA, 23 nt, Human
cccucaacacacaggagcuccac

SEQ ID NO: 1141110 - RNA, 18 nt, Human
cccucacccacuccaucc

SEQ ID NO: 1141111 - RNA, 18 nt, Human
cccuggagcccuuggagg

SEQ ID NO: 1141112 - RNA, 19 nt, Human
cccuuccuucccccuugcc

SEQ ID NO: 1141113 - RNA, 21 nt, Human
cccuuggaggccuaugaggcc

SEQ ID NO: 1141114 - RNA, 20 nt, Human
ccucaacacacaggagcucc

SEQ ID NO: 1141115 - RNA, 23 nt, Human
ccucacaucaccccccaccccuc

SEQ ID NO: 1141116 - RNA, 21 nt, Human
ccuccaagccucccacucugc

SEQ ID NO: 1141117 - RNA, 22 nt, Human
ccuccagaacgaagcccagccu

SEQ ID NO: 1141118 - RNA, 24 nt, Human
ccucccagguucaagcaguucucc

SEQ ID NO: 1141119 - RNA, 22 nt, Human
ccuccuggccuuggcucagagg

SEQ ID NO: 1141120 - RNA, 22 nt, Human
ccucugggaagccuccuggccu

SEQ ID NO: 1141121 - RNA, 22 nt, Human
ccuggccccccaccccacccaa

SEQ ID NO: 1141122 - RNA, 19 nt, Human
ccuggccuuggcucagagg

SEQ ID NO: 1141123 - RNA, 19 nt, Human
ccuguacauuguacuucuc

SEQ ID NO: 1141124 - RNA, 25 nt, Human
ccuugugccgugcccccgacccucc

SEQ ID NO: 1141125 - RNA, 22 nt, Human
ccuuucaccaaaaccgcccuuc

SEQ ID NO: 1141126 - RNA, 19 nt, Human
cgccacaaugucaugugau

SEQ ID NO: 1141127 - RNA, 18 nt, Human
cgcccuuccuucccccuu

SEQ ID NO: 1141128 - RNA, 27 nt, Human
cgccucaaccucccgaauagcugggac

SEQ ID NO: 1141129 - RNA, 20 nt, Human
cuacauccacaaagccauga

SEQ ID NO: 1141130 - RNA, 18 nt, Human
cucacaucaccccccacc

SEQ ID NO: 1141131 - RNA, 21 nt, Human
cucaccugggccccuccccaa

SEQ ID NO: 1141132 - RNA, 19 nt, Human
cucaccuuaccaugucccc

SEQ ID NO: 1141133 - RNA, 24 nt, Human
cucacugcaaccuccgccucccag

SEQ ID NO: 1141134 - RNA, 20 nt, Human
cuccccaagccacaggacau

SEQ ID NO: 1141135 - RNA, 20 nt, Human
cucuuccccauucucccccu

SEQ ID NO: 1141136 - RNA, 18 nt, Human
cucuugaccucgugaucc

SEQ ID NO: 1141137 - RNA, 25 nt, Human
cucuugaccucgugauccacccacc

SEQ ID NO: 1141138 - RNA, 23 nt, Human
cugcaaccuccgccucccagguu

SEQ ID NO: 1141139 - RNA, 24 nt, Human
cugcaaccuccgccucccagguuc

SEQ ID NO: 1141140 - RNA, 23 nt, Human
cugcuccugggucaucacuuccc

SEQ ID NO: 1141141 - RNA, 20 nt, Human
cuggagggacucccugcugg

SEQ ID NO: 1141142 - RNA, 22 nt, Human
cuguacauuguacuucucgggu

SEQ ID NO: 1141143 - RNA, 21 nt, Human
cuguaucuguacuggccuggg

SEQ ID NO: 1141144 - RNA, 20 nt, Human
cuguggcagcucaccugggc

SEQ ID NO: 1141145 - RNA, 18 nt, Human
cuugggcuaagacauagc

SEQ ID NO: 1141146 - RNA, 25 nt, Human
gaaaaucccucauucuguuucuguc

SEQ ID NO: 1141147 - RNA, 19 nt, Human
gaacauauacagaacauaa

SEQ ID NO: 1141148 - RNA, 20 nt, Human
gaacccaggagggaagccca

SEQ ID NO: 1141149 - RNA, 21 nt, Human
gaagcccagccuccucugccc

SEQ ID NO: 1141150 - RNA, 26 nt, Human
gaauagcugggacuacaguugugugc

SEQ ID NO: 1141151 - RNA, 21 nt, Human
gaccucgugauccacccaccu

SEQ ID NO: 1141152 - RNA, 24 nt, Human
gaccucgugauccacccaccuugg

SEQ ID NO: 1141153 - RNA, 25 nt, Human
gaccucgugauccacccaccuuggc

SEQ ID NO: 1141154 - RNA, 19 nt, Human
gagaagaccaaggcccaga

SEQ ID NO: 1141155 - RNA, 25 nt, Human
gagcacuuacucugagcuagaaacg

SEQ ID NO: 1141156 - RNA, 20 nt, Human
gagggcagggggagggguac

SEQ ID NO: 1141157 - RNA, 21 nt, Human
gauccuggccccccaccccac

SEQ ID NO: 1141158 - RNA, 21 nt, Human
gauuacaggugugaaccacca

SEQ ID NO: 1141159 - RNA, 22 nt, Human
gcaaccuccgccucccagguuc

SEQ ID NO: 1141160 - RNA, 21 nt, Human
gcagcucaccugggccccucc

SEQ ID NO: 1141161 - RNA, 18 nt, Human
gccuccucugcccauccc

SEQ ID NO: 1141162 - RNA, 24 nt, Human
gcugccccucacaucaccccccac

SEQ ID NO: 1141163 - RNA, 19 nt, Human
gcuggggggcgggucccgg

SEQ ID NO: 1141164 - RNA, 19 nt, Human
ggacaccccccaccacaau

SEQ ID NO: 1141165 - RNA, 18 nt, Human
ggauccuggccccccacc

SEQ ID NO: 1141166 - RNA, 19 nt, Human
ggcaccccaguucccaggg

SEQ ID NO: 1141167 - RNA, 24 nt, Human
ggcagggggagggguaccgggggc

SEQ ID NO: 1141168 - RNA, 23 nt, Human
ggcccaagcuggaaacuggaagc

SEQ ID NO: 1141169 - RNA, 19 nt, Human
ggccccccaccccacccaa

SEQ ID NO: 1141170 - RNA, 20 nt, Human
ggccccccaccccacccaac

SEQ ID NO: 1141171 - RNA, 18 nt, Human
gggaagcccaaccacagg

SEQ ID NO: 1141172 - RNA, 24 nt, Human
gggaaggcacuaaugaaaaaaggc

SEQ ID NO: 1141173 - RNA, 19 nt, Human
gggcccuggucagccucag

SEQ ID NO: 1141174 - RNA, 21 nt, Human
ggguggagggcagggggaggg

SEQ ID NO: 1141175 - RNA, 22 nt, Human
ggguuucaccauguuggccagg

SEQ ID NO: 1141176 - RNA, 21 nt, Human
ggugaugcugccuucugagcc

SEQ ID NO: 1141177 - RNA, 24 nt, Human
gguuucaccauguuggccaggaug

SEQ ID NO: 1141178 - RNA, 22 nt, Human
guaaagugcagcucccagcccc

SEQ ID NO: 1141179 - RNA, 24 nt, Human
gucuugcucugucaccaggcugga

SEQ ID NO: 1141180 - RNA, 24 nt, Human
gugagcucucccaccccaagcccc

SEQ ID NO: 1141181 - RNA, 24 nt, Human
gugauccacccaccuuggccuccc

SEQ ID NO: 1141182 - RNA, 21 nt, Human
gugauggugaagagacacagc

SEQ ID NO: 1141183 - RNA, 21 nt, Human
gugccuggcugcugcuccugg

SEQ ID NO: 1141184 - RNA, 22 nt, Human
uaaaaaauucugaucuaccuuc

SEQ ID NO: 1141185 - RNA, 25 nt, Human
uaaaaaauucugaucuaccuucuug

SEQ ID NO: 1141186 - RNA, 23 nt, Human
uaaagcacagaacauauacagaa

SEQ ID NO: 1141187 - RNA, 23 nt, Human
uaauuauuguauuuuuaguagag

SEQ ID NO: 1141188 - RNA, 24 nt, Human
uaauuauuguauuuuuaguagaga

SEQ ID NO: 1141189 - RNA, 20 nt, Human
uaauuuuugcuauuguagag

SEQ ID NO: 1141190 - RNA, 24 nt, Human
uacaggugugaaccaccacgccca

SEQ ID NO: 1141191 - RNA, 20 nt, Human
uaccauguccccaccuccag

SEQ ID NO: 1141192 - RNA, 21 nt, Human
uaccccaggaaacacccccaa

SEQ ID NO: 1141193 - RNA, 22 nt, Human
uagagacaggguuucaccaugu

SEQ ID NO: 1141194 - RNA, 18 nt, Human
uaggugccuggcugcugc

SEQ ID NO: 1141195 - RNA, 24 nt, Human
uaguagagacaggguuucaccaug

SEQ ID NO: 1141196 - RNA, 26 nt, Human
uaguagagacaggguuucaccauguu

SEQ ID NO: 1141197 - RNA, 27 nt, Human
uauacagaacauaaacagauauauagu

SEQ ID NO: 1141198 - RNA, 19 nt, Human
ucaagaucacacaccuuuu

SEQ ID NO: 1141199 - RNA, 27 nt, Human
ucaaucccggcccucgucuccacgcug

SEQ ID NO: 1141200 - RNA, 20 nt, Human
ucacacaccuuuuuccaccc

SEQ ID NO: 1141201 - RNA, 22 nt, Human
ucaccaggcuggaaugcaguga

SEQ ID NO: 1141202 - RNA, 24 nt, Human
ucaccauguuggccaggauggucu

SEQ ID NO: 1141203 - RNA, 18 nt, Human
ucacccacuccauccaaa

SEQ ID NO: 1141204 - RNA, 19 nt, Human
ucacugcaaccuccgccuc

SEQ ID NO: 1141205 - RNA, 23 nt, Human
ucacugcaaccuccgccucccag

SEQ ID NO: 1141206 - RNA, 24 nt, Human
ucacugcaaccuccgccucccagg

SEQ ID NO: 1141207 - RNA, 27 nt, Human
ucacugcaaccuccgccucccagguuc

SEQ ID NO: 1141208 - RNA, 22 nt, Human
ucagccacuccugaggagcaga

SEQ ID NO: 1141209 - RNA, 24 nt, Human
ucaggauccccucaaauuauuucc

SEQ ID NO: 1141210 - RNA, 19 nt, Human
uccaaagccagccccccac

SEQ ID NO: 1141211 - RNA, 23 nt, Human
uccaccauuuccagcauccuaca

SEQ ID NO: 1141212 - RNA, 21 nt, Human
uccagugucucuugaccaccu

SEQ ID NO: 1141213 - RNA, 23 nt, Human
ucccaaagugcugggauuacagg

SEQ ID NO: 1141214 - RNA, 22 nt, Human
ucccaccccaagccccacugcc

SEQ ID NO: 1141215 - RNA, 20 nt, Human
ucccacucugcacucaccuu

SEQ ID NO: 1141216 - RNA, 19 nt, Human
ucccagggcaugaaagacu

SEQ ID NO: 1141217 - RNA, 21 nt, Human
ucccagguucaagcaguucuc

SEQ ID NO: 1141218 - RNA, 24 nt, Human
ucccagguucaagcaguucucccg

SEQ ID NO: 1141219 - RNA, 22 nt, Human
uccccaggccaccugggggcuc

SEQ ID NO: 1141220 - RNA, 23 nt, Human
uccccaggccaccugggggcucu

SEQ ID NO: 1141221 - RNA, 18 nt, Human
uccccaggcccaagcugg

SEQ ID NO: 1141222 - RNA, 21 nt, Human
uccccaggcccaagcuggaaa

SEQ ID NO: 1141223 - RNA, 25 nt, Human
uccccaguguccagacagggccugc

SEQ ID NO: 1141224 - RNA, 19 nt, Human
uccccauucucccccuggg

SEQ ID NO: 1141225 - RNA, 22 nt, Human
ucccugcuggcucuguccugag

SEQ ID NO: 1141226 - RNA, 19 nt, Human
uccugggucaucacuuccc

SEQ ID NO: 1141227 - RNA, 22 nt, Human
uccuuauaauuaccugucgccc

SEQ ID NO: 1141228 - RNA, 20 nt, Human
ucucaguacagucuccaucc

SEQ ID NO: 1141229 - RNA, 23 nt, Human
ucuccaaaccauuuccucacuug

SEQ ID NO: 1141230 - RNA, 26 nt, Human
ucucccgccucaaccucccgaauagc

SEQ ID NO: 1141231 - RNA, 19 nt, Human
ucugacuccucccucuccc

SEQ ID NO: 1141232 - RNA, 18 nt, Human
ucugagcuagaaacgauu

SEQ ID NO: 1141233 - RNA, 22 nt, Human
ucugcagcugcuucccuggagc

SEQ ID NO: 1141234 - RNA, 19 nt, Human
ucugggaagccuccuggcc

SEQ ID NO: 1141235 - RNA, 23 nt, Human
ucuguaucuguacuggccugggg

SEQ ID NO: 1141236 - RNA, 23 nt, Human
ucuguccugagggguggagggca

SEQ ID NO: 1141237 - RNA, 24 nt, Human
ucugucuccuccucugggaagccu

SEQ ID NO: 1141238 - RNA, 21 nt, Human
ucuugcucugucaccaggcug

SEQ ID NO: 1141239 - RNA, 22 nt, Human
ucuugcucugucaccaggcugg

SEQ ID NO: 1141240 - RNA, 23 nt, Human
ucuugcucugucaccaggcugga

SEQ ID NO: 1141241 - RNA, 22 nt, Human
ucuuugcaggcccaucuccacc

SEQ ID NO: 1141242 - RNA, 22 nt, Human
ugaaaaaaggcuaaaaaauucu

SEQ ID NO: 1141243 - RNA, 22 nt, Human
ugaaaaucccucauucuguuuc

SEQ ID NO: 1141244 - RNA, 27 nt, Human
ugaagaugcuggggggcgggucccggg

SEQ ID NO: 1141245 - RNA, 19 nt, Human
ugaaggugaagaugcuggg

SEQ ID NO: 1141246 - RNA, 20 nt, Human
ugaccucgugauccacccac

SEQ ID NO: 1141247 - RNA, 23 nt, Human
ugaccucgugauccacccaccuu

SEQ ID NO: 1141248 - RNA, 23 nt, Human
ugacuccucccucucccucaccc

SEQ ID NO: 1141249 - RNA, 22 nt, Human
ugacuucacaaaacccugucuu

SEQ ID NO: 1141250 - RNA, 19 nt, Human
ugagaagaccaaggcccag

SEQ ID NO: 1141251 - RNA, 22 nt, Human
ugagaagaccaaggcccagaag

SEQ ID NO: 1141252 - RNA, 28 nt, Human
ugagcuagaaacgauucucaacauuuua

SEQ ID NO: 1141253 - RNA, 23 nt, Human
ugagcucucccaccccaagcccc

SEQ ID NO: 1141254 - RNA, 22 nt, Human
ugaggcaccucaccucuacacc

SEQ ID NO: 1141255 - RNA, 24 nt, Human
ugauccacccaccuuggccuccca

SEQ ID NO: 1141256 - RNA, 22 nt, Human
ugccuggccccagggucagugg

SEQ ID NO: 1141257 - RNA, 25 nt, Human
ugccuggcugcugcuccuggguccu

SEQ ID NO: 1141258 - RNA, 19 nt, Human
ugccuucugagccccaggc

SEQ ID NO: 1141259 - RNA, 23 nt, Human
ugcucaagaucacacaccuuuuu

SEQ ID NO: 1141260 - RNA, 23 nt, Human
ugcugggauuacaggugugaacc

SEQ ID NO: 1141261 - RNA, 21 nt, Human
ugcuguggcagcucaccuggg

SEQ ID NO: 1141262 - RNA, 18 nt, Human
ugcuuuauuggggaaggg

SEQ ID NO: 1141263 - RNA, 24 nt, Human
uggaaugcagugaugcgaucuugg

SEQ ID NO: 1141264 - RNA, 20 nt, Human
uggagggacucccugcuggc

SEQ ID NO: 1141265 - RNA, 19 nt, Human
uggauccuggccccccacc

SEQ ID NO: 1141266 - RNA, 24 nt, Human
uggccaggauggucucgaucucuu

SEQ ID NO: 1141267 - RNA, 24 nt, Human
uggccccccaccccacccaaccuc

SEQ ID NO: 1141268 - RNA, 18 nt, Human
uggccuuggcucagaggc

SEQ ID NO: 1141269 - RNA, 19 nt, Human
uggcucaggugugcuuucu

SEQ ID NO: 1141270 - RNA, 19 nt, Human
ugggacuacaguugugugc

SEQ ID NO: 1141271 - RNA, 22 nt, Human
ugggauuacaggugugaaccac

SEQ ID NO: 1141272 - RNA, 23 nt, Human
ugggauuacaggugugaaccacc

SEQ ID NO: 1141273 - RNA, 24 nt, Human
ugggauuacaggugugaaccacca

SEQ ID NO: 1141274 - RNA, 24 nt, Human
ugggauuacaggugugaaccacca

SEQ ID NO: 1141275 - RNA, 23 nt, Human
ugggggagcuccaaggcuuuuuu

SEQ ID NO: 1141276 - RNA, 19 nt, Human
uggugaagagacacagcug

SEQ ID NO: 1141277 - RNA, 19 nt, Human
uguaaagugcagcucccag

SEQ ID NO: 1141278 - RNA, 22 nt, Human
ugucauucuuucaucucaccuu

SEQ ID NO: 1141279 - RNA, 20 nt, Human
uguccugucuaucuggaggg

SEQ ID NO: 1141280 - RNA, 19 nt, Human
ugugccauaacacccagcu

SEQ ID NO: 1141281 - RNA, 18 nt, Human
uguggauggacauuuggg

SEQ ID NO: 1141282 - RNA, 19 nt, Human
uuaauauucacagcaacac

SEQ ID NO: 1141283 - RNA, 22 nt, Human
uuacuccacacucuagcuacau

SEQ ID NO: 1141284 - RNA, 24 nt, Human
uuaguagagacaggguuucaccau

SEQ ID NO: 1141285 - RNA, 22 nt, Human
uuccaagucccauaggcaacuc

SEQ ID NO: 1141286 - RNA, 25 nt, Human
uucccuggagcccuuggaggccuau

SEQ ID NO: 1141287 - RNA, 21 nt, Human
uuccugugucuucauguguuc

SEQ ID NO: 1141288 - RNA, 21 nt, Human
uucuaaaccucaccuuaccau

SEQ ID NO: 1141289 - RNA, 23 nt, Human
uucugacuccucccucucccuca

SEQ ID NO: 1141290 - RNA, 18 nt, Human
uuggccucccaaagugcu

SEQ ID NO: 1141291 - RNA, 21 nt, Human
uugugccgugcccccgacccu

SEQ ID NO: 1141292 - RNA, 19 nt, Human
uuucaccauguuggccagg

SEQ ID NO: 1141293 - RNA, 20 nt, Human
uuucaccauguuggccagga

SEQ ID NO: 1141294 - RNA, 18 nt, Human
uuuccuauuccuucaugu

SEQ ID NO: 1141295 - RNA, 21 nt, Human
uuuuccaccccccauuccaag

SEQ ID NO: 1141296 - RNA, 24 nt, Human
uuuuuaguagagacaggguuucac

SEQ ID NO: 1141297 - RNA, 18 nt, Human
aauggaauuauacaguau

SEQ ID NO: 1141298 - RNA, 24 nt, Human
acaagacacagcaauacacuucaa

SEQ ID NO: 1141299 - RNA, 21 nt, Human
accggcucuugagcgggggca

SEQ ID NO: 1141300 - RNA, 23 nt, Human
acuaaaauacauaaaaagcuagu

SEQ ID NO: 1141301 - RNA, 22 nt, Human
caaaguaaacuauaaauaccag

SEQ ID NO: 1141302 - RNA, 24 nt, Human
caacuaaaauacauaaaaagcuag

SEQ ID NO: 1141303 - RNA, 22 nt, Human
caagacacagcaauacacuuca

SEQ ID NO: 1141304 - RNA, 18 nt, Human
caccccccucccccgacc

SEQ ID NO: 1141305 - RNA, 22 nt, Human
caccuuuucaccaccccccucc

SEQ ID NO: 1141306 - RNA, 19 nt, Human
cacuucaauucaucugggg

SEQ ID NO: 1141307 - RNA, 21 nt, Human
cagcuuccagccccagccccu

SEQ ID NO: 1141308 - RNA, 20 nt, Human
ccaccccccucccccgaccc

SEQ ID NO: 1141309 - RNA, 21 nt, Human
ccaccccccucccccgacccc

SEQ ID NO: 1141310 - RNA, 20 nt, Human
cccccgaccccggccgaccc

SEQ ID NO: 1141311 - RNA, 18 nt, Human
cccggccgacccagcccc

SEQ ID NO: 1141312 - RNA, 23 nt, Human
cccugucaccuuuucaccacccc

SEQ ID NO: 1141313 - RNA, 21 nt, Human
cuaaauuaugauuuuauaaca

SEQ ID NO: 1141314 - RNA, 22 nt, Human
cucccccgaccccggccgaccc

SEQ ID NO: 1141315 - RNA, 20 nt, Human
cuucauguaaauggaauuau

SEQ ID NO: 1141316 - RNA, 20 nt, Human
cuuccagccccagccccuuu

SEQ ID NO: 1141317 - RNA, 19 nt, Human
cuugcaaacauuaaucuac

SEQ ID NO: 1141318 - RNA, 19 nt, Human
gcgggggcagcucccuguc

SEQ ID NO: 1141319 - RNA, 20 nt, Human
gcucuugagcgggggcagcu

SEQ ID NO: 1141320 - RNA, 25 nt, Human
gcuuccagccccagccccuugcaaa

SEQ ID NO: 1141321 - RNA, 21 nt, Human
uaaaaagcuaguuaaagcaag

SEQ ID NO: 1141322 - RNA, 20 nt, Human
uaaaauuucauaggugacac

SEQ ID NO: 1141323 - RNA, 21 nt, Human
uaaauaccagugggaagacua

SEQ ID NO: 1141324 - RNA, 22 nt, Human
uaaauggaauuauacaguaugg

SEQ ID NO: 1141325 - RNA, 22 nt, Human
uaacaaguaggugccuuuaaaa

SEQ ID NO: 1141326 - RNA, 21 nt, Human
uaagccgauauaguaaacaac

SEQ ID NO: 1141327 - RNA, 20 nt, Human
uaccuuaaaauaugacucug

SEQ ID NO: 1141328 - RNA, 22 nt, Human
uagaaaugaggcauguuucuaa

SEQ ID NO: 1141329 - RNA, 21 nt, Human
uagaauguaucuguuuugacu

SEQ ID NO: 1141330 - RNA, 20 nt, Human
uauaacaaguaggugccuuu

SEQ ID NO: 1141331 - RNA, 25 nt, Human
ucacuguaagauuccucaugcccau

SEQ ID NO: 1141332 - RNA, 20 nt, Human
ucagacccccaaccaccggc

SEQ ID NO: 1141333 - RNA, 24 nt, Human
ucccugucaccuuuucaccacccc

SEQ ID NO: 1141334 - RNA, 21 nt, Human
ucuacaauccaacuuuagagc

SEQ ID NO: 1141335 - RNA, 25 nt, Human
ucugugccuaauaaaauuucauagg

SEQ ID NO: 1141336 - RNA, 19 nt, Human
ugaaauauaauuuacauac

SEQ ID NO: 1141337 - RNA, 24 nt, Human
ugaaauauaauuuacauacuauag

SEQ ID NO: 1141338 - RNA, 26 nt, Human
ugaaauauaauuuacauacuauagaa

SEQ ID NO: 1141339 - RNA, 18 nt, Human
ugaccuaauuauuaauau

SEQ ID NO: 1141340 - RNA, 25 nt, Human
uuauacaguaugguaaacacacuuu

SEQ ID NO: 1141341 - RNA, 24 nt, Human
uucuggaugcuucauguaaaugga

SEQ ID NO: 1141342 - RNA, 23 nt, Human
uuucuaagccgauauaguaaaca

SEQ ID NO: 1141343 - RNA, 18 nt, Human
uuuucaccaccccccucc

SEQ ID NO: 1141344 - RNA, 20 nt, Human
aaaaaaaaaaaaacagggaa

SEQ ID NO: 1141345 - RNA, 21 nt, Human
aaaaaaaaaaaacagggaagg

SEQ ID NO: 1141346 - RNA, 24 nt, Human
aaaaaaacagggaaggaaccuaaa

SEQ ID NO: 1141347 - RNA, 19 nt, Human
aaaaagccuccaugcaguc

SEQ ID NO: 1141348 - RNA, 22 nt, Human
aaagucagauuuggugguucuc

SEQ ID NO: 1141349 - RNA, 21 nt, Human
aaauccacagaaauucacucu

SEQ ID NO: 1141350 - RNA, 21 nt, Human
aacauuuuuuacagcaaaacc

SEQ ID NO: 1141351 - RNA, 23 nt, Human
aaccaucucaggcuaacacccaa

SEQ ID NO: 1141352 - RNA, 20 nt, Human
aacucccuccccaaacgacc

SEQ ID NO: 1141353 - RNA, 22 nt, Human
aacucccuccccaaacgaccug

SEQ ID NO: 1141354 - RNA, 22 nt, Human
aagaauugaacaggcaugcagg

SEQ ID NO: 1141355 - RNA, 21 nt, Human
aaggaaccuaaauucugagac

SEQ ID NO: 1141356 - RNA, 22 nt, Human
aaugcugaaaaagccuccaugc

SEQ ID NO: 1141357 - RNA, 23 nt, Human
accuagaagucuaauggcuuuca

SEQ ID NO: 1141358 - RNA, 19 nt, Human
agaagaaacaaagaauuga

SEQ ID NO: 1141359 - RNA, 21 nt, Human
agaccaaauguaaaagucaga

SEQ ID NO: 1141360 - RNA, 19 nt, Human
aggaggggaggaaugaggg

SEQ ID NO: 1141361 - RNA, 24 nt, Human
agggggaaggagaagaaacaaaga

SEQ ID NO: 1141362 - RNA, 18 nt, Human
auggggaggagggggugg

SEQ ID NO: 1141363 - RNA, 20 nt, Human
auggggaggagggggugguc

SEQ ID NO: 1141364 - RNA, 24 nt, Human
auugguauaaaauacaguuuaaac

SEQ ID NO: 1141365 - RNA, 21 nt, Human
caacucccuccccaaacgacc

SEQ ID NO: 1141366 - RNA, 22 nt, Human
caccuucaacgcuaaccugcuu

SEQ ID NO: 1141367 - RNA, 18 nt, Human
cacucuugccuuuaagaa

SEQ ID NO: 1141368 - RNA, 28 nt, Human
cacucuugccuuuaagaacuuuugaaaa

SEQ ID NO: 1141369 - RNA, 23 nt, Human
cagcagggucugcgugacugaug

SEQ ID NO: 1141370 - RNA, 22 nt, Human
caguggcuccagcagggucugc

SEQ ID NO: 1141371 - RNA, 22 nt, Human
caguuugaaacauuuuuuacag

SEQ ID NO: 1141372 - RNA, 24 nt, Human
cauaccaccuucaacggggaagcc

SEQ ID NO: 1141373 - RNA, 22 nt, Human
caugcaggcuuuuccauaccac

SEQ ID NO: 1141374 - RNA, 20 nt, Human
cauuacaacucccuccccaa

SEQ ID NO: 1141375 - RNA, 21 nt, Human
cccuccccaaacgaccuguaa

SEQ ID NO: 1141376 - RNA, 21 nt, Human
cgaccuguaaccaucucaggc

SEQ ID NO: 1141377 - RNA, 24 nt, Human
gaacaggcaugcaggcuuuuccau

SEQ ID NO: 1141378 - RNA, 18 nt, Human
gacugauggaaguggaua

SEQ ID NO: 1141379 - RNA, 22 nt, Human
gaggggaaggagguagugggag

SEQ ID NO: 1141380 - RNA, 19 nt, Human
gaggggaggaaugagggga

SEQ ID NO: 1141381 - RNA, 18 nt, Human
gagguagugggaggggga

SEQ ID NO: 1141382 - RNA, 23 nt, Human
gagguagugggagggggaaggag

SEQ ID NO: 1141383 - RNA, 20 nt, Human
gcgaaggaggggaggaauga

SEQ ID NO: 1141384 - RNA, 22 nt, Human
ggaaccuaaauucugagaccaa

SEQ ID NO: 1141385 - RNA, 19 nt, Human
ggaaggagguagugggagg

SEQ ID NO: 1141386 - RNA, 24 nt, Human
ggagaguaaaguaggcaagaauga

SEQ ID NO: 1141387 - RNA, 18 nt, Human
ggauggggaggagggggu

SEQ ID NO: 1141388 - RNA, 20 nt, Human
gggaaggagguagugggagg

SEQ ID NO: 1141389 - RNA, 18 nt, Human
gggaguuuccaaggggug

SEQ ID NO: 1141390 - RNA, 18 nt, Human
gggauggggaggaggggg

SEQ ID NO: 1141391 - RNA, 20 nt, Human
ggggaggaaugaggggaagg

SEQ ID NO: 1141392 - RNA, 21 nt, Human
ggggaggaaugaggggaagga

SEQ ID NO: 1141393 - RNA, 19 nt, Human
gguagugggagggggaagg

SEQ ID NO: 1141394 - RNA, 20 nt, Human
ggugggauggggaggagggg

SEQ ID NO: 1141395 - RNA, 19 nt, Human
gguggucagagaugguuuc

SEQ ID NO: 1141396 - RNA, 20 nt, Human
guaaccaucucaggcuaaca

SEQ ID NO: 1141397 - RNA, 18 nt, Human
guuuuuuuaaaaaaaaaa

SEQ ID NO: 1141398 - RNA, 21 nt, Human
guuuuuuuaaaaaaaaaaaaa

SEQ ID NO: 1141399 - RNA, 20 nt, Human
uaaaagagauugagcgagcg

SEQ ID NO: 1141400 - RNA, 18 nt, Human
uaaagaaccuaaaagcug

SEQ ID NO: 1141401 - RNA, 25 nt, Human
uaaaguaggcaagaaugagcagcca

SEQ ID NO: 1141402 - RNA, 24 nt, Human
uaaguuuaaugcuaauuccaugcu

SEQ ID NO: 1141403 - RNA, 21 nt, Human
uaccuagaagucuaauggcuu

SEQ ID NO: 1141404 - RNA, 25 nt, Human
ucagugacaauggggaguuuccaag

SEQ ID NO: 1141405 - RNA, 20 nt, Human
uccaaggggugggaugggga

SEQ ID NO: 1141406 - RNA, 22 nt, Human
uccccaaacgaccuguaaccau

SEQ ID NO: 1141407 - RNA, 19 nt, Human
ucuaauggcuuucaaaugu

SEQ ID NO: 1141408 - RNA, 19 nt, Human
ucugcgugacugauggaag

SEQ ID NO: 1141409 - RNA, 23 nt, Human
ugagcgagcgaaggaggggagga

SEQ ID NO: 1141410 - RNA, 24 nt, Human
ugagcgagcgaaggaggggaggaa

SEQ ID NO: 1141411 - RNA, 21 nt, Human
ugaggggaaggagguagugga

SEQ ID NO: 1141412 - RNA, 22 nt, Human
ugaggggaaggagguaguggga

SEQ ID NO: 1141413 - RNA, 20 nt, Human
ugcauuaccuagaagucuaa

SEQ ID NO: 1141414 - RNA, 20 nt, Human
ugggauggggaggagggggu

SEQ ID NO: 1141415 - RNA, 25 nt, Human
ugggauggggaggagggggugguca

SEQ ID NO: 1141416 - RNA, 20 nt, Human
uggggaggagggggugguca

SEQ ID NO: 1141417 - RNA, 24 nt, Human
uguuaucggcaccaugcuuuucag

SEQ ID NO: 1141418 - RNA, 19 nt, Human
uucagcaacauuucagcac

SEQ ID NO: 1141419 - RNA, 21 nt, Human
aaacuuaucugacugauccca

SEQ ID NO: 1141420 - RNA, 22 nt, Human
acaucacaguucccaaaaggac

SEQ ID NO: 1141421 - RNA, 19 nt, Human
acugaucccauccucuucu

SEQ ID NO: 1141422 - RNA, 25 nt, Human
aucaaaugaccucucugugaaaugc

SEQ ID NO: 1141423 - RNA, 23 nt, Human
cagcucaccaauauucccuuacu

SEQ ID NO: 1141424 - RNA, 18 nt, Human
cccgagcugcagccgugc

SEQ ID NO: 1141425 - RNA, 23 nt, Human
cccgagcugcagccgugcagagg

SEQ ID NO: 1141426 - RNA, 22 nt, Human
ccucuucugaagccaugggggc

SEQ ID NO: 1141427 - RNA, 20 nt, Human
cugcagccgugcagaggaag

SEQ ID NO: 1141428 - RNA, 19 nt, Human
ggaaacgccgcgccaagcc

SEQ ID NO: 1141429 - RNA, 23 nt, Human
ggccgaaggcccgagcugcagcc

SEQ ID NO: 1141430 - RNA, 21 nt, Human
gggcugggucaggccgaaggc

SEQ ID NO: 1141431 - RNA, 18 nt, Human
uaccaaaagaucaaauga

SEQ ID NO: 1141432 - RNA, 22 nt, Human
uaccaaaagaucaaaugaccuu

SEQ ID NO: 1141433 - RNA, 24 nt, Human
uauuuuauuuaaauaaauccucca

SEQ ID NO: 1141434 - RNA, 22 nt, Human
uccacaucacaucacaguuccc

SEQ ID NO: 1141435 - RNA, 22 nt, Human
ugaaaugcaccugcacauucuc

SEQ ID NO: 1141436 - RNA, 27 nt, Human
uuccacaucacaucacaguucccaaaa

SEQ ID NO: 1141437 - RNA, 22 nt, Human
uuuuuuuuuuuuuuuuuuguuu

SEQ ID NO: 1141438 - RNA, 24 nt, Human
uuuuuuuuuuuuuuuuuuuuuggg

SEQ ID NO: 1141439 - RNA, 21 nt, Human
aaacuuaucugacugauccca

SEQ ID NO: 1141440 - RNA, 18 nt, Human
aaccgagcgcagaggccu

SEQ ID NO: 1141441 - RNA, 22 nt, Human
acaucacaguucccaaaaggac

SEQ ID NO: 1141442 - RNA, 22 nt, Human
accgagcgcagaggccuacccg

SEQ ID NO: 1141443 - RNA, 25 nt, Human
auuucuguugcaacuuguucuugau

SEQ ID NO: 1141444 - RNA, 21 nt, Human
caagcccucaaaccgagcgca

SEQ ID NO: 1141445 - RNA, 21 nt, Human
caagcccucaaaccgagcgca

SEQ ID NO: 1141446 - RNA, 22 nt, Human
caccuuuaccucuucuagaucu

SEQ ID NO: 1141447 - RNA, 20 nt, Human
cagcaacaccuuuaccucuu

SEQ ID NO: 1141448 - RNA, 26 nt, Human
cagcaacaccuuuaccucuucuagau

SEQ ID NO: 1141449 - RNA, 23 nt, Human
cagcucaccaauauucccuuacu

SEQ ID NO: 1141450 - RNA, 22 nt, Human
ccaagcccucaaaccgagcgca

SEQ ID NO: 1141451 - RNA, 18 nt, Human
cccgagcugcagccgugc

SEQ ID NO: 1141452 - RNA, 23 nt, Human
cccgagcugcagccgugcagagg

SEQ ID NO: 1141453 - RNA, 21 nt, Human
cccgcacgagucgcagcgccg

SEQ ID NO: 1141454 - RNA, 23 nt, Human
cccgcacgagucgcagcgccgca

SEQ ID NO: 1141455 - RNA, 21 nt, Human
cgcgcacaccgacccugugcg

SEQ ID NO: 1141456 - RNA, 25 nt, Human
cuaguagccuuuuccagcaacaccu

SEQ ID NO: 1141457 - RNA, 20 nt, Human
cugcagccgugcagaggaag

SEQ ID NO: 1141458 - RNA, 19 nt, Human
ggaaacgccgcgccaagcc

SEQ ID NO: 1141459 - RNA, 23 nt, Human
ggccgaaggcccgagcugcagcc

SEQ ID NO: 1141460 - RNA, 18 nt, Human
gggagcaaccacagcagc

SEQ ID NO: 1141461 - RNA, 21 nt, Human
gggcugggucaggccgaaggc

SEQ ID NO: 1141462 - RNA, 18 nt, Human
uaccaaaagaucaaauga

SEQ ID NO: 1141463 - RNA, 20 nt, Human
uaccaaaagaucaaaugacc

SEQ ID NO: 1141464 - RNA, 21 nt, Human
uaccucuucuagaucuuucug

SEQ ID NO: 1141465 - RNA, 24 nt, Human
uauuuuauuuaaauaaauccucca

SEQ ID NO: 1141466 - RNA, 26 nt, Human
ucaaaccgagcgcagaggccuacccg

SEQ ID NO: 1141467 - RNA, 24 nt, Human
ucaaaugaccucucugugaaaugc

SEQ ID NO: 1141468 - RNA, 22 nt, Human
uccacaucacaucacaguuccc

SEQ ID NO: 1141469 - RNA, 18 nt, Human
uccagcaacaccuuuacc

SEQ ID NO: 1141470 - RNA, 22 nt, Human
ugaaaugcaccugcacauucuc

SEQ ID NO: 1141471 - RNA, 23 nt, Human
ugcgcgcacaccgacccugugcg

SEQ ID NO: 1141472 - RNA, 19 nt, Human
uguaaugggagcaaccaca

SEQ ID NO: 1141473 - RNA, 22 nt, Human
uucauuaucaagaaguucugcu

SEQ ID NO: 1141474 - RNA, 27 nt, Human
uuccacaucacaucacaguucccaaaa

SEQ ID NO: 1141475 - RNA, 25 nt, Human
aaaauacacaccaccacgagugcaa

SEQ ID NO: 1141476 - RNA, 20 nt, Human
aaacccaggcgguucuccca

SEQ ID NO: 1141477 - RNA, 22 nt, Human
aaauacacaccaccacgagugc

SEQ ID NO: 1141478 - RNA, 23 nt, Human
aaauacacaccaccacgagugca

SEQ ID NO: 1141479 - RNA, 19 nt, Human
aaggagccuuugccuuugg

SEQ ID NO: 1141480 - RNA, 18 nt, Human
aaggucccaaaauacaca

SEQ ID NO: 1141481 - RNA, 24 nt, Human
accacgagugcaaaaacccaggcg

SEQ ID NO: 1141482 - RNA, 20 nt, Human
agcugcacaguaaagguccc

SEQ ID NO: 1141483 - RNA, 23 nt, Human
agcugccccucgcccccggcccc

SEQ ID NO: 1141484 - RNA, 23 nt, Human
agggucugccggcucccgggccc

SEQ ID NO: 1141485 - RNA, 22 nt, Human
auuucugugcuccuaccugcag

SEQ ID NO: 1141486 - RNA, 21 nt, Human
caaaaacccaggcgguucucc

SEQ ID NO: 1141487 - RNA, 20 nt, Human
cacaccaccacgagugcaaa

SEQ ID NO: 1141488 - RNA, 19 nt, Human
cacaguaaaggucccaaaa

SEQ ID NO: 1141489 - RNA, 20 nt, Human
caccaccacgagugcaaaaa

SEQ ID NO: 1141490 - RNA, 23 nt, Human
caccacgagugcaaaaacccagg

SEQ ID NO: 1141491 - RNA, 21 nt, Human
cagccgccaccgcuccggcuc

SEQ ID NO: 1141492 - RNA, 25 nt, Human
cagcgaaucuccgauaagaaggucu

SEQ ID NO: 1141493 - RNA, 27 nt, Human
ccaaaauacacaccaccacgagugcaa

SEQ ID NO: 1141494 - RNA, 19 nt, Human
cccagccuccccacagccg

SEQ ID NO: 1141495 - RNA, 22 nt, Human
ccccacagccgccaccgcuccg

SEQ ID NO: 1141496 - RNA, 18 nt, Human
ccccucgcccccggcccc

SEQ ID NO: 1141497 - RNA, 18 nt, Human
cccggcccccucccaggc

SEQ ID NO: 1141498 - RNA, 23 nt, Human
cccggcccccucccaggcgcucc

SEQ ID NO: 1141499 - RNA, 21 nt, Human
ccgagcugccccucgcccccg

SEQ ID NO: 1141500 - RNA, 22 nt, Human
ccucgcccccggcccccuccca

SEQ ID NO: 1141501 - RNA, 22 nt, Human
cgagggcaccaaggagccuuug

SEQ ID NO: 1141502 - RNA, 24 nt, Human
cgagggcaccaaggagcuggagac

SEQ ID NO: 1141503 - RNA, 21 nt, Human
cgcccccggcccccucccagg

SEQ ID NO: 1141504 - RNA, 22 nt, Human
cgcccccggcccccucccaggc

SEQ ID NO: 1141505 - RNA, 21 nt, Human
cuauaaucaugaaaggcuuuu

SEQ ID NO: 1141506 - RNA, 18 nt, Human
gcgaaucuccgauaagaa

SEQ ID NO: 1141507 - RNA, 24 nt, Human
ggucugugcagauuucugugcucc

SEQ ID NO: 1141508 - RNA, 21 nt, Human
uccccacagccgccaccgcuc

SEQ ID NO: 1141509 - RNA, 24 nt, Human
ucgcccccggcccccucccaggcg

SEQ ID NO: 1141510 - RNA, 18 nt, Human
ugaaaggcuuuugcuuca

SEQ ID NO: 1141511 - RNA, 22 nt, Human
ugaaaggcuuuugcuucacuug

SEQ ID NO: 1141512 - RNA, 20 nt, Human
uucugugcuccuaccugcag

SEQ ID NO: 1141513 - RNA, 19 nt, Human
augaaaaacuaaugaaaga

SEQ ID NO: 1141514 - RNA, 18 nt, Human
uacaacugaaugaaaaac

SEQ ID NO: 1141515 - RNA, 25 nt, Human
ugaaauaaaaauuaaauaaauacaa

SEQ ID NO: 1141516 - RNA, 23 nt, Human
ugagguuaccagauguacagugg

SEQ ID NO: 1141517 - RNA, 22 nt, Human
aaacagauauaagugaguagac

SEQ ID NO: 1141518 - RNA, 20 nt, Human
aacccuccuucaucaugccu

SEQ ID NO: 1141519 - RNA, 20 nt, Human
aaucaugucuccccugacac

SEQ ID NO: 1141520 - RNA, 22 nt, Human
acagggcuggauggccuggggc

SEQ ID NO: 1141521 - RNA, 21 nt, Human
accauacauguaaugacauaa

SEQ ID NO: 1141522 - RNA, 18 nt, Human
accccgaagcccccggcg

SEQ ID NO: 1141523 - RNA, 20 nt, Human
accuggaugguuaguguccc

SEQ ID NO: 1141524 - RNA, 18 nt, Human
agcccgaggccaggggaa

SEQ ID NO: 1141525 - RNA, 20 nt, Human
agcuggguggugacagccgc

SEQ ID NO: 1141526 - RNA, 22 nt, Human
auccaugccuucuuccaauccu

SEQ ID NO: 1141527 - RNA, 23 nt, Human
augucacagugugcccucagaau

SEQ ID NO: 1141528 - RNA, 21 nt, Human
auugugucucuuccuucucuu

SEQ ID NO: 1141529 - RNA, 20 nt, Human
auuucccacaaaucuuacug

SEQ ID NO: 1141530 - RNA, 22 nt, Human
caaaccaacccauuucccacaa

SEQ ID NO: 1141531 - RNA, 21 nt, Human
caacaaaccaacccauuuccc

SEQ ID NO: 1141532 - RNA, 19 nt, Human
cacacagcuggguggugac

SEQ ID NO: 1141533 - RNA, 20 nt, Human
cacacaggccuggacaaagc

SEQ ID NO: 1141534 - RNA, 27 nt, Human
cacaggaugcaaaaacaaaggacauac

SEQ ID NO: 1141535 - RNA, 22 nt, Human
cacaggaugcaaaaacaaaucc

SEQ ID NO: 1141536 - RNA, 20 nt, Human
cacagugugcccucagaauc

SEQ ID NO: 1141537 - RNA, 18 nt, Human
cagcacacugcguucccu

SEQ ID NO: 1141538 - RNA, 22 nt, Human
caggaugcaaaaacaaauccug

SEQ ID NO: 1141539 - RNA, 22 nt, Human
cauacauguaaugacauaauca

SEQ ID NO: 1141540 - RNA, 21 nt, Human
ccacauccuuccugucacuuc

SEQ ID NO: 1141541 - RNA, 30 nt, Human
ccauacaacaaaccaacccauuucccacaa

SEQ ID NO: 1141542 - RNA, 21 nt, Human
cccauaaucacaauguuuucu

SEQ ID NO: 1141543 - RNA, 20 nt, Human
cccaucacuaccauacaugu

SEQ ID NO: 1141544 - RNA, 21 nt, Human
ccccgaagcccccggcgaccc

SEQ ID NO: 1141545 - RNA, 19 nt, Human
ccccgccgucugcguccua

SEQ ID NO: 1141546 - RNA, 21 nt, Human
ccccggcgaccccgccgucug

SEQ ID NO: 1141547 - RNA, 28 nt, Human
cccguaccgcaagcgccgccugcaggag

SEQ ID NO: 1141548 - RNA, 21 nt, Human
cccugcgccgagcccgaggcc

SEQ ID NO: 1141549 - RNA, 18 nt, Human
ccggucuugaauacugac

SEQ ID NO: 1141550 - RNA, 18 nt, Human
ccuaacugaacuuuguuc

SEQ ID NO: 1141551 - RNA, 23 nt, Human
ccucaacagcgugugggacucca

SEQ ID NO: 1141552 - RNA, 21 nt, Human
ccucugauuucuucauucauc

SEQ ID NO: 1141553 - RNA, 23 nt, Human
ccuggggccgaggccaccccgaa

SEQ ID NO: 1141554 - RNA, 25 nt, Human
ccuggggccgaggccaccccgaagc

SEQ ID NO: 1141555 - RNA, 19 nt, Human
ccuggugccuccuuggcuc

SEQ ID NO: 1141556 - RNA, 24 nt, Human
ccuuauaaaggggcuaacacagag

SEQ ID NO: 1141557 - RNA, 22 nt, Human
cgaggccaggggaacccaugac

SEQ ID NO: 1141558 - RNA, 19 nt, Human
cucacagaauacauaauga

SEQ ID NO: 1141559 - RNA, 18 nt, Human
cuccaaauuuggacaaac

SEQ ID NO: 1141560 - RNA, 21 nt, Human
cucuuccuucucuuuccuaac

SEQ ID NO: 1141561 - RNA, 23 nt, Human
cugcaggagcgcugacccugcgc

SEQ ID NO: 1141562 - RNA, 20 nt, Human
cuuccaauccugacauauuu

SEQ ID NO: 1141563 - RNA, 21 nt, Human
gagaaagaagauguccuaugu

SEQ ID NO: 1141564 - RNA, 20 nt, Human
gaggccaggggaacccauga

SEQ ID NO: 1141565 - RNA, 21 nt, Human
gccagcccguaccgcaagcgc

SEQ ID NO: 1141566 - RNA, 18 nt, Human
gccauaaguucuuccuuc

SEQ ID NO: 1141567 - RNA, 23 nt, Human
gcccuggugccuccuuggcucuu

SEQ ID NO: 1141568 - RNA, 19 nt, Human
gcuccaaauuuggacaaac

SEQ ID NO: 1141569 - RNA, 21 nt, Human
gggccgaggccaccccgaagc

SEQ ID NO: 1141570 - RNA, 22 nt, Human
guaaaaacaaacauggguuaug

SEQ ID NO: 1141571 - RNA, 25 nt, Human
gucuccucuaaacccuccuucauca

SEQ ID NO: 1141572 - RNA, 18 nt, Human
guuaugagcuccaaauuu

SEQ ID NO: 1141573 - RNA, 24 nt, Human
guuuucuuuucacuuugcucaaga

SEQ ID NO: 1141574 - RNA, 21 nt, Human
ucaagugagacagagaaagaa

SEQ ID NO: 1141575 - RNA, 21 nt, Human
ucaucaugccuaccuugagga

SEQ ID NO: 1141576 - RNA, 22 nt, Human
ucaugucacagugugcccucag

SEQ ID NO: 1141577 - RNA, 21 nt, Human
ucccagcacagcaaaacauuc

SEQ ID NO: 1141578 - RNA, 23 nt, Human
ucccguacaaauauuuuccccau

SEQ ID NO: 1141579 - RNA, 22 nt, Human
uccuagcugaguauacuaaggc

SEQ ID NO: 1141580 - RNA, 26 nt, Human
ucucuaaguagcaguaaauccggucu

SEQ ID NO: 1141581 - RNA, 20 nt, Human
ucuggcaugcacagguccca

SEQ ID NO: 1141582 - RNA, 24 nt, Human
ugaauacugacuuugacacucagc

SEQ ID NO: 1141583 - RNA, 22 nt, Human
ugaccaccacuuaugcaaauuu

SEQ ID NO: 1141584 - RNA, 20 nt, Human
ugacuuugacacucagcuuu

SEQ ID NO: 1141585 - RNA, 19 nt, Human
ugaguauacuaaggcuuuc

SEQ ID NO: 1141586 - RNA, 19 nt, Human
ugauuucuucauucaucuc

SEQ ID NO: 1141587 - RNA, 19 nt, Human
ugcaauaccauggcuaugg

SEQ ID NO: 1141588 - RNA, 19 nt, Human
ugcccuggugccuccuugg

SEQ ID NO: 1141589 - RNA, 21 nt, Human
uggcaugcacaggucccagca

SEQ ID NO: 1141590 - RNA, 23 nt, Human
uggggccgaggccaccccgaagc

SEQ ID NO: 1141591 - RNA, 24 nt, Human
uggguuuucuucuuuuccuaucuu

SEQ ID NO: 1141592 - RNA, 24 nt, Human
ugucacacagcuggguggugacag

SEQ ID NO: 1141593 - RNA, 21 nt, Human
ugucacagugugcccucagaa

SEQ ID NO: 1141594 - RNA, 18 nt, Human
ugucuccucuaaacccuc

SEQ ID NO: 1141595 - RNA, 23 nt, Human
ugucuccucuaaacccuccuuca

SEQ ID NO: 1141596 - RNA, 19 nt, Human
uuaacugauuuuugugggg

SEQ ID NO: 1141597 - RNA, 20 nt, Human
uuagaguguugcacaaagga

SEQ ID NO: 1141598 - RNA, 19 nt, Human
uucaucaugccuaccuuga

SEQ ID NO: 1141599 - RNA, 26 nt, Human
uugugucugugucuccucuaaacccu

SEQ ID NO: 1141600 - RNA, 20 nt, Human
uuucacuuugcucaagaacu

SEQ ID NO: 1141601 - RNA, 22 nt, Human
uuugacacucagcuuucuccac

SEQ ID NO: 1141602 - RNA, 22 nt, Human
uuuucuuuucacuuugcucaag

SEQ ID NO: 1141603 - RNA, 22 nt, Human
aacagccuucuuaagucuggcu

SEQ ID NO: 1141604 - RNA, 21 nt, Human
acgcgcagcggcaggaggauu

SEQ ID NO: 1141605 - RNA, 25 nt, Human
agcggcaggaggauuggccagagga

SEQ ID NO: 1141606 - RNA, 20 nt, Human
agugcgcagugcccccgccg

SEQ ID NO: 1141607 - RNA, 20 nt, Human
cacaacacauggaggccugg

SEQ ID NO: 1141608 - RNA, 20 nt, Human
cacugccuucucgccuccac

SEQ ID NO: 1141609 - RNA, 23 nt, Human
caggguaacuucaguuucuccaa

SEQ ID NO: 1141610 - RNA, 24 nt, Human
caguauuguggccugggguccucc

SEQ ID NO: 1141611 - RNA, 20 nt, Human
ccauccuccauucccagcua

SEQ ID NO: 1141612 - RNA, 19 nt, Human
ccccauccuccauucccag

SEQ ID NO: 1141613 - RNA, 18 nt, Human
ccucccuugccacugacc

SEQ ID NO: 1141614 - RNA, 19 nt, Human
ccugcagaucuguucuguu

SEQ ID NO: 1141615 - RNA, 30 nt, Human
cucccagccuuuccguagcaccacucacuu

SEQ ID NO: 1141616 - RNA, 20 nt, Human
cuggccugagcgcucugccc

SEQ ID NO: 1141617 - RNA, 20 nt, Human
gcacaacacauggaggccug

SEQ ID NO: 1141618 - RNA, 20 nt, Human
gcagagagggacgaggugga

SEQ ID NO: 1141619 - RNA, 20 nt, Human
gcagcggcaggaggauuggc

SEQ ID NO: 1141620 - RNA, 18 nt, Human
gccggcccuggccugagc

SEQ ID NO: 1141621 - RNA, 21 nt, Human
gcggcaggaggauuggccaga

SEQ ID NO: 1141622 - RNA, 20 nt, Human
gcucugccccugcuucccuc

SEQ ID NO: 1141623 - RNA, 25 nt, Human
ggccugagcgcucugccccugcuuc

SEQ ID NO: 1141624 - RNA, 24 nt, Human
guaacuucaguuucuccaagauuu

SEQ ID NO: 1141625 - RNA, 24 nt, Human
guaggaacaugccugcugcagaga

SEQ ID NO: 1141626 - RNA, 21 nt, Human
uaacuucaguuucuccaagau

SEQ ID NO: 1141627 - RNA, 23 nt, Human
ucaguauuguggccugggguccu

SEQ ID NO: 1141628 - RNA, 23 nt, Human
ucaguuucuccaagauuuucuca

SEQ ID NO: 1141629 - RNA, 22 nt, Human
uccaagauuuucucacugauuu

SEQ ID NO: 1141630 - RNA, 20 nt, Human
uccauucccagcuacagccg

SEQ ID NO: 1141631 - RNA, 22 nt, Human
uccauucccagcuacagccgcc

SEQ ID NO: 1141632 - RNA, 23 nt, Human
ugaugucaguauuguggccuggg

SEQ ID NO: 1141633 - RNA, 19 nt, Human
uggagccccugacgauggg

SEQ ID NO: 1141634 - RNA, 18 nt, Human
uggccugggguccucccu

SEQ ID NO: 1141635 - RNA, 18 nt, Human
uggcuccuggcugccccu

SEQ ID NO: 1141636 - RNA, 20 nt, Human
uguucuguucccugauguca

SEQ ID NO: 1141637 - RNA, 21 nt, Human
uuguggccugggguccucccu

SEQ ID NO: 1141638 - RNA, 20 nt, Human
aaaacacuguuagccacugu

SEQ ID NO: 1141639 - RNA, 22 nt, Human
aaaggggagaggaggaagggau

SEQ ID NO: 1141640 - RNA, 18 nt, Human
aaaugaaagccuguaaac

SEQ ID NO: 1141641 - RNA, 22 nt, Human
aacaacggggaauuaggaggga

SEQ ID NO: 1141642 - RNA, 23 nt, Human
aaggggguaaaggggagaggagg

SEQ ID NO: 1141643 - RNA, 22 nt, Human
acaccauuuguucccgaaugaa

SEQ ID NO: 1141644 - RNA, 19 nt, Human
acaggaagacagggugcca

SEQ ID NO: 1141645 - RNA, 19 nt, Human
accacugcuauacacauac

SEQ ID NO: 1141646 - RNA, 23 nt, Human
acccgccaccaggcuucuugccc

SEQ ID NO: 1141647 - RNA, 20 nt, Human
accuuacccagcugaggagc

SEQ ID NO: 1141648 - RNA, 19 nt, Human
agaaaauaauagggugaag

SEQ ID NO: 1141649 - RNA, 21 nt, Human
agagucccggccgcuggcagc

SEQ ID NO: 1141650 - RNA, 20 nt, Human
agcagguggaguccucccga

SEQ ID NO: 1141651 - RNA, 21 nt, Human
agcccgucgccuccgugcccc

SEQ ID NO: 1141652 - RNA, 21 nt, Human
aggagggagcuuggccgucug

SEQ ID NO: 1141653 - RNA, 19 nt, Human
aggaggugaucucaccuac

SEQ ID NO: 1141654 - RNA, 18 nt, Human
agggagcuuggccgucug

SEQ ID NO: 1141655 - RNA, 24 nt, Human
aggggguaaaggggagaggaggaa

SEQ ID NO: 1141656 - RNA, 21 nt, Human
agggugccauacagcugaaga

SEQ ID NO: 1141657 - RNA, 23 nt, Human
agggugccauacagcugaagaaa

SEQ ID NO: 1141658 - RNA, 23 nt, Human
aguccggagcagcgccgauggcu

SEQ ID NO: 1141659 - RNA, 25 nt, Human
agugaaggaaggggguaaaggggag

SEQ ID NO: 1141660 - RNA, 18 nt, Human
caaaggaggugaucucac

SEQ ID NO: 1141661 - RNA, 19 nt, Human
caaauaaacaucugaaacg

SEQ ID NO: 1141662 - RNA, 21 nt, Human
caagcuccagggagucggggg

SEQ ID NO: 1141663 - RNA, 21 nt, Human
caagcuccucaccaguaaacu

SEQ ID NO: 1141664 - RNA, 19 nt, Human
caagugcccaccgcacgcc

SEQ ID NO: 1141665 - RNA, 19 nt, Human
caccaagcgcuccccgagu

SEQ ID NO: 1141666 - RNA, 21 nt, Human
cacgggagacugugacgaccu

SEQ ID NO: 1141667 - RNA, 19 nt, Human
cagaacacaauccggccug

SEQ ID NO: 1141668 - RNA, 19 nt, Human
cagagcggaagcgcuccgc

SEQ ID NO: 1141669 - RNA, 23 nt, Human
cagcacaagaaauuaguugcaaa

SEQ ID NO: 1141670 - RNA, 19 nt, Human
cagcaucuuccuggggauc

SEQ ID NO: 1141671 - RNA, 18 nt, Human
cagccgcccgcuccuugg

SEQ ID NO: 1141672 - RNA, 20 nt, Human
caggagagguaaacgaccau

SEQ ID NO: 1141673 - RNA, 26 nt, Human
cauacguauauauaugggcaaacaca

SEQ ID NO: 1141674 - RNA, 19 nt, Human
ccagacuuucuugcccgac

SEQ ID NO: 1141675 - RNA, 21 nt, Human
ccagccacacaaucuugauuc

SEQ ID NO: 1141676 - RNA, 21 nt, Human
cccaaguuggcaucccgagac

SEQ ID NO: 1141677 - RNA, 18 nt, Human
ccccaccaagcgcucccc

SEQ ID NO: 1141678 - RNA, 21 nt, Human
ccccgaggccagaacacaauc

SEQ ID NO: 1141679 - RNA, 21 nt, Human
cccgcggcggcucccccuacc

SEQ ID NO: 1141680 - RNA, 18 nt, Human
cccgucgccuccgugccc

SEQ ID NO: 1141681 - RNA, 22 nt, Human
cccugcccgguaucugcgcgug

SEQ ID NO: 1141682 - RNA, 22 nt, Human
ccgccccgaggccagaacacaa

SEQ ID NO: 1141683 - RNA, 18 nt, Human
ccgccgggccggaccgcg

SEQ ID NO: 1141684 - RNA, 22 nt, Human
ccgucgccuccgugccccaagu

SEQ ID NO: 1141685 - RNA, 23 nt, Human
ccuaugcugggaucaccuaaaac

SEQ ID NO: 1141686 - RNA, 19 nt, Human
ccucucccagccgcccgcu

SEQ ID NO: 1141687 - RNA, 23 nt, Human
ccugggauacccggacccaggag

SEQ ID NO: 1141688 - RNA, 22 nt, Human
ccugucugcuuucuucucucug

SEQ ID NO: 1141689 - RNA, 22 nt, Human
cgcacaacccuccccagcuccg

SEQ ID NO: 1141690 - RNA, 25 nt, Human
cgccuccgugccccaaguuggcauc

SEQ ID NO: 1141691 - RNA, 19 nt, Human
cggagcagcccgucgccuc

SEQ ID NO: 1141692 - RNA, 21 nt, Human
cggcaggggcugcgaccugug

SEQ ID NO: 1141693 - RNA, 18 nt, Human
cguacauauuuacauaug

SEQ ID NO: 1141694 - RNA, 26 nt, Human
cguuauggggcucucaggcaacaaga

SEQ ID NO: 1141695 - RNA, 23 nt, Human
cucagaagcugugcuguuacaga

SEQ ID NO: 1141696 - RNA, 22 nt, Human
cucucaggcaacaagauuccac

SEQ ID NO: 1141697 - RNA, 23 nt, Human
cucugcaacaacggggaauuagg

SEQ ID NO: 1141698 - RNA, 22 nt, Human
cucuuccgcaggccgagggcag

SEQ ID NO: 1141699 - RNA, 23 nt, Human
cugaacccgagcacagagacugg

SEQ ID NO: 1141700 - RNA, 19 nt, Human
cugacccaagcagaaaccc

SEQ ID NO: 1141701 - RNA, 20 nt, Human
cugagcuccuaugcucagcu

SEQ ID NO: 1141702 - RNA, 20 nt, Human
cugggccugggaaggagcca

SEQ ID NO: 1141703 - RNA, 19 nt, Human
cuggggauccuccgcggca

SEQ ID NO: 1141704 - RNA, 21 nt, Human
cuggugucuucccagccacac

SEQ ID NO: 1141705 - RNA, 23 nt, Human
cuuagcccuuuccguuauggggc

SEQ ID NO: 1141706 - RNA, 25 nt, Human
gaaaauaauagggugaagguuugac

SEQ ID NO: 1141707 - RNA, 21 nt, Human
gaacacaauccggccuggcgc

SEQ ID NO: 1141708 - RNA, 26 nt, Human
gaacacaauccggccuggcgcccggc

SEQ ID NO: 1141709 - RNA, 19 nt, Human
gaacacggagcccuucuuc

SEQ ID NO: 1141710 - RNA, 24 nt, Human
gaacccgagcacagagacuggugg

SEQ ID NO: 1141711 - RNA, 18 nt, Human
gacuuggaaaauacagug

SEQ ID NO: 1141712 - RNA, 20 nt, Human
gagcuccuaugcucagcucc

SEQ ID NO: 1141713 - RNA, 18 nt, Human
gcacaacccuccccagcu

SEQ ID NO: 1141714 - RNA, 18 nt, Human
gcacaaccucucccagcc

SEQ ID NO: 1141715 - RNA, 21 nt, Human
gccagaacacaauccggccug

SEQ ID NO: 1141716 - RNA, 19 nt, Human
gcggggccguggggguggu

SEQ ID NO: 1141717 - RNA, 20 nt, Human
gcuuucuucucucugccuuc

SEQ ID NO: 1141718 - RNA, 20 nt, Human
ggagcccuucuucccugccc

SEQ ID NO: 1141719 - RNA, 18 nt, Human
ggaguccucccgagcucu

SEQ ID NO: 1141720 - RNA, 22 nt, Human
ggccugggaaggagccaggggu

SEQ ID NO: 1141721 - RNA, 20 nt, Human
ggcggggccguggggguggu

SEQ ID NO: 1141722 - RNA, 21 nt, Human
ggcggggccguggggguggug

SEQ ID NO: 1141723 - RNA, 19 nt, Human
gggaucaccuaaaacucuu

SEQ ID NO: 1141724 - RNA, 19 nt, Human
gggccgugggggugguggg

SEQ ID NO: 1141725 - RNA, 22 nt, Human
ggggccgugggggugguggggg

SEQ ID NO: 1141726 - RNA, 19 nt, Human
gggggugagaaugguggga

SEQ ID NO: 1141727 - RNA, 18 nt, Human
ggguaaaggggagaggag

SEQ ID NO: 1141728 - RNA, 18 nt, Human
ggugcaguggaguggucu

SEQ ID NO: 1141729 - RNA, 24 nt, Human
ggugcaguggaguggucugcaggu

SEQ ID NO: 1141730 - RNA, 19 nt, Human
ggugucuucccagccacac

SEQ ID NO: 1141731 - RNA, 18 nt, Human
guagggguggaugcaggg

SEQ ID NO: 1141732 - RNA, 21 nt, Human
gugcaguggaguggucugcag

SEQ ID NO: 1141733 - RNA, 25 nt, Human
gugcaguggaguggucugcagguuc

SEQ ID NO: 1141734 - RNA, 23 nt, Human
uaaaauauuaaaagggcucaaaa

SEQ ID NO: 1141735 - RNA, 20 nt, Human
uaaaaugaaagccuguaaac

SEQ ID NO: 1141736 - RNA, 24 nt, Human
uaaaccaagugcccaccgcacgcc

SEQ ID NO: 1141737 - RNA, 21 nt, Human
uacccggacccaggagagagc

SEQ ID NO: 1141738 - RNA, 21 nt, Human
uagaccuagagaauauaauua

SEQ ID NO: 1141739 - RNA, 22 nt, Human
uagggugaagguuugacccgcc

SEQ ID NO: 1141740 - RNA, 26 nt, Human
uauacacauacauacacacucguaca

SEQ ID NO: 1141741 - RNA, 24 nt, Human
uauauauaugggcaaacacaugua

SEQ ID NO: 1141742 - RNA, 27 nt, Human
uauuuacauauggcauacguauauaua

SEQ ID NO: 1141743 - RNA, 21 nt, Human
ucaagcuccucaccaguaaac

SEQ ID NO: 1141744 - RNA, 18 nt, Human
uccccagcaucuuccugg

SEQ ID NO: 1141745 - RNA, 19 nt, Human
ucccucugacccaagcaga

SEQ ID NO: 1141746 - RNA, 22 nt, Human
ucccucugacccaagcagaaac

SEQ ID NO: 1141747 - RNA, 18 nt, Human
uccgcacaacccucccca

SEQ ID NO: 1141748 - RNA, 18 nt, Human
ucgccuccgugccccaag

SEQ ID NO: 1141749 - RNA, 18 nt, Human
ucuacucaguucaagcuc

SEQ ID NO: 1141750 - RNA, 19 nt, Human
ucucaucugagcuccuaug

SEQ ID NO: 1141751 - RNA, 19 nt, Human
ucucccagccgcccgcucc

SEQ ID NO: 1141752 - RNA, 20 nt, Human
ucucccagccgcccgcuccu

SEQ ID NO: 1141753 - RNA, 22 nt, Human
ucugagcuccuaugcucagcuc

SEQ ID NO: 1141754 - RNA, 22 nt, Human
ucugggacuguaugaugaaaag

SEQ ID NO: 1141755 - RNA, 18 nt, Human
ucuguucccuucucugcu

SEQ ID NO: 1141756 - RNA, 20 nt, Human
ucuucccugcccgguaucug

SEQ ID NO: 1141757 - RNA, 19 nt, Human
ucuuccgcaggccgagggc

SEQ ID NO: 1141758 - RNA, 19 nt, Human
ucuugcccgacugggcuga

SEQ ID NO: 1141759 - RNA, 19 nt, Human
ugaaacgccgguucuguaa

SEQ ID NO: 1141760 - RNA, 19 nt, Human
ugaaagacuagagaacaca

SEQ ID NO: 1141761 - RNA, 28 nt, Human
ugaaggaaggggguaaaggggagaggag

SEQ ID NO: 1141762 - RNA, 22 nt, Human
ugagacuaauucuaaaccacug

SEQ ID NO: 1141763 - RNA, 22 nt, Human
ugauguuguuggacugagagua

SEQ ID NO: 1141764 - RNA, 20 nt, Human
ugcacacaucuccccuuccc

SEQ ID NO: 1141765 - RNA, 18 nt, Human
ugccauacagcugaagaa

SEQ ID NO: 1141766 - RNA, 19 nt, Human
ugccauacagcugaagaaa

SEQ ID NO: 1141767 - RNA, 19 nt, Human
ugcugagagucccggccgc

SEQ ID NO: 1141768 - RNA, 23 nt, Human
ugcuuaauaaaauccagagacag

SEQ ID NO: 1141769 - RNA, 21 nt, Human
uggaaaauacagugagaaggu

SEQ ID NO: 1141770 - RNA, 22 nt, Human
uggaacacggagcccuucuucc

SEQ ID NO: 1141771 - RNA, 21 nt, Human
uggccucucagcauauacucc

SEQ ID NO: 1141772 - RNA, 22 nt, Human
uggccucucagcauauacuccu

SEQ ID NO: 1141773 - RNA, 19 nt, Human
ugggaaggagccaggggua

SEQ ID NO: 1141774 - RNA, 18 nt, Human
ugggccugggaaggagcc

SEQ ID NO: 1141775 - RNA, 19 nt, Human
uguacaggaagacagggug

SEQ ID NO: 1141776 - RNA, 23 nt, Human
uguggaacugagacuaauucuaa

SEQ ID NO: 1141777 - RNA, 22 nt, Human
uguuuuuuaugauucucuuuca

SEQ ID NO: 1141778 - RNA, 21 nt, Human
uuaagucuauagagucagaaa

SEQ ID NO: 1141779 - RNA, 23 nt, Human
uuacugcagcaaaacuggcaagu

SEQ ID NO: 1141780 - RNA, 19 nt, Human
uuaguugcaaauaaacauc

SEQ ID NO: 1141781 - RNA, 20 nt, Human
uucccagccacacaaucuug

SEQ ID NO: 1141782 - RNA, 18 nt, Human
uuuccugucugcuuucuu

SEQ ID NO: 1141783 - RNA, 19 nt, Human
aagucagaucuaggaccaa

SEQ ID NO: 1141784 - RNA, 25 nt, Human
agcugcauggccucaaucaagucac

SEQ ID NO: 1141785 - RNA, 18 nt, Human
agguaacauaaaucaacu

SEQ ID NO: 1141786 - RNA, 18 nt, Human
aucaagucacuuaguuuu

SEQ ID NO: 1141787 - RNA, 27 nt, Human
caguaaacgcuucuucuccaaaugucu

SEQ ID NO: 1141788 - RNA, 21 nt, Human
ccacaucucugcuaaucugga

SEQ ID NO: 1141789 - RNA, 20 nt, Human
ccacuggaucccagucaugc

SEQ ID NO: 1141790 - RNA, 18 nt, Human
ccaggacccaggaacuuc

SEQ ID NO: 1141791 - RNA, 21 nt, Human
ccgugaacaggaaggaggugu

SEQ ID NO: 1141792 - RNA, 18 nt, Human
ccugguccuccccucgcc

SEQ ID NO: 1141793 - RNA, 19 nt, Human
ccuuauuaccacaucucug

SEQ ID NO: 1141794 - RNA, 20 nt, Human
cgcaaaggacugccgugaac

SEQ ID NO: 1141795 - RNA, 22 nt, Human
cuagcauaauguaaaacugaag

SEQ ID NO: 1141796 - RNA, 25 nt, Human
cugcacuguccccagauuggguuuc

SEQ ID NO: 1141797 - RNA, 22 nt, Human
cugguucugucggcugagacaa

SEQ ID NO: 1141798 - RNA, 22 nt, Human
cuucauucccuuucuggcuugc

SEQ ID NO: 1141799 - RNA, 20 nt, Human
cuucuaucugcagagguaga

SEQ ID NO: 1141800 - RNA, 27 nt, Human
cuugcuuuggagucugucagaccuggc

SEQ ID NO: 1141801 - RNA, 20 nt, Human
gcaaaggacugccgugaaca

SEQ ID NO: 1141802 - RNA, 26 nt, Human
gcagugccugaugaggugaggccagg

SEQ ID NO: 1141803 - RNA, 23 nt, Human
gcuccuuuuuucuagcauaaugu

SEQ ID NO: 1141804 - RNA, 23 nt, Human
gcugguucugucggcugagacaa

SEQ ID NO: 1141805 - RNA, 21 nt, Human
gcuuuggagucugucagaccu

SEQ ID NO: 1141806 - RNA, 21 nt, Human
ggauuucuagggaagcaguuu

SEQ ID NO: 1141807 - RNA, 18 nt, Human
gugaacaggaaggaggug

SEQ ID NO: 1141808 - RNA, 22 nt, Human
uaacauaaaucaacuauauucu

SEQ ID NO: 1141809 - RNA, 24 nt, Human
uagcauaauguaaaacugaagaau

SEQ ID NO: 1141810 - RNA, 24 nt, Human
ucacguagagugacggcuccuuuu

SEQ ID NO: 1141811 - RNA, 20 nt, Human
ucaggaacaguaaguguucu

SEQ ID NO: 1141812 - RNA, 19 nt, Human
ucgcaaaggacugccguga

SEQ ID NO: 1141813 - RNA, 22 nt, Human
ucguccacuggaucccagucau

SEQ ID NO: 1141814 - RNA, 27 nt, Human
ugaggccaggacccaggaacuucuauu

SEQ ID NO: 1141815 - RNA, 18 nt, Human
ugaggugaggccaggacc

SEQ ID NO: 1141816 - RNA, 22 nt, Human
ugaggugaggccaggacccagg

SEQ ID NO: 1141817 - RNA, 24 nt, Human
ugcuuagcacaucguggguacuuc

SEQ ID NO: 1141818 - RNA, 21 nt, Human
uggaaugcuuccuauuggaua

SEQ ID NO: 1141819 - RNA, 18 nt, Human
uggcaagaaugcuggaga

SEQ ID NO: 1141820 - RNA, 19 nt, Human
uggcagugccugaugaggu

SEQ ID NO: 1141821 - RNA, 19 nt, Human
ugucaacaugaacuguaga

SEQ ID NO: 1141822 - RNA, 22 nt, Human
uguccuuauuaccacaucucug

SEQ ID NO: 1141823 - RNA, 21 nt, Human
aaaaggccaaaggcaaagauc

SEQ ID NO: 1141824 - RNA, 23 nt, Human
aaaaggccaaaggcaaagaucug

SEQ ID NO: 1141825 - RNA, 21 nt, Human
aaacagaugaacgccauaauc

SEQ ID NO: 1141826 - RNA, 24 nt, Human
aaacagaugaacgccauaaucccu

SEQ ID NO: 1141827 - RNA, 24 nt, Human
aaagaagcucaguguggacuugag

SEQ ID NO: 1141828 - RNA, 19 nt, Human
aaagugcugggauuacaga

SEQ ID NO: 1141829 - RNA, 24 nt, Human
aaagugcugggauuacagagguga

SEQ ID NO: 1141830 - RNA, 24 nt, Human
aaauuacacaaaauguugacguaa

SEQ ID NO: 1141831 - RNA, 20 nt, Human
aaccuccucuucuccacccu

SEQ ID NO: 1141832 - RNA, 23 nt, Human
aagcaacccugaccccugacccc

SEQ ID NO: 1141833 - RNA, 21 nt, Human
aagcugcucuuaccccuucca

SEQ ID NO: 1141834 - RNA, 24 nt, Human
aagugauccucuugccuuggccuc

SEQ ID NO: 1141835 - RNA, 25 nt, Human
aagugauccucuugccuuggccucc

SEQ ID NO: 1141836 - RNA, 18 nt, Human
aagugcugggauuacaga

SEQ ID NO: 1141837 - RNA, 21 nt, Human
aagugcugggauuacagaggu

SEQ ID NO: 1141838 - RNA, 26 nt, Human
aagugcugggauuacagaggugagcc

SEQ ID NO: 1141839 - RNA, 19 nt, Human
aaguuuuuauagagauggg

SEQ ID NO: 1141840 - RNA, 22 nt, Human
acaaaaggccaaaggcaaagau

SEQ ID NO: 1141841 - RNA, 22 nt, Human
acagaaugaggccaaauguuga

SEQ ID NO: 1141842 - RNA, 18 nt, Human
acccgcagcaucuucccu

SEQ ID NO: 1141843 - RNA, 22 nt, Human
accuuggugaccauugacguug

SEQ ID NO: 1141844 - RNA, 18 nt, Human
acucugucauccaggcug

SEQ ID NO: 1141845 - RNA, 24 nt, Human
acucugucauccaggcuggagugc

SEQ ID NO: 1141846 - RNA, 23 nt, Human
acuguucugcugugugaccuggg

SEQ ID NO: 1141847 - RNA, 21 nt, Human
agaaagaagcucaguguggaa

SEQ ID NO: 1141848 - RNA, 24 nt, Human
agagaaagaggcugaaggagggug

SEQ ID NO: 1141849 - RNA, 23 nt, Human
agagagagagagagaaagaggcu

SEQ ID NO: 1141850 - RNA, 18 nt, Human
agaggcugaaggagggug

SEQ ID NO: 1141851 - RNA, 22 nt, Human
agcaacccugaccccugacccc

SEQ ID NO: 1141852 - RNA, 19 nt, Human
agcagaaugaccccaacaa

SEQ ID NO: 1141853 - RNA, 18 nt, Human
agccgagacaaauuacac

SEQ ID NO: 1141854 - RNA, 20 nt, Human
agccgagacaaauuacacaa

SEQ ID NO: 1141855 - RNA, 23 nt, Human
aggcauucgguaaaggcauggac

SEQ ID NO: 1141856 - RNA, 18 nt, Human
agguacuggcagggccau

SEQ ID NO: 1141857 - RNA, 23 nt, Human
agucugagguuuaggguuuugcu

SEQ ID NO: 1141858 - RNA, 23 nt, Human
agugcagugguacgaugguggcu

SEQ ID NO: 1141859 - RNA, 24 nt, Human
agugcugggauuacagaggugagc

SEQ ID NO: 1141860 - RNA, 21 nt, Human
auaacaaaaggccaaaggcaa

SEQ ID NO: 1141861 - RNA, 21 nt, Human
auagagaugggguuuugccau

SEQ ID NO: 1141862 - RNA, 22 nt, Human
auagagaugggguuuugccaug

SEQ ID NO: 1141863 - RNA, 24 nt, Human
aucagagaaaugcaaauuaaaaca

SEQ ID NO: 1141864 - RNA, 31 nt, Human
augaagggagugugugugugugugugugugg

SEQ ID NO: 1141865 - RNA, 22 nt, Human
augagacaggcacuaugacccu

SEQ ID NO: 1141866 - RNA, 19 nt, Human
augaggccaaauguugacu

SEQ ID NO: 1141867 - RNA, 18 nt, Human
auggcccaaauccagggc

SEQ ID NO: 1141868 - RNA, 24 nt, Human
caaagugaacacgugcaucacccc

SEQ ID NO: 1141869 - RNA, 24 nt, Human
caaagugcugggauuacagaggug

SEQ ID NO: 1141870 - RNA, 24 nt, Human
caaauuaaaacaacaaugagacac

SEQ ID NO: 1141871 - RNA, 22 nt, Human
caagugauccucuugccuuggc

SEQ ID NO: 1141872 - RNA, 27 nt, Human
caagugauccucuugccuuggccuccc

SEQ ID NO: 1141873 - RNA, 21 nt, Human
cacaucauaugucaucagaga

SEQ ID NO: 1141874 - RNA, 18 nt, Human
caccagguugcgcugagg

SEQ ID NO: 1141875 - RNA, 24 nt, Human
caccucagccuccugaguagcugg

SEQ ID NO: 1141876 - RNA, 20 nt, Human
caccucccucaccuucacug

SEQ ID NO: 1141877 - RNA, 22 nt, Human
cacucugucauccaggcuggag

SEQ ID NO: 1141878 - RNA, 23 nt, Human
cacucugucauccaggcuggagu

SEQ ID NO: 1141879 - RNA, 20 nt, Human
cacugcagucucaaccuucu

SEQ ID NO: 1141880 - RNA, 18 nt, Human
cagagagucaccuuguca

SEQ ID NO: 1141881 - RNA, 19 nt, Human
cagagcccaaauguccuuu

SEQ ID NO: 1141882 - RNA, 22 nt, Human
cagaugaacgccauaaucccua

SEQ ID NO: 1141883 - RNA, 26 nt, Human
cagcaaaugcggugaggacguggagc

SEQ ID NO: 1141884 - RNA, 22 nt, Human
cagcagaaugaccccaacaaag

SEQ ID NO: 1141885 - RNA, 21 nt, Human
cagccacaggucugcccccag

SEQ ID NO: 1141886 - RNA, 20 nt, Human
cagccuccugaguagcuggg

SEQ ID NO: 1141887 - RNA, 18 nt, Human
cagcgcggggaagcugcu

SEQ ID NO: 1141888 - RNA, 18 nt, Human
caggaagaaauucaggaa

SEQ ID NO: 1141889 - RNA, 23 nt, Human
caggagaaggaauguacuaagga

SEQ ID NO: 1141890 - RNA, 22 nt, Human
caggcacaugccaccacaccca

SEQ ID NO: 1141891 - RNA, 24 nt, Human
caggccagaugucagagcccaaau

SEQ ID NO: 1141892 - RNA, 22 nt, Human
cagggaagcaacccugaccccu

SEQ ID NO: 1141893 - RNA, 24 nt, Human
caggguuucacucugucauccagg

SEQ ID NO: 1141894 - RNA, 18 nt, Human
cauccaugaccuuuucac

SEQ ID NO: 1141895 - RNA, 18 nt, Human
caugacucuaugagacag

SEQ ID NO: 1141896 - RNA, 24 nt, Human
caugccaccacacccagcuaaguu

SEQ ID NO: 1141897 - RNA, 25 nt, Human
caugccaccacacccagcuaaguuu

SEQ ID NO: 1141898 - RNA, 20 nt, Human
cauguauucauucacuuuau

SEQ ID NO: 1141899 - RNA, 21 nt, Human
ccaaagugcugggauuacaga

SEQ ID NO: 1141900 - RNA, 24 nt, Human
ccaaagugcugggauuacagaggu

SEQ ID NO: 1141901 - RNA, 23 nt, Human
ccaccucagccuccugaguagcu

SEQ ID NO: 1141902 - RNA, 21 nt, Human
ccagcacaucacauguauuca

SEQ ID NO: 1141903 - RNA, 23 nt, Human
ccagcacaucacauguauucauu

SEQ ID NO: 1141904 - RNA, 22 nt, Human
ccaggcacaugccaccacaccc

SEQ ID NO: 1141905 - RNA, 21 nt, Human
ccagggaagcaacccugaccc

SEQ ID NO: 1141906 - RNA, 28 nt, Human
ccaguaucuuccaaugggaaugucuucc

SEQ ID NO: 1141907 - RNA, 23 nt, Human
cccaccucagccuccugaguagc

SEQ ID NO: 1141908 - RNA, 22 nt, Human
cccucugcacagucccuuugag

SEQ ID NO: 1141909 - RNA, 21 nt, Human
ccugaccccugacccccucca

SEQ ID NO: 1141910 - RNA, 23 nt, Human
ccugaccccugacccccuccaac

SEQ ID NO: 1141911 - RNA, 23 nt, Human
ccugagccuccucuugcaggugu

SEQ ID NO: 1141912 - RNA, 24 nt, Human
ccuggacagacaauguguucaaga

SEQ ID NO: 1141913 - RNA, 20 nt, Human
ccugggcucaagugauccuc

SEQ ID NO: 1141914 - RNA, 20 nt, Human
ccugggcucaagugauccuc

SEQ ID NO: 1141915 - RNA, 22 nt, Human
ccugggcucaagugauccucuu

SEQ ID NO: 1141916 - RNA, 18 nt, Human
cgguaaaggcauggacca

SEQ ID NO: 1141917 - RNA, 18 nt, Human
cucacugcagucucaacc

SEQ ID NO: 1141918 - RNA, 19 nt, Human
cucacugcagucucaaccu

SEQ ID NO: 1141919 - RNA, 24 nt, Human
cucagccuccugaguagcugggac

SEQ ID NO: 1141920 - RNA, 23 nt, Human
cuccucauuuugcagauggggaa

SEQ ID NO: 1141921 - RNA, 23 nt, Human
cuccucuucuccacccuaugaac

SEQ ID NO: 1141922 - RNA, 18 nt, Human
cugacccccuccaacagg

SEQ ID NO: 1141923 - RNA, 19 nt, Human
cugaccccugacccccucc

SEQ ID NO: 1141924 - RNA, 21 nt, Human
cugcauguuaaccugucucuc

SEQ ID NO: 1141925 - RNA, 19 nt, Human
cugggcccuagggagucuc

SEQ ID NO: 1141926 - RNA, 22 nt, Human
cuggucuuuccagagcuccagg

SEQ ID NO: 1141927 - RNA, 22 nt, Human
cuucaggaccuuggugaccauu

SEQ ID NO: 1141928 - RNA, 21 nt, Human
cuuccagcuucuggugguugu

SEQ ID NO: 1141929 - RNA, 24 nt, Human
cuucccaccucagccuccugagua

SEQ ID NO: 1141930 - RNA, 22 nt, Human
cuucccagcagaaugaccccaa

SEQ ID NO: 1141931 - RNA, 24 nt, Human
cuugccuuggccucccaaagugcu

SEQ ID NO: 1141932 - RNA, 18 nt, Human
gaauguacuaagggagga

SEQ ID NO: 1141933 - RNA, 24 nt, Human
gacacaccuaccggauaccacaca

SEQ ID NO: 1141934 - RNA, 23 nt, Human
gacaggguuucacucugucaucc

SEQ ID NO: 1141935 - RNA, 19 nt, Human
gaccccugacccccuccaa

SEQ ID NO: 1141936 - RNA, 18 nt, Human
gagaugggguuuugccau

SEQ ID NO: 1141937 - RNA, 23 nt, Human
gagcagaugaaaagauaauccac

SEQ ID NO: 1141938 - RNA, 20 nt, Human
gaguagcugggacuccaggc

SEQ ID NO: 1141939 - RNA, 25 nt, Human
gaguagcugggacuccaggcacaug

SEQ ID NO: 1141940 - RNA, 18 nt, Human
gauuacagaggugagcca

SEQ ID NO: 1141941 - RNA, 22 nt, Human
gauuacagaggugagccacugc

SEQ ID NO: 1141942 - RNA, 25 nt, Human
gcagcgaucccucugcacagucccu

SEQ ID NO: 1141943 - RNA, 22 nt, Human
gccuuggccucccaaagugcug

SEQ ID NO: 1141944 - RNA, 20 nt, Human
gcgggggcagcagggagagg

SEQ ID NO: 1141945 - RNA, 20 nt, Human
gcucacugcagucucaaccu

SEQ ID NO: 1141946 - RNA, 20 nt, Human
ggaaaacuauuucuauucac

SEQ ID NO: 1141947 - RNA, 20 nt, Human
ggagggugaaggaagggcug

SEQ ID NO: 1141948 - RNA, 18 nt, Human
ggaggugggugugaagug

SEQ ID NO: 1141949 - RNA, 19 nt, Human
ggcagcagggagaggcaaa

SEQ ID NO: 1141950 - RNA, 22 nt, Human
gggcucaagugauccucuugcc

SEQ ID NO: 1141951 - RNA, 21 nt, Human
ggggcagcagggagaggcaaa

SEQ ID NO: 1141952 - RNA, 20 nt, Human
gugauucuccaaucucugcc

SEQ ID NO: 1141953 - RNA, 21 nt, Human
guggagcaauaggaacucuca

SEQ ID NO: 1141954 - RNA, 21 nt, Human
gugugugugugugugugugag

SEQ ID NO: 1141955 - RNA, 20 nt, Human
gugugugugugugugugugu

SEQ ID NO: 1141956 - RNA, 20 nt, Human
guuccuuucuuuuccuggac

SEQ ID NO: 1141957 - RNA, 18 nt, Human
uaacaaaaggccaaaggc

SEQ ID NO: 1141958 - RNA, 18 nt, Human
uaacgcacccugcaccgc

SEQ ID NO: 1141959 - RNA, 22 nt, Human
uacagaggugagccacugcgcc

SEQ ID NO: 1141960 - RNA, 22 nt, Human
uacagaggugagccacugcgcc

SEQ ID NO: 1141961 - RNA, 23 nt, Human
uacagaggugagccacugcgccu

SEQ ID NO: 1141962 - RNA, 18 nt, Human
uaccccuuccagcuucug

SEQ ID NO: 1141963 - RNA, 25 nt, Human
uagaacauaaacugcagcucgacag

SEQ ID NO: 1141964 - RNA, 22 nt, Human
uagagaugggguuuugccaugu

SEQ ID NO: 1141965 - RNA, 24 nt, Human
uauagaacauaaacugcagcucga

SEQ ID NO: 1141966 - RNA, 24 nt, Human
uauagagaugggguuuugccaugu

SEQ ID NO: 1141967 - RNA, 23 nt, Human
uauauagauggcaaaugagcagu

SEQ ID NO: 1141968 - RNA, 22 nt, Human
uaucucacaacuguggaagcca

SEQ ID NO: 1141969 - RNA, 18 nt, Human
uaugaacuggauccaaug

SEQ ID NO: 1141970 - RNA, 22 nt, Human
uaugagacaggcacuaugaccc

SEQ ID NO: 1141971 - RNA, 19 nt, Human
ucaagaggaguuuugggau

SEQ ID NO: 1141972 - RNA, 21 nt, Human
ucacucugucauccaggcugg

SEQ ID NO: 1141973 - RNA, 22 nt, Human
ucacucugucauccaggcugga

SEQ ID NO: 1141974 - RNA, 24 nt, Human
ucacucugucauccaggcuggagu

SEQ ID NO: 1141975 - RNA, 24 nt, Human
ucacugcagucucaaccuucuggg

SEQ ID NO: 1141976 - RNA, 22 nt, Human
ucacuggucuuuccagagcucc

SEQ ID NO: 1141977 - RNA, 27 nt, Human
ucagccaggccagaugucagagcccaa

SEQ ID NO: 1141978 - RNA, 23 nt, Human
ucagccuccugaguagcugggac

SEQ ID NO: 1141979 - RNA, 24 nt, Human
ucauccaggcuggagugcaguggu

SEQ ID NO: 1141980 - RNA, 25 nt, Human
uccaaaaucaagguacuggcagggc

SEQ ID NO: 1141981 - RNA, 23 nt, Human
uccagggcacagauagcagcaaa

SEQ ID NO: 1141982 - RNA, 22 nt, Human
uccaugaccuuuucacuguucu

SEQ ID NO: 1141983 - RNA, 18 nt, Human
ucccaaagugcugggauu

SEQ ID NO: 1141984 - RNA, 23 nt, Human
ucccaaagugcugggauuacaga

SEQ ID NO: 1141985 - RNA, 19 nt, Human
ucccaaugcuccaguuuuc

SEQ ID NO: 1141986 - RNA, 19 nt, Human
ucccaucucauugaaauuc

SEQ ID NO: 1141987 - RNA, 22 nt, Human
ucccaucucauugaaauucagg

SEQ ID NO: 1141988 - RNA, 22 nt, Human
uccgcgacuaucucagcaaacc

SEQ ID NO: 1141989 - RNA, 24 nt, Human
uccugaguagcugggacuccaggc

SEQ ID NO: 1141990 - RNA, 18 nt, Human
ucuagaaacagcgcgggg

SEQ ID NO: 1141991 - RNA, 18 nt, Human
ucucaaccuucugggcuu

SEQ ID NO: 1141992 - RNA, 23 nt, Human
ucucgaacgccugggcucaagug

SEQ ID NO: 1141993 - RNA, 23 nt, Human
ucucguggaaauaauuccuuuau

SEQ ID NO: 1141994 - RNA, 24 nt, Human
ucucugagaagcagucauuggucu

SEQ ID NO: 1141995 - RNA, 24 nt, Human
ucugucauccaggcuggagugcag

SEQ ID NO: 1141996 - RNA, 23 nt, Human
ugaagugaaagccuuugaggucc

SEQ ID NO: 1141997 - RNA, 24 nt, Human
ugaagugaaagccuuugagguccc

SEQ ID NO: 1141998 - RNA, 21 nt, Human
ugaccccaacaaaggaggcau

SEQ ID NO: 1141999 - RNA, 18 nt, Human
ugagacaggcacuaugac

SEQ ID NO: 1142000 - RNA, 19 nt, Human
ugagacaggcacuaugacc

SEQ ID NO: 1142001 - RNA, 20 nt, Human
ugagacaggcacuaugaccc

SEQ ID NO: 1142002 - RNA, 20 nt, Human
ugcaucaccagguugcgcug

SEQ ID NO: 1142003 - RNA, 20 nt, Human
ugcugugugaccugggcccg

SEQ ID NO: 1142004 - RNA, 19 nt, Human
uggagugcagugguacgau

SEQ ID NO: 1142005 - RNA, 24 nt, Human
uggagugcagugguacgauggugg

SEQ ID NO: 1142006 - RNA, 23 nt, Human
uggcuggcgugcuugucucgugg

SEQ ID NO: 1142007 - RNA, 24 nt, Human
ugggacuccaggcacaugccacca

SEQ ID NO: 1142008 - RNA, 21 nt, Human
ugggauaguggggaucccugg

SEQ ID NO: 1142009 - RNA, 22 nt, Human
ugggauuacagaggugagccac

SEQ ID NO: 1142010 - RNA, 22 nt, Human
ugggauuacagaggugagccac

SEQ ID NO: 1142011 - RNA, 24 nt, Human
ugggauuacagaggugagccacug

SEQ ID NO: 1142012 - RNA, 18 nt, Human
ugggcucaagugauccuc

SEQ ID NO: 1142013 - RNA, 24 nt, Human
ugggcucaagugauccucuugccu

SEQ ID NO: 1142014 - RNA, 22 nt, Human
ugggcuuagaugaucuucccac

SEQ ID NO: 1142015 - RNA, 24 nt, Human
ugggcuuagaugaucuucccaccu

SEQ ID NO: 1142016 - RNA, 21 nt, Human
ugguggcucacugcagucuca

SEQ ID NO: 1142017 - RNA, 22 nt, Human
ugucucguggaaauaauuccuu

SEQ ID NO: 1142018 - RNA, 19 nt, Human
ugugaagugaaagccuuug

SEQ ID NO: 1142019 - RNA, 23 nt, Human
ugugcgggggcagcagggagagg

SEQ ID NO: 1142020 - RNA, 19 nt, Human
uguggaagccagaagucca

SEQ ID NO: 1142021 - RNA, 18 nt, Human
ugugugugugugugugug

SEQ ID NO: 1142022 - RNA, 18 nt, Human
ugugugugugugugugug

SEQ ID NO: 1142023 - RNA, 21 nt, Human
ugugugugugugugugugugu

SEQ ID NO: 1142024 - RNA, 21 nt, Human
ugugugugugugugugugugu

SEQ ID NO: 1142025 - RNA, 22 nt, Human
ugugugugugugugugugugug

SEQ ID NO: 1142026 - RNA, 18 nt, Human
uguucagucagcaccuga

SEQ ID NO: 1142027 - RNA, 20 nt, Human
uuagaugaucuucccaccuu

SEQ ID NO: 1142028 - RNA, 21 nt, Human
uuaguucaccacucugaaccu

SEQ ID NO: 1142029 - RNA, 24 nt, Human
uuauagagaugggguuuugccaug

SEQ ID NO: 1142030 - RNA, 18 nt, Human
uucacaggaucuucuccu

SEQ ID NO: 1142031 - RNA, 24 nt, Human
uucacucugucauccaggcuggag

SEQ ID NO: 1142032 - RNA, 23 nt, Human
uucccaccucagccuccugagua

SEQ ID NO: 1142033 - RNA, 21 nt, Human
uuccuggacagacgauggcau

SEQ ID NO: 1142034 - RNA, 27 nt, Human
uugauuggaucagacaugcuggaagag

SEQ ID NO: 1142035 - RNA, 23 nt, Human
uugcagcgaucccucugcacagu

SEQ ID NO: 1142036 - RNA, 24 nt, Human
uugccuuggccucccaaagugcug

SEQ ID NO: 1142037 - RNA, 24 nt, Human
uuuauagagaugggguuuugccau

SEQ ID NO: 1142038 - RNA, 22 nt, Human
uuucacucugucauccaggcug

SEQ ID NO: 1142039 - RNA, 24 nt, Human
uuucacucugucauccaggcugga

SEQ ID NO: 1142040 - RNA, 24 nt, Human
uuuccuaaaagggagacaugaaaa

SEQ ID NO: 1142041 - RNA, 20 nt, Human
uuugaggucccugcccaugg

SEQ ID NO: 1142042 - RNA, 20 nt, Human
uuuuuauagagaugggguuu

SEQ ID NO: 1142043 - RNA, 20 nt, Human
aacaacuuuucacaagccga

SEQ ID NO: 1142044 - RNA, 22 nt, Human
aacucucuucuucaauggacua

SEQ ID NO: 1142045 - RNA, 19 nt, Human
aagucuucaucucaugcuc

SEQ ID NO: 1142046 - RNA, 19 nt, Human
acaacaacuuucaaacucu

SEQ ID NO: 1142047 - RNA, 22 nt, Human
acuaccagaaaucagaaagcca

SEQ ID NO: 1142048 - RNA, 24 nt, Human
agaaagccacuauaaaacccaaug

SEQ ID NO: 1142049 - RNA, 20 nt, Human
ccacaaucuagaaauggaac

SEQ ID NO: 1142050 - RNA, 22 nt, Human
uacaacaacuuucaaacucucu

SEQ ID NO: 1142051 - RNA, 22 nt, Human
uaccagaaaucagaaagccacu

SEQ ID NO: 1142052 - RNA, 25 nt, Human
uagaaauggaaccacugcucuuuug

SEQ ID NO: 1142053 - RNA, 22 nt, Human
uauacaacaacuuucaaacucu

SEQ ID NO: 1142054 - RNA, 23 nt, Human
ucagaaagugaaaugaaaauggu

SEQ ID NO: 1142055 - RNA, 22 nt, Human
ucaggcaggacaugggcagaca

SEQ ID NO: 1142056 - RNA, 20 nt, Human
ugaaaaugguagaauuuauc

SEQ ID NO: 1142057 - RNA, 21 nt, Human
ugaaaaugguagaauuuaucu

SEQ ID NO: 1142058 - RNA, 23 nt, Human
uggaaccacugcucuuuugacag

SEQ ID NO: 1142059 - RNA, 20 nt, Human
uuaucugaagauccacaauc

SEQ ID NO: 1142060 - RNA, 21 nt, Human
uucaaacucucuucuucaaug

SEQ ID NO: 1142061 - RNA, 22 nt, Human
uucaaacucucuucuucaaugg

SEQ ID NO: 1142062 - RNA, 19 nt, Human
aaaaggaacaaguuaugaa

SEQ ID NO: 1142063 - RNA, 21 nt, Human
aacauagugagacccccaucu

SEQ ID NO: 1142064 - RNA, 21 nt, Human
aaccaaaccaacaacaacagc

SEQ ID NO: 1142065 - RNA, 19 nt, Human
aagguauuucaacuugaaa

SEQ ID NO: 1142066 - RNA, 21 nt, Human
aauauauauguauaugcuacu

SEQ ID NO: 1142067 - RNA, 24 nt, Human
acaacaacagcaguaacaacaaaa

SEQ ID NO: 1142068 - RNA, 21 nt, Human
acacaagaaagguauuucaac

SEQ ID NO: 1142069 - RNA, 24 nt, Human
acagagccagacccggucucaaaa

SEQ ID NO: 1142070 - RNA, 21 nt, Human
acauagugagacccccaucuc

SEQ ID NO: 1142071 - RNA, 24 nt, Human
accgcauuccagcuugggcuacag

SEQ ID NO: 1142072 - RNA, 19 nt, Human
acugcuaaagucucuuggg

SEQ ID NO: 1142073 - RNA, 23 nt, Human
agccgggugugguggcacgugcc

SEQ ID NO: 1142074 - RNA, 22 nt, Human
agccugggcaacauagugagac

SEQ ID NO: 1142075 - RNA, 23 nt, Human
agccugggcaacauagugagacc

SEQ ID NO: 1142076 - RNA, 24 nt, Human
agccugggcaacauagugagaccc

SEQ ID NO: 1142077 - RNA, 22 nt, Human
aggaauauaccuggaccggggc

SEQ ID NO: 1142078 - RNA, 20 nt, Human
aggaguuugagaccagccug

SEQ ID NO: 1142079 - RNA, 24 nt, Human
aggaucgcuugagcccaggaguuu

SEQ ID NO: 1142080 - RNA, 24 nt, Human
aggauugcuugagcccaggaguuu

SEQ ID NO: 1142081 - RNA, 21 nt, Human
aggcagaagggacaaccaggg

SEQ ID NO: 1142082 - RNA, 19 nt, Human
aggcagacauguuuaaucc

SEQ ID NO: 1142083 - RNA, 23 nt, Human
aggcaggaggauugcuugagccc

SEQ ID NO: 1142084 - RNA, 24 nt, Human
aggcaggaggauugcuugagccca

SEQ ID NO: 1142085 - RNA, 19 nt, Human
aggcaugguggcucaugca

SEQ ID NO: 1142086 - RNA, 24 nt, Human
aggccgaggccaaaggaucgcuug

SEQ ID NO: 1142087 - RNA, 25 nt, Human
aggccgaggccaaaggaucgcuuga

SEQ ID NO: 1142088 - RNA, 21 nt, Human
aggcugaggcaggaggauugc

SEQ ID NO: 1142089 - RNA, 24 nt, Human
aggcugaggcaggaggauugcuug

SEQ ID NO: 1142090 - RNA, 22 nt, Human
aguaacaacaaaacuaaguaaa

SEQ ID NO: 1142091 - RNA, 24 nt, Human
aucgcgccaccgcauuccagcuug

SEQ ID NO: 1142092 - RNA, 20 nt, Human
augacuuucacaagcaacaa

SEQ ID NO: 1142093 - RNA, 24 nt, Human
auugcuugagcccaggaguuugag

SEQ ID NO: 1142094 - RNA, 21 nt, Human
caaaaccaaccaaaccaacaa

SEQ ID NO: 1142095 - RNA, 24 nt, Human
caaaaccaaccaaaccaacaacaa

SEQ ID NO: 1142096 - RNA, 21 nt, Human
caacaacaacagcaguaacaa

SEQ ID NO: 1142097 - RNA, 25 nt, Human
caacagcaguaacaacaaaacuaag

SEQ ID NO: 1142098 - RNA, 18 nt, Human
caaccaaaccaacaacaa

SEQ ID NO: 1142099 - RNA, 19 nt, Human
caaguuuccauuugcaauu

SEQ ID NO: 1142100 - RNA, 18 nt, Human
caccgcauuccagcuugg

SEQ ID NO: 1142101 - RNA, 33 nt, Human
cagcaguaacaacaaaacuaaguaaaaggaaag

SEQ ID NO: 1142102 - RNA, 20 nt, Human
cagccugggcaacauaguga

SEQ ID NO: 1142103 - RNA, 24 nt, Human
cagcugcuugggaggcugaggcag

SEQ ID NO: 1142104 - RNA, 23 nt, Human
caggccaggcaugguggcucaug

SEQ ID NO: 1142105 - RNA, 24 nt, Human
caucucuacaaaaaaaauaaagaa

SEQ ID NO: 1142106 - RNA, 22 nt, Human
cauuagauuguggguuucaagu

SEQ ID NO: 1142107 - RNA, 27 nt, Human
ccaacaacaacagcaguaacaacaaaa

SEQ ID NO: 1142108 - RNA, 23 nt, Human
ccaaccaaaccaacaacaacagc

SEQ ID NO: 1142109 - RNA, 20 nt, Human
ccaccgcauuccagcuuggg

SEQ ID NO: 1142110 - RNA, 20 nt, Human
ccaccgcauuccagcuuggg

SEQ ID NO: 1142111 - RNA, 21 nt, Human
ccaccgcauuccagcuugggc

SEQ ID NO: 1142112 - RNA, 23 nt, Human
ccagaaaucucugucuuaaccaa

SEQ ID NO: 1142113 - RNA, 22 nt, Human
ccuaucuucccagcugcuuggg

SEQ ID NO: 1142114 - RNA, 22 nt, Human
ccucaguccuccaaaaaaauga

SEQ ID NO: 1142115 - RNA, 21 nt, Human
cucaaaaccaaccaaaccaac

SEQ ID NO: 1142116 - RNA, 22 nt, Human
cucaaaaccaaccaaaccaaca

SEQ ID NO: 1142117 - RNA, 22 nt, Human
cuuaaccaaaccucucucucca

SEQ ID NO: 1142118 - RNA, 20 nt, Human
cuuccaaguugaugcgaaca

SEQ ID NO: 1142119 - RNA, 20 nt, Human
gaacaaagccucaguccucc

SEQ ID NO: 1142120 - RNA, 19 nt, Human
gagccaugaucgcgccacc

SEQ ID NO: 1142121 - RNA, 18 nt, Human
gagcccaggaguuugagg

SEQ ID NO: 1142122 - RNA, 24 nt, Human
gaucgcuugagcccaggaguuuga

SEQ ID NO: 1142123 - RNA, 22 nt, Human
gauugcuugagcccaggaguuu

SEQ ID NO: 1142124 - RNA, 24 nt, Human
gauugcuugagcccaggaguuuga

SEQ ID NO: 1142125 - RNA, 18 nt, Human
gcacuuugggaggccgag

SEQ ID NO: 1142126 - RNA, 19 nt, Human
gccaugaucgcgccaccgc

SEQ ID NO: 1142127 - RNA, 22 nt, Human
gcccaggaguuugagaccagcc

SEQ ID NO: 1142128 - RNA, 22 nt, Human
ggaucgcuugagcccaggaguu

SEQ ID NO: 1142129 - RNA, 22 nt, Human
ggauugcuugagcccaggaguu

SEQ ID NO: 1142130 - RNA, 26 nt, Human
gguagaacaaagccucaguccuccaa

SEQ ID NO: 1142131 - RNA, 22 nt, Human
gguggcucaugcacuuugggag

SEQ ID NO: 1142132 - RNA, 22 nt, Human
gucucaaaaccaaccaaaccaa

SEQ ID NO: 1142133 - RNA, 24 nt, Human
gugaaaaauguuauuuaaaaauau

SEQ ID NO: 1142134 - RNA, 23 nt, Human
gugguugucucaggcagaaggga

SEQ ID NO: 1142135 - RNA, 22 nt, Human
uaaaaggaacaaguuaugaaug

SEQ ID NO: 1142136 - RNA, 19 nt, Human
uaagucacaauaauauccu

SEQ ID NO: 1142137 - RNA, 25 nt, Human
uacacacaucauuguuguacauaug

SEQ ID NO: 1142138 - RNA, 22 nt, Human
uagaacaaagccucaguccucc

SEQ ID NO: 1142139 - RNA, 22 nt, Human
uagccgggugugguggcacgug

SEQ ID NO: 1142140 - RNA, 20 nt, Human
uagugagacccccaucucua

SEQ ID NO: 1142141 - RNA, 26 nt, Human
uauaauacacacaucauuguuguaca

SEQ ID NO: 1142142 - RNA, 25 nt, Human
uauauaauacacacaucauuguugu

SEQ ID NO: 1142143 - RNA, 24 nt, Human
uccagcuugggcuacagagccaga

SEQ ID NO: 1142144 - RNA, 18 nt, Human
ucgcgccaccgcauucca

SEQ ID NO: 1142145 - RNA, 19 nt, Human
ucgcuugagcccaggaguu

SEQ ID NO: 1142146 - RNA, 19 nt, Human
ucucaaaaccaaccaaacc

SEQ ID NO: 1142147 - RNA, 23 nt, Human
ucucaaaaccaaccaaaccaaca

SEQ ID NO: 1142148 - RNA, 24 nt, Human
ucucuccaggcacgauucugcaca

SEQ ID NO: 1142149 - RNA, 25 nt, Human
ucugcacaugagucugaucugugua

SEQ ID NO: 1142150 - RNA, 24 nt, Human
ugagaccagccugggcaacauagu

SEQ ID NO: 1142151 - RNA, 23 nt, Human
ugagcccaggaguuugagaccag

SEQ ID NO: 1142152 - RNA, 22 nt, Human
ugagcccaggaguuugaggcug

SEQ ID NO: 1142153 - RNA, 24 nt, Human
ugaggcaggaggauugcuugagcc

SEQ ID NO: 1142154 - RNA, 25 nt, Human
ugaggcaggaggauugcuugagccc

SEQ ID NO: 1142155 - RNA, 23 nt, Human
ugcauugcauuccauguguucaa

SEQ ID NO: 1142156 - RNA, 24 nt, Human
ugccuaucuucccagcugcuuggg

SEQ ID NO: 1142157 - RNA, 18 nt, Human
ugcuugagcccaggaguu

SEQ ID NO: 1142158 - RNA, 21 nt, Human
ugggaggccgaggccaaagga

SEQ ID NO: 1142159 - RNA, 23 nt, Human
ugggaggccgaggccaaaggauc

SEQ ID NO: 1142160 - RNA, 20 nt, Human
ugggaggcugaggcaggagg

SEQ ID NO: 1142161 - RNA, 22 nt, Human
ugggaggcugaggcaggaggau

SEQ ID NO: 1142162 - RNA, 21 nt, Human
uguacacaucacuguuauaua

SEQ ID NO: 1142163 - RNA, 20 nt, Human
uguacauaugaggauaaguu

SEQ ID NO: 1142164 - RNA, 24 nt, Human
uguguugaacuuuggaggcaaaug

SEQ ID NO: 1142165 - RNA, 23 nt, Human
uuacugcacuuccaaguugaugc

SEQ ID NO: 1142166 - RNA, 18 nt, Human
uuagaaaggcagacaugu

SEQ ID NO: 1142167 - RNA, 20 nt, Human
uuagccgggugugguggcac

SEQ ID NO: 1142168 - RNA, 20 nt, Human
uuagccgggugugguggcac

SEQ ID NO: 1142169 - RNA, 24 nt, Human
uuagccgggugugguggcacgugc

SEQ ID NO: 1142170 - RNA, 20 nt, Human
uuaggcacuaguaauauccu

SEQ ID NO: 1142171 - RNA, 22 nt, Human
uugagcccaggaguuugagacc

SEQ ID NO: 1142172 - RNA, 24 nt, Human
uugcuuaaauuugagagucucugg

SEQ ID NO: 1142173 - RNA, 24 nt, Human
uugcuugagcccaggaguuugagg

SEQ ID NO: 1142174 - RNA, 24 nt, Human
uugggaggccgaggccaaaggauc

SEQ ID NO: 1142175 - RNA, 20 nt, Human
uugggaggcugaggcaggag

SEQ ID NO: 1142176 - RNA, 25 nt, Human
uuugaucaggaauauaccuggacua

SEQ ID NO: 1142177 - RNA, 27 nt, Human
uuugaucaggaauauaccuggacuacu

SEQ ID NO: 1142178 - RNA, 23 nt, Human
uuuuacaaugaguagauauuacu

SEQ ID NO: 1142179 - RNA, 23 nt, Human
aaccuaugcacuauacuucccuu

SEQ ID NO: 1142180 - RNA, 22 nt, Human
aacuuucucuccaccucucagc

SEQ ID NO: 1142181 - RNA, 22 nt, Human
aagaacagaggggcaaacuaac

SEQ ID NO: 1142182 - RNA, 25 nt, Human
acucccagggauguaguuugaagag

SEQ ID NO: 1142183 - RNA, 20 nt, Human
agaaaaguugguugaccuaa

SEQ ID NO: 1142184 - RNA, 18 nt, Human
agaacagaggggcaaacu

SEQ ID NO: 1142185 - RNA, 20 nt, Human
aggaacugugguuaucaaca

SEQ ID NO: 1142186 - RNA, 20 nt, Human
aggaauaaacucuuaagaac

SEQ ID NO: 1142187 - RNA, 20 nt, Human
auaaguauccauccuguagu

SEQ ID NO: 1142188 - RNA, 22 nt, Human
caacauuguuucuagaugaugg

SEQ ID NO: 1142189 - RNA, 19 nt, Human
caccucauaacucaucauc

SEQ ID NO: 1142190 - RNA, 19 nt, Human
cauugcugcugagucaucc

SEQ ID NO: 1142191 - RNA, 21 nt, Human
cccugccaaacuuccuucccu

SEQ ID NO: 1142192 - RNA, 25 nt, Human
ccuuaagagcaaugccaggaauaaa

SEQ ID NO: 1142193 - RNA, 20 nt, Human
gauccucaacagugaaguuu

SEQ ID NO: 1142194 - RNA, 19 nt, Human
uaacaagcccaaguucagg

SEQ ID NO: 1142195 - RNA, 23 nt, Human
uaagaacagaggggcaaacuaac

SEQ ID NO: 1142196 - RNA, 22 nt, Human
uaagagcaaugccaggaauaaa

SEQ ID NO: 1142197 - RNA, 19 nt, Human
uaagcaacuuucucuccac

SEQ ID NO: 1142198 - RNA, 23 nt, Human
uaagcugagucuuaagggacuaa

SEQ ID NO: 1142199 - RNA, 22 nt, Human
uaaguauccauccuguaguuuc

SEQ ID NO: 1142200 - RNA, 21 nt, Human
uauaaguauccauccuguagu

SEQ ID NO: 1142201 - RNA, 20 nt, Human
uaugacaucacuaacacucc

SEQ ID NO: 1142202 - RNA, 23 nt, Human
ucccuuaagagcaaugccaggaa

SEQ ID NO: 1142203 - RNA, 22 nt, Human
ucuuggcccugccaaacuuccu

SEQ ID NO: 1142204 - RNA, 27 nt, Human
ugauccucaacagugaaguuuuaauau

SEQ ID NO: 1142205 - RNA, 19 nt, Human
ugauggcuucuuuugcucc

SEQ ID NO: 1142206 - RNA, 21 nt, Human
ugcuuaagcugagucuuaagg

SEQ ID NO: 1142207 - RNA, 22 nt, Human
uggagcuggcacauugcugcug

SEQ ID NO: 1142208 - RNA, 19 nt, Human
uggcccugccaaacuuccu

SEQ ID NO: 1142209 - RNA, 19 nt, Human
uguuguuaguguuuagaga

SEQ ID NO: 1142210 - RNA, 22 nt, Human
uugcuauguaugcuagcugugu

SEQ ID NO: 1142211 - RNA, 23 nt, Human
uugcuauguaugcuagcuguguu

SEQ ID NO: 1142212 - RNA, 26 nt, Human
uuguuaguguuuagagagaaaggucu

SEQ ID NO: 1142213 - RNA, 24 nt, Human
uuucuagaucucgagaccugauug

SEQ ID NO: 1142214 - RNA, 20 nt, Human
aaaaaagagaagcagcuugc

SEQ ID NO: 1142215 - RNA, 21 nt, Human
aaacaggcccugggcccuuca

SEQ ID NO: 1142216 - RNA, 22 nt, Human
aaacagugccauggggagcuca

SEQ ID NO: 1142217 - RNA, 23 nt, Human
aaggggccaaaacagcugguggg

SEQ ID NO: 1142218 - RNA, 19 nt, Human
acaggcaugugacacuggu

SEQ ID NO: 1142219 - RNA, 19 nt, Human
acccagagcgcacccccuc

SEQ ID NO: 1142220 - RNA, 19 nt, Human
acccccuccccucgcccca

SEQ ID NO: 1142221 - RNA, 22 nt, Human
acuuccugcacugcccagaaac

SEQ ID NO: 1142222 - RNA, 19 nt, Human
aggcauggggcugggacuu

SEQ ID NO: 1142223 - RNA, 21 nt, Human
aggccucugguuuagauccag

SEQ ID NO: 1142224 - RNA, 22 nt, Human
aggggccaaaacagcuggcggg

SEQ ID NO: 1142225 - RNA, 26 nt, Human
aggggcugugaugcacccguuggugg

SEQ ID NO: 1142226 - RNA, 19 nt, Human
augaauuuuuaaaaaagag

SEQ ID NO: 1142227 - RNA, 20 nt, Human
caccggagagggaggccccc

SEQ ID NO: 1142228 - RNA, 19 nt, Human
cagagcgcacccccucccc

SEQ ID NO: 1142229 - RNA, 21 nt, Human
cagaguggggaaagggaaaga

SEQ ID NO: 1142230 - RNA, 19 nt, Human
cagauacauuaagcugucc

SEQ ID NO: 1142231 - RNA, 25 nt, Human
cagcuccaccucagugugcugaggg

SEQ ID NO: 1142232 - RNA, 20 nt, Human
caggaccacgaucucugcca

SEQ ID NO: 1142233 - RNA, 20 nt, Human
caggaccacgaucucugccg

SEQ ID NO: 1142234 - RNA, 19 nt, Human
caggccacagcagggugcu

SEQ ID NO: 1142235 - RNA, 23 nt, Human
caggcccugggcccuucacaccu

SEQ ID NO: 1142236 - RNA, 21 nt, Human
caguguccaggaggagaaagu

SEQ ID NO: 1142237 - RNA, 19 nt, Human
ccacaggccacagcagggu

SEQ ID NO: 1142238 - RNA, 20 nt, Human
ccacaggccacagcagggug

SEQ ID NO: 1142239 - RNA, 19 nt, Human
cccagagcgcacccccucc

SEQ ID NO: 1142240 - RNA, 23 nt, Human
ccccaaggggucugcuggccucu

SEQ ID NO: 1142241 - RNA, 22 nt, Human
cccccuccccucgccccagcuc

SEQ ID NO: 1142242 - RNA, 20 nt, Human
ccccgugccuuuugaggaug

SEQ ID NO: 1142243 - RNA, 19 nt, Human
ccugcacugcccagaaaca

SEQ ID NO: 1142244 - RNA, 22 nt, Human
ccugggcuccaguguccaggag

SEQ ID NO: 1142245 - RNA, 25 nt, Human
ccuucaguuacccagagcgcacccc

SEQ ID NO: 1142246 - RNA, 19 nt, Human
cuacaggggaucucaccac

SEQ ID NO: 1142247 - RNA, 24 nt, Human
cucgccagaacaggccucugguuu

SEQ ID NO: 1142248 - RNA, 22 nt, Human
cugcccagaaacaggcccuggg

SEQ ID NO: 1142249 - RNA, 19 nt, Human
cugggacuuccugcacugc

SEQ ID NO: 1142250 - RNA, 23 nt, Human
gaaucacagagaugcacaggcau

SEQ ID NO: 1142251 - RNA, 19 nt, Human
gaggaugggaaacagcaug

SEQ ID NO: 1142252 - RNA, 19 nt, Human
gcccugggcccuucacacc

SEQ ID NO: 1142253 - RNA, 21 nt, Human
gcuugcagaguggggaaaggg

SEQ ID NO: 1142254 - RNA, 25 nt, Human
gcuugcccuccagcaacauucccac

SEQ ID NO: 1142255 - RNA, 22 nt, Human
gggccaaaacagcugcuagaga

SEQ ID NO: 1142256 - RNA, 24 nt, Human
ggggaggguugggaaggaguuggg

SEQ ID NO: 1142257 - RNA, 20 nt, Human
ggguugggaaggaguugggu

SEQ ID NO: 1142258 - RNA, 21 nt, Human
guugggaaggaguuggguggc

SEQ ID NO: 1142259 - RNA, 21 nt, Human
uaaaaaagagaagcagcuugc

SEQ ID NO: 1142260 - RNA, 18 nt, Human
ucacagagaugcacaggc

SEQ ID NO: 1142261 - RNA, 19 nt, Human
ucagugugcugaggggucc

SEQ ID NO: 1142262 - RNA, 22 nt, Human
uccccaaggggucugcuggccu

SEQ ID NO: 1142263 - RNA, 22 nt, Human
ucccccagugugugagaggugc

SEQ ID NO: 1142264 - RNA, 18 nt, Human
uccccucgccccagcucc

SEQ ID NO: 1142265 - RNA, 25 nt, Human
uccuuuauaagcagaaucauugaac

SEQ ID NO: 1142266 - RNA, 21 nt, Human
ucucaccacaggcauggggcu

SEQ ID NO: 1142267 - RNA, 22 nt, Human
ucugaugaaggcuuugguuacu

SEQ ID NO: 1142268 - RNA, 20 nt, Human
ugagaugaagucaguuaacc

SEQ ID NO: 1142269 - RNA, 23 nt, Human
ugagggguccugugugcccagga

SEQ ID NO: 1142270 - RNA, 22 nt, Human
ugcccagaaacaggcccugggc

SEQ ID NO: 1142271 - RNA, 21 nt, Human
ugcugagggguccugugugcc

SEQ ID NO: 1142272 - RNA, 21 nt, Human
ugcuugcagaguggggaaagg

SEQ ID NO: 1142273 - RNA, 21 nt, Human
ugugagaggugcgcgggcacc

SEQ ID NO: 1142274 - RNA, 21 nt, Human
uucaguuacccagagcgcacc

SEQ ID NO: 1142275 - RNA, 18 nt, Human
uugaacucacaguguauu

SEQ ID NO: 1142276 - RNA, 18 nt, Human
uugggaaggaguugggug

SEQ ID NO: 1142277 - RNA, 18 nt, Human
aaaaagcagacacuggag

SEQ ID NO: 1142278 - RNA, 19 nt, Human
aaaacucugaacaacaaca

SEQ ID NO: 1142279 - RNA, 24 nt, Human
aaaacucugaacaacaacaacaac

SEQ ID NO: 1142280 - RNA, 20 nt, Human
aaaagacaacugucaaauac

SEQ ID NO: 1142281 - RNA, 23 nt, Human
aaaagacaacugucaaauacuac

SEQ ID NO: 1142282 - RNA, 19 nt, Human
aaagggcuggagaggagua

SEQ ID NO: 1142283 - RNA, 19 nt, Human
aagaaggagagagucccac

SEQ ID NO: 1142284 - RNA, 18 nt, Human
aagcacacucuacacaua

SEQ ID NO: 1142285 - RNA, 23 nt, Human
aagcauccccaaaacagugguaa

SEQ ID NO: 1142286 - RNA, 22 nt, Human
aauacuacaacgacaaaaagga

SEQ ID NO: 1142287 - RNA, 22 nt, Human
aaucuagcuccuaaucaaacua

SEQ ID NO: 1142288 - RNA, 22 nt, Human
acaaaacuauggacaacacacc

SEQ ID NO: 1142289 - RNA, 21 nt, Human
acaacaacaacaaaacuaugg

SEQ ID NO: 1142290 - RNA, 25 nt, Human
acaacaacaacaacaaaacuaugga

SEQ ID NO: 1142291 - RNA, 19 nt, Human
acaacaacaacaacaacaa

SEQ ID NO: 1142292 - RNA, 19 nt, Human
acaacaacaacaacaacaa

SEQ ID NO: 1142293 - RNA, 19 nt, Human
acaacaacaacaacaacaa

SEQ ID NO: 1142294 - RNA, 21 nt, Human
acaacaacaacaacaacaaaa

SEQ ID NO: 1142295 - RNA, 24 nt, Human
acaacaacaacaacaacaacaaaa

SEQ ID NO: 1142296 - RNA, 23 nt, Human
acacacacacacacacacacaca

SEQ ID NO: 1142297 - RNA, 24 nt, Human
acacacacacgaacagaaggauuc

SEQ ID NO: 1142298 - RNA, 22 nt, Human
acacacacgaacagaaggauuc

SEQ ID NO: 1142299 - RNA, 19 nt, Human
acacacugacuuucccaca

SEQ ID NO: 1142300 - RNA, 20 nt, Human
acacagggucugcucauaug

SEQ ID NO: 1142301 - RNA, 26 nt, Human
acacugggcguaagaugcugccuaac

SEQ ID NO: 1142302 - RNA, 25 nt, Human
acaggcagagccaugcaaauaaagc

SEQ ID NO: 1142303 - RNA, 18 nt, Human
accagcuuuugcuucccu

SEQ ID NO: 1142304 - RNA, 21 nt, Human
agaaaaaaagcauccccaaaa

SEQ ID NO: 1142305 - RNA, 21 nt, Human
agaaggagagagucccacagg

SEQ ID NO: 1142306 - RNA, 19 nt, Human
agaauaucugggagaacac

SEQ ID NO: 1142307 - RNA, 23 nt, Human
agagagucccacaggagaggaga

SEQ ID NO: 1142308 - RNA, 19 nt, Human
aggagaggagaccggaggg

SEQ ID NO: 1142309 - RNA, 18 nt, Human
aggcaaaagugaagaccu

SEQ ID NO: 1142310 - RNA, 18 nt, Human
aggcaaaagugaagaccu

SEQ ID NO: 1142311 - RNA, 31 nt, Human
agggaacacacacacacacacacacacacag

SEQ ID NO: 1142312 - RNA, 19 nt, Human
aguacaaauacaauaagga

SEQ ID NO: 1142313 - RNA, 19 nt, Human
agugaagaccucccugggg

SEQ ID NO: 1142314 - RNA, 18 nt, Human
agugcagcugugccuaag

SEQ ID NO: 1142315 - RNA, 21 nt, Human
aguuagaggagaacagcucca

SEQ ID NO: 1142316 - RNA, 31 nt, Human
auagggaacacacacacacacacacacacag

SEQ ID NO: 1142317 - RNA, 23 nt, Human
augccagaaacagacuugcacac

SEQ ID NO: 1142318 - RNA, 19 nt, Human
caaaaagcagacacuggag

SEQ ID NO: 1142319 - RNA, 24 nt, Human
caaacacacacauacagaaaagga

SEQ ID NO: 1142320 - RNA, 24 nt, Human
caaaguggagaccgacucuccacu

SEQ ID NO: 1142321 - RNA, 25 nt, Human
caacaacaaaacuauggacaacaca

SEQ ID NO: 1142322 - RNA, 22 nt, Human
cacaacagucagguagaugccc

SEQ ID NO: 1142323 - RNA, 20 nt, Human
cacacacacacacacacaca

SEQ ID NO: 1142324 - RNA, 20 nt, Human
cacacacacacacacacaca

SEQ ID NO: 1142325 - RNA, 20 nt, Human
cacacacacacacacacaca

SEQ ID NO: 1142326 - RNA, 22 nt, Human
cacacacacacacacacacaca

SEQ ID NO: 1142327 - RNA, 26 nt, Human
cacacacacacacacacacacacacg

SEQ ID NO: 1142328 - RNA, 26 nt, Human
cacacacacacacacacacacacgaa

SEQ ID NO: 1142329 - RNA, 19 nt, Human
cacacacgaacagaaggau

SEQ ID NO: 1142330 - RNA, 19 nt, Human
cacacauacagaaaaggau

SEQ ID NO: 1142331 - RNA, 20 nt, Human
cacagggucugcucauaugg

SEQ ID NO: 1142332 - RNA, 21 nt, Human
cacauacacacugacuuuccc

SEQ ID NO: 1142333 - RNA, 19 nt, Human
caccagaaugcacucuuca

SEQ ID NO: 1142334 - RNA, 18 nt, Human
caccuagccaggaggccu

SEQ ID NO: 1142335 - RNA, 21 nt, Human
cacggcucagggacgucccuu

SEQ ID NO: 1142336 - RNA, 24 nt, Human
cacuaaaucacucuugucauagcc

SEQ ID NO: 1142337 - RNA, 21 nt, Human
cacuggauuacaauucuaagu

SEQ ID NO: 1142338 - RNA, 20 nt, Human
cagaggcccauggaguaaaa

SEQ ID NO: 1142339 - RNA, 25 nt, Human
cagcacacauuugcucauacacaua

SEQ ID NO: 1142340 - RNA, 24 nt, Human
caugcaaauaaagccauccagcaa

SEQ ID NO: 1142341 - RNA, 22 nt, Human
cauucugguuacguuggcccug

SEQ ID NO: 1142342 - RNA, 20 nt, Human
ccaaauaucugcucucuuug

SEQ ID NO: 1142343 - RNA, 21 nt, Human
ccacacacacaacagucaggu

SEQ ID NO: 1142344 - RNA, 20 nt, Human
ccacugcagacaggcagagc

SEQ ID NO: 1142345 - RNA, 24 nt, Human
ccagaaacagacuugcacacaggc

SEQ ID NO: 1142346 - RNA, 18 nt, Human
ccagaaugcacucuucau

SEQ ID NO: 1142347 - RNA, 21 nt, Human
ccagcuuuugcuucccuuccu

SEQ ID NO: 1142348 - RNA, 21 nt, Human
ccccugagugugagagacaga

SEQ ID NO: 1142349 - RNA, 22 nt, Human
cccugagugugagagacagagg

SEQ ID NO: 1142350 - RNA, 23 nt, Human
ccuagccaggaggccugaccacu

SEQ ID NO: 1142351 - RNA, 22 nt, Human
ccucccauccauuucggacaaa

SEQ ID NO: 1142352 - RNA, 18 nt, Human
cgacucuucacucuccuc

SEQ ID NO: 1142353 - RNA, 23 nt, Human
cuaaaucacucuugucauagccu

SEQ ID NO: 1142354 - RNA, 19 nt, Human
cucacauucugguacugug

SEQ ID NO: 1142355 - RNA, 21 nt, Human
cucauaugauuucucugagac

SEQ ID NO: 1142356 - RNA, 18 nt, Human
cucugaugagugacuggu

SEQ ID NO: 1142357 - RNA, 24 nt, Human
cuggaggccucccauccauuucgg

SEQ ID NO: 1142358 - RNA, 24 nt, Human
cuucaaagacagccuuugcucucc

SEQ ID NO: 1142359 - RNA, 25 nt, Human
cuugcacacaggcucugcucauaug

SEQ ID NO: 1142360 - RNA, 18 nt, Human
gaaaaaaagcauccccaa

SEQ ID NO: 1142361 - RNA, 20 nt, Human
gaaaacaugagcagcucuag

SEQ ID NO: 1142362 - RNA, 20 nt, Human
gauacaaaauccuggacagu

SEQ ID NO: 1142363 - RNA, 19 nt, Human
gaucuucuuaucugaucua

SEQ ID NO: 1142364 - RNA, 21 nt, Human
gcaauggaaggacuggcugga

SEQ ID NO: 1142365 - RNA, 21 nt, Human
gcaguagauaauugcucugaa

SEQ ID NO: 1142366 - RNA, 22 nt, Human
gcuagaucuucuuaucugaucu

SEQ ID NO: 1142367 - RNA, 23 nt, Human
ggaaaaugauuucagucacaguc

SEQ ID NO: 1142368 - RNA, 18 nt, Human
ggacaaacacacacauac

SEQ ID NO: 1142369 - RNA, 21 nt, Human
ggacaacacaccuagccagga

SEQ ID NO: 1142370 - RNA, 26 nt, Human
ggagaacacugggcguaagaugcugc

SEQ ID NO: 1142371 - RNA, 20 nt, Human
ggcuggagaggaguaggggc

SEQ ID NO: 1142372 - RNA, 22 nt, Human
ggcuggagaggaguaggggccc

SEQ ID NO: 1142373 - RNA, 21 nt, Human
ggggccaauuucaaacagaaa

SEQ ID NO: 1142374 - RNA, 21 nt, Human
ggggccaauuucaaacagaaa

SEQ ID NO: 1142375 - RNA, 23 nt, Human
guacugcagucuuugcucacaag

SEQ ID NO: 1142376 - RNA, 19 nt, Human
gucaccuuuuccucagaug

SEQ ID NO: 1142377 - RNA, 18 nt, Human
uaaaaauagaugaaaaga

SEQ ID NO: 1142378 - RNA, 19 nt, Human
uaaagcaugccugcagcag

SEQ ID NO: 1142379 - RNA, 20 nt, Human
uaaagucagcgaugcuggag

SEQ ID NO: 1142380 - RNA, 23 nt, Human
uaacaggcauaaccccuugcucu

SEQ ID NO: 1142381 - RNA, 21 nt, Human
uaaccagcuuuugcuucccuu

SEQ ID NO: 1142382 - RNA, 21 nt, Human
uaaccgugccacaucucagca

SEQ ID NO: 1142383 - RNA, 22 nt, Human
uaaccgugccacaucucagcau

SEQ ID NO: 1142384 - RNA, 20 nt, Human
uaauaggccuggcaauaacc

SEQ ID NO: 1142385 - RNA, 26 nt, Human
uacacauacacacugacuuucccaca

SEQ ID NO: 1142386 - RNA, 21 nt, Human
uagaagcaccucccuuuuggc

SEQ ID NO: 1142387 - RNA, 18 nt, Human
uagaugcccaaaggaggg

SEQ ID NO: 1142388 - RNA, 26 nt, Human
uauugccacugccaguaucauaggga

SEQ ID NO: 1142389 - RNA, 18 nt, Human
ucaaacagaaaacccagc

SEQ ID NO: 1142390 - RNA, 21 nt, Human
ucaaacagaaaacccagcaaa

SEQ ID NO: 1142391 - RNA, 21 nt, Human
ucaaacagaaaacccaguaaa

SEQ ID NO: 1142392 - RNA, 20 nt, Human
ucacuccuaagcacacucuu

SEQ ID NO: 1142393 - RNA, 31 nt, Human
ucauagggaacacacacacacacacacacag

SEQ ID NO: 1142394 - RNA, 20 nt, Human
uccacuggcaaauacuugga

SEQ ID NO: 1142395 - RNA, 25 nt, Human
uccauuucggacaaacacacacaua

SEQ ID NO: 1142396 - RNA, 21 nt, Human
ucccacacacacaacagucag

SEQ ID NO: 1142397 - RNA, 19 nt, Human
ucccacaggagaggagacc

SEQ ID NO: 1142398 - RNA, 19 nt, Human
uccccugagugugagagac

SEQ ID NO: 1142399 - RNA, 18 nt, Human
ucccucuaagcugccuca

SEQ ID NO: 1142400 - RNA, 26 nt, Human
ucccuggggucuucaaagacagccuu

SEQ ID NO: 1142401 - RNA, 27 nt, Human
uccgcuuuauaaagucagcgaugcugg

SEQ ID NO: 1142402 - RNA, 19 nt, Human
uccguccuccaggaaugag

SEQ ID NO: 1142403 - RNA, 21 nt, Human
uccuggaguuuaaaucacugc

SEQ ID NO: 1142404 - RNA, 27 nt, Human
ucuacacauacacacugacuuucccaa

SEQ ID NO: 1142405 - RNA, 21 nt, Human
ucuagcggaauccguccucca

SEQ ID NO: 1142406 - RNA, 22 nt, Human
ucuagcuccuaaucaaacuaga

SEQ ID NO: 1142407 - RNA, 23 nt, Human
ucucugaugagugacuggucauu

SEQ ID NO: 1142408 - RNA, 18 nt, Human
ucuggagucagaucaccc

SEQ ID NO: 1142409 - RNA, 21 nt, Human
ugaaaagaccucucaagcuag

SEQ ID NO: 1142410 - RNA, 20 nt, Human
ugaacaacaacaacaacaac

SEQ ID NO: 1142411 - RNA, 27 nt, Human
ugaacaacaacaacaacaacaacaaaa

SEQ ID NO: 1142412 - RNA, 20 nt, Human
ugacacacagggucugcuca

SEQ ID NO: 1142413 - RNA, 19 nt, Human
ugacuggucauuuuuaaag

SEQ ID NO: 1142414 - RNA, 18 nt, Human
ugaugaggacucaaccac

SEQ ID NO: 1142415 - RNA, 21 nt, Human
ugcaaaaggagagcgcacggc

SEQ ID NO: 1142416 - RNA, 24 nt, Human
ugccagaaacagacuugguccagg

SEQ ID NO: 1142417 - RNA, 22 nt, Human
ugccucagugaaaccagugaga

SEQ ID NO: 1142418 - RNA, 20 nt, Human
ugccugggcaucacaaucag

SEQ ID NO: 1142419 - RNA, 18 nt, Human
uggcuggaggccucccau

SEQ ID NO: 1142420 - RNA, 19 nt, Human
uguaauagaagcaccuccc

SEQ ID NO: 1142421 - RNA, 21 nt, Human
uguaguacaaauacaauaagg

SEQ ID NO: 1142422 - RNA, 18 nt, Human
uguccccugagugugaga

SEQ ID NO: 1142423 - RNA, 23 nt, Human
uuauauuugccgagcccuucaca

SEQ ID NO: 1142424 - RNA, 19 nt, Human
uucaaaaagcagacacugg

SEQ ID NO: 1142425 - RNA, 21 nt, Human
uucugguuacguuggcccugg

SEQ ID NO: 1142426 - RNA, 27 nt, Human
uucuuucagaaaaaaagcauccccaaa

SEQ ID NO: 1142427 - RNA, 20 nt, Human
uugauggaaaagacaacugu

SEQ ID NO: 1142428 - RNA, 18 nt, Human
uuucccacacacacaaca

SEQ ID NO: 1142429 - RNA, 23 nt, Human
uuuggaaaaauagaggguuuaga

SEQ ID NO: 1142430 - RNA, 23 nt, Human
uuuuaaagcaugccugcagcagu

SEQ ID NO: 1142431 - RNA, 18 nt, Human
aaaaagaauaagaccugg

SEQ ID NO: 1142432 - RNA, 20 nt, Human
aaaacacaguccagaauacc

SEQ ID NO: 1142433 - RNA, 24 nt, Human
aaaguguugggauuacaggcguga

SEQ ID NO: 1142434 - RNA, 26 nt, Human
aacacauucauauaaucaaaucagca

SEQ ID NO: 1142435 - RNA, 25 nt, Human
aagcaaauacuaguguucaagaaau

SEQ ID NO: 1142436 - RNA, 21 nt, Human
aaguguugggauuacaggcgu

SEQ ID NO: 1142437 - RNA, 26 nt, Human
aaguguugggauuacaggcgugagcc

SEQ ID NO: 1142438 - RNA, 19 nt, Human
acaaacagugucugguuac

SEQ ID NO: 1142439 - RNA, 20 nt, Human
acaagaaagacugaccuaaa

SEQ ID NO: 1142440 - RNA, 18 nt, Human
acggggucucaccauggu

SEQ ID NO: 1142441 - RNA, 20 nt, Human
acggggucucaccauggugg

SEQ ID NO: 1142442 - RNA, 24 nt, Human
acggggucucaccaugguggccag

SEQ ID NO: 1142443 - RNA, 23 nt, Human
agaaagccagacacaacuccuga

SEQ ID NO: 1142444 - RNA, 23 nt, Human
agaacaacucuugacagugccca

SEQ ID NO: 1142445 - RNA, 21 nt, Human
agaagguguaacguacaagaa

SEQ ID NO: 1142446 - RNA, 20 nt, Human
agaggauggauuaguuaggg

SEQ ID NO: 1142447 - RNA, 20 nt, Human
agauuccagcucauauagcc

SEQ ID NO: 1142448 - RNA, 19 nt, Human
agcaacuggcagagcugaa

SEQ ID NO: 1142449 - RNA, 21 nt, Human
agcaggugauaccuggguacu

SEQ ID NO: 1142450 - RNA, 19 nt, Human
agccagcaacuggcagagc

SEQ ID NO: 1142451 - RNA, 24 nt, Human
agcuccacugcccaggccaaaccc

SEQ ID NO: 1142452 - RNA, 21 nt, Human
agcugagauuacaaguaccca

SEQ ID NO: 1142453 - RNA, 20 nt, Human
aggugaggccagggaaacug

SEQ ID NO: 1142454 - RNA, 24 nt, Human
aggugauccgccugccucggccuc

SEQ ID NO: 1142455 - RNA, 23 nt, Human
agugcaauggcgcaaucuuggcu

SEQ ID NO: 1142456 - RNA, 24 nt, Human
agugcaauggcgcaaucuuggcuc

SEQ ID NO: 1142457 - RNA, 18 nt, Human
aguuguuuucuccccaag

SEQ ID NO: 1142458 - RNA, 20 nt, Human
auacaaggccugccucugug

SEQ ID NO: 1142459 - RNA, 26 nt, Human
auauaaucaaaucagcauaauuggga

SEQ ID NO: 1142460 - RNA, 18 nt, Human
auccggacagccauagaa

SEQ ID NO: 1142461 - RNA, 22 nt, Human
augcacuucaagaaugugaccc

SEQ ID NO: 1142462 - RNA, 18 nt, Human
augccuggugccugggcu

SEQ ID NO: 1142463 - RNA, 26 nt, Human
auggaacauacacauuugaaaccccc

SEQ ID NO: 1142464 - RNA, 21 nt, Human
caaaguacugggccugcccca

SEQ ID NO: 1142465 - RNA, 24 nt, Human
caaaguguugggauuacaggcgug

SEQ ID NO: 1142466 - RNA, 19 nt, Human
caacuccugacuuccuccu

SEQ ID NO: 1142467 - RNA, 27 nt, Human
caagaaagacugaccuaaaaguggcag

SEQ ID NO: 1142468 - RNA, 21 nt, Human
caaguacccaccaccacgccc

SEQ ID NO: 1142469 - RNA, 21 nt, Human
caccaugguggccaggcuggu

SEQ ID NO: 1142470 - RNA, 22 nt, Human
caccaugguggccaggcugguc

SEQ ID NO: 1142471 - RNA, 24 nt, Human
caccaugguggccaggcuggucuc

SEQ ID NO: 1142472 - RNA, 21 nt, Human
cacugcaaccuccgccuccug

SEQ ID NO: 1142473 - RNA, 23 nt, Human
cacugcaaccuccgccuccuggg

SEQ ID NO: 1142474 - RNA, 21 nt, Human
cagacgacauugcuuggaugc

SEQ ID NO: 1142475 - RNA, 20 nt, Human
cagccagcaacuggcagagc

SEQ ID NO: 1142476 - RNA, 20 nt, Human
cagguaaagaagggugugga

SEQ ID NO: 1142477 - RNA, 19 nt, Human
caggugacaucagaggaug

SEQ ID NO: 1142478 - RNA, 22 nt, Human
caggugauccgccugccucggc

SEQ ID NO: 1142479 - RNA, 20 nt, Human
cauguggccuggacauggcc

SEQ ID NO: 1142480 - RNA, 22 nt, Human
ccaaaguguugggauuacaggc

SEQ ID NO: 1142481 - RNA, 22 nt, Human
ccaaaguguugggauuacaggc

SEQ ID NO: 1142482 - RNA, 24 nt, Human
ccaaaguguugggauuacaggcgu

SEQ ID NO: 1142483 - RNA, 21 nt, Human
ccagcagaugcucagaaacuu

SEQ ID NO: 1142484 - RNA, 26 nt, Human
ccagggaaacuggcucagcaggugau

SEQ ID NO: 1142485 - RNA, 24 nt, Human
cccagccuugacucagauuccagc

SEQ ID NO: 1142486 - RNA, 18 nt, Human
cccauguggccuggacau

SEQ ID NO: 1142487 - RNA, 21 nt, Human
ccccaagaucugcgccuuucc

SEQ ID NO: 1142488 - RNA, 22 nt, Human
ccccugcaggugaggccaggga

SEQ ID NO: 1142489 - RNA, 23 nt, Human
cccggguagcugagauuacaagu

SEQ ID NO: 1142490 - RNA, 24 nt, Human
ccgccuccuggguucaagcgauuc

SEQ ID NO: 1142491 - RNA, 25 nt, Human
ccuccaaguucugggauauuguggg

SEQ ID NO: 1142492 - RNA, 19 nt, Human
ccuccgccuccuggguuca

SEQ ID NO: 1142493 - RNA, 24 nt, Human
ccuccuggguucaagcgauucucc

SEQ ID NO: 1142494 - RNA, 18 nt, Human
ccugaccucaggugaucc

SEQ ID NO: 1142495 - RNA, 21 nt, Human
ccugaccucaggugauccgcc

SEQ ID NO: 1142496 - RNA, 23 nt, Human
ccugaccucaggugauccgccug

SEQ ID NO: 1142497 - RNA, 24 nt, Human
ccugcauuagccucccggguagcu

SEQ ID NO: 1142498 - RNA, 24 nt, Human
ccuggguacuccaacaucugagaa

SEQ ID NO: 1142499 - RNA, 23 nt, Human
ccuggguucaagcgauucuccug

SEQ ID NO: 1142500 - RNA, 19 nt, Human
ccuggugccugggcugggg

SEQ ID NO: 1142501 - RNA, 20 nt, Human
cuagaacucaggucuuaggg

SEQ ID NO: 1142502 - RNA, 24 nt, Human
cucacugcaaccuccgccuccugg

SEQ ID NO: 1142503 - RNA, 26 nt, Human
cuccugaccucaggugauccgccugc

SEQ ID NO: 1142504 - RNA, 21 nt, Human
cuccuggguucaagcgauucu

SEQ ID NO: 1142505 - RNA, 23 nt, Human
cugcaaccuccgccuccuggguu

SEQ ID NO: 1142506 - RNA, 24 nt, Human
cugcaaccuccgccuccuggguuc

SEQ ID NO: 1142507 - RNA, 18 nt, Human
cugccucggccucccaaa

SEQ ID NO: 1142508 - RNA, 22 nt, Human
cuuguucaguuucaaucagcca

SEQ ID NO: 1142509 - RNA, 24 nt, Human
cuuguugcccaggcuggagugcaa

SEQ ID NO: 1142510 - RNA, 23 nt, Human
gaaaugcuuuuguccugaaggug

SEQ ID NO: 1142511 - RNA, 18 nt, Human
gaacauacacauuugaac

SEQ ID NO: 1142512 - RNA, 21 nt, Human
gaccaccagguucagaaacac

SEQ ID NO: 1142513 - RNA, 24 nt, Human
gaccucaggugauccgccugccuc

SEQ ID NO: 1142514 - RNA, 26 nt, Human
gagaaaccccgagauaagaccuccaa

SEQ ID NO: 1142515 - RNA, 19 nt, Human
gagaagagacagucucagg

SEQ ID NO: 1142516 - RNA, 20 nt, Human
gauaagaccuccaaguucug

SEQ ID NO: 1142517 - RNA, 18 nt, Human
gauuacaggcgugagcca

SEQ ID NO: 1142518 - RNA, 21 nt, Human
gauuacaggcgugagccacca

SEQ ID NO: 1142519 - RNA, 22 nt, Human
gauuacaggcgugagccaccac

SEQ ID NO: 1142520 - RNA, 21 nt, Human
gcaaaguacugggccugcccc

SEQ ID NO: 1142521 - RNA, 19 nt, Human
gcccaggcuggagugcaau

SEQ ID NO: 1142522 - RNA, 21 nt, Human
gccucuaaggcaugcaguccu

SEQ ID NO: 1142523 - RNA, 20 nt, Human
gcuccacugcccaggccaaa

SEQ ID NO: 1142524 - RNA, 26 nt, Human
gcuccacugcccaggccaaaccccuc

SEQ ID NO: 1142525 - RNA, 25 nt, Human
gcuccaguucuguaacucauccauc

SEQ ID NO: 1142526 - RNA, 21 nt, Human
gcucuuguugcccaggcugga

SEQ ID NO: 1142527 - RNA, 24 nt, Human
gcucuuguugcccaggcuggagug

SEQ ID NO: 1142528 - RNA, 20 nt, Human
gcugcaaaugggcuacuggu

SEQ ID NO: 1142529 - RNA, 19 nt, Human
gcuggagugcaauggcgca

SEQ ID NO: 1142530 - RNA, 23 nt, Human
gcuggucucaaacuccugaccuc

SEQ ID NO: 1142531 - RNA, 22 nt, Human
gcugugaaggaaugcauccgga

SEQ ID NO: 1142532 - RNA, 19 nt, Human
ggagaacucaccagaccaa

SEQ ID NO: 1142533 - RNA, 19 nt, Human
ggauuacaggcgugagcca

SEQ ID NO: 1142534 - RNA, 21 nt, Human
ggcuccuuccugcagcagucc

SEQ ID NO: 1142535 - RNA, 24 nt, Human
ggcuggucucaaacuccugaccuc

SEQ ID NO: 1142536 - RNA, 19 nt, Human
gggauauuguggggcucug

SEQ ID NO: 1142537 - RNA, 20 nt, Human
gggcagcugcuccucggaag

SEQ ID NO: 1142538 - RNA, 22 nt, Human
gggucucaccaugguggccagg

SEQ ID NO: 1142539 - RNA, 20 nt, Human
guccugaagguggagaacuc

SEQ ID NO: 1142540 - RNA, 22 nt, Human
gugaacuccuuucaccagccca

SEQ ID NO: 1142541 - RNA, 23 nt, Human
guguggaugucagagaagaacaa

SEQ ID NO: 1142542 - RNA, 23 nt, Human
guguguuuuuaguagagacgggg

SEQ ID NO: 1142543 - RNA, 24 nt, Human
uaaaaaccaacaacauuacuaccg

SEQ ID NO: 1142544 - RNA, 23 nt, Human
uaaaacacaguccagaauaccug

SEQ ID NO: 1142545 - RNA, 25 nt, Human
uaaaacacaguccagaauaccugcu

SEQ ID NO: 1142546 - RNA, 18 nt, Human
uaaacaaaacuuaaaugu

SEQ ID NO: 1142547 - RNA, 26 nt, Human
uaauuuuuuguguguuuuuaguagag

SEQ ID NO: 1142548 - RNA, 27 nt, Human
uaauuuuuuguguguuuuuaguagaga

SEQ ID NO: 1142549 - RNA, 23 nt, Human
uacaaguacccaccaccacgccc

SEQ ID NO: 1142550 - RNA, 19 nt, Human
uacaggcgugagccaccac

SEQ ID NO: 1142551 - RNA, 22 nt, Human
uacaggcgugagccaccacgcu

SEQ ID NO: 1142552 - RNA, 20 nt, Human
uagagacggggucucaccau

SEQ ID NO: 1142553 - RNA, 22 nt, Human
uagcaggugacaucagaggaug

SEQ ID NO: 1142554 - RNA, 19 nt, Human
uagcaugugcccauguggc

SEQ ID NO: 1142555 - RNA, 22 nt, Human
uagcucacaagcuccacugccc

SEQ ID NO: 1142556 - RNA, 21 nt, Human
uagggcuccaguucuguaacu

SEQ ID NO: 1142557 - RNA, 22 nt, Human
uagggcuccaguucuguaacuc

SEQ ID NO: 1142558 - RNA, 24 nt, Human
uaguagagacggggucucaccaug

SEQ ID NO: 1142559 - RNA, 26 nt, Human
uaguagagacggggucucaccauggu

SEQ ID NO: 1142560 - RNA, 19 nt, Human
uauuguggggcucuguuga

SEQ ID NO: 1142561 - RNA, 23 nt, Human
ucacugcaaccuccgccuccugg

SEQ ID NO: 1142562 - RNA, 24 nt, Human
ucacugcaaccuccgccuccuggg

SEQ ID NO: 1142563 - RNA, 25 nt, Human
ucacugcaaccuccgccuccugggu

SEQ ID NO: 1142564 - RNA, 27 nt, Human
ucacugcaaccuccgccuccuggguuc

SEQ ID NO: 1142565 - RNA, 21 nt, Human
ucaggugauccgccugccucg

SEQ ID NO: 1142566 - RNA, 20 nt, Human
uccacugcccaggccaaacc

SEQ ID NO: 1142567 - RNA, 20 nt, Human
uccagcucauauagcucaca

SEQ ID NO: 1142568 - RNA, 19 nt, Human
uccagcugugaaggaaugc

SEQ ID NO: 1142569 - RNA, 24 nt, Human
ucccaaaguguugggauuacaggc

SEQ ID NO: 1142570 - RNA, 25 nt, Human
uccccagacugagucaggaucuccg

SEQ ID NO: 1142571 - RNA, 22 nt, Human
uccggacagccauagaaggccc

SEQ ID NO: 1142572 - RNA, 19 nt, Human
uccugcauuagccucccgg

SEQ ID NO: 1142573 - RNA, 21 nt, Human
uccuggguucaagcgauucuc

SEQ ID NO: 1142574 - RNA, 24 nt, Human
uccuggguucaagcgauucuccug

SEQ ID NO: 1142575 - RNA, 25 nt, Human
ucuaagcaaauacuaguguucaaga

SEQ ID NO: 1142576 - RNA, 21 nt, Human
ucugugcucagcucccagaga

SEQ ID NO: 1142577 - RNA, 20 nt, Human
ucuuagggcuccaguucugu

SEQ ID NO: 1142578 - RNA, 22 nt, Human
ucuuguugcccaggcuggagug

SEQ ID NO: 1142579 - RNA, 23 nt, Human
ugaaacccagcuggcagccucua

SEQ ID NO: 1142580 - RNA, 18 nt, Human
ugaaccgagagacaggag

SEQ ID NO: 1142581 - RNA, 26 nt, Human
ugaacuccuuucaccagcccagccuu

SEQ ID NO: 1142582 - RNA, 18 nt, Human
ugaagaaucaucaauuga

SEQ ID NO: 1142583 - RNA, 19 nt, Human
ugaccuaaaaguggcauca

SEQ ID NO: 1142584 - RNA, 24 nt, Human
ugaccucaauggauguaacagaaa

SEQ ID NO: 1142585 - RNA, 18 nt, Human
ugaccucaggugauccgc

SEQ ID NO: 1142586 - RNA, 24 nt, Human
ugaccucaggugauccgccugccu

SEQ ID NO: 1142587 - RNA, 19 nt, Human
ugacucagagccccugcag

SEQ ID NO: 1142588 - RNA, 19 nt, Human
ugacuuccucaaaaugcac

SEQ ID NO: 1142589 - RNA, 23 nt, Human
ugagacccacugccucuaaggca

SEQ ID NO: 1142590 - RNA, 24 nt, Human
ugagauuacaaguacccaccacca

SEQ ID NO: 1142591 - RNA, 23 nt, Human
ugcaauggcgcaaucuuggcuca

SEQ ID NO: 1142592 - RNA, 22 nt, Human
ugcauacagacccaauuuugua

SEQ ID NO: 1142593 - RNA, 24 nt, Human
ugccacaggggaaguuguuagcag

SEQ ID NO: 1142594 - RNA, 18 nt, Human
ugcccaggcuggagugca

SEQ ID NO: 1142595 - RNA, 21 nt, Human
ugcccaggcuggagugcaaug

SEQ ID NO: 1142596 - RNA, 21 nt, Human
ugcccaggcuggagugcaaug

SEQ ID NO: 1142597 - RNA, 24 nt, Human
ugcccaggcuggagugcaauggcg

SEQ ID NO: 1142598 - RNA, 24 nt, Human
ugccucggccucccaaaguguugg

SEQ ID NO: 1142599 - RNA, 19 nt, Human
ugccucugugcucagcucc

SEQ ID NO: 1142600 - RNA, 19 nt, Human
ugccugggcugggguaugu

SEQ ID NO: 1142601 - RNA, 24 nt, Human
ugcucuuguugcccaggcuggagu

SEQ ID NO: 1142602 - RNA, 23 nt, Human
uggagugcaauggcgcaaucuug

SEQ ID NO: 1142603 - RNA, 24 nt, Human
uggagugcaauggcgcaaucuugg

SEQ ID NO: 1142604 - RNA, 20 nt, Human
uggauguaacagaaagaacc

SEQ ID NO: 1142605 - RNA, 24 nt, Human
uggauguaacagaaagaaccugcu

SEQ ID NO: 1142606 - RNA, 24 nt, Human
uggccaggcuggucucaaacuccu

SEQ ID NO: 1142607 - RNA, 19 nt, Human
uggccuggacauggccugu

SEQ ID NO: 1142608 - RNA, 25 nt, Human
ugggaacagaagucaacaagccaac

SEQ ID NO: 1142609 - RNA, 20 nt, Human
ugggauauuguggggcucug

SEQ ID NO: 1142610 - RNA, 18 nt, Human
ugggauuacaggcgugag

SEQ ID NO: 1142611 - RNA, 19 nt, Human
ugggauuacaggcgugagc

SEQ ID NO: 1142612 - RNA, 22 nt, Human
ugggauuacaggcgugagccac

SEQ ID NO: 1142613 - RNA, 23 nt, Human
ugggauuacaggcgugagccacc

SEQ ID NO: 1142614 - RNA, 24 nt, Human
ugggauuacaggcgugagccacca

SEQ ID NO: 1142615 - RNA, 20 nt, Human
uguaaaagcuuuaauuuuug

SEQ ID NO: 1142616 - RNA, 20 nt, Human
uguugcccaggcuggagugc

SEQ ID NO: 1142617 - RNA, 18 nt, Human
uuacucuuggcuaaggug

SEQ ID NO: 1142618 - RNA, 24 nt, Human
uuaguagagacggggucucaccau

SEQ ID NO: 1142619 - RNA, 19 nt, Human
uucacaggagaagagacag

SEQ ID NO: 1142620 - RNA, 19 nt, Human
uucuagagaguuguuuucu

SEQ ID NO: 1142621 - RNA, 18 nt, Human
uugcccaggcuggagugc

SEQ ID NO: 1142622 - RNA, 23 nt, Human
uugcucuuguugcccaggcugga

SEQ ID NO: 1142623 - RNA, 22 nt, Human
uuguuuguuuauuugaaagagu

SEQ ID NO: 1142624 - RNA, 18 nt, Human
uuucauugaagaaucauc

SEQ ID NO: 1142625 - RNA, 24 nt, Human
uuugcucuuguugcccaggcugga

SEQ ID NO: 1142626 - RNA, 20 nt, Human
uuuugcacaaagaacucuga

SEQ ID NO: 1142627 - RNA, 23 nt, Human
uuuugcucuuguugcccaggcug

SEQ ID NO: 1142628 - RNA, 24 nt, Human
uuuugcucuuguugcccaggcugg

SEQ ID NO: 1142629 - RNA, 24 nt, Human
uuuuguguguuuuuaguagagacg

SEQ ID NO: 1142630 - RNA, 24 nt, Human
uuuuuaguagagacggggucucac

SEQ ID NO: 1142631 - RNA, 23 nt, Human
uuuuuguguguuuuuaguagaga

SEQ ID NO: 1142632 - RNA, 19 nt, Human
aaacucuuggcaacaauga

SEQ ID NO: 1142633 - RNA, 24 nt, Human
aaagugcugggauuacaggcauga

SEQ ID NO: 1142634 - RNA, 21 nt, Human
aaagugcugggcuuacaggug

SEQ ID NO: 1142635 - RNA, 23 nt, Human
aaagugcugggcuuacaggugua

SEQ ID NO: 1142636 - RNA, 24 nt, Human
aaccucaggugaucugccugccuc

SEQ ID NO: 1142637 - RNA, 23 nt, Human
aagaacucauacauacuauugcc

SEQ ID NO: 1142638 - RNA, 24 nt, Human
aagcaguccuccugccuuggccuc

SEQ ID NO: 1142639 - RNA, 25 nt, Human
aagcaguccuccugccuuggccucc

SEQ ID NO: 1142640 - RNA, 19 nt, Human
aagugcugggauuacaggc

SEQ ID NO: 1142641 - RNA, 21 nt, Human
aagugcugggauuacaggcau

SEQ ID NO: 1142642 - RNA, 26 nt, Human
aagugcugggauuacaggcaugagcc

SEQ ID NO: 1142643 - RNA, 24 nt, Human
aauuuuguauuuuuaacagagaca

SEQ ID NO: 1142644 - RNA, 19 nt, Human
acagcccucugggggagau

SEQ ID NO: 1142645 - RNA, 24 nt, Human
acccccucucuacuaaaaauacaa

SEQ ID NO: 1142646 - RNA, 25 nt, Human
acucugcugcccaggcuggagugca

SEQ ID NO: 1142647 - RNA, 24 nt, Human
acuggccgggcgcgguggcucacg

SEQ ID NO: 1142648 - RNA, 22 nt, Human
agacagacuuuccuugcgaggg

SEQ ID NO: 1142649 - RNA, 21 nt, Human
agacagggguuucuccauguu

SEQ ID NO: 1142650 - RNA, 24 nt, Human
agacccaacaaacuucuuguugga

SEQ ID NO: 1142651 - RNA, 21 nt, Human
agagcaggacuggagcccagg

SEQ ID NO: 1142652 - RNA, 18 nt, Human
agaggauuucacucagua

SEQ ID NO: 1142653 - RNA, 24 nt, Human
agcacuuugggaggcugaggcggg

SEQ ID NO: 1142654 - RNA, 20 nt, Human
agccaccacacccagccccu

SEQ ID NO: 1142655 - RNA, 18 nt, Human
agccucccgaguagcugg

SEQ ID NO: 1142656 - RNA, 24 nt, Human
agcuucuauggggaguggcagaag

SEQ ID NO: 1142657 - RNA, 19 nt, Human
aggcaugugccaccacgcc

SEQ ID NO: 1142658 - RNA, 21 nt, Human
aggcauuagaaggcaagugcu

SEQ ID NO: 1142659 - RNA, 24 nt, Human
aggcgggcggaucacgaggucagg

SEQ ID NO: 1142660 - RNA, 19 nt, Human
aggcugaggcaggagaaug

SEQ ID NO: 1142661 - RNA, 21 nt, Human
aggcugaggcgggcggaucac

SEQ ID NO: 1142662 - RNA, 22 nt, Human
aggcugaggcgggcggaucacg

SEQ ID NO: 1142663 - RNA, 23 nt, Human
agggguuucuccauguuggucag

SEQ ID NO: 1142664 - RNA, 24 nt, Human
agggguuucuccauguuggucagg

SEQ ID NO: 1142665 - RNA, 24 nt, Human
aggugaucugccugccucggccuc

SEQ ID NO: 1142666 - RNA, 23 nt, Human
aguagcugggauuauaggcaugu

SEQ ID NO: 1142667 - RNA, 21 nt, Human
agucgccagccugcuucgcau

SEQ ID NO: 1142668 - RNA, 23 nt, Human
agugcagugaugcaaacacagcu

SEQ ID NO: 1142669 - RNA, 20 nt, Human
agugcaguggugcgaucucg

SEQ ID NO: 1142670 - RNA, 23 nt, Human
agugcaguggugcgaucucggcu

SEQ ID NO: 1142671 - RNA, 24 nt, Human
agugcaguggugcgaucucggcuc

SEQ ID NO: 1142672 - RNA, 24 nt, Human
aguggcgggcgccuguagucccag

SEQ ID NO: 1142673 - RNA, 24 nt, Human
augggacagcccucugggggagau

SEQ ID NO: 1142674 - RNA, 23 nt, Human
caaaaaauuagccgggcgcagug

SEQ ID NO: 1142675 - RNA, 24 nt, Human
caaagugcugggauuacaggcaug

SEQ ID NO: 1142676 - RNA, 24 nt, Human
caaagugcugggcuuacaggugua

SEQ ID NO: 1142677 - RNA, 22 nt, Human
caagcaguccuccugccuuggc

SEQ ID NO: 1142678 - RNA, 27 nt, Human
caagcaguccuccugccuuggccuccc

SEQ ID NO: 1142679 - RNA, 20 nt, Human
caagcgauucuccugccuua

SEQ ID NO: 1142680 - RNA, 22 nt, Human
caagcgauucuccugccuuagc

SEQ ID NO: 1142681 - RNA, 26 nt, Human
caaugaguguccuuuacaaugggcuc

SEQ ID NO: 1142682 - RNA, 19 nt, Human
cacacccagccccuugucu

SEQ ID NO: 1142683 - RNA, 19 nt, Human
cacagcucaacgccgguuc

SEQ ID NO: 1142684 - RNA, 25 nt, Human
cacagcucaacgccgguucgcgccc

SEQ ID NO: 1142685 - RNA, 24 nt, Human
cacgccuguaaucccagcacuuug

SEQ ID NO: 1142686 - RNA, 18 nt, Human
cacggugaaacccccucu

SEQ ID NO: 1142687 - RNA, 19 nt, Human
cacggugaaacccccucuc

SEQ ID NO: 1142688 - RNA, 18 nt, Human
cacucaguauuuauugag

SEQ ID NO: 1142689 - RNA, 21 nt, Human
cacucaguauuuauugagcac

SEQ ID NO: 1142690 - RNA, 24 nt, Human
cacucugcugcccaggcuggagug

SEQ ID NO: 1142691 - RNA, 21 nt, Human
cagaccccuuuauugugggga

SEQ ID NO: 1142692 - RNA, 21 nt, Human
cagaccugaguaaggggcugg

SEQ ID NO: 1142693 - RNA, 22 nt, Human
cagcacuuugggaggcugaggc

SEQ ID NO: 1142694 - RNA, 24 nt, Human
cagcacuuugggaggcugaggcgg

SEQ ID NO: 1142695 - RNA, 20 nt, Human
cagccuugaccuccugggcu

SEQ ID NO: 1142696 - RNA, 21 nt, Human
cagccuugaccuccugggcuc

SEQ ID NO: 1142697 - RNA, 23 nt, Human
cagccuugaccuccugggcucaa

SEQ ID NO: 1142698 - RNA, 24 nt, Human
cagccuugaccuccugggcucaag

SEQ ID NO: 1142699 - RNA, 24 nt, Human
cagcuacucgggaggcugaggcag

SEQ ID NO: 1142700 - RNA, 22 nt, Human
cagcucaacgccgguucgcgcc

SEQ ID NO: 1142701 - RNA, 24 nt, Human
cagcucacuucagccuugaccucc

SEQ ID NO: 1142702 - RNA, 22 nt, Human
caggugaucugccugccucggc

SEQ ID NO: 1142703 - RNA, 21 nt, Human
cauacauacuauugccaccuc

SEQ ID NO: 1142704 - RNA, 21 nt, Human
caucucacagccgccccagcg

SEQ ID NO: 1142705 - RNA, 24 nt, Human
cauguuggucaggcuggucuugaa

SEQ ID NO: 1142706 - RNA, 23 nt, Human
ccaaagugcugggauuacaggca

SEQ ID NO: 1142707 - RNA, 24 nt, Human
ccaaagugcugggauuacaggcau

SEQ ID NO: 1142708 - RNA, 21 nt, Human
ccaaagugcugggcuuacagg

SEQ ID NO: 1142709 - RNA, 24 nt, Human
ccaaagugcugggcuuacaggugu

SEQ ID NO: 1142710 - RNA, 20 nt, Human
ccaccacgccuggcuaauuu

SEQ ID NO: 1142711 - RNA, 24 nt, Human
ccaccugugcauccccugaauccu

SEQ ID NO: 1142712 - RNA, 19 nt, Human
ccauguuggucaggcuggu

SEQ ID NO: 1142713 - RNA, 21 nt, Human
ccauguuggucaggcuggucu

SEQ ID NO: 1142714 - RNA, 21 nt, Human
ccauguuggucaggcuggucu

SEQ ID NO: 1142715 - RNA, 24 nt, Human
cccaaagugcugggauuacaggca

SEQ ID NO: 1142716 - RNA, 24 nt, Human
cccaaccucaggugaucugccugc

SEQ ID NO: 1142717 - RNA, 21 nt, Human
cccagauguccauuccaccuu

SEQ ID NO: 1142718 - RNA, 21 nt, Human
cccagcucggacacgggaggu

SEQ ID NO: 1142719 - RNA, 23 nt, Human
cccagcucggacacgggaggugu

SEQ ID NO: 1142720 - RNA, 20 nt, Human
cccaggcuggagugcaguga

SEQ ID NO: 1142721 - RNA, 18 nt, Human
cccauugugcauuuuucu

SEQ ID NO: 1142722 - RNA, 23 nt, Human
cccgaguagcugggauuauaggc

SEQ ID NO: 1142723 - RNA, 24 nt, Human
cccgaguagcugggauuauaggca

SEQ ID NO: 1142724 - RNA, 24 nt, Human
ccgaguagcugggauuauaggcau

SEQ ID NO: 1142725 - RNA, 24 nt, Human
ccgcaaccucugccucugggguuc

SEQ ID NO: 1142726 - RNA, 26 nt, Human
ccuccugccuuggccucccaaagugc

SEQ ID NO: 1142727 - RNA, 24 nt, Human
ccuccugggcucaagcaguccucc

SEQ ID NO: 1142728 - RNA, 21 nt, Human
ccucugggggagaugggccag

SEQ ID NO: 1142729 - RNA, 24 nt, Human
ccucugggguucaagcgauucucc

SEQ ID NO: 1142730 - RNA, 24 nt, Human
ccugccucggccucccaaagugcu

SEQ ID NO: 1142731 - RNA, 23 nt, Human
ccugccuuagccucccgaguagc

SEQ ID NO: 1142732 - RNA, 20 nt, Human
ccugggcucaagcaguccuc

SEQ ID NO: 1142733 - RNA, 23 nt, Human
ccugggcucaagcaguccuccug

SEQ ID NO: 1142734 - RNA, 19 nt, Human
ccuguagucccagcuacuc

SEQ ID NO: 1142735 - RNA, 21 nt, Human
ccuguagucccagcuacucgg

SEQ ID NO: 1142736 - RNA, 19 nt, Human
ccuugaccuccugggcuca

SEQ ID NO: 1142737 - RNA, 24 nt, Human
ccuugaccuccugggcucaagcag

SEQ ID NO: 1142738 - RNA, 23 nt, Human
cgcaaccucugccucugggguuc

SEQ ID NO: 1142739 - RNA, 23 nt, Human
cgcaguggcgggcgccuguaguc

SEQ ID NO: 1142740 - RNA, 24 nt, Human
cgccuguaaucccagcacuuuggg

SEQ ID NO: 1142741 - RNA, 24 nt, Human
cgccuguagucccagcuacucggg

SEQ ID NO: 1142742 - RNA, 23 nt, Human
cuaagcaucagaaagugaaugcc

SEQ ID NO: 1142743 - RNA, 24 nt, Human
cucacagccgccccagcgaggguc

SEQ ID NO: 1142744 - RNA, 22 nt, Human
cucacgccuguaaucccagcac

SEQ ID NO: 1142745 - RNA, 24 nt, Human
cucacgccuguaaucccagcacuu

SEQ ID NO: 1142746 - RNA, 19 nt, Human
cucaggaaggcucugggcu

SEQ ID NO: 1142747 - RNA, 23 nt, Human
cucauacauacuauugccaccuc

SEQ ID NO: 1142748 - RNA, 24 nt, Human
cuccauguuggucaggcuggucuu

SEQ ID NO: 1142749 - RNA, 25 nt, Human
cuccugggcucaagcaguccuccug

SEQ ID NO: 1142750 - RNA, 24 nt, Human
cugcccaggcuggagugcagugau

SEQ ID NO: 1142751 - RNA, 23 nt, Human
cugccuuagccucccgaguagcu

SEQ ID NO: 1142752 - RNA, 23 nt, Human
cugccuuggccucccaaagugcu

SEQ ID NO: 1142753 - RNA, 24 nt, Human
cuggagcccagggcgcagcugcac

SEQ ID NO: 1142754 - RNA, 19 nt, Human
cugggucaccccuucuuuc

SEQ ID NO: 1142755 - RNA, 21 nt, Human
cugguuuacagcguugggcug

SEQ ID NO: 1142756 - RNA, 23 nt, Human
cugguuuacagcguugggcuggg

SEQ ID NO: 1142757 - RNA, 22 nt, Human
cuguguguucccucgguguagg

SEQ ID NO: 1142758 - RNA, 23 nt, Human
cuuagccucccgaguagcuggga

SEQ ID NO: 1142759 - RNA, 22 nt, Human
cuucagccuugaccuccugggc

SEQ ID NO: 1142760 - RNA, 22 nt, Human
gaacacagcacaacgucugugc

SEQ ID NO: 1142761 - RNA, 18 nt, Human
gaacuaggacagcugcuc

SEQ ID NO: 1142762 - RNA, 19 nt, Human
gaacuggccgggcgcggug

SEQ ID NO: 1142763 - RNA, 24 nt, Human
gagacagggguuucuccauguugg

SEQ ID NO: 1142764 - RNA, 23 nt, Human
gagccaccacacccagccccuug

SEQ ID NO: 1142765 - RNA, 18 nt, Human
gauuacaggcaugagcca

SEQ ID NO: 1142766 - RNA, 21 nt, Human
gauuacaggcaugagccacca

SEQ ID NO: 1142767 - RNA, 22 nt, Human
gauuacaggcaugagccaccac

SEQ ID NO: 1142768 - RNA, 18 nt, Human
gauuauaggcaugugcca

SEQ ID NO: 1142769 - RNA, 20 nt, Human
gcaggugcuggcuccggugg

SEQ ID NO: 1142770 - RNA, 19 nt, Human
gcccaggcuggagugcagu

SEQ ID NO: 1142771 - RNA, 24 nt, Human
gccccuugucuaauuuuuuaaaaa

SEQ ID NO: 1142772 - RNA, 22 nt, Human
gccgguucgcgcccugguuuac

SEQ ID NO: 1142773 - RNA, 23 nt, Human
gccuguagucccagcuacucggg

SEQ ID NO: 1142774 - RNA, 22 nt, Human
gccuuggccucccaaagugcug

SEQ ID NO: 1142775 - RNA, 24 nt, Human
gcgauucuccugccuuagccuccc

SEQ ID NO: 1142776 - RNA, 23 nt, Human
gcuggucuugaacucccaaccuc

SEQ ID NO: 1142777 - RNA, 19 nt, Human
ggauuacaggcaugagcca

SEQ ID NO: 1142778 - RNA, 19 nt, Human
ggauuauaggcaugugcca

SEQ ID NO: 1142779 - RNA, 21 nt, Human
ggcucacgccuguaaucccag

SEQ ID NO: 1142780 - RNA, 24 nt, Human
ggcuggucuugaacucccaaccuc

SEQ ID NO: 1142781 - RNA, 21 nt, Human
ggcuuacagguguaagccaug

SEQ ID NO: 1142782 - RNA, 28 nt, Human
gggaauauguagaaaaaugccgguaccc

SEQ ID NO: 1142783 - RNA, 24 nt, Human
gggcgcaguggcgggcgccuguag

SEQ ID NO: 1142784 - RNA, 24 nt, Human
gggcgcgguggcucacgccuguaa

SEQ ID NO: 1142785 - RNA, 24 nt, Human
gggcggaucacgaggucaggagau

SEQ ID NO: 1142786 - RNA, 18 nt, Human
ggggucugcggcagagca

SEQ ID NO: 1142787 - RNA, 22 nt, Human
gggguuucuccauguuggucag

SEQ ID NO: 1142788 - RNA, 23 nt, Human
gggguuucuccauguuggucagg

SEQ ID NO: 1142789 - RNA, 20 nt, Human
ggguucaagcgauucuccug

SEQ ID NO: 1142790 - RNA, 24 nt, Human
ggucaggagaucgagaccacggug

SEQ ID NO: 1142791 - RNA, 23 nt, Human
gguggcucacgccuguaauccca

SEQ ID NO: 1142792 - RNA, 24 nt, Human
gguggcucacgccuguaaucccag

SEQ ID NO: 1142793 - RNA, 18 nt, Human
guagcugggauuauaggc

SEQ ID NO: 1142794 - RNA, 20 nt, Human
guagcugggauuauaggcau

SEQ ID NO: 1142795 - RNA, 22 nt, Human
gugaugcaaacacagcucaccg

SEQ ID NO: 1142796 - RNA, 23 nt, Human
gugcuggcuccgguggggucugc

SEQ ID NO: 1142797 - RNA, 23 nt, Human
guggcucacgccuguaaucccag

SEQ ID NO: 1142798 - RNA, 19 nt, Human
uaaaaagaaucugaaacug

SEQ ID NO: 1142799 - RNA, 24 nt, Human
uaaaaagaaucugaaacugaggca

SEQ ID NO: 1142800 - RNA, 25 nt, Human
uaacagagacagggguuucuccaug

SEQ ID NO: 1142801 - RNA, 22 nt, Human
uaacuugcuuaauggcuaguag

SEQ ID NO: 1142802 - RNA, 21 nt, Human
uaaguguggcagaugccauga

SEQ ID NO: 1142803 - RNA, 23 nt, Human
uaauuuuguauuuuuaacagaga

SEQ ID NO: 1142804 - RNA, 18 nt, Human
uacaaugggcucuauggg

SEQ ID NO: 1142805 - RNA, 24 nt, Human
uacaggcaugagccaccacaccca

SEQ ID NO: 1142806 - RNA, 18 nt, Human
uagauuccaacaagcugg

SEQ ID NO: 1142807 - RNA, 23 nt, Human
uagcagaagacaaauuaugcaga

SEQ ID NO: 1142808 - RNA, 24 nt, Human
uagcagaagacaaauuaugcagag

SEQ ID NO: 1142809 - RNA, 18 nt, Human
uauaaagauguaugugua

SEQ ID NO: 1142810 - RNA, 21 nt, Human
uauaugcacaucugacguaua

SEQ ID NO: 1142811 - RNA, 23 nt, Human
uauuuaccagaauaacuucucaa

SEQ ID NO: 1142812 - RNA, 23 nt, Human
ucaccgcaaccucugccucuggg

SEQ ID NO: 1142813 - RNA, 18 nt, Human
ucacgaggucaggagauc

SEQ ID NO: 1142814 - RNA, 24 nt, Human
ucacgaggucaggagaucgagacc

SEQ ID NO: 1142815 - RNA, 24 nt, Human
ucacucugcugcccaggcuggagu

SEQ ID NO: 1142816 - RNA, 24 nt, Human
ucacuucagccuugaccuccuggg

SEQ ID NO: 1142817 - RNA, 24 nt, Human
ucccaaagugcugggauuacaggc

SEQ ID NO: 1142818 - RNA, 23 nt, Human
ucccaaagugcugggcuuacagg

SEQ ID NO: 1142819 - RNA, 24 nt, Human
ucccgaguagcugggauuauaggc

SEQ ID NO: 1142820 - RNA, 18 nt, Human
ucccggggggcccucuuu

SEQ ID NO: 1142821 - RNA, 24 nt, Human
uccugggcucaagcaguccuccug

SEQ ID NO: 1142822 - RNA, 18 nt, Human
ucggccucccaaagugcu

SEQ ID NO: 1142823 - RNA, 22 nt, Human
ucuauggggaguggcagaagau

SEQ ID NO: 1142824 - RNA, 23 nt, Human
ucucacucugcugcccaggcugg

SEQ ID NO: 1142825 - RNA, 24 nt, Human
ucucacucugcugcccaggcugga

SEQ ID NO: 1142826 - RNA, 26 nt, Human
ucucacucugcugcccaggcuggagu

SEQ ID NO: 1142827 - RNA, 27 nt, Human
ucucacucugcugcccaggcuggagug

SEQ ID NO: 1142828 - RNA, 24 nt, Human
ucuccugccuuagccucccgagua

SEQ ID NO: 1142829 - RNA, 22 nt, Human
ucucuacuaaaaauacaaaaaa

SEQ ID NO: 1142830 - RNA, 24 nt, Human
ucugaaacugaggcauuagaaggc

SEQ ID NO: 1142831 - RNA, 24 nt, Human
ucugcggcagagcaggacuggagc

SEQ ID NO: 1142832 - RNA, 24 nt, Human
ucugcugcccaggcuggagugcag

SEQ ID NO: 1142833 - RNA, 24 nt, Human
ucugggguucaagcgauucuccug

SEQ ID NO: 1142834 - RNA, 26 nt, Human
ucuucauccuucaagacaaggauugg

SEQ ID NO: 1142835 - RNA, 23 nt, Human
ucuucguaggcaggucucaggau

SEQ ID NO: 1142836 - RNA, 22 nt, Human
ucuuggcaacaaugaguguccu

SEQ ID NO: 1142837 - RNA, 25 nt, Human
ugaauuuagaccacacaguguggag

SEQ ID NO: 1142838 - RNA, 25 nt, Human
ugaccuccugggcucaagcaguccu

SEQ ID NO: 1142839 - RNA, 19 nt, Human
ugaggcaggagaauggcgu

SEQ ID NO: 1142840 - RNA, 24 nt, Human
ugaggcgggcggaucacgagguca

SEQ ID NO: 1142841 - RNA, 18 nt, Human
ugaguaaggggcuggacu

SEQ ID NO: 1142842 - RNA, 23 nt, Human
ugagucauacugcauuggcacaa

SEQ ID NO: 1142843 - RNA, 24 nt, Human
ugaguguccuuuacaaugggcucu

SEQ ID NO: 1142844 - RNA, 23 nt, Human
ugaucaacacagacaaagacuaa

SEQ ID NO: 1142845 - RNA, 22 nt, Human
ugaugcaaacacagcucacuuc

SEQ ID NO: 1142846 - RNA, 24 nt, Human
ugcagugcaguggugcgaucucgg

SEQ ID NO: 1142847 - RNA, 19 nt, Human
ugcaguggugcgaucucgg

SEQ ID NO: 1142848 - RNA, 23 nt, Human
ugcaguggugcgaucucggcucc

SEQ ID NO: 1142849 - RNA, 18 nt, Human
ugcauuugcagucaccca

SEQ ID NO: 1142850 - RNA, 23 nt, Human
ugccaggcugcagugcaguggug

SEQ ID NO: 1142851 - RNA, 18 nt, Human
ugcccaggcuggagugca

SEQ ID NO: 1142852 - RNA, 22 nt, Human
ugcccaggcuggagugcaguga

SEQ ID NO: 1142853 - RNA, 24 nt, Human
ugcccaggcuggagugcagugaug

SEQ ID NO: 1142854 - RNA, 21 nt, Human
ugccucggccucccaaagugc

SEQ ID NO: 1142855 - RNA, 24 nt, Human
ugccucggccucccaaagugcugg

SEQ ID NO: 1142856 - RNA, 24 nt, Human
ugccuuagccucccgaguagcugg

SEQ ID NO: 1142857 - RNA, 24 nt, Human
ugcucagaggcaaagcucagagua

SEQ ID NO: 1142858 - RNA, 21 nt, Human
uggaagcacgaagaccuuaau

SEQ ID NO: 1142859 - RNA, 18 nt, Human
uggagugcagugaugcaa

SEQ ID NO: 1142860 - RNA, 22 nt, Human
uggcacaaacucuuggcaacaa

SEQ ID NO: 1142861 - RNA, 21 nt, Human
uggccuauuugacuuguuuaa

SEQ ID NO: 1142862 - RNA, 22 nt, Human
uggccuauuugacuuguuuaau

SEQ ID NO: 1142863 - RNA, 21 nt, Human
uggcgggcgccuguaguccca

SEQ ID NO: 1142864 - RNA, 24 nt, Human
uggcucacgccuguaaucccagca

SEQ ID NO: 1142865 - RNA, 18 nt, Human
uggcucaggaaggcucug

SEQ ID NO: 1142866 - RNA, 19 nt, Human
ugggaggcugaggcgggcg

SEQ ID NO: 1142867 - RNA, 20 nt, Human
ugggaggcugaggcgggcgg

SEQ ID NO: 1142868 - RNA, 24 nt, Human
ugggaggcugaggcgggcggauca

SEQ ID NO: 1142869 - RNA, 18 nt, Human
ugggauuacaggcaugag

SEQ ID NO: 1142870 - RNA, 19 nt, Human
ugggauuacaggcaugagc

SEQ ID NO: 1142871 - RNA, 22 nt, Human
ugggauuacaggcaugagccac

SEQ ID NO: 1142872 - RNA, 23 nt, Human
ugggauuacaggcaugagccacc

SEQ ID NO: 1142873 - RNA, 24 nt, Human
ugggauuacaggcaugagccacca

SEQ ID NO: 1142874 - RNA, 24 nt, Human
ugggauuacaggcaugagccacca

SEQ ID NO: 1142875 - RNA, 18 nt, Human
ugggauuauaggcaugug

SEQ ID NO: 1142876 - RNA, 21 nt, Human
ugggauuauaggcaugugcca

SEQ ID NO: 1142877 - RNA, 22 nt, Human
ugggauuauaggcaugugccac

SEQ ID NO: 1142878 - RNA, 24 nt, Human
ugggauuauaggcaugugccacca

SEQ ID NO: 1142879 - RNA, 24 nt, Human
ugggcucaagcaguccuccugccu

SEQ ID NO: 1142880 - RNA, 19 nt, Human
ugggcucuaugggacagcc

SEQ ID NO: 1142881 - RNA, 23 nt, Human
ugggcugggucaccccuucuuuc

SEQ ID NO: 1142882 - RNA, 21 nt, Human
ugggcuuacagguguaagcca

SEQ ID NO: 1142883 - RNA, 22 nt, Human
ugggcuuacagguguaagccau

SEQ ID NO: 1142884 - RNA, 27 nt, Human
uggggaacacagcacaacgucugugca

SEQ ID NO: 1142885 - RNA, 24 nt, Human
ugggguucaagcgauucuccugcc

SEQ ID NO: 1142886 - RNA, 23 nt, Human
uggucaggcuggucuugaacucc

SEQ ID NO: 1142887 - RNA, 23 nt, Human
ugucuagaagagaagugucagaa

SEQ ID NO: 1142888 - RNA, 21 nt, Human
uuaaaauccauugaacuggcc

SEQ ID NO: 1142889 - RNA, 23 nt, Human
uucaagcgauucuccugccuuag

SEQ ID NO: 1142890 - RNA, 24 nt, Human
uucaagcgauucuccugccuuagc

SEQ ID NO: 1142891 - RNA, 27 nt, Human
uucaaugagugaagggugagucauacu

SEQ ID NO: 1142892 - RNA, 19 nt, Human
uucauccuucaagacaagg

SEQ ID NO: 1142893 - RNA, 20 nt, Human
uucugggccauuugcugcag

SEQ ID NO: 1142894 - RNA, 18 nt, Human
uuggccucccaaagugcu

SEQ ID NO: 1142895 - RNA, 25 nt, Human
uugggaggcugaggcgggcggauca

SEQ ID NO: 1142896 - RNA, 22 nt, Human
uuguugccaggcugcagugcag

SEQ ID NO: 1142897 - RNA, 19 nt, Human
uuucgcucuuguugccagg

SEQ ID NO: 1142898 - RNA, 21 nt, Human
uuucuccauguuggucaggcu

SEQ ID NO: 1142899 - RNA, 20 nt, Human
uuuuguauuuuuaacagaga

SEQ ID NO: 1142900 - RNA, 22 nt, Human
agguuuuugcggggacuccaug

SEQ ID NO: 1142901 - RNA, 21 nt, Human
cggggacuccaugccugugga

SEQ ID NO: 1142902 - RNA, 24 nt, Human
gcagccuggcggggugggcgggca

SEQ ID NO: 1142903 - RNA, 23 nt, Human
uuugcggggacuccaugccugug

SEQ ID NO: 1142904 - RNA, 21 nt, Human
ggagcugcagaccagucuucc

SEQ ID NO: 1142905 - RNA, 23 nt, Human
ucccuuuaaguuacgaugggaau

SEQ ID NO: 1142906 - RNA, 20 nt, Human
ugagcagugggagcugcaga

SEQ ID NO: 1142907 - RNA, 24 nt, Human
ugagcagugggagcugcagaccag

SEQ ID NO: 1142908 - RNA, 19 nt, Human
ugggaauccagaacaacgc

SEQ ID NO: 1142909 - RNA, 20 nt, Human
ugggagcugcagaccagucu

SEQ ID NO: 1142910 - RNA, 20 nt, Human
aagcagguaggucuguccuc

SEQ ID NO: 1142911 - RNA, 27 nt, Human
auaguaggcuccuccuccacccaaccc

SEQ ID NO: 1142912 - RNA, 23 nt, Human
caacagccaggagaaaucuuuga

SEQ ID NO: 1142913 - RNA, 20 nt, Human
cacagcucuggccuccuggu

SEQ ID NO: 1142914 - RNA, 23 nt, Human
cagcugcugccaagguagccaca

SEQ ID NO: 1142915 - RNA, 24 nt, Human
ccagccagaaaaacagcagcuuca

SEQ ID NO: 1142916 - RNA, 22 nt, Human
cccagccagaaaaacagcagcu

SEQ ID NO: 1142917 - RNA, 21 nt, Human
cgcugaugagaagaacggagc

SEQ ID NO: 1142918 - RNA, 18 nt, Human
cuccuccuccacccaacc

SEQ ID NO: 1142919 - RNA, 21 nt, Human
ggggcucacacggaggaggca

SEQ ID NO: 1142920 - RNA, 22 nt, Human
gggggcugcugcuguggugggg

SEQ ID NO: 1142921 - RNA, 21 nt, Human
uagcagggacucuggcaggug

SEQ ID NO: 1142922 - RNA, 20 nt, Human
uaggcuccuccuccacccaa

SEQ ID NO: 1142923 - RNA, 19 nt, Human
ucagagaaaugaggagagc

SEQ ID NO: 1142924 - RNA, 22 nt, Human
ucuggcagguggcaggcagcuc

SEQ ID NO: 1142925 - RNA, 18 nt, Human
ugacugcagcucggaagc

SEQ ID NO: 1142926 - RNA, 19 nt, Human
ugagaagaacggagcucuu

SEQ ID NO: 1142927 - RNA, 22 nt, Human
ugaguaauaguaggcuccuccu

SEQ ID NO: 1142928 - RNA, 25 nt, Human
ugaguaauaguaggcuccuccuccc

SEQ ID NO: 1142929 - RNA, 24 nt, Human
ugccaagguagccacagcucuggc

SEQ ID NO: 1142930 - RNA, 24 nt, Human
uuggcccuccccagccagaaaaac

SEQ ID NO: 1142931 - RNA, 24 nt, Human
uuugaguaauaguaggcuccuccu

SEQ ID NO: 1142932 - RNA, 24 nt, Human
aaaacaaacaaacaaacaaaaaca

SEQ ID NO: 1142933 - RNA, 24 nt, Human
aaaacaaacaacacagacacuccc

SEQ ID NO: 1142934 - RNA, 22 nt, Human
aaacaaaaacaaacaacacaga

SEQ ID NO: 1142935 - RNA, 24 nt, Human
aaacaaacaaacaaacaaaaacaa

SEQ ID NO: 1142936 - RNA, 23 nt, Human
aaacaaacaacacagaccggacc

SEQ ID NO: 1142937 - RNA, 24 nt, Human
aaacaacacagacacucccugaaa

SEQ ID NO: 1142938 - RNA, 26 nt, Human
aaacaacacagacacucccugaaacc

SEQ ID NO: 1142939 - RNA, 28 nt, Human
aaacccagcagaccacaaucuuaaagga

SEQ ID NO: 1142940 - RNA, 22 nt, Human
aacaaacaaacaaacaaaaaca

SEQ ID NO: 1142941 - RNA, 26 nt, Human
aacaaacaacacagacacucccugaa

SEQ ID NO: 1142942 - RNA, 26 nt, Human
aacaacacagacacucccugaaaccc

SEQ ID NO: 1142943 - RNA, 23 nt, Human
aacacagacacucccugaaaccc

SEQ ID NO: 1142944 - RNA, 20 nt, Human
aacauggcaaaaccccgucu

SEQ ID NO: 1142945 - RNA, 21 nt, Human
aacauggcaaaaccccgucuc

SEQ ID NO: 1142946 - RNA, 20 nt, Human
aagcaaaaaaaaaaccucua

SEQ ID NO: 1142947 - RNA, 21 nt, Human
aagcaaaaaaaaaaccucuag

SEQ ID NO: 1142948 - RNA, 18 nt, Human
aaggacccagaaccaagu

SEQ ID NO: 1142949 - RNA, 24 nt, Human
aaucgcuugagcccaggaggugga

SEQ ID NO: 1142950 - RNA, 20 nt, Human
aauucccaguagaaaacuug

SEQ ID NO: 1142951 - RNA, 20 nt, Human
acaaaaacaaacaacacaga

SEQ ID NO: 1142952 - RNA, 24 nt, Human
acaaacaaaaacaaacaacacaga

SEQ ID NO: 1142953 - RNA, 27 nt, Human
acaaacaacacagacacucccugaaac

SEQ ID NO: 1142954 - RNA, 24 nt, Human
acacuccagccugggugacagagc

SEQ ID NO: 1142955 - RNA, 19 nt, Human
acagagcgagaccccgucu

SEQ ID NO: 1142956 - RNA, 24 nt, Human
acagagcgagaccccgucucaaaa

SEQ ID NO: 1142957 - RNA, 20 nt, Human
acagguuugggucccugagc

SEQ ID NO: 1142958 - RNA, 19 nt, Human
acccagcagaccacaaucu

SEQ ID NO: 1142959 - RNA, 18 nt, Human
acuacacuccagccuggg

SEQ ID NO: 1142960 - RNA, 24 nt, Human
acuacacuccagccugggugacag

SEQ ID NO: 1142961 - RNA, 21 nt, Human
acugagcauuuguuuugugcc

SEQ ID NO: 1142962 - RNA, 24 nt, Human
agccugggcaacauggcaaaaccc

SEQ ID NO: 1142963 - RNA, 28 nt, Human
aggaaaccugguuuuaaggacccagaac

SEQ ID NO: 1142964 - RNA, 18 nt, Human
aggcaugagaaucgcuug

SEQ ID NO: 1142965 - RNA, 24 nt, Human
aggcugaggcaugagaaucgcuug

SEQ ID NO: 1142966 - RNA, 19 nt, Human
aggggcucaggcucaggag

SEQ ID NO: 1142967 - RNA, 21 nt, Human
aggggcucaggcucaggaggg

SEQ ID NO: 1142968 - RNA, 19 nt, Human
agguggaggcugcagugag

SEQ ID NO: 1142969 - RNA, 24 nt, Human
agguggaggcugcagugagccaag

SEQ ID NO: 1142970 - RNA, 21 nt, Human
auaaacacucauuaaacacca

SEQ ID NO: 1142971 - RNA, 19 nt, Human
aucucuucucucuccucuu

SEQ ID NO: 1142972 - RNA, 24 nt, Human
caacauggcaaaaccccgucucua

SEQ ID NO: 1142973 - RNA, 23 nt, Human
caacccuuugaggaggcugugac

SEQ ID NO: 1142974 - RNA, 21 nt, Human
caagcccagggcaggccauac

SEQ ID NO: 1142975 - RNA, 19 nt, Human
cacaccugcagucccagcu

SEQ ID NO: 1142976 - RNA, 26 nt, Human
caccacuacacuccagccugggugac

SEQ ID NO: 1142977 - RNA, 28 nt, Human
caccacuacacuccagccugggugacag

SEQ ID NO: 1142978 - RNA, 18 nt, Human
caccauucuaauucccag

SEQ ID NO: 1142979 - RNA, 23 nt, Human
caccugcagucccagcuacucgg

SEQ ID NO: 1142980 - RNA, 24 nt, Human
caccugcagucccagcuacucggg

SEQ ID NO: 1142981 - RNA, 18 nt, Human
cacucagggcugacacag

SEQ ID NO: 1142982 - RNA, 22 nt, Human
cacuccagccugggugacagag

SEQ ID NO: 1142983 - RNA, 24 nt, Human
cacuccagccugggugacagagcg

SEQ ID NO: 1142984 - RNA, 23 nt, Human
cagacacucccugaaacccagca

SEQ ID NO: 1142985 - RNA, 22 nt, Human
caggaagguaaggggcucaggc

SEQ ID NO: 1142986 - RNA, 18 nt, Human
caggagggaacagacaag

SEQ ID NO: 1142987 - RNA, 20 nt, Human
caggagguggaggcugcagu

SEQ ID NO: 1142988 - RNA, 28 nt, Human
caggcucccaggcugggacccacucccu

SEQ ID NO: 1142989 - RNA, 19 nt, Human
ccaccagaucacucccaca

SEQ ID NO: 1142990 - RNA, 20 nt, Human
ccacuacacuccagccuggg

SEQ ID NO: 1142991 - RNA, 21 nt, Human
ccacuacacuccagccugggu

SEQ ID NO: 1142992 - RNA, 23 nt, Human
ccacuacacuccagccuggguga

SEQ ID NO: 1142993 - RNA, 24 nt, Human
ccacuacacuccagccugggugac

SEQ ID NO: 1142994 - RNA, 25 nt, Human
ccacuacacuccagccugggugaca

SEQ ID NO: 1142995 - RNA, 21 nt, Human
ccucuaggaaaagcaaaaaga

SEQ ID NO: 1142996 - RNA, 18 nt, Human
ccugacagcaggcuccca

SEQ ID NO: 1142997 - RNA, 22 nt, Human
ccugcagucccagcuacuccuc

SEQ ID NO: 1142998 - RNA, 21 nt, Human
ccugcagucccagcuacucgg

SEQ ID NO: 1142999 - RNA, 23 nt, Human
ccugggcaacauggcaaaacccc

SEQ ID NO: 1143000 - RNA, 24 nt, Human
ccugggcaacauggcaaaaccccg

SEQ ID NO: 1143001 - RNA, 20 nt, Human
ccugggugacagagcgagac

SEQ ID NO: 1143002 - RNA, 22 nt, Human
cggcccagagcagucauggcaa

SEQ ID NO: 1143003 - RNA, 23 nt, Human
cucaaaaccugcccgacagguuu

SEQ ID NO: 1143004 - RNA, 21 nt, Human
cuccacagcucucaaaaccug

SEQ ID NO: 1143005 - RNA, 18 nt, Human
cuccagccucugucccuc

SEQ ID NO: 1143006 - RNA, 19 nt, Human
cucccugaaacccagcaga

SEQ ID NO: 1143007 - RNA, 19 nt, Human
cucucaaaaccugcccgac

SEQ ID NO: 1143008 - RNA, 20 nt, Human
cucuccauaaacacucauua

SEQ ID NO: 1143009 - RNA, 21 nt, Human
cucucuccacagcucucaaaa

SEQ ID NO: 1143010 - RNA, 18 nt, Human
cugaaacccagcagacca

SEQ ID NO: 1143011 - RNA, 21 nt, Human
cugcagucccagcuacucggg

SEQ ID NO: 1143012 - RNA, 22 nt, Human
cugcagugagccaagacugcac

SEQ ID NO: 1143013 - RNA, 19 nt, Human
cuuagaacucuccucucca

SEQ ID NO: 1143014 - RNA, 24 nt, Human
gacccagaaccaagucucagggaa

SEQ ID NO: 1143015 - RNA, 22 nt, Human
gagcagucauggcaaacaacaa

SEQ ID NO: 1143016 - RNA, 18 nt, Human
gaggcugcagugagccaa

SEQ ID NO: 1143017 - RNA, 19 nt, Human
gaggcugcagugagccaag

SEQ ID NO: 1143018 - RNA, 21 nt, Human
gaguccaggucugccugcucc

SEQ ID NO: 1143019 - RNA, 18 nt, Human
gaugcaguuaaacauaga

SEQ ID NO: 1143020 - RNA, 19 nt, Human
gcaaaaaaaaaaccucuag

SEQ ID NO: 1143021 - RNA, 19 nt, Human
gcaaaaaaaaaaccucuag

SEQ ID NO: 1143022 - RNA, 23 nt, Human
gccauacauccuucuccagccuc

SEQ ID NO: 1143023 - RNA, 24 nt, Human
gcccaggagguggaggcugcagug

SEQ ID NO: 1143024 - RNA, 18 nt, Human
ggaggcugcagugagcca

SEQ ID NO: 1143025 - RNA, 20 nt, Human
ggaggcugcagugagccaag

SEQ ID NO: 1143026 - RNA, 22 nt, Human
gggaacagacaagcccagggca

SEQ ID NO: 1143027 - RNA, 18 nt, Human
gucucagggaagugagaa

SEQ ID NO: 1143028 - RNA, 23 nt, Human
uaaggacccagaaccaagucuca

SEQ ID NO: 1143029 - RNA, 24 nt, Human
uacaaaaaacacaaaaauuagcca

SEQ ID NO: 1143030 - RNA, 21 nt, Human
uacccccggcccagagcaguc

SEQ ID NO: 1143031 - RNA, 24 nt, Human
uagacacuuccagccugggcaaca

SEQ ID NO: 1143032 - RNA, 21 nt, Human
uaggaaaagcaaaaagaggca

SEQ ID NO: 1143033 - RNA, 19 nt, Human
uaggcagcuuccauccacu

SEQ ID NO: 1143034 - RNA, 23 nt, Human
uaguggcacacaccugcaguccc

SEQ ID NO: 1143035 - RNA, 25 nt, Human
ucaaaacaaacaaacaaacaaaaac

SEQ ID NO: 1143036 - RNA, 20 nt, Human
ucaacagaugaguaacaagc

SEQ ID NO: 1143037 - RNA, 19 nt, Human
ucacagccaggcugugagu

SEQ ID NO: 1143038 - RNA, 19 nt, Human
ucaggagggaacagacaag

SEQ ID NO: 1143039 - RNA, 23 nt, Human
uccagccugggugacagagcgag

SEQ ID NO: 1143040 - RNA, 24 nt, Human
uccagccugggugacagagcgaga

SEQ ID NO: 1143041 - RNA, 18 nt, Human
uccaggucugccugcucc

SEQ ID NO: 1143042 - RNA, 20 nt, Human
uccauaaacacucauuaaac

SEQ ID NO: 1143043 - RNA, 20 nt, Human
uccauccacugagcauuugu

SEQ ID NO: 1143044 - RNA, 22 nt, Human
ucccaggcugggacccacuccc

SEQ ID NO: 1143045 - RNA, 20 nt, Human
ucccuaccugcagauugcug

SEQ ID NO: 1143046 - RNA, 19 nt, Human
ucccucguacaugcccgga

SEQ ID NO: 1143047 - RNA, 18 nt, Human
ucccucucuccacagcuc

SEQ ID NO: 1143048 - RNA, 24 nt, Human
ucgcuugagcccaggagguggagg

SEQ ID NO: 1143049 - RNA, 24 nt, Human
ucgggaggcugaggcaugagaauc

SEQ ID NO: 1143050 - RNA, 20 nt, Human
ucuaggaaaagcaaaaagag

SEQ ID NO: 1143051 - RNA, 18 nt, Human
ucucucuccucuuccuca

SEQ ID NO: 1143052 - RNA, 22 nt, Human
ucugccugcuccugacagcagg

SEQ ID NO: 1143053 - RNA, 19 nt, Human
ugaccuuagaacucuccuc

SEQ ID NO: 1143054 - RNA, 19 nt, Human
ugaguaacaagcaaaaaaa

SEQ ID NO: 1143055 - RNA, 21 nt, Human
ugccaggccacugcuaagggc

SEQ ID NO: 1143056 - RNA, 19 nt, Human
ugccuuugaauagaggccu

SEQ ID NO: 1143057 - RNA, 20 nt, Human
uggaugccugcagccagagg

SEQ ID NO: 1143058 - RNA, 19 nt, Human
uggcaaacaacaacaacga

SEQ ID NO: 1143059 - RNA, 22 nt, Human
uggcacacaccugcagucccag

SEQ ID NO: 1143060 - RNA, 22 nt, Human
ugucccucucuccacagcucuc

SEQ ID NO: 1143061 - RNA, 25 nt, Human
uguucuggccaccagaucacuccca

SEQ ID NO: 1143062 - RNA, 22 nt, Human
uguuuugugccaggccacugcu

SEQ ID NO: 1143063 - RNA, 19 nt, Human
uuccucauuucuggaacgc

SEQ ID NO: 1143064 - RNA, 23 nt, Human
uugcuggaauaaucccuggaugc

SEQ ID NO: 1143065 - RNA, 22 nt, Human
uuugaggaggcugugacuauuc

SEQ ID NO: 1143066 - RNA, 23 nt, Human
caacuucugauauaaacauuccu

SEQ ID NO: 1143067 - RNA, 26 nt, Human
uaacaaauauaaagaugccaaagggu

SEQ ID NO: 1143068 - RNA, 19 nt, Human
uacuuuuuuuuuuauaaug

SEQ ID NO: 1143069 - RNA, 20 nt, Human
uagaauaugucacuuucugg

SEQ ID NO: 1143070 - RNA, 20 nt, Human
uauaaagaugccaaagggua

SEQ ID NO: 1143071 - RNA, 19 nt, Human
uccucauaaguuuggaauu

SEQ ID NO: 1143072 - RNA, 23 nt, Human
ugauaaaugccacuaucagcuau

SEQ ID NO: 1143073 - RNA, 23 nt, Human
aaaccccauagucuuagccccaa

SEQ ID NO: 1143074 - RNA, 24 nt, Human
aaagcuccuucugcugauaaacuu

SEQ ID NO: 1143075 - RNA, 28 nt, Human
aaaguuccucucccuggauccucuuuuu

SEQ ID NO: 1143076 - RNA, 24 nt, Human
aagaaaucagagaagacacaaaca

SEQ ID NO: 1143077 - RNA, 22 nt, Human
aagaguucaagaccagccuggu

SEQ ID NO: 1143078 - RNA, 24 nt, Human
aagcaauccucagcaaaaagaaca

SEQ ID NO: 1143079 - RNA, 19 nt, Human
aaggcucuccuacccucca

SEQ ID NO: 1143080 - RNA, 22 nt, Human
aaggcucuccuacccuccauca

SEQ ID NO: 1143081 - RNA, 23 nt, Human
aagggcauccaaauagaggaggg

SEQ ID NO: 1143082 - RNA, 20 nt, Human
aaguuccucucccuggaucc

SEQ ID NO: 1143083 - RNA, 26 nt, Human
aaguuccucucccuggauccucuuuu

SEQ ID NO: 1143084 - RNA, 20 nt, Human
aaucagaauacaaaaacaaa

SEQ ID NO: 1143085 - RNA, 20 nt, Human
aauuuccauuugugcauccc

SEQ ID NO: 1143086 - RNA, 23 nt, Human
acaaaaacaaccaccaacaacau

SEQ ID NO: 1143087 - RNA, 21 nt, Human
acacaaacaaauggaaaaaca

SEQ ID NO: 1143088 - RNA, 22 nt, Human
acacagccaaaaaccaucacau

SEQ ID NO: 1143089 - RNA, 23 nt, Human
agaaaaccccauagucuuagccc

SEQ ID NO: 1143090 - RNA, 24 nt, Human
agaaaucagagaagacacaaacaa

SEQ ID NO: 1143091 - RNA, 21 nt, Human
agaauacaaaaacaaccacca

SEQ ID NO: 1143092 - RNA, 23 nt, Human
agccaaaaaccaucacauagucc

SEQ ID NO: 1143093 - RNA, 19 nt, Human
agccauggcaaacccacag

SEQ ID NO: 1143094 - RNA, 21 nt, Human
agccauggcaaacccacagcc

SEQ ID NO: 1143095 - RNA, 21 nt, Human
agcccuaccccaguccucaga

SEQ ID NO: 1143096 - RNA, 19 nt, Human
agccuggucaacauaguga

SEQ ID NO: 1143097 - RNA, 24 nt, Human
agccuggucaacauagugagauuc

SEQ ID NO: 1143098 - RNA, 24 nt, Human
agugcccgguugcccaagucaaaa

SEQ ID NO: 1143099 - RNA, 22 nt, Human
aguuguuccuucucugucuucu

SEQ ID NO: 1143100 - RNA, 20 nt, Human
auaaaaaguaauuacaauga

SEQ ID NO: 1143101 - RNA, 24 nt, Human
auaaauuuugucuuuaaaacagag

SEQ ID NO: 1143102 - RNA, 21 nt, Human
aucagaauacaaaaacaacca

SEQ ID NO: 1143103 - RNA, 23 nt, Human
aucuugaaauguccucucccuca

SEQ ID NO: 1143104 - RNA, 25 nt, Human
auucuggaucuccuuuucuucuccu

SEQ ID NO: 1143105 - RNA, 24 nt, Human
caaaaacagcucaucacuuugagc

SEQ ID NO: 1143106 - RNA, 23 nt, Human
caaaaagaacaaagcuggaggca

SEQ ID NO: 1143107 - RNA, 24 nt, Human
caaacccacagccaacauuacacu

SEQ ID NO: 1143108 - RNA, 23 nt, Human
caaacuauacuacagggcuacag

SEQ ID NO: 1143109 - RNA, 21 nt, Human
caaacuuccuuagaaagaggc

SEQ ID NO: 1143110 - RNA, 18 nt, Human
caaauagaggagggaaga

SEQ ID NO: 1143111 - RNA, 22 nt, Human
caacaacaucagcccaacuuuc

SEQ ID NO: 1143112 - RNA, 22 nt, Human
caacauagugagauucuaucuc

SEQ ID NO: 1143113 - RNA, 24 nt, Human
caagaccagccuggucaacauagu

SEQ ID NO: 1143114 - RNA, 21 nt, Human
caagaugauguuggccucaua

SEQ ID NO: 1143115 - RNA, 21 nt, Human
cacaacuuuaaccucagcuuc

SEQ ID NO: 1143116 - RNA, 20 nt, Human
cacaguuacucagcagcacu

SEQ ID NO: 1143117 - RNA, 19 nt, Human
cagaauacaaaaacaacca

SEQ ID NO: 1143118 - RNA, 21 nt, Human
cagaauacaaaaacaaccacc

SEQ ID NO: 1143119 - RNA, 23 nt, Human
cagaauacaaaaacaaccaccaa

SEQ ID NO: 1143120 - RNA, 24 nt, Human
cagaauacaaaaacaaccaccaac

SEQ ID NO: 1143121 - RNA, 25 nt, Human
cagaauacaaaaacaaccaccaaca

SEQ ID NO: 1143122 - RNA, 21 nt, Human
cagcaaaaagaacaaagcugg

SEQ ID NO: 1143123 - RNA, 26 nt, Human
cagcaaaaagaacaaagcuggaggca

SEQ ID NO: 1143124 - RNA, 20 nt, Human
caguaaccaaaacagcauga

SEQ ID NO: 1143125 - RNA, 24 nt, Human
caguaaccaaaacagcaugauacu

SEQ ID NO: 1143126 - RNA, 19 nt, Human
caucauguuacccaacuuc

SEQ ID NO: 1143127 - RNA, 24 nt, Human
caucccaugcccagcccacccucc

SEQ ID NO: 1143128 - RNA, 23 nt, Human
cauggcaaacccacagccaacau

SEQ ID NO: 1143129 - RNA, 18 nt, Human
cauucauaauugcuacac

SEQ ID NO: 1143130 - RNA, 21 nt, Human
ccaccaacaacaucagcccaa

SEQ ID NO: 1143131 - RNA, 23 nt, Human
ccagcuagucuauccuucagcca

SEQ ID NO: 1143132 - RNA, 22 nt, Human
cccaacuucaaacuauacuaca

SEQ ID NO: 1143133 - RNA, 18 nt, Human
ccccaaagcuccuucugc

SEQ ID NO: 1143134 - RNA, 24 nt, Human
ccccacacagccagcaugugucca

SEQ ID NO: 1143135 - RNA, 23 nt, Human
ccccacugucuuccacaacuuua

SEQ ID NO: 1143136 - RNA, 18 nt, Human
ccuccaucauuccucccu

SEQ ID NO: 1143137 - RNA, 24 nt, Human
ccucccucuaccccacacagccag

SEQ ID NO: 1143138 - RNA, 24 nt, Human
ccucuuuuuccuucuugagugccc

SEQ ID NO: 1143139 - RNA, 20 nt, Human
cucaaaauacaguucuguaa

SEQ ID NO: 1143140 - RNA, 18 nt, Human
cucccucuaccccacaca

SEQ ID NO: 1143141 - RNA, 23 nt, Human
cucugcaguucacucugcugcuu

SEQ ID NO: 1143142 - RNA, 23 nt, Human
cugaaaucagacaaugauuagaa

SEQ ID NO: 1143143 - RNA, 28 nt, Human
cugaaguuugugugugugugugugugug

SEQ ID NO: 1143144 - RNA, 24 nt, Human
cugcuaaauguaucucaauuguau

SEQ ID NO: 1143145 - RNA, 19 nt, Human
cuggguucugguuucuuuc

SEQ ID NO: 1143146 - RNA, 22 nt, Human
cugugacagugaaagauggcug

SEQ ID NO: 1143147 - RNA, 18 nt, Human
cuguugugacuuccuaug

SEQ ID NO: 1143148 - RNA, 23 nt, Human
cuucugcugauaaacuuuagcaa

SEQ ID NO: 1143149 - RNA, 21 nt, Human
gaagacacaaacaaauggaaa

SEQ ID NO: 1143150 - RNA, 19 nt, Human
gaaucacaguuacucagca

SEQ ID NO: 1143151 - RNA, 22 nt, Human
gagcuagccauggcaaacccac

SEQ ID NO: 1143152 - RNA, 22 nt, Human
gcaaaaagaacaaagcuggagg

SEQ ID NO: 1143153 - RNA, 19 nt, Human
gcauccaaauagaggaggg

SEQ ID NO: 1143154 - RNA, 22 nt, Human
gccauggcaaacccacagccaa

SEQ ID NO: 1143155 - RNA, 20 nt, Human
gccccaaagcuccuucugcu

SEQ ID NO: 1143156 - RNA, 22 nt, Human
gcccuaauagccaagcaauccu

SEQ ID NO: 1143157 - RNA, 23 nt, Human
gcuagccauggcaaacccacagc

SEQ ID NO: 1143158 - RNA, 25 nt, Human
ggcuucucccucuaguuguuccuuc

SEQ ID NO: 1143159 - RNA, 22 nt, Human
ggggaaucacaguuacucagca

SEQ ID NO: 1143160 - RNA, 21 nt, Human
ggucaugccuaugugugagcu

SEQ ID NO: 1143161 - RNA, 21 nt, Human
gugcaucccaugcccagccca

SEQ ID NO: 1143162 - RNA, 21 nt, Human
gugugugugugugugugugug

SEQ ID NO: 1143163 - RNA, 21 nt, Human
gugugugugugugugugugug

SEQ ID NO: 1143164 - RNA, 23 nt, Human
guuccuguaaaaaugguaccagc

SEQ ID NO: 1143165 - RNA, 24 nt, Human
guuccuguaaaaaugguaccagcu

SEQ ID NO: 1143166 - RNA, 24 nt, Human
guuuuguccuaccucucugugaca

SEQ ID NO: 1143167 - RNA, 24 nt, Human
uaaauuuugucuuuaaaacagagc

SEQ ID NO: 1143168 - RNA, 19 nt, Human
uaaccaaaacagcaugaua

SEQ ID NO: 1143169 - RNA, 20 nt, Human
uaaucccauucauaauugcu

SEQ ID NO: 1143170 - RNA, 25 nt, Human
uaauuuacagaugcaaguuaucccu

SEQ ID NO: 1143171 - RNA, 21 nt, Human
uacaaaaacaaccaccaacaa

SEQ ID NO: 1143172 - RNA, 24 nt, Human
uaccuaggaauacagcuaaccagg

SEQ ID NO: 1143173 - RNA, 21 nt, Human
uaccucacugucccuacccau

SEQ ID NO: 1143174 - RNA, 21 nt, Human
uagaaagaggccuuaccucac

SEQ ID NO: 1143175 - RNA, 18 nt, Human
uagacaggaagucaaacu

SEQ ID NO: 1143176 - RNA, 18 nt, Human
uagacaggaagucaaacu

SEQ ID NO: 1143177 - RNA, 19 nt, Human
uagacaggaagucaaacug

SEQ ID NO: 1143178 - RNA, 19 nt, Human
uagaggagggaagagagga

SEQ ID NO: 1143179 - RNA, 19 nt, Human
uagcauacaaaaucaaugu

SEQ ID NO: 1143180 - RNA, 22 nt, Human
uagugucuguggagaaacuuuu

SEQ ID NO: 1143181 - RNA, 23 nt, Human
uagugucuguggagaaacuuuuu

SEQ ID NO: 1143182 - RNA, 23 nt, Human
uaguuguuccuucucugucuucu

SEQ ID NO: 1143183 - RNA, 18 nt, Human
uauacugcccaaaguaau

SEQ ID NO: 1143184 - RNA, 23 nt, Human
uauaucuucuucuucacugcauu

SEQ ID NO: 1143185 - RNA, 18 nt, Human
ucacucugcugcuucaga

SEQ ID NO: 1143186 - RNA, 19 nt, Human
ucacugcauuuuugugggc

SEQ ID NO: 1143187 - RNA, 22 nt, Human
ucaguuauccccacugucuucc

SEQ ID NO: 1143188 - RNA, 18 nt, Human
uccacaacuuuaaccuca

SEQ ID NO: 1143189 - RNA, 22 nt, Human
ucccaugcccagcccacccucc

SEQ ID NO: 1143190 - RNA, 21 nt, Human
ucccuggauccucuuuuuccu

SEQ ID NO: 1143191 - RNA, 22 nt, Human
ucccuggauccucuuuuuccuu

SEQ ID NO: 1143192 - RNA, 21 nt, Human
uccucuuuuuccuucuugagu

SEQ ID NO: 1143193 - RNA, 20 nt, Human
ucgcuugggugccaagaguu

SEQ ID NO: 1143194 - RNA, 24 nt, Human
ucgcuugggugccaagaguucaag

SEQ ID NO: 1143195 - RNA, 20 nt, Human
ucuagucggaagugccaaaa

SEQ ID NO: 1143196 - RNA, 20 nt, Human
ucucucugucaugauucugg

SEQ ID NO: 1143197 - RNA, 22 nt, Human
ucuuccacaacuuuaaccucag

SEQ ID NO: 1143198 - RNA, 18 nt, Human
ugaaaauuuucaggucug

SEQ ID NO: 1143199 - RNA, 19 nt, Human
ugaaagccuuuucugcaua

SEQ ID NO: 1143200 - RNA, 18 nt, Human
ugaagaacauaaucccau

SEQ ID NO: 1143201 - RNA, 24 nt, Human
ugaagaacauaaucccauucauaa

SEQ ID NO: 1143202 - RNA, 18 nt, Human
ugagauaaucacaugguu

SEQ ID NO: 1143203 - RNA, 21 nt, Human
ugaugccaucaccuggggaau

SEQ ID NO: 1143204 - RNA, 21 nt, Human
ugcccagcccacccuccacca

SEQ ID NO: 1143205 - RNA, 22 nt, Human
ugccuuggcuucucccucuagu

SEQ ID NO: 1143206 - RNA, 22 nt, Human
uggaaccaaaaaaaaaaagagc

SEQ ID NO: 1143207 - RNA, 19 nt, Human
uggacacagccaaaaacca

SEQ ID NO: 1143208 - RNA, 18 nt, Human
uggcaaacccacagccaa

SEQ ID NO: 1143209 - RNA, 20 nt, Human
uggcaaaggucaucucucug

SEQ ID NO: 1143210 - RNA, 25 nt, Human
uggccugaaguuugugugugugugu

SEQ ID NO: 1143211 - RNA, 23 nt, Human
ugucccuacccaucuccucucug

SEQ ID NO: 1143212 - RNA, 21 nt, Human
ugugacuuccuauggacacag

SEQ ID NO: 1143213 - RNA, 19 nt, Human
ugugcaaaacuggaagggc

SEQ ID NO: 1143214 - RNA, 18 nt, Human
ugugugugugugugugug

SEQ ID NO: 1143215 - RNA, 18 nt, Human
ugugugugugugugugug

SEQ ID NO: 1143216 - RNA, 18 nt, Human
ugugugugugugugugug

SEQ ID NO: 1143217 - RNA, 18 nt, Human
ugugugugugugugugug

SEQ ID NO: 1143218 - RNA, 18 nt, Human
ugugugugugugugugug

SEQ ID NO: 1143219 - RNA, 18 nt, Human
ugugugugugugugugug

SEQ ID NO: 1143220 - RNA, 18 nt, Human
ugugugugugugugugug

SEQ ID NO: 1143221 - RNA, 18 nt, Human
ugugugugugugugugug

SEQ ID NO: 1143222 - RNA, 18 nt, Human
ugugugugugugugugug

SEQ ID NO: 1143223 - RNA, 18 nt, Human
ugugugugugugugugug

SEQ ID NO: 1143224 - RNA, 18 nt, Human
ugugugugugugugugug

SEQ ID NO: 1143225 - RNA, 18 nt, Human
ugugugugugugugugug

SEQ ID NO: 1143226 - RNA, 19 nt, Human
ugugugugugugugugugc

SEQ ID NO: 1143227 - RNA, 21 nt, Human
ugugugugugugugugugugu

SEQ ID NO: 1143228 - RNA, 21 nt, Human
ugugugugugugugugugugu

SEQ ID NO: 1143229 - RNA, 21 nt, Human
ugugugugugugugugugugu

SEQ ID NO: 1143230 - RNA, 21 nt, Human
ugugugugugugugugugugu

SEQ ID NO: 1143231 - RNA, 21 nt, Human
ugugugugugugugugugugu

SEQ ID NO: 1143232 - RNA, 21 nt, Human
ugugugugugugugugugugu

SEQ ID NO: 1143233 - RNA, 21 nt, Human
ugugugugugugugugugugu

SEQ ID NO: 1143234 - RNA, 21 nt, Human
ugugugugugugugugugugu

SEQ ID NO: 1143235 - RNA, 21 nt, Human
ugugugugugugugugugugu

SEQ ID NO: 1143236 - RNA, 21 nt, Human
ugugugugugugugugugugu

SEQ ID NO: 1143237 - RNA, 21 nt, Human
ugugugugugugugugugugu

SEQ ID NO: 1143238 - RNA, 21 nt, Human
ugugugugugugugugugugu

SEQ ID NO: 1143239 - RNA, 21 nt, Human
ugugugugugugugugugugu

SEQ ID NO: 1143240 - RNA, 21 nt, Human
ugugugugugugugugugugu

SEQ ID NO: 1143241 - RNA, 21 nt, Human
ugugugugugugugugugugu

SEQ ID NO: 1143242 - RNA, 21 nt, Human
ugugugugugugugugugugu

SEQ ID NO: 1143243 - RNA, 21 nt, Human
ugugugugugugugugugugu

SEQ ID NO: 1143244 - RNA, 21 nt, Human
ugugugugugugugugugugu

SEQ ID NO: 1143245 - RNA, 21 nt, Human
ugugugugugugugugugugu

SEQ ID NO: 1143246 - RNA, 21 nt, Human
ugugugugugugugugugugu

SEQ ID NO: 1143247 - RNA, 21 nt, Human
ugugugugugugugugugugu

SEQ ID NO: 1143248 - RNA, 21 nt, Human
ugugugugugugugugugugu

SEQ ID NO: 1143249 - RNA, 22 nt, Human
ugugugugugugugugugugug

SEQ ID NO: 1143250 - RNA, 22 nt, Human
ugugugugugugugugugugug

SEQ ID NO: 1143251 - RNA, 22 nt, Human
ugugugugugugugugugugug

SEQ ID NO: 1143252 - RNA, 22 nt, Human
ugugugugugugugugugugug

SEQ ID NO: 1143253 - RNA, 22 nt, Human
ugugugugugugugugugugug

SEQ ID NO: 1143254 - RNA, 22 nt, Human
ugugugugugugugugugugug

SEQ ID NO: 1143255 - RNA, 22 nt, Human
ugugugugugugugugugugug

SEQ ID NO: 1143256 - RNA, 22 nt, Human
ugugugugugugugugugugug

SEQ ID NO: 1143257 - RNA, 18 nt, Human
uuaaaacagagcucuuga

SEQ ID NO: 1143258 - RNA, 23 nt, Human
uuccauuugugcaucccaugccc

SEQ ID NO: 1143259 - RNA, 24 nt, Human
uuccucccucuaccccacacagcc

SEQ ID NO: 1143260 - RNA, 21 nt, Human
uuccuucuugagugcccgguu

SEQ ID NO: 1143261 - RNA, 19 nt, Human
uugaaauguccucucccuc

SEQ ID NO: 1143262 - RNA, 20 nt, Human
uugaauuuuuuuuucuucau

SEQ ID NO: 1143263 - RNA, 25 nt, Human
uugacguguauguugaggcaaccuu

SEQ ID NO: 1143264 - RNA, 18 nt, Human
uugugggcugcacuuacc

SEQ ID NO: 1143265 - RNA, 24 nt, Human
uuuccauuugugcaucccaugccc

SEQ ID NO: 1143266 - RNA, 24 nt, Human
uuugugugugugugugugugugug

SEQ ID NO: 1143267 - RNA, 20 nt, Human
aacucccgccaaagcagcag

SEQ ID NO: 1143268 - RNA, 22 nt, Human
caaagcagcagcuccgcaaagc

SEQ ID NO: 1143269 - RNA, 23 nt, Human
caaagcagcagcuccgcaaagcc

SEQ ID NO: 1143270 - RNA, 22 nt, Human
ccucacaccagcuuccaacucc

SEQ ID NO: 1143271 - RNA, 21 nt, Human
cucccgccaaagcagcagcuc

SEQ ID NO: 1143272 - RNA, 21 nt, Human
ucccgccaaagcagcagcucc

SEQ ID NO: 1143273 - RNA, 19 nt, Human
uccgcaaagccgccacaag

SEQ ID NO: 1143274 - RNA, 22 nt, Human
uccgcaaagccgccacaaggcg

SEQ ID NO: 1143275 - RNA, 26 nt, Human
aaccaugggcaccagauaugaccugg

SEQ ID NO: 1143276 - RNA, 19 nt, Human
ccaaggaauuagaaauacc

SEQ ID NO: 1143277 - RNA, 24 nt, Human
ccacugauauaucugaaaaguaaa

SEQ ID NO: 1143278 - RNA, 20 nt, Human
cccaaggaauuagaaauacc

SEQ ID NO: 1143279 - RNA, 21 nt, Human
cucaugaccaccucacacgcu

SEQ ID NO: 1143280 - RNA, 23 nt, Human
gcccccacuggcaaggugaaggu

SEQ ID NO: 1143281 - RNA, 19 nt, Human
uccuugacuaggcccugca

SEQ ID NO: 1143282 - RNA, 21 nt, Human
ucugaaaaguaaacacuuuug

SEQ ID NO: 1143283 - RNA, 21 nt, Human
ugaccugcugaucccagaggc

SEQ ID NO: 1143284 - RNA, 23 nt, Human
ugauauaucugaaaaguaaacac

SEQ ID NO: 1143285 - RNA, 19 nt, Human
ugggcaccagauaugaccu

SEQ ID NO: 1143286 - RNA, 23 nt, Human
uuagaaauaccuuccucuguuuu

SEQ ID NO: 1143287 - RNA, 22 nt, Human
aaaaacauuaaagcaaaccccc

SEQ ID NO: 1143288 - RNA, 22 nt, Human
aacauuaaagcaaacccccaaa

SEQ ID NO: 1143289 - RNA, 25 nt, Human
aacccccaaaaccccacaccgaaaa

SEQ ID NO: 1143290 - RNA, 19 nt, Human
aagaccccgugcugguuuc

SEQ ID NO: 1143291 - RNA, 18 nt, Human
aagcaaacccccaaaacc

SEQ ID NO: 1143292 - RNA, 20 nt, Human
aagcaaacccccaaaacccc

SEQ ID NO: 1143293 - RNA, 23 nt, Human
aagcaaacccccaaaaccccaca

SEQ ID NO: 1143294 - RNA, 22 nt, Human
acagagcguggcuguugagccc

SEQ ID NO: 1143295 - RNA, 23 nt, Human
acagagcguggcuguugagcccu

SEQ ID NO: 1143296 - RNA, 24 nt, Human
acccacucugccuaccucaaggcc

SEQ ID NO: 1143297 - RNA, 18 nt, Human
accgaaaacaaaggcuug

SEQ ID NO: 1143298 - RNA, 18 nt, Human
accguguucccuccugga

SEQ ID NO: 1143299 - RNA, 22 nt, Human
agaaacuggcagaauccgaccc

SEQ ID NO: 1143300 - RNA, 19 nt, Human
agcccugguagccacuccu

SEQ ID NO: 1143301 - RNA, 19 nt, Human
aggccaggcccaggcggcu

SEQ ID NO: 1143302 - RNA, 20 nt, Human
aggccccgagagcuggcuug

SEQ ID NO: 1143303 - RNA, 21 nt, Human
agugaagaaucaggagagcca

SEQ ID NO: 1143304 - RNA, 23 nt, Human
caaaauacaaagcccaacauuua

SEQ ID NO: 1143305 - RNA, 26 nt, Human
caacgccugaggaccagcacccaucu

SEQ ID NO: 1143306 - RNA, 19 nt, Human
cacuggaaaaaaggccccg

SEQ ID NO: 1143307 - RNA, 24 nt, Human
cacuggaaaaaaggccccgagagc

SEQ ID NO: 1143308 - RNA, 22 nt, Human
cagaagccugaggaugaccgug

SEQ ID NO: 1143309 - RNA, 19 nt, Human
cagaguagccaaaugggca

SEQ ID NO: 1143310 - RNA, 21 nt, Human
cagcagaguagccaaaugggc

SEQ ID NO: 1143311 - RNA, 25 nt, Human
caggcuggcucccaagcuuggugca

SEQ ID NO: 1143312 - RNA, 21 nt, Human
caugucuuugagcacuugaug

SEQ ID NO: 1143313 - RNA, 18 nt, Human
ccaaggguggggcugugu

SEQ ID NO: 1143314 - RNA, 21 nt, Human
ccaaggguggggcuguguggc

SEQ ID NO: 1143315 - RNA, 26 nt, Human
ccagcaguguccccaacgccugagga

SEQ ID NO: 1143316 - RNA, 22 nt, Human
cccaaaaccccacaccgaaaac

SEQ ID NO: 1143317 - RNA, 21 nt, Human
cccaacugccuuccuuucuug

SEQ ID NO: 1143318 - RNA, 20 nt, Human
cccacacagagagaggaggc

SEQ ID NO: 1143319 - RNA, 18 nt, Human
cccacaccgaaaacaaag

SEQ ID NO: 1143320 - RNA, 20 nt, Human
cccacaccgaaaacaaaggc

SEQ ID NO: 1143321 - RNA, 21 nt, Human
ccccacaccgaaaacaaaggc

SEQ ID NO: 1143322 - RNA, 24 nt, Human
ccccaucgacccagcagugucccc

SEQ ID NO: 1143323 - RNA, 23 nt, Human
cccccaaaaccccacaccgaaaa

SEQ ID NO: 1143324 - RNA, 24 nt, Human
cccccaaaaccccacaccgaaaac

SEQ ID NO: 1143325 - RNA, 28 nt, Human
cccccaaaaccccacaccgaaaacaaag

SEQ ID NO: 1143326 - RNA, 27 nt, Human
ccucucagcccaaggguggggcugugu

SEQ ID NO: 1143327 - RNA, 20 nt, Human
ccucugcggcugcaggaacu

SEQ ID NO: 1143328 - RNA, 18 nt, Human
cgcaccccagagugaaga

SEQ ID NO: 1143329 - RNA, 21 nt, Human
cgccacaacccacucugccua

SEQ ID NO: 1143330 - RNA, 22 nt, Human
cggcgcugagcucugcgcuguc

SEQ ID NO: 1143331 - RNA, 18 nt, Human
cuaaaaugccauuauucu

SEQ ID NO: 1143332 - RNA, 25 nt, Human
cucugcggcugcaggaaccccgcuc

SEQ ID NO: 1143333 - RNA, 21 nt, Human
cugcggugaagcaccugggcu

SEQ ID NO: 1143334 - RNA, 20 nt, Human
cuggaggggcuucccagguc

SEQ ID NO: 1143335 - RNA, 21 nt, Human
cuuggccaugaguccuuggcc

SEQ ID NO: 1143336 - RNA, 25 nt, Human
gaccccaucgacccagcaguguccc

SEQ ID NO: 1143337 - RNA, 18 nt, Human
gcaaacccccaaaacccc

SEQ ID NO: 1143338 - RNA, 19 nt, Human
gcaaacccccaaaacccca

SEQ ID NO: 1143339 - RNA, 21 nt, Human
gcagagcagaaacuggcagaa

SEQ ID NO: 1143340 - RNA, 20 nt, Human
gcagcagaguagccaaaugg

SEQ ID NO: 1143341 - RNA, 18 nt, Human
gcaggcuggcucccaagc

SEQ ID NO: 1143342 - RNA, 19 nt, Human
gucugcggugaagcaccug

SEQ ID NO: 1143343 - RNA, 23 nt, Human
gugaagcaccugggcucugggag

SEQ ID NO: 1143344 - RNA, 18 nt, Human
gugcucaauggcuugcgg

SEQ ID NO: 1143345 - RNA, 22 nt, Human
uaaagcaaacccccaaaacccc

SEQ ID NO: 1143346 - RNA, 23 nt, Human
uaagccaccguccuggucccaca

SEQ ID NO: 1143347 - RNA, 21 nt, Human
uccucucagcccaaggguggg

SEQ ID NO: 1143348 - RNA, 23 nt, Human
uccuuugcuggggcccaacugcc

SEQ ID NO: 1143349 - RNA, 18 nt, Human
ucgacccagcaguguccc

SEQ ID NO: 1143350 - RNA, 23 nt, Human
ucgccuguggggugaaugaaggu

SEQ ID NO: 1143351 - RNA, 21 nt, Human
ucuacggcccagucuuggaac

SEQ ID NO: 1143352 - RNA, 20 nt, Human
ucugcggugaagcaccuggg

SEQ ID NO: 1143353 - RNA, 18 nt, Human
ucugguuuucucacaacu

SEQ ID NO: 1143354 - RNA, 18 nt, Human
ucugugacaaggcacagg

SEQ ID NO: 1143355 - RNA, 22 nt, Human
ucuuuggcugcagagcagaaac

SEQ ID NO: 1143356 - RNA, 22 nt, Human
ugaagaacgcaccccagaguga

SEQ ID NO: 1143357 - RNA, 22 nt, Human
ugaauacuuaaguaccacugaa

SEQ ID NO: 1143358 - RNA, 18 nt, Human
ugagaugcuguucucccu

SEQ ID NO: 1143359 - RNA, 25 nt, Human
ugcagcagaguagccaaaugggcac

SEQ ID NO: 1143360 - RNA, 21 nt, Human
ugcggucugcggugaagcacc

SEQ ID NO: 1143361 - RNA, 18 nt, Human
ugcuggggcccaacugcc

SEQ ID NO: 1143362 - RNA, 23 nt, Human
ugcuggggcccaacugccuuccu

SEQ ID NO: 1143363 - RNA, 21 nt, Human
uggaaaaaaggccccgagagc

SEQ ID NO: 1143364 - RNA, 19 nt, Human
uggcagaauccgaccccau

SEQ ID NO: 1143365 - RNA, 22 nt, Human
uggcagagggagggaaaggccg

SEQ ID NO: 1143366 - RNA, 25 nt, Human
uggcaggcuggcucccaagcuuggu

SEQ ID NO: 1143367 - RNA, 22 nt, Human
uggccacugcuuugggugaugu

SEQ ID NO: 1143368 - RNA, 20 nt, Human
uggcugcagagcagaaacug

SEQ ID NO: 1143369 - RNA, 21 nt, Human
uuaaagcaaacccccaaaacc

SEQ ID NO: 1143370 - RNA, 25 nt, Human
uuaaagcaaacccccaaaaccccac

SEQ ID NO: 1143371 - RNA, 24 nt, Human
uucaaaaacauuaaagcaaacccc

SEQ ID NO: 1143372 - RNA, 21 nt, Human
uucuugguuguguuuccucca

SEQ ID NO: 1143373 - RNA, 21 nt, Human
uugcuggggcccaacugccuu

SEQ ID NO: 1143374 - RNA, 22 nt, Human
uugggugaugugcucaauggcu

SEQ ID NO: 1143375 - RNA, 19 nt, Human
aacaaggccucuguccaaa

SEQ ID NO: 1143376 - RNA, 21 nt, Human
aaccgaaggaaaagccuuagc

SEQ ID NO: 1143377 - RNA, 26 nt, Human
accgaaggaaaagccuuagccuuagc

SEQ ID NO: 1143378 - RNA, 23 nt, Human
agagggggaaagggagaacgaau

SEQ ID NO: 1143379 - RNA, 20 nt, Human
agcaaggagaguuggccuca

SEQ ID NO: 1143380 - RNA, 25 nt, Human
aggaaagcaaggaggcccaacuggc

SEQ ID NO: 1143381 - RNA, 24 nt, Human
aggcccaacuggccuggucuguaa

SEQ ID NO: 1143382 - RNA, 19 nt, Human
ccaacccggcccuggccac

SEQ ID NO: 1143383 - RNA, 18 nt, Human
ccagcagagaaggaaccg

SEQ ID NO: 1143384 - RNA, 19 nt, Human
cccagaucccccuccccaa

SEQ ID NO: 1143385 - RNA, 19 nt, Human
ccccagaucccccucccca

SEQ ID NO: 1143386 - RNA, 20 nt, Human
ccccagaucccccuccccaa

SEQ ID NO: 1143387 - RNA, 26 nt, Human
cccggcccuggccacgcgccgguucc

SEQ ID NO: 1143388 - RNA, 20 nt, Human
ccggcccuggccacgcgcgc

SEQ ID NO: 1143389 - RNA, 18 nt, Human
ccuuagccuuagccccag

SEQ ID NO: 1143390 - RNA, 18 nt, Human
cuguccaaaagggcagau

SEQ ID NO: 1143391 - RNA, 21 nt, Human
gaaaagccuuagccuuagccc

SEQ ID NO: 1143392 - RNA, 22 nt, Human
gaaacagaaaaauccagguacc

SEQ ID NO: 1143393 - RNA, 26 nt, Human
gagaaggaaccgaaggaaaagccuua

SEQ ID NO: 1143394 - RNA, 19 nt, Human
gcaaaugccccagccagga

SEQ ID NO: 1143395 - RNA, 24 nt, Human
gcagauccaacccggcccuggcca

SEQ ID NO: 1143396 - RNA, 19 nt, Human
gccccagaucccccucccc

SEQ ID NO: 1143397 - RNA, 18 nt, Human
ggagagagggggaaaggg

SEQ ID NO: 1143398 - RNA, 19 nt, Human
ggagcaagaaugagcggug

SEQ ID NO: 1143399 - RNA, 20 nt, Human
uagccccagaucccccuccc

SEQ ID NO: 1143400 - RNA, 24 nt, Human
uagccccagaucccccuccccaaa

SEQ ID NO: 1143401 - RNA, 22 nt, Human
uccaacccggcccuggccacgc

SEQ ID NO: 1143402 - RNA, 22 nt, Human
ucccccaacguggaagccuuaa

SEQ ID NO: 1143403 - RNA, 22 nt, Human
ucccucaggaggccuuccacuc

SEQ ID NO: 1143404 - RNA, 21 nt, Human
ucucuugguggcuucuggggc

SEQ ID NO: 1143405 - RNA, 22 nt, Human
ucucuugguggcuucuggggcc

SEQ ID NO: 1143406 - RNA, 21 nt, Human
ucugagcccuaacuaggcgac

SEQ ID NO: 1143407 - RNA, 20 nt, Human
ugcacugguacuuccgcacg

SEQ ID NO: 1143408 - RNA, 19 nt, Human
ugguacuuccgcacguuuc

SEQ ID NO: 1143409 - RNA, 23 nt, Human
ugguggcuucuggggccagcaga

SEQ ID NO: 1143410 - RNA, 22 nt, Human
uuccgcacguuucucacgggcu

SEQ ID NO: 1143411 - RNA, 24 nt, Human
uuccgcacguuucucacgggcuuc

SEQ ID NO: 1143412 - RNA, 22 nt, Human
aaaaaaaacagacuucugccca

SEQ ID NO: 1143413 - RNA, 25 nt, Human
aaaaaaaacagacuucugcccagaa

SEQ ID NO: 1143414 - RNA, 19 nt, Human
aaaacguauacccacggga

SEQ ID NO: 1143415 - RNA, 21 nt, Human
aaaccugcaguaaguuuccaa

SEQ ID NO: 1143416 - RNA, 22 nt, Human
aaauggaaugaaaaccaacacc

SEQ ID NO: 1143417 - RNA, 20 nt, Human
aacacagcuuuaaaaauaag

SEQ ID NO: 1143418 - RNA, 23 nt, Human
aacaugcucgucgaaauggaaug

SEQ ID NO: 1143419 - RNA, 24 nt, Human
aaccugcaguaaguuuccaaaaag

SEQ ID NO: 1143420 - RNA, 19 nt, Human
aagaaggggaaacggcaga

SEQ ID NO: 1143421 - RNA, 23 nt, Human
aagacgcaaaaauagucugaaau

SEQ ID NO: 1143422 - RNA, 23 nt, Human
aagccugcaaccagaaaagccag

SEQ ID NO: 1143423 - RNA, 18 nt, Human
aaugaaaaaaaacagacu

SEQ ID NO: 1143424 - RNA, 25 nt, Human
aaugaaaaaaaacagacuucugccc

SEQ ID NO: 1143425 - RNA, 28 nt, Human
acacagcuuuaaaaauaaggggaacgcc

SEQ ID NO: 1143426 - RNA, 20 nt, Human
acacuggaccaaaucuaugc

SEQ ID NO: 1143427 - RNA, 23 nt, Human
acuaaaaugcaggaggccaagca

SEQ ID NO: 1143428 - RNA, 18 nt, Human
agacauccagucaucgcu

SEQ ID NO: 1143429 - RNA, 19 nt, Human
agacauuuggcucaguuga

SEQ ID NO: 1143430 - RNA, 18 nt, Human
agcuggaugcugcagcug

SEQ ID NO: 1143431 - RNA, 21 nt, Human
aggaaaaagugaauaugcaau

SEQ ID NO: 1143432 - RNA, 20 nt, Human
aggccaagcaaauggccauc

SEQ ID NO: 1143433 - RNA, 23 nt, Human
agugaugaggaaagacgcaaaaa

SEQ ID NO: 1143434 - RNA, 22 nt, Human
aguuacagaguucacagaauug

SEQ ID NO: 1143435 - RNA, 19 nt, Human
aucugcugccucugaaaug

SEQ ID NO: 1143436 - RNA, 25 nt, Human
caaaaagugaugaggaaagacgcaa

SEQ ID NO: 1143437 - RNA, 24 nt, Human
caaaaccugcaguaaguuuccaaa

SEQ ID NO: 1143438 - RNA, 23 nt, Human
caaccagaaaagccagcagcaca

SEQ ID NO: 1143439 - RNA, 20 nt, Human
caagauacaggcagauauua

SEQ ID NO: 1143440 - RNA, 23 nt, Human
cacaaaaccugcaguaaguuucc

SEQ ID NO: 1143441 - RNA, 25 nt, Human
cacagaauugucuucccuccucacu

SEQ ID NO: 1143442 - RNA, 18 nt, Human
caccaaaugcuucccagu

SEQ ID NO: 1143443 - RNA, 24 nt, Human
cacuacauggcuggggucacaagu

SEQ ID NO: 1143444 - RNA, 22 nt, Human
cacugcacucauaaggagcagg

SEQ ID NO: 1143445 - RNA, 19 nt, Human
cacuggaccaaaucuaugc

SEQ ID NO: 1143446 - RNA, 24 nt, Human
cagaagcccugccccaggccugug

SEQ ID NO: 1143447 - RNA, 19 nt, Human
cagcagcacaaaggggcgu

SEQ ID NO: 1143448 - RNA, 18 nt, Human
caguguguggcuuccuuc

SEQ ID NO: 1143449 - RNA, 20 nt, Human
cauuaagaaggggaaacggc

SEQ ID NO: 1143450 - RNA, 21 nt, Human
ccaaggagauucuuggggaaa

SEQ ID NO: 1143451 - RNA, 21 nt, Human
ccacugcacucauaaggagca

SEQ ID NO: 1143452 - RNA, 22 nt, Human
ccagaaaagccagcagcacaaa

SEQ ID NO: 1143453 - RNA, 24 nt, Human
ccaucagaagcccugccccaggcc

SEQ ID NO: 1143454 - RNA, 24 nt, Human
cccugccccaggccugugccaauu

SEQ ID NO: 1143455 - RNA, 20 nt, Human
ccgcaacccccacccccaaa

SEQ ID NO: 1143456 - RNA, 21 nt, Human
ccugcaaccagaaaagccagc

SEQ ID NO: 1143457 - RNA, 19 nt, Human
ccugugaccaugggaaagc

SEQ ID NO: 1143458 - RNA, 19 nt, Human
cuccgcaacccccaccccc

SEQ ID NO: 1143459 - RNA, 22 nt, Human
cugcugccucugaaaugacuga

SEQ ID NO: 1143460 - RNA, 23 nt, Human
cuggaaaaaugaaaaaaaacaga

SEQ ID NO: 1143461 - RNA, 21 nt, Human
cuggaugcugcagcuggacuc

SEQ ID NO: 1143462 - RNA, 23 nt, Human
cuggugccaacagccuggucuuu

SEQ ID NO: 1143463 - RNA, 21 nt, Human
gaaaagccagcagcacaaagg

SEQ ID NO: 1143464 - RNA, 21 nt, Human
gaauuuuaaacuugauuucuc

SEQ ID NO: 1143465 - RNA, 23 nt, Human
gacacuuuuuacaaaccucacau

SEQ ID NO: 1143466 - RNA, 22 nt, Human
gaccaugggaaagccugcaacc

SEQ ID NO: 1143467 - RNA, 25 nt, Human
gagcuccaacacagcuuuaaaaaua

SEQ ID NO: 1143468 - RNA, 18 nt, Human
gcacaaaaccugcaguaa

SEQ ID NO: 1143469 - RNA, 18 nt, Human
gcacagagaaagagcacc

SEQ ID NO: 1143470 - RNA, 18 nt, Human
gccuggaggccgccaggc

SEQ ID NO: 1143471 - RNA, 22 nt, Human
ggaaaaagugaauaugcaauau

SEQ ID NO: 1143472 - RNA, 21 nt, Human
ggacuaaaaugcaggaggcca

SEQ ID NO: 1143473 - RNA, 19 nt, Human
ggagauucuuggggaaagg

SEQ ID NO: 1143474 - RNA, 21 nt, Human
gggcaaaacacuaguuggugg

SEQ ID NO: 1143475 - RNA, 19 nt, Human
guucugacucaauuucacu

SEQ ID NO: 1143476 - RNA, 19 nt, Human
uaaaggaaacacaauugca

SEQ ID NO: 1143477 - RNA, 18 nt, Human
uaagaguauuuggauuga

SEQ ID NO: 1143478 - RNA, 25 nt, Human
uaaggagcaggcacagagaaagagc

SEQ ID NO: 1143479 - RNA, 21 nt, Human
uaaguaauaugaccuacgaau

SEQ ID NO: 1143480 - RNA, 22 nt, Human
uaaguucuggugccaacagccu

SEQ ID NO: 1143481 - RNA, 19 nt, Human
uacauggcuggggucacaa

SEQ ID NO: 1143482 - RNA, 22 nt, Human
uacauuaagaaggggaaacggc

SEQ ID NO: 1143483 - RNA, 24 nt, Human
uacauuaagaaggggaaacggcca

SEQ ID NO: 1143484 - RNA, 19 nt, Human
uaugcaauauauacauaua

SEQ ID NO: 1143485 - RNA, 23 nt, Human
uauucuucuauggugcuggugga

SEQ ID NO: 1143486 - RNA, 20 nt, Human
ucccugggcaucugcugccu

SEQ ID NO: 1143487 - RNA, 23 nt, Human
ucccugggcaucugcugccucug

SEQ ID NO: 1143488 - RNA, 20 nt, Human
uccgcaacccccacccccaa

SEQ ID NO: 1143489 - RNA, 22 nt, Human
uccgcaacccccacccccaaaa

SEQ ID NO: 1143490 - RNA, 22 nt, Human
uccuggaaaaaugaaaaaaaac

SEQ ID NO: 1143491 - RNA, 23 nt, Human
ucgaaauggaaugaaaaccaaca

SEQ ID NO: 1143492 - RNA, 23 nt, Human
ucuucuauggugcugguggaagu

SEQ ID NO: 1143493 - RNA, 24 nt, Human
ugaaaaaaaacagacuucugccca

SEQ ID NO: 1143494 - RNA, 19 nt, Human
ugacaauauccaacugucc

SEQ ID NO: 1143495 - RNA, 18 nt, Human
ugacagugcauccuguga

SEQ ID NO: 1143496 - RNA, 20 nt, Human
ugagcuggaugcugcagcug

SEQ ID NO: 1143497 - RNA, 20 nt, Human
ugauaaguaauaugaccuac

SEQ ID NO: 1143498 - RNA, 18 nt, Human
ugauuucuccgcaacccc

SEQ ID NO: 1143499 - RNA, 22 nt, Human
uggaaaaaugaaaaaaaacaga

SEQ ID NO: 1143500 - RNA, 19 nt, Human
uggaaugaaaaccaacacc

SEQ ID NO: 1143501 - RNA, 22 nt, Human
uggcucaguugauaaguaauau

SEQ ID NO: 1143502 - RNA, 19 nt, Human
ugucaaggcacaaaaccug

SEQ ID NO: 1143503 - RNA, 23 nt, Human
uguccuggaaaaaugaaaaaaaa

SEQ ID NO: 1143504 - RNA, 18 nt, Human
uuaauacuccuacaauuc

SEQ ID NO: 1143505 - RNA, 20 nt, Human
uuacaagguaaaggaaacac

SEQ ID NO: 1143506 - RNA, 25 nt, Human
uucacuuuaucaugaaaauacacug

SEQ ID NO: 1143507 - RNA, 18 nt, Human
uugucaaggcacaaaacc

SEQ ID NO: 1143508 - RNA, 19 nt, Human
uuuaaaaauaagucaaagu

SEQ ID NO: 1143509 - RNA, 21 nt, Human
uuuaaacuugauuucuccgca

SEQ ID NO: 1143510 - RNA, 20 nt, Human
uuuaauacuccuacaauuca

SEQ ID NO: 1143511 - RNA, 21 nt, Human
uuucuugggucucccugggca

SEQ ID NO: 1143512 - RNA, 25 nt, Human
uuuuaaacuugauuucuccgcaacc

SEQ ID NO: 1143513 - RNA, 19 nt, Human
aagcagacagaaagaaucu

SEQ ID NO: 1143514 - RNA, 20 nt, Human
acagaaagaaucuuuuugau

SEQ ID NO: 1143515 - RNA, 19 nt, Human
cuuuuugaugucgauguuc

SEQ ID NO: 1143516 - RNA, 23 nt, Human
ggaggucuguguuucuccuuucu

SEQ ID NO: 1143517 - RNA, 24 nt, Human
uaugcuguauuguuuuuauuugua

SEQ ID NO: 1143518 - RNA, 24 nt, Human
uggauacagagggccaacuguauu

SEQ ID NO: 1143519 - RNA, 20 nt, Human
uggauguggaacccauggau

SEQ ID NO: 1143520 - RNA, 24 nt, Human
ugugaauaagcagacagaaagaau

SEQ ID NO: 1143521 - RNA, 24 nt, Human
accuuccacauagaaagcuuugac

SEQ ID NO: 1143522 - RNA, 19 nt, Human
agagacauauauggucccu

SEQ ID NO: 1143523 - RNA, 18 nt, Human
agaggguggcacuggugu

SEQ ID NO: 1143524 - RNA, 23 nt, Human
agcugucaucuggccccagccuc

SEQ ID NO: 1143525 - RNA, 18 nt, Human
aggugguucuugcucagg

SEQ ID NO: 1143526 - RNA, 21 nt, Human
caaagugucugucgaacccuu

SEQ ID NO: 1143527 - RNA, 23 nt, Human
caaguucuugucauagcaaaaca

SEQ ID NO: 1143528 - RNA, 19 nt, Human
cacgcagacuagagaugcu

SEQ ID NO: 1143529 - RNA, 18 nt, Human
cagagaugauauuuuucc

SEQ ID NO: 1143530 - RNA, 18 nt, Human
caggaaugcugcaguggu

SEQ ID NO: 1143531 - RNA, 26 nt, Human
cagucaccuuccacauagaaagcuuu

SEQ ID NO: 1143532 - RNA, 18 nt, Human
cauguuacucaagcuaug

SEQ ID NO: 1143533 - RNA, 24 nt, Human
cucaaagugucugucgaacccuua

SEQ ID NO: 1143534 - RNA, 23 nt, Human
cuggaguccaagcucacaugucu

SEQ ID NO: 1143535 - RNA, 20 nt, Human
gaagagaggcugacagagug

SEQ ID NO: 1143536 - RNA, 18 nt, Human
gauuucacaaaucacaug

SEQ ID NO: 1143537 - RNA, 20 nt, Human
gcagacuagagaugcucucu

SEQ ID NO: 1143538 - RNA, 24 nt, Human
ggagagaagcuguccaaugcaacg

SEQ ID NO: 1143539 - RNA, 21 nt, Human
uacuugcucaauuaggaugga

SEQ ID NO: 1143540 - RNA, 25 nt, Human
uagguuuuuacauaguuugaaguuc

SEQ ID NO: 1143541 - RNA, 18 nt, Human
uauuagucacggggugag

SEQ ID NO: 1143542 - RNA, 21 nt, Human
ucacaggcucgccuugucuug

SEQ ID NO: 1143543 - RNA, 22 nt, Human
ucacauucuugagagggggaag

SEQ ID NO: 1143544 - RNA, 22 nt, Human
ucccucacuagcugucaucugg

SEQ ID NO: 1143545 - RNA, 20 nt, Human
ucgaagagaggcugacagag

SEQ ID NO: 1143546 - RNA, 21 nt, Human
ucgaagagaggcugacagagu

SEQ ID NO: 1143547 - RNA, 20 nt, Human
ucucgcucugucacaggcuc

SEQ ID NO: 1143548 - RNA, 18 nt, Human
ucugcucccucacuagcu

SEQ ID NO: 1143549 - RNA, 22 nt, Human
ugagacagggucucgcucuguc

SEQ ID NO: 1143550 - RNA, 21 nt, Human
ugagagggggaaggacuacag

SEQ ID NO: 1143551 - RNA, 21 nt, Human
ugucacaggcucgccuugucu

SEQ ID NO: 1143552 - RNA, 20 nt, Human
ugucuugucucugcucccuc

SEQ ID NO: 1143553 - RNA, 21 nt, Human
uguggagagcgaagccucauu

SEQ ID NO: 1143554 - RNA, 22 nt, Human
uguuacucaagcuauggccaug

SEQ ID NO: 1143555 - RNA, 19 nt, Human
uuagucacggggugaguga

SEQ ID NO: 1143556 - RNA, 21 nt, Human
uuagucacggggugagugagu

SEQ ID NO: 1143557 - RNA, 20 nt, Human
uuccaaguuccauaauguca

SEQ ID NO: 1143558 - RNA, 22 nt, Human
uugagacagggucucgcucugu

SEQ ID NO: 1143559 - RNA, 23 nt, Human
uugucauagcaaaacauguuacu

SEQ ID NO: 1143560 - RNA, 19 nt, Human
uuuccuagguucacaaugc

SEQ ID NO: 1143561 - RNA, 23 nt, Human
uuuuguuuuuugagacagggucu

SEQ ID NO: 1143562 - RNA, 21 nt, Human
uuuuuguuuuuugagacaggg

SEQ ID NO: 1143563 - RNA, 24 nt, Human
uuuuuguuuuuugagacagggucu

SEQ ID NO: 1143564 - RNA, 23 nt, Human
aaccacaaggcaggggucaagac

SEQ ID NO: 1143565 - RNA, 23 nt, Human
agcugucaucuggccccagccuc

SEQ ID NO: 1143566 - RNA, 20 nt, Human
caggaagaacccaggcagag

SEQ ID NO: 1143567 - RNA, 21 nt, Human
cccccaggacagaccgaagug

SEQ ID NO: 1143568 - RNA, 23 nt, Human
cccccaggacagaccgaaguggg

SEQ ID NO: 1143569 - RNA, 20 nt, Human
ccccccaggacagaccgaag

SEQ ID NO: 1143570 - RNA, 21 nt, Human
ccccccaggacagaccgaagu

SEQ ID NO: 1143571 - RNA, 22 nt, Human
ccuaucccacaucaaccacaag

SEQ ID NO: 1143572 - RNA, 20 nt, Human
ccugaggcuucacgggaagg

SEQ ID NO: 1143573 - RNA, 23 nt, Human
cuggaguccaagcucacaugucu

SEQ ID NO: 1143574 - RNA, 20 nt, Human
cuggccccagccuccucacc

SEQ ID NO: 1143575 - RNA, 23 nt, Human
ggacaggggcgugagacccccca

SEQ ID NO: 1143576 - RNA, 24 nt, Human
ggccccagccuccucaccugcugg

SEQ ID NO: 1143577 - RNA, 20 nt, Human
gggagcuuucucuugugucu

SEQ ID NO: 1143578 - RNA, 19 nt, Human
ucacaggcucgccuugucu

SEQ ID NO: 1143579 - RNA, 21 nt, Human
ucaucuggccccagccuccuc

SEQ ID NO: 1143580 - RNA, 22 nt, Human
ucccucacuagcugucaucugg

SEQ ID NO: 1143581 - RNA, 21 nt, Human
ucucgcucugucacaggcucg

SEQ ID NO: 1143582 - RNA, 19 nt, Human
ucucuaggaggacaggggc

SEQ ID NO: 1143583 - RNA, 22 nt, Human
ugagacagggucucgcucuguc

SEQ ID NO: 1143584 - RNA, 21 nt, Human
ugucacaggcucgccuugucu

SEQ ID NO: 1143585 - RNA, 20 nt, Human
ugucuugucucugcucccuc

SEQ ID NO: 1143586 - RNA, 20 nt, Human
uuagaaucaccccuccucau

SEQ ID NO: 1143587 - RNA, 22 nt, Human
uugagacagggucucgcucugu

SEQ ID NO: 1143588 - RNA, 23 nt, Human
uuuuguuuuuugagacagggucu

SEQ ID NO: 1143589 - RNA, 21 nt, Human
uuuuuguuuuuugagacaggg

SEQ ID NO: 1143590 - RNA, 24 nt, Human
uuuuuguuuuuugagacagggucu

SEQ ID NO: 1143591 - RNA, 24 nt, Human
aaaaaaaaauuaacuuagacaaaa

SEQ ID NO: 1143592 - RNA, 23 nt, Human
aaaaaaagaaaaaaggaauagaa

SEQ ID NO: 1143593 - RNA, 24 nt, Human
aaaaaagaaaaaaggaauagaagg

SEQ ID NO: 1143594 - RNA, 18 nt, Human
aaaaacaaaaagagagag

SEQ ID NO: 1143595 - RNA, 19 nt, Human
aaaaagaaaaaaggaauag

SEQ ID NO: 1143596 - RNA, 20 nt, Human
aaaaaugaaaaccauaucug

SEQ ID NO: 1143597 - RNA, 22 nt, Human
aaaacaacaacaacaacaaaac

SEQ ID NO: 1143598 - RNA, 18 nt, Human
aaaacacccagaacacau

SEQ ID NO: 1143599 - RNA, 22 nt, Human
aaaaccacaagacacucagaac

SEQ ID NO: 1143600 - RNA, 20 nt, Human
aaaagcccaggaaaucccag

SEQ ID NO: 1143601 - RNA, 23 nt, Human
aaaaugaaaauacaaaggaaagg

SEQ ID NO: 1143602 - RNA, 23 nt, Human
aaaauugcagaaaauuuuccuga

SEQ ID NO: 1143603 - RNA, 25 nt, Human
aaacaacaacaacaacaacaacaac

SEQ ID NO: 1143604 - RNA, 20 nt, Human
aaacacccagaacacauuca

SEQ ID NO: 1143605 - RNA, 23 nt, Human
aaacaggcaagaaaaagacaaaa

SEQ ID NO: 1143606 - RNA, 18 nt, Human
aaacauauccaaauacaa

SEQ ID NO: 1143607 - RNA, 22 nt, Human
aaacugaaaagcucuuagauau

SEQ ID NO: 1143608 - RNA, 21 nt, Human
aaagauugaaaccugggauaa

SEQ ID NO: 1143609 - RNA, 18 nt, Human
aaaggaagccaaugaaua

SEQ ID NO: 1143610 - RNA, 19 nt, Human
aacaacaacaaaaccagcc

SEQ ID NO: 1143611 - RNA, 22 nt, Human
aacaacaacaacaaaaccagcc

SEQ ID NO: 1143612 - RNA, 24 nt, Human
aacaacaacaacaaaaccagccuu

SEQ ID NO: 1143613 - RNA, 24 nt, Human
aacaacaacaacaacaacaacaac

SEQ ID NO: 1143614 - RNA, 24 nt, Human
aacaacaacaacaacaacaacaac

SEQ ID NO: 1143615 - RNA, 27 nt, Human
aacaacaacaacaacaacaacaacaac

SEQ ID NO: 1143616 - RNA, 20 nt, Human
aaccauauuuccaaacaucg

SEQ ID NO: 1143617 - RNA, 20 nt, Human
aagauaccaaaguaguuaca

SEQ ID NO: 1143618 - RNA, 19 nt, Human
aagcacagaagaaaaucua

SEQ ID NO: 1143619 - RNA, 20 nt, Human
aagcaguagaacuaaauuuu

SEQ ID NO: 1143620 - RNA, 19 nt, Human
aagcccaggaaaucccaga

SEQ ID NO: 1143621 - RNA, 18 nt, Human
aaggaaaauguaaaaaga

SEQ ID NO: 1143622 - RNA, 22 nt, Human
aagguaccauucucagccaaaa

SEQ ID NO: 1143623 - RNA, 19 nt, Human
aaggugagauuauugaaaa

SEQ ID NO: 1143624 - RNA, 20 nt, Human
aagugacccaucuccacacc

SEQ ID NO: 1143625 - RNA, 24 nt, Human
aauaaaagcccaggaaaucccaga

SEQ ID NO: 1143626 - RNA, 24 nt, Human
aauaacauaaugaaaaauugagaa

SEQ ID NO: 1143627 - RNA, 19 nt, Human
aaucauucuucugagauuu

SEQ ID NO: 1143628 - RNA, 25 nt, Human
aauuccauuccuucaguaauuuaca

SEQ ID NO: 1143629 - RNA, 23 nt, Human
aauuuguaguaagaguuccccuu

SEQ ID NO: 1143630 - RNA, 20 nt, Human
acaaaugacaaugaagucau

SEQ ID NO: 1143631 - RNA, 18 nt, Human
acaacaacaaaaccagcc

SEQ ID NO: 1143632 - RNA, 21 nt, Human
acaacaacaacaacaaaacca

SEQ ID NO: 1143633 - RNA, 22 nt, Human
acaacaacaacaacaaaaccag

SEQ ID NO: 1143634 - RNA, 19 nt, Human
acaacaacaacaacaacaa

SEQ ID NO: 1143635 - RNA, 19 nt, Human
acaacaacaacaacaacaa

SEQ ID NO: 1143636 - RNA, 19 nt, Human
acaacaacaacaacaacaa

SEQ ID NO: 1143637 - RNA, 19 nt, Human
acaacaacaacaacaacaa

SEQ ID NO: 1143638 - RNA, 21 nt, Human
acaacaacaacaacaacaaaa

SEQ ID NO: 1143639 - RNA, 22 nt, Human
acaacaacaacaacaacaacaa

SEQ ID NO: 1143640 - RNA, 22 nt, Human
acaacaacaacaacaacaacaa

SEQ ID NO: 1143641 - RNA, 22 nt, Human
acaacaacaacaacaacaacaa

SEQ ID NO: 1143642 - RNA, 24 nt, Human
acaacaacaacaacaacaacaaaa

SEQ ID NO: 1143643 - RNA, 21 nt, Human
acauuuauaaaacucugucuu

SEQ ID NO: 1143644 - RNA, 21 nt, Human
accaaaaacaacaacaacaac

SEQ ID NO: 1143645 - RNA, 22 nt, Human
acccaaacugggcaggagccca

SEQ ID NO: 1143646 - RNA, 23 nt, Human
acccgugccuguugccaaaacag

SEQ ID NO: 1143647 - RNA, 18 nt, Human
accugggauaaaaagcuc

SEQ ID NO: 1143648 - RNA, 19 nt, Human
acugaaaacucacuagggu

SEQ ID NO: 1143649 - RNA, 24 nt, Human
agaaaaagacaaaaucugucuuca

SEQ ID NO: 1143650 - RNA, 19 nt, Human
agaaaagagaaauagccaa

SEQ ID NO: 1143651 - RNA, 20 nt, Human
agaaaagagaaauagccaau

SEQ ID NO: 1143652 - RNA, 24 nt, Human
agaagaaaaaacacauaaaacggu

SEQ ID NO: 1143653 - RNA, 21 nt, Human
agaagaaaaucuagaggcaau

SEQ ID NO: 1143654 - RNA, 21 nt, Human
agacaaacauauccaaauaca

SEQ ID NO: 1143655 - RNA, 22 nt, Human
agagagaagcacagaagaaaau

SEQ ID NO: 1143656 - RNA, 23 nt, Human
agagagaagcacagaagaaaauc

SEQ ID NO: 1143657 - RNA, 20 nt, Human
agaguuccccuugacuuucc

SEQ ID NO: 1143658 - RNA, 20 nt, Human
agauuauaucugugaaaccu

SEQ ID NO: 1143659 - RNA, 19 nt, Human
agcaaucucagaggaaaac

SEQ ID NO: 1143660 - RNA, 22 nt, Human
agcauuaucgccugagcucugc

SEQ ID NO: 1143661 - RNA, 21 nt, Human
aggagaaaggaaauugacugg

SEQ ID NO: 1143662 - RNA, 25 nt, Human
aggcaagaaaaagacaaaagggacc

SEQ ID NO: 1143663 - RNA, 23 nt, Human
aggcaagaaaaagacaaaaucug

SEQ ID NO: 1143664 - RNA, 19 nt, Human
agggaaaaaugaaaauaca

SEQ ID NO: 1143665 - RNA, 23 nt, Human
agguagccauuugcacuaauagg

SEQ ID NO: 1143666 - RNA, 20 nt, Human
aggugcuuucucuaaaacag

SEQ ID NO: 1143667 - RNA, 24 nt, Human
auagaauacuaaggcuaauguggg

SEQ ID NO: 1143668 - RNA, 20 nt, Human
auaggccgcccaaaugucaa

SEQ ID NO: 1143669 - RNA, 19 nt, Human
auauauuugugccugagau

SEQ ID NO: 1143670 - RNA, 20 nt, Human
aucacucuuguuccucuccu

SEQ ID NO: 1143671 - RNA, 21 nt, Human
auccaaauacaaaauauuucu

SEQ ID NO: 1143672 - RNA, 18 nt, Human
auccaccuccucccuguu

SEQ ID NO: 1143673 - RNA, 23 nt, Human
aucugaaaaccauucccccaccc

SEQ ID NO: 1143674 - RNA, 21 nt, Human
aucuugggcaggauguagauu

SEQ ID NO: 1143675 - RNA, 23 nt, Human
augacaaugaagucauugcgguc

SEQ ID NO: 1143676 - RNA, 24 nt, Human
augagaaucagagaguauuaaaac

SEQ ID NO: 1143677 - RNA, 18 nt, Human
auuuuuuuguuuguuugu

SEQ ID NO: 1143678 - RNA, 26 nt, Human
caaaaagaaauuaaaaacguuuauac

SEQ ID NO: 1143679 - RNA, 20 nt, Human
caaaaauagauauaaaaaua

SEQ ID NO: 1143680 - RNA, 21 nt, Human
caaacacagaacuaagaauuu

SEQ ID NO: 1143681 - RNA, 21 nt, Human
caacaacaacaaaaccagccu

SEQ ID NO: 1143682 - RNA, 20 nt, Human
caacaacaacaacaaaacca

SEQ ID NO: 1143683 - RNA, 23 nt, Human
caacaacaacaacaacaacaaca

SEQ ID NO: 1143684 - RNA, 20 nt, Human
caaccccugggccacugacc

SEQ ID NO: 1143685 - RNA, 26 nt, Human
caagcaauaaucacuagcaauaacau

SEQ ID NO: 1143686 - RNA, 20 nt, Human
cacaguacccaaacugggca

SEQ ID NO: 1143687 - RNA, 22 nt, Human
cacaguacccaaacugggcagg

SEQ ID NO: 1143688 - RNA, 21 nt, Human
caccaaaaacaacaacaacaa

SEQ ID NO: 1143689 - RNA, 22 nt, Human
caccaaaaacaacaacaacaac

SEQ ID NO: 1143690 - RNA, 20 nt, Human
cacccagaacacauucacuc

SEQ ID NO: 1143691 - RNA, 26 nt, Human
cacccagaacacauucacucauccau

SEQ ID NO: 1143692 - RNA, 19 nt, Human
caccuggugucuuuuacug

SEQ ID NO: 1143693 - RNA, 23 nt, Human
cacuccccaccuaagacagucuc

SEQ ID NO: 1143694 - RNA, 21 nt, Human
cacucuaguuuuggcccugcu

SEQ ID NO: 1143695 - RNA, 22 nt, Human
cagagcagugguccccaacccc

SEQ ID NO: 1143696 - RNA, 20 nt, Human
cagcauaguuccuggaacaa

SEQ ID NO: 1143697 - RNA, 25 nt, Human
cagccaagaaugauuucucagauau

SEQ ID NO: 1143698 - RNA, 20 nt, Human
cagcuuccuaguccuucuca

SEQ ID NO: 1143699 - RNA, 22 nt, Human
caggaguucuuucuaucagcuu

SEQ ID NO: 1143700 - RNA, 27 nt, Human
caguuuuacccuccaauuuuaaucuua

SEQ ID NO: 1143701 - RNA, 18 nt, Human
caucaaaaaaagugugac

SEQ ID NO: 1143702 - RNA, 24 nt, Human
caucguccucaaggccagaaaucu

SEQ ID NO: 1143703 - RNA, 19 nt, Human
cauucuauaaaauuuagcu

SEQ ID NO: 1143704 - RNA, 21 nt, Human
ccaaccauauuuccaaacauc

SEQ ID NO: 1143705 - RNA, 21 nt, Human
ccaaccccugggccacugacc

SEQ ID NO: 1143706 - RNA, 21 nt, Human
ccagaacuuugggugccccua

SEQ ID NO: 1143707 - RNA, 25 nt, Human
ccagagcagauagagagaagcacag

SEQ ID NO: 1143708 - RNA, 20 nt, Human
ccaggaaaucccagaaaaga

SEQ ID NO: 1143709 - RNA, 20 nt, Human
cccaaccccugggccacuga

SEQ ID NO: 1143710 - RNA, 23 nt, Human
cccaaccccugggccacugacca

SEQ ID NO: 1143711 - RNA, 19 nt, Human
ccccacccucacccgugcc

SEQ ID NO: 1143712 - RNA, 19 nt, Human
ccccacccucacccgugcc

SEQ ID NO: 1143713 - RNA, 21 nt, Human
ccccacccucacccgugccug

SEQ ID NO: 1143714 - RNA, 19 nt, Human
ccccauauauauuugugcc

SEQ ID NO: 1143715 - RNA, 22 nt, Human
ccucaccaaaaacaacaacaac

SEQ ID NO: 1143716 - RNA, 23 nt, Human
ccucacccgugccuguugccaaa

SEQ ID NO: 1143717 - RNA, 23 nt, Human
ccuggaacaaaguacgcucugaa

SEQ ID NO: 1143718 - RNA, 22 nt, Human
ccuguugccaaaacaguugggg

SEQ ID NO: 1143719 - RNA, 19 nt, Human
cuaaucauucuucugagau

SEQ ID NO: 1143720 - RNA, 22 nt, Human
cuaccucuagauuuguggcccu

SEQ ID NO: 1143721 - RNA, 18 nt, Human
cuauaaaaacaaaaagag

SEQ ID NO: 1143722 - RNA, 22 nt, Human
cucuaaaacagaaaaauaagga

SEQ ID NO: 1143723 - RNA, 19 nt, Human
cugaaaaccauucccccac

SEQ ID NO: 1143724 - RNA, 25 nt, Human
cugaaauaaagauugaaaccuggga

SEQ ID NO: 1143725 - RNA, 26 nt, Human
cugagcaauuuuggagccugaggcag

SEQ ID NO: 1143726 - RNA, 24 nt, Human
cugggauuccccuauagaaacuaa

SEQ ID NO: 1143727 - RNA, 25 nt, Human
cugggugguagaauuuugagauugu

SEQ ID NO: 1143728 - RNA, 23 nt, Human
cuuucagccuuaaaauguguuga

SEQ ID NO: 1143729 - RNA, 27 nt, Human
gaaaagcucuuagauauuacauaaucc

SEQ ID NO: 1143730 - RNA, 22 nt, Human
gaaauaaagauugaaaccuggg

SEQ ID NO: 1143731 - RNA, 21 nt, Human
gaagaaaaaacacauaaaacg

SEQ ID NO: 1143732 - RNA, 21 nt, Human
gaagagaagaccauuaagaac

SEQ ID NO: 1143733 - RNA, 24 nt, Human
gaaucaauuuuaaauugggggguu

SEQ ID NO: 1143734 - RNA, 23 nt, Human
gaaucagagaguauuaaaacuga

SEQ ID NO: 1143735 - RNA, 18 nt, Human
gacccaucuccacaccug

SEQ ID NO: 1143736 - RNA, 19 nt, Human
gaggaaaacucugggauuc

SEQ ID NO: 1143737 - RNA, 19 nt, Human
gcaagaaaaagacaaaauc

SEQ ID NO: 1143738 - RNA, 22 nt, Human
gcauucacccuuaccuccaaac

SEQ ID NO: 1143739 - RNA, 18 nt, Human
gccaauuaacuacuauca

SEQ ID NO: 1143740 - RNA, 23 nt, Human
gccacaaauaaauuguuuaugcu

SEQ ID NO: 1143741 - RNA, 23 nt, Human
gcucugacucucuaaaucucuug

SEQ ID NO: 1143742 - RNA, 21 nt, Human
ggaacaauuucaucugaaaac

SEQ ID NO: 1143743 - RNA, 21 nt, Human
ggaauaccuagaaagacagcc

SEQ ID NO: 1143744 - RNA, 19 nt, Human
ggaguucuuucuaucagcu

SEQ ID NO: 1143745 - RNA, 20 nt, Human
ggccaauagauuagcaaaga

SEQ ID NO: 1143746 - RNA, 21 nt, Human
ggccagaaaucuauucacauu

SEQ ID NO: 1143747 - RNA, 19 nt, Human
gggaagggggugggacuac

SEQ ID NO: 1143748 - RNA, 19 nt, Human
guaaagcccaagagggaaa

SEQ ID NO: 1143749 - RNA, 27 nt, Human
guagcaguuaguggccaacauggaaga

SEQ ID NO: 1143750 - RNA, 20 nt, Human
gucuuagagagguuaagaga

SEQ ID NO: 1143751 - RNA, 19 nt, Human
gugacucuacucucuaccu

SEQ ID NO: 1143752 - RNA, 23 nt, Human
gugaguggcacccauugagcauu

SEQ ID NO: 1143753 - RNA, 19 nt, Human
guggccaacauggacugca

SEQ ID NO: 1143754 - RNA, 23 nt, Human
gugggaauggaggcuauaagaac

SEQ ID NO: 1143755 - RNA, 18 nt, Human
guuuaaugcuugauucca

SEQ ID NO: 1143756 - RNA, 20 nt, Human
guuuccagcauaguuccugg

SEQ ID NO: 1143757 - RNA, 18 nt, Human
uaaaacacccagaacaca

SEQ ID NO: 1143758 - RNA, 23 nt, Human
uaaaacacccagaacacauucac

SEQ ID NO: 1143759 - RNA, 21 nt, Human
uaaaagaguuauauaaaggua

SEQ ID NO: 1143760 - RNA, 21 nt, Human
uaaacaggcaagaaaaagacu

SEQ ID NO: 1143761 - RNA, 22 nt, Human
uaaagaaaguaaaacagagagu

SEQ ID NO: 1143762 - RNA, 22 nt, Human
uaacauaaagaaaguaaaacag

SEQ ID NO: 1143763 - RNA, 19 nt, Human
uaaccagaacuuugggugc

SEQ ID NO: 1143764 - RNA, 19 nt, Human
uaaguagguagccauuugc

SEQ ID NO: 1143765 - RNA, 20 nt, Human
uaaguagguagccauuugca

SEQ ID NO: 1143766 - RNA, 21 nt, Human
uaagugacccaucuccacacc

SEQ ID NO: 1143767 - RNA, 24 nt, Human
uaauaaauuaacauugggauagaa

SEQ ID NO: 1143768 - RNA, 18 nt, Human
uaauguggggaagggggu

SEQ ID NO: 1143769 - RNA, 23 nt, Human
uaauuuacacaaaacucuuccua

SEQ ID NO: 1143770 - RNA, 22 nt, Human
uacaaaauauuucugauuucug

SEQ ID NO: 1143771 - RNA, 19 nt, Human
uacacaaaacucuuccuaa

SEQ ID NO: 1143772 - RNA, 21 nt, Human
uacacgacugaaaaguaaagc

SEQ ID NO: 1143773 - RNA, 19 nt, Human
uaccucuagauuuguggcc

SEQ ID NO: 1143774 - RNA, 26 nt, Human
uacuaccaaggaaaauguaaaaagaa

SEQ ID NO: 1143775 - RNA, 18 nt, Human
uacuauauacuuccgaau

SEQ ID NO: 1143776 - RNA, 22 nt, Human
uagaaggcaaaguuuaagacag

SEQ ID NO: 1143777 - RNA, 24 nt, Human
uagaauaaucacaacugaaaacuc

SEQ ID NO: 1143778 - RNA, 21 nt, Human
uagauuagcaaagaguaagag

SEQ ID NO: 1143779 - RNA, 23 nt, Human
uagcaaagaguaagaguuccuca

SEQ ID NO: 1143780 - RNA, 21 nt, Human
uaggagggcaugcaagguugu

SEQ ID NO: 1143781 - RNA, 22 nt, Human
uaggccaauagauuagcaaaga

SEQ ID NO: 1143782 - RNA, 21 nt, Human
uagggaaaccuuaguuugaag

SEQ ID NO: 1143783 - RNA, 21 nt, Human
uauagagacaaaagggauuug

SEQ ID NO: 1143784 - RNA, 20 nt, Human
uauauacauauauacaggug

SEQ ID NO: 1143785 - RNA, 23 nt, Human
uaucauuauccugcgauguuuca

SEQ ID NO: 1143786 - RNA, 30 nt, Human
uauccugcgauguuucaaacaaagauuggg

SEQ ID NO: 1143787 - RNA, 27 nt, Human
uaugagaaucagagaguauuaaaacug

SEQ ID NO: 1143788 - RNA, 25 nt, Human
uauggaauaccuagaaagacagcca

SEQ ID NO: 1143789 - RNA, 20 nt, Human
uauguauaugcacaagugca

SEQ ID NO: 1143790 - RNA, 23 nt, Human
uauuaaauauauacauauauaca

SEQ ID NO: 1143791 - RNA, 20 nt, Human
uauuucugauuucugggugg

SEQ ID NO: 1143792 - RNA, 23 nt, Human
ucacuuuuacaaaugacaaugaa

SEQ ID NO: 1143793 - RNA, 21 nt, Human
ucagcacaguacccaaacugg

SEQ ID NO: 1143794 - RNA, 19 nt, Human
ucagguaucaaaaacaacc

SEQ ID NO: 1143795 - RNA, 23 nt, Human
ucaucugaaaaccauucccccac

SEQ ID NO: 1143796 - RNA, 19 nt, Human
uccaaaaauaacauaauga

SEQ ID NO: 1143797 - RNA, 18 nt, Human
uccaaacacagaacuaag

SEQ ID NO: 1143798 - RNA, 20 nt, Human
uccaaauacaaaauauuucu

SEQ ID NO: 1143799 - RNA, 19 nt, Human
uccaccucuaucuagauca

SEQ ID NO: 1143800 - RNA, 20 nt, Human
uccagagcagauagagagaa

SEQ ID NO: 1143801 - RNA, 21 nt, Human
ucccagaaaagagaaauagcc

SEQ ID NO: 1143802 - RNA, 23 nt, Human
uccccuauagaaacuaaagaagc

SEQ ID NO: 1143803 - RNA, 21 nt, Human
uccucaaggccagaaaucuau

SEQ ID NO: 1143804 - RNA, 18 nt, Human
uccucaucucuucuccug

SEQ ID NO: 1143805 - RNA, 24 nt, Human
ucguccucaaggccagaaaucuau

SEQ ID NO: 1143806 - RNA, 19 nt, Human
ucuaaaacagaaaaauaag

SEQ ID NO: 1143807 - RNA, 25 nt, Human
ucuaaaacagaaaaauaaggauguu

SEQ ID NO: 1143808 - RNA, 22 nt, Human
ucuacaaugucuaucuuuaaca

SEQ ID NO: 1143809 - RNA, 19 nt, Human
ucuagguuuaaugcuugau

SEQ ID NO: 1143810 - RNA, 21 nt, Human
ucucuaaaacagaaaaauaag

SEQ ID NO: 1143811 - RNA, 18 nt, Human
ucucuugcuuuaaagaag

SEQ ID NO: 1143812 - RNA, 21 nt, Human
ucugauagacuauauuugaga

SEQ ID NO: 1143813 - RNA, 18 nt, Human
ucuguccuuucucauucu

SEQ ID NO: 1143814 - RNA, 22 nt, Human
ucugugaaaccuucucugcuau

SEQ ID NO: 1143815 - RNA, 25 nt, Human
ucuuaaaaaaaaaaaauuaacuuag

SEQ ID NO: 1143816 - RNA, 21 nt, Human
ucuuuaaagaauacagucuuc

SEQ ID NO: 1143817 - RNA, 22 nt, Human
ugaaaaggggucacuuuuaagg

SEQ ID NO: 1143818 - RNA, 24 nt, Human
ugaauaaccaaauaauuauuucuu

SEQ ID NO: 1143819 - RNA, 19 nt, Human
ugacauaauuggcauuucu

SEQ ID NO: 1143820 - RNA, 24 nt, Human
ugagauggaacaauuucaucugaa

SEQ ID NO: 1143821 - RNA, 23 nt, Human
ugagauuauugaaaaaugaccuu

SEQ ID NO: 1143822 - RNA, 25 nt, Human
ugagauuauugaaaaaugaccuuuc

SEQ ID NO: 1143823 - RNA, 24 nt, Human
ugauguauuuuuaaaccuucauau

SEQ ID NO: 1143824 - RNA, 22 nt, Human
ugauuccagugacaucugauau

SEQ ID NO: 1143825 - RNA, 21 nt, Human
ugcagaaaauuuuccugaaau

SEQ ID NO: 1143826 - RNA, 18 nt, Human
ugcauuaauuuugaguuu

SEQ ID NO: 1143827 - RNA, 25 nt, Human
ugcauucacccuuaccuccaaacac

SEQ ID NO: 1143828 - RNA, 22 nt, Human
ugcggucaaaaaaagaaaaaag

SEQ ID NO: 1143829 - RNA, 23 nt, Human
uggaacaaaguacgcucugaaua

SEQ ID NO: 1143830 - RNA, 23 nt, Human
uggcauuucuuaaaaaaaaaaaa

SEQ ID NO: 1143831 - RNA, 19 nt, Human
ugggaagauagaaauaaug

SEQ ID NO: 1143832 - RNA, 18 nt, Human
ugggauaaaaagcucuga

SEQ ID NO: 1143833 - RNA, 19 nt, Human
uggggaggugggcuugaaa

SEQ ID NO: 1143834 - RNA, 21 nt, Human
uggggaggugggcuugaaacc

SEQ ID NO: 1143835 - RNA, 22 nt, Human
ugggugccccuaaucauucuuu

SEQ ID NO: 1143836 - RNA, 19 nt, Human
uguaaacaggcaagaaaaa

SEQ ID NO: 1143837 - RNA, 20 nt, Human
uguaaacaggcaagaaaaag

SEQ ID NO: 1143838 - RNA, 23 nt, Human
uguaaacaggcaagaaaaagaca

SEQ ID NO: 1143839 - RNA, 21 nt, Human
ugucauguaacuucucuguga

SEQ ID NO: 1143840 - RNA, 21 nt, Human
ugugaacuacauaggccgccc

SEQ ID NO: 1143841 - RNA, 24 nt, Human
ugugaacuacauaggccgcccaaa

SEQ ID NO: 1143842 - RNA, 26 nt, Human
uguuccucuccuucaacaauguaauu

SEQ ID NO: 1143843 - RNA, 19 nt, Human
uuaaaaccacaagacacuc

SEQ ID NO: 1143844 - RNA, 18 nt, Human
uuaacauugggauagaaa

SEQ ID NO: 1143845 - RNA, 22 nt, Human
uucaugaaauaauuuaugauaa

SEQ ID NO: 1143846 - RNA, 23 nt, Human
uucccuggggaagaauauacuuu

SEQ ID NO: 1143847 - RNA, 21 nt, Human
uuccugaaauaaagauugaaa

SEQ ID NO: 1143848 - RNA, 20 nt, Human
uucuaucagcuuccuagucc

SEQ ID NO: 1143849 - RNA, 19 nt, Human
uucucugugacucauuuca

SEQ ID NO: 1143850 - RNA, 20 nt, Human
uugaaggacaggaaaauaua

SEQ ID NO: 1143851 - RNA, 26 nt, Human
uugaaggacaggaaaauauaaacagu

SEQ ID NO: 1143852 - RNA, 21 nt, Human
uuggaaguuacaaaauagaau

SEQ ID NO: 1143853 - RNA, 28 nt, Human
uugugguucaaaguauucaguguuuuuc

SEQ ID NO: 1143854 - RNA, 21 nt, Human
uuuaaaaauuuuccauuaaau

SEQ ID NO: 1143855 - RNA, 20 nt, Human
uuuaucuaaauggagagaug

SEQ ID NO: 1143856 - RNA, 18 nt, Human
uuucucauucuuuggcca

SEQ ID NO: 1143857 - RNA, 18 nt, Human
uuugaagguagggaaacc

SEQ ID NO: 1143858 - RNA, 23 nt, Human
uuuuugaagguagggaaaccuua

SEQ ID NO: 1143859 - RNA, 22 nt, Human
aaaaugcuucagagaguuacug

SEQ ID NO: 1143860 - RNA, 22 nt, Human
accagaaagacaucccaacaac

SEQ ID NO: 1143861 - RNA, 25 nt, Human
agaaagacaucccaacaacaugugu

SEQ ID NO: 1143862 - RNA, 18 nt, Human
agaagugcugaagguaug

SEQ ID NO: 1143863 - RNA, 18 nt, Human
agggcagcuucgcccaca

SEQ ID NO: 1143864 - RNA, 20 nt, Human
cagcaaagaccaguauggca

SEQ ID NO: 1143865 - RNA, 19 nt, Human
cccaggaggcugcacaggc

SEQ ID NO: 1143866 - RNA, 20 nt, Human
gcaaagaccaguauggcaca

SEQ ID NO: 1143867 - RNA, 20 nt, Human
gccgacaugguggggacugu

SEQ ID NO: 1143868 - RNA, 19 nt, Human
gccugagaaagaugcaagg

SEQ ID NO: 1143869 - RNA, 21 nt, Human
ggcugcagguccgguucgucu

SEQ ID NO: 1143870 - RNA, 22 nt, Human
uacuccaaauuaaaggaagauc

SEQ ID NO: 1143871 - RNA, 20 nt, Human
ucaaagacuuaaaggagauu

SEQ ID NO: 1143872 - RNA, 21 nt, Human
ucagggacgguuaucuuuucc

SEQ ID NO: 1143873 - RNA, 29 nt, Human
ucccaggaggcugcacaggcuagguuggg

SEQ ID NO: 1143874 - RNA, 20 nt, Human
uccuuagggcagcuucgccc

SEQ ID NO: 1143875 - RNA, 20 nt, Human
ugagaagugcugaagguaug

SEQ ID NO: 1143876 - RNA, 24 nt, Human
uggggcaccagaaagacuggagac

SEQ ID NO: 1143877 - RNA, 24 nt, Human
uugcuguucaugguggcugcaggu

SEQ ID NO: 1143878 - RNA, 20 nt, Human
ccgggagccuguugauuugg

SEQ ID NO: 1143879 - RNA, 22 nt, Human
ccuuccacgcuauuccggaacc

SEQ ID NO: 1143880 - RNA, 22 nt, Human
agaaaguugcaccuuggccucc

SEQ ID NO: 1143881 - RNA, 28 nt, Human
caaaugauccuuuauugaaauauuuucc

SEQ ID NO: 1143882 - RNA, 18 nt, Human
cgaccgaagaaaguugca

SEQ ID NO: 1143883 - RNA, 24 nt, Human
aaacagaaacuuauuucuucuagu

SEQ ID NO: 1143884 - RNA, 21 nt, Human
aaacugggucauguagaaaaa

SEQ ID NO: 1143885 - RNA, 19 nt, Human
aacccaugacaaaagucca

SEQ ID NO: 1143886 - RNA, 18 nt, Human
aaccugaucauaucugca

SEQ ID NO: 1143887 - RNA, 24 nt, Human
aaguuuugacagaagcauucaaac

SEQ ID NO: 1143888 - RNA, 18 nt, Human
acaucccugggaggggag

SEQ ID NO: 1143889 - RNA, 21 nt, Human
aggacaauuaaagaaagcauc

SEQ ID NO: 1143890 - RNA, 20 nt, Human
aggaggggcaaaaaggggug

SEQ ID NO: 1143891 - RNA, 21 nt, Human
aggggcaggaggggcaaaaag

SEQ ID NO: 1143892 - RNA, 24 nt, Human
auguagaaaaaacagaaacuuauu

SEQ ID NO: 1143893 - RNA, 23 nt, Human
caaaaguccacacauacuuccug

SEQ ID NO: 1143894 - RNA, 22 nt, Human
caaaccacagcggucacauuca

SEQ ID NO: 1143895 - RNA, 18 nt, Human
cacuucagucuccgcccc

SEQ ID NO: 1143896 - RNA, 23 nt, Human
cagauaaugcagccucggcgucc

SEQ ID NO: 1143897 - RNA, 23 nt, Human
cagcacgcuuuucugucuaaccu

SEQ ID NO: 1143898 - RNA, 21 nt, Human
caggaggggcaaaaaggggug

SEQ ID NO: 1143899 - RNA, 21 nt, Human
cauguagaaaaaacagaaacu

SEQ ID NO: 1143900 - RNA, 26 nt, Human
cauguagaaaaaacagaaacuuauuu

SEQ ID NO: 1143901 - RNA, 21 nt, Human
cauucaaaccacagcggucac

SEQ ID NO: 1143902 - RNA, 25 nt, Human
ccgcccccaucuucgcacgguggcc

SEQ ID NO: 1143903 - RNA, 21 nt, Human
ccucugcuaccuuuauugcuu

SEQ ID NO: 1143904 - RNA, 23 nt, Human
cgcccccaucuucgcacgguggc

SEQ ID NO: 1143905 - RNA, 19 nt, Human
cucuaaaaaauaucugaaa

SEQ ID NO: 1143906 - RNA, 26 nt, Human
cugacagcagaggcccagguccucuu

SEQ ID NO: 1143907 - RNA, 27 nt, Human
cuggcggacacaucccugggaggggag

SEQ ID NO: 1143908 - RNA, 18 nt, Human
cugucuaaccucugcuac

SEQ ID NO: 1143909 - RNA, 23 nt, Human
gaaggggcaggaggggcaaaaag

SEQ ID NO: 1143910 - RNA, 18 nt, Human
gacaaaaguccacacaua

SEQ ID NO: 1143911 - RNA, 20 nt, Human
gaggcccagguccucuuggc

SEQ ID NO: 1143912 - RNA, 22 nt, Human
gaggcccagguccucuuggcuc

SEQ ID NO: 1143913 - RNA, 22 nt, Human
gcgagggacacuauucaaccca

SEQ ID NO: 1143914 - RNA, 25 nt, Human
ggaaggggcaggaggggcaaaaagg

SEQ ID NO: 1143915 - RNA, 24 nt, Human
ggcaaaaaggggugagcucccuca

SEQ ID NO: 1143916 - RNA, 21 nt, Human
ggcaggaggggcaaaaagggg

SEQ ID NO: 1143917 - RNA, 22 nt, Human
guccacacauacuuccugagca

SEQ ID NO: 1143918 - RNA, 19 nt, Human
uagguaaaacaugacuuca

SEQ ID NO: 1143919 - RNA, 25 nt, Human
uaucugaaacugggucauguagaag

SEQ ID NO: 1143920 - RNA, 18 nt, Human
ucacuucagucuccgccc

SEQ ID NO: 1143921 - RNA, 24 nt, Human
uccacagaauuaauuucuuaagcg

SEQ ID NO: 1143922 - RNA, 18 nt, Human
uccacagccgguguggga

SEQ ID NO: 1143923 - RNA, 26 nt, Human
ucuaaaaaauaucugaaacuggguca

SEQ ID NO: 1143924 - RNA, 22 nt, Human
ucucaguucacccagcacgcuu

SEQ ID NO: 1143925 - RNA, 22 nt, Human
ucuccugguuauuuuuaacugc

SEQ ID NO: 1143926 - RNA, 21 nt, Human
ucuuugcuggaaaguccaagg

SEQ ID NO: 1143927 - RNA, 22 nt, Human
ugacagaagcauucaaaccaca

SEQ ID NO: 1143928 - RNA, 24 nt, Human
ugacagcagaggcccagguccucu

SEQ ID NO: 1143929 - RNA, 18 nt, Human
ugagaacuucuuuguggg

SEQ ID NO: 1143930 - RNA, 24 nt, Human
ugauguugggaucuggcggacaca

SEQ ID NO: 1143931 - RNA, 24 nt, Human
ugcaaucaugaaaaauaaaaauau

SEQ ID NO: 1143932 - RNA, 20 nt, Human
uggaaaguccaaggugaaga

SEQ ID NO: 1143933 - RNA, 18 nt, Human
uggaaggggcaggagggg

SEQ ID NO: 1143934 - RNA, 20 nt, Human
uggaaggggcaggaggggca

SEQ ID NO: 1143935 - RNA, 21 nt, Human
uggcuccacagccgguguggg

SEQ ID NO: 1143936 - RNA, 21 nt, Human
ugggaggggagcguguugggc

SEQ ID NO: 1143937 - RNA, 24 nt, Human
ugggaggggagcguguugggcuga

SEQ ID NO: 1143938 - RNA, 19 nt, Human
uuccacagaauuaauuucu

SEQ ID NO: 1143939 - RNA, 20 nt, Human
uuccauguggacgugaacuu

SEQ ID NO: 1143940 - RNA, 22 nt, Human
uucuuuguauuguugcauuggg

SEQ ID NO: 1143941 - RNA, 21 nt, Human
uugaugcagcaguaucucuuu

SEQ ID NO: 1143942 - RNA, 23 nt, Human
uugcauuggggauuaaguuuuga

SEQ ID NO: 1143943 - RNA, 18 nt, Human
uuggcuccacagccggug

SEQ ID NO: 1143944 - RNA, 21 nt, Human
uuggcuccacagccggugugg

SEQ ID NO: 1143945 - RNA, 24 nt, Human
uuuauugcuuagguaaaacaugac

SEQ ID NO: 1143946 - RNA, 25 nt, Human
aaacagauguucuuaauuuuaaugc

SEQ ID NO: 1143947 - RNA, 24 nt, Human
aaagugcugggauuacaggcauga

SEQ ID NO: 1143948 - RNA, 22 nt, Human
aacauccuagcacagcaugaga

SEQ ID NO: 1143949 - RNA, 21 nt, Human
aaccacaguuaauagccacug

SEQ ID NO: 1143950 - RNA, 20 nt, Human
aaccauaagggcaccaaccc

SEQ ID NO: 1143951 - RNA, 19 nt, Human
aagaaauucucccaccucc

SEQ ID NO: 1143952 - RNA, 19 nt, Human
aagugcugggauuacaggc

SEQ ID NO: 1143953 - RNA, 21 nt, Human
aagugcugggauuacaggcau

SEQ ID NO: 1143954 - RNA, 26 nt, Human
aagugcugggauuacaggcaugagcc

SEQ ID NO: 1143955 - RNA, 23 nt, Human
aauuuuuguauuuuuaguagaga

SEQ ID NO: 1143956 - RNA, 23 nt, Human
acacaggcauucaguccacagug

SEQ ID NO: 1143957 - RNA, 21 nt, Human
acagugcuccacccugugggc

SEQ ID NO: 1143958 - RNA, 18 nt, Human
accaggccuccuccauuc

SEQ ID NO: 1143959 - RNA, 18 nt, Human
accccagcaugggucucc

SEQ ID NO: 1143960 - RNA, 23 nt, Human
accuccgcuucccauguagcugg

SEQ ID NO: 1143961 - RNA, 22 nt, Human
agaagaugcacacccacgaggg

SEQ ID NO: 1143962 - RNA, 21 nt, Human
agcugggauuacaagugcaca

SEQ ID NO: 1143963 - RNA, 21 nt, Human
aggcagugggugugauugaaa

SEQ ID NO: 1143964 - RNA, 25 nt, Human
aggcuggagugcaguggcacgaucu

SEQ ID NO: 1143965 - RNA, 21 nt, Human
agugcaguggcacgaucucag

SEQ ID NO: 1143966 - RNA, 23 nt, Human
agugcaguggcacgaucucagcu

SEQ ID NO: 1143967 - RNA, 24 nt, Human
agugcaguggcacgaucucagcuc

SEQ ID NO: 1143968 - RNA, 18 nt, Human
agugcugggauuacaggc

SEQ ID NO: 1143969 - RNA, 21 nt, Human
augaacccaggggacacaggc

SEQ ID NO: 1143970 - RNA, 19 nt, Human
augggagaaccauaagggc

SEQ ID NO: 1143971 - RNA, 24 nt, Human
auuuuuguauuuuuaguagagaug

SEQ ID NO: 1143972 - RNA, 24 nt, Human
caaagugcugggauuacaggcaug

SEQ ID NO: 1143973 - RNA, 24 nt, Human
caaauuuuuguauuuuuaguagag

SEQ ID NO: 1143974 - RNA, 23 nt, Human
caacauaugaacccaggggacac

SEQ ID NO: 1143975 - RNA, 24 nt, Human
cacaccaccaagcccagcaaauuu

SEQ ID NO: 1143976 - RNA, 19 nt, Human
caccaaccccagcaugggu

SEQ ID NO: 1143977 - RNA, 24 nt, Human
caccaagcccagcaaauuuuugua

SEQ ID NO: 1143978 - RNA, 19 nt, Human
caccaugugcccagaccuc

SEQ ID NO: 1143979 - RNA, 19 nt, Human
cacccugugggcucacauc

SEQ ID NO: 1143980 - RNA, 23 nt, Human
caccuccgcuucccauguagcug

SEQ ID NO: 1143981 - RNA, 18 nt, Human
cacggccuaaccaccucc

SEQ ID NO: 1143982 - RNA, 21 nt, Human
cacggccuaaccaccucccaa

SEQ ID NO: 1143983 - RNA, 19 nt, Human
cacucugucccgcaggcug

SEQ ID NO: 1143984 - RNA, 24 nt, Human
cacucugucccgcaggcuggagug

SEQ ID NO: 1143985 - RNA, 23 nt, Human
cacugcaaagucugccucccggg

SEQ ID NO: 1143986 - RNA, 23 nt, Human
cauguuggccaggcugaucuugg

SEQ ID NO: 1143987 - RNA, 23 nt, Human
cauucaguccacagugcuccacc

SEQ ID NO: 1143988 - RNA, 22 nt, Human
cauucuugacuccaagaccaga

SEQ ID NO: 1143989 - RNA, 23 nt, Human
ccaaagugcugggauuacaggca

SEQ ID NO: 1143990 - RNA, 24 nt, Human
ccaaagugcugggauuacaggcau

SEQ ID NO: 1143991 - RNA, 24 nt, Human
ccacccucacggccuaaccaccuc

SEQ ID NO: 1143992 - RNA, 18 nt, Human
ccacugcaccuggccugg

SEQ ID NO: 1143993 - RNA, 20 nt, Human
ccacugcaccuggccuggau

SEQ ID NO: 1143994 - RNA, 22 nt, Human
ccacuguccaccaccaugugcc

SEQ ID NO: 1143995 - RNA, 24 nt, Human
ccaggggacacaggcauucagucc

SEQ ID NO: 1143996 - RNA, 24 nt, Human
cccaaagugcugggauuacaggca

SEQ ID NO: 1143997 - RNA, 21 nt, Human
cccaggugauccaccggccuc

SEQ ID NO: 1143998 - RNA, 23 nt, Human
cccauguagcugggauuacaagu

SEQ ID NO: 1143999 - RNA, 18 nt, Human
cccggguucaagaaauuc

SEQ ID NO: 1144000 - RNA, 22 nt, Human
cccuggccugcaggcuuugcgg

SEQ ID NO: 1144001 - RNA, 24 nt, Human
ccucccggguucaagaaauucucc

SEQ ID NO: 1144002 - RNA, 22 nt, Human
ccuccgcuucccauguagcugg

SEQ ID NO: 1144003 - RNA, 24 nt, Human
ccucucuucuuggcuuguagaugg

SEQ ID NO: 1144004 - RNA, 20 nt, Human
ccugaucccaggugauccac

SEQ ID NO: 1144005 - RNA, 24 nt, Human
ccugaucccaggugauccaccggc

SEQ ID NO: 1144006 - RNA, 24 nt, Human
cgacauguuggccaggcugaucuu

SEQ ID NO: 1144007 - RNA, 23 nt, Human
cucacggccuaaccaccucccaa

SEQ ID NO: 1144008 - RNA, 24 nt, Human
cucacucugucccgcaggcuggag

SEQ ID NO: 1144009 - RNA, 23 nt, Human
cucacugcaaagucugccucccg

SEQ ID NO: 1144010 - RNA, 24 nt, Human
cucacugcaaagucugccucccgg

SEQ ID NO: 1144011 - RNA, 21 nt, Human
cucaggucagauuucuccucc

SEQ ID NO: 1144012 - RNA, 21 nt, Human
cucuggcuucucacgcucuuc

SEQ ID NO: 1144013 - RNA, 19 nt, Human
cuuguagauggcugcccuc

SEQ ID NO: 1144014 - RNA, 21 nt, Human
gaaauucucccaccuccgcuu

SEQ ID NO: 1144015 - RNA, 21 nt, Human
gacaccaucacauugggaguu

SEQ ID NO: 1144016 - RNA, 21 nt, Human
gagaaccauaagggcaccaac

SEQ ID NO: 1144017 - RNA, 21 nt, Human
gagaggcagugggugugauug

SEQ ID NO: 1144018 - RNA, 18 nt, Human
gauuacaggcaugagcca

SEQ ID NO: 1144019 - RNA, 22 nt, Human
gauuacaggcaugagccacugc

SEQ ID NO: 1144020 - RNA, 23 nt, Human
gauuacaggcaugagccacugca

SEQ ID NO: 1144021 - RNA, 22 nt, Human
gcaaggugccggcagguuuggu

SEQ ID NO: 1144022 - RNA, 19 nt, Human
gcacaccaccaagcccagc

SEQ ID NO: 1144023 - RNA, 21 nt, Human
gcagugaccaaggaugcagaa

SEQ ID NO: 1144024 - RNA, 18 nt, Human
gccaaucuguaucuacag

SEQ ID NO: 1144025 - RNA, 23 nt, Human
gccucagccucccaaagugcugg

SEQ ID NO: 1144026 - RNA, 19 nt, Human
gcuggagugcaguggcacg

SEQ ID NO: 1144027 - RNA, 22 nt, Human
ggauuacaggcaugagccacug

SEQ ID NO: 1144028 - RNA, 21 nt, Human
ggcuuguagauggcugcccuc

SEQ ID NO: 1144029 - RNA, 18 nt, Human
gggcuacuguaacaaaau

SEQ ID NO: 1144030 - RNA, 18 nt, Human
ggugaggccucucuucuu

SEQ ID NO: 1144031 - RNA, 18 nt, Human
guagcugggauuacaagu

SEQ ID NO: 1144032 - RNA, 24 nt, Human
gugauccaccggccucagccuccc

SEQ ID NO: 1144033 - RNA, 23 nt, Human
uaaccaccucccaaaggcuccac

SEQ ID NO: 1144034 - RNA, 22 nt, Human
uacaggcaugagccacugcacc

SEQ ID NO: 1144035 - RNA, 21 nt, Human
uagcacagcaugagaugcgug

SEQ ID NO: 1144036 - RNA, 24 nt, Human
uaguagagauggcacuucgacaug

SEQ ID NO: 1144037 - RNA, 22 nt, Human
ucaacauaugaacccaggggac

SEQ ID NO: 1144038 - RNA, 23 nt, Human
ucacggccuaaccaccucccaaa

SEQ ID NO: 1144039 - RNA, 24 nt, Human
ucacugcaaagucugccucccggg

SEQ ID NO: 1144040 - RNA, 18 nt, Human
ucagccucccaaagugcu

SEQ ID NO: 1144041 - RNA, 23 nt, Human
uccacagugcuccacccuguggg

SEQ ID NO: 1144042 - RNA, 21 nt, Human
uccaccaccaugugcccagac

SEQ ID NO: 1144043 - RNA, 22 nt, Human
uccaccaccaugugcccagacc

SEQ ID NO: 1144044 - RNA, 24 nt, Human
ucccaaagugcugggauuacaggc

SEQ ID NO: 1144045 - RNA, 19 nt, Human
ucccacccucccuggccug

SEQ ID NO: 1144046 - RNA, 22 nt, Human
ucccacccucccuggccugcag

SEQ ID NO: 1144047 - RNA, 20 nt, Human
ucccacucugcacucuggcu

SEQ ID NO: 1144048 - RNA, 21 nt, Human
ucccggguucaagaaauucuc

SEQ ID NO: 1144049 - RNA, 23 nt, Human
ucccggguucaagaaauucuccc

SEQ ID NO: 1144050 - RNA, 18 nt, Human
uccgugugaucuuggaau

SEQ ID NO: 1144051 - RNA, 24 nt, Human
ucucacucugucccgcaggcugga

SEQ ID NO: 1144052 - RNA, 19 nt, Human
ucucccaccuccgcuuccc

SEQ ID NO: 1144053 - RNA, 24 nt, Human
ucugucccgcaggcuggagugcag

SEQ ID NO: 1144054 - RNA, 19 nt, Human
ugaggccucucuucuuggc

SEQ ID NO: 1144055 - RNA, 24 nt, Human
ugaucccaggugauccaccggccu

SEQ ID NO: 1144056 - RNA, 20 nt, Human
ugcccguccuccucucggcu

SEQ ID NO: 1144057 - RNA, 18 nt, Human
ugcgugucagugagcgua

SEQ ID NO: 1144058 - RNA, 20 nt, Human
ugcuggcagugaccaaggau

SEQ ID NO: 1144059 - RNA, 23 nt, Human
uggagugcaguggcacgaucuca

SEQ ID NO: 1144060 - RNA, 24 nt, Human
uggagugcaguggcacgaucucag

SEQ ID NO: 1144061 - RNA, 24 nt, Human
uggcacgaucucagcucacugcaa

SEQ ID NO: 1144062 - RNA, 24 nt, Human
uggccaggcugaucuuggacuccu

SEQ ID NO: 1144063 - RNA, 20 nt, Human
uggccuggauaucucuucug

SEQ ID NO: 1144064 - RNA, 19 nt, Human
uggcuuuuauguacggcau

SEQ ID NO: 1144065 - RNA, 24 nt, Human
ugggauuacaagugcacaccacca

SEQ ID NO: 1144066 - RNA, 18 nt, Human
ugggauuacaggcaugag

SEQ ID NO: 1144067 - RNA, 19 nt, Human
ugggauuacaggcaugagc

SEQ ID NO: 1144068 - RNA, 21 nt, Human
ugggauuacaggcaugagcca

SEQ ID NO: 1144069 - RNA, 22 nt, Human
ugggauuacaggcaugagccac

SEQ ID NO: 1144070 - RNA, 22 nt, Human
ugggauuacaggcaugagccac

SEQ ID NO: 1144071 - RNA, 24 nt, Human
ugggauuacaggcaugagccacug

SEQ ID NO: 1144072 - RNA, 24 nt, Human
ugggauuacaggcaugagccacug

SEQ ID NO: 1144073 - RNA, 18 nt, Human
uguagauggcugcccucu

SEQ ID NO: 1144074 - RNA, 25 nt, Human
uguagcugggauuacaagugcacac

SEQ ID NO: 1144075 - RNA, 24 nt, Human
uucaagaaauucucccaccuccgc

SEQ ID NO: 1144076 - RNA, 24 nt, Human
uucuugacuccaagaccagacacc

SEQ ID NO: 1144077 - RNA, 22 nt, Human
uuggugucuggugaggccucuc

SEQ ID NO: 1144078 - RNA, 25 nt, Human
aaaaagaaagcgagaguucagggac

SEQ ID NO: 1144079 - RNA, 28 nt, Human
aaauacaaacaaauuuccuuuuuaaagu

SEQ ID NO: 1144080 - RNA, 22 nt, Human
acaaauuuccuuuuuaaaguac

SEQ ID NO: 1144081 - RNA, 22 nt, Human
aggaggcgcguggcggaggcgg

SEQ ID NO: 1144082 - RNA, 23 nt, Human
cacaccacaaguaaagucagaag

SEQ ID NO: 1144083 - RNA, 18 nt, Human
gaacauggucacaccacc

SEQ ID NO: 1144084 - RNA, 19 nt, Human
gaaggcugguuuggucauc

SEQ ID NO: 1144085 - RNA, 19 nt, Human
gaguccgcggcggcggagg

SEQ ID NO: 1144086 - RNA, 18 nt, Human
gcggcggcggaggaggcg

SEQ ID NO: 1144087 - RNA, 24 nt, Human
gcugguuuggucaucggagaucau

SEQ ID NO: 1144088 - RNA, 24 nt, Human
ggucaucggagaucauuaaaaaug

SEQ ID NO: 1144089 - RNA, 19 nt, Human
guaggacagagaacgcucc

SEQ ID NO: 1144090 - RNA, 23 nt, Human
guaggacagagaacgcuccgaag

SEQ ID NO: 1144091 - RNA, 21 nt, Human
guggcggaggcggcugcggcg

SEQ ID NO: 1144092 - RNA, 21 nt, Human
uaaaaagaaagcgagaguuca

SEQ ID NO: 1144093 - RNA, 22 nt, Human
uaaauaaaaaauacaaacaaau

SEQ ID NO: 1144094 - RNA, 26 nt, Human
uacaaacaaauuuccuuuuuaaagua

SEQ ID NO: 1144095 - RNA, 18 nt, Human
ucacaccacaaguaaagu

SEQ ID NO: 1144096 - RNA, 24 nt, Human
uccgaaggcugguuuggucaucgg

SEQ ID NO: 1144097 - RNA, 19 nt, Human
ugccggaguccgcggcggc

SEQ ID NO: 1144098 - RNA, 19 nt, Human
ugccggaguccgcggcggc

SEQ ID NO: 1144099 - RNA, 27 nt, Human
uguaaauaaaaaauacaaacaaauuuc

SEQ ID NO: 1144100 - RNA, 25 nt, Human
aaaacaacuuuaguacacaaacugg

SEQ ID NO: 1144101 - RNA, 20 nt, Human
aaaauaugcauuuccaucug

SEQ ID NO: 1144102 - RNA, 26 nt, Human
aaacaaccccaagaagaggggaacgc

SEQ ID NO: 1144103 - RNA, 28 nt, Human
aaacagguacaaucacagauuacccaag

SEQ ID NO: 1144104 - RNA, 22 nt, Human
aaauacuugcuuagcaucuacc

SEQ ID NO: 1144105 - RNA, 24 nt, Human
aacaacaaacauauauacauauca

SEQ ID NO: 1144106 - RNA, 23 nt, Human
aacagacauaaguuuaaaagacc

SEQ ID NO: 1144107 - RNA, 21 nt, Human
aagcagaaaugagguauguga

SEQ ID NO: 1144108 - RNA, 22 nt, Human
aagccuccuaucagagucccag

SEQ ID NO: 1144109 - RNA, 19 nt, Human
aagccuucagcccacacag

SEQ ID NO: 1144110 - RNA, 20 nt, Human
aagcugaagggaguauugcc

SEQ ID NO: 1144111 - RNA, 27 nt, Human
aagucacagacaaccuacuuaacagac

SEQ ID NO: 1144112 - RNA, 22 nt, Human
acaaacuggaacacuuugguau

SEQ ID NO: 1144113 - RNA, 18 nt, Human
acacuacugcuuccccgc

SEQ ID NO: 1144114 - RNA, 25 nt, Human
accccauuuccugugacugaaaugg

SEQ ID NO: 1144115 - RNA, 21 nt, Human
acucugcaacggugcgacuuc

SEQ ID NO: 1144116 - RNA, 22 nt, Human
acugcaacccccuucgcugccu

SEQ ID NO: 1144117 - RNA, 21 nt, Human
agaaaaacaacuuuaguacac

SEQ ID NO: 1144118 - RNA, 21 nt, Human
agaaguuguucgaggaggaaa

SEQ ID NO: 1144119 - RNA, 20 nt, Human
agaaucccaggaagaaacag

SEQ ID NO: 1144120 - RNA, 20 nt, Human
agacggcccuauagcugagg

SEQ ID NO: 1144121 - RNA, 19 nt, Human
agaggugggcuucggcaug

SEQ ID NO: 1144122 - RNA, 23 nt, Human
agcugggcugccuccugucucug

SEQ ID NO: 1144123 - RNA, 19 nt, Human
aggaaccauaaugccucuc

SEQ ID NO: 1144124 - RNA, 18 nt, Human
aggaagaaacagguacaa

SEQ ID NO: 1144125 - RNA, 23 nt, Human
aucacagauuacccaagccaugc

SEQ ID NO: 1144126 - RNA, 19 nt, Human
aucccauacucucugcuuc

SEQ ID NO: 1144127 - RNA, 24 nt, Human
auggccacaagaauauggaaggug

SEQ ID NO: 1144128 - RNA, 19 nt, Human
auuuccaucugcauauccc

SEQ ID NO: 1144129 - RNA, 19 nt, Human
caaccccaagaagagcugg

SEQ ID NO: 1144130 - RNA, 22 nt, Human
caagaaaacacggaaugaagca

SEQ ID NO: 1144131 - RNA, 23 nt, Human
caagucacagacaaccuacuuaa

SEQ ID NO: 1144132 - RNA, 24 nt, Human
caauugcugcauuuuuuaaaaagc

SEQ ID NO: 1144133 - RNA, 23 nt, Human
cacacaaggucauccccuugaaa

SEQ ID NO: 1144134 - RNA, 24 nt, Human
cacagacaaccuacuuaacagaca

SEQ ID NO: 1144135 - RNA, 25 nt, Human
cacagacaaccuacuuaacagacau

SEQ ID NO: 1144136 - RNA, 21 nt, Human
cacagaccuggccaaacaauc

SEQ ID NO: 1144137 - RNA, 23 nt, Human
caccccuccucaguggcugggag

SEQ ID NO: 1144138 - RNA, 20 nt, Human
cagaaggcagaaagcucaga

SEQ ID NO: 1144139 - RNA, 19 nt, Human
cagcagccacacaagguca

SEQ ID NO: 1144140 - RNA, 22 nt, Human
cagcagccacacaaggucaucc

SEQ ID NO: 1144141 - RNA, 24 nt, Human
cagcaucuuccagcugcuccagga

SEQ ID NO: 1144142 - RNA, 19 nt, Human
caggcugccagaaaaacaa

SEQ ID NO: 1144143 - RNA, 23 nt, Human
cauuuuagacuugagcccagcug

SEQ ID NO: 1144144 - RNA, 19 nt, Human
ccacaauuucucuauccca

SEQ ID NO: 1144145 - RNA, 19 nt, Human
ccacacaaggucauccccu

SEQ ID NO: 1144146 - RNA, 21 nt, Human
ccacgaagagcaguucucacc

SEQ ID NO: 1144147 - RNA, 18 nt, Human
ccagguggucgcuuugau

SEQ ID NO: 1144148 - RNA, 20 nt, Human
ccaguggagcaaugaacauc

SEQ ID NO: 1144149 - RNA, 22 nt, Human
ccauccaggaacacuggaucau

SEQ ID NO: 1144150 - RNA, 22 nt, Human
ccaucuuggauuaggacuacag

SEQ ID NO: 1144151 - RNA, 23 nt, Human
cccagcagcagccacacaagguc

SEQ ID NO: 1144152 - RNA, 22 nt, Human
ccccuacugcaacccccuucgc

SEQ ID NO: 1144153 - RNA, 19 nt, Human
cccucaaaauaaaggcaag

SEQ ID NO: 1144154 - RNA, 23 nt, Human
cccuggucaccaagccuucagcc

SEQ ID NO: 1144155 - RNA, 18 nt, Human
ccuacaggcagcugauga

SEQ ID NO: 1144156 - RNA, 25 nt, Human
ccuacugcaacccccuucgcugccu

SEQ ID NO: 1144157 - RNA, 23 nt, Human
ccucccucccucaaaauaaaggc

SEQ ID NO: 1144158 - RNA, 18 nt, Human
ccucugccaccccuccuc

SEQ ID NO: 1144159 - RNA, 25 nt, Human
ccuggcacgucggguuccaaguugg

SEQ ID NO: 1144160 - RNA, 20 nt, Human
ccuggccaaacaauccucug

SEQ ID NO: 1144161 - RNA, 22 nt, Human
ccuucugccaguuaccacuggg

SEQ ID NO: 1144162 - RNA, 20 nt, Human
cgaagauggcugaauacccu

SEQ ID NO: 1144163 - RNA, 22 nt, Human
cucaaaauaaaggcaagaugaa

SEQ ID NO: 1144164 - RNA, 21 nt, Human
cucacccuuaauguugacuca

SEQ ID NO: 1144165 - RNA, 23 nt, Human
cucagagguggagaaaacaacaa

SEQ ID NO: 1144166 - RNA, 19 nt, Human
cuccucaguggcugggagc

SEQ ID NO: 1144167 - RNA, 23 nt, Human
cucuuuaauacuguggugucucc

SEQ ID NO: 1144168 - RNA, 18 nt, Human
cugcagcaagagcgcccc

SEQ ID NO: 1144169 - RNA, 23 nt, Human
cuucaggaacaacaaaaaucaac

SEQ ID NO: 1144170 - RNA, 19 nt, Human
cuugccccucccucccuca

SEQ ID NO: 1144171 - RNA, 24 nt, Human
cuuuucaccugcugaagcugaagg

SEQ ID NO: 1144172 - RNA, 19 nt, Human
gaaaaacaacuuuaguaca

SEQ ID NO: 1144173 - RNA, 21 nt, Human
gaacagcagcagguagagggg

SEQ ID NO: 1144174 - RNA, 24 nt, Human
gaacagcagcagguagagggguag

SEQ ID NO: 1144175 - RNA, 26 nt, Human
gaagaaacagguacaaucacagauua

SEQ ID NO: 1144176 - RNA, 20 nt, Human
gacaaccuacuuaacagaca

SEQ ID NO: 1144177 - RNA, 22 nt, Human
gagcaaugaacaucuggcuggg

SEQ ID NO: 1144178 - RNA, 21 nt, Human
gcaaggaugggcguaaacaac

SEQ ID NO: 1144179 - RNA, 21 nt, Human
gccagggugccagacaggaaa

SEQ ID NO: 1144180 - RNA, 22 nt, Human
gcugccuccugucucugcauuc

SEQ ID NO: 1144181 - RNA, 24 nt, Human
guggagagcagacucuagaugaga

SEQ ID NO: 1144182 - RNA, 21 nt, Human
uaaaacacuucugcacauuuu

SEQ ID NO: 1144183 - RNA, 21 nt, Human
uaaagaagguggcucaagcca

SEQ ID NO: 1144184 - RNA, 21 nt, Human
uaacagacauaaguuuaaaag

SEQ ID NO: 1144185 - RNA, 22 nt, Human
uaccucaccuccuacaggcagc

SEQ ID NO: 1144186 - RNA, 25 nt, Human
uaccucaccuccuacaggcagcuga

SEQ ID NO: 1144187 - RNA, 23 nt, Human
uagaggugggcuucggcauggcc

SEQ ID NO: 1144188 - RNA, 22 nt, Human
uagaugagaauguaacacagca

SEQ ID NO: 1144189 - RNA, 18 nt, Human
uauaaaacacuucugcac

SEQ ID NO: 1144190 - RNA, 20 nt, Human
uauaaaacacuucugcacau

SEQ ID NO: 1144191 - RNA, 21 nt, Human
uaugcaaagcgaagauggcug

SEQ ID NO: 1144192 - RNA, 22 nt, Human
ucaacuucauugagaaccacac

SEQ ID NO: 1144193 - RNA, 19 nt, Human
ucaccugcugaagcugaag

SEQ ID NO: 1144194 - RNA, 23 nt, Human
ucacugggcagcuuuucuggccu

SEQ ID NO: 1144195 - RNA, 23 nt, Human
ucagauaccguggguagugugau

SEQ ID NO: 1144196 - RNA, 21 nt, Human
ucaggaacaacaaaaaucaac

SEQ ID NO: 1144197 - RNA, 19 nt, Human
ucaggagaucuaagaguuc

SEQ ID NO: 1144198 - RNA, 22 nt, Human
ucaucugaacagaaagagcaaa

SEQ ID NO: 1144199 - RNA, 21 nt, Human
ucauggagugcaaugacagcc

SEQ ID NO: 1144200 - RNA, 18 nt, Human
ucugcagcaagagcgccc

SEQ ID NO: 1144201 - RNA, 31 nt, Human
ucuggccucuacaaugggaacacuacugcuu

SEQ ID NO: 1144202 - RNA, 24 nt, Human
ucuucucauaugcaaagcgaagau

SEQ ID NO: 1144203 - RNA, 23 nt, Human
ugaccaccucccuaauguuaccc

SEQ ID NO: 1144204 - RNA, 23 nt, Human
ugacucgagacagacggcccuau

SEQ ID NO: 1144205 - RNA, 24 nt, Human
ugcaaagcgaagauggcugaauac

SEQ ID NO: 1144206 - RNA, 21 nt, Human
ugcagcaagagcgccccuacu

SEQ ID NO: 1144207 - RNA, 18 nt, Human
ugcagggacugggcccug

SEQ ID NO: 1144208 - RNA, 20 nt, Human
uggccaaacaauccucugcc

SEQ ID NO: 1144209 - RNA, 20 nt, Human
uggccacaagaauauggaag

SEQ ID NO: 1144210 - RNA, 18 nt, Human
uggcgcuccccugccagg

SEQ ID NO: 1144211 - RNA, 20 nt, Human
uggcucaagccagcucacag

SEQ ID NO: 1144212 - RNA, 26 nt, Human
uggcugcagggacuggggggacccgc

SEQ ID NO: 1144213 - RNA, 20 nt, Human
uggggagaggagaauccuac

SEQ ID NO: 1144214 - RNA, 21 nt, Human
ugguaucaggcaacccagcac

SEQ ID NO: 1144215 - RNA, 18 nt, Human
uguagaaggagaccuggc

SEQ ID NO: 1144216 - RNA, 20 nt, Human
ugugaaaagugagauggcug

SEQ ID NO: 1144217 - RNA, 22 nt, Human
ugugcagaaucccaggaagaaa

SEQ ID NO: 1144218 - RNA, 25 nt, Human
uuaaaagacccacuuaaugcccuaa

SEQ ID NO: 1144219 - RNA, 23 nt, Human
uuaauguugacucaacauuuccu

SEQ ID NO: 1144220 - RNA, 18 nt, Human
uuccccgccaggguccuu

SEQ ID NO: 1144221 - RNA, 27 nt, Human
uucucauaugcaaagcgaagauggcug

SEQ ID NO: 1144222 - RNA, 22 nt, Human
uugaaaguccuguggaaggagg

SEQ ID NO: 1144223 - RNA, 22 nt, Human
uugagauugucuucucauaugc

SEQ ID NO: 1144224 - RNA, 21 nt, Human
aaacgaagacuggaaccugag

SEQ ID NO: 1144225 - RNA, 19 nt, Human
aaagcgcugggauuacagg

SEQ ID NO: 1144226 - RNA, 24 nt, Human
aaagcgcugggauuacaggcauga

SEQ ID NO: 1144227 - RNA, 18 nt, Human
aaaguucuccaagucccc

SEQ ID NO: 1144228 - RNA, 22 nt, Human
aaaguucuccaaguccccaccu

SEQ ID NO: 1144229 - RNA, 22 nt, Human
aacagacucggggcuugcuuca

SEQ ID NO: 1144230 - RNA, 20 nt, Human
aacagggaggggguguggcu

SEQ ID NO: 1144231 - RNA, 24 nt, Human
aacugguugcagaaccaguugccc

SEQ ID NO: 1144232 - RNA, 24 nt, Human
aacuucccuucccugcugucccca

SEQ ID NO: 1144233 - RNA, 22 nt, Human
aagacaaaagaacagaccugag

SEQ ID NO: 1144234 - RNA, 20 nt, Human
aagcaccucccccuucacgc

SEQ ID NO: 1144235 - RNA, 23 nt, Human
aagcagcagcaagauuuauaauc

SEQ ID NO: 1144236 - RNA, 19 nt, Human
aagcgcugggauuacaggc

SEQ ID NO: 1144237 - RNA, 26 nt, Human
aagcgcugggauuacaggcaugagcc

SEQ ID NO: 1144238 - RNA, 19 nt, Human
aagcuggcaguggccagcu

SEQ ID NO: 1144239 - RNA, 23 nt, Human
acacaacauuucacgguuucccc

SEQ ID NO: 1144240 - RNA, 21 nt, Human
acagaacagaugcuuucuaaa

SEQ ID NO: 1144241 - RNA, 19 nt, Human
acagagcacugauuggucc

SEQ ID NO: 1144242 - RNA, 24 nt, Human
acauaguaaaaccaaaagccaaca

SEQ ID NO: 1144243 - RNA, 24 nt, Human
accaaaaggaccaccccagcucca

SEQ ID NO: 1144244 - RNA, 22 nt, Human
accaccccagcuccaugcagaa

SEQ ID NO: 1144245 - RNA, 18 nt, Human
accauguuggccaggcug

SEQ ID NO: 1144246 - RNA, 19 nt, Human
acccuggguugcugggccc

SEQ ID NO: 1144247 - RNA, 20 nt, Human
accgaaagagcaagcagcag

SEQ ID NO: 1144248 - RNA, 23 nt, Human
accgaaagagcaagcagcagcaa

SEQ ID NO: 1144249 - RNA, 23 nt, Human
accucggccucccaaagcgcugg

SEQ ID NO: 1144250 - RNA, 21 nt, Human
acgcacgaagagacuggcaac

SEQ ID NO: 1144251 - RNA, 18 nt, Human
acgggguuucaccauguu

SEQ ID NO: 1144252 - RNA, 23 nt, Human
acgggguuucaccauguuggcca

SEQ ID NO: 1144253 - RNA, 24 nt, Human
acgggguuucaccauguuggccag

SEQ ID NO: 1144254 - RNA, 22 nt, Human
acuccagcucacugaccacacc

SEQ ID NO: 1144255 - RNA, 26 nt, Human
acugacccauaguccuggcucccaag

SEQ ID NO: 1144256 - RNA, 21 nt, Human
acuucccuucccugcuguccc

SEQ ID NO: 1144257 - RNA, 25 nt, Human
acuuucauguucuagaugaagaggu

SEQ ID NO: 1144258 - RNA, 18 nt, Human
agaauuucagcccccacc

SEQ ID NO: 1144259 - RNA, 19 nt, Human
agacaaaagaacagaccug

SEQ ID NO: 1144260 - RNA, 23 nt, Human
agacaaaagaacagaccugagca

SEQ ID NO: 1144261 - RNA, 21 nt, Human
agacaaaccauuuucccaggc

SEQ ID NO: 1144262 - RNA, 22 nt, Human
agacgaauggauacaacgagcu

SEQ ID NO: 1144263 - RNA, 20 nt, Human
agacuggaaccugagccagc

SEQ ID NO: 1144264 - RNA, 21 nt, Human
agacuggaaccugagccagca

SEQ ID NO: 1144265 - RNA, 24 nt, Human
agagaaguuaacuuuaacacucau

SEQ ID NO: 1144266 - RNA, 21 nt, Human
agagagagaggugccaguggg

SEQ ID NO: 1144267 - RNA, 27 nt, Human
agagagaggugccaguggggaccuggu

SEQ ID NO: 1144268 - RNA, 18 nt, Human
agcgcugggauuacaggc

SEQ ID NO: 1144269 - RNA, 19 nt, Human
aggcaggagaaggauguga

SEQ ID NO: 1144270 - RNA, 24 nt, Human
aggugauccgcccaccucggccuc

SEQ ID NO: 1144271 - RNA, 19 nt, Human
aggugccaguggggaccug

SEQ ID NO: 1144272 - RNA, 19 nt, Human
aguccccaccugacccaga

SEQ ID NO: 1144273 - RNA, 18 nt, Human
agucuggcuagaguuggg

SEQ ID NO: 1144274 - RNA, 19 nt, Human
agucuuguugagaacacag

SEQ ID NO: 1144275 - RNA, 20 nt, Human
caaaagaacagaccugagca

SEQ ID NO: 1144276 - RNA, 24 nt, Human
caaagcgcugggauuacaggcaug

SEQ ID NO: 1144277 - RNA, 25 nt, Human
caagaacgcaaccacagacccucgc

SEQ ID NO: 1144278 - RNA, 24 nt, Human
caagacaaaagaacagaccugagc

SEQ ID NO: 1144279 - RNA, 22 nt, Human
caaguccccaccugacccagaa

SEQ ID NO: 1144280 - RNA, 19 nt, Human
caauggauccauuuucuaa

SEQ ID NO: 1144281 - RNA, 19 nt, Human
cacagaacagaugcuuucu

SEQ ID NO: 1144282 - RNA, 22 nt, Human
caccagguacuagaacccuggg

SEQ ID NO: 1144283 - RNA, 21 nt, Human
caccauguuggccaggcuggu

SEQ ID NO: 1144284 - RNA, 24 nt, Human
caccauguuggccaggcugguuuc

SEQ ID NO: 1144285 - RNA, 31 nt, Human; identical to SEQ ID NO: 466129

SEQ ID NO: 1144286 - RNA, 24 nt, Human
caccugacccagaagcacagcugg

SEQ ID NO: 1144287 - RNA, 18 nt, Human
cacgcuucuucucaccag

SEQ ID NO: 1144288 - RNA, 23 nt, Human
cacgguuuccccgggccuuggcc

SEQ ID NO: 1144289 - RNA, 19 nt, Human
cagagcacugauuggucca

SEQ ID NO: 1144290 - RNA, 19 nt, Human
cagauaacuucaaaguuca

SEQ ID NO: 1144291 - RNA, 21 nt, Human
cagcaaaauagaagcaccucc

SEQ ID NO: 1144292 - RNA, 23 nt, Human
cagcaaaauagaagcaccucccu

SEQ ID NO: 1144293 - RNA, 21 nt, Human
cagcaagcuggcaguggccag

SEQ ID NO: 1144294 - RNA, 20 nt, Human
cagcagaggggggcugcggc

SEQ ID NO: 1144295 - RNA, 27 nt, Human
cagcagaggggggcugcggcuaggggg

SEQ ID NO: 1144296 - RNA, 19 nt, Human
cagcagcaagauuuauaau

SEQ ID NO: 1144297 - RNA, 22 nt, Human
cagcagcguggggucuugaagc

SEQ ID NO: 1144298 - RNA, 21 nt, Human
cagccagcugugccuucccag

SEQ ID NO: 1144299 - RNA, 21 nt, Human
cagcugugccuucccagaugc

SEQ ID NO: 1144300 - RNA, 22 nt, Human
cagucugucacuuaguuaucuc

SEQ ID NO: 1144301 - RNA, 21 nt, Human
caugcagaauuucagccccca

SEQ ID NO: 1144302 - RNA, 23 nt, Human
caugcguuuaaaacgaagacugg

SEQ ID NO: 1144303 - RNA, 21 nt, Human
cauggcccggaaaguggcaga

SEQ ID NO: 1144304 - RNA, 23 nt, Human
cauguuggccaggcugguuucaa

SEQ ID NO: 1144305 - RNA, 19 nt, Human
ccaaagcgcugggauuaca

SEQ ID NO: 1144306 - RNA, 23 nt, Human
ccaaagcgcugggauuacaggca

SEQ ID NO: 1144307 - RNA, 24 nt, Human
ccaaagcgcugggauuacaggcau

SEQ ID NO: 1144308 - RNA, 20 nt, Human
ccacccagucccgagguggg

SEQ ID NO: 1144309 - RNA, 24 nt, Human
ccagccccugcucugguuuacgcc

SEQ ID NO: 1144310 - RNA, 20 nt, Human
ccaggcauagcaggugggcu

SEQ ID NO: 1144311 - RNA, 25 nt, Human
ccagguacuagaacccuggguugcu

SEQ ID NO: 1144312 - RNA, 23 nt, Human
ccagucccgaggugggacagaaa

SEQ ID NO: 1144313 - RNA, 24 nt, Human
ccaguggcggucagguguccuggg

SEQ ID NO: 1144314 - RNA, 21 nt, Human
ccauuuucccaggcauagcag

SEQ ID NO: 1144315 - RNA, 24 nt, Human
cccaaagcgcugggauuacaggca

SEQ ID NO: 1144316 - RNA, 21 nt, Human
cccaccucggccucccaaagc

SEQ ID NO: 1144317 - RNA, 20 nt, Human
cccagcagguuucugcagca

SEQ ID NO: 1144318 - RNA, 26 nt, Human
ccccagccccugcucugguuuacgcc

SEQ ID NO: 1144319 - RNA, 26 nt, Human
cccugcuguccccagcgccucgccca

SEQ ID NO: 1144320 - RNA, 20 nt, Human
cccuucccucugacgcuguc

SEQ ID NO: 1144321 - RNA, 21 nt, Human
ccgcagcaagcuggcaguggc

SEQ ID NO: 1144322 - RNA, 24 nt, Human
ccuccagauaacuucaaaguucau

SEQ ID NO: 1144323 - RNA, 24 nt, Human
ccugaccucaggugauccgcccac

SEQ ID NO: 1144324 - RNA, 18 nt, Human
ccugcggcggagcacuga

SEQ ID NO: 1144325 - RNA, 24 nt, Human
ccuggguugcugggcccacgggcu

SEQ ID NO: 1144326 - RNA, 19 nt, Human
ccuuccccucuacauccca

SEQ ID NO: 1144327 - RNA, 23 nt, Human
cggaccgaaagagcaagcagcag

SEQ ID NO: 1144328 - RNA, 18 nt, Human
cggagcccaaaggccagu

SEQ ID NO: 1144329 - RNA, 24 nt, Human
cgggguuucaccauguuggccagg

SEQ ID NO: 1144330 - RNA, 20 nt, Human
cggucucucccuggccgcuc

SEQ ID NO: 1144331 - RNA, 23 nt, Human
cucccccuucacgcuucuucuca

SEQ ID NO: 1144332 - RNA, 22 nt, Human
cucuacaucccacgacgguguc

SEQ ID NO: 1144333 - RNA, 22 nt, Human
cucuuccagggcggccguuccc

SEQ ID NO: 1144334 - RNA, 19 nt, Human
cugcagcagcguggggucu

SEQ ID NO: 1144335 - RNA, 20 nt, Human
cuggcugacugaggaccuuc

SEQ ID NO: 1144336 - RNA, 19 nt, Human
cugggcuucugcuggucua

SEQ ID NO: 1144337 - RNA, 20 nt, Human
cugguccugcugacuucaag

SEQ ID NO: 1144338 - RNA, 18 nt, Human
cugugccuucccagaugc

SEQ ID NO: 1144339 - RNA, 24 nt, Human
cuuggccugaccuuugcugauaac

SEQ ID NO: 1144340 - RNA, 22 nt, Human
gaacagaccugagcauguuccc

SEQ ID NO: 1144341 - RNA, 20 nt, Human
gaacgcaaccacagacccuc

SEQ ID NO: 1144342 - RNA, 24 nt, Human
gaccucaggugauccgcccaccuc

SEQ ID NO: 1144343 - RNA, 20 nt, Human
gagagagaggugccaguggg

SEQ ID NO: 1144344 - RNA, 21 nt, Human
gagccccagccccugcucugg

SEQ ID NO: 1144345 - RNA, 24 nt, Human
gagcuguucaauggauccauuuuc

SEQ ID NO: 1144346 - RNA, 18 nt, Human
gauuacaggcaugagcca

SEQ ID NO: 1144347 - RNA, 22 nt, Human
gauuacaggcaugagccaccgc

SEQ ID NO: 1144348 - RNA, 23 nt, Human
gauuacaggcaugagccaccgca

SEQ ID NO: 1144349 - RNA, 18 nt, Human
gcacgugguggguguccg

SEQ ID NO: 1144350 - RNA, 20 nt, Human
gcacgugguggguguccggg

SEQ ID NO: 1144351 - RNA, 19 nt, Human
gcggucagguguccugggc

SEQ ID NO: 1144352 - RNA, 24 nt, Human
gcugcagcucaccugcggagccca

SEQ ID NO: 1144353 - RNA, 24 nt, Human
gcugcggcuagggggucucaguuc

SEQ ID NO: 1144354 - RNA, 23 nt, Human
gcugguuucaaacuccugaccuc

SEQ ID NO: 1144355 - RNA, 20 nt, Human
gcuugcuucagcuccgaggc

SEQ ID NO: 1144356 - RNA, 19 nt, Human
ggacagaggcaggagaagg

SEQ ID NO: 1144357 - RNA, 18 nt, Human
ggagguggugacgggugg

SEQ ID NO: 1144358 - RNA, 24 nt, Human
ggauagagaaaauuacagaagcaa

SEQ ID NO: 1144359 - RNA, 22 nt, Human
ggauuacaggcaugagccaccg

SEQ ID NO: 1144360 - RNA, 22 nt, Human
ggccguucccugcagccagcug

SEQ ID NO: 1144361 - RNA, 24 nt, Human
ggcugguuucaaacuccugaccuc

SEQ ID NO: 1144362 - RNA, 18 nt, Human
gggagguggugacgggug

SEQ ID NO: 1144363 - RNA, 23 nt, Human
gggguuucaccauguuggccagg

SEQ ID NO: 1144364 - RNA, 22 nt, Human
guacuaaaacauaguaaaacca

SEQ ID NO: 1144365 - RNA, 21 nt, Human
guccauuuuacagagugcuga

SEQ ID NO: 1144366 - RNA, 21 nt, Human
guccggccacagcugagcccc

SEQ ID NO: 1144367 - RNA, 24 nt, Human
gugauccgcccaccucggccuccc

SEQ ID NO: 1144368 - RNA, 23 nt, Human
guggguuucugguccugcugacu

SEQ ID NO: 1144369 - RNA, 21 nt, Human
uaaaacgaagacuggaaccug

SEQ ID NO: 1144370 - RNA, 24 nt, Human
uaaaacgaagacuggaaccugagc

SEQ ID NO: 1144371 - RNA, 18 nt, Human
uaaauacuuuccugggcu

SEQ ID NO: 1144372 - RNA, 20 nt, Human
uaacuucaaaguucaucacu

SEQ ID NO: 1144373 - RNA, 23 nt, Human
uacaggcaugagccaccgcaccc

SEQ ID NO: 1144374 - RNA, 21 nt, Human
uacaucccacgacggugucug

SEQ ID NO: 1144375 - RNA, 24 nt, Human
uagcaggugggcucccuggcuccu

SEQ ID NO: 1144376 - RNA, 24 nt, Human
uagcuagaaagaaaaguucuccaa

SEQ ID NO: 1144377 - RNA, 24 nt, Human
uagcugcucgcuauuaugauacuc

SEQ ID NO: 1144378 - RNA, 21 nt, Human
uagugacgggguuucaccaug

SEQ ID NO: 1144379 - RNA, 22 nt, Human
uagugacgggguuucaccaugu

SEQ ID NO: 1144380 - RNA, 20 nt, Human
uauaaucaagacaaaagaac

SEQ ID NO: 1144381 - RNA, 24 nt, Human
uauuagugacgggguuucaccaug

SEQ ID NO: 1144382 - RNA, 24 nt, Human
ucaagacaaaagaacagaccugag

SEQ ID NO: 1144383 - RNA, 20 nt, Human
ucaccaggauagagaaaauu

SEQ ID NO: 1144384 - RNA, 25 nt, Human
uccaaguccccaccugacccagaag

SEQ ID NO: 1144385 - RNA, 20 nt, Human
uccaccaaaaggaccacccc

SEQ ID NO: 1144386 - RNA, 18 nt, Human
uccagcaaaauagaagca

SEQ ID NO: 1144387 - RNA, 25 nt, Human
uccaguggcggucagguguccuggg

SEQ ID NO: 1144388 - RNA, 24 nt, Human
ucccaaagcgcugggauuacaggc

SEQ ID NO: 1144389 - RNA, 22 nt, Human
uccccagcgccucgcccagccu

SEQ ID NO: 1144390 - RNA, 21 nt, Human
uccccgggccuuggccugacc

SEQ ID NO: 1144391 - RNA, 23 nt, Human
uccccgggccuuggccugaccuu

SEQ ID NO: 1144392 - RNA, 21 nt, Human
ucccugcagccagcugugccu

SEQ ID NO: 1144393 - RNA, 18 nt, Human
uccuggcucccaaggcuc

SEQ ID NO: 1144394 - RNA, 21 nt, Human
ucuccaaguccccaccugacc

SEQ ID NO: 1144395 - RNA, 22 nt, Human
ucuccaaguccccaccugaccc

SEQ ID NO: 1144396 - RNA, 18 nt, Human
ucugagcuuagcucacuu

SEQ ID NO: 1144397 - RNA, 24 nt, Human
ucuuaccagaaagggucagucacc

SEQ ID NO: 1144398 - RNA, 18 nt, Human
ugaccucaggugauccgc

SEQ ID NO: 1144399 - RNA, 21 nt, Human
ugaccucaggugauccgccca

SEQ ID NO: 1144400 - RNA, 24 nt, Human
ugaccucaggugauccgcccaccu

SEQ ID NO: 1144401 - RNA, 30 nt, Human
ugacgggguuucaccauguuggccaggcuu

SEQ ID NO: 1144402 - RNA, 19 nt, Human
ugaggaccuucgcugcagc

SEQ ID NO: 1144403 - RNA, 24 nt, Human
ugauccgcccaccucggccuccca

SEQ ID NO: 1144404 - RNA, 23 nt, Human
ugcagccagcugugccuucccag

SEQ ID NO: 1144405 - RNA, 20 nt, Human
ugcgcgccacgcccaaucgu

SEQ ID NO: 1144406 - RNA, 25 nt, Human
uggaagcaucccaugggcacguggu

SEQ ID NO: 1144407 - RNA, 19 nt, Human
uggaauaaaugauuugggg

SEQ ID NO: 1144408 - RNA, 24 nt, Human
uggcagagcgaggguccagcaaaa

SEQ ID NO: 1144409 - RNA, 24 nt, Human
uggccaggcugguuucaaacuccu

SEQ ID NO: 1144410 - RNA, 18 nt, Human
uggcccggaaaguggcag

SEQ ID NO: 1144411 - RNA, 19 nt, Human
ugggacagaaaaugguucc

SEQ ID NO: 1144412 - RNA, 19 nt, Human
ugggauuacaggcaugagc

SEQ ID NO: 1144413 - RNA, 21 nt, Human
ugggauuacaggcaugagcca

SEQ ID NO: 1144414 - RNA, 22 nt, Human
ugggauuacaggcaugagccac

SEQ ID NO: 1144415 - RNA, 23 nt, Human
ugggauuacaggcaugagccacc

SEQ ID NO: 1144416 - RNA, 24 nt, Human
ugggauuacaggcaugagccaccg

SEQ ID NO: 1144417 - RNA, 24 nt, Human
ugggauuacaggcaugagccaccg

SEQ ID NO: 1144418 - RNA, 20 nt, Human
uggugacgggugguuggcag

SEQ ID NO: 1144419 - RNA, 21 nt, Human
ugguggguguccggccacagc

SEQ ID NO: 1144420 - RNA, 22 nt, Human
ugguggguguccggccacagcu

SEQ ID NO: 1144421 - RNA, 18 nt, Human
ugguuggcagagcgaggg

SEQ ID NO: 1144422 - RNA, 20 nt, Human
uguccggccacagcugagcc

SEQ ID NO: 1144423 - RNA, 18 nt, Human
ugugcagguuguagaaug

SEQ ID NO: 1144424 - RNA, 20 nt, Human
uguguacacaacauuucacg

SEQ ID NO: 1144425 - RNA, 26 nt, Human
uguucccuucccucugacgcugucuu

SEQ ID NO: 1144426 - RNA, 21 nt, Human
uuagugacgggguuucaccau

SEQ ID NO: 1144427 - RNA, 24 nt, Human
uuauuagugacgggguuucaccau

SEQ ID NO: 1144428 - RNA, 21 nt, Human
uucaauggauccauuuucuaa

SEQ ID NO: 1144429 - RNA, 23 nt, Human
uucaguggggagguggugacggg

SEQ ID NO: 1144430 - RNA, 23 nt, Human
uucauuuuguucuuuguccuucc

SEQ ID NO: 1144431 - RNA, 20 nt, Human
uuccugagucuuguugagaa

SEQ ID NO: 1144432 - RNA, 20 nt, Human
uuccuucccguggguuucug

SEQ ID NO: 1144433 - RNA, 22 nt, Human
uugcuucagcuccgaggcuucu

SEQ ID NO: 1144434 - RNA, 20 nt, Human
uugguccauuuuacagaaug

SEQ ID NO: 1144435 - RNA, 19 nt, Human
uugguccauuuuacagagc

SEQ ID NO: 1144436 - RNA, 19 nt, Human
uugguccauuuuacagagu

SEQ ID NO: 1144437 - RNA, 24 nt, Human
uuucaccauguuggccaggcuggu

SEQ ID NO: 1144438 - RNA, 20 nt, Human
uuuguccccgcccauguccu

SEQ ID NO: 1144439 - RNA, 21 nt, Human
uuuuguucuuuguccuucccc

SEQ ID NO: 1144440 - RNA, 24 nt, Human
uuuuuauuagugacgggguuucac

SEQ ID NO: 1144441 - RNA, 19 nt, Human
acaucagccuugucugcau

SEQ ID NO: 1144442 - RNA, 20 nt, Human
gcgugggucacacaugcgca

SEQ ID NO: 1144443 - RNA, 19 nt, Human
ucaggccagcgugggucac

SEQ ID NO: 1144444 - RNA, 20 nt, Human
ugacaucagccuugucugca

SEQ ID NO: 1144445 - RNA, 20 nt, Human
ugugacaauguucaggccag

SEQ ID NO: 1144446 - RNA, 19 nt, Human
uucaggccagcguggguca

SEQ ID NO: 1144447 - RNA, 21 nt, Human
acaugcaucuccccuggaucc

SEQ ID NO: 1144448 - RNA, 19 nt, Human
accacauuuccacaugcau

SEQ ID NO: 1144449 - RNA, 18 nt, Human
agacaggucagcaggggg

SEQ ID NO: 1144450 - RNA, 21 nt, Human
agcccgaugaaacgcagacug

SEQ ID NO: 1144451 - RNA, 20 nt, Human
auuccagcugugcagcucca

SEQ ID NO: 1144452 - RNA, 19 nt, Human
caggaggcccuuccaggcg

SEQ ID NO: 1144453 - RNA, 18 nt, Human
caucucggacuccaaagc

SEQ ID NO: 1144454 - RNA, 23 nt, Human
ccaaagccuguggcuccaucccg

SEQ ID NO: 1144455 - RNA, 19 nt, Human
ccacccaguggcugcugag

SEQ ID NO: 1144456 - RNA, 23 nt, Human
ccauaccagcauuccagcugugc

SEQ ID NO: 1144457 - RNA, 19 nt, Human
ccccauaccagcauuccag

SEQ ID NO: 1144458 - RNA, 20 nt, Human
ccucagucucgacauagauc

SEQ ID NO: 1144459 - RNA, 26 nt, Human
ccucugagagcccgaugaaacgcaga

SEQ ID NO: 1144460 - RNA, 25 nt, Human
cuggggcccccauaccagcauucca

SEQ ID NO: 1144461 - RNA, 22 nt, Human
cuguaccuggggcccccauacc

SEQ ID NO: 1144462 - RNA, 19 nt, Human
cuuggugagguggaaguca

SEQ ID NO: 1144463 - RNA, 18 nt, Human
gaggaggcaucucggacu

SEQ ID NO: 1144464 - RNA, 22 nt, Human
uaccuggggcccccauaccagc

SEQ ID NO: 1144465 - RNA, 23 nt, Human
uccaaagccuguggcuccauccc

SEQ ID NO: 1144466 - RNA, 20 nt, Human
uccccuggauccacccagug

SEQ ID NO: 1144467 - RNA, 21 nt, Human
uccucugagagcccgaugaaa

SEQ ID NO: 1144468 - RNA, 22 nt, Human
ucgggcaaagaagcucaccaca

SEQ ID NO: 1144469 - RNA, 20 nt, Human
ucugccaggauguccucacu

SEQ ID NO: 1144470 - RNA, 22 nt, Human
ugagguggaagucaucugccag

SEQ ID NO: 1144471 - RNA, 26 nt, Human
ugccaggaggaggcaucucggacucc

SEQ ID NO: 1144472 - RNA, 21 nt, Human
ugugcagcuccagcugggcag

SEQ ID NO: 1144473 - RNA, 21 nt, Human
ugugcagcuccagcugggcag

SEQ ID NO: 1144474 - RNA, 25 nt, Human
uuccacaugcaucuccccuggaucc

SEQ ID NO: 1144475 - RNA, 19 nt, Human
aaaaugggcaaaccagguu

SEQ ID NO: 1144476 - RNA, 24 nt, Human
aaauaaaaauauuuuaccccaaaa

SEQ ID NO: 1144477 - RNA, 23 nt, Human
aaguggcagugggaaugucacag

SEQ ID NO: 1144478 - RNA, 23 nt, Human
acuagcccuaacccuuaaguggc

SEQ ID NO: 1144479 - RNA, 21 nt, Human
agaggagcggggccccccaga

SEQ ID NO: 1144480 - RNA, 22 nt, Human
agccucucuguggggcuaaaga

SEQ ID NO: 1144481 - RNA, 18 nt, Human
aggcagggaggguggggu

SEQ ID NO: 1144482 - RNA, 21 nt, Human
aggcagggaggguggggugaa

SEQ ID NO: 1144483 - RNA, 19 nt, Human
agguggucaggaaagcuug

SEQ ID NO: 1144484 - RNA, 24 nt, Human
agguggucaggaaagcuugguaac

SEQ ID NO: 1144485 - RNA, 21 nt, Human
agugugaggccuggccaggga

SEQ ID NO: 1144486 - RNA, 19 nt, Human
aguuggccuaaggccagga

SEQ ID NO: 1144487 - RNA, 21 nt, Human
aucuucuuugaaaucuugcug

SEQ ID NO: 1144488 - RNA, 22 nt, Human
caaaaugggcaaaccagguucc

SEQ ID NO: 1144489 - RNA, 24 nt, Human
cacucccgcagggaccccuccacu

SEQ ID NO: 1144490 - RNA, 19 nt, Human
cagaggaugcuuggugagg

SEQ ID NO: 1144491 - RNA, 18 nt, Human
cagcaggaccagcuccuc

SEQ ID NO: 1144492 - RNA, 18 nt, Human
cagugggaaugucacagc

SEQ ID NO: 1144493 - RNA, 19 nt, Human
ccacucccugcucucuccc

SEQ ID NO: 1144494 - RNA, 20 nt, Human
ccauuccaucacauuagcaa

SEQ ID NO: 1144495 - RNA, 21 nt, Human
cccaaaacauguuucuuugcc

SEQ ID NO: 1144496 - RNA, 21 nt, Human
ccccagagaccuuccaauccu

SEQ ID NO: 1144497 - RNA, 21 nt, Human
cccccagagaccuuccaaucc

SEQ ID NO: 1144498 - RNA, 26 nt, Human
ccgcagggaccccuccacuccuuccc

SEQ ID NO: 1144499 - RNA, 18 nt, Human
ccuaccaucaggugguca

SEQ ID NO: 1144500 - RNA, 26 nt, Human
ccucccaauccuaaagagaugaacua

SEQ ID NO: 1144501 - RNA, 19 nt, Human
ccuuaaguggcagugggaa

SEQ ID NO: 1144502 - RNA, 19 nt, Human
cggcuucuugagcuguccu

SEQ ID NO: 1144503 - RNA, 26 nt, Human
cuccuucccuguguggcccugggcca

SEQ ID NO: 1144504 - RNA, 23 nt, Human
cucuaagcagcaggaccagcucu

SEQ ID NO: 1144505 - RNA, 19 nt, Human
cuuuccagccugacucugg

SEQ ID NO: 1144506 - RNA, 24 nt, Human
gaggugacuuaggcagggagggug

SEQ ID NO: 1144507 - RNA, 18 nt, Human
gaucuuuuucuuccugac

SEQ ID NO: 1144508 - RNA, 18 nt, Human
gcccuaacccuuaagugg

SEQ ID NO: 1144509 - RNA, 22 nt, Human
ggaaaauuugcaucuguaaaga

SEQ ID NO: 1144510 - RNA, 19 nt, Human
ggaggguggggugaaggcu

SEQ ID NO: 1144511 - RNA, 21 nt, Human
ggugacagaggaggccuggaa

SEQ ID NO: 1144512 - RNA, 20 nt, Human
uaaacucugauuuuuuuuau

SEQ ID NO: 1144513 - RNA, 21 nt, Human
uaaggugaaaaaauaguagau

SEQ ID NO: 1144514 - RNA, 21 nt, Human
uaauaugacucuaagcagcag

SEQ ID NO: 1144515 - RNA, 21 nt, Human
ucccauuaagccaacugacuc

SEQ ID NO: 1144516 - RNA, 21 nt, Human
ucccugagccacucccugcuc

SEQ ID NO: 1144517 - RNA, 25 nt, Human
ucgucaguaccagaggaugcuuggu

SEQ ID NO: 1144518 - RNA, 19 nt, Human
ucuaugauucucugacuag

SEQ ID NO: 1144519 - RNA, 20 nt, Human
ucucugacuagcccuaaccc

SEQ ID NO: 1144520 - RNA, 20 nt, Human
ucugcugauaccccccuaca

SEQ ID NO: 1144521 - RNA, 18 nt, Human
ucuuuuucuuccugaccc

SEQ ID NO: 1144522 - RNA, 19 nt, Human
ugacagaggaggccuggaa

SEQ ID NO: 1144523 - RNA, 22 nt, Human
ugacagguggggcaggugaucc

SEQ ID NO: 1144524 - RNA, 22 nt, Human
ugagcuguccugaugguuccuu

SEQ ID NO: 1144525 - RNA, 18 nt, Human
ugggcaaaccagguuccc

SEQ ID NO: 1144526 - RNA, 24 nt, Human
uggggcaggugauccuuccccccg

SEQ ID NO: 1144527 - RNA, 22 nt, Human
ugguaaccaggccaaaagcauc

SEQ ID NO: 1144528 - RNA, 22 nt, Human
uuagugugaggccuggccaggg

SEQ ID NO: 1144529 - RNA, 18 nt, Human
uucaauuucugcugauac

SEQ ID NO: 1144530 - RNA, 25 nt, Human
uucccuguguggcccugggccaucu

SEQ ID NO: 1144531 - RNA, 23 nt, Human
uucuaugauucucugacuagccg

SEQ ID NO: 1144532 - RNA, 21 nt, Human
uucucaucagauagguuucau

SEQ ID NO: 1144533 - RNA, 22 nt, Human
aaaaaaaaaaaaaaaaucaaag

SEQ ID NO: 1144534 - RNA, 25 nt, Human
aaaaacaaaaacaaaacaaaacaaa

SEQ ID NO: 1144535 - RNA, 23 nt, Human
aaaaacaaaacaaaacaaaaaga

SEQ ID NO: 1144536 - RNA, 27 nt, Human
aaaacaaaacaaaacaaaaagacuuaa

SEQ ID NO: 1144537 - RNA, 27 nt, Human
aaaagaccaagacacaugggcugggug

SEQ ID NO: 1144538 - RNA, 19 nt, Human
aaacaaaacaaaacaaaaa

SEQ ID NO: 1144539 - RNA, 19 nt, Human
aaacaaugcuagacucuca

SEQ ID NO: 1144540 - RNA, 24 nt, Human
aaagugcugggauuagaggcauga

SEQ ID NO: 1144541 - RNA, 23 nt, Human
aacaaaaagacuuaagacaugga

SEQ ID NO: 1144542 - RNA, 20 nt, Human
aacaaaacaaaaagacuuaa

SEQ ID NO: 1144543 - RNA, 19 nt, Human
aacagggugagaccccauc

SEQ ID NO: 1144544 - RNA, 20 nt, Human
aacagggugagaccccaucu

SEQ ID NO: 1144545 - RNA, 21 nt, Human
aacagggugagaccccaucuc

SEQ ID NO: 1144546 - RNA, 23 nt, Human
aagaucacgccacugcacuccag

SEQ ID NO: 1144547 - RNA, 19 nt, Human
aaguagcugggacuacagg

SEQ ID NO: 1144548 - RNA, 20 nt, Human
aaguagcugggacuacaggu

SEQ ID NO: 1144549 - RNA, 19 nt, Human
aagugcugggauuagaggc

SEQ ID NO: 1144550 - RNA, 24 nt, Human
aaucucuugaaccugggaggcgga

SEQ ID NO: 1144551 - RNA, 22 nt, Human
aauuuuuguauuuuaguagaga

SEQ ID NO: 1144552 - RNA, 24 nt, Human
aauuuuuguauuuuaguagagacg

SEQ ID NO: 1144553 - RNA, 21 nt, Human
acaaaacaaaacaaaaagacu

SEQ ID NO: 1144554 - RNA, 23 nt, Human
acaaaacaaaacaaaaagacuua

SEQ ID NO: 1144555 - RNA, 26 nt, Human
acaaaacaaaacaaaaagacuuaaga

SEQ ID NO: 1144556 - RNA, 22 nt, Human
acagacugagacucugucaaaa

SEQ ID NO: 1144557 - RNA, 19 nt, Human
acagaugcauauuuucccc

SEQ ID NO: 1144558 - RNA, 20 nt, Human
accagccuggccaacagggu

SEQ ID NO: 1144559 - RNA, 24 nt, Human
accauguugcccaggcuggucucg

SEQ ID NO: 1144560 - RNA, 25 nt, Human
accauguugcccaggcuggucucga

SEQ ID NO: 1144561 - RNA, 18 nt, Human
acccgcuuuucuuuuuuu

SEQ ID NO: 1144562 - RNA, 18 nt, Human
acgccacugcacuccagc

SEQ ID NO: 1144563 - RNA, 22 nt, Human
acgccacugcacuccagccugg

SEQ ID NO: 1144564 - RNA, 18 nt, Human
acgggguuucaccauguu

SEQ ID NO: 1144565 - RNA, 19 nt, Human
acgggguuucaccauguug

SEQ ID NO: 1144566 - RNA, 24 nt, Human
acgggguuucaccauguugcccag

SEQ ID NO: 1144567 - RNA, 19 nt, Human
acuacaggugcaugccacu

SEQ ID NO: 1144568 - RNA, 21 nt, Human
acugcaaccucugcccgccgg

SEQ ID NO: 1144569 - RNA, 22 nt, Human
acugcaaccucugcccgccggg

SEQ ID NO: 1144570 - RNA, 18 nt, Human
acugcacuccagccuggg

SEQ ID NO: 1144571 - RNA, 24 nt, Human
acugcacuccagccugggugacag

SEQ ID NO: 1144572 - RNA, 25 nt, Human
acuuuguugcccaagcuggagugca

SEQ ID NO: 1144573 - RNA, 22 nt, Human
agacaggagaaucucuugaacc

SEQ ID NO: 1144574 - RNA, 24 nt, Human
agacaggagaaucucuugaaccug

SEQ ID NO: 1144575 - RNA, 27 nt, Human
agacucugucaaaaacaaaaacaaagc

SEQ ID NO: 1144576 - RNA, 22 nt, Human
agacugagacucugucaaaaac

SEQ ID NO: 1144577 - RNA, 24 nt, Human
agcacuuugggaggccgagguggg

SEQ ID NO: 1144578 - RNA, 18 nt, Human
agcagggcaugguggugc

SEQ ID NO: 1144579 - RNA, 24 nt, Human
agccuggccaacagggugagaccc

SEQ ID NO: 1144580 - RNA, 24 nt, Human
agccugggugacagacugagacuc

SEQ ID NO: 1144581 - RNA, 20 nt, Human
aggaauuugagaccagccug

SEQ ID NO: 1144582 - RNA, 25 nt, Human
aggagugagauaguugugcaggggu

SEQ ID NO: 1144583 - RNA, 23 nt, Human
aggcaaucugcccgccuuggucu

SEQ ID NO: 1144584 - RNA, 21 nt, Human
aggccgagguggguggaucac

SEQ ID NO: 1144585 - RNA, 19 nt, Human
aggcggagguugcagcgag

SEQ ID NO: 1144586 - RNA, 24 nt, Human
aggcggagguugcagcgagccaag

SEQ ID NO: 1144587 - RNA, 24 nt, Human
aggcugagacaggagaaucucuug

SEQ ID NO: 1144588 - RNA, 18 nt, Human
agguauggacauguugac

SEQ ID NO: 1144589 - RNA, 22 nt, Human
agguggguggaucaccugaggu

SEQ ID NO: 1144590 - RNA, 25 nt, Human
aguagcugggacuacaggugcaugc

SEQ ID NO: 1144591 - RNA, 21 nt, Human
agugcaguggcacgaucucug

SEQ ID NO: 1144592 - RNA, 21 nt, Human
auaaaacucaucugaugagaa

SEQ ID NO: 1144593 - RNA, 24 nt, Human
aucacgccacugcacuccagccug

SEQ ID NO: 1144594 - RNA, 22 nt, Human
augguuuguugggcaugacucc

SEQ ID NO: 1144595 - RNA, 26 nt, Human
auuugguucagccauuguuccccagg

SEQ ID NO: 1144596 - RNA, 23 nt, Human
caaaacaaaacaaaaagacuuaa

SEQ ID NO: 1144597 - RNA, 24 nt, Human
caaagugcugggauuagaggcaug

SEQ ID NO: 1144598 - RNA, 25 nt, Human
caaagugcugggauuagaggcauga

SEQ ID NO: 1144599 - RNA, 24 nt, Human
cacaccuguugucccagcuacuug

SEQ ID NO: 1144600 - RNA, 24 nt, Human
caccauguugcccaggcuggucuc

SEQ ID NO: 1144601 - RNA, 27 nt, Human
caccauguugcccaggcuggucucgaa

SEQ ID NO: 1144602 - RNA, 18 nt, Human
caccugaggucaggaauu

SEQ ID NO: 1144603 - RNA, 23 nt, Human
caccuguugucccagcuacuugg

SEQ ID NO: 1144604 - RNA, 24 nt, Human
caccuguugucccagcuacuuggg

SEQ ID NO: 1144605 - RNA, 18 nt, Human
cacuccagccugggugac

SEQ ID NO: 1144606 - RNA, 21 nt, Human
cacuccagccugggugacaga

SEQ ID NO: 1144607 - RNA, 24 nt, Human
cacuccagccugggugacagacug

SEQ ID NO: 1144608 - RNA, 19 nt, Human
cacugcacuccagccuggg

SEQ ID NO: 1144609 - RNA, 21 nt, Human
cacugcacuccagccugggug

SEQ ID NO: 1144610 - RNA, 22 nt, Human
cacugcacuccagccuggguga

SEQ ID NO: 1144611 - RNA, 23 nt, Human
cacugcacuccagccugggugac

SEQ ID NO: 1144612 - RNA, 24 nt, Human
cacugcacuccagccugggugaca

SEQ ID NO: 1144613 - RNA, 24 nt, Human
cacugcacuccagccugggugaca

SEQ ID NO: 1144614 - RNA, 22 nt, Human
cacuuuguugcccaagcuggag

SEQ ID NO: 1144615 - RNA, 24 nt, Human
cacuuuguugcccaagcuggagug

SEQ ID NO: 1144616 - RNA, 24 nt, Human
cagcacuuugggaggccgaggugg

SEQ ID NO: 1144617 - RNA, 19 nt, Human
cauguugcccaggcugguc

SEQ ID NO: 1144618 - RNA, 21 nt, Human
cauguugcccaggcuggucuc

SEQ ID NO: 1144619 - RNA, 23 nt, Human
cauguugcccaggcuggucucga

SEQ ID NO: 1144620 - RNA, 24 nt, Human
cauguugcccaggcuggucucgaa

SEQ ID NO: 1144621 - RNA, 20 nt, Human
cauuuaagcaaaccuggcug

SEQ ID NO: 1144622 - RNA, 22 nt, Human
ccaaagugcugggauuagaggc

SEQ ID NO: 1144623 - RNA, 24 nt, Human
ccaaagugcugggauuagaggcau

SEQ ID NO: 1144624 - RNA, 24 nt, Human
ccaagacacaugggcugggugcgg

SEQ ID NO: 1144625 - RNA, 20 nt, Human
ccacugcacuccagccuggg

SEQ ID NO: 1144626 - RNA, 20 nt, Human
ccacugcacuccagccuggg

SEQ ID NO: 1144627 - RNA, 21 nt, Human
ccacugcacuccagccugggu

SEQ ID NO: 1144628 - RNA, 21 nt, Human
ccacugcacuccagccugggu

SEQ ID NO: 1144629 - RNA, 23 nt, Human
ccacugcacuccagccuggguga

SEQ ID NO: 1144630 - RNA, 23 nt, Human
ccacugcacuccagccuggguga

SEQ ID NO: 1144631 - RNA, 24 nt, Human
ccacugcacuccagccugggugac

SEQ ID NO: 1144632 - RNA, 24 nt, Human
ccagauuaaaaaaaaaaaaaaaaa

SEQ ID NO: 1144633 - RNA, 28 nt, Human
ccagauuaaaaaaaaaaaaaaaaaucaa

SEQ ID NO: 1144634 - RNA, 24 nt, Human
ccagccaauuuaaacauuuucuaa

SEQ ID NO: 1144635 - RNA, 22 nt, Human
ccagccuggccaacagggugag

SEQ ID NO: 1144636 - RNA, 23 nt, Human
cccaagcuggagugcaguggcac

SEQ ID NO: 1144637 - RNA, 22 nt, Human
cccaaguagcugggacuacagg

SEQ ID NO: 1144638 - RNA, 24 nt, Human
cccaaguagcugggacuacaggug

SEQ ID NO: 1144639 - RNA, 24 nt, Human
ccccuuagauaggaauuugggcca

SEQ ID NO: 1144640 - RNA, 22 nt, Human
cccgccuuggucuuccaaagug

SEQ ID NO: 1144641 - RNA, 19 nt, Human
ccgcagcauccuuuucucc

SEQ ID NO: 1144642 - RNA, 18 nt, Human
ccggcgccuuucucucca

SEQ ID NO: 1144643 - RNA, 18 nt, Human
ccucuucauagcagggau

SEQ ID NO: 1144644 - RNA, 22 nt, Human
ccugaggucaggaauuugagac

SEQ ID NO: 1144645 - RNA, 24 nt, Human
ccuggccaacagggugagacccca

SEQ ID NO: 1144646 - RNA, 19 nt, Human
ccuggcugguccauuuucu

SEQ ID NO: 1144647 - RNA, 19 nt, Human
ccugggaggcggagguugc

SEQ ID NO: 1144648 - RNA, 22 nt, Human
ccugggugacagacugagacuc

SEQ ID NO: 1144649 - RNA, 20 nt, Human
ccuguaauuacagcacuuug

SEQ ID NO: 1144650 - RNA, 24 nt, Human
ccuguaauuacagcacuuugggag

SEQ ID NO: 1144651 - RNA, 21 nt, Human
ccuguugucccagcuacuugg

SEQ ID NO: 1144652 - RNA, 23 nt, Human
cgagccaagaucacgccacugca

SEQ ID NO: 1144653 - RNA, 24 nt, Human
cgagguggguggaucaccugaggu

SEQ ID NO: 1144654 - RNA, 24 nt, Human
cggcuccaagcaggagugagauag

SEQ ID NO: 1144655 - RNA, 24 nt, Human
cgggguuucaccauguugcccagg

SEQ ID NO: 1144656 - RNA, 24 nt, Human
cucacuuuguugcccaagcuggag

SEQ ID NO: 1144657 - RNA, 24 nt, Human
cucagcuucccaaguagcugggac

SEQ ID NO: 1144658 - RNA, 24 nt, Human
cucaugccuguaauuacagcacuu

SEQ ID NO: 1144659 - RNA, 19 nt, Human
cuccuuccucagcuuccca

SEQ ID NO: 1144660 - RNA, 22 nt, Human
cucucagucucuucaggauugg

SEQ ID NO: 1144661 - RNA, 19 nt, Human
cucugucaaaaacaaaaac

SEQ ID NO: 1144662 - RNA, 24 nt, Human
cugcaaccucugcccgccggguuc

SEQ ID NO: 1144663 - RNA, 21 nt, Human
cuguugucccagcuacuuggg

SEQ ID NO: 1144664 - RNA, 18 nt, Human
gacagcagggaucguugg

SEQ ID NO: 1144665 - RNA, 20 nt, Human
gacauggaguacauuaguuu

SEQ ID NO: 1144666 - RNA, 22 nt, Human
gacgggguuucaccauguugcc

SEQ ID NO: 1144667 - RNA, 19 nt, Human
gacuggaaagcaagucacc

SEQ ID NO: 1144668 - RNA, 19 nt, Human
gagaccagccuggccaaca

SEQ ID NO: 1144669 - RNA, 23 nt, Human
gagacgggguuucaccauguugc

SEQ ID NO: 1144670 - RNA, 23 nt, Human
gagguggguggaucaccugaggu

SEQ ID NO: 1144671 - RNA, 25 nt, Human
gagguggguggaucaccugagguca

SEQ ID NO: 1144672 - RNA, 19 nt, Human
gagguugcagcgagccaag

SEQ ID NO: 1144673 - RNA, 24 nt, Human
gaucaccugaggucaggaauuuga

SEQ ID NO: 1144674 - RNA, 21 nt, Human
gauuagaggcaugagacacug

SEQ ID NO: 1144675 - RNA, 24 nt, Human
gauuagaggcaugagacacugugc

SEQ ID NO: 1144676 - RNA, 23 nt, Human
gcagggcaugguggugcacaccu

SEQ ID NO: 1144677 - RNA, 24 nt, Human
gccaacagggugagaccccaucuc

SEQ ID NO: 1144678 - RNA, 19 nt, Human
gccacugcacuccagccug

SEQ ID NO: 1144679 - RNA, 24 nt, Human
gccacugcacuccagccuggguga

SEQ ID NO: 1144680 - RNA, 27 nt, Human
gccagauuaaaaaaaaaaaaaaaaauc

SEQ ID NO: 1144681 - RNA, 22 nt, Human
gcccucaggagguccugagaac

SEQ ID NO: 1144682 - RNA, 22 nt, Human
gccuuggucuuccaaagugcug

SEQ ID NO: 1144683 - RNA, 20 nt, Human
gcgguggcucaugccuguaa

SEQ ID NO: 1144684 - RNA, 25 nt, Human
gcuggagugcaguggcacgaucucu

SEQ ID NO: 1144685 - RNA, 19 nt, Human
gcugggugcgguggcucau

SEQ ID NO: 1144686 - RNA, 20 nt, Human
ggagguugcagcgagccaag

SEQ ID NO: 1144687 - RNA, 24 nt, Human
ggagguugcagcgagccaagauca

SEQ ID NO: 1144688 - RNA, 19 nt, Human
ggcugggugcgguggcuca

SEQ ID NO: 1144689 - RNA, 23 nt, Human
ggcugggugcgguggcucaugcc

SEQ ID NO: 1144690 - RNA, 23 nt, Human
gggguuucaccauguugcccagg

SEQ ID NO: 1144691 - RNA, 21 nt, Human
gguggaucaccugaggucagg

SEQ ID NO: 1144692 - RNA, 19 nt, Human
gguggcucaugccuguaau

SEQ ID NO: 1144693 - RNA, 24 nt, Human
gguggcucaugccuguaauuacag

SEQ ID NO: 1144694 - RNA, 23 nt, Human
guagagacgggguuucaccaugu

SEQ ID NO: 1144695 - RNA, 26 nt, Human
uaaaaaagaccaagacacaugggcug

SEQ ID NO: 1144696 - RNA, 21 nt, Human
uaaaacaaugcuagacucuca

SEQ ID NO: 1144697 - RNA, 22 nt, Human
uaaaacacaaaaauuagcaggg

SEQ ID NO: 1144698 - RNA, 23 nt, Human
uaaauuuuuguauuuuaguagag

SEQ ID NO: 1144699 - RNA, 24 nt, Human
uaaauuuuuguauuuuaguagaga

SEQ ID NO: 1144700 - RNA, 27 nt, Human
uacagcacuuugggaggccgagguggg

SEQ ID NO: 1144701 - RNA, 23 nt, Human
uacugcaaccucugcccgccggg

SEQ ID NO: 1144702 - RNA, 22 nt, Human
uagagacgggguuucaccaugu

SEQ ID NO: 1144703 - RNA, 21 nt, Human
uagccggcuccaagcaggagu

SEQ ID NO: 1144704 - RNA, 24 nt, Human
uaguagagacgggguuucaccaug

SEQ ID NO: 1144705 - RNA, 26 nt, Human
uaguagagacgggguuucaccauguu

SEQ ID NO: 1144706 - RNA, 19 nt, Human
ucaaaaacaaaaacaaaac

SEQ ID NO: 1144707 - RNA, 23 nt, Human
ucacgccacugcacuccagccug

SEQ ID NO: 1144708 - RNA, 22 nt, Human
ucaucaaccaaaucgggaaagc

SEQ ID NO: 1144709 - RNA, 24 nt, Human
uccagccugggugacagacugaga

SEQ ID NO: 1144710 - RNA, 23 nt, Human
uccaggcuauagguaaagguaaa

SEQ ID NO: 1144711 - RNA, 22 nt, Human
uccauuuucugaacuagccagu

SEQ ID NO: 1144712 - RNA, 24 nt, Human
ucccaaguagcugggacuacaggu

SEQ ID NO: 1144713 - RNA, 21 nt, Human
uccugaggucaggcaaucugc

SEQ ID NO: 1144714 - RNA, 23 nt, Human
ucucacuuuguugcccaagcugg

SEQ ID NO: 1144715 - RNA, 24 nt, Human
ucucacuuuguugcccaagcugga

SEQ ID NO: 1144716 - RNA, 19 nt, Human
ucucgaacuccugagguca

SEQ ID NO: 1144717 - RNA, 22 nt, Human
ucucuugaaccugggaggcgga

SEQ ID NO: 1144718 - RNA, 24 nt, Human
ucucuugaaccugggaggcggagg

SEQ ID NO: 1144719 - RNA, 21 nt, Human
ucugucccggcgccuuucucu

SEQ ID NO: 1144720 - RNA, 24 nt, Human
ugaaccugggaggcggagguugca

SEQ ID NO: 1144721 - RNA, 20 nt, Human
ugacccgugacacggcccuc

SEQ ID NO: 1144722 - RNA, 21 nt, Human
ugagaacaugugcccaaggug

SEQ ID NO: 1144723 - RNA, 20 nt, Human
ugagacaggagaaucucuug

SEQ ID NO: 1144724 - RNA, 24 nt, Human
ugagacaggagaaucucuugaacc

SEQ ID NO: 1144725 - RNA, 23 nt, Human
ugagaccagccuggccaacaggg

SEQ ID NO: 1144726 - RNA, 21 nt, Human
ugaggcagcuucugaaauggu

SEQ ID NO: 1144727 - RNA, 22 nt, Human
ugagggccacaggaagaccccu

SEQ ID NO: 1144728 - RNA, 18 nt, Human
ugaggucaggcaaucugc

SEQ ID NO: 1144729 - RNA, 23 nt, Human
ugcaggggugcauuuaagcaaac

SEQ ID NO: 1144730 - RNA, 24 nt, Human
ugcccaagcuggagugcaguggca

SEQ ID NO: 1144731 - RNA, 24 nt, Human
ugcccaggcuggucucgaacuccu

SEQ ID NO: 1144732 - RNA, 24 nt, Human
ugccuguaauuacagcacuuuggg

SEQ ID NO: 1144733 - RNA, 19 nt, Human
uggaagaaaaagaucuagc

SEQ ID NO: 1144734 - RNA, 22 nt, Human
uggagugcaguggcacgaucuc

SEQ ID NO: 1144735 - RNA, 24 nt, Human
uggagugcaguggcacgaucucug

SEQ ID NO: 1144736 - RNA, 23 nt, Human
uggaucaccugaggucaggaauu

SEQ ID NO: 1144737 - RNA, 24 nt, Human
uggaucaccugaggucaggaauuu

SEQ ID NO: 1144738 - RNA, 27 nt, Human
uggaucaccugaggucaggaauuugag

SEQ ID NO: 1144739 - RNA, 19 nt, Human
uggcaaagaaacauguuuu

SEQ ID NO: 1144740 - RNA, 24 nt, Human
uggcucaugccuguaauuacagca

SEQ ID NO: 1144741 - RNA, 21 nt, Human
ugggacuacaggugcaugcca

SEQ ID NO: 1144742 - RNA, 22 nt, Human
ugggacuacaggugcaugccac

SEQ ID NO: 1144743 - RNA, 22 nt, Human
ugggacuacaggugcaugccac

SEQ ID NO: 1144744 - RNA, 24 nt, Human
ugggacuacaggugcaugccacua

SEQ ID NO: 1144745 - RNA, 23 nt, Human
ugggaggccgagguggguggauc

SEQ ID NO: 1144746 - RNA, 24 nt, Human
ugggaggccgagguggguggauca

SEQ ID NO: 1144747 - RNA, 20 nt, Human
ugggaggcggagguugcagc

SEQ ID NO: 1144748 - RNA, 22 nt, Human
ugggaggcggagguugcagcgg

SEQ ID NO: 1144749 - RNA, 23 nt, Human
ugggagggccuggaagaaaaaga

SEQ ID NO: 1144750 - RNA, 28 nt, Human
ugggaucaauaggaagcacauguucagg

SEQ ID NO: 1144751 - RNA, 21 nt, Human
ugggauuagaggcaugagaca

SEQ ID NO: 1144752 - RNA, 24 nt, Human
ugggauuagaggcaugagacacug

SEQ ID NO: 1144753 - RNA, 18 nt, Human
ugggccagauuaaaaaaa

SEQ ID NO: 1144754 - RNA, 24 nt, Human
ugggccagauuaaaaaaaaaaaaa

SEQ ID NO: 1144755 - RNA, 24 nt, Human
uggguggaucaccugaggucagga

SEQ ID NO: 1144756 - RNA, 22 nt, Human
uggugcacaccuguugucccag

SEQ ID NO: 1144757 - RNA, 21 nt, Human
uggugggaaaaaaugugaguu

SEQ ID NO: 1144758 - RNA, 20 nt, Human
ugucaaaaacaaaaacaaaa

SEQ ID NO: 1144759 - RNA, 21 nt, Human
ugucaaaaacaaaaacaaaac

SEQ ID NO: 1144760 - RNA, 22 nt, Human
ugucaaaaacaaaaacaaaaca

SEQ ID NO: 1144761 - RNA, 25 nt, Human
uguuugaagagauuuauucugagcc

SEQ ID NO: 1144762 - RNA, 20 nt, Human
uuacagaugcauauuuuccc

SEQ ID NO: 1144763 - RNA, 24 nt, Human
uuacugcaaccucugcccgccggg

SEQ ID NO: 1144764 - RNA, 20 nt, Human
uuagcagggcaugguggugc

SEQ ID NO: 1144765 - RNA, 18 nt, Human
uuaguagagacgggguuu

SEQ ID NO: 1144766 - RNA, 22 nt, Human
uuaguagagacgggguuucacc

SEQ ID NO: 1144767 - RNA, 24 nt, Human
uuaguagagacgggguuucaccau

SEQ ID NO: 1144768 - RNA, 20 nt, Human
uucaaccuacuauaaagagg

SEQ ID NO: 1144769 - RNA, 24 nt, Human
uucaagcaauucuccuuccucagc

SEQ ID NO: 1144770 - RNA, 24 nt, Human
uucagaaagauggagcaacucaaa

SEQ ID NO: 1144771 - RNA, 24 nt, Human
uuccucagcuucccaaguagcugg

SEQ ID NO: 1144772 - RNA, 23 nt, Human
uucuucuuugucacaugucaugc

SEQ ID NO: 1144773 - RNA, 24 nt, Human
uugaaccugggaggcggagguugc

SEQ ID NO: 1144774 - RNA, 23 nt, Human
uugaugaagcaucucaucaggua

SEQ ID NO: 1144775 - RNA, 18 nt, Human
uugcccaagcuggagugc

SEQ ID NO: 1144776 - RNA, 25 nt, Human
uugggaggccgagguggguggauca

SEQ ID NO: 1144777 - RNA, 24 nt, Human
uugguaggacccgcuuuucuuuuu

SEQ ID NO: 1144778 - RNA, 22 nt, Human
uuucaccauguugcccaggcug

SEQ ID NO: 1144779 - RNA, 23 nt, Human
uuucaccauguugcccaggcugg

SEQ ID NO: 1144780 - RNA, 24 nt, Human
uuucaccauguugcccaggcuggu

SEQ ID NO: 1144781 - RNA, 24 nt, Human
uuuguugcccaagcuggagugcag

SEQ ID NO: 1144782 - RNA, 23 nt, Human
uuuuaguagagacgggguuucac

SEQ ID NO: 1144783 - RNA, 18 nt, Human
aaaaagcagggcaggaca

SEQ ID NO: 1144784 - RNA, 22 nt, Human
aaaggcaucuaacccugacacu

SEQ ID NO: 1144785 - RNA, 20 nt, Human
aagaggcaguuugauuccag

SEQ ID NO: 1144786 - RNA, 21 nt, Human
aagcacucaccuaaauucugg

SEQ ID NO: 1144787 - RNA, 19 nt, Human
aagcaggcuucugggagau

SEQ ID NO: 1144788 - RNA, 24 nt, Human
aaguauuuacuguacacuuacuau

SEQ ID NO: 1144789 - RNA, 18 nt, Human
aaguggcccauaaaaggc

SEQ ID NO: 1144790 - RNA, 21 nt, Human
acaaagacauacaauaucuaa

SEQ ID NO: 1144791 - RNA, 21 nt, Human
acagagcaaguuauggacaaa

SEQ ID NO: 1144792 - RNA, 22 nt, Human
acagcauuuucacuuaaccccu

SEQ ID NO: 1144793 - RNA, 24 nt, Human
accuccuaacacagcaagaacauc

SEQ ID NO: 1144794 - RNA, 18 nt, Human
acuccucccucccgcucc

SEQ ID NO: 1144795 - RNA, 19 nt, Human
agaaagaaggggacuaaaa

SEQ ID NO: 1144796 - RNA, 22 nt, Human
agcacacauauccacacacaca

SEQ ID NO: 1144797 - RNA, 18 nt, Human
agccuggguuucauggga

SEQ ID NO: 1144798 - RNA, 22 nt, Human
aggaagaaaaauagaauugcag

SEQ ID NO: 1144799 - RNA, 23 nt, Human
aggcagcugucuguuuuguagga

SEQ ID NO: 1144800 - RNA, 23 nt, Human
aggcaucugacagauauaaaaca

SEQ ID NO: 1144801 - RNA, 24 nt, Human
agggaguuggaaagagggaaggaa

SEQ ID NO: 1144802 - RNA, 21 nt, Human
aggggcucagaugucuauuau

SEQ ID NO: 1144803 - RNA, 21 nt, Human
agguuuugaaagaggcaguuu

SEQ ID NO: 1144804 - RNA, 21 nt, Human
auaaaaggacacaaagacaua

SEQ ID NO: 1144805 - RNA, 18 nt, Human
auggcccggugguggcag

SEQ ID NO: 1144806 - RNA, 24 nt, Human
augguccugugguguugggcugga

SEQ ID NO: 1144807 - RNA, 20 nt, Human
cacaaacauacaugugcacg

SEQ ID NO: 1144808 - RNA, 20 nt, Human
cacacacacacacuuauaga

SEQ ID NO: 1144809 - RNA, 24 nt, Human
cacacauauccacacacacacacu

SEQ ID NO: 1144810 - RNA, 19 nt, Human
cacauauccacacacacac

SEQ ID NO: 1144811 - RNA, 21 nt, Human
caccuaaauucugguguaggg

SEQ ID NO: 1144812 - RNA, 19 nt, Human
cacucauaaaaagcagggc

SEQ ID NO: 1144813 - RNA, 18 nt, Human
caggaaaaccacaacugc

SEQ ID NO: 1144814 - RNA, 19 nt, Human
caggggcuguguagagaag

SEQ ID NO: 1144815 - RNA, 22 nt, Human
caggugcagaaacugagacuga

SEQ ID NO: 1144816 - RNA, 22 nt, Human
cauaaaaagcagggcaggacau

SEQ ID NO: 1144817 - RNA, 24 nt, Human
cauauccacacacacacacuuaua

SEQ ID NO: 1144818 - RNA, 21 nt, Human
cauggacaaauguuuaucacc

SEQ ID NO: 1144819 - RNA, 26 nt, Human
ccacacacacacacuuauagaaagaa

SEQ ID NO: 1144820 - RNA, 21 nt, Human
ccagagguggcgggcuggaua

SEQ ID NO: 1144821 - RNA, 24 nt, Human
ccaggauauaguggcagguuuuga

SEQ ID NO: 1144822 - RNA, 18 nt, Human
ccaucuagaacccaacug

SEQ ID NO: 1144823 - RNA, 23 nt, Human
ccaugucuguacuccucccuccc

SEQ ID NO: 1144824 - RNA, 20 nt, Human
cccaaaacuuaaggccucaa

SEQ ID NO: 1144825 - RNA, 21 nt, Human
ccccucccuccccuuuuaccc

SEQ ID NO: 1144826 - RNA, 18 nt, Human
cccuacaccggguaagac

SEQ ID NO: 1144827 - RNA, 23 nt, Human
cccuccccuuuuacccuugccuu

SEQ ID NO: 1144828 - RNA, 19 nt, Human
cccuuugccagugggcaga

SEQ ID NO: 1144829 - RNA, 23 nt, Human
ccgcuccagcuccacaguuggcg

SEQ ID NO: 1144830 - RNA, 19 nt, Human
ccuccucccaucuagaacc

SEQ ID NO: 1144831 - RNA, 21 nt, Human
ccuuguaccacauguaucuuc

SEQ ID NO: 1144832 - RNA, 24 nt, Human
cggauuuucuagcucgaaacacac

SEQ ID NO: 1144833 - RNA, 19 nt, Human
cgugggccagcccaaggcu

SEQ ID NO: 1144834 - RNA, 20 nt, Human
cuaacccugacacuguugga

SEQ ID NO: 1144835 - RNA, 23 nt, Human
cucccaucuagaacccaacuguu

SEQ ID NO: 1144836 - RNA, 23 nt, Human
cucgaaacacacauucaggagca

SEQ ID NO: 1144837 - RNA, 19 nt, Human
cugaagcccuggauuacag

SEQ ID NO: 1144838 - RNA, 18 nt, Human
cugccugcaaacaucaug

SEQ ID NO: 1144839 - RNA, 25 nt, Human
cuucuguucucuuagcgggcuuccc

SEQ ID NO: 1144840 - RNA, 19 nt, Human
gaagaaaaauagaauugca

SEQ ID NO: 1144841 - RNA, 19 nt, Human
gaaggaagaaaaauagaau

SEQ ID NO: 1144842 - RNA, 22 nt, Human
gacagauauaaaacacacuccc

SEQ ID NO: 1144843 - RNA, 18 nt, Human
gaggucacaaagccagga

SEQ ID NO: 1144844 - RNA, 20 nt, Human
gcccggugguggcaggcugg

SEQ ID NO: 1144845 - RNA, 23 nt, Human
gcccggugguggcaggcugggca

SEQ ID NO: 1144846 - RNA, 23 nt, Human
gcuucccauuccuccuaugcccc

SEQ ID NO: 1144847 - RNA, 18 nt, Human
ggauuuucuagcucgaaa

SEQ ID NO: 1144848 - RNA, 20 nt, Human
ggcgugggccagcccaaggc

SEQ ID NO: 1144849 - RNA, 19 nt, Human
ggggagggaguccagaggu

SEQ ID NO: 1144850 - RNA, 19 nt, Human
gugcagaaacugagacuga

SEQ ID NO: 1144851 - RNA, 25 nt, Human
uaaaaggacacaaagacauacaaua

SEQ ID NO: 1144852 - RNA, 20 nt, Human
uaaaaucucugacaaugaca

SEQ ID NO: 1144853 - RNA, 24 nt, Human
uaaaauuccaugucuguacuccuc

SEQ ID NO: 1144854 - RNA, 22 nt, Human
uaacauggacaaauguuuauca

SEQ ID NO: 1144855 - RNA, 28 nt, Human
uaacauggacaaauguuuaucaccuccu

SEQ ID NO: 1144856 - RNA, 20 nt, Human
uaaccccuuucccuaaugag

SEQ ID NO: 1144857 - RNA, 22 nt, Human
uacaauaucuaauaacagugaa

SEQ ID NO: 1144858 - RNA, 23 nt, Human
uacacuuacuauacaccaaacau

SEQ ID NO: 1144859 - RNA, 26 nt, Human
uacuccucccucccgcuccagcucca

SEQ ID NO: 1144860 - RNA, 21 nt, Human
uagcucgaaacacacauucag

SEQ ID NO: 1144861 - RNA, 21 nt, Human
uauagauaagaaacgaaucuc

SEQ ID NO: 1144862 - RNA, 24 nt, Human
uaucaggugcauuuacccuacacc

SEQ ID NO: 1144863 - RNA, 18 nt, Human
uaucuaauaacagugaac

SEQ ID NO: 1144864 - RNA, 24 nt, Human
ucaaagcacucaccuaaauucugg

SEQ ID NO: 1144865 - RNA, 23 nt, Human
uccacacacacacacuuauagaa

SEQ ID NO: 1144866 - RNA, 19 nt, Human
uccacauagggcugggggu

SEQ ID NO: 1144867 - RNA, 21 nt, Human
uccacucauaaaaagcagggc

SEQ ID NO: 1144868 - RNA, 23 nt, Human
ucccauuccuccuaugcccccaa

SEQ ID NO: 1144869 - RNA, 23 nt, Human
ucccauuccuccuaugcccccaa

SEQ ID NO: 1144870 - RNA, 20 nt, Human
uccccugccucccuuugcca

SEQ ID NO: 1144871 - RNA, 18 nt, Human
ucccgcuccagcuccaca

SEQ ID NO: 1144872 - RNA, 20 nt, Human
ucgaaacacacauucaggag

SEQ ID NO: 1144873 - RNA, 18 nt, Human
ucucugacaaugacagga

SEQ ID NO: 1144874 - RNA, 18 nt, Human
ucucugagugucauuacu

SEQ ID NO: 1144875 - RNA, 24 nt, Human
ucucugagugucauuacuuaacuu

SEQ ID NO: 1144876 - RNA, 21 nt, Human
ucucuggagauauaauaaucu

SEQ ID NO: 1144877 - RNA, 24 nt, Human
ucugugugugucuaguucaauccc

SEQ ID NO: 1144878 - RNA, 25 nt, Human
ugaaacacaaacauacaugugcaag

SEQ ID NO: 1144879 - RNA, 25 nt, Human
ugaaacacaaacauacaugugcacg

SEQ ID NO: 1144880 - RNA, 25 nt, Human
ugaaagaggcaguuugauuccaggc

SEQ ID NO: 1144881 - RNA, 27 nt, Human
ugaauaaaaggacacaaagacauacaa

SEQ ID NO: 1144882 - RNA, 23 nt, Human
ugacagauauaaaacacacuccc

SEQ ID NO: 1144883 - RNA, 18 nt, Human
ugacaggaugugaggaau

SEQ ID NO: 1144884 - RNA, 18 nt, Human
ugacaggaugugaggaau

SEQ ID NO: 1144885 - RNA, 19 nt, Human
ugagaggcagcugucuguu

SEQ ID NO: 1144886 - RNA, 20 nt, Human
ugagauuccaagaccugaaa

SEQ ID NO: 1144887 - RNA, 25 nt, Human
ugcugagauuccaagaccugaaaca

SEQ ID NO: 1144888 - RNA, 19 nt, Human
uggaaucaucaaauggcau

SEQ ID NO: 1144889 - RNA, 23 nt, Human
uggacaaauguuuaucaccuccu

SEQ ID NO: 1144890 - RNA, 22 nt, Human
uggcgugggccagcccaaggcc

SEQ ID NO: 1144891 - RNA, 23 nt, Human
ugggcaggaaaaccacaacugcc

SEQ ID NO: 1144892 - RNA, 28 nt, Human
ugggccaggggcucagaugucggauccg

SEQ ID NO: 1144893 - RNA, 18 nt, Human
uggguuagaaagaucugg

SEQ ID NO: 1144894 - RNA, 19 nt, Human
ugguggugggaggaauagc

SEQ ID NO: 1144895 - RNA, 21 nt, Human
uguacuccucccucccgcucc

SEQ ID NO: 1144896 - RNA, 21 nt, Human
ugucuguacuccucccucccg

SEQ ID NO: 1144897 - RNA, 21 nt, Human
ugugcacgcacaccuccuccc

SEQ ID NO: 1144898 - RNA, 24 nt, Human
uguggaagagacccagcaugccuu

SEQ ID NO: 1144899 - RNA, 28 nt, Human
uguggaagagacccagcaugccuuucca

SEQ ID NO: 1144900 - RNA, 20 nt, Human
uguguugaagucccaacccu

SEQ ID NO: 1144901 - RNA, 24 nt, Human
uucaauccccucccuccccuuuua

SEQ ID NO: 1144902 - RNA, 25 nt, Human
uucaauccccucccuccccuuuuac

SEQ ID NO: 1144903 - RNA, 25 nt, Human
uuccccugccucccuuugccagugg

SEQ ID NO: 1144904 - RNA, 24 nt, Human
uucucuggagauauaauaaucuca

SEQ ID NO: 1144905 - RNA, 25 nt, Human
uuggaggauccaggacccagggagu

SEQ ID NO: 1144906 - RNA, 20 nt, Human
uuucacuuaaccccuuuccc

SEQ ID NO: 1144907 - RNA, 24 nt, Human
uuucccuaaugagcgacaccuucc

SEQ ID NO: 1144908 - RNA, 21 nt, Human
ccagauccaucuccacaaccu

SEQ ID NO: 1144909 - RNA, 18 nt, Human
uaacuucuguggucucaa

SEQ ID NO: 1144910 - RNA, 21 nt, Human
uaacuucuguggucucaaucu

SEQ ID NO: 1144911 - RNA, 19 nt, Human
uccucucuuuuuuuccacu

SEQ ID NO: 1144912 - RNA, 23 nt, Human
ugaacaacaauuuuaucaacugu

SEQ ID NO: 1144913 - RNA, 21 nt, Human
ugauccagcagacugcaucuc

SEQ ID NO: 1144914 - RNA, 19 nt, Human
aguucagcuuuuuauugaa

SEQ ID NO: 1144915 - RNA, 18 nt, Human
gcacgggcgaguguaggg

SEQ ID NO: 1144916 - RNA, 21 nt, Human
uugaacacguuauaaaagagg

SEQ ID NO: 1144917 - RNA, 20 nt, Human
aacuagaaaccagcuaacaa

SEQ ID NO: 1144918 - RNA, 23 nt, Human
aagccugcugcuggucacaaugg

SEQ ID NO: 1144919 - RNA, 23 nt, Human
ccaccgcuccgcuagcugcugaa

SEQ ID NO: 1144920 - RNA, 22 nt, Human
ccgccgccaccgcuccgcuagc

SEQ ID NO: 1144921 - RNA, 20 nt, Human
ccgcuccgcuagcugcugaa

SEQ ID NO: 1144922 - RNA, 21 nt, Human
cgcggucgggcugcagcugca

SEQ ID NO: 1144923 - RNA, 19 nt, Human
ucccaaagguuucuuucag

SEQ ID NO: 1144924 - RNA, 21 nt, Human
ucuugggggaaaaaagccugc

SEQ ID NO: 1144925 - RNA, 21 nt, Human
ucuuguugagaucauccuuug

SEQ ID NO: 1144926 - RNA, 18 nt, Human
ugagaucauccuuuguuu

SEQ ID NO: 1144927 - RNA, 19 nt, Human
aaaguacugggauuacagg

SEQ ID NO: 1144928 - RNA, 20 nt, Human
aaaguacugggauuacaggg

SEQ ID NO: 1144929 - RNA, 24 nt, Human
aaaguacugggauuacagggguga

SEQ ID NO: 1144930 - RNA, 18 nt, Human
aaguacugggauuacagg

SEQ ID NO: 1144931 - RNA, 26 nt, Human
aaguacugggauuacaggggugagcc

SEQ ID NO: 1144932 - RNA, 25 nt, Human
aagugauccucccuucucggccucc

SEQ ID NO: 1144933 - RNA, 20 nt, Human
acacagcuugucccccaucc

SEQ ID NO: 1144934 - RNA, 21 nt, Human
acacagcuugucccccauccc

SEQ ID NO: 1144935 - RNA, 21 nt, Human
acauuggaaauuccaggagcc

SEQ ID NO: 1144936 - RNA, 20 nt, Human
accuuagccuccuguguagc

SEQ ID NO: 1144937 - RNA, 27 nt, Human
acucaaaguccacacagcuuguccccc

SEQ ID NO: 1144938 - RNA, 21 nt, Human
acuggaacccaagucuaucug

SEQ ID NO: 1144939 - RNA, 26 nt, Human
agaagccaggguugaaauagaggccu

SEQ ID NO: 1144940 - RNA, 19 nt, Human
agagacacccuaaacuuga

SEQ ID NO: 1144941 - RNA, 21 nt, Human
agagacagggucuugcucugu

SEQ ID NO: 1144942 - RNA, 22 nt, Human
agagacagggucuugcucuguc

SEQ ID NO: 1144943 - RNA, 22 nt, Human
agauaaggaacugaggcucaga

SEQ ID NO: 1144944 - RNA, 23 nt, Human
aggcaaaaagcugagaagccagg

SEQ ID NO: 1144945 - RNA, 24 nt, Human
aggcaaaaagcugagaagccaggg

SEQ ID NO: 1144946 - RNA, 21 nt, Human
aggguugaaauagaggccucu

SEQ ID NO: 1144947 - RNA, 26 nt, Human
agucuaucugacucaaaguccacaca

SEQ ID NO: 1144948 - RNA, 18 nt, Human
auggcacagcaagagcug

SEQ ID NO: 1144949 - RNA, 25 nt, Human
caaacuccugggcucaagugauccu

SEQ ID NO: 1144950 - RNA, 24 nt, Human
caaaguacugggauuacaggggug

SEQ ID NO: 1144951 - RNA, 21 nt, Human
caaauggugcuauuaaacuaa

SEQ ID NO: 1144952 - RNA, 20 nt, Human
caagaagagacacccuaaac

SEQ ID NO: 1144953 - RNA, 27 nt, Human
caagugauccucccuucucggccuccc

SEQ ID NO: 1144954 - RNA, 23 nt, Human
cacagcaagagcugggcuaugua

SEQ ID NO: 1144955 - RNA, 18 nt, Human
cacaucucuccacccacc

SEQ ID NO: 1144956 - RNA, 18 nt, Human
cacccaggcugcagccug

SEQ ID NO: 1144957 - RNA, 21 nt, Human
cacccaggcugcagccuggac

SEQ ID NO: 1144958 - RNA, 24 nt, Human
cacccaggcugcagccuggaccuc

SEQ ID NO: 1144959 - RNA, 24 nt, Human
caccuuagccuccuguguagcugg

SEQ ID NO: 1144960 - RNA, 19 nt, Human
cagcgaguucuuuauuucc

SEQ ID NO: 1144961 - RNA, 23 nt, Human
caggcaaaaagcugagaagccag

SEQ ID NO: 1144962 - RNA, 24 nt, Human
cagggucuugcucugucacccagg

SEQ ID NO: 1144963 - RNA, 23 nt, Human
cauugcuguuuuacagauaagga

SEQ ID NO: 1144964 - RNA, 24 nt, Human
ccaaaguacugggauuacaggggu

SEQ ID NO: 1144965 - RNA, 18 nt, Human
ccaagucuaucugacuca

SEQ ID NO: 1144966 - RNA, 19 nt, Human
ccaucaggcaaaaagcuga

SEQ ID NO: 1144967 - RNA, 19 nt, Human
ccccacgaaacccccucag

SEQ ID NO: 1144968 - RNA, 18 nt, Human
cccgcagggaccucucca

SEQ ID NO: 1144969 - RNA, 24 nt, Human
cccgcagggaccucuccacgcuag

SEQ ID NO: 1144970 - RNA, 19 nt, Human
cccuaaacuugaacuccug

SEQ ID NO: 1144971 - RNA, 26 nt, Human
ccucccaccuuagccuccuguguagc

SEQ ID NO: 1144972 - RNA, 19 nt, Human
ccuggaccucuugggcuca

SEQ ID NO: 1144973 - RNA, 21 nt, Human
ccuggaccucuugggcucaag

SEQ ID NO: 1144974 - RNA, 22 nt, Human
ccugggcucaagugauccuccc

SEQ ID NO: 1144975 - RNA, 22 nt, Human
cuaaauaaggccacggcccguu

SEQ ID NO: 1144976 - RNA, 19 nt, Human
cucaagggauccucccacc

SEQ ID NO: 1144977 - RNA, 24 nt, Human
cucaagggauccucccaccuuagc

SEQ ID NO: 1144978 - RNA, 23 nt, Human
cuccuguguagcugggaccacag

SEQ ID NO: 1144979 - RNA, 24 nt, Human
cuccuguguagcugggaccacagg

SEQ ID NO: 1144980 - RNA, 25 nt, Human
cucuugggcucaagggauccuccca

SEQ ID NO: 1144981 - RNA, 20 nt, Human
cugacucaaaguccacacag

SEQ ID NO: 1144982 - RNA, 24 nt, Human
cuuagccuccuguguagcugggac

SEQ ID NO: 1144983 - RNA, 23 nt, Human
gaaugggccugggcaggucaaac

SEQ ID NO: 1144984 - RNA, 19 nt, Human
gaccucuccacgcuaguga

SEQ ID NO: 1144985 - RNA, 24 nt, Human
gagaagccaggguugaaauagagg

SEQ ID NO: 1144986 - RNA, 22 nt, Human
gagccccacgaaacccccucag

SEQ ID NO: 1144987 - RNA, 21 nt, Human
gagccgaagcccauuuggaaa

SEQ ID NO: 1144988 - RNA, 18 nt, Human
gauuacaggggugagcca

SEQ ID NO: 1144989 - RNA, 18 nt, Human
gccuccagccggccaggc

SEQ ID NO: 1144990 - RNA, 21 nt, Human
gcucugucacccaggcugcag

SEQ ID NO: 1144991 - RNA, 19 nt, Human
gcugcagccuggaccucuu

SEQ ID NO: 1144992 - RNA, 19 nt, Human
gcuggccucaaacuccugg

SEQ ID NO: 1144993 - RNA, 22 nt, Human
ggauccucccaccuuagccucc

SEQ ID NO: 1144994 - RNA, 19 nt, Human
ggcaaaaagcugagaagcc

SEQ ID NO: 1144995 - RNA, 20 nt, Human
ggcaagaagagacacccuaa

SEQ ID NO: 1144996 - RNA, 19 nt, Human
gggcucaagugauccuccc

SEQ ID NO: 1144997 - RNA, 19 nt, Human
uaaacuaauggcuucggga

SEQ ID NO: 1144998 - RNA, 19 nt, Human
uaaggaacugaggcucaga

SEQ ID NO: 1144999 - RNA, 25 nt, Human
uaauuuuuuuuauuuuuuugcagag

SEQ ID NO: 1145000 - RNA, 22 nt, Human
uacaccaucauggcacagcaag

SEQ ID NO: 1145001 - RNA, 20 nt, Human
uacaggggugagccaccuca

SEQ ID NO: 1145002 - RNA, 26 nt, Human
uaccuucaagcccagucagcgaguuc

SEQ ID NO: 1145003 - RNA, 19 nt, Human
uagaggccucuuucuguuu

SEQ ID NO: 1145004 - RNA, 25 nt, Human
uagcagaccccaucaggcaaaaagc

SEQ ID NO: 1145005 - RNA, 18 nt, Human
uagugagccccacgaaac

SEQ ID NO: 1145006 - RNA, 22 nt, Human
uauguugcccaggcuggccuca

SEQ ID NO: 1145007 - RNA, 23 nt, Human
uauguugcccaggcuggccucaa

SEQ ID NO: 1145008 - RNA, 24 nt, Human
uauguugcccaggcuggccucaaa

SEQ ID NO: 1145009 - RNA, 24 nt, Human
ucaagggauccucccaccuuagcc

SEQ ID NO: 1145010 - RNA, 22 nt, Human
uccacacagcuugucccccauc

SEQ ID NO: 1145011 - RNA, 23 nt, Human
ucccaaaguacugggauuacagg

SEQ ID NO: 1145012 - RNA, 21 nt, Human
uccugggcucaagugauccuc

SEQ ID NO: 1145013 - RNA, 22 nt, Human
uccugggcucaagugauccucc

SEQ ID NO: 1145014 - RNA, 18 nt, Human
ucuauguugcccaggcug

SEQ ID NO: 1145015 - RNA, 18 nt, Human
ucuauguugcccaggcug

SEQ ID NO: 1145016 - RNA, 24 nt, Human
ucuccacgcuagugagccccacga

SEQ ID NO: 1145017 - RNA, 20 nt, Human
ucucuauguugcccaggcug

SEQ ID NO: 1145018 - RNA, 23 nt, Human
ucucucuauguugcccaggcugg

SEQ ID NO: 1145019 - RNA, 19 nt, Human
ucugucacccaggcugcag

SEQ ID NO: 1145020 - RNA, 19 nt, Human
ucuugcucugucacccagg

SEQ ID NO: 1145021 - RNA, 22 nt, Human
ucuugcucugucacccaggcug

SEQ ID NO: 1145022 - RNA, 24 nt, Human
ucuugcucugucacccaggcugca

SEQ ID NO: 1145023 - RNA, 22 nt, Human
ucuugggcucaagggauccucc

SEQ ID NO: 1145024 - RNA, 18 nt, Human
ugaaauagaggccucuuu

SEQ ID NO: 1145025 - RNA, 23 nt, Human
ugaaauagaggccucuuucuguu

SEQ ID NO: 1145026 - RNA, 22 nt, Human
ugaacuccugucugugcagccu

SEQ ID NO: 1145027 - RNA, 21 nt, Human
ugagaagccaggguugaaaua

SEQ ID NO: 1145028 - RNA, 22 nt, Human
ugagaagccaggguugaaauag

SEQ ID NO: 1145029 - RNA, 20 nt, Human
ugaggcucagagagguucag

SEQ ID NO: 1145030 - RNA, 24 nt, Human
ugcagagauggggucucucuaugu

SEQ ID NO: 1145031 - RNA, 28 nt, Human
ugcccaggcuggccucaaacuccugggc

SEQ ID NO: 1145032 - RNA, 21 nt, Human
ugccuuuaggugauagagcua

SEQ ID NO: 1145033 - RNA, 19 nt, Human
ugcucugucacccaggcug

SEQ ID NO: 1145034 - RNA, 19 nt, Human
uggcacagcaagagcuggg

SEQ ID NO: 1145035 - RNA, 21 nt, Human
uggcacagcaagagcugggcu

SEQ ID NO: 1145036 - RNA, 21 nt, Human
uggcuuccaaauaaauacauu

SEQ ID NO: 1145037 - RNA, 20 nt, Human
ugggaccacaggcgugcacc

SEQ ID NO: 1145038 - RNA, 21 nt, Human
ugggaccacaggcgugcaccg

SEQ ID NO: 1145039 - RNA, 24 nt, Human
ugggaccacaggcgugcaccgcca

SEQ ID NO: 1145040 - RNA, 18 nt, Human
ugggauuacaggggugag

SEQ ID NO: 1145041 - RNA, 19 nt, Human
ugggauuacaggggugagc

SEQ ID NO: 1145042 - RNA, 21 nt, Human
ugggauuacaggggugagcca

SEQ ID NO: 1145043 - RNA, 22 nt, Human
ugggauuacaggggugagccac

SEQ ID NO: 1145044 - RNA, 23 nt, Human
ugggauuacaggggugagccacc

SEQ ID NO: 1145045 - RNA, 18 nt, Human
ugggcaggucaaacaggg

SEQ ID NO: 1145046 - RNA, 22 nt, Human
ugggcaggucaaacaggggcca

SEQ ID NO: 1145047 - RNA, 20 nt, Human
ugggcucaagugauccuccc

SEQ ID NO: 1145048 - RNA, 24 nt, Human
uggggucucucuauguugcccagg

SEQ ID NO: 1145049 - RNA, 19 nt, Human
uguagcugggaccacaggc

SEQ ID NO: 1145050 - RNA, 25 nt, Human
uguagcugggaccacaggcgugcac

SEQ ID NO: 1145051 - RNA, 21 nt, Human
ugucacagcuagcauuucacu

SEQ ID NO: 1145052 - RNA, 24 nt, Human
uugcagagauggggucucucuaug

SEQ ID NO: 1145053 - RNA, 22 nt, Human
uuggagaaugggccugggcagg

SEQ ID NO: 1145054 - RNA, 28 nt, Human
uuuuauuuuuuugcagagauggggucuu

SEQ ID NO: 1145055 - RNA, 24 nt, Human
uuuuuuuuauuuuuuugcagagau

SEQ ID NO: 1145056 - RNA, 23 nt, Human
aagccaauucagauuggcuauuu

SEQ ID NO: 1145057 - RNA, 22 nt, Human
aagcuuuuggacacuccaaccu

SEQ ID NO: 1145058 - RNA, 21 nt, Human
acuaagaaugacuaaagacaa

SEQ ID NO: 1145059 - RNA, 24 nt, Human
acucauuguacuuaaucuuccccc

SEQ ID NO: 1145060 - RNA, 20 nt, Human
agaaccuuuaggcagcugag

SEQ ID NO: 1145061 - RNA, 23 nt, Human
agcuuuuggacacuccaaccucu

SEQ ID NO: 1145062 - RNA, 23 nt, Human
aggacagagcagguuacuaagaa

SEQ ID NO: 1145063 - RNA, 25 nt, Human
agguguuagaggcuagaagggggcu

SEQ ID NO: 1145064 - RNA, 25 nt, Human
auggagcaauggcaagaucacaccg

SEQ ID NO: 1145065 - RNA, 18 nt, Human
caaagaacagagaagcug

SEQ ID NO: 1145066 - RNA, 19 nt, Human
caaagcagguguuagaggc

SEQ ID NO: 1145067 - RNA, 22 nt, Human
caagaucacaccggacaaggga

SEQ ID NO: 1145068 - RNA, 18 nt, Human
caauggcaagaucacacc

SEQ ID NO: 1145069 - RNA, 21 nt, Human
cagagaagcugaacauacuga

SEQ ID NO: 1145070 - RNA, 24 nt, Human
cagcugagcagaaccguuaggcac

SEQ ID NO: 1145071 - RNA, 22 nt, Human
caguccccgccgcucgcccucg

SEQ ID NO: 1145072 - RNA, 22 nt, Human
cauauuuguucuuugaugagga

SEQ ID NO: 1145073 - RNA, 19 nt, Human
cccgccgcucgcccucgcc

SEQ ID NO: 1145074 - RNA, 19 nt, Human
cccgcugcucgcccuuccc

SEQ ID NO: 1145075 - RNA, 18 nt, Human
ccgcccugacaagacuag

SEQ ID NO: 1145076 - RNA, 20 nt, Human
ccgccgcucgcccucgcccu

SEQ ID NO: 1145077 - RNA, 25 nt, Human
ccgccgcucgcccucgcccuucuuc

SEQ ID NO: 1145078 - RNA, 20 nt, Human
ccucccgcugcucgcccuuc

SEQ ID NO: 1145079 - RNA, 21 nt, Human
cgcccugacaagacuagaaau

SEQ ID NO: 1145080 - RNA, 24 nt, Human
cgcugcucgcccuuccccaguccc

SEQ ID NO: 1145081 - RNA, 21 nt, Human
cuucagucccugcauccgccc

SEQ ID NO: 1145082 - RNA, 21 nt, Human
gauggagcaauggcaagauca

SEQ ID NO: 1145083 - RNA, 20 nt, Human
gccaagcuuuuggacacucc

SEQ ID NO: 1145084 - RNA, 18 nt, Human
ggagcaauggcaagauca

SEQ ID NO: 1145085 - RNA, 22 nt, Human
ggcagggguaugagcuggagug

SEQ ID NO: 1145086 - RNA, 20 nt, Human
uaaaacggagaacaaagaac

SEQ ID NO: 1145087 - RNA, 20 nt, Human
uagaagggggcuguuuaaug

SEQ ID NO: 1145088 - RNA, 18 nt, Human
uccccaguccccgccgcu

SEQ ID NO: 1145089 - RNA, 19 nt, Human
uccgcccugacaagacuag

SEQ ID NO: 1145090 - RNA, 21 nt, Human
ucuaaggaugacuaaggacag

SEQ ID NO: 1145091 - RNA, 18 nt, Human
ugacuaaagacaaagcag

SEQ ID NO: 1145092 - RNA, 21 nt, Human
ugagcagaaccguuaggcacc

SEQ ID NO: 1145093 - RNA, 23 nt, Human
uguuagaggcuagaagggggcug

SEQ ID NO: 1145094 - RNA, 20 nt, Human
uuggacugcacacucuaagc

SEQ ID NO: 1145095 - RNA, 23 nt, Human
aaccuaaugaguuauuuuuaacc

SEQ ID NO: 1145096 - RNA, 20 nt, Human
aaguucuucagauuguggaa

SEQ ID NO: 1145097 - RNA, 23 nt, Human
acacaggccaucaguuuagcagc

SEQ ID NO: 1145098 - RNA, 20 nt, Human
accccagccaugccaacauc

SEQ ID NO: 1145099 - RNA, 21 nt, Human
acucucucugucuucucugcu

SEQ ID NO: 1145100 - RNA, 18 nt, Human
agaaguucuucagauugu

SEQ ID NO: 1145101 - RNA, 21 nt, Human
aggccaucaguuuagcagccu

SEQ ID NO: 1145102 - RNA, 18 nt, Human
caaggaacacaggccauc

SEQ ID NO: 1145103 - RNA, 21 nt, Human
ccagaggcaaggaacacaggc

SEQ ID NO: 1145104 - RNA, 24 nt, Human
ccagugccaaguuguccaucccua

SEQ ID NO: 1145105 - RNA, 18 nt, Human
cccucauugccuccucca

SEQ ID NO: 1145106 - RNA, 23 nt, Human
cuagcggacucucucugucuucu

SEQ ID NO: 1145107 - RNA, 21 nt, Human
cucuuuauuccugggaacaag

SEQ ID NO: 1145108 - RNA, 20 nt, Human
cuuuauuccugggaacaagg

SEQ ID NO: 1145109 - RNA, 19 nt, Human
gaguuauuuuuaaccagua

SEQ ID NO: 1145110 - RNA, 24 nt, Human
gcccagaaagugugucccaguccc

SEQ ID NO: 1145111 - RNA, 21 nt, Human
ggaacacauaaccagugccaa

SEQ ID NO: 1145112 - RNA, 19 nt, Human
guagauucuucuccagucc

SEQ ID NO: 1145113 - RNA, 21 nt, Human
guagauucuucuccaguccag

SEQ ID NO: 1145114 - RNA, 25 nt, Human
uaaauucuuccaacuaccacauaag

SEQ ID NO: 1145115 - RNA, 18 nt, Human
uacaccauucauugcagg

SEQ ID NO: 1145116 - RNA, 24 nt, Human
uaccucacuuggaacacauaacca

SEQ ID NO: 1145117 - RNA, 21 nt, Human
uagaauacagcaaaaaugaua

SEQ ID NO: 1145118 - RNA, 19 nt, Human
uauagucaucugguucucu

SEQ ID NO: 1145119 - RNA, 22 nt, Human
uauucagcuuacaccauucauu

SEQ ID NO: 1145120 - RNA, 22 nt, Human
ucccagaggcaaggaacacagg

SEQ ID NO: 1145121 - RNA, 19 nt, Human
ucccagucccaggauguug

SEQ ID NO: 1145122 - RNA, 26 nt, Human
ucccuaagcaauaucgcuuccuucua

SEQ ID NO: 1145123 - RNA, 18 nt, Human
ugaacauacaacagugca

SEQ ID NO: 1145124 - RNA, 25 nt, Human
ugagaacacagcaaaauuggagacc

SEQ ID NO: 1145125 - RNA, 22 nt, Human
ugagaacacagcaaaauuuuua

SEQ ID NO: 1145126 - RNA, 24 nt, Human
ugagagccaguaggcuaaccuaau

SEQ ID NO: 1145127 - RNA, 21 nt, Human
uggaacacauaaccagugcca

SEQ ID NO: 1145128 - RNA, 25 nt, Human
uggaaguagauucuucuccagucca

SEQ ID NO: 1145129 - RNA, 22 nt, Human
ugggaacaagguuaccucacuu

SEQ ID NO: 1145130 - RNA, 26 nt, Human
uucuuugcccucauugccuccuccag

SEQ ID NO: 1145131 - RNA, 18 nt, Human
uugcuagcggacucucuc

SEQ ID NO: 1145132 - RNA, 18 nt, Human
uuggaaguagauucuucu

SEQ ID NO: 1145133 - RNA, 23 nt, Human
uuuauagucaucugguucucuuu

SEQ ID NO: 1145134 - RNA, 25 nt, Human
aaacagauaaagaaauugagaccca

SEQ ID NO: 1145135 - RNA, 18 nt, Human
aaaguugauggugguucu

SEQ ID NO: 1145136 - RNA, 18 nt, Human
aaggagccaguuccagac

SEQ ID NO: 1145137 - RNA, 23 nt, Human
acagagugaagccccgcagguac

SEQ ID NO: 1145138 - RNA, 19 nt, Human
accagaacucaccgacaca

SEQ ID NO: 1145139 - RNA, 21 nt, Human
acccaguguugugugacuuca

SEQ ID NO: 1145140 - RNA, 20 nt, Human
accgccugcgccaccugcug

SEQ ID NO: 1145141 - RNA, 21 nt, Human
acucauggcugcgucggugcu

SEQ ID NO: 1145142 - RNA, 18 nt, Human
acugacgaugagaccgau

SEQ ID NO: 1145143 - RNA, 21 nt, Human
acuggccucucugacuacaac

SEQ ID NO: 1145144 - RNA, 21 nt, Human
agaagaaaacggaggagaaga

SEQ ID NO: 1145145 - RNA, 22 nt, Human
agaagaaaacggaggagaagag

SEQ ID NO: 1145146 - RNA, 20 nt, Human
agacccaguguugugugacu

SEQ ID NO: 1145147 - RNA, 19 nt, Human
agacuauagcaaucuagca

SEQ ID NO: 1145148 - RNA, 23 nt, Human
agagaagaaaacggaggagaaga

SEQ ID NO: 1145149 - RNA, 22 nt, Human
agagugaagccccgcagguacu

SEQ ID NO: 1145150 - RNA, 18 nt, Human
agaugauguucucuauaa

SEQ ID NO: 1145151 - RNA, 18 nt, Human
agcaaguguggccacaca

SEQ ID NO: 1145152 - RNA, 22 nt, Human
agcaccucugcacccgcgcccc

SEQ ID NO: 1145153 - RNA, 20 nt, Human
agcaugaacauaaaugaacc

SEQ ID NO: 1145154 - RNA, 30 nt, Human
agccaagcaccuccuuccuucccagacugg

SEQ ID NO: 1145155 - RNA, 18 nt, Human
agcccccacaucacccaa

SEQ ID NO: 1145156 - RNA, 23 nt, Human
aggaagagaagaaaacggaggag

SEQ ID NO: 1145157 - RNA, 18 nt, Human
agggagaagugcacggug

SEQ ID NO: 1145158 - RNA, 27 nt, Human
auagggcaggaagagaagaaaacggag

SEQ ID NO: 1145159 - RNA, 19 nt, Human
augcgugcggccacuguug

SEQ ID NO: 1145160 - RNA, 23 nt, Human
caagacaagcugcugcucggccc

SEQ ID NO: 1145161 - RNA, 20 nt, Human
cacacaauggucaaguugga

SEQ ID NO: 1145162 - RNA, 21 nt, Human
cacacagcccccacaucaccc

SEQ ID NO: 1145163 - RNA, 21 nt, Human
cacagcccccacaucacccaa

SEQ ID NO: 1145164 - RNA, 18 nt, Human
caccaagcacauguucau

SEQ ID NO: 1145165 - RNA, 25 nt, Human
cacccaaccacccagcagagauccu

SEQ ID NO: 1145166 - RNA, 18 nt, Human
caccccuuucccuccucc

SEQ ID NO: 1145167 - RNA, 22 nt, Human
caccgacacagcaggagagcag

SEQ ID NO: 1145168 - RNA, 28 nt, Human
caccgccugcgccaccugcuggcugcgc

SEQ ID NO: 1145169 - RNA, 18 nt, Human
caccugagcagcugcguc

SEQ ID NO: 1145170 - RNA, 22 nt, Human
cacucaggggccucugugggca

SEQ ID NO: 1145171 - RNA, 23 nt, Human
cagcaugaacauaaaugaaccuu

SEQ ID NO: 1145172 - RNA, 18 nt, Human
cagcugggucugcacaug

SEQ ID NO: 1145173 - RNA, 22 nt, Human
caggagagcagcuuggaaccuu

SEQ ID NO: 1145174 - RNA, 22 nt, Human
caggagguugcagguugaccag

SEQ ID NO: 1145175 - RNA, 19 nt, Human
caggaucauucaccuucca

SEQ ID NO: 1145176 - RNA, 23 nt, Human
cagggaggcuaagaguccuggca

SEQ ID NO: 1145177 - RNA, 20 nt, Human
caggggccucugugggcauc

SEQ ID NO: 1145178 - RNA, 23 nt, Human
cauaagacccaguguugugugac

SEQ ID NO: 1145179 - RNA, 19 nt, Human
caucaaaugagccaguuua

SEQ ID NO: 1145180 - RNA, 23 nt, Human
cauccgucuccucugcagcaucu

SEQ ID NO: 1145181 - RNA, 18 nt, Human
cauucaccuuccaaggua

SEQ ID NO: 1145182 - RNA, 20 nt, Human
ccacaucacccaaccaccca

SEQ ID NO: 1145183 - RNA, 24 nt, Human
ccagagccaccccuuucccuccuc

SEQ ID NO: 1145184 - RNA, 20 nt, Human
ccaugaaacagauaaagaaa

SEQ ID NO: 1145185 - RNA, 21 nt, Human
cccacaucacccaaccaccca

SEQ ID NO: 1145186 - RNA, 23 nt, Human
ccccacaucacccaaccacccag

SEQ ID NO: 1145187 - RNA, 21 nt, Human
cccccgacaccugccaaagcc

SEQ ID NO: 1145188 - RNA, 25 nt, Human
ccccucacuguccgcggccccugac

SEQ ID NO: 1145189 - RNA, 22 nt, Human
ccccugcccaccccugugcccc

SEQ ID NO: 1145190 - RNA, 19 nt, Human
ccccugugcccccgccacu

SEQ ID NO: 1145191 - RNA, 20 nt, Human
ccccugugcccccgccacuc

SEQ ID NO: 1145192 - RNA, 19 nt, Human
ccccuuucccuccuccuaa

SEQ ID NO: 1145193 - RNA, 20 nt, Human
cccgcgagcaccucugcacc

SEQ ID NO: 1145194 - RNA, 18 nt, Human
ccgauggcgaggacggcg

SEQ ID NO: 1145195 - RNA, 19 nt, Human
ccgcgccccugcccacccc

SEQ ID NO: 1145196 - RNA, 18 nt, Human
ccggcuuccucacugcug

SEQ ID NO: 1145197 - RNA, 20 nt, Human
ccguguaagcaaggcaaagu

SEQ ID NO: 1145198 - RNA, 22 nt, Human
ccugccagagccaccccuuucc

SEQ ID NO: 1145199 - RNA, 23 nt, Human
ccuucaacccagccaagacccag

SEQ ID NO: 1145200 - RNA, 26 nt, Human
cgaaugcacgcagauuaucgcacgcg

SEQ ID NO: 1145201 - RNA, 24 nt, Human
cgagcaccucugcacccgcgcccc

SEQ ID NO: 1145202 - RNA, 18 nt, Human
cgaugacgaggaaacuga

SEQ ID NO: 1145203 - RNA, 20 nt, Human
cgcccuccuuccaagacaag

SEQ ID NO: 1145204 - RNA, 24 nt, Human
cgucaccgccugcgccaccugcug

SEQ ID NO: 1145205 - RNA, 19 nt, Human
cucaaggaaaaacgacacc

SEQ ID NO: 1145206 - RNA, 25 nt, Human
cucccguguaagcaaggcaaaguac

SEQ ID NO: 1145207 - RNA, 19 nt, Human
cucgcccuccuuccaagac

SEQ ID NO: 1145208 - RNA, 25 nt, Human
cugcacccgcgagcaccucugcacc

SEQ ID NO: 1145209 - RNA, 25 nt, Human
cugcacccgcgccccugcccacccc

SEQ ID NO: 1145210 - RNA, 20 nt, Human
cugcgccaccugcuggcugc

SEQ ID NO: 1145211 - RNA, 23 nt, Human
cugcgcccccgacaccugccaaa

SEQ ID NO: 1145212 - RNA, 20 nt, Human
cugcgcgcacgccuuccagu

SEQ ID NO: 1145213 - RNA, 19 nt, Human
cugcgucaccgccugcgcc

SEQ ID NO: 1145214 - RNA, 18 nt, Human
cuggcuuuuccugccaga

SEQ ID NO: 1145215 - RNA, 24 nt, Human
cugugcagacggugcgacagcuag

SEQ ID NO: 1145216 - RNA, 21 nt, Human
cuugcaaacuuugauagaagc

SEQ ID NO: 1145217 - RNA, 20 nt, Human
cuuuaaggaaagggagaagu

SEQ ID NO: 1145218 - RNA, 21 nt, Human
gaaaacaugcagccauuccuc

SEQ ID NO: 1145219 - RNA, 21 nt, Human
gaagagaagaaaacggaggag

SEQ ID NO: 1145220 - RNA, 27 nt, Human
gagaagaaaacggaggagaagagggga

SEQ ID NO: 1145221 - RNA, 23 nt, Human
gagcagcugcgucaccgccugcg

SEQ ID NO: 1145222 - RNA, 19 nt, Human
gagccaguuccagaccugg

SEQ ID NO: 1145223 - RNA, 21 nt, Human
gaggacggcgaagguggcggc

SEQ ID NO: 1145224 - RNA, 18 nt, Human
gaggcuaagaguccuggc

SEQ ID NO: 1145225 - RNA, 26 nt, Human
gaguuugcagcugccugcgcccccga

SEQ ID NO: 1145226 - RNA, 19 nt, Human
gcaggaagagaagaaaacg

SEQ ID NO: 1145227 - RNA, 23 nt, Human
gcccccgacaccugccaaagccg

SEQ ID NO: 1145228 - RNA, 18 nt, Human
gccccugcccaccccugu

SEQ ID NO: 1145229 - RNA, 18 nt, Human
gcgccaccugcuggcugc

SEQ ID NO: 1145230 - RNA, 20 nt, Human
ggaaccuucaacccagccaa

SEQ ID NO: 1145231 - RNA, 21 nt, Human
ggagagagccaagcaccuccu

SEQ ID NO: 1145232 - RNA, 22 nt, Human
ggauucuggcuuuuccugccag

SEQ ID NO: 1145233 - RNA, 21 nt, Human
ggcuagaggggauucuggcuu

SEQ ID NO: 1145234 - RNA, 24 nt, Human
gggagagagccaagcaccuccuuc

SEQ ID NO: 1145235 - RNA, 22 nt, Human
gggcaggaagagaagaaaacgg

SEQ ID NO: 1145236 - RNA, 19 nt, Human
ggggauucuggcuuuuccu

SEQ ID NO: 1145237 - RNA, 18 nt, Human
gguaagcagcgccggccc

SEQ ID NO: 1145238 - RNA, 18 nt, Human
ggugacaacgaugacgag

SEQ ID NO: 1145239 - RNA, 18 nt, Human
gguggcggcccgggagag

SEQ ID NO: 1145240 - RNA, 21 nt, Human
guccuggcaggaucauucacc

SEQ ID NO: 1145241 - RNA, 19 nt, Human
uaaauccauucuccucucc

SEQ ID NO: 1145242 - RNA, 22 nt, Human
uaagcaggcagaagaaacggca

SEQ ID NO: 1145243 - RNA, 24 nt, Human
uacaguggugugggagagauuuuc

SEQ ID NO: 1145244 - RNA, 23 nt, Human
uacugccguuucaagcacauggu

SEQ ID NO: 1145245 - RNA, 23 nt, Human
uagaugauguucucuauaaaucc

SEQ ID NO: 1145246 - RNA, 22 nt, Human
uagauuuagacuauagcaaucu

SEQ ID NO: 1145247 - RNA, 21 nt, Human
uagcaaguguggccacacaau

SEQ ID NO: 1145248 - RNA, 20 nt, Human
uauaaauccauucuccucuc

SEQ ID NO: 1145249 - RNA, 18 nt, Human
ucaaaaagcuccuuauag

SEQ ID NO: 1145250 - RNA, 19 nt, Human
ucacccaaccacccagcag

SEQ ID NO: 1145251 - RNA, 18 nt, Human
ucaccgccugcgccaccu

SEQ ID NO: 1145252 - RNA, 19 nt, Human
ucacugcugcugcugacag

SEQ ID NO: 1145253 - RNA, 20 nt, Human
ucacugcugcugcugacagc

SEQ ID NO: 1145254 - RNA, 21 nt, Human
ucaggggccucugugggcauc

SEQ ID NO: 1145255 - RNA, 18 nt, Human
uccauagucaaaaagcuc

SEQ ID NO: 1145256 - RNA, 20 nt, Human
uccaugcacccacuggccuc

SEQ ID NO: 1145257 - RNA, 18 nt, Human
ucccccgucuuucuacaa

SEQ ID NO: 1145258 - RNA, 22 nt, Human
ucccguguaagcaaggcaaagu

SEQ ID NO: 1145259 - RNA, 18 nt, Human
uccucauucccaugaaac

SEQ ID NO: 1145260 - RNA, 18 nt, Human
uccuuggguuaggccucu

SEQ ID NO: 1145261 - RNA, 25 nt, Human
ucgcacgcgcuccucugcacccgcg

SEQ ID NO: 1145262 - RNA, 21 nt, Human
ucuacaaugcuagauuuagac

SEQ ID NO: 1145263 - RNA, 22 nt, Human
ucuagaauaggcaaauccauag

SEQ ID NO: 1145264 - RNA, 18 nt, Human
ucuccucugcagcaucuu

SEQ ID NO: 1145265 - RNA, 21 nt, Human
ucugacuacagugguguggga

SEQ ID NO: 1145266 - RNA, 20 nt, Human
ugacaacgaugacgaggaaa

SEQ ID NO: 1145267 - RNA, 24 nt, Human
ugacaacgaugacgaggaaacuga

SEQ ID NO: 1145268 - RNA, 21 nt, Human
ugaccuugguaugguggugau

SEQ ID NO: 1145269 - RNA, 18 nt, Human
ugagacccagggaggcua

SEQ ID NO: 1145270 - RNA, 24 nt, Human
ugauagggcaggaagagaagaaaa

SEQ ID NO: 1145271 - RNA, 20 nt, Human
ugaucagugaugaccuuggu

SEQ ID NO: 1145272 - RNA, 22 nt, Human
ugcagcaucuuuccuccccaca

SEQ ID NO: 1145273 - RNA, 20 nt, Human
ugccaaagccgaggggcuug

SEQ ID NO: 1145274 - RNA, 18 nt, Human
ugcgaggaguuccaugca

SEQ ID NO: 1145275 - RNA, 24 nt, Human
ugcgcgcacgccuuccagugcgcg

SEQ ID NO: 1145276 - RNA, 25 nt, Human
ugcgugcgcaccgcugcgggcuggc

SEQ ID NO: 1145277 - RNA, 19 nt, Human
uggcaaucggcucgcccuc

SEQ ID NO: 1145278 - RNA, 20 nt, Human
uggcaggaucauucaccuuc

SEQ ID NO: 1145279 - RNA, 21 nt, Human
uggcaggaucauucaccuucc

SEQ ID NO: 1145280 - RNA, 19 nt, Human
uggcugcgucggugcuucg

SEQ ID NO: 1145281 - RNA, 20 nt, Human
ugugcagacggugcgacagc

SEQ ID NO: 1145282 - RNA, 22 nt, Human
ugugcugccggcuuccucacug

SEQ ID NO: 1145283 - RNA, 18 nt, Human
uuagacuauagcaaucua

SEQ ID NO: 1145284 - RNA, 25 nt, Human
uuaucgcacgcgcuccucugcaccc

SEQ ID NO: 1145285 - RNA, 21 nt, Human
uucacacagcccccacaucac

SEQ ID NO: 1145286 - RNA, 20 nt, Human
uucccuccuccuaaaguuga

SEQ ID NO: 1145287 - RNA, 23 nt, Human
uuucacacagcccccacaucacc

SEQ ID NO: 1145288 - RNA, 24 nt, Human
uuucccauaagcaggcagaagaaa

SEQ ID NO: 1145289 - RNA, 23 nt, Human
uuuucuuccgggaucuggggcag

SEQ ID NO: 1145290 - RNA, 18 nt, Human
ccuuuuguuuauuuuauu

SEQ ID NO: 1145291 - RNA, 25 nt, Human
gccccuuuuguuuauuuuauuuugg

SEQ ID NO: 1145292 - RNA, 21 nt, Human
ggaaaaaaauuuuauugugaa

SEQ ID NO: 1145293 - RNA, 23 nt, Human
accccaacuccggggagacucuu

SEQ ID NO: 1145294 - RNA, 18 nt, Human
agacuggcccaccccaga

SEQ ID NO: 1145295 - RNA, 22 nt, Human
agacuuccaccagaugccccgg

SEQ ID NO: 1145296 - RNA, 18 nt, Human
agccugcccaagacccca

SEQ ID NO: 1145297 - RNA, 18 nt, Human
aucacaucccagaaaagg

SEQ ID NO: 1145298 - RNA, 19 nt, Human
auggugacuuccacccaca

SEQ ID NO: 1145299 - RNA, 22 nt, Human
caagaccccaacuccggggaga

SEQ ID NO: 1145300 - RNA, 24 nt, Human
caagaccccaacuccggggagacu

SEQ ID NO: 1145301 - RNA, 22 nt, Human
caccagaugccccgggugggcc

SEQ ID NO: 1145302 - RNA, 23 nt, Human
caucacgucccgcuacccuccca

SEQ ID NO: 1145303 - RNA, 20 nt, Human
ccaaccuccacuuguggcug

SEQ ID NO: 1145304 - RNA, 20 nt, Human
ccaggcaacggcaggggaac

SEQ ID NO: 1145305 - RNA, 19 nt, Human
cccaagaccccaacuccgg

SEQ ID NO: 1145306 - RNA, 20 nt, Human
cccacggcuaccugccaccu

SEQ ID NO: 1145307 - RNA, 25 nt, Human
ccccaucacgucccgcuacccuccc

SEQ ID NO: 1145308 - RNA, 22 nt, Human
cccccaucacgucccgcuaccc

SEQ ID NO: 1145309 - RNA, 20 nt, Human
cccugugucccagauuggcc

SEQ ID NO: 1145310 - RNA, 21 nt, Human
ccgaugccaaugcucaucaca

SEQ ID NO: 1145311 - RNA, 23 nt, Human
cgcuaaggaguguaacaacucag

SEQ ID NO: 1145312 - RNA, 20 nt, Human
cggaaccuccagggucaacc

SEQ ID NO: 1145313 - RNA, 20 nt, Human
cggcggcucccuguguccca

SEQ ID NO: 1145314 - RNA, 25 nt, Human
cucccacagcuggccuuugccaggc

SEQ ID NO: 1145315 - RNA, 18 nt, Human
cuccugggucaggccucu

SEQ ID NO: 1145316 - RNA, 21 nt, Human
cuugggagcccagccuuccuc

SEQ ID NO: 1145317 - RNA, 20 nt, Human
gcuggacgguggccauggaa

SEQ ID NO: 1145318 - RNA, 20 nt, Human
ggaugcccccaucacguccc

SEQ ID NO: 1145319 - RNA, 24 nt, Human
ggccucuggggucgaccagcugac

SEQ ID NO: 1145320 - RNA, 20 nt, Human
gggguggguugacguacagg

SEQ ID NO: 1145321 - RNA, 23 nt, Human
ggugaaaucacuguuaccaucac

SEQ ID NO: 1145322 - RNA, 25 nt, Human
ucacaucccagaaaagguguugguu

SEQ ID NO: 1145323 - RNA, 24 nt, Human
uccaaagggauggugacuuccacc

SEQ ID NO: 1145324 - RNA, 19 nt, Human
ucccacagcuggccuuugc

SEQ ID NO: 1145325 - RNA, 19 nt, Human
ucccacggcuaccugccac

SEQ ID NO: 1145326 - RNA, 20 nt, Human
ucccagaaaagguguugguu

SEQ ID NO: 1145327 - RNA, 23 nt, Human
ucggaaccuccagggucaaccag

SEQ ID NO: 1145328 - RNA, 23 nt, Human
ucucggucggaaccuccaggguc

SEQ ID NO: 1145329 - RNA, 24 nt, Human
ugaaaucacuguuaccaucaccgu

SEQ ID NO: 1145330 - RNA, 22 nt, Human
ugacuuccacccacaagguccc

SEQ ID NO: 1145331 - RNA, 21 nt, Human
ugagccugcccaagaccccaa

SEQ ID NO: 1145332 - RNA, 19 nt, Human
ugaggcggaugcccccauc

SEQ ID NO: 1145333 - RNA, 21 nt, Human
ugccaaugcucaucacauccc

SEQ ID NO: 1145334 - RNA, 21 nt, Human
ugggaugaaccgaaugccaug

SEQ ID NO: 1145335 - RNA, 21 nt, Human
uggggucgaccagcugacgcc

SEQ ID NO: 1145336 - RNA, 18 nt, Human
uggguugacguacagggu

SEQ ID NO: 1145337 - RNA, 25 nt, Human
uuggggguggguugacguacagggu

SEQ ID NO: 1145338 - RNA, 19 nt, Human
aagccaccacaacucacuu

SEQ ID NO: 1145339 - RNA, 24 nt, Human
acacaggaacuacaacucucucca

SEQ ID NO: 1145340 - RNA, 20 nt, Human
acaguccuggagacagacac

SEQ ID NO: 1145341 - RNA, 20 nt, Human
agaaucccccgucuguuucc

SEQ ID NO: 1145342 - RNA, 20 nt, Human
agagagaugcaccucaggaa

SEQ ID NO: 1145343 - RNA, 19 nt, Human
aucguuguuggacauuugg

SEQ ID NO: 1145344 - RNA, 21 nt, Human
augguauuucuaguucuagau

SEQ ID NO: 1145345 - RNA, 21 nt, Human
auuagcucaucaaacacaaca

SEQ ID NO: 1145346 - RNA, 24 nt, Human
caaagccaccacaacucacuugaa

SEQ ID NO: 1145347 - RNA, 22 nt, Human
cacaacaguccccggaguguga

SEQ ID NO: 1145348 - RNA, 25 nt, Human
cacauaucacaguccuggagacaga

SEQ ID NO: 1145349 - RNA, 21 nt, Human
caccccacaacaguccccgga

SEQ ID NO: 1145350 - RNA, 21 nt, Human
caggaacuacaacucucucca

SEQ ID NO: 1145351 - RNA, 22 nt, Human
caucaggaaagaaaagacaacc

SEQ ID NO: 1145352 - RNA, 19 nt, Human
caugucccuacaaaggaca

SEQ ID NO: 1145353 - RNA, 18 nt, Human
ccacauuuucuuaaucca

SEQ ID NO: 1145354 - RNA, 22 nt, Human
ccagcuaaaaauuuccucccgc

SEQ ID NO: 1145355 - RNA, 30 nt, Human
ccaucaggaaagaaaagacaaccaguuucc

SEQ ID NO: 1145356 - RNA, 19 nt, Human
cccaauguuaucccucccc

SEQ ID NO: 1145357 - RNA, 24 nt, Human
ccccaccccacaacaguccccgga

SEQ ID NO: 1145358 - RNA, 19 nt, Human
cccccaccccacaacaguc

SEQ ID NO: 1145359 - RNA, 19 nt, Human
ccccccaccccacaacagu

SEQ ID NO: 1145360 - RNA, 20 nt, Human
ccccccaccccacaacaguc

SEQ ID NO: 1145361 - RNA, 20 nt, Human
ccuaguaaugggauggcugg

SEQ ID NO: 1145362 - RNA, 23 nt, Human
ccuccccgcuccccccaccccac

SEQ ID NO: 1145363 - RNA, 18 nt, Human
cgcuccccccaccccaca

SEQ ID NO: 1145364 - RNA, 22 nt, Human
cuacuccuuaguguuuccucua

SEQ ID NO: 1145365 - RNA, 24 nt, Human
cuaugagugagaacaugugguauu

SEQ ID NO: 1145366 - RNA, 24 nt, Human
cugcacccauuaacucgucauuua

SEQ ID NO: 1145367 - RNA, 19 nt, Human
cuggccuuuuaaaggacaa

SEQ ID NO: 1145368 - RNA, 19 nt, Human
cuugcucccugggcugcgg

SEQ ID NO: 1145369 - RNA, 18 nt, Human
gcuccccccaccccacaa

SEQ ID NO: 1145370 - RNA, 21 nt, Human
ggacaugaacucuucauuuuu

SEQ ID NO: 1145371 - RNA, 18 nt, Human
gugugcaugugucuuuau

SEQ ID NO: 1145372 - RNA, 20 nt, Human
gugugcaugugucuuuauag

SEQ ID NO: 1145373 - RNA, 18 nt, Human
uacaccuaguaaugggau

SEQ ID NO: 1145374 - RNA, 19 nt, Human
uagcagcaugauuuauaau

SEQ ID NO: 1145375 - RNA, 20 nt, Human
uauaugugccacauuuucuu

SEQ ID NO: 1145376 - RNA, 24 nt, Human
uauugugaauagugccucaauaaa

SEQ ID NO: 1145377 - RNA, 22 nt, Human
ucagucagaacagaaggucuaa

SEQ ID NO: 1145378 - RNA, 18 nt, Human
uccccccaccccacaaca

SEQ ID NO: 1145379 - RNA, 18 nt, Human
uccccgcuccccccaccc

SEQ ID NO: 1145380 - RNA, 19 nt, Human
uccccgcuccccccacccc

SEQ ID NO: 1145381 - RNA, 22 nt, Human
uccccgcuccccccaccccaca

SEQ ID NO: 1145382 - RNA, 20 nt, Human
ucccuacaaaggacaugaac

SEQ ID NO: 1145383 - RNA, 21 nt, Human
ucccuccccgcuccccccacc

SEQ ID NO: 1145384 - RNA, 18 nt, Human
ucccugaggaauuuuggc

SEQ ID NO: 1145385 - RNA, 24 nt, Human
ucugaaugccauaggaugcuucag

SEQ ID NO: 1145386 - RNA, 23 nt, Human
ucuuugcuauugugaauagugcc

SEQ ID NO: 1145387 - RNA, 19 nt, Human
ugacuuauaagaauccccc

SEQ ID NO: 1145388 - RNA, 20 nt, Human
ugacuuauaagaaucccccg

SEQ ID NO: 1145389 - RNA, 23 nt, Human
ugacuuauaagaaucccccgucu

SEQ ID NO: 1145390 - RNA, 20 nt, Human
ugaggaauuuuggcuggccu

SEQ ID NO: 1145391 - RNA, 19 nt, Human
ugagugagaacauguggua

SEQ ID NO: 1145392 - RNA, 24 nt, Human
ugagugagaacaugugguauuugg

SEQ ID NO: 1145393 - RNA, 19 nt, Human
ugccaugcuggugugcugc

SEQ ID NO: 1145394 - RNA, 25 nt, Human
ugccucaauaaacauacgugugcau

SEQ ID NO: 1145395 - RNA, 23 nt, Human
ugcuggugugcugcacccauuaa

SEQ ID NO: 1145396 - RNA, 21 nt, Human
uggcuggccuuuuuuuuuuuu

SEQ ID NO: 1145397 - RNA, 23 nt, Human
uggugcagagagagaugcaccuc

SEQ ID NO: 1145398 - RNA, 23 nt, Human
ugugcagguuuguuacauaugua

SEQ ID NO: 1145399 - RNA, 18 nt, Human
uguuacauauguauacau

SEQ ID NO: 1145400 - RNA, 19 nt, Human
uguuacauauguauacaug

SEQ ID NO: 1145401 - RNA, 21 nt, Human
uuauggcugcauaguauucaa

SEQ ID NO: 1145402 - RNA, 18 nt, Human
uucaaaggccacgcuaac

SEQ ID NO: 1145403 - RNA, 18 nt, Human
uuccugaacauccacagc

SEQ ID NO: 1145404 - RNA, 19 nt, Human
uuuccaguuucauccaugu

SEQ ID NO: 1145405 - RNA, 19 nt, Human
uuuccaguuucauccaugu

SEQ ID NO: 1145406 - RNA, 18 nt, Human
uuucuaguucuagauccc

SEQ ID NO: 1145407 - RNA, 19 nt, Human
uuucuaguucuagaucccu

SEQ ID NO: 1145408 - RNA, 22 nt, Human
uuuuauggcugcauaguauuca

SEQ ID NO: 1145409 - RNA, 24 nt, Human
uuuuggcuggccuuuuuuuuuuuu

SEQ ID NO: 1145410 - RNA, 20 nt, Human
aacauggugaaacucugucu

SEQ ID NO: 1145411 - RNA, 21 nt, Human
aacauggugaaacucugucuc

SEQ ID NO: 1145412 - RNA, 19 nt, Human
acauggugaaacucugucu

SEQ ID NO: 1145413 - RNA, 24 nt, Human
agcauggccaacauggugaaacuc

SEQ ID NO: 1145414 - RNA, 20 nt, Human
agccgggcaugguggugggc

SEQ ID NO: 1145415 - RNA, 19 nt, Human
auggccaacauggugaaac

SEQ ID NO: 1145416 - RNA, 24 nt, Human
caacauggugaaacucugucucua

SEQ ID NO: 1145417 - RNA, 18 nt, Human
caacuguaaucccagcua

SEQ ID NO: 1145418 - RNA, 19 nt, Human
caacuguaaucccagcuac

SEQ ID NO: 1145419 - RNA, 21 nt, Human
caggaguucgagaucagcaug

SEQ ID NO: 1145420 - RNA, 24 nt, Human
cauggccaacauggugaaacucug

SEQ ID NO: 1145421 - RNA, 24 nt, Human
cgagaucagcauggccaacauggu

SEQ ID NO: 1145422 - RNA, 18 nt, Human
cugagaucaggaguucga

SEQ ID NO: 1145423 - RNA, 21 nt, Human
cugagaucaggaguucgagau

SEQ ID NO: 1145424 - RNA, 19 nt, Human
gaaacucugucucuacuaa

SEQ ID NO: 1145425 - RNA, 24 nt, Human
gccaacauggugaaacucugucuc

SEQ ID NO: 1145426 - RNA, 21 nt, Human
uagauaaguauuggaaaccug

SEQ ID NO: 1145427 - RNA, 21 nt, Human
ucucuacuaaaaauauaaaaa

SEQ ID NO: 1145428 - RNA, 23 nt, Human
ugagaucaggaguucgagaucag

SEQ ID NO: 1145429 - RNA, 18 nt, Human
uggaaaccugagaucagg

SEQ ID NO: 1145430 - RNA, 23 nt, Human
uggaaaccugagaucaggaguuc

SEQ ID NO: 1145431 - RNA, 18 nt, Human
uggccaacauggugaaac

SEQ ID NO: 1145432 - RNA, 23 nt, Human
uggccaacauggugaaacucugu

SEQ ID NO: 1145433 - RNA, 24 nt, Human
uggccaacauggugaaacucuguc

SEQ ID NO: 1145434 - RNA, 21 nt, Human
uggugggcaacuguaauccca

SEQ ID NO: 1145435 - RNA, 18 nt, Human
uuagccgggcaugguggu

SEQ ID NO: 1145436 - RNA, 21 nt, Human
aaacaauucaguucacuccca

SEQ ID NO: 1145437 - RNA, 18 nt, Human
aaagaagaaacagaugug

SEQ ID NO: 1145438 - RNA, 24 nt, Human
aaaucaaauaacuggcaugcucuu

SEQ ID NO: 1145439 - RNA, 22 nt, Human
aacagagaagcccuucagggaa

SEQ ID NO: 1145440 - RNA, 18 nt, Human
aagaagaaacagauguga

SEQ ID NO: 1145441 - RNA, 24 nt, Human
aagaauagaaacuugcaggaaaaa

SEQ ID NO: 1145442 - RNA, 21 nt, Human
aaggcagaggacaggcaugca

SEQ ID NO: 1145443 - RNA, 19 nt, Human
aagggugggguggggggag

SEQ ID NO: 1145444 - RNA, 26 nt, Human
aagucacaggaaucuaucuuuucuga

SEQ ID NO: 1145445 - RNA, 23 nt, Human
aaguguagccugauguuacaacc

SEQ ID NO: 1145446 - RNA, 18 nt, Human
accccauggcgcacagcc

SEQ ID NO: 1145447 - RNA, 25 nt, Human
agaaaaaccccauggcgcacagcca

SEQ ID NO: 1145448 - RNA, 18 nt, Human
agaggacugggaucugga

SEQ ID NO: 1145449 - RNA, 19 nt, Human
agaggacugggaucuggag

SEQ ID NO: 1145450 - RNA, 20 nt, Human
agcacauacuugcugggaau

SEQ ID NO: 1145451 - RNA, 18 nt, Human
aggagaauuuugagucag

SEQ ID NO: 1145452 - RNA, 20 nt, Human
aggagcugcgggaagaauag

SEQ ID NO: 1145453 - RNA, 24 nt, Human
agggugggguggggggaggggcgg

SEQ ID NO: 1145454 - RNA, 25 nt, Human
auaguaaaauagccccauuucuugg

SEQ ID NO: 1145455 - RNA, 20 nt, Human
caaauaacuggcaugcucuu

SEQ ID NO: 1145456 - RNA, 22 nt, Human
caaccucauugcuuuugguaac

SEQ ID NO: 1145457 - RNA, 26 nt, Human
cacagccaguguauguauguaauacc

SEQ ID NO: 1145458 - RNA, 19 nt, Human
cacccucccuccccaagcc

SEQ ID NO: 1145459 - RNA, 22 nt, Human
cacccucccuccccaagcccua

SEQ ID NO: 1145460 - RNA, 23 nt, Human
cacccucccuccccaagcccuaa

SEQ ID NO: 1145461 - RNA, 22 nt, Human
cagacaggauuucuuuguuuug

SEQ ID NO: 1145462 - RNA, 22 nt, Human
cagaucucuccuaagucucaca

SEQ ID NO: 1145463 - RNA, 24 nt, Human
cauggcgcacagccaguguaugua

SEQ ID NO: 1145464 - RNA, 21 nt, Human
cauucuguaagguauucucaa

SEQ ID NO: 1145465 - RNA, 19 nt, Human
cauuucuuggaaguuagga

SEQ ID NO: 1145466 - RNA, 20 nt, Human
ccaacacccucccuccccaa

SEQ ID NO: 1145467 - RNA, 19 nt, Human
ccagacaggauuucuuugu

SEQ ID NO: 1145468 - RNA, 18 nt, Human
ccagugccaacagagaag

SEQ ID NO: 1145469 - RNA, 21 nt, Human
cccuccccaagcccuaaugag

SEQ ID NO: 1145470 - RNA, 18 nt, Human
cccucccuccccaagccc

SEQ ID NO: 1145471 - RNA, 22 nt, Human
ccucauccuuuccaucaugucc

SEQ ID NO: 1145472 - RNA, 19 nt, Human
ccucauuuuuccugguccc

SEQ ID NO: 1145473 - RNA, 23 nt, Human
ccugccacagccugguuuaagaa

SEQ ID NO: 1145474 - RNA, 22 nt, Human
cuaacccauaucuggcucaucc

SEQ ID NO: 1145475 - RNA, 19 nt, Human
cuccucauccuuuccauca

SEQ ID NO: 1145476 - RNA, 21 nt, Human
cuccugccacagccugguuua

SEQ ID NO: 1145477 - RNA, 22 nt, Human
cuucuuagcacauacuugcugg

SEQ ID NO: 1145478 - RNA, 18 nt, Human
gauuccaacacccucccu

SEQ ID NO: 1145479 - RNA, 20 nt, Human
gcaggaaaaaaaaagggugg

SEQ ID NO: 1145480 - RNA, 24 nt, Human
gcaguguggauuccaacacccucc

SEQ ID NO: 1145481 - RNA, 19 nt, Human
gcucaugguguggcugugg

SEQ ID NO: 1145482 - RNA, 21 nt, Human
ggaauuuggugacugguuugu

SEQ ID NO: 1145483 - RNA, 20 nt, Human
ggacaggcaugcagacccuu

SEQ ID NO: 1145484 - RNA, 20 nt, Human
ggagcagagcuucauccaca

SEQ ID NO: 1145485 - RNA, 20 nt, Human
ggauuccaacacccucccuc

SEQ ID NO: 1145486 - RNA, 24 nt, Human
ggcgcacagccaguguauguaugu

SEQ ID NO: 1145487 - RNA, 21 nt, Human
ggggcaagauaaggcagagga

SEQ ID NO: 1145488 - RNA, 18 nt, Human
gggguggggggaggggcg

SEQ ID NO: 1145489 - RNA, 19 nt, Human
gggugggguggggggaggg

SEQ ID NO: 1145490 - RNA, 21 nt, Human
gguagaggggcaagauaaggc

SEQ ID NO: 1145491 - RNA, 18 nt, Human
ggugaaccagcugggacc

SEQ ID NO: 1145492 - RNA, 21 nt, Human
gugggguggggggaggggcgg

SEQ ID NO: 1145493 - RNA, 18 nt, Human
uaaagcauaauccaaagg

SEQ ID NO: 1145494 - RNA, 20 nt, Human
uaaucgcuaucaacuccuca

SEQ ID NO: 1145495 - RNA, 26 nt, Human
uacagaaaaaccccauggcgcacagc

SEQ ID NO: 1145496 - RNA, 23 nt, Human
uacucuggcaguguggauuccaa

SEQ ID NO: 1145497 - RNA, 22 nt, Human
uagacuggacauuuuccuacag

SEQ ID NO: 1145498 - RNA, 26 nt, Human
uagauccucagcucggccuccugcca

SEQ ID NO: 1145499 - RNA, 20 nt, Human
uaucuggcucauccauccuc

SEQ ID NO: 1145500 - RNA, 20 nt, Human
uccaaaggaaaaagagcgcc

SEQ ID NO: 1145501 - RNA, 19 nt, Human
uccaacacccucccuccca

SEQ ID NO: 1145502 - RNA, 21 nt, Human
uccacaacuaaggaguccugc

SEQ ID NO: 1145503 - RNA, 23 nt, Human
uccaccagccuccuggccuggac

SEQ ID NO: 1145504 - RNA, 18 nt, Human
uccaucuuuucagagcuc

SEQ ID NO: 1145505 - RNA, 21 nt, Human
uccaugcagaugcaaagaaga

SEQ ID NO: 1145506 - RNA, 28 nt, Human
uccccaagcccuaaugaggggagccugu

SEQ ID NO: 1145507 - RNA, 24 nt, Human
uccucauccuuuccaucauguccu

SEQ ID NO: 1145508 - RNA, 23 nt, Human
uccucugcauauccguuugagaa

SEQ ID NO: 1145509 - RNA, 21 nt, Human
ucggccuccugccacagccug

SEQ ID NO: 1145510 - RNA, 21 nt, Human
ucuccaucuuuucagagcuca

SEQ ID NO: 1145511 - RNA, 25 nt, Human
ucugggauaguaaaauagccccauu

SEQ ID NO: 1145512 - RNA, 21 nt, Human
ucuuggauugacagagccagg

SEQ ID NO: 1145513 - RNA, 20 nt, Human
ugacuuccuauguuaccuuu

SEQ ID NO: 1145514 - RNA, 19 nt, Human
ugcagaugcaaagaagaaa

SEQ ID NO: 1145515 - RNA, 19 nt, Human
ugcaggaaaaaaaaagggu

SEQ ID NO: 1145516 - RNA, 20 nt, Human
uggaaguuaggagcagagcu

SEQ ID NO: 1145517 - RNA, 18 nt, Human
uggauugacagagccagg

SEQ ID NO: 1145518 - RNA, 25 nt, Human
uggccuggacagguagauccucagc

SEQ ID NO: 1145519 - RNA, 20 nt, Human
uggcuucuuagcacauacuu

SEQ ID NO: 1145520 - RNA, 22 nt, Human
uggggcauucuguaagguauuc

SEQ ID NO: 1145521 - RNA, 21 nt, Human
uggggggaggggcggugaagc

SEQ ID NO: 1145522 - RNA, 22 nt, Human
uggggggaggggcggugaagcg

SEQ ID NO: 1145523 - RNA, 20 nt, Human
ugggguggggggaggggcgg

SEQ ID NO: 1145524 - RNA, 21 nt, Human
ugggguggggggaggggcggu

SEQ ID NO: 1145525 - RNA, 19 nt, Human
uguaaggguuaccuuuguc

SEQ ID NO: 1145526 - RNA, 23 nt, Human
uuaauuuuuggcuucuuagcaca

SEQ ID NO: 1145527 - RNA, 18 nt, Human
uuaggacugguuucuuuc

SEQ ID NO: 1145528 - RNA, 21 nt, Human
uucaccaugcucaucucucca

SEQ ID NO: 1145529 - RNA, 23 nt, Human
uucccagucucgacaaccucauu

SEQ ID NO: 1145530 - RNA, 22 nt, Human
uucccggaggauguucgccagg

SEQ ID NO: 1145531 - RNA, 25 nt, Human
uuccucagguauuugguggcuuugc

SEQ ID NO: 1145532 - RNA, 20 nt, Human
uuuccugguccccauauuca

SEQ ID NO: 1145533 - RNA, 22 nt, Human
uuugccaaguguuccuugguga

SEQ ID NO: 1145534 - RNA, 23 nt, Human
aaaaaagaaagaaagaaagaaga

SEQ ID NO: 1145535 - RNA, 19 nt, Human
aacagcauccaccauacag

SEQ ID NO: 1145536 - RNA, 19 nt, Human
aacauggugaaaccccguc

SEQ ID NO: 1145537 - RNA, 20 nt, Human
aacauggugaaaccccgucu

SEQ ID NO: 1145538 - RNA, 21 nt, Human
aacauggugaaaccccgucuc

SEQ ID NO: 1145539 - RNA, 22 nt, Human
aacuugcuguucuccacugcuc

SEQ ID NO: 1145540 - RNA, 22 nt, Human
aagaaaaagaguaguugcucac

SEQ ID NO: 1145541 - RNA, 22 nt, Human
aagaaagaaagaaagaagaaaa

SEQ ID NO: 1145542 - RNA, 21 nt, Human
aagaaagaaagaagaaaaaga

SEQ ID NO: 1145543 - RNA, 24 nt, Human
aaucacuugaacccaggaggcaga

SEQ ID NO: 1145544 - RNA, 27 nt, Human
aauuguguucugacuuguuuuaaaguu

SEQ ID NO: 1145545 - RNA, 24 nt, Human
acagagaaagacucugucucagaa

SEQ ID NO: 1145546 - RNA, 19 nt, Human
accacugcacuccagccug

SEQ ID NO: 1145547 - RNA, 24 nt, Human
acccaggaggcagagguugcagug

SEQ ID NO: 1145548 - RNA, 24 nt, Human
accccgucucuacuaagaauacaa

SEQ ID NO: 1145549 - RNA, 18 nt, Human
acccuggcagcauccugg

SEQ ID NO: 1145550 - RNA, 24 nt, Human
acugcacuccagccugggugacag

SEQ ID NO: 1145551 - RNA, 26 nt, Human
acugcacuccagccugggugacagag

SEQ ID NO: 1145552 - RNA, 22 nt, Human
agaaucacuugaacccaggagg

SEQ ID NO: 1145553 - RNA, 22 nt, Human
agagguugcagugagccgagau

SEQ ID NO: 1145554 - RNA, 24 nt, Human
agagguugcagugagccgagauug

SEQ ID NO: 1145555 - RNA, 24 nt, Human
agcacuuuaggaggccgagguggg

SEQ ID NO: 1145556 - RNA, 20 nt, Human
agccagucuugggucauugc

SEQ ID NO: 1145557 - RNA, 22 nt, Human
agccuggccaacauggugaaac

SEQ ID NO: 1145558 - RNA, 24 nt, Human
agccuggccaacauggugaaaccc

SEQ ID NO: 1145559 - RNA, 24 nt, Human
agccugggugacagagaaagacuc

SEQ ID NO: 1145560 - RNA, 21 nt, Human
aggcagagguugcagugagcc

SEQ ID NO: 1145561 - RNA, 24 nt, Human
aggcagagguugcagugagccgag

SEQ ID NO: 1145562 - RNA, 18 nt, Human
aggcaggagaaucacuug

SEQ ID NO: 1145563 - RNA, 23 nt, Human
aggcaggagaaucacuugaaccc

SEQ ID NO: 1145564 - RNA, 24 nt, Human
aggcaggagaaucacuugaaccca

SEQ ID NO: 1145565 - RNA, 21 nt, Human
aggccgaggugggcagaucac

SEQ ID NO: 1145566 - RNA, 24 nt, Human
aggcugaggcaggagaaucacuug

SEQ ID NO: 1145567 - RNA, 24 nt, Human
aggugggcagaucacaaggucagg

SEQ ID NO: 1145568 - RNA, 21 nt, Human
aucacaaggucaggaguucga

SEQ ID NO: 1145569 - RNA, 19 nt, Human
auggggaauaucuucagau

SEQ ID NO: 1145570 - RNA, 24 nt, Human
auugcaccacugcacuccagccug

SEQ ID NO: 1145571 - RNA, 22 nt, Human
auuucauccuauauucuucagu

SEQ ID NO: 1145572 - RNA, 20 nt, Human
caaacaaugucaucaggaac

SEQ ID NO: 1145573 - RNA, 24 nt, Human
caacauggugaaaccccgucucua

SEQ ID NO: 1145574 - RNA, 21 nt, Human
caauauggacauuaucuuaca

SEQ ID NO: 1145575 - RNA, 23 nt, Human
cacaccuguaaucccagcacuuu

SEQ ID NO: 1145576 - RNA, 26 nt, Human
caccacugcacuccagccugggugac

SEQ ID NO: 1145577 - RNA, 18 nt, Human
caccauacagacacagcc

SEQ ID NO: 1145578 - RNA, 18 nt, Human
caccuguaaucccagcac

SEQ ID NO: 1145579 - RNA, 22 nt, Human
caccuguaaucccagcacuuua

SEQ ID NO: 1145580 - RNA, 18 nt, Human
cacuccagccugggugac

SEQ ID NO: 1145581 - RNA, 22 nt, Human
cacuccagccugggugacagag

SEQ ID NO: 1145582 - RNA, 19 nt, Human
cacugcacuccagccuggg

SEQ ID NO: 1145583 - RNA, 19 nt, Human
cacugcacuccagccuggg

SEQ ID NO: 1145584 - RNA, 21 nt, Human
cacugcacuccagccugggug

SEQ ID NO: 1145585 - RNA, 22 nt, Human
cacugcacuccagccuggguga

SEQ ID NO: 1145586 - RNA, 24 nt, Human
cacugcacuccagccugggugaca

SEQ ID NO: 1145587 - RNA, 24 nt, Human
cacugcacuccagccugggugaca

SEQ ID NO: 1145588 - RNA, 19 nt, Human
cagaagaagacuuguucau

SEQ ID NO: 1145589 - RNA, 22 nt, Human
cagagaaagacucugucucaga

SEQ ID NO: 1145590 - RNA, 24 nt, Human
cagcacuuuaggaggccgaggugg

SEQ ID NO: 1145591 - RNA, 18 nt, Human
cagcauccugggcccccc

SEQ ID NO: 1145592 - RNA, 19 nt, Human
cagccggacugguuugcac

SEQ ID NO: 1145593 - RNA, 22 nt, Human
cagccugggugacagagaaaga

SEQ ID NO: 1145594 - RNA, 24 nt, Human
cagcuacucgggaggcugaggcag

SEQ ID NO: 1145595 - RNA, 23 nt, Human
cagguagcaccaucuuccuuagu

SEQ ID NO: 1145596 - RNA, 21 nt, Human
caucucuaaacaauauggaca

SEQ ID NO: 1145597 - RNA, 24 nt, Human
cauuaacacuauuuguaccaagac

SEQ ID NO: 1145598 - RNA, 19 nt, Human
ccacagucucaaaugugac

SEQ ID NO: 1145599 - RNA, 20 nt, Human
ccacugcacuccagccuggg

SEQ ID NO: 1145600 - RNA, 20 nt, Human
ccacugcacuccagccuggg

SEQ ID NO: 1145601 - RNA, 21 nt, Human
ccacugcacuccagccugggu

SEQ ID NO: 1145602 - RNA, 21 nt, Human
ccacugcacuccagccugggu

SEQ ID NO: 1145603 - RNA, 23 nt, Human
ccacugcacuccagccuggguga

SEQ ID NO: 1145604 - RNA, 24 nt, Human
ccacugcacuccagccugggugac

SEQ ID NO: 1145605 - RNA, 25 nt, Human
ccacugcacuccagccugggugaca

SEQ ID NO: 1145606 - RNA, 24 nt, Human
ccacuguuccugccuucuuuccug

SEQ ID NO: 1145607 - RNA, 20 nt, Human
ccagaagaagacuuguucau

SEQ ID NO: 1145608 - RNA, 24 nt, Human
ccccaccacuguuccugccuucuu

SEQ ID NO: 1145609 - RNA, 23 nt, Human
ccccaccccgccccagccucaga

SEQ ID NO: 1145610 - RNA, 19 nt, Human
ccccgccccagccucagac

SEQ ID NO: 1145611 - RNA, 19 nt, Human
cccugaaccugggcccuuc

SEQ ID NO: 1145612 - RNA, 19 nt, Human
cccuguagcuucccugccu

SEQ ID NO: 1145613 - RNA, 27 nt, Human
cccuuggagcuucauuuccuccgcggg

SEQ ID NO: 1145614 - RNA, 25 nt, Human
ccucagacuguacguuuuagaccuu

SEQ ID NO: 1145615 - RNA, 19 nt, Human
ccugcagugaaaucucagc

SEQ ID NO: 1145616 - RNA, 23 nt, Human
ccuggccaacauggugaaacccc

SEQ ID NO: 1145617 - RNA, 24 nt, Human
ccuggccaacauggugaaaccccg

SEQ ID NO: 1145618 - RNA, 22 nt, Human
ccugggugacagagaaagacuc

SEQ ID NO: 1145619 - RNA, 20 nt, Human
ccuuuccccaccccgcccca

SEQ ID NO: 1145620 - RNA, 24 nt, Human
cgagaccagccuggccaacauggu

SEQ ID NO: 1145621 - RNA, 24 nt, Human
cgagauugcaccacugcacuccag

SEQ ID NO: 1145622 - RNA, 18 nt, Human
cggcagagggaagagggg

SEQ ID NO: 1145623 - RNA, 22 nt, Human
cggcagagggaagagggggucg

SEQ ID NO: 1145624 - RNA, 18 nt, Human
cuaagaguuugagccaca

SEQ ID NO: 1145625 - RNA, 21 nt, Human
cuacaauccugaaccuaucac

SEQ ID NO: 1145626 - RNA, 21 nt, Human
cuaggcuuccagcuucucuua

SEQ ID NO: 1145627 - RNA, 18 nt, Human
cuauaaucccagcuacuc

SEQ ID NO: 1145628 - RNA, 18 nt, Human
cucaaggguagggucacc

SEQ ID NO: 1145629 - RNA, 22 nt, Human
cucacaccuguaaucccagcac

SEQ ID NO: 1145630 - RNA, 24 nt, Human
cucacaccuguaaucccagcacuu

SEQ ID NO: 1145631 - RNA, 25 nt, Human
cucagaaccauccuuuccccacccc

SEQ ID NO: 1145632 - RNA, 22 nt, Human
cugaaccugggcccuuccucau

SEQ ID NO: 1145633 - RNA, 22 nt, Human
cugcaguagucccaagucuggc

SEQ ID NO: 1145634 - RNA, 21 nt, Human
cuggaucguguguccaugugu

SEQ ID NO: 1145635 - RNA, 19 nt, Human
cuggucccaggcaauccca

SEQ ID NO: 1145636 - RNA, 22 nt, Human
cugugauccccaccacuguucc

SEQ ID NO: 1145637 - RNA, 18 nt, Human
cuuggcuggauuggaagu

SEQ ID NO: 1145638 - RNA, 23 nt, Human
cuuuccccaccccgccccagccu

SEQ ID NO: 1145639 - RNA, 18 nt, Human
gaaaaacgagugcuucuc

SEQ ID NO: 1145640 - RNA, 18 nt, Human
gaaagaagaaaaagagua

SEQ ID NO: 1145641 - RNA, 18 nt, Human
gaaccugggcccuuccuc

SEQ ID NO: 1145642 - RNA, 18 nt, Human
gacaggcugauaguggcu

SEQ ID NO: 1145643 - RNA, 20 nt, Human
gaccauggcugugagacccu

SEQ ID NO: 1145644 - RNA, 21 nt, Human
gaccggcagagggaagagggg

SEQ ID NO: 1145645 - RNA, 18 nt, Human
gacucugucucagaaaaa

SEQ ID NO: 1145646 - RNA, 24 nt, Human
gaggugggcagaucacaaggucag

SEQ ID NO: 1145647 - RNA, 21 nt, Human
gaucacaaggucaggaguucg

SEQ ID NO: 1145648 - RNA, 22 nt, Human
gaucacaaggucaggaguucga

SEQ ID NO: 1145649 - RNA, 24 nt, Human
gaucacaaggucaggaguucgaga

SEQ ID NO: 1145650 - RNA, 21 nt, Human
gcagaaaacaacuuguuucua

SEQ ID NO: 1145651 - RNA, 22 nt, Human
gcaggagaaucacuugaaccca

SEQ ID NO: 1145652 - RNA, 24 nt, Human
gccaacauggugaaaccccgucuc

SEQ ID NO: 1145653 - RNA, 19 nt, Human
gccuugugcugucaauugu

SEQ ID NO: 1145654 - RNA, 22 nt, Human
ggaggcagagguugcagugagc

SEQ ID NO: 1145655 - RNA, 19 nt, Human
ggcagagggaagagggggu

SEQ ID NO: 1145656 - RNA, 23 nt, Human
ggcagaucacaaggucaggaguu

SEQ ID NO: 1145657 - RNA, 25 nt, Human
ggcugugagacccuggcagcauccu

SEQ ID NO: 1145658 - RNA, 18 nt, Human
gggaagagggggucgggu

SEQ ID NO: 1145659 - RNA, 23 nt, Human
gggaggcugaggcaggagaauca

SEQ ID NO: 1145660 - RNA, 24 nt, Human
gggcgcgguggcucacaccuguaa

SEQ ID NO: 1145661 - RNA, 22 nt, Human
ggugcucgggccgggcgcggug

SEQ ID NO: 1145662 - RNA, 24 nt, Human
gguggcacgugucuauaaucccag

SEQ ID NO: 1145663 - RNA, 23 nt, Human
gguggcucacaccuguaauccca

SEQ ID NO: 1145664 - RNA, 24 nt, Human
gguggcucacaccuguaaucccag

SEQ ID NO: 1145665 - RNA, 21 nt, Human
guucuuugaagacugauccuu

SEQ ID NO: 1145666 - RNA, 19 nt, Human
guugcagugagccgagauu

SEQ ID NO: 1145667 - RNA, 21 nt, Human
uaaagcagccggacugguuug

SEQ ID NO: 1145668 - RNA, 20 nt, Human
uaacaggaaaguccagggag

SEQ ID NO: 1145669 - RNA, 21 nt, Human
uaacuguagccagggaaguga

SEQ ID NO: 1145670 - RNA, 18 nt, Human
uacaauccugaaccuauc

SEQ ID NO: 1145671 - RNA, 21 nt, Human
uaccagaagaagacuuguuca

SEQ ID NO: 1145672 - RNA, 22 nt, Human
uaccugcauuuguuuuucugga

SEQ ID NO: 1145673 - RNA, 22 nt, Human
uagccgggcgugguggcacgug

SEQ ID NO: 1145674 - RNA, 20 nt, Human
uaggaggccgaggugggcag

SEQ ID NO: 1145675 - RNA, 24 nt, Human
uaggaggccgaggugggcagauca

SEQ ID NO: 1145676 - RNA, 24 nt, Human
ucacaaggucaggaguucgagacc

SEQ ID NO: 1145677 - RNA, 19 nt, Human
ucaccagcuuccaaguucu

SEQ ID NO: 1145678 - RNA, 20 nt, Human
ucacgcaggcuccugggugg

SEQ ID NO: 1145679 - RNA, 25 nt, Human
ucagauauuuggagauacuucagau

SEQ ID NO: 1145680 - RNA, 21 nt, Human
ucagcucuggaaacuugggca

SEQ ID NO: 1145681 - RNA, 19 nt, Human
ucaggaacuugcuguucuc

SEQ ID NO: 1145682 - RNA, 19 nt, Human
uccaccauacagacacagc

SEQ ID NO: 1145683 - RNA, 20 nt, Human
uccagccugggugacagaga

SEQ ID NO: 1145684 - RNA, 24 nt, Human
ucccaggcaaucccaucaauuuac

SEQ ID NO: 1145685 - RNA, 21 nt, Human
uccccaccacuguuccugccu

SEQ ID NO: 1145686 - RNA, 24 nt, Human
uccucaagucaguguccaucagca

SEQ ID NO: 1145687 - RNA, 18 nt, Human
uccugggugguucuggaa

SEQ ID NO: 1145688 - RNA, 25 nt, Human
ucgggaggcugaggcaggagaauca

SEQ ID NO: 1145689 - RNA, 24 nt, Human
ucgggccgggcgcgguggcucaca

SEQ ID NO: 1145690 - RNA, 18 nt, Human
ucgggugggggaagagac

SEQ ID NO: 1145691 - RNA, 21 nt, Human
ucuauaaucccagcuacucgg

SEQ ID NO: 1145692 - RNA, 23 nt, Human
ucucacccuuugcauuaaccaga

SEQ ID NO: 1145693 - RNA, 20 nt, Human
ucucccagggucuucugcag

SEQ ID NO: 1145694 - RNA, 21 nt, Human
ucucuacuaagaauacaaaaa

SEQ ID NO: 1145695 - RNA, 20 nt, Human
ucuuccuuagucagggguca

SEQ ID NO: 1145696 - RNA, 19 nt, Human
ugaaaucucagcucuguug

SEQ ID NO: 1145697 - RNA, 22 nt, Human
ugagccgagauugcaccacugc

SEQ ID NO: 1145698 - RNA, 21 nt, Human
ugaggacaggcugauaguggc

SEQ ID NO: 1145699 - RNA, 20 nt, Human
ugaggcaggagaaucacuug

SEQ ID NO: 1145700 - RNA, 24 nt, Human
ugaggcaggagaaucacuugaacc

SEQ ID NO: 1145701 - RNA, 25 nt, Human
ugaggcaggagaaucacuugaaccc

SEQ ID NO: 1145702 - RNA, 21 nt, Human
ugcaccacugcacuccagccu

SEQ ID NO: 1145703 - RNA, 21 nt, Human
ugcagugaaaucucagcucug

SEQ ID NO: 1145704 - RNA, 25 nt, Human
ugcaucucuaaacaauauggacauu

SEQ ID NO: 1145705 - RNA, 20 nt, Human
ugccaacauccuaucagacu

SEQ ID NO: 1145706 - RNA, 20 nt, Human
ugcccauacuucccugaacc

SEQ ID NO: 1145707 - RNA, 18 nt, Human
ugcccuguagcuucccug

SEQ ID NO: 1145708 - RNA, 22 nt, Human
ugcccuguagcuucccugccuu

SEQ ID NO: 1145709 - RNA, 22 nt, Human
ugccucaugcccccaauauuuu

SEQ ID NO: 1145710 - RNA, 28 nt, Human
ugcuaccaccuucgugagaacuuuucug

SEQ ID NO: 1145711 - RNA, 24 nt, Human
uggaagccaaacccugugccgccu

SEQ ID NO: 1145712 - RNA, 22 nt, Human
uggcacgugucuauaaucccag

SEQ ID NO: 1145713 - RNA, 24 nt, Human
uggccaacauggugaaaccccguc

SEQ ID NO: 1145714 - RNA, 21 nt, Human
uggcucacaccuguaauccca

SEQ ID NO: 1145715 - RNA, 22 nt, Human
uggcucacaccuguaaucccag

SEQ ID NO: 1145716 - RNA, 24 nt, Human
uggcucacaccuguaaucccagca

SEQ ID NO: 1145717 - RNA, 21 nt, Human
uggcuccucaagucagugucc

SEQ ID NO: 1145718 - RNA, 19 nt, Human
uggcugugagacccuggca

SEQ ID NO: 1145719 - RNA, 22 nt, Human
ugggcagaucacaaggucagga

SEQ ID NO: 1145720 - RNA, 24 nt, Human
ugguggcacgugucuauaauccca

SEQ ID NO: 1145721 - RNA, 18 nt, Human
uguaaucccucaccagcu

SEQ ID NO: 1145722 - RNA, 24 nt, Human
ugucuauaaucccagcuacucggg

SEQ ID NO: 1145723 - RNA, 18 nt, Human
ugucugcccuguagcuuc

SEQ ID NO: 1145724 - RNA, 26 nt, Human
ugugacucucagaagccagucuuggg

SEQ ID NO: 1145725 - RNA, 21 nt, Human
uguugcuuuucagcucuggaa

SEQ ID NO: 1145726 - RNA, 20 nt, Human
uuagccgggcgugguggcac

SEQ ID NO: 1145727 - RNA, 20 nt, Human
uuagccgggcgugguggcac

SEQ ID NO: 1145728 - RNA, 23 nt, Human
uuagccgggcgugguggcacgug

SEQ ID NO: 1145729 - RNA, 22 nt, Human
uuauucuucuuggcuggauugg

SEQ ID NO: 1145730 - RNA, 18 nt, Human
uucacuagcacauuugga

SEQ ID NO: 1145731 - RNA, 24 nt, Human
uucagauauuuggagauacuucag

SEQ ID NO: 1145732 - RNA, 22 nt, Human
uucauuaacacuauuuguacca

SEQ ID NO: 1145733 - RNA, 18 nt, Human
uuccauggggaauaucuu

SEQ ID NO: 1145734 - RNA, 22 nt, Human
uuccauggggaauaucuucaga

SEQ ID NO: 1145735 - RNA, 23 nt, Human
uugcaccacugcacuccagccug

SEQ ID NO: 1145736 - RNA, 19 nt, Human
uugcagugagccgagauug

SEQ ID NO: 1145737 - RNA, 20 nt, Human
uugcagugagccgagauugc

SEQ ID NO: 1145738 - RNA, 22 nt, Human
uugcagugagccgagauugcac

SEQ ID NO: 1145739 - RNA, 23 nt, Human
uuggagcuucauuucccaacugg

SEQ ID NO: 1145740 - RNA, 21 nt, Human
uuggggugcucuuaccagaag

SEQ ID NO: 1145741 - RNA, 20 nt, Human
uuuccuggcuccucaaguca

SEQ ID NO: 1145742 - RNA, 26 nt, Human
uuugcagcccucuagguuggcuuucu

SEQ ID NO: 1145743 - RNA, 23 nt, Human
uuuguaaucccucaccagcuucc

SEQ ID NO: 1145744 - RNA, 21 nt, Human
uuuuccauggggaauaucuuc

SEQ ID NO: 1145745 - RNA, 19 nt, Human
aaagugcugacauuacagg

SEQ ID NO: 1145746 - RNA, 20 nt, Human
aaagugcugacauuacaggc

SEQ ID NO: 1145747 - RNA, 20 nt, Human
acccagcuaaguuuuguauu

SEQ ID NO: 1145748 - RNA, 25 nt, Human
aggcaauccucccaucucagccucc

SEQ ID NO: 1145749 - RNA, 20 nt, Human
agugcagugacgcaaucuug

SEQ ID NO: 1145750 - RNA, 24 nt, Human
agugcagugacgcaaucuuggcuc

SEQ ID NO: 1145751 - RNA, 24 nt, Human
agugcugacauuacaggcuugagc

SEQ ID NO: 1145752 - RNA, 22 nt, Human
auuacaggcuugagccacugca

SEQ ID NO: 1145753 - RNA, 22 nt, Human
caagugaacugccugccucagc

SEQ ID NO: 1145754 - RNA, 19 nt, Human
cagaucacaccaccacacc

SEQ ID NO: 1145755 - RNA, 24 nt, Human
caucucagccuccugaguugcugg

SEQ ID NO: 1145756 - RNA, 23 nt, Human
cauguuguccaggcuggucuuga

SEQ ID NO: 1145757 - RNA, 24 nt, Human
cauguuguccaggcuggucuugag

SEQ ID NO: 1145758 - RNA, 24 nt, Human
cauucugucacccaggcugcagug

SEQ ID NO: 1145759 - RNA, 19 nt, Human
ccauguuguccaggcuggu

SEQ ID NO: 1145760 - RNA, 21 nt, Human
ccauguuguccaggcuggucu

SEQ ID NO: 1145761 - RNA, 20 nt, Human
cccaggcugcagugcaguga

SEQ ID NO: 1145762 - RNA, 24 nt, Human
cccugggcucaggcaauccuccca

SEQ ID NO: 1145763 - RNA, 18 nt, Human
ccugggcucaagugaacu

SEQ ID NO: 1145764 - RNA, 22 nt, Human
ccugggcucaagugaacugccu

SEQ ID NO: 1145765 - RNA, 23 nt, Human
ccugggcucaagugaacugccug

SEQ ID NO: 1145766 - RNA, 18 nt, Human
cuccugaguugcuggaac

SEQ ID NO: 1145767 - RNA, 23 nt, Human
cugccucagccuuuuaaagugcu

SEQ ID NO: 1145768 - RNA, 19 nt, Human
cuggaacuacagaucacac

SEQ ID NO: 1145769 - RNA, 19 nt, Human
cuggucuugagcuccuggg

SEQ ID NO: 1145770 - RNA, 22 nt, Human
cuuggcucacgguagccucagc

SEQ ID NO: 1145771 - RNA, 22 nt, Human
cuuuaagaauacauuccucaaa

SEQ ID NO: 1145772 - RNA, 20 nt, Human
gaucacaccaccacacccag

SEQ ID NO: 1145773 - RNA, 22 nt, Human
gggucuugccauguuguccagg

SEQ ID NO: 1145774 - RNA, 24 nt, Human
ggucuugccauguuguccaggcug

SEQ ID NO: 1145775 - RNA, 19 nt, Human
guagaaaugggucuugcca

SEQ ID NO: 1145776 - RNA, 18 nt, Human
guccuucugggagucucc

SEQ ID NO: 1145777 - RNA, 24 nt, Human
gugaacugccugccucagccuuuu

SEQ ID NO: 1145778 - RNA, 21 nt, Human
uaaguuuuguauuuuuguaga

SEQ ID NO: 1145779 - RNA, 21 nt, Human
uacagaucacaccaccacacc

SEQ ID NO: 1145780 - RNA, 23 nt, Human
uacagaucacaccaccacaccca

SEQ ID NO: 1145781 - RNA, 22 nt, Human
uccagccagccagaugcccaaa

SEQ ID NO: 1145782 - RNA, 20 nt, Human
ucccugggcucaggcaaucc

SEQ ID NO: 1145783 - RNA, 26 nt, Human
uccucccaucucagccuccugaguug

SEQ ID NO: 1145784 - RNA, 24 nt, Human
ucuccagguccaagcacuuaguuu

SEQ ID NO: 1145785 - RNA, 24 nt, Human
ucugucacccaggcugcagugcag

SEQ ID NO: 1145786 - RNA, 18 nt, Human
ucugugcuuucuuuaaaa

SEQ ID NO: 1145787 - RNA, 22 nt, Human
ucuugagcuccugggcucaagu

SEQ ID NO: 1145788 - RNA, 22 nt, Human
ucuugccauguuguccaggcug

SEQ ID NO: 1145789 - RNA, 23 nt, Human
ucuugccauguuguccaggcugg

SEQ ID NO: 1145790 - RNA, 24 nt, Human
ucuugccauguuguccaggcuggu

SEQ ID NO: 1145791 - RNA, 21 nt, Human
ugacauuacaggcuugagcca

SEQ ID NO: 1145792 - RNA, 24 nt, Human
ugacauuacaggcuugagccacug

SEQ ID NO: 1145793 - RNA, 19 nt, Human
ugcagugacgcaaucuugg

SEQ ID NO: 1145794 - RNA, 22 nt, Human
ugcagugacgcaaucuuggcuc

SEQ ID NO: 1145795 - RNA, 23 nt, Human
ugcagugacgcaaucuuggcuca

SEQ ID NO: 1145796 - RNA, 24 nt, Human
ugcagugcagugacgcaaucuugg

SEQ ID NO: 1145797 - RNA, 22 nt, Human
ugccauguuguccaggcugguc

SEQ ID NO: 1145798 - RNA, 24 nt, Human
ugccauguuguccaggcuggucuu

SEQ ID NO: 1145799 - RNA, 23 nt, Human
uggaacuacagaucacaccacca

SEQ ID NO: 1145800 - RNA, 21 nt, Human
uggcucacgguagccucagca

SEQ ID NO: 1145801 - RNA, 20 nt, Human
ugggcucaagugaacugccu

SEQ ID NO: 1145802 - RNA, 23 nt, Human
ugggucuugccauguuguccagg

SEQ ID NO: 1145803 - RNA, 23 nt, Human
uguagaaaugggucuugccaugu

SEQ ID NO: 1145804 - RNA, 21 nt, Human
ugucacccaggcugcagugca

SEQ ID NO: 1145805 - RNA, 24 nt, Human
uguccaggcuggucuugagcuccu

SEQ ID NO: 1145806 - RNA, 22 nt, Human
uugagccacugcaaacggcccu

SEQ ID NO: 1145807 - RNA, 20 nt, Human
uuuaaaaucugucuucccuu

SEQ ID NO: 1145808 - RNA, 22 nt, Human
uuuauguuuaccuccauuuguu

SEQ ID NO: 1145809 - RNA, 20 nt, Human
uuucuuggauucacuguuuc

SEQ ID NO: 1145810 - RNA, 24 nt, Human
uuuguauuuuuguagaaauggguc

SEQ ID NO: 1145811 - RNA, 21 nt, Human
aauagaagacuucagucugga

SEQ ID NO: 1145812 - RNA, 26 nt, Human
agaaaggaaagggcaagguucacuga

SEQ ID NO: 1145813 - RNA, 21 nt, Human
augcacaaguaauagaaagga

SEQ ID NO: 1145814 - RNA, 18 nt, Human
cacugaaucacagcagcc

SEQ ID NO: 1145815 - RNA, 20 nt, Human
cacugaaucacagcagccgg

SEQ ID NO: 1145816 - RNA, 23 nt, Human
cagcagugcccaggacuguucaa

SEQ ID NO: 1145817 - RNA, 24 nt, Human
caguauggacuauauuugucucuc

SEQ ID NO: 1145818 - RNA, 19 nt, Human
cagugcccaggacuguuca

SEQ ID NO: 1145819 - RNA, 23 nt, Human
cuuaaaacauugucagaggugag

SEQ ID NO: 1145820 - RNA, 19 nt, Human
gauacaaaggcgacuuaaa

SEQ ID NO: 1145821 - RNA, 21 nt, Human
uccuuucuccccaucuuuggg

SEQ ID NO: 1145822 - RNA, 19 nt, Human
uggcaaaucagaaaagggg

SEQ ID NO: 1145823 - RNA, 24 nt, Human
uugucucuccuuuuccuuucuccc

SEQ ID NO: 1145824 - RNA, 24 nt, Human
aaaaacagcuccuggauucguuga

SEQ ID NO: 1145825 - RNA, 20 nt, Human
aaaaauguacauucuguugu

SEQ ID NO: 1145826 - RNA, 18 nt, Human
aaagcuuuuccaagucca

SEQ ID NO: 1145827 - RNA, 22 nt, Human
aacagucagugagaauccuguc

SEQ ID NO: 1145828 - RNA, 21 nt, Human
aaguuuaaagauuuccaagcu

SEQ ID NO: 1145829 - RNA, 22 nt, Human
accaucucaucuucuugagccu

SEQ ID NO: 1145830 - RNA, 19 nt, Human
agagucauucuggaaaagg

SEQ ID NO: 1145831 - RNA, 19 nt, Human
agggguaacagucagugag

SEQ ID NO: 1145832 - RNA, 19 nt, Human
auucuggaaaagguuguuc

SEQ ID NO: 1145833 - RNA, 18 nt, Human
caaaaaacagcuccugga

SEQ ID NO: 1145834 - RNA, 22 nt, Human
caaaaaacagcuccuggauucg

SEQ ID NO: 1145835 - RNA, 21 nt, Human
cacuacuuuagcugcguccca

SEQ ID NO: 1145836 - RNA, 20 nt, Human
cagagauucugguacauucu

SEQ ID NO: 1145837 - RNA, 18 nt, Human
cagcagucaaaacagcgc

SEQ ID NO: 1145838 - RNA, 22 nt, Human
caggacugucugacuccugccu

SEQ ID NO: 1145839 - RNA, 23 nt, Human
cagggugaauauuauuauccccu

SEQ ID NO: 1145840 - RNA, 20 nt, Human
ccguccaggcagcccagagg

SEQ ID NO: 1145841 - RNA, 22 nt, Human
cuccacacugcuccucuggacu

SEQ ID NO: 1145842 - RNA, 23 nt, Human
cuccacacugcuccucuggacuc

SEQ ID NO: 1145843 - RNA, 24 nt, Human
cugggcaaaagcauugccauucau

SEQ ID NO: 1145844 - RNA, 19 nt, Human
gaauaaagaaaagcuggca

SEQ ID NO: 1145845 - RNA, 19 nt, Human
gcaaagcuuuuccaagucc

SEQ ID NO: 1145846 - RNA, 21 nt, Human
gcaaagcuuuuccaaguccaa

SEQ ID NO: 1145847 - RNA, 22 nt, Human
gccuguuuauuuuucuaauccu

SEQ ID NO: 1145848 - RNA, 20 nt, Human
gugggcaaagcuuuuccaag

SEQ ID NO: 1145849 - RNA, 19 nt, Human
uaaauaacacucagcuaaa

SEQ ID NO: 1145850 - RNA, 25 nt, Human
uaaguaggaaaaaagauacaacauc

SEQ ID NO: 1145851 - RNA, 18 nt, Human
uacauucucucuuuuucu

SEQ ID NO: 1145852 - RNA, 22 nt, Human
uagccuaauagucuauuaagua

SEQ ID NO: 1145853 - RNA, 23 nt, Human
uagugcuauaaauuucccucuua

SEQ ID NO: 1145854 - RNA, 20 nt, Human
ucaaaaaacagcuccuggau

SEQ ID NO: 1145855 - RNA, 18 nt, Human
ucacaagaggcuuucaca

SEQ ID NO: 1145856 - RNA, 18 nt, Human
ucauuccagcaacaggau

SEQ ID NO: 1145857 - RNA, 19 nt, Human
ucccagagauucugguaca

SEQ ID NO: 1145858 - RNA, 21 nt, Human
ucccuggagucguagcucccg

SEQ ID NO: 1145859 - RNA, 21 nt, Human
uccuccacacugcuccucugg

SEQ ID NO: 1145860 - RNA, 18 nt, Human
ugaaacagacuuuuaaaa

SEQ ID NO: 1145861 - RNA, 26 nt, Human
ugaaagacaaaacuuuuauacuaaga

SEQ ID NO: 1145862 - RNA, 22 nt, Human
ugacugaauuuccuaaucuuga

SEQ ID NO: 1145863 - RNA, 21 nt, Human
ugcccauaugacaugcuuuau

SEQ ID NO: 1145864 - RNA, 25 nt, Human
ugcuauaaauuucccucuuaacacu

SEQ ID NO: 1145865 - RNA, 18 nt, Human
ugggcaaaagcauugcca

SEQ ID NO: 1145866 - RNA, 22 nt, Human
ugggguuuauuugcucuugguu

SEQ ID NO: 1145867 - RNA, 19 nt, Human
uguacuggugacuguagaa

SEQ ID NO: 1145868 - RNA, 20 nt, Human
uuacugaggaguguuuuacu

SEQ ID NO: 1145869 - RNA, 23 nt, Human
uuacugaggaguguuuuacuucc

SEQ ID NO: 1145870 - RNA, 23 nt, Human
uuacugguucuugugaaucucuu

SEQ ID NO: 1145871 - RNA, 22 nt, Human
uucaauuacuguuuauaagacc

SEQ ID NO: 1145872 - RNA, 22 nt, Human
uucaguugaguuucacaagagg

SEQ ID NO: 1145873 - RNA, 25 nt, Human
uuguucaauuuccauguaguugugu

SEQ ID NO: 1145874 - RNA, 23 nt, Human
uuguuccaacgguuaagcucgga

SEQ ID NO: 1145875 - RNA, 23 nt, Human
aggguugaaugguggaauccaag

SEQ ID NO: 1145876 - RNA, 19 nt, Human
aucuguggcgcauuuccuu

SEQ ID NO: 1145877 - RNA, 19 nt, Human
cagaucccaggcccuggga

SEQ ID NO: 1145878 - RNA, 24 nt, Human
caggugagauccaggaaaauguau

SEQ ID NO: 1145879 - RNA, 21 nt, Human
ccuggccagaucccaggcccu

SEQ ID NO: 1145880 - RNA, 19 nt, Human
cucccuggccagaucccag

SEQ ID NO: 1145881 - RNA, 22 nt, Human
cuugccgaagcuacuuccucca

SEQ ID NO: 1145882 - RNA, 21 nt, Human
gaaugguggaauccaaggccc

SEQ ID NO: 1145883 - RNA, 19 nt, Human
gcccuggagcagaugggcc

SEQ ID NO: 1145884 - RNA, 21 nt, Human
gcccuggagcagaugggccag

SEQ ID NO: 1145885 - RNA, 23 nt, Human
ucaggguugaaugguggaaucca

SEQ ID NO: 1145886 - RNA, 20 nt, Human
ucccaggcccugggagcggg

SEQ ID NO: 1145887 - RNA, 21 nt, Human
ucccuggccagaucccaggcc

SEQ ID NO: 1145888 - RNA, 23 nt, Human
ucccuggccagaucccaggcccu

SEQ ID NO: 1145889 - RNA, 18 nt, Human
ucgggcaggggaaauuca

SEQ ID NO: 1145890 - RNA, 20 nt, Human
ucgggcaggggaaauucaca

SEQ ID NO: 1145891 - RNA, 19 nt, Human
ugaaaccucggcaagaguc

SEQ ID NO: 1145892 - RNA, 25 nt, Human
uggccagaucccaggcccugggagc

SEQ ID NO: 1145893 - RNA, 18 nt, Human
ugggagcggggacacacu

SEQ ID NO: 1145894 - RNA, 21 nt, Human
ugucagcaaaguuugccuuug

SEQ ID NO: 1145895 - RNA, 18 nt, Human
uuccagcccucccuggcc

SEQ ID NO: 1145896 - RNA, 23 nt, Human
uuggccagcagcaagagucuucu

SEQ ID NO: 1145897 - RNA, 18 nt, Human
aaaaagugguaaaaaucu

SEQ ID NO: 1145898 - RNA, 22 nt, Human
aaaagaacauacacuccacauu

SEQ ID NO: 1145899 - RNA, 24 nt, Human
aaaaggcauauauuacugugaaaa

SEQ ID NO: 1145900 - RNA, 20 nt, Human
aaacaaggcauauucaugua

SEQ ID NO: 1145901 - RNA, 23 nt, Human
acaagauaauaaauaaguuaaau

SEQ ID NO: 1145902 - RNA, 22 nt, Human
acauaauaaaagaauauauauc

SEQ ID NO: 1145903 - RNA, 20 nt, Human
accaagugaaguuacaaaag

SEQ ID NO: 1145904 - RNA, 20 nt, Human
acugugaaaagaacauacac

SEQ ID NO: 1145905 - RNA, 18 nt, Human
agaacauacacuccacau

SEQ ID NO: 1145906 - RNA, 19 nt, Human
agacuccccccccacuccc

SEQ ID NO: 1145907 - RNA, 23 nt, Human
agcugcuggugcuggguugauuu

SEQ ID NO: 1145908 - RNA, 22 nt, Human
aggaaagaaauuaaugaaauaa

SEQ ID NO: 1145909 - RNA, 23 nt, Human
aggaaagaaauuaaugaaauaaa

SEQ ID NO: 1145910 - RNA, 21 nt, Human
aggcacugugagacucccccc

SEQ ID NO: 1145911 - RNA, 20 nt, Human
auaaccaagugaaguuacaa

SEQ ID NO: 1145912 - RNA, 23 nt, Human
caguugaacccauccuacauuca

SEQ ID NO: 1145913 - RNA, 21 nt, Human
cguacaaacuaaagcuaccgc

SEQ ID NO: 1145914 - RNA, 20 nt, Human
cucaaacuacuuccacagca

SEQ ID NO: 1145915 - RNA, 19 nt, Human
cuccccccccacuccccgu

SEQ ID NO: 1145916 - RNA, 23 nt, Human
cuggugcuggguugauuuuuccu

SEQ ID NO: 1145917 - RNA, 21 nt, Human
cugugagacuccccccccacu

SEQ ID NO: 1145918 - RNA, 18 nt, Human
cuguucaagugaagagau

SEQ ID NO: 1145919 - RNA, 20 nt, Human
gaaauaaauauuacauacaa

SEQ ID NO: 1145920 - RNA, 18 nt, Human
gggcccuuccaaaggcac

SEQ ID NO: 1145921 - RNA, 23 nt, Human
gugaaaagaacauacacuccaca

SEQ ID NO: 1145922 - RNA, 21 nt, Human
gugguugguagcugcuggugc

SEQ ID NO: 1145923 - RNA, 25 nt, Human
uaaaguuggaauuagaaaagcaugc

SEQ ID NO: 1145924 - RNA, 26 nt, Human
uacagucacaauuuguagugagcuga

SEQ ID NO: 1145925 - RNA, 23 nt, Human
ucauuuacaauaaaauaaccaag

SEQ ID NO: 1145926 - RNA, 20 nt, Human
ucgggcccuuccaaaggcac

SEQ ID NO: 1145927 - RNA, 24 nt, Human
ucuguaauuaaacaaggccggggc

SEQ ID NO: 1145928 - RNA, 23 nt, Human
ugaaaagaacauacacuccacau

SEQ ID NO: 1145929 - RNA, 26 nt, Human
ugaaauaaauauuacauacaaucucu

SEQ ID NO: 1145930 - RNA, 18 nt, Human
ugaaguuggaugggcuac

SEQ ID NO: 1145931 - RNA, 18 nt, Human
ugcuccaacuguaccuac

SEQ ID NO: 1145932 - RNA, 24 nt, Human
uggugguugguagcugcuggugcu

SEQ ID NO: 1145933 - RNA, 21 nt, Human
uguuuacagucacaauuugua

SEQ ID NO: 1145934 - RNA, 19 nt, Human
uuaaggcaaguucgggccc

SEQ ID NO: 1145935 - RNA, 24 nt, Human
uuagaaaagcaugccacauuucag

SEQ ID NO: 1145936 - RNA, 21 nt, Human
uucaaaaaccuacuucugucc

SEQ ID NO: 1145937 - RNA, 21 nt, Human
uucacaagauaauaaauaagu

SEQ ID NO: 1145938 - RNA, 19 nt, Human
cgaccgcccggagcccagc

SEQ ID NO: 1145939 - RNA, 23 nt, Human
cgaggcgggcggcgccagggcca

SEQ ID NO: 1145940 - RNA, 21 nt, Human
gcgggcggaggcggccccucu

SEQ ID NO: 1145941 - RNA, 22 nt, Human
ggaggcggccccucugcucggc

SEQ ID NO: 1145942 - RNA, 18 nt, Human
gggcggaggcggccccuc

SEQ ID NO: 1145943 - RNA, 18 nt, Human
uaaguaggcaaauuccaa

SEQ ID NO: 1145944 - RNA, 19 nt, Human
uagguaaguaggcaaauuc

SEQ ID NO: 1145945 - RNA, 22 nt, Human
acccaggucacaauacccaaaa

SEQ ID NO: 1145946 - RNA, 24 nt, Human
accuauggguggcaggaauaugcu

SEQ ID NO: 1145947 - RNA, 20 nt, Human
acuugauucccuguuguauu

SEQ ID NO: 1145948 - RNA, 27 nt, Human
agacaaaagaggagucccaucaccuag

SEQ ID NO: 1145949 - RNA, 22 nt, Human
agagaacaggaccaggagugag

SEQ ID NO: 1145950 - RNA, 22 nt, Human
agagauaugucaugaggccccc

SEQ ID NO: 1145951 - RNA, 22 nt, Human
agagccaagcaguagaaaagag

SEQ ID NO: 1145952 - RNA, 21 nt, Human
aggcaaaagaggagaguccca

SEQ ID NO: 1145953 - RNA, 20 nt, Human
aggcaaauguguaacuucga

SEQ ID NO: 1145954 - RNA, 19 nt, Human
agguaagucacauaaccua

SEQ ID NO: 1145955 - RNA, 21 nt, Human
aucacaauuucuccuugggca

SEQ ID NO: 1145956 - RNA, 20 nt, Human
aucaccuaggugaggggucc

SEQ ID NO: 1145957 - RNA, 18 nt, Human
aucugucacaaggcucuc

SEQ ID NO: 1145958 - RNA, 18 nt, Human
augucacaauacccacag

SEQ ID NO: 1145959 - RNA, 22 nt, Human
augucacaauccccccuuuugg

SEQ ID NO: 1145960 - RNA, 23 nt, Human
augucacaauuaccccagugggc

SEQ ID NO: 1145961 - RNA, 22 nt, Human
augucacgauccccccuuuugg

SEQ ID NO: 1145962 - RNA, 24 nt, Human
augugcagagaacaggaccaggag

SEQ ID NO: 1145963 - RNA, 20 nt, Human
caaaagaggagucccaucac

SEQ ID NO: 1145964 - RNA, 22 nt, Human
cacaauacccacaguauguggg

SEQ ID NO: 1145965 - RNA, 22 nt, Human
cagcacagggacugaaggucag

SEQ ID NO: 1145966 - RNA, 22 nt, Human
cagcagccucuuagucuucccc

SEQ ID NO: 1145967 - RNA, 23 nt, Human
cagcaggggugggugcuccaacc

SEQ ID NO: 1145968 - RNA, 22 nt, Human
caggagaaagaggagaguccca

SEQ ID NO: 1145969 - RNA, 18 nt, Human
caguagaaaagagucaca

SEQ ID NO: 1145970 - RNA, 23 nt, Human
cagugcugacuuacagaaggaag

SEQ ID NO: 1145971 - RNA, 23 nt, Human
caucacaauuucuccuugggcag

SEQ ID NO: 1145972 - RNA, 20 nt, Human
caucacaguggugcugggcc

SEQ ID NO: 1145973 - RNA, 23 nt, Human
cauuaugucacaauacccacagu

SEQ ID NO: 1145974 - RNA, 22 nt, Human
ccaagacaaaagaggaguccca

SEQ ID NO: 1145975 - RNA, 25 nt, Human
ccacaguaugugggaccaagacaaa

SEQ ID NO: 1145976 - RNA, 18 nt, Human
ccagcaggggugggugcu

SEQ ID NO: 1145977 - RNA, 23 nt, Human
cccacaugugcagagaacaggac

SEQ ID NO: 1145978 - RNA, 23 nt, Human
cccaucacccaggucacaauacc

SEQ ID NO: 1145979 - RNA, 22 nt, Human
ccccaggaagggucuuguccag

SEQ ID NO: 1145980 - RNA, 22 nt, Human
ccccccaggaagggucuugucc

SEQ ID NO: 1145981 - RNA, 18 nt, Human
ccccuugugggcagggcu

SEQ ID NO: 1145982 - RNA, 18 nt, Human
ccuaggugaugaauccag

SEQ ID NO: 1145983 - RNA, 22 nt, Human
ccuuggugcugggcccagcaau

SEQ ID NO: 1145984 - RNA, 20 nt, Human
cgacuugguguuggggccag

SEQ ID NO: 1145985 - RNA, 18 nt, Human
cucacucuucaagucucu

SEQ ID NO: 1145986 - RNA, 23 nt, Human
cuccccugugggcagaaccuugu

SEQ ID NO: 1145987 - RNA, 21 nt, Human
cugucacaaggcucucuguga

SEQ ID NO: 1145988 - RNA, 18 nt, Human
cuguucacuugauucccu

SEQ ID NO: 1145989 - RNA, 18 nt, Human
cuuggugcugggcccagc

SEQ ID NO: 1145990 - RNA, 21 nt, Human
cuuggugcugggcccagcaau

SEQ ID NO: 1145991 - RNA, 21 nt, Human
cuuuuggcuggggccaggcac

SEQ ID NO: 1145992 - RNA, 20 nt, Human
gaacaggaccaggagugagu

SEQ ID NO: 1145993 - RNA, 23 nt, Human
gagaaaggaaccagcaugugcua

SEQ ID NO: 1145994 - RNA, 19 nt, Human
gagcagggcccaggcagga

SEQ ID NO: 1145995 - RNA, 19 nt, Human
gcagaacaggagagucaca

SEQ ID NO: 1145996 - RNA, 21 nt, Human
gcagcagccucuuagucuucc

SEQ ID NO: 1145997 - RNA, 20 nt, Human
gcagggcccaggcaggagcc

SEQ ID NO: 1145998 - RNA, 22 nt, Human
gcagugaggcagggguagggau

SEQ ID NO: 1145999 - RNA, 21 nt, Human
gccaguguuucuacacagugc

SEQ ID NO: 1146000 - RNA, 18 nt, Human
ggaccaagacaaaagagg

SEQ ID NO: 1146001 - RNA, 19 nt, Human
ggccagcaauaggucacaa

SEQ ID NO: 1146002 - RNA, 21 nt, Human
ggccagcaauaggucacaauc

SEQ ID NO: 1146003 - RNA, 23 nt, Human
gggcagagccaagcaguagaaaa

SEQ ID NO: 1146004 - RNA, 24 nt, Human
gggcagggcucaggaaggagaggu

SEQ ID NO: 1146005 - RNA, 22 nt, Human
uaaggcaccacugaguaggaaa

SEQ ID NO: 1146006 - RNA, 20 nt, Human
uacacagugcuuucauugga

SEQ ID NO: 1146007 - RNA, 18 nt, Human
uacccacaguauguggga

SEQ ID NO: 1146008 - RNA, 21 nt, Human
ucacccagguguugggcccag

SEQ ID NO: 1146009 - RNA, 24 nt, Human
uccaaguucauuagguuuuuggca

SEQ ID NO: 1146010 - RNA, 26 nt, Human
uccccugugggcagaaccuuguaggu

SEQ ID NO: 1146011 - RNA, 19 nt, Human
ucccuguuguauuguacac

SEQ ID NO: 1146012 - RNA, 21 nt, Human
ucuccuugggcagagccaagc

SEQ ID NO: 1146013 - RNA, 28 nt, Human
ucucugugagcagggcccaggcaggagc

SEQ ID NO: 1146014 - RNA, 22 nt, Human
ucugcugggauccccaucaaca

SEQ ID NO: 1146015 - RNA, 23 nt, Human
ucugucacaaggcucucugugag

SEQ ID NO: 1146016 - RNA, 22 nt, Human
ucuugaauuagaugcuuaguuc

SEQ ID NO: 1146017 - RNA, 19 nt, Human
ucuuguggguugcaguuuc

SEQ ID NO: 1146018 - RNA, 21 nt, Human
ucuuguggguugcaguuucuu

SEQ ID NO: 1146019 - RNA, 21 nt, Human
ugacaugucacgauccccccu

SEQ ID NO: 1146020 - RNA, 23 nt, Human
ugagcagggcccaggcaggagcc

SEQ ID NO: 1146021 - RNA, 18 nt, Human
ugcaguuucuucaguggu

SEQ ID NO: 1146022 - RNA, 23 nt, Human
uggcccccccaggaagggucuug

SEQ ID NO: 1146023 - RNA, 23 nt, Human
ugggaccaagacaaaagaggagu

SEQ ID NO: 1146024 - RNA, 18 nt, Human
ugggauccccaucaacac

SEQ ID NO: 1146025 - RNA, 26 nt, Human
uggguucuguuauuauaaagagaagu

SEQ ID NO: 1146026 - RNA, 19 nt, Human
uggugcucauuauaauucc

SEQ ID NO: 1146027 - RNA, 20 nt, Human
ugguucuuggucuggauuua

SEQ ID NO: 1146028 - RNA, 20 nt, Human
uguacacuucaucuucaaau

SEQ ID NO: 1146029 - RNA, 25 nt, Human
uguagaagugagguucccuuuuguu

SEQ ID NO: 1146030 - RNA, 23 nt, Human
ugucacaaagcucccucugggua

SEQ ID NO: 1146031 - RNA, 26 nt, Human
ugucacaaggcucucugugagcaggg

SEQ ID NO: 1146032 - RNA, 19 nt, Human
ugucacagcaccuucucag

SEQ ID NO: 1146033 - RNA, 21 nt, Human
ugucacagcaccuucucaggg

SEQ ID NO: 1146034 - RNA, 18 nt, Human
ugucacuauacacccuga

SEQ ID NO: 1146035 - RNA, 22 nt, Human
ugucaugaggcccccuuguggg

SEQ ID NO: 1146036 - RNA, 21 nt, Human
uguccagcaggggugggugcu

SEQ ID NO: 1146037 - RNA, 19 nt, Human
ugugagcagggcccaggcc

SEQ ID NO: 1146038 - RNA, 19 nt, Human
uguguugcuuuguuucuug

SEQ ID NO: 1146039 - RNA, 20 nt, Human
uucacuuuuucuauaaguua

SEQ ID NO: 1146040 - RNA, 20 nt, Human
uucuaauaucccucuuccug

SEQ ID NO: 1146041 - RNA, 23 nt, Human
uucuauaaguuagauguguugcu

SEQ ID NO: 1146042 - RNA, 25 nt, Human
uucuuggucuggauuuauuuucauu

SEQ ID NO: 1146043 - RNA, 23 nt, Human
uugccuaaagagaggcuaagauc

SEQ ID NO: 1146044 - RNA, 24 nt, Human
uugugggcagggcucaggaaggag

SEQ ID NO: 1146045 - RNA, 22 nt, Human
uuuuuggcagaaugcaguuccu

SEQ ID NO: 1146046 - RNA, 22 nt, Human
aaaaagauucaaacaaugccca

SEQ ID NO: 1146047 - RNA, 19 nt, Human
aaacaaugcccagugcaca

SEQ ID NO: 1146048 - RNA, 23 nt, Human
aaacaaugcccagugcacaguac

SEQ ID NO: 1146049 - RNA, 18 nt, Human
aaaugugaacgcuguacc

SEQ ID NO: 1146050 - RNA, 19 nt, Human
aacucaggauugcuggguc

SEQ ID NO: 1146051 - RNA, 19 nt, Human
aagaauggguacugggugg

SEQ ID NO: 1146052 - RNA, 19 nt, Human
acaaggaaaaaucccacuu

SEQ ID NO: 1146053 - RNA, 22 nt, Human
acaggagacagagcauccuugc

SEQ ID NO: 1146054 - RNA, 20 nt, Human
acauauucccagaaugcgcc

SEQ ID NO: 1146055 - RNA, 21 nt, Human
accccaaaaugucaagggagc

SEQ ID NO: 1146056 - RNA, 20 nt, Human
acugggguucucucaggcaa

SEQ ID NO: 1146057 - RNA, 18 nt, Human
agacacauauucccagaa

SEQ ID NO: 1146058 - RNA, 22 nt, Human
agacacauauucccagaaugcg

SEQ ID NO: 1146059 - RNA, 26 nt, Human
agagguaggcacugaucucccaaggg

SEQ ID NO: 1146060 - RNA, 22 nt, Human
agcaagggguagaggaaaagga

SEQ ID NO: 1146061 - RNA, 24 nt, Human
aggcaggcagagcacuuggcauuu

SEQ ID NO: 1146062 - RNA, 20 nt, Human
aggcaggccagagcaagggg

SEQ ID NO: 1146063 - RNA, 23 nt, Human
aggccagagcaagggguagagga

SEQ ID NO: 1146064 - RNA, 19 nt, Human
aucccacuuggcuuccugu

SEQ ID NO: 1146065 - RNA, 22 nt, Human
aucucgggguccaagugaaccc

SEQ ID NO: 1146066 - RNA, 19 nt, Human
caacauccaguccaucauc

SEQ ID NO: 1146067 - RNA, 26 nt, Human
caaccaggccuuugccuuuggaaauc

SEQ ID NO: 1146068 - RNA, 22 nt, Human
caaggccacaucaaccaggccu

SEQ ID NO: 1146069 - RNA, 22 nt, Human
caagugaaccccaaaaugucaa

SEQ ID NO: 1146070 - RNA, 24 nt, Human
cacagcuggcuuugggucugcggc

SEQ ID NO: 1146071 - RNA, 18 nt, Human
cacagggccacagggggg

SEQ ID NO: 1146072 - RNA, 22 nt, Human
caccacaacccccgcccucccu

SEQ ID NO: 1146073 - RNA, 19 nt, Human
cacugucagcuuuggccac

SEQ ID NO: 1146074 - RNA, 21 nt, Human
cagacaccccaggaacaaggg

SEQ ID NO: 1146075 - RNA, 18 nt, Human
cagcgcagccugggaacc

SEQ ID NO: 1146076 - RNA, 18 nt, Human
caucaaccaggccuuugc

SEQ ID NO: 1146077 - RNA, 24 nt, Human
ccaacauccaguccaucaucagcu

SEQ ID NO: 1146078 - RNA, 27 nt, Human
ccaaucaggcuacaaauaagguuggca

SEQ ID NO: 1146079 - RNA, 19 nt, Human
ccacaacccccgcccuccc

SEQ ID NO: 1146080 - RNA, 21 nt, Human
ccacaacccccgcccucccua

SEQ ID NO: 1146081 - RNA, 20 nt, Human
ccacugcagguggauuucug

SEQ ID NO: 1146082 - RNA, 21 nt, Human
ccccagcauggccugugaagc

SEQ ID NO: 1146083 - RNA, 22 nt, Human
cccccacccaaucaggcuacaa

SEQ ID NO: 1146084 - RNA, 24 nt, Human
cccuugcugcagacaccccaggaa

SEQ ID NO: 1146085 - RNA, 18 nt, Human
ccuauaaucaacaugaga

SEQ ID NO: 1146086 - RNA, 21 nt, Human
ccucaugauugcuuuuuugcu

SEQ ID NO: 1146087 - RNA, 22 nt, Human
ccugggcuaggaggcacagggc

SEQ ID NO: 1146088 - RNA, 18 nt, Human
ccuugcugcagacacccc

SEQ ID NO: 1146089 - RNA, 25 nt, Human
cucaccacaacccccgcccucccua

SEQ ID NO: 1146090 - RNA, 22 nt, Human
cucacggccaccggguuuuguu

SEQ ID NO: 1146091 - RNA, 21 nt, Human
cucauccuccuuucacccuca

SEQ ID NO: 1146092 - RNA, 20 nt, Human
cucccuugcugcagacaccc

SEQ ID NO: 1146093 - RNA, 24 nt, Human
cucucaccacaacccccgcccucc

SEQ ID NO: 1146094 - RNA, 19 nt, Human
cucucagaaacaccauccg

SEQ ID NO: 1146095 - RNA, 19 nt, Human
cugggcuaggaggcacagg

SEQ ID NO: 1146096 - RNA, 20 nt, Human
cugggguucuggccccagca

SEQ ID NO: 1146097 - RNA, 18 nt, Human
cugggucuucagugcuuu

SEQ ID NO: 1146098 - RNA, 18 nt, Human
cuuccuccucuucacguc

SEQ ID NO: 1146099 - RNA, 26 nt, Human
cuuccuguuccaacauccaguccauc

SEQ ID NO: 1146100 - RNA, 21 nt, Human
gaaacugggguucucucaggc

SEQ ID NO: 1146101 - RNA, 24 nt, Human
gaaugcgcccgaggcucuuaccac

SEQ ID NO: 1146102 - RNA, 25 nt, Human
gagcacuuggcauuugcugggagac

SEQ ID NO: 1146103 - RNA, 19 nt, Human
gccacgccuuacagagaca

SEQ ID NO: 1146104 - RNA, 20 nt, Human
gcuaggaggcacagggcugg

SEQ ID NO: 1146105 - RNA, 23 nt, Human
ggaagaacagagauggccuauaa

SEQ ID NO: 1146106 - RNA, 20 nt, Human
ggaaggaacugugcuaggca

SEQ ID NO: 1146107 - RNA, 22 nt, Human
gggagcuggcaccacugcaggu

SEQ ID NO: 1146108 - RNA, 24 nt, Human
gugggagcuggcaccacugcaggu

SEQ ID NO: 1146109 - RNA, 20 nt, Human
guucucuucagugaggacag

SEQ ID NO: 1146110 - RNA, 24 nt, Human
uaaaugauagaugauacuccuccc

SEQ ID NO: 1146111 - RNA, 18 nt, Human
uaccacagcuccacagcu

SEQ ID NO: 1146112 - RNA, 24 nt, Human
uagcugcacccccacccaaucagg

SEQ ID NO: 1146113 - RNA, 25 nt, Human
uagcugcacccccacccaaucaggc

SEQ ID NO: 1146114 - RNA, 18 nt, Human
uaggaggcacagggcugg

SEQ ID NO: 1146115 - RNA, 21 nt, Human
uaggaggcacagggcuggggu

SEQ ID NO: 1146116 - RNA, 25 nt, Human
uauaaucaacaugagacacagugcc

SEQ ID NO: 1146117 - RNA, 21 nt, Human
ucaaacaaugcccagugcaca

SEQ ID NO: 1146118 - RNA, 19 nt, Human
ucaccacaacccccgcccu

SEQ ID NO: 1146119 - RNA, 26 nt, Human
ucaccacaacccccgcccucccuagg

SEQ ID NO: 1146120 - RNA, 18 nt, Human
ucagacacauauucccag

SEQ ID NO: 1146121 - RNA, 21 nt, Human
ucagcucauucuugugugccu

SEQ ID NO: 1146122 - RNA, 21 nt, Human
ucaguuccuugccuguuaaau

SEQ ID NO: 1146123 - RNA, 18 nt, Human
ucccagaaugcgcccgag

SEQ ID NO: 1146124 - RNA, 23 nt, Human
ucucuagaccagagguaggcacu

SEQ ID NO: 1146125 - RNA, 24 nt, Human
ucucugucucugucucucccuggu

SEQ ID NO: 1146126 - RNA, 18 nt, Human
ucugucucugucucuccc

SEQ ID NO: 1146127 - RNA, 18 nt, Human
ucuuaccacagcuccaca

SEQ ID NO: 1146128 - RNA, 23 nt, Human
ucuucacgucucucauccuccuu

SEQ ID NO: 1146129 - RNA, 23 nt, Human
ucuuccuccucuucacgucucuc

SEQ ID NO: 1146130 - RNA, 24 nt, Human
ugaaaaagauucaaacaaugccca

SEQ ID NO: 1146131 - RNA, 19 nt, Human
ugaacucaggauugcuggg

SEQ ID NO: 1146132 - RNA, 22 nt, Human
ugaacucaggauugcugggucu

SEQ ID NO: 1146133 - RNA, 19 nt, Human
ugaacuuccugagccguuc

SEQ ID NO: 1146134 - RNA, 19 nt, Human
ugacuuccugccgaacccc

SEQ ID NO: 1146135 - RNA, 19 nt, Human
ugagaggguugggcuuggu

SEQ ID NO: 1146136 - RNA, 20 nt, Human
ugauagaugauacuccuccc

SEQ ID NO: 1146137 - RNA, 21 nt, Human
ugccgaaccccauucagcacu

SEQ ID NO: 1146138 - RNA, 21 nt, Human
ugccuggaaccgacaggagac

SEQ ID NO: 1146139 - RNA, 21 nt, Human
ugccuuuggaaaucucuagac

SEQ ID NO: 1146140 - RNA, 19 nt, Human
ugcuaggcaggccagagca

SEQ ID NO: 1146141 - RNA, 20 nt, Human
uggccugguucuggccagug

SEQ ID NO: 1146142 - RNA, 21 nt, Human
uggccugguucuggccaguga

SEQ ID NO: 1146143 - RNA, 21 nt, Human
uggcuuugggucugcggcucg

SEQ ID NO: 1146144 - RNA, 23 nt, Human
ugggcuaggaggcacagggcucc

SEQ ID NO: 1146145 - RNA, 19 nt, Human
uggggaagaacagagaugg

SEQ ID NO: 1146146 - RNA, 21 nt, Human
ugggguucuggccccagcaug

SEQ ID NO: 1146147 - RNA, 18 nt, Human
ugugcagaugaaaugaau

SEQ ID NO: 1146148 - RNA, 19 nt, Human
ugugcagaugaaaugaauu

SEQ ID NO: 1146149 - RNA, 19 nt, Human
ugugcuaggcaggccagag

SEQ ID NO: 1146150 - RNA, 21 nt, Human
ugugcuaggcaggccagagca

SEQ ID NO: 1146151 - RNA, 22 nt, Human
uucacugucagcuuuggccacu

SEQ ID NO: 1146152 - RNA, 20 nt, Human
uugaacuuccugagccguuc

SEQ ID NO: 1146153 - RNA, 18 nt, Human
uuggaaaucucuagacca

SEQ ID NO: 1146154 - RNA, 26 nt, Human
uuggcaaacuuuuuuggaggagaagc

SEQ ID NO: 1146155 - RNA, 21 nt, Human
uuuuauagcugcacccccacc

SEQ ID NO: 1146156 - RNA, 20 nt, Human
aaaaaaauacacagacauuu

SEQ ID NO: 1146157 - RNA, 24 nt, Human
aaauaauuccaucaucucaaccug

SEQ ID NO: 1146158 - RNA, 22 nt, Human
aacaacaguacaccaaaaagag

SEQ ID NO: 1146159 - RNA, 22 nt, Human
aacagguuaaaaaugaagaaga

SEQ ID NO: 1146160 - RNA, 27 nt, Human
aacaguacacaaucccugucaacaacu

SEQ ID NO: 1146161 - RNA, 19 nt, Human
aauacauuauuuuaucuuu

SEQ ID NO: 1146162 - RNA, 23 nt, Human
acucuugccccugauaucacaaa

SEQ ID NO: 1146163 - RNA, 24 nt, Human
agaauacacccaguuggauaccag

SEQ ID NO: 1146164 - RNA, 19 nt, Human
agacaagagauacagaucu

SEQ ID NO: 1146165 - RNA, 21 nt, Human
agacaagagauacagaucuag

SEQ ID NO: 1146166 - RNA, 24 nt, Human
agagcaggaaggguaguaguggua

SEQ ID NO: 1146167 - RNA, 25 nt, Human
agccggcaggcagugcuucugaaca

SEQ ID NO: 1146168 - RNA, 24 nt, Human
auaucacaaacauuccagucuugu

SEQ ID NO: 1146169 - RNA, 21 nt, Human
auccuuguggcuuucuuucuc

SEQ ID NO: 1146170 - RNA, 18 nt, Human
caacaacaguacaccaaa

SEQ ID NO: 1146171 - RNA, 20 nt, Human
caacaguacaccaaaaagaa

SEQ ID NO: 1146172 - RNA, 22 nt, Human
caacaguacaccaaaaagagaa

SEQ ID NO: 1146173 - RNA, 20 nt, Human
caagaaaucaaauaucugag

SEQ ID NO: 1146174 - RNA, 19 nt, Human
caagagcaggaaggguagu

SEQ ID NO: 1146175 - RNA, 22 nt, Human
caagaggugcaaaaaugugcaa

SEQ ID NO: 1146176 - RNA, 23 nt, Human
caccaaaaagagaacuuugugau

SEQ ID NO: 1146177 - RNA, 21 nt, Human
caggaaggguaguaguguggc

SEQ ID NO: 1146178 - RNA, 21 nt, Human
caucugaggaagauccuaguu

SEQ ID NO: 1146179 - RNA, 21 nt, Human
ccugauaucacaaacauucca

SEQ ID NO: 1146180 - RNA, 23 nt, Human
cggcuuagaaaggggggcauggg

SEQ ID NO: 1146181 - RNA, 22 nt, Human
cguccuguaauugccgcuuagc

SEQ ID NO: 1146182 - RNA, 19 nt, Human
cuaacauuuacacagcaac

SEQ ID NO: 1146183 - RNA, 22 nt, Human
cucaacuuccuacuggccucaa

SEQ ID NO: 1146184 - RNA, 22 nt, Human
cuugccccugauaucacaaaca

SEQ ID NO: 1146185 - RNA, 20 nt, Human
gaaaggggggcaugggagca

SEQ ID NO: 1146186 - RNA, 22 nt, Human
gauaguauccacaaguaagcac

SEQ ID NO: 1146187 - RNA, 20 nt, Human
ggcaugggagcaugaccugc

SEQ ID NO: 1146188 - RNA, 18 nt, Human
gggcaugggagcaugacc

SEQ ID NO: 1146189 - RNA, 22 nt, Human
ggggcaugggagcaugaccugc

SEQ ID NO: 1146190 - RNA, 19 nt, Human
ggugaaugggggguacugc

SEQ ID NO: 1146191 - RNA, 18 nt, Human
gugaaugggggguacugc

SEQ ID NO: 1146192 - RNA, 20 nt, Human
uaacucuugccccugauauc

SEQ ID NO: 1146193 - RNA, 21 nt, Human
uacagagaaaauucaaagcua

SEQ ID NO: 1146194 - RNA, 22 nt, Human
uacagcaguacuugggucgaaa

SEQ ID NO: 1146195 - RNA, 25 nt, Human
uacagguugcagauauagaugcucu

SEQ ID NO: 1146196 - RNA, 24 nt, Human
uagaauacacccaguuggauacca

SEQ ID NO: 1146197 - RNA, 21 nt, Human
uaggaagcucuuuuucuguuu

SEQ ID NO: 1146198 - RNA, 26 nt, Human
uccacacuagaauacacccaguugga

SEQ ID NO: 1146199 - RNA, 20 nt, Human
uccauauuguuuuaagccag

SEQ ID NO: 1146200 - RNA, 24 nt, Human
ucucuuacagagaaaauucaaagc

SEQ ID NO: 1146201 - RNA, 23 nt, Human
ugagauacacaaauugaacgcgg

SEQ ID NO: 1146202 - RNA, 19 nt, Human
ugauaucacaaacauucca

SEQ ID NO: 1146203 - RNA, 21 nt, Human
ugcauuuugugggugaauggg

SEQ ID NO: 1146204 - RNA, 24 nt, Human
uggaaaaauagagaaugguuuucu

SEQ ID NO: 1146205 - RNA, 20 nt, Human
ugggagcaugaccugcaaua

SEQ ID NO: 1146206 - RNA, 24 nt, Human
uggugcuaggaaacagccggcagg

SEQ ID NO: 1146207 - RNA, 22 nt, Human
uguagcaucauuacaaaugaaa

SEQ ID NO: 1146208 - RNA, 18 nt, Human
ugugaaauaaagaaaaua

SEQ ID NO: 1146209 - RNA, 21 nt, Human
uuaagccagaucauacccaug

SEQ ID NO: 1146210 - RNA, 23 nt, Human
uugcugaauccuuguggcuuucu

SEQ ID NO: 1146211 - RNA, 21 nt, Human
agcucggcccggcgcggcccc

SEQ ID NO: 1146212 - RNA, 18 nt, Human
aggcgguggcgguggcgg

SEQ ID NO: 1146213 - RNA, 24 nt, Human
agguggcgcgggcgacagcucggc

SEQ ID NO: 1146214 - RNA, 20 nt, Human
auauguguguaugugugugu

SEQ ID NO: 1146215 - RNA, 21 nt, Human
auauguguguaugugugugug

SEQ ID NO: 1146216 - RNA, 20 nt, Human
augugugugugccagugugu

SEQ ID NO: 1146217 - RNA, 22 nt, Human
cacauuguggggauacaggaag

SEQ ID NO: 1146218 - RNA, 22 nt, Human
cagguuagcccauaaacaucaa

SEQ ID NO: 1146219 - RNA, 19 nt, Human
cauauguguguaugugugu

SEQ ID NO: 1146220 - RNA, 19 nt, Human
cauuguggggauacaggaa

SEQ ID NO: 1146221 - RNA, 21 nt, Human
ccagguuagcccauaaacauc

SEQ ID NO: 1146222 - RNA, 26 nt, Human
ccauauacaaauugugcauaugugug

SEQ ID NO: 1146223 - RNA, 20 nt, Human
cccaggcgguggcgguggcg

SEQ ID NO: 1146224 - RNA, 23 nt, Human
cgcgcgggccgcgggcgcguggg

SEQ ID NO: 1146225 - RNA, 19 nt, Human
cuccggugguugcugcggu

SEQ ID NO: 1146226 - RNA, 19 nt, Human
cuucgcgcagacguucucc

SEQ ID NO: 1146227 - RNA, 21 nt, Human
gacagcucggcccggcgcggc

SEQ ID NO: 1146228 - RNA, 19 nt, Human
gcagcggcggcgguggagg

SEQ ID NO: 1146229 - RNA, 21 nt, Human
gcagcggcggcgguggaggug

SEQ ID NO: 1146230 - RNA, 20 nt, Human
gccgcgggcgcguggggcag

SEQ ID NO: 1146231 - RNA, 20 nt, Human
gcggcggcgguggagguggc

SEQ ID NO: 1146232 - RNA, 21 nt, Human
gcggcggcgguggagguggcg

SEQ ID NO: 1146233 - RNA, 20 nt, Human
gcgguggcgguggcgguagc

SEQ ID NO: 1146234 - RNA, 22 nt, Human
gcuccuccagccgggaagcugu

SEQ ID NO: 1146235 - RNA, 21 nt, Human
ggaagcuguugcucacgcucc

SEQ ID NO: 1146236 - RNA, 21 nt, Human
ggaagcuguugcucacgcucc

SEQ ID NO: 1146237 - RNA, 20 nt, Human
ggcgcgggcgacagcucggc

SEQ ID NO: 1146238 - RNA, 20 nt, Human
guggcgguagcagcggcggc

SEQ ID NO: 1146239 - RNA, 20 nt, Human
guggcgguggcgguagcagc

SEQ ID NO: 1146240 - RNA, 19 nt, Human
uagcagcggcggcggugga

SEQ ID NO: 1146241 - RNA, 21 nt, Human
uaugugugugugccagugugu

SEQ ID NO: 1146242 - RNA, 18 nt, Human
ucucccgcgaucugcugc

SEQ ID NO: 1146243 - RNA, 18 nt, Human
uggcgguagcagcggcgg

SEQ ID NO: 1146244 - RNA, 26 nt, Human
uggcgguagcagcggcggcgguggag

SEQ ID NO: 1146245 - RNA, 24 nt, Human
uguaugugugugugccagugugua

SEQ ID NO: 1146246 - RNA, 19 nt, Human
ugugcauauguguguaugu

SEQ ID NO: 1146247 - RNA, 25 nt, Human
ugugcauauguguguaugugugugu

SEQ ID NO: 1146248 - RNA, 18 nt, Human
uguguguaugugugugug

SEQ ID NO: 1146249 - RNA, 19 nt, Human
ugugugugugccagugugu

SEQ ID NO: 1146250 - RNA, 18 nt, Human
uugugcauauguguguau

SEQ ID NO: 1146251 - RNA, 21 nt, Human
uugugcauauguguguaugug

SEQ ID NO: 1146252 - RNA, 19 nt, Human
aacagagagagccaugacc

SEQ ID NO: 1146253 - RNA, 22 nt, Human
aaccugccucccaguuccucca

SEQ ID NO: 1146254 - RNA, 24 nt, Human
acaagcuccuggccugaaacugua

SEQ ID NO: 1146255 - RNA, 20 nt, Human
accaaaccagagggagagac

SEQ ID NO: 1146256 - RNA, 21 nt, Human
acugcagccuccaaaccugcc

SEQ ID NO: 1146257 - RNA, 18 nt, Human
agagggagagacaccugc

SEQ ID NO: 1146258 - RNA, 18 nt, Human
agaguccugcccccuccu

SEQ ID NO: 1146259 - RNA, 22 nt, Human
agccaugaccaaaccagaggga

SEQ ID NO: 1146260 - RNA, 19 nt, Human
agcuugggggaagaggaag

SEQ ID NO: 1146261 - RNA, 18 nt, Human
aggaaguuaagaugggcu

SEQ ID NO: 1146262 - RNA, 22 nt, Human
aggcacugggcuccugaaaaca

SEQ ID NO: 1146263 - RNA, 28 nt, Human
aggugccaacaagcuccuggccugaaac

SEQ ID NO: 1146264 - RNA, 24 nt, Human
agguuugggaguuugcaccaggug

SEQ ID NO: 1146265 - RNA, 20 nt, Human
cacaggagaaauaguuacag

SEQ ID NO: 1146266 - RNA, 19 nt, Human
cacugaagugcucgcagcc

SEQ ID NO: 1146267 - RNA, 25 nt, Human
cacugggcucuuucccuuugugggu

SEQ ID NO: 1146268 - RNA, 23 nt, Human
cacuucucaccguacaggacacu

SEQ ID NO: 1146269 - RNA, 19 nt, Human
cacuuugcaugggcagggc

SEQ ID NO: 1146270 - RNA, 22 nt, Human
cacuuugcaugggcagggcugu

SEQ ID NO: 1146271 - RNA, 19 nt, Human
cagcaaaagcugacugaua

SEQ ID NO: 1146272 - RNA, 20 nt, Human
cagcacugccugcccaugcc

SEQ ID NO: 1146273 - RNA, 21 nt, Human
cagccucacagaucgaacgac

SEQ ID NO: 1146274 - RNA, 22 nt, Human
cagcuguagcucccucaggcau

SEQ ID NO: 1146275 - RNA, 19 nt, Human
ccacugcagccuccaaacc

SEQ ID NO: 1146276 - RNA, 23 nt, Human
ccaguggucccacugcagccucc

SEQ ID NO: 1146277 - RNA, 19 nt, Human
ccccacugccuggcaccau

SEQ ID NO: 1146278 - RNA, 21 nt, Human
cccccuccuccucgagacaaa

SEQ ID NO: 1146279 - RNA, 23 nt, Human
ccccuaaaucuuacugaaaugaa

SEQ ID NO: 1146280 - RNA, 23 nt, Human
cccuccuccucgagacaaaggag

SEQ ID NO: 1146281 - RNA, 21 nt, Human
cccugcauuuugcaaaagcug

SEQ ID NO: 1146282 - RNA, 23 nt, Human
ccuccagcacugccugcccaugc

SEQ ID NO: 1146283 - RNA, 20 nt, Human
ccuggcaccaugcuuggcuc

SEQ ID NO: 1146284 - RNA, 22 nt, Human
cgacuuccuacaaccugucacu

SEQ ID NO: 1146285 - RNA, 21 nt, Human
cuagagcuggcuuuuguugac

SEQ ID NO: 1146286 - RNA, 25 nt, Human
cuccagcacugccugcccaugcacc

SEQ ID NO: 1146287 - RNA, 27 nt, Human
cuccagcacugccugcccaugcacccc

SEQ ID NO: 1146288 - RNA, 20 nt, Human
cuccugaaaacaaagaugag

SEQ ID NO: 1146289 - RNA, 21 nt, Human
cucuccacugcauccccacug

SEQ ID NO: 1146290 - RNA, 25 nt, Human
cugaaacuguagccaggaggggcca

SEQ ID NO: 1146291 - RNA, 24 nt, Human
cugcagccuccaaaccugccuccc

SEQ ID NO: 1146292 - RNA, 22 nt, Human
cugcccaugcaccccuaaaucu

SEQ ID NO: 1146293 - RNA, 21 nt, Human
cugccuggcaccaugcuuggc

SEQ ID NO: 1146294 - RNA, 20 nt, Human
gacuuccuacaaccugucac

SEQ ID NO: 1146295 - RNA, 23 nt, Human
gagccaugaccaaaccagaggga

SEQ ID NO: 1146296 - RNA, 22 nt, Human
gagcucaaucccagccaacuaa

SEQ ID NO: 1146297 - RNA, 22 nt, Human
gcagccuccaaaccugccuccc

SEQ ID NO: 1146298 - RNA, 18 nt, Human
gcggauggccuaccuggu

SEQ ID NO: 1146299 - RNA, 18 nt, Human
gcuccugaaaacaaagau

SEQ ID NO: 1146300 - RNA, 25 nt, Human
ggaagaugggggugcaucagauagc

SEQ ID NO: 1146301 - RNA, 21 nt, Human
ggaguuugcaccaggugccaa

SEQ ID NO: 1146302 - RNA, 19 nt, Human
ggcagggcuguuugcucuc

SEQ ID NO: 1146303 - RNA, 22 nt, Human
ggccaguggucccacugcagcc

SEQ ID NO: 1146304 - RNA, 18 nt, Human
gggcuccugaaaacaaag

SEQ ID NO: 1146305 - RNA, 22 nt, Human
ggguggaggggaggcacugggc

SEQ ID NO: 1146306 - RNA, 23 nt, Human
gguggaggggaggcacugggcuc

SEQ ID NO: 1146307 - RNA, 21 nt, Human
uaaaucccaggcacugaaggg

SEQ ID NO: 1146308 - RNA, 22 nt, Human
uacagaaucugacacaugcuga

SEQ ID NO: 1146309 - RNA, 19 nt, Human
uagaacagagagagccaug

SEQ ID NO: 1146310 - RNA, 19 nt, Human
uagggguggaggggaggca

SEQ ID NO: 1146311 - RNA, 24 nt, Human
uauccuggguugcgggcuggaaga

SEQ ID NO: 1146312 - RNA, 24 nt, Human
ucccucagacagcgagcucaaucc

SEQ ID NO: 1146313 - RNA, 22 nt, Human
uccugcccccuccuccucgaga

SEQ ID NO: 1146314 - RNA, 23 nt, Human
ucuccacugcauccccacugccu

SEQ ID NO: 1146315 - RNA, 23 nt, Human
ucuggcagaguccugcccccucc

SEQ ID NO: 1146316 - RNA, 21 nt, Human
ugaggcuagcagcauccuucc

SEQ ID NO: 1146317 - RNA, 18 nt, Human
ugaggugcgcgcauggga

SEQ ID NO: 1146318 - RNA, 26 nt, Human
ugcaucagauagccaaggaaaguggu

SEQ ID NO: 1146319 - RNA, 24 nt, Human
uggcuuuccaacaccagauagcuu

SEQ ID NO: 1146320 - RNA, 27 nt, Human
ugggaagaugggggugcaucagauagc

SEQ ID NO: 1146321 - RNA, 21 nt, Human
uuagguaaaucccaggcacug

SEQ ID NO: 1146322 - RNA, 23 nt, Human
uugcagcaaaagcugacugauac

SEQ ID NO: 1146323 - RNA, 22 nt, Human
uugcucuccacugcauccccac

SEQ ID NO: 1146324 - RNA, 21 nt, Human
uugggggaagaggaaguuaag

SEQ ID NO: 1146325 - RNA, 26 nt, Human
uuguggggaccccucagguuugggag

SEQ ID NO: 1146326 - RNA, 26 nt, Human
aaagauauauacauccucuacauuuc

SEQ ID NO: 1146327 - RNA, 18 nt, Human
aagggacugaccuacugg

SEQ ID NO: 1146328 - RNA, 19 nt, Human
auccagaaacuuuaauugc

SEQ ID NO: 1146329 - RNA, 22 nt, Human
caaggggccacaguggcccacg

SEQ ID NO: 1146330 - RNA, 18 nt, Human
gcaaggggccacaguggc

SEQ ID NO: 1146331 - RNA, 27 nt, Human
ggaaagcaaauggaagggacugaccua

SEQ ID NO: 1146332 - RNA, 23 nt, Human
ucuacauuucauuuuuuuaucca

SEQ ID NO: 1146333 - RNA, 23 nt, Human
uggaagggacugaccuacuggug

SEQ ID NO: 1146334 - RNA, 20 nt, Human
uggacgcaaggggccacagu

SEQ ID NO: 1146335 - RNA, 19 nt, Human
agcgggagggaggccgccu

SEQ ID NO: 1146336 - RNA, 27 nt, Human
agcugugagccuccgccugcugagagg

SEQ ID NO: 1146337 - RNA, 24 nt, Human
aggccagagcucaaucugcaggga

SEQ ID NO: 1146338 - RNA, 23 nt, Human
ccacaaugcggucagcccucccu

SEQ ID NO: 1146339 - RNA, 24 nt, Human
ccacaaugcggucagcccucccua

SEQ ID NO: 1146340 - RNA, 18 nt, Human
gaccugaaguuaagaggc

SEQ ID NO: 1146341 - RNA, 25 nt, Human
gagaaaagagacuuuuaauuuaaag

SEQ ID NO: 1146342 - RNA, 25 nt, Human
gagacuuuuaauuuaaaguaaugau

SEQ ID NO: 1146343 - RNA, 23 nt, Human
ggugaaggccagagcucaaucug

SEQ ID NO: 1146344 - RNA, 21 nt, Human
gucacuuugcaccacaaugcg

SEQ ID NO: 1146345 - RNA, 21 nt, Human
uagagggucucuggggaaagg

SEQ ID NO: 1146346 - RNA, 21 nt, Human
uccccaagucaacacucgacu

SEQ ID NO: 1146347 - RNA, 22 nt, Human
uccccaagucaacacucgacuu

SEQ ID NO: 1146348 - RNA, 26 nt, Human
ucccgacagagcugugagccuccgcc

SEQ ID NO: 1146349 - RNA, 21 nt, Human
uccgccugcugagaggagggc

SEQ ID NO: 1146350 - RNA, 23 nt, Human
ucgacuugucacuuugcaccaca

SEQ ID NO: 1146351 - RNA, 20 nt, Human
aaaagcaucuccauuuauac

SEQ ID NO: 1146352 - RNA, 30 nt, Human
aaaaggcacaucaaggaaacaaauaucacc

SEQ ID NO: 1146353 - RNA, 22 nt, Human
aaacaaaaaugaaaagcaucuc

SEQ ID NO: 1146354 - RNA, 21 nt, Human
aaacacacaaaaaagcaaacu

SEQ ID NO: 1146355 - RNA, 19 nt, Human
aaagaaaaacgaaaaggca

SEQ ID NO: 1146356 - RNA, 22 nt, Human
aacaagaaucacaggaacucac

SEQ ID NO: 1146357 - RNA, 24 nt, Human
aagcaaacuguaaugagcagugac

SEQ ID NO: 1146358 - RNA, 23 nt, Human
aagccaauauggaaauuaaaaua

SEQ ID NO: 1146359 - RNA, 19 nt, Human
aagcgaacaagaaucacag

SEQ ID NO: 1146360 - RNA, 21 nt, Human
aagcgaacaagaaucacagga

SEQ ID NO: 1146361 - RNA, 28 nt, Human
aauccucucccccaaaacaaaaagcaaa

SEQ ID NO: 1146362 - RNA, 21 nt, Human
acaaacccaguccaaacaaaa

SEQ ID NO: 1146363 - RNA, 23 nt, Human
acacaccuaccuacagacauaca

SEQ ID NO: 1146364 - RNA, 18 nt, Human
acagagccugucguuaac

SEQ ID NO: 1146365 - RNA, 22 nt, Human
acagcaaacacacaaaaaagca

SEQ ID NO: 1146366 - RNA, 24 nt, Human
acaugcauacacgcuauggccugg

SEQ ID NO: 1146367 - RNA, 19 nt, Human
acccuaagugcuaagaaag

SEQ ID NO: 1146368 - RNA, 22 nt, Human
acgaaacucccagcuuccuaaa

SEQ ID NO: 1146369 - RNA, 22 nt, Human
acuaugugccaagcacugugcu

SEQ ID NO: 1146370 - RNA, 19 nt, Human
acucacccucagcuucacg

SEQ ID NO: 1146371 - RNA, 23 nt, Human
aggaaacaaauaucacuaaagaa

SEQ ID NO: 1146372 - RNA, 21 nt, Human
aggcuaaauccucucccccaa

SEQ ID NO: 1146373 - RNA, 21 nt, Human
auaaaacuuugaauccaucag

SEQ ID NO: 1146374 - RNA, 23 nt, Human
aucaagaauuuuuggccagaggu

SEQ ID NO: 1146375 - RNA, 21 nt, Human
auccucucccccaaaacaaaa

SEQ ID NO: 1146376 - RNA, 24 nt, Human
augaaaagcaucuccauuuauaca

SEQ ID NO: 1146377 - RNA, 23 nt, Human
auguccauccgucuacucacaug

SEQ ID NO: 1146378 - RNA, 23 nt, Human
caaaaaccccaaagaaaaacgaa

SEQ ID NO: 1146379 - RNA, 25 nt, Human
caaacaaaaaugaaaagcaucucca

SEQ ID NO: 1146380 - RNA, 20 nt, Human
caaacacacaaaaaagcaaa

SEQ ID NO: 1146381 - RNA, 18 nt, Human
caaacccaguccaaacaa

SEQ ID NO: 1146382 - RNA, 26 nt, Human
caaagaaaaacgaaaaggcacaucaa

SEQ ID NO: 1146383 - RNA, 21 nt, Human
caacagcauccggauuccaaa

SEQ ID NO: 1146384 - RNA, 27 nt, Human
caaccagcagucccaagguagacccaa

SEQ ID NO: 1146385 - RNA, 21 nt, Human
caagacucuacagcuaauuug

SEQ ID NO: 1146386 - RNA, 23 nt, Human
caagcuagguaaaccaccuugga

SEQ ID NO: 1146387 - RNA, 21 nt, Human
caaggcuucacacccuccucu

SEQ ID NO: 1146388 - RNA, 23 nt, Human
caauauggaaauuaaaauacuuu

SEQ ID NO: 1146389 - RNA, 19 nt, Human
cacaaaaucugggcuacag

SEQ ID NO: 1146390 - RNA, 22 nt, Human
cacaaacccaguccaaacaaaa

SEQ ID NO: 1146391 - RNA, 18 nt, Human
cacacccuccucuguggg

SEQ ID NO: 1146392 - RNA, 21 nt, Human
cacagcaaacacacaaaaaag

SEQ ID NO: 1146393 - RNA, 23 nt, Human
cacagcaaacacacaaaaaagca

SEQ ID NO: 1146394 - RNA, 21 nt, Human
cacugaauccucacaaaaccc

SEQ ID NO: 1146395 - RNA, 19 nt, Human
cacugggcuccacucccaa

SEQ ID NO: 1146396 - RNA, 25 nt, Human
cagaauccugcauuacuuaaccccc

SEQ ID NO: 1146397 - RNA, 24 nt, Human
cagcagucccaagguagacccaaa

SEQ ID NO: 1146398 - RNA, 22 nt, Human
cagcauccggauuccaaaaacc

SEQ ID NO: 1146399 - RNA, 24 nt, Human
cagcauccggauuccaaaaacccc

SEQ ID NO: 1146400 - RNA, 18 nt, Human
cagccacaccucagcaag

SEQ ID NO: 1146401 - RNA, 21 nt, Human
cagccucuaggagcuguucug

SEQ ID NO: 1146402 - RNA, 21 nt, Human
cagcuggcagggugggguugg

SEQ ID NO: 1146403 - RNA, 22 nt, Human
cagcuucacgaaacucccagcu

SEQ ID NO: 1146404 - RNA, 19 nt, Human
cagggcaggagauaaggag

SEQ ID NO: 1146405 - RNA, 22 nt, Human
caguauguggcuagccaaaggu

SEQ ID NO: 1146406 - RNA, 23 nt, Human
cagucccaagguagacccaaagg

SEQ ID NO: 1146407 - RNA, 24 nt, Human
ccaaaaaccccaaagaaaaacgaa

SEQ ID NO: 1146408 - RNA, 21 nt, Human
ccaaaacaaaaagcaaaccga

SEQ ID NO: 1146409 - RNA, 25 nt, Human
ccacaccucagcaaguggugggaac

SEQ ID NO: 1146410 - RNA, 20 nt, Human
ccaccuuggagaaauggggu

SEQ ID NO: 1146411 - RNA, 21 nt, Human
ccagccguggggucagggugg

SEQ ID NO: 1146412 - RNA, 19 nt, Human
cccaagguagacccaaagg

SEQ ID NO: 1146413 - RNA, 28 nt, Human
ccccaaagaaaaacgaaaaggcacagug

SEQ ID NO: 1146414 - RNA, 21 nt, Human
ccccauugcccccagcuggca

SEQ ID NO: 1146415 - RNA, 20 nt, Human
cccccaaaacaaaaagcaaa

SEQ ID NO: 1146416 - RNA, 22 nt, Human
cccccaaaacaaaaagcaaacc

SEQ ID NO: 1146417 - RNA, 20 nt, Human
cccuaagugcuaagaaagcu

SEQ ID NO: 1146418 - RNA, 24 nt, Human
cccuaagugcuaagaaagcuaggg

SEQ ID NO: 1146419 - RNA, 24 nt, Human
ccuacagacauacaguuucagucc

SEQ ID NO: 1146420 - RNA, 24 nt, Human
ccucacaaaacccuaagugcuaag

SEQ ID NO: 1146421 - RNA, 20 nt, Human
ccuuggagaaaugggguggc

SEQ ID NO: 1146422 - RNA, 23 nt, Human
ccuuguuuccuugggggcugaag

SEQ ID NO: 1146423 - RNA, 22 nt, Human
cgaaaaggcacaucaaggaaac

SEQ ID NO: 1146424 - RNA, 23 nt, Human
cggauuccaaaaaccccaaagaa

SEQ ID NO: 1146425 - RNA, 23 nt, Human
cggcgacaccuuguuugcagaau

SEQ ID NO: 1146426 - RNA, 19 nt, Human
cuaaaaggcacacaccuac

SEQ ID NO: 1146427 - RNA, 23 nt, Human
cuaggagcuguucugagaggcca

SEQ ID NO: 1146428 - RNA, 23 nt, Human
cuccagccguggggucagggugg

SEQ ID NO: 1146429 - RNA, 18 nt, Human
gagaggccaaaaucccug

SEQ ID NO: 1146430 - RNA, 25 nt, Human
gcacagcaaacacacaaaaaagcaa

SEQ ID NO: 1146431 - RNA, 23 nt, Human
gccacaccucagcaagugcgugg

SEQ ID NO: 1146432 - RNA, 23 nt, Human
gcccccagcuggcaggguggggu

SEQ ID NO: 1146433 - RNA, 24 nt, Human
gcggaacagaauccaaaggaauuu

SEQ ID NO: 1146434 - RNA, 23 nt, Human
gcuaaauccucucccccaaaaca

SEQ ID NO: 1146435 - RNA, 23 nt, Human
gcuccacaaaaucugggcuacag

SEQ ID NO: 1146436 - RNA, 21 nt, Human
gcugcacugggcuccacuccc

SEQ ID NO: 1146437 - RNA, 20 nt, Human
ggagcgucugguguccagcu

SEQ ID NO: 1146438 - RNA, 22 nt, Human
ggccgagaacugggcuacucua

SEQ ID NO: 1146439 - RNA, 19 nt, Human
gggaauguguaaguucaau

SEQ ID NO: 1146440 - RNA, 23 nt, Human
ggguggcagggaacacaggcugg

SEQ ID NO: 1146441 - RNA, 21 nt, Human
gugccaagacagggcaggaga

SEQ ID NO: 1146442 - RNA, 23 nt, Human
uaaaaggcacacaccuaccuaca

SEQ ID NO: 1146443 - RNA, 18 nt, Human
uaaaguauuucuucucca

SEQ ID NO: 1146444 - RNA, 27 nt, Human
uaaauccucucccccaaaacaaaaagc

SEQ ID NO: 1146445 - RNA, 24 nt, Human
uaacccccgaagugaaucacacaa

SEQ ID NO: 1146446 - RNA, 18 nt, Human
uacagagaugcuuugcag

SEQ ID NO: 1146447 - RNA, 19 nt, Human
uacaguuucaguccaacac

SEQ ID NO: 1146448 - RNA, 19 nt, Human
uacauuuggacggcgacac

SEQ ID NO: 1146449 - RNA, 24 nt, Human
uacuaugugccaagcacugugcua

SEQ ID NO: 1146450 - RNA, 22 nt, Human
uagacccaaagguauggcagaa

SEQ ID NO: 1146451 - RNA, 22 nt, Human
uauaaaaacuuggucucccacu

SEQ ID NO: 1146452 - RNA, 23 nt, Human
uauggaaauuaaaauacuuuuaa

SEQ ID NO: 1146453 - RNA, 19 nt, Human
uauugcccuucaacagcau

SEQ ID NO: 1146454 - RNA, 22 nt, Human
ucacaggaacucacccucagcu

SEQ ID NO: 1146455 - RNA, 23 nt, Human
ucacuaaagaaacugacuaauau

SEQ ID NO: 1146456 - RNA, 24 nt, Human
ucagcucuauuucucaaguuuuac

SEQ ID NO: 1146457 - RNA, 22 nt, Human
ucagggaaguaagaggcuaaau

SEQ ID NO: 1146458 - RNA, 22 nt, Human
ucauacugaugucaacccuguc

SEQ ID NO: 1146459 - RNA, 20 nt, Human
uccaaaaaccccaaagaaaa

SEQ ID NO: 1146460 - RNA, 23 nt, Human
uccaaaaaccccaaagaaaaacg

SEQ ID NO: 1146461 - RNA, 27 nt, Human
uccaaaaaccccaaagaaaaacgaaaa

SEQ ID NO: 1146462 - RNA, 25 nt, Human
uccaaaggaauuugacgaagucacc

SEQ ID NO: 1146463 - RNA, 20 nt, Human
uccacaaaaucugggcuaca

SEQ ID NO: 1146464 - RNA, 24 nt, Human
uccacaaaaucugggcuacagaga

SEQ ID NO: 1146465 - RNA, 18 nt, Human
uccacaccugcaaucuau

SEQ ID NO: 1146466 - RNA, 19 nt, Human
uccacagggauggauggga

SEQ ID NO: 1146467 - RNA, 25 nt, Human
ucccccaaaacaaaaagcaaaccga

SEQ ID NO: 1146468 - RNA, 20 nt, Human
ucccugaggacaggaggggc

SEQ ID NO: 1146469 - RNA, 22 nt, Human
uccuuggaugcacccauucaca

SEQ ID NO: 1146470 - RNA, 23 nt, Human
ucucaaggcuucacacccuccuc

SEQ ID NO: 1146471 - RNA, 19 nt, Human
ucuccaaacgcacagcaaa

SEQ ID NO: 1146472 - RNA, 19 nt, Human
ucuccaagcagggcccuga

SEQ ID NO: 1146473 - RNA, 18 nt, Human
ucugaaagacgucagugg

SEQ ID NO: 1146474 - RNA, 22 nt, Human
ucugcuauugcccuucaacagc

SEQ ID NO: 1146475 - RNA, 23 nt, Human
ucuguggguggaagugcacaugc

SEQ ID NO: 1146476 - RNA, 25 nt, Human
ugaagcgaacaagaaucacaggaac

SEQ ID NO: 1146477 - RNA, 23 nt, Human
ugaaucacacaaaauggcuguaa

SEQ ID NO: 1146478 - RNA, 18 nt, Human
ugaauccucacaaaaccc

SEQ ID NO: 1146479 - RNA, 19 nt, Human
ugacacguuggcaaccagc

SEQ ID NO: 1146480 - RNA, 22 nt, Human
ugacuaauaucuccaaacgcac

SEQ ID NO: 1146481 - RNA, 19 nt, Human
ugaggacaggaggggccac

SEQ ID NO: 1146482 - RNA, 25 nt, Human
ugagggagugucuuaaggcuccaca

SEQ ID NO: 1146483 - RNA, 21 nt, Human
ugaugucaacccugucaguga

SEQ ID NO: 1146484 - RNA, 20 nt, Human
ugauucugccucagccacac

SEQ ID NO: 1146485 - RNA, 19 nt, Human
ugcacguucuuucccuuuc

SEQ ID NO: 1146486 - RNA, 19 nt, Human
ugcccccagcuggcagggu

SEQ ID NO: 1146487 - RNA, 19 nt, Human
ugccucagccacaccucag

SEQ ID NO: 1146488 - RNA, 21 nt, Human
ugcuaaaguauuucuucucca

SEQ ID NO: 1146489 - RNA, 20 nt, Human
ugcuauugcccuucaacagc

SEQ ID NO: 1146490 - RNA, 20 nt, Human
uggaaaacaaagcagugcuc

SEQ ID NO: 1146491 - RNA, 19 nt, Human
uggaaacaugcagaacuaa

SEQ ID NO: 1146492 - RNA, 27 nt, Human
uggcagggugggguugguuuucucccc

SEQ ID NO: 1146493 - RNA, 19 nt, Human
uggcauugagggagugucu

SEQ ID NO: 1146494 - RNA, 27 nt, Human
uggccagaggugaggguggucgacacg

SEQ ID NO: 1146495 - RNA, 24 nt, Human
ugggguugguuuucuccaggaggc

SEQ ID NO: 1146496 - RNA, 24 nt, Human
uguaaugagcagugacacaaaccc

SEQ ID NO: 1146497 - RNA, 20 nt, Human
uucacuuuuauuaaaucuug

SEQ ID NO: 1146498 - RNA, 23 nt, Human
uuccaaaaaccccaaagaaaaac

SEQ ID NO: 1146499 - RNA, 20 nt, Human
uuccuugaggaaaacccuug

SEQ ID NO: 1146500 - RNA, 22 nt, Human
uuccuugggggcugaagucugg

SEQ ID NO: 1146501 - RNA, 24 nt, Human
uucuugcagccuuguuuccuuggg

SEQ ID NO: 1146502 - RNA, 21 nt, Human
uuggagaaaugggguggccac

SEQ ID NO: 1146503 - RNA, 21 nt, Human
uuuggccagaggugagggugg

SEQ ID NO: 1146504 - RNA, 20 nt, Human
aaaagggucuucugaugaug

SEQ ID NO: 1146505 - RNA, 22 nt, Human
aacugggcagcccccgaucccu

SEQ ID NO: 1146506 - RNA, 22 nt, Human
acagcaccggggagggccacac

SEQ ID NO: 1146507 - RNA, 23 nt, Human
acugggcagcagaggggacagag

SEQ ID NO: 1146508 - RNA, 22 nt, Human
agauagccuagucccagacccc

SEQ ID NO: 1146509 - RNA, 23 nt, Human
agcagcaguggugagggcaggcc

SEQ ID NO: 1146510 - RNA, 19 nt, Human
agcagcuucggugucuggu

SEQ ID NO: 1146511 - RNA, 24 nt, Human
agcaguggugagggcaggccuggg

SEQ ID NO: 1146512 - RNA, 22 nt, Human
aggagcugggaggcgugggggg

SEQ ID NO: 1146513 - RNA, 19 nt, Human
aggcacucgacuccacugg

SEQ ID NO: 1146514 - RNA, 18 nt, Human
agggaggagggagucugg

SEQ ID NO: 1146515 - RNA, 18 nt, Human
aggggacagagcuucuag

SEQ ID NO: 1146516 - RNA, 22 nt, Human
agucccagaccccagaccagaa

SEQ ID NO: 1146517 - RNA, 21 nt, Human
aucccuggcacuucugggcau

SEQ ID NO: 1146518 - RNA, 21 nt, Human
auggacaaaagggucuucuga

SEQ ID NO: 1146519 - RNA, 21 nt, Human
caaaauaccguacacggcgug

SEQ ID NO: 1146520 - RNA, 24 nt, Human
caccuuuagcuccuaucuuggucc

SEQ ID NO: 1146521 - RNA, 26 nt, Human
cacugggcagcagaggggacagagcu

SEQ ID NO: 1146522 - RNA, 21 nt, Human
cagaggggacagagcuucuag

SEQ ID NO: 1146523 - RNA, 24 nt, Human
cagcaccucucgggggaggacugg

SEQ ID NO: 1146524 - RNA, 24 nt, Human
cagcagaggggacagagcuucuag

SEQ ID NO: 1146525 - RNA, 18 nt, Human
cagcagcaguggugaggg

SEQ ID NO: 1146526 - RNA, 19 nt, Human
cagcagcaguggugagggc

SEQ ID NO: 1146527 - RNA, 21 nt, Human
cagcagcaguggugagggcag

SEQ ID NO: 1146528 - RNA, 24 nt, Human
cagcagcaguggugagggcaggcc

SEQ ID NO: 1146529 - RNA, 18 nt, Human
cauggaggucggugaagc

SEQ ID NO: 1146530 - RNA, 20 nt, Human
cauggaggucggugaagcug

SEQ ID NO: 1146531 - RNA, 18 nt, Human
ccacugggcagcagaggg

SEQ ID NO: 1146532 - RNA, 22 nt, Human
ccagaccccagaccagaaaucc

SEQ ID NO: 1146533 - RNA, 23 nt, Human
ccagcagcuucggugucuggugc

SEQ ID NO: 1146534 - RNA, 20 nt, Human
cccccuuccucaaggcuggg

SEQ ID NO: 1146535 - RNA, 18 nt, Human
ccccugcuacucagcccu

SEQ ID NO: 1146536 - RNA, 21 nt, Human
ccccugugagaggugcugccc

SEQ ID NO: 1146537 - RNA, 24 nt, Human
cccuaauuucuccucuuucuuucc

SEQ ID NO: 1146538 - RNA, 23 nt, Human
ccucaaccagguugguggccacc

SEQ ID NO: 1146539 - RNA, 21 nt, Human
ccucaaggcugggcaagcggc

SEQ ID NO: 1146540 - RNA, 21 nt, Human
ccucaucaccuccuaauguga

SEQ ID NO: 1146541 - RNA, 20 nt, Human
ccucugugaccucaucaccu

SEQ ID NO: 1146542 - RNA, 21 nt, Human
cgaaggcccagcagcuucggu

SEQ ID NO: 1146543 - RNA, 20 nt, Human
cgagcaagaccccaggcagc

SEQ ID NO: 1146544 - RNA, 23 nt, Human
cgcccucacuuggggaugaggau

SEQ ID NO: 1146545 - RNA, 22 nt, Human
cgcuuccgucaggagcugggag

SEQ ID NO: 1146546 - RNA, 21 nt, Human
cggcauggaggucggugaagc

SEQ ID NO: 1146547 - RNA, 22 nt, Human
cggggcagaggagcccucaacg

SEQ ID NO: 1146548 - RNA, 20 nt, Human
cugccccugcuacucagccc

SEQ ID NO: 1146549 - RNA, 20 nt, Human
cugccccugcuacucagccc

SEQ ID NO: 1146550 - RNA, 18 nt, Human
cugcuacucagcccugcc

SEQ ID NO: 1146551 - RNA, 19 nt, Human
gagcgaggcaggcuugggg

SEQ ID NO: 1146552 - RNA, 25 nt, Human
gagggcaggccuggguguccaggag

SEQ ID NO: 1146553 - RNA, 21 nt, Human
gaggucggugaagcuggacag

SEQ ID NO: 1146554 - RNA, 18 nt, Human
gcagugggaagaguuuga

SEQ ID NO: 1146555 - RNA, 19 nt, Human
gcauggcccuguggggcag

SEQ ID NO: 1146556 - RNA, 25 nt, Human
gcggggcagaggagcccucaacgag

SEQ ID NO: 1146557 - RNA, 18 nt, Human
ggaggucggugaagcugg

SEQ ID NO: 1146558 - RNA, 22 nt, Human
ggcgcuggcucaggagcccugc

SEQ ID NO: 1146559 - RNA, 24 nt, Human
ggcuuggggggggcgcuggcucag

SEQ ID NO: 1146560 - RNA, 18 nt, Human
gggaccccauggacaaaa

SEQ ID NO: 1146561 - RNA, 18 nt, Human
ggggguuucuuggcaaau

SEQ ID NO: 1146562 - RNA, 19 nt, Human
ggugcagugcucacaccuc

SEQ ID NO: 1146563 - RNA, 18 nt, Human
gugaaguggcugcgccug

SEQ ID NO: 1146564 - RNA, 20 nt, Human
gugaaguggcugcgccugca

SEQ ID NO: 1146565 - RNA, 31 nt, Human
guuggccucagcuacucuuccggccguaaca

SEQ ID NO: 1146566 - RNA, 19 nt, Human
uagaauggcggccccgaga

SEQ ID NO: 1146567 - RNA, 19 nt, Human
ucaggaauguguggcucac

SEQ ID NO: 1146568 - RNA, 21 nt, Human
ucugccucugugaccucauca

SEQ ID NO: 1146569 - RNA, 23 nt, Human
ucuggcauaccgugaaggacaaa

SEQ ID NO: 1146570 - RNA, 23 nt, Human
ucugugaucaucuuggggacagu

SEQ ID NO: 1146571 - RNA, 19 nt, Human
ucuugcagggaggagggag

SEQ ID NO: 1146572 - RNA, 18 nt, Human
ugaaggacaaacagugaa

SEQ ID NO: 1146573 - RNA, 20 nt, Human
ugaaggacaaacagugaagu

SEQ ID NO: 1146574 - RNA, 22 nt, Human
ugaaggacaaacagugaagugg

SEQ ID NO: 1146575 - RNA, 19 nt, Human
ugaaguggcugcgccugca

SEQ ID NO: 1146576 - RNA, 22 nt, Human
ugacagcaccggggagggccac

SEQ ID NO: 1146577 - RNA, 23 nt, Human
ugagaaaggcaaugucugggucc

SEQ ID NO: 1146578 - RNA, 20 nt, Human
ugagaaugggaccccaugga

SEQ ID NO: 1146579 - RNA, 19 nt, Human
ugaggccccgcccucacuu

SEQ ID NO: 1146580 - RNA, 18 nt, Human
ugcccugcggacgcaguc

SEQ ID NO: 1146581 - RNA, 21 nt, Human
uggcaggcggggggccccucu

SEQ ID NO: 1146582 - RNA, 21 nt, Human
uggcauaccgugaaggacaaa

SEQ ID NO: 1146583 - RNA, 23 nt, Human
uggcucaggagcccugccugaug

SEQ ID NO: 1146584 - RNA, 18 nt, Human
ugggaagaguuugacugu

SEQ ID NO: 1146585 - RNA, 19 nt, Human
ugggagcgaggcaggcuug

SEQ ID NO: 1146586 - RNA, 22 nt, Human
ugggaggcgugggggggcccuc

SEQ ID NO: 1146587 - RNA, 22 nt, Human
uggggacaguccccucaaccag

SEQ ID NO: 1146588 - RNA, 19 nt, Human
ugggguuggcuggcagaug

SEQ ID NO: 1146589 - RNA, 24 nt, Human
ugggguuggcuggcagaugguucc

SEQ ID NO: 1146590 - RNA, 22 nt, Human
uguccaggagcaggagaugcgg

SEQ ID NO: 1146591 - RNA, 19 nt, Human
ugugauggcccugucugga

SEQ ID NO: 1146592 - RNA, 22 nt, Human
uuuaggggcucaguauugagaa

SEQ ID NO: 1146593 - RNA, 18 nt, Human
aaacagaacacagcagaa

SEQ ID NO: 1146594 - RNA, 21 nt, Human
aaccuacacaaacagaacaca

SEQ ID NO: 1146595 - RNA, 20 nt, Human
aaggaaagguccgugcagca

SEQ ID NO: 1146596 - RNA, 24 nt, Human
agaaggaggggcgucgcagaggcc

SEQ ID NO: 1146597 - RNA, 26 nt, Human
agagaaggaggggcgucgcagaggcc

SEQ ID NO: 1146598 - RNA, 21 nt, Human
agagacggcagcccagccucc

SEQ ID NO: 1146599 - RNA, 24 nt, Human
agccaaacagcagaaaagaucgag

SEQ ID NO: 1146600 - RNA, 21 nt, Human
agcuguggggugagccgggcc

SEQ ID NO: 1146601 - RNA, 20 nt, Human
agggcugggcccccaggggc

SEQ ID NO: 1146602 - RNA, 22 nt, Human
caacgcccccaacuccuggucu

SEQ ID NO: 1146603 - RNA, 28 nt, Human
caagaacacagacacagguuggagaccc

SEQ ID NO: 1146604 - RNA, 24 nt, Human
caaucgacaacuuucuguucccua

SEQ ID NO: 1146605 - RNA, 20 nt, Human
cacaaacagaacacagcaga

SEQ ID NO: 1146606 - RNA, 20 nt, Human
caccagaguaaggacagagu

SEQ ID NO: 1146607 - RNA, 18 nt, Human
cacuccugccagcccugc

SEQ ID NO: 1146608 - RNA, 18 nt, Human
cacuccuggaggguaggg

SEQ ID NO: 1146609 - RNA, 20 nt, Human
cagcagaaacaggggagaag

SEQ ID NO: 1146610 - RNA, 20 nt, Human
cagcagagaagccgagccuc

SEQ ID NO: 1146611 - RNA, 22 nt, Human
cagcagagaagccgagccuccc

SEQ ID NO: 1146612 - RNA, 19 nt, Human
cagcucugucaagggguaa

SEQ ID NO: 1146613 - RNA, 24 nt, Human
ccccaggggcuggacgaccucucu

SEQ ID NO: 1146614 - RNA, 28 nt, Human
cccucaacgcccccaacuccuggucugu

SEQ ID NO: 1146615 - RNA, 19 nt, Human
cccugacugaggccucggg

SEQ ID NO: 1146616 - RNA, 23 nt, Human
ccgcacggagcgugcaaucuacu

SEQ ID NO: 1146617 - RNA, 18 nt, Human
ccggggcucugucugcau

SEQ ID NO: 1146618 - RNA, 21 nt, Human
ccucaugggcugagcuguggg

SEQ ID NO: 1146619 - RNA, 19 nt, Human
ccucccugcccuggcccug

SEQ ID NO: 1146620 - RNA, 23 nt, Human
ccucccugcccuggcccuguccc

SEQ ID NO: 1146621 - RNA, 19 nt, Human
ccuguggaaccuccucccc

SEQ ID NO: 1146622 - RNA, 20 nt, Human
ccuguggaaccuccuccccg

SEQ ID NO: 1146623 - RNA, 22 nt, Human
ccuugaggcagaggcuccuucc

SEQ ID NO: 1146624 - RNA, 20 nt, Human
cgacaacuuucuguucccua

SEQ ID NO: 1146625 - RNA, 19 nt, Human
cgggagggaccuugaggca

SEQ ID NO: 1146626 - RNA, 22 nt, Human
cgggccccgcagcccgcgcccc

SEQ ID NO: 1146627 - RNA, 21 nt, Human
cucccugcccuggcccugucc

SEQ ID NO: 1146628 - RNA, 23 nt, Human
cuccugccagcccugcucugcgc

SEQ ID NO: 1146629 - RNA, 22 nt, Human
cucugauaagccuuccaguucc

SEQ ID NO: 1146630 - RNA, 19 nt, Human
cuuccucccugcccuggcc

SEQ ID NO: 1146631 - RNA, 22 nt, Human
cuuccucccugcccuggcccug

SEQ ID NO: 1146632 - RNA, 19 nt, Human
cuuucucagcauggugaac

SEQ ID NO: 1146633 - RNA, 19 nt, Human
gagaaggaggggcgucgca

SEQ ID NO: 1146634 - RNA, 18 nt, Human
gagaguggggagggcggu

SEQ ID NO: 1146635 - RNA, 21 nt, Human
gcccacuccugccagcccugc

SEQ ID NO: 1146636 - RNA, 23 nt, Human
gcccauuccccggcuguccuccu

SEQ ID NO: 1146637 - RNA, 24 nt, Human
gcccccaggggcuggacgaccucu

SEQ ID NO: 1146638 - RNA, 23 nt, Human
gcgggcaauuuguuacacagcaa

SEQ ID NO: 1146639 - RNA, 23 nt, Human
gcucucuagggcugggcccccag

SEQ ID NO: 1146640 - RNA, 22 nt, Human
gcugcugcccagggagccguga

SEQ ID NO: 1146641 - RNA, 23 nt, Human
ggaaaggcuuaagagaaggaggg

SEQ ID NO: 1146642 - RNA, 24 nt, Human
ggccuccagccaaacagcagaaaa

SEQ ID NO: 1146643 - RNA, 18 nt, Human
ggcugcguggacucugau

SEQ ID NO: 1146644 - RNA, 20 nt, Human
gggagggcgguggggcugcg

SEQ ID NO: 1146645 - RNA, 22 nt, Human
gggcagcgcgagucccucgggc

SEQ ID NO: 1146646 - RNA, 20 nt, Human
gggcaugcacgagcucugcc

SEQ ID NO: 1146647 - RNA, 25 nt, Human
gugaaacaccagaguaaggacagag

SEQ ID NO: 1146648 - RNA, 21 nt, Human
uaaaaucacagugaaacacca

SEQ ID NO: 1146649 - RNA, 19 nt, Human
uaagaaaagaugcucugug

SEQ ID NO: 1146650 - RNA, 19 nt, Human
ucagacagcuuggaaaggc

SEQ ID NO: 1146651 - RNA, 21 nt, Human
ucagacccucaaucguugauu

SEQ ID NO: 1146652 - RNA, 18 nt, Human
ucccccgcaggucuuucu

SEQ ID NO: 1146653 - RNA, 19 nt, Human
ucccuucggcugcaggagc

SEQ ID NO: 1146654 - RNA, 26 nt, Human
ucuagggcugggcccccaggggcugg

SEQ ID NO: 1146655 - RNA, 23 nt, Human
ucucagcauggugaacaugggag

SEQ ID NO: 1146656 - RNA, 20 nt, Human
ucucuagggcugggccccca

SEQ ID NO: 1146657 - RNA, 19 nt, Human
ucucucgccuucgcuuucu

SEQ ID NO: 1146658 - RNA, 22 nt, Human
ucuguccuguggaaccuccucc

SEQ ID NO: 1146659 - RNA, 21 nt, Human
ucuguucccuauuucuguucu

SEQ ID NO: 1146660 - RNA, 18 nt, Human
ugaaacaccagaguaagg

SEQ ID NO: 1146661 - RNA, 23 nt, Human
ugaaccuacacaaacagaacaca

SEQ ID NO: 1146662 - RNA, 19 nt, Human
ugaaggcacuaaacugcgg

SEQ ID NO: 1146663 - RNA, 22 nt, Human
ugagggaggugcucagacccuc

SEQ ID NO: 1146664 - RNA, 22 nt, Human
ugcccagggagccgugaggagc

SEQ ID NO: 1146665 - RNA, 24 nt, Human
ugcugcccagggagccgugaggag

SEQ ID NO: 1146666 - RNA, 18 nt, Human
uggaaccuccuccccggg

SEQ ID NO: 1146667 - RNA, 23 nt, Human
uggcccucaacgcccccaacucc

SEQ ID NO: 1146668 - RNA, 21 nt, Human
uggcugcgugggggcuguggu

SEQ ID NO: 1146669 - RNA, 18 nt, Human
ugggggagcuuucaacgc

SEQ ID NO: 1146670 - RNA, 21 nt, Human
uggggugagccgggcccuguc

SEQ ID NO: 1146671 - RNA, 21 nt, Human
ugucccccgaugcccaccccc

SEQ ID NO: 1146672 - RNA, 22 nt, Human
uguccuguggaaccuccucccc

SEQ ID NO: 1146673 - RNA, 26 nt, Human
ugugagauggcccucaacgcccccaa

SEQ ID NO: 1146674 - RNA, 21 nt, Human
uguggaguggcccacuccugc

SEQ ID NO: 1146675 - RNA, 19 nt, Human
uguggggugagccgggccc

SEQ ID NO: 1146676 - RNA, 20 nt, Human
uguggugggcagccugugag

SEQ ID NO: 1146677 - RNA, 19 nt, Human
uguuacacagcaaucgaca

SEQ ID NO: 1146678 - RNA, 25 nt, Human
uugcucagcuaugcgggagcugugc

SEQ ID NO: 1146679 - RNA, 21 nt, Human
uuguuugaaggcacuaaacug

SEQ ID NO: 1146680 - RNA, 25 nt, Human
uuucucagcauggugaacaaccuug

SEQ ID NO: 1146681 - RNA, 25 nt, Human
uuucuguucccuauuucuguucuuu

SEQ ID NO: 1146682 - RNA, 18 nt, Human
aaaugugggaggcuacau

SEQ ID NO: 1146683 - RNA, 24 nt, Human
accagcuuggcucccaggaggucc

SEQ ID NO: 1146684 - RNA, 24 nt, Human
accccugguggaagacucugcuuc

SEQ ID NO: 1146685 - RNA, 19 nt, Human
accuacucugggacagucc

SEQ ID NO: 1146686 - RNA, 18 nt, Human
agaaggugaaggugacug

SEQ ID NO: 1146687 - RNA, 23 nt, Human
agaccagcuuggcucccaggagg

SEQ ID NO: 1146688 - RNA, 23 nt, Human
agagauggugaagagcucacugg

SEQ ID NO: 1146689 - RNA, 21 nt, Human
agaggggaggggaaaagggau

SEQ ID NO: 1146690 - RNA, 18 nt, Human
agauguggauauguggcu

SEQ ID NO: 1146691 - RNA, 24 nt, Human
agauuugcagaggaggggaagagu

SEQ ID NO: 1146692 - RNA, 18 nt, Human
agccaggcccuggcaccc

SEQ ID NO: 1146693 - RNA, 18 nt, Human
aggcccgggccgcggcgg

SEQ ID NO: 1146694 - RNA, 20 nt, Human
aggcccuggaggucgcugcc

SEQ ID NO: 1146695 - RNA, 22 nt, Human
aggcugcgggcucacagccugu

SEQ ID NO: 1146696 - RNA, 18 nt, Human
agggagcagccgcuggcg

SEQ ID NO: 1146697 - RNA, 19 nt, Human
agggcguggccacaucacc

SEQ ID NO: 1146698 - RNA, 19 nt, Human
aggggcagggaagaccaag

SEQ ID NO: 1146699 - RNA, 26 nt, Human
aucaaaacacacggaugcaguaccca

SEQ ID NO: 1146700 - RNA, 23 nt, Human
augugggaggcuacauuugagga

SEQ ID NO: 1146701 - RNA, 25 nt, Human
caaaggcccuuguccagugccccuc

SEQ ID NO: 1146702 - RNA, 21 nt, Human
caagaacacggagguccacug

SEQ ID NO: 1146703 - RNA, 22 nt, Human
cacacugagaaaaaugaaagag

SEQ ID NO: 1146704 - RNA, 18 nt, Human
cacccuuucucgggacca

SEQ ID NO: 1146705 - RNA, 20 nt, Human
cacggagguccacugcccca

SEQ ID NO: 1146706 - RNA, 21 nt, Human
cacugaagugggagccacugc

SEQ ID NO: 1146707 - RNA, 20 nt, Human
cacugcugcucuccaggccc

SEQ ID NO: 1146708 - RNA, 20 nt, Human
cagcacugaagugggagcca

SEQ ID NO: 1146709 - RNA, 21 nt, Human
caucacccccuuaucaaaaca

SEQ ID NO: 1146710 - RNA, 20 nt, Human
cauucgggccugguggcagc

SEQ ID NO: 1146711 - RNA, 21 nt, Human
cauuuggaaaggccuucugag

SEQ ID NO: 1146712 - RNA, 21 nt, Human
ccacugcgcacugugagggag

SEQ ID NO: 1146713 - RNA, 22 nt, Human
ccagggaggcguugcgcuggca

SEQ ID NO: 1146714 - RNA, 22 nt, Human
cccaagaccacccuuucucggg

SEQ ID NO: 1146715 - RNA, 19 nt, Human
ccccauccccaggccccau

SEQ ID NO: 1146716 - RNA, 23 nt, Human
ccccugagaggaagggccugugg

SEQ ID NO: 1146717 - RNA, 25 nt, Human
cccuggcaccccugguggaagacuc

SEQ ID NO: 1146718 - RNA, 19 nt, Human
cccuguacuggccgcuggu

SEQ ID NO: 1146719 - RNA, 21 nt, Human
ccgcuggacccagccaggccc

SEQ ID NO: 1146720 - RNA, 23 nt, Human
ccgggggcgcggcggcccccucc

SEQ ID NO: 1146721 - RNA, 20 nt, Human
ccucccaagaccacccuuuc

SEQ ID NO: 1146722 - RNA, 18 nt, Human
ccuguacuuuggggaaaa

SEQ ID NO: 1146723 - RNA, 18 nt, Human
ccugugguggccgcucac

SEQ ID NO: 1146724 - RNA, 18 nt, Human
ccuuguccagugccccuc

SEQ ID NO: 1146725 - RNA, 20 nt, Human
cgccgcauggccacccaagu

SEQ ID NO: 1146726 - RNA, 18 nt, Human
cguggccacaucaccccc

SEQ ID NO: 1146727 - RNA, 20 nt, Human
cucacugcugcucuccaggc

SEQ ID NO: 1146728 - RNA, 24 nt, Human
cuccagggaggcguugcgcuggca

SEQ ID NO: 1146729 - RNA, 25 nt, Human
cuccucggcggcuccccgagcgcca

SEQ ID NO: 1146730 - RNA, 25 nt, Human
cucguccaccaccuguccaauguca

SEQ ID NO: 1146731 - RNA, 21 nt, Human
cucuucacuaccuacucuggg

SEQ ID NO: 1146732 - RNA, 23 nt, Human
cugcucuccaggcccaugauggc

SEQ ID NO: 1146733 - RNA, 19 nt, Human
cugcugcucuccaggccca

SEQ ID NO: 1146734 - RNA, 21 nt, Human
cugcugcucuccaggcccaug

SEQ ID NO: 1146735 - RNA, 22 nt, Human
gacuuacugucccccaaaggcc

SEQ ID NO: 1146736 - RNA, 21 nt, Human
gagauguuugauucgauguug

SEQ ID NO: 1146737 - RNA, 18 nt, Human
gaugcagaugagcaggcg

SEQ ID NO: 1146738 - RNA, 22 nt, Human
gcaccaggccuuucccagggca

SEQ ID NO: 1146739 - RNA, 22 nt, Human
gcaggcccggcugucuccaauc

SEQ ID NO: 1146740 - RNA, 18 nt, Human
gcaguacccaggccagcc

SEQ ID NO: 1146741 - RNA, 24 nt, Human
gccacaucacccccuuaucaaaac

SEQ ID NO: 1146742 - RNA, 19 nt, Human
gccgcucacacgcccagga

SEQ ID NO: 1146743 - RNA, 18 nt, Human
gcgucgggcugcgagggg

SEQ ID NO: 1146744 - RNA, 19 nt, Human
gcucccaggagguccugag

SEQ ID NO: 1146745 - RNA, 24 nt, Human
gcugccgagggccuuguccucuuc

SEQ ID NO: 1146746 - RNA, 23 nt, Human
ggagcacagcaggcuugggacca

SEQ ID NO: 1146747 - RNA, 20 nt, Human
ggagcccagauggagaccag

SEQ ID NO: 1146748 - RNA, 20 nt, Human
ggccugagcgcccuugccag

SEQ ID NO: 1146749 - RNA, 21 nt, Human
ggcgcggcggcccccuccucg

SEQ ID NO: 1146750 - RNA, 22 nt, Human
gggcacggauggucaccccggc

SEQ ID NO: 1146751 - RNA, 22 nt, Human
guuaaucuugcacacauuagaa

SEQ ID NO: 1146752 - RNA, 18 nt, Human
uacaaagugaaaucuaga

SEQ ID NO: 1146753 - RNA, 19 nt, Human
uacaaagugaaaucuagau

SEQ ID NO: 1146754 - RNA, 21 nt, Human
uacauuugaggaggcugcggg

SEQ ID NO: 1146755 - RNA, 20 nt, Human
uaccuacucugggacagucc

SEQ ID NO: 1146756 - RNA, 20 nt, Human
uaggaggcccuggaggucgc

SEQ ID NO: 1146757 - RNA, 18 nt, Human
uccaagaacacggagguc

SEQ ID NO: 1146758 - RNA, 19 nt, Human
uccaagaacacggaggucc

SEQ ID NO: 1146759 - RNA, 18 nt, Human
uccacugccccaucugca

SEQ ID NO: 1146760 - RNA, 26 nt, Human
uccacuuggcaguauuuauuagacaa

SEQ ID NO: 1146761 - RNA, 19 nt, Human
uccccgagcgccacguggu

SEQ ID NO: 1146762 - RNA, 18 nt, Human
ucucgggaccaucucucg

SEQ ID NO: 1146763 - RNA, 22 nt, Human
ucugcagguacaggacgccauu

SEQ ID NO: 1146764 - RNA, 22 nt, Human
ucugugcccaguggauacaaag

SEQ ID NO: 1146765 - RNA, 19 nt, Human
ugaagauuugcagaggagg

SEQ ID NO: 1146766 - RNA, 19 nt, Human
ugaagugggagccacugcg

SEQ ID NO: 1146767 - RNA, 21 nt, Human
ugagaaaaaugaaagagaugu

SEQ ID NO: 1146768 - RNA, 21 nt, Human
ugagggagcagccgcuggcgu

SEQ ID NO: 1146769 - RNA, 18 nt, Human
ugccacaggagcacagca

SEQ ID NO: 1146770 - RNA, 24 nt, Human
ugccccaucugcagguacaggacu

SEQ ID NO: 1146771 - RNA, 20 nt, Human
uggaaaggccuucugaggug

SEQ ID NO: 1146772 - RNA, 20 nt, Human
uggaggucgcugccgagggc

SEQ ID NO: 1146773 - RNA, 26 nt, Human
uggcagguagaacacgguuaggggag

SEQ ID NO: 1146774 - RNA, 18 nt, Human
uggcaguauuuauuagac

SEQ ID NO: 1146775 - RNA, 18 nt, Human
uggcugugaagauuugca

SEQ ID NO: 1146776 - RNA, 20 nt, Human
uggcuuuuacaagagugaaa

SEQ ID NO: 1146777 - RNA, 21 nt, Human
ugggaaagaugcuugggaggc

SEQ ID NO: 1146778 - RNA, 23 nt, Human
ugggaggcucaucccagagccgc

SEQ ID NO: 1146779 - RNA, 22 nt, Human
ugggguuuggaagcugggcucc

SEQ ID NO: 1146780 - RNA, 22 nt, Human
uguggcuuuuacaagagugaaa

SEQ ID NO: 1146781 - RNA, 20 nt, Human
ugugguggccgcucacacgc

SEQ ID NO: 1146782 - RNA, 23 nt, Human
ugugguggccgcucacacgccca

SEQ ID NO: 1146783 - RNA, 21 nt, Human
uuaaucuugcacacauuagaa

SEQ ID NO: 1146784 - RNA, 20 nt, Human
uuccucugguggguggcucc

SEQ ID NO: 1146785 - RNA, 24 nt, Human
uucguagccuguuguguggggagg

SEQ ID NO: 1146786 - RNA, 24 nt, Human
uuggcucccaggagguccugaggc

SEQ ID NO: 1146787 - RNA, 18 nt, Human
uuggcugugaagauuugc

SEQ ID NO: 1146788 - RNA, 22 nt, Human
uugguuuuuguguguuacugca

SEQ ID NO: 1146789 - RNA, 22 nt, Human
uuuggaagcugggcuccugggg

SEQ ID NO: 1146790 - RNA, 23 nt, Human
aacccuccuccccacuuucccug

SEQ ID NO: 1146791 - RNA, 18 nt, Human
aacuuccuggcuacaguc

SEQ ID NO: 1146792 - RNA, 20 nt, Human
acaguggcagggaaagcugu

SEQ ID NO: 1146793 - RNA, 18 nt, Human
accccaucuuccucaucu

SEQ ID NO: 1146794 - RNA, 21 nt, Human
acccuggagcccauucugccc

SEQ ID NO: 1146795 - RNA, 19 nt, Human
acugaacuccgggagcaga

SEQ ID NO: 1146796 - RNA, 23 nt, Human
agagcccuuccagggcuucacac

SEQ ID NO: 1146797 - RNA, 20 nt, Human
agagggcccuuccacccaca

SEQ ID NO: 1146798 - RNA, 19 nt, Human
agaggggagaggagagggc

SEQ ID NO: 1146799 - RNA, 19 nt, Human
agcucagcccccuucugcc

SEQ ID NO: 1146800 - RNA, 20 nt, Human
aggaaauagguguugacuga

SEQ ID NO: 1146801 - RNA, 18 nt, Human
aggcagcuuggugggucu

SEQ ID NO: 1146802 - RNA, 21 nt, Human
aggcagcuuggugggucuucu

SEQ ID NO: 1146803 - RNA, 19 nt, Human
aggccaggagggcaggcgc

SEQ ID NO: 1146804 - RNA, 20 nt, Human
aggugggaagaggaagaggg

SEQ ID NO: 1146805 - RNA, 18 nt, Human
agugcagugguugaacuu

SEQ ID NO: 1146806 - RNA, 24 nt, Human
aucuuccucaucuuuaagccuuca

SEQ ID NO: 1146807 - RNA, 23 nt, Human
caaaggccccugcuuggagccca

SEQ ID NO: 1146808 - RNA, 21 nt, Human
caacccuccuccccacuuucc

SEQ ID NO: 1146809 - RNA, 21 nt, Human
caacuuccuggcuacaguccu

SEQ ID NO: 1146810 - RNA, 26 nt, Human
cacacacaggcaaucgaucaaucauc

SEQ ID NO: 1146811 - RNA, 21 nt, Human
caccuaaauccuccauccuga

SEQ ID NO: 1146812 - RNA, 24 nt, Human
cagagguaucaggcagcuuggugg

SEQ ID NO: 1146813 - RNA, 21 nt, Human
cagcagaaucagugucugguu

SEQ ID NO: 1146814 - RNA, 22 nt, Human
cagcucagcccccuucugccca

SEQ ID NO: 1146815 - RNA, 19 nt, Human
cagcuuccugccccucccc

SEQ ID NO: 1146816 - RNA, 24 nt, Human
caggaccuggucaccugcaggccc

SEQ ID NO: 1146817 - RNA, 24 nt, Human
caggcccagacuggccucuacuag

SEQ ID NO: 1146818 - RNA, 18 nt, Human
cagggcuucacacacagg

SEQ ID NO: 1146819 - RNA, 24 nt, Human
caggguggaaugccaggucaggcc

SEQ ID NO: 1146820 - RNA, 20 nt, Human
cagugucugguugaggccca

SEQ ID NO: 1146821 - RNA, 24 nt, Human
caguuccugucugggcagagggga

SEQ ID NO: 1146822 - RNA, 22 nt, Human
cauaacaacuuccuggcuacag

SEQ ID NO: 1146823 - RNA, 23 nt, Human
ccaucaucuguccacuuccagaa

SEQ ID NO: 1146824 - RNA, 25 nt, Human
cccauucugcccgcagggcugggag

SEQ ID NO: 1146825 - RNA, 20 nt, Human
ccccaggcaaaggccccugc

SEQ ID NO: 1146826 - RNA, 22 nt, Human
ccccaucaucuguccacuucca

SEQ ID NO: 1146827 - RNA, 21 nt, Human
cccuccuccccacuuucccug

SEQ ID NO: 1146828 - RNA, 18 nt, Human
cccuggagcccauucugc

SEQ ID NO: 1146829 - RNA, 24 nt, Human
ccucuaccuugucaggguagggac

SEQ ID NO: 1146830 - RNA, 19 nt, Human
ccuggagcccauucugccc

SEQ ID NO: 1146831 - RNA, 23 nt, Human
ccuucugcccagcugcagcuuca

SEQ ID NO: 1146832 - RNA, 19 nt, Human
cucccuuugcucccugucc

SEQ ID NO: 1146833 - RNA, 23 nt, Human
cuccgugcuuggggugccuccuc

SEQ ID NO: 1146834 - RNA, 21 nt, Human
cucgcuaucugcaggguggaa

SEQ ID NO: 1146835 - RNA, 18 nt, Human
cucugggugccugagcug

SEQ ID NO: 1146836 - RNA, 19 nt, Human
cugcagcuucagcugcaag

SEQ ID NO: 1146837 - RNA, 24 nt, Human
cuucauuggaacuuugagccacuu

SEQ ID NO: 1146838 - RNA, 22 nt, Human
gacauugcucugggugccugag

SEQ ID NO: 1146839 - RNA, 19 nt, Human
gaccauggccucuaccuug

SEQ ID NO: 1146840 - RNA, 19 nt, Human
gccuggaagcuguaugaag

SEQ ID NO: 1146841 - RNA, 24 nt, Human
gcucagcccccuucugcccagcug

SEQ ID NO: 1146842 - RNA, 18 nt, Human
gcucugggugccugagcu

SEQ ID NO: 1146843 - RNA, 19 nt, Human
gcuuccugccccuccccca

SEQ ID NO: 1146844 - RNA, 19 nt, Human
gcuuggugggucuucuccg

SEQ ID NO: 1146845 - RNA, 28 nt, Human
ggagggcaggcgcugaccccccaagggg

SEQ ID NO: 1146846 - RNA, 19 nt, Human
ggagguuucauugcaggga

SEQ ID NO: 1146847 - RNA, 23 nt, Human
ggugugaccagauugcuuuggau

SEQ ID NO: 1146848 - RNA, 22 nt, Human
uaaauggaaauacgggugccca

SEQ ID NO: 1146849 - RNA, 22 nt, Human
uaacaccuaaauccuccauccu

SEQ ID NO: 1146850 - RNA, 20 nt, Human
uagacagagguaucaggcag

SEQ ID NO: 1146851 - RNA, 22 nt, Human
ucagcucagcccccuucugccc

SEQ ID NO: 1146852 - RNA, 19 nt, Human
ucagcuuccugccccuccc

SEQ ID NO: 1146853 - RNA, 20 nt, Human
uccacuuccagaaaagagcc

SEQ ID NO: 1146854 - RNA, 23 nt, Human
uccacuuccagaaaagagccgcc

SEQ ID NO: 1146855 - RNA, 21 nt, Human
ucccaacccuccuccccacuu

SEQ ID NO: 1146856 - RNA, 24 nt, Human
ucccaacccuccuccccacuuucc

SEQ ID NO: 1146857 - RNA, 19 nt, Human
uccccacuuucccuguugg

SEQ ID NO: 1146858 - RNA, 20 nt, Human
uccccaggcaaaggccccug

SEQ ID NO: 1146859 - RNA, 26 nt, Human
ucccuccaggcuuuuguguaagggca

SEQ ID NO: 1146860 - RNA, 24 nt, Human
ucccuguuggauuguuguccagag

SEQ ID NO: 1146861 - RNA, 18 nt, Human
ucugcaggguggaaugcc

SEQ ID NO: 1146862 - RNA, 19 nt, Human
ucuuaguuccuuugugcug

SEQ ID NO: 1146863 - RNA, 21 nt, Human
ucuuccucaucuuuaagccuu

SEQ ID NO: 1146864 - RNA, 18 nt, Human
ugacugaacuccgggagc

SEQ ID NO: 1146865 - RNA, 19 nt, Human
ugacugaacuccgggagca

SEQ ID NO: 1146866 - RNA, 21 nt, Human
ugacugaaucuuccaggccau

SEQ ID NO: 1146867 - RNA, 22 nt, Human
ugagccacuuuuugcuaacacc

SEQ ID NO: 1146868 - RNA, 19 nt, Human
ugaggccaggagggcaggc

SEQ ID NO: 1146869 - RNA, 24 nt, Human
ugccguggggacuggccagaggug

SEQ ID NO: 1146870 - RNA, 18 nt, Human
ugccugagcugacgcagg

SEQ ID NO: 1146871 - RNA, 20 nt, Human
ugccugagcugacgcaggug

SEQ ID NO: 1146872 - RNA, 18 nt, Human
uggaaugaauggugaaca

SEQ ID NO: 1146873 - RNA, 18 nt, Human
uggagugcagugguugaa

SEQ ID NO: 1146874 - RNA, 21 nt, Human
uggagugcagugguugaacuu

SEQ ID NO: 1146875 - RNA, 21 nt, Human
uggagugcagugguugaacuu

SEQ ID NO: 1146876 - RNA, 26 nt, Human
uggagugcagugguugaaggcucuag

SEQ ID NO: 1146877 - RNA, 18 nt, Human
uggcagggaaagcuguug

SEQ ID NO: 1146878 - RNA, 23 nt, Human
ugggagaccagguggugguuggg

SEQ ID NO: 1146879 - RNA, 25 nt, Human
ugggcagaggggagcuagacagagg

SEQ ID NO: 1146880 - RNA, 24 nt, Human
ugggggggccaccgccauccagac

SEQ ID NO: 1146881 - RNA, 24 nt, Human
uguggaacagaguucaguucccaa

SEQ ID NO: 1146882 - RNA, 23 nt, Human
uuccaggccauauuuacauuacu

SEQ ID NO: 1146883 - RNA, 21 nt, Human
uucccaacccuccuccccacu

SEQ ID NO: 1146884 - RNA, 21 nt, Human
uucugcccgcagggcugggag

SEQ ID NO: 1146885 - RNA, 21 nt, Human
uuggaacuuugagccacuuuu

SEQ ID NO: 1146886 - RNA, 21 nt, Human
uuguucaugacugaacuccgg

SEQ ID NO: 1146887 - RNA, 23 nt, Human
uuugcuaacaccuaaauccucca

SEQ ID NO: 1146888 - RNA, 21 nt, Human
aaaaacacauaaggaacuaug

SEQ ID NO: 1146889 - RNA, 18 nt, Human
aaaaauuaguaaaaaugg

SEQ ID NO: 1146890 - RNA, 19 nt, Human
aacaaugcuuuaaaagguc

SEQ ID NO: 1146891 - RNA, 21 nt, Human
aacaaugcuuuaaaaggucuu

SEQ ID NO: 1146892 - RNA, 19 nt, Human
aacccgcggagaacgagcc

SEQ ID NO: 1146893 - RNA, 19 nt, Human
aacuucccucccgcuacuc

SEQ ID NO: 1146894 - RNA, 21 nt, Human
aagcgcgcagggagaagcgag

SEQ ID NO: 1146895 - RNA, 22 nt, Human
aaguaguccaucuuucuaaaac

SEQ ID NO: 1146896 - RNA, 20 nt, Human
aauaccuuuucuacuuuggu

SEQ ID NO: 1146897 - RNA, 24 nt, Human
acacaaaaguaaaaagaugaggua

SEQ ID NO: 1146898 - RNA, 19 nt, Human
accaagauaaauauuugga

SEQ ID NO: 1146899 - RNA, 25 nt, Human
accuauuugucuucucccuucuucc

SEQ ID NO: 1146900 - RNA, 22 nt, Human
acgaaacccgcggagaacgagc

SEQ ID NO: 1146901 - RNA, 23 nt, Human
acgaaacccgcggagaacgagcc

SEQ ID NO: 1146902 - RNA, 18 nt, Human
acucccugcggggcuucg

SEQ ID NO: 1146903 - RNA, 20 nt, Human
agaaauaguaaaaauuucaa

SEQ ID NO: 1146904 - RNA, 19 nt, Human
agagcaagggugggcggcg

SEQ ID NO: 1146905 - RNA, 21 nt, Human
aggcauuuuuuguuaaaaaua

SEQ ID NO: 1146906 - RNA, 22 nt, Human
agguucccccauuaagggcacc

SEQ ID NO: 1146907 - RNA, 21 nt, Human
aguaacaauauauacaccaag

SEQ ID NO: 1146908 - RNA, 18 nt, Human
aucacaauuacaggagca

SEQ ID NO: 1146909 - RNA, 23 nt, Human
auucucacauacaaaaauuucau

SEQ ID NO: 1146910 - RNA, 19 nt, Human
caacuaaacagaaauauca

SEQ ID NO: 1146911 - RNA, 25 nt, Human
caacuugaaagaacuacacacacaa

SEQ ID NO: 1146912 - RNA, 23 nt, Human
cacccccgcgucaccaacgggag

SEQ ID NO: 1146913 - RNA, 21 nt, Human
cacccguacuacaacuucccu

SEQ ID NO: 1146914 - RNA, 22 nt, Human
cagagcucgaccccagggcugu

SEQ ID NO: 1146915 - RNA, 21 nt, Human
cauacaaauucaguauguagu

SEQ ID NO: 1146916 - RNA, 26 nt, Human
cauuaaaagucuuuaguaacauaggg

SEQ ID NO: 1146917 - RNA, 24 nt, Human
ccagggcuguagccggaaagggga

SEQ ID NO: 1146918 - RNA, 22 nt, Human
ccauaaaaaauauaaaugcaac

SEQ ID NO: 1146919 - RNA, 25 nt, Human
ccccacuacgcucacacucuucucc

SEQ ID NO: 1146920 - RNA, 22 nt, Human
cccccgcgucaccaacgggagc

SEQ ID NO: 1146921 - RNA, 20 nt, Human
cccuccuuucgccuuccccg

SEQ ID NO: 1146922 - RNA, 21 nt, Human
ccgacagccccaaagccucau

SEQ ID NO: 1146923 - RNA, 22 nt, Human
ccguacuacaacuucccucccg

SEQ ID NO: 1146924 - RNA, 21 nt, Human
ccuacaacuugaaagaacuac

SEQ ID NO: 1146925 - RNA, 24 nt, Human
ccuauggccagggaaaaccggggc

SEQ ID NO: 1146926 - RNA, 20 nt, Human
ccucagagcccagggguaaa

SEQ ID NO: 1146927 - RNA, 21 nt, Human
ccuccccuccgccucgagcac

SEQ ID NO: 1146928 - RNA, 22 nt, Human
ccuccgaaccccuccuuucgcc

SEQ ID NO: 1146929 - RNA, 23 nt, Human
ccuccgccacccccgcgucacca

SEQ ID NO: 1146930 - RNA, 24 nt, Human
ccuccgccacccccgcgucaccaa

SEQ ID NO: 1146931 - RNA, 20 nt, Human
ccuuccccgccuccuccccu

SEQ ID NO: 1146932 - RNA, 21 nt, Human
ccuuuagugugguucucccca

SEQ ID NO: 1146933 - RNA, 24 nt, Human
cgaaacacaacgaaacccgcggag

SEQ ID NO: 1146934 - RNA, 26 nt, Human
cgaaacccgcggagaacgagccucuc

SEQ ID NO: 1146935 - RNA, 22 nt, Human
cgcuaccaccaggccucagagc

SEQ ID NO: 1146936 - RNA, 18 nt, Human
cggggcuucgucccggcc

SEQ ID NO: 1146937 - RNA, 25 nt, Human
cuacacacacaaaaguaaaaagaug

SEQ ID NO: 1146938 - RNA, 24 nt, Human
cugaagaaaguacuuaauacucag

SEQ ID NO: 1146939 - RNA, 20 nt, Human
cuguagccggaaaggggagc

SEQ ID NO: 1146940 - RNA, 19 nt, Human
gagaccuccgccacccccg

SEQ ID NO: 1146941 - RNA, 22 nt, Human
gagcaagggugggcggcggguu

SEQ ID NO: 1146942 - RNA, 18 nt, Human
gcagggagaagcgagcgg

SEQ ID NO: 1146943 - RNA, 19 nt, Human
gccccggguccgcaacagc

SEQ ID NO: 1146944 - RNA, 19 nt, Human
gccggguccuagcgcccgc

SEQ ID NO: 1146945 - RNA, 19 nt, Human
gcgaaacacaacgaaaccc

SEQ ID NO: 1146946 - RNA, 21 nt, Human
gcgaaacacaacgaaacccgc

SEQ ID NO: 1146947 - RNA, 18 nt, Human
gcggaaugcgcuucgacc

SEQ ID NO: 1146948 - RNA, 21 nt, Human
gcggagaacgagccucuccca

SEQ ID NO: 1146949 - RNA, 21 nt, Human
gcuaccaccaggccucagagc

SEQ ID NO: 1146950 - RNA, 21 nt, Human
ggagaagcgagcggaggccga

SEQ ID NO: 1146951 - RNA, 19 nt, Human
guacuacaacuucccuccc

SEQ ID NO: 1146952 - RNA, 21 nt, Human
uaaauaucugaacuacauaau

SEQ ID NO: 1146953 - RNA, 24 nt, Human
uaacaauauauacaccaagauaaa

SEQ ID NO: 1146954 - RNA, 22 nt, Human
uaacaauuuuaaaaacauacaa

SEQ ID NO: 1146955 - RNA, 21 nt, Human
uaaugcaaguucuguuaaagu

SEQ ID NO: 1146956 - RNA, 22 nt, Human
uacacacacaaaaguaaaaaga

SEQ ID NO: 1146957 - RNA, 22 nt, Human
uacacacacaaaaguaaaaaga

SEQ ID NO: 1146958 - RNA, 22 nt, Human
uaccuggcgcucucgcgguucc

SEQ ID NO: 1146959 - RNA, 19 nt, Human
uagccggaaaggggagcag

SEQ ID NO: 1146960 - RNA, 20 nt, Human
uagugugguucuccccaccc

SEQ ID NO: 1146961 - RNA, 21 nt, Human
uagugugguucuccccacccu

SEQ ID NO: 1146962 - RNA, 22 nt, Human
uaucaguauuucuuagcaaaaa

SEQ ID NO: 1146963 - RNA, 23 nt, Human
ucauucucacauacaaaaauuuc

SEQ ID NO: 1146964 - RNA, 21 nt, Human
uccaucuuucuaaaacugagg

SEQ ID NO: 1146965 - RNA, 21 nt, Human
uccccaggcgcgcgcucucca

SEQ ID NO: 1146966 - RNA, 19 nt, Human
uccccgccuccuccccucc

SEQ ID NO: 1146967 - RNA, 23 nt, Human
ucugaacuacauaaugaacagca

SEQ ID NO: 1146968 - RNA, 22 nt, Human
ucuucuccagguucccccauua

SEQ ID NO: 1146969 - RNA, 18 nt, Human
ucuucucccuucuucccc

SEQ ID NO: 1146970 - RNA, 25 nt, Human
ugaaagaacuacacacacaaaagua

SEQ ID NO: 1146971 - RNA, 23 nt, Human
ugacuuaaauaauuuagcuuuuu

SEQ ID NO: 1146972 - RNA, 23 nt, Human
ugauuaaguuuugccaacaauau

SEQ ID NO: 1146973 - RNA, 18 nt, Human
ugcuuuuuuuaaagacaa

SEQ ID NO: 1146974 - RNA, 24 nt, Human
uuaauacucagauauucccaauug

SEQ ID NO: 1146975 - RNA, 27 nt, Human
uuaaugguuucuuauuguaaguuuucc

SEQ ID NO: 1146976 - RNA, 18 nt, Human
uucauuucccacuuagcc

SEQ ID NO: 1146977 - RNA, 22 nt, Human
uucuaaaacaaugcuuuaaaag

SEQ ID NO: 1146978 - RNA, 19 nt, Human
uuuagugugguucucccca

SEQ ID NO: 1146979 - RNA, 21 nt, Human
uuuccuacaacuugaaagaac

SEQ ID NO: 1146980 - RNA, 21 nt, Human
uuugacuacuuaaugguuucu

SEQ ID NO: 1146981 - RNA, 20 nt, Human
aagcaggucauggcccacgc

SEQ ID NO: 1146982 - RNA, 18 nt, Human
aagguguugauggcugga

SEQ ID NO: 1146983 - RNA, 19 nt, Human
acagguaagcaccccccuc

SEQ ID NO: 1146984 - RNA, 22 nt, Human
accccccucccacacacacaca

SEQ ID NO: 1146985 - RNA, 19 nt, Human
acuacacacagguaagcac

SEQ ID NO: 1146986 - RNA, 22 nt, Human
aggucauggcccacgccuguaa

SEQ ID NO: 1146987 - RNA, 18 nt, Human
auccugaaaggaugugcc

SEQ ID NO: 1146988 - RNA, 25 nt, Human
cacagguaagcaccccccucccaca

SEQ ID NO: 1146989 - RNA, 21 nt, Human
caccccccucccacacacaca

SEQ ID NO: 1146990 - RNA, 23 nt, Human
caccccccucccacacacacaca

SEQ ID NO: 1146991 - RNA, 18 nt, Human
cagaagacagcuuucugu

SEQ ID NO: 1146992 - RNA, 25 nt, Human
cauacauccugaaaggaugugccac

SEQ ID NO: 1146993 - RNA, 21 nt, Human
cccacacacacacauacaucc

SEQ ID NO: 1146994 - RNA, 26 nt, Human
cucccacacacacacauacauccuga

SEQ ID NO: 1146995 - RNA, 19 nt, Human
gguuacagaauuccuuggg

SEQ ID NO: 1146996 - RNA, 21 nt, Human
uaaaaagcaggucauggccca

SEQ ID NO: 1146997 - RNA, 23 nt, Human
uacuacacacagguaagcacccc

SEQ ID NO: 1146998 - RNA, 24 nt, Human
uagcucauuuuauuuucuucuuug

SEQ ID NO: 1146999 - RNA, 24 nt, Human
uauagauugauaauaaaaagcagg

SEQ ID NO: 1147000 - RNA, 22 nt, Human
ucccacacacacacauacaucc

SEQ ID NO: 1147001 - RNA, 18 nt, Human
uggcccacgccuguaauc

SEQ ID NO: 1147002 - RNA, 20 nt, Human
aaaaaacaaaacagagaaau

SEQ ID NO: 1147003 - RNA, 21 nt, Human
aaacagagaaaugagucagag

SEQ ID NO: 1147004 - RNA, 20 nt, Human
aacaaaacagagaaaugagu

SEQ ID NO: 1147005 - RNA, 22 nt, Human
aacagagaaaugagucagagag

SEQ ID NO: 1147006 - RNA, 23 nt, Human
aacccacugcuagugcuccccca

SEQ ID NO: 1147007 - RNA, 24 nt, Human
aagaaagcaaaaaaguaaacaaaa

SEQ ID NO: 1147008 - RNA, 21 nt, Human
aagagaagugagucaugggcg

SEQ ID NO: 1147009 - RNA, 18 nt, Human
acaaaacagagaaaugag

SEQ ID NO: 1147010 - RNA, 24 nt, Human
acaaaacagagaaaugagucagag

SEQ ID NO: 1147011 - RNA, 25 nt, Human
acaaaacagagaaaugagucagaga

SEQ ID NO: 1147012 - RNA, 26 nt, Human
acaagaaagcaaaaaaguaaacaaaa

SEQ ID NO: 1147013 - RNA, 24 nt, Human
agaaaaaacaaaacagagaaagaa

SEQ ID NO: 1147014 - RNA, 21 nt, Human
agaagugagucaugggcggag

SEQ ID NO: 1147015 - RNA, 26 nt, Human
agacagaugguaaacaagagggaccc

SEQ ID NO: 1147016 - RNA, 23 nt, Human
agagaagugagucaugggcggag

SEQ ID NO: 1147017 - RNA, 25 nt, Human
aggcagaaggaucuccuaguuccuu

SEQ ID NO: 1147018 - RNA, 25 nt, Human
aucgaacccucucugcuuccuaaag

SEQ ID NO: 1147019 - RNA, 21 nt, Human
augauaaaaucuggggagaga

SEQ ID NO: 1147020 - RNA, 24 nt, Human
caagaaagcaaaaaaguaaacaaa

SEQ ID NO: 1147021 - RNA, 22 nt, Human
caagaaggagauggucaugaua

SEQ ID NO: 1147022 - RNA, 24 nt, Human
cacauggaacuuauauucauggag

SEQ ID NO: 1147023 - RNA, 21 nt, Human
cagaaucgaacccucucugcu

SEQ ID NO: 1147024 - RNA, 22 nt, Human
cauaagacuagcaaugucccag

SEQ ID NO: 1147025 - RNA, 25 nt, Human
caugggcggaguccagaaucgaacc

SEQ ID NO: 1147026 - RNA, 22 nt, Human
ccaucgcugucuucucccucug

SEQ ID NO: 1147027 - RNA, 31 nt, Human
cccccaguauccauccuaacauugcaucucc

SEQ ID NO: 1147028 - RNA, 18 nt, Human
cccgccuucgccuucccu

SEQ ID NO: 1147029 - RNA, 20 nt, Human
cccggcgccgggcucagccc

SEQ ID NO: 1147030 - RNA, 23 nt, Human
ccucccggcgccgggcucagccc

SEQ ID NO: 1147031 - RNA, 18 nt, Human
ccuggaguaccaggaagg

SEQ ID NO: 1147032 - RNA, 23 nt, Human
ccuuagcggcaagaaggagaugg

SEQ ID NO: 1147033 - RNA, 22 nt, Human
cgaacccucucugcuuccuaaa

SEQ ID NO: 1147034 - RNA, 19 nt, Human
cuccauuauccugcauccc

SEQ ID NO: 1147035 - RNA, 18 nt, Human
cuccucccggcgccgggc

SEQ ID NO: 1147036 - RNA, 25 nt, Human
gaacccacugcuagugcucccccag

SEQ ID NO: 1147037 - RNA, 22 nt, Human
gaacccucucugcuuccuaaag

SEQ ID NO: 1147038 - RNA, 21 nt, Human
gagaaaaaacaaaacagagaa

SEQ ID NO: 1147039 - RNA, 22 nt, Human
gagaaaaaacaaaacagagaaa

SEQ ID NO: 1147040 - RNA, 20 nt, Human
gagauggucaugauaaaauc

SEQ ID NO: 1147041 - RNA, 18 nt, Human
gccgggcucagcccgccu

SEQ ID NO: 1147042 - RNA, 18 nt, Human
ggagacagaugguaaaca

SEQ ID NO: 1147043 - RNA, 23 nt, Human
ggcaagaaggagauggucaugag

SEQ ID NO: 1147044 - RNA, 21 nt, Human
ggcaauaaggucugagaaaaa

SEQ ID NO: 1147045 - RNA, 18 nt, Human
uaagacuagcaauguccc

SEQ ID NO: 1147046 - RNA, 25 nt, Human
uaauuaaacaaaauccucucuccua

SEQ ID NO: 1147047 - RNA, 22 nt, Human
uaccaggaaggacaacucuuuc

SEQ ID NO: 1147048 - RNA, 21 nt, Human
uaggaaaacauaaacuaaaga

SEQ ID NO: 1147049 - RNA, 20 nt, Human
ucuccuaguagcauggaguu

SEQ ID NO: 1147050 - RNA, 21 nt, Human
ucuucucccucugucauaaga

SEQ ID NO: 1147051 - RNA, 23 nt, Human
ugagaaaaaacaaaacagagaaa

SEQ ID NO: 1147052 - RNA, 19 nt, Human
uggaacuuauauucaugga

SEQ ID NO: 1147053 - RNA, 23 nt, Human
uucagggcaauaaggucugagaa

SEQ ID NO: 1147054 - RNA, 22 nt, Human
uugcugaacccacugcuagugc

SEQ ID NO: 1147055 - RNA, 22 nt, Human
aaagugcuguccaggugucucc

SEQ ID NO: 1147056 - RNA, 20 nt, Human
accaggcgaggggggucaca

SEQ ID NO: 1147057 - RNA, 21 nt, Human
aggcgaggggggucacagggc

SEQ ID NO: 1147058 - RNA, 22 nt, Human
aggcgaggggggucacagggcc

SEQ ID NO: 1147059 - RNA, 21 nt, Human
agucuccuucagucugugaaa

SEQ ID NO: 1147060 - RNA, 19 nt, Human
cacccagggcucgcccagg

SEQ ID NO: 1147061 - RNA, 20 nt, Human
cagaguuccggauacccuuc

SEQ ID NO: 1147062 - RNA, 19 nt, Human
cagggcucgcccaggccgg

SEQ ID NO: 1147063 - RNA, 19 nt, Human
cagucugugaaaguuuguu

SEQ ID NO: 1147064 - RNA, 20 nt, Human
cauacggggcgccgugagcu

SEQ ID NO: 1147065 - RNA, 18 nt, Human
ccaggccauacggggcgc

SEQ ID NO: 1147066 - RNA, 19 nt, Human
ccaggcgaggggggucaca

SEQ ID NO: 1147067 - RNA, 18 nt, Human
ccccgcccucugcucaga

SEQ ID NO: 1147068 - RNA, 28 nt, Human
ccccgcccucugcucagaccccucuccc

SEQ ID NO: 1147069 - RNA, 23 nt, Human
ccccggagcugcggcaacccucc

SEQ ID NO: 1147070 - RNA, 24 nt, Human
cccgggaggcggucccgcguggag

SEQ ID NO: 1147071 - RNA, 20 nt, Human
cccgggcuggcugcgaaaac

SEQ ID NO: 1147072 - RNA, 19 nt, Human
cccucugcucagaccccuc

SEQ ID NO: 1147073 - RNA, 23 nt, Human
ccgcuuuccccgccccgggcugg

SEQ ID NO: 1147074 - RNA, 19 nt, Human
ccgggggccccggagcugc

SEQ ID NO: 1147075 - RNA, 24 nt, Human
cgauauuaacuuugaucacuuggu

SEQ ID NO: 1147076 - RNA, 19 nt, Human
cgcccaggccgggcugagg

SEQ ID NO: 1147077 - RNA, 24 nt, Human
cggacaaaagcagguuaccaaaga

SEQ ID NO: 1147078 - RNA, 23 nt, Human
cggagcugcggcaacccuccagg

SEQ ID NO: 1147079 - RNA, 18 nt, Human
cuaccauuuuucucuuug

SEQ ID NO: 1147080 - RNA, 26 nt, Human
cucagaccccucucccgggacgacca

SEQ ID NO: 1147081 - RNA, 18 nt, Human
cugcaccccgcccucugc

SEQ ID NO: 1147082 - RNA, 23 nt, Human
cugcaccccgcccucugcucaga

SEQ ID NO: 1147083 - RNA, 24 nt, Human
cuuaggauccccaggccauacggg

SEQ ID NO: 1147084 - RNA, 18 nt, Human
gagcugcggcaacccucc

SEQ ID NO: 1147085 - RNA, 22 nt, Human
gauaauagguuuuggggaggaa

SEQ ID NO: 1147086 - RNA, 22 nt, Human
gccccggagcugcggcaacccu

SEQ ID NO: 1147087 - RNA, 23 nt, Human
ggacaaaagcagguuaccaaaga

SEQ ID NO: 1147088 - RNA, 22 nt, Human
ggauacccuucauccagcuuuc

SEQ ID NO: 1147089 - RNA, 20 nt, Human
ggcugaggcgccgccacgcc

SEQ ID NO: 1147090 - RNA, 22 nt, Human
gggaagauguucucggacaaaa

SEQ ID NO: 1147091 - RNA, 20 nt, Human
uaacuuugaucacuugguua

SEQ ID NO: 1147092 - RNA, 20 nt, Human
uaagaguaaauaaaggugua

SEQ ID NO: 1147093 - RNA, 21 nt, Human
ucaguuugcauuuguccagug

SEQ ID NO: 1147094 - RNA, 21 nt, Human
uccagcuuucucuaaucuuag

SEQ ID NO: 1147095 - RNA, 18 nt, Human
uccaggggugagagggag

SEQ ID NO: 1147096 - RNA, 25 nt, Human
ucucccgggacgaccagugcgcccu

SEQ ID NO: 1147097 - RNA, 21 nt, Human
ucugugaaaguuuguuuccuu

SEQ ID NO: 1147098 - RNA, 23 nt, Human
ugaggcgccgccacgccgguacu

SEQ ID NO: 1147099 - RNA, 27 nt, Human
ugcauuuguccaguguuuucuauggau

SEQ ID NO: 1147100 - RNA, 18 nt, Human
uggcgauauuaacuuuga

SEQ ID NO: 1147101 - RNA, 21 nt, Human
ugggaagauguucucggacaa

SEQ ID NO: 1147102 - RNA, 21 nt, Human
uggggaggaauuccacagagg

SEQ ID NO: 1147103 - RNA, 21 nt, Human
uugcauuuguccaguguuuuc

SEQ ID NO: 1147104 - RNA, 23 nt, Human
uuuguccagcccauauucaaggg

SEQ ID NO: 1147105 - RNA, 24 nt, Human
uuuguccagcccauauucaagggg

SEQ ID NO: 1147106 - RNA, 19 nt, Human
uuuuuuuuuuuuuuuuuaa

SEQ ID NO: 1147107 - RNA, 23 nt, Human
aaaaacaaacaaaacaaaacaaa

SEQ ID NO: 1147108 - RNA, 18 nt, Human
aaaacaaacaaaacaaaa

SEQ ID NO: 1147109 - RNA, 24 nt, Human
aaaacaaacaaaacaaaacaaaaa

SEQ ID NO: 1147110 - RNA, 21 nt, Human
aaaagccuuucuaaguaaacc

SEQ ID NO: 1147111 - RNA, 19 nt, Human
aaacaaaacaaaacaaaaa

SEQ ID NO: 1147112 - RNA, 24 nt, Human
aaagccuuucuaaguaaaccaaag

SEQ ID NO: 1147113 - RNA, 19 nt, Human
aaugcggggggagggagag

SEQ ID NO: 1147114 - RNA, 24 nt, Human
acaaaacaaaacaaaaaacuuuca

SEQ ID NO: 1147115 - RNA, 25 nt, Human
acaaaacaaaacaaaaaacuuucaa

SEQ ID NO: 1147116 - RNA, 18 nt, Human
acaagaaaugcaacaugg

SEQ ID NO: 1147117 - RNA, 23 nt, Human
acccccaucucuuuaaaaacaaa

SEQ ID NO: 1147118 - RNA, 23 nt, Human
accucaagcaauccuccagccuc

SEQ ID NO: 1147119 - RNA, 19 nt, Human
accuuggaggcaagaagaa

SEQ ID NO: 1147120 - RNA, 18 nt, Human
acuaauuuugcugguuuu

SEQ ID NO: 1147121 - RNA, 21 nt, Human
acugaaccaccauguugguug

SEQ ID NO: 1147122 - RNA, 21 nt, Human
acugcacuccagccuggacaa

SEQ ID NO: 1147123 - RNA, 22 nt, Human
acugcacuccagccuggacaac

SEQ ID NO: 1147124 - RNA, 25 nt, Human
acugcacuccagccuggacaacgca

SEQ ID NO: 1147125 - RNA, 21 nt, Human
agaagcaccauuuauaguuca

SEQ ID NO: 1147126 - RNA, 21 nt, Human
agcaauccuccagccucagcc

SEQ ID NO: 1147127 - RNA, 23 nt, Human
agcacuaaaaagaguacgaacaa

SEQ ID NO: 1147128 - RNA, 23 nt, Human
agccucagccucccaaguagcug

SEQ ID NO: 1147129 - RNA, 18 nt, Human
aggaagaacccuucagua

SEQ ID NO: 1147130 - RNA, 19 nt, Human
aggauggcuugagaccagg

SEQ ID NO: 1147131 - RNA, 24 nt, Human
aggcaagaagaauggcucccagaa

SEQ ID NO: 1147132 - RNA, 20 nt, Human
aguaccuaacaacgcugcug

SEQ ID NO: 1147133 - RNA, 24 nt, Human
aucucuuuaaaaacaaacaaaaca

SEQ ID NO: 1147134 - RNA, 23 nt, Human
caaaacaaaacaaaaaacuuuca

SEQ ID NO: 1147135 - RNA, 25 nt, Human
caacgcaguaagacccccaucucuu

SEQ ID NO: 1147136 - RNA, 19 nt, Human
caagaaaugcaacauggac

SEQ ID NO: 1147137 - RNA, 19 nt, Human
caagaagaauggcucccag

SEQ ID NO: 1147138 - RNA, 22 nt, Human
caagaagaauggcucccagaac

SEQ ID NO: 1147139 - RNA, 18 nt, Human
cacugcacuccagccugg

SEQ ID NO: 1147140 - RNA, 19 nt, Human
cacugcacuccagccugga

SEQ ID NO: 1147141 - RNA, 21 nt, Human
cacugcacuccagccuggaca

SEQ ID NO: 1147142 - RNA, 25 nt, Human
cacugcacuccagccuggacaacgc

SEQ ID NO: 1147143 - RNA, 21 nt, Human
cagcacuaaaaagaguacgaa

SEQ ID NO: 1147144 - RNA, 20 nt, Human
cagcauaaguuaaaagccuu

SEQ ID NO: 1147145 - RNA, 25 nt, Human
cagccucagccucccaaguagcuga

SEQ ID NO: 1147146 - RNA, 22 nt, Human
cagcuuuuugguuuaaaaugau

SEQ ID NO: 1147147 - RNA, 24 nt, Human
caguaagacccccaucucuuuaaa

SEQ ID NO: 1147148 - RNA, 21 nt, Human
caguaccuaacaacgcugcug

SEQ ID NO: 1147149 - RNA, 21 nt, Human
caucuagaaauauuguugagc

SEQ ID NO: 1147150 - RNA, 19 nt, Human
ccacugcacuccagccugg

SEQ ID NO: 1147151 - RNA, 19 nt, Human
ccacugcacuccagccugg

SEQ ID NO: 1147152 - RNA, 21 nt, Human
ccacugcacuccagccuggac

SEQ ID NO: 1147153 - RNA, 22 nt, Human
ccacugcacuccagccuggaca

SEQ ID NO: 1147154 - RNA, 26 nt, Human
ccaugagucucuugaauuugagaucu

SEQ ID NO: 1147155 - RNA, 21 nt, Human
ccccaaacaugcuaaaaugcu

SEQ ID NO: 1147156 - RNA, 26 nt, Human
ccuccagccucagccucccaaguagc

SEQ ID NO: 1147157 - RNA, 19 nt, Human
cuagaaauauuguugagca

SEQ ID NO: 1147158 - RNA, 24 nt, Human
cucaacuguaauguccuugaggau

SEQ ID NO: 1147159 - RNA, 22 nt, Human
cucaugcugcagugccuuggag

SEQ ID NO: 1147160 - RNA, 24 nt, Human
cuccagccucagccucccaaguag

SEQ ID NO: 1147161 - RNA, 25 nt, Human
cuccagccucagccucccaaguagc

SEQ ID NO: 1147162 - RNA, 27 nt, Human
cuucacuuuuucucaucgucacugaac

SEQ ID NO: 1147163 - RNA, 31 nt, Human
cuugaccucaagcaauccuccagccucagcc

SEQ ID NO: 1147164 - RNA, 22 nt, Human
cuuuaugugguaauauauugcu

SEQ ID NO: 1147165 - RNA, 22 nt, Human
gagcaggaaaggugguauuucu

SEQ ID NO: 1147166 - RNA, 18 nt, Human
gagggcccaaacuauauu

SEQ ID NO: 1147167 - RNA, 24 nt, Human
gaugggagccuucacuuuggagug

SEQ ID NO: 1147168 - RNA, 22 nt, Human
gcagcaaaaugcggggggaggg

SEQ ID NO: 1147169 - RNA, 19 nt, Human
gccacugcacuccagccug

SEQ ID NO: 1147170 - RNA, 23 nt, Human
gcccacacaguaagcaaauaucu

SEQ ID NO: 1147171 - RNA, 20 nt, Human
gccuggacaacgcaguaaga

SEQ ID NO: 1147172 - RNA, 21 nt, Human
ggcuugagaccaggaaguucu

SEQ ID NO: 1147173 - RNA, 18 nt, Human
gggggagggagagaaacu

SEQ ID NO: 1147174 - RNA, 21 nt, Human
ggucacacauuuuacuguggu

SEQ ID NO: 1147175 - RNA, 20 nt, Human
ggugguauuucuccagucuu

SEQ ID NO: 1147176 - RNA, 21 nt, Human
guaacaguagggaggaagaac

SEQ ID NO: 1147177 - RNA, 18 nt, Human
guauaauccuuguugucc

SEQ ID NO: 1147178 - RNA, 20 nt, Human
uaaaaagaguacgaacaaau

SEQ ID NO: 1147179 - RNA, 19 nt, Human
uaaaaaggacagaagagug

SEQ ID NO: 1147180 - RNA, 21 nt, Human
uaaaaugauugccaaugacua

SEQ ID NO: 1147181 - RNA, 21 nt, Human
uaaaguaaugcuugcaaagaa

SEQ ID NO: 1147182 - RNA, 18 nt, Human
uaagacccccaucucuuu

SEQ ID NO: 1147183 - RNA, 23 nt, Human
uaagcaaauaucuguguguagga

SEQ ID NO: 1147184 - RNA, 19 nt, Human
uaucagaaaaugagaagca

SEQ ID NO: 1147185 - RNA, 22 nt, Human
ucagaaaaugagaagcaccauu

SEQ ID NO: 1147186 - RNA, 19 nt, Human
ucagcauaaguuaaaagcc

SEQ ID NO: 1147187 - RNA, 26 nt, Human
ucagccucccaaguagcugaggcuag

SEQ ID NO: 1147188 - RNA, 24 nt, Human
ucaucuagaaauauuguugagcau

SEQ ID NO: 1147189 - RNA, 24 nt, Human
ucccaaaccuuggaggcaagaaga

SEQ ID NO: 1147190 - RNA, 21 nt, Human
ucccagaacaauccuuuucca

SEQ ID NO: 1147191 - RNA, 19 nt, Human
uccuccagccucagccucc

SEQ ID NO: 1147192 - RNA, 18 nt, Human
uccuuguuguccaugagu

SEQ ID NO: 1147193 - RNA, 22 nt, Human
uccuuguuguccaugagucucu

SEQ ID NO: 1147194 - RNA, 24 nt, Human
ucggcccacacaguaagcaaauau

SEQ ID NO: 1147195 - RNA, 24 nt, Human
ucuccagucuuuguagaugaaggu

SEQ ID NO: 1147196 - RNA, 26 nt, Human
ugaaggucccaugacguuauaacccc

SEQ ID NO: 1147197 - RNA, 23 nt, Human
ugaaugacaaauguuauccagca

SEQ ID NO: 1147198 - RNA, 22 nt, Human
ugaauuugagaucuuuccuuuu

SEQ ID NO: 1147199 - RNA, 20 nt, Human
ugaccucaagcaauccucca

SEQ ID NO: 1147200 - RNA, 25 nt, Human
ugaccucaagcaauccuccagccuc

SEQ ID NO: 1147201 - RNA, 19 nt, Human
ugacuagcagcuucaaugg

SEQ ID NO: 1147202 - RNA, 24 nt, Human
ugcacauucagcuguuagcugugc

SEQ ID NO: 1147203 - RNA, 24 nt, Human
ugcagcacuaaaaagaguacgaac

SEQ ID NO: 1147204 - RNA, 19 nt, Human
uggagugguuuuuguaacu

SEQ ID NO: 1147205 - RNA, 19 nt, Human
uggcucccagaacaauccu

SEQ ID NO: 1147206 - RNA, 20 nt, Human
uuagcugugcagcacuaaaa

SEQ ID NO: 1147207 - RNA, 22 nt, Human
uuagcugugcagcacuaaaaag

SEQ ID NO: 1147208 - RNA, 21 nt, Human
uugaccucaagcaauccucca

SEQ ID NO: 1147209 - RNA, 21 nt, Human
uugcacauucagcuguuagcu

SEQ ID NO: 1147210 - RNA, 21 nt, Human
uuguccaugagucucuugaau

SEQ ID NO: 1147211 - RNA, 25 nt, Human
uuuaauacauuuauuuagcaagaga

SEQ ID NO: 1147212 - RNA, 23 nt, Human
uuuggagugguuuuuguaacucu

SEQ ID NO: 1147213 - RNA, 24 nt, Human
uuuuuaguaagcugcccuggagau

SEQ ID NO: 1147214 - RNA, 24 nt, Human
aaagugcugggauuacaggcguga

SEQ ID NO: 1147215 - RNA, 24 nt, Human
aaccaaagggggaaacauguucuc

SEQ ID NO: 1147216 - RNA, 21 nt, Human
aaccccugaccucagugaucc

SEQ ID NO: 1147217 - RNA, 22 nt, Human
aagauauucuguaccugcuugu

SEQ ID NO: 1147218 - RNA, 19 nt, Human
aagaugcuuccuccccagu

SEQ ID NO: 1147219 - RNA, 19 nt, Human
aagugcugggauuacaggc

SEQ ID NO: 1147220 - RNA, 19 nt, Human
aagugcugggauuacaggc

SEQ ID NO: 1147221 - RNA, 26 nt, Human
aagugcugggauuacaggcgugagcc

SEQ ID NO: 1147222 - RNA, 18 nt, Human
aaugaccuugcccaagaa

SEQ ID NO: 1147223 - RNA, 20 nt, Human
acagauuucacagaugaacc

SEQ ID NO: 1147224 - RNA, 19 nt, Human
accaguguccucuaguuuu

SEQ ID NO: 1147225 - RNA, 23 nt, Human
accaugcccggcuaauuuuugua

SEQ ID NO: 1147226 - RNA, 24 nt, Human
accauguuggccaggcuggucuug

SEQ ID NO: 1147227 - RNA, 18 nt, Human
accgcacccagccuggug

SEQ ID NO: 1147228 - RNA, 22 nt, Human
accucagugauccaccugccuc

SEQ ID NO: 1147229 - RNA, 24 nt, Human
accucagugauccaccugccucgg

SEQ ID NO: 1147230 - RNA, 20 nt, Human
accugcucaggaaacuggag

SEQ ID NO: 1147231 - RNA, 18 nt, Human
acgggguuucaccauguu

SEQ ID NO: 1147232 - RNA, 23 nt, Human
acgggguuucaccauguuggcca

SEQ ID NO: 1147233 - RNA, 24 nt, Human
acgggguuucaccauguuggccag

SEQ ID NO: 1147234 - RNA, 22 nt, Human
acuauagccuccaccgccuggg

SEQ ID NO: 1147235 - RNA, 18 nt, Human
agacagagucuugcugug

SEQ ID NO: 1147236 - RNA, 19 nt, Human
agacugcaguuucccauug

SEQ ID NO: 1147237 - RNA, 18 nt, Human
agccaccgcacccagccu

SEQ ID NO: 1147238 - RNA, 19 nt, Human
aggaaacuggaggcugaac

SEQ ID NO: 1147239 - RNA, 25 nt, Human
aggcuggagugcaguggcguaaucu

SEQ ID NO: 1147240 - RNA, 18 nt, Human
agggggaaacauguucuc

SEQ ID NO: 1147241 - RNA, 21 nt, Human
aguagcugggguuacaggugc

SEQ ID NO: 1147242 - RNA, 23 nt, Human
agugauccaccugccucggccuc

SEQ ID NO: 1147243 - RNA, 19 nt, Human
agugcaguggcguaaucuc

SEQ ID NO: 1147244 - RNA, 21 nt, Human
agugcaguggcguaaucucag

SEQ ID NO: 1147245 - RNA, 23 nt, Human
agugcaguggcguaaucucagcu

SEQ ID NO: 1147246 - RNA, 24 nt, Human
agugcaguggcguaaucucagcuu

SEQ ID NO: 1147247 - RNA, 18 nt, Human
auggagccagcuuucccu

SEQ ID NO: 1147248 - RNA, 24 nt, Human
auuuuuguaucuuuaguagagacg

SEQ ID NO: 1147249 - RNA, 24 nt, Human
caaagugcugggauuacaggcgug

SEQ ID NO: 1147250 - RNA, 21 nt, Human
caaccuccugaguagcugggg

SEQ ID NO: 1147251 - RNA, 22 nt, Human
caagugauucuccugccucaac

SEQ ID NO: 1147252 - RNA, 22 nt, Human
cacacaggaaaggaaaggaauu

SEQ ID NO: 1147253 - RNA, 21 nt, Human
caccauguuggccaggcuggu

SEQ ID NO: 1147254 - RNA, 24 nt, Human
caccauguuggccaggcuggucuu

SEQ ID NO: 1147255 - RNA, 27 nt, Human
caccauguuggccaggcuggucuugaa

SEQ ID NO: 1147256 - RNA, 20 nt, Human
caccgcacccagccuggugu

SEQ ID NO: 1147257 - RNA, 23 nt, Human
caccgcacccagccugguguaca

SEQ ID NO: 1147258 - RNA, 23 nt, Human
caccugccucggccucccaaagu

SEQ ID NO: 1147259 - RNA, 24 nt, Human
cagagucuugcuguguugcccagg

SEQ ID NO: 1147260 - RNA, 24 nt, Human
cauguuggccaggcuggucuugaa

SEQ ID NO: 1147261 - RNA, 20 nt, Human
ccaaagugcugggauuacag

SEQ ID NO: 1147262 - RNA, 22 nt, Human
ccaaagugcugggauuacaggc

SEQ ID NO: 1147263 - RNA, 22 nt, Human
ccaaagugcugggauuacaggc

SEQ ID NO: 1147264 - RNA, 24 nt, Human
ccaaagugcugggauuacaggcgu

SEQ ID NO: 1147265 - RNA, 22 nt, Human
cccaggcuggagugcaguggcg

SEQ ID NO: 1147266 - RNA, 21 nt, Human
ccccuucuggcuacaaagacu

SEQ ID NO: 1147267 - RNA, 24 nt, Human
ccgccuggguucaagugauucucc

SEQ ID NO: 1147268 - RNA, 18 nt, Human
ccuccaccgccuggguuc

SEQ ID NO: 1147269 - RNA, 22 nt, Human
ccucugagacugcaauuuccca

SEQ ID NO: 1147270 - RNA, 24 nt, Human
ccucugagacugcaguuucccauu

SEQ ID NO: 1147271 - RNA, 20 nt, Human
ccugaccucagugauccacc

SEQ ID NO: 1147272 - RNA, 22 nt, Human
ccugaccucagugauccaccug

SEQ ID NO: 1147273 - RNA, 22 nt, Human
ccugaguagcugggguuacagg

SEQ ID NO: 1147274 - RNA, 23 nt, Human
ccugaguagcugggguuacaggu

SEQ ID NO: 1147275 - RNA, 23 nt, Human
ccugccucaaccuccugaguagc

SEQ ID NO: 1147276 - RNA, 20 nt, Human
ccuggguucaagugauucuc

SEQ ID NO: 1147277 - RNA, 23 nt, Human
ccuggguucaagugauucuccuc

SEQ ID NO: 1147278 - RNA, 23 nt, Human
ccuggguucaagugauucuccug

SEQ ID NO: 1147279 - RNA, 20 nt, Human
ccuuccucugagacugcagu

SEQ ID NO: 1147280 - RNA, 19 nt, Human
cgccuggguucaagugauu

SEQ ID NO: 1147281 - RNA, 25 nt, Human
cucagcuuacuauagccuccaccgc

SEQ ID NO: 1147282 - RNA, 18 nt, Human
cuccaagaacaaggaaaa

SEQ ID NO: 1147283 - RNA, 23 nt, Human
cugaguagcugggguuacaggug

SEQ ID NO: 1147284 - RNA, 23 nt, Human
cugccucaaccuccugaguagcu

SEQ ID NO: 1147285 - RNA, 23 nt, Human
cugccucggccucccaaagugcu

SEQ ID NO: 1147286 - RNA, 20 nt, Human
cuguguugcccaggcuggag

SEQ ID NO: 1147287 - RNA, 21 nt, Human
cuguguugcccaggcuggagu

SEQ ID NO: 1147288 - RNA, 22 nt, Human
cuugcuguguugcccaggcugg

SEQ ID NO: 1147289 - RNA, 23 nt, Human
gaccucagugauccaccugccuc

SEQ ID NO: 1147290 - RNA, 24 nt, Human
gagacgggguuucaccauguuggc

SEQ ID NO: 1147291 - RNA, 18 nt, Human
gauuacaggcgugagcca

SEQ ID NO: 1147292 - RNA, 22 nt, Human
gauuacaggcgugagccaccgc

SEQ ID NO: 1147293 - RNA, 23 nt, Human
gauuacaggcgugagccaccgca

SEQ ID NO: 1147294 - RNA, 25 nt, Human
gcaauguuucuuugcagcucuguua

SEQ ID NO: 1147295 - RNA, 24 nt, Human
gcccaggcuggagugcaguggcgu

SEQ ID NO: 1147296 - RNA, 18 nt, Human
gccuuccucugagacugc

SEQ ID NO: 1147297 - RNA, 18 nt, Human
gccuuccucugagacugc

SEQ ID NO: 1147298 - RNA, 19 nt, Human
gcuggagugcaguggcgua

SEQ ID NO: 1147299 - RNA, 23 nt, Human
gcuggucuugaaccccugaccuc

SEQ ID NO: 1147300 - RNA, 19 nt, Human
ggccaggcagcagcugcuc

SEQ ID NO: 1147301 - RNA, 24 nt, Human
ggcuggucuugaaccccugaccuc

SEQ ID NO: 1147302 - RNA, 22 nt, Human
gggaaacauguucuccaagaac

SEQ ID NO: 1147303 - RNA, 23 nt, Human
gggguuucaccauguuggccagg

SEQ ID NO: 1147304 - RNA, 22 nt, Human
ggguuucaccauguuggccagg

SEQ ID NO: 1147305 - RNA, 19 nt, Human
ggucuugaaccccugaccu

SEQ ID NO: 1147306 - RNA, 18 nt, Human
guacacacaggaaaggaa

SEQ ID NO: 1147307 - RNA, 23 nt, Human
guagagacgggguuucaccaugu

SEQ ID NO: 1147308 - RNA, 24 nt, Human
gucuugcuguguugcccaggcugg

SEQ ID NO: 1147309 - RNA, 24 nt, Human
gugauccaccugccucggccuccc

SEQ ID NO: 1147310 - RNA, 24 nt, Human
gugauucuccugccucaaccuccu

SEQ ID NO: 1147311 - RNA, 21 nt, Human
gugugugugugugugugugug

SEQ ID NO: 1147312 - RNA, 21 nt, Human
gugugugugugugugugugug

SEQ ID NO: 1147313 - RNA, 21 nt, Human
gugugugugugugugugugug

SEQ ID NO: 1147314 - RNA, 21 nt, Human
gugugugugugugugugugug

SEQ ID NO: 1147315 - RNA, 21 nt, Human
guuacaggugccugcuaccau

SEQ ID NO: 1147316 - RNA, 20 nt, Human
uaagauauucuguaccugcu

SEQ ID NO: 1147317 - RNA, 24 nt, Human
uaauuuuuguaucuuuaguagaga

SEQ ID NO: 1147318 - RNA, 24 nt, Human
uacaggcgugagccaccgcaccca

SEQ ID NO: 1147319 - RNA, 22 nt, Human
uagagacgggguuucaccaugu

SEQ ID NO: 1147320 - RNA, 20 nt, Human
uaggagaggcuaaaagggcu

SEQ ID NO: 1147321 - RNA, 24 nt, Human
uaguagagacgggguuucaccaug

SEQ ID NO: 1147322 - RNA, 26 nt, Human
uaguagagacgggguuucaccauguu

SEQ ID NO: 1147323 - RNA, 20 nt, Human
ucaaccuccugaguagcugg

SEQ ID NO: 1147324 - RNA, 19 nt, Human
ucaagugauucuccugccu

SEQ ID NO: 1147325 - RNA, 23 nt, Human
ucagugauccaccugccucggcc

SEQ ID NO: 1147326 - RNA, 22 nt, Human
uccaagaacaaggaaaaccuga

SEQ ID NO: 1147327 - RNA, 20 nt, Human
uccaggguaagagacagaga

SEQ ID NO: 1147328 - RNA, 24 nt, Human
ucccaaagugcugggauuacaggc

SEQ ID NO: 1147329 - RNA, 24 nt, Human
uccugaguagcugggguuacaggu

SEQ ID NO: 1147330 - RNA, 18 nt, Human
ucggccucccaaagugcu

SEQ ID NO: 1147331 - RNA, 19 nt, Human
ucucauucuggauaaaggu

SEQ ID NO: 1147332 - RNA, 24 nt, Human
ucuccugccucaaccuccugagua

SEQ ID NO: 1147333 - RNA, 24 nt, Human
ucugugugugugugugugugugug

SEQ ID NO: 1147334 - RNA, 23 nt, Human
ucuugcuguguugcccaggcugg

SEQ ID NO: 1147335 - RNA, 24 nt, Human
ucuugcuguguugcccaggcugga

SEQ ID NO: 1147336 - RNA, 24 nt, Human
ucuuuaguagagacgggguuucac

SEQ ID NO: 1147337 - RNA, 23 nt, Human
ugaccucagugauccaccugccu

SEQ ID NO: 1147338 - RNA, 18 nt, Human
ugcccaggcuggagugca

SEQ ID NO: 1147339 - RNA, 21 nt, Human
ugcccaggcuggagugcagug

SEQ ID NO: 1147340 - RNA, 22 nt, Human
ugcccaggcuggagugcagugg

SEQ ID NO: 1147341 - RNA, 24 nt, Human
ugcccggcuaauuuuuguaucuuu

SEQ ID NO: 1147342 - RNA, 24 nt, Human
ugccucaaccuccugaguagcugg

SEQ ID NO: 1147343 - RNA, 21 nt, Human
ugccucggccucccaaagugc

SEQ ID NO: 1147344 - RNA, 24 nt, Human
ugccucggccucccaaagugcugg

SEQ ID NO: 1147345 - RNA, 21 nt, Human
ugccucugugugugugugugu

SEQ ID NO: 1147346 - RNA, 24 nt, Human
ugcugggauuacaggcgugagcca

SEQ ID NO: 1147347 - RNA, 26 nt, Human
uggagugcaguggcguaaggcucuag

SEQ ID NO: 1147348 - RNA, 23 nt, Human
uggagugcaguggcguaaucuca

SEQ ID NO: 1147349 - RNA, 24 nt, Human
uggagugcaguggcguaaucucag

SEQ ID NO: 1147350 - RNA, 18 nt, Human
uggccaggcagcagcugc

SEQ ID NO: 1147351 - RNA, 19 nt, Human
uggccaggcagcagcugcu

SEQ ID NO: 1147352 - RNA, 24 nt, Human
uggccaggcuggucuugaaccccu

SEQ ID NO: 1147353 - RNA, 24 nt, Human
uggcguaaucucagcuuacuauag

SEQ ID NO: 1147354 - RNA, 18 nt, Human
ugggauuacaggcgugag

SEQ ID NO: 1147355 - RNA, 19 nt, Human
ugggauuacaggcgugagc

SEQ ID NO: 1147356 - RNA, 21 nt, Human
ugggauuacaggcgugagcca

SEQ ID NO: 1147357 - RNA, 22 nt, Human
ugggauuacaggcgugagccac

SEQ ID NO: 1147358 - RNA, 23 nt, Human
ugggauuacaggcgugagccacc

SEQ ID NO: 1147359 - RNA, 24 nt, Human
ugggauuacaggcgugagccaccg

SEQ ID NO: 1147360 - RNA, 22 nt, Human
ugggguuacaggugccugcuac

SEQ ID NO: 1147361 - RNA, 23 nt, Human
uggguucaagugauucuccugcc

SEQ ID NO: 1147362 - RNA, 23 nt, Human
uguguguguaucugcaugucuau

SEQ ID NO: 1147363 - RNA, 21 nt, Human
uguguguguguaucugcaugu

SEQ ID NO: 1147364 - RNA, 22 nt, Human
uguguguguguguguguaucug

SEQ ID NO: 1147365 - RNA, 18 nt, Human
ugugugugugugugugug

SEQ ID NO: 1147366 - RNA, 18 nt, Human
ugugugugugugugugug

SEQ ID NO: 1147367 - RNA, 18 nt, Human
ugugugugugugugugug

SEQ ID NO: 1147368 - RNA, 18 nt, Human
ugugugugugugugugug

SEQ ID NO: 1147369 - RNA, 18 nt, Human
ugugugugugugugugug

SEQ ID NO: 1147370 - RNA, 18 nt, Human
ugugugugugugugugug

SEQ ID NO: 1147371 - RNA, 18 nt, Human
ugugugugugugugugug

SEQ ID NO: 1147372 - RNA, 18 nt, Human
ugugugugugugugugug

SEQ ID NO: 1147373 - RNA, 18 nt, Human
ugugugugugugugugug

SEQ ID NO: 1147374 - RNA, 18 nt, Human
ugugugugugugugugug

SEQ ID NO: 1147375 - RNA, 18 nt, Human
ugugugugugugugugug

SEQ ID NO: 1147376 - RNA, 18 nt, Human
ugugugugugugugugug

SEQ ID NO: 1147377 - RNA, 18 nt, Human
ugugugugugugugugug

SEQ ID NO: 1147378 - RNA, 18 nt, Human
ugugugugugugugugug

SEQ ID NO: 1147379 - RNA, 18 nt, Human
ugugugugugugugugug

SEQ ID NO: 1147380 - RNA, 18 nt, Human
ugugugugugugugugug

SEQ ID NO: 1147381 - RNA, 18 nt, Human
ugugugugugugugugug

SEQ ID NO: 1147382 - RNA, 18 nt, Human
ugugugugugugugugug

SEQ ID NO: 1147383 - RNA, 18 nt, Human
ugugugugugugugugug

SEQ ID NO: 1147384 - RNA, 20 nt, Human
ugugugugugugugugugug

SEQ ID NO: 1147385 - RNA, 21 nt, Human
ugugugugugugugugugugu

SEQ ID NO: 1147386 - RNA, 21 nt, Human
ugugugugugugugugugugu

SEQ ID NO: 1147387 - RNA, 21 nt, Human
ugugugugugugugugugugu

SEQ ID NO: 1147388 - RNA, 21 nt, Human
ugugugugugugugugugugu

SEQ ID NO: 1147389 - RNA, 21 nt, Human
ugugugugugugugugugugu

SEQ ID NO: 1147390 - RNA, 21 nt, Human
ugugugugugugugugugugu

SEQ ID NO: 1147391 - RNA, 21 nt, Human
ugugugugugugugugugugu

SEQ ID NO: 1147392 - RNA, 21 nt, Human
ugugugugugugugugugugu

SEQ ID NO: 1147393 - RNA, 21 nt, Human
ugugugugugugugugugugu

SEQ ID NO: 1147394 - RNA, 21 nt, Human
ugugugugugugugugugugu

SEQ ID NO: 1147395 - RNA, 21 nt, Human
ugugugugugugugugugugu

SEQ ID NO: 1147396 - RNA, 21 nt, Human
ugugugugugugugugugugu

SEQ ID NO: 1147397 - RNA, 21 nt, Human
ugugugugugugugugugugu

SEQ ID NO: 1147398 - RNA, 21 nt, Human
ugugugugugugugugugugu

SEQ ID NO: 1147399 - RNA, 21 nt, Human
ugugugugugugugugugugu

SEQ ID NO: 1147400 - RNA, 21 nt, Human
ugugugugugugugugugugu

SEQ ID NO: 1147401 - RNA, 21 nt, Human
ugugugugugugugugugugu

SEQ ID NO: 1147402 - RNA, 21 nt, Human
ugugugugugugugugugugu

SEQ ID NO: 1147403 - RNA, 21 nt, Human
ugugugugugugugugugugu

SEQ ID NO: 1147404 - RNA, 21 nt, Human
ugugugugugugugugugugu

SEQ ID NO: 1147405 - RNA, 21 nt, Human
ugugugugugugugugugugu

SEQ ID NO: 1147406 - RNA, 21 nt, Human
ugugugugugugugugugugu

SEQ ID NO: 1147407 - RNA, 21 nt, Human
ugugugugugugugugugugu

SEQ ID NO: 1147408 - RNA, 21 nt, Human
ugugugugugugugugugugu

SEQ ID NO: 1147409 - RNA, 21 nt, Human
ugugugugugugugugugugu

SEQ ID NO: 1147410 - RNA, 21 nt, Human
ugugugugugugugugugugu

SEQ ID NO: 1147411 - RNA, 21 nt, Human
ugugugugugugugugugugu

SEQ ID NO: 1147412 - RNA, 21 nt, Human
ugugugugugugugugugugu

SEQ ID NO: 1147413 - RNA, 21 nt, Human
ugugugugugugugugugugu

SEQ ID NO: 1147414 - RNA, 21 nt, Human
ugugugugugugugugugugu

SEQ ID NO: 1147415 - RNA, 21 nt, Human
ugugugugugugugugugugu

SEQ ID NO: 1147416 - RNA, 21 nt, Human
ugugugugugugugugugugu

SEQ ID NO: 1147417 - RNA, 21 nt, Human
ugugugugugugugugugugu

SEQ ID NO: 1147418 - RNA, 21 nt, Human
ugugugugugugugugugugu

SEQ ID NO: 1147419 - RNA, 22 nt, Human
ugugugugugugugugugugua

SEQ ID NO: 1147420 - RNA, 22 nt, Human
ugugugugugugugugugugug

SEQ ID NO: 1147421 - RNA, 22 nt, Human
ugugugugugugugugugugug

SEQ ID NO: 1147422 - RNA, 22 nt, Human
ugugugugugugugugugugug

SEQ ID NO: 1147423 - RNA, 22 nt, Human
ugugugugugugugugugugug

SEQ ID NO: 1147424 - RNA, 22 nt, Human
ugugugugugugugugugugug

SEQ ID NO: 1147425 - RNA, 22 nt, Human
ugugugugugugugugugugug

SEQ ID NO: 1147426 - RNA, 22 nt, Human
ugugugugugugugugugugug

SEQ ID NO: 1147427 - RNA, 22 nt, Human
ugugugugugugugugugugug

SEQ ID NO: 1147428 - RNA, 22 nt, Human
ugugugugugugugugugugug

SEQ ID NO: 1147429 - RNA, 22 nt, Human
ugugugugugugugugugugug

SEQ ID NO: 1147430 - RNA, 22 nt, Human
ugugugugugugugugugugug

SEQ ID NO: 1147431 - RNA, 22 nt, Human
ugugugugugugugugugugug

SEQ ID NO: 1147432 - RNA, 18 nt, Human
uguguugcccaggcugga

SEQ ID NO: 1147433 - RNA, 22 nt, Human
uguguugcccaggcuggagugc

SEQ ID NO: 1147434 - RNA, 24 nt, Human
uguguugcccaggcuggagugcag

SEQ ID NO: 1147435 - RNA, 24 nt, Human
uuacuauagccuccaccgccuggg

SEQ ID NO: 1147436 - RNA, 18 nt, Human
uuaguagagacgggguuu

SEQ ID NO: 1147437 - RNA, 22 nt, Human
uuaguagagacgggguuucacc

SEQ ID NO: 1147438 - RNA, 24 nt, Human
uuaguagagacgggguuucaccau

SEQ ID NO: 1147439 - RNA, 21 nt, Human
uucaagugauucuccugccuc

SEQ ID NO: 1147440 - RNA, 24 nt, Human
uucaagugauucuccugccucaac

SEQ ID NO: 1147441 - RNA, 24 nt, Human
uugcccaggcuggagugcaguggc

SEQ ID NO: 1147442 - RNA, 25 nt, Human
uuguuacagauuucacagaugaacc

SEQ ID NO: 1147443 - RNA, 24 nt, Human
uuuaugugucuguuuuucugugug

SEQ ID NO: 1147444 - RNA, 24 nt, Human
uuucaccauguuggccaggcuggu

SEQ ID NO: 1147445 - RNA, 20 nt, Human
uuuuuguaucuuuaguagag

SEQ ID NO: 1147446 - RNA, 23 nt, Human
aaaagaagaaagcucaacaucaa

SEQ ID NO: 1147447 - RNA, 20 nt, Human
aagaaagcucaacaucaaaa

SEQ ID NO: 1147448 - RNA, 19 nt, Human
acacaugcuuuuuccuggu

SEQ ID NO: 1147449 - RNA, 27 nt, Human
acuucagugcaguuguaccaaaaacag

SEQ ID NO: 1147450 - RNA, 23 nt, Human
aggcaaccggagaccgguuccag

SEQ ID NO: 1147451 - RNA, 21 nt, Human
caacaucaaaaauaacacuuc

SEQ ID NO: 1147452 - RNA, 21 nt, Human
caggaacacaugcuuuuuccu

SEQ ID NO: 1147453 - RNA, 18 nt, Human
cccacuccaucacugugc

SEQ ID NO: 1147454 - RNA, 23 nt, Human
cuuuuguucuuucucugcuucug

SEQ ID NO: 1147455 - RNA, 19 nt, Human
gaauucuccagcagucuuc

SEQ ID NO: 1147456 - RNA, 22 nt, Human
gacagauuaauuuuauuuugga

SEQ ID NO: 1147457 - RNA, 25 nt, Human
gagaacacaguaaaggcaaucaaug

SEQ ID NO: 1147458 - RNA, 20 nt, Human
guaaaaugugcuacaaagcc

SEQ ID NO: 1147459 - RNA, 19 nt, Human
uaaaagaagaaagcucaac

SEQ ID NO: 1147460 - RNA, 19 nt, Human
uaaaaugugcuacaaagcc

SEQ ID NO: 1147461 - RNA, 24 nt, Human
uaacucuuuggaaaucugccuccc

SEQ ID NO: 1147462 - RNA, 23 nt, Human
ucaaaaauaacacuucagugcag

SEQ ID NO: 1147463 - RNA, 19 nt, Human
ucgucugcucccagagaau

SEQ ID NO: 1147464 - RNA, 22 nt, Human
ugagaacacaguaaaggcaauc

SEQ ID NO: 1147465 - RNA, 22 nt, Human
ugagcagguaucugcagcuaac

SEQ ID NO: 1147466 - RNA, 21 nt, Human
uggaaaucugccucccacucc

SEQ ID NO: 1147467 - RNA, 22 nt, Human
uuggaaaucugccucccacucc

SEQ ID NO: 1147468 - RNA, 22 nt, Human
uuuggaaaucugccucccacuc

SEQ ID NO: 1147469 - RNA, 18 nt, Human
aagagagagagaaagagg

SEQ ID NO: 1147470 - RNA, 21 nt, Human
aaucauaguuccagcgauuua

SEQ ID NO: 1147471 - RNA, 20 nt, Human
agaaagaggaaacaucuguu

SEQ ID NO: 1147472 - RNA, 23 nt, Human
augcggugcucuacaucaauauu

SEQ ID NO: 1147473 - RNA, 19 nt, Human
caccugagcucagaagaaa

SEQ ID NO: 1147474 - RNA, 24 nt, Human
cagacaccugagcucagaagaaac

SEQ ID NO: 1147475 - RNA, 22 nt, Human
uaaaauagccagacaccugagc

SEQ ID NO: 1147476 - RNA, 21 nt, Human
ucauaguuccagcgauuuaua

SEQ ID NO: 1147477 - RNA, 22 nt, Human
uccuacaaauacaugcggugcu

SEQ ID NO: 1147478 - RNA, 24 nt, Human
ugaaaaauaauucuaaugagaagc

SEQ ID NO: 1147479 - RNA, 21 nt, Human
ugcggugcucuacaucaauau

SEQ ID NO: 1147480 - RNA, 26 nt, Human
uguggaauaaaaucauuacaaacuga

SEQ ID NO: 1147481 - RNA, 23 nt, Human
aaaaagcaaucaugaaaaauaau

SEQ ID NO: 1147482 - RNA, 20 nt, Human
aaacaaacaaacaaaaagca

SEQ ID NO: 1147483 - RNA, 24 nt, Human
aaacaaacaaacaaacaaaaagca

SEQ ID NO: 1147484 - RNA, 21 nt, Human
aaacaaaucuacacuaacuaa

SEQ ID NO: 1147485 - RNA, 19 nt, Human
aaagacccaaccuacuauu

SEQ ID NO: 1147486 - RNA, 20 nt, Human
aaagaguauacucuucugcc

SEQ ID NO: 1147487 - RNA, 20 nt, Human
aaaggcaaagaacuuuccuu

SEQ ID NO: 1147488 - RNA, 22 nt, Human
aaagucccuucuacauuuaccu

SEQ ID NO: 1147489 - RNA, 22 nt, Human
aacaaaaaugacauuaaaaaau

SEQ ID NO: 1147490 - RNA, 19 nt, Human
aacauggugaaaccccguc

SEQ ID NO: 1147491 - RNA, 20 nt, Human
aacauggugaaaccccgucu

SEQ ID NO: 1147492 - RNA, 21 nt, Human
aacauggugaaaccccgucuc

SEQ ID NO: 1147493 - RNA, 21 nt, Human
aaccaacaacaaacacuaugc

SEQ ID NO: 1147494 - RNA, 21 nt, Human
aacucaauguuaaccaggcac

SEQ ID NO: 1147495 - RNA, 27 nt, Human
aagacaaccaacaacaaaaggucaucc

SEQ ID NO: 1147496 - RNA, 20 nt, Human
aaggcaaagaacuuuccuuu

SEQ ID NO: 1147497 - RNA, 20 nt, Human
aaguguucaaaguuacaaug

SEQ ID NO: 1147498 - RNA, 20 nt, Human
aauccuaauaugcuaagaaa

SEQ ID NO: 1147499 - RNA, 22 nt, Human
acaaaacaaauaauccaccuca

SEQ ID NO: 1147500 - RNA, 22 nt, Human
acaaacaaacaaacaaaaagca

SEQ ID NO: 1147501 - RNA, 25 nt, Human
acaaccaacaacaaacacuaugccu

SEQ ID NO: 1147502 - RNA, 18 nt, Human
acaagacaaccaacaaca

SEQ ID NO: 1147503 - RNA, 22 nt, Human
acaccaacagauacaguuuuuc

SEQ ID NO: 1147504 - RNA, 25 nt, Human
acagaaugagacucuguuucuaaag

SEQ ID NO: 1147505 - RNA, 19 nt, Human
acagacuauauuugaucug

SEQ ID NO: 1147506 - RNA, 24 nt, Human
acagcgugagacuccaucucaaaa

SEQ ID NO: 1147507 - RNA, 24 nt, Human
acaugagccaaagaguucaaggcu

SEQ ID NO: 1147508 - RNA, 24 nt, Human
accaccuuuuauuucccuuggcca

SEQ ID NO: 1147509 - RNA, 24 nt, Human
accccgucucuacuaaaaauacaa

SEQ ID NO: 1147510 - RNA, 20 nt, Human
acuacuuugggaggccgagg

SEQ ID NO: 1147511 - RNA, 24 nt, Human
acuacuuugggaggccgagguggg

SEQ ID NO: 1147512 - RNA, 21 nt, Human
acuccagccugggugacagaa

SEQ ID NO: 1147513 - RNA, 28 nt, Human
acuccaucucaaaaacaaacaaacaaac

SEQ ID NO: 1147514 - RNA, 23 nt, Human
acugcacuccagccuggugacag

SEQ ID NO: 1147515 - RNA, 19 nt, Human
acuugcaccugggaggugg

SEQ ID NO: 1147516 - RNA, 21 nt, Human
acuugcaccugggagguggag

SEQ ID NO: 1147517 - RNA, 19 nt, Human
agaaaaaaaagaguuagca

SEQ ID NO: 1147518 - RNA, 25 nt, Human
agacaaccaacaacaaaccggaccc

SEQ ID NO: 1147519 - RNA, 20 nt, Human
agagcuuucaagaacuaaac

SEQ ID NO: 1147520 - RNA, 19 nt, Human
agaugaaacauacugaaaa

SEQ ID NO: 1147521 - RNA, 21 nt, Human
agccaggugugguggcgggug

SEQ ID NO: 1147522 - RNA, 24 nt, Human
agccuagccaacauggugaaaccc

SEQ ID NO: 1147523 - RNA, 24 nt, Human
agccugggugacagaaugagacuc

SEQ ID NO: 1147524 - RNA, 21 nt, Human
agccuggugacagcgugagac

SEQ ID NO: 1147525 - RNA, 23 nt, Human
agccuggugacagcgugagacuc

SEQ ID NO: 1147526 - RNA, 20 nt, Human
agcuuuaugcuaaagagaau

SEQ ID NO: 1147527 - RNA, 24 nt, Human
aggaucgcuugaaaccaggaguuc

SEQ ID NO: 1147528 - RNA, 24 nt, Human
aggcacaguggcauguaccuguag

SEQ ID NO: 1147529 - RNA, 18 nt, Human
aggcaggggcaucacuug

SEQ ID NO: 1147530 - RNA, 20 nt, Human
aggccgaggugggaggaucg

SEQ ID NO: 1147531 - RNA, 24 nt, Human
aggccgaggugggaggaucgcuug

SEQ ID NO: 1147532 - RNA, 19 nt, Human
aggcgggcaaaucacgagg

SEQ ID NO: 1147533 - RNA, 24 nt, Human
aggcgggcaaaucacgaggucaag

SEQ ID NO: 1147534 - RNA, 24 nt, Human
aggcugagaugggaggaucacaug

SEQ ID NO: 1147535 - RNA, 24 nt, Human
aggcugaggcaggggcaucacuug

SEQ ID NO: 1147536 - RNA, 22 nt, Human
agguggagguugcagugagcug

SEQ ID NO: 1147537 - RNA, 18 nt, Human
aggugggaggaucgcuug

SEQ ID NO: 1147538 - RNA, 23 nt, Human
aggugggaggaucgcuugaaacc

SEQ ID NO: 1147539 - RNA, 18 nt, Human
agguggucaugccugaaa

SEQ ID NO: 1147540 - RNA, 21 nt, Human
aguuugugugaauuuuggaaa

SEQ ID NO: 1147541 - RNA, 23 nt, Human
auaaaauguuacucuuauuuguc

SEQ ID NO: 1147542 - RNA, 21 nt, Human
auaauacaaacauauuacugc

SEQ ID NO: 1147543 - RNA, 25 nt, Human
auaaugaacaaaacaaauaauccac

SEQ ID NO: 1147544 - RNA, 19 nt, Human
auaggaacuaggccaggug

SEQ ID NO: 1147545 - RNA, 24 nt, Human
aucgcgccacugcacuccagccug

SEQ ID NO: 1147546 - RNA, 24 nt, Human
augaacaguacuaacuaaacaaag

SEQ ID NO: 1147547 - RNA, 19 nt, Human
auggauuuuccccaguaaa

SEQ ID NO: 1147548 - RNA, 19 nt, Human
auuggacuccagccugggu

SEQ ID NO: 1147549 - RNA, 24 nt, Human
auuggacuccagccugggugacag

SEQ ID NO: 1147550 - RNA, 20 nt, Human
caaaaagcaaauguacuacu

SEQ ID NO: 1147551 - RNA, 25 nt, Human
caaaaagcaaauguacuacucacaa

SEQ ID NO: 1147552 - RNA, 22 nt, Human
caaacaaacaaaaagcaaaugu

SEQ ID NO: 1147553 - RNA, 22 nt, Human
caaacaaacaaacaaacaaaaa

SEQ ID NO: 1147554 - RNA, 19 nt, Human
caaaucacgaggucaagag

SEQ ID NO: 1147555 - RNA, 24 nt, Human
caacaaacugaaaccucgucucua

SEQ ID NO: 1147556 - RNA, 24 nt, Human
caacauggugaaaccccgucucua

SEQ ID NO: 1147557 - RNA, 24 nt, Human
caaccaacaacaaacacuaugccu

SEQ ID NO: 1147558 - RNA, 19 nt, Human
caaccuacuauugauuaua

SEQ ID NO: 1147559 - RNA, 21 nt, Human
caacugaacugcuccaauacc

SEQ ID NO: 1147560 - RNA, 21 nt, Human
caauaauauagauugugggca

SEQ ID NO: 1147561 - RNA, 25 nt, Human
cacagcagaaaaaaugguacaaacc

SEQ ID NO: 1147562 - RNA, 24 nt, Human
cacgccuguaaucccagcacuuug

SEQ ID NO: 1147563 - RNA, 24 nt, Human
cacuacuuugggaggccgaggugg

SEQ ID NO: 1147564 - RNA, 20 nt, Human
cacuccagccuggugacagc

SEQ ID NO: 1147565 - RNA, 18 nt, Human
cacugcacuccagccugg

SEQ ID NO: 1147566 - RNA, 18 nt, Human
cacugcacuccagccugg

SEQ ID NO: 1147567 - RNA, 22 nt, Human
cacugcacuccagccuggugac

SEQ ID NO: 1147568 - RNA, 23 nt, Human
cacugcacuccagccuggugaca

SEQ ID NO: 1147569 - RNA, 23 nt, Human
cacugcacuccagccuggugaca

SEQ ID NO: 1147570 - RNA, 25 nt, Human
cagaggcgggcaaaucacgagguca

SEQ ID NO: 1147571 - RNA, 25 nt, Human
cagcacuuuggggaggcagaggcgg

SEQ ID NO: 1147572 - RNA, 23 nt, Human
cagcagaaaaaaugguacaaacc

SEQ ID NO: 1147573 - RNA, 24 nt, Human
cagcuacucgggaggcugaggcag

SEQ ID NO: 1147574 - RNA, 20 nt, Human
cagcuggguuuaaagugcau

SEQ ID NO: 1147575 - RNA, 18 nt, Human
caguacuaacuaaacaaa

SEQ ID NO: 1147576 - RNA, 24 nt, Human
caucucaaaaacaaacaaacaaac

SEQ ID NO: 1147577 - RNA, 25 nt, Human
caugccaaacacuuucagaaagucc

SEQ ID NO: 1147578 - RNA, 19 nt, Human
cauuggacuccagccuggg

SEQ ID NO: 1147579 - RNA, 23 nt, Human
cauuggacuccagccugggugac

SEQ ID NO: 1147580 - RNA, 24 nt, Human
cauuggacuccagccugggugaca

SEQ ID NO: 1147581 - RNA, 25 nt, Human
cauuggacuccagccugggugacag

SEQ ID NO: 1147582 - RNA, 28 nt, Human
cauuuugcuaaucuucaaagagcccacc

SEQ ID NO: 1147583 - RNA, 18 nt, Human
ccaacaacaaacacuaug

SEQ ID NO: 1147584 - RNA, 19 nt, Human
ccacugcacuccagccugg

SEQ ID NO: 1147585 - RNA, 19 nt, Human
ccacugcacuccagccugg

SEQ ID NO: 1147586 - RNA, 20 nt, Human
ccacugcacuccagccuggu

SEQ ID NO: 1147587 - RNA, 22 nt, Human
ccacugcacuccagccugguga

SEQ ID NO: 1147588 - RNA, 23 nt, Human
ccacugcacuccagccuggugac

SEQ ID NO: 1147589 - RNA, 18 nt, Human
ccagccuggugacagcgu

SEQ ID NO: 1147590 - RNA, 20 nt, Human
ccauuggacuccagccuggg

SEQ ID NO: 1147591 - RNA, 21 nt, Human
ccauuggacuccagccugggu

SEQ ID NO: 1147592 - RNA, 24 nt, Human
ccauuggacuccagccugggugac

SEQ ID NO: 1147593 - RNA, 22 nt, Human
cccagcacuuuggggaggcaga

SEQ ID NO: 1147594 - RNA, 24 nt, Human
cccauuggacuccagccuggguga

SEQ ID NO: 1147595 - RNA, 26 nt, Human
ccccauuggacuccagccugggugac

SEQ ID NO: 1147596 - RNA, 23 nt, Human
ccuagccaacauggugaaacccc

SEQ ID NO: 1147597 - RNA, 24 nt, Human
ccuagccaacauggugaaaccccg

SEQ ID NO: 1147598 - RNA, 21 nt, Human
ccugggagguggagguugcag

SEQ ID NO: 1147599 - RNA, 22 nt, Human
ccugggugacagaaugagacuc

SEQ ID NO: 1147600 - RNA, 22 nt, Human
ccuguaaucccagcacuuuggg

SEQ ID NO: 1147601 - RNA, 24 nt, Human
ccuguacuuuauuuaaaaguuauc

SEQ ID NO: 1147602 - RNA, 18 nt, Human
ccuuggccacaaagggug

SEQ ID NO: 1147603 - RNA, 18 nt, Human
cgaggugggaggaucgcu

SEQ ID NO: 1147604 - RNA, 23 nt, Human
cgccuguaaucccagcacuuugg

SEQ ID NO: 1147605 - RNA, 24 nt, Human
cgggaggcugaggcaggggcauca

SEQ ID NO: 1147606 - RNA, 22 nt, Human
cgggcaaaucacgaggucaaga

SEQ ID NO: 1147607 - RNA, 21 nt, Human
cuagaguuuccaaccacugga

SEQ ID NO: 1147608 - RNA, 23 nt, Human
cucaaacucaauguuaaccaggc

SEQ ID NO: 1147609 - RNA, 20 nt, Human
cucaagugacagaaacgucc

SEQ ID NO: 1147610 - RNA, 22 nt, Human
cucacgccuguaaucccagcac

SEQ ID NO: 1147611 - RNA, 24 nt, Human
cucacgccuguaaucccagcacuu

SEQ ID NO: 1147612 - RNA, 24 nt, Human
cuggaauaaaauuuuggcuccuaa

SEQ ID NO: 1147613 - RNA, 20 nt, Human
cuguagucccagcuacucgg

SEQ ID NO: 1147614 - RNA, 21 nt, Human
cuguagucccagcuacucggg

SEQ ID NO: 1147615 - RNA, 21 nt, Human
cuugcaccugggagguggagg

SEQ ID NO: 1147616 - RNA, 21 nt, Human
gaaaaaacauauaggaacuaa

SEQ ID NO: 1147617 - RNA, 23 nt, Human
gaaaucgcgccacugcacuccag

SEQ ID NO: 1147618 - RNA, 23 nt, Human
gaaauugaagcuuguuacauuca

SEQ ID NO: 1147619 - RNA, 18 nt, Human
gaacaguacuaacuaaac

SEQ ID NO: 1147620 - RNA, 19 nt, Human
gaacuaaacugaaaacuga

SEQ ID NO: 1147621 - RNA, 19 nt, Human
gaaucacuggaaauuuaca

SEQ ID NO: 1147622 - RNA, 19 nt, Human
gacaaccaacaacaaacac

SEQ ID NO: 1147623 - RNA, 24 nt, Human
gacagaaugagacucuguuucuaa

SEQ ID NO: 1147624 - RNA, 24 nt, Human
gacuccagccugggugacagaaug

SEQ ID NO: 1147625 - RNA, 24 nt, Human
gaucgcuugaaaccaggaguucaa

SEQ ID NO: 1147626 - RNA, 22 nt, Human
gcagcacuguaaaguuucacac

SEQ ID NO: 1147627 - RNA, 18 nt, Human
gcagugaacuaugaccgc

SEQ ID NO: 1147628 - RNA, 18 nt, Human
gcauguaccuguagucuc

SEQ ID NO: 1147629 - RNA, 22 nt, Human
gccaaagaguucaaggcugcag

SEQ ID NO: 1147630 - RNA, 24 nt, Human
gccaacauggugaaaccccgucuc

SEQ ID NO: 1147631 - RNA, 20 nt, Human
gcugaaaucgcgccacugca

SEQ ID NO: 1147632 - RNA, 22 nt, Human
gcuugaaaccaggaguucaaga

SEQ ID NO: 1147633 - RNA, 18 nt, Human
ggagguugcagugagcug

SEQ ID NO: 1147634 - RNA, 24 nt, Human
ggagguugcagugagcugaaaucg

SEQ ID NO: 1147635 - RNA, 23 nt, Human
ggaucgcuugaaaccaggaguuc

SEQ ID NO: 1147636 - RNA, 23 nt, Human
ggcaaaucacgaggucaagaguu

SEQ ID NO: 1147637 - RNA, 21 nt, Human
ggcucacgccuguaaucccag

SEQ ID NO: 1147638 - RNA, 21 nt, Human
ggcugggcgugguggcucacg

SEQ ID NO: 1147639 - RNA, 24 nt, Human
gggcgugguggcucacgccuguaa

SEQ ID NO: 1147640 - RNA, 19 nt, Human
gguggagguugcagugagc

SEQ ID NO: 1147641 - RNA, 24 nt, Human
gguggcucacgccuguaaucccag

SEQ ID NO: 1147642 - RNA, 23 nt, Human
guauaaauauuaaaaacaaaaau

SEQ ID NO: 1147643 - RNA, 23 nt, Human
guggcucacgccuguaaucccag

SEQ ID NO: 1147644 - RNA, 24 nt, Human
guuuccuccauuucccagagcuuu

SEQ ID NO: 1147645 - RNA, 21 nt, Human
uaaaaauacaaaaauuagcca

SEQ ID NO: 1147646 - RNA, 20 nt, Human
uaaagauuaaucaauacaug

SEQ ID NO: 1147647 - RNA, 20 nt, Human
uaaagugcaucaagacucaa

SEQ ID NO: 1147648 - RNA, 27 nt, Human
uaacuccaaaggaggcuuuagaaauac

SEQ ID NO: 1147649 - RNA, 19 nt, Human
uaaguguauacauaugugu

SEQ ID NO: 1147650 - RNA, 24 nt, Human
uaauuuggaccuaacaccuaaaau

SEQ ID NO: 1147651 - RNA, 26 nt, Human
uacauaugugucuguauauauacaca

SEQ ID NO: 1147652 - RNA, 19 nt, Human
uacuuuaggacuuggugau

SEQ ID NO: 1147653 - RNA, 19 nt, Human
uaguucacucaagaagggg

SEQ ID NO: 1147654 - RNA, 19 nt, Human
uauaauggcuaaagaccca

SEQ ID NO: 1147655 - RNA, 22 nt, Human
uaucauguaggcuuuugaacag

SEQ ID NO: 1147656 - RNA, 21 nt, Human
uaugaaacagaacgagugcaa

SEQ ID NO: 1147657 - RNA, 23 nt, Human
uaugaacuuuacaaaaauggcua

SEQ ID NO: 1147658 - RNA, 20 nt, Human
uaugugucuguauauauaca

SEQ ID NO: 1147659 - RNA, 25 nt, Human
uauuuggauuuggauuacugaccug

SEQ ID NO: 1147660 - RNA, 22 nt, Human
ucaaaacacaccaacagauaca

SEQ ID NO: 1147661 - RNA, 19 nt, Human
ucaaacaguaaucccagaa

SEQ ID NO: 1147662 - RNA, 25 nt, Human
ucaaauacgcaaacaaaucuacacu

SEQ ID NO: 1147663 - RNA, 24 nt, Human
ucaagauuccacuguuaaaccuuu

SEQ ID NO: 1147664 - RNA, 24 nt, Human
ucacaugaaugacaagacaaccaa

SEQ ID NO: 1147665 - RNA, 24 nt, Human
ucacgaggucaagaguuugagacc

SEQ ID NO: 1147666 - RNA, 22 nt, Human
ucacuugcaccugggaggugga

SEQ ID NO: 1147667 - RNA, 21 nt, Human
ucaggcacaguggcauguacc

SEQ ID NO: 1147668 - RNA, 22 nt, Human
ucauaguuuuguguuuccucca

SEQ ID NO: 1147669 - RNA, 19 nt, Human
uccaaauuacaaucaguag

SEQ ID NO: 1147670 - RNA, 24 nt, Human
uccagccugggugacagaaugaga

SEQ ID NO: 1147671 - RNA, 22 nt, Human
uccagccuggugacagcgugag

SEQ ID NO: 1147672 - RNA, 23 nt, Human
ucgcgccacugcacuccagccug

SEQ ID NO: 1147673 - RNA, 23 nt, Human
ucgcuugaaaccaggaguucaag

SEQ ID NO: 1147674 - RNA, 20 nt, Human
ucuccaauuuauucaggugu

SEQ ID NO: 1147675 - RNA, 23 nt, Human
ucuccugauguucaccgagaaua

SEQ ID NO: 1147676 - RNA, 21 nt, Human
ucucuacuaaaaauacaaaaa

SEQ ID NO: 1147677 - RNA, 22 nt, Human
ucucugguagccagcuggguuu

SEQ ID NO: 1147678 - RNA, 27 nt, Human
ucuguacucaauacaauuuaucaaaaa

SEQ ID NO: 1147679 - RNA, 22 nt, Human
ugaaaaaauaaagauuaaucaa

SEQ ID NO: 1147680 - RNA, 22 nt, Human
ugaaaaauaaucaacaaaugcc

SEQ ID NO: 1147681 - RNA, 24 nt, Human
ugaaaugaaugcacuauacuaaau

SEQ ID NO: 1147682 - RNA, 21 nt, Human
ugaauuagauaaucuauaacc

SEQ ID NO: 1147683 - RNA, 21 nt, Human
ugaauugaauccaaugguaua

SEQ ID NO: 1147684 - RNA, 20 nt, Human
ugacagaauaaaagacgcaa

SEQ ID NO: 1147685 - RNA, 18 nt, Human
ugagaaaacaaaaagcaa

SEQ ID NO: 1147686 - RNA, 23 nt, Human
ugagaccagccuagccaacaugg

SEQ ID NO: 1147687 - RNA, 24 nt, Human
ugagaccagccuagccaacauggu

SEQ ID NO: 1147688 - RNA, 24 nt, Human
ugagaugggaggaucacaugagcc

SEQ ID NO: 1147689 - RNA, 25 nt, Human
ugagaugggaggaucacaugagcca

SEQ ID NO: 1147690 - RNA, 22 nt, Human
ugagcugaaaucgcgccacugc

SEQ ID NO: 1147691 - RNA, 20 nt, Human
ugaggcaggggcaucacuug

SEQ ID NO: 1147692 - RNA, 20 nt, Human
ugcaaugguggaaucacugg

SEQ ID NO: 1147693 - RNA, 19 nt, Human
ugccaaacacuuucagaaa

SEQ ID NO: 1147694 - RNA, 24 nt, Human
ugccaaacacuuucagaaaguccu

SEQ ID NO: 1147695 - RNA, 22 nt, Human
uggacuccagccugggugacag

SEQ ID NO: 1147696 - RNA, 18 nt, Human
uggagguugcagugagcu

SEQ ID NO: 1147697 - RNA, 19 nt, Human
uggcaaaugucaugcacuc

SEQ ID NO: 1147698 - RNA, 24 nt, Human
uggcgggugucuguagucccagcu

SEQ ID NO: 1147699 - RNA, 19 nt, Human
uggcuaaagacccaaccua

SEQ ID NO: 1147700 - RNA, 24 nt, Human
uggcucacgccuguaaucccagca

SEQ ID NO: 1147701 - RNA, 20 nt, Human
ugggaggaucacaugagcca

SEQ ID NO: 1147702 - RNA, 18 nt, Human
ugggaggaucgcuugaaa

SEQ ID NO: 1147703 - RNA, 19 nt, Human
ugggaggccgaggugggag

SEQ ID NO: 1147704 - RNA, 23 nt, Human
ugggaggccgaggugggaggauc

SEQ ID NO: 1147705 - RNA, 24 nt, Human
ugggaggccgaggugggaggaucg

SEQ ID NO: 1147706 - RNA, 19 nt, Human
ugggaggcugagaugggag

SEQ ID NO: 1147707 - RNA, 24 nt, Human
ugggaggcugagaugggaggauca

SEQ ID NO: 1147708 - RNA, 29 nt, Human
ugggagguggagguugcagugacaacggu

SEQ ID NO: 1147709 - RNA, 24 nt, Human
ugggagguggagguugcagugagc

SEQ ID NO: 1147710 - RNA, 23 nt, Human
ugguggcgggugucuguaguccc

SEQ ID NO: 1147711 - RNA, 24 nt, Human
ugguggcgggugucuguaguccca

SEQ ID NO: 1147712 - RNA, 24 nt, Human
ugguggcucacgccuguaauccca

SEQ ID NO: 1147713 - RNA, 21 nt, Human
uguaaaaaguccaauaugaaa

SEQ ID NO: 1147714 - RNA, 21 nt, Human
uguaaguguauacauaugugu

SEQ ID NO: 1147715 - RNA, 24 nt, Human
uguacggcugggcgugguggcuca

SEQ ID NO: 1147716 - RNA, 22 nt, Human
uguauacauaugugucuguaua

SEQ ID NO: 1147717 - RNA, 24 nt, Human
uguauacauaugugucuguauaua

SEQ ID NO: 1147718 - RNA, 18 nt, Human
uguauauauacacauaua

SEQ ID NO: 1147719 - RNA, 23 nt, Human
ugucuguagucccagcuacucgg

SEQ ID NO: 1147720 - RNA, 24 nt, Human
ugucuguagucccagcuacucggg

SEQ ID NO: 1147721 - RNA, 22 nt, Human
ugucuguauauauacacauaua

SEQ ID NO: 1147722 - RNA, 21 nt, Human
ugugagaagucugaagaauua

SEQ ID NO: 1147723 - RNA, 20 nt, Human
ugugucuguauauauacaca

SEQ ID NO: 1147724 - RNA, 22 nt, Human
ugugucuguauauauacacaua

SEQ ID NO: 1147725 - RNA, 20 nt, Human
uguuguuguuguuuuuuccc

SEQ ID NO: 1147726 - RNA, 20 nt, Human
uguuuuccucuguacagacu

SEQ ID NO: 1147727 - RNA, 26 nt, Human
uuaaaaaauagcauaugaacuuuaca

SEQ ID NO: 1147728 - RNA, 25 nt, Human
uuaaaacauucuuaguucaaaaaaa

SEQ ID NO: 1147729 - RNA, 25 nt, Human
uuaauagucuccugauguucaccga

SEQ ID NO: 1147730 - RNA, 21 nt, Human
uuaccuugaucauguuguugu

SEQ ID NO: 1147731 - RNA, 20 nt, Human
uuacuaggaaagaaaguuuu

SEQ ID NO: 1147732 - RNA, 25 nt, Human
uucaugaacaguacuaacuaaacaa

SEQ ID NO: 1147733 - RNA, 24 nt, Human
uugcaccugggagguggagguugc

SEQ ID NO: 1147734 - RNA, 19 nt, Human
uugcagugagcugaaaucg

SEQ ID NO: 1147735 - RNA, 20 nt, Human
uugcagugagcugaaaucgc

SEQ ID NO: 1147736 - RNA, 22 nt, Human
uugcagugagcugaaaucgcgc

SEQ ID NO: 1147737 - RNA, 24 nt, Human
uugggaggccgaggugggaggauc

SEQ ID NO: 1147738 - RNA, 22 nt, Human
uuguuuccuguaauauacaagu

SEQ ID NO: 1147739 - RNA, 18 nt, Human
uuuaaaacauucuuaguu

SEQ ID NO: 1147740 - RNA, 21 nt, Human
uuucuggcaggguguaauuuu

SEQ ID NO: 1147741 - RNA, 21 nt, Human
uuuggaccuaacaccuaaaau

SEQ ID NO: 1147742 - RNA, 21 nt, Human
uuuggggaggcagaggcgggc

SEQ ID NO: 1147743 - RNA, 28 nt, Human
aaaaggggaaaagccccuuagaaaacca

SEQ ID NO: 1147744 - RNA, 23 nt, Human
aaagguaggaaucugaggaaguu

SEQ ID NO: 1147745 - RNA, 22 nt, Human
aaccauaucaacaggagcaacc

SEQ ID NO: 1147746 - RNA, 18 nt, Human
aaccuauagcaucagccu

SEQ ID NO: 1147747 - RNA, 22 nt, Human
aaccugacuuacucgggaccug

SEQ ID NO: 1147748 - RNA, 23 nt, Human
aacucacuugucuccuccaccuu

SEQ ID NO: 1147749 - RNA, 23 nt, Human
aaggacauaccugagaccggggc

SEQ ID NO: 1147750 - RNA, 24 nt, Human
aaguuagcucagagguggagccaa

SEQ ID NO: 1147751 - RNA, 19 nt, Human
aauucaagaugagauuugg

SEQ ID NO: 1147752 - RNA, 19 nt, Human
acagcauggaggcaaccac

SEQ ID NO: 1147753 - RNA, 20 nt, Human
acagcauggaggcaaccacc

SEQ ID NO: 1147754 - RNA, 21 nt, Human
acucacuugucuccuccaccu

SEQ ID NO: 1147755 - RNA, 21 nt, Human
agaaguuagcucagaggugga

SEQ ID NO: 1147756 - RNA, 24 nt, Human
agcaaaaggaagugcugagaaaaa

SEQ ID NO: 1147757 - RNA, 23 nt, Human
agcauggaggcaaccacccauga

SEQ ID NO: 1147758 - RNA, 19 nt, Human
agcugccauaccauacccc

SEQ ID NO: 1147759 - RNA, 23 nt, Human
aggaagugcugagaaaaagggga

SEQ ID NO: 1147760 - RNA, 19 nt, Human
aggaaguuagguaggugau

SEQ ID NO: 1147761 - RNA, 20 nt, Human
auagcaucagccuauccaca

SEQ ID NO: 1147762 - RNA, 21 nt, Human
auaucauuuuggcauugacag

SEQ ID NO: 1147763 - RNA, 18 nt, Human
aucaacaggagcaaccaa

SEQ ID NO: 1147764 - RNA, 20 nt, Human
auuccauucacuugggaaaa

SEQ ID NO: 1147765 - RNA, 24 nt, Human
auucuaacucacuugucuccucca

SEQ ID NO: 1147766 - RNA, 19 nt, Human
auuuggguggggacacagu

SEQ ID NO: 1147767 - RNA, 22 nt, Human
caaccacccaugauuccauuac

SEQ ID NO: 1147768 - RNA, 22 nt, Human
caugauggcagcaaaaggaagu

SEQ ID NO: 1147769 - RNA, 22 nt, Human
ccagagggacacagggaggggu

SEQ ID NO: 1147770 - RNA, 18 nt, Human
ccccuuagaaaaccauca

SEQ ID NO: 1147771 - RNA, 19 nt, Human
ccuccaucccucugccaca

SEQ ID NO: 1147772 - RNA, 21 nt, Human
ccucuccuccaucccucugcc

SEQ ID NO: 1147773 - RNA, 19 nt, Human
ccucuggugucuccucucc

SEQ ID NO: 1147774 - RNA, 26 nt, Human
ccucuggugucuccucuccuccaucc

SEQ ID NO: 1147775 - RNA, 22 nt, Human
ccugacuuacucgggaccuguu

SEQ ID NO: 1147776 - RNA, 23 nt, Human
cuccuccaccuuauccuuuagcc

SEQ ID NO: 1147777 - RNA, 23 nt, Human
cuccucuccuccaucccucugcc

SEQ ID NO: 1147778 - RNA, 24 nt, Human
cugaguuaaaguuuacaauuauau

SEQ ID NO: 1147779 - RNA, 20 nt, Human
cuucgcccaaaccccucuuc

SEQ ID NO: 1147780 - RNA, 24 nt, Human
gaacagcauggaggcaaccaccca

SEQ ID NO: 1147781 - RNA, 20 nt, Human
gaaguuagguaggugaugac

SEQ ID NO: 1147782 - RNA, 23 nt, Human
gagaacagcauggaggcaaccac

SEQ ID NO: 1147783 - RNA, 19 nt, Human
gaugaccucaggaaagugg

SEQ ID NO: 1147784 - RNA, 22 nt, Human
gauuugcguuuuuuuuuucccu

SEQ ID NO: 1147785 - RNA, 21 nt, Human
gcaaaaggaagugcugagaaa

SEQ ID NO: 1147786 - RNA, 18 nt, Human
gcagcaaaaggaagugcu

SEQ ID NO: 1147787 - RNA, 22 nt, Human
gcuacacccuccuggugcuuuc

SEQ ID NO: 1147788 - RNA, 24 nt, Human
ggaaagggaagcaaacauauccuu

SEQ ID NO: 1147789 - RNA, 18 nt, Human
ggauaagacagccccacc

SEQ ID NO: 1147790 - RNA, 23 nt, Human
ggauuugcguuuuuuuuuucccu

SEQ ID NO: 1147791 - RNA, 22 nt, Human
gggaccuguuggugccaaccug

SEQ ID NO: 1147792 - RNA, 24 nt, Human
gggaggggugaagaaaaccugacu

SEQ ID NO: 1147793 - RNA, 18 nt, Human
gucccacaacaugugggg

SEQ ID NO: 1147794 - RNA, 22 nt, Human
guggucuugggcaccagcaggg

SEQ ID NO: 1147795 - RNA, 24 nt, Human
gugguugggcaggcuggcuuugcu

SEQ ID NO: 1147796 - RNA, 23 nt, Human
uaagacagccccaccuuccaggu

SEQ ID NO: 1147797 - RNA, 18 nt, Human
uaaggacauaccugagac

SEQ ID NO: 1147798 - RNA, 26 nt, Human
uagaaaaccaucagaucccaugagaa

SEQ ID NO: 1147799 - RNA, 24 nt, Human
uagcaagaacaaauuuuacugccu

SEQ ID NO: 1147800 - RNA, 20 nt, Human
uagcaucagccuauccacac

SEQ ID NO: 1147801 - RNA, 20 nt, Human
uaugaugagaacagcaugga

SEQ ID NO: 1147802 - RNA, 25 nt, Human
ucagcaaauuuacaaucauggugga

SEQ ID NO: 1147803 - RNA, 18 nt, Human
ucauuuuauugacuuacc

SEQ ID NO: 1147804 - RNA, 20 nt, Human
ucccuggacgugcucggucc

SEQ ID NO: 1147805 - RNA, 23 nt, Human
ucccuggacgugcucggucccca

SEQ ID NO: 1147806 - RNA, 22 nt, Human
ucgggaccuguuggugccaacc

SEQ ID NO: 1147807 - RNA, 21 nt, Human
ucucugacguggcaguaacuc

SEQ ID NO: 1147808 - RNA, 21 nt, Human
ucucuuggcagauuccucccc

SEQ ID NO: 1147809 - RNA, 19 nt, Human
ugagaaaaaggggaaaagc

SEQ ID NO: 1147810 - RNA, 26 nt, Human
ugagaacagcauggaggcaaccaccc

SEQ ID NO: 1147811 - RNA, 21 nt, Human
ugagaacagcuuauaaugucc

SEQ ID NO: 1147812 - RNA, 22 nt, Human
ugcacauccaacuucgcccaaa

SEQ ID NO: 1147813 - RNA, 24 nt, Human
ugcuacacccuccuggugcuuucu

SEQ ID NO: 1147814 - RNA, 21 nt, Human
uggauacucugagaacagcuu

SEQ ID NO: 1147815 - RNA, 21 nt, Human
uggugcuuucuccucuguauu

SEQ ID NO: 1147816 - RNA, 22 nt, Human
ugguugggcaggcuggcuuugc

SEQ ID NO: 1147817 - RNA, 19 nt, Human
uguuccaggcccugugcuc

SEQ ID NO: 1147818 - RNA, 22 nt, Human
uuaaaguuuacaauuauauaaa

SEQ ID NO: 1147819 - RNA, 24 nt, Human
uucaagaugagauuugggugggga

SEQ ID NO: 1147820 - RNA, 22 nt, Human
uuccauuguugaccuccugggu

SEQ ID NO: 1147821 - RNA, 24 nt, Human
uucuccucuguauuccuuccauug

SEQ ID NO: 1147822 - RNA, 19 nt, Human
uuugaagaaugauuccauu

SEQ ID NO: 1147823 - RNA, 23 nt, Human
uuugcaaagaauuugggcauccc

SEQ ID NO: 1147824 - RNA, 21 nt, Human
uuugcacauccaacuucgccc

SEQ ID NO: 1147825 - RNA, 23 nt, Human
uuuuuuuucccucuggugucucc

SEQ ID NO: 1147826 - RNA, 23 nt, Human
acccacacacacacacacacaca

SEQ ID NO: 1147827 - RNA, 19 nt, Human
acccuaagugguguccggg

SEQ ID NO: 1147828 - RNA, 19 nt, Human
aguucuaaaguucagucaa

SEQ ID NO: 1147829 - RNA, 27 nt, Human
cacacacacacacacacucaugucuaa

SEQ ID NO: 1147830 - RNA, 31 nt, Human
cacacacacacacacucaugucuaaaugugg

SEQ ID NO: 1147831 - RNA, 23 nt, Human
caguaggacaucaaggauuaagc

SEQ ID NO: 1147832 - RNA, 27 nt, Human
ccacacacacacacacacacacucaug

SEQ ID NO: 1147833 - RNA, 20 nt, Human
cccacacacacacacacaca

SEQ ID NO: 1147834 - RNA, 22 nt, Human
cccacacacacacacacacaca

SEQ ID NO: 1147835 - RNA, 19 nt, Human
gaagccuucuugcugcaga

SEQ ID NO: 1147836 - RNA, 21 nt, Human
gaugugaagagcucagaaaga

SEQ ID NO: 1147837 - RNA, 23 nt, Human
ggaagucaagcaguggaauucca

SEQ ID NO: 1147838 - RNA, 18 nt, Human
uaaaaagaagaaucacug

SEQ ID NO: 1147839 - RNA, 27 nt, Human
uaaacccacacacacacacacacacac

SEQ ID NO: 1147840 - RNA, 19 nt, Human
uaagcuaaacccacacaca

SEQ ID NO: 1147841 - RNA, 22 nt, Human
uacauaguuaaaaagaagaauc

SEQ ID NO: 1147842 - RNA, 19 nt, Human
ucacuguaaaauaaaugcu

SEQ ID NO: 1147843 - RNA, 25 nt, Human
ucagaaagacuaacccuaaguggug

SEQ ID NO: 1147844 - RNA, 19 nt, Human
uccaagaagccuucuugcu

SEQ ID NO: 1147845 - RNA, 20 nt, Human
uccaugguauacucagaaaa

SEQ ID NO: 1147846 - RNA, 23 nt, Human
ucuaaaguucagucaaggagacu

SEQ ID NO: 1147847 - RNA, 24 nt, Human
uggaagucaagcaguggaauucca

SEQ ID NO: 1147848 - RNA, 19 nt, Human
ugucuaaauguguuuacua

SEQ ID NO: 1147849 - RNA, 24 nt, Human
uguuagaaugcaaaccuuaucagu

SEQ ID NO: 1147850 - RNA, 24 nt, Human
uuaguucuaaaguucagucaagga

SEQ ID NO: 1147851 - RNA, 24 nt, Human
aaacaggaagguaaguuauaugag

SEQ ID NO: 1147852 - RNA, 21 nt, Human
aaccagaauccauaaauucac

SEQ ID NO: 1147853 - RNA, 24 nt, Human
aagauaaccaaugcaaaaggucac

SEQ ID NO: 1147854 - RNA, 24 nt, Human
aaggccaaagaaacaaaaaaaaaa

SEQ ID NO: 1147855 - RNA, 23 nt, Human
agaaacaaaaaaaaaaccuuuuc

SEQ ID NO: 1147856 - RNA, 18 nt, Human
agagcugggauuugaagc

SEQ ID NO: 1147857 - RNA, 22 nt, Human
aggccaaagaaacaaaaaaaaa

SEQ ID NO: 1147858 - RNA, 26 nt, Human
caacacuccaugaaaggccaaagaaa

SEQ ID NO: 1147859 - RNA, 22 nt, Human
caagauaaccaaugcaaaggua

SEQ ID NO: 1147860 - RNA, 22 nt, Human
caggaagguaaguuauaugaug

SEQ ID NO: 1147861 - RNA, 20 nt, Human
ccaaagaaacaaaaaaaaaa

SEQ ID NO: 1147862 - RNA, 19 nt, Human
ccaugaaaggccaaagaaa

SEQ ID NO: 1147863 - RNA, 24 nt, Human
ccuauagucacauugauuuucauu

SEQ ID NO: 1147864 - RNA, 21 nt, Human
gaaaauucagaaaaaccagaa

SEQ ID NO: 1147865 - RNA, 18 nt, Human
gccaaagaaacaaaaaaa

SEQ ID NO: 1147866 - RNA, 19 nt, Human
ggcuacuagguaaaaagaa

SEQ ID NO: 1147867 - RNA, 25 nt, Human
uaagaauggacaaaucaacacucca

SEQ ID NO: 1147868 - RNA, 21 nt, Human
uaagaauggacaaaucaacag

SEQ ID NO: 1147869 - RNA, 23 nt, Human
uacaagauaaccaaugcaaaggu

SEQ ID NO: 1147870 - RNA, 18 nt, Human
uauaugaugaccaaaaug

SEQ ID NO: 1147871 - RNA, 22 nt, Human
ugaaaggccaaagaaacaaaaa

SEQ ID NO: 1147872 - RNA, 20 nt, Human
ugcuuuugcaaacccaacac

SEQ ID NO: 1147873 - RNA, 18 nt, Human
uuaaauaaacaggaaggu

SEQ ID NO: 1147874 - RNA, 22 nt, Human
aaaaaaccucaaauacagccau

SEQ ID NO: 1147875 - RNA, 22 nt, Human
aaagauacucaacagucucugg

SEQ ID NO: 1147876 - RNA, 24 nt, Human
aaagugcugggauuacaggcguga

SEQ ID NO: 1147877 - RNA, 24 nt, Human
aaagugcugggauuaugggcuuga

SEQ ID NO: 1147878 - RNA, 21 nt, Human
aaauccugaaggcuaugcuuc

SEQ ID NO: 1147879 - RNA, 24 nt, Human
aagguauuuuuaaauguacucaau

SEQ ID NO: 1147880 - RNA, 19 nt, Human
aagugcugggauuacaggc

SEQ ID NO: 1147881 - RNA, 19 nt, Human
aagugcugggauuacaggc

SEQ ID NO: 1147882 - RNA, 26 nt, Human
aagugcugggauuacaggcgugagcc

SEQ ID NO: 1147883 - RNA, 19 nt, Human
aagugcugggauuaugggc

SEQ ID NO: 1147884 - RNA, 19 nt, Human
aagugcugggauuaugggc

SEQ ID NO: 1147885 - RNA, 26 nt, Human
aagugcugggauuaugggcuugagcc

SEQ ID NO: 1147886 - RNA, 22 nt, Human
aaguggaaucuggaugauguga

SEQ ID NO: 1147887 - RNA, 25 nt, Human
acccgccucagccucccaaagugcu

SEQ ID NO: 1147888 - RNA, 24 nt, Human
accugggcuggagugcaauggcau

SEQ ID NO: 1147889 - RNA, 24 nt, Human
accuugugauccacccgccucagc

SEQ ID NO: 1147890 - RNA, 20 nt, Human
acgagguuucaccggauuag

SEQ ID NO: 1147891 - RNA, 20 nt, Human
agaauggagaaaacuggaua

SEQ ID NO: 1147892 - RNA, 21 nt, Human
aggagcaauggcgcccaggac

SEQ ID NO: 1147893 - RNA, 25 nt, Human
aggcgggagugcaguggcacaaucu

SEQ ID NO: 1147894 - RNA, 25 nt, Human
aggcuggagugcaguggcgcgaucu

SEQ ID NO: 1147895 - RNA, 18 nt, Human
aguagcugggacuacagg

SEQ ID NO: 1147896 - RNA, 19 nt, Human
aguagcugggacuacaggc

SEQ ID NO: 1147897 - RNA, 18 nt, Human
aguagcugggauuacagg

SEQ ID NO: 1147898 - RNA, 20 nt, Human
agugcaguggcacaaucucg

SEQ ID NO: 1147899 - RNA, 24 nt, Human
agugcaguggcacaaucucggcuc

SEQ ID NO: 1147900 - RNA, 23 nt, Human
agugcaguggcgcgaucuuggcu

SEQ ID NO: 1147901 - RNA, 24 nt, Human
agugcaguggcgcgaucuuggcuc

SEQ ID NO: 1147902 - RNA, 18 nt, Human
agugcugggauuacaggc

SEQ ID NO: 1147903 - RNA, 24 nt, Human
agugcugggauuaugggcuugagc

SEQ ID NO: 1147904 - RNA, 19 nt, Human
aguuguuaaaggcuuaacu

SEQ ID NO: 1147905 - RNA, 21 nt, Human
augccaaaguuuuaguguaca

SEQ ID NO: 1147906 - RNA, 19 nt, Human
auuuagcucuuggcacucu

SEQ ID NO: 1147907 - RNA, 24 nt, Human
caaagugcugggauuacaggcgug

SEQ ID NO: 1147908 - RNA, 18 nt, Human
caacuacuauagugcucu

SEQ ID NO: 1147909 - RNA, 22 nt, Human
caagcgauucucuugcuucagc

SEQ ID NO: 1147910 - RNA, 22 nt, Human
cacaccauucuccugucucagc

SEQ ID NO: 1147911 - RNA, 24 nt, Human
caccaccccuggcuaauuuuugua

SEQ ID NO: 1147912 - RNA, 24 nt, Human
caccacguugaucaggcuggucuc

SEQ ID NO: 1147913 - RNA, 23 nt, Human
caccaggcuggagugcaguggcg

SEQ ID NO: 1147914 - RNA, 23 nt, Human
cacccgccucagccucccaaagu

SEQ ID NO: 1147915 - RNA, 22 nt, Human
cacgccauucuccugccucagc

SEQ ID NO: 1147916 - RNA, 24 nt, Human
cacucuguuaccugggcuggagug

SEQ ID NO: 1147917 - RNA, 23 nt, Human
cacugcaaucucugccuccuggg

SEQ ID NO: 1147918 - RNA, 20 nt, Human
cagccuccugaguagcuggg

SEQ ID NO: 1147919 - RNA, 27 nt, Human
cagcuagacuuuuuucuaauagagucc

SEQ ID NO: 1147920 - RNA, 22 nt, Human
caggcgcccaccaaccaagccc

SEQ ID NO: 1147921 - RNA, 19 nt, Human
caguggcgcgaucuuggcu

SEQ ID NO: 1147922 - RNA, 20 nt, Human
ccaaagugcugggauuacag

SEQ ID NO: 1147923 - RNA, 22 nt, Human
ccaaagugcugggauuacaggc

SEQ ID NO: 1147924 - RNA, 22 nt, Human
ccaaagugcugggauuacaggc

SEQ ID NO: 1147925 - RNA, 24 nt, Human
ccaaagugcugggauuacaggcgu

SEQ ID NO: 1147926 - RNA, 18 nt, Human
ccaaagugcugggauuau

SEQ ID NO: 1147927 - RNA, 22 nt, Human
ccaaagugcugggauuaugggc

SEQ ID NO: 1147928 - RNA, 23 nt, Human
ccaaagugcugggauuaugggcu

SEQ ID NO: 1147929 - RNA, 21 nt, Human
ccaccaaccaagcccggcuaa

SEQ ID NO: 1147930 - RNA, 26 nt, Human
ccacccgccucagccucccaaagugc

SEQ ID NO: 1147931 - RNA, 24 nt, Human
cccaaagugcugggauuaugggcu

SEQ ID NO: 1147932 - RNA, 19 nt, Human
cccaccaaccaagcccggc

SEQ ID NO: 1147933 - RNA, 20 nt, Human
ccccauaaauuuuauuacca

SEQ ID NO: 1147934 - RNA, 23 nt, Human
cccgaguagcugggacuacaggc

SEQ ID NO: 1147935 - RNA, 24 nt, Human
cccgaguagcugggacuacaggcg

SEQ ID NO: 1147936 - RNA, 23 nt, Human
ccgccucagccucccaaagugcu

SEQ ID NO: 1147937 - RNA, 19 nt, Human
ccuacagguuaaaauaccg

SEQ ID NO: 1147938 - RNA, 24 nt, Human
ccucccggguucacgccauucucc

SEQ ID NO: 1147939 - RNA, 22 nt, Human
ccuccuagcugggauuacaggc

SEQ ID NO: 1147940 - RNA, 24 nt, Human
ccuccuggguucaagcgauucucu

SEQ ID NO: 1147941 - RNA, 21 nt, Human
ccugaccucguggucugccug

SEQ ID NO: 1147942 - RNA, 20 nt, Human
ccugaccuugugauccaccc

SEQ ID NO: 1147943 - RNA, 23 nt, Human
ccugaguagcugggauuacaggc

SEQ ID NO: 1147944 - RNA, 23 nt, Human
ccugaguagcugggauuacaggc

SEQ ID NO: 1147945 - RNA, 24 nt, Human
ccugccucagccucccgaguagcu

SEQ ID NO: 1147946 - RNA, 22 nt, Human
ccugccuuggccucccaaagug

SEQ ID NO: 1147947 - RNA, 21 nt, Human
ccuggguucaagcgauucucu

SEQ ID NO: 1147948 - RNA, 27 nt, Human
ccuugcuuugucaucuuaaggucgguc

SEQ ID NO: 1147949 - RNA, 24 nt, Human
cgccucagccucccaaagugcugg

SEQ ID NO: 1147950 - RNA, 19 nt, Human
cgccucccggguucacgcc

SEQ ID NO: 1147951 - RNA, 24 nt, Human
cgcucugucgcccaggcgggagug

SEQ ID NO: 1147952 - RNA, 22 nt, Human
cggccaccaccaccccuggcua

SEQ ID NO: 1147953 - RNA, 24 nt, Human
cucacucuguuaccugggcuggag

SEQ ID NO: 1147954 - RNA, 24 nt, Human
cucacugcaaucucugccuccugg

SEQ ID NO: 1147955 - RNA, 24 nt, Human
cucagccucccgaguagcugggac

SEQ ID NO: 1147956 - RNA, 21 nt, Human
cucccggguucacgccauucu

SEQ ID NO: 1147957 - RNA, 24 nt, Human
cuccugaccucguggucugccugc

SEQ ID NO: 1147958 - RNA, 24 nt, Human
cuccugaccuugugauccacccgc

SEQ ID NO: 1147959 - RNA, 21 nt, Human
cuccuggguucaagcgauucu

SEQ ID NO: 1147960 - RNA, 23 nt, Human
cucgcucugucaccaggcuggag

SEQ ID NO: 1147961 - RNA, 21 nt, Human
cucucauacugaaguaggcug

SEQ ID NO: 1147962 - RNA, 19 nt, Human
cucugucaccaggcuggag

SEQ ID NO: 1147963 - RNA, 22 nt, Human
cugaguagcugggauuacaggc

SEQ ID NO: 1147964 - RNA, 24 nt, Human
cugcaaucucugccuccuggguuc

SEQ ID NO: 1147965 - RNA, 20 nt, Human
cugccugccuuggccuccca

SEQ ID NO: 1147966 - RNA, 23 nt, Human
cugccuuggccucccaaagugcu

SEQ ID NO: 1147967 - RNA, 24 nt, Human
cuggagugcaauggcaugaucuca

SEQ ID NO: 1147968 - RNA, 19 nt, Human
cuggcauuugaagaacaaa

SEQ ID NO: 1147969 - RNA, 18 nt, Human
cugucgcccaggcgggag

SEQ ID NO: 1147970 - RNA, 21 nt, Human
gaccucguggucugccugccu

SEQ ID NO: 1147971 - RNA, 24 nt, Human
gaccucguggucugccugccuugg

SEQ ID NO: 1147972 - RNA, 22 nt, Human
gaccuugugauccacccgccuc

SEQ ID NO: 1147973 - RNA, 24 nt, Human
gaccuugugauccacccgccucag

SEQ ID NO: 1147974 - RNA, 24 nt, Human
gacggagucucgcucugucaccag

SEQ ID NO: 1147975 - RNA, 19 nt, Human
gacggcacacagaauggag

SEQ ID NO: 1147976 - RNA, 22 nt, Human
gacuacaggcgcccgccaccau

SEQ ID NO: 1147977 - RNA, 22 nt, Human
gagacagucucacucuguuacc

SEQ ID NO: 1147978 - RNA, 21 nt, Human
gagauaaaccuguuggaaaua

SEQ ID NO: 1147979 - RNA, 25 nt, Human
gaguagcugggacuacaggcgcccg

SEQ ID NO: 1147980 - RNA, 25 nt, Human
gaguagcugggauuacaggcggcca

SEQ ID NO: 1147981 - RNA, 18 nt, Human
gauuacaggcgugagcca

SEQ ID NO: 1147982 - RNA, 21 nt, Human
gauuacaggcgugagccacca

SEQ ID NO: 1147983 - RNA, 22 nt, Human
gauuacaggcgugagccaccau

SEQ ID NO: 1147984 - RNA, 22 nt, Human
gauuaugggcuugagccaccgc

SEQ ID NO: 1147985 - RNA, 21 nt, Human
gauucucuugcuucagccucc

SEQ ID NO: 1147986 - RNA, 18 nt, Human
gcccaggacggcacacag

SEQ ID NO: 1147987 - RNA, 24 nt, Human
gcccgacuaauuuuuuuguauuuu

SEQ ID NO: 1147988 - RNA, 20 nt, Human
gccucagccucccgaguagc

SEQ ID NO: 1147989 - RNA, 22 nt, Human
gccuuggccucccaaagugcug

SEQ ID NO: 1147990 - RNA, 24 nt, Human
gcgauucucuugcuucagccuccu

SEQ ID NO: 1147991 - RNA, 19 nt, Human
gcuggagugcaauggcaug

SEQ ID NO: 1147992 - RNA, 19 nt, Human
gcuggagugcaguggcgcg

SEQ ID NO: 1147993 - RNA, 23 nt, Human
gcuggucucaaacuccugaccuc

SEQ ID NO: 1147994 - RNA, 18 nt, Human
ggagugcaguggcacaau

SEQ ID NO: 1147995 - RNA, 23 nt, Human
ggagugcaguggcacaaucucgg

SEQ ID NO: 1147996 - RNA, 24 nt, Human
ggauggucucaaucuccugaccuu

SEQ ID NO: 1147997 - RNA, 24 nt, Human
ggauuacaggcgugagccaccaug

SEQ ID NO: 1147998 - RNA, 20 nt, Human
ggcacucuaaaaaaccucaa

SEQ ID NO: 1147999 - RNA, 24 nt, Human
ggcuggucucaaacuccugaccuc

SEQ ID NO: 1148000 - RNA, 20 nt, Human
ggcuugagccaccgcgccca

SEQ ID NO: 1148001 - RNA, 20 nt, Human
ggucugccugccuuggccuc

SEQ ID NO: 1148002 - RNA, 21 nt, Human
guaaauacaccucauuuccau

SEQ ID NO: 1148003 - RNA, 24 nt, Human
gucucgcucugucaccaggcugga

SEQ ID NO: 1148004 - RNA, 24 nt, Human
gugauccacccgccucagccuccc

SEQ ID NO: 1148005 - RNA, 23 nt, Human
gugguuguguagugcauuugggg

SEQ ID NO: 1148006 - RNA, 24 nt, Human
gugguuguguagugcauuuggggu

SEQ ID NO: 1148007 - RNA, 18 nt, Human
uaauagagucccccauaa

SEQ ID NO: 1148008 - RNA, 23 nt, Human
uaauuuuuguauuuuuaguagag

SEQ ID NO: 1148009 - RNA, 24 nt, Human
uaauuuuuguauuuuuaguagagg

SEQ ID NO: 1148010 - RNA, 24 nt, Human
uacaggcgugagccaccaugccca

SEQ ID NO: 1148011 - RNA, 28 nt, Human
uaccaaauuaccuuuguacaaauauucc

SEQ ID NO: 1148012 - RNA, 20 nt, Human
uaccaggaauaaaaagguuu

SEQ ID NO: 1148013 - RNA, 21 nt, Human
uaccaggaauaaaaagguuuu

SEQ ID NO: 1148014 - RNA, 21 nt, Human
uaccugggcuggagugcaaug

SEQ ID NO: 1148015 - RNA, 24 nt, Human
uaccugggcuggagugcaauggca

SEQ ID NO: 1148016 - RNA, 27 nt, Human
uaccuuugucuuuggaguaaugaguuu

SEQ ID NO: 1148017 - RNA, 21 nt, Human
uacuauagugcucuagugggg

SEQ ID NO: 1148018 - RNA, 26 nt, Human
uagacauaauuauaugaaacuggauc

SEQ ID NO: 1148019 - RNA, 19 nt, Human
uagagucccccauaaauuu

SEQ ID NO: 1148020 - RNA, 22 nt, Human
uagauagauagauagauagaua

SEQ ID NO: 1148021 - RNA, 22 nt, Human
uagauagauagauagauagaua

SEQ ID NO: 1148022 - RNA, 22 nt, Human
uagauagauagauagauagaua

SEQ ID NO: 1148023 - RNA, 22 nt, Human
uagauagauagauagauagaua

SEQ ID NO: 1148024 - RNA, 21 nt, Human
uaguagagacgagguuucacc

SEQ ID NO: 1148025 - RNA, 26 nt, Human
uaguagagacgagguuucaccggauu

SEQ ID NO: 1148026 - RNA, 18 nt, Human
uaucugaacaaucuuaga

SEQ ID NO: 1148027 - RNA, 19 nt, Human
ucaaucuccugaccuugug

SEQ ID NO: 1148028 - RNA, 20 nt, Human
ucaaucuccugaccuuguga

SEQ ID NO: 1148029 - RNA, 24 nt, Human
ucacucuguuaccugggcuggagu

SEQ ID NO: 1148030 - RNA, 18 nt, Human
ucacugcaagcuccgccu

SEQ ID NO: 1148031 - RNA, 18 nt, Human
ucacugcaagcuccgccu

SEQ ID NO: 1148032 - RNA, 21 nt, Human
ucacugcaagcuccgccuugg

SEQ ID NO: 1148033 - RNA, 22 nt, Human
ucacugcaagcuccgccuuggg

SEQ ID NO: 1148034 - RNA, 18 nt, Human
ucacugcaaguuccgccu

SEQ ID NO: 1148035 - RNA, 19 nt, Human
ucacugcaaguuccgccuc

SEQ ID NO: 1148036 - RNA, 24 nt, Human
ucacugcaaguuccgccucccggg

SEQ ID NO: 1148037 - RNA, 24 nt, Human
ucacugcaaucucugccuccuggg

SEQ ID NO: 1148038 - RNA, 25 nt, Human
ucacugcaaucucugccuccugggu

SEQ ID NO: 1148039 - RNA, 22 nt, Human
ucagaaccucaguuguuaaagg

SEQ ID NO: 1148040 - RNA, 23 nt, Human
ucagccucccgaguagcugggac

SEQ ID NO: 1148041 - RNA, 20 nt, Human
ucagccuccugaguagcugg

SEQ ID NO: 1148042 - RNA, 21 nt, Human
uccacccgccucagccuccca

SEQ ID NO: 1148043 - RNA, 24 nt, Human
ucccaaagugcugggauuacaggc

SEQ ID NO: 1148044 - RNA, 24 nt, Human
ucccaaagugcugggauuaugggc

SEQ ID NO: 1148045 - RNA, 21 nt, Human
uccccagccuacuaaggccua

SEQ ID NO: 1148046 - RNA, 24 nt, Human
ucccgaguagcugggacuacaggc

SEQ ID NO: 1148047 - RNA, 21 nt, Human
ucccggguucacgccauucuc

SEQ ID NO: 1148048 - RNA, 24 nt, Human
ucccggguucacgccauucuccug

SEQ ID NO: 1148049 - RNA, 20 nt, Human
uccuagcugggauuacaggc

SEQ ID NO: 1148050 - RNA, 20 nt, Human
uccuagcugggauuacaggc

SEQ ID NO: 1148051 - RNA, 24 nt, Human
uccugaguagcugggauuacaggc

SEQ ID NO: 1148052 - RNA, 21 nt, Human
uccuggguucaagcgauucuc

SEQ ID NO: 1148053 - RNA, 24 nt, Human
uccuggguucaagcgauucucuug

SEQ ID NO: 1148054 - RNA, 24 nt, Human
ucgcccaggcgggagugcaguggc

SEQ ID NO: 1148055 - RNA, 22 nt, Human
ucucaaacuccugaccucgugg

SEQ ID NO: 1148056 - RNA, 22 nt, Human
ucucacucuguuaccugggcug

SEQ ID NO: 1148057 - RNA, 23 nt, Human
ucucacucuguuaccugggcugg

SEQ ID NO: 1148058 - RNA, 24 nt, Human
ucucacucuguuaccugggcugga

SEQ ID NO: 1148059 - RNA, 24 nt, Human
ucuccugccucagccucccgagua

SEQ ID NO: 1148060 - RNA, 22 nt, Human
ucuccugucucagccuccuagc

SEQ ID NO: 1148061 - RNA, 21 nt, Human
ucucgcucugucaccaggcug

SEQ ID NO: 1148062 - RNA, 22 nt, Human
ucucgcucugucaccaggcugg

SEQ ID NO: 1148063 - RNA, 23 nt, Human
ucucgcucugucaccaggcugga

SEQ ID NO: 1148064 - RNA, 18 nt, Human
ucucgcucugucgcccag

SEQ ID NO: 1148065 - RNA, 18 nt, Human
ucucgcucugucgcccag

SEQ ID NO: 1148066 - RNA, 19 nt, Human
ucucgcucugucgcccagg

SEQ ID NO: 1148067 - RNA, 20 nt, Human
ucucgcucugucgcccaggc

SEQ ID NO: 1148068 - RNA, 24 nt, Human
ucucgcucugucgcccaggcggga

SEQ ID NO: 1148069 - RNA, 24 nt, Human
ucugucgcccaggcgggagugcag

SEQ ID NO: 1148070 - RNA, 24 nt, Human
ucuguuaccugggcuggagugcaa

SEQ ID NO: 1148071 - RNA, 20 nt, Human
ucuuaaggacaaaaauaguu

SEQ ID NO: 1148072 - RNA, 23 nt, Human
ugaccuugugauccacccgccuc

SEQ ID NO: 1148073 - RNA, 18 nt, Human
ugagacagagucucgcuc

SEQ ID NO: 1148074 - RNA, 22 nt, Human
ugagacagagucucgcucuguc

SEQ ID NO: 1148075 - RNA, 22 nt, Human
ugagacggagucucgcucuguc

SEQ ID NO: 1148076 - RNA, 24 nt, Human
ugaucaggcuggucucaaacuccu

SEQ ID NO: 1148077 - RNA, 22 nt, Human
ugauccacccgccucagccucc

SEQ ID NO: 1148078 - RNA, 20 nt, Human
ugauuagaauguuggugguu

SEQ ID NO: 1148079 - RNA, 22 nt, Human
ugcaaauucugguaaauugccu

SEQ ID NO: 1148080 - RNA, 22 nt, Human
ugcaguggcacaaucucggcuc

SEQ ID NO: 1148081 - RNA, 22 nt, Human
ugcaguggcgcgaucuuggcuc

SEQ ID NO: 1148082 - RNA, 24 nt, Human
ugccucagccucccgaguagcugg

SEQ ID NO: 1148083 - RNA, 24 nt, Human
ugcugggauuacaggcgugagcca

SEQ ID NO: 1148084 - RNA, 22 nt, Human
ugcuucagccuccugaguagcu

SEQ ID NO: 1148085 - RNA, 24 nt, Human
ugcuucagccuccugaguagcugg

SEQ ID NO: 1148086 - RNA, 18 nt, Human
ugcuuugucaucuuaucc

SEQ ID NO: 1148087 - RNA, 19 nt, Human
uggagugcaauggcaugau

SEQ ID NO: 1148088 - RNA, 24 nt, Human
uggagugcaauggcaugaucucag

SEQ ID NO: 1148089 - RNA, 23 nt, Human
uggagugcaguggcgcgaucuug

SEQ ID NO: 1148090 - RNA, 24 nt, Human
uggagugcaguggcgcgaucuugg

SEQ ID NO: 1148091 - RNA, 23 nt, Human
uggcaaaacaagcuaggagcuag

SEQ ID NO: 1148092 - RNA, 24 nt, Human
uggcacaaucucggcucacugcaa

SEQ ID NO: 1148093 - RNA, 24 nt, Human
uggcaugaucucagcucacugcaa

SEQ ID NO: 1148094 - RNA, 19 nt, Human
uggcucacugcaaguuccg

SEQ ID NO: 1148095 - RNA, 21 nt, Human
ugggacuacaggcgcccgcca

SEQ ID NO: 1148096 - RNA, 22 nt, Human
ugggacuacaggcgcccgccac

SEQ ID NO: 1148097 - RNA, 24 nt, Human
ugggacuacaggcgcccgccacca

SEQ ID NO: 1148098 - RNA, 25 nt, Human
ugggacuacaggcgcccgccaccau

SEQ ID NO: 1148099 - RNA, 21 nt, Human
ugggaugaagauauagauaga

SEQ ID NO: 1148100 - RNA, 21 nt, Human
ugggauuacaggcgcccacca

SEQ ID NO: 1148101 - RNA, 25 nt, Human
ugggauuacaggcgcccaccaacca

SEQ ID NO: 1148102 - RNA, 21 nt, Human
ugggauuacaggcggccacca

SEQ ID NO: 1148103 - RNA, 18 nt, Human
ugggauuacaggcgugag

SEQ ID NO: 1148104 - RNA, 22 nt, Human
ugggauuacaggcgugagccac

SEQ ID NO: 1148105 - RNA, 23 nt, Human
ugggauuacaggcgugagccacc

SEQ ID NO: 1148106 - RNA, 24 nt, Human
ugggauuacaggcgugagccacca

SEQ ID NO: 1148107 - RNA, 25 nt, Human
ugggauuacaggcgugagccaccau

SEQ ID NO: 1148108 - RNA, 18 nt, Human
ugggauuaugggcuugag

SEQ ID NO: 1148109 - RNA, 19 nt, Human
ugggauuaugggcuugagc

SEQ ID NO: 1148110 - RNA, 22 nt, Human
ugggauuaugggcuugagccac

SEQ ID NO: 1148111 - RNA, 23 nt, Human
ugggauuaugggcuugagccacc

SEQ ID NO: 1148112 - RNA, 24 nt, Human
ugggauuaugggcuugagccaccg

SEQ ID NO: 1148113 - RNA, 20 nt, Human
uggguucaagcgauucucuu

SEQ ID NO: 1148114 - RNA, 23 nt, Human
uggguucaagcgauucucuugcu

SEQ ID NO: 1148115 - RNA, 23 nt, Human
uggugguuguguagugcauuugg

SEQ ID NO: 1148116 - RNA, 20 nt, Human
ugucaccaggcuggagugca

SEQ ID NO: 1148117 - RNA, 18 nt, Human
ugucaucuuauccagaag

SEQ ID NO: 1148118 - RNA, 19 nt, Human
uguccaaaaacucuuaagu

SEQ ID NO: 1148119 - RNA, 25 nt, Human
ugucucagccuccuagcugggauua

SEQ ID NO: 1148120 - RNA, 21 nt, Human
ugugaaacuugcuucuugucu

SEQ ID NO: 1148121 - RNA, 20 nt, Human
uguuaccugggcuggagugc

SEQ ID NO: 1148122 - RNA, 18 nt, Human
uuacaggcgcccaccaag

SEQ ID NO: 1148123 - RNA, 22 nt, Human
uuaguagagacgagguuucacc

SEQ ID NO: 1148124 - RNA, 24 nt, Human
uucaaaaagauacucaacagucuc

SEQ ID NO: 1148125 - RNA, 23 nt, Human
uucaagcgauucucuugcuucag

SEQ ID NO: 1148126 - RNA, 24 nt, Human
uucagccuccugaguagcugggau

SEQ ID NO: 1148127 - RNA, 23 nt, Human
uuccccagccuacuaaggccuac

SEQ ID NO: 1148128 - RNA, 18 nt, Human
uucuguguuuaacuguga

SEQ ID NO: 1148129 - RNA, 18 nt, Human
uuggccucccaaagugcu

SEQ ID NO: 1148130 - RNA, 24 nt, Human
uuggcuuuuguccaaaaacucuua

SEQ ID NO: 1148131 - RNA, 22 nt, Human
uuucucuucacuuuuuucuccc

SEQ ID NO: 1148132 - RNA, 22 nt, Human
uuugcaaauucugguaaauugc

SEQ ID NO: 1148133 - RNA, 24 nt, Human
uuuuccaguguacuuaucauccuu

SEQ ID NO: 1148134 - RNA, 21 nt, Human
uuuuguauuuuuaguagagac

SEQ ID NO: 1148135 - RNA, 24 nt, Human
uuuuuaguagagacgagguuucac

SEQ ID NO: 1148136 - RNA, 20 nt, Human
uuuuuguauuuuuaguagag

SEQ ID NO: 1148137 - RNA, 21 nt, Human
uuuuuguauuuuuaguagaga

SEQ ID NO: 1148138 - RNA, 21 nt, Human
uuuuuuguauuuuuaguagag

SEQ ID NO: 1148139 - RNA, 25 nt, Human
uuuuuuuuuuuugagacagagucuc

SEQ ID NO: 1148140 - RNA, 25 nt, Human
uuuuuuuuuuuugagacggagucuc

SEQ ID NO: 1148141 - RNA, 22 nt, Human
uuuuuuuuuuuuuugagacgga

SEQ ID NO: 1148142 - RNA, 18 nt, Human
uuuuuuuuuuuuuuuuug

SEQ ID NO: 1148143 - RNA, 20 nt, Human
uuuuuuuuuuuuuuuuuugg

SEQ ID NO: 1148144 - RNA, 21 nt, Human
aacccuuuguuggaaugcuuu

SEQ ID NO: 1148145 - RNA, 22 nt, Human
aacccuuuguuggaaugcuuuc

SEQ ID NO: 1148146 - RNA, 19 nt, Human
aagagagacuuuaacgaug

SEQ ID NO: 1148147 - RNA, 25 nt, Human
agcuucauucccaucuauaauuuua

SEQ ID NO: 1148148 - RNA, 23 nt, Human
auagaaccuggcaucacccugaa

SEQ ID NO: 1148149 - RNA, 26 nt, Human
auuuugcuuggguaaucccuuuuaau

SEQ ID NO: 1148150 - RNA, 18 nt, Human
caacagcaugggugcaaa

SEQ ID NO: 1148151 - RNA, 23 nt, Human
caacuacaccaagguuuccgaag

SEQ ID NO: 1148152 - RNA, 28 nt, Human
caacuacaccaagguuuccgaagacaau

SEQ ID NO: 1148153 - RNA, 21 nt, Human
caauagcuucuccacccaagc

SEQ ID NO: 1148154 - RNA, 20 nt, Human
cagcacauuaaaaaaaaaga

SEQ ID NO: 1148155 - RNA, 23 nt, Human
cagcaugggugcaaaaaaaaaaa

SEQ ID NO: 1148156 - RNA, 21 nt, Human
cagggugaagagagacuuuaa

SEQ ID NO: 1148157 - RNA, 20 nt, Human
ccugcuaagcuuuguuuccu

SEQ ID NO: 1148158 - RNA, 18 nt, Human
cugcuaagcuuuguuucc

SEQ ID NO: 1148159 - RNA, 21 nt, Human
cuuuccacagaacagaaacua

SEQ ID NO: 1148160 - RNA, 24 nt, Human
guuuuuugcccauacacaugaguc

SEQ ID NO: 1148161 - RNA, 26 nt, Human
uaaaaaaaaagacauuuauucagcgu

SEQ ID NO: 1148162 - RNA, 19 nt, Human
uacacaagcuucauuccca

SEQ ID NO: 1148163 - RNA, 21 nt, Human
uacaccaagguuuccgaagac

SEQ ID NO: 1148164 - RNA, 25 nt, Human
uccgaagacaauagcuucuccaccc

SEQ ID NO: 1148165 - RNA, 20 nt, Human
ucucuggcucuccucuccug

SEQ ID NO: 1148166 - RNA, 19 nt, Human
uguuguaaccuguagcuuc

SEQ ID NO: 1148167 - RNA, 20 nt, Human
uucagaguagacuaacuuua

SEQ ID NO: 1148168 - RNA, 18 nt, Human
aagaagagaucuccaaac

SEQ ID NO: 1148169 - RNA, 18 nt, Human
aagaagagaucuccaaac

SEQ ID NO: 1148170 - RNA, 21 nt, Human
acaaaagaagagaucuccaaa

SEQ ID NO: 1148171 - RNA, 22 nt, Human
acaaaagaagagaucuccaaac

SEQ ID NO: 1148172 - RNA, 22 nt, Human
caaaagaagagaucuccaaacc

SEQ ID NO: 1148173 - RNA, 18 nt, Human
cugucugcgcccaaccga

SEQ ID NO: 1148174 - RNA, 22 nt, Human
uauaauaucacaaaugagcgaa

SEQ ID NO: 1148175 - RNA, 18 nt, Human
ugcgcccaaccgacggcc

SEQ ID NO: 1148176 - RNA, 18 nt, Human
gggggagaagcgaccacu

SEQ ID NO: 1148177 - RNA, 21 nt, Human
gggggagaagcgaccacuguu

SEQ ID NO: 1148178 - RNA, 21 nt, Human
aaacaugcuguagagguuuau

SEQ ID NO: 1148179 - RNA, 19 nt, Human
aaauauuagauauuacagu

SEQ ID NO: 1148180 - RNA, 24 nt, Human
aacauaaauacagacuaaagcaag

SEQ ID NO: 1148181 - RNA, 19 nt, Human
acagaaacaugcuguagag

SEQ ID NO: 1148182 - RNA, 21 nt, Human
accaggucaucauuucugcag

SEQ ID NO: 1148183 - RNA, 18 nt, Human
aggagcaauaagcuauag

SEQ ID NO: 1148184 - RNA, 18 nt, Human
agguuuauagccuaggag

SEQ ID NO: 1148185 - RNA, 23 nt, Human
agugacaccauaacaaaaucuuc

SEQ ID NO: 1148186 - RNA, 26 nt, Human
auaacaaaaucuuccaaauguuacca

SEQ ID NO: 1148187 - RNA, 18 nt, Human
caucaccuaauggcccac

SEQ ID NO: 1148188 - RNA, 22 nt, Human
ccuacagaauucaguacagaaa

SEQ ID NO: 1148189 - RNA, 19 nt, Human
cuaaauguuugagauaacu

SEQ ID NO: 1148190 - RNA, 23 nt, Human
gcaguaauuuucaaauaaguccc

SEQ ID NO: 1148191 - RNA, 27 nt, Human
uacucugugauguuugccagguucccc

SEQ ID NO: 1148192 - RNA, 23 nt, Human
ucaaaaugacagugacaccauaa

SEQ ID NO: 1148193 - RNA, 20 nt, Human
ucuuccaaauguuaccaggu

SEQ ID NO: 1148194 - RNA, 23 nt, Human
ugacaccauaacaaaaucuucca

SEQ ID NO: 1148195 - RNA, 19 nt, Human
ugacagugacaccauaaca

SEQ ID NO: 1148196 - RNA, 23 nt, Human
ugcaucaccuaauggcccacaua

SEQ ID NO: 1148197 - RNA, 20 nt, Human
uguguacguauacucuguga

SEQ ID NO: 1148198 - RNA, 21 nt, Human
uucugcuacaguugccuacag

SEQ ID NO: 1148199 - RNA, 22 nt, Human
uuuauagccuaggagcaauaag

SEQ ID NO: 1148200 - RNA, 18 nt, Human
aauuuccuccuucaccuc

SEQ ID NO: 1148201 - RNA, 22 nt, Human
caggguggagcuggguuuccag

SEQ ID NO: 1148202 - RNA, 19 nt, Human
ccuccugauguaguggaag

SEQ ID NO: 1148203 - RNA, 23 nt, Human
cuuucaauuuccuccuucaccuc

SEQ ID NO: 1148204 - RNA, 22 nt, Human
guggaagcaggguggagcuggg

SEQ ID NO: 1148205 - RNA, 23 nt, Human
uaguggaagcaggguggagcugg

SEQ ID NO: 1148206 - RNA, 20 nt, Human
uggaagcaggguggagcugg

SEQ ID NO: 1148207 - RNA, 20 nt, Human
uggagcuggguuuccagggc

SEQ ID NO: 1148208 - RNA, 26 nt, Human
uguuucacacuuucaauuuccuccuu

SEQ ID NO: 1148209 - RNA, 28 nt, Human
uguuucacacuuucaauuuccuccuuca

SEQ ID NO: 1148210 - RNA, 18 nt, Human
uuucaggauccuuuguag

SEQ ID NO: 1148211 - RNA, 23 nt, Human
aagaggcaguuuucugucagcau

SEQ ID NO: 1148212 - RNA, 22 nt, Human
acccaucccaaccccucccacu

SEQ ID NO: 1148213 - RNA, 23 nt, Human
acccaucccaaccccucccacug

SEQ ID NO: 1148214 - RNA, 21 nt, Human
agauaccuguauugccacaca

SEQ ID NO: 1148215 - RNA, 23 nt, Human
auucuucaauucacauucuaaaa

SEQ ID NO: 1148216 - RNA, 24 nt, Human
auugcacuagaucauuuuuugcua

SEQ ID NO: 1148217 - RNA, 25 nt, Human
caacagauaccuguauugccacaca

SEQ ID NO: 1148218 - RNA, 22 nt, Human
caaccccucccacugaaaacua

SEQ ID NO: 1148219 - RNA, 21 nt, Human
caguacugccacuaacagccu

SEQ ID NO: 1148220 - RNA, 18 nt, Human
cagugguaguaggagacc

SEQ ID NO: 1148221 - RNA, 23 nt, Human
caucccaaccccucccacugaaa

SEQ ID NO: 1148222 - RNA, 20 nt, Human
ccacugaaacaugggauagg

SEQ ID NO: 1148223 - RNA, 24 nt, Human
cccaaccccucccacugaaaacua

SEQ ID NO: 1148224 - RNA, 19 nt, Human
cuuggagcugcuguugcug

SEQ ID NO: 1148225 - RNA, 20 nt, Human
gaugcagugguaguaggaga

SEQ ID NO: 1148226 - RNA, 23 nt, Human
gccacaguugaaauuuucuaacc

SEQ ID NO: 1148227 - RNA, 19 nt, Human
uaacccaaugaugucauua

SEQ ID NO: 1148228 - RNA, 19 nt, Human
uaacuugauaucguaguga

SEQ ID NO: 1148229 - RNA, 22 nt, Human
uacaacagauaccuguauugcc

SEQ ID NO: 1148230 - RNA, 21 nt, Human
uacccaucccaaccccuccca

SEQ ID NO: 1148231 - RNA, 22 nt, Human
uacuguaagaggcaguuuucug

SEQ ID NO: 1148232 - RNA, 24 nt, Human
uagaucauuuuuugcuauccucuu

SEQ ID NO: 1148233 - RNA, 18 nt, Human
uauauaugcauauauaua

SEQ ID NO: 1148234 - RNA, 19 nt, Human
uauauguguauauaugcau

SEQ ID NO: 1148235 - RNA, 19 nt, Human
uauguaacaaugagauuac

SEQ ID NO: 1148236 - RNA, 22 nt, Human
uauguguauauaugcauauaua

SEQ ID NO: 1148237 - RNA, 24 nt, Human
uauguguauauaugcauauauaua

SEQ ID NO: 1148238 - RNA, 20 nt, Human
ucuaaaauaccuauauuagc

SEQ ID NO: 1148239 - RNA, 23 nt, Human
ucugaaguuuuugggauccauuc

SEQ ID NO: 1148240 - RNA, 21 nt, Human
ucuucaauucacauucuaaaa

SEQ ID NO: 1148241 - RNA, 21 nt, Human
ugacugaacugccacaguuga

SEQ ID NO: 1148242 - RNA, 25 nt, Human
ugacugaacugccacaguugaaauu

SEQ ID NO: 1148243 - RNA, 28 nt, Human
ugcacuagaucauuuuuugcuauccucu

SEQ ID NO: 1148244 - RNA, 19 nt, Human
ugccacuaacagccugaag

SEQ ID NO: 1148245 - RNA, 22 nt, Human
uguauauaugcauauauauaua

SEQ ID NO: 1148246 - RNA, 19 nt, Human
ugucaguacugccacuaac

SEQ ID NO: 1148247 - RNA, 20 nt, Human
ugucaguacugccacuaaca

SEQ ID NO: 1148248 - RNA, 19 nt, Human
ugugcaaacacaguaauaa

SEQ ID NO: 1148249 - RNA, 18 nt, Human
uguguauauaugcauaua

SEQ ID NO: 1148250 - RNA, 20 nt, Human
uguguauauaugcauauaua

SEQ ID NO: 1148251 - RNA, 25 nt, Human
uguguauauaugcauauauauauau

SEQ ID NO: 1148252 - RNA, 22 nt, Human
uugaaauuuucuaacccaauga

SEQ ID NO: 1148253 - RNA, 25 nt, Human
uuucugaaguuuuugggauccauuc

SEQ ID NO: 1148254 - RNA, 24 nt, Human
uuugcuauccucuuucugaaguuu

SEQ ID NO: 1148255 - RNA, 18 nt, Human
uuuucacauagcaccagu

SEQ ID NO: 1148256 - RNA, 21 nt, Human
aaaaagaaauaacacccaaag

SEQ ID NO: 1148257 - RNA, 23 nt, Human
aaacugccauaaaaaaacauuug

SEQ ID NO: 1148258 - RNA, 21 nt, Human
aaccacaucuaacuucugguu

SEQ ID NO: 1148259 - RNA, 22 nt, Human
aaguauuccugcugaaacauuu

SEQ ID NO: 1148260 - RNA, 22 nt, Human
acugccauaaaaaaacauuugg

SEQ ID NO: 1148261 - RNA, 23 nt, Human
agaugaccagauaguacuaaaac

SEQ ID NO: 1148262 - RNA, 19 nt, Human
agaugcuaacuugaggaau

SEQ ID NO: 1148263 - RNA, 21 nt, Human
agcaugacuuuggaauaauau

SEQ ID NO: 1148264 - RNA, 21 nt, Human
aguacuaaaacccaggagaga

SEQ ID NO: 1148265 - RNA, 24 nt, Human
auaaaaaaacauuuggacaacuga

SEQ ID NO: 1148266 - RNA, 24 nt, Human
auucugaacaucagggaggaacau

SEQ ID NO: 1148267 - RNA, 20 nt, Human
cacaguguagagaagaaaau

SEQ ID NO: 1148268 - RNA, 20 nt, Human
cacccaaagccaauguauga

SEQ ID NO: 1148269 - RNA, 23 nt, Human
cacccaaagccaauguaugaacc

SEQ ID NO: 1148270 - RNA, 19 nt, Human
cccccaaaacuggguugaa

SEQ ID NO: 1148271 - RNA, 22 nt, Human
cccccaaaacuggguugaacaa

SEQ ID NO: 1148272 - RNA, 21 nt, Human
cccuuaauccacauuuaccca

SEQ ID NO: 1148273 - RNA, 18 nt, Human
ccuacaagcccugauggc

SEQ ID NO: 1148274 - RNA, 21 nt, Human
ccuacaagcccugauggcuaa

SEQ ID NO: 1148275 - RNA, 22 nt, Human
ccuacaagcccugauggcuaaa

SEQ ID NO: 1148276 - RNA, 22 nt, Human
cuagaagcacacagaucaucua

SEQ ID NO: 1148277 - RNA, 30 nt, Human
gcacacccccaaaacuggguugaacaaagg

SEQ ID NO: 1148278 - RNA, 18 nt, Human
ggaaaauaaaaacugcca

SEQ ID NO: 1148279 - RNA, 18 nt, Human
gggcauaggucauucuga

SEQ ID NO: 1148280 - RNA, 21 nt, Human
guauuccugcugaaacauuua

SEQ ID NO: 1148281 - RNA, 27 nt, Human
uaaaaacugccauaaaaaaacauuugg

SEQ ID NO: 1148282 - RNA, 19 nt, Human
uaaacacaguguagagaag

SEQ ID NO: 1148283 - RNA, 25 nt, Human
uaggagaucauccuuauucuuaaau

SEQ ID NO: 1148284 - RNA, 23 nt, Human
uaggcacacccccaaaacugggu

SEQ ID NO: 1148285 - RNA, 20 nt, Human
uauauaaacacaguguagag

SEQ ID NO: 1148286 - RNA, 21 nt, Human
uaugcaggaaaauaaaaacuu

SEQ ID NO: 1148287 - RNA, 23 nt, Human
ucaaaaguaaaccuccuuuuaac

SEQ ID NO: 1148288 - RNA, 18 nt, Human
ucgaugugauaauggcau

SEQ ID NO: 1148289 - RNA, 19 nt, Human
ucgaugugauaauggcauu

SEQ ID NO: 1148290 - RNA, 19 nt, Human
ucuauagauaccucaucug

SEQ ID NO: 1148291 - RNA, 24 nt, Human
ugacuauguugauguuuguuuccc

SEQ ID NO: 1148292 - RNA, 22 nt, Human
ugagccuucugaugugcuagaa

SEQ ID NO: 1148293 - RNA, 21 nt, Human
ugagcuauagggauggggaga

SEQ ID NO: 1148294 - RNA, 20 nt, Human
ugauugugucaaauaaaaaa

SEQ ID NO: 1148295 - RNA, 22 nt, Human
ugccauaaaaaaacauuuggac

SEQ ID NO: 1148296 - RNA, 27 nt, Human
ugcccuacaagcccugauggcuaaaag

SEQ ID NO: 1148297 - RNA, 22 nt, Human
uucaaaaagucaaugucauaga

SEQ ID NO: 1148298 - RNA, 24 nt, Human
uugauguuuguuucccuuaaucca

SEQ ID NO: 1148299 - RNA, 20 nt, Human
aaaaagaagacgaagaagaa

SEQ ID NO: 1148300 - RNA, 21 nt, Human
aaaaagaagacgaagaagaac

SEQ ID NO: 1148301 - RNA, 22 nt, Human
aacaggaagaaaggcucucuga

SEQ ID NO: 1148302 - RNA, 21 nt, Human
aagaagaacaggaagaaagga

SEQ ID NO: 1148303 - RNA, 22 nt, Human
aagaagacgaagaagaacagga

SEQ ID NO: 1148304 - RNA, 22 nt, Human
aagacgaagaagaacaggaaga

SEQ ID NO: 1148305 - RNA, 25 nt, Human
aagaggaaauggguguuuucuuggg

SEQ ID NO: 1148306 - RNA, 24 nt, Human
acgcugagaaucaauuagccaugc

SEQ ID NO: 1148307 - RNA, 24 nt, Human
agaaaaaaaagaagacgaagaaga

SEQ ID NO: 1148308 - RNA, 25 nt, Human
agaaaaaaaagaagacgaagaagaa

SEQ ID NO: 1148309 - RNA, 22 nt, Human
agacgaagaagaacaggaagaa

SEQ ID NO: 1148310 - RNA, 27 nt, Human
agccggugauaauauauuuuugcagcc

SEQ ID NO: 1148311 - RNA, 22 nt, Human
aggaaauggguguuuucuugga

SEQ ID NO: 1148312 - RNA, 19 nt, Human
aggaacuuaaugcaaguca

SEQ ID NO: 1148313 - RNA, 21 nt, Human
auucaggaagcuuaggccucc

SEQ ID NO: 1148314 - RNA, 18 nt, Human
caauuuguccauucgaaa

SEQ ID NO: 1148315 - RNA, 21 nt, Human
caccugcuucuccaaucucca

SEQ ID NO: 1148316 - RNA, 18 nt, Human
cacugcgcugguucagga

SEQ ID NO: 1148317 - RNA, 22 nt, Human
caggaagcuuaggccuccugcu

SEQ ID NO: 1148318 - RNA, 20 nt, Human
caggagcuggggccgcgugg

SEQ ID NO: 1148319 - RNA, 22 nt, Human
cccgcguuuuaccuccauucuu

SEQ ID NO: 1148320 - RNA, 21 nt, Human
ccgcugaaauccaucucgagg

SEQ ID NO: 1148321 - RNA, 20 nt, Human
ccucgcgucacuggccccuc

SEQ ID NO: 1148322 - RNA, 20 nt, Human
cgcagggccaccguggggag

SEQ ID NO: 1148323 - RNA, 22 nt, Human
cucucugcaaauccuggcggag

SEQ ID NO: 1148324 - RNA, 20 nt, Human
cucuuuccugccgcugaaau

SEQ ID NO: 1148325 - RNA, 18 nt, Human
cugccgcaugcucccucc

SEQ ID NO: 1148326 - RNA, 18 nt, Human
cugccgcugaaauccauc

SEQ ID NO: 1148327 - RNA, 23 nt, Human
cuucugccgcaugcucccuccag

SEQ ID NO: 1148328 - RNA, 21 nt, Human
cuuggagguuggcggguuagc

SEQ ID NO: 1148329 - RNA, 24 nt, Human
gaagacgaagaagaacaggaagaa

SEQ ID NO: 1148330 - RNA, 22 nt, Human
gcgcugcucucugcaaauccug

SEQ ID NO: 1148331 - RNA, 21 nt, Human
ggagaaggaggugaaccggcu

SEQ ID NO: 1148332 - RNA, 22 nt, Human
ggagaaggaggugaaccggcuu

SEQ ID NO: 1148333 - RNA, 22 nt, Human
ggggugccccucauagaguuuu

SEQ ID NO: 1148334 - RNA, 19 nt, Human
ggugcgcgcgcagggccac

SEQ ID NO: 1148335 - RNA, 23 nt, Human
uagaaaaaaaagaagacgaagaa

SEQ ID NO: 1148336 - RNA, 25 nt, Human
uagaaaaaaaagaagacgaagaaga

SEQ ID NO: 1148337 - RNA, 19 nt, Human
ucaguuuucaucuuuuuag

SEQ ID NO: 1148338 - RNA, 20 nt, Human
uccugccgcugaaauccauc

SEQ ID NO: 1148339 - RNA, 19 nt, Human
uccuggcggagcugggcgg

SEQ ID NO: 1148340 - RNA, 18 nt, Human
ucuccagaaaaagaaacu

SEQ ID NO: 1148341 - RNA, 22 nt, Human
ucuccugucccucgcucccaaa

SEQ ID NO: 1148342 - RNA, 23 nt, Human
ucuccugucccucgcucccaaac

SEQ ID NO: 1148343 - RNA, 23 nt, Human
ucugcaaauccuggcggagcugg

SEQ ID NO: 1148344 - RNA, 21 nt, Human
ucugccgcaugcucccuccag

SEQ ID NO: 1148345 - RNA, 20 nt, Human
ugaggcuccuuccucuuggg

SEQ ID NO: 1148346 - RNA, 18 nt, Human
ugccgcaugcucccucca

SEQ ID NO: 1148347 - RNA, 18 nt, Human
ugguuguggugaggagag

SEQ ID NO: 1148348 - RNA, 20 nt, Human
ugucccggcugcgcccacac

SEQ ID NO: 1148349 - RNA, 21 nt, Human
uucugccgcaugcucccucca

SEQ ID NO: 1148350 - RNA, 26 nt, Human
uuucugagacccaguuugagaagcgg

SEQ ID NO: 1148351 - RNA, 19 nt, Human
uuucuugggugacgggaga

SEQ ID NO: 1148352 - RNA, 20 nt, Human
aaaagaccauaaauaaauga

SEQ ID NO: 1148353 - RNA, 18 nt, Human
aaaugguucagaaucuau

SEQ ID NO: 1148354 - RNA, 23 nt, Human
aacauacuuagagugauacaaaa

SEQ ID NO: 1148355 - RNA, 23 nt, Human
aacugcucagaagagucaaccuc

SEQ ID NO: 1148356 - RNA, 23 nt, Human
aagaaaaaaauauauuuauauca

SEQ ID NO: 1148357 - RNA, 21 nt, Human
aaggaacugaugauucagaug

SEQ ID NO: 1148358 - RNA, 18 nt, Human
aaugcuugauguuguuug

SEQ ID NO: 1148359 - RNA, 23 nt, Human
aauguuaaauaagugaaaauauu

SEQ ID NO: 1148360 - RNA, 23 nt, Human
acaccaucucaaagcugacacac

SEQ ID NO: 1148361 - RNA, 20 nt, Human
accagacacauuccaucucc

SEQ ID NO: 1148362 - RNA, 19 nt, Human
acuugauuuggugcagcgg

SEQ ID NO: 1148363 - RNA, 19 nt, Human
agaccauaaauaaaugaca

SEQ ID NO: 1148364 - RNA, 23 nt, Human
agcaguguagcgagcacaaccuu

SEQ ID NO: 1148365 - RNA, 21 nt, Human
auaaauggccacgguuucugc

SEQ ID NO: 1148366 - RNA, 20 nt, Human
auacugaaucuucacacucc

SEQ ID NO: 1148367 - RNA, 23 nt, Human
auagaacacaaugccacacaccc

SEQ ID NO: 1148368 - RNA, 22 nt, Human
auccuucacagauugaauacaa

SEQ ID NO: 1148369 - RNA, 21 nt, Human
auuccaucuccuucucucucu

SEQ ID NO: 1148370 - RNA, 25 nt, Human
auuccaucuccuucucucucuccau

SEQ ID NO: 1148371 - RNA, 23 nt, Human
auuuuuuuuccucauuuuucccu

SEQ ID NO: 1148372 - RNA, 23 nt, Human
caaaugcaaacucuuugcauuua

SEQ ID NO: 1148373 - RNA, 20 nt, Human
caacccaccagaacauuuca

SEQ ID NO: 1148374 - RNA, 21 nt, Human
caaccuuucuuuaaaauaaga

SEQ ID NO: 1148375 - RNA, 22 nt, Human
cacacauaucuacguucaucuc

SEQ ID NO: 1148376 - RNA, 26 nt, Human
cagaauguaauaaauauuuauugaug

SEQ ID NO: 1148377 - RNA, 21 nt, Human
caguaugaacuaaauuauaau

SEQ ID NO: 1148378 - RNA, 23 nt, Human
cauaucuacguucaucuccaaaa

SEQ ID NO: 1148379 - RNA, 23 nt, Human
caucuccuucucucucuccauca

SEQ ID NO: 1148380 - RNA, 18 nt, Human
ccaacuaccuuaaccuca

SEQ ID NO: 1148381 - RNA, 19 nt, Human
ccagaacauuucacucgua

SEQ ID NO: 1148382 - RNA, 19 nt, Human
ccuacccuuaccucuggaa

SEQ ID NO: 1148383 - RNA, 23 nt, Human
ccucuggaaaagaugaacugcuc

SEQ ID NO: 1148384 - RNA, 22 nt, Human
cugauuugauguuauagcuuau

SEQ ID NO: 1148385 - RNA, 21 nt, Human
gaacacaaugccacacacccu

SEQ ID NO: 1148386 - RNA, 22 nt, Human
gauugcuaaaaaauaacuuggg

SEQ ID NO: 1148387 - RNA, 19 nt, Human
gccugaggccauuucaucc

SEQ ID NO: 1148388 - RNA, 19 nt, Human
ggagacaaaguauuaaucc

SEQ ID NO: 1148389 - RNA, 19 nt, Human
ggagcucacucggccaggg

SEQ ID NO: 1148390 - RNA, 23 nt, Human
uaaauaaaugacauaaguuaugu

SEQ ID NO: 1148391 - RNA, 19 nt, Human
uaaaugacauaaguuaugu

SEQ ID NO: 1148392 - RNA, 22 nt, Human
uaaccucaagagucacuggcau

SEQ ID NO: 1148393 - RNA, 24 nt, Human
uaacuccagaaaucacucaaaguu

SEQ ID NO: 1148394 - RNA, 27 nt, Human
uaagguccccaaaaaggggugaaucaa

SEQ ID NO: 1148395 - RNA, 24 nt, Human
uaauuacuguagaacuuuccaggu

SEQ ID NO: 1148396 - RNA, 22 nt, Human
uaccagacacauuccaucuccu

SEQ ID NO: 1148397 - RNA, 22 nt, Human
uacccuuaccucuggaaaagau

SEQ ID NO: 1148398 - RNA, 24 nt, Human
uagaacacaaugccacacacccug

SEQ ID NO: 1148399 - RNA, 25 nt, Human
uagaaggcugaugcucuugugaggg

SEQ ID NO: 1148400 - RNA, 23 nt, Human
uaugcaggaaaacaaaggcuacu

SEQ ID NO: 1148401 - RNA, 24 nt, Human
uauugggagacaaaguauuaaucc

SEQ ID NO: 1148402 - RNA, 19 nt, Human
ucaaccucauuucuuuaua

SEQ ID NO: 1148403 - RNA, 19 nt, Human
ucagaagagucaaccucau

SEQ ID NO: 1148404 - RNA, 22 nt, Human
ucuaagaaaaaaauauauuuau

SEQ ID NO: 1148405 - RNA, 24 nt, Human
ucuacuuauucaacaauaaauggu

SEQ ID NO: 1148406 - RNA, 18 nt, Human
ucuccuucucucucucca

SEQ ID NO: 1148407 - RNA, 24 nt, Human
ucuggaaaagaugaacugcucaga

SEQ ID NO: 1148408 - RNA, 25 nt, Human
ucuucaguguguaucaaugcuugau

SEQ ID NO: 1148409 - RNA, 18 nt, Human
ugaaauugccugaggcca

SEQ ID NO: 1148410 - RNA, 24 nt, Human
ugaacuaaauuauaauaugccuua

SEQ ID NO: 1148411 - RNA, 24 nt, Human
ugauacaaaaaauaaacgcacucu

SEQ ID NO: 1148412 - RNA, 18 nt, Human
ugauuugauguuauagcu

SEQ ID NO: 1148413 - RNA, 18 nt, Human
ugcacacaccagcagugu

SEQ ID NO: 1148414 - RNA, 22 nt, Human
ugcccacgggcucagacccaga

SEQ ID NO: 1148415 - RNA, 25 nt, Human
uggaacgugugaaccgaacaauguu

SEQ ID NO: 1148416 - RNA, 23 nt, Human
uggaguuugguauacauaucaua

SEQ ID NO: 1148417 - RNA, 23 nt, Human
uggggccugcauacacaagguga

SEQ ID NO: 1148418 - RNA, 20 nt, Human
ugguauacauaucauaucaa

SEQ ID NO: 1148419 - RNA, 19 nt, Human
uucguucgcauucaacaag

SEQ ID NO: 1148420 - RNA, 23 nt, Human
uuuaugcaggaaaacaaaggcua

SEQ ID NO: 1148421 - RNA, 22 nt, Human
uuugcauuuaguuugcuauuuu

SEQ ID NO: 1148422 - RNA, 24 nt, Human
gggcaguccuuccuguuugccucu

SEQ ID NO: 1148423 - RNA, 19 nt, Human
agauggaauuagaagcccu

SEQ ID NO: 1148424 - RNA, 20 nt, Human
agcagacccuucugugagaa

SEQ ID NO: 1148425 - RNA, 23 nt, Human
cacacucagcuuccugaugaucc

SEQ ID NO: 1148426 - RNA, 23 nt, Human
cacagucacagugcaaugaugcc

SEQ ID NO: 1148427 - RNA, 23 nt, Human
cacucagcuuccugaugauccag

SEQ ID NO: 1148428 - RNA, 23 nt, Human
cagacccuucugugagaagcaga

SEQ ID NO: 1148429 - RNA, 18 nt, Human
ccaccauugcuuuccucu

SEQ ID NO: 1148430 - RNA, 26 nt, Human
ccugugacuaagggcaguauugggac

SEQ ID NO: 1148431 - RNA, 24 nt, Human
ccuugguccuuggcucuccaaggu

SEQ ID NO: 1148432 - RNA, 21 nt, Human
cucugugcaacuaagcuccac

SEQ ID NO: 1148433 - RNA, 19 nt, Human
cuuggaauccacacucagc

SEQ ID NO: 1148434 - RNA, 22 nt, Human
cuugguccuuggcucuccaagg

SEQ ID NO: 1148435 - RNA, 18 nt, Human
cuuuaucaccucauucaa

SEQ ID NO: 1148436 - RNA, 19 nt, Human
gacccuuaaccccuugguc

SEQ ID NO: 1148437 - RNA, 24 nt, Human
gaccuggaugccugugacuaaggg

SEQ ID NO: 1148438 - RNA, 18 nt, Human
guaaaacagaugucaccu

SEQ ID NO: 1148439 - RNA, 20 nt, Human
gugagaagcagagaggggag

SEQ ID NO: 1148440 - RNA, 18 nt, Human
uaaaacagaugucaccuu

SEQ ID NO: 1148441 - RNA, 21 nt, Human
ucccaccauugcuuuccucug

SEQ ID NO: 1148442 - RNA, 23 nt, Human
ucuccaagguaucgaucccacca

SEQ ID NO: 1148443 - RNA, 22 nt, Human
ucuuggaauccacacucagcuu

SEQ ID NO: 1148444 - RNA, 18 nt, Human
ugagaagcagagagggga

SEQ ID NO: 1148445 - RNA, 24 nt, Human
ugagacucuuggaauccacacuca

SEQ ID NO: 1148446 - RNA, 19 nt, Human
uggaauuagaagcccugcu

SEQ ID NO: 1148447 - RNA, 22 nt, Human
uggaauuagaagcccugcuaac

SEQ ID NO: 1148448 - RNA, 26 nt, Human
uggacccuuaaccccuugguccuugg

SEQ ID NO: 1148449 - RNA, 22 nt, Human
uggaugccugugacuaagggca

SEQ ID NO: 1148450 - RNA, 20 nt, Human
ugggacacgugguuggaagc

SEQ ID NO: 1148451 - RNA, 20 nt, Human
uguccauacuguuugggacc

SEQ ID NO: 1148452 - RNA, 20 nt, Human
uguucagcagacccuucugu

SEQ ID NO: 1148453 - RNA, 21 nt, Human
uuucugaaguucugagccuuu

SEQ ID NO: 1148454 - RNA, 20 nt, Human
uuuucugaaguucugagccu

SEQ ID NO: 1148455 - RNA, 24 nt, Human
aauggucagcucucccugaggcuc

SEQ ID NO: 1148456 - RNA, 21 nt, Human
acagcaucuguagcuccuccu

SEQ ID NO: 1148457 - RNA, 19 nt, Human
auuucccucucugcaccuc

SEQ ID NO: 1148458 - RNA, 18 nt, Human
caauccaauccucugacc

SEQ ID NO: 1148459 - RNA, 22 nt, Human
cagcaucuguagcuccuccuug

SEQ ID NO: 1148460 - RNA, 21 nt, Human
cagcgucucagagaagaacag

SEQ ID NO: 1148461 - RNA, 25 nt, Human
ccaccaguguccccacaguccccac

SEQ ID NO: 1148462 - RNA, 18 nt, Human
ccccacaguccccaccug

SEQ ID NO: 1148463 - RNA, 22 nt, Human
ccucaauggucagcucucccug

SEQ ID NO: 1148464 - RNA, 23 nt, Human
ccucugaccccaugaccaccagg

SEQ ID NO: 1148465 - RNA, 21 nt, Human
ccuugucuggggugaggggcc

SEQ ID NO: 1148466 - RNA, 21 nt, Human
cgagggcuggugguccuuagc

SEQ ID NO: 1148467 - RNA, 18 nt, Human
cuccggacccgagggcug

SEQ ID NO: 1148468 - RNA, 24 nt, Human
cuccuugucuggggugaggggccc

SEQ ID NO: 1148469 - RNA, 23 nt, Human
cugagaccauggccagcgucuca

SEQ ID NO: 1148470 - RNA, 24 nt, Human
cugcuccugggccccaauccaauc

SEQ ID NO: 1148471 - RNA, 23 nt, Human
gaacagauaaagccccugcuccu

SEQ ID NO: 1148472 - RNA, 23 nt, Human
gaccccaugaccaccaguguccc

SEQ ID NO: 1148473 - RNA, 22 nt, Human
gccccaauccaauccucugacc

SEQ ID NO: 1148474 - RNA, 21 nt, Human
gcuggugguccuuagcucugg

SEQ ID NO: 1148475 - RNA, 22 nt, Human
gcuggugguccuuagcucugga

SEQ ID NO: 1148476 - RNA, 24 nt, Human
ucaauggucagcucucccugaggc

SEQ ID NO: 1148477 - RNA, 18 nt, Human
uccugguauuucccucuc

SEQ ID NO: 1148478 - RNA, 22 nt, Human
uguccccacaguccccaccugc

SEQ ID NO: 1148479 - RNA, 19 nt, Human
ugucugagaccauggccag

SEQ ID NO: 1148480 - RNA, 18 nt, Human
ugucuggggugaggggcc

SEQ ID NO: 1148481 - RNA, 19 nt, Human
aggagcuuuauucagucag

SEQ ID NO: 1148482 - RNA, 24 nt, Human
agaagaggcggcuugcagggcugg

SEQ ID NO: 1148483 - RNA, 24 nt, Human
agagagcucuguccuucucccuuc

SEQ ID NO: 1148484 - RNA, 18 nt, Human
caccugcccacaccugcc

SEQ ID NO: 1148485 - RNA, 20 nt, Human
ccugccacugggccuuuccc

SEQ ID NO: 1148486 - RNA, 23 nt, Human
cgagaagaggcggcuugcagggc

SEQ ID NO: 1148487 - RNA, 22 nt, Human
gcagggcuggcaccugcccaca

SEQ ID NO: 1148488 - RNA, 21 nt, Human
uccuucucccuucuaccgaga

SEQ ID NO: 1148489 - RNA, 21 nt, Human
ugagugggagcagaugcccuc

SEQ ID NO: 1148490 - RNA, 19 nt, Human
aacaugcaaauacugaaaa

SEQ ID NO: 1148491 - RNA, 21 nt, Human
aauacugaaaaaucaaaauaa

SEQ ID NO: 1148492 - RNA, 22 nt, Human
aauacugaaaaaucaaaauaaa

SEQ ID NO: 1148493 - RNA, 22 nt, Human
agaccgagaaacaugcaaauac

SEQ ID NO: 1148494 - RNA, 21 nt, Human
caacgagcaaagcagucuguc

SEQ ID NO: 1148495 - RNA, 19 nt, Human
cacaagccuccugccucag

SEQ ID NO: 1148496 - RNA, 22 nt, Human
cagccugucaguauuagaccga

SEQ ID NO: 1148497 - RNA, 23 nt, Human
caguauuagaccgagaaacaugc

SEQ ID NO: 1148498 - RNA, 20 nt, Human
ccugcagccguauuucagcu

SEQ ID NO: 1148499 - RNA, 25 nt, Human
cgagaaacaugcaaauacugaaaaa

SEQ ID NO: 1148500 - RNA, 23 nt, Human
gagaaacaugcaaauacugaaaa

SEQ ID NO: 1148501 - RNA, 26 nt, Human
uagaccgagaaacaugcaaauacuga

SEQ ID NO: 1148502 - RNA, 23 nt, Human
aagcaacugcuugaccaucaaac

SEQ ID NO: 1148503 - RNA, 19 nt, Human
aauuauaaaaauggaacuc

SEQ ID NO: 1148504 - RNA, 18 nt, Human
acaaggcauccaugaggg

SEQ ID NO: 1148505 - RNA, 20 nt, Human
acagccucugggggaguggg

SEQ ID NO: 1148506 - RNA, 22 nt, Human
acccucccauccucccgggccc

SEQ ID NO: 1148507 - RNA, 20 nt, Human
acucaggguguuuguggagc

SEQ ID NO: 1148508 - RNA, 19 nt, Human
acugcaagcugagcuccug

SEQ ID NO: 1148509 - RNA, 22 nt, Human
agaucuucauucugaacagccu

SEQ ID NO: 1148510 - RNA, 18 nt, Human
agcaaacucuaggcaaua

SEQ ID NO: 1148511 - RNA, 21 nt, Human
agcaaguuguucccgccaagc

SEQ ID NO: 1148512 - RNA, 22 nt, Human
agcacaucauacaaggauagcu

SEQ ID NO: 1148513 - RNA, 18 nt, Human
agcagaaaaugaaaaugg

SEQ ID NO: 1148514 - RNA, 23 nt, Human
auggaacucuccuccagucaaag

SEQ ID NO: 1148515 - RNA, 31 nt, Human
caaagcagcaaccucuuucaaaaaccuguuu

SEQ ID NO: 1148516 - RNA, 19 nt, Human
caagaugcucauuucuuug

SEQ ID NO: 1148517 - RNA, 20 nt, Human
cacuccucagccagcaagau

SEQ ID NO: 1148518 - RNA, 19 nt, Human
cagccacccucccauccuc

SEQ ID NO: 1148519 - RNA, 20 nt, Human
cagccacccucccauccucc

SEQ ID NO: 1148520 - RNA, 22 nt, Human
cauagaacagauuuccuuuuga

SEQ ID NO: 1148521 - RNA, 23 nt, Human
caucaaagaccuuagacacgacu

SEQ ID NO: 1148522 - RNA, 28 nt, Human
ccaaaauuauaaaaauggaacucuccuc

SEQ ID NO: 1148523 - RNA, 21 nt, Human
ccaagccauaggucuucagcc

SEQ ID NO: 1148524 - RNA, 24 nt, Human
ccagucaaagcagcaaccucuuuc

SEQ ID NO: 1148525 - RNA, 21 nt, Human
cccauggucccuucaacauau

SEQ ID NO: 1148526 - RNA, 18 nt, Human
cccuucaacauauucaga

SEQ ID NO: 1148527 - RNA, 20 nt, Human
ccucccgggcccgccugacc

SEQ ID NO: 1148528 - RNA, 21 nt, Human
ccuucaccaaguccaguuugc

SEQ ID NO: 1148529 - RNA, 21 nt, Human
cggcugcuggcauuggagagg

SEQ ID NO: 1148530 - RNA, 19 nt, Human
cucccgggcccgccugacc

SEQ ID NO: 1148531 - RNA, 20 nt, Human
cugaacagccucugggggag

SEQ ID NO: 1148532 - RNA, 23 nt, Human
cuguaugaacugaaugaucuugu

SEQ ID NO: 1148533 - RNA, 22 nt, Human
cugugacccuguuccauuuccu

SEQ ID NO: 1148534 - RNA, 21 nt, Human
gaaagagcagucggcaagcac

SEQ ID NO: 1148535 - RNA, 20 nt, Human
gaacucuccuccagucaaag

SEQ ID NO: 1148536 - RNA, 22 nt, Human
gagccuguuccaaauuaucuuc

SEQ ID NO: 1148537 - RNA, 18 nt, Human
gagggaggacaucuggcu

SEQ ID NO: 1148538 - RNA, 18 nt, Human
gccacccucccauccucc

SEQ ID NO: 1148539 - RNA, 25 nt, Human
ggcacucaggguguuuguggagcuu

SEQ ID NO: 1148540 - RNA, 18 nt, Human
ggcgaaggcugcgcgccg

SEQ ID NO: 1148541 - RNA, 20 nt, Human
ggcgggcgagguaagcaucc

SEQ ID NO: 1148542 - RNA, 20 nt, Human
uaaaaauggaacucuccucc

SEQ ID NO: 1148543 - RNA, 22 nt, Human
uacuuuuauauuucagcuguuc

SEQ ID NO: 1148544 - RNA, 21 nt, Human
uauuucagcuguuccuguaug

SEQ ID NO: 1148545 - RNA, 24 nt, Human
ucaaagcagcaaccucuuucaaaa

SEQ ID NO: 1148546 - RNA, 23 nt, Human
ucacagcaaacucuaggcaauau

SEQ ID NO: 1148547 - RNA, 24 nt, Human
ucagcagccacccucccauccucc

SEQ ID NO: 1148548 - RNA, 24 nt, Human
ucaucaaagaccuuagacacgaca

SEQ ID NO: 1148549 - RNA, 21 nt, Human
uccaaucuuuaugucucuaau

SEQ ID NO: 1148550 - RNA, 21 nt, Human
uccaggacgggaacauaggug

SEQ ID NO: 1148551 - RNA, 21 nt, Human
uccaggacugagccuguucca

SEQ ID NO: 1148552 - RNA, 23 nt, Human
ucccgccaagcaacugcuugacc

SEQ ID NO: 1148553 - RNA, 21 nt, Human
ucccgcucagcagccacccuc

SEQ ID NO: 1148554 - RNA, 23 nt, Human
ucccgcucagcagccacccuccc

SEQ ID NO: 1148555 - RNA, 19 nt, Human
ucccgggcccgccugaccc

SEQ ID NO: 1148556 - RNA, 19 nt, Human
uccucagccagcaagaugc

SEQ ID NO: 1148557 - RNA, 21 nt, Human
ucugaaaggccccaugguccc

SEQ ID NO: 1148558 - RNA, 22 nt, Human
ucugggguugaaaucauagaac

SEQ ID NO: 1148559 - RNA, 20 nt, Human
ugaaaauggccucaaguagg

SEQ ID NO: 1148560 - RNA, 21 nt, Human
ugaaaggccccauggucccuu

SEQ ID NO: 1148561 - RNA, 21 nt, Human
ugaacagccucugggggagug

SEQ ID NO: 1148562 - RNA, 19 nt, Human
ugacaaggcauccaugagg

SEQ ID NO: 1148563 - RNA, 18 nt, Human
ugagggugaguuucuugg

SEQ ID NO: 1148564 - RNA, 20 nt, Human
uggcuucugagcaggcuggu

SEQ ID NO: 1148565 - RNA, 20 nt, Human
ugguuuugguugauucugcg

SEQ ID NO: 1148566 - RNA, 23 nt, Human
ugucggguggaagacguggcggc

SEQ ID NO: 1148567 - RNA, 24 nt, Human
uuauaaaaauggaacucuccucca

SEQ ID NO: 1148568 - RNA, 19 nt, Human
uuccuucucgcgucaccuu

SEQ ID NO: 1148569 - RNA, 21 nt, Human
uucugacgauuugucauccag

SEQ ID NO: 1148570 - RNA, 21 nt, Human
uucugcgugaaggacuuucuu

SEQ ID NO: 1148571 - RNA, 23 nt, Human
uuucacugcaagcugagcuccug

SEQ ID NO: 1148572 - RNA, 22 nt, Human
aaaguccugccaugcacaaccc

SEQ ID NO: 1148573 - RNA, 28 nt, Human
aaaguuccucucccuggauccucuuuuu

SEQ ID NO: 1148574 - RNA, 19 nt, Human
aacacuuccaccuggaauc

SEQ ID NO: 1148575 - RNA, 21 nt, Human
aagaguucaagaccagccugg

SEQ ID NO: 1148576 - RNA, 19 nt, Human
aaggcucuccuacccucca

SEQ ID NO: 1148577 - RNA, 22 nt, Human
aaggcucuccuacccuccauca

SEQ ID NO: 1148578 - RNA, 20 nt, Human
aaguuccucucccuggaucc

SEQ ID NO: 1148579 - RNA, 26 nt, Human
aaguuccucucccuggauccucuuuu

SEQ ID NO: 1148580 - RNA, 20 nt, Human
aauuuccauuugugcauccc

SEQ ID NO: 1148581 - RNA, 18 nt, Human
acacagaaaaaauaagau

SEQ ID NO: 1148582 - RNA, 22 nt, Human
acacagccaaaaaucaucacau

SEQ ID NO: 1148583 - RNA, 21 nt, Human
accauacugaaggcaaguugc

SEQ ID NO: 1148584 - RNA, 21 nt, Human
accucacugucccuaccccuc

SEQ ID NO: 1148585 - RNA, 22 nt, Human
acucauuuuguccuaccucucu

SEQ ID NO: 1148586 - RNA, 24 nt, Human
agaaaguccugccaugcacaaccc

SEQ ID NO: 1148587 - RNA, 24 nt, Human
agaaaucagagaagacagaaacaa

SEQ ID NO: 1148588 - RNA, 23 nt, Human
agccaaaaaucaucacauagucc

SEQ ID NO: 1148589 - RNA, 21 nt, Human
agcccuaccccaguccucaga

SEQ ID NO: 1148590 - RNA, 19 nt, Human
agccuggucaacauaguga

SEQ ID NO: 1148591 - RNA, 24 nt, Human
agccuggucaacauagugagauuc

SEQ ID NO: 1148592 - RNA, 21 nt, Human
aggcaagagaaauucuggaaa

SEQ ID NO: 1148593 - RNA, 24 nt, Human
agugcccgguugcccaagucaaaa

SEQ ID NO: 1148594 - RNA, 22 nt, Human
aguuguuccuucucugucuucu

SEQ ID NO: 1148595 - RNA, 20 nt, Human
auaaaaaguaauuacaauga

SEQ ID NO: 1148596 - RNA, 24 nt, Human
auaaauuuuguauuuaaaacagag

SEQ ID NO: 1148597 - RNA, 23 nt, Human
aucuugaaauguccucucccuca

SEQ ID NO: 1148598 - RNA, 19 nt, Human
auucuugaacaccacucau

SEQ ID NO: 1148599 - RNA, 22 nt, Human
auuuuguccuaccucucuguga

SEQ ID NO: 1148600 - RNA, 23 nt, Human
caaagaaaucagagaagacagaa

SEQ ID NO: 1148601 - RNA, 22 nt, Human
caacauagugagauucuaucuc

SEQ ID NO: 1148602 - RNA, 24 nt, Human
caagaccagccuggucaacauagu

SEQ ID NO: 1148603 - RNA, 20 nt, Human
cacacagaaaaaauaagaua

SEQ ID NO: 1148604 - RNA, 20 nt, Human
cacaguuacucagcagcacu

SEQ ID NO: 1148605 - RNA, 24 nt, Human
caccuggaauccccaaagaggccc

SEQ ID NO: 1148606 - RNA, 22 nt, Human
cacugcucaaagaaaucagaga

SEQ ID NO: 1148607 - RNA, 19 nt, Human
cacuguguggccguucagc

SEQ ID NO: 1148608 - RNA, 24 nt, Human
cagaaaaaauaagauaccuaggaa

SEQ ID NO: 1148609 - RNA, 24 nt, Human
caucccaugcccagcccacccucc

SEQ ID NO: 1148610 - RNA, 22 nt, Human
ccagcccacccuccaccagccu

SEQ ID NO: 1148611 - RNA, 23 nt, Human
ccagcuagucuauccuucagcca

SEQ ID NO: 1148612 - RNA, 21 nt, Human
cccaugcccagcccacccucc

SEQ ID NO: 1148613 - RNA, 19 nt, Human
ccccaaagaggcccgcuuu

SEQ ID NO: 1148614 - RNA, 24 nt, Human
ccccacacagccagcaugugucca

SEQ ID NO: 1148615 - RNA, 18 nt, Human
ccuccaucauuccucccu

SEQ ID NO: 1148616 - RNA, 24 nt, Human
ccucccucuaccccacacagccag

SEQ ID NO: 1148617 - RNA, 24 nt, Human
ccucugcaguucacucugcugcuu

SEQ ID NO: 1148618 - RNA, 24 nt, Human
ccuggucaacauagugagauucua

SEQ ID NO: 1148619 - RNA, 19 nt, Human
ccuguugugacuuccuaug

SEQ ID NO: 1148620 - RNA, 18 nt, Human
cucccucuaccccacaca

SEQ ID NO: 1148621 - RNA, 23 nt, Human
cucuuccacaacuuuaacuucag

SEQ ID NO: 1148622 - RNA, 23 nt, Human
cugaaaucagacaaugauuagaa

SEQ ID NO: 1148623 - RNA, 21 nt, Human
cugacucacuucuuagcucca

SEQ ID NO: 1148624 - RNA, 24 nt, Human
cugcuaaauauaucucaauuguau

SEQ ID NO: 1148625 - RNA, 19 nt, Human
cuggguucugguuucuuuc

SEQ ID NO: 1148626 - RNA, 21 nt, Human
cuucaugagugcccgguugcc

SEQ ID NO: 1148627 - RNA, 18 nt, Human
cuucucuauucuaagaga

SEQ ID NO: 1148628 - RNA, 29 nt, Human
cuuggcuucucccucuaguuguuccuucu

SEQ ID NO: 1148629 - RNA, 21 nt, Human
cuuuuagccuccacacugguu

SEQ ID NO: 1148630 - RNA, 19 nt, Human
gaaucacaguuacucagca

SEQ ID NO: 1148631 - RNA, 24 nt, Human
gagauucuaucucaauggaucacu

SEQ ID NO: 1148632 - RNA, 18 nt, Human
gcccacccuccaccagcc

SEQ ID NO: 1148633 - RNA, 22 nt, Human
ggggaaucacaguuacucagca

SEQ ID NO: 1148634 - RNA, 21 nt, Human
ggucaugccuaugugugagcu

SEQ ID NO: 1148635 - RNA, 18 nt, Human
guauuuaaaacagagcuc

SEQ ID NO: 1148636 - RNA, 24 nt, Human
guccaacacuuccaccuggaaucc

SEQ ID NO: 1148637 - RNA, 21 nt, Human
gugagauucuaucucaaugga

SEQ ID NO: 1148638 - RNA, 21 nt, Human
uaacugauguguuucaccaua

SEQ ID NO: 1148639 - RNA, 18 nt, Human
uacaucuucuucuucacu

SEQ ID NO: 1148640 - RNA, 23 nt, Human
uacaucuucuucuucacugcauu

SEQ ID NO: 1148641 - RNA, 21 nt, Human
uaccccucuacucucugacuc

SEQ ID NO: 1148642 - RNA, 21 nt, Human
uagaaagaggacuuaccucac

SEQ ID NO: 1148643 - RNA, 22 nt, Human
uagugucuguggagaaacuuuu

SEQ ID NO: 1148644 - RNA, 23 nt, Human
uagugucuguggagaaacuuuuu

SEQ ID NO: 1148645 - RNA, 23 nt, Human
uaguuguuccuucucugucuucu

SEQ ID NO: 1148646 - RNA, 18 nt, Human
ucacucugcugcuucaga

SEQ ID NO: 1148647 - RNA, 19 nt, Human
ucacugcauuuuugugggc

SEQ ID NO: 1148648 - RNA, 24 nt, Human
ucaguguccucucaugggcuuccu

SEQ ID NO: 1148649 - RNA, 20 nt, Human
uccaacacuuccaccuggaa

SEQ ID NO: 1148650 - RNA, 23 nt, Human
ucccucaguuccuauguguuacc

SEQ ID NO: 1148651 - RNA, 22 nt, Human
ucccuggauccucuuuuuccuu

SEQ ID NO: 1148652 - RNA, 21 nt, Human
uccucuuuuuccuucaugagu

SEQ ID NO: 1148653 - RNA, 20 nt, Human
uccuucaugagugcccgguu

SEQ ID NO: 1148654 - RNA, 20 nt, Human
ucgcuugggugccaagaguu

SEQ ID NO: 1148655 - RNA, 24 nt, Human
ucgcuugggugccaagaguucaag

SEQ ID NO: 1148656 - RNA, 24 nt, Human
ucugugaccgugaaagaccggggc

SEQ ID NO: 1148657 - RNA, 18 nt, Human
ugaaaauuuucaggucug

SEQ ID NO: 1148658 - RNA, 18 nt, Human
ugaaauguccucucccuc

SEQ ID NO: 1148659 - RNA, 21 nt, Human
ugaugccaucaccuggggaau

SEQ ID NO: 1148660 - RNA, 21 nt, Human
ugcccagcccacccuccacca

SEQ ID NO: 1148661 - RNA, 23 nt, Human
ugcccagcccacccuccaccagc

SEQ ID NO: 1148662 - RNA, 22 nt, Human
ugccuuggcuucucccucuagu

SEQ ID NO: 1148663 - RNA, 19 nt, Human
uggacacagccaaaaauca

SEQ ID NO: 1148664 - RNA, 20 nt, Human
uggcaaaggucaucucucug

SEQ ID NO: 1148665 - RNA, 23 nt, Human
uggguguccuuguagaaaguccu

SEQ ID NO: 1148666 - RNA, 23 nt, Human
ugucccuaccccucuacucucug

SEQ ID NO: 1148667 - RNA, 22 nt, Human
ugugaauaacaaaaugaagaau

SEQ ID NO: 1148668 - RNA, 21 nt, Human
ugugaccgugaaagacggcug

SEQ ID NO: 1148669 - RNA, 21 nt, Human
ugugacuuccuauggacacag

SEQ ID NO: 1148670 - RNA, 18 nt, Human
uuaaaacagagcucuuga

SEQ ID NO: 1148671 - RNA, 19 nt, Human
uucacucugcugcuucaga

SEQ ID NO: 1148672 - RNA, 23 nt, Human
uuccauuugugcaucccaugccc

SEQ ID NO: 1148673 - RNA, 24 nt, Human
uuccucccucuaccccacacagcc

SEQ ID NO: 1148674 - RNA, 23 nt, Human
uugugcaucccaugcccagccca

SEQ ID NO: 1148675 - RNA, 18 nt, Human
uugugggcugcacuuacc

SEQ ID NO: 1148676 - RNA, 18 nt, Human
uuguuccugccuagucca

SEQ ID NO: 1148677 - RNA, 24 nt, Human
uuuccauuugugcaucccaugccc

SEQ ID NO: 1148678 - RNA, 20 nt, Human
aaugaucaaguaucugcauc

SEQ ID NO: 1148679 - RNA, 22 nt, Human
acccaccgcaaaugaaccugug

SEQ ID NO: 1148680 - RNA, 18 nt, Human
acccagagcaccuagccu

SEQ ID NO: 1148681 - RNA, 21 nt, Human
acccagagcaccuagccucag

SEQ ID NO: 1148682 - RNA, 18 nt, Human
acuucaggaacacagagg

SEQ ID NO: 1148683 - RNA, 24 nt, Human
agauaacccagagcaccuagccuc

SEQ ID NO: 1148684 - RNA, 20 nt, Human
aggcuugauuccuuccuuuu

SEQ ID NO: 1148685 - RNA, 18 nt, Human
cacauucugucucccagg

SEQ ID NO: 1148686 - RNA, 24 nt, Human
cacuagauaacccagagcaccuag

SEQ ID NO: 1148687 - RNA, 24 nt, Human
ccagaaacacauucugucucccag

SEQ ID NO: 1148688 - RNA, 20 nt, Human
ccuagccucagacccaccgc

SEQ ID NO: 1148689 - RNA, 24 nt, Human
ccucagacccaccgcaaaugaacc

SEQ ID NO: 1148690 - RNA, 20 nt, Human
ccuggucagucuagcuucug

SEQ ID NO: 1148691 - RNA, 21 nt, Human
cucagacccaccgcaaaugaa

SEQ ID NO: 1148692 - RNA, 23 nt, Human
cuucaggaagcacuagauaaccc

SEQ ID NO: 1148693 - RNA, 22 nt, Human
uaggcaaagaaugaucaaguau

SEQ ID NO: 1148694 - RNA, 18 nt, Human
ucacaguaucgccugguc

SEQ ID NO: 1148695 - RNA, 20 nt, Human
ucacaguaucgccuggucag

SEQ ID NO: 1148696 - RNA, 26 nt, Human
ucucuguuccucuccgggauuuacug

SEQ ID NO: 1148697 - RNA, 20 nt, Human
uuuugggagugaaaaggacc

SEQ ID NO: 1148698 - RNA, 21 nt, Human
aaaaacaacaacaacaacaac

SEQ ID NO: 1148699 - RNA, 22 nt, Human
aaaacaacaacaacaacaaaac

SEQ ID NO: 1148700 - RNA, 19 nt, Human
aaaagaaaaagaaaaacaa

SEQ ID NO: 1148701 - RNA, 22 nt, Human
aaacaaaaaagaggagagaaca

SEQ ID NO: 1148702 - RNA, 23 nt, Human
aaacaaaaaagaggagagaacag

SEQ ID NO: 1148703 - RNA, 23 nt, Human
aaacaacaacaacaacaacgaaa

SEQ ID NO: 1148704 - RNA, 27 nt, Human
aaacaacaacaacaacaacgaaaacaa

SEQ ID NO: 1148705 - RNA, 24 nt, Human
aagaaaaagaaaaacaacaacaac

SEQ ID NO: 1148706 - RNA, 25 nt, Human
aagaaaaagaaaaacaacaacaaca

SEQ ID NO: 1148707 - RNA, 21 nt, Human
acaacaacaacaacaacgaaa

SEQ ID NO: 1148708 - RNA, 24 nt, Human
acaacaacaacaacaacgaaaaca

SEQ ID NO: 1148709 - RNA, 21 nt, Human
acagggaagcugggguccccu

SEQ ID NO: 1148710 - RNA, 24 nt, Human
acccuccccaccuucccuuucccc

SEQ ID NO: 1148711 - RNA, 20 nt, Human
accggggacugguggagugg

SEQ ID NO: 1148712 - RNA, 22 nt, Human
acuccauuagaaaaccaagaaa

SEQ ID NO: 1148713 - RNA, 20 nt, Human
agaaaaacaacaacaacaac

SEQ ID NO: 1148714 - RNA, 19 nt, Human
agaaaaagaaaaacaacaa

SEQ ID NO: 1148715 - RNA, 18 nt, Human
aggagacuccggcuggcg

SEQ ID NO: 1148716 - RNA, 20 nt, Human
caacaacaacaacaacgaaa

SEQ ID NO: 1148717 - RNA, 25 nt, Human
caacaacaacaacgaaaacaaccgg

SEQ ID NO: 1148718 - RNA, 28 nt, Human
caacaacaacaacgaaaacaaccgguag

SEQ ID NO: 1148719 - RNA, 20 nt, Human
caacaacaacgaaaacaacc

SEQ ID NO: 1148720 - RNA, 26 nt, Human
caacaacgaaaacaaccgguaggcaa

SEQ ID NO: 1148721 - RNA, 19 nt, Human
cagggaagcuggggucccc

SEQ ID NO: 1148722 - RNA, 21 nt, Human
caguggcgguagagaggagac

SEQ ID NO: 1148723 - RNA, 24 nt, Human
cccuccccaccuucccuuucccca

SEQ ID NO: 1148724 - RNA, 18 nt, Human
cccucggacccuccccac

SEQ ID NO: 1148725 - RNA, 19 nt, Human
cggacccuccccaccuucc

SEQ ID NO: 1148726 - RNA, 20 nt, Human
cggacccuccccaccuuccc

SEQ ID NO: 1148727 - RNA, 21 nt, Human
cggcuuuuuuuuuuuuuucuc

SEQ ID NO: 1148728 - RNA, 21 nt, Human
cuuccccucggacccucccca

SEQ ID NO: 1148729 - RNA, 21 nt, Human
gagcgggcacagggaagcugg

SEQ ID NO: 1148730 - RNA, 22 nt, Human
gaguggggugagcgggcacagg

SEQ ID NO: 1148731 - RNA, 19 nt, Human
ggaaucugaaggaaucuug

SEQ ID NO: 1148732 - RNA, 20 nt, Human
ggcuuuuuuuuuuuuuucuc

SEQ ID NO: 1148733 - RNA, 18 nt, Human
ggguccccuuccccucgg

SEQ ID NO: 1148734 - RNA, 20 nt, Human
gguagagaggagacuccggc

SEQ ID NO: 1148735 - RNA, 20 nt, Human
guugcauuuguugauuuauu

SEQ ID NO: 1148736 - RNA, 24 nt, Human
uauuuuuguuuuuaaaguugaaaa

SEQ ID NO: 1148737 - RNA, 24 nt, Human
ucaaaaaaaaaaagaaaaagaaaa

SEQ ID NO: 1148738 - RNA, 25 nt, Human
ucaaaaaaaaaaagaaaaagaaaaa

SEQ ID NO: 1148739 - RNA, 26 nt, Human
ugaaaacaaaaaagaggagagaacag

SEQ ID NO: 1148740 - RNA, 18 nt, Human
ugaaauagaaacaaaagc

SEQ ID NO: 1148741 - RNA, 24 nt, Human
ugagcgggcacagggaagcugggg

SEQ ID NO: 1148742 - RNA, 23 nt, Human
uggaguggggugagcgggcacag

SEQ ID NO: 1148743 - RNA, 19 nt, Human
uggcgguagagaggagacu

SEQ ID NO: 1148744 - RNA, 20 nt, Human
ugggcuacggugugacagug

SEQ ID NO: 1148745 - RNA, 23 nt, Human
ugggguccccuuccccucggacc

SEQ ID NO: 1148746 - RNA, 19 nt, Human
uggggugagcgggcacagg

SEQ ID NO: 1148747 - RNA, 18 nt, Human
uugaaauagaaacaaaag

SEQ ID NO: 1148748 - RNA, 22 nt, Human
uugcauuuguugauuuauuuuu

SEQ ID NO: 1148749 - RNA, 24 nt, Human
uuucaggagaggaggccagagucu

SEQ ID NO: 1148750 - RNA, 20 nt, Human
uuuuuuuucucacaaacugg

SEQ ID NO: 1148751 - RNA, 30 nt, Human
uuuuuuuuuuuuucggcuuuuuuuuuuuuu

SEQ ID NO: 1148752 - RNA, 22 nt, Human
uuuuuuuuuuuuuucggcuuuu

SEQ ID NO: 1148753 - RNA, 21 nt, Human
aaaaacaacaacaacaacaac

SEQ ID NO: 1148754 - RNA, 22 nt, Human
aaaagaaaaagaaaaacaacaa

SEQ ID NO: 1148755 - RNA, 22 nt, Human
aaacaaaaaagaggagagaaca

SEQ ID NO: 1148756 - RNA, 23 nt, Human
aaacaaaaaagaggagagaacag

SEQ ID NO: 1148757 - RNA, 23 nt, Human
aaacaacaacaacaacaacgaaa

SEQ ID NO: 1148758 - RNA, 27 nt, Human
aaacaacaacaacaacaacgaaaacaa

SEQ ID NO: 1148759 - RNA, 19 nt, Human
aaaccggaagagucuggcg

SEQ ID NO: 1148760 - RNA, 23 nt, Human
aaagaaaaaaacaaagaaaaaga

SEQ ID NO: 1148761 - RNA, 22 nt, Human
aaaggcuggggugggacuggug

SEQ ID NO: 1148762 - RNA, 22 nt, Human
aacccauucccccauuuuccuc

SEQ ID NO: 1148763 - RNA, 19 nt, Human
aaccccugucccucguccc

SEQ ID NO: 1148764 - RNA, 21 nt, Human
aaccggugcguggcgggagca

SEQ ID NO: 1148765 - RNA, 21 nt, Human
aaccugccucccucacacccu

SEQ ID NO: 1148766 - RNA, 22 nt, Human
aaccugccucccucacacccug

SEQ ID NO: 1148767 - RNA, 20 nt, Human
aacgcaaggggcagaagccu

SEQ ID NO: 1148768 - RNA, 22 nt, Human
aagaaaaaaacaaagaaaaaga

SEQ ID NO: 1148769 - RNA, 24 nt, Human
aagaaaaagaaaaacaacaacaac

SEQ ID NO: 1148770 - RNA, 25 nt, Human
aagaaaaagaaaaacaacaacaaca

SEQ ID NO: 1148771 - RNA, 22 nt, Human
aaggccagccuggagucaaaga

SEQ ID NO: 1148772 - RNA, 23 nt, Human
aaggcccagcuucucuggggagu

SEQ ID NO: 1148773 - RNA, 20 nt, Human
aaggggcaugaucagaaaag

SEQ ID NO: 1148774 - RNA, 25 nt, Human
aauagaaacaaaagccuaagagaaa

SEQ ID NO: 1148775 - RNA, 21 nt, Human
acaacaacaacaacaacgaaa

SEQ ID NO: 1148776 - RNA, 25 nt, Human
acaacaacaacaacaacgaaaacaa

SEQ ID NO: 1148777 - RNA, 27 nt, Human
acaccaggcucuaaucccccaccugau

SEQ ID NO: 1148778 - RNA, 21 nt, Human
acagggaagcugggguccccu

SEQ ID NO: 1148779 - RNA, 21 nt, Human
acaguccgugaagagagagcc

SEQ ID NO: 1148780 - RNA, 26 nt, Human
acagugcaauguaauucuugcacuuu

SEQ ID NO: 1148781 - RNA, 24 nt, Human
acccuccccaccuucccuuucccc

SEQ ID NO: 1148782 - RNA, 20 nt, Human
accggggacugguggagugg

SEQ ID NO: 1148783 - RNA, 22 nt, Human
accugauggcuggcagcaaaga

SEQ ID NO: 1148784 - RNA, 18 nt, Human
accuugaggggggcuugg

SEQ ID NO: 1148785 - RNA, 22 nt, Human
acuccauuagaaaaccaagaaa

SEQ ID NO: 1148786 - RNA, 22 nt, Human
acucuggccggaaccauccauc

SEQ ID NO: 1148787 - RNA, 19 nt, Human
acugcucaagaugcaaagg

SEQ ID NO: 1148788 - RNA, 18 nt, Human
acugucccaccuugaggg

SEQ ID NO: 1148789 - RNA, 21 nt, Human
acugucccaccuugagggggg

SEQ ID NO: 1148790 - RNA, 23 nt, Human
acuuacaccaggcucuaaucccc

SEQ ID NO: 1148791 - RNA, 20 nt, Human
agaaaaacaacaacaacaac

SEQ ID NO: 1148792 - RNA, 19 nt, Human
agaaaaagaaaaacaacaa

SEQ ID NO: 1148793 - RNA, 21 nt, Human
agaaagaaaaaaacaaagaaa

SEQ ID NO: 1148794 - RNA, 21 nt, Human
agaaaggaagaaagaaaaaaa

SEQ ID NO: 1148795 - RNA, 26 nt, Human
aggaagaaagaaaaaaacaaagaaaa

SEQ ID NO: 1148796 - RNA, 20 nt, Human
aggaagcuccucaaugcccc

SEQ ID NO: 1148797 - RNA, 18 nt, Human
aggaaggagggucagucc

SEQ ID NO: 1148798 - RNA, 18 nt, Human
aggagacuccggcuggcg

SEQ ID NO: 1148799 - RNA, 18 nt, Human
aggcucuaaucccccacc

SEQ ID NO: 1148800 - RNA, 19 nt, Human
aggcuggggugggacuggu

SEQ ID NO: 1148801 - RNA, 18 nt, Human
aggggacagcugugcaga

SEQ ID NO: 1148802 - RNA, 18 nt, Human
agguggugguggggagau

SEQ ID NO: 1148803 - RNA, 25 nt, Human
agguuccagucucuuccuccccaug

SEQ ID NO: 1148804 - RNA, 23 nt, Human
agugaccagcugcccaggagaaa

SEQ ID NO: 1148805 - RNA, 23 nt, Human
agugcaauguaauucuugcacuu

SEQ ID NO: 1148806 - RNA, 22 nt, Human
aguuggguuuaggggacagcug

SEQ ID NO: 1148807 - RNA, 20 nt, Human
caacaacaacaacaacgaaa

SEQ ID NO: 1148808 - RNA, 25 nt, Human
caacaacaacaacgaaaacaaccgg

SEQ ID NO: 1148809 - RNA, 28 nt, Human
caacaacaacaacgaaaacaaccgguag

SEQ ID NO: 1148810 - RNA, 20 nt, Human
caacaacaacgaaaacaacc

SEQ ID NO: 1148811 - RNA, 26 nt, Human
caacaacgaaaacaaccgguaggcaa

SEQ ID NO: 1148812 - RNA, 19 nt, Human
caaggcccagguugcuggc

SEQ ID NO: 1148813 - RNA, 19 nt, Human
caccauuccaaaccugccu

SEQ ID NO: 1148814 - RNA, 24 nt, Human
cacccuccuaaaguuacucaccuu

SEQ ID NO: 1148815 - RNA, 24 nt, Human
cacccugggcucagccagaacucc

SEQ ID NO: 1148816 - RNA, 19 nt, Human
caccuugaggggggcuugg

SEQ ID NO: 1148817 - RNA, 18 nt, Human
cagcauggagagugaggg

SEQ ID NO: 1148818 - RNA, 22 nt, Human
cagcccccucucccuucagccc

SEQ ID NO: 1148819 - RNA, 21 nt, Human
cagccuauccucccccacaga

SEQ ID NO: 1148820 - RNA, 19 nt, Human
cagggaagcuggggucccc

SEQ ID NO: 1148821 - RNA, 20 nt, Human
caggugguugaggcccaccc

SEQ ID NO: 1148822 - RNA, 21 nt, Human
caguacaaggcccagguugcu

SEQ ID NO: 1148823 - RNA, 26 nt, Human
cagucagcccccucucccuucagccc

SEQ ID NO: 1148824 - RNA, 18 nt, Human
cagucggccaaaggccag

SEQ ID NO: 1148825 - RNA, 21 nt, Human
caguggcgguagagaggagac

SEQ ID NO: 1148826 - RNA, 21 nt, Human
caguguccccaggccugucug

SEQ ID NO: 1148827 - RNA, 19 nt, Human
cauccaucuuacuguucuc

SEQ ID NO: 1148828 - RNA, 21 nt, Human
ccaaaccugccucccucacac

SEQ ID NO: 1148829 - RNA, 24 nt, Human
ccaaaccugccucccucacacccu

SEQ ID NO: 1148830 - RNA, 22 nt, Human
ccacagaggcugcugcgcuacu

SEQ ID NO: 1148831 - RNA, 24 nt, Human
ccaccugauggcuggcagcaaaga

SEQ ID NO: 1148832 - RNA, 22 nt, Human
ccacggagggcuggccucugcc

SEQ ID NO: 1148833 - RNA, 24 nt, Human
ccagccuggagucaaagagaccag

SEQ ID NO: 1148834 - RNA, 24 nt, Human
ccaucucuuacuucagucucccuc

SEQ ID NO: 1148835 - RNA, 21 nt, Human
cccacccucuaggggaggcca

SEQ ID NO: 1148836 - RNA, 20 nt, Human
cccacuuuuuuuuuucagcc

SEQ ID NO: 1148837 - RNA, 22 nt, Human
cccagaaugaggaagcuccuca

SEQ ID NO: 1148838 - RNA, 23 nt, Human
ccccaugugcccugcuuugccag

SEQ ID NO: 1148839 - RNA, 24 nt, Human
cccuccccaccuucccuuucccca

SEQ ID NO: 1148840 - RNA, 20 nt, Human
cccuccuaaaguuacucacc

SEQ ID NO: 1148841 - RNA, 18 nt, Human
cccucggacccuccccac

SEQ ID NO: 1148842 - RNA, 20 nt, Human
cccucucccuucagcccucu

SEQ ID NO: 1148843 - RNA, 21 nt, Human
cccugggcucagccagaacuc

SEQ ID NO: 1148844 - RNA, 23 nt, Human
cccugucccucgucccuccucca

SEQ ID NO: 1148845 - RNA, 20 nt, Human
ccuccccacaucgacucugg

SEQ ID NO: 1148846 - RNA, 20 nt, Human
ccucuaggggaggccagccc

SEQ ID NO: 1148847 - RNA, 19 nt, Human
ccucucaaauccuagaaaa

SEQ ID NO: 1148848 - RNA, 21 nt, Human
ccucucuuuccucucaaaucc

SEQ ID NO: 1148849 - RNA, 21 nt, Human
ccugccucccucacacccugc

SEQ ID NO: 1148850 - RNA, 20 nt, Human
ccuggcucagucuuuucuca

SEQ ID NO: 1148851 - RNA, 23 nt, Human
ccugggcucagccagaacuccca

SEQ ID NO: 1148852 - RNA, 19 nt, Human
ccugucugucuaggccugg

SEQ ID NO: 1148853 - RNA, 20 nt, Human
cgaggcaggcaaaaaugcua

SEQ ID NO: 1148854 - RNA, 18 nt, Human
cgcacuuacaccaggcuc

SEQ ID NO: 1148855 - RNA, 19 nt, Human
cggacccuccccaccuucc

SEQ ID NO: 1148856 - RNA, 20 nt, Human
cggacccuccccaccuuccc

SEQ ID NO: 1148857 - RNA, 21 nt, Human
cgugggaaagacagaggcauc

SEQ ID NO: 1148858 - RNA, 20 nt, Human
cuaggggaggccagcccugu

SEQ ID NO: 1148859 - RNA, 22 nt, Human
cucccuucagcccucuguuccc

SEQ ID NO: 1148860 - RNA, 22 nt, Human
cuccuguccccagccaacuguc

SEQ ID NO: 1148861 - RNA, 21 nt, Human
cuggagucaaagagaccagac

SEQ ID NO: 1148862 - RNA, 22 nt, Human
cuggcugucaaagaaagguucc

SEQ ID NO: 1148863 - RNA, 22 nt, Human
cuuugaaagaaaggaagaaaga

SEQ ID NO: 1148864 - RNA, 19 nt, Human
gaagcuccucaaugccccu

SEQ ID NO: 1148865 - RNA, 20 nt, Human
gacucuggccggaaccaucc

SEQ ID NO: 1148866 - RNA, 26 nt, Human
gagcaggugguugaggcccacccucu

SEQ ID NO: 1148867 - RNA, 21 nt, Human
gagcgggcacagggaagcugg

SEQ ID NO: 1148868 - RNA, 23 nt, Human
gagggucaguccuggcugggcuu

SEQ ID NO: 1148869 - RNA, 18 nt, Human
gagugaccagcugcccag

SEQ ID NO: 1148870 - RNA, 22 nt, Human
gaguggggugagcgggcacagg

SEQ ID NO: 1148871 - RNA, 23 nt, Human
gcaacccauucccccauuuuccu

SEQ ID NO: 1148872 - RNA, 23 nt, Human
gcaccauuccaaaccugccuccc

SEQ ID NO: 1148873 - RNA, 20 nt, Human
gccacagagguggugguggg

SEQ ID NO: 1148874 - RNA, 19 nt, Human
gcccuguggggguaccaug

SEQ ID NO: 1148875 - RNA, 19 nt, Human
gccguggcagcccugucuc

SEQ ID NO: 1148876 - RNA, 20 nt, Human
gccuccuuucucuuggaagc

SEQ ID NO: 1148877 - RNA, 19 nt, Human
ggaaucugaaggaaucuug

SEQ ID NO: 1148878 - RNA, 18 nt, Human
ggagauggggugggagag

SEQ ID NO: 1148879 - RNA, 19 nt, Human
ggaggccagcccugugggg

SEQ ID NO: 1148880 - RNA, 22 nt, Human
ggaugggaagaccuucuguggg

SEQ ID NO: 1148881 - RNA, 20 nt, Human
ggcgguugccguggcagccc

SEQ ID NO: 1148882 - RNA, 19 nt, Human
gggaggaauguggggggag

SEQ ID NO: 1148883 - RNA, 23 nt, Human
ggggaggccagcccugugggggu

SEQ ID NO: 1148884 - RNA, 18 nt, Human
ggguccccuuccccucgg

SEQ ID NO: 1148885 - RNA, 22 nt, Human
ggguuucuucuccuuagagcuc

SEQ ID NO: 1148886 - RNA, 20 nt, Human
gguagagaggagacuccggc

SEQ ID NO: 1148887 - RNA, 21 nt, Human
ggugguggggagauggggugg

SEQ ID NO: 1148888 - RNA, 21 nt, Human
gguuucuucuccuuagagcuc

SEQ ID NO: 1148889 - RNA, 20 nt, Human
guagauaaauacgagcccac

SEQ ID NO: 1148890 - RNA, 21 nt, Human
guccagacacaguccgugaag

SEQ ID NO: 1148891 - RNA, 18 nt, Human
guggggagaugggguggg

SEQ ID NO: 1148892 - RNA, 24 nt, Human
guggugguggggagaugggguggg

SEQ ID NO: 1148893 - RNA, 26 nt, Human
guugaggcccacccucuaggggaggc

SEQ ID NO: 1148894 - RNA, 20 nt, Human
guugcauuuguugauuuauu

SEQ ID NO: 1148895 - RNA, 23 nt, Human
uaaaaacacagacaguacaaggc

SEQ ID NO: 1148896 - RNA, 25 nt, Human
uaaaaacacagacaguacaaggccc

SEQ ID NO: 1148897 - RNA, 18 nt, Human
uaaagucuagcacccucc

SEQ ID NO: 1148898 - RNA, 24 nt, Human
uaccauggaggccacagagguggu

SEQ ID NO: 1148899 - RNA, 20 nt, Human
uacuucagucucccuccugc

SEQ ID NO: 1148900 - RNA, 18 nt, Human
uagaaaauacauauggug

SEQ ID NO: 1148901 - RNA, 23 nt, Human
uagaauggaacagucagcccccu

SEQ ID NO: 1148902 - RNA, 23 nt, Human
uaguuccuggcucagucuuuucu

SEQ ID NO: 1148903 - RNA, 19 nt, Human
uaugguggggaagcuaagg

SEQ ID NO: 1148904 - RNA, 25 nt, Human
uauuggcuuuucccccuuucugguc

SEQ ID NO: 1148905 - RNA, 25 nt, Human
ucaaaaaaaaaaagaaaaagaaaaa

SEQ ID NO: 1148906 - RNA, 20 nt, Human
ucaguccuggcugggcuucc

SEQ ID NO: 1148907 - RNA, 30 nt, Human
ucauuucuauuuugcaacccauucccccaa

SEQ ID NO: 1148908 - RNA, 23 nt, Human
uccaaaccugccucccucacacc

SEQ ID NO: 1148909 - RNA, 20 nt, Human
uccacuuugcaaaacggagc

SEQ ID NO: 1148910 - RNA, 22 nt, Human
ucccaggaucuccccacccugg

SEQ ID NO: 1148911 - RNA, 22 nt, Human
uccccagccaacuguccugucc

SEQ ID NO: 1148912 - RNA, 19 nt, Human
uccccucggacccucccca

SEQ ID NO: 1148913 - RNA, 27 nt, Human
ucccucgucccuccuccacuuugcaaa

SEQ ID NO: 1148914 - RNA, 24 nt, Human
uccgggguacugucccaccuugag

SEQ ID NO: 1148915 - RNA, 22 nt, Human
uccuccacuuugcaaaacggag

SEQ ID NO: 1148916 - RNA, 23 nt, Human
uccucucuuuccucucaaauccu

SEQ ID NO: 1148917 - RNA, 18 nt, Human
ucgugcgccugccuuccu

SEQ ID NO: 1148918 - RNA, 21 nt, Human
ucuaaaccuuuuugccaccau

SEQ ID NO: 1148919 - RNA, 23 nt, Human
ucuccccacccugggcucagcca

SEQ ID NO: 1148920 - RNA, 18 nt, Human
ucucccucugccaucucu

SEQ ID NO: 1148921 - RNA, 21 nt, Human
ucugagguucccauucugggc

SEQ ID NO: 1148922 - RNA, 22 nt, Human
ucugggccggagcccucucagg

SEQ ID NO: 1148923 - RNA, 26 nt, Human
ugaaaacaaaaaagaggagagaacag

SEQ ID NO: 1148924 - RNA, 18 nt, Human
ugaaauagaaacaaaagc

SEQ ID NO: 1148925 - RNA, 18 nt, Human
ugaaauagaaacaaaagc

SEQ ID NO: 1148926 - RNA, 19 nt, Human
ugaaauagaaacaaaagcc

SEQ ID NO: 1148927 - RNA, 21 nt, Human
ugaaauagaaacaaaagccua

SEQ ID NO: 1148928 - RNA, 24 nt, Human
ugagcgggcacagggaagcugggg

SEQ ID NO: 1148929 - RNA, 20 nt, Human
ugcaaaccuuugaaagaaag

SEQ ID NO: 1148930 - RNA, 23 nt, Human
ugcaaaccuuugaaagaaaggaa

SEQ ID NO: 1148931 - RNA, 23 nt, Human
ugcaacccauucccccauuuucc

SEQ ID NO: 1148932 - RNA, 19 nt, Human
ugcagaagagacucacagg

SEQ ID NO: 1148933 - RNA, 18 nt, Human
ugccaaagcuagaaugga

SEQ ID NO: 1148934 - RNA, 23 nt, Human
uggaaagaacagugacguggaag

SEQ ID NO: 1148935 - RNA, 26 nt, Human
uggaacagucagcccccucucccuuc

SEQ ID NO: 1148936 - RNA, 20 nt, Human
uggaagccagacauauccuc

SEQ ID NO: 1148937 - RNA, 20 nt, Human
uggaccuguugggcucaugu

SEQ ID NO: 1148938 - RNA, 23 nt, Human
uggaguggggugagcgggcacag

SEQ ID NO: 1148939 - RNA, 23 nt, Human
uggauuaagcucauuucuauuuu

SEQ ID NO: 1148940 - RNA, 18 nt, Human
uggcagauccuaguugga

SEQ ID NO: 1148941 - RNA, 19 nt, Human
uggccuaagacauacagaa

SEQ ID NO: 1148942 - RNA, 19 nt, Human
uggcgguagagaggagacu

SEQ ID NO: 1148943 - RNA, 23 nt, Human
uggcuucuaaagucuagcacccu

SEQ ID NO: 1148944 - RNA, 20 nt, Human
ugggcuacggugugacagug

SEQ ID NO: 1148945 - RNA, 18 nt, Human
uggggagaugggguggga

SEQ ID NO: 1148946 - RNA, 19 nt, Human
uggggagauggggugggag

SEQ ID NO: 1148947 - RNA, 18 nt, Human
uggggagugaccagcugc

SEQ ID NO: 1148948 - RNA, 23 nt, Human
ugggguccccuuccccucggacc

SEQ ID NO: 1148949 - RNA, 19 nt, Human
uggggugagcgggcacagg

SEQ ID NO: 1148950 - RNA, 21 nt, Human
uggggugggagagaaggggca

SEQ ID NO: 1148951 - RNA, 23 nt, Human
uggggugggagagaaggggcaac

SEQ ID NO: 1148952 - RNA, 22 nt, Human
ugggugagcagacagucggcca

SEQ ID NO: 1148953 - RNA, 21 nt, Human
uggugguggggagauggggug

SEQ ID NO: 1148954 - RNA, 23 nt, Human
ugucaaagaaagguuccagucuc

SEQ ID NO: 1148955 - RNA, 18 nt, Human
ugugcagagagauggggc

SEQ ID NO: 1148956 - RNA, 19 nt, Human
ugugcagagagauggggca

SEQ ID NO: 1148957 - RNA, 18 nt, Human
uguggugugguguccgga

SEQ ID NO: 1148958 - RNA, 23 nt, Human
uuaaugcaaaccuuugaaagaaa

SEQ ID NO: 1148959 - RNA, 22 nt, Human
uuagugguuuuaaaaacacaga

SEQ ID NO: 1148960 - RNA, 22 nt, Human
uuccagucucuuccuccccaug

SEQ ID NO: 1148961 - RNA, 22 nt, Human
uuccuggcucagucuuuucuca

SEQ ID NO: 1148962 - RNA, 21 nt, Human
uucuauuggcuuuucccccuu

SEQ ID NO: 1148963 - RNA, 20 nt, Human
uucuccugcaucuaaaccuu

SEQ ID NO: 1148964 - RNA, 23 nt, Human
uucucugagguucccauucuggg

SEQ ID NO: 1148965 - RNA, 22 nt, Human
uugcauuuguugauuuauuuuu

SEQ ID NO: 1148966 - RNA, 22 nt, Human
uugcuggcuggugaaaccccug

SEQ ID NO: 1148967 - RNA, 24 nt, Human
uuucaggagaggaggccagagucu

SEQ ID NO: 1148968 - RNA, 22 nt, Human
uuucucaggggaguggcacccc

SEQ ID NO: 1148969 - RNA, 19 nt, Human
gccugcuccuacuguuguc

SEQ ID NO: 1148970 - RNA, 21 nt, Human
aaaagaagcaguaggagacaa

SEQ ID NO: 1148971 - RNA, 22 nt, Human
aaacagaaagcccaggcauagu

SEQ ID NO: 1148972 - RNA, 21 nt, Human
aaacauaagcgacagagacaa

SEQ ID NO: 1148973 - RNA, 20 nt, Human
aaacuccuagcaugagagaa

SEQ ID NO: 1148974 - RNA, 23 nt, Human
aaacuccuagcaugagagaaaug

SEQ ID NO: 1148975 - RNA, 25 nt, Human
aagaacaagaaaagaagccgguacc

SEQ ID NO: 1148976 - RNA, 21 nt, Human
aagaagaaacaaauucacuaa

SEQ ID NO: 1148977 - RNA, 26 nt, Human
acaaauacaaccuuucacugucacac

SEQ ID NO: 1148978 - RNA, 23 nt, Human
accccaaguagaguaaaggugga

SEQ ID NO: 1148979 - RNA, 21 nt, Human
accugggaaucuagagggcuc

SEQ ID NO: 1148980 - RNA, 27 nt, Human
agaaacuggcuguguguccucagacaa

SEQ ID NO: 1148981 - RNA, 19 nt, Human
agaagcuugcauucccuag

SEQ ID NO: 1148982 - RNA, 19 nt, Human
agaggcaaagacagagaag

SEQ ID NO: 1148983 - RNA, 26 nt, Human
agauguugaaaaucuucggaaaagcc

SEQ ID NO: 1148984 - RNA, 26 nt, Human
agcgacagagacaagaacaucagaaa

SEQ ID NO: 1148985 - RNA, 19 nt, Human
aggaagaguagaggcaaag

SEQ ID NO: 1148986 - RNA, 23 nt, Human
aggaauagaggaagaguagaggc

SEQ ID NO: 1148987 - RNA, 20 nt, Human
aggagagguuguuugcugag

SEQ ID NO: 1148988 - RNA, 19 nt, Human
aggcaagauuacagguucu

SEQ ID NO: 1148989 - RNA, 25 nt, Human
aggggauggaugagaauaaagaaca

SEQ ID NO: 1148990 - RNA, 23 nt, Human
agguggacugcaaaaaacagcuu

SEQ ID NO: 1148991 - RNA, 19 nt, Human
aguaggagacaaaugagaa

SEQ ID NO: 1148992 - RNA, 18 nt, Human
auucuggucccaaacucc

SEQ ID NO: 1148993 - RNA, 19 nt, Human
caaccuuucacugucacac

SEQ ID NO: 1148994 - RNA, 18 nt, Human
caagggaguccccaaacc

SEQ ID NO: 1148995 - RNA, 21 nt, Human
cagcacugagaagugaaggaa

SEQ ID NO: 1148996 - RNA, 24 nt, Human
cagcacugagaagugaaggaauau

SEQ ID NO: 1148997 - RNA, 25 nt, Human
cagcagaauuguacaauaugacauu

SEQ ID NO: 1148998 - RNA, 22 nt, Human
caucagaaagggccgcugugac

SEQ ID NO: 1148999 - RNA, 23 nt, Human
ccagccuuuacaaauacaaccuu

SEQ ID NO: 1149000 - RNA, 19 nt, Human
ccaggcauagucugaugcc

SEQ ID NO: 1149001 - RNA, 20 nt, Human
cccuggguuucuguuuucuc

SEQ ID NO: 1149002 - RNA, 18 nt, Human
cuagcaaugaguucaucu

SEQ ID NO: 1149003 - RNA, 20 nt, Human
cuagcaugagagaaaugugg

SEQ ID NO: 1149004 - RNA, 18 nt, Human
cuauauuuuacccaugag

SEQ ID NO: 1149005 - RNA, 20 nt, Human
cucagauccucaacgucuuc

SEQ ID NO: 1149006 - RNA, 22 nt, Human
cucgggucguggcugccgaugg

SEQ ID NO: 1149007 - RNA, 19 nt, Human
gaaacccauggauuuggga

SEQ ID NO: 1149008 - RNA, 21 nt, Human
gacagagacaagaacaucaga

SEQ ID NO: 1149009 - RNA, 19 nt, Human
gagaaacauaagcgacaga

SEQ ID NO: 1149010 - RNA, 19 nt, Human
gaggaaacuaaggaccugg

SEQ ID NO: 1149011 - RNA, 23 nt, Human
gauggaugagaauaaagaacaag

SEQ ID NO: 1149012 - RNA, 21 nt, Human
gcaaaaaacagcuuagucuga

SEQ ID NO: 1149013 - RNA, 18 nt, Human
gcaugcuuugaucuuucu

SEQ ID NO: 1149014 - RNA, 23 nt, Human
gccaucaacaggaacuugaugac

SEQ ID NO: 1149015 - RNA, 24 nt, Human
gcuaacccaaagguacuaggccca

SEQ ID NO: 1149016 - RNA, 20 nt, Human
ggagacaaaugagaagguua

SEQ ID NO: 1149017 - RNA, 24 nt, Human
ggggauuucugcucuuccagccuu

SEQ ID NO: 1149018 - RNA, 22 nt, Human
guccccaaacccuggguuucug

SEQ ID NO: 1149019 - RNA, 19 nt, Human
uaaaacagaaagcccaggc

SEQ ID NO: 1149020 - RNA, 21 nt, Human
uaagcgacagagacaagaaca

SEQ ID NO: 1149021 - RNA, 21 nt, Human
uagaggcaaagacagagaagg

SEQ ID NO: 1149022 - RNA, 25 nt, Human
uagcaaaaggcggaaauauuuugaa

SEQ ID NO: 1149023 - RNA, 20 nt, Human
uagcaugagagaaaugugga

SEQ ID NO: 1149024 - RNA, 24 nt, Human
uagcaugagagaaauguggaccuu

SEQ ID NO: 1149025 - RNA, 23 nt, Human
uaggagacaaaugagaagguuaa

SEQ ID NO: 1149026 - RNA, 19 nt, Human
uagucuccaugaugguuua

SEQ ID NO: 1149027 - RNA, 21 nt, Human
uaucaagaagaaacaaauuca

SEQ ID NO: 1149028 - RNA, 25 nt, Human
uaucaagaagaaacaaauucacuaa

SEQ ID NO: 1149029 - RNA, 21 nt, Human
uaugcaugcuuugaucuuucu

SEQ ID NO: 1149030 - RNA, 23 nt, Human
ucagugcacagcugaguuuuuau

SEQ ID NO: 1149031 - RNA, 20 nt, Human
uccaagggaagaacauuuga

SEQ ID NO: 1149032 - RNA, 24 nt, Human
uccaggaguuuagcauguaggagg

SEQ ID NO: 1149033 - RNA, 19 nt, Human
uccucaacgucuucaacug

SEQ ID NO: 1149034 - RNA, 24 nt, Human
uccuuggcucugcaucuaagaaac

SEQ ID NO: 1149035 - RNA, 23 nt, Human
ucuggcaaaauugcuaacccaaa

SEQ ID NO: 1149036 - RNA, 24 nt, Human
ugaaggaauagaggaagaguagag

SEQ ID NO: 1149037 - RNA, 19 nt, Human
ugacuucaagggagucccc

SEQ ID NO: 1149038 - RNA, 23 nt, Human
ugagaagugaaggaauauuuggg

SEQ ID NO: 1149039 - RNA, 19 nt, Human
ugaguucaucugaauucug

SEQ ID NO: 1149040 - RNA, 21 nt, Human
uggcaaaauugcuaacccaaa

SEQ ID NO: 1149041 - RNA, 22 nt, Human
uggcugccgauggagcucguaa

SEQ ID NO: 1149042 - RNA, 18 nt, Human
uuaaaaagaaaugaaccc

SEQ ID NO: 1149043 - RNA, 21 nt, Human
uugaaccaguacuagcaauga

SEQ ID NO: 1149044 - RNA, 19 nt, Human
uuggaaauuguauguggua

SEQ ID NO: 1149045 - RNA, 20 nt, Human
uuuauaauuguaugcaugcu

SEQ ID NO: 1149046 - RNA, 21 nt, Human
aaaacaaaauacagcaaagag

SEQ ID NO: 1149047 - RNA, 22 nt, Human
aaaauaaacguacaccuagucc

SEQ ID NO: 1149048 - RNA, 19 nt, Human
aaacaaaauacagcaaaga

SEQ ID NO: 1149049 - RNA, 22 nt, Human
aaaccuagcaauggauuuggug

SEQ ID NO: 1149050 - RNA, 19 nt, Human
aaagagccauugccaauga

SEQ ID NO: 1149051 - RNA, 19 nt, Human
aacuacauaaccuaauacc

SEQ ID NO: 1149052 - RNA, 25 nt, Human
aagcaaugcagcaacaggaaaagau

SEQ ID NO: 1149053 - RNA, 21 nt, Human
aagcccgccuaccugcguagc

SEQ ID NO: 1149054 - RNA, 19 nt, Human
aagcuuccuccgagcugaa

SEQ ID NO: 1149055 - RNA, 21 nt, Human
acuuccccaguuaaagacacc

SEQ ID NO: 1149056 - RNA, 19 nt, Human
agaugagcaaugaaguuag

SEQ ID NO: 1149057 - RNA, 20 nt, Human
agcaaaugaauggcaggugc

SEQ ID NO: 1149058 - RNA, 24 nt, Human
agcaccuauuacucagaaagcaac

SEQ ID NO: 1149059 - RNA, 22 nt, Human
aggacccagcaacaaggaaaca

SEQ ID NO: 1149060 - RNA, 21 nt, Human
auauucauacacacauagcuu

SEQ ID NO: 1149061 - RNA, 21 nt, Human
caaaacaaaauacagcaaaga

SEQ ID NO: 1149062 - RNA, 21 nt, Human
caaggaaacacuaagcaaugc

SEQ ID NO: 1149063 - RNA, 21 nt, Human
cacgccacaaaaauuagcaaa

SEQ ID NO: 1149064 - RNA, 23 nt, Human
cacuaacucuuguuggguaacau

SEQ ID NO: 1149065 - RNA, 20 nt, Human
cacuuaacacuaacucuugu

SEQ ID NO: 1149066 - RNA, 21 nt, Human
ccacgccacaaaaauuagcaa

SEQ ID NO: 1149067 - RNA, 19 nt, Human
cccagaugagcaaugaagu

SEQ ID NO: 1149068 - RNA, 18 nt, Human
cccagcaacaaggaaaca

SEQ ID NO: 1149069 - RNA, 20 nt, Human
ccuaugaagccaggaguaag

SEQ ID NO: 1149070 - RNA, 20 nt, Human
ccuccaagcuuccuccgagc

SEQ ID NO: 1149071 - RNA, 21 nt, Human
ccugcguagcaccuauuacuc

SEQ ID NO: 1149072 - RNA, 22 nt, Human
cuaguaggagcagcucuaauuc

SEQ ID NO: 1149073 - RNA, 22 nt, Human
cucaaauuaauaaaaaagaauc

SEQ ID NO: 1149074 - RNA, 21 nt, Human
cuuccccaguuaaagacaccu

SEQ ID NO: 1149075 - RNA, 20 nt, Human
gaccacuguggucugauuua

SEQ ID NO: 1149076 - RNA, 21 nt, Human
gagaggccuuguagauagccc

SEQ ID NO: 1149077 - RNA, 19 nt, Human
gagcugaaagagccauugc

SEQ ID NO: 1149078 - RNA, 22 nt, Human
gcagcaacaggaaaagauacca

SEQ ID NO: 1149079 - RNA, 18 nt, Human
guuggguaacauuaaaca

SEQ ID NO: 1149080 - RNA, 26 nt, Human
uaaaaaagaaucuccacgccacaaaa

SEQ ID NO: 1149081 - RNA, 19 nt, Human
uaaaacguaacaucgcaca

SEQ ID NO: 1149082 - RNA, 23 nt, Human
uaacaaaaaguuacacugacauu

SEQ ID NO: 1149083 - RNA, 18 nt, Human
uaacaugaaucuugcuga

SEQ ID NO: 1149084 - RNA, 20 nt, Human
uaaccuaauaccaucaaaaa

SEQ ID NO: 1149085 - RNA, 23 nt, Human
uaagacggauaacaugaaucuug

SEQ ID NO: 1149086 - RNA, 26 nt, Human
uaauaaaaaagaaucuccacgccaca

SEQ ID NO: 1149087 - RNA, 21 nt, Human
uacaauguuguuugugaaaug

SEQ ID NO: 1149088 - RNA, 19 nt, Human
uacacacauagcuuaaagc

SEQ ID NO: 1149089 - RNA, 27 nt, Human
uacacacauagcuuaaagcuuguguag

SEQ ID NO: 1149090 - RNA, 21 nt, Human
uaccaaguaaucugaguuucc

SEQ ID NO: 1149091 - RNA, 19 nt, Human
uacuagagaguaggaccca

SEQ ID NO: 1149092 - RNA, 21 nt, Human
uagcaaaugaauggcaggugc

SEQ ID NO: 1149093 - RNA, 19 nt, Human
uaggagcagcucuaauuca

SEQ ID NO: 1149094 - RNA, 24 nt, Human
ucaaauuaauaaaaaagaaucucc

SEQ ID NO: 1149095 - RNA, 18 nt, Human
uccauuuuuacaauugau

SEQ ID NO: 1149096 - RNA, 21 nt, Human
ucuauuguagaauauagaaau

SEQ ID NO: 1149097 - RNA, 24 nt, Human
ugaaucuugcugaaaagggaccag

SEQ ID NO: 1149098 - RNA, 19 nt, Human
ugcaaaacaaaauacagca

SEQ ID NO: 1149099 - RNA, 21 nt, Human
ugcagcaacaggaaaagauac

SEQ ID NO: 1149100 - RNA, 24 nt, Human
ugccaguguaacaaaaaguuacac

SEQ ID NO: 1149101 - RNA, 22 nt, Human
ugcuaccuguguccuaugaagc

SEQ ID NO: 1149102 - RNA, 22 nt, Human
ugggaacuugaucaucacuuaa

SEQ ID NO: 1149103 - RNA, 18 nt, Human
uggggaccacuguggucu

SEQ ID NO: 1149104 - RNA, 18 nt, Human
ugguguacuucacagcag

SEQ ID NO: 1149105 - RNA, 20 nt, Human
uguacugcucaguuaucuag

SEQ ID NO: 1149106 - RNA, 21 nt, Human
ugucaugaagaagugaugagu

SEQ ID NO: 1149107 - RNA, 21 nt, Human
uguccuaugaagccaggaguu

SEQ ID NO: 1149108 - RNA, 18 nt, Human
uguuugugguacuucccc

SEQ ID NO: 1149109 - RNA, 19 nt, Human
uuggggaccacuguggucu

SEQ ID NO: 1149110 - RNA, 24 nt, Human
uuguguauuuuacauauacacaaa

SEQ ID NO: 1149111 - RNA, 24 nt, Human
uuuguuuuguaaccaacaugauuu

SEQ ID NO: 1149112 - RNA, 18 nt, Human
aaacaaguuacacguccc

SEQ ID NO: 1149113 - RNA, 21 nt, Human
aaacuauagcuacagugaagc

SEQ ID NO: 1149114 - RNA, 20 nt, Human
aaagaaggaaugugaaaagg

SEQ ID NO: 1149115 - RNA, 19 nt, Human
aaagggagaaaaauagggc

SEQ ID NO: 1149116 - RNA, 19 nt, Human
aagagcugcugguuuuuaa

SEQ ID NO: 1149117 - RNA, 24 nt, Human
aagaucacuuuagcucaagaauuu

SEQ ID NO: 1149118 - RNA, 19 nt, Human
aagcagcccuacagaugga

SEQ ID NO: 1149119 - RNA, 24 nt, Human
aaggagcccagucaggagacaggu

SEQ ID NO: 1149120 - RNA, 20 nt, Human
aaguuggcaggaacugggag

SEQ ID NO: 1149121 - RNA, 23 nt, Human
aaucucagccaaaauagaccuaa

SEQ ID NO: 1149122 - RNA, 22 nt, Human
aauguucuggcuuggcuauguu

SEQ ID NO: 1149123 - RNA, 22 nt, Human
acaaaagcacaggaaacaccag

SEQ ID NO: 1149124 - RNA, 23 nt, Human
acacacauacacacacacacaca

SEQ ID NO: 1149125 - RNA, 19 nt, Human
acagguuagaagagucuuu

SEQ ID NO: 1149126 - RNA, 21 nt, Human
acauacacacacacacacaua

SEQ ID NO: 1149127 - RNA, 23 nt, Human
acauacacacacacacacauacu

SEQ ID NO: 1149128 - RNA, 20 nt, Human
accagugcucagguuuugcu

SEQ ID NO: 1149129 - RNA, 18 nt, Human
acuuggugccauccugug

SEQ ID NO: 1149130 - RNA, 22 nt, Human
agacucagaaagcaguagggug

SEQ ID NO: 1149131 - RNA, 23 nt, Human
agcagggaaaccgguagcucccc

SEQ ID NO: 1149132 - RNA, 21 nt, Human
agcaguaggguguucucccaa

SEQ ID NO: 1149133 - RNA, 19 nt, Human
agggaggaaggugagggcc

SEQ ID NO: 1149134 - RNA, 21 nt, Human
aggggacaaugagucauguuu

SEQ ID NO: 1149135 - RNA, 22 nt, Human
agugguuacagguuuggggaaa

SEQ ID NO: 1149136 - RNA, 19 nt, Human
auacucucucucucucucu

SEQ ID NO: 1149137 - RNA, 24 nt, Human
aucuagugacuugagggcaaacau

SEQ ID NO: 1149138 - RNA, 19 nt, Human
caaauugcaaacacucuaa

SEQ ID NO: 1149139 - RNA, 25 nt, Human
caaccacuucgaacaaauugcaaac

SEQ ID NO: 1149140 - RNA, 23 nt, Human
cacaaaguccaguaaauaacacu

SEQ ID NO: 1149141 - RNA, 20 nt, Human
cacacacauacacacacaca

SEQ ID NO: 1149142 - RNA, 22 nt, Human
cacacacauacacacacacaca

SEQ ID NO: 1149143 - RNA, 19 nt, Human
cacacauucagaccaaacu

SEQ ID NO: 1149144 - RNA, 19 nt, Human
caccagaaaaagugauggu

SEQ ID NO: 1149145 - RNA, 19 nt, Human
caccucacgugagcagggc

SEQ ID NO: 1149146 - RNA, 25 nt, Human
cagcagggaaaccgguagcuccccu

SEQ ID NO: 1149147 - RNA, 21 nt, Human
cagccaaaauagaccuaaauu

SEQ ID NO: 1149148 - RNA, 21 nt, Human
cagcuccucgcuguccccgag

SEQ ID NO: 1149149 - RNA, 21 nt, Human
caggagaacacuuucugaagg

SEQ ID NO: 1149150 - RNA, 25 nt, Human
caguaggcccucuuucccaacuaca

SEQ ID NO: 1149151 - RNA, 18 nt, Human
caguugcauccuucuugg

SEQ ID NO: 1149152 - RNA, 22 nt, Human
cauacacacacacacacauacu

SEQ ID NO: 1149153 - RNA, 22 nt, Human
ccaauuggaggccuuggcccug

SEQ ID NO: 1149154 - RNA, 23 nt, Human
ccaguaggcccucuuucccaacu

SEQ ID NO: 1149155 - RNA, 22 nt, Human
cccaggcacauuacugauuaua

SEQ ID NO: 1149156 - RNA, 22 nt, Human
ccccaguaggcccucuuuccca

SEQ ID NO: 1149157 - RNA, 22 nt, Human
ccuacagauggaacaggagaac

SEQ ID NO: 1149158 - RNA, 24 nt, Human
ccucaaguggccuaggcuuaaucc

SEQ ID NO: 1149159 - RNA, 21 nt, Human
ccuccacccccauaugccaaa

SEQ ID NO: 1149160 - RNA, 18 nt, Human
cuagugacuugagggcaa

SEQ ID NO: 1149161 - RNA, 22 nt, Human
cuccugcaaaaagggagaaaaa

SEQ ID NO: 1149162 - RNA, 19 nt, Human
cucuaaaagccuguucccc

SEQ ID NO: 1149163 - RNA, 18 nt, Human
cucucucucucucauuca

SEQ ID NO: 1149164 - RNA, 22 nt, Human
cucucucucucucucucauuca

SEQ ID NO: 1149165 - RNA, 22 nt, Human
cucucucucucucucucucuca

SEQ ID NO: 1149166 - RNA, 18 nt, Human
cugaaaccagauaucucc

SEQ ID NO: 1149167 - RNA, 21 nt, Human
cugaaaccagauaucuccaug

SEQ ID NO: 1149168 - RNA, 19 nt, Human
cuggacuuggcauuuccca

SEQ ID NO: 1149169 - RNA, 20 nt, Human
cuggcaaucauauguguucg

SEQ ID NO: 1149170 - RNA, 19 nt, Human
cuuaaaauaucuagugacu

SEQ ID NO: 1149171 - RNA, 24 nt, Human
cuuggcccugcccugaccugacuu

SEQ ID NO: 1149172 - RNA, 19 nt, Human
cuuguauuucauccacuga

SEQ ID NO: 1149173 - RNA, 22 nt, Human
gaaugugggagggaggaaggug

SEQ ID NO: 1149174 - RNA, 24 nt, Human
gacccagcagucagaucugcagcc

SEQ ID NO: 1149175 - RNA, 19 nt, Human
gagggaggaaggugagggc

SEQ ID NO: 1149176 - RNA, 19 nt, Human
gaucacuuuagcucaagaa

SEQ ID NO: 1149177 - RNA, 18 nt, Human
gcacugagucuggacuug

SEQ ID NO: 1149178 - RNA, 23 nt, Human
gccauugauuguagguuucagag

SEQ ID NO: 1149179 - RNA, 19 nt, Human
gcuacaauguuccuccaaa

SEQ ID NO: 1149180 - RNA, 20 nt, Human
ggaggcuguguuucucuccc

SEQ ID NO: 1149181 - RNA, 24 nt, Human
gggcacugccuccugugagaccuc

SEQ ID NO: 1149182 - RNA, 23 nt, Human
gguagcuccccugcacuccaccu

SEQ ID NO: 1149183 - RNA, 21 nt, Human
guagcuccccugcacuccacc

SEQ ID NO: 1149184 - RNA, 21 nt, Human
gucagaucugcagccaagugg

SEQ ID NO: 1149185 - RNA, 19 nt, Human
guggaaaacuauagcuaca

SEQ ID NO: 1149186 - RNA, 23 nt, Human
uaaagaauucauccuccaccccc

SEQ ID NO: 1149187 - RNA, 18 nt, Human
uaaauccugugagucaga

SEQ ID NO: 1149188 - RNA, 19 nt, Human
uaaauccugugagucagag

SEQ ID NO: 1149189 - RNA, 23 nt, Human
uaauugcacuaagaccagucuuu

SEQ ID NO: 1149190 - RNA, 24 nt, Human
uacagacacacauucagaccaaac

SEQ ID NO: 1149191 - RNA, 24 nt, Human
uacucucucucucucucucucuca

SEQ ID NO: 1149192 - RNA, 25 nt, Human
uacugcuuggcacugagucuggacu

SEQ ID NO: 1149193 - RNA, 19 nt, Human
uagaaaauuacugcaaagc

SEQ ID NO: 1149194 - RNA, 24 nt, Human
uagaagagucuuugggguugguuc

SEQ ID NO: 1149195 - RNA, 21 nt, Human
uagagguugggguuucagcuu

SEQ ID NO: 1149196 - RNA, 22 nt, Human
uagcaguugcauccuucuuggu

SEQ ID NO: 1149197 - RNA, 24 nt, Human
uagccaagcuugucuuuaaaaguc

SEQ ID NO: 1149198 - RNA, 25 nt, Human
uauauaacaacuuccaaaauguuuu

SEQ ID NO: 1149199 - RNA, 22 nt, Human
uaucacaaaguccaguaaauaa

SEQ ID NO: 1149200 - RNA, 20 nt, Human
ucaacagggccauaguaaag

SEQ ID NO: 1149201 - RNA, 22 nt, Human
ucaagcaaggaaagaaaacugu

SEQ ID NO: 1149202 - RNA, 21 nt, Human
ucacuuccaucuaauaccugc

SEQ ID NO: 1149203 - RNA, 25 nt, Human
ucagaaaacauugugaucuacuuag

SEQ ID NO: 1149204 - RNA, 24 nt, Human
ucagaaccccuacuaugcucuuaa

SEQ ID NO: 1149205 - RNA, 23 nt, Human
ucaggauuagcaacuauuuuauu

SEQ ID NO: 1149206 - RNA, 19 nt, Human
ucagguuuugcugucuucc

SEQ ID NO: 1149207 - RNA, 21 nt, Human
uccacgggugacagucggucu

SEQ ID NO: 1149208 - RNA, 22 nt, Human
ucuucuaaauacucuaaaagcc

SEQ ID NO: 1149209 - RNA, 23 nt, Human
ucuuuagaucucucgacccuccu

SEQ ID NO: 1149210 - RNA, 25 nt, Human
ucuuucaucucucuacuccugcaaa

SEQ ID NO: 1149211 - RNA, 24 nt, Human
ucuuucccaacuacauuuuagccc

SEQ ID NO: 1149212 - RNA, 25 nt, Human
ugaaaaggcuuaaagcauuucaaau

SEQ ID NO: 1149213 - RNA, 20 nt, Human
ugaaaugcuacaauguuccu

SEQ ID NO: 1149214 - RNA, 21 nt, Human
ugaaaugcuacaauguuccuc

SEQ ID NO: 1149215 - RNA, 19 nt, Human
ugacccagcagucagaucu

SEQ ID NO: 1149216 - RNA, 21 nt, Human
ugaccugacuuuagcuaauga

SEQ ID NO: 1149217 - RNA, 26 nt, Human
ugagauccucaaccacuuuccacagg

SEQ ID NO: 1149218 - RNA, 21 nt, Human
ugcucagguuuugcugucuuc

SEQ ID NO: 1149219 - RNA, 19 nt, Human
uggaucaucuuaaaaaguc

SEQ ID NO: 1149220 - RNA, 23 nt, Human
uggauucuggggaggcuguguuu

SEQ ID NO: 1149221 - RNA, 23 nt, Human
uggcaggaacugggagugcugag

SEQ ID NO: 1149222 - RNA, 24 nt, Human
uggcaggaacugggagugcugaga

SEQ ID NO: 1149223 - RNA, 23 nt, Human
ugggagcuauuuccugcucccag

SEQ ID NO: 1149224 - RNA, 18 nt, Human
ugggagggaggaagguga

SEQ ID NO: 1149225 - RNA, 23 nt, Human
ugggcacucuuccuguaaaggcc

SEQ ID NO: 1149226 - RNA, 18 nt, Human
ugguaacaauugaagggu

SEQ ID NO: 1149227 - RNA, 20 nt, Human
ugguuaaaauauggaacaua

SEQ ID NO: 1149228 - RNA, 21 nt, Human
ugugaaaaggcuuaaagcauu

SEQ ID NO: 1149229 - RNA, 22 nt, Human
uguggaagucucaauucuccug

SEQ ID NO: 1149230 - RNA, 24 nt, Human
ugugguacaaauggaucaucuuaa

SEQ ID NO: 1149231 - RNA, 19 nt, Human
uucccaaggccauaaauaa

SEQ ID NO: 1149232 - RNA, 31 nt, Human
uucgaacacacacauacacacacacacacag

SEQ ID NO: 1149233 - RNA, 21 nt, Human
uugcucguagacucagaaagc

SEQ ID NO: 1149234 - RNA, 23 nt, Human
uuggaaucacaaaagcacaggaa

SEQ ID NO: 1149235 - RNA, 21 nt, Human
uuuccauagaaaauuacugca

SEQ ID NO: 1149236 - RNA, 21 nt, Human
uuuuguuuuagguuccaguag

SEQ ID NO: 1149237 - RNA, 23 nt, Human
aaacuccccccaucccugcagcc

SEQ ID NO: 1149238 - RNA, 18 nt, Human
aaaggcauccuacccaga

SEQ ID NO: 1149239 - RNA, 24 nt, Human
aaagggcugggauuacaggcauga

SEQ ID NO: 1149240 - RNA, 24 nt, Human
aaagugcugggauuacagguguga

SEQ ID NO: 1149241 - RNA, 20 nt, Human
aacaaaacguacccccaccc

SEQ ID NO: 1149242 - RNA, 22 nt, Human
aaccucaucgcuccagccucuc

SEQ ID NO: 1149243 - RNA, 23 nt, Human
aagaaaugcaauugucuuaagac

SEQ ID NO: 1149244 - RNA, 18 nt, Human
aagaacauacaagaugaa

SEQ ID NO: 1149245 - RNA, 24 nt, Human
aagacacacuucaugcuccaauug

SEQ ID NO: 1149246 - RNA, 22 nt, Human
aagaggaagguuuagaacaaaa

SEQ ID NO: 1149247 - RNA, 20 nt, Human
aaggcucuacagccuaaggg

SEQ ID NO: 1149248 - RNA, 19 nt, Human
aaguagcugggacuacagg

SEQ ID NO: 1149249 - RNA, 20 nt, Human
aaguagcugggacuacaggc

SEQ ID NO: 1149250 - RNA, 27 nt, Human
aaguagcugggacuacaggcgccagcc

SEQ ID NO: 1149251 - RNA, 18 nt, Human
aagugcugggauuacagg

SEQ ID NO: 1149252 - RNA, 19 nt, Human
aagugcugggauuacaggu

SEQ ID NO: 1149253 - RNA, 23 nt, Human
aaucaugccagccgggcaucuga

SEQ ID NO: 1149254 - RNA, 22 nt, Human
aaugcauaccauucacaaauaa

SEQ ID NO: 1149255 - RNA, 21 nt, Human
acaauuuuuggagcauccaga

SEQ ID NO: 1149256 - RNA, 22 nt, Human
acacaggaggggccccccaggg

SEQ ID NO: 1149257 - RNA, 27 nt, Human
acaccaagaacauacaagaugaagagc

SEQ ID NO: 1149258 - RNA, 23 nt, Human
acaccaagccacacuaaaaaggc

SEQ ID NO: 1149259 - RNA, 18 nt, Human
acagaaggcaaaucccug

SEQ ID NO: 1149260 - RNA, 22 nt, Human
acagccacuuccagccuguguc

SEQ ID NO: 1149261 - RNA, 18 nt, Human
acaggguuucaccguguu

SEQ ID NO: 1149262 - RNA, 19 nt, Human
acaggguuucaccguguua

SEQ ID NO: 1149263 - RNA, 20 nt, Human
acaggguuucaccguguuag

SEQ ID NO: 1149264 - RNA, 24 nt, Human
acaggguuucaccguguuagccag

SEQ ID NO: 1149265 - RNA, 21 nt, Human
accacagccacuuccagccug

SEQ ID NO: 1149266 - RNA, 24 nt, Human
accauguuggcaaggcuggucuug

SEQ ID NO: 1149267 - RNA, 19 nt, Human
acccaggcuggagugcagu

SEQ ID NO: 1149268 - RNA, 21 nt, Human
acgcagccacaguccacaggc

SEQ ID NO: 1149269 - RNA, 18 nt, Human
acugcaagcuccgccucc

SEQ ID NO: 1149270 - RNA, 21 nt, Human
acugcacccagccuacacugg

SEQ ID NO: 1149271 - RNA, 26 nt, Human
agaaaggauacacagcgauguaagga

SEQ ID NO: 1149272 - RNA, 22 nt, Human
agaagacuccggcugugaggau

SEQ ID NO: 1149273 - RNA, 19 nt, Human
agaaggcaaaucccugagc

SEQ ID NO: 1149274 - RNA, 23 nt, Human
agacagccuggcuucuuuuccuu

SEQ ID NO: 1149275 - RNA, 18 nt, Human
agacaggguuucaccgug

SEQ ID NO: 1149276 - RNA, 19 nt, Human
agagacaggguuucaccgu

SEQ ID NO: 1149277 - RNA, 19 nt, Human
agagggcagugggggaaag

SEQ ID NO: 1149278 - RNA, 19 nt, Human
agcagggaggcagagccca

SEQ ID NO: 1149279 - RNA, 22 nt, Human
agcccagcagagcccuggaggc

SEQ ID NO: 1149280 - RNA, 21 nt, Human
agccuggggaggugggguggg

SEQ ID NO: 1149281 - RNA, 21 nt, Human
agccuggugguggcaccaacc

SEQ ID NO: 1149282 - RNA, 22 nt, Human
agccuguguccuuugccacaac

SEQ ID NO: 1149283 - RNA, 23 nt, Human
agcgguucuccugcucagccucc

SEQ ID NO: 1149284 - RNA, 18 nt, Human
agcucagggaccuagcaa

SEQ ID NO: 1149285 - RNA, 21 nt, Human
agcugggggcggagucagagg

SEQ ID NO: 1149286 - RNA, 18 nt, Human
aggaagaaaggggagccg

SEQ ID NO: 1149287 - RNA, 22 nt, Human
aggcagagcccagcagagcccu

SEQ ID NO: 1149288 - RNA, 19 nt, Human
aggcagagcuuccugccuc

SEQ ID NO: 1149289 - RNA, 19 nt, Human
aggcaggagaagcagcaag

SEQ ID NO: 1149290 - RNA, 21 nt, Human
aggcaggagaagcagcaaggu

SEQ ID NO: 1149291 - RNA, 25 nt, Human
aggcuggagugcaguggcacgaucu

SEQ ID NO: 1149292 - RNA, 25 nt, Human
aggcuggagugcaguggcgcgaucu

SEQ ID NO: 1149293 - RNA, 24 nt, Human
agggcugggauuacaggcaugagc

SEQ ID NO: 1149294 - RNA, 19 nt, Human
aggggcuggcggcaggagg

SEQ ID NO: 1149295 - RNA, 23 nt, Human
aguagcugagacuacaugugugc

SEQ ID NO: 1149296 - RNA, 20 nt, Human
agugcaguggcacgaucucg

SEQ ID NO: 1149297 - RNA, 23 nt, Human
agugcaguggcacgaucucggcu

SEQ ID NO: 1149298 - RNA, 24 nt, Human
agugcaguggcacgaucucggcuc

SEQ ID NO: 1149299 - RNA, 19 nt, Human
agugcaguggcgcgaucuc

SEQ ID NO: 1149300 - RNA, 21 nt, Human
agugcaguggcgcgaucucag

SEQ ID NO: 1149301 - RNA, 21 nt, Human
agugggaccccucacccuccc

SEQ ID NO: 1149302 - RNA, 22 nt, Human
augggguuucaccauguuggca

SEQ ID NO: 1149303 - RNA, 23 nt, Human
augggguuucaccauguuggcaa

SEQ ID NO: 1149304 - RNA, 24 nt, Human
augggguuucaccauguuggcaag

SEQ ID NO: 1149305 - RNA, 20 nt, Human
caaaacgcagcugucggggc

SEQ ID NO: 1149306 - RNA, 22 nt, Human
caaacuccccccaucccugcag

SEQ ID NO: 1149307 - RNA, 24 nt, Human
caaagggcugggauuacaggcaug

SEQ ID NO: 1149308 - RNA, 24 nt, Human
caaagugcugggauuacaggugug

SEQ ID NO: 1149309 - RNA, 22 nt, Human
caacacacaggaggggcccccc

SEQ ID NO: 1149310 - RNA, 23 nt, Human
caaccuccaccucccggguucca

SEQ ID NO: 1149311 - RNA, 20 nt, Human
cacacccagccaucucccuu

SEQ ID NO: 1149312 - RNA, 21 nt, Human
cacacccagccaucucccuuc

SEQ ID NO: 1149313 - RNA, 21 nt, Human
cacaguccacaggccaggccu

SEQ ID NO: 1149314 - RNA, 22 nt, Human
cacaguccacaggccaggccug

SEQ ID NO: 1149315 - RNA, 18 nt, Human
cacagugcaauacccacg

SEQ ID NO: 1149316 - RNA, 21 nt, Human
cacaucugcccuccacucuga

SEQ ID NO: 1149317 - RNA, 28 nt, Human
cacauguccacacggcugccccaaaacg

SEQ ID NO: 1149318 - RNA, 22 nt, Human
caccacagccacuuccagccug

SEQ ID NO: 1149319 - RNA, 23 nt, Human
caccauguuggcaaggcuggucu

SEQ ID NO: 1149320 - RNA, 24 nt, Human
caccauguuggcaaggcuggucuu

SEQ ID NO: 1149321 - RNA, 28 nt, Human
cacccagccuacacugguuaauuuuugu

SEQ ID NO: 1149322 - RNA, 20 nt, Human
caccccccaccccgcccacc

SEQ ID NO: 1149323 - RNA, 22 nt, Human
caccgugcccagcagggucccc

SEQ ID NO: 1149324 - RNA, 18 nt, Human
caccguguuagccaggau

SEQ ID NO: 1149325 - RNA, 23 nt, Human
caccguguuagccaggauggucu

SEQ ID NO: 1149326 - RNA, 24 nt, Human
caccguguuagccaggauggucuu

SEQ ID NO: 1149327 - RNA, 22 nt, Human
caccugaacagucaccacagcc

SEQ ID NO: 1149328 - RNA, 23 nt, Human
caccugaggucuccucuuucucc

SEQ ID NO: 1149329 - RNA, 23 nt, Human
cacgagggccucccacaggccug

SEQ ID NO: 1149330 - RNA, 21 nt, Human
cacugcaaccuccaccucccg

SEQ ID NO: 1149331 - RNA, 23 nt, Human
cacugcaaccuccaccucccggg

SEQ ID NO: 1149332 - RNA, 18 nt, Human
cacugcacccagccuaca

SEQ ID NO: 1149333 - RNA, 21 nt, Human
cacugguaccgcagaaacacc

SEQ ID NO: 1149334 - RNA, 21 nt, Human
cagaccacucaggucaggaag

SEQ ID NO: 1149335 - RNA, 21 nt, Human
cagaccccacugggugauggc

SEQ ID NO: 1149336 - RNA, 20 nt, Human
cagagagcagggaggcagag

SEQ ID NO: 1149337 - RNA, 20 nt, Human
cagagcuuccugccuccccc

SEQ ID NO: 1149338 - RNA, 23 nt, Human
cagccacaguccacaggccaggc

SEQ ID NO: 1149339 - RNA, 20 nt, Human
cagccccauuuguuuccauu

SEQ ID NO: 1149340 - RNA, 20 nt, Human
cagcccccucuguuccccug

SEQ ID NO: 1149341 - RNA, 20 nt, Human
cagccuccugagcagccccc

SEQ ID NO: 1149342 - RNA, 24 nt, Human
cagcgguucuccugcucagccucc

SEQ ID NO: 1149343 - RNA, 24 nt, Human
cagcugccugcaggcccuccgggu

SEQ ID NO: 1149344 - RNA, 21 nt, Human
cagcuucagcuuccccagcuc

SEQ ID NO: 1149345 - RNA, 24 nt, Human
caggguuucaccguguuagccagg

SEQ ID NO: 1149346 - RNA, 22 nt, Human
cauagacaccaagaacauacaa

SEQ ID NO: 1149347 - RNA, 21 nt, Human
cauccagaacuuacugggcac

SEQ ID NO: 1149348 - RNA, 19 nt, Human
caugagccaccaugccugu

SEQ ID NO: 1149349 - RNA, 24 nt, Human
caugagccaccaugccugucccuu

SEQ ID NO: 1149350 - RNA, 19 nt, Human
caugccagccgggcaucug

SEQ ID NO: 1149351 - RNA, 25 nt, Human
caugcccuuguccccucucccaccu

SEQ ID NO: 1149352 - RNA, 24 nt, Human
cauguccacacggcugccccaaaa

SEQ ID NO: 1149353 - RNA, 24 nt, Human
cauguuggcaaggcuggucuugaa

SEQ ID NO: 1149354 - RNA, 21 nt, Human
ccaaagccugagugggacccc

SEQ ID NO: 1149355 - RNA, 23 nt, Human
ccaaaggcauccuacccagaggc

SEQ ID NO: 1149356 - RNA, 19 nt, Human
ccaaagggcugggauuaca

SEQ ID NO: 1149357 - RNA, 23 nt, Human
ccaaagggcugggauuacaggca

SEQ ID NO: 1149358 - RNA, 24 nt, Human
ccaaagggcugggauuacaggcau

SEQ ID NO: 1149359 - RNA, 20 nt, Human
ccaaagugcugggauuacag

SEQ ID NO: 1149360 - RNA, 21 nt, Human
ccaaagugcugggauuacagg

SEQ ID NO: 1149361 - RNA, 21 nt, Human
ccaaagugcugggauuacagg

SEQ ID NO: 1149362 - RNA, 24 nt, Human
ccaaagugcugggauuacaggugu

SEQ ID NO: 1149363 - RNA, 20 nt, Human
ccaagccacacuaaaaaggc

SEQ ID NO: 1149364 - RNA, 19 nt, Human
ccacaccugaggucuccuc

SEQ ID NO: 1149365 - RNA, 20 nt, Human
ccaccacgcccagcuaauuu

SEQ ID NO: 1149366 - RNA, 21 nt, Human
ccacugaccccggcagcugcc

SEQ ID NO: 1149367 - RNA, 18 nt, Human
ccacugcaagccuuuccc

SEQ ID NO: 1149368 - RNA, 21 nt, Human
ccacugcaagccuuucccaaa

SEQ ID NO: 1149369 - RNA, 20 nt, Human
ccacugcacccagccuacac

SEQ ID NO: 1149370 - RNA, 22 nt, Human
ccacugcacccagccuacacug

SEQ ID NO: 1149371 - RNA, 21 nt, Human
ccacugggugauggcgggggg

SEQ ID NO: 1149372 - RNA, 24 nt, Human
ccagcagagcccuggaggcaggag

SEQ ID NO: 1149373 - RNA, 23 nt, Human
ccagccgggcaucugacacagcc

SEQ ID NO: 1149374 - RNA, 19 nt, Human
ccagccugggacccccccc

SEQ ID NO: 1149375 - RNA, 21 nt, Human
ccagccuguguccuuugccac

SEQ ID NO: 1149376 - RNA, 26 nt, Human
ccagcgguucuccugcucagccuccc

SEQ ID NO: 1149377 - RNA, 18 nt, Human
ccagggucuccaaucucc

SEQ ID NO: 1149378 - RNA, 22 nt, Human
ccauagggccggcgcggggucc

SEQ ID NO: 1149379 - RNA, 19 nt, Human
ccaugggacuucaacacac

SEQ ID NO: 1149380 - RNA, 27 nt, Human
cccaaaaauuuccccucaaagcccccu

SEQ ID NO: 1149381 - RNA, 23 nt, Human
cccaaguagcugggacuacaggc

SEQ ID NO: 1149382 - RNA, 24 nt, Human
cccaaguagcugggacuacaggcg

SEQ ID NO: 1149383 - RNA, 22 nt, Human
cccacccaggcugggggacaag

SEQ ID NO: 1149384 - RNA, 21 nt, Human
cccacccccagcugccugcag

SEQ ID NO: 1149385 - RNA, 20 nt, Human
cccaccgugcccagcagggu

SEQ ID NO: 1149386 - RNA, 24 nt, Human
cccacugcaagccuuucccaaaaa

SEQ ID NO: 1149387 - RNA, 22 nt, Human
cccaggcuggagugcaguggcg

SEQ ID NO: 1149388 - RNA, 23 nt, Human
cccagggccgggcuccauagggc

SEQ ID NO: 1149389 - RNA, 18 nt, Human
cccagggucuccaaucuc

SEQ ID NO: 1149390 - RNA, 19 nt, Human
cccauuuguuuccauuccc

SEQ ID NO: 1149391 - RNA, 19 nt, Human
ccccaaaaguuuggcgcuu

SEQ ID NO: 1149392 - RNA, 19 nt, Human
ccccaccccgcccaccagg

SEQ ID NO: 1149393 - RNA, 20 nt, Human
ccccaccccgcccaccagga

SEQ ID NO: 1149394 - RNA, 21 nt, Human
ccccaccccgcccaccaggaa

SEQ ID NO: 1149395 - RNA, 21 nt, Human
cccccacccaggcugggggac

SEQ ID NO: 1149396 - RNA, 23 nt, Human
cccccacccaggcugggggacaa

SEQ ID NO: 1149397 - RNA, 22 nt, Human
cccccagcugccugcaggcccu

SEQ ID NO: 1149398 - RNA, 20 nt, Human
ccccccaccccgcccaccag

SEQ ID NO: 1149399 - RNA, 18 nt, Human
ccccccccuccccacccc

SEQ ID NO: 1149400 - RNA, 21 nt, Human
ccccccccuccccaccccgca

SEQ ID NO: 1149401 - RNA, 18 nt, Human
cccccccuccccaccccg

SEQ ID NO: 1149402 - RNA, 24 nt, Human
ccccucacacccagccaucucccu

SEQ ID NO: 1149403 - RNA, 21 nt, Human
ccccucacccucccacaccug

SEQ ID NO: 1149404 - RNA, 18 nt, Human
ccccucuguggggccaca

SEQ ID NO: 1149405 - RNA, 20 nt, Human
ccccugggugccucucaacc

SEQ ID NO: 1149406 - RNA, 18 nt, Human
cccgcccaccaggaaggc

SEQ ID NO: 1149407 - RNA, 23 nt, Human
cccgccucggccucccaaagggc

SEQ ID NO: 1149408 - RNA, 23 nt, Human
cccggguuccagcgguucuccug

SEQ ID NO: 1149409 - RNA, 18 nt, Human
cccugagcacgagggccu

SEQ ID NO: 1149410 - RNA, 23 nt, Human
cccuggguggcagaggcaggucc

SEQ ID NO: 1149411 - RNA, 21 nt, Human
ccgcaccccccaccccgccca

SEQ ID NO: 1149412 - RNA, 28 nt, Human
ccgcaccccccaccccgcccaccagggg

SEQ ID NO: 1149413 - RNA, 18 nt, Human
ccgcagggacucuccucc

SEQ ID NO: 1149414 - RNA, 24 nt, Human
ccucacacccagccaucucccuuc

SEQ ID NO: 1149415 - RNA, 24 nt, Human
ccucccggguuccagcgguucucc

SEQ ID NO: 1149416 - RNA, 25 nt, Human
ccucuguuccccugggagauugagc

SEQ ID NO: 1149417 - RNA, 23 nt, Human
ccugaacagucaccacagccacu

SEQ ID NO: 1149418 - RNA, 23 nt, Human
ccugagaaccuggggaugucaga

SEQ ID NO: 1149419 - RNA, 19 nt, Human
ccugccauccagccuggga

SEQ ID NO: 1149420 - RNA, 23 nt, Human
ccuggcaggcaccagaacacuga

SEQ ID NO: 1149421 - RNA, 18 nt, Human
ccuggccagggggaaggg

SEQ ID NO: 1149422 - RNA, 19 nt, Human
ccugggaccccccccuccc

SEQ ID NO: 1149423 - RNA, 19 nt, Human
ccuguaugccgcacccccc

SEQ ID NO: 1149424 - RNA, 22 nt, Human
ccuucugggcccacgcuucugg

SEQ ID NO: 1149425 - RNA, 22 nt, Human
cgaugaggaugggguacuccag

SEQ ID NO: 1149426 - RNA, 20 nt, Human
cgcaccccccaccccgccca

SEQ ID NO: 1149427 - RNA, 20 nt, Human
cgcaugcugcccaccucccc

SEQ ID NO: 1149428 - RNA, 19 nt, Human
cgccucccggguucacgcc

SEQ ID NO: 1149429 - RNA, 22 nt, Human
cgccucggccucccaaagggcu

SEQ ID NO: 1149430 - RNA, 24 nt, Human
cgccucggccucccaaagggcugg

SEQ ID NO: 1149431 - RNA, 27 nt, Human
cggauacccauaguaacacugguaccg

SEQ ID NO: 1149432 - RNA, 22 nt, Human
cggcggauacccauaguaacac

SEQ ID NO: 1149433 - RNA, 19 nt, Human
cgguucuccugcucagccu

SEQ ID NO: 1149434 - RNA, 27 nt, Human
cucaacccugccauccagccugggacu

SEQ ID NO: 1149435 - RNA, 18 nt, Human
cuccaugcagccauugga

SEQ ID NO: 1149436 - RNA, 23 nt, Human
cucccacugcaagccuuucccaa

SEQ ID NO: 1149437 - RNA, 19 nt, Human
cucccccucacacccagcc

SEQ ID NO: 1149438 - RNA, 21 nt, Human
cucccggguucacgccauucu

SEQ ID NO: 1149439 - RNA, 21 nt, Human
cucccggguuccagcgguucu

SEQ ID NO: 1149440 - RNA, 25 nt, Human
cucccggguuccagcgguucuccuu

SEQ ID NO: 1149441 - RNA, 19 nt, Human
cucccuggccuguuucuga

SEQ ID NO: 1149442 - RNA, 26 nt, Human
cuccugaccucagguuaucugcccgc

SEQ ID NO: 1149443 - RNA, 24 nt, Human
cuccugaccucgugauccgccggc

SEQ ID NO: 1149444 - RNA, 20 nt, Human
cucugucacccaggcuggag

SEQ ID NO: 1149445 - RNA, 23 nt, Human
cucugucacccaggcuggagugc

SEQ ID NO: 1149446 - RNA, 20 nt, Human
cucuuucucccccgcacccc

SEQ ID NO: 1149447 - RNA, 23 nt, Human
cugagcagcccccucuguucccc

SEQ ID NO: 1149448 - RNA, 20 nt, Human
cugagugggaccccucaccc

SEQ ID NO: 1149449 - RNA, 23 nt, Human
cugagugggaccccucacccucc

SEQ ID NO: 1149450 - RNA, 18 nt, Human
cugcaaccuccaccuccc

SEQ ID NO: 1149451 - RNA, 23 nt, Human
cugcaaccuccaccucccggguu

SEQ ID NO: 1149452 - RNA, 24 nt, Human
cugcaaccuccaccucccggguuc

SEQ ID NO: 1149453 - RNA, 23 nt, Human
cugcaagccuuucccaaaaauuu

SEQ ID NO: 1149454 - RNA, 23 nt, Human
cugcagccuggggagguggggug

SEQ ID NO: 1149455 - RNA, 23 nt, Human
cugccauguugggcucccacuga

SEQ ID NO: 1149456 - RNA, 19 nt, Human
cugcccaccuccccugggu

SEQ ID NO: 1149457 - RNA, 20 nt, Human
cugccgcagggacucuccuc

SEQ ID NO: 1149458 - RNA, 21 nt, Human
cugccgcagggacucuccucc

SEQ ID NO: 1149459 - RNA, 21 nt, Human
cugcucccagccugguggugg

SEQ ID NO: 1149460 - RNA, 22 nt, Human
cugcugcacacaucugcccucc

SEQ ID NO: 1149461 - RNA, 20 nt, Human
cugggaccccccccucccca

SEQ ID NO: 1149462 - RNA, 21 nt, Human
cugggccucccaaagugcugg

SEQ ID NO: 1149463 - RNA, 32 nt, Human
cugguuaauuuuuguguuuuuaguagagauga

SEQ ID NO: 1149464 - RNA, 23 nt, Human
cuguaugccgcaccccccacccc

SEQ ID NO: 1149465 - RNA, 18 nt, Human
cugucacccaggcuggag

SEQ ID NO: 1149466 - RNA, 19 nt, Human
cugucacccaggcuggagu

SEQ ID NO: 1149467 - RNA, 20 nt, Human
cugugaggaugcugcgaagg

SEQ ID NO: 1149468 - RNA, 25 nt, Human
cuuaagacccucucccaaggaaucu

SEQ ID NO: 1149469 - RNA, 19 nt, Human
cuuacugggcaccgggcca

SEQ ID NO: 1149470 - RNA, 19 nt, Human
cuuccccagcucagggacc

SEQ ID NO: 1149471 - RNA, 21 nt, Human
cuugcucugucacccaggcug

SEQ ID NO: 1149472 - RNA, 19 nt, Human
gaacagcaccuggaugguc

SEQ ID NO: 1149473 - RNA, 18 nt, Human
gaagggcacauguccaca

SEQ ID NO: 1149474 - RNA, 18 nt, Human
gaccacucaggucaggaa

SEQ ID NO: 1149475 - RNA, 19 nt, Human
gaccccccccuccccaccc

SEQ ID NO: 1149476 - RNA, 20 nt, Human
gaccccccccuccccacccc

SEQ ID NO: 1149477 - RNA, 24 nt, Human
gaccucagguuaucugcccgccuc

SEQ ID NO: 1149478 - RNA, 18 nt, Human
gaccucgugauccgccgg

SEQ ID NO: 1149479 - RNA, 18 nt, Human
gagaugggguuucaccau

SEQ ID NO: 1149480 - RNA, 24 nt, Human
gagaugggguuucaccauguuggc

SEQ ID NO: 1149481 - RNA, 21 nt, Human
gagcaaggggugggcuccaaa

SEQ ID NO: 1149482 - RNA, 24 nt, Human
gagccacugcacccagccuacacu

SEQ ID NO: 1149483 - RNA, 20 nt, Human
gagcccaggggggcuggcag

SEQ ID NO: 1149484 - RNA, 19 nt, Human
gagcccuggaggcaggaga

SEQ ID NO: 1149485 - RNA, 19 nt, Human
gagccgcaaccaucccugg

SEQ ID NO: 1149486 - RNA, 23 nt, Human
gagccugcuucacaaugcauacc

SEQ ID NO: 1149487 - RNA, 21 nt, Human
gaggcagagcccagcagagcc

SEQ ID NO: 1149488 - RNA, 18 nt, Human
gauuacaggcaugagcca

SEQ ID NO: 1149489 - RNA, 21 nt, Human
gauuacaggcaugagccacca

SEQ ID NO: 1149490 - RNA, 24 nt, Human
gauuacaggcaugagccaccaugc

SEQ ID NO: 1149491 - RNA, 18 nt, Human
gauuacaggugugagcca

SEQ ID NO: 1149492 - RNA, 19 nt, Human
gauuacaggugugagccac

SEQ ID NO: 1149493 - RNA, 23 nt, Human
gauuacaggugugagccacugca

SEQ ID NO: 1149494 - RNA, 27 nt, Human
gauucacaaacaggcugugccucccuu

SEQ ID NO: 1149495 - RNA, 20 nt, Human
gcaugcugcccaccuccccu

SEQ ID NO: 1149496 - RNA, 24 nt, Human
gccacugagugcugaagaacaaaa

SEQ ID NO: 1149497 - RNA, 19 nt, Human
gcccaggcuggagugcagu

SEQ ID NO: 1149498 - RNA, 20 nt, Human
gcccaggcuggagugcagug

SEQ ID NO: 1149499 - RNA, 20 nt, Human
gccgaggccaaaucccacuc

SEQ ID NO: 1149500 - RNA, 25 nt, Human
gccucccggguucacgccauucucc

SEQ ID NO: 1149501 - RNA, 19 nt, Human
gccuggccagggggaaggg

SEQ ID NO: 1149502 - RNA, 25 nt, Human
gcucugucgcccaggcuggagugca

SEQ ID NO: 1149503 - RNA, 20 nt, Human
gcugaagaacaaaagcuaug

SEQ ID NO: 1149504 - RNA, 19 nt, Human
gcuggagugcaguggcacg

SEQ ID NO: 1149505 - RNA, 19 nt, Human
gcuggagugcaguggcgcg

SEQ ID NO: 1149506 - RNA, 23 nt, Human
gcuggucuugaacuccugaccuc

SEQ ID NO: 1149507 - RNA, 23 nt, Human
gcuucuggccugccugccauguu

SEQ ID NO: 1149508 - RNA, 24 nt, Human
gcuuuuuggcucccucccucucaa

SEQ ID NO: 1149509 - RNA, 20 nt, Human
ggaaccaugggacuucaacc

SEQ ID NO: 1149510 - RNA, 19 nt, Human
ggaggugggguggggacag

SEQ ID NO: 1149511 - RNA, 23 nt, Human
ggagucuugcucugucgcccagg

SEQ ID NO: 1149512 - RNA, 18 nt, Human
ggaugguccaguugccuu

SEQ ID NO: 1149513 - RNA, 24 nt, Human
ggauuacaggcaugagccaccaug

SEQ ID NO: 1149514 - RNA, 19 nt, Human
ggcagaggcaggucccugg

SEQ ID NO: 1149515 - RNA, 21 nt, Human
ggcccauagacaccaagaaca

SEQ ID NO: 1149516 - RNA, 24 nt, Human
ggcuggucuugaacuccugaccuc

SEQ ID NO: 1149517 - RNA, 20 nt, Human
gggaaggggcuguuaccuug

SEQ ID NO: 1149518 - RNA, 21 nt, Human
gggaccccccccuccccaccc

SEQ ID NO: 1149519 - RNA, 21 nt, Human
gggagggccgcaguccaugga

SEQ ID NO: 1149520 - RNA, 23 nt, Human
gggcaaaggggaaggccuggccu

SEQ ID NO: 1149521 - RNA, 19 nt, Human
gggcccccaccgugcccag

SEQ ID NO: 1149522 - RNA, 20 nt, Human
gggguggggacagugucuuu

SEQ ID NO: 1149523 - RNA, 22 nt, Human
gggguuucaccauguuggcaag

SEQ ID NO: 1149524 - RNA, 18 nt, Human
ggucauccaugcuggccu

SEQ ID NO: 1149525 - RNA, 21 nt, Human
gguccaguugccuuccagaag

SEQ ID NO: 1149526 - RNA, 19 nt, Human
ggucuugaacuccugaccu

SEQ ID NO: 1149527 - RNA, 20 nt, Human
ggucuugaucuccugaccuc

SEQ ID NO: 1149528 - RNA, 18 nt, Human
gguggcaccaaccugaaa

SEQ ID NO: 1149529 - RNA, 20 nt, Human
ggugggcuccaaaggcaucc

SEQ ID NO: 1149530 - RNA, 18 nt, Human
gguuccagcgguucuccu

SEQ ID NO: 1149531 - RNA, 23 nt, Human
guagagaugggguuucaccaugu

SEQ ID NO: 1149532 - RNA, 27 nt, Human
gucaccccuucccaacugcagagacuc

SEQ ID NO: 1149533 - RNA, 24 nt, Human
gucacugcaaccuccaccucccgg

SEQ ID NO: 1149534 - RNA, 24 nt, Human
gucuugcucugucacccaggcugg

SEQ ID NO: 1149535 - RNA, 24 nt, Human
gugcagcugagccaccucccagcc

SEQ ID NO: 1149536 - RNA, 24 nt, Human
guuaucugcccgccucggccuccc

SEQ ID NO: 1149537 - RNA, 19 nt, Human
uaaccaaaaaauacacauc

SEQ ID NO: 1149538 - RNA, 25 nt, Human
uaauuuuuguguuuuuaguagagaa

SEQ ID NO: 1149539 - RNA, 24 nt, Human
uaauuuuuuguaucuuuaguagag

SEQ ID NO: 1149540 - RNA, 25 nt, Human
uaauuuuuuguaucuuuaguagaga

SEQ ID NO: 1149541 - RNA, 21 nt, Human
uacaagaugaagagccuggau

SEQ ID NO: 1149542 - RNA, 22 nt, Human
uacaggcaugagccaccaugcc

SEQ ID NO: 1149543 - RNA, 24 nt, Human
uacaggcgccagccaccacgccca

SEQ ID NO: 1149544 - RNA, 19 nt, Human
uacaggugugagccacugc

SEQ ID NO: 1149545 - RNA, 24 nt, Human
uacaggugugagccacugcaccca

SEQ ID NO: 1149546 - RNA, 26 nt, Human
uaccgcagaaacaccaggaaucugga

SEQ ID NO: 1149547 - RNA, 20 nt, Human
uacugggcaccgggccacag

SEQ ID NO: 1149548 - RNA, 22 nt, Human
uagagacaggguuucaccgugu

SEQ ID NO: 1149549 - RNA, 22 nt, Human
uagagaugggguuucaccaugu

SEQ ID NO: 1149550 - RNA, 26 nt, Human
uagcaaggggccgaggccaaauccca

SEQ ID NO: 1149551 - RNA, 21 nt, Human
uaguagagacaggguuucacc

SEQ ID NO: 1149552 - RNA, 24 nt, Human
uaguagagacaggguuucaccgug

SEQ ID NO: 1149553 - RNA, 24 nt, Human
uaguagagaugggguuucaccaug

SEQ ID NO: 1149554 - RNA, 24 nt, Human
uaguuuaaccaaaaaauacacauc

SEQ ID NO: 1149555 - RNA, 25 nt, Human
uaugggggucuucaccaucgaagua

SEQ ID NO: 1149556 - RNA, 23 nt, Human
ucaacaccuacuagaggguuaaa

SEQ ID NO: 1149557 - RNA, 24 nt, Human
ucacccaggcuggagugcaguggc

SEQ ID NO: 1149558 - RNA, 24 nt, Human
ucaccguguuagccaggauggucu

SEQ ID NO: 1149559 - RNA, 23 nt, Human
ucacugcaaccuccaccucccgg

SEQ ID NO: 1149560 - RNA, 24 nt, Human
ucacugcaaccuccaccucccggg

SEQ ID NO: 1149561 - RNA, 25 nt, Human
ucacugcaaccuccaccucccgggu

SEQ ID NO: 1149562 - RNA, 27 nt, Human
ucacugcaaccuccaccucccggguuc

SEQ ID NO: 1149563 - RNA, 18 nt, Human
ucacugcaagcuccgccu

SEQ ID NO: 1149564 - RNA, 19 nt, Human
ucacugcaagcuccgccuc

SEQ ID NO: 1149565 - RNA, 24 nt, Human
ucacugcaagcuccgccucccggg

SEQ ID NO: 1149566 - RNA, 20 nt, Human
ucauggguccagcuucagcu

SEQ ID NO: 1149567 - RNA, 23 nt, Human
uccacaggccaggccugagaacc

SEQ ID NO: 1149568 - RNA, 27 nt, Human
ucccaaaaauuuccccucaaagcccuu

SEQ ID NO: 1149569 - RNA, 19 nt, Human
ucccaaagggcugggauua

SEQ ID NO: 1149570 - RNA, 23 nt, Human
ucccaaagggcugggauuacagg

SEQ ID NO: 1149571 - RNA, 24 nt, Human
ucccaaagggcugggauuacaggc

SEQ ID NO: 1149572 - RNA, 23 nt, Human
ucccaaagugcugggauuacagg

SEQ ID NO: 1149573 - RNA, 24 nt, Human
ucccaaguagcugggacuacaggc

SEQ ID NO: 1149574 - RNA, 22 nt, Human
ucccacaggccugguccccgag

SEQ ID NO: 1149575 - RNA, 23 nt, Human
uccccucaaagcccccuauugga

SEQ ID NO: 1149576 - RNA, 21 nt, Human
ucccggguucacgccauucuc

SEQ ID NO: 1149577 - RNA, 24 nt, Human
ucccggguucacgccauucuccug

SEQ ID NO: 1149578 - RNA, 19 nt, Human
ucccggguuccagcgguuc

SEQ ID NO: 1149579 - RNA, 21 nt, Human
ucccggguuccagcgguucuc

SEQ ID NO: 1149580 - RNA, 24 nt, Human
ucccggguuccagcgguucuccug

SEQ ID NO: 1149581 - RNA, 22 nt, Human
ucccuguggucuccuggggcua

SEQ ID NO: 1149582 - RNA, 24 nt, Human
uccugaccucgugauccgccggcc

SEQ ID NO: 1149583 - RNA, 24 nt, Human
uccugcucagccucccgaguagcu

SEQ ID NO: 1149584 - RNA, 23 nt, Human
uccuggcugcagagagcagggag

SEQ ID NO: 1149585 - RNA, 18 nt, Human
uccuguaugccgcacccc

SEQ ID NO: 1149586 - RNA, 22 nt, Human
uccuucauggguccagcuucag

SEQ ID NO: 1149587 - RNA, 24 nt, Human
ucgcccaggcuggagugcaguggc

SEQ ID NO: 1149588 - RNA, 22 nt, Human
ucgcuccagccucucugcuccc

SEQ ID NO: 1149589 - RNA, 18 nt, Human
ucuccuggggcuaccugu

SEQ ID NO: 1149590 - RNA, 21 nt, Human
ucugcucccagccugguggug

SEQ ID NO: 1149591 - RNA, 24 nt, Human
ucugucacccaggcuggagugcag

SEQ ID NO: 1149592 - RNA, 24 nt, Human
ucugucgcccaggcuggagugcag

SEQ ID NO: 1149593 - RNA, 23 nt, Human
ucuugaacuccugaccucagguu

SEQ ID NO: 1149594 - RNA, 22 nt, Human
ucuugcucugucacccaggcug

SEQ ID NO: 1149595 - RNA, 23 nt, Human
ucuugcucugucacccaggcugg

SEQ ID NO: 1149596 - RNA, 24 nt, Human
ucuugcucugucacccaggcugga

SEQ ID NO: 1149597 - RNA, 23 nt, Human
ucuugcucugucgcccaggcugg

SEQ ID NO: 1149598 - RNA, 24 nt, Human
ucuugcucugucgcccaggcugga

SEQ ID NO: 1149599 - RNA, 24 nt, Human
ucuuuaguagagacaggguuucac

SEQ ID NO: 1149600 - RNA, 18 nt, Human
ucuuuuuuuugaggcgga

SEQ ID NO: 1149601 - RNA, 22 nt, Human
ucuuuuuuuuugagauggaguc

SEQ ID NO: 1149602 - RNA, 18 nt, Human
ugaacagucaccacagcc

SEQ ID NO: 1149603 - RNA, 19 nt, Human
ugaagaacaaaagcuaugg

SEQ ID NO: 1149604 - RNA, 26 nt, Human
ugaagaaccacccucaauuucgcuaa

SEQ ID NO: 1149605 - RNA, 19 nt, Human
ugaccccugggacgcagcc

SEQ ID NO: 1149606 - RNA, 18 nt, Human
ugaccucagguuaucugc

SEQ ID NO: 1149607 - RNA, 20 nt, Human
ugaccucagguuaucugccc

SEQ ID NO: 1149608 - RNA, 24 nt, Human
ugaccucagguuaucugcccgccu

SEQ ID NO: 1149609 - RNA, 22 nt, Human
ugagacuacaugugugccacua

SEQ ID NO: 1149610 - RNA, 18 nt, Human
ugagagggcaguggggga

SEQ ID NO: 1149611 - RNA, 22 nt, Human
ugagauggagucuugcucuguc

SEQ ID NO: 1149612 - RNA, 27 nt, Human
ugagcccaggggggcugggaccaaagu

SEQ ID NO: 1149613 - RNA, 22 nt, Human
ugaggcggagucuugcucuguc

SEQ ID NO: 1149614 - RNA, 18 nt, Human
ugaggggggaaggggaga

SEQ ID NO: 1149615 - RNA, 21 nt, Human
ugaggucaguuugccgaaucc

SEQ ID NO: 1149616 - RNA, 22 nt, Human
ugcaguggcacgaucucggcuc

SEQ ID NO: 1149617 - RNA, 19 nt, Human
ugcccuuguccccucuccc

SEQ ID NO: 1149618 - RNA, 24 nt, Human
ugcccuuguccccucucccaccug

SEQ ID NO: 1149619 - RNA, 23 nt, Human
ugccucagaaucaaggauuuaac

SEQ ID NO: 1149620 - RNA, 21 nt, Human
ugccucagacucccaaguagc

SEQ ID NO: 1149621 - RNA, 24 nt, Human
ugccucagacucccaaguagcugg

SEQ ID NO: 1149622 - RNA, 19 nt, Human
ugcgaaggccacagggucc

SEQ ID NO: 1149623 - RNA, 23 nt, Human
ugcgaaggccacagggucccaca

SEQ ID NO: 1149624 - RNA, 23 nt, Human
ugcucagccucccgaguagcuga

SEQ ID NO: 1149625 - RNA, 23 nt, Human
ugcuccaugcagccauuggaguu

SEQ ID NO: 1149626 - RNA, 24 nt, Human
ugcucugucgcccaggcuggagug

SEQ ID NO: 1149627 - RNA, 24 nt, Human
ugcugggauuacaggugugagcca

SEQ ID NO: 1149628 - RNA, 22 nt, Human
uggaaggcugcaggcagggcag

SEQ ID NO: 1149629 - RNA, 23 nt, Human
uggaggaccaggcuucagacccc

SEQ ID NO: 1149630 - RNA, 18 nt, Human
uggaggcaggagaagcag

SEQ ID NO: 1149631 - RNA, 23 nt, Human
uggagucuugcucugucgcccag

SEQ ID NO: 1149632 - RNA, 24 nt, Human
uggagucuugcucugucgcccagg

SEQ ID NO: 1149633 - RNA, 23 nt, Human
uggagugcaguggcacgaucucg

SEQ ID NO: 1149634 - RNA, 24 nt, Human
uggagugcaguggcacgaucucgg

SEQ ID NO: 1149635 - RNA, 23 nt, Human
uggagugcaguggcgcgaucuca

SEQ ID NO: 1149636 - RNA, 24 nt, Human
uggagugcaguggcgcgaucucag

SEQ ID NO: 1149637 - RNA, 24 nt, Human
uggcaaggcuggucuugaacuccu

SEQ ID NO: 1149638 - RNA, 21 nt, Human
uggcagaggcaggucccuggg

SEQ ID NO: 1149639 - RNA, 18 nt, Human
uggcagagggggaggcug

SEQ ID NO: 1149640 - RNA, 19 nt, Human
uggcuucuucccauccugu

SEQ ID NO: 1149641 - RNA, 21 nt, Human
uggcuuucaugcccuuguccc

SEQ ID NO: 1149642 - RNA, 22 nt, Human
ugggacuacaggcgccagccac

SEQ ID NO: 1149643 - RNA, 24 nt, Human
ugggacuacaggcgccagccacca

SEQ ID NO: 1149644 - RNA, 18 nt, Human
ugggauuacaggcaugag

SEQ ID NO: 1149645 - RNA, 22 nt, Human
ugggauuacaggcaugagccac

SEQ ID NO: 1149646 - RNA, 23 nt, Human
ugggauuacaggcaugagccacc

SEQ ID NO: 1149647 - RNA, 24 nt, Human
ugggauuacaggcaugagccacca

SEQ ID NO: 1149648 - RNA, 25 nt, Human
ugggauuacaggcaugagccaccau

SEQ ID NO: 1149649 - RNA, 19 nt, Human
ugggauuacaggugugagc

SEQ ID NO: 1149650 - RNA, 21 nt, Human
ugggauuacaggugugagcca

SEQ ID NO: 1149651 - RNA, 22 nt, Human
ugggauuacaggugugagccac

SEQ ID NO: 1149652 - RNA, 22 nt, Human
ugggauuacaggugugagccac

SEQ ID NO: 1149653 - RNA, 24 nt, Human
ugggauuacaggugugagccacug

SEQ ID NO: 1149654 - RNA, 23 nt, Human
uggggacagugucuuuccccccg

SEQ ID NO: 1149655 - RNA, 21 nt, Human
uggggacagugucuuuccuuu

SEQ ID NO: 1149656 - RNA, 18 nt, Human
uggggagguggggugggg

SEQ ID NO: 1149657 - RNA, 21 nt, Human
uggggaugucagagcccguuc

SEQ ID NO: 1149658 - RNA, 24 nt, Human
ugggguuucaccauguuggcaagg

SEQ ID NO: 1149659 - RNA, 24 nt, Human
uggguggcagaggcaggucccugg

SEQ ID NO: 1149660 - RNA, 25 nt, Human
ugguccccgagugcgggcccccucc

SEQ ID NO: 1149661 - RNA, 23 nt, Human
ugucggggccuggcaggcaccag

SEQ ID NO: 1149662 - RNA, 20 nt, Human
ugucucaucacccagcuuuu

SEQ ID NO: 1149663 - RNA, 18 nt, Human
ugugcagcugagccaccu

SEQ ID NO: 1149664 - RNA, 18 nt, Human
uguguggaggaccaggcu

SEQ ID NO: 1149665 - RNA, 21 nt, Human
uguguuuuuaguagagauggg

SEQ ID NO: 1149666 - RNA, 18 nt, Human
uguuuccauucccaucug

SEQ ID NO: 1149667 - RNA, 23 nt, Human
uuaaacaaaacguacccccaccc

SEQ ID NO: 1149668 - RNA, 26 nt, Human
uuaacgaccuuuccgucaccccuucc

SEQ ID NO: 1149669 - RNA, 19 nt, Human
uuacaaaggauuuuuacag

SEQ ID NO: 1149670 - RNA, 23 nt, Human
uuagcugggggcggagucagagg

SEQ ID NO: 1149671 - RNA, 22 nt, Human
uuaguagagacaggguuucacc

SEQ ID NO: 1149672 - RNA, 24 nt, Human
uuaguagagacaggguuucaccgu

SEQ ID NO: 1149673 - RNA, 18 nt, Human
uuaguagagaugggguuu

SEQ ID NO: 1149674 - RNA, 22 nt, Human
uuaguagagaugggguuucacc

SEQ ID NO: 1149675 - RNA, 24 nt, Human
uuaguagagaugggguuucaccau

SEQ ID NO: 1149676 - RNA, 20 nt, Human
uucacaaauaacauccccgu

SEQ ID NO: 1149677 - RNA, 19 nt, Human
uucaccaucgaaguaagug

SEQ ID NO: 1149678 - RNA, 22 nt, Human
uucaccauguuggcaaggcugg

SEQ ID NO: 1149679 - RNA, 20 nt, Human
uuccccagcucagggaccua

SEQ ID NO: 1149680 - RNA, 20 nt, Human
uucucccucaacaccuacua

SEQ ID NO: 1149681 - RNA, 20 nt, Human
uugcgagggggaaggcucca

SEQ ID NO: 1149682 - RNA, 24 nt, Human
uugcucugucgcccaggcuggagu

SEQ ID NO: 1149683 - RNA, 23 nt, Human
uuguguuuuuaguagagaugggg

SEQ ID NO: 1149684 - RNA, 21 nt, Human
uuucaccauguuggcaaggcu

SEQ ID NO: 1149685 - RNA, 19 nt, Human
uuucaccguguuagccagg

SEQ ID NO: 1149686 - RNA, 20 nt, Human
uuugccgaauccuugcagug

SEQ ID NO: 1149687 - RNA, 24 nt, Human
uuuuuaguagagaugggguuucac

SEQ ID NO: 1149688 - RNA, 24 nt, Human
uuuuugagauggagucuugcucug

SEQ ID NO: 1149689 - RNA, 21 nt, Human
uuuuuguaucuuuaguagaga

SEQ ID NO: 1149690 - RNA, 20 nt, Human
uuuuuguguuuuuaguagag

SEQ ID NO: 1149691 - RNA, 24 nt, Human
uuuuuuguaucuuuaguagagaca

SEQ ID NO: 1149692 - RNA, 24 nt, Human
aaaguacuccuugccccagccuug

SEQ ID NO: 1149693 - RNA, 20 nt, Human
acuccuugccccagccuugc

SEQ ID NO: 1149694 - RNA, 23 nt, Human
cacgaccagguuccuagucuacc

SEQ ID NO: 1149695 - RNA, 21 nt, Human
cgaccagguuccuagucuacc

SEQ ID NO: 1149696 - RNA, 23 nt, Human
gagggaacaaacagaaaagauuc

SEQ ID NO: 1149697 - RNA, 23 nt, Human
gauugccaggaugccggagagau

SEQ ID NO: 1149698 - RNA, 28 nt, Human
gugcaacuccaaauaaaaagggaacgcc

SEQ ID NO: 1149699 - RNA, 21 nt, Human
uaacaaacauguauuuuucca

SEQ ID NO: 1149700 - RNA, 22 nt, Human
ugcgcaggcugugauugccagg

SEQ ID NO: 1149701 - RNA, 21 nt, Human
ugcuucaaugcagaaccuuau

SEQ ID NO: 1149702 - RNA, 22 nt, Human
aaaaacacaaaauuauagacac

SEQ ID NO: 1149703 - RNA, 23 nt, Human
aaaacacuucucucccccagggc

SEQ ID NO: 1149704 - RNA, 18 nt, Human
aaaagaccaggccaguca

SEQ ID NO: 1149705 - RNA, 21 nt, Human
aaagacagggguguagcaaag

SEQ ID NO: 1149706 - RNA, 21 nt, Human
aaagugcugcgauuacaggca

SEQ ID NO: 1149707 - RNA, 23 nt, Human
aaagugcugcgauuacaggcagg

SEQ ID NO: 1149708 - RNA, 24 nt, Human
aaagugcugcgauuacaggcagga

SEQ ID NO: 1149709 - RNA, 26 nt, Human
aacuccugggcucaagugaucccccu

SEQ ID NO: 1149710 - RNA, 23 nt, Human
aagaccccucaccuggcauggga

SEQ ID NO: 1149711 - RNA, 19 nt, Human
aagcggcaugacccaaggc

SEQ ID NO: 1149712 - RNA, 19 nt, Human
aaucguaguucacuguaac

SEQ ID NO: 1149713 - RNA, 23 nt, Human
aaugagggagacgugcagagaga

SEQ ID NO: 1149714 - RNA, 18 nt, Human
aauggagggacacccaga

SEQ ID NO: 1149715 - RNA, 22 nt, Human
acaaaaacacaaaauuauagac

SEQ ID NO: 1149716 - RNA, 18 nt, Human
acacugcuacagccagcc

SEQ ID NO: 1149717 - RNA, 20 nt, Human
acagacuuccagcugcuuuu

SEQ ID NO: 1149718 - RNA, 18 nt, Human
acaggacaguggugcuuc

SEQ ID NO: 1149719 - RNA, 23 nt, Human
acagucacccuucccugacucag

SEQ ID NO: 1149720 - RNA, 24 nt, Human
accccaggaagccugcaucccacc

SEQ ID NO: 1149721 - RNA, 19 nt, Human
accucagccucuggaguag

SEQ ID NO: 1149722 - RNA, 23 nt, Human
accugcucugcuuucuaauaguc

SEQ ID NO: 1149723 - RNA, 21 nt, Human
agaaaagcaagugccccaggg

SEQ ID NO: 1149724 - RNA, 22 nt, Human
agaaaauaacaggcuugcacaa

SEQ ID NO: 1149725 - RNA, 23 nt, Human
agaaaauaacaggcuugcacaaa

SEQ ID NO: 1149726 - RNA, 23 nt, Human
agaaccuuucaagguggacucac

SEQ ID NO: 1149727 - RNA, 22 nt, Human
agagacagagucucccucuguu

SEQ ID NO: 1149728 - RNA, 20 nt, Human
agagagacuuuaaauggauc

SEQ ID NO: 1149729 - RNA, 20 nt, Human
aggagccaccguucccagca

SEQ ID NO: 1149730 - RNA, 24 nt, Human
aggcaccccugaccugcuagucuu

SEQ ID NO: 1149731 - RNA, 25 nt, Human
aggcaccccugaccugcuagucuug

SEQ ID NO: 1149732 - RNA, 26 nt, Human
aggcaggagccaccguucccagcaac

SEQ ID NO: 1149733 - RNA, 23 nt, Human
aggcaugcaccacaacacccagc

SEQ ID NO: 1149734 - RNA, 19 nt, Human
aggccucucaacugcccaa

SEQ ID NO: 1149735 - RNA, 19 nt, Human
agggaaaccggggaucuca

SEQ ID NO: 1149736 - RNA, 20 nt, Human
agggaggugggaagaccccu

SEQ ID NO: 1149737 - RNA, 22 nt, Human
auguuugcgccccaggggcuga

SEQ ID NO: 1149738 - RNA, 26 nt, Human
caaaaacacaaaauuauagacacuac

SEQ ID NO: 1149739 - RNA, 22 nt, Human
caaagugcugcgauuacaggca

SEQ ID NO: 1149740 - RNA, 23 nt, Human
caagcaccugcuccaagcccagc

SEQ ID NO: 1149741 - RNA, 23 nt, Human
caagccaguggaggaaaguggca

SEQ ID NO: 1149742 - RNA, 23 nt, Human
caagguagagccauuccaauguc

SEQ ID NO: 1149743 - RNA, 19 nt, Human
cacaccgaaaaagaccagg

SEQ ID NO: 1149744 - RNA, 20 nt, Human
cacaccgaaaaagaccaggc

SEQ ID NO: 1149745 - RNA, 25 nt, Human
caccccaggcuacuggaucagaggc

SEQ ID NO: 1149746 - RNA, 22 nt, Human
cacccugccagggauagcccag

SEQ ID NO: 1149747 - RNA, 19 nt, Human
cacccuucccugacucagg

SEQ ID NO: 1149748 - RNA, 19 nt, Human
caccugcuccaagcccagc

SEQ ID NO: 1149749 - RNA, 20 nt, Human
caccugcuccaagcccagca

SEQ ID NO: 1149750 - RNA, 23 nt, Human
caccuggcaugggaggggcuggc

SEQ ID NO: 1149751 - RNA, 19 nt, Human
cacgcaaacuccaugcagg

SEQ ID NO: 1149752 - RNA, 18 nt, Human
cacucaggcaguacaacu

SEQ ID NO: 1149753 - RNA, 21 nt, Human
cacuuccagggccacaucuca

SEQ ID NO: 1149754 - RNA, 20 nt, Human
cagcacugccgaagaaauug

SEQ ID NO: 1149755 - RNA, 21 nt, Human
cagcagcaggacauccugugc

SEQ ID NO: 1149756 - RNA, 21 nt, Human
cagcaggacauccugugcccc

SEQ ID NO: 1149757 - RNA, 20 nt, Human
cagcauagcgagaaaagcaa

SEQ ID NO: 1149758 - RNA, 25 nt, Human
caggaagcagcaaaugcccuggguc

SEQ ID NO: 1149759 - RNA, 22 nt, Human
caggacauccugugccccaccc

SEQ ID NO: 1149760 - RNA, 19 nt, Human
caggagccaccguucccag

SEQ ID NO: 1149761 - RNA, 18 nt, Human
caggagccucuggugucc

SEQ ID NO: 1149762 - RNA, 22 nt, Human
caggcaggagccaccguuccca

SEQ ID NO: 1149763 - RNA, 21 nt, Human
caggccucagcaaagggcagg

SEQ ID NO: 1149764 - RNA, 24 nt, Human
cagggccacaucucagguccagga

SEQ ID NO: 1149765 - RNA, 18 nt, Human
cagugaacaagucccuca

SEQ ID NO: 1149766 - RNA, 24 nt, Human
caugaaggggaauccacgcuccuc

SEQ ID NO: 1149767 - RNA, 18 nt, Human
cauucuguguggucacug

SEQ ID NO: 1149768 - RNA, 23 nt, Human
ccaaagugcugcgauuacaggca

SEQ ID NO: 1149769 - RNA, 25 nt, Human
ccaacuccugggcucaagugauccc

SEQ ID NO: 1149770 - RNA, 18 nt, Human
ccaaugucauuucuugcu

SEQ ID NO: 1149771 - RNA, 19 nt, Human
ccacgcuccucuguguccu

SEQ ID NO: 1149772 - RNA, 18 nt, Human
ccagccuugguccccaga

SEQ ID NO: 1149773 - RNA, 20 nt, Human
ccaggcuggccuccaacucc

SEQ ID NO: 1149774 - RNA, 21 nt, Human
ccaggggcugaccacugagau

SEQ ID NO: 1149775 - RNA, 21 nt, Human
cccaaggccucucaacugccc

SEQ ID NO: 1149776 - RNA, 21 nt, Human
cccacagcugcucugcucugc

SEQ ID NO: 1149777 - RNA, 19 nt, Human
cccacguucuccauugcua

SEQ ID NO: 1149778 - RNA, 22 nt, Human
ccccaccccaggcuacuggauc

SEQ ID NO: 1149779 - RNA, 24 nt, Human
ccccaucucuugagaccacaucug

SEQ ID NO: 1149780 - RNA, 21 nt, Human
cccccaucucuugagaccaca

SEQ ID NO: 1149781 - RNA, 27 nt, Human
ccccccuaccucagccucccaaagugc

SEQ ID NO: 1149782 - RNA, 18 nt, Human
cccccuaccucagccucc

SEQ ID NO: 1149783 - RNA, 20 nt, Human
ccuaaguggaacuucagcuu

SEQ ID NO: 1149784 - RNA, 18 nt, Human
ccucccaccucagccucc

SEQ ID NO: 1149785 - RNA, 21 nt, Human
ccugcagugaacaagucccuc

SEQ ID NO: 1149786 - RNA, 22 nt, Human
ccugggcucaagugaucccccc

SEQ ID NO: 1149787 - RNA, 22 nt, Human
ccugggucagggagugagggac

SEQ ID NO: 1149788 - RNA, 21 nt, Human
cuacaaucacauacuuaagaa

SEQ ID NO: 1149789 - RNA, 21 nt, Human
cuaggcucuaaggauuuccaa

SEQ ID NO: 1149790 - RNA, 18 nt, Human
cucaaagcuuggcuggug

SEQ ID NO: 1149791 - RNA, 24 nt, Human
cucaagccauccucccaccucagc

SEQ ID NO: 1149792 - RNA, 25 nt, Human
cucaagugauccccccuaccucagc

SEQ ID NO: 1149793 - RNA, 23 nt, Human
cucuauuauaucccuagcuucca

SEQ ID NO: 1149794 - RNA, 23 nt, Human
cucugcacuggacaguucccucc

SEQ ID NO: 1149795 - RNA, 19 nt, Human
cucugcucuagggccuccc

SEQ ID NO: 1149796 - RNA, 23 nt, Human
cucuguguccugucacgggcugg

SEQ ID NO: 1149797 - RNA, 23 nt, Human
cugcaucaucccacuuuauccag

SEQ ID NO: 1149798 - RNA, 20 nt, Human
cugcaucccaccuucacacc

SEQ ID NO: 1149799 - RNA, 20 nt, Human
cuggauucaaucugggcaau

SEQ ID NO: 1149800 - RNA, 22 nt, Human
cuugcuguguugcccaggcugg

SEQ ID NO: 1149801 - RNA, 24 nt, Human
gaacuucuggacucaagccauccu

SEQ ID NO: 1149802 - RNA, 23 nt, Human
gaaugcacuugacagacuuccag

SEQ ID NO: 1149803 - RNA, 18 nt, Human
gagaccugcucugcuuuc

SEQ ID NO: 1149804 - RNA, 19 nt, Human
gagaugggacccagcaacc

SEQ ID NO: 1149805 - RNA, 24 nt, Human
gaguaguuaagaauacaggcaugc

SEQ ID NO: 1149806 - RNA, 18 nt, Human
gauuacaggcaggagcca

SEQ ID NO: 1149807 - RNA, 25 nt, Human
gcacaccccuuccaccugggaacug

SEQ ID NO: 1149808 - RNA, 21 nt, Human
gcagagagaagcaggagugag

SEQ ID NO: 1149809 - RNA, 20 nt, Human
gcaugggaggggcuggcuga

SEQ ID NO: 1149810 - RNA, 18 nt, Human
gcauuaucuguugucacu

SEQ ID NO: 1149811 - RNA, 26 nt, Human
gcccugggcccccaucucuugagacc

SEQ ID NO: 1149812 - RNA, 18 nt, Human
gcuaaguacaaaaacaca

SEQ ID NO: 1149813 - RNA, 21 nt, Human
gcuagucuugccacaccuaaa

SEQ ID NO: 1149814 - RNA, 20 nt, Human
gcucaagugauccccccuac

SEQ ID NO: 1149815 - RNA, 20 nt, Human
gcugcccagaccccagcagc

SEQ ID NO: 1149816 - RNA, 19 nt, Human
gcuggccuccaacuccugg

SEQ ID NO: 1149817 - RNA, 20 nt, Human
ggcaggcuuuggcagcgggg

SEQ ID NO: 1149818 - RNA, 22 nt, Human
ggcagggcagcauagcgagaaa

SEQ ID NO: 1149819 - RNA, 20 nt, Human
ggcaugccagcuuucaucag

SEQ ID NO: 1149820 - RNA, 26 nt, Human
ggccauggaggcacacugcuacagcc

SEQ ID NO: 1149821 - RNA, 20 nt, Human
gggaauguuugcgccccagg

SEQ ID NO: 1149822 - RNA, 19 nt, Human
gggaccaccugaucgagcu

SEQ ID NO: 1149823 - RNA, 23 nt, Human
gggcucaagugauccccccuacc

SEQ ID NO: 1149824 - RNA, 22 nt, Human
gggucuugcuguguugcccagg

SEQ ID NO: 1149825 - RNA, 20 nt, Human
guguggucacugcaucaucc

SEQ ID NO: 1149826 - RNA, 18 nt, Human
guugacaucuaugcccca

SEQ ID NO: 1149827 - RNA, 23 nt, Human
guuucauugaaucuugagaccug

SEQ ID NO: 1149828 - RNA, 21 nt, Human
uaagaauacaggcaugcacca

SEQ ID NO: 1149829 - RNA, 24 nt, Human
uaagaauacaggcaugcaccacaa

SEQ ID NO: 1149830 - RNA, 21 nt, Human
uaagguguaaacucaagugcu

SEQ ID NO: 1149831 - RNA, 19 nt, Human
uaaguacaaaaacacaaaa

SEQ ID NO: 1149832 - RNA, 20 nt, Human
uaauaaagacagggguguag

SEQ ID NO: 1149833 - RNA, 21 nt, Human
uaaugauaccuguguuacagu

SEQ ID NO: 1149834 - RNA, 24 nt, Human
uacaaaaacacaaaauuauagaca

SEQ ID NO: 1149835 - RNA, 25 nt, Human
uaccucagccucccaaagugcugcg

SEQ ID NO: 1149836 - RNA, 18 nt, Human
uagcccaggccucagcaa

SEQ ID NO: 1149837 - RNA, 19 nt, Human
uagcccugggcccccaucu

SEQ ID NO: 1149838 - RNA, 24 nt, Human
uaggcgucucuauucagaacacuc

SEQ ID NO: 1149839 - RNA, 24 nt, Human
uauagaaauggggucuugcugugu

SEQ ID NO: 1149840 - RNA, 19 nt, Human
uaugcuuucaagcaccugc

SEQ ID NO: 1149841 - RNA, 25 nt, Human
ucaagccauccucccaccucagccu

SEQ ID NO: 1149842 - RNA, 22 nt, Human
ucacaaaagaccgaggucugca

SEQ ID NO: 1149843 - RNA, 19 nt, Human
ucaccaagcucacaaaaga

SEQ ID NO: 1149844 - RNA, 23 nt, Human
ucacuguaaccuugaacuucugg

SEQ ID NO: 1149845 - RNA, 22 nt, Human
ucagaacacucuguuagccuga

SEQ ID NO: 1149846 - RNA, 18 nt, Human
ucagacucugguucacac

SEQ ID NO: 1149847 - RNA, 25 nt, Human
ucagcaguucucauagcgcugccca

SEQ ID NO: 1149848 - RNA, 18 nt, Human
ucagccucccaaagugcu

SEQ ID NO: 1149849 - RNA, 23 nt, Human
ucaguacuuuuuaagcuccuacg

SEQ ID NO: 1149850 - RNA, 22 nt, Human
ucauucaagccuaucugcuucu

SEQ ID NO: 1149851 - RNA, 18 nt, Human
uccacaagguagagccau

SEQ ID NO: 1149852 - RNA, 19 nt, Human
uccauuuccagaaugcacu

SEQ ID NO: 1149853 - RNA, 24 nt, Human
ucccaaagugcugcgauuacaggc

SEQ ID NO: 1149854 - RNA, 24 nt, Human
ucccccagggcaggcaaucagggc

SEQ ID NO: 1149855 - RNA, 26 nt, Human
uccccggauggcggcauuccuagccc

SEQ ID NO: 1149856 - RNA, 21 nt, Human
uccuggcacaccccuuccacc

SEQ ID NO: 1149857 - RNA, 18 nt, Human
uccugggcucaagugauc

SEQ ID NO: 1149858 - RNA, 21 nt, Human
uccugggcucaagugaucccc

SEQ ID NO: 1149859 - RNA, 20 nt, Human
ucgccaggguggagggcugu

SEQ ID NO: 1149860 - RNA, 21 nt, Human
ucgccaggguggagggcugua

SEQ ID NO: 1149861 - RNA, 23 nt, Human
ucucaacugcccaagcagacccu

SEQ ID NO: 1149862 - RNA, 19 nt, Human
ucucagguccaggagccuc

SEQ ID NO: 1149863 - RNA, 19 nt, Human
ucucauagcgcugcccaga

SEQ ID NO: 1149864 - RNA, 20 nt, Human
ucugauguggccagaagugu

SEQ ID NO: 1149865 - RNA, 18 nt, Human
ucugcacccugccaggga

SEQ ID NO: 1149866 - RNA, 23 nt, Human
ucuguuacccagcuggaaugcag

SEQ ID NO: 1149867 - RNA, 20 nt, Human
ucuucuccuccuccuguaga

SEQ ID NO: 1149868 - RNA, 18 nt, Human
ucuugcuguguugcccag

SEQ ID NO: 1149869 - RNA, 19 nt, Human
ucuugcuguguugcccagg

SEQ ID NO: 1149870 - RNA, 23 nt, Human
ucuugcuguguugcccaggcugg

SEQ ID NO: 1149871 - RNA, 21 nt, Human
ucuuucauucauucauuuauu

SEQ ID NO: 1149872 - RNA, 25 nt, Human
ugaauuggccugcaggguccaaggu

SEQ ID NO: 1149873 - RNA, 19 nt, Human
ugagaaaagaauggcagag

SEQ ID NO: 1149874 - RNA, 19 nt, Human
ugagaaaagaauggcagag

SEQ ID NO: 1149875 - RNA, 20 nt, Human
ugagaaaagaauggcagaga

SEQ ID NO: 1149876 - RNA, 21 nt, Human
ugagaaaagaauggcagagac

SEQ ID NO: 1149877 - RNA, 19 nt, Human
ugagaaccuuucaaggugg

SEQ ID NO: 1149878 - RNA, 19 nt, Human
ugagggaccaccugaucga

SEQ ID NO: 1149879 - RNA, 21 nt, Human
ugcacuggacaguucccucca

SEQ ID NO: 1149880 - RNA, 18 nt, Human
ugccagggauagcccagg

SEQ ID NO: 1149881 - RNA, 19 nt, Human
ugccagggauagcccaggc

SEQ ID NO: 1149882 - RNA, 20 nt, Human
ugcccaggcuggccuccaac

SEQ ID NO: 1149883 - RNA, 28 nt, Human
ugcccaggcuggccuccaacuccugggc

SEQ ID NO: 1149884 - RNA, 22 nt, Human
ugccccacacuucugaaaagua

SEQ ID NO: 1149885 - RNA, 21 nt, Human
ugccccagguugagaaaagaa

SEQ ID NO: 1149886 - RNA, 20 nt, Human
ugcccugggucagggaguga

SEQ ID NO: 1149887 - RNA, 21 nt, Human
ugcccugggucagggagugag

SEQ ID NO: 1149888 - RNA, 20 nt, Human
ugccgagcugggugagaagg

SEQ ID NO: 1149889 - RNA, 23 nt, Human
ugccgagcugggugagaaggggc

SEQ ID NO: 1149890 - RNA, 20 nt, Human
ugccuucuggaauugcuccc

SEQ ID NO: 1149891 - RNA, 22 nt, Human
ugcgauuacaggcaggagccac

SEQ ID NO: 1149892 - RNA, 24 nt, Human
ugcgauuacaggcaggagccaccg

SEQ ID NO: 1149893 - RNA, 23 nt, Human
ugcuaggcucaguugacaucuaa

SEQ ID NO: 1149894 - RNA, 19 nt, Human
ugcuaugucuuuggcuccu

SEQ ID NO: 1149895 - RNA, 19 nt, Human
ugcuccaagcccagcauug

SEQ ID NO: 1149896 - RNA, 20 nt, Human
ugcucugcucugcucuaggg

SEQ ID NO: 1149897 - RNA, 24 nt, Human
ugcucugcuuucuaauagucucuu

SEQ ID NO: 1149898 - RNA, 24 nt, Human
ugcuguguugcccaggcuggccuc

SEQ ID NO: 1149899 - RNA, 21 nt, Human
ugcuugaauuggccugcaggg

SEQ ID NO: 1149900 - RNA, 23 nt, Human
uggcagagacaggaagcagcaaa

SEQ ID NO: 1149901 - RNA, 21 nt, Human
uggccuccaacuccugggcuc

SEQ ID NO: 1149902 - RNA, 24 nt, Human
uggcucaaucguaguucacuguaa

SEQ ID NO: 1149903 - RNA, 23 nt, Human
uggcugaagucaaccaugaaggg

SEQ ID NO: 1149904 - RNA, 22 nt, Human
uggcugagguuagagacaagga

SEQ ID NO: 1149905 - RNA, 22 nt, Human
uggcuggugggguccagguucc

SEQ ID NO: 1149906 - RNA, 22 nt, Human
ugggaagaccccucaccuggca

SEQ ID NO: 1149907 - RNA, 18 nt, Human
ugggacccagcaaccugc

SEQ ID NO: 1149908 - RNA, 24 nt, Human
uggggucuugcuguguugcccagg

SEQ ID NO: 1149909 - RNA, 20 nt, Human
ugggugguccaauugccugu

SEQ ID NO: 1149910 - RNA, 24 nt, Human
uguagcaaaggcugccgagcuggg

SEQ ID NO: 1149911 - RNA, 25 nt, Human
uguggaugauucuucuccuucaaag

SEQ ID NO: 1149912 - RNA, 26 nt, Human
uguggaugauucuucuccuucaaagg

SEQ ID NO: 1149913 - RNA, 24 nt, Human
uguguugcccaggcuggccuccaa

SEQ ID NO: 1149914 - RNA, 19 nt, Human
uguuacagaaaauaacagg

SEQ ID NO: 1149915 - RNA, 22 nt, Human
uguugcccaggcuggccuccaa

SEQ ID NO: 1149916 - RNA, 18 nt, Human
uuacagaaaauaacaggc

SEQ ID NO: 1149917 - RNA, 19 nt, Human
uuauagaaauggggucuug

SEQ ID NO: 1149918 - RNA, 26 nt, Human
uucaaaacacuucucucccccagggc

SEQ ID NO: 1149919 - RNA, 21 nt, Human
uuccaccugcauguccuccug

SEQ ID NO: 1149920 - RNA, 24 nt, Human
uucccagcaacauacucuauuaua

SEQ ID NO: 1149921 - RNA, 20 nt, Human
uucugaaaaguagugauggu

SEQ ID NO: 1149922 - RNA, 20 nt, Human
uugcacaaauuccaccugca

SEQ ID NO: 1149923 - RNA, 22 nt, Human
uuggaauuuggucccagaagga

SEQ ID NO: 1149924 - RNA, 18 nt, Human
uuggcuccugcagagaga

SEQ ID NO: 1149925 - RNA, 21 nt, Human
uuguuuuuucuuuaggaauuu

SEQ ID NO: 1149926 - RNA, 22 nt, Human
uuuguaagccuugaucugaccg

SEQ ID NO: 1149927 - RNA, 19 nt, Human
uuuugguuuguuuuuucuu

SEQ ID NO: 1149928 - RNA, 23 nt, Human
aagaagcuggucaucggagagau

SEQ ID NO: 1149929 - RNA, 20 nt, Human
aagaugacaccaucuccauc

SEQ ID NO: 1149930 - RNA, 22 nt, Human
aagcaaccuucucuagagucga

SEQ ID NO: 1149931 - RNA, 25 nt, Human
aaugcagaaagcaaccuucucuaga

SEQ ID NO: 1149932 - RNA, 21 nt, Human
acaaucaaggcaagaugacac

SEQ ID NO: 1149933 - RNA, 20 nt, Human
acaguauuuggccuauuguu

SEQ ID NO: 1149934 - RNA, 20 nt, Human
agagauguccauccuuuauc

SEQ ID NO: 1149935 - RNA, 19 nt, Human
agagggcaguugccagaau

SEQ ID NO: 1149936 - RNA, 24 nt, Human
agccucguguucucugaccugggg

SEQ ID NO: 1149937 - RNA, 21 nt, Human
aggaauggaaucuugggccau

SEQ ID NO: 1149938 - RNA, 19 nt, Human
aggcagaaggaucuuaaau

SEQ ID NO: 1149939 - RNA, 19 nt, Human
augcagugaguguuauagc

SEQ ID NO: 1149940 - RNA, 19 nt, Human
caggugguccuugcuccca

SEQ ID NO: 1149941 - RNA, 24 nt, Human
ccaaaauggcggcgggcugcuucc

SEQ ID NO: 1149942 - RNA, 24 nt, Human
ccaagaugguggugggccacuucc

SEQ ID NO: 1149943 - RNA, 24 nt, Human
cgggcugcuuccaagaugguggaa

SEQ ID NO: 1149944 - RNA, 22 nt, Human
cuggucaucggagagaugucca

SEQ ID NO: 1149945 - RNA, 18 nt, Human
gauacaaucaaggcaaga

SEQ ID NO: 1149946 - RNA, 22 nt, Human
gcagaaagcaaccuucucuaga

SEQ ID NO: 1149947 - RNA, 21 nt, Human
gcaguugccagaaugcagaaa

SEQ ID NO: 1149948 - RNA, 21 nt, Human
gguccuugcucccagagcucc

SEQ ID NO: 1149949 - RNA, 21 nt, Human
gucaucggagagauguccauc

SEQ ID NO: 1149950 - RNA, 23 nt, Human
uacaaucaaggcaagaugacacc

SEQ ID NO: 1149951 - RNA, 21 nt, Human
uaccaggugguccuugcuccu

SEQ ID NO: 1149952 - RNA, 24 nt, Human
uaucagcacaguauuuggccuauu

SEQ ID NO: 1149953 - RNA, 24 nt, Human
uauuagaagccgugggucauggaa

SEQ ID NO: 1149954 - RNA, 22 nt, Human
ucccagagcucccaagauggug

SEQ ID NO: 1149955 - RNA, 26 nt, Human
uccuuuaucuuggggaugaagcuucu

SEQ ID NO: 1149956 - RNA, 28 nt, Human
uggaaucuugggccaugcagugaguguu

SEQ ID NO: 1149957 - RNA, 18 nt, Human
uggauacaaucaaggcaa

SEQ ID NO: 1149958 - RNA, 21 nt, Human
uggcaagccucguguucucug

SEQ ID NO: 1149959 - RNA, 24 nt, Human
uggcaagccucguguucucugacc

SEQ ID NO: 1149960 - RNA, 22 nt, Human
aaaauacuccugucagccucag

SEQ ID NO: 1149961 - RNA, 23 nt, Human
aagcgucugguuuuccgcccuuc

SEQ ID NO: 1149962 - RNA, 18 nt, Human
accccaucagcuuccauc

SEQ ID NO: 1149963 - RNA, 20 nt, Human
auuuucagcgauucugugcc

SEQ ID NO: 1149964 - RNA, 18 nt, Human
caacuccuuggccgaccc

SEQ ID NO: 1149965 - RNA, 25 nt, Human
caccuccucaucacuauccacagcc

SEQ ID NO: 1149966 - RNA, 25 nt, Human
cagcagguuucuucucuuccagcuu

SEQ ID NO: 1149967 - RNA, 22 nt, Human
cagccaugucauccaucguggc

SEQ ID NO: 1149968 - RNA, 20 nt, Human
caucaacaaucgagucucca

SEQ ID NO: 1149969 - RNA, 20 nt, Human
ccacagccaugucauccauc

SEQ ID NO: 1149970 - RNA, 20 nt, Human
ccaccuccucaucacuaucc

SEQ ID NO: 1149971 - RNA, 22 nt, Human
ccccaucagcuuccaucuucuu

SEQ ID NO: 1149972 - RNA, 20 nt, Human
ccucuucucucucucguucc

SEQ ID NO: 1149973 - RNA, 24 nt, Human
ccucuucucucucucguucccgau

SEQ ID NO: 1149974 - RNA, 19 nt, Human
ccuucccagccagcagacc

SEQ ID NO: 1149975 - RNA, 21 nt, Human
ccuugcugcggauaagagugg

SEQ ID NO: 1149976 - RNA, 21 nt, Human
cucucggucacggucucuguc

SEQ ID NO: 1149977 - RNA, 18 nt, Human
cuuugucauugguuuccu

SEQ ID NO: 1149978 - RNA, 20 nt, Human
gucagcuuacucaucaucca

SEQ ID NO: 1149979 - RNA, 20 nt, Human
uacccugguccauuuugcua

SEQ ID NO: 1149980 - RNA, 18 nt, Human
ucaaagucccaacggcuu

SEQ ID NO: 1149981 - RNA, 26 nt, Human
ucagcuuccaucuucuuccucuucuc

SEQ ID NO: 1149982 - RNA, 23 nt, Human
uccaccuccucaucacuauccac

SEQ ID NO: 1149983 - RNA, 29 nt, Human
uccccaaugucuucgaaaauacuccuguu

SEQ ID NO: 1149984 - RNA, 18 nt, Human
uccuucuucuuaagcuuc

SEQ ID NO: 1149985 - RNA, 24 nt, Human
ucgaaaauacuccugucagccuca

SEQ ID NO: 1149986 - RNA, 27 nt, Human
ucuccugaucacgcucccguucccgau

SEQ ID NO: 1149987 - RNA, 18 nt, Human
ucucuucuuuuccucuuc

SEQ ID NO: 1149988 - RNA, 19 nt, Human
ucuucucuuccagcuuccc

SEQ ID NO: 1149989 - RNA, 23 nt, Human
ugacaauaucauuuguggucagu

SEQ ID NO: 1149990 - RNA, 24 nt, Human
uggggcagucaaccuugcugcgga

SEQ ID NO: 1149991 - RNA, 20 nt, Human
uggucuuuugacuucaaccc

SEQ ID NO: 1149992 - RNA, 18 nt, Human
uucugcaauuuucagcga

SEQ ID NO: 1149993 - RNA, 25 nt, Human
uucuuaagcuucuuguuacggguuc

SEQ ID NO: 1149994 - RNA, 23 nt, Human
uuuccucuucucucucucguucc

SEQ ID NO: 1149995 - RNA, 23 nt, Human
aaagaauuucccucaaauuggaa

SEQ ID NO: 1149996 - RNA, 24 nt, Human
aaagugcugggauuacgggcauga

SEQ ID NO: 1149997 - RNA, 18 nt, Human
aacacuuugugcaggaga

SEQ ID NO: 1149998 - RNA, 19 nt, Human
aacuggcuccaaaacuuuu

SEQ ID NO: 1149999 - RNA, 18 nt, Human
aagaacuccaacucacgg

SEQ ID NO: 1150000 - RNA, 19 nt, Human
aagaacuccacgguagggg

SEQ ID NO: 1150001 - RNA, 21 nt, Human
aagaccaguggccuuggggac

SEQ ID NO: 1150002 - RNA, 21 nt, Human
aagaccaguggccuuggggac

SEQ ID NO: 1150003 - RNA, 19 nt, Human
aagugcugggauuacgggc

SEQ ID NO: 1150004 - RNA, 21 nt, Human
aagugcugggauuacgggcau

SEQ ID NO: 1150005 - RNA, 26 nt, Human
aagugcugggauuacgggcaugagcc

SEQ ID NO: 1150006 - RNA, 21 nt, Human
acaggcauuugccaccacacc

SEQ ID NO: 1150007 - RNA, 23 nt, Human
acaggcauuugccaccacacccg

SEQ ID NO: 1150008 - RNA, 19 nt, Human
acucagguaaaccagggag

SEQ ID NO: 1150009 - RNA, 18 nt, Human
acuggguuucaccauguu

SEQ ID NO: 1150010 - RNA, 23 nt, Human
acuggguuucaccauguugccua

SEQ ID NO: 1150011 - RNA, 24 nt, Human
acuggguuucaccauguugccuag

SEQ ID NO: 1150012 - RNA, 24 nt, Human
acuugcuucugcuguggcaccuuu

SEQ ID NO: 1150013 - RNA, 20 nt, Human
acuuuuuuaucuuucugaag

SEQ ID NO: 1150014 - RNA, 18 nt, Human
agaagggauugugcucug

SEQ ID NO: 1150015 - RNA, 22 nt, Human
agauacaugcuuccagccaaca

SEQ ID NO: 1150016 - RNA, 23 nt, Human
agguucuuaacugcuuucaauuu

SEQ ID NO: 1150017 - RNA, 21 nt, Human
aguagcugggauuacaggcau

SEQ ID NO: 1150018 - RNA, 21 nt, Human
auagcaauauacaaguauauc

SEQ ID NO: 1150019 - RNA, 22 nt, Human
aucacuaaugccauccuuucuu

SEQ ID NO: 1150020 - RNA, 23 nt, Human
augcaguggcacaaucucggcuc

SEQ ID NO: 1150021 - RNA, 20 nt, Human
auuccugacaaaugcacugg

SEQ ID NO: 1150022 - RNA, 18 nt, Human
auuuguuucccuucccca

SEQ ID NO: 1150023 - RNA, 20 nt, Human
auuuuuguauuuucaguaga

SEQ ID NO: 1150024 - RNA, 22 nt, Human
auuuuuguauuuucaguagaga

SEQ ID NO: 1150025 - RNA, 24 nt, Human
caaagugcugggauuacgggcaug

SEQ ID NO: 1150026 - RNA, 25 nt, Human
caagugaucugcccacccccugaag

SEQ ID NO: 1150027 - RNA, 20 nt, Human
caagugauucuugugucuca

SEQ ID NO: 1150028 - RNA, 22 nt, Human
caagugauucuugugucucagc

SEQ ID NO: 1150029 - RNA, 21 nt, Human
cacauaaagaacaacccaaua

SEQ ID NO: 1150030 - RNA, 24 nt, Human
cacauaaagaacaacccaauaguu

SEQ ID NO: 1150031 - RNA, 19 nt, Human
cacauugcagcuacucuuu

SEQ ID NO: 1150032 - RNA, 22 nt, Human
caccaagaacuccaacucacgg

SEQ ID NO: 1150033 - RNA, 28 nt, Human
caccaagaacuccaacucacggcaccaa

SEQ ID NO: 1150034 - RNA, 19 nt, Human
caccaagaacuccacggua

SEQ ID NO: 1150035 - RNA, 22 nt, Human
caccaagaacuccacgguaggg

SEQ ID NO: 1150036 - RNA, 24 nt, Human
caccacacccggcugauuuuugua

SEQ ID NO: 1150037 - RNA, 24 nt, Human
caccauguugccuaggcuggucuc

SEQ ID NO: 1150038 - RNA, 27 nt, Human
caccauguugccuaggcuggucucaaa

SEQ ID NO: 1150039 - RNA, 25 nt, Human
cacccaggcaccaagaacuccaacu

SEQ ID NO: 1150040 - RNA, 21 nt, Human
cacugcaaacucccccuccug

SEQ ID NO: 1150041 - RNA, 19 nt, Human
cagcuccuggaagaauccc

SEQ ID NO: 1150042 - RNA, 24 nt, Human
caguagagacuggguuucaccaug

SEQ ID NO: 1150043 - RNA, 25 nt, Human
caguagcugggauuacaggcauuug

SEQ ID NO: 1150044 - RNA, 18 nt, Human
cagugacuucuaagacau

SEQ ID NO: 1150045 - RNA, 22 nt, Human
cauguucaaagccuucucucaa

SEQ ID NO: 1150046 - RNA, 24 nt, Human
cauguugccuaggcuggucucaaa

SEQ ID NO: 1150047 - RNA, 19 nt, Human
cauugcagcuacucuuugg

SEQ ID NO: 1150048 - RNA, 24 nt, Human
ccaaagugcugggauuacgggcau

SEQ ID NO: 1150049 - RNA, 19 nt, Human
ccaccccuccuccacugaa

SEQ ID NO: 1150050 - RNA, 22 nt, Human
ccaguagcugggauuacaggca

SEQ ID NO: 1150051 - RNA, 23 nt, Human
ccaguagcugggauuacaggcau

SEQ ID NO: 1150052 - RNA, 31 nt, Human
cccaggcaccaagaacuccaacucacggcaa

SEQ ID NO: 1150053 - RNA, 23 nt, Human
cccaguagcugggauuacaggca

SEQ ID NO: 1150054 - RNA, 24 nt, Human
cccaguagcugggauuacaggcau

SEQ ID NO: 1150055 - RNA, 21 nt, Human
ccccaacccaccccuccuccu

SEQ ID NO: 1150056 - RNA, 23 nt, Human
ccccaguagcugggauuacaggc

SEQ ID NO: 1150057 - RNA, 23 nt, Human
cccggccucauucugguuuuguu

SEQ ID NO: 1150058 - RNA, 22 nt, Human
ccuacugccaacacaacuugcu

SEQ ID NO: 1150059 - RNA, 22 nt, Human
ccuccuggguucaagugauucu

SEQ ID NO: 1150060 - RNA, 19 nt, Human
ccugaccucaagugaucug

SEQ ID NO: 1150061 - RNA, 24 nt, Human
ccugaccucaagugaucugcccac

SEQ ID NO: 1150062 - RNA, 22 nt, Human
cguacaccaagcuguguguaua

SEQ ID NO: 1150063 - RNA, 23 nt, Human
cucaaguaagaaagaucugaaga

SEQ ID NO: 1150064 - RNA, 25 nt, Human
cucaagugaucugcccaccccuuag

SEQ ID NO: 1150065 - RNA, 21 nt, Human
cucacugcaaacucccccucc

SEQ ID NO: 1150066 - RNA, 23 nt, Human
cucacugcaaacucccccuccug

SEQ ID NO: 1150067 - RNA, 24 nt, Human
cucagccuccccaguagcugggau

SEQ ID NO: 1150068 - RNA, 20 nt, Human
cuccuggguucaagugauuc

SEQ ID NO: 1150069 - RNA, 21 nt, Human
cuccuggguucaagugauucu

SEQ ID NO: 1150070 - RNA, 23 nt, Human
cugauuuuuguauuuucaguaga

SEQ ID NO: 1150071 - RNA, 24 nt, Human
cuggguuucaccauguugccuagg

SEQ ID NO: 1150072 - RNA, 21 nt, Human
cuuaaaguccccgaccuguuc

SEQ ID NO: 1150073 - RNA, 19 nt, Human
cuuccccaacccaccccuc

SEQ ID NO: 1150074 - RNA, 21 nt, Human
cuuccccaacccaccccuccu

SEQ ID NO: 1150075 - RNA, 23 nt, Human
cuucugcuguggcaccuugacaa

SEQ ID NO: 1150076 - RNA, 22 nt, Human
cuuugugcaggagaaaguccuc

SEQ ID NO: 1150077 - RNA, 25 nt, Human
gaaaguaucuucauuucucccaaga

SEQ ID NO: 1150078 - RNA, 21 nt, Human
gaacuccaacucacggcacca

SEQ ID NO: 1150079 - RNA, 18 nt, Human
gacaaaugcacuggcccc

SEQ ID NO: 1150080 - RNA, 24 nt, Human
gaccucaagugaucugcccacccc

SEQ ID NO: 1150081 - RNA, 22 nt, Human
gagaaaguccucgaacuggcuc

SEQ ID NO: 1150082 - RNA, 18 nt, Human
gauuacgggcaugagcca

SEQ ID NO: 1150083 - RNA, 20 nt, Human
gauuacgggcaugagccacu

SEQ ID NO: 1150084 - RNA, 24 nt, Human
gauuacgggcaugagccacuuugc

SEQ ID NO: 1150085 - RNA, 21 nt, Human
gauucuugugucucagccucc

SEQ ID NO: 1150086 - RNA, 19 nt, Human
gcagucagauguuuucagc

SEQ ID NO: 1150087 - RNA, 20 nt, Human
gcugggcagcaaucugugcu

SEQ ID NO: 1150088 - RNA, 23 nt, Human
gcuggucucaaacuccugaccuc

SEQ ID NO: 1150089 - RNA, 20 nt, Human
ggagagccaggaggcggagg

SEQ ID NO: 1150090 - RNA, 18 nt, Human
ggaggagaaaguaucuuc

SEQ ID NO: 1150091 - RNA, 24 nt, Human
ggcuggucucaaacuccugaccuc

SEQ ID NO: 1150092 - RNA, 18 nt, Human
ggguuucaccauguugcc

SEQ ID NO: 1150093 - RNA, 22 nt, Human
ggguuucaccauguugccuagg

SEQ ID NO: 1150094 - RNA, 23 nt, Human
ggugcuggaaacucagguaaacc

SEQ ID NO: 1150095 - RNA, 18 nt, Human
guagcugggauuacaggc

SEQ ID NO: 1150096 - RNA, 21 nt, Human
gucccuuucaucacuuaauuc

SEQ ID NO: 1150097 - RNA, 26 nt, Human
gugaucugcccaccccuuagccuccc

SEQ ID NO: 1150098 - RNA, 24 nt, Human
gugauucuugugucucagccuccc

SEQ ID NO: 1150099 - RNA, 19 nt, Human
gugcuuuaugcuggugugu

SEQ ID NO: 1150100 - RNA, 22 nt, Human
guggugguggcaauaccacugg

SEQ ID NO: 1150101 - RNA, 23 nt, Human
uaaaguccccgaccuguuccaca

SEQ ID NO: 1150102 - RNA, 21 nt, Human
uaagaaagaucugaagaccag

SEQ ID NO: 1150103 - RNA, 23 nt, Human
uaagaaagaucugaagaccagug

SEQ ID NO: 1150104 - RNA, 21 nt, Human
uaauuccaagcuuaagauaau

SEQ ID NO: 1150105 - RNA, 23 nt, Human
uacaggcauuugccaccacaccc

SEQ ID NO: 1150106 - RNA, 20 nt, Human
uacgggcaugagccacuuug

SEQ ID NO: 1150107 - RNA, 28 nt, Human
uacuuuacuaaaacugggaaggaguaau

SEQ ID NO: 1150108 - RNA, 21 nt, Human
uagagacuggguuucaccaug

SEQ ID NO: 1150109 - RNA, 22 nt, Human
uagagacuggguuucaccaugu

SEQ ID NO: 1150110 - RNA, 21 nt, Human
uauagugaaaggagggcuggc

SEQ ID NO: 1150111 - RNA, 24 nt, Human
ucacugcaaacucccccuccuggg

SEQ ID NO: 1150112 - RNA, 23 nt, Human
ucacugcagguguacacaucacu

SEQ ID NO: 1150113 - RNA, 22 nt, Human
ucagacuggcaugcaguggcac

SEQ ID NO: 1150114 - RNA, 18 nt, Human
ucagccuccccaguagcu

SEQ ID NO: 1150115 - RNA, 20 nt, Human
ucagccuccccaguagcugg

SEQ ID NO: 1150116 - RNA, 24 nt, Human
ucaguagagacuggguuucaccau

SEQ ID NO: 1150117 - RNA, 19 nt, Human
uccaaaacuuuucaauucc

SEQ ID NO: 1150118 - RNA, 20 nt, Human
uccaaaacuuuucaauuccu

SEQ ID NO: 1150119 - RNA, 24 nt, Human
ucccaaagugcugggauuacgggc

SEQ ID NO: 1150120 - RNA, 20 nt, Human
ucccaagaguguuauuucuc

SEQ ID NO: 1150121 - RNA, 24 nt, Human
uccccaguagcugggauuacaggc

SEQ ID NO: 1150122 - RNA, 19 nt, Human
uccuggguucaagugauuc

SEQ ID NO: 1150123 - RNA, 21 nt, Human
uccuggguucaagugauucuu

SEQ ID NO: 1150124 - RNA, 22 nt, Human
uccuggguucaagugauucuug

SEQ ID NO: 1150125 - RNA, 23 nt, Human
ucugaagaccaguggccuugggg

SEQ ID NO: 1150126 - RNA, 25 nt, Human
ucuucaguguacgccuuucccaagg

SEQ ID NO: 1150127 - RNA, 20 nt, Human
ucuucaguguacgccuuucu

SEQ ID NO: 1150128 - RNA, 18 nt, Human
ucuugcucuguuguucag

SEQ ID NO: 1150129 - RNA, 19 nt, Human
ucuugcucuguuguucaga

SEQ ID NO: 1150130 - RNA, 23 nt, Human
ucuugcucuguuguucagacugg

SEQ ID NO: 1150131 - RNA, 26 nt, Human
ugacaaauagugcaucuucacuuucc

SEQ ID NO: 1150132 - RNA, 19 nt, Human
ugacaaaugcacuggcccc

SEQ ID NO: 1150133 - RNA, 24 nt, Human
ugacaaaugcacuggccccucuuc

SEQ ID NO: 1150134 - RNA, 19 nt, Human
ugacagagucuugcucugu

SEQ ID NO: 1150135 - RNA, 18 nt, Human
ugaccucaagugaucugc

SEQ ID NO: 1150136 - RNA, 27 nt, Human
ugaccucaagugaucugcccaccccuu

SEQ ID NO: 1150137 - RNA, 26 nt, Human
ugaucugcccaccccuuagccuccca

SEQ ID NO: 1150138 - RNA, 24 nt, Human
ugauuuuuguauuuucaguagaga

SEQ ID NO: 1150139 - RNA, 24 nt, Human
ugccuaggcuggucucaaacuccu

SEQ ID NO: 1150140 - RNA, 23 nt, Human
ugcuucugcuguggcaccuugac

SEQ ID NO: 1150141 - RNA, 20 nt, Human
uggcaaaaugucuaccacga

SEQ ID NO: 1150142 - RNA, 24 nt, Human
uggcacaaucucggcucacugcaa

SEQ ID NO: 1150143 - RNA, 24 nt, Human
uggcaugcaguggcacaaucucgg

SEQ ID NO: 1150144 - RNA, 23 nt, Human
ugggagagccaggaggcggaggc

SEQ ID NO: 1150145 - RNA, 18 nt, Human
ugggauuacaggcauuug

SEQ ID NO: 1150146 - RNA, 19 nt, Human
ugggauuacaggcauuugc

SEQ ID NO: 1150147 - RNA, 21 nt, Human
ugggauuacaggcauuugcca

SEQ ID NO: 1150148 - RNA, 22 nt, Human
ugggauuacaggcauuugccac

SEQ ID NO: 1150149 - RNA, 24 nt, Human
ugggauuacaggcauuugccacca

SEQ ID NO: 1150150 - RNA, 18 nt, Human
ugggauuacgggcaugag

SEQ ID NO: 1150151 - RNA, 19 nt, Human
ugggauuacgggcaugagc

SEQ ID NO: 1150152 - RNA, 22 nt, Human
ugggauuacgggcaugagccac

SEQ ID NO: 1150153 - RNA, 22 nt, Human
ugggauuacgggcaugagccac

SEQ ID NO: 1150154 - RNA, 23 nt, Human
ugggauuacgggcaugagccacu

SEQ ID NO: 1150155 - RNA, 26 nt, Human
ugggauuacgggcaugagccacuuug

SEQ ID NO: 1150156 - RNA, 24 nt, Human
uggguucaagugauucuugugucu

SEQ ID NO: 1150157 - RNA, 23 nt, Human
uggguuucaccauguugccuagg

SEQ ID NO: 1150158 - RNA, 22 nt, Human
ugguggcaauaccacugguggg

SEQ ID NO: 1150159 - RNA, 24 nt, Human
uguacgccuuucuugauaagcccc

SEQ ID NO: 1150160 - RNA, 21 nt, Human
ugucucagccuccccaguagc

SEQ ID NO: 1150161 - RNA, 22 nt, Human
ugucucagccuccccaguagcu

SEQ ID NO: 1150162 - RNA, 24 nt, Human
ugucucagccuccccaguagcugg

SEQ ID NO: 1150163 - RNA, 21 nt, Human
ugugcaggagaaaguccucga

SEQ ID NO: 1150164 - RNA, 21 nt, Human
uguguguauagugaaaggagg

SEQ ID NO: 1150165 - RNA, 19 nt, Human
uguugugugcuuuguucug

SEQ ID NO: 1150166 - RNA, 18 nt, Human
uuagccucccaaagugcu

SEQ ID NO: 1150167 - RNA, 23 nt, Human
uucaagugauucuugugucucag

SEQ ID NO: 1150168 - RNA, 27 nt, Human
uuccccaacccaccccuccuccacuga

SEQ ID NO: 1150169 - RNA, 23 nt, Human
uucgaaggucccuuucaucacuu

SEQ ID NO: 1150170 - RNA, 23 nt, Human
uuggaauauuugaggguuaagaa

SEQ ID NO: 1150171 - RNA, 24 nt, Human
uuucaccauguugccuaggcuggu

SEQ ID NO: 1150172 - RNA, 24 nt, Human
uuuucaguagagacuggguuucac

SEQ ID NO: 1150173 - RNA, 20 nt, Human
uuuuuguauuuucaguagag

SEQ ID NO: 1150174 - RNA, 21 nt, Human
cggcugccgauucgucuuggg

SEQ ID NO: 1150175 - RNA, 18 nt, Human
gcugccgauucgucuugg

SEQ ID NO: 1150176 - RNA, 21 nt, Human
aacagcucagccuccaggacu

SEQ ID NO: 1150177 - RNA, 20 nt, Human
aagaaggcauaccaagcaaa

SEQ ID NO: 1150178 - RNA, 24 nt, Human
aagguccuucacccuggggcccag

SEQ ID NO: 1150179 - RNA, 21 nt, Human
agaaggcauaccaagcaaacc

SEQ ID NO: 1150180 - RNA, 21 nt, Human
agauacaaauagaaccaggug

SEQ ID NO: 1150181 - RNA, 24 nt, Human
agcagagugcuugacaagggccug

SEQ ID NO: 1150182 - RNA, 23 nt, Human
aggugcagggagaggugggugug

SEQ ID NO: 1150183 - RNA, 22 nt, Human
aguaguuggugaggggucucua

SEQ ID NO: 1150184 - RNA, 21 nt, Human
caaagaucaguacccccagac

SEQ ID NO: 1150185 - RNA, 18 nt, Human
cacccuggggcccaccuc

SEQ ID NO: 1150186 - RNA, 24 nt, Human
caggugcagggagaggugggugug

SEQ ID NO: 1150187 - RNA, 19 nt, Human
ccagacuccagcagagugc

SEQ ID NO: 1150188 - RNA, 22 nt, Human
cccagcacuccugccuacugcc

SEQ ID NO: 1150189 - RNA, 21 nt, Human
cccuggggcccaccucuguuc

SEQ ID NO: 1150190 - RNA, 20 nt, Human
ccuccaggacugacauuucc

SEQ ID NO: 1150191 - RNA, 20 nt, Human
ccuggggcccaccucuguuc

SEQ ID NO: 1150192 - RNA, 20 nt, Human
gaacagcucagccuccagga

SEQ ID NO: 1150193 - RNA, 23 nt, Human
gauuucccagcacuccugccuac

SEQ ID NO: 1150194 - RNA, 19 nt, Human
gcucagccuccaggacuga

SEQ ID NO: 1150195 - RNA, 21 nt, Human
gcucuggggaacagcucagcc

SEQ ID NO: 1150196 - RNA, 18 nt, Human
gggaggcugagcaagguc

SEQ ID NO: 1150197 - RNA, 19 nt, Human
gggcucuggggaacagcuc

SEQ ID NO: 1150198 - RNA, 19 nt, Human
gggcucuggggaacagcuc

SEQ ID NO: 1150199 - RNA, 21 nt, Human
ggggaggcugagcaagguccu

SEQ ID NO: 1150200 - RNA, 19 nt, Human
uaaaguaguuggugagggg

SEQ ID NO: 1150201 - RNA, 18 nt, Human
uagaaccaggugcaggga

SEQ ID NO: 1150202 - RNA, 24 nt, Human
uaguuggugaggggucucuagggc

SEQ ID NO: 1150203 - RNA, 24 nt, Human
ucccagcacuccugccuacugccu

SEQ ID NO: 1150204 - RNA, 19 nt, Human
ucuguucagcagcagucac

SEQ ID NO: 1150205 - RNA, 19 nt, Human
ugacaagggccugguagac

SEQ ID NO: 1150206 - RNA, 23 nt, Human
ugacaagggccugguagaccaaa

SEQ ID NO: 1150207 - RNA, 22 nt, Human
ugccuugucccucaauaaagua

SEQ ID NO: 1150208 - RNA, 20 nt, Human
ugcuugacaagggccuggua

SEQ ID NO: 1150209 - RNA, 24 nt, Human
uuucccagcacuccugccuacugc

SEQ ID NO: 1150210 - RNA, 24 nt, Human
aaaccaacaaauccaauucaagca

SEQ ID NO: 1150211 - RNA, 23 nt, Human
aaccuucuucugcaccuccacca

SEQ ID NO: 1150212 - RNA, 20 nt, Human
aaugccaaagacuuccagcu

SEQ ID NO: 1150213 - RNA, 19 nt, Human
accaacaaauccaauucaa

SEQ ID NO: 1150214 - RNA, 22 nt, Human
accuucuucugcaccuccacca

SEQ ID NO: 1150215 - RNA, 31 nt, Human
agcauccagcucacucugugggcaaguggcc

SEQ ID NO: 1150216 - RNA, 19 nt, Human
aggcacagugcucagagua

SEQ ID NO: 1150217 - RNA, 19 nt, Human
caaauggaaaaccaacaaa

SEQ ID NO: 1150218 - RNA, 19 nt, Human
caagugaaugccaaagacu

SEQ ID NO: 1150219 - RNA, 22 nt, Human
caagugaaugccaaagacuucc

SEQ ID NO: 1150220 - RNA, 22 nt, Human
caagugaaugccaaagacuucc

SEQ ID NO: 1150221 - RNA, 21 nt, Human
caauaggucaucaaaauucca

SEQ ID NO: 1150222 - RNA, 21 nt, Human
cacaaauggaaaaccaacaaa

SEQ ID NO: 1150223 - RNA, 23 nt, Human
caccaccaccaccacccuuugga

SEQ ID NO: 1150224 - RNA, 23 nt, Human
cacucugugggcaaguggcugug

SEQ ID NO: 1150225 - RNA, 24 nt, Human
cacucugugggcaaguggcuguga

SEQ ID NO: 1150226 - RNA, 24 nt, Human
cagaaaucuccacugugguccugg

SEQ ID NO: 1150227 - RNA, 22 nt, Human
cauccagcucacucugugggca

SEQ ID NO: 1150228 - RNA, 21 nt, Human
ccacaaauggaaaaccaacaa

SEQ ID NO: 1150229 - RNA, 21 nt, Human
ccacaaauggaaaaccaacaa

SEQ ID NO: 1150230 - RNA, 22 nt, Human
cccacaaauggaaaaccaacaa

SEQ ID NO: 1150231 - RNA, 22 nt, Human
ccuccaccaccaccaccacccu

SEQ ID NO: 1150232 - RNA, 18 nt, Human
ccucccuuguccuucuuc

SEQ ID NO: 1150233 - RNA, 19 nt, Human
ccucccuuguccuucuucu

SEQ ID NO: 1150234 - RNA, 18 nt, Human
ccugguaauugccuuugg

SEQ ID NO: 1150235 - RNA, 21 nt, Human
cgacgaccucuaccuuuccca

SEQ ID NO: 1150236 - RNA, 19 nt, Human
cgagccuuaagcagcccca

SEQ ID NO: 1150237 - RNA, 26 nt, Human
cugcaccuccaccaccaccaccaccc

SEQ ID NO: 1150238 - RNA, 22 nt, Human
cugccagguuacuaagcagugu

SEQ ID NO: 1150239 - RNA, 20 nt, Human
cuuucccaucccuggcaccu

SEQ ID NO: 1150240 - RNA, 21 nt, Human
gaccucuaccuuucccauccc

SEQ ID NO: 1150241 - RNA, 20 nt, Human
gacgaccucuaccuuuccca

SEQ ID NO: 1150242 - RNA, 21 nt, Human
ggacauccagaacaaucagga

SEQ ID NO: 1150243 - RNA, 19 nt, Human
gugguccuggaguaaggaa

SEQ ID NO: 1150244 - RNA, 24 nt, Human
guggugaugggcagagauggguac

SEQ ID NO: 1150245 - RNA, 18 nt, Human
guggugugcuguggccuu

SEQ ID NO: 1150246 - RNA, 20 nt, Human
uaaagccauuguuggggggc

SEQ ID NO: 1150247 - RNA, 22 nt, Human
uacaccgugaggcaccuuauag

SEQ ID NO: 1150248 - RNA, 22 nt, Human
uagugaguucucgacgaagcuu

SEQ ID NO: 1150249 - RNA, 21 nt, Human
uauaccccugccagguuacua

SEQ ID NO: 1150250 - RNA, 19 nt, Human
ucaagugaaugccaaagac

SEQ ID NO: 1150251 - RNA, 22 nt, Human
uccaccaccaccaccacccuuu

SEQ ID NO: 1150252 - RNA, 19 nt, Human
uccacugugguccuggagu

SEQ ID NO: 1150253 - RNA, 21 nt, Human
ucccuuguccuucuucuuaaa

SEQ ID NO: 1150254 - RNA, 18 nt, Human
ucgggccacugcaaugaa

SEQ ID NO: 1150255 - RNA, 19 nt, Human
ucugugggcaaguggcugu

SEQ ID NO: 1150256 - RNA, 20 nt, Human
ugagaugaaugccucccuug

SEQ ID NO: 1150257 - RNA, 23 nt, Human
ugaggcaccuuauagugcuaucc

SEQ ID NO: 1150258 - RNA, 22 nt, Human
ugcaccuccaccaccaccacca

SEQ ID NO: 1150259 - RNA, 25 nt, Human
ugcaccuccaccaccaccaccaccc

SEQ ID NO: 1150260 - RNA, 24 nt, Human
ugccuuuggguuuggugcaaauuc

SEQ ID NO: 1150261 - RNA, 24 nt, Human
uggaaaaccaacaaauccaauuca

SEQ ID NO: 1150262 - RNA, 21 nt, Human
uuacagguucgggccacugca

SEQ ID NO: 1150263 - RNA, 20 nt, Human
aaugccaaagacuuccagcu

SEQ ID NO: 1150264 - RNA, 18 nt, Human
agaugaaugccucccuug

SEQ ID NO: 1150265 - RNA, 31 nt, Human; identical to SEQ ID NO: 1150215

SEQ ID NO: 1150266 - RNA, 19 nt, Human
caagugaaugccaaagacu

SEQ ID NO: 1150267 - RNA, 21 nt, Human
caagugaaugccaaagacuuc

SEQ ID NO: 1150268 - RNA, 22 nt, Human
caagugaaugccaaagacuucc

SEQ ID NO: 1150269 - RNA, 21 nt, Human
caauaggucaucaaaauucca

SEQ ID NO: 1150270 - RNA, 23 nt, Human
cacucugugggcaaguggcugug

SEQ ID NO: 1150271 - RNA, 24 nt, Human
cacucugugggcaaguggcuguga

SEQ ID NO: 1150272 - RNA, 22 nt, Human
cauccagcucacucugugggca

SEQ ID NO: 1150273 - RNA, 18 nt, Human
ccucccuuguccuucuuc

SEQ ID NO: 1150274 - RNA, 19 nt, Human
ccucccuuguccuucuucu

SEQ ID NO: 1150275 - RNA, 20 nt, Human
ccucccuuguccuucuucuu

SEQ ID NO: 1150276 - RNA, 18 nt, Human
ccugguaauugccuuugg

SEQ ID NO: 1150277 - RNA, 19 nt, Human
gugguccuggaguaaggaa

SEQ ID NO: 1150278 - RNA, 24 nt, Human
guggugaugggcagagauggguac

SEQ ID NO: 1150279 - RNA, 20 nt, Human
uaaagccauuguuggggggc

SEQ ID NO: 1150280 - RNA, 26 nt, Human
uaagauaaaggggauauaaacucugg

SEQ ID NO: 1150281 - RNA, 22 nt, Human
uacaccgugaggcaccuuauag

SEQ ID NO: 1150282 - RNA, 19 nt, Human
ucaagugaaugccaaagac

SEQ ID NO: 1150283 - RNA, 19 nt, Human
uccacugugguccuggagu

SEQ ID NO: 1150284 - RNA, 20 nt, Human
ucccuuguccuucuucuuaa

SEQ ID NO: 1150285 - RNA, 19 nt, Human
ucugugggcaaguggcugu

SEQ ID NO: 1150286 - RNA, 23 nt, Human
ugaggcaccuuauagugcuaucc

SEQ ID NO: 1150287 - RNA, 18 nt, Human
ugaggucaucagcuguag

SEQ ID NO: 1150288 - RNA, 24 nt, Human
ugccuuuggguuuggugcaaauuc

SEQ ID NO: 1150289 - RNA, 24 nt, Human
aaaaaauuagguagaagagcaaga

SEQ ID NO: 1150290 - RNA, 23 nt, Human
aaaugaagacagacaacacaaaa

SEQ ID NO: 1150291 - RNA, 20 nt, Human
acagcauauuaagcuuuaga

SEQ ID NO: 1150292 - RNA, 20 nt, Human
acucuguggagacauccuac

SEQ ID NO: 1150293 - RNA, 21 nt, Human
agacacuuggcaauuaaacca

SEQ ID NO: 1150294 - RNA, 20 nt, Human
agacagacaacacaaaauuu

SEQ ID NO: 1150295 - RNA, 21 nt, Human
aggaacucuccgguggucggg

SEQ ID NO: 1150296 - RNA, 20 nt, Human
augcagaacuucuccacaua

SEQ ID NO: 1150297 - RNA, 22 nt, Human
cacauaaaaagaggacaagacc

SEQ ID NO: 1150298 - RNA, 19 nt, Human
cacugguucaaagggcagc

SEQ ID NO: 1150299 - RNA, 22 nt, Human
cauaaaaagaggacaagacccc

SEQ ID NO: 1150300 - RNA, 24 nt, Human
cauaaaaagaggacaagaccccca

SEQ ID NO: 1150301 - RNA, 25 nt, Human
ccacauaaaaagaggacaagacccc

SEQ ID NO: 1150302 - RNA, 18 nt, Human
cccccauccuacauguuu

SEQ ID NO: 1150303 - RNA, 22 nt, Human
gagcaagaucaaaccccagcuc

SEQ ID NO: 1150304 - RNA, 18 nt, Human
gcgccacaggaacucucc

SEQ ID NO: 1150305 - RNA, 18 nt, Human
gggcagcagaggcaagag

SEQ ID NO: 1150306 - RNA, 22 nt, Human
ggguaccauuuuaucccuaaaa

SEQ ID NO: 1150307 - RNA, 22 nt, Human
uaaaaagaggacaagaccccca

SEQ ID NO: 1150308 - RNA, 19 nt, Human
uaacccagugucauguacc

SEQ ID NO: 1150309 - RNA, 23 nt, Human
uaucccuaaaacucuguugacau

SEQ ID NO: 1150310 - RNA, 20 nt, Human
uauuuacauagcacagcaua

SEQ ID NO: 1150311 - RNA, 19 nt, Human
ucaaagggcagcagaggca

SEQ ID NO: 1150312 - RNA, 22 nt, Human
ucacaugcagaacuucuccaca

SEQ ID NO: 1150313 - RNA, 20 nt, Human
ucacuugauguuggccgggu

SEQ ID NO: 1150314 - RNA, 18 nt, Human
ucccuaaaacucuguuga

SEQ ID NO: 1150315 - RNA, 18 nt, Human
ugacaucaaaauaugaca

SEQ ID NO: 1150316 - RNA, 23 nt, Human
uggaaucagguguucaccggucc

SEQ ID NO: 1150317 - RNA, 25 nt, Human
ugucuuuuuuuccuuccucacaugc

SEQ ID NO: 1150318 - RNA, 22 nt, Human
uuagacacuuggcaauuaaacc

SEQ ID NO: 1150319 - RNA, 22 nt, Human
aaaaaagguaauaacaaaaugu

SEQ ID NO: 1150320 - RNA, 23 nt, Human
aaaaaauagaaauaacauuaucc

SEQ ID NO: 1150321 - RNA, 25 nt, Human
aaaaauaaaaaauagaaauaacauu

SEQ ID NO: 1150322 - RNA, 19 nt, Human
aaaagacacagggaaggag

SEQ ID NO: 1150323 - RNA, 19 nt, Human
aaagacacagggaaggagg

SEQ ID NO: 1150324 - RNA, 19 nt, Human
aaagauaucuuaaagcuga

SEQ ID NO: 1150325 - RNA, 22 nt, Human
aaagcugaaaacuugaacagaa

SEQ ID NO: 1150326 - RNA, 20 nt, Human
aacccaaagaagcaaaguuu

SEQ ID NO: 1150327 - RNA, 19 nt, Human
aagaucaacaaacugccag

SEQ ID NO: 1150328 - RNA, 22 nt, Human
aagcagccuuccaguuaaagau

SEQ ID NO: 1150329 - RNA, 19 nt, Human
aagccaauaagcugcagga

SEQ ID NO: 1150330 - RNA, 22 nt, Human
aagggauucgauugcugcuuca

SEQ ID NO: 1150331 - RNA, 21 nt, Human
acaaaacaacaaaaaagguaa

SEQ ID NO: 1150332 - RNA, 22 nt, Human
accuaacagaccuccuagaaac

SEQ ID NO: 1150333 - RNA, 22 nt, Human
agagaccacauaaaaggagagu

SEQ ID NO: 1150334 - RNA, 18 nt, Human
agcagggugggacugggg

SEQ ID NO: 1150335 - RNA, 23 nt, Human
aggagaaagcagccuuccaguua

SEQ ID NO: 1150336 - RNA, 24 nt, Human
aggauguacaccuaacagaccucc

SEQ ID NO: 1150337 - RNA, 23 nt, Human
aggcagagacaguuuggugaaaa

SEQ ID NO: 1150338 - RNA, 25 nt, Human
agggaaggagggggcggcaaaagga

SEQ ID NO: 1150339 - RNA, 20 nt, Human
agggugccacaaacccaaag

SEQ ID NO: 1150340 - RNA, 19 nt, Human
auaguggagucuccugggc

SEQ ID NO: 1150341 - RNA, 19 nt, Human
auuaaggugaaaagucacc

SEQ ID NO: 1150342 - RNA, 21 nt, Human
caccuuucugguuuagcuagu

SEQ ID NO: 1150343 - RNA, 18 nt, Human
cagcagcagggugggacu

SEQ ID NO: 1150344 - RNA, 26 nt, Human
cagcuucaaacccagaaaaggguaau

SEQ ID NO: 1150345 - RNA, 22 nt, Human
cagggcuguggaauuauuugga

SEQ ID NO: 1150346 - RNA, 22 nt, Human
ccaaagaagcaaaguuucaaaa

SEQ ID NO: 1150347 - RNA, 21 nt, Human
ccaaagauaucuuaaagcuga

SEQ ID NO: 1150348 - RNA, 24 nt, Human
ccuuaccagaaaauggggacuagg

SEQ ID NO: 1150349 - RNA, 19 nt, Human
cuaaugaaaaaaauaaaaa

SEQ ID NO: 1150350 - RNA, 23 nt, Human
cuacaaaacaacaaaaaagguaa

SEQ ID NO: 1150351 - RNA, 23 nt, Human
cuccuagaaaccuuaccagaaaa

SEQ ID NO: 1150352 - RNA, 21 nt, Human
cucuuucucccaaucggcccc

SEQ ID NO: 1150353 - RNA, 18 nt, Human
cugguuuagcuaguacuu

SEQ ID NO: 1150354 - RNA, 19 nt, Human
gagcagcagcaggguggga

SEQ ID NO: 1150355 - RNA, 21 nt, Human
gaggagcagcagcaggguggg

SEQ ID NO: 1150356 - RNA, 21 nt, Human
gaucuuuguuucuuucaagga

SEQ ID NO: 1150357 - RNA, 21 nt, Human
gcagcagcagggugggacugg

SEQ ID NO: 1150358 - RNA, 24 nt, Human
gcagcagcagggugggacuggggc

SEQ ID NO: 1150359 - RNA, 28 nt, Human
ggagcagcagcagggugggacuggggcg

SEQ ID NO: 1150360 - RNA, 22 nt, Human
ggagggacugguucuuuauuuc

SEQ ID NO: 1150361 - RNA, 19 nt, Human
ggaggggguagagauggga

SEQ ID NO: 1150362 - RNA, 23 nt, Human
ggcacuucuagagacagcagcuu

SEQ ID NO: 1150363 - RNA, 23 nt, Human
gggaaggagggggcggcaaaagg

SEQ ID NO: 1150364 - RNA, 24 nt, Human
gggaggagcagcagcaggguggga

SEQ ID NO: 1150365 - RNA, 23 nt, Human
ggugaaaaagacacagggaagga

SEQ ID NO: 1150366 - RNA, 21 nt, Human
guaagcaggugggagggggua

SEQ ID NO: 1150367 - RNA, 31 nt, Human
uacaaaacaacaaaaaagguaauaacaaaag

SEQ ID NO: 1150368 - RNA, 22 nt, Human
uacaccuaacagaccuccuaga

SEQ ID NO: 1150369 - RNA, 22 nt, Human
uagaaauaacauuauccaaaga

SEQ ID NO: 1150370 - RNA, 21 nt, Human
uagcuaguacuuuguacagag

SEQ ID NO: 1150371 - RNA, 20 nt, Human
ucaaacccagaaaaggguaa

SEQ ID NO: 1150372 - RNA, 22 nt, Human
ucaccuuccaaaagugagaaag

SEQ ID NO: 1150373 - RNA, 21 nt, Human
ucagaggucuuaccaucuuaa

SEQ ID NO: 1150374 - RNA, 22 nt, Human
uccugggcucuguuuggcucuc

SEQ ID NO: 1150375 - RNA, 22 nt, Human
ucggccccaaagagaccacaua

SEQ ID NO: 1150376 - RNA, 18 nt, Human
ucuagagacagcagcuuc

SEQ ID NO: 1150377 - RNA, 18 nt, Human
ucucaguaaggcaggccu

SEQ ID NO: 1150378 - RNA, 19 nt, Human
ucucugagaagaggcagag

SEQ ID NO: 1150379 - RNA, 22 nt, Human
ugaaaaaaauaaaaaauagaaa

SEQ ID NO: 1150380 - RNA, 20 nt, Human
ugaaaaagacacagggaagg

SEQ ID NO: 1150381 - RNA, 19 nt, Human
ugagaaagggauucgauug

SEQ ID NO: 1150382 - RNA, 20 nt, Human
ugagaaagggauucgauugc

SEQ ID NO: 1150383 - RNA, 20 nt, Human
ugagaagaggcagagacagu

SEQ ID NO: 1150384 - RNA, 18 nt, Human
ugagaugaguuucacaug

SEQ ID NO: 1150385 - RNA, 22 nt, Human
ugcuacaaaacaacaaaaaagg

SEQ ID NO: 1150386 - RNA, 23 nt, Human
ugcucagccucuagcccagcugg

SEQ ID NO: 1150387 - RNA, 19 nt, Human
ugggaggggguagagaugg

SEQ ID NO: 1150388 - RNA, 20 nt, Human
ugggaggggguagagaugga

SEQ ID NO: 1150389 - RNA, 22 nt, Human
uggggacuagguagggaaagaa

SEQ ID NO: 1150390 - RNA, 24 nt, Human
uggggacuagguagggaaagaaac

SEQ ID NO: 1150391 - RNA, 18 nt, Human
uggucaccucaacauaag

SEQ ID NO: 1150392 - RNA, 18 nt, Human
uguguacaucacaacaug

SEQ ID NO: 1150393 - RNA, 24 nt, Human
uuaaagacauuaugcauugugcuc

SEQ ID NO: 1150394 - RNA, 22 nt, Human
uuaccagaaaauggggacuagg

SEQ ID NO: 1150395 - RNA, 22 nt, Human
uuauccaaagauaucuuaaagc

SEQ ID NO: 1150396 - RNA, 18 nt, Human
uucuccagcacugacuga

SEQ ID NO: 1150397 - RNA, 18 nt, Human
uucucccaaucggcccca

SEQ ID NO: 1150398 - RNA, 23 nt, Human
uugcuacaaaacaacaaaaaagg

SEQ ID NO: 1150399 - RNA, 21 nt, Human
uuuacaaaugguugcuacaaa

SEQ ID NO: 1150400 - RNA, 20 nt, Human
uuuggugaaaaagacacagg

SEQ ID NO: 1150401 - RNA, 21 nt, Human
uuuggugaaaaagacacaggg

SEQ ID NO: 1150402 - RNA, 22 nt, Human
aaaaagagaacuuguccauuga

SEQ ID NO: 1150403 - RNA, 19 nt, Human
aaacaaguaaggcagccag

SEQ ID NO: 1150404 - RNA, 20 nt, Human
aacacgagagucuagagaug

SEQ ID NO: 1150405 - RNA, 19 nt, Human
aacacugucaucucuagaa

SEQ ID NO: 1150406 - RNA, 21 nt, Human
aaccagcagugcaagcauuca

SEQ ID NO: 1150407 - RNA, 21 nt, Human
aagaggccaaugauacgaaua

SEQ ID NO: 1150408 - RNA, 21 nt, Human
aagcaauguaguuuuuaaaac

SEQ ID NO: 1150409 - RNA, 24 nt, Human
aaggauuugugugugugugaugau

SEQ ID NO: 1150410 - RNA, 21 nt, Human
acaaaaagagaacuuguccau

SEQ ID NO: 1150411 - RNA, 23 nt, Human
accacucccacuauacauuagag

SEQ ID NO: 1150412 - RNA, 19 nt, Human
accaugcuuuugucucucc

SEQ ID NO: 1150413 - RNA, 18 nt, Human
accucaugcuuauaucau

SEQ ID NO: 1150414 - RNA, 19 nt, Human
agagagagauagaggaggg

SEQ ID NO: 1150415 - RNA, 19 nt, Human
agagaugggcuauuuguua

SEQ ID NO: 1150416 - RNA, 23 nt, Human
aggaaauaauggagauggaacaa

SEQ ID NO: 1150417 - RNA, 21 nt, Human
aggaaaucauuacuguuauuu

SEQ ID NO: 1150418 - RNA, 23 nt, Human
aggaggauuuaggagucacaauc

SEQ ID NO: 1150419 - RNA, 20 nt, Human
aggcagccagaaauuucaaa

SEQ ID NO: 1150420 - RNA, 19 nt, Human
auaaacaggaaauauuugc

SEQ ID NO: 1150421 - RNA, 23 nt, Human
auuccaauuccuaguagcauucc

SEQ ID NO: 1150422 - RNA, 23 nt, Human
caaaccuaaccugggcuuccuuc

SEQ ID NO: 1150423 - RNA, 22 nt, Human
caacaugaauacugcaagcagg

SEQ ID NO: 1150424 - RNA, 23 nt, Human
caagagaacuauuuuuaaaacug

SEQ ID NO: 1150425 - RNA, 20 nt, Human
cacaacuguacaaacugaac

SEQ ID NO: 1150426 - RNA, 23 nt, Human
cacagcaaccaugcgagguaggc

SEQ ID NO: 1150427 - RNA, 18 nt, Human
cagagagagauagaggag

SEQ ID NO: 1150428 - RNA, 21 nt, Human
cagugccaguuaccguacaaa

SEQ ID NO: 1150429 - RNA, 20 nt, Human
ccaaagcuguaaugauaaca

SEQ ID NO: 1150430 - RNA, 20 nt, Human
ccaggccaggugagcguuug

SEQ ID NO: 1150431 - RNA, 22 nt, Human
cuauaauaauuuacaggcaauu

SEQ ID NO: 1150432 - RNA, 22 nt, Human
cucaugcuuauaucaucuaaga

SEQ ID NO: 1150433 - RNA, 21 nt, Human
cuuagaaaaauagacaucuca

SEQ ID NO: 1150434 - RNA, 23 nt, Human
cuuagaaaaauagacaucucaga

SEQ ID NO: 1150435 - RNA, 20 nt, Human
cuugccuuuguuugaugcua

SEQ ID NO: 1150436 - RNA, 19 nt, Human
cuuuuagaggaggauuuag

SEQ ID NO: 1150437 - RNA, 18 nt, Human
gagaacuauuuuuaaaac

SEQ ID NO: 1150438 - RNA, 21 nt, Human
gagcaggaaauaauggagaug

SEQ ID NO: 1150439 - RNA, 24 nt, Human
gcagaauucccucauaaaaauaca

SEQ ID NO: 1150440 - RNA, 28 nt, Human
gcugaggcccugggcgagggcgcucugu

SEQ ID NO: 1150441 - RNA, 18 nt, Human
gggcucccgggcucuucc

SEQ ID NO: 1150442 - RNA, 18 nt, Human
uaaaagcuguauuuaaaa

SEQ ID NO: 1150443 - RNA, 21 nt, Human
uaacugaaacugcuggcuaaa

SEQ ID NO: 1150444 - RNA, 18 nt, Human
uaacuggauagcacugaa

SEQ ID NO: 1150445 - RNA, 24 nt, Human
uaagucaacacacaacuguacaaa

SEQ ID NO: 1150446 - RNA, 23 nt, Human
uacaaaaugcuuucccacguccu

SEQ ID NO: 1150447 - RNA, 23 nt, Human
uagaaaaauagacaucucagaua

SEQ ID NO: 1150448 - RNA, 20 nt, Human
uagaagucaccacuuucaaa

SEQ ID NO: 1150449 - RNA, 19 nt, Human
uagauguaauuagaguuga

SEQ ID NO: 1150450 - RNA, 26 nt, Human
uagcugcagaauucccucauaaaaau

SEQ ID NO: 1150451 - RNA, 21 nt, Human
uaggugccucacagcaaccau

SEQ ID NO: 1150452 - RNA, 20 nt, Human
uaguagaucaauagcucccu

SEQ ID NO: 1150453 - RNA, 19 nt, Human
uauaagggcauuucuacca

SEQ ID NO: 1150454 - RNA, 24 nt, Human
uauuuuugggcagaagaaacucag

SEQ ID NO: 1150455 - RNA, 25 nt, Human
ucaacacacaacuguacaaacugaa

SEQ ID NO: 1150456 - RNA, 19 nt, Human
ucaaggauuugugugugug

SEQ ID NO: 1150457 - RNA, 23 nt, Human
ucaaucuaaucauccuaauucua

SEQ ID NO: 1150458 - RNA, 24 nt, Human
ucagaaaaaaauauuacaggcccc

SEQ ID NO: 1150459 - RNA, 25 nt, Human
ucagaaaaaaauauuacaggcccca

SEQ ID NO: 1150460 - RNA, 18 nt, Human
ucagauaaagaaagggca

SEQ ID NO: 1150461 - RNA, 18 nt, Human
ucauuggagguaauauua

SEQ ID NO: 1150462 - RNA, 20 nt, Human
ucccuguaauaauuaauuuc

SEQ ID NO: 1150463 - RNA, 22 nt, Human
ucuaagaggccaaugauacgaa

SEQ ID NO: 1150464 - RNA, 21 nt, Human
ucuguaagcuuucuggaagca

SEQ ID NO: 1150465 - RNA, 22 nt, Human
ucugugaggggcucccgggcuc

SEQ ID NO: 1150466 - RNA, 23 nt, Human
ucuuccgccgcucgcugccaggc

SEQ ID NO: 1150467 - RNA, 18 nt, Human
ucuugugcuugaaaccca

SEQ ID NO: 1150468 - RNA, 19 nt, Human
ugaaaagcuuuuauucccu

SEQ ID NO: 1150469 - RNA, 18 nt, Human
ugaaagcucgacgccuca

SEQ ID NO: 1150470 - RNA, 23 nt, Human
ugaucugggaagaacauucugca

SEQ ID NO: 1150471 - RNA, 18 nt, Human
ugcacuaaauuguauuac

SEQ ID NO: 1150472 - RNA, 21 nt, Human
ugccuuuuauuauuuuggugg

SEQ ID NO: 1150473 - RNA, 23 nt, Human
uggaguaugacaugcaaucuauu

SEQ ID NO: 1150474 - RNA, 21 nt, Human
ugggaagaacauucugcagga

SEQ ID NO: 1150475 - RNA, 27 nt, Human
ugggaagaacauucugcagucugaaaa

SEQ ID NO: 1150476 - RNA, 21 nt, Human
ugggcuauuuguuaucacuac

SEQ ID NO: 1150477 - RNA, 21 nt, Human
uguaaugauaacacauagguu

SEQ ID NO: 1150478 - RNA, 23 nt, Human
ugugaaggauaauugagaauggg

SEQ ID NO: 1150479 - RNA, 19 nt, Human
ugugaggggcucccgggcu

SEQ ID NO: 1150480 - RNA, 18 nt, Human
ugugaugaucaaauugug

SEQ ID NO: 1150481 - RNA, 18 nt, Human
uguggcacagacaucuac

SEQ ID NO: 1150482 - RNA, 20 nt, Human
uguggcacagacaucuacac

SEQ ID NO: 1150483 - RNA, 26 nt, Human
uguuuuuguuuuuaaaagcuguauuu

SEQ ID NO: 1150484 - RNA, 21 nt, Human
uuaaaacccuagucccaguag

SEQ ID NO: 1150485 - RNA, 21 nt, Human
uuacucuguugucaacaugaa

SEQ ID NO: 1150486 - RNA, 24 nt, Human
uuuaaaacccuagucccaguagau

SEQ ID NO: 1150487 - RNA, 22 nt, Human
uuuuacucuguugucaacauga

SEQ ID NO: 1150488 - RNA, 23 nt, Human
uuuuacucuguugucaacaugaa
